United States Patent 11,332,783 (SAMPLE ANALYSIS, PRESENCE DETERMINATION OF A TARGET SEQUENCE) - sequence listing, part 5

SEQ ID NO: 80358 - DNA, 75 bp, Artificial Sequence
  Synthetic
tcctatccccatgaggttgacgctagtctcctagcccaatcaggaaaagactatggactaaccatgactccggca

SEQ ID NO: 80359 - DNA, 75 bp, Artificial Sequence
  Synthetic
ctgtttccccggtgaggttgtataaactgtccccacggttgaaaacgactgatccgttacccgctcttgtacttc

SEQ ID NO: 80360 - DNA, 75 bp, Artificial Sequence
  Synthetic
gagaagcctagtatcatcttggaatcttcgatgcgttgcgctcagcactcgaccccggagtgtagcttaggctga

SEQ ID NO: 80361 - DNA, 75 bp, Artificial Sequence
  Synthetic
tcaggtttcatcacagaaagtgggcgcacatgaaaactcaaatagagcgtatggtggttctaccatcaattacac

SEQ ID NO: 80362 - DNA, 75 bp, Artificial Sequence
  Synthetic
gatcaccacccaagaagcggccaattctgttgttgcttacggtagatggcctgaatacatcagagataccgaggc

SEQ ID NO: 80363 - DNA, 75 bp, Artificial Sequence
  Synthetic
tctgttgttgcttacggtagatggcctgaatacatcagagataccgaggcaaatcctgtagaccaaccaaccgag

SEQ ID NO: 80364 - DNA, 75 bp, Artificial Sequence
  Synthetic
caaggagtccagagggtggtggtggaaactaccagacgctttaaaagacatggggttatttggtcaaaacatgtt

SEQ ID NO: 80365 - DNA, 75 bp, Artificial Sequence
  Synthetic
taggtaggtccgggtacaccgtgcatgtacagtgtaatgcctccaaattccaccagggggcactaggggtattcg

SEQ ID NO: 80366 - DNA, 75 bp, Artificial Sequence
  Synthetic
aggggtgtttgcagttccagaaatgtgtttagctggtgatagcacaactcacatgttcacaaagtacgagaatgc

SEQ ID NO: 80367 - DNA, 75 bp, Artificial Sequence
  Synthetic
ccaacgccactaaccctgcacggaacttctgcccagttgattacctcttcgggagtggagtgctggtagggaatg

SEQ ID NO: 80368 - DNA, 75 bp, Artificial Sequence
  Synthetic
tgaccatagcccccatgtgctgtgagttcaatggattgagaaacattaccctaccacgcttgcagggcctgccgg

SEQ ID NO: 80369 - DNA, 75 bp, Artificial Sequence
  Synthetic
gcacaacaactgggggatcgctatcctccccctggcgccactagactttgccactgaatcttccactgagatacc

SEQ ID NO: 80370 - DNA, 75 bp, Artificial Sequence
  Synthetic
ctccccctggcgccactagactttgccactgaatcttccactgagatacccattacactgaccattgctcccatg

SEQ ID NO: 80371 - DNA, 75 bp, Artificial Sequence
  Synthetic
cattacactgaccattgctcccatgtgctgcgaattcaatggtttacgcaacatcactgtgccaagaacccaagg

SEQ ID NO: 80372 - DNA, 75 bp, Artificial Sequence
  Synthetic
acgatcccgtactctgcctgtcactttccccagcttcagatcctaggttgtcacatactatgctaggagaaattc

SEQ ID NO: 80373 - DNA, 75 bp, Artificial Sequence
  Synthetic
tgatggaattggcagaaatagacaccatgatacccctcaacttgacaagccaacgcaagaacacaatggacatgt

SEQ ID NO: 80374 - DNA, 75 bp, Artificial Sequence
  Synthetic
tggggccacaaatccactagtcccttctgatacagtgcaaaccagacatgttatacaacataggtcaaggtcaga

SEQ ID NO: 80375 - DNA, 75 bp, Artificial Sequence
  Synthetic
agatacaacacacattagtcaagaggctatgccacaaggaatcggtgacatgattgagggggccgttgaagggat

SEQ ID NO: 80376 - DNA, 75 bp, Artificial Sequence
  Synthetic
tggaagatcacatataaagatactgtccagttacggaggaagttggagttcttcacctattccagatttgatatg

SEQ ID NO: 80377 - DNA, 75 bp, Artificial Sequence
  Synthetic
gtggagacaggggctaccaatccgttggtgccttcggacaccgtgcaaacgcgccatgtcatccagagacgaacg

SEQ ID NO: 80378 - DNA, 75 bp, Artificial Sequence
  Synthetic
atcagataatgtatataccacccggagcacctatccctggtaaatgggatgactatacgtggcagacgtcctcta

SEQ ID NO: 80379 - DNA, 75 bp, Artificial Sequence
  Synthetic
agacagttggttgaagaaattcactgaggcatgtaacgccgccaaaggattggaatgggtgtccaacaaaatttc

SEQ ID NO: 80380 - DNA, 75 bp, Artificial Sequence
  Synthetic
ctagctacacaagaagacttgcaaaatgccgtgagtgtcatgtggaatagggatctcctagtgtcagaatccaaa

SEQ ID NO: 80381 - DNA, 75 bp, Artificial Sequence
  Synthetic
taccccgtttctttcattggtccaactttccagtacatggaagcaaatgattactatccagcccggtaccaatct

SEQ ID NO: 80382 - DNA, 75 bp, Artificial Sequence
  Synthetic
ctttccagtacatggaagcaaatgattactatccagcccggtaccaatctcatatgctaatcggccatggctttg

SEQ ID NO: 80383 - DNA, 75 bp, Artificial Sequence
  Synthetic
gtttagtggctttctcagacatccgagacctttatgcatatgaggaagaagccatggagcagggcatctccaact

SEQ ID NO: 80384 - DNA, 75 bp, Artificial Sequence
  Synthetic
agacctttatgcatatgaggaagaagccatggagcagggcatctccaactacatcgaatctcttggagctgcatt

SEQ ID NO: 80385 - DNA, 75 bp, Artificial Sequence
  Synthetic
gaaattattgaagaacttaataaaaattatctcttctctagttattataaccagaaactatgaagataccacaac

SEQ ID NO: 80386 - DNA, 75 bp, Artificial Sequence
  Synthetic
ggctcaagaagaaggctagtgacattctggagatcccgtatgtcatgcgacaaggtgacagctggcttaagaaat

SEQ ID NO: 80387 - DNA, 75 bp, Artificial Sequence
  Synthetic
aagagaagatcattccacaagccagggataagttggaatttgtcaccaagctgaaacaacttgaaatgctggaaa

SEQ ID NO: 80388 - DNA, 75 bp, Artificial Sequence
  Synthetic
accaaattgcaaccattcatcagtcgtgtcctagtcaagagcatcaggaaatcctattcaacaacgtgagatggt

SEQ ID NO: 80389 - DNA, 75 bp, Artificial Sequence
  Synthetic
agaatacaaaagctagaacacacaatcaacaattacatacagttcaagagcaaacaccgtattgaaccagtatgt

SEQ ID NO: 80390 - DNA, 75 bp, Artificial Sequence
  Synthetic
caaacaccgtattgaaccagtatgtctattggtgcacggtagtcctggaacaggtaaatcagtggccactaactt

SEQ ID NO: 80391 - DNA, 75 bp, Artificial Sequence
  Synthetic
gtataaacaacagggagtggtaatcatggatgatctaaatcaaaatcccgatggggcagacatgaaactcttttg

SEQ ID NO: 80392 - DNA, 75 bp, Artificial Sequence
  Synthetic
atggatgatctaaatcaaaatcccgatggggcagacatgaaactcttttgtcagatggtttctacagtagagttc

SEQ ID NO: 80393 - DNA, 75 bp, Artificial Sequence
  Synthetic
agccgcatcacaccacccacagttgcacacagtgatgcattggccagacgctttgcttttgacatggatatccaa

SEQ ID NO: 80394 - DNA, 75 bp, Artificial Sequence
  Synthetic
cacacagtgatgcattggccagacgctttgcttttgacatggatatccaagtcatgggtgagtactccagagatg

SEQ ID NO: 80395 - DNA, 75 bp, Artificial Sequence
  Synthetic
cgttggtatgtgggaaggccattcagctgatggataaatcctctagagttaggtatagtgtggatcaaatcacca

SEQ ID NO: 80396 - DNA, 75 bp, Artificial Sequence
  Synthetic
gctgatggataaatcctctagagttaggtatagtgtggatcaaatcaccacaatgatcatcaatgagagaaacag

SEQ ID NO: 80397 - DNA, 75 bp, Artificial Sequence
  Synthetic
caagacttcacccccccccgagtgcatcaatgatttactccaggcggtggattctcaggaagtgagggattactg

SEQ ID NO: 80398 - DNA, 75 bp, Artificial Sequence
  Synthetic
atcaatgatttactccaggcggtggattctcaggaagtgagggattactgtgaaaagaagggatggatagtcaac

SEQ ID NO: 80399 - DNA, 75 bp, Artificial Sequence
  Synthetic
gctgtcgccggggtggtgtatgtgatgtacaaactgtttgcagggcaccagggtgcttacaccgggctcccgaac

SEQ ID NO: 80400 - DNA, 75 bp, Artificial Sequence
  Synthetic
tgtacaaactgtttgcagggcaccagggtgcttacaccgggctcccgaacaagagacccaacattccaactatta

SEQ ID NO: 80401 - DNA, 75 bp, Artificial Sequence
  Synthetic
ctagcaaaggggaattcacgatgcttggagtgcacgacaatgtggccattttaccaactcatgcctcacctggtg

SEQ ID NO: 80402 - DNA, 75 bp, Artificial Sequence
  Synthetic
ggtggaagttctggacgcaaaagcactggaagaccaagtagggaccaatttggaaataaccattatcactcttaa

SEQ ID NO: 80403 - DNA, 75 bp, Artificial Sequence
  Synthetic
tgtttccccggtgaagttacatagactgttcccacggttgaaagtgattgatccgttatccgctcatgtacttcg

SEQ ID NO: 80404 - DNA, 75 bp, Artificial Sequence
  Synthetic
atgtacaactttccaaccagagcaggacagtgcggaggtgttatcacttgcacaggcaaggtcattgggatgcat

SEQ ID NO: 80405 - DNA, 75 bp, Artificial Sequence
  Synthetic
ttgcagcggccctgaagcgatcatacttcacacagagtcaaggtgaaatccagtggatgaggccatcaaaagaag

SEQ ID NO: 80406 - DNA, 75 bp, Artificial Sequence
  Synthetic
tcaaggaaccagctgtgctgaccaaaaatgaccccagattgaaaaccgacttcgaggaagccattttctcaaaat

SEQ ID NO: 80407 - DNA, 75 bp, Artificial Sequence
  Synthetic
aaatgaccccagattgaaaaccgacttcgaggaagccattttctcaaaatatgtcgggaacaaaatcaccgaggt

SEQ ID NO: 80408 - DNA, 75 bp, Artificial Sequence
  Synthetic
ttgggtgtccgtgtttccttttatttttgaatggctgcttatggtgacaatcacagattgttatcataaagcaaa

SEQ ID NO: 80409 - DNA, 75 bp, Artificial Sequence
  Synthetic
gtgccttgaggacgccatgtatgggactgatggtttggaagctctcgatcttagcaccagtgctggataccccta

SEQ ID NO: 80410 - DNA, 75 bp, Artificial Sequence
  Synthetic
actgatggtttggaagctctcgatcttagcaccagtgctggatacccctatgtagcaatggggaaaaagaaaagg

SEQ ID NO: 80411 - DNA, 75 bp, Artificial Sequence
  Synthetic
atacctaaacagaggattatactacagcgatgggagctcaggtatcatctcaaaaagtgggtgcccacgaaaatt

SEQ ID NO: 80412 - DNA, 75 bp, Artificial Sequence
  Synthetic
agcgatgggagctcaggtatcatctcaaaaagtgggtgcccacgaaaattctaaccgggcctacggtggctccac

SEQ ID NO: 80413 - DNA, 75 bp, Artificial Sequence
  Synthetic
ttggtcacttatgtaaaagatgaacttagatctaaaacaaaagttgaacagggcaaatccaggttgattgaggct

SEQ ID NO: 80414 - DNA, 75 bp, Artificial Sequence
  Synthetic
cccatcaaagttcaccgagccgctaaaggatgtactcataaagacggccccagcactcaactcaccaaacgtgga

SEQ ID NO: 80415 - DNA, 75 bp, Artificial Sequence
  Synthetic
aaggatgtactcataaagacggccccagcactcaactcaccaaacgtggaagcgtgcggatacagcgatagagtg

SEQ ID NO: 80416 - DNA, 75 bp, Artificial Sequence
  Synthetic
tgaggatggctttcggtaatctctatgcagcatttcataaaaatccaggtgtggtgacaggctcggctgttggtt

SEQ ID NO: 80417 - DNA, 75 bp, Artificial Sequence
  Synthetic
cccgagtacattagagatgatgaggcaaacccggtggatcaaccaactgagccagatgtggccacctgcaggttc

SEQ ID NO: 80418 - DNA, 75 bp, Artificial Sequence
  Synthetic
caaacccggtggatcaaccaactgagccagatgtggccacctgcaggttctacactttagacacagtaatgtggg

SEQ ID NO: 80419 - DNA, 75 bp, Artificial Sequence
  Synthetic
attaccattacctgggaagatccgggtacactgtgcatgtgcagtgcaatgcgtccaaatttcatcaaggtgctc

SEQ ID NO: 80420 - DNA, 75 bp, Artificial Sequence
  Synthetic
gtacactgtgcatgtgcagtgcaatgcgtccaaatttcatcaaggtgctctcggggtgtttgcgatccctgagta

SEQ ID NO: 80421 - DNA, 75 bp, Artificial Sequence
  Synthetic
gttcttctcccaatttaatatggacaccactacaacatccccaaaaagagagttttgtccggtggattacctctt

SEQ ID NO: 80422 - DNA, 75 bp, Artificial Sequence
  Synthetic
accactacaacatccccaaaaagagagttttgtccggtggattacctcttggggtgtggagtgttactggggaac

SEQ ID NO: 80423 - DNA, 75 bp, Artificial Sequence
  Synthetic
gcactagcaattgattcgatggttaaacacaacaactggggcattgctattctacccctgtcaccattggacttt

SEQ ID NO: 80424 - DNA, 75 bp, Artificial Sequence
  Synthetic
aacacaacaactggggcattgctattctacccctgtcaccattggactttgctcaagattcgtcagttgagatac

SEQ ID NO: 80425 - DNA, 75 bp, Artificial Sequence
  Synthetic
gactgccagtgctgaacacacctggtagcaaccagtacttgacttcagataaccaccaatcaccatgtgcaatcc

SEQ ID NO: 80426 - DNA, 75 bp, Artificial Sequence
  Synthetic
tttttagcaaccctacctcagtcgaattggattgggttatactgttgtaggggtaaatttttctttaattcggag

SEQ ID NO: 80427 - DNA, 75 bp, Artificial Sequence
  Synthetic
tagcaaccagtacttgacttcagataaccaccaatcaccatgtgcaatcccggaatttgatgtcactccacccat

SEQ ID NO: 80428 - DNA, 75 bp, Artificial Sequence
  Synthetic
gactaaaagaaatactatggacatgtacagggtcaccctaagtgacggtgctgatttgtcacatccaattctatg

SEQ ID NO: 80429 - DNA, 75 bp, Artificial Sequence
  Synthetic
tccccggtgatattgtatagactgtgcccacggttgaagacaatagatccgttatccgcttttatacttcgagaa

SEQ ID NO: 80430 - DNA, 75 bp, Artificial Sequence
  Synthetic
tacagggtcaccctaagtgacggtgctgatttgtcacatccaattctatgtttgtcactatccccagcatctgac

SEQ ID NO: 80431 - DNA, 75 bp, Artificial Sequence
  Synthetic
gcccacggttgaagacaatagatccgttatccgcttttatacttcgagaagcccagtaccaccttggaatcttcg

SEQ ID NO: 80432 - DNA, 75 bp, Artificial Sequence
  Synthetic
ttcctgttctgcggctcaatgatggctacggggaaaattttagtagcctacgcaccacctggcgcacaaccccct

SEQ ID NO: 80433 - DNA, 75 bp, Artificial Sequence
  Synthetic
ctacggggaaaattttagtagcctacgcaccacctggcgcacaacccccttccaaccgcaaggaggccatgctgg

SEQ ID NO: 80434 - DNA, 75 bp, Artificial Sequence
  Synthetic
gcccctgaatgcggctaatcccaaccacggagcaggtgatcacaaaccagtgactagcctgtcgtaacgcgcaag

SEQ ID NO: 80435 - DNA, 75 bp, Artificial Sequence
  Synthetic
acagacagaccacgcaagatagtttcacagagggtgggtatatcagtatgttctaccagacacgaattgtggtgc

SEQ ID NO: 80436 - DNA, 75 bp, Artificial Sequence
  Synthetic
gtgtccgtgtttccttttatttcatttatggctgcttatggtgacaatcatagattgttatcataaagcgaattg

SEQ ID NO: 80437 - DNA, 75 bp, Artificial Sequence
  Synthetic
cacagagggtgggtatatcagtatgttctaccagacacgaattgtggtgccgttgtccacccctaagagtatgaa

SEQ ID NO: 80438 - DNA, 75 bp, Artificial Sequence
  Synthetic
tagattgttatcataaagcgaattggattggccatccggtgaaaatcaagcacatcatttatctgtttgttggat

SEQ ID NO: 80439 - DNA, 75 bp, Artificial Sequence
  Synthetic
tgcacttccacagggtattgatgacttgatcactgaggtcgcacaaggtgctctaactctgtcgctcccgaagtc

SEQ ID NO: 80440 - DNA, 75 bp, Artificial Sequence
  Synthetic
ttgatcactgaggtcgcacaaggtgctctaactctgtcgctcccgaagtcacaggacagcctgcctgacactaaa

SEQ ID NO: 80441 - DNA, 75 bp, Artificial Sequence
  Synthetic
gctcaagtatcatcacagaaggttggagcccacgaaaacaccaatgtggcgactggtggctcaactgtaaattac

SEQ ID NO: 80442 - DNA, 75 bp, Artificial Sequence
  Synthetic
ccatcagacacggtacaaacacgccacgtgatccaacggcgcagtaggtcagagtcctcgatagaatcattcttt

SEQ ID NO: 80443 - DNA, 75 bp, Artificial Sequence
  Synthetic
tttacagaacctgtgaaagatatcatgttgaaatccgccccagcattaaattctccaaacgttgaggcgtgtggg

SEQ ID NO: 80444 - DNA, 75 bp, Artificial Sequence
  Synthetic
tgttgaaatccgccccagcattaaattctccaaacgttgaggcgtgtgggtatagcgatagggttaggcagatca

SEQ ID NO: 80445 - DNA, 75 bp, Artificial Sequence
  Synthetic
acgtgatccaacggcgcagtaggtcagagtcctcgatagaatcattctttgcacgcggcgcatgcgtcgccatta

SEQ ID NO: 80446 - DNA, 75 bp, Artificial Sequence
  Synthetic
cagtacagctgcgccgcaagttggagttcttcacatactcccgcttcgatatggaattcacctttgtggtaactg

SEQ ID NO: 80447 - DNA, 75 bp, Artificial Sequence
  Synthetic
ttgccccacaagaagctaacccagttgatgcaccaacggaacctgacgtgagtagcaacagattctacacactag

SEQ ID NO: 80448 - DNA, 75 bp, Artificial Sequence
  Synthetic
tgatgcaccaacggaacctgacgtgagtagcaacagattctacacactagagtcagtgcaatggaacaaagaatc

SEQ ID NO: 80449 - DNA, 75 bp, Artificial Sequence
  Synthetic
gttcttcacatactcccgcttcgatatggaattcacctttgtggtaactgccaacttcactaacaccaacaacgg

SEQ ID NO: 80450 - DNA, 75 bp, Artificial Sequence
  Synthetic
cacctggcaaacttcatccaacccatccatattttacacttatggggccgctccggcgcgaatctcagtaccgta

SEQ ID NO: 80451 - DNA, 75 bp, Artificial Sequence
  Synthetic
cctgggtagatcaggttacaccgtgcacgtccaatgcaatgcgtctaaattccatcaaggcgctttagccgtgtt

SEQ ID NO: 80452 - DNA, 75 bp, Artificial Sequence
  Synthetic
cacgtccaatgcaatgcgtctaaattccatcaaggcgctttagccgtgtttgccgtccctgagtgtgtgttttca

SEQ ID NO: 80453 - DNA, 75 bp, Artificial Sequence
  Synthetic
tccatattttacacttatggggccgctccggcgcgaatctcagtaccgtatgtggggctggctaatgcctactca

SEQ ID NO: 80454 - DNA, 75 bp, Artificial Sequence
  Synthetic
gccatgactgttgatgactttggtgtgttggcagtccgtgtggtcaatgatcacaaccccaccaaagtgacctcc

SEQ ID NO: 80455 - DNA, 75 bp, Artificial Sequence
  Synthetic
tcacaatatgtacctggtgaaactactgaagtagcaagggaattttgccccattgattacttgttcgggtcaggt

SEQ ID NO: 80456 - DNA, 75 bp, Artificial Sequence
  Synthetic
ctgaagtagcaagggaattttgccccattgattacttgttcgggtcaggtgtcttattcggaaatgcattcattt

SEQ ID NO: 80457 - DNA, 75 bp, Artificial Sequence
  Synthetic
tgttggcagtccgtgtggtcaatgatcacaaccccaccaaagtgacctccaaaatccgcatttacatgaaaccca

SEQ ID NO: 80458 - DNA, 75 bp, Artificial Sequence
  Synthetic
acctggaacccttgtccgaaaagggcttgaccacttatggttttggacatcagaacaaggctgtgtacactactg

SEQ ID NO: 80459 - DNA, 75 bp, Artificial Sequence
  Synthetic
tcgattgcatggctaggcacaataactggggaatagtcatcatcccggtagttcctttggacttcgctgatgcta

SEQ ID NO: 80460 - DNA, 75 bp, Artificial Sequence
  Synthetic
ctggggaatagtcatcatcccggtagttcctttggacttcgctgatgctagtagcacgcaaataccgatcacact

SEQ ID NO: 80461 - DNA, 75 bp, Artificial Sequence
  Synthetic
cttgaccacttatggttttggacatcagaacaaggctgtgtacactactggatataagatctgcaattaccatct

SEQ ID NO: 80462 - DNA, 75 bp, Artificial Sequence
  Synthetic
tcagggtactgactcaatagcaaggtgcaactgtaaggcaggagtgtactactgtgagtccagaaggaagtatta

SEQ ID NO: 80463 - DNA, 75 bp, Artificial Sequence
  Synthetic
catgctagtgcctggatcaaatcagtttttgacgtctgacaatttccaatcaccgtgtgcactgcccgaatttga

SEQ ID NO: 80464 - DNA, 75 bp, Artificial Sequence
  Synthetic
tttttgacgtctgacaatttccaatcaccgtgtgcactgcccgaatttgatgtgacacctcccatccacatacct

SEQ ID NO: 80465 - DNA, 75 bp, Artificial Sequence
  Synthetic
tgcaactgtaaggcaggagtgtactactgtgagtccagaaggaagtattaccccgtcacgtttgtaggtcccacc

SEQ ID NO: 80466 - DNA, 75 bp, Artificial Sequence
  Synthetic
tcaccaggtgattgtggaggcatccttaggtgtcaacatggtgtcatcgggattgtaacggctggtggtgagggg

SEQ ID NO: 80467 - DNA, 75 bp, Artificial Sequence
  Synthetic
aacacaatggacatgtataggatcgggctggatagtaatgcatccaacctgaacactccaattttctgtctctca

SEQ ID NO: 80468 - DNA, 75 bp, Artificial Sequence
  Synthetic
ggctggatagtaatgcatccaacctgaacactccaattttctgtctctcactttcccccgccagtgaccaaagat

SEQ ID NO: 80469 - DNA, 75 bp, Artificial Sequence
  Synthetic
ttaggtgtcaacatggtgtcatcgggattgtaacggctggtggtgaggggctggtcgcgttttctgacataaggg

SEQ ID NO: 80470 - DNA, 75 bp, Artificial Sequence
  Synthetic
gtagtgggttcactcagcaaataggagacaaaatatcagaattgaccagtatggtgaccagtacggttacagaga

SEQ ID NO: 80471 - DNA, 75 bp, Artificial Sequence
  Synthetic
tttgtggtagtatgatggccacaggtaagttactactcagctatagccctcctggtgcagcccccccaacaacac

SEQ ID NO: 80472 - DNA, 75 bp, Artificial Sequence
  Synthetic
taagttactactcagctatagccctcctggtgcagcccccccaacaacacggaaagatgctatgctgggtaccca

SEQ ID NO: 80473 - DNA, 75 bp, Artificial Sequence
  Synthetic
agacaaaatatcagaattgaccagtatggtgaccagtacggttacagagaagttattaaaaaacttaataaagat

SEQ ID NO: 80474 - DNA, 75 bp, Artificial Sequence
  Synthetic
gtgtgatgtttcaccgtggcaatggctgaagaaaaaggcatgtgacattctggagattccctatgttatcaaaca

SEQ ID NO: 80475 - DNA, 75 bp, Artificial Sequence
  Synthetic
atgtgttaaagatgactacaccgcaggtggttatattacatgtttttatcaaaccaaaattgtcgtacctctaag

SEQ ID NO: 80476 - DNA, 75 bp, Artificial Sequence
  Synthetic
ggtggttatattacatgtttttatcaaaccaaaattgtcgtacctctaagtacaccaaccaaaatggacatgctg

SEQ ID NO: 80477 - DNA, 75 bp, Artificial Sequence
  Synthetic
ctgaagaaaaaggcatgtgacattctggagattccctatgttatcaaacaaggtgatagctggttgaagaaattt

SEQ ID NO: 80478 - DNA, 75 bp, Artificial Sequence
  Synthetic
gaaagaatcattccccaagccagggacaagcttgagttcgtgaccaaactgaagcaattggagatgctagagaac

SEQ ID NO: 80479 - DNA, 75 bp, Artificial Sequence
  Synthetic
gtattaccacaagggttggaagacattatcgagtcagtggcccaaaatgctcttcaaatttcccaaccaaggcca

SEQ ID NO: 80480 - DNA, 75 bp, Artificial Sequence
  Synthetic
ttatcgagtcagtggcccaaaatgctcttcaaatttcccaaccaaggccagcccaaagaccagcaatcactaata

SEQ ID NO: 80481 - DNA, 75 bp, Artificial Sequence
  Synthetic
acaagcttgagttcgtgaccaaactgaagcaattggagatgctagagaaccaaatatcaaccatacaccagtcgt

SEQ ID NO: 80482 - DNA, 75 bp, Artificial Sequence
  Synthetic
cattatacgcacttgaagccaagagaatacagagactggagcataccatcaataattacatacagttcaagagca

SEQ ID NO: 80483 - DNA, 75 bp, Artificial Sequence
  Synthetic
ctagcggacaggcagtacctgcagacgtcatagaaaccagaaaagtgatcaactacaaaactagaagtgaatcaa

SEQ ID NO: 80484 - DNA, 75 bp, Artificial Sequence
  Synthetic
cgtcatagaaaccagaaaagtgatcaactacaaaactagaagtgaatcaaccattgaaagctttttcggacgatc

SEQ ID NO: 80485 - DNA, 75 bp, Artificial Sequence
  Synthetic
aatacagagactggagcataccatcaataattacatacagttcaagagcaaacaccgtattgaaccagtatgttt

SEQ ID NO: 80486 - DNA, 75 bp, Artificial Sequence
  Synthetic
aaacacctccacttactcgctaccaccagacccttcccactttgatgggtacaaacagcaaggagtggttatcat

SEQ ID NO: 80487 - DNA, 75 bp, Artificial Sequence
  Synthetic
gtgggagatcagttacacagacactgtccaacttaggaggaaattggagatgttcacgtactcacgttttgacac

SEQ ID NO: 80488 - DNA, 75 bp, Artificial Sequence
  Synthetic
gtccaacttaggaggaaattggagatgttcacgtactcacgttttgacacggagtttacctttgtattgaccgag

SEQ ID NO: 80489 - DNA, 75 bp, Artificial Sequence
  Synthetic
ccagacccttcccactttgatgggtacaaacagcaaggagtggttatcatggatgacctaaaccagaatccggat

SEQ ID NO: 80490 - DNA, 75 bp, Artificial Sequence
  Synthetic
aaaggcattttgttcacatccaactacgtcttggcctctaccaactccagtcgaatcacaccacccacagtggca

SEQ ID NO: 80491 - DNA, 75 bp, Artificial Sequence
  Synthetic
agacccaatgcatgggacgactatacatggcaatcctcatcaaacccgtccatcttttacacttatggttgcgca

SEQ ID NO: 80492 - DNA, 75 bp, Artificial Sequence
  Synthetic
catggcaatcctcatcaaacccgtccatcttttacacttatggttgcgcaccaccaagaatgtctgtaccatttg

SEQ ID NO: 80493 - DNA, 75 bp, Artificial Sequence
  Synthetic
aagttgaatatggcaatggctacagagttgtgtaaaaactgtcaccaaccagcaaacttcaaacgatgctgccct

SEQ ID NO: 80494 - DNA, 75 bp, Artificial Sequence
  Synthetic
gtggagacgcatactatggccaaacttcaattaacgactttggagcaattgcccttagagtggtcaatgagcaca

SEQ ID NO: 80495 - DNA, 75 bp, Artificial Sequence
  Synthetic
ttcaattaacgactttggagcaattgcccttagagtggtcaatgagcacaatccagcgcgaatcacatcacgaat

SEQ ID NO: 80496 - DNA, 75 bp, Artificial Sequence
  Synthetic
atgatcatcaatgagagaaacagaaggtccaacattggtaactgcatggaagccttgttccaaggacctctccag

SEQ ID NO: 80497 - DNA, 75 bp, Artificial Sequence
  Synthetic
ggtccaacattggtaactgcatggaagccttgttccaaggacctctccagtataaagacttgaaaatagatgtca

SEQ ID NO: 80498 - DNA, 75 bp, Artificial Sequence
  Synthetic
tggagtggacatcaaagaagacaccttgactcccatcacaccagtcacgtctatgaccacttatgggtttggcca

SEQ ID NO: 80499 - DNA, 75 bp, Artificial Sequence
  Synthetic
ttgactcccatcacaccagtcacgtctatgaccacttatgggtttggccatcagagcaaagcagtttatgtcgcc

SEQ ID NO: 80500 - DNA, 75 bp, Artificial Sequence
  Synthetic
aaaagaagggctggatagttaacatcaccagccagattcaaatggaaaggaacatcaacagggcaatgacgattt

SEQ ID NO: 80501 - DNA, 75 bp, Artificial Sequence
  Synthetic
caccagccagattcaaatggaaaggaacatcaacagggcaatgacgattttgcaagcagtcactacattcgccgc

SEQ ID NO: 80502 - DNA, 75 bp, Artificial Sequence
  Synthetic
gatttaatagtgactgaatccagagcccaggggaccgacaccatagccaggtgtaattgtagagcaggtgtatat

SEQ ID NO: 80503 - DNA, 75 bp, Artificial Sequence
  Synthetic
cccaggggaccgacaccatagccaggtgtaattgtagagcaggtgtatattattgtgaatctagaagaaagtact

SEQ ID NO: 80504 - DNA, 75 bp, Artificial Sequence
  Synthetic
gaaacccaatgtgcccaccattagaacggcaaaggtgcaggggccagggtttgattatgcagtggcaatggctaa

SEQ ID NO: 80505 - DNA, 75 bp, Artificial Sequence
  Synthetic
acggcaaaggtgcaggggccagggtttgattatgcagtggcaatggctaagagaaatattgttacagcaactact

SEQ ID NO: 80506 - DNA, 75 bp, Artificial Sequence
  Synthetic
acatgttgcttggacatggctttgcggaaccaggtgactgtggtggcattctgagatgtaatcatggtgtaatgg

SEQ ID NO: 80507 - DNA, 75 bp, Artificial Sequence
  Synthetic
ggaaccaggtgactgtggtggcattctgagatgtaatcatggtgtaatgggcatcattacagctggaggacatgg

SEQ ID NO: 80508 - DNA, 75 bp, Artificial Sequence
  Synthetic
agtgttgtgatcgatggtaaggaagttgagattttggacgccaaagcacttgaagaccaagcagggaccaacctt

SEQ ID NO: 80509 - DNA, 75 bp, Artificial Sequence
  Synthetic
ttgagattttggacgccaaagcacttgaagaccaagcagggaccaaccttgaaatcaccataattactctaaaaa

SEQ ID NO: 80510 - DNA, 75 bp, Artificial Sequence
  Synthetic
catcgagtctctgggggcagccttcggttcaggtttcactaatcagattggagagaaggttgctgaactaaccag

SEQ ID NO: 80511 - DNA, 75 bp, Artificial Sequence
  Synthetic
ggttcaggtttcactaatcagattggagagaaggttgctgaactaaccagcatggtcaccagctcgattactgag

SEQ ID NO: 80512 - DNA, 75 bp, Artificial Sequence
  Synthetic
gtcttggcaacgctagctctccttggatgtgattgctccccttggcagtggatcaaaaagaaggcatgtgatatt

SEQ ID NO: 80513 - DNA, 75 bp, Artificial Sequence
  Synthetic
gatgtgattgctccccttggcagtggatcaaaaagaaggcatgtgatattcttgaaattccttacgtcatgaggc

SEQ ID NO: 80514 - DNA, 75 bp, Artificial Sequence
  Synthetic
tttccaagttcattgattggttgaaagagaaagtgattccagaagccaaagacaaagtggagtacattacgaagt

SEQ ID NO: 80515 - DNA, 75 bp, Artificial Sequence
  Synthetic
tgaaacagctgggagtgctagaaaatcaaatcaacaccatccatcagtcatgcccgagtcaagagcagcaagaag

SEQ ID NO: 80516 - DNA, 75 bp, Artificial Sequence
  Synthetic
gaatccttaaactggaaaacactatcaacaattacatacagttcaagagcaaacaccgtattgaaccagtatgta

SEQ ID NO: 80517 - DNA, 75 bp, Artificial Sequence
  Synthetic
caacaattacatacagttcaagagcaaacaccgtattgaaccagtatgtatgttgatacacggcactcccgggac

SEQ ID NO: 80518 - DNA, 75 bp, Artificial Sequence
  Synthetic
accagaccccacccactttgatgggtataagcagcaaggggttgtcataatggatgacctgaaccagaatcccga

SEQ ID NO: 80519 - DNA, 75 bp, Artificial Sequence
  Synthetic
acaaaggaaatgcaaaaattgctcgatacatatggaatcaatctcccactggtgacttacgtgaaggatgagctt

SEQ ID NO: 80520 - DNA, 75 bp, Artificial Sequence
  Synthetic
tataagcagcaaggggttgtcataatggatgacctgaaccagaatcccgatgggaacgacatgaaattattctgt

SEQ ID NO: 80521 - DNA, 75 bp, Artificial Sequence
  Synthetic
tatgtcttggcatctacaaactctagtaccatagccccacccacagtcgctcacagtgatgcactcaccagaaga

SEQ ID NO: 80522 - DNA, 75 bp, Artificial Sequence
  Synthetic
gtaccatagccccacccacagtcgctcacagtgatgcactcaccagaagattcgcctttgatatggaggtgtaca

SEQ ID NO: 80523 - DNA, 75 bp, Artificial Sequence
  Synthetic
gtttgccttcgattacactgggtacgatgcatccctcagtcctgcatggttcgaagcgctaaagatggtgctcga

SEQ ID NO: 80524 - DNA, 75 bp, Artificial Sequence
  Synthetic
cagctaacttcaagaagtgttgccctttgatttgtggaaaggctttacaacttatggacaaaaacacaaggcaaa

SEQ ID NO: 80525 - DNA, 75 bp, Artificial Sequence
  Synthetic
tttgatttgtggaaaggctttacaacttatggacaaaaacacaaggcaaaggttcaccttggatgaaatcaccac

SEQ ID NO: 80526 - DNA, 75 bp, Artificial Sequence
  Synthetic
gtacaaggatatcaaaatagatattaaggaaacccctgccccagaatatataaatgatctgctccaagcggtcga

SEQ ID NO: 80527 - DNA, 75 bp, Artificial Sequence
  Synthetic
aaggaaacccctgccccagaatatataaatgatctgctccaagcggtcgacagtcaagaggtgagggactactgt

SEQ ID NO: 80528 - DNA, 75 bp, Artificial Sequence
  Synthetic
ttgcaagccgtgaccacctttgcagctgtcgctggagtagtatatgtgatgtacaagttgtttgccggacagcag

SEQ ID NO: 80529 - DNA, 75 bp, Artificial Sequence
  Synthetic
ctgtcgctggagtagtatatgtgatgtacaagttgtttgccggacagcagggtgcctatactgggttgccaagca

SEQ ID NO: 80530 - DNA, 75 bp, Artificial Sequence
  Synthetic
gtacacccagtaatgccaatgaaggaaattcatgaatcaattagatggacaaaagatcccaggaacacccaggat

SEQ ID NO: 80531 - DNA, 75 bp, Artificial Sequence
  Synthetic
agagaaatatcttgacagctaccactagtaaaggagagttcaccatgctgggggtatatgacaatgttgccatcc

SEQ ID NO: 80532 - DNA, 75 bp, Artificial Sequence
  Synthetic
tagtaaaggagagttcaccatgctgggggtatatgacaatgttgccatcctgccaacacatgccgctcccgggga

SEQ ID NO: 80533 - DNA, 75 bp, Artificial Sequence
  Synthetic
cccacgtggcggccagtacaccggtatcacggtacccttgtacgcctgttttatactccctttcccctgtaactt

SEQ ID NO: 80534 - DNA, 75 bp, Artificial Sequence
  Synthetic
tgaaatcaccattgtcaagttaaagagaaatgaaaagttcagagacattagaccccatatacccactcaaatcac

SEQ ID NO: 80535 - DNA, 75 bp, Artificial Sequence
  Synthetic
agaaatgaaaagttcagagacattagaccccatatacccactcaaatcactgagacaaatgatggagtattgatc

SEQ ID NO: 80536 - DNA, 75 bp, Artificial Sequence
  Synthetic
gaagggggtacaaaccagtaccaccacgaacaagcacttctgtttccccggtgaggttgtataaactgtccccac

SEQ ID NO: 80537 - DNA, 75 bp, Artificial Sequence
  Synthetic
ggtcgtcagactgctcgtacgctaatgtacaactttcccacgagagcaggacaatgtggtggagtcatcacatgt

SEQ ID NO: 80538 - DNA, 75 bp, Artificial Sequence
  Synthetic
tgtacaactttcccacgagagcaggacaatgtggtggagtcatcacatgtactggtaaagtcatcggaatgcatg

SEQ ID NO: 80539 - DNA, 75 bp, Artificial Sequence
  Synthetic
gaacagggtgtgaagagcctattgagctacaagagagtcctccggcccctgaatgcggctaatcccaaccacgga

SEQ ID NO: 80540 - DNA, 75 bp, Artificial Sequence
  Synthetic
aatggatgaggccatccaaagaggtggggtatcccattattaatgcccctagtaaaaccaagcttgagcctagtg

SEQ ID NO: 80541 - DNA, 75 bp, Artificial Sequence
  Synthetic
ggggtatcccattattaatgcccctagtaaaaccaagcttgagcctagtgcatttcactacatttttgagggagt

SEQ ID NO: 80542 - DNA, 75 bp, Artificial Sequence
  Synthetic
gcggaaccgactactttgggtgtccgtgtttccttttattcttacaatggctgcttatggtgacaatcatagatt

SEQ ID NO: 80543 - DNA, 75 bp, Artificial Sequence
  Synthetic
cgtgggcaacaaaatcactgaggtcgatgaatacatgaaggaagctgttgaccactatgctggacaactcatgtc

SEQ ID NO: 80544 - DNA, 75 bp, Artificial Sequence
  Synthetic
gatgaatacatgaaggaagctgttgaccactatgctggacaactcatgtctcttgacattaacactgatcagatg

SEQ ID NO: 80545 - DNA, 75 bp, Artificial Sequence
  Synthetic
gtggcgatggggaagaaaaagagagatattctcaacaagcaaactagagacactaaagagatgcaaagattgctt

SEQ ID NO: 80546 - DNA, 75 bp, Artificial Sequence
  Synthetic
atattctcaacaagcaaactagagacactaaagagatgcaaagattgcttgacacctacggcatcaatctaccct

SEQ ID NO: 80547 - DNA, 75 bp, Artificial Sequence
  Synthetic
caagtcttaatgattctgtggcaatgagaatggcctttggaaatctgtatgcagcattccacaagaatccaggag

SEQ ID NO: 80548 - DNA, 75 bp, Artificial Sequence
  Synthetic
gagaatggcctttggaaatctgtatgcagcattccacaagaatccaggagtggtgacaggatcagcagttggttg

SEQ ID NO: 80549 - DNA, 75 bp, Artificial Sequence
  Synthetic
tgacgcatcactcagtcctgcttggtttgaggcactaaagatggtgttggagaagattggctttggagacagagt

SEQ ID NO: 80550 - DNA, 75 bp, Artificial Sequence
  Synthetic
catactgtgttaagggcggtatgccatctggctgctctggcacctcaattttcaactcaatgattaacaacttaa

SEQ ID NO: 80551 - DNA, 75 bp, Artificial Sequence
  Synthetic
ggttgacgctagtctcctagcccaatcaggaaaagactatggactaaccatgactccagctgacaagtcagccac

SEQ ID NO: 80552 - DNA, 75 bp, Artificial Sequence
  Synthetic
gaaattcatgaatcaatcagatggacaaaggatcctagaaacacacaggatcacgttcgctcactgtgtctattg

SEQ ID NO: 80553 - DNA, 75 bp, Artificial Sequence
  Synthetic
ctgctccctgagtactcaacactgtaccgccgttggctcgactcattttagtaaccctacctcagtcgaattgga

SEQ ID NO: 80554 - DNA, 75 bp, Artificial Sequence
  Synthetic
gggggtggcttgtcgtaacgcgcaagtctgtggcggaaccgactactttgggtgtccgtgtttccttttattttt

SEQ ID NO: 80555 - DNA, 75 bp, Artificial Sequence
  Synthetic
tttcctccattaactcaactcacgcctgttttgatatctatagtgttattgatttggacaaagctatcataatgg

SEQ ID NO: 80556 - DNA, 75 bp, Artificial Sequence
  Synthetic
gatttggacaaagctatcataatgggcgctcaagtctcatctcagaaagtcggagctcacgaaaattcgaacaga

SEQ ID NO: 80557 - DNA, 75 bp, Artificial Sequence
  Synthetic
actcaggaagcagcaaattcagtggttgcatatgggcggtggccagaatatttgagagatagtgaagccaaccca

SEQ ID NO: 80558 - DNA, 75 bp, Artificial Sequence
  Synthetic
ccgatgcactgagagacatgggattgtttgggcaaaatatgtattaccactacctaggaaggtccgggtacacag

SEQ ID NO: 80559 - DNA, 75 bp, Artificial Sequence
  Synthetic
ccggggatagtaacaccactcccacacacaccagttaccagaatgcaaacccgggcgagaaggggggcaccttca

SEQ ID NO: 80560 - DNA, 75 bp, Artificial Sequence
  Synthetic
ccagacgacacccgcccgtaaattctgcccagtggattacctctttgggaacggtactttactaggtaatgcgtt

SEQ ID NO: 80561 - DNA, 75 bp, Artificial Sequence
  Synthetic
tgtgtttccgcatcaaataatcaacctgcgcaccaacaattgtgcaactttggtgctcccatacgtaaactctct

SEQ ID NO: 80562 - DNA, 75 bp, Artificial Sequence
  Synthetic
tgaatcatccccagagatccctatcacgctaaccatagcaccgatgtgttgtgaatttaatgggttgagaaacat

SEQ ID NO: 80563 - DNA, 75 bp, Artificial Sequence
  Synthetic
aacacgggtgtgtactactgtgaatccaggagaaaatattatccagtttctttcattgggcccaccttccaatac

SEQ ID NO: 80564 - DNA, 75 bp, Artificial Sequence
  Synthetic
aacacggggtgataggaataatcactgctggtggggaaggcttggttgcattttcagacattagagacctgtatg

SEQ ID NO: 80565 - DNA, 75 bp, Artificial Sequence
  Synthetic
attttgaattattacacacattgggcaggatccctgaaatttacatttttattctgtggttccatgatggcaaca

SEQ ID NO: 80566 - DNA, 75 bp, Artificial Sequence
  Synthetic
acgcaaagaggcgatgctgggaacgcatgtgatctgggacattggattgcaatcctcttgtacaatggtggtgcc

SEQ ID NO: 80567 - DNA, 75 bp, Artificial Sequence
  Synthetic
catgtgatctgggacattggattgcaatcctcttgtacaatggtggtgccttggatcagcaacaccacgtacaga

SEQ ID NO: 80568 - DNA, 75 bp, Artificial Sequence
  Synthetic
cgtgaaacaataggagcttcgacctcaagggatgctctcccgaacaccgagcccagtggtccagcacactctaaa

SEQ ID NO: 80569 - DNA, 75 bp, Artificial Sequence
  Synthetic
tccatcggacacggtacagaccagacacgtcatacaacacagatcgagatcggagtctagtattgagtctttctt

SEQ ID NO: 80570 - DNA, 75 bp, Artificial Sequence
  Synthetic
agtgtggaaaatcacatacaaggacactgtgcagctgagaagaaagctggagtttttcacatattccaggtttga

SEQ ID NO: 80571 - DNA, 75 bp, Artificial Sequence
  Synthetic
actgtgcagctgagaagaaagctggagtttttcacatattccaggtttgacatggaattcacctttgtaatcact

SEQ ID NO: 80572 - DNA, 75 bp, Artificial Sequence
  Synthetic
gcaccggcccgcatttcagtaccatatgttggtatctcaaacgcctactcacacttctatgacgggttctccaaa

SEQ ID NO: 80573 - DNA, 75 bp, Artificial Sequence
  Synthetic
ttggctgtcagagtggttaatgatcacaacccaacaacggttacttctaaggtcagagtatatttgaaacccaaa

SEQ ID NO: 80574 - DNA, 75 bp, Artificial Sequence
  Synthetic
acaacccaacaacggttacttctaaggtcagagtatatttgaaacccaaacacatcagagtctggtgcccgcgtc

SEQ ID NO: 80575 - DNA, 75 bp, Artificial Sequence
  Synthetic
atctgaccacatatggattcggacaccaaaacaaagcggtgtacactgcaggttacaaaatttgcaactaccatt

SEQ ID NO: 80576 - DNA, 75 bp, Artificial Sequence
  Synthetic
ccaaaacaaagcggtgtacactgcaggttacaaaatttgcaactaccatttggccactcaggaggatttgcaaaa

SEQ ID NO: 80577 - DNA, 75 bp, Artificial Sequence
  Synthetic
agcccctggtgactgtgggggcattttgaggtgccagcacggagtaattggaattatcacagctgggggagaagg

SEQ ID NO: 80578 - DNA, 75 bp, Artificial Sequence
  Synthetic
tcttgttgcattctcagacataagagatctgtatgcttatgaagatgaggctatggagcagggtatctccaacta

SEQ ID NO: 80579 - DNA, 75 bp, Artificial Sequence
  Synthetic
gatctgtatgcttatgaagatgaggctatggagcagggtatctccaactacattgaatctcttggcgctgccttc

SEQ ID NO: 80580 - DNA, 75 bp, Artificial Sequence
  Synthetic
gctgtgatgtctccccgtggcaatggctcaaaaagaaagcctgtgacatcttagagataccatatgtcattcgcc

SEQ ID NO: 80581 - DNA, 75 bp, Artificial Sequence
  Synthetic
tatccaaattcattgactggttgaaagagaaaattatacctcagacaagagataagctcgaatttgtgacaaagc

SEQ ID NO: 80582 - DNA, 75 bp, Artificial Sequence
  Synthetic
tcagatatccacaatacaccaatcttgcccgagccaggaacaccaagaaattctcttcaacaacgtgagatggct

SEQ ID NO: 80583 - DNA, 75 bp, Artificial Sequence
  Synthetic
agaacacgtccacatactctctaccgccagatcctagtcactttgatgggtacaaacagcaaggagtggtgatta

SEQ ID NO: 80584 - DNA, 75 bp, Artificial Sequence
  Synthetic
gaaaggcatcttgttcacctcaaattacgtgttggcctccaccaactccagtcgcatcacaccacccacggttgc

SEQ ID NO: 80585 - DNA, 75 bp, Artificial Sequence
  Synthetic
caagctgaatatggcaatggccaccgagatgtgcaagaactgccaccaaccagccaactttaaaagatgctgtcc

SEQ ID NO: 80586 - DNA, 75 bp, Artificial Sequence
  Synthetic
gagatgtgcaagaactgccaccaaccagccaactttaaaagatgctgtccgctcgtgtgcggaaaagctattcag

SEQ ID NO: 80587 - DNA, 75 bp, Artificial Sequence
  Synthetic
cggtcgaacattggaaactgcatggaggcgttgttccaaggaccaattcaatataaagatctcaagatagacatc

SEQ ID NO: 80588 - DNA, 75 bp, Artificial Sequence
  Synthetic
aggcgttgttccaaggaccaattcaatataaagatctcaagatagacatcaagactactccgcccccagaatgca

SEQ ID NO: 80589 - DNA, 75 bp, Artificial Sequence
  Synthetic
tctcgagtcaagtgcagttggagcgaaatatcaacagagccatgactattctccaggctgttacaacttttgccg

SEQ ID NO: 80590 - DNA, 75 bp, Artificial Sequence
  Synthetic
aaatatcaacagagccatgactattctccaggctgttacaacttttgccgcagtggcgggagtggtgtacgtgat

SEQ ID NO: 80591 - DNA, 75 bp, Artificial Sequence
  Synthetic
aacagcaaaagtacaagggccaggatttgattacgcggttgccatggccaagagaaacatcgtcactgccaccac

SEQ ID NO: 80592 - DNA, 75 bp, Artificial Sequence
  Synthetic
tttgattacgcggttgccatggccaagagaaacatcgtcactgccaccaccagtaaaggggagttcactatgctt

SEQ ID NO: 80593 - DNA, 75 bp, Artificial Sequence
  Synthetic
gtggaagtcctagacgccaaagcacttgaggaccaagctggcactaacctagaaatcactattgtcaccttaaag

SEQ ID NO: 80594 - DNA, 75 bp, Artificial Sequence
  Synthetic
ttgaggaccaagctggcactaacctagaaatcactattgtcaccttaaagagaaatgaaaaatttagggacatta

SEQ ID NO: 80595 - DNA, 75 bp, Artificial Sequence
  Synthetic
tgtacgtgcctgttggtgcagtgaccgaacaggggtacctcaatctgggtgggcgccaaacagcccgcaccctta

SEQ ID NO: 80596 - DNA, 75 bp, Artificial Sequence
  Synthetic
cgaacaggggtacctcaatctgggtgggcgccaaacagcccgcacccttatgtacaacttcccaacccgtgctgg

SEQ ID NO: 80597 - DNA, 75 bp, Artificial Sequence
  Synthetic
cgctgcggccctaaagcggtcgtacttcactcaaagtcaaggtgaaattcaatggatgaaaccatcgaaggaagt

SEQ ID NO: 80598 - DNA, 75 bp, Artificial Sequence
  Synthetic
ttcactcaaagtcaaggtgaaattcaatggatgaaaccatcgaaggaagttggataccctattattaatgcccct

SEQ ID NO: 80599 - DNA, 75 bp, Artificial Sequence
  Synthetic
aatgatccaagattgaaaacagacttcgaggaagccatcttctctaagtatgtaggcaacaagatcactgaagtg

SEQ ID NO: 80600 - DNA, 75 bp, Artificial Sequence
  Synthetic
tcgaggaagccatcttctctaagtatgtaggcaacaagatcactgaagtggatgaatacatgaaagaagctgttg

SEQ ID NO: 80601 - DNA, 75 bp, Artificial Sequence
  Synthetic
ctgatggcctggaagcactggatctaagcaccagtgcagggtacccgtatgttgctcttggaaagaagaaaaggg

SEQ ID NO: 80602 - DNA, 75 bp, Artificial Sequence
  Synthetic
aagcaccagtgcagggtacccgtatgttgctcttggaaagaagaaaagggatattctgaacaaacaaactagaga

SEQ ID NO: 80603 - DNA, 75 bp, Artificial Sequence
  Synthetic
caggtctaaaaccaaagtggaacaaggcaaatctagattgattgaagcgtcaagtctaaatgattcagtggccat

SEQ ID NO: 80604 - DNA, 75 bp, Artificial Sequence
  Synthetic
ggcaaatctagattgattgaagcgtcaagtctaaatgattcagtggccatgagaatggcttttggaaacttgtat

SEQ ID NO: 80605 - DNA, 75 bp, Artificial Sequence
  Synthetic
ataccagtactgatggaggataagctctttgcatttgactacacaggctatgatgcatcacttagccctgcctgg

SEQ ID NO: 80606 - DNA, 75 bp, Artificial Sequence
  Synthetic
agattacatagattatctgaaccactcacaccacctgtataaaaataagacctactgtgtcaagggcggcatgcc

SEQ ID NO: 80607 - DNA, 75 bp, Artificial Sequence
  Synthetic
ctacaagggcatagacttagaccacctaaaaatgattgcctatggtgatgatgtaattgcttcctacccccatga

SEQ ID NO: 80608 - DNA, 75 bp, Artificial Sequence
  Synthetic
tcaggaaaagactatggactaaccatgacaccagctgacaagtcagctatatttgaaacagtcacatgggagaat

SEQ ID NO: 80609 - DNA, 75 bp, Artificial Sequence
  Synthetic
gaaattcatgaatcaatcagatggaccaaggatcctagaaatacccaggatcatgttcgctcactgtgcctattg

SEQ ID NO: 80610 - DNA, 75 bp, Artificial Sequence
  Synthetic
tcatgttcgctcactgtgcctattggcttggcacaatggtgaggaagagtataataaatttttagctaaaataag

SEQ ID NO: 80611 - DNA, 75 bp, Artificial Sequence
  Synthetic
cagaggcccacgtggcggctagtactccggtattgcggtacccttgtacgcctgttttatactcccttcccgtaa

SEQ ID NO: 80612 - DNA, 75 bp, Artificial Sequence
  Synthetic
tccggtattgcggtacccttgtacgcctgttttatactcccttcccgtaacttagacgcacaaaaccaagttcaa

SEQ ID NO: 80613 - DNA, 75 bp, Artificial Sequence
  Synthetic
tcacgcggttgaaagtgatcgatccgttacccgcttgtgtacttcgagaagcctagtatcactttgggatcttcg

SEQ ID NO: 80614 - DNA, 75 bp, Artificial Sequence
  Synthetic
ccacgaacaagcacttctgtttccccggtgatgttgtatagactgcttgcgtggttgaaagcgacggatccgtta

SEQ ID NO: 80615 - DNA, 75 bp, Artificial Sequence
  Synthetic
agtaccacctcggaatcttcgatgcgttgcgctcagcactcaaccccagagtgtagcttaggctgatgagtctgg

SEQ ID NO: 80616 - DNA, 75 bp, Artificial Sequence
  Synthetic
gtgtagcttaggctgatgagtctggacatccctcaccggtgacggtggtccaggctgcgttggcggcctacctat

SEQ ID NO: 80617 - DNA, 75 bp, Artificial Sequence
  Synthetic
tactgtgttatctctactttccatttaactggttaatcaggaacgatacgagaataaaacaacaacatcacgatg

SEQ ID NO: 80618 - DNA, 75 bp, Artificial Sequence
  Synthetic
cgtgtttccttttattttattgtggctgcttatggtgacaatcacagattgttatcataaagcgaattggattgg

SEQ ID NO: 80619 - DNA, 75 bp, Artificial Sequence
  Synthetic
taactggttaatcaggaacgatacgagaataaaacaacaacatcacgatgggcacccaagtttcatcgcagaagg

SEQ ID NO: 80620 - DNA, 75 bp, Artificial Sequence
  Synthetic
atctatctgtttgctggattcgctccattgagtgtgtttactctaagtacaatttcaacagttatttcaatcaga

SEQ ID NO: 80621 - DNA, 75 bp, Artificial Sequence
  Synthetic
aatttcaacagttatttcaatcagacaattgtatcataatgggtgctcaggtttcatcacagaaagtgggcgcac

SEQ ID NO: 80622 - DNA, 75 bp, Artificial Sequence
  Synthetic
actctgcaagcaatgcggcaagtaggcaagatctcgcacaagatccgtccaagttcactgagcccgttaaggacg

SEQ ID NO: 80623 - DNA, 75 bp, Artificial Sequence
  Synthetic
tggttctaccattaattacaccaccattaattattatagagattcagctagtaacgcggcttcgaaacaggactt

SEQ ID NO: 80624 - DNA, 75 bp, Artificial Sequence
  Synthetic
taactctgggcaactcaacgatcaccactcaagaagcagccaactccgttgttgcctacggtaggtggcccgaat

SEQ ID NO: 80625 - DNA, 75 bp, Artificial Sequence
  Synthetic
ctctcaagacccttccaagttcaccgagcccatcaaggatgtcctgataaaaacatccccaatgctaaactcgcc

SEQ ID NO: 80626 - DNA, 75 bp, Artificial Sequence
  Synthetic
cactcaagaagcagccaactccgttgttgcctacggtaggtggcccgaatacatcagggacaccgaagcgaaccc

SEQ ID NO: 80627 - DNA, 75 bp, Artificial Sequence
  Synthetic
aaacatagaggcttgcgggtatagcgatagagtactgcaattaacactgggaaactccactataaccacacagga

SEQ ID NO: 80628 - DNA, 75 bp, Artificial Sequence
  Synthetic
ccagatgctttaaaagacatggggttgtttggtcaaaacatgttttatcactaccttgggagggccggttacaca

SEQ ID NO: 80629 - DNA, 75 bp, Artificial Sequence
  Synthetic
gccggcgatagcacgaagcacatgttcacaaggtatgaaaatgcaaatccaggtgaaagagggggtgaattcaag

SEQ ID NO: 80630 - DNA, 75 bp, Artificial Sequence
  Synthetic
tcacaaggtatgaaaatgcaaatccaggtgaaagagggggtgaattcaaggaaagatttacccttgataaaaaca

SEQ ID NO: 80631 - DNA, 75 bp, Artificial Sequence
  Synthetic
cagtgtaacgcctccaaattccaccagggggcactaggggtattcgccgtaccagagatgtgtctggccggggat

SEQ ID NO: 80632 - DNA, 75 bp, Artificial Sequence
  Synthetic
accagagatgtgtctggccggggatagcaacaccactaccatgcacaccagctatcaaaatgccaatcctggcga

SEQ ID NO: 80633 - DNA, 75 bp, Artificial Sequence
  Synthetic
tctatccacaccaaataataaacctgcgcaccaataactgtgctacactagtgctgccctatgtgaactcactct

SEQ ID NO: 80634 - DNA, 75 bp, Artificial Sequence
  Synthetic
gctatcaaaatgccaatcctggcgagaaaggaggcactttcacgggtacgttcactcctgacgacaaccagacat

SEQ ID NO: 80635 - DNA, 75 bp, Artificial Sequence
  Synthetic
ttcactcctgacgacaaccagacatcacctgcccgtaggttctgcccggtggattacctctttggaaatggcacg

SEQ ID NO: 80636 - DNA, 75 bp, Artificial Sequence
  Synthetic
cacctgcccgtaggttctgcccggtggattacctctttggaaatggcacgttattggggaatgcctttgtgttcc

SEQ ID NO: 80637 - DNA, 75 bp, Artificial Sequence
  Synthetic
gcgcaccaataactgtgctacactagtgctgccctatgtgaactcactctcaatagatagcatgacaaagcacaa

SEQ ID NO: 80638 - DNA, 75 bp, Artificial Sequence
  Synthetic
actaaccatcgctcccatgtgctgcgagttcaacggattacgcaacatcactgtgccaagaacccaaggattacc

SEQ ID NO: 80639 - DNA, 75 bp, Artificial Sequence
  Synthetic
gagttcaacggattacgcaacatcactgtgccaagaacccaaggattaccagttttgaacactccagggagcaac

SEQ ID NO: 80640 - DNA, 75 bp, Artificial Sequence
  Synthetic
catagcccctatgtgctgtgagttcaatggattaagaaacattaccctgccacgcttacagggcctgccggtcat

SEQ ID NO: 80641 - DNA, 75 bp, Artificial Sequence
  Synthetic
ccaggagaggtgcacaatatgatggagttggcagaaatagacaccatgatacccctcaacttgacaagtcaacgc

SEQ ID NO: 80642 - DNA, 75 bp, Artificial Sequence
  Synthetic
agttggcagaaatagacaccatgatacccctcaacttgacaagtcaacgcagaaacacaatggacatgtatagag

SEQ ID NO: 80643 - DNA, 75 bp, Artificial Sequence
  Synthetic
gaacacccctggtagcaatcaatatcttactgcagacaacttccagtcaccgtgtgcgctgcctgaatttgatgt

SEQ ID NO: 80644 - DNA, 75 bp, Artificial Sequence
  Synthetic
cttactgcagacaacttccagtcaccgtgtgcgctgcctgaatttgatgtgaccccacctattgacatacccggt

SEQ ID NO: 80645 - DNA, 75 bp, Artificial Sequence
  Synthetic
gaccccacctattgacatacccggtgaagttaagaacatgatggaattggcagaaatcgacaccatgattccctt

SEQ ID NO: 80646 - DNA, 75 bp, Artificial Sequence
  Synthetic
tggcacacaccatgttaggtgaaatattgaattattacacacattgggcagggtccttgaagtttacctttctct

SEQ ID NO: 80647 - DNA, 75 bp, Artificial Sequence
  Synthetic
attgaattattacacacattgggcagggtccttgaagtttacctttctcttttgtggctcaatgatggccactgg

SEQ ID NO: 80648 - DNA, 75 bp, Artificial Sequence
  Synthetic
ccagcttcagatcctaggttgtcacatactatgcttggagaaatcctaaattactacacacactgggcaggatcc

SEQ ID NO: 80649 - DNA, 75 bp, Artificial Sequence
  Synthetic
tgtgatatgggacattgggctgcagtcttcatgcaccatggtagtgccgtggatcagtaataccatgtacagaca

SEQ ID NO: 80650 - DNA, 75 bp, Artificial Sequence
  Synthetic
tcttcatgcaccatggtagtgccgtggatcagtaataccatgtacagacagaccatcaacgacagcttcacagag

SEQ ID NO: 80651 - DNA, 75 bp, Artificial Sequence
  Synthetic
ctgggacataggactgcagtcctcatgtactatggtagtgccatggattagcaacaccacgtatcggcaaaccat

SEQ ID NO: 80652 - DNA, 75 bp, Artificial Sequence
  Synthetic
agttttgtgtcagcctgcaacgacttcagtgtgcgcttgctgcgggatacaacacacattagtcaaaaagccatg

SEQ ID NO: 80653 - DNA, 75 bp, Artificial Sequence
  Synthetic
tcagtgtgcgcttgctgcgggatacaacacacattagtcaaaaagccatgccccaaggaattggtgacgcgattg

SEQ ID NO: 80654 - DNA, 75 bp, Artificial Sequence
  Synthetic
tacatcagcgtcttctaccaaaccagaatagtcgtccctctttcgacacccagagagatggacatccttggtttt

SEQ ID NO: 80655 - DNA, 75 bp, Artificial Sequence
  Synthetic
cgagtggtccagcccattccagggagatacccgcgctgacagcagtggaaacaggggctaccaaccccttggtgc

SEQ ID NO: 80656 - DNA, 75 bp, Artificial Sequence
  Synthetic
gatacccgcgctgacagcagtggaaacaggggctaccaaccccttggtgccctcggataccgtgcagacgcgcca

SEQ ID NO: 80657 - DNA, 75 bp, Artificial Sequence
  Synthetic
tgattgacaacacagtccgtgaaacggtgggggcggcaacgtctagagacgctctcccaaacactgaagccagtg

SEQ ID NO: 80658 - DNA, 75 bp, Artificial Sequence
  Synthetic
ggtgggggcggcaacgtctagagacgctctcccaaacactgaagccagtggaccagcacactccaaggaaattcc

SEQ ID NO: 80659 - DNA, 75 bp, Artificial Sequence
  Synthetic
tgaagtggaaaacgatgcaccaacggaacgcgacagattgttttcagtctggaaaataacttacaaagacactgt

SEQ ID NO: 80660 - DNA, 75 bp, Artificial Sequence
  Synthetic
gaacgcgacagattgttttcagtctggaaaataacttacaaagacactgttcagctgagacgcaaactggaattc

SEQ ID NO: 80661 - DNA, 75 bp, Artificial Sequence
  Synthetic
gcattgaaccaagtttatcaaataatgtatataccacccggggcgcctatccctggtaaatgggatgattataca

SEQ ID NO: 80662 - DNA, 75 bp, Artificial Sequence
  Synthetic
agatcacttataaagatactgtccagttacggaggaaattggagttcttcacctattctagatttgatatggaat

SEQ ID NO: 80663 - DNA, 75 bp, Artificial Sequence
  Synthetic
tgtatataccacccggggcgcctatccctggtaaatgggatgattatacatggcagacgtcttccaacccgtccg

SEQ ID NO: 80664 - DNA, 75 bp, Artificial Sequence
  Synthetic
gttacggaggaaattggagttcttcacctattctagatttgatatggaatttacctttgtggttactgcaaattt

SEQ ID NO: 80665 - DNA, 75 bp, Artificial Sequence
  Synthetic
cactgagactaacaatgggcatgccttaaatcaagtgtaccaaattatgtacgtaccaccaggcgctccagtgcc

SEQ ID NO: 80666 - DNA, 75 bp, Artificial Sequence
  Synthetic
ttaaatcaagtgtaccaaattatgtacgtaccaccaggcgctccagtgcccgagaaatgggacgactacacatgg

SEQ ID NO: 80667 - DNA, 75 bp, Artificial Sequence
  Synthetic
tttacgatgggtttgcaaaagtaccactagaaggacaggcccaagctgaaggtgactcattatacggtgctgcct

SEQ ID NO: 80668 - DNA, 75 bp, Artificial Sequence
  Synthetic
actagaaggacaggcccaagctgaaggtgactcattatacggtgctgcctcactaaatgattttgggtcactggc

SEQ ID NO: 80669 - DNA, 75 bp, Artificial Sequence
  Synthetic
cagtgtttggtgcccacgacctccacgagcagtcccatacttcgggccaggcgttgattacaaagacgagctcac

SEQ ID NO: 80670 - DNA, 75 bp, Artificial Sequence
  Synthetic
cgagcagtcccatacttcgggccaggcgttgattacaaagacgagctcacccctctgtcagaaaagggattgaca

SEQ ID NO: 80671 - DNA, 75 bp, Artificial Sequence
  Synthetic
tgtatctaaaacccaaacacatcagagtctggtgcccgcgtccaccgagggcagtggcgtactacggccctggag

SEQ ID NO: 80672 - DNA, 75 bp, Artificial Sequence
  Synthetic
caagaagacctacaaaacgccgtgagcgtcatgtgggacagagacctcttagtggttgaatcaaaggcctctggc

SEQ ID NO: 80673 - DNA, 75 bp, Artificial Sequence
  Synthetic
gcgtcatgtgggacagagacctcttagtggttgaatcaaaggcctctggcatcgactcaatcgcaaggtgtagct

SEQ ID NO: 80674 - DNA, 75 bp, Artificial Sequence
  Synthetic
aatttgcaactaccatttggccactcaggaagatttgcaaaacgcagtgaacgtcatgtggaatagagacctctt

SEQ ID NO: 80675 - DNA, 75 bp, Artificial Sequence
  Synthetic
acatggaggccaatgagtattacccagctagatatcagtcacacatgcttattggtcatgggtttgcatcaccgg

SEQ ID NO: 80676 - DNA, 75 bp, Artificial Sequence
  Synthetic
agctagatatcagtcacacatgcttattggtcatgggtttgcatcaccgggtgattgtggtggtatactaaggtg

SEQ ID NO: 80677 - DNA, 75 bp, Artificial Sequence
  Synthetic
agctaggtaccagtcccatatgctcattggccatggattcgcatctccaggggattgtggtggcatactcagatg

SEQ ID NO: 80678 - DNA, 75 bp, Artificial Sequence
  Synthetic
cgcttatgaagaggaggccatggagcagggcatttccaactatgttgagtcacttggtgccgcatttggtagtgg

SEQ ID NO: 80679 - DNA, 75 bp, Artificial Sequence
  Synthetic
cagggcatttccaactatgttgagtcacttggtgccgcatttggtagtggattcactcaacagattagtgacaaa

SEQ ID NO: 80680 - DNA, 75 bp, Artificial Sequence
  Synthetic
tcacttgtgattatcaccaggaattatgaagataccaccacagtgtttgccactcttgccctccttgggtgtgat

SEQ ID NO: 80681 - DNA, 75 bp, Artificial Sequence
  Synthetic
cacttggggccgcatttggaagtggatttactcagcagattggagacaaaataacagagttgactaatatggtga

SEQ ID NO: 80682 - DNA, 75 bp, Artificial Sequence
  Synthetic
atgaagataccaccacagtgtttgccactcttgccctccttgggtgtgatgtttcaccgtggcagtggttgaaga

SEQ ID NO: 80683 - DNA, 75 bp, Artificial Sequence
  Synthetic
atttactcagcagattggagacaaaataacagagttgactaatatggtgaccagtaccatcactgaaaagctact

SEQ ID NO: 80684 - DNA, 75 bp, Artificial Sequence
  Synthetic
ccagtaccatcactgaaaagctacttaagaacttgatcaagatcatatcctcactagttattataactaggaatt

SEQ ID NO: 80685 - DNA, 75 bp, Artificial Sequence
  Synthetic
catgcaatgctgcaaagggactggagtgggtatctaataagatatccaagttcatcagttggttacaggacaaaa

SEQ ID NO: 80686 - DNA, 75 bp, Artificial Sequence
  Synthetic
gtgggtatctaataagatatccaagttcatcagttggttacaggacaaaattatcccacaagcgagagacaagtt

SEQ ID NO: 80687 - DNA, 75 bp, Artificial Sequence
  Synthetic
tcaagaacaccaggagattctgttcaacaatgtgcggtggctgtccatccagtctaagaagtttgcaccgttata

SEQ ID NO: 80688 - DNA, 75 bp, Artificial Sequence
  Synthetic
aacaatgtgcggtggctgtccatccagtctaagaagtttgcaccgttatatgctcatgaggccagaaggatacaa

SEQ ID NO: 80689 - DNA, 75 bp, Artificial Sequence
  Synthetic
cacggcagcccagggactgggaaatcagttgcgaccaatctaattgctagggcaatagccgagaaagagaacact

SEQ ID NO: 80690 - DNA, 75 bp, Artificial Sequence
  Synthetic
cagttgcgaccaatctaattgctagggcaatagccgagaaagagaacacttccacttactcactgccacctgatc

SEQ ID NO: 80691 - DNA, 75 bp, Artificial Sequence
  Synthetic
aaactagagcataccattaacaactacatacagttcaagagcaaacaccgtattgaaccagtatgtttgctagta

SEQ ID NO: 80692 - DNA, 75 bp, Artificial Sequence
  Synthetic
catggcagccccggaacaggtaaatctgtagcaaccaacctgattgctagagccatagctgaaagagaaaacacg

SEQ ID NO: 80693 - DNA, 75 bp, Artificial Sequence
  Synthetic
acatgaaacttttttgtcaaatggtgtcaaccgtagaatttatcccaccgatggcctcactagaggagaaaggca

SEQ ID NO: 80694 - DNA, 75 bp, Artificial Sequence
  Synthetic
gtcaaccgtagaatttatcccaccgatggcctcactagaggagaaaggcattttgttcacatctaattatgtgtt

SEQ ID NO: 80695 - DNA, 75 bp, Artificial Sequence
  Synthetic
tgacatggacattcaagtcatgagcgagtattccagagatggaaagctcaacatggcaatggccactgagatgtg

SEQ ID NO: 80696 - DNA, 75 bp, Artificial Sequence
  Synthetic
gagtattccagagatggaaagctcaacatggcaatggccactgagatgtgtaaaaactgtcatcagccagcaaac

SEQ ID NO: 80697 - DNA, 75 bp, Artificial Sequence
  Synthetic
agcatccacgaactcaagcagaatttccccccccactgtggcacacagtgatgcattagccaggcgctttgcgtt

SEQ ID NO: 80698 - DNA, 75 bp, Artificial Sequence
  Synthetic
gttgaccagatcaccacaatgattgttaatgagagaaataggagatcaaacattggtaattgcatggaagctctg

SEQ ID NO: 80699 - DNA, 75 bp, Artificial Sequence
  Synthetic
ttaatgagagaaataggagatcaaacattggtaattgcatggaagctctgttccaggggccgctacaatacaagg

SEQ ID NO: 80700 - DNA, 75 bp, Artificial Sequence
  Synthetic
caaatcttccagagttagatacagtattgaccagatcactacaatgattatcaatgagagaaacagaagatccaa

SEQ ID NO: 80701 - DNA, 75 bp, Artificial Sequence
  Synthetic
aagtgagagattattgtgagaagaaaggctggattgttaatataaccagccaggtacaaacagagaggaatatta

SEQ ID NO: 80702 - DNA, 75 bp, Artificial Sequence
  Synthetic
accgggctatgaccattctgcaggcagtgaccaccttcgctacagtggctggtgttgtgtacgtcatgtacaaac

SEQ ID NO: 80703 - DNA, 75 bp, Artificial Sequence
  Synthetic
caggttcaaacagaaaggaacatcaacagggcaatgacaattctacaagcggtgacaaccttcgccgcagtggct

SEQ ID NO: 80704 - DNA, 75 bp, Artificial Sequence
  Synthetic
acagggcaatgacaattctacaagcggtgacaaccttcgccgcagtggctggagttgtctatgtcatgtataaac

SEQ ID NO: 80705 - DNA, 75 bp, Artificial Sequence
  Synthetic
aggtacaagggccagggttcgattacgcagtggctatggctaaaagaaacattgttacagcaactactagcaagg

SEQ ID NO: 80706 - DNA, 75 bp, Artificial Sequence
  Synthetic
tgatcaacggaaaggaaacggaaattattgacgccaaagccctcgaggatcaggcagggactaatcttgaaatca

SEQ ID NO: 80707 - DNA, 75 bp, Artificial Sequence
  Synthetic
attgttacagcaactactagcaagggagagttcactatgttaggagtccacgacaacgtggctattttaccaacc

SEQ ID NO: 80708 - DNA, 75 bp, Artificial Sequence
  Synthetic
cgacaacgtggctattttaccaacccacgcttcacctggtgaaagcattgtgatcgatggcaaagaagtggagat

SEQ ID NO: 80709 - DNA, 75 bp, Artificial Sequence
  Synthetic
tagtaagtaccccaacatgtatgttcctgttggtgctgtgactgaacagggatatctcaatctcggtgggcgcca

SEQ ID NO: 80710 - DNA, 75 bp, Artificial Sequence
  Synthetic
caagcaggaaccaatcttgaaatcactataatcactctaaagagaaatgaaaagttcagagacattagaccacat

SEQ ID NO: 80711 - DNA, 75 bp, Artificial Sequence
  Synthetic
ggtcatcggaatgcatgttggcgggaacggttcacacgggtttgcagcagccctaaagcggtcatacttcactca

SEQ ID NO: 80712 - DNA, 75 bp, Artificial Sequence
  Synthetic
aacggttcacacgggtttgcagcagccctaaagcggtcatacttcactcagacccaaggtgagattcaatggatg

SEQ ID NO: 80713 - DNA, 75 bp, Artificial Sequence
  Synthetic
catgtatttgaaggggtgaaggaaccagcggtcctcactaaaaatgaccccaggctcaaggtggactttgaagaa

SEQ ID NO: 80714 - DNA, 75 bp, Artificial Sequence
  Synthetic
cagcggtcctcactaaaaatgaccccaggctcaaggtggactttgaagaagcaatattctccaagtacgtgggca

SEQ ID NO: 80715 - DNA, 75 bp, Artificial Sequence
  Synthetic
aacggttcacacgggtttgcagcggccctgaagcgatcatacttcactcagagtcaaggtgaaatccagtggatg

SEQ ID NO: 80716 - DNA, 75 bp, Artificial Sequence
  Synthetic
caatcataaatgccccgtccaaaaccaagcttgaacccagtgctttccactatgtgtttgaaggggtgaaggaac

SEQ ID NO: 80717 - DNA, 75 bp, Artificial Sequence
  Synthetic
tatgtgtttgaaggggtgaaggaaccagcagtcctcactaaaaacgatcccaggcttaagacaaactttgaggag

SEQ ID NO: 80718 - DNA, 75 bp, Artificial Sequence
  Synthetic
tcaactcagaacaaatgtgcctggaagatgccatgtatggcaccgatggcctggaagcgcttgatttgaccacta

SEQ ID NO: 80719 - DNA, 75 bp, Artificial Sequence
  Synthetic
agatgccatgtatggcaccgatggcctggaagcgcttgatttgaccactagtgctggatacccctatgtgacaat

SEQ ID NO: 80720 - DNA, 75 bp, Artificial Sequence
  Synthetic
cgggatcaacctcccactcgtgacgtatgtcaaagatgagttgaggtcaagaaataaggtggagttaggaaaatc

SEQ ID NO: 80721 - DNA, 75 bp, Artificial Sequence
  Synthetic
tatgtcaaagatgagttgaggtcaagaaataaggtggagttaggaaaatccagattaattgaagcctccagctta

SEQ ID NO: 80722 - DNA, 75 bp, Artificial Sequence
  Synthetic
aacaaacaaaccagagacactaaggaaatgcaaaaactgctcgacacatatggaatcaacctcccactggtgact

SEQ ID NO: 80723 - DNA, 75 bp, Artificial Sequence
  Synthetic
ggcagtgcagttggttgtgatccagacttgttttggagcaagatcccagtgttaatggaagaaaagctctttgct

SEQ ID NO: 80724 - DNA, 75 bp, Artificial Sequence
  Synthetic
aatgactcagtggcaatgagaatggcttttgggaacctatatgctgcttttcacaaaaacccaggagtgataaca

SEQ ID NO: 80725 - DNA, 75 bp, Artificial Sequence
  Synthetic
ggattcggggatagggtggattacattgattacctcaaccattctcatcatctgtacaaaaacaaaacttattgc

SEQ ID NO: 80726 - DNA, 75 bp, Artificial Sequence
  Synthetic
ttgattacctcaaccattctcatcatctgtacaaaaacaaaacttattgcgtgaagggcggcatgccatctggct

SEQ ID NO: 80727 - DNA, 75 bp, Artificial Sequence
  Synthetic
cagtcacatgggagaacgtaacattcttgaagagattcttcagagcggatgagaggtattccttcctcatacatc

SEQ ID NO: 80728 - DNA, 75 bp, Artificial Sequence
  Synthetic
ctagtctcctagcccaatcaggaaaagactatggactaactatgactccagctgacaaatcagctatatttgaaa

SEQ ID NO: 80729 - DNA, 75 bp, Artificial Sequence
  Synthetic
cagtaatgccaatgaaggaaattcatgaatcaattagatggacaaaagatcctaggaacactcaggatcacgttc

SEQ ID NO: 80730 - DNA, 75 bp, Artificial Sequence
  Synthetic
ctgtggcggaaccgactactttgggtgtccgtgtttcctgttatttttatcatggctgcttatggtgacaatcag

SEQ ID NO: 80731 - DNA, 75 bp, Artificial Sequence
  Synthetic
taaccaattaatcaaaaacaatacgaggataaaacaacaatactacaatgggcgcccaagtttcatcacagaaag

SEQ ID NO: 80732 - DNA, 75 bp, Artificial Sequence
  Synthetic
gtttgcagttccagaaatgtgtttagctggtgatagcacaactcacatgttcacaaagtacgagaatgcgaatcc

SEQ ID NO: 80733 - DNA, 75 bp, Artificial Sequence
  Synthetic
gcgcactaacaactgtgctacgctagtattgccctatgtaaactcactctcaatagatagcatgacaaagcacaa

SEQ ID NO: 80734 - DNA, 75 bp, Artificial Sequence
  Synthetic
catagattgttatcataaagcgacttggattggccatccagtggaagtgaaatactttgtctacctgtctgttgg

SEQ ID NO: 80735 - DNA, 75 bp, Artificial Sequence
  Synthetic
tgttcaactgagacgcaaactggaatttttcacatattcgagatttgacatggagttcacttttgtggtcacctc

SEQ ID NO: 80736 - DNA, 75 bp, Artificial Sequence
  Synthetic
tgaatccaggagaaaatattatccagtttctttcattgggcccaccttccaatacatggaagccaatgaatatta

SEQ ID NO: 80737 - DNA, 75 bp, Artificial Sequence
  Synthetic
gtttctttcattgggcccaccttccaatacatggaagccaatgaatattacccggctagatatcaatcacacatg

SEQ ID NO: 80738 - DNA, 75 bp, Artificial Sequence
  Synthetic
ttgcattttcagacattagagacctgtatgcttatgaggaggaagctatggagcagggcatttccaactatattg

SEQ ID NO: 80739 - DNA, 75 bp, Artificial Sequence
  Synthetic
gacatctcaccgtggcagtggctaaagaagaaggcatgtgacatcctggaaattccatacgccatcaaacaagga

SEQ ID NO: 80740 - DNA, 75 bp, Artificial Sequence
  Synthetic
aaatcatcccacaagcgagagacaaattagagtttgtcactaaactaaagcaattagaaatgcttgaaaatcaga

SEQ ID NO: 80741 - DNA, 75 bp, Artificial Sequence
  Synthetic
caattagaaatgcttgaaaatcagatttccaccatacaccaatcttgtccaagtcaagaacatcaggagatctta

SEQ ID NO: 80742 - DNA, 75 bp, Artificial Sequence
  Synthetic
tgtgtgggaaagcaattcagttgatggacaagtcctctagagtcaggtatagcattgaccaaatcaccacaatga

SEQ ID NO: 80743 - DNA, 75 bp, Artificial Sequence
  Synthetic
atccgtctcactttgatggctacaagcaacagggtgtggttattatggatgacctaaaccaaaatccagacggag

SEQ ID NO: 80744 - DNA, 75 bp, Artificial Sequence
  Synthetic
ggacaagtcctctagagtcaggtatagcattgaccaaatcaccacaatgatcatcaatgaaagaagcaggaggtc

SEQ ID NO: 80745 - DNA, 75 bp, Artificial Sequence
  Synthetic
ggtgtccactgtggagtttattccaccgatggcctcgctagaagagaaaggcattttgttcacatctaattacgt

SEQ ID NO: 80746 - DNA, 75 bp, Artificial Sequence
  Synthetic
cacacctccacctgaatgtataaatgacctcctccaggctgtcgattcccaggaagtgagagattactgtgagag

SEQ ID NO: 80747 - DNA, 75 bp, Artificial Sequence
  Synthetic
aggaagtgagagattactgtgagaggaaagggtggattgttaatatcaccagtcaagttcaaactgaaagaaaca

SEQ ID NO: 80748 - DNA, 75 bp, Artificial Sequence
  Synthetic
agcgagtactccagagacggaaagctcaacatggcaatggctactgaaatgtgcaaaaactgtcaccaaccagca

SEQ ID NO: 80749 - DNA, 75 bp, Artificial Sequence
  Synthetic
gctggagtggtgtatgttatgtacaaactatttgctgggcatcaaggagcttacactggattacccaacaaaagg

SEQ ID NO: 80750 - DNA, 75 bp, Artificial Sequence
  Synthetic
tgtgtggcaaggcaattcagttaatggataaatcttccagggttagatacagcattgatcagatcactacaatga

SEQ ID NO: 80751 - DNA, 75 bp, Artificial Sequence
  Synthetic
caaaagtacaaggcccaggttttgactacgcagtagcaatggccaagagaaacattctcacagcaaccacttgta

SEQ ID NO: 80752 - DNA, 75 bp, Artificial Sequence
  Synthetic
tagtcattgatggaaaggagattgaagttctagacgccaaggccctagaggaccaagctggcaccaaccttgaaa

SEQ ID NO: 80753 - DNA, 75 bp, Artificial Sequence
  Synthetic
agttctagacgccaaggccctagaggaccaagctggcaccaaccttgaaatcaccatagtaacactcaaaagaaa

SEQ ID NO: 80754 - DNA, 75 bp, Artificial Sequence
  Synthetic
cactagtaagtaccccaacatgtatgtccctgttggtgctgtgactgaacaggggtacctcaatctcggtggccg

SEQ ID NO: 80755 - DNA, 75 bp, Artificial Sequence
  Synthetic
agctgttcgctgggcaccagggtgcatacactggtttgccaaataaacgacccaatgtacccactatcaggacag

SEQ ID NO: 80756 - DNA, 75 bp, Artificial Sequence
  Synthetic
ccaaaccgcccgtactctaatgtacaatttcccaacgagggcaggccaatgcggtggtgttatcacttgcactgg

SEQ ID NO: 80757 - DNA, 75 bp, Artificial Sequence
  Synthetic
tcagagtcaaggtgagattcagtggatgagaccatcaaaagaggtcggttaccctatcattaatgcccccagcaa

SEQ ID NO: 80758 - DNA, 75 bp, Artificial Sequence
  Synthetic
atgagaccatcaaaagaggtcggttaccctatcattaatgcccccagcaaaactaaactggaaccaagtgctttc

SEQ ID NO: 80759 - DNA, 75 bp, Artificial Sequence
  Synthetic
gaggcaatcttctccaagtacgtaggtaacaagatcacagaagtggatgagtacatgagagaagcagttgatcat

SEQ ID NO: 80760 - DNA, 75 bp, Artificial Sequence
  Synthetic
gtaacaagatcacagaagtggatgagtacatgagagaagcagttgatcattatgctggtcaattgatgtcgctag

SEQ ID NO: 80761 - DNA, 75 bp, Artificial Sequence
  Synthetic
gttcccgttggtgctgtgaccgaacaggggtatcttaatctcggtggacgacaaaccgctcgtacgctaatgtac

SEQ ID NO: 80762 - DNA, 75 bp, Artificial Sequence
  Synthetic
taaagtcattgggatgcatgttggtgggaacggttcacatgggttcgcggcggccctaaagcggtcatacttcac

SEQ ID NO: 80763 - DNA, 75 bp, Artificial Sequence
  Synthetic
ctagtgcgggatatccttacgtagccttgggaaagaaaaagagagacatcttgaacaaacaaacgagagatacaa

SEQ ID NO: 80764 - DNA, 75 bp, Artificial Sequence
  Synthetic
cttgggaaagaaaaagagagacatcttgaacaaacaaacgagagatacaaaggaaatgcaaagactgctagatac

SEQ ID NO: 80765 - DNA, 75 bp, Artificial Sequence
  Synthetic
aaccaaacttgaacccagtgcttttcactatgtgtttgaaggggtgaaggaaccagcagtcctcaccaaaaatga

SEQ ID NO: 80766 - DNA, 75 bp, Artificial Sequence
  Synthetic
atccagactgattgaagcatctagccttaatgactcagtggcaatgagaatggcctttggtaatttgtatgcagc

SEQ ID NO: 80767 - DNA, 75 bp, Artificial Sequence
  Synthetic
cttaatgactcagtggcaatgagaatggcctttggtaatttgtatgcagccttccacaaaaacccaggagtgata

SEQ ID NO: 80768 - DNA, 75 bp, Artificial Sequence
  Synthetic
gcatttgactacaccggctacgacgcctccttgagcccagcttggtttgaggctctcaaaatggttttggaaaag

SEQ ID NO: 80769 - DNA, 75 bp, Artificial Sequence
  Synthetic
ggcctggaagcacttgacttgaccactagtgctggatacccttatgtagcaatgggaaagaaaaagagagacatc

SEQ ID NO: 80770 - DNA, 75 bp, Artificial Sequence
  Synthetic
acatagattaccttaaccattcacaccacttgtacaaaaacaaaacatactgtgtcaagggcggcatgccatctg

SEQ ID NO: 80771 - DNA, 75 bp, Artificial Sequence
  Synthetic
tcatgaatcaattagatggactaaggatcccagaaacacacaggatcacgtacgctccttgtgcctattggcttg

SEQ ID NO: 80772 - DNA, 75 bp, Artificial Sequence
  Synthetic
aaatttttagctaaaatcagaagcgtgcctatcggacgggctttactgctccctgagtactcaacattgtaccgc

SEQ ID NO: 80773 - DNA, 75 bp, Artificial Sequence
  Synthetic
cagagacccacgtggcggctagtacactggtatcacggtacctttgtacgcctgttttatactccctcccccgca

SEQ ID NO: 80774 - DNA, 75 bp, Artificial Sequence
  Synthetic
actggtatcacggtacctttgtacgcctgttttatactccctcccccgcaacttagaagcatacaattcaagctc

SEQ ID NO: 80775 - DNA, 75 bp, Artificial Sequence
  Synthetic
gtgtgaagagcctattgagctacatgagagtcctccggcccctgaatgcggctaatcctaaccatggagcaggca

SEQ ID NO: 80776 - DNA, 75 bp, Artificial Sequence
  Synthetic
aataggagggggtgcaagccagcgcctccgtgggcaagcactactgtttccccggtgaggccgcatagactgttc

SEQ ID NO: 80777 - DNA, 75 bp, Artificial Sequence
  Synthetic
ctccgtgggcaagcactactgtttccccggtgaggccgcatagactgttcccacggttgaaagtgtccgatccgt

SEQ ID NO: 80778 - DNA, 75 bp, Artificial Sequence
  Synthetic
gtccgtgtttccttttattcttgaatggctgcttatggtgacaatcatagattgttatcataaagcgagttggat

SEQ ID NO: 80779 - DNA, 75 bp, Artificial Sequence
  Synthetic
tggctgcttatggtgacaatcatagattgttatcataaagcgagttggattggccatccagtgtgaatcagatta

SEQ ID NO: 80780 - DNA, 75 bp, Artificial Sequence
  Synthetic
tttcagtgtcacaatgggagctcaagtatcatcccaaaaagtaggcgctcacgagaattctaaccgagcctacgg

SEQ ID NO: 80781 - DNA, 75 bp, Artificial Sequence
  Synthetic
gtatcatcccaaaaagtaggcgctcacgagaattctaaccgagcctacggtggttctacgatcaactacaccaca

SEQ ID NO: 80782 - DNA, 75 bp, Artificial Sequence
  Synthetic
gagccactaaaggacgtgctcataaaaacagctccagcactcaattcaccaaatgtggaagcgtgtgggtatagt

SEQ ID NO: 80783 - DNA, 75 bp, Artificial Sequence
  Synthetic
aaatgtggaagcgtgtgggtatagtgatagagtgttgcaactcactttaggcaattccactattactacacagga

SEQ ID NO: 80784 - DNA, 75 bp, Artificial Sequence
  Synthetic
accaactgaaccagatgtggctacatgcagattctacacactagacactgtaatgtggggtaaggagtcgaaagg

SEQ ID NO: 80785 - DNA, 75 bp, Artificial Sequence
  Synthetic
ctgagagacatgggtctgtttggacaaaacatgtattaccactacctaggaagatccgggtacactgtgcacgtg

SEQ ID NO: 80786 - DNA, 75 bp, Artificial Sequence
  Synthetic
agtgacaagcaaaggtacactagttatgcaaatgcgaatccaggtgaaagagggggaaaattttactcccaattc

SEQ ID NO: 80787 - DNA, 75 bp, Artificial Sequence
  Synthetic
atgcaaatgcgaatccaggtgaaagagggggaaaattttactcccaattcaacaaggataacgcagtaacatccc

SEQ ID NO: 80788 - DNA, 75 bp, Artificial Sequence
  Synthetic
atcaaatcattaatctgaggaccaacaacagcgcaactattgtcctaccatatgtgaatgctttggccattgatt

SEQ ID NO: 80789 - DNA, 75 bp, Artificial Sequence
  Synthetic
caacagcgcaactattgtcctaccatatgtgaatgctttggccattgattcaatggttaaacacaacaactgggg

SEQ ID NO: 80790 - DNA, 75 bp, Artificial Sequence
  Synthetic
tgccccaatgtgtagcgagttcaacggccttcgcaacgtgactgcacctaaatttcaaggactaccagtgttgaa

SEQ ID NO: 80791 - DNA, 75 bp, Artificial Sequence
  Synthetic
cactcctggtagtaaccagtacctgacgtcagacaaccaccaatcaccatgcgcaatcccagaatttgatgtcac

SEQ ID NO: 80792 - DNA, 75 bp, Artificial Sequence
  Synthetic
agatagacaccatgattcctctcaatttggagagcaccaagagaaacacaatggacatgtacagagttactctga

SEQ ID NO: 80793 - DNA, 75 bp, Artificial Sequence
  Synthetic
tttggagagcaccaagagaaacacaatggacatgtacagagttactctgagcgacagtgccgatctatcgcaacc

SEQ ID NO: 80794 - DNA, 75 bp, Artificial Sequence
  Synthetic
ttatactcattgggccgggtccttgaaatttaccttcctgttctgtggttcaatgatggctacggggaaaatcct

SEQ ID NO: 80795 - DNA, 75 bp, Artificial Sequence
  Synthetic
aaatttaccttcctgttctgtggttcaatgatggctacggggaaaatcctagtggcctatgcaccaccaggtgca

SEQ ID NO: 80796 - DNA, 75 bp, Artificial Sequence
  Synthetic
actatggtggtgccgtggattagtaatgtgacatacagacagactacacaagatagtttcactgagggcggatat

SEQ ID NO: 80797 - DNA, 75 bp, Artificial Sequence
  Synthetic
gagtatgagcatgctggggtttgtgtcagcctgtaatgatttcagtgtgcgattgctgcgagacaccactcacat

SEQ ID NO: 80798 - DNA, 75 bp, Artificial Sequence
  Synthetic
cccgaagcaacaggatagcttacctgatactaaggccagtggcccggcgcattccaaggaggtacctgcactcac

SEQ ID NO: 80799 - DNA, 75 bp, Artificial Sequence
  Synthetic
gatactaaggccagtggcccggcgcattccaaggaggtacctgcactcactgcagtcgagactggagccaccaat

SEQ ID NO: 80800 - DNA, 75 bp, Artificial Sequence
  Synthetic
tcattcttcgcacgcggggcgtgcgtcgctattattgaggtggacaatgaacaaccaaccacccgggcacagaaa

SEQ ID NO: 80801 - DNA, 75 bp, Artificial Sequence
  Synthetic
taataatgggcatgcactcaaccaggtgtaccagataatgtacatccccccaggggcacccacaccaaagtcatg

SEQ ID NO: 80802 - DNA, 75 bp, Artificial Sequence
  Synthetic
gtgtaccagataatgtacatccccccaggggcacccacaccaaagtcatgggacgactacacttggcaaacatct

SEQ ID NO: 80803 - DNA, 75 bp, Artificial Sequence
  Synthetic
gcttactcgcacttttacgacggcttcgccaaggtgccattgaagacagatgccaatgaccagattggtgattcc

SEQ ID NO: 80804 - DNA, 75 bp, Artificial Sequence
  Synthetic
tgagaaaggtttgaccacatatggctttgggcatcagaataaagctgtgtacactgctggttacaagatctgcaa

SEQ ID NO: 80805 - DNA, 75 bp, Artificial Sequence
  Synthetic
atagcaaggtgcaattgcaatgcaggggtgtactattgtgagtccagaaggaaatactaccctgtgtcgtttgtg

SEQ ID NO: 80806 - DNA, 75 bp, Artificial Sequence
  Synthetic
aatcaaaattatttcatctctggtgattatcactagaaattacgaagataccaccacagtgctcgccactctagc

SEQ ID NO: 80807 - DNA, 75 bp, Artificial Sequence
  Synthetic
tcttcttgggtgtgatgtttcaccgtggcaatggctgaagaagaaagcatgtgacactttggagattccctatgt

SEQ ID NO: 80808 - DNA, 75 bp, Artificial Sequence
  Synthetic
tggttgagagaaagaatcatcccacaagccagggacaagcttgagtttgtaaccaaattgaaacagttggaaatg

SEQ ID NO: 80809 - DNA, 75 bp, Artificial Sequence
  Synthetic
cgctggttgtccattcaatccaagagattcgctccattgtacgcacttgaggccaagagaatacaaaagttggaa

SEQ ID NO: 80810 - DNA, 75 bp, Artificial Sequence
  Synthetic
tcaagagcaaacaccgtattgagccagtatgtttgttagtgcatgggagcccaggtacaggaaaatcagttgcga

SEQ ID NO: 80811 - DNA, 75 bp, Artificial Sequence
  Synthetic
tcgctaccaccggacccgtctcactttgatggatacaaacaacaaggtgtggttatcatggacgacctaaaccaa

SEQ ID NO: 80812 - DNA, 75 bp, Artificial Sequence
  Synthetic
tcttttgtcaaatggtgtccactgtggagtttatcccacctatggcctcgctggaagagaaaggcattctgttca

SEQ ID NO: 80813 - DNA, 75 bp, Artificial Sequence
  Synthetic
acagtagcccacagtgacgctctggccaggaggttcgctttcgatatggatattcaagtgatgggcgagtactcc

SEQ ID NO: 80814 - DNA, 75 bp, Artificial Sequence
  Synthetic
ccaccaaccagcaaacttcaaaagatgctgtcctttagtgtgtggtaaggcaattcagttaatggacaaatcttc

SEQ ID NO: 80815 - DNA, 75 bp, Artificial Sequence
  Synthetic
ttgcatggaggctttgttccaaggaccactccagtacaaagacctgaaaattgacatcaagacgaggcccccccc

SEQ ID NO: 80816 - DNA, 75 bp, Artificial Sequence
  Synthetic
ccactccagtacaaagacctgaaaattgacatcaagacgaggcccccccctgaatgcatcaatgatctgcttcaa

SEQ ID NO: 80817 - DNA, 75 bp, Artificial Sequence
  Synthetic
tacgtcatgtacaagttattcgctggacaccagggagcatacactggtctgccaaacaaaagacccaatgtgccc

SEQ ID NO: 80818 - DNA, 75 bp, Artificial Sequence
  Synthetic
gcaaagaggttgaaatcctagacgctaaagccctcgaagatcaggcaggcactaatctggaaatcaccataataa

SEQ ID NO: 80819 - DNA, 75 bp, Artificial Sequence
  Synthetic
caaatcaccgagacgaatgatggagttctgattgtgaacactagtaagtaccccaacatgtatgttcctgtcggt

SEQ ID NO: 80820 - DNA, 75 bp, Artificial Sequence
  Synthetic
ccccaacatgtatgttcctgtcggtgctgtgactgagcagggatacctaaatctcggtgggcgccagactgctcg

SEQ ID NO: 80821 - DNA, 75 bp, Artificial Sequence
  Synthetic
catgggtttgcagcggccctgaagcggtcatacttcactcagagccaaggtgaaatccagtggatgagaccatca

SEQ ID NO: 80822 - DNA, 75 bp, Artificial Sequence
  Synthetic
acatccagtaatgccaatgaaggagattcatgaatcaattagatggacaaaggatcccagaaacacacaggatca

SEQ ID NO: 80823 - DNA, 75 bp, Artificial Sequence
  Synthetic
gcccagtgctttccactatgtgtttgaaggagtaaaggaaccagcagtcctcacaaagaatgatcccagactcaa

SEQ ID NO: 80824 - DNA, 75 bp, Artificial Sequence
  Synthetic
tcacaaagaatgatcccagactcaaaacagactttgaagaagcaatcttctctaagtatgtagggaacaagatca

SEQ ID NO: 80825 - DNA, 75 bp, Artificial Sequence
  Synthetic
atgggtgcacaagtgtcctcacaaaaagtgggagcccatgagaacaccaatgttgccacaggcggttctacagtc

SEQ ID NO: 80826 - DNA, 75 bp, Artificial Sequence
  Synthetic
cttatgtcgctggatatcagcacagagcaaatgtgtctagaagacgccatgtatggtactgatggtctggaggcg

SEQ ID NO: 80827 - DNA, 75 bp, Artificial Sequence
  Synthetic
tgttgccacaggcggttctacagtcaattacacaacaattaacttctacaaagactcagccagcaatgcagcatc

SEQ ID NO: 80828 - DNA, 75 bp, Artificial Sequence
  Synthetic
gtatggtactgatggtctggaggcgctagatctgtctaccagtgccgggtacccctacgtggcaatggggaagaa

SEQ ID NO: 80829 - DNA, 75 bp, Artificial Sequence
  Synthetic
aattacacaacaattaacttctacaaagactcagccagcaatgcagcatccaaacaagatttctcccaagatccg

SEQ ID NO: 80830 - DNA, 75 bp, Artificial Sequence
  Synthetic
cctaccattagtgacatatgtcaaggacgagctgaggtccaaaacaaaagtggaacagggaaaatccagactgat

SEQ ID NO: 80831 - DNA, 75 bp, Artificial Sequence
  Synthetic
gacgagctgaggtccaaaacaaaagtggaacagggaaaatccagactgattgaagcttccagtctaaatgactca

SEQ ID NO: 80832 - DNA, 75 bp, Artificial Sequence
  Synthetic
tgtggctacagtgatagggtgcgacaaattacgttagggaactccactatcaccacacaagaggcagccaatgca

SEQ ID NO: 80833 - DNA, 75 bp, Artificial Sequence
  Synthetic
aaattacgttagggaactccactatcaccacacaagaggcagccaatgcaatagtagcctatggagagtggccat

SEQ ID NO: 80834 - DNA, 75 bp, Artificial Sequence
  Synthetic
gttggatgcgatccagacctattctggagcaagatcccagtgttgatggaagaaaagctatttgcctttgattac

SEQ ID NO: 80835 - DNA, 75 bp, Artificial Sequence
  Synthetic
ggagcaagatcccagtgttgatggaagaaaagctatttgcctttgattacacaggatacgacgcatcacttagcc

SEQ ID NO: 80836 - DNA, 75 bp, Artificial Sequence
  Synthetic
ctctagaatctgtccagtggtcaagtagcagtaaggggtggtggtggaaattacctgatgccttaaaggacatgg

SEQ ID NO: 80837 - DNA, 75 bp, Artificial Sequence
  Synthetic
tagcagtaaggggtggtggtggaaattacctgatgccttaaaggacatggggttgtttggacagaacatgtttta

SEQ ID NO: 80838 - DNA, 75 bp, Artificial Sequence
  Synthetic
ttaaccattcacaccacttgtacaaaaacaagatatattgtgttaagggcggcatgccatctggctgctccggca

SEQ ID NO: 80839 - DNA, 75 bp, Artificial Sequence
  Synthetic
ggtatttgcgatacccgaatatgtcatggctacaaacacagagatcaaaacatcatatgtctcgtatgtaaatgc

SEQ ID NO: 80840 - DNA, 75 bp, Artificial Sequence
  Synthetic
atggctacaaacacagagatcaaaacatcatatgtctcgtatgtaaatgcaaatccgggggaagctggtggtgta

SEQ ID NO: 80841 - DNA, 75 bp, Artificial Sequence
  Synthetic
tgtggtgtgctagctggcaacgcctttgtgttcccacaccaaatcattaatttaagaacaaacaacagtgcaact

SEQ ID NO: 80842 - DNA, 75 bp, Artificial Sequence
  Synthetic
ttgtgttcccacaccaaatcattaatttaagaacaaacaacagtgcaactctagtcttgccctacgtgaactctc

SEQ ID NO: 80843 - DNA, 75 bp, Artificial Sequence
  Synthetic
cagaggcttccaccatgatccctattactgtcaccatagcccctatgtttacagagtttaacgggttgagaaaca

SEQ ID NO: 80844 - DNA, 75 bp, Artificial Sequence
  Synthetic
tactgtcaccatagcccctatgtttacagagtttaacgggttgagaaacatcacaatccctgccacgcaaggctt

SEQ ID NO: 80845 - DNA, 75 bp, Artificial Sequence
  Synthetic
cagatggacaaaagatcctcggaatacgcaggaccatgtacgctccttgtgtctattggcttggcacaacgggga

SEQ ID NO: 80846 - DNA, 75 bp, Artificial Sequence
  Synthetic
ttttgatgtaacaccgcctatacacatcccaggggaggtgaagaacatgatggagctggctgaaatagacacact

SEQ ID NO: 80847 - DNA, 75 bp, Artificial Sequence
  Synthetic
atcccaggggaggtgaagaacatgatggagctggctgaaatagacacactgataccaatgaattctgtatctggc

SEQ ID NO: 80848 - DNA, 75 bp, Artificial Sequence
  Synthetic
gttcaatagaagggggtacaaaccagtaccaccacgaacaagcacttctgtttccccggtgatgttgtatagact

SEQ ID NO: 80849 - DNA, 75 bp, Artificial Sequence
  Synthetic
ctgtctcctgcttcagatcaaagactgcagtacactatggttggtgaaatacttaactattacacacactggacc

SEQ ID NO: 80850 - DNA, 75 bp, Artificial Sequence
  Synthetic
tgcagtacactatggttggtgaaatacttaactattacacacactggaccggatcattgagattcacttttcttt

SEQ ID NO: 80851 - DNA, 75 bp, Artificial Sequence
  Synthetic
gaaaggacgctatgcttggtactcacatcatatgggacttagggttacaatcaagctgcacaatggtggcaccct

SEQ ID NO: 80852 - DNA, 75 bp, Artificial Sequence
  Synthetic
catcatatgggacttagggttacaatcaagctgcacaatggtggcaccctggatatcgaacaccgtgtatcgaag

SEQ ID NO: 80853 - DNA, 75 bp, Artificial Sequence
  Synthetic
cacccccacaaatatggcaatgctgtcttttgttagcgcatgcccagacttcagcgtcagactgctcagggatac

SEQ ID NO: 80854 - DNA, 75 bp, Artificial Sequence
  Synthetic
tcttttgttagcgcatgcccagacttcagcgtcagactgctcagggatactatacacatatcacagaccactttg

SEQ ID NO: 80855 - DNA, 75 bp, Artificial Sequence
  Synthetic
aggccagtaaatgaaaccgcatctacgccagcaaccagtggagttaattcccaagaagtgccagcactaactgcg

SEQ ID NO: 80856 - DNA, 75 bp, Artificial Sequence
  Synthetic
cgccagcaaccagtggagttaattcccaagaagtgccagcactaactgcggtagaaacgggcgcatctggacagg

SEQ ID NO: 80857 - DNA, 75 bp, Artificial Sequence
  Synthetic
accaccattaattattatagagattcagctagtaacgcggcttcgaaacaggacttctctcaagacccttccaag

SEQ ID NO: 80858 - DNA, 75 bp, Artificial Sequence
  Synthetic
tctttgggaggtctgcgtgtgtaactatcctagaagtggaaaacttcaatgccacagcagttgctgacaagaaaa

SEQ ID NO: 80859 - DNA, 75 bp, Artificial Sequence
  Synthetic
tatcctagaagtggaaaacttcaatgccacagcagttgctgacaagaaaaagcagttcactgtatggcccattac

SEQ ID NO: 80860 - DNA, 75 bp, Artificial Sequence
  Synthetic
tgtgatcacggaaaggtattatacaggttcaggttacgccaagaactcagtttatcagattatgtatgtcccacc

SEQ ID NO: 80861 - DNA, 75 bp, Artificial Sequence
  Synthetic
ggttcaggttacgccaagaactcagtttatcagattatgtatgtcccaccaggggcccccagacccacagcatgg

SEQ ID NO: 80862 - DNA, 75 bp, Artificial Sequence
  Synthetic
acaccgtgtcttggacgaaagagtcgcgagggtggtggtggaagttgcctgatgcactgcgggacatgggactct

SEQ ID NO: 80863 - DNA, 75 bp, Artificial Sequence
  Synthetic
atcccatatgttgggatcgctaatgcttattctcacttttatgatgggtttgcccgagtccctctcaaagacgaa

SEQ ID NO: 80864 - DNA, 75 bp, Artificial Sequence
  Synthetic
cttattctcacttttatgatgggtttgcccgagtccctctcaaagacgaaacaagagattctggtgacacatttt

SEQ ID NO: 80865 - DNA, 75 bp, Artificial Sequence
  Synthetic
ctgccaaggtgagagtttatatgaagccaaaacacatacgctgttggtgtccacgcccaccaagggcggtacctt

SEQ ID NO: 80866 - DNA, 75 bp, Artificial Sequence
  Synthetic
gccaaaacacatacgctgttggtgtccacgcccaccaagggcggtaccttacagaggtgacggggtagatatcac

SEQ ID NO: 80867 - DNA, 75 bp, Artificial Sequence
  Synthetic
ctttgtggcgggttacaaaataatcaactaccaccttgctacagctgaagatttcagaaattgtgtgaggagcat

SEQ ID NO: 80868 - DNA, 75 bp, Artificial Sequence
  Synthetic
gtactcccttacgtgaactccctctcgatagatagtatggtaaagcacaataattggggaattgcaatattacca

SEQ ID NO: 80869 - DNA, 75 bp, Artificial Sequence
  Synthetic
aactaccaccttgctacagctgaagatttcagaaattgtgtgaggagcatgtgggagagagatctgatggtggtt

SEQ ID NO: 80870 - DNA, 75 bp, Artificial Sequence
  Synthetic
taattggggaattgcaatattaccattggccccattaaattttgctagtgagtcctccccagagattccaatcac

SEQ ID NO: 80871 - DNA, 75 bp, Artificial Sequence
  Synthetic
agtcctccccagagattccaatcaccttgaccatagcccctatgtgctgtgagttcaatggattaagaaacatta

SEQ ID NO: 80872 - DNA, 75 bp, Artificial Sequence
  Synthetic
aacaagcattatccaattaccatcacaagcccaactttccagtggatggagaagaatgattattaccctagcaga

SEQ ID NO: 80873 - DNA, 75 bp, Artificial Sequence
  Synthetic
caagcccaactttccagtggatggagaagaatgattattaccctagcagataccaatcacatatgactatgggac

SEQ ID NO: 80874 - DNA, 75 bp, Artificial Sequence
  Synthetic
gcggtgggggcattgttgcattttcagacataagagacctatatgtggaagatgaggcaatggagcaaggaataa

SEQ ID NO: 80875 - DNA, 75 bp, Artificial Sequence
  Synthetic
agacataagagacctatatgtggaagatgaggcaatggagcaaggaataactagctacatagaatctttgggagc

SEQ ID NO: 80876 - DNA, 75 bp, Artificial Sequence
  Synthetic
cactgagaaattacttaaaaatttgatcaaactagttagcagcttagttattatctccaggaactacgaagacac

SEQ ID NO: 80877 - DNA, 75 bp, Artificial Sequence
  Synthetic
atcaaactagttagcagcttagttattatctccaggaactacgaagacaccaccacagtattggccacactagct

SEQ ID NO: 80878 - DNA, 75 bp, Artificial Sequence
  Synthetic
tataggcaaggagactcctggttgaagaagtttacagaagcatgcaacgcagccaagggtttagagtggattggg

SEQ ID NO: 80879 - DNA, 75 bp, Artificial Sequence
  Synthetic
aaccatagatgatagtttcaccgaaggcggatacatcagcgtcttctaccaaaccagaatagtcgtccctctttc

SEQ ID NO: 80880 - DNA, 75 bp, Artificial Sequence
  Synthetic
actaaactaaaacaattggatttccttgagaatcagataagtactatacaccagtcatgtccaagtcaggagcaa

SEQ ID NO: 80881 - DNA, 75 bp, Artificial Sequence
  Synthetic
ggttttgtgtcagcgtgtaatgacttcagcgtgcgcttgttgcgagataccacacatatagagcaaaaagcgcta

SEQ ID NO: 80882 - DNA, 75 bp, Artificial Sequence
  Synthetic
ttgagaatcagataagtactatacaccagtcatgtccaagtcaggagcaacaagaggtcctgttcaacaatgtga

SEQ ID NO: 80883 - DNA, 75 bp, Artificial Sequence
  Synthetic
gcacaggggttaggtcagatgcttgaaagcatgattgacaacacagtccgtgaaacggtgggggcggcaacgtct

SEQ ID NO: 80884 - DNA, 75 bp, Artificial Sequence
  Synthetic
acaccatcaacaattacatacagttcaagagcaaacaccgtattgaaccagtatgtatgttgatacacggagaac

SEQ ID NO: 80885 - DNA, 75 bp, Artificial Sequence
  Synthetic
tgttgtacaacataggtcaaggtcagagtctagcatagagtctttcttcgcgcggggtgcatgcgtggccatttt

SEQ ID NO: 80886 - DNA, 75 bp, Artificial Sequence
  Synthetic
ccttgcctccagacccgtcacactttgatgggtacaagcaacaggaggtagtcatcatggatgatttgaatcaga

SEQ ID NO: 80887 - DNA, 75 bp, Artificial Sequence
  Synthetic
tgatgggtacaagcaacaggaggtagtcatcatggatgatttgaatcagaacccggacggtgcagatatgaagtt

SEQ ID NO: 80888 - DNA, 75 bp, Artificial Sequence
  Synthetic
ctccaattacgttcttgcttccacaaattcaaacaccataacgccacccacaattgctcatgctgatgccctgtc

SEQ ID NO: 80889 - DNA, 75 bp, Artificial Sequence
  Synthetic
aattcaaacaccataacgccacccacaattgctcatgctgatgccctgtcaaggagattcgcatttgatatggat

SEQ ID NO: 80890 - DNA, 75 bp, Artificial Sequence
  Synthetic
acatggcaaacctcatcaaatccatcaatcttttacacctacggaacagctccagcccggatctcggtaccgtat

SEQ ID NO: 80891 - DNA, 75 bp, Artificial Sequence
  Synthetic
ccacaaccagcaaatttcaagaaatgttgccctttagtttgtggcaaggcactacaattaatggacaaacactct

SEQ ID NO: 80892 - DNA, 75 bp, Artificial Sequence
  Synthetic
gttgccctttagtttgtggcaaggcactacaattaatggacaaacactctagacaaagatttacgattgatgaaa

SEQ ID NO: 80893 - DNA, 75 bp, Artificial Sequence
  Synthetic
ctttgcagtacaaagatttaaagatagacatcaagaacacaccagccccagagtgtatcaatgacttgttacaat

SEQ ID NO: 80894 - DNA, 75 bp, Artificial Sequence
  Synthetic
agacatcaagaacacaccagccccagagtgtatcaatgacttgttacaatcagtggatagccaggaagtcagaga

SEQ ID NO: 80895 - DNA, 75 bp, Artificial Sequence
  Synthetic
ttacaaaatttgcaactaccatttggccactcaggaagatttgcaaaacgcagtgaacgtcatgtgggatagaga

SEQ ID NO: 80896 - DNA, 75 bp, Artificial Sequence
  Synthetic
gactatcctacaagctataactacttttaccgcagtagcaggggttgtgtatgtgatgtacaagttgtttgcggg

SEQ ID NO: 80897 - DNA, 75 bp, Artificial Sequence
  Synthetic
tttaccgcagtagcaggggttgtgtatgtgatgtacaagttgtttgcgggccaacaaggaccctacactggactc

SEQ ID NO: 80898 - DNA, 75 bp, Artificial Sequence
  Synthetic
gcaattgcaacgcaggggtgtactactgcgagtctagaaggaaatactacccagtatccttcgttggcccaacgt

SEQ ID NO: 80899 - DNA, 75 bp, Artificial Sequence
  Synthetic
atggccaagcgcaatgtggtgacagctactacatccaaaggcgagttcaccatgttaggcattcatgacaatgtg

SEQ ID NO: 80900 - DNA, 75 bp, Artificial Sequence
  Synthetic
ctactacatccaaaggcgagttcaccatgttaggcattcatgacaatgtggctgttttacccacccacgcagccc

SEQ ID NO: 80901 - DNA, 75 bp, Artificial Sequence
  Synthetic
ctccaggggattgtggtggcatactcagatgtcaccacggggtgatagggatcattactgctggtggagaagggt

SEQ ID NO: 80902 - DNA, 75 bp, Artificial Sequence
  Synthetic
ccaatttggaaattaccataatcaaattgcaacgaaatgagaagttcagagatatcagaccacacatcccaaccc

SEQ ID NO: 80903 - DNA, 75 bp, Artificial Sequence
  Synthetic
aagtggatttactcagcagattggagacaaaataacagagttgactaatatggtgaccagtaccatcactgaaaa

SEQ ID NO: 80904 - DNA, 75 bp, Artificial Sequence
  Synthetic
cccaacatgtatatccctgttggtgctgtgaccgaacagggatacctcaatcttggtggacgccaaaccgctcgc

SEQ ID NO: 80905 - DNA, 75 bp, Artificial Sequence
  Synthetic
ctgaagcatgcaacgcagctaagggactggagtgggtgtcaaacaaaatctcaaaattcattgattggctcaagg

SEQ ID NO: 80906 - DNA, 75 bp, Artificial Sequence
  Synthetic
cccagtgcattccactatgtgtttgagggtgtcaaagaaccagccgtgctcacgaagaatgatcccaggttgaag

SEQ ID NO: 80907 - DNA, 75 bp, Artificial Sequence
  Synthetic
agggtgtcaaagaaccagccgtgctcacgaagaatgatcccaggttgaagacagattttgaagaagccatatttt

SEQ ID NO: 80908 - DNA, 75 bp, Artificial Sequence
  Synthetic
taatgtcactagatatcaacactgaacaaatgtgtcttgaagatgcaatgtatggcactgatggccttgaagccc

SEQ ID NO: 80909 - DNA, 75 bp, Artificial Sequence
  Synthetic
acaaatgtgtcttgaagatgcaatgtatggcactgatggccttgaagccctagaccttagcactagtgcaggata

SEQ ID NO: 80910 - DNA, 75 bp, Artificial Sequence
  Synthetic
atacagaaactagagcataccattaacaactacatacagttcaagagcaaacaccgtattgaaccagtatgtttg

SEQ ID NO: 80911 - DNA, 75 bp, Artificial Sequence
  Synthetic
actcttagacacctatggtattaatttgccattggtcacatatgtgaaagatgaactcagatctaaaacaaaagt

SEQ ID NO: 80912 - DNA, 75 bp, Artificial Sequence
  Synthetic
ttgccattggtcacatatgtgaaagatgaactcagatctaaaacaaaagtggaacaaggtaagtccaggctcatt

SEQ ID NO: 80913 - DNA, 75 bp, Artificial Sequence
  Synthetic
caaacaacagggagtggtgattatggacgacctgaatcaaaacccagatggtgcggacatgaagctgttctgtca

SEQ ID NO: 80914 - DNA, 75 bp, Artificial Sequence
  Synthetic
ccaggagtagtgacaggttcagcggttggatgtgacccagatctgttttggagcaaaataccagtgttgatggag

SEQ ID NO: 80915 - DNA, 75 bp, Artificial Sequence
  Synthetic
gagcaaaataccagtgttgatggaggataaactctttgcttttgactacacaggttatgatgcatcactcagtcc

SEQ ID NO: 80916 - DNA, 75 bp, Artificial Sequence
  Synthetic
ataaagacttgaagattgacatcaagacgagtccccctcctgaatgtatcaatgacttgctccaagcagttgact

SEQ ID NO: 80917 - DNA, 75 bp, Artificial Sequence
  Synthetic
agcccaatcaggaaaagactatggactaaccatgacaccagcagacaaatcggccacttttgaaacagtcacatg

SEQ ID NO: 80918 - DNA, 75 bp, Artificial Sequence
  Synthetic
tatgaaggagattcatgaatctattagatggacaaaggatcctagaaatacccaggatcatgttcgctcgttgtg

SEQ ID NO: 80919 - DNA, 75 bp, Artificial Sequence
  Synthetic
agcatacactggtttaccaaacaaaaaacccaacgtgcccaccattaggacagcaaaggtacaagggccagggtt

SEQ ID NO: 80920 - DNA, 75 bp, Artificial Sequence
  Synthetic
aaatcaggagcgtgccaattggaagagctttattgctacccgagtactctactttgtaccgccgttggctcgatt

SEQ ID NO: 80921 - DNA, 75 bp, Artificial Sequence
  Synthetic
tatgttcctgtcggtgctgtgactgaacagggatatctaaatctcggtgggcgccaaactgctcgtactctaatg

SEQ ID NO: 80922 - DNA, 75 bp, Artificial Sequence
  Synthetic
ggtgggaacggttcacacgggtttgcagcggccctgaagcgatcatacttcactcagagtcaaggtgaaatccag

SEQ ID NO: 80923 - DNA, 75 bp, Artificial Sequence
  Synthetic
cagcggccctgaagcgatcatacttcactcagagtcaaggtgaaatccagtggatgagaccttcgaaggaagtgg

SEQ ID NO: 80924 - DNA, 75 bp, Artificial Sequence
  Synthetic
aaatgggacgactacacatggcaaacctcatcaaatccatcaatcttttacacctacggaacagctccagcccgg

SEQ ID NO: 80925 - DNA, 75 bp, Artificial Sequence
  Synthetic
atcaggacactcttactgaaaacctacaagggcatagatttagaccacctaaaaatgattgcctatggtgatgat

SEQ ID NO: 80926 - DNA, 75 bp, Artificial Sequence
  Synthetic
aacaaattcctagctaaaatcaggagtgtgccaattggaagagctttattgctcccagagtactcaacattgtac

SEQ ID NO: 80927 - DNA, 75 bp, Artificial Sequence
  Synthetic
gtagccgcgtgcaggttctacacattagataccgtcacttggcgcaaggagtccagagggtggtggtggaaacta

SEQ ID NO: 80928 - DNA, 75 bp, Artificial Sequence
  Synthetic
gccacataatcacaatgggagctcaagtttctactcagaagtccggctcacatgaaaatcaaaacgtagccgctg

SEQ ID NO: 80929 - DNA, 75 bp, Artificial Sequence
  Synthetic
agtttctactcagaagtccggctcacatgaaaatcaaaacgtagccgctggaggatctaccatcaactataccac

SEQ ID NO: 80930 - DNA, 75 bp, Artificial Sequence
  Synthetic
cgaaccagtgaaggatgttatgataaagactgcccctgctctaaattcaccaaatattgaggcgtgtgggtatag

SEQ ID NO: 80931 - DNA, 75 bp, Artificial Sequence
  Synthetic
aagactgcccctgctctaaattcaccaaatattgaggcgtgtgggtatagtgacagagttatgcagctaacatta

SEQ ID NO: 80932 - DNA, 75 bp, Artificial Sequence
  Synthetic
gacaaagaagcaaaccctgttgatgcaccaaccgaaccagatgcctcagcaaacagattctacacactggagagc

SEQ ID NO: 80933 - DNA, 75 bp, Artificial Sequence
  Synthetic
caccaaccgaaccagatgcctcagcaaacagattctacacactggagagcgtttcatgggacaaaaattctaaag

SEQ ID NO: 80934 - DNA, 75 bp, Artificial Sequence
  Synthetic
gcagagcaggctacactgttcatgtgcagtgtaacgcatccaaattccaccagggtactctaatcgtagcagcta

SEQ ID NO: 80935 - DNA, 75 bp, Artificial Sequence
  Synthetic
gcagtgtaacgcatccaaattccaccagggtactctaatcgtagcagctataccagagttcatgatgggaagcaa

SEQ ID NO: 80936 - DNA, 75 bp, Artificial Sequence
  Synthetic
aaactagggttgttgtcccgttgtccacacccagaaagatggacatcctgggttttgtgtcagcttgcaatgact

SEQ ID NO: 80937 - DNA, 75 bp, Artificial Sequence
  Synthetic
attcaccccagcaaccaacacttcttcaaacaagaatgagtttgccccagttgactggcttttgggctctggagt

SEQ ID NO: 80938 - DNA, 75 bp, Artificial Sequence
  Synthetic
tcaaacaagaatgagtttgccccagttgactggcttttgggctctggagtgcttgccggaaacataaccgtgttt

SEQ ID NO: 80939 - DNA, 75 bp, Artificial Sequence
  Synthetic
cgagcggtccagcccactccaaggagatacctgcattgacagccgtggagacaggggctaccaatccgttggtgc

SEQ ID NO: 80940 - DNA, 75 bp, Artificial Sequence
  Synthetic
gattgcatggcaaagcataacaactggggtctagtgattttaccattcgtcccactcgacgcagttgctggagca

SEQ ID NO: 80941 - DNA, 75 bp, Artificial Sequence
  Synthetic
ggggtctagtgattttaccattcgtcccactcgacgcagttgctggagcaacacaacaggtcccaataacagtaa

SEQ ID NO: 80942 - DNA, 75 bp, Artificial Sequence
  Synthetic
tggccacgccaggatctaatcaatttctcacttcagatgatttccagtcgccatgtgcattgccaagctttgatg

SEQ ID NO: 80943 - DNA, 75 bp, Artificial Sequence
  Synthetic
tctcacttcagatgatttccagtcgccatgtgcattgccaagctttgatgtcacaccagagatccacatacctgg

SEQ ID NO: 80944 - DNA, 75 bp, Artificial Sequence
  Synthetic
caccatgcaagcctaccctatcccactggctgcctctcaaaacaatgcttcagaatccattttctctataagctt

SEQ ID NO: 80945 - DNA, 75 bp, Artificial Sequence
  Synthetic
ctggctgcctctcaaaacaatgcttcagaatccattttctctataagcttgagcccagcagctgacaggagacta

SEQ ID NO: 80946 - DNA, 75 bp, Artificial Sequence
  Synthetic
cccagcaagaatatcagtgccctacgtgggaattgctaatgcgtattcccacttttatgatgggtttgcaaaagt

SEQ ID NO: 80947 - DNA, 75 bp, Artificial Sequence
  Synthetic
tgtggtagcatgatggctactggtaagatactaatcagctacagcccaccaggtgcaaaaccaccaactaacaga

SEQ ID NO: 80948 - DNA, 75 bp, Artificial Sequence
  Synthetic
agatactaatcagctacagcccaccaggtgcaaaaccaccaactaacagaaaggaagcaatgttaggtactcata

SEQ ID NO: 80949 - DNA, 75 bp, Artificial Sequence
  Synthetic
caggtgttgattataaagatgggctcaccccactaccagaaaagggattaacgacttatggatttggacaccaaa

SEQ ID NO: 80950 - DNA, 75 bp, Artificial Sequence
  Synthetic
gtgtgaaagatgacttcacagagggaggttacatctgtgccttttaccaaactgccattatagtccccccaaata

SEQ ID NO: 80951 - DNA, 75 bp, Artificial Sequence
  Synthetic
aggttacatctgtgccttttaccaaactgccattatagtccccccaaatacgcccaccagcatgtctatgctcgc

SEQ ID NO: 80952 - DNA, 75 bp, Artificial Sequence
  Synthetic
caacacacaagggatagaagacacgattgagaaggtagttggagatgcacttagagtttcaatgccacaagttgc

SEQ ID NO: 80953 - DNA, 75 bp, Artificial Sequence
  Synthetic
attgagaaggtagttggagatgcacttagagtttcaatgccacaagttgcaaatacatctgcatctggtccagtg

SEQ ID NO: 80954 - DNA, 75 bp, Artificial Sequence
  Synthetic
atcacagcaggaggcgaaggtctagtcgctttctcagacatcagagatctttatgcatatgaagaggaagccatg

SEQ ID NO: 80955 - DNA, 75 bp, Artificial Sequence
  Synthetic
tcgctttctcagacatcagagatctttatgcatatgaagaggaagccatggaacagggcatttctaattacattg

SEQ ID NO: 80956 - DNA, 75 bp, Artificial Sequence
  Synthetic
gaaacacgacatgtgataaataacagactcagatcagagagtacaattgaatccttcttttgtagggctgcctgt

SEQ ID NO: 80957 - DNA, 75 bp, Artificial Sequence
  Synthetic
gactcagatcagagagtacaattgaatccttcttttgtagggctgcctgtgttgctatactaggagtatcaaaca

SEQ ID NO: 80958 - DNA, 75 bp, Artificial Sequence
  Synthetic
tcactagcacaatcactgagaaactattgaagaacttggtaaagattatctcctcactggtcattataaccagaa

SEQ ID NO: 80959 - DNA, 75 bp, Artificial Sequence
  Synthetic
attgaagaacttggtaaagattatctcctcactggtcattataaccagaaactatgaggacactacaacagtttt

SEQ ID NO: 80960 - DNA, 75 bp, Artificial Sequence
  Synthetic
ggcgaaagcttgaattctttacctactctagatttgatgttgagttaacctttgtaattaccgagaggtactact

SEQ ID NO: 80961 - DNA, 75 bp, Artificial Sequence
  Synthetic
ctctagatttgatgttgagttaacctttgtaattaccgagaggtactactctggaaattcagcaaccacccgcaa

SEQ ID NO: 80962 - DNA, 75 bp, Artificial Sequence
  Synthetic
aatcccatatgtcatgcgacaaggtgacagctggctcaagaaatttacagaggcatgtaatgctgctaagggatt

SEQ ID NO: 80963 - DNA, 75 bp, Artificial Sequence
  Synthetic
gacagctggctcaagaaatttacagaggcatgtaatgctgctaagggattggagtgggtatcaaacaagatatcc

SEQ ID NO: 80964 - DNA, 75 bp, Artificial Sequence
  Synthetic
ttccacaaatccatcagttttctacaccactggaaatgctagccccagaatgtctataccctttgttggtattgg

SEQ ID NO: 80965 - DNA, 75 bp, Artificial Sequence
  Synthetic
accactggaaatgctagccccagaatgtctataccctttgttggtattggtgctgcttattcacacttttacgat

SEQ ID NO: 80966 - DNA, 75 bp, Artificial Sequence
  Synthetic
caactcgaaatgctggagaaccagattgcgactattcatcagtcatgtcctagccaagagcaccaggaaattcta

SEQ ID NO: 80967 - DNA, 75 bp, Artificial Sequence
  Synthetic
ttgcgactattcatcagtcatgtcctagccaagagcaccaggaaattctatttaacaatgtgaggtggttgtcca

SEQ ID NO: 80968 - DNA, 75 bp, Artificial Sequence
  Synthetic
tttggaaccatcgctattcgcatagttaatgaacatgacccagttactataaatgcgaaaattcgcatttacatg

SEQ ID NO: 80969 - DNA, 75 bp, Artificial Sequence
  Synthetic
ttaatgaacatgacccagttactataaatgcgaaaattcgcatttacatgaaacccaaacatgttagagtgtggt

SEQ ID NO: 80970 - DNA, 75 bp, Artificial Sequence
  Synthetic
attacatacagttcaagagcaaacaccgtattgaaccagtatgcctattggtgcacggcagtcctggaacaggta

SEQ ID NO: 80971 - DNA, 75 bp, Artificial Sequence
  Synthetic
aagtggcaacaattagaacctatgggtttggacaccaaaataaggcagtctatacagctgggtacaaaatttgca

SEQ ID NO: 80972 - DNA, 75 bp, Artificial Sequence
  Synthetic
gtttggacaccaaaataaggcagtctatacagctgggtacaaaatttgcaactatcatctagctaccccagaaga

SEQ ID NO: 80973 - DNA, 75 bp, Artificial Sequence
  Synthetic
acccatcccatttcgatggatataaacaacagggagtggtaatcatggacgacctaaatcaaaatcccgatggag

SEQ ID NO: 80974 - DNA, 75 bp, Artificial Sequence
  Synthetic
acaacagggagtggtaatcatggacgacctaaatcaaaatcccgatggagctgacatgaaacttttttgtcagat

SEQ ID NO: 80975 - DNA, 75 bp, Artificial Sequence
  Synthetic
cattgcgaggtgctcatgtaaagcaggagtttactactgtgagtctaagaggaagtattatcccatttcagtttg

SEQ ID NO: 80976 - DNA, 75 bp, Artificial Sequence
  Synthetic
ggagtttactactgtgagtctaagaggaagtattatcccatttcagtttgtggaccaacattccaatacatggag

SEQ ID NO: 80977 - DNA, 75 bp, Artificial Sequence
  Synthetic
tttggcctctaccaattctagccgcattacaccaccaacagtagcacacagtgatgcgctagccagacggtttgc

SEQ ID NO: 80978 - DNA, 75 bp, Artificial Sequence
  Synthetic
atttgacatggatattcaagttatgggtgaatactcaaaggatggaaagttaaacatggcgatggctacggagat

SEQ ID NO: 80979 - DNA, 75 bp, Artificial Sequence
  Synthetic
ggtggaatcctcagatgtcaacacggagtgatgggtatcatcaccgctggtggtgagggagtagtggcatttgca

SEQ ID NO: 80980 - DNA, 75 bp, Artificial Sequence
  Synthetic
gagtgatgggtatcatcaccgctggtggtgagggagtagtggcatttgcagacgtcagggacctgtatatgtatg

SEQ ID NO: 80981 - DNA, 75 bp, Artificial Sequence
  Synthetic
ggataaatcatccagagttagatacagcattgatcaaatcaccaccatgatcatcaacgaaagaaacaggagatc

SEQ ID NO: 80982 - DNA, 75 bp, Artificial Sequence
  Synthetic
agcattgatcaaatcaccaccatgatcatcaacgaaagaaacaggagatccaacattggcaactgcatggaagcg

SEQ ID NO: 80983 - DNA, 75 bp, Artificial Sequence
  Synthetic
ctgaagtggcaaacaaaatttcagagatccagagcacagttcaaagtgttctcacagaaaagcttctgaaaaatc

SEQ ID NO: 80984 - DNA, 75 bp, Artificial Sequence
  Synthetic
gatccagagcacagttcaaagtgttctcacagaaaagcttctgaaaaatcttataaaaattgtctcagcacttgt

SEQ ID NO: 80985 - DNA, 75 bp, Artificial Sequence
  Synthetic
gaccttcttcaagcggttgattcccaggaagtgagggactattgtgaaaagaaaggatggattgttaacataacc

SEQ ID NO: 80986 - DNA, 75 bp, Artificial Sequence
  Synthetic
aggaagtgagggactattgtgaaaagaaaggatggattgttaacataaccagccaagtccagactgaaaggaata

SEQ ID NO: 80987 - DNA, 75 bp, Artificial Sequence
  Synthetic
atggcaatggctcaaggaaaaactctgcaacataattggcatcccttacgtcatgagacaaggagactcttggtt

SEQ ID NO: 80988 - DNA, 75 bp, Artificial Sequence
  Synthetic
tgcaacataattggcatcccttacgtcatgagacaaggagactcttggttgaaaaagttcacggaagcttgtaat

SEQ ID NO: 80989 - DNA, 75 bp, Artificial Sequence
  Synthetic
aactctttgcagggcaacagggagcttacaccgggctccccaccaaacgacccaatgttcctaccattaggacag

SEQ ID NO: 80990 - DNA, 75 bp, Artificial Sequence
  Synthetic
ttacaccgggctccccaccaaacgacccaatgttcctaccattaggacagccaaagtgcagggcccagggtttga

SEQ ID NO: 80991 - DNA, 75 bp, Artificial Sequence
  Synthetic
gaagcaaaagacaaattggaatacctttctaagttaaaacagcttgaaatgatagaaaatcaaatggcaactttg

SEQ ID NO: 80992 - DNA, 75 bp, Artificial Sequence
  Synthetic
caccaatcatgtcctagtcaagaggaacaagaagttctctttaacaacatcagatggttagcaataaaagcaaga

SEQ ID NO: 80993 - DNA, 75 bp, Artificial Sequence
  Synthetic
gcacgacaacgtggccattctgccgacccacgcctcaccaggagagacgatagtcattgatggtagggaggtaga

SEQ ID NO: 80994 - DNA, 75 bp, Artificial Sequence
  Synthetic
agtcctggacgccaaagctttagaagatcaagccgggaccaacttggaaatcaccattgtcacattaaagagaaa

SEQ ID NO: 80995 - DNA, 75 bp, Artificial Sequence
  Synthetic
ttcaagaccaaacatcgcattgaaccagtatgtttgttgattcatggaacacctggcactggcaaatcagttgct

SEQ ID NO: 80996 - DNA, 75 bp, Artificial Sequence
  Synthetic
cagtatgtttgttgattcatggaacacctggcactggcaaatcagttgctacaggtcttattggaagagcaattg

SEQ ID NO: 80997 - DNA, 75 bp, Artificial Sequence
  Synthetic
cactagcaagtaccccaatatgtatgtcccagtcggggctgtgactgaacagggatatctcaatctcggtggccg

SEQ ID NO: 80998 - DNA, 75 bp, Artificial Sequence
  Synthetic
tcgtaatcatggatgatctaaatcagaatccagatggtgaagatatgaaattattttgtcaaatggtttccacag

SEQ ID NO: 80999 - DNA, 75 bp, Artificial Sequence
  Synthetic
gaatccagatggtgaagatatgaaattattttgtcaaatggtttccacagtggaatttataccaccaatggctag

SEQ ID NO: 81000 - DNA, 75 bp, Artificial Sequence
  Synthetic
gaaggtcatcgggatgcatgttggtgggaacggttcgcatgggtttgcagcagccctaaagcgatcatacttcac

SEQ ID NO: 81001 - DNA, 75 bp, Artificial Sequence
  Synthetic
cagccctaaagcgatcatacttcactcagagtcaaggtgaaattcaatggatgaggccttccaaagaggtagggt

SEQ ID NO: 81002 - DNA, 75 bp, Artificial Sequence
  Synthetic
cacagtatcagcatctgatgcattatccagaagattcgcttttgatatggacatatgcccaatgtctgaatacac

SEQ ID NO: 81003 - DNA, 75 bp, Artificial Sequence
  Synthetic
tccagaagattcgcttttgatatggacatatgcccaatgtctgaatacacagtaaagggaaagttaaatatggct

SEQ ID NO: 81004 - DNA, 75 bp, Artificial Sequence
  Synthetic
aacctgcagtcttgaccaagaatgacccaaggctcaaaactgactttgaggaagctatcttttcaaagtatgtgg

SEQ ID NO: 81005 - DNA, 75 bp, Artificial Sequence
  Synthetic
cccaaggctcaaaactgactttgaggaagctatcttttcaaagtatgtggggaacaaaatcactgaagtggatga

SEQ ID NO: 81006 - DNA, 75 bp, Artificial Sequence
  Synthetic
gccattcaactaatggacaagagcactagaatgagatattcattagatcagatcaccacaatgatgataaatgaa

SEQ ID NO: 81007 - DNA, 75 bp, Artificial Sequence
  Synthetic
ctagaatgagatattcattagatcagatcaccacaatgatgataaatgaaagaaacaggagatacaacattggag

SEQ ID NO: 81008 - DNA, 75 bp, Artificial Sequence
  Synthetic
tgaagatgcaatgtacggcactgatggccttgaagctctagatcttagtaccagtgctgggtacccctatgttgc

SEQ ID NO: 81009 - DNA, 75 bp, Artificial Sequence
  Synthetic
ggccttgaagctctagatcttagtaccagtgctgggtacccctatgttgcaatgggaaagaagaagagagatatt

SEQ ID NO: 81010 - DNA, 75 bp, Artificial Sequence
  Synthetic
cctcagcgatttcagacttactcaaagcagttgacaatcaagaagtcagggattattgcaaacaacagggctggg

SEQ ID NO: 81011 - DNA, 75 bp, Artificial Sequence
  Synthetic
agcagttgacaatcaagaagtcagggattattgcaaacaacagggctgggtagttgagattccctcaaactctgt

SEQ ID NO: 81012 - DNA, 75 bp, Artificial Sequence
  Synthetic
acctatgtcaaagatgagctcagatccaagaccaaagtggaacagggcaagtccagattgatagaagcctcaagc

SEQ ID NO: 81013 - DNA, 75 bp, Artificial Sequence
  Synthetic
ggtttacgtggtctacaaactttttgcaggattccagggtgcatatacaggacttccaaatgcaaaaccaaaagt

SEQ ID NO: 81014 - DNA, 75 bp, Artificial Sequence
  Synthetic
ctaaatgactcagttgccatgagaatggcgtttggcaatctttatgcagcgttccacaggaacccaggtgtggtg

SEQ ID NO: 81015 - DNA, 75 bp, Artificial Sequence
  Synthetic
gcaggattccagggtgcatatacaggacttccaaatgcaaaaccaaaagttcctacaatcagaacagctaaggtg

SEQ ID NO: 81016 - DNA, 75 bp, Artificial Sequence
  Synthetic
ttcacaatgctaggtgtctatgatagagtagctgtgctccccacccactcaaacccaggtgaaactatagttata

SEQ ID NO: 81017 - DNA, 75 bp, Artificial Sequence
  Synthetic
gagtagctgtgctccccacccactcaaacccaggtgaaactatagttatatcaggaaaggaagtgaaggttttag

SEQ ID NO: 81018 - DNA, 75 bp, Artificial Sequence
  Synthetic
acattgattatctgaaccattcacaccacctttataaaaacaaaacatactgtgtcaagggcggcatgccatctg

SEQ ID NO: 81019 - DNA, 75 bp, Artificial Sequence
  Synthetic
tcagagatattaggacccacttaccaactcaaattcatgaaactaatgatgctgtccttgctgtgaacacctcca

SEQ ID NO: 81020 - DNA, 75 bp, Artificial Sequence
  Synthetic
aactcaaattcatgaaactaatgatgctgtccttgctgtgaacacctccaagtttccaaacatgtacattccagt

SEQ ID NO: 81021 - DNA, 75 bp, Artificial Sequence
  Synthetic
aaccaaagcaggacaatgtggtggtgttttaatggctactggcaaagtaattggcatacacgttggtggtaatgg

SEQ ID NO: 81022 - DNA, 75 bp, Artificial Sequence
  Synthetic
gttttaatggctactggcaaagtaattggcatacacgttggtggtaatggatcccatggttttgctgctgctctt

SEQ ID NO: 81023 - DNA, 75 bp, Artificial Sequence
  Synthetic
atccagtgatgccaatgaaagagattcatgaatcaattagatggacaaaggatcctagaaacacccaggatcatg

SEQ ID NO: 81024 - DNA, 75 bp, Artificial Sequence
  Synthetic
tcatgaatcaattagatggacaaaggatcctagaaacacccaggatcatgttcgctcactgtgcctattggcttg

SEQ ID NO: 81025 - DNA, 75 bp, Artificial Sequence
  Synthetic
attaacgcgccttcaaagacaaaattagagcctagtgttttctttgatgtactcccgggagaaaaagaaccagcc

SEQ ID NO: 81026 - DNA, 75 bp, Artificial Sequence
  Synthetic
tagagcctagtgttttctttgatgtactcccgggagaaaaagaaccagccgccctaaccaagagtgaccccaggt

SEQ ID NO: 81027 - DNA, 75 bp, Artificial Sequence
  Synthetic
ccctgagtactctacattgtaccgccgttggcttgactcattttagtaaccctacctcagtcgaattggattggg

SEQ ID NO: 81028 - DNA, 75 bp, Artificial Sequence
  Synthetic
aggaagcagttgatcattatgctggtcagttaatgtcccttgacatacccacagaacagatgtgtctggaagatg

SEQ ID NO: 81029 - DNA, 75 bp, Artificial Sequence
  Synthetic
tcagttaatgtcccttgacatacccacagaacagatgtgtctggaagatgccatgtatggcacagatggtcttga

SEQ ID NO: 81030 - DNA, 75 bp, Artificial Sequence
  Synthetic
acaaacaagagacactaaagaaatgcagaaaatgctagacaaatatggaataaacctaccattggtaacctacgt

SEQ ID NO: 81031 - DNA, 75 bp, Artificial Sequence
  Synthetic
cagaaaatgctagacaaatatggaataaacctaccattggtaacctacgttaaagacgaacttagatccaaatca

SEQ ID NO: 81032 - DNA, 75 bp, Artificial Sequence
  Synthetic
ggccacttgtatgccaagttccatcaaaacccaggtgtaataacaggctcagcagttggatgtgacccagatgtc

SEQ ID NO: 81033 - DNA, 75 bp, Artificial Sequence
  Synthetic
aaaacccaggtgtaataacaggctcagcagttggatgtgacccagatgtcttttggagtaaggttccagtgatgc

SEQ ID NO: 81034 - DNA, 75 bp, Artificial Sequence
  Synthetic
gctagttgtgaacaaggtgtgaagagcctattgagctacttgagagtcctccggcccctgaatgcggctaatccc

SEQ ID NO: 81035 - DNA, 75 bp, Artificial Sequence
  Synthetic
aaatggtgttggaaaagattggctttggagaccgggttgactttatagattatttaaatcactcacaccatctat

SEQ ID NO: 81036 - DNA, 75 bp, Artificial Sequence
  Synthetic
aggtggaatgccttcaggatgctcaggaacctcaatctttaattccatgattaacaatttaataattagaacatt

SEQ ID NO: 81037 - DNA, 75 bp, Artificial Sequence
  Synthetic
gatttactgcattatctaagcacactccagatttaattcgtatcgttcttgcgattaggagagcacacttttcca

SEQ ID NO: 81038 - DNA, 75 bp, Artificial Sequence
  Synthetic
tccagatttaattcgtatcgttcttgcgattaggagagcacacttttccagcaatgggtgcacaggtttcatcac

SEQ ID NO: 81039 - DNA, 75 bp, Artificial Sequence
  Synthetic
acaaagactcagctagtaacgctgcctccaagcaggacttttctcaagatccttccaaatttactgaaccagtca

SEQ ID NO: 81040 - DNA, 75 bp, Artificial Sequence
  Synthetic
ctccaagcaggacttttctcaagatccttccaaatttactgaaccagtcaaggacataatgctaaaatcagctcc

SEQ ID NO: 81041 - DNA, 75 bp, Artificial Sequence
  Synthetic
cataaccacacaggaagctgcaaatgcagtggttgcatacggtaggtggccctcgtacttgagaccaaccgaggc

SEQ ID NO: 81042 - DNA, 75 bp, Artificial Sequence
  Synthetic
gcagtggttgcatacggtaggtggccctcgtacttgagaccaaccgaggctaatccagtggatgctcctaccgaa

SEQ ID NO: 81043 - DNA, 75 bp, Artificial Sequence
  Synthetic
aaattgccagactgcctcaaggacatgggtttgttcgggcaaaacatgttctatcattacttaggtagaagtggg

SEQ ID NO: 81044 - DNA, 75 bp, Artificial Sequence
  Synthetic
tgggtttgttcgggcaaaacatgttctatcattacttaggtagaagtgggtacactgtccatgtgcaatgtaacg

SEQ ID NO: 81045 - DNA, 75 bp, Artificial Sequence
  Synthetic
aaacatcgtatgtttcatatgtcaatgcaaaccccggagaagccggtggcacattcaccagtagttacaacccaa

SEQ ID NO: 81046 - DNA, 75 bp, Artificial Sequence
  Synthetic
tgcaaaccccggagaagccggtggcacattcaccagtagttacaacccaagtacagaaactgaccaagggagaac

SEQ ID NO: 81047 - DNA, 75 bp, Artificial Sequence
  Synthetic
gcacatgaaaactcaaatagagcatatggtggttctaccattaattacaccaccattaattattatagagattca

SEQ ID NO: 81048 - DNA, 75 bp, Artificial Sequence
  Synthetic
caatttaagaaccaacaacagtgccactattgtcttgccatatgtcaactcactagctattgattgtatggctaa

SEQ ID NO: 81049 - DNA, 75 bp, Artificial Sequence
  Synthetic
actattgtcttgccatatgtcaactcactagctattgattgtatggctaagcacaacaactgggggttagtaatc

SEQ ID NO: 81050 - DNA, 75 bp, Artificial Sequence
  Synthetic
tttactgagttcaatggattgagaaacatcacaattccagcgacacaagggctgccagtaatggtcacaccaggg

SEQ ID NO: 81051 - DNA, 75 bp, Artificial Sequence
  Synthetic
acatcacaattccagcgacacaagggctgccagtaatggtcacaccagggtcgagtcaatatctcacttcagatg

SEQ ID NO: 81052 - DNA, 75 bp, Artificial Sequence
  Synthetic
tgatggagctggcagaaattgacacattgataccaatgaacagtgtttcgggtaaggcaaacaccatggatatgt

SEQ ID NO: 81053 - DNA, 75 bp, Artificial Sequence
  Synthetic
attgataccaatgaacagtgtttcgggtaaggcaaacaccatggatatgtatagaattccattaaacactgaggg

SEQ ID NO: 81054 - DNA, 75 bp, Artificial Sequence
  Synthetic
aatcctgaactattacactcactggaccgggtcacttagattcacgttcttgttttgcggtagcatgatggcaac

SEQ ID NO: 81055 - DNA, 75 bp, Artificial Sequence
  Synthetic
cgggaagttgatcttaacatactcaccaccaggggcatcacctccaaagagtagaaaagatgctatgcttggcac

SEQ ID NO: 81056 - DNA, 75 bp, Artificial Sequence
  Synthetic
aaggtgtgtgaaagatgatttcacagaagggggttacataacatgcttttaccaaactcgcattgtagtcccagc

SEQ ID NO: 81057 - DNA, 75 bp, Artificial Sequence
  Synthetic
gaagggggttacataacatgcttttaccaaactcgcattgtagtcccagctagtacaccaaccaatatggccatg

SEQ ID NO: 81058 - DNA, 75 bp, Artificial Sequence
  Synthetic
ctgatagcccagacccagggtattgatgatgttattgataaggtgattaacaatgcactacagctctcacaacct

SEQ ID NO: 81059 - DNA, 75 bp, Artificial Sequence
  Synthetic
atgatgttattgataaggtgattaacaatgcactacagctctcacaacctactcgaccagtcaccgcgtcggaca

SEQ ID NO: 81060 - DNA, 75 bp, Artificial Sequence
  Synthetic
cagtgccatcagatgttattgaaaccagacatgttgttaactacaaaacaagatctgaaagtactttggaatcct

SEQ ID NO: 81061 - DNA, 75 bp, Artificial Sequence
  Synthetic
cagacatgttgttaactacaaaacaagatctgaaagtactttggaatccttctttggcagatcagcatgtgttac

SEQ ID NO: 81062 - DNA, 75 bp, Artificial Sequence
  Synthetic
atacactaacacagtccagttaagaagaaaattagaattcttcacctactccagattcgacttggaaatgacttt

SEQ ID NO: 81063 - DNA, 75 bp, Artificial Sequence
  Synthetic
agaaaattagaattcttcacctactccagattcgacttggaaatgactttcgttgtgacggaaagatattacacc

SEQ ID NO: 81064 - DNA, 75 bp, Artificial Sequence
  Synthetic
tgggatgactacacatggcaatcatcgtccaacccttcaatattctacacgtacggatgcgcaccagcacgcatt

SEQ ID NO: 81065 - DNA, 75 bp, Artificial Sequence
  Synthetic
cgtccaacccttcaatattctacacgtacggatgcgcaccagcacgcatttcaattccatatgtgggcatagcca

SEQ ID NO: 81066 - DNA, 75 bp, Artificial Sequence
  Synthetic
actacggcttggtttccatcaatgactttggagccctagcaattagagtagtaaatgagtttaaccccgctcgca

SEQ ID NO: 81067 - DNA, 75 bp, Artificial Sequence
  Synthetic
ctttggagccctagcaattagagtagtaaatgagtttaaccccgctcgcataacagcaaaagtgcgagtgtatat

SEQ ID NO: 81068 - DNA, 75 bp, Artificial Sequence
  Synthetic
gaaacaagggagtgtgttaccattgactccagtgaacagcataactacatatggatttggacaccaaaaccaagc

SEQ ID NO: 81069 - DNA, 75 bp, Artificial Sequence
  Synthetic
actccagtgaacagcataactacatatggatttggacaccaaaaccaagcagtttatgttgctgggtacaaaata

SEQ ID NO: 81070 - DNA, 75 bp, Artificial Sequence
  Synthetic
gtagaatccaaagcacagggaattgaccaaatcgctaggtgctcatgtacaaccggtgtttactattgttcatca

SEQ ID NO: 81071 - DNA, 75 bp, Artificial Sequence
  Synthetic
accaaatcgctaggtgctcatgtacaaccggtgtttactattgttcatcacgaagtaagcactacccaattactg

SEQ ID NO: 81072 - DNA, 75 bp, Artificial Sequence
  Synthetic
gtcatggctttgctgaaccaggggattgtggtggtatcctcagatgtcaacatggagtgatgggactcattactg

SEQ ID NO: 81073 - DNA, 75 bp, Artificial Sequence
  Synthetic
ttgtggtggtatcctcagatgtcaacatggagtgatgggactcattactgctggtggtaatgggattgttgcctt

SEQ ID NO: 81074 - DNA, 75 bp, Artificial Sequence
  Synthetic
ggcagcattcggatgcggattcactaatcaaataagtgagagggttactgaaattgcttcaatggtcaacagtgt

SEQ ID NO: 81075 - DNA, 75 bp, Artificial Sequence
  Synthetic
aatcaaataagtgagagggttactgaaattgcttcaatggtcaacagtgtcatcacagagaagttactaaagaac

SEQ ID NO: 81076 - DNA, 75 bp, Artificial Sequence
  Synthetic
gctctcctaggttgtgacgtgtcaccatggtcttggctcagaaagaaggcttgtgatattctagagttgccttac

SEQ ID NO: 81077 - DNA, 75 bp, Artificial Sequence
  Synthetic
catggtcttggctcagaaagaaggcttgtgatattctagagttgccttacgtgtgtaggcaaggagattcctggt

SEQ ID NO: 81078 - DNA, 75 bp, Artificial Sequence
  Synthetic
attggctcaagaccaaaataataccagaagccagggacaaggtagaatacgttaccaaactgaaacagttgggca

SEQ ID NO: 81079 - DNA, 75 bp, Artificial Sequence
  Synthetic
agaagccagggacaaggtagaatacgttaccaaactgaaacagttgggcatgcttgagaaccagatcaacacaat

SEQ ID NO: 81080 - DNA, 75 bp, Artificial Sequence
  Synthetic
acgctttgcaccattatacgccgtggaggcaaagcgcatatccaaattggaaaacacaatcaacaattacataca

SEQ ID NO: 81081 - DNA, 75 bp, Artificial Sequence
  Synthetic
gaggcaaagcgcatatccaaattggaaaacacaatcaacaattacatacagttcaagagcaaacaccgtattgag

SEQ ID NO: 81082 - DNA, 75 bp, Artificial Sequence
  Synthetic
gcggaaagagagaatacatctgtatattccctacccccagatcccgcacattttgacgggtacaaacaacaggga

SEQ ID NO: 81083 - DNA, 75 bp, Artificial Sequence
  Synthetic
attccctacccccagatcccgcacattttgacgggtacaaacaacagggagtggtcataatggatgacttgaatc

SEQ ID NO: 81084 - DNA, 75 bp, Artificial Sequence
  Synthetic
cactagaggaaaaaggaatcctgttcacctcagattatgtccttgcttccaccaattcaggtagtatagtaccac

SEQ ID NO: 81085 - DNA, 75 bp, Artificial Sequence
  Synthetic
cacctcagattatgtccttgcttccaccaattcaggtagtatagtaccaccaacagtatccagcgcagatgccct

SEQ ID NO: 81086 - DNA, 75 bp, Artificial Sequence
  Synthetic
aactgccacagtgttatgtaaagaatgtcccaaaccagcaaatttcaaaaaatgttgccctttgatctgcggcaa

SEQ ID NO: 81087 - DNA, 75 bp, Artificial Sequence
  Synthetic
tgtcccaaaccagcaaatttcaaaaaatgttgccctttgatctgcggcaaggccatacaattaatggataaacac

SEQ ID NO: 81088 - DNA, 75 bp, Artificial Sequence
  Synthetic
aactgtatggaagcgctgttccaaggaccgatacaatataaggacctgaaaatagacatcaagaccacccctcca

SEQ ID NO: 81089 - DNA, 75 bp, Artificial Sequence
  Synthetic
gaccgatacaatataaggacctgaaaatagacatcaagaccacccctccaccggagtgtattaatgatttgctgc

SEQ ID NO: 81090 - DNA, 75 bp, Artificial Sequence
  Synthetic
agatggagcgcaatctgaacagggctatgacaatcctgcaggcaataaccacctttgctgcagttgctggcgttg

SEQ ID NO: 81091 - DNA, 75 bp, Artificial Sequence
  Synthetic
tatgacaatcctgcaggcaataaccacctttgctgcagttgctggcgttgtttatgtgatgtatcgcctatttgc

SEQ ID NO: 81092 - DNA, 75 bp, Artificial Sequence
  Synthetic
aggtccaggttttgactatgcagtggcaatggcaaaaagaaatatcctaacggccaccactcaaaaaggtgaatt

SEQ ID NO: 81093 - DNA, 75 bp, Artificial Sequence
  Synthetic
gcaatggcaaaaagaaatatcctaacggccaccactcaaaaaggtgaattcaccatgctgggagtgcatgacaac

SEQ ID NO: 81094 - DNA, 75 bp, Artificial Sequence
  Synthetic
gcacaagcactggtggaccaagcaggtacaaacttggaaataactattgttaaattggctagaaatgagaagttt

SEQ ID NO: 81095 - DNA, 75 bp, Artificial Sequence
  Synthetic
taccctaacatgtatgtcccggtcggtgctgtgaccgagcagggatatctcaatctcggtggacgccaaactgct

SEQ ID NO: 81096 - DNA, 75 bp, Artificial Sequence
  Synthetic
gggatgcatgttggagggaacggttcacatgggttcgcagcagccctaaaacggtcatacttcactcagagtcaa

SEQ ID NO: 81097 - DNA, 75 bp, Artificial Sequence
  Synthetic
cacatgggttcgcagcagccctaaaacggtcatacttcactcagagtcaaggtgagatccaatggatgagaccat

SEQ ID NO: 81098 - DNA, 75 bp, Artificial Sequence
  Synthetic
agtaccaccacgaacgagcacttctgtttccccggtgagattgtataagctgttcccacggccgaaaacgatcga

SEQ ID NO: 81099 - DNA, 75 bp, Artificial Sequence
  Synthetic
ttgagggagtcaaagagccagcggtgctaaccaagaacgatcccaggctgaagacagattttgaggaggccattt

SEQ ID NO: 81100 - DNA, 75 bp, Artificial Sequence
  Synthetic
gctaaccaagaacgatcccaggctgaagacagattttgaggaggccattttctcgaaatacgtaggaaacaagat

SEQ ID NO: 81101 - DNA, 75 bp, Artificial Sequence
  Synthetic
agaacagatgtgtcttgaggatgccatgtatgggactgatgggctcgaggctctggatcttagcaccagtgctgg

SEQ ID NO: 81102 - DNA, 75 bp, Artificial Sequence
  Synthetic
atgtatgggactgatgggctcgaggctctggatcttagcaccagtgctgggtatccctatgtggcattaggcaag

SEQ ID NO: 81103 - DNA, 75 bp, Artificial Sequence
  Synthetic
aatttacccttagtcacttatgtgaaagatgaactcagatcgaaaactaaagtagagcaaggtaaatccagactg

SEQ ID NO: 81104 - DNA, 75 bp, Artificial Sequence
  Synthetic
ttggattggccatccggtgagagttaagacaattatccacttgtttgttggatttacccctctgactaattacac

SEQ ID NO: 81105 - DNA, 75 bp, Artificial Sequence
  Synthetic
aagatgaactcagatcgaaaactaaagtagagcaaggtaaatccagactgattgaagcctctagtctgaatgact

SEQ ID NO: 81106 - DNA, 75 bp, Artificial Sequence
  Synthetic
ctgttgggtgtgacccagacttgttttggagtaaaataccagtgctaatggaagagaaactctttgcttttgact

SEQ ID NO: 81107 - DNA, 75 bp, Artificial Sequence
  Synthetic
gtgatagagtggactacatagactacctgaaccattcacaccacctatacaaaaacaagacttattgtgtcaagg

SEQ ID NO: 81108 - DNA, 75 bp, Artificial Sequence
  Synthetic
ttaaaacagctctggggttgttcccaccccagaggcccacgtggcggctagtactccggtattacggtacccttg

SEQ ID NO: 81109 - DNA, 75 bp, Artificial Sequence
  Synthetic
agtaccaccacgaacaagcacttctgtttccccggtgcggtggtatagactgtacccacggttaaaaaccaccaa

SEQ ID NO: 81110 - DNA, 75 bp, Artificial Sequence
  Synthetic
agtctgtggcggaaccgactactttgggtgtccgtgtttccttttattcttattatggctgcttatggtgacaat

SEQ ID NO: 81111 - DNA, 75 bp, Artificial Sequence
  Synthetic
gggtgtccgtgtttccttttattcttattatggctgcttatggtgacaatcttagattgttatcatatagcaatt

SEQ ID NO: 81112 - DNA, 75 bp, Artificial Sequence
  Synthetic
ttactttgattagaattgtgctattgatcagattgacacatcactatgggtgcacaagtttcatctcagaaggtg

SEQ ID NO: 81113 - DNA, 75 bp, Artificial Sequence
  Synthetic
gatcagattgacacatcactatgggtgcacaagtttcatctcagaaggtgggtgcacatgagaacaccaatgtgg

SEQ ID NO: 81114 - DNA, 75 bp, Artificial Sequence
  Synthetic
gatacctgcattgacagctgtggagacaggggctaccaatccgttggtgccttcggacaccgtgcaaacgcgcca

SEQ ID NO: 81115 - DNA, 75 bp, Artificial Sequence
  Synthetic
aggacttttctcaagatccctccaaattcactgaaccattcaaagatgtgatgttaaaatcagccccggctctaa

SEQ ID NO: 81116 - DNA, 75 bp, Artificial Sequence
  Synthetic
attcactgaaccattcaaagatgtgatgttaaaatcagccccggctctaaactcaccaaatgtggaggcatgcgg

SEQ ID NO: 81117 - DNA, 75 bp, Artificial Sequence
  Synthetic
cgcatatgggagatggccttcgtatctcaaaccaactgaagccaacccagtagacgctcccactgagccagatgt

SEQ ID NO: 81118 - DNA, 75 bp, Artificial Sequence
  Synthetic
ctcaaaccaactgaagccaacccagtagacgctcccactgagccagatgttagttctaacagattctacacactg

SEQ ID NO: 81119 - DNA, 75 bp, Artificial Sequence
  Synthetic
tttggtcaaaacatgttctatcattacctaggtaggagtggatacactgttcatgtacagtgtaacgcatcaaaa

SEQ ID NO: 81120 - DNA, 75 bp, Artificial Sequence
  Synthetic
acctaggtaggagtggatacactgttcatgtacagtgtaacgcatcaaaattccaccaaggagcccttggggttt

SEQ ID NO: 81121 - DNA, 75 bp, Artificial Sequence
  Synthetic
ctggggaggcaggtggtacatttactgatcaatactctcccagtaatgactcttctgaaggaaggaaatttgcag

SEQ ID NO: 81122 - DNA, 75 bp, Artificial Sequence
  Synthetic
tgatcaatactctcccagtaatgactcttctgaaggaaggaaatttgcagctgttgattatctactggggtgcgg

SEQ ID NO: 81123 - DNA, 75 bp, Artificial Sequence
  Synthetic
tttaccatatgttaattcactagctattgactgtatggccaagcacaacaattgggggctagtgattctgccgct

SEQ ID NO: 81124 - DNA, 75 bp, Artificial Sequence
  Synthetic
attgactgtatggccaagcacaacaattgggggctagtgattctgccgctagagcctcttgcatacgcaccacaa

SEQ ID NO: 81125 - DNA, 75 bp, Artificial Sequence
  Synthetic
ggcacagattccatcgccaggtgtaattgtaacactggagtgtattactgtgaatccagaaagaaatattacccc

SEQ ID NO: 81126 - DNA, 75 bp, Artificial Sequence
  Synthetic
attgtaacactggagtgtattactgtgaatccagaaagaaatattaccccgtctccttcatagggccaacctttc

SEQ ID NO: 81127 - DNA, 75 bp, Artificial Sequence
  Synthetic
gtaccagcaacacaagggttgcctgtgttggttactccagggtccagtcaatatttgacatctgacgattttcaa

SEQ ID NO: 81128 - DNA, 75 bp, Artificial Sequence
  Synthetic
tgttggttactccagggtccagtcaatatttgacatctgacgattttcaatcaccttgtgcattaccaaactttg

SEQ ID NO: 81129 - DNA, 75 bp, Artificial Sequence
  Synthetic
ctggagactgcggtggtatcctcaggtgccaacacggagtgattggaatcatcacagctggaggtgaaggtttag

SEQ ID NO: 81130 - DNA, 75 bp, Artificial Sequence
  Synthetic
gtgccaacacggagtgattggaatcatcacagctggaggtgaaggtttagtggccttctcagacatcagggacct

SEQ ID NO: 81131 - DNA, 75 bp, Artificial Sequence
  Synthetic
caatgaacagcgtttcgggaaaagcgaacaccatggaaatgtacagaatcccattgaatacaaccggcagcaaag

SEQ ID NO: 81132 - DNA, 75 bp, Artificial Sequence
  Synthetic
gaacaccatggaaatgtacagaatcccattgaatacaaccggcagcaaagatcccatattctgcctgagtctctc

SEQ ID NO: 81133 - DNA, 75 bp, Artificial Sequence
  Synthetic
cgggttcacccagcaaataggagataaaatttcagaactcaccagcatggttactagcactatcactgaaaaact

SEQ ID NO: 81134 - DNA, 75 bp, Artificial Sequence
  Synthetic
aaaatttcagaactcaccagcatggttactagcactatcactgaaaaacttttaaaaaacctgatcaaaatcatc

SEQ ID NO: 81135 - DNA, 75 bp, Artificial Sequence
  Synthetic
tcttaggtttacctttttgttttgtgggagcatgatggcaaccggaaagttaatcttgacatactcacctccagg

SEQ ID NO: 81136 - DNA, 75 bp, Artificial Sequence
  Synthetic
gggagcatgatggcaaccggaaagttaatcttgacatactcacctccaggtgcctcccccccgaaaactcgaaaa

SEQ ID NO: 81137 - DNA, 75 bp, Artificial Sequence
  Synthetic
gatgtttccccatggcagtggcttaagaagaaagcatgtgacatactagaaatcccatatgtcatgcgacaaggt

SEQ ID NO: 81138 - DNA, 75 bp, Artificial Sequence
  Synthetic
agaagaaagcatgtgacatactagaaatcccatatgtcatgcgacaaggtgacagttggcttaagaaattcacag

SEQ ID NO: 81139 - DNA, 75 bp, Artificial Sequence
  Synthetic
tccaacaccgtctatagaagatgtgtaagggatgattttactgaaggaggctatataacatgtttctaccagact

SEQ ID NO: 81140 - DNA, 75 bp, Artificial Sequence
  Synthetic
taagggatgattttactgaaggaggctatataacatgtttctaccagactcgcatagtcgttcccgccagcactc

SEQ ID NO: 81141 - DNA, 75 bp, Artificial Sequence
  Synthetic
aaatcatccctcaagccagagacaagttggagtttgttaccaaattaaaacaactggaaatgctagagaaccaga

SEQ ID NO: 81142 - DNA, 75 bp, Artificial Sequence
  Synthetic
gttggagtttgttaccaaattaaaacaactggaaatgctagagaaccagattgcaaccatacatcaatcatgccc

SEQ ID NO: 81143 - DNA, 75 bp, Artificial Sequence
  Synthetic
acatcagtcagagcactctgctcgcttcaacacagggaatagatgaggtcatcgataaagtcattaacaatgcac

SEQ ID NO: 81144 - DNA, 75 bp, Artificial Sequence
  Synthetic
ttcaacacagggaatagatgaggtcatcgataaagtcattaacaatgcactacaactctctcaacccactcgacc

SEQ ID NO: 81145 - DNA, 75 bp, Artificial Sequence
  Synthetic
ctacgctgtagaagcaaaaaggattcagaagttagaacacacaatcaacaattacatacagttcaagagcaaaca

SEQ ID NO: 81146 - DNA, 75 bp, Artificial Sequence
  Synthetic
cagaagttagaacacacaatcaacaattacatacagttcaagagcaaacaccgtattgagccagtatgtttgttg

SEQ ID NO: 81147 - DNA, 75 bp, Artificial Sequence
  Synthetic
cggagcctctggacaagcaataccatcagatgttattgaaactagacatgtggttaactacaaaacgagatccga

SEQ ID NO: 81148 - DNA, 75 bp, Artificial Sequence
  Synthetic
tcagatgttattgaaactagacatgtggttaactacaaaacgagatccgagagcaccctagaatccttctttggt

SEQ ID NO: 81149 - DNA, 75 bp, Artificial Sequence
  Synthetic
acctccacctattcattaccaccagatccgtcccactttgatgggtataaacaacagggagtggtaatcatggat

SEQ ID NO: 81150 - DNA, 75 bp, Artificial Sequence
  Synthetic
atccgtcccactttgatgggtataaacaacagggagtggtaatcatggatgatctgaatcagaatccagacggag

SEQ ID NO: 81151 - DNA, 75 bp, Artificial Sequence
  Synthetic
acggtttggcccattacttataccaataccgtgcaacttagaagaaaactagagtttttcacatactccaggttt

SEQ ID NO: 81152 - DNA, 75 bp, Artificial Sequence
  Synthetic
ataccgtgcaacttagaagaaaactagagtttttcacatactccaggtttgatttagaaatgacctttgtcgtga

SEQ ID NO: 81153 - DNA, 75 bp, Artificial Sequence
  Synthetic
gcattctattcacatcaaattatgttttggcctccaccaactctaaccgtatcacaccgcccacagttgcacaca

SEQ ID NO: 81154 - DNA, 75 bp, Artificial Sequence
  Synthetic
tttggcctccaccaactctaaccgtatcacaccgcccacagttgcacacagtgatgcgctagccaggcgctttgc

SEQ ID NO: 81155 - DNA, 75 bp, Artificial Sequence
  Synthetic
cacccaggccgaatgcgtgggatgactacacatggcaatcatcttccaatccttccatattctacacttacgggt

SEQ ID NO: 81156 - DNA, 75 bp, Artificial Sequence
  Synthetic
ctacacatggcaatcatcttccaatccttccatattctacacttacgggtgtgcaccagcacgcatatcgatccc

SEQ ID NO: 81157 - DNA, 75 bp, Artificial Sequence
  Synthetic
gtgcaagaattgccaccaaccggctaacttcaagagatgctgccctctagtgtgtggaaaggcaattcagctaat

SEQ ID NO: 81158 - DNA, 75 bp, Artificial Sequence
  Synthetic
aacttcaagagatgctgccctctagtgtgtggaaaggcaattcagctaatggacaaatcctctagagtcagatat

SEQ ID NO: 81159 - DNA, 75 bp, Artificial Sequence
  Synthetic
agactctggtgacacctactatggattggtcgccatcaatgattttggatccttggcaattagagtggtgaatga

SEQ ID NO: 81160 - DNA, 75 bp, Artificial Sequence
  Synthetic
ttggtcgccatcaatgattttggatccttggcaattagagtggtgaatgagttcaatcctgcccgcattacagcg

SEQ ID NO: 81161 - DNA, 75 bp, Artificial Sequence
  Synthetic
ctctttcaaggcccacttcaatacaaagatctgaaaattgacatcaagaccgcccccccccctgagtgcatcaat

SEQ ID NO: 81162 - DNA, 75 bp, Artificial Sequence
  Synthetic
aagatctgaaaattgacatcaagaccgcccccccccctgagtgcatcaatgacttgctccaggctgtggactccc

SEQ ID NO: 81163 - DNA, 75 bp, Artificial Sequence
  Synthetic
ggagagggagtagatttgaaaagtgggtcaatcacaccgttaactccagtgaacagtataactacatatggattt

SEQ ID NO: 81164 - DNA, 75 bp, Artificial Sequence
  Synthetic
ggtcaatcacaccgttaactccagtgaacagtataactacatatggatttggacatcagaaccaggcggtctacg

SEQ ID NO: 81165 - DNA, 75 bp, Artificial Sequence
  Synthetic
ttaacagagcaatgaccattctgcaagcagtcacaacatttgctgcggttgccggggtggtatacgtgatgtaca

SEQ ID NO: 81166 - DNA, 75 bp, Artificial Sequence
  Synthetic
agcagtcacaacatttgctgcggttgccggggtggtatacgtgatgtacaaactctttgcaggacatcaaggtgc

SEQ ID NO: 81167 - DNA, 75 bp, Artificial Sequence
  Synthetic
agagagacataatggtagtggaatccaaagcacaaggaactgaccaaattgccaggtgctcatgtgtgacgggcg

SEQ ID NO: 81168 - DNA, 75 bp, Artificial Sequence
  Synthetic
caaagcacaaggaactgaccaaattgccaggtgctcatgtgtgacgggcgtctactactgcctctcacgcaacaa

SEQ ID NO: 81169 - DNA, 75 bp, Artificial Sequence
  Synthetic
ctacgcagtggcaatggcaaagagaaacatccttacagcgactactagtaagggagagtttactatgcttggcgt

SEQ ID NO: 81170 - DNA, 75 bp, Artificial Sequence
  Synthetic
gtcacacatgacgctgggatatggctttgctgaaccaggagactgcggtggaattcttaggtgccaacatggagt

SEQ ID NO: 81171 - DNA, 75 bp, Artificial Sequence
  Synthetic
agtgctggacgccaaggccttggaagaccaagctggaaccaatctagaaattactatcataacactcaagaggaa

SEQ ID NO: 81172 - DNA, 75 bp, Artificial Sequence
  Synthetic
tttgctgaaccaggagactgcggtggaattcttaggtgccaacatggagtgatggggttagttactgccggcggc

SEQ ID NO: 81173 - DNA, 75 bp, Artificial Sequence
  Synthetic
tacgtggagtctctaggagcagcatttggatgtgggtttactaaccaaataagtgaaaaagttacagaaattacc

SEQ ID NO: 81174 - DNA, 75 bp, Artificial Sequence
  Synthetic
gtccccgttggtgctgtgactgaacagggatatcttaaccttggtggacgccaaaccgctcgtactttgatgtac

SEQ ID NO: 81175 - DNA, 75 bp, Artificial Sequence
  Synthetic
ttggatgtgggtttactaaccaaataagtgaaaaagttacagaaattacctcaatggtgaatagtgttgtcacag

SEQ ID NO: 81176 - DNA, 75 bp, Artificial Sequence
  Synthetic
cagtcatggcgactcttgccctattgggttgtgacatctccccctggtcttggctcaggaagaaagcttgtgata

SEQ ID NO: 81177 - DNA, 75 bp, Artificial Sequence
  Synthetic
cggccctgaagcgatcatacttcactcagaatcaaggtgaaatccagtggataagaccatctaaggaagtgggtt

SEQ ID NO: 81178 - DNA, 75 bp, Artificial Sequence
  Synthetic
gggttgtgacatctccccctggtcttggctcaggaagaaagcttgtgatattttggagttaccttatgtgtgcaa

SEQ ID NO: 81179 - DNA, 75 bp, Artificial Sequence
  Synthetic
aatatccaagtttattgattggctcaagacgaaaataataccagaggcaagagacaaagtggaatacatcaccaa

SEQ ID NO: 81180 - DNA, 75 bp, Artificial Sequence
  Synthetic
aacctgctgtgttaactaaaaatgatcccaggttgaagacagattttgaggaagccattttctcaaagtacgttg

SEQ ID NO: 81181 - DNA, 75 bp, Artificial Sequence
  Synthetic
aagacgaaaataataccagaggcaagagacaaagtggaatacatcaccaaactgaagcaactgagcatgcttgag

SEQ ID NO: 81182 - DNA, 75 bp, Artificial Sequence
  Synthetic
tcccaggttgaagacagattttgaggaagccattttctcaaagtacgttggaaataagatcactgaggttgatga

SEQ ID NO: 81183 - DNA, 75 bp, Artificial Sequence
  Synthetic
ctagcaatccaatcacgccgatttgcaccgctgtacgcagtggaagcgaagcgcatatctaaattggagaacaca

SEQ ID NO: 81184 - DNA, 75 bp, Artificial Sequence
  Synthetic
cgaggatgccatgtacggcactgatgggcttgaagccctggatctcagcactagtgccggatatccctatgttgc

SEQ ID NO: 81185 - DNA, 75 bp, Artificial Sequence
  Synthetic
caccgctgtacgcagtggaagcgaagcgcatatctaaattggagaacacaatcaataactatatacagttcaaga

SEQ ID NO: 81186 - DNA, 75 bp, Artificial Sequence
  Synthetic
gggcttgaagccctggatctcagcactagtgccggatatccctatgttgcaatgggaaagaagaaaagagacatc

SEQ ID NO: 81187 - DNA, 75 bp, Artificial Sequence
  Synthetic
ttgttggcagagccattgcagaaagagagaacacctctgtttattccctcccaccagaccctgcacatttcgacg

SEQ ID NO: 81188 - DNA, 75 bp, Artificial Sequence
  Synthetic
acctatgtaaaagatgagcttagatctaaaaccaaagttgaacaaggtaaatctagattgattgaagcatcaagt

SEQ ID NO: 81189 - DNA, 75 bp, Artificial Sequence
  Synthetic
agagaacacctctgtttattccctcccaccagaccctgcacatttcgacggttacaaacagcagggtgttgtcat

SEQ ID NO: 81190 - DNA, 75 bp, Artificial Sequence
  Synthetic
ctaaaaccaaagttgaacaaggtaaatctagattgattgaagcatcaagtctgaatgactccgtggccatgagaa

SEQ ID NO: 81191 - DNA, 75 bp, Artificial Sequence
  Synthetic
tattccaccaatggcatcactagaggaaaagggaattctcttcacatcagactatgtccttgcatcaaccaactc

SEQ ID NO: 81192 - DNA, 75 bp, Artificial Sequence
  Synthetic
cagacttgttttggagcaaaataccagttctgatggaagaaaaactctttgcatttgattacacaggttacgatg

SEQ ID NO: 81193 - DNA, 75 bp, Artificial Sequence
  Synthetic
gaaaagggaattctcttcacatcagactatgtccttgcatcaaccaactccggtagtatagtgccacccacagtg

SEQ ID NO: 81194 - DNA, 75 bp, Artificial Sequence
  Synthetic
agctcttaagatggttttagagaagattggatttggagatagagtggattacattgactacctgaaccattcaca

SEQ ID NO: 81195 - DNA, 75 bp, Artificial Sequence
  Synthetic
ggtaaactaaatatggccacagccacagttttatgcaaggactgccccaggccagctaatttcaaaaagtgttgc

SEQ ID NO: 81196 - DNA, 75 bp, Artificial Sequence
  Synthetic
cagttttatgcaaggactgccccaggccagctaatttcaaaaagtgttgccctttgatttgtggcaaggctatac

SEQ ID NO: 81197 - DNA, 75 bp, Artificial Sequence
  Synthetic
gaagggcaaatattggaaattgcatggaagccctctttcaaggacctccacaatataaagatctgaaaatagaca

SEQ ID NO: 81198 - DNA, 75 bp, Artificial Sequence
  Synthetic
ggaagccctctttcaaggacctccacaatataaagatctgaaaatagacataaaaaccaccccaccacctgagtg

SEQ ID NO: 81199 - DNA, 75 bp, Artificial Sequence
  Synthetic
tgtaaacagtgaggttcagattgaacgcaatttgaacagagccatgacgatcttgcaagctataacaactttcgc

SEQ ID NO: 81200 - DNA, 75 bp, Artificial Sequence
  Synthetic
cgcaatttgaacagagccatgacgatcttgcaagctataacaactttcgctgctgttgcaggagttgtgtacgtc

SEQ ID NO: 81201 - DNA, 75 bp, Artificial Sequence
  Synthetic
ttcgctcgttatgcttattggcttggcataatggtgaagaagaatacaacaaattcttagctaaaattaggagtg

SEQ ID NO: 81202 - DNA, 75 bp, Artificial Sequence
  Synthetic
agaactgctaaggtgcaaggtccaggttttgactatgcagttgccatggccaagagaaacatcgttactgcaaca

SEQ ID NO: 81203 - DNA, 75 bp, Artificial Sequence
  Synthetic
gttttgactatgcagttgccatggccaagagaaacatcgttactgcaacaaccactaaaggggagtttacaatgc

SEQ ID NO: 81204 - DNA, 75 bp, Artificial Sequence
  Synthetic
aagtgagaataatcgacgcccaggctctagtagatcaagctggcaccaatctggaaatcacaataataacactag

SEQ ID NO: 81205 - DNA, 75 bp, Artificial Sequence
  Synthetic
tctagtagatcaagctggcaccaatctggaaatcacaataataacactagaaagaaatgaaaagttcagagacat

SEQ ID NO: 81206 - DNA, 75 bp, Artificial Sequence
  Synthetic
catgtacatccctgttggagcagtgaccgaacaagggtatctgaaccttgggggaagacaaacagcccggacact

SEQ ID NO: 81207 - DNA, 75 bp, Artificial Sequence
  Synthetic
accgaacaagggtatctgaaccttgggggaagacaaacagcccggacactcatgtatcactttccaactagagca

SEQ ID NO: 81208 - DNA, 75 bp, Artificial Sequence
  Synthetic
gtctgtggcggaaccgactactttgggtgtccgtgtttccctttatttttactatggctgcttatggtgacaatc

SEQ ID NO: 81209 - DNA, 75 bp, Artificial Sequence
  Synthetic
tttgcagcagccttaaaacgatcatacttcacacaaaaccaaggtgagattcaatggatgagaccatcaaaagaa

SEQ ID NO: 81210 - DNA, 75 bp, Artificial Sequence
  Synthetic
acttcacacaaaaccaaggtgagattcaatggatgagaccatcaaaagaaatagggtatcccatcatcaacgcac

SEQ ID NO: 81211 - DNA, 75 bp, Artificial Sequence
  Synthetic
agaatgatcccagacttaaggtggatttcgaagaagccatcttttcaaaatatgtagggaacaaaatcactgaag

SEQ ID NO: 81212 - DNA, 75 bp, Artificial Sequence
  Synthetic
tttcgaagaagccatcttttcaaaatatgtagggaacaaaatcactgaagtggatgagtacatgcgagaggctgt

SEQ ID NO: 81213 - DNA, 75 bp, Artificial Sequence
  Synthetic
cactgatggattggaagctcttgaccttagcactagtgcagggtacccatatgtggctttaggaaagaagaagag

SEQ ID NO: 81214 - DNA, 75 bp, Artificial Sequence
  Synthetic
cttagcactagtgcagggtacccatatgtggctttaggaaagaagaagagagacatactcaacaagcaaactaga

SEQ ID NO: 81215 - DNA, 75 bp, Artificial Sequence
  Synthetic
ctcagatcaaaatccaaaattgagcaaggtaaatcaagattgattgaagcttccagcctaaatgattcggtagct

SEQ ID NO: 81216 - DNA, 75 bp, Artificial Sequence
  Synthetic
aaggtaaatcaagattgattgaagcttccagcctaaatgattcggtagctatgaggatggcattcggtaatctct

SEQ ID NO: 81217 - DNA, 75 bp, Artificial Sequence
  Synthetic
aaatcccagtcatgatggaagaaaagttgtttgcttttgactacactggctatgacgcttcactcagtcccgcct

SEQ ID NO: 81218 - DNA, 75 bp, Artificial Sequence
  Synthetic
attcacaccacctctataaaaacaaaacttactgtgtgaaaggtggaatgccatcaggttgttccggcacctcaa

SEQ ID NO: 81219 - DNA, 75 bp, Artificial Sequence
  Synthetic
cagagcagatgagaagtacccatttctagtgcaccctgtcatgcctatgaaggaaatacatgagtccattagatg

SEQ ID NO: 81220 - DNA, 75 bp, Artificial Sequence
  Synthetic
aggaaatacatgagtccattagatggactaaggatcccaggaacacacaggatcacgtacgctccctgtgcctat

SEQ ID NO: 81221 - DNA, 75 bp, Artificial Sequence
  Synthetic
gtaccgccgttggctcgactcattttagtaaccctacctcagtcgaattggattgggttatactgttgtaggggt

SEQ ID NO: 81222 - DNA, 75 bp, Artificial Sequence
  Synthetic
ccagtaccaccacgaacaagcacttctgtcaccccggtgaggttgtatagactgtccccacggttgaaagcgact

SEQ ID NO: 81223 - DNA, 75 bp, Artificial Sequence
  Synthetic
cttcgatgcgttgcgctcagcactcaaccccagagtgtagcttaggccgatgagtctggacaatcctcactggcg

SEQ ID NO: 81224 - DNA, 75 bp, Artificial Sequence
  Synthetic
gtgcggggttctggcagggaatgcgtttgtgtaccctcatcagattattaatctcaggacaaacaattcggcaac

SEQ ID NO: 81225 - DNA, 75 bp, Artificial Sequence
  Synthetic
cctacctgtggtccaaagccacaggacgctagttgtgaacaaggtgcgaagagcctactgagctaattgagagtc

SEQ ID NO: 81226 - DNA, 75 bp, Artificial Sequence
  Synthetic
tttgggtgtccgtgtttccttttattcttatgatggctgcttatggtgacaatcgttgattgttatcataaagcg

SEQ ID NO: 81227 - DNA, 75 bp, Artificial Sequence
  Synthetic
actatatatctcattaaggtcgtattactagtaaggaattatcaccaaaatgggagctcaagtttcatcacagaa

SEQ ID NO: 81228 - DNA, 75 bp, Artificial Sequence
  Synthetic
tactagtaaggaattatcaccaaaatgggagctcaagtttcatcacagaaagtcggtgcacacgaaaacaccaat

SEQ ID NO: 81229 - DNA, 75 bp, Artificial Sequence
  Synthetic
aagcaagatttctcacaagacccttcgaaatttactgaacccgttaaagacataatgttgaaatcagcacccgct

SEQ ID NO: 81230 - DNA, 75 bp, Artificial Sequence
  Synthetic
cgaaatttactgaacccgttaaagacataatgttgaaatcagcacccgctttgaactccccaaatgttgaagcgt

SEQ ID NO: 81231 - DNA, 75 bp, Artificial Sequence
  Synthetic
tggtcgcttatggacaatggccgacctacctgaatgcaaaggacgccaacccagttgaccaaccgaccgaacccg

SEQ ID NO: 81232 - DNA, 75 bp, Artificial Sequence
  Synthetic
ctacctgaatgcaaaggacgccaacccagttgaccaaccgaccgaacccgatgtggctgcgtgccgcttttacac

SEQ ID NO: 81233 - DNA, 75 bp, Artificial Sequence
  Synthetic
actgtttggtcagaatatgtactatcattaccttggtcgttccgggtacactgtgcacgtccaatgtaacgcctc

SEQ ID NO: 81234 - DNA, 75 bp, Artificial Sequence
  Synthetic
acattgattacttaaaccactctcaccatctctacaaaaacaagacatactgtgttaagggtggcatgccatctg

SEQ ID NO: 81235 - DNA, 75 bp, Artificial Sequence
  Synthetic
cattaccttggtcgttccgggtacactgtgcacgtccaatgtaacgcctccaagttccaccagggggcccttgga

SEQ ID NO: 81236 - DNA, 75 bp, Artificial Sequence
  Synthetic
aacccaggagaggttggaggtgagtttgtagataagtttgtggctgccacagaagctacacgcaaattctgtccg

SEQ ID NO: 81237 - DNA, 75 bp, Artificial Sequence
  Synthetic
ttgtagataagtttgtggctgccacagaagctacacgcaaattctgtccggtagactacttgtttgggtgtggtg

SEQ ID NO: 81238 - DNA, 75 bp, Artificial Sequence
  Synthetic
taccttatgtgaacagtttggcaatagattgcatggccaaacacaacaattggggtctagtggttattccactca

SEQ ID NO: 81239 - DNA, 75 bp, Artificial Sequence
  Synthetic
agattgcatggccaaacacaacaattggggtctagtggttattccactcagtaagttacaatttccagatacatc

SEQ ID NO: 81240 - DNA, 75 bp, Artificial Sequence
  Synthetic
gtttccccggtgatctcgtataggctgtacccacggctgaaaacaagtgatccgttatccgcttaggtacttcga

SEQ ID NO: 81241 - DNA, 75 bp, Artificial Sequence
  Synthetic
gccatcaacccaaggtctccctgtgatgaacacgccaggtagcaatcagtatttgacatcagataactttcaatc

SEQ ID NO: 81242 - DNA, 75 bp, Artificial Sequence
  Synthetic
atgaacacgccaggtagcaatcagtatttgacatcagataactttcaatccccgtgtgcattgccagagtttgat

SEQ ID NO: 81243 - DNA, 75 bp, Artificial Sequence
  Synthetic
ttgaatttggcggtagacaaaaagaacacgatggacatgtacagagttcctgtcaccactagtgcagatacgagt

SEQ ID NO: 81244 - DNA, 75 bp, Artificial Sequence
  Synthetic
acacgatggacatgtacagagttcctgtcaccactagtgcagatacgagtgcccccatattatgtctgagtttgt

SEQ ID NO: 81245 - DNA, 75 bp, Artificial Sequence
  Synthetic
ccataaagtatacttttctcttttgtggatctatgatggcaaccggaaaattactggttgcttacgccccaccag

SEQ ID NO: 81246 - DNA, 75 bp, Artificial Sequence
  Synthetic
tggatctatgatggcaaccggaaaattactggttgcttacgccccaccaggcgccaaaccaccgaagacacggaa

SEQ ID NO: 81247 - DNA, 75 bp, Artificial Sequence
  Synthetic
tagtaacactgcatacaggcgcacggtcaaagatgactttactgaagggggctacatatcaatgttttatcaaac

SEQ ID NO: 81248 - DNA, 75 bp, Artificial Sequence
  Synthetic
gtcaaagatgactttactgaagggggctacatatcaatgttttatcaaacaaaaatagtagtgccagcttctaca

SEQ ID NO: 81249 - DNA, 75 bp, Artificial Sequence
  Synthetic
cacatctcccaaacagcaatgccccagggtattgaggaccttatcgagaaagttgcaagtaatgcactgcaatta

SEQ ID NO: 81250 - DNA, 75 bp, Artificial Sequence
  Synthetic
agggtattgaggaccttatcgagaaagttgcaagtaatgcactgcaattatcccagcccagacccagcacatccc

SEQ ID NO: 81251 - DNA, 75 bp, Artificial Sequence
  Synthetic
caggagccacaagcagtgtggtgcctgcagatctggtccaaacccgccatgttattcaaacccggagcaggagtg

SEQ ID NO: 81252 - DNA, 75 bp, Artificial Sequence
  Synthetic
tgcagatctggtccaaacccgccatgttattcaaacccggagcaggagtgagtccacgatagagtctttctttgc

SEQ ID NO: 81253 - DNA, 75 bp, Artificial Sequence
  Synthetic
caagtggaacatcacatacacggacactgtgcagttaagaagaaaattggagatgttcacttactcacggtttga

SEQ ID NO: 81254 - DNA, 75 bp, Artificial Sequence
  Synthetic
actgtgcagttaagaagaaaattggagatgttcacttactcacggtttgacatagaattcacctttgtagtcact

SEQ ID NO: 81255 - DNA, 75 bp, Artificial Sequence
  Synthetic
ccggtgcctcaaaagtgggatgactacacgtggcaaacttcctccaatccatcggtattctacacgtacgggact

SEQ ID NO: 81256 - DNA, 75 bp, Artificial Sequence
  Synthetic
acacgtggcaaacttcctccaatccatcggtattctacacgtacgggactgcccccgcaagaatttctataccat

SEQ ID NO: 81257 - DNA, 75 bp, Artificial Sequence
  Synthetic
atccaggtgcagcatactatggggcaacttccattaatgattttggcatcttagcagtgagagtggtgaatgagc

SEQ ID NO: 81258 - DNA, 75 bp, Artificial Sequence
  Synthetic
aacttccattaatgattttggcatcttagcagtgagagtggtgaatgagcacaatccagtccaggtatcatcaaa

SEQ ID NO: 81259 - DNA, 75 bp, Artificial Sequence
  Synthetic
tccgggtgtggattacaaaggggacgcattgactcctctttcaacaaagagcttaaccacctacgggtttggtca

SEQ ID NO: 81260 - DNA, 75 bp, Artificial Sequence
  Synthetic
gcattgactcctctttcaacaaagagcttaaccacctacgggtttggtcaccaaaacaaggcagtatacacggcg

SEQ ID NO: 81261 - DNA, 75 bp, Artificial Sequence
  Synthetic
gatcttttggtgtcagaatccaaggcccagggtacagactcaattgctagatgtaattgcaataccggggtatat

SEQ ID NO: 81262 - DNA, 75 bp, Artificial Sequence
  Synthetic
cccagggtacagactcaattgctagatgtaattgcaataccggggtatattattgtgaatccagaagaaagtatt

SEQ ID NO: 81263 - DNA, 75 bp, Artificial Sequence
  Synthetic
acatgctaataggccacggtttcgcatcacctggagactgcggcggcattcttagatgccaacacggagtgattg

SEQ ID NO: 81264 - DNA, 75 bp, Artificial Sequence
  Synthetic
atcacctggagactgcggcggcattcttagatgccaacacggagtgattgggattgtcacggctggaggagaagg

SEQ ID NO: 81265 - DNA, 75 bp, Artificial Sequence
  Synthetic
gagacaaaatttcagaactaaccagtatggtcaccagtacaattacagagaagttgctaaaaaatttgattaaga

SEQ ID NO: 81266 - DNA, 75 bp, Artificial Sequence
  Synthetic
cattgagtctcttggagcagcatttggaagtgggttcactcaacagattggagacaaaatatctgaacttaccag

SEQ ID NO: 81267 - DNA, 75 bp, Artificial Sequence
  Synthetic
ggaagtgggttcactcaacagattggagacaaaatatctgaacttaccagcatggttaccagcactatcactgaa

SEQ ID NO: 81268 - DNA, 75 bp, Artificial Sequence
  Synthetic
gtgttggctactttggcacttcttggatgtgatgtgtcaccatggcaatggctcaagaaaaaggcttgtgacata

SEQ ID NO: 81269 - DNA, 75 bp, Artificial Sequence
  Synthetic
gatgtgatgtgtcaccatggcaatggctcaagaaaaaggcttgtgacatattggaaattccatatgttatgcgcc

SEQ ID NO: 81270 - DNA, 75 bp, Artificial Sequence
  Synthetic
tttctaagttcattgattggttaaaggaaaagatcatcccacaggctagagacaagctagaatttgtcactaagc

SEQ ID NO: 81271 - DNA, 75 bp, Artificial Sequence
  Synthetic
ggaaaagatcatcccacaggctagagacaagctagaatttgtcactaagctaaaacaattggagatgctggaaaa

SEQ ID NO: 81272 - DNA, 75 bp, Artificial Sequence
  Synthetic
atctatacaatcaaaaagatttgccccgctttacgcggtagaagcaaaaaggatccagaaactggaacacacaat

SEQ ID NO: 81273 - DNA, 75 bp, Artificial Sequence
  Synthetic
ccgctttacgcggtagaagcaaaaaggatccagaaactggaacacacaattaacaactacatacagttcaagagc

SEQ ID NO: 81274 - DNA, 75 bp, Artificial Sequence
  Synthetic
ttccgcctatggcgtcactagaggagaaaggcatcttattcacctcaaattacgtgttggcctccaccaactcca

SEQ ID NO: 81275 - DNA, 75 bp, Artificial Sequence
  Synthetic
attgccagagcaatagcagagaaagagaacacttccacctattcgctaccaccagatccatctcacttcgatgga

SEQ ID NO: 81276 - DNA, 75 bp, Artificial Sequence
  Synthetic
agaacacttccacctattcgctaccaccagatccatctcacttcgatggatacaaacaacaaggagtggtaatta

SEQ ID NO: 81277 - DNA, 75 bp, Artificial Sequence
  Synthetic
aaagctcaacatggcaatggccacagaaatgtgcaagaactgccaccagccagcaaattttaaacggtgctgccc

SEQ ID NO: 81278 - DNA, 75 bp, Artificial Sequence
  Synthetic
ttccaccaatggcctcactagaggagaaaggtattctgtttacatcaaattatgtcctggcttctactaactcca

SEQ ID NO: 81279 - DNA, 75 bp, Artificial Sequence
  Synthetic
gaaaggtattctgtttacatcaaattatgtcctggcttctactaactccagccgcatcacaccacccacagttgc

SEQ ID NO: 81280 - DNA, 75 bp, Artificial Sequence
  Synthetic
gaaatgtgcaagaactgccaccagccagcaaattttaaacggtgctgccccctggtgtgtggtaaagcaatccaa

SEQ ID NO: 81281 - DNA, 75 bp, Artificial Sequence
  Synthetic
agatccaacattggcaattgcatggaagcactctttcaaggaccactccagtacagggatctgaagatagatgtc

SEQ ID NO: 81282 - DNA, 75 bp, Artificial Sequence
  Synthetic
aaaattgaatatggcgatggcaacagaaatgtgcaaaaattgccatcaaccatcaaacttcaagagatgttgccc

SEQ ID NO: 81283 - DNA, 75 bp, Artificial Sequence
  Synthetic
gaaatgtgcaaaaattgccatcaaccatcaaacttcaagagatgttgccccctggtgtgtggaaaagcaatccag

SEQ ID NO: 81284 - DNA, 75 bp, Artificial Sequence
  Synthetic
aagcactctttcaaggaccactccagtacagggatctgaagatagatgtcaaaactacaccaccaccagagtgta

SEQ ID NO: 81285 - DNA, 75 bp, Artificial Sequence
  Synthetic
tcaccagccaggttcagactgaaaggaacattaacagggctatgacaatattgcaagcagttactactttcgctg

SEQ ID NO: 81286 - DNA, 75 bp, Artificial Sequence
  Synthetic
agatctaacattggtaactgcatggaagcacttttccaaggtccgctccaatacaaggacttgaaaatcgacatt

SEQ ID NO: 81287 - DNA, 75 bp, Artificial Sequence
  Synthetic
aagcacttttccaaggtccgctccaatacaaggacttgaaaatcgacattaagactacacctcctccagagtgca

SEQ ID NO: 81288 - DNA, 75 bp, Artificial Sequence
  Synthetic
gaacattaacagggctatgacaatattgcaagcagttactactttcgctgcagtggcgggagtagtatatgttat

SEQ ID NO: 81289 - DNA, 75 bp, Artificial Sequence
  Synthetic
aactgctaaagtgcagggacctgggtttgattatgcagtggccatggctaaaagaaatattgtcactgccactac

SEQ ID NO: 81290 - DNA, 75 bp, Artificial Sequence
  Synthetic
tcacaagtgcagtgcaaaccgaaagaaatattaacagggctatgactatccttcaagcagttaccactttcgcag

SEQ ID NO: 81291 - DNA, 75 bp, Artificial Sequence
  Synthetic
aaatattaacagggctatgactatccttcaagcagttaccactttcgcagcggttgctggagtagtgtacgtaat

SEQ ID NO: 81292 - DNA, 75 bp, Artificial Sequence
  Synthetic
tagtaaaggggagttcactatgcttggtgtgcatgacaacgtggctgtgcttccaacgcacgcatcacctggcga

SEQ ID NO: 81293 - DNA, 75 bp, Artificial Sequence
  Synthetic
aactgccagagtacaaggcccagggtttgactacgcagtggcaatggccaaaagaaatatactcactgctactac

SEQ ID NO: 81294 - DNA, 75 bp, Artificial Sequence
  Synthetic
tgaaacaaacgatggagtgctgattgtgaacactagtaagtaccccaacatgtatgtgcctgtcggtgcagtgac

SEQ ID NO: 81295 - DNA, 75 bp, Artificial Sequence
  Synthetic
gagcattgtcattgatggtaaagaggtggaaatcctagacgccaaggctcttgaagaccaagctggcactaatct

SEQ ID NO: 81296 - DNA, 75 bp, Artificial Sequence
  Synthetic
gtggaaatcctagacgccaaggctcttgaagaccaagctggcactaatctagaaatcaccattatcaccctcaaa

SEQ ID NO: 81297 - DNA, 75 bp, Artificial Sequence
  Synthetic
tcaatgtggtggcatcatcacttgcactggcaaagtgattggaatgcatgttggagggaatggttcacacgggtt

SEQ ID NO: 81298 - DNA, 75 bp, Artificial Sequence
  Synthetic
actggcaaagtgattggaatgcatgttggagggaatggttcacacgggttcgctgcagccctaaaacgatcatac

SEQ ID NO: 81299 - DNA, 75 bp, Artificial Sequence
  Synthetic
gtgaacactagtaagtaccccaacatgtatattcctgtcggtgctgtgaccgaacaggggtatctcaatctcggt

SEQ ID NO: 81300 - DNA, 75 bp, Artificial Sequence
  Synthetic
tgtatattcctgtcggtgctgtgaccgaacaggggtatctcaatctcggtggccgccaaactgctcgtacactga

SEQ ID NO: 81301 - DNA, 75 bp, Artificial Sequence
  Synthetic
agcaaaactaaactagagcctagtgcctttcactacatctttgaaggtgtgaaggaacctgcagtgctcactaag

SEQ ID NO: 81302 - DNA, 75 bp, Artificial Sequence
  Synthetic
cctttcactacatctttgaaggtgtgaaggaacctgcagtgctcactaagaatgatcccaggctaaaagctgact

SEQ ID NO: 81303 - DNA, 75 bp, Artificial Sequence
  Synthetic
ttggagggaacggttcacatgggttcgcagcagccctgaaacggtcatacttcactcagagccaaggtgaaattc

SEQ ID NO: 81304 - DNA, 75 bp, Artificial Sequence
  Synthetic
accactatgcaggacaattgatgtcgctcgatattaacactgatcagatgtgcttggaggatgccatgtacggaa

SEQ ID NO: 81305 - DNA, 75 bp, Artificial Sequence
  Synthetic
gctcgatattaacactgatcagatgtgcttggaggatgccatgtacggaactgatggattggaagcactagatct

SEQ ID NO: 81306 - DNA, 75 bp, Artificial Sequence
  Synthetic
cttttcactatgtgtttgagggagtcaaagagccggccgtgcttactaagaatgaccctagactgaaaacagatt

SEQ ID NO: 81307 - DNA, 75 bp, Artificial Sequence
  Synthetic
caaagagccggccgtgcttactaagaatgaccctagactgaaaacagattttgaagaggccatcttctcaaagta

SEQ ID NO: 81308 - DNA, 75 bp, Artificial Sequence
  Synthetic
cactaaggaaatgcaaagactacttgacacatatggcatcaacttgccattggtcacatatgtaaaggatgagct

SEQ ID NO: 81309 - DNA, 75 bp, Artificial Sequence
  Synthetic
gacacatatggcatcaacttgccattggtcacatatgtaaaggatgagcttaggtcaaaaaccaaagtggaacag

SEQ ID NO: 81310 - DNA, 75 bp, Artificial Sequence
  Synthetic
tttagacatcaacacagagcaaatgtgcctggaggatgcaatgtatggcacagacggtcttgaagccctagacct

SEQ ID NO: 81311 - DNA, 75 bp, Artificial Sequence
  Synthetic
tgcctggaggatgcaatgtatggcacagacggtcttgaagccctagacctcagcaccagtgctggatacccctac

SEQ ID NO: 81312 - DNA, 75 bp, Artificial Sequence
  Synthetic
gcagcattccataaaaacccaggtgtagtaacaggatcggcagtcggttgtgacccagatttgttttggagtaag

SEQ ID NO: 81313 - DNA, 75 bp, Artificial Sequence
  Synthetic
tagtaacaggatcggcagtcggttgtgacccagatttgttttggagtaagataccagttttgatggaagaaaagc

SEQ ID NO: 81314 - DNA, 75 bp, Artificial Sequence
  Synthetic
gacacctatggaatcaatttaccattagtcacctatgttaaagatgaactcagatccagaactaaggtggagcag

SEQ ID NO: 81315 - DNA, 75 bp, Artificial Sequence
  Synthetic
tagtcacctatgttaaagatgaactcagatccagaactaaggtggagcagggcaaatctagattgattgaagcct

SEQ ID NO: 81316 - DNA, 75 bp, Artificial Sequence
  Synthetic
aaaagataggatttggggatagggtagattacattgattacctcaaccactcacaccacctttataagaacaaga

SEQ ID NO: 81317 - DNA, 75 bp, Artificial Sequence
  Synthetic
tggtgacaggctcagctgtaggttgtgaccctgacttgttttggagcaagattccagttttaatggaggagaaac

SEQ ID NO: 81318 - DNA, 75 bp, Artificial Sequence
  Synthetic
catactgtgtcaagggcggcatgccatctggctgctccggcacttcaatctttaactcaatgattaataacttga

SEQ ID NO: 81319 - DNA, 75 bp, Artificial Sequence
  Synthetic
agaaaatagggtttggagatagagtagattacatagattacttaaaccactcacaccacctctacaaaaataaaa

SEQ ID NO: 81320 - DNA, 75 bp, Artificial Sequence
  Synthetic
tcaggaaaagactatggactaaccatgacaccagctgacaaatcagctacttttgaaaaagtcacgtgggaaaat

SEQ ID NO: 81321 - DNA, 75 bp, Artificial Sequence
  Synthetic
ctacaagggcatagatttagaccacctaaaaatgattgcctatggtgatgatgtaattgcttcctacccccatga

SEQ ID NO: 81322 - DNA, 75 bp, Artificial Sequence
  Synthetic
gaaattcatgagtcaatcagatggacaaaagatcctagaaacacccaggatcatgtacgctcattgtgcttattg

SEQ ID NO: 81323 - DNA, 75 bp, Artificial Sequence
  Synthetic
tcaggaaaagactacggactaacaatgactccagctgacaaatcggcgacatttgaaacagtcacatgggagaat

SEQ ID NO: 81324 - DNA, 75 bp, Artificial Sequence
  Synthetic
acaataaatttttagctaaaatcaggagtgtgccaatcggaagagcattactgctccctgagtactcaacactgt

SEQ ID NO: 81325 - DNA, 75 bp, Artificial Sequence
  Synthetic
ccaaagatcctagaaacacgcaggatcacgtgcgctctttgtgcttattggcttggcacaatggcgaagaagaat

SEQ ID NO: 81326 - DNA, 75 bp, Artificial Sequence
  Synthetic
cagaggcccacgtggcggctagcactccggtattacggtacccttgtgcgcctgttttatactcccctcccgcaa

SEQ ID NO: 81327 - DNA, 75 bp, Artificial Sequence
  Synthetic
ctacgaacaagcacttctgtttccccggtgacattgcatagactgctcacgcggttgaaagtgatcgatccgtta

SEQ ID NO: 81328 - DNA, 75 bp, Artificial Sequence
  Synthetic
tgaacaaggtgtgaagagcctattgagctacataagagtcctccggcccctgaatgcggctaatcctaaccacgg

SEQ ID NO: 81329 - DNA, 75 bp, Artificial Sequence
  Synthetic
ggcttgtcgtaacgcgcaagtctgtggcggaaccgactactttgggtgtccgtgtttcctgttatttttatcatg

SEQ ID NO: 81330 - DNA, 75 bp, Artificial Sequence
  Synthetic
gctgcttatggtgacaatcagagattgttatcataaagcgaattggattggccatccggtgagtgttgtgtcagg

SEQ ID NO: 81331 - DNA, 75 bp, Artificial Sequence
  Synthetic
tgttatcataaagcgaattggattggccatccggtgagtgttgtgtcaggtatacaactgtttgttggaaccact

SEQ ID NO: 81332 - DNA, 75 bp, Artificial Sequence
  Synthetic
acacactatgttgggtgagatattaaattactacacacactgggcagggtccttgaaatttacctttctcttttg

SEQ ID NO: 81333 - DNA, 75 bp, Artificial Sequence
  Synthetic
aattactacacacactgggcagggtccttgaaatttacctttctcttttgcggctcaatgatggccaccggaaag

SEQ ID NO: 81334 - DNA, 75 bp, Artificial Sequence
  Synthetic
atccagagacgaacgcgatcagagtccacggttgagtcattctttgcaagaggggcttgcgtggctatcattgag

SEQ ID NO: 81335 - DNA, 75 bp, Artificial Sequence
  Synthetic
gttttacacctatggggcgcccccagcaagaatatcagtgccctacgtgggaattgctaatgcgtattcccactt

SEQ ID NO: 81336 - DNA, 75 bp, Artificial Sequence
  Synthetic
gcaagaatatcagtgccctacgtgggaattgctaatgcgtattcccacttttatgatgggtttgcaaaagtacca

SEQ ID NO: 81337 - DNA, 75 bp, Artificial Sequence
  Synthetic
cacttgtgatcattaccaggaattatgaggacactaccacagtgcttgccaccctcgccctccttgggtgcgaca

SEQ ID NO: 81338 - DNA, 75 bp, Artificial Sequence
  Synthetic
cagtgttttacacctatggggcgcccccagcaagaatatcagtgccctacgtgggaattgctaatgcgtattccc

SEQ ID NO: 81339 - DNA, 75 bp, Artificial Sequence
  Synthetic
gagcagggcatttccaactacatcgaatcccttggagctgcgtttggaagtggattcactcaacaaattggggat

SEQ ID NO: 81340 - DNA, 75 bp, Artificial Sequence
  Synthetic
tctaaaaatagatgttaagaccagtccccctccggagtgtatcaacgatttgctccaggcagttgattcccagga

SEQ ID NO: 81341 - DNA, 75 bp, Artificial Sequence
  Synthetic
tcatcactagtcatcatcaccagaaattatgaagataccaccacagtgctcgccactttggccctccttggatgt

SEQ ID NO: 81342 - DNA, 75 bp, Artificial Sequence
  Synthetic
attatgaagataccaccacagtgctcgccactttggccctccttggatgtgatgtatccccctggcagtggctta

SEQ ID NO: 81343 - DNA, 75 bp, Artificial Sequence
  Synthetic
aagcatgtaatgctgctaaagggttggagtgggtgtcaaacaaaatatctaagttcattgattggctaaaggaaa

SEQ ID NO: 81344 - DNA, 75 bp, Artificial Sequence
  Synthetic
gcagtggccatggctaaaagaaacattgttacagcaaccaccagcaaaggggagtttacgatgttgggagtctat

SEQ ID NO: 81345 - DNA, 75 bp, Artificial Sequence
  Synthetic
ggagtgggtgtcaaacaaaatatctaagttcattgattggctaaaggaaaagatcatcccgcaagccagagacaa

SEQ ID NO: 81346 - DNA, 75 bp, Artificial Sequence
  Synthetic
aagtcaagaacaccaggaaattttattcaacaatgtgagatggctatcaatacaatcaaagaggtttgcaccact

SEQ ID NO: 81347 - DNA, 75 bp, Artificial Sequence
  Synthetic
ttcaacaatgtgagatggctatcaatacaatcaaagaggtttgcaccactttacgcagtggaagcgaaacgaatc

SEQ ID NO: 81348 - DNA, 75 bp, Artificial Sequence
  Synthetic
ttcccacccaaatcaccgaaacaaatgatggagttttgatcgtgaacactagtaagtaccccaacatgtatgttc

SEQ ID NO: 81349 - DNA, 75 bp, Artificial Sequence
  Synthetic
gtacatggtagcccgggcacaggaaaatcagtagccaccaacttgattgctagagccattgcggaaaaagaaaac

SEQ ID NO: 81350 - DNA, 75 bp, Artificial Sequence
  Synthetic
aatcagtagccaccaacttgattgctagagccattgcggaaaaagaaaacacttccacctactcactgccaccag

SEQ ID NO: 81351 - DNA, 75 bp, Artificial Sequence
  Synthetic
ctgacatgaaactcttctgtcaaatggtctccactgtggaatttattccacctatggcatctctggaagagaagg

SEQ ID NO: 81352 - DNA, 75 bp, Artificial Sequence
  Synthetic
ggtctccactgtggaatttattccacctatggcatctctggaagagaagggcattcttttcacatcagactatgt

SEQ ID NO: 81353 - DNA, 75 bp, Artificial Sequence
  Synthetic
atttgacatggacattcaggtcatgggtgagtattccagggatggaaaactaaacatggcgatggcaacagaaat

SEQ ID NO: 81354 - DNA, 75 bp, Artificial Sequence
  Synthetic
ggtgagtattccagggatggaaaactaaacatggcgatggcaacagaaatgtgcaaaaactgtcatcaaccagca

SEQ ID NO: 81355 - DNA, 75 bp, Artificial Sequence
  Synthetic
agtgttgatcagattaccactatgatcattaatgagagaaacaggaggtctaacattggaaactgcatggaagca

SEQ ID NO: 81356 - DNA, 75 bp, Artificial Sequence
  Synthetic
tcattaatgagagaaacaggaggtctaacattggaaactgcatggaagcactatttcagggtccactacagtaca

SEQ ID NO: 81357 - DNA, 75 bp, Artificial Sequence
  Synthetic
aggaagttagagactactgtgagaagaaaggctggattgtcaacatcactagccaagtgcaaacagaaaggaata

SEQ ID NO: 81358 - DNA, 75 bp, Artificial Sequence
  Synthetic
gaaaggctggattgtcaacatcactagccaagtgcaaacagaaaggaatattaacagggcaatgaccatactaca

SEQ ID NO: 81359 - DNA, 75 bp, Artificial Sequence
  Synthetic
atatacaggcttacctaacaaaagacccaatgttcctacaattagaactgctaaagtacaaggcccaggctttga

SEQ ID NO: 81360 - DNA, 75 bp, Artificial Sequence
  Synthetic
cccaatgttcctacaattagaactgctaaagtacaaggcccaggctttgattatgccgtcgccatggccaaaaga

SEQ ID NO: 81361 - DNA, 75 bp, Artificial Sequence
  Synthetic
tgattacctcaaccattcccaccacctgtacaaaaacaaaacttattgcgtaaaaggcggcatgccatctggctg

SEQ ID NO: 81362 - DNA, 75 bp, Artificial Sequence
  Synthetic
acccatgcctcaccaggtgagacgatagtcattgatggcaaggaaattgaggtgttagatgctaaggcactagag

SEQ ID NO: 81363 - DNA, 75 bp, Artificial Sequence
  Synthetic
tagtcattgatggcaaggaaattgaggtgttagatgctaaggcactagaggatcaagctggtaccaatttggaga

SEQ ID NO: 81364 - DNA, 75 bp, Artificial Sequence
  Synthetic
caagtgatggagtcctgatcgtgaacactagtaagtaccccaacatgtacgttcctgttggtgctgtgactgagc

SEQ ID NO: 81365 - DNA, 75 bp, Artificial Sequence
  Synthetic
gactatggactaaccatgactccagcagacaagtcagctacctttgaaacagtcacatgggagaatgtaacattc

SEQ ID NO: 81366 - DNA, 75 bp, Artificial Sequence
  Synthetic
cactagtaagtaccccaacatgtacgttcctgttggtgctgtgactgagcagggatatctcaatctcggaggccg

SEQ ID NO: 81367 - DNA, 75 bp, Artificial Sequence
  Synthetic
aaaggtcatagggatgcatgttggagggaacggttcacacgggtttgcagcggccctaaagcgatcttacttcac

SEQ ID NO: 81368 - DNA, 75 bp, Artificial Sequence
  Synthetic
gggaacggttcacacgggtttgcagcggccctaaagcgatcttacttcactcagagtcaaggtgaaattcaatgg

SEQ ID NO: 81369 - DNA, 75 bp, Artificial Sequence
  Synthetic
cactatgtgtttgagggtgtgaaggaaccagctgttttaaccaagaatgatcccagacttaaggtagattttgag

SEQ ID NO: 81370 - DNA, 75 bp, Artificial Sequence
  Synthetic
aaccagctgttttaaccaagaatgatcccagacttaaggtagattttgaggaggcaatattctccaaatatgtag

SEQ ID NO: 81371 - DNA, 75 bp, Artificial Sequence
  Synthetic
atattaacacagaccagatgtgcttggaggatgcaatgtacggcacagatggtttagaagccctggacttaacaa

SEQ ID NO: 81372 - DNA, 75 bp, Artificial Sequence
  Synthetic
ggaggatgcaatgtacggcacagatggtttagaagccctggacttaacaactagtgcgggttacccctatgtagc

SEQ ID NO: 81373 - DNA, 75 bp, Artificial Sequence
  Synthetic
atatggtatcaacctcccattagttacttatgttaaagatgaactaagatccaagagtaaggttgagcaaggaaa

SEQ ID NO: 81374 - DNA, 75 bp, Artificial Sequence
  Synthetic
acttatgttaaagatgaactaagatccaagagtaaggttgagcaaggaaagtcaagacttattgaagcgtccagc

SEQ ID NO: 81375 - DNA, 75 bp, Artificial Sequence
  Synthetic
cccacgtggcggctagtacactggtatcacggtacctttgtacgcctgttttacactccctccccccgcaactta

SEQ ID NO: 81376 - DNA, 75 bp, Artificial Sequence
  Synthetic
actgggagtgcagtgggctgtgacccagacttattttggagtaaaattccagttctcatggaagagaagttgttt

SEQ ID NO: 81377 - DNA, 75 bp, Artificial Sequence
  Synthetic
attggctttggcgatagagtagactacatagattatctcaaccactcacatcacctttataggaacaaaacatat

SEQ ID NO: 81378 - DNA, 75 bp, Artificial Sequence
  Synthetic
tccccaggagactgcggaggaatcctcaggtgtcaacacggggttataggcataatcactgcagggggtgaaggc

SEQ ID NO: 81379 - DNA, 75 bp, Artificial Sequence
  Synthetic
atcgaatctctcggggccgccttcgggagcggtttcactcaacaaattggagacaaaatctcagaattgactagc

SEQ ID NO: 81380 - DNA, 75 bp, Artificial Sequence
  Synthetic
ggagcggtttcactcaacaaattggagacaaaatctcagaattgactagcatggtcactagtactattacagaaa

SEQ ID NO: 81381 - DNA, 75 bp, Artificial Sequence
  Synthetic
tactagcaactctcgcactactgggatgtgacgtctcaccgtggcaatggcttaaaaagaaagcttgtgacatac

SEQ ID NO: 81382 - DNA, 75 bp, Artificial Sequence
  Synthetic
tggaaatcccatatgtgattcgccaaggtgatagttggctcaagaagtttacagaggcctgcaatgcggccaagg

SEQ ID NO: 81383 - DNA, 75 bp, Artificial Sequence
  Synthetic
ctctaaattcatcgactggttgaaagagagaataatccctcaggcaagagacaagcttgaatttgtgacgaaact

SEQ ID NO: 81384 - DNA, 75 bp, Artificial Sequence
  Synthetic
gagagaataatccctcaggcaagagacaagcttgaatttgtgacgaaactcaagcaactagaaatgttggaaaat

SEQ ID NO: 81385 - DNA, 75 bp, Artificial Sequence
  Synthetic
tccattcagtcaaagaggtttgcgcctctatatgcagttgaagcaaaaaggatccaaaagctggaacacaccatt

SEQ ID NO: 81386 - DNA, 75 bp, Artificial Sequence
  Synthetic
ctctatatgcagttgaagcaaaaaggatccaaaagctggaacacaccattaacaattacatacagttcaagagca

SEQ ID NO: 81387 - DNA, 75 bp, Artificial Sequence
  Synthetic
ttgcaagagcaatagctgagaaagagaatacgtccacttactcactaccaccagatccctcacactttgatgggt

SEQ ID NO: 81388 - DNA, 75 bp, Artificial Sequence
  Synthetic
gaatacgtccacttactcactaccaccagatccctcacactttgatgggtacaaacaacaaggagtgattattat

SEQ ID NO: 81389 - DNA, 75 bp, Artificial Sequence
  Synthetic
tcccccaatggcttctctagaggaaaagggaattctcttcacgtccaattatgtactggcctccaccaattccag

SEQ ID NO: 81390 - DNA, 75 bp, Artificial Sequence
  Synthetic
aagggaattctcttcacgtccaattatgtactggcctccaccaattccagcagaataacacccccgaccgtggcc

SEQ ID NO: 81391 - DNA, 75 bp, Artificial Sequence
  Synthetic
atgatcacaaccccactaaagtaacctccaaagtccgcatttacatgaaacccaaacacgtacgtgtctggtgcc

SEQ ID NO: 81392 - DNA, 75 bp, Artificial Sequence
  Synthetic
aaacttaatatggcaatggccactgagatgtgcaagaactgccaccaacccgcaaatttcaaaaggtgttgtccc

SEQ ID NO: 81393 - DNA, 75 bp, Artificial Sequence
  Synthetic
atgatcatcaacgagcgaaacagacgctctaacattggaaattgcatggaagccctatttcaaggcccggtccag

SEQ ID NO: 81394 - DNA, 75 bp, Artificial Sequence
  Synthetic
aagctcaaggtaccgactcaatagcaaggtgcaattgcaatgcaggggtgtactattgtgagtccagaaggaaat

SEQ ID NO: 81395 - DNA, 75 bp, Artificial Sequence
  Synthetic
gctctaacattggaaattgcatggaagccctatttcaaggcccggtccagtacaaggatctcaagatagatatca

SEQ ID NO: 81396 - DNA, 75 bp, Artificial Sequence
  Synthetic
tgcctcaccaggtgactgtggtggtatccttaggtgtcaacatggcgtcatcggaatcgtgacagctggtggaga

SEQ ID NO: 81397 - DNA, 75 bp, Artificial Sequence
  Synthetic
ttgaggtgttggacgccaaggcgcttgaagaccaagcgggcactaatttagaaatcaccattgtcaccctcaaga

SEQ ID NO: 81398 - DNA, 75 bp, Artificial Sequence
  Synthetic
atttactgaggcgtgcaacgcagctaaggggttggaatgggtgtccaacaaaatctcaaaatttattgattggct

SEQ ID NO: 81399 - DNA, 75 bp, Artificial Sequence
  Synthetic
gaaccaaattgcgaccattcaccagtcgtgccctagccaagaacatcaggaaattctgtttaacaatgtgaggtg

SEQ ID NO: 81400 - DNA, 75 bp, Artificial Sequence
  Synthetic
tggagggaacggttcacatgggtttgctgcggccctgaagcgatcatacttcgttcagaatcaaggtgagataca

SEQ ID NO: 81401 - DNA, 75 bp, Artificial Sequence
  Synthetic
ctagccgcattacaccaccaacagtggcacacagtgacgcgctagccagacggtttgcatttgacatggacattc

SEQ ID NO: 81402 - DNA, 75 bp, Artificial Sequence
  Synthetic
cccacttgtgtgcggaaaagctatccaattgatggacaagtcatccagggtcagatacagcattgaccaaattac

SEQ ID NO: 81403 - DNA, 75 bp, Artificial Sequence
  Synthetic
gcagtacaaagacttaaagattgacataaagactacaccccctcccgagtgtataaacgacctacttcaagcggt

SEQ ID NO: 81404 - DNA, 75 bp, Artificial Sequence
  Synthetic
cagggagcctacactggacttcccaccaaacggcccaatgtccctaccattaggacagctaaagtgcaaggccca

SEQ ID NO: 81405 - DNA, 75 bp, Artificial Sequence
  Synthetic
taggacagctaaagtgcaaggcccagggtttgattacgcagtggctatggccaaaaggaacatcctcacagcaac

SEQ ID NO: 81406 - DNA, 75 bp, Artificial Sequence
  Synthetic
acatgtatgtcccagttggtgctgtgaccgagcagggatatctcaatctcggtggccgtcaaactgctcgcactc

SEQ ID NO: 81407 - DNA, 75 bp, Artificial Sequence
  Synthetic
atgttggagggaacggttcgcatgggtttgcagcagccctaaagcgatcatacttcactcagagtcaaggtgaaa

SEQ ID NO: 81408 - DNA, 75 bp, Artificial Sequence
  Synthetic
tgttaaggagcctgcagtcttgaccaagaatgacccaagactcaaaactgattttgaagaagccattttctcaaa

SEQ ID NO: 81409 - DNA, 75 bp, Artificial Sequence
  Synthetic
aagtctgtggcggaaccgactactttgggtgtccgtgtttccttttatttttacattggctgcttatggtgacaa

SEQ ID NO: 81410 - DNA, 75 bp, Artificial Sequence
  Synthetic
ttacattggctgcttatggtgacaatcgaagattgttatcataaagcgagttggattggccatccggtgaaagta

SEQ ID NO: 81411 - DNA, 75 bp, Artificial Sequence
  Synthetic
tatgcagcattccacaagaatccaggtgtagtgacgggatcagctgttgggtgtgatccagacttgttttggagc

SEQ ID NO: 81412 - DNA, 75 bp, Artificial Sequence
  Synthetic
tgaggttgacgctagtctcctagcccaatcaggaaaagactatggactaaccatgactccagctgacaaatcagc

SEQ ID NO: 81413 - DNA, 75 bp, Artificial Sequence
  Synthetic
ccatgactccagctgacaaatcagcaacctttgaaaaagtcacatgggagaatgtaacattcttgaaaagattct

SEQ ID NO: 81414 - DNA, 75 bp, Artificial Sequence
  Synthetic
actcacatgttcacaaagtacgagaatgcgaatccaggcgaaaaaggaggtgaattcaaagggagtttcaccctt

SEQ ID NO: 81415 - DNA, 75 bp, Artificial Sequence
  Synthetic
agaggctatgccacaaggaattggtgacatgattgagggggccgttgaagggattactaaaaatgcattggttcc

SEQ ID NO: 81416 - DNA, 75 bp, Artificial Sequence
  Synthetic
tacttcggaccaggtgttgattataaagatgggctcaccccactaccagaaaagggattaacgacttatggattt

SEQ ID NO: 81417 - DNA, 75 bp, Artificial Sequence
  Synthetic
cactagtaagtaccccaacatgtatgttcctgtcggtgctgtgactgagcagggatacctaaatctcggtgggcg

SEQ ID NO: 81418 - DNA, 75 bp, Artificial Sequence
  Synthetic
caaacaaggagatagttggttgaagaaattcactgaggcatgtaatgctgcaaagggactggagtgggtgtccaa

SEQ ID NO: 81419 - DNA, 75 bp, Artificial Sequence
  Synthetic
aaattcactgaggcatgtaatgctgcaaagggactggagtgggtgtccaataagatatccaaattcattagttgg

SEQ ID NO: 81420 - DNA, 75 bp, Artificial Sequence
  Synthetic
ttgcaccactatatgcacatgaagctaaaaggattcagaagctggaacacgccattaacaactacatacagttca

SEQ ID NO: 81421 - DNA, 75 bp, Artificial Sequence
  Synthetic
atctgatcgctagagccattgcagagaaagagaatacatccacttactcgctaccaccagacccatcccactttg

SEQ ID NO: 81422 - DNA, 75 bp, Artificial Sequence
  Synthetic
gaaagagaatacatccacttactcgctaccaccagacccatcccactttgatggttacaaacaacagggagttgt

SEQ ID NO: 81423 - DNA, 75 bp, Artificial Sequence
  Synthetic
gtttataccaccaatggcatcactggaggaaaaaggcatcctattcacgtcaaattacgtcttggcatccaccaa

SEQ ID NO: 81424 - DNA, 75 bp, Artificial Sequence
  Synthetic
gaggaaaaaggcatcctattcacgtcaaattacgtcttggcatccaccaactctagtcgaatcaccccacccact

SEQ ID NO: 81425 - DNA, 75 bp, Artificial Sequence
  Synthetic
gatggtaagttgaacatggcgatggcgactgagatgtgtaaaaactgccaccaaccagcaaacttcaaaaggtgc

SEQ ID NO: 81426 - DNA, 75 bp, Artificial Sequence
  Synthetic
cgactgagatgtgtaaaaactgccaccaaccagcaaacttcaaaaggtgctgcccgttagtgtgtggaaaagcca

SEQ ID NO: 81427 - DNA, 75 bp, Artificial Sequence
  Synthetic
atagaagatccaacattggtaactgcatggaggcgctgttccaaggcccactgcagtacaaagacttaaaaatag

SEQ ID NO: 81428 - DNA, 75 bp, Artificial Sequence
  Synthetic
catggaggcgctgttccaaggcccactgcagtacaaagacttaaaaatagacattaagacctcacccccacccga

SEQ ID NO: 81429 - DNA, 75 bp, Artificial Sequence
  Synthetic
gaatattacaagccaggtccaaaccgaaagaaatatcaacagagcaatgaccatcctacaagcagtcactacgtt

SEQ ID NO: 81430 - DNA, 75 bp, Artificial Sequence
  Synthetic
gaaagaaatatcaacagagcaatgaccatcctacaagcagtcactacgtttgcagcagtcgcaggagtggtgtat

SEQ ID NO: 81431 - DNA, 75 bp, Artificial Sequence
  Synthetic
acgctagtctcctagcccaatcaggaaaagactatggactaaccatgactccggcagataaatctgccacttttg

SEQ ID NO: 81432 - DNA, 75 bp, Artificial Sequence
  Synthetic
atcagaactgctaaggtgcagggtccaggttttgattacgcagtggctatggccaagagaaacatccttacggca

SEQ ID NO: 81433 - DNA, 75 bp, Artificial Sequence
  Synthetic
ggagataccatagtcattgatggaaaggaaatagaggtgctagatgctgaggcactagaggaccaggctggtact

SEQ ID NO: 81434 - DNA, 75 bp, Artificial Sequence
  Synthetic
taacatgtacgttcctgttggtgctgtgaccgaacagggatatctcaatctcggtggacgccagactgctcgcac

SEQ ID NO: 81435 - DNA, 75 bp, Artificial Sequence
  Synthetic
gcatgttggcgggaacggttcgcatgggtttgcagcagccctaaagcgttcttacttcactcagagccaaggtga

SEQ ID NO: 81436 - DNA, 75 bp, Artificial Sequence
  Synthetic
gggtttgcagcagccctaaagcgttcttacttcactcagagccaaggtgaaattcagtggatgagaccttcaaaa

SEQ ID NO: 81437 - DNA, 75 bp, Artificial Sequence
  Synthetic
ggtgtgaaagaaccagcagtcctaaccaagaacgaccccagacttaaagcagattttgaagaggcaatcttttca

SEQ ID NO: 81438 - DNA, 75 bp, Artificial Sequence
  Synthetic
cgccgtaccagagatgtgtctggccggggatagcaacaccactaccatgtacaccagctatcaaaatgccaatcc

SEQ ID NO: 81439 - DNA, 75 bp, Artificial Sequence
  Synthetic
ccaagaacgaccccagacttaaagcagattttgaagaggcaatcttttcaaagtacgtgggcaacaaaatcactg

SEQ ID NO: 81440 - DNA, 75 bp, Artificial Sequence
  Synthetic
agatgtgcctggaagatgccatgtatgggaccgacggtctagaagctttagatctcacaactagtgcagggtatc

SEQ ID NO: 81441 - DNA, 75 bp, Artificial Sequence
  Synthetic
tgggaccgacggtctagaagctttagatctcacaactagtgcagggtatccttacgtagccctggggaaaaagaa

SEQ ID NO: 81442 - DNA, 75 bp, Artificial Sequence
  Synthetic
acctctggtcacttacgttaaggatgagttaaggtcaaagagcaaagttgaacagggcaaatcaagacttattga

SEQ ID NO: 81443 - DNA, 75 bp, Artificial Sequence
  Synthetic
gagttaaggtcaaagagcaaagttgaacagggcaaatcaagacttattgaagcttccagtctaaatgactcagtg

SEQ ID NO: 81444 - DNA, 75 bp, Artificial Sequence
  Synthetic
catcagagtctggtgcccgcgtccaccgagggcagtggcgtactacggccctggagtggattacaaggatggtac

SEQ ID NO: 81445 - DNA, 75 bp, Artificial Sequence
  Synthetic
gggtgcgacccggatctgttttggagtaagatcccggttcttatggaggagaagttgtttgccttcgattacact

SEQ ID NO: 81446 - DNA, 75 bp, Artificial Sequence
  Synthetic
agggtggactacatagattaccttaatcactcacatcatttgtataaaaacaaaacatattgtgtcaagggtggc

SEQ ID NO: 81447 - DNA, 75 bp, Artificial Sequence
  Synthetic
aaaacctacaagggcatagatttagaccacctaaagatgatagcctatggtgatgatgtaattgcttcctacccc

SEQ ID NO: 81448 - DNA, 75 bp, Artificial Sequence
  Synthetic
tgatgatgtaattgcttcctacccccatgaagtggacgctagtctcctagcccaatcaggaaaagactatggact

SEQ ID NO: 81449 - DNA, 75 bp, Artificial Sequence
  Synthetic
gaggaggcaattttctccaagtacgtgggtaacaaaattactgaagtggatgagtacatgaaagaggcagtagac

SEQ ID NO: 81450 - DNA, 75 bp, Artificial Sequence
  Synthetic
ctttagagcagatgagaagtatccattcctcattcatccagtgatgccaatgagggaaattcatgaatcaattag

SEQ ID NO: 81451 - DNA, 75 bp, Artificial Sequence
  Synthetic
atggaccaaggatcccagaaacacacaggatcatgtacgctctttgtgcctattggcttggcacaacggagagga

SEQ ID NO: 81452 - DNA, 75 bp, Artificial Sequence
  Synthetic
ctagttgtgaacagggtgtgaagagcctattgagctacatgagagtcctccggcccctgaatgcggctaatccta

SEQ ID NO: 81453 - DNA, 75 bp, Artificial Sequence
  Synthetic
aattggattggccatccggtgaaagtcagatcaactatttatttgtttgttggaaccactgtgttagctttactt

SEQ ID NO: 81454 - DNA, 75 bp, Artificial Sequence
  Synthetic
agcagccagcctgtcgtaacgcgcaagtccgtggcggaaccgactactttgggtgtccgtgtttccttttattct

SEQ ID NO: 81455 - DNA, 75 bp, Artificial Sequence
  Synthetic
tggctacaaaatttgcaattaccacctagctacacaagaagacttgcaaaatgccgtgagtgtcatgtggaacag

SEQ ID NO: 81456 - DNA, 75 bp, Artificial Sequence
  Synthetic
tatccagtttctttcattggacccaccttccaatacatggaagccaatgaatattacccggctagatatcaatca

SEQ ID NO: 81457 - DNA, 75 bp, Artificial Sequence
  Synthetic
ggtgctgcgttcggtagtgggttcactcagcaaataggggataagatatcagaactaaccagcatggtgaccagc

SEQ ID NO: 81458 - DNA, 75 bp, Artificial Sequence
  Synthetic
ctcctgaatgtatcaatgacttgctccaagcagttgactcccaggaggtgagagattactgtgagaagaagggtt

SEQ ID NO: 81459 - DNA, 75 bp, Artificial Sequence
  Synthetic
gatggcaaagaagtggagatcttggatgccaaagcgctcgaagatcaagcaggaaccaatcttgaaatcactata

SEQ ID NO: 81460 - DNA, 75 bp, Artificial Sequence
  Synthetic
ttcacacgggtttgcagcggccctgaagcgatcatacttcactcagagtcaaggtgaaatccagtggatgagacc

SEQ ID NO: 81461 - DNA, 75 bp, Artificial Sequence
  Synthetic
ctacacagggtatgatgcatctctcagccctgcttggttcgaggcactaaagatggtgcttgagaaaatcggatt

SEQ ID NO: 81462 - DNA, 75 bp, Artificial Sequence
  Synthetic
ctcctagcccaatcaggaaaagactatggactaactatgactccagctgacaaatcagctacatttgaaacagtc

SEQ ID NO: 81463 - DNA, 75 bp, Artificial Sequence
  Synthetic
tgactcattttagtaaccctacctcagtcgaattggattgggttatactgctgtaggggtaaatttttctttaat

SEQ ID NO: 81464 - DNA, 75 bp, Artificial Sequence
  Synthetic
accccagaggcccacgtggcggctagtactccggtattgcggtacccttgtacgcctgttttatactcccttccc

SEQ ID NO: 81465 - DNA, 75 bp, Artificial Sequence
  Synthetic
ttgcgtggtcgaaagcgacggatccgtcatccgcttatgtacttcgagaagcccagtaccacctcgggatcttcg

SEQ ID NO: 81466 - DNA, 75 bp, Artificial Sequence
  Synthetic
atggctgcttatggtgacaatcacagattgttatcataaagcgaattggattggccatccggtgaaagtgagatt

SEQ ID NO: 81467 - DNA, 75 bp, Artificial Sequence
  Synthetic
tcaccattgtcactcttaagagaaatgagaagttcagggacatcagaccacacatccccactcaaatcactgaga

SEQ ID NO: 81468 - DNA, 75 bp, Artificial Sequence
  Synthetic
ctgccacgtttgcagggcctgccggttatgaacacccctggtagtaatcaatatcttactgcagacaacttccag

SEQ ID NO: 81469 - DNA, 75 bp, Artificial Sequence
  Synthetic
acgatcccatactctgcctgtcactctccccagcttcagatccaaggttgtcacatactatgctaggagaaattt

SEQ ID NO: 81470 - DNA, 75 bp, Artificial Sequence
  Synthetic
taaattactacacacactgggcaggatccctgaagttcacgtttctgttctgtggatccatgatggcaactggca

SEQ ID NO: 81471 - DNA, 75 bp, Artificial Sequence
  Synthetic
cggatacatcagcgtcttctaccaaaccagaatagtcgtccctctttcgacacccagagagatggacatccttgg

SEQ ID NO: 81472 - DNA, 75 bp, Artificial Sequence
  Synthetic
tcttagtcacagaatcaagagcccagggcaccgattcgatcgcaaggtgcaattgcaacgcaggggtgtactact

SEQ ID NO: 81473 - DNA, 75 bp, Artificial Sequence
  Synthetic
cgtgaacactagtaagtaccccaatatgtatgtccccgttggtgctgtgaccgaacagggatatctcaatcttgg

SEQ ID NO: 81474 - DNA, 75 bp, Artificial Sequence
  Synthetic
agtatccttcgttggtccaacgttccagtacatggaagctaacgactattacccagctaggtaccagtcccattt

SEQ ID NO: 81475 - DNA, 75 bp, Artificial Sequence
  Synthetic
gatgtcaccacggggtgatagggatcgttactgctggtggagaagggctggttgcatttgcagacattagagact

SEQ ID NO: 81476 - DNA, 75 bp, Artificial Sequence
  Synthetic
cactggtaaggtcattgggatgcatgttggtgggaacggttcacatgggtttgcagcatccctaaagcgatctta

SEQ ID NO: 81477 - DNA, 75 bp, Artificial Sequence
  Synthetic
gttggtgggaacggttcacatgggtttgcagcatccctaaagcgatcttacttcactcagagtcaaggcgaaatt

SEQ ID NO: 81478 - DNA, 75 bp, Artificial Sequence
  Synthetic
gtgggttcacccagcaaataggggacaaagtatcagagatagcaagtatggtaactagcaccattactgaaaagc

SEQ ID NO: 81479 - DNA, 75 bp, Artificial Sequence
  Synthetic
gccttccactatgtgtttgatggagtcaaggaaccagccgtactcactaagaacgatcccagactgaagacagat

SEQ ID NO: 81480 - DNA, 75 bp, Artificial Sequence
  Synthetic
tcaaggaaccagccgtactcactaagaacgatcccagactgaagacagattttgaggaagcaattttctcaaagt

SEQ ID NO: 81481 - DNA, 75 bp, Artificial Sequence
  Synthetic
tagctactctagctctccttggttgtgacatttcgccatggcaatggttgaaaaagaaggcatgtgacatccttg

SEQ ID NO: 81482 - DNA, 75 bp, Artificial Sequence
  Synthetic
tgacatttcgccatggcaatggttgaaaaagaaggcatgtgacatccttgaaatcccgtacgtgatcagacaagg

SEQ ID NO: 81483 - DNA, 75 bp, Artificial Sequence
  Synthetic
ccctggacataaacacagaacaaatgtgccttgaggatgccatgtatgggaccgatggcttggaagcccttgatg

SEQ ID NO: 81484 - DNA, 75 bp, Artificial Sequence
  Synthetic
gtgccttgaggatgccatgtatgggaccgatggcttggaagcccttgatgttagtaccagtgctggataccctta

SEQ ID NO: 81485 - DNA, 75 bp, Artificial Sequence
  Synthetic
agacacttatggaatcaatctgccactggtcacctatgtgaaagatgagcttagatccaagtcaaaagttgagca

SEQ ID NO: 81486 - DNA, 75 bp, Artificial Sequence
  Synthetic
ctggtcacctatgtgaaagatgagcttagatccaagtcaaaagttgagcaaggtaaatccaggttgattgaggcc

SEQ ID NO: 81487 - DNA, 75 bp, Artificial Sequence
  Synthetic
acaaaaattggaacacaccattaataattacatacagttcaagagcaaacaccgtattgaaccagtatgtttgtt

SEQ ID NO: 81488 - DNA, 75 bp, Artificial Sequence
  Synthetic
gtggtaacaggctcggccgttggttgtgacccagatctattttggagtaaaataccagtactgatggaggaaaag

SEQ ID NO: 81489 - DNA, 75 bp, Artificial Sequence
  Synthetic
gtgacccagatctattttggagtaaaataccagtactgatggaggaaaagctctttgcatttgactacacaggct

SEQ ID NO: 81490 - DNA, 75 bp, Artificial Sequence
  Synthetic
ctcacaccatctttacaaaaacaaaacttactgtgtcaagggcggcatgccatctggctgctcaggcacttcaat

SEQ ID NO: 81491 - DNA, 75 bp, Artificial Sequence
  Synthetic
gccgacatgaaacttttctgccaaatggtgtctactgtagagttcattccacctatggcctccctggaagaaaaa

SEQ ID NO: 81492 - DNA, 75 bp, Artificial Sequence
  Synthetic
atcattaggacactcttactgaaaacctacaagggcatagatttagaccacttaaagatgattgcctatggtgat

SEQ ID NO: 81493 - DNA, 75 bp, Artificial Sequence
  Synthetic
ggcatcttattcacgtccaattatgttttggcctccaccaattccagtcgcataacgccaccgacagtggctcac

SEQ ID NO: 81494 - DNA, 75 bp, Artificial Sequence
  Synthetic
cctacaagggcatagatttagaccacttaaagatgattgcctatggtgatgatgtaattgcttcctacccccatg

SEQ ID NO: 81495 - DNA, 75 bp, Artificial Sequence
  Synthetic
ccagccccccaccagagtgcatcaacgacctgcttcaagctgttgactcgcaggaggtcagggactattgtgaaa

SEQ ID NO: 81496 - DNA, 75 bp, Artificial Sequence
  Synthetic
aacccatgctgcaccaggtgatagcattgtgatagacggcaaggaagttgaaattttagatgcgaaggccttaga

SEQ ID NO: 81497 - DNA, 75 bp, Artificial Sequence
  Synthetic
gcagccctaaagcgctcatacttcactcagagtcaaggtgaaattcagtggatgagaccatcaaaagaagtgggt

SEQ ID NO: 81498 - DNA, 75 bp, Artificial Sequence
  Synthetic
acccaagactcaaaacagagtttgaagaggctatcttttccaagtatgtaggaaataagatcactgaggtggacg

SEQ ID NO: 81499 - DNA, 75 bp, Artificial Sequence
  Synthetic
aaagaaatgcagagactattggacacctatggcattaatttacctttagtaacttatgtgaaggatgaacttagg

SEQ ID NO: 81500 - DNA, 75 bp, Artificial Sequence
  Synthetic
tctaaaaccaaagttgaacagggtaaatccagactaattgaagcctcaagtttgaatgattctgtggcaatgaga

SEQ ID NO: 81501 - DNA, 75 bp, Artificial Sequence
  Synthetic
ccagacttgttttggagcaagataccagttttgatggaagaaaagctttttgcatttgattacacagggtatgat

SEQ ID NO: 81502 - DNA, 75 bp, Artificial Sequence
  Synthetic
cagttttgatggaagaaaagctttttgcatttgattacacagggtatgatgcttcactcagtcccgcttggtttg

SEQ ID NO: 81503 - DNA, 75 bp, Artificial Sequence
  Synthetic
gaaaagactatggactaaccatgactccagctgacaaatcagccacctttgaaaaagtcacatgggagaatgtaa

SEQ ID NO: 81504 - DNA, 75 bp, Artificial Sequence
  Synthetic
catccagtcatgccaatgaaagaaattcatgagtccatcagatggactaaggatcctaggaacacccaggatcat

SEQ ID NO: 81505 - DNA, 75 bp, Artificial Sequence
  Synthetic
ggatcctaggaacacccaggatcatgttcgctcactgtgcctattggcctggcacaatggcgaagaagaatacaa

SEQ ID NO: 81506 - DNA, 75 bp, Artificial Sequence
  Synthetic
gttcgctcactgtgcctattggcctggcacaatggcgaagaagaatacaacaaatttttagctaaaatcagaagc

SEQ ID NO: 81507 - DNA, 75 bp, Artificial Sequence
  Synthetic
agtgcaaggccctgggtttgattacgcagtggccatggctaaaagaaacattgttacagcaaccaccagcaaagg

SEQ ID NO: 81508 - DNA, 75 bp, Artificial Sequence
  Synthetic
gcaaggtcatcgggatgcatgttggagggaacggttcacacgggttcgcagcagccctaaagcgctcatacttca

SEQ ID NO: 81509 - DNA, 75 bp, Artificial Sequence
  Synthetic
agttcaatagaagggggtacaaaccagtaccaccacgaacaagcacttctgtttccccggtgacgttgtatagac

SEQ ID NO: 81510 - DNA, 75 bp, Artificial Sequence
  Synthetic
ccccagagtgtagcttaggtcgatgagtctggacaatcctcaccggcgacggtggtccaggctgcgttggcggcc

SEQ ID NO: 81511 - DNA, 75 bp, Artificial Sequence
  Synthetic
attatggctgcttatggtgacaatcacagattgttatcataaagcgacttggattggccatccagtgaaaataaa

SEQ ID NO: 81512 - DNA, 75 bp, Artificial Sequence
  Synthetic
acagattgttatcataaagcgacttggattggccatccagtgaaaataaaacacatcatttacctgattgttgga

SEQ ID NO: 81513 - DNA, 75 bp, Artificial Sequence
  Synthetic
agctcaagtatcttctcagaaagtgggagcccacgaaaataccaacgtggcgactggcggatctaccgttaatta

SEQ ID NO: 81514 - DNA, 75 bp, Artificial Sequence
  Synthetic
ggagcccacgaaaataccaacgtggcgactggcggatctaccgttaattataccaccattaattactacaaggat

SEQ ID NO: 81515 - DNA, 75 bp, Artificial Sequence
  Synthetic
atgttaaaatcagctccggccttgaactccccgaacgtggaagcatgtgggtacagtgatagggtaagacaaatt

SEQ ID NO: 81516 - DNA, 75 bp, Artificial Sequence
  Synthetic
actccccgaacgtggaagcatgtgggtacagtgatagggtaagacaaattactttgggtaactccaccataacaa

SEQ ID NO: 81517 - DNA, 75 bp, Artificial Sequence
  Synthetic
tggatgcacctactgaacctgatgttagcagtaacagattttacaccctagattctgtgcagtggaaaagcacta

SEQ ID NO: 81518 - DNA, 75 bp, Artificial Sequence
  Synthetic
tagcagtaacagattttacaccctagattctgtgcagtggaaaagcactagtaggggttggtggtggaaactgcc

SEQ ID NO: 81519 - DNA, 75 bp, Artificial Sequence
  Synthetic
ccacgtgcagtgcaacgcctcaaagttccaccaggggactcttggtgtcttcgcaatcccagagtacgtgatggc

SEQ ID NO: 81520 - DNA, 75 bp, Artificial Sequence
  Synthetic
ttccaccaggggactcttggtgtcttcgcaatcccagagtacgtgatggcatgcaacactgagacaaaaacatca

SEQ ID NO: 81521 - DNA, 75 bp, Artificial Sequence
  Synthetic
gcagcagaagggcggaagtttgcagccctggattacttactagggtgtggagtcctagcaggtaatgcgttcgtg

SEQ ID NO: 81522 - DNA, 75 bp, Artificial Sequence
  Synthetic
ccctggattacttactagggtgtggagtcctagcaggtaatgcgttcgtgttcccgcatcaaataataaatctga

SEQ ID NO: 81523 - DNA, 75 bp, Artificial Sequence
  Synthetic
attgggggttggttattttacctttgtgcaaattagactacgcaccaaactcaagcacagagatacccattacgg

SEQ ID NO: 81524 - DNA, 75 bp, Artificial Sequence
  Synthetic
gtgcaaattagactacgcaccaaactcaagcacagagatacccattacggtcaccattgcccccatgtgtactga

SEQ ID NO: 81525 - DNA, 75 bp, Artificial Sequence
  Synthetic
gtttctaacgtctgatgatttccagtcgccatgtgcattgccaaactttgacgtcaccccgccaatacatattcc

SEQ ID NO: 81526 - DNA, 75 bp, Artificial Sequence
  Synthetic
tcgccatgtgcattgccaaactttgacgtcaccccgccaatacatattcctggggaagtaactaacatgatggag

SEQ ID NO: 81527 - DNA, 75 bp, Artificial Sequence
  Synthetic
ccacttaatgataaagggagcgctgaccccattttcagtatatctttgagtcctgcatcagacaaaaggctgcag

SEQ ID NO: 81528 - DNA, 75 bp, Artificial Sequence
  Synthetic
accccattttcagtatatctttgagtcctgcatcagacaaaaggctgcagtacaccatgctgggtgaaattttga

SEQ ID NO: 81529 - DNA, 75 bp, Artificial Sequence
  Synthetic
ttcttctcagctactccccaccgggtgcaagcccacctaagactaggaaggatgctatgttgggcacacacatca

SEQ ID NO: 81530 - DNA, 75 bp, Artificial Sequence
  Synthetic
tgcaagcccacctaagactaggaaggatgctatgttgggcacacacatcatatgggaccttgggctgcagtcgtc

SEQ ID NO: 81531 - DNA, 75 bp, Artificial Sequence
  Synthetic
atacatcacttgtttttaccaaaccaggatcgtggtcccatcaggcacgccaacttcaatgttcatgctagcatt

SEQ ID NO: 81532 - DNA, 75 bp, Artificial Sequence
  Synthetic
aggatcgtggtcccatcaggcacgccaacttcaatgttcatgctagcattcgtcagtgcttgtccggacttcagt

SEQ ID NO: 81533 - DNA, 75 bp, Artificial Sequence
  Synthetic
attgacactgtcattaacaatgccctacaactatctcaaccacagccaaataagcagttgacagctcagtctacc

SEQ ID NO: 81534 - DNA, 75 bp, Artificial Sequence
  Synthetic
tacaactatctcaaccacagccaaataagcagttgacagctcagtctaccccctccacaagtggagtaaactccc

SEQ ID NO: 81535 - DNA, 75 bp, Artificial Sequence
  Synthetic
gacacgtggttaattataagacccgatctgaatctactcttgagtctttctttggaaggtcagcttgtgtcacca

SEQ ID NO: 81536 - DNA, 75 bp, Artificial Sequence
  Synthetic
atctgaatctactcttgagtctttctttggaaggtcagcttgtgtcaccataattgaggtcgagaacttcaatgc

SEQ ID NO: 81537 - DNA, 75 bp, Artificial Sequence
  Synthetic
gaaactagaattcttcacttactccaggtttgacctagagatgacctttgtagtgacagaaagatattatgccag

SEQ ID NO: 81538 - DNA, 75 bp, Artificial Sequence
  Synthetic
aggtttgacctagagatgacctttgtagtgacagaaagatattatgccagcaacacaggtcacgccagaaaccaa

SEQ ID NO: 81539 - DNA, 75 bp, Artificial Sequence
  Synthetic
tcgaatccgtcagtcttttacacttatgggagtgctccacccaggatgtctataccgtatgtcggtatcgcaaat

SEQ ID NO: 81540 - DNA, 75 bp, Artificial Sequence
  Synthetic
atgggagtgctccacccaggatgtctataccgtatgtcggtatcgcaaatgcatactctcttttttatgatgggt

SEQ ID NO: 81541 - DNA, 75 bp, Artificial Sequence
  Synthetic
ttggaatcttagcaataagagtagtgaatgaatttaacccagctaggattacatcaaaaattagagtgtatatga

SEQ ID NO: 81542 - DNA, 75 bp, Artificial Sequence
  Synthetic
gaatgaatttaacccagctaggattacatcaaaaattagagtgtatatgaaaccaaagcatgtaagatgctggtg

SEQ ID NO: 81543 - DNA, 75 bp, Artificial Sequence
  Synthetic
agcagtcgcaaacatcaacacattcggtggattcgggcaccaaaacaaggccgtgtacgttgctggttacaagat

SEQ ID NO: 81544 - DNA, 75 bp, Artificial Sequence
  Synthetic
ggtggattcgggcaccaaaacaaggccgtgtacgttgctggttacaagatctgcaattaccaccttgcaacgcca

SEQ ID NO: 81545 - DNA, 75 bp, Artificial Sequence
  Synthetic
gacaccattgctaggtgcaattgtaaagcaggtgtatactattgtgaatcaaggagagagtactacccagtaaca

SEQ ID NO: 81546 - DNA, 75 bp, Artificial Sequence
  Synthetic
aagcaggtgtatactattgtgaatcaaggagagagtactacccagtaacattgacaggaccaactttccagtaca

SEQ ID NO: 81547 - DNA, 75 bp, Artificial Sequence
  Synthetic
attgtggtggtatcttaagatgcaaccacggggtcatgggcatcatcacagcaggtggtaatggagttgtggctt

SEQ ID NO: 81548 - DNA, 75 bp, Artificial Sequence
  Synthetic
ccacggggtcatgggcatcatcacagcaggtggtaatggagttgtggcttttgcggacatcagagacttgtgggt

SEQ ID NO: 81549 - DNA, 75 bp, Artificial Sequence
  Synthetic
caccagtcagatcggagaaaaagttgctgagttaactagcatggtcaccagcacaattacagataaattgttaaa

SEQ ID NO: 81550 - DNA, 75 bp, Artificial Sequence
  Synthetic
gctgagttaactagcatggtcaccagcacaattacagataaattgttaaagactctgatcaaaatagtatctaca

SEQ ID NO: 81551 - DNA, 75 bp, Artificial Sequence
  Synthetic
tccccgtggcaatggattaagaagaaagcatgtgatattctagaactaccatatgtcatgagacagggtgacagc

SEQ ID NO: 81552 - DNA, 75 bp, Artificial Sequence
  Synthetic
aagcatgtgatattctagaactaccatatgtcatgagacagggtgacagctggttgaagaagttcacagaagcat

SEQ ID NO: 81553 - DNA, 75 bp, Artificial Sequence
  Synthetic
tcccagaggctaaggacaaagtcgaatatattactaagcttaaacagttaggaatgctggaaaatcaaatcaaca

SEQ ID NO: 81554 - DNA, 75 bp, Artificial Sequence
  Synthetic
atatattactaagcttaaacagttaggaatgctggaaaatcaaatcaacacaatccaccaatcctgccccagcca

SEQ ID NO: 81555 - DNA, 75 bp, Artificial Sequence
  Synthetic
tgtagaggccaagagaatttcaaaattagagaacactattaacaactacatacagttcaagagcaaacaccgtat

SEQ ID NO: 81556 - DNA, 75 bp, Artificial Sequence
  Synthetic
ttagagaacactattaacaactacatacagttcaagagcaaacaccgtattgaaccagtatgcatgctcatacat

SEQ ID NO: 81557 - DNA, 75 bp, Artificial Sequence
  Synthetic
ggcgaattcaccatgcttggcgttcatgacaatgttgcaattcttccaactcatgcagccccaggggattcaatt

SEQ ID NO: 81558 - DNA, 75 bp, Artificial Sequence
  Synthetic
gtgtactcccttcccccagatccaacacattttgatggatacaaacaacaaggagtggttattatggacgacctg

SEQ ID NO: 81559 - DNA, 75 bp, Artificial Sequence
  Synthetic
cacattttgatggatacaaacaacaaggagtggttattatggacgacctgaatcaaaacccagatgggaatgaca

SEQ ID NO: 81560 - DNA, 75 bp, Artificial Sequence
  Synthetic
tattcacttcagattacgtcttggcttccaccaattctcacacgatcattcctccaaccgtttcacacagtgatg

SEQ ID NO: 81561 - DNA, 75 bp, Artificial Sequence
  Synthetic
ttccaccaattctcacacgatcattcctccaaccgtttcacacagtgatgcgttgtctagaaggttcgccttcga

SEQ ID NO: 81562 - DNA, 75 bp, Artificial Sequence
  Synthetic
agagtgcccacaaccagctaattttaagaagtgttgcccactaatttgtgggaaagccctgcagctaatggacaa

SEQ ID NO: 81563 - DNA, 75 bp, Artificial Sequence
  Synthetic
aagaagtgttgcccactaatttgtgggaaagccctgcagctaatggacaagaacaccagacagcgcttcacacta

SEQ ID NO: 81564 - DNA, 75 bp, Artificial Sequence
  Synthetic
cagggccctgtccaatacaaagacatcaaaattgacattaaggagacacctgctccggagtacatcaatgacctt

SEQ ID NO: 81565 - DNA, 75 bp, Artificial Sequence
  Synthetic
tcaaaattgacattaaggagacacctgctccggagtacatcaatgaccttttacaatcagttgacagtcaagaag

SEQ ID NO: 81566 - DNA, 75 bp, Artificial Sequence
  Synthetic
gagctatgaccattctacaggctgttactacctttgctgctgttgctggtgttgtctatgtgatgtatagattgt

SEQ ID NO: 81567 - DNA, 75 bp, Artificial Sequence
  Synthetic
tactacctttgctgctgttgctggtgttgtctatgtgatgtatagattgtttgccgggcaccaaggagcatacac

SEQ ID NO: 81568 - DNA, 75 bp, Artificial Sequence
  Synthetic
agtggctatggctaaaaggaatatcctgactgcaaccaccagtaagggggagtttaccatgttaggtgtacatga

SEQ ID NO: 81569 - DNA, 75 bp, Artificial Sequence
  Synthetic
ctgactgcaaccaccagtaagggggagtttaccatgttaggtgtacatgataatgttgctatccttccaacacac

SEQ ID NO: 81570 - DNA, 75 bp, Artificial Sequence
  Synthetic
tcaggtactaatttagaaatcaccatagtgaagcttaagaggaatgagaagttcagagatattagaccccatata

SEQ ID NO: 81571 - DNA, 75 bp, Artificial Sequence
  Synthetic
tagtgaagcttaagaggaatgagaagttcagagatattagaccccatataccaacacaaatcactgagaccaatg

SEQ ID NO: 81572 - DNA, 75 bp, Artificial Sequence
  Synthetic
gctagtctcctagcccaatcaggaaaagactatggactaaccatgactccagctgacaaatcagctacctttgaa

SEQ ID NO: 81573 - DNA, 75 bp, Artificial Sequence
  Synthetic
acctgaatcttggagggcgccaaactgcgcgtactcttatgtacaacttcccaactcgcgccggtcagtgtggtg

SEQ ID NO: 81574 - DNA, 75 bp, Artificial Sequence
  Synthetic
tgcgcgtactcttatgtacaacttcccaactcgcgccggtcagtgtggtggtgtcatcacgtgtactggcaaggt

SEQ ID NO: 81575 - DNA, 75 bp, Artificial Sequence
  Synthetic
tcaaggtgagatccaatggatgaggccttctaaagaagttggttacccagtgattaatgcaccaagcaagactaa

SEQ ID NO: 81576 - DNA, 75 bp, Artificial Sequence
  Synthetic
gcctattggcttggcacaacggggaagaagaatacaacaaatttttagctaaaattaggagtgtgccaatcggaa

SEQ ID NO: 81577 - DNA, 75 bp, Artificial Sequence
  Synthetic
ccttctaaagaagttggttacccagtgattaatgcaccaagcaagactaaactcgagcccagtgttttccactat

SEQ ID NO: 81578 - DNA, 75 bp, Artificial Sequence
  Synthetic
attttctccaagtatgtggggaataaaatcactgaagtggatgagtacatgaaggaagctgtggatcactacgct

SEQ ID NO: 81579 - DNA, 75 bp, Artificial Sequence
  Synthetic
aaatcactgaagtggatgagtacatgaaggaagctgtggatcactacgctggacaacttatgtctttggacatca

SEQ ID NO: 81580 - DNA, 75 bp, Artificial Sequence
  Synthetic
caggctatccctacgtggcccttggaaagaaaaagagagacattcttaacaagcaaaccagagatactaaggaaa

SEQ ID NO: 81581 - DNA, 75 bp, Artificial Sequence
  Synthetic
aaagaaaaagagagacattcttaacaagcaaaccagagatactaaggaaatgcagaggcttctcgatacttatgg

SEQ ID NO: 81582 - DNA, 75 bp, Artificial Sequence
  Synthetic
attaattgaagcttccagtctcaatgattcagtagcgatgagaatggcatttggcaatttgtatgcggctttcca

SEQ ID NO: 81583 - DNA, 75 bp, Artificial Sequence
  Synthetic
gattcagtagcgatgagaatggcatttggcaatttgtatgcggctttccacaagaacccaggagtagtcacaggc

SEQ ID NO: 81584 - DNA, 75 bp, Artificial Sequence
  Synthetic
gattatactggatatgatgcctcactcagccccgcttggttcgaagctcttaaaatggttctagagaaaattgga

SEQ ID NO: 81585 - DNA, 75 bp, Artificial Sequence
  Synthetic
attacttaaaccactcccaccatctatacaaaaacaaaacatactgtgttaagggcggcatgccatctggctgct

SEQ ID NO: 81586 - DNA, 75 bp, Artificial Sequence
  Synthetic
ttggaagagcattactgctccctgagtactctacattgtaccgccgttggctcgactcattttagtaaccctacc

SEQ ID NO: 81587 - DNA, 75 bp, Artificial Sequence
  Synthetic
gtactctacattgtaccgccgttggctcgactcattttagtaaccctacctcagtcgaattggattgggttatac

SEQ ID NO: 81588 - DNA, 75 bp, Artificial Sequence
  Synthetic
ttaaaacagcctgtgggttgttcccaccccagaggcccacgtggcggctagtactctggtatcacggtacctttg

SEQ ID NO: 81589 - DNA, 75 bp, Artificial Sequence
  Synthetic
agtaccaccacgaacaagcacttctgtttccccggtgcgatgacatagactgtacccacggtcaaaagtcaccaa

SEQ ID NO: 81590 - DNA, 75 bp, Artificial Sequence
  Synthetic
tgactggcctgtcgtaacgcgcaagtccgtggcggaaccgactactttgggtgtccgtgtttccttttattttat

SEQ ID NO: 81591 - DNA, 75 bp, Artificial Sequence
  Synthetic
tacccatagctattgctatgggatgctagagttgaacaaggtgtgaagagccaattgagctactaaagagtcctc

SEQ ID NO: 81592 - DNA, 75 bp, Artificial Sequence
  Synthetic
gggtgtccgtgtttccttttatttttatcgtggctgcttatggtgacaatcatagattgttatcataaagcgaat

SEQ ID NO: 81593 - DNA, 75 bp, Artificial Sequence
  Synthetic
ttggacaattgtactataatgggtgctcaggtttcatcacagaaggtgggcgcacatgaaaactcaaataaagcg

SEQ ID NO: 81594 - DNA, 75 bp, Artificial Sequence
  Synthetic
agtggaggttctaccattaattataccaccattaattattatagggactcagctagtaacgcggcatcaaaacag

SEQ ID NO: 81595 - DNA, 75 bp, Artificial Sequence
  Synthetic
ccagttttaattcgtattgtgttactaattagatttcactactacaatgggagctcaagtttcatcccagaaggt

SEQ ID NO: 81596 - DNA, 75 bp, Artificial Sequence
  Synthetic
taattagatttcactactacaatgggagctcaagtttcatcccagaaggtcggtgcgcatgaaaacaccaatgtg

SEQ ID NO: 81597 - DNA, 75 bp, Artificial Sequence
  Synthetic
tcaccaaatatagaagcttgtgggtatagcgatagagtgatgcaattaacactgggaaactctactataaccaca

SEQ ID NO: 81598 - DNA, 75 bp, Artificial Sequence
  Synthetic
caggacttttctcaggacccatcaaaattcaccgagccagttaaagacattatgctaaagtcagcccctgcattg

SEQ ID NO: 81599 - DNA, 75 bp, Artificial Sequence
  Synthetic
aattcaccgagccagttaaagacattatgctaaagtcagcccctgcattgaactcaccaaatgttgaggcatgcg

SEQ ID NO: 81600 - DNA, 75 bp, Artificial Sequence
  Synthetic
cctacgggcgttggcctgaatatctgagggacagcgaggctaatccagtggaccaaccgacagaaccagatgtcg

SEQ ID NO: 81601 - DNA, 75 bp, Artificial Sequence
  Synthetic
ctgcatgcaggttttacacgttggataccgtgtcttggacaaaagagtcgcgagggtggtggtggaagctgcctg

SEQ ID NO: 81602 - DNA, 75 bp, Artificial Sequence
  Synthetic
taccgtgtcttggacaaaagagtcgcgagggtggtggtggaagctgcctgatgcactgcgggatatggggctttt

SEQ ID NO: 81603 - DNA, 75 bp, Artificial Sequence
  Synthetic
ttgcatatggagagtggccatcttacttgaaaccctctgaagccaaccctgtcgatgcacctactgagcctgatg

SEQ ID NO: 81604 - DNA, 75 bp, Artificial Sequence
  Synthetic
cttgaaaccctctgaagccaaccctgtcgatgcacctactgagcctgatgttagttccaacagattttacacact

SEQ ID NO: 81605 - DNA, 75 bp, Artificial Sequence
  Synthetic
tcatcagggggcactaggggtattcgctgtaccagagatgtgtttggccggagatagtaacaccaccaccatgca

SEQ ID NO: 81606 - DNA, 75 bp, Artificial Sequence
  Synthetic
gctgtaccagagatgtgtttggccggagatagtaacaccaccaccatgcacaccagctatcaaaatgccaaccca

SEQ ID NO: 81607 - DNA, 75 bp, Artificial Sequence
  Synthetic
atttggtcaaaacatgttttatcattacctgggtaggagtggatatacagtacacatacagtgcaatgcctcaaa

SEQ ID NO: 81608 - DNA, 75 bp, Artificial Sequence
  Synthetic
tacctgggtaggagtggatatacagtacacatacagtgcaatgcctcaaaatttcatcaaggagcgctgggggtt

SEQ ID NO: 81609 - DNA, 75 bp, Artificial Sequence
  Synthetic
ccagtggattatctttttggaaatggtacgctattagggaatgcctttgtgttcccgcaccagataataaacctg

SEQ ID NO: 81610 - DNA, 75 bp, Artificial Sequence
  Synthetic
gtacgctattagggaatgcctttgtgttcccgcaccagataataaacctgcgaaccaacaactgcgctacactgg

SEQ ID NO: 81611 - DNA, 75 bp, Artificial Sequence
  Synthetic
ccaggagaggcgggtggtgtgttcaccgataagtataacccaagcactgatgcagcagatggacgcaagtttgct

SEQ ID NO: 81612 - DNA, 75 bp, Artificial Sequence
  Synthetic
ccgataagtataacccaagcactgatgcagcagatggacgcaagtttgctgccgttgactacttgcttgggtgtg

SEQ ID NO: 81613 - DNA, 75 bp, Artificial Sequence
  Synthetic
tggcccctttaaatttcgccagtgaatcctccactgagattccaattactttgaccatagcccccatgtgctgtg

SEQ ID NO: 81614 - DNA, 75 bp, Artificial Sequence
  Synthetic
atcctccactgagattccaattactttgaccatagcccccatgtgctgtgagtttaatgggttaagaaatattac

SEQ ID NO: 81615 - DNA, 75 bp, Artificial Sequence
  Synthetic
ttctgccgtatgtcaactcactggcgatagattgtatggccaaacacaacaactggggattggtaattttacctc

SEQ ID NO: 81616 - DNA, 75 bp, Artificial Sequence
  Synthetic
gatagattgtatggccaaacacaacaactggggattggtaattttacctcttgaaccactagcgtatgcaccaga

SEQ ID NO: 81617 - DNA, 75 bp, Artificial Sequence
  Synthetic
gtcaccgtgtgcactacctgaatttgatgtgaccccacctatagacatacccggtgaagtcaagaatatgatgga

SEQ ID NO: 81618 - DNA, 75 bp, Artificial Sequence
  Synthetic
tgtacctgccactcagggattaccagtgctggttactccagggtcgtcacagtatcttacttccgacgactttca

SEQ ID NO: 81619 - DNA, 75 bp, Artificial Sequence
  Synthetic
gtgctggttactccagggtcgtcacagtatcttacttccgacgactttcagtccccatgcgctataccaaacttt

SEQ ID NO: 81620 - DNA, 75 bp, Artificial Sequence
  Synthetic
cccctcaacttaagtgcaacaaaaaagaacaccatggacatgtacagggtccagctaaatgacaatccgcatacg

SEQ ID NO: 81621 - DNA, 75 bp, Artificial Sequence
  Synthetic
ccgatgaacagcgtgtcagggaaagcaaacacaatggagatgtacagaatcccattaaacacaactggcagtaca

SEQ ID NO: 81622 - DNA, 75 bp, Artificial Sequence
  Synthetic
ctaaattactacacgcattgggcaggatctctgaagttcacgtttctgttctgtgggtccatgatggcaactggc

SEQ ID NO: 81623 - DNA, 75 bp, Artificial Sequence
  Synthetic
caaacacaatggagatgtacagaatcccattaaacacaactggcagtacagatcccatattttgcttaagtttgt

SEQ ID NO: 81624 - DNA, 75 bp, Artificial Sequence
  Synthetic
cactaagattcacattcctattctgtggtagcatgatggcaaccggcaaactaatcttaacatactctccaccag

SEQ ID NO: 81625 - DNA, 75 bp, Artificial Sequence
  Synthetic
tggtagcatgatggcaaccggcaaactaatcttaacatactctccaccaggagccagtccacccaagaccagaaa

SEQ ID NO: 81626 - DNA, 75 bp, Artificial Sequence
  Synthetic
aaccagagtagtcgtccctctttcgactcccagagaaatggatatccttggttttgtatcagcgtgcaatgactt

SEQ ID NO: 81627 - DNA, 75 bp, Artificial Sequence
  Synthetic
atccaacactgtgtatagaagatgtgtaaaagacgatttcactgagggcgggtacattacttgcttctaccaaac

SEQ ID NO: 81628 - DNA, 75 bp, Artificial Sequence
  Synthetic
gtaaaagacgatttcactgagggcgggtacattacttgcttctaccaaactagaattgtagtaccagcgagcaca

SEQ ID NO: 81629 - DNA, 75 bp, Artificial Sequence
  Synthetic
aagcatgatcgacaacacagtccgcgaaacggcgggggcggcgacgtctagaaacgccctcccgaacactgaagc

SEQ ID NO: 81630 - DNA, 75 bp, Artificial Sequence
  Synthetic
cacatttctcaaaccgctctcattgcagcaactcaagggattgacgacgtaatcgacaaggtcattagcaatgca

SEQ ID NO: 81631 - DNA, 75 bp, Artificial Sequence
  Synthetic
cagcaactcaagggattgacgacgtaatcgacaaggtcattagcaatgcactgcagttatcacaacctactaaac

SEQ ID NO: 81632 - DNA, 75 bp, Artificial Sequence
  Synthetic
ttctgatacagtgcaaaccagacatgttatacaacataggtcaaggtcggagtctagcattgagtcattctttgc

SEQ ID NO: 81633 - DNA, 75 bp, Artificial Sequence
  Synthetic
gttatacaacataggtcaaggtcggagtctagcattgagtcattctttgcacggggtgcatgcgtgtccattata

SEQ ID NO: 81634 - DNA, 75 bp, Artificial Sequence
  Synthetic
aaaccggagcatctgggcaggccattccaagtgatgttatagaaaccaggcatgtggtgaattacaaaaccagat

SEQ ID NO: 81635 - DNA, 75 bp, Artificial Sequence
  Synthetic
tccaagtgatgttatagaaaccaggcatgtggtgaattacaaaaccagatctgagtcaacactggagtcgttctt

SEQ ID NO: 81636 - DNA, 75 bp, Artificial Sequence
  Synthetic
gttcagttgcggaggaagttagagtttttcacctattctagatttgacatggaattcacctttgtggttactgca

SEQ ID NO: 81637 - DNA, 75 bp, Artificial Sequence
  Synthetic
attcacagtgtggcccatcacttacacaaacacagtgcaattgagaaggaaactggagttcttcacctactcgag

SEQ ID NO: 81638 - DNA, 75 bp, Artificial Sequence
  Synthetic
acaaacacagtgcaattgagaaggaaactggagttcttcacctactcgagatttgacattgaaatgactttcgtc

SEQ ID NO: 81639 - DNA, 75 bp, Artificial Sequence
  Synthetic
gtgcccgcgaagtgggacgactacacatggcagacctcatcaaatccatcaatcttttacacctatggagcagct

SEQ ID NO: 81640 - DNA, 75 bp, Artificial Sequence
  Synthetic
gcccctaggccaaacgcttgggatgattatacctggcaatcttcatccaatccatccatcttttacacctatgga

SEQ ID NO: 81641 - DNA, 75 bp, Artificial Sequence
  Synthetic
attatacctggcaatcttcatccaatccatccatcttttacacctatggatgtgctcctgcccgaatctcaatcc

SEQ ID NO: 81642 - DNA, 75 bp, Artificial Sequence
  Synthetic
cagattcaggggatactttctatgggcaggttgctataaatgactttggtacgctagccgtaagggtcgtgaatg

SEQ ID NO: 81643 - DNA, 75 bp, Artificial Sequence
  Synthetic
attagagtctggtgcccgcgtccaccaagggcagtggcgtattatggccccggggtggattacaaggatggtaca

SEQ ID NO: 81644 - DNA, 75 bp, Artificial Sequence
  Synthetic
gcaggttgctataaatgactttggtacgctagccgtaagggtcgtgaatgagttcaatccaacacgagttactgc

SEQ ID NO: 81645 - DNA, 75 bp, Artificial Sequence
  Synthetic
caagggcagtggcgtattatggccccggggtggattacaaggatggtacactcacgcccctctctacaaaggatt

SEQ ID NO: 81646 - DNA, 75 bp, Artificial Sequence
  Synthetic
aggggacggagtggacataaaacagggtaccatcacacctttaactccagttagtaagatcacgacatacggatt

SEQ ID NO: 81647 - DNA, 75 bp, Artificial Sequence
  Synthetic
ctactcaagaagacttgcaaaacgcggtgagcactatgtgggatagagacctcttagtcacagaatcaaaagctc

SEQ ID NO: 81648 - DNA, 75 bp, Artificial Sequence
  Synthetic
ggtaccatcacacctttaactccagttagtaagatcacgacatacggatttggacaccagaacaaaggcatattc

SEQ ID NO: 81649 - DNA, 75 bp, Artificial Sequence
  Synthetic
ggtgagcactatgtgggatagagacctcttagtcacagaatcaaaagctcagggcactgatacaattgcaagatg

SEQ ID NO: 81650 - DNA, 75 bp, Artificial Sequence
  Synthetic
gagagagacttgatggtggtggaatccaaagctcaaggcgtggatcaaattgccagatgctcatgcaaaactggg

SEQ ID NO: 81651 - DNA, 75 bp, Artificial Sequence
  Synthetic
tcaatacatggaggctaatggctattacccagccaggtatcaatcccacatactcattggccatggattcgcgtc

SEQ ID NO: 81652 - DNA, 75 bp, Artificial Sequence
  Synthetic
tactcattggccatggattcgcgtctccaggagactgtggtggtatacttagatgtcaccacggggtgataggga

SEQ ID NO: 81653 - DNA, 75 bp, Artificial Sequence
  Synthetic
ccaaagctcaaggcgtggatcaaattgccagatgctcatgcaaaactggggtgtactattgtgcgtcgcgccaaa

SEQ ID NO: 81654 - DNA, 75 bp, Artificial Sequence
  Synthetic
agtcacacatgatactaggtcacgggtttgcagaaccaggcgactgtggaggtattctcagatgtcagcacggag

SEQ ID NO: 81655 - DNA, 75 bp, Artificial Sequence
  Synthetic
gtttgcagaaccaggcgactgtggaggtattctcagatgtcagcacggagtcatgggcctgattactgcaggggg

SEQ ID NO: 81656 - DNA, 75 bp, Artificial Sequence
  Synthetic
ctgctaaagaacttgattaagattatatcttcactagttattataactaggaattatgaagacaccacaacagtg

SEQ ID NO: 81657 - DNA, 75 bp, Artificial Sequence
  Synthetic
ctacattgagtccttaggggctgccttcgggtctggattcaccaaccaaatcagtgataaagtcagtgagattac

SEQ ID NO: 81658 - DNA, 75 bp, Artificial Sequence
  Synthetic
ttcgggtctggattcaccaaccaaatcagtgataaagtcagtgagattacatcattggtaacatccacattcacg

SEQ ID NO: 81659 - DNA, 75 bp, Artificial Sequence
  Synthetic
taaaaagaaagcatgtgatattctggagataccttatgttatcaagcaaggtgacagctggttgaagaagttcac

SEQ ID NO: 81660 - DNA, 75 bp, Artificial Sequence
  Synthetic
gagataccttatgttatcaagcaaggtgacagctggttgaagaagttcaccgaagcatgcaatgcggctaaaggc

SEQ ID NO: 81661 - DNA, 75 bp, Artificial Sequence
  Synthetic
acggtgttggccactctagcacttttggggtgtgacgtatcaccatgggcgtggctgaaaaagaaaacttgtgat

SEQ ID NO: 81662 - DNA, 75 bp, Artificial Sequence
  Synthetic
tggggtgtgacgtatcaccatgggcgtggctgaaaaagaaaacttgtgatctgctagagattccatacaccttca

SEQ ID NO: 81663 - DNA, 75 bp, Artificial Sequence
  Synthetic
aagttggaatttgttacaagacttaaacaactagaaatgctggaaaatcaaatttcaactatacaccaatcatgt

SEQ ID NO: 81664 - DNA, 75 bp, Artificial Sequence
  Synthetic
aatttcaactatacaccaatcatgtcctagtcaggaacaccaggaagttctgttcaataacgtcagatggttatc

SEQ ID NO: 81665 - DNA, 75 bp, Artificial Sequence
  Synthetic
aaatcagtaagtttatagattggttgaaaaacaagattatccctgaagccaaagaaaagctagattatgtaacaa

SEQ ID NO: 81666 - DNA, 75 bp, Artificial Sequence
  Synthetic
gaaaaacaagattatccctgaagccaaagaaaagctagattatgtaacaaaattgaaacagttggacctcttgga

SEQ ID NO: 81667 - DNA, 75 bp, Artificial Sequence
  Synthetic
gttggcaataaacgccagaaaatttgcgcccctttatgcatttgaagctaagagaatattcaaacttgagagtac

SEQ ID NO: 81668 - DNA, 75 bp, Artificial Sequence
  Synthetic
gcgcccctttatgcatttgaagctaagagaatattcaaacttgagagtacaataaataattacatacagttcaag

SEQ ID NO: 81669 - DNA, 75 bp, Artificial Sequence
  Synthetic
ggatccgtcacacttcgacggatataaacaacagggagtagtgattatggacgacctgaaccaaaacccagacgg

SEQ ID NO: 81670 - DNA, 75 bp, Artificial Sequence
  Synthetic
ctcataggtagagctattgcagagaaggaaaatagttctgtgtattcactccctccagacccagcacattttgac

SEQ ID NO: 81671 - DNA, 75 bp, Artificial Sequence
  Synthetic
aggaaaatagttctgtgtattcactccctccagacccagcacattttgacgggtacaaacaacaagaggttgtga

SEQ ID NO: 81672 - DNA, 75 bp, Artificial Sequence
  Synthetic
aggaatcctgttcacttcaaattacgttctagcgtccacgaattcaagcagaattaccccccccactgtggcaca

SEQ ID NO: 81673 - DNA, 75 bp, Artificial Sequence
  Synthetic
gttctagcgtccacgaattcaagcagaattaccccccccactgtggcacacagtgatgcattaaccaggcgtttt

SEQ ID NO: 81674 - DNA, 75 bp, Artificial Sequence
  Synthetic
tcatcccaccaatggcttctctggaggaaaaaggaatactattcacctccaattatgtgctggcttctactaact

SEQ ID NO: 81675 - DNA, 75 bp, Artificial Sequence
  Synthetic
ggaaaaaggaatactattcacctccaattatgtgctggcttctactaactcaaataccataacacctccaacagt

SEQ ID NO: 81676 - DNA, 75 bp, Artificial Sequence
  Synthetic
atgtgcaagaactgtcaccaaccagcaaacttcaagaggtgctgtcccctagtgtgtggtaaggcaatacaatta

SEQ ID NO: 81677 - DNA, 75 bp, Artificial Sequence
  Synthetic
gggaaagctcaatatggccactgcaactcaattatgtaaagactgtccccagcctgccaacttcaaaaagtgctg

SEQ ID NO: 81678 - DNA, 75 bp, Artificial Sequence
  Synthetic
actcaattatgtaaagactgtccccagcctgccaacttcaaaaagtgctgccccctagtgtgtggaaaagctata

SEQ ID NO: 81679 - DNA, 75 bp, Artificial Sequence
  Synthetic
taaggacttgaagattgacattaagacaagtcctccccctgagtgtattaatgatttgctccaagcagtagactc

SEQ ID NO: 81680 - DNA, 75 bp, Artificial Sequence
  Synthetic
acaagtcctccccctgagtgtattaatgatttgctccaagcagtagactcgcaggaggtgagaaattattgcgag

SEQ ID NO: 81681 - DNA, 75 bp, Artificial Sequence
  Synthetic
agaagggctaacattggcaactgcatggaagctttatttcagggacctctccattacaaggatttaaaaattgat

SEQ ID NO: 81682 - DNA, 75 bp, Artificial Sequence
  Synthetic
tggaagctttatttcagggacctctccattacaaggatttaaaaattgatatcaagacctccccagcaccagaat

SEQ ID NO: 81683 - DNA, 75 bp, Artificial Sequence
  Synthetic
caagcggtaacaacctttgccgcagtggctggagttgtatatgtcatgtataaactgtttgctgggcatcaaggt

SEQ ID NO: 81684 - DNA, 75 bp, Artificial Sequence
  Synthetic
aggtaaacagagatgtccaagttgagagagacatcaatagggccatgaccatactgcaagcaataactacttttg

SEQ ID NO: 81685 - DNA, 75 bp, Artificial Sequence
  Synthetic
gagagacatcaatagggccatgaccatactgcaagcaataactacttttgccgccgtggcaggtgtagtctttgt

SEQ ID NO: 81686 - DNA, 75 bp, Artificial Sequence
  Synthetic
ccgtactgcaaaggtccaaggcccaggttttgactacgctgttgccatggcgaaacgtaatgtagttacggcaac

SEQ ID NO: 81687 - DNA, 75 bp, Artificial Sequence
  Synthetic
ggttttgactacgctgttgccatggcgaaacgtaatgtagttacggcaaccactaccaagggtgagtttactatg

SEQ ID NO: 81688 - DNA, 75 bp, Artificial Sequence
  Synthetic
caacccacgcttcacctggtgagagcattgtgattgatggcaaagaagtggagattttggatgccaaagcgcttg

SEQ ID NO: 81689 - DNA, 75 bp, Artificial Sequence
  Synthetic
cacacatacccactcagatcactgagacaaatgatggagtcttgattgtgaacactagtaagtaccccaatatgt

SEQ ID NO: 81690 - DNA, 75 bp, Artificial Sequence
  Synthetic
gaagtcaagatcttggatgcgcaagctctggtggaccaggcaggtactaatttggagatcacagtggttaaacta

SEQ ID NO: 81691 - DNA, 75 bp, Artificial Sequence
  Synthetic
gacaaatgatggagtcttgattgtgaacactagtaagtaccccaatatgtttgttcctgttggtgctgtaactga

SEQ ID NO: 81692 - DNA, 75 bp, Artificial Sequence
  Synthetic
atcgtgaacactagtaagtaccctaacatgtatatccctgtgggtgctgtaactgaacaggggtacttgaatctt

SEQ ID NO: 81693 - DNA, 75 bp, Artificial Sequence
  Synthetic
acatgtatatccctgtgggtgctgtaactgaacaggggtacttgaatcttggtggccgccaaacagcacgaactc

SEQ ID NO: 81694 - DNA, 75 bp, Artificial Sequence
  Synthetic
atgttggagggaatggttcacacgggtttgcagcggccctaaaacgatcatacttcactcaaagtcaaggtgaga

SEQ ID NO: 81695 - DNA, 75 bp, Artificial Sequence
  Synthetic
gtttgcagcggccctaaaacgatcatacttcactcaaagtcaaggtgagatacaatggatgagaccatcgaaaga

SEQ ID NO: 81696 - DNA, 75 bp, Artificial Sequence
  Synthetic
agagccagcggtcctcaccaaaagtgatcccagactcaagacagattttgaggaggcgattttctctaagtatgt

SEQ ID NO: 81697 - DNA, 75 bp, Artificial Sequence
  Synthetic
gagtacatgaaagaggctgtggaccactatgccggacagctcatggcattagacatcaacacagaacaaatgtgc

SEQ ID NO: 81698 - DNA, 75 bp, Artificial Sequence
  Synthetic
tgtcaaagaaccagccgtactcactagaaatgaccctagactaaaagtagattttgaagaagccatcttctctaa

SEQ ID NO: 81699 - DNA, 75 bp, Artificial Sequence
  Synthetic
agaaatgaccctagactaaaagtagattttgaagaagccatcttctctaagtatgtagggaataaaatcactgag

SEQ ID NO: 81700 - DNA, 75 bp, Artificial Sequence
  Synthetic
atgtgccttgaggatgccatgtatggtactgacggtcttgaggctctagatttaagtactagtgctggatacccc

SEQ ID NO: 81701 - DNA, 75 bp, Artificial Sequence
  Synthetic
gtactgacggtcttgaggctctagatttaagtactagtgctggatacccctatgtagctatggggaagaagaaaa

SEQ ID NO: 81702 - DNA, 75 bp, Artificial Sequence
  Synthetic
tgacatatgtaaaggatgaacttaggtccaaagcaaaggtcgagcaggggaagtctagattaattgaagcttcta

SEQ ID NO: 81703 - DNA, 75 bp, Artificial Sequence
  Synthetic
ctctagtcacctatgttaaggatgagttgaggagtaaaagcaaggtggagcaaggcaaatccaggctaattgaag

SEQ ID NO: 81704 - DNA, 75 bp, Artificial Sequence
  Synthetic
taacaggttcagcagtagggtgtgatccagacttgttctggagcaaaattccagtattgatggaagagaggctgt

SEQ ID NO: 81705 - DNA, 75 bp, Artificial Sequence
  Synthetic
gttgaggagtaaaagcaaggtggagcaaggcaaatccaggctaattgaagcttcaagcctaaatgattcagtggc

SEQ ID NO: 81706 - DNA, 75 bp, Artificial Sequence
  Synthetic
ccagtattgatggaagagaggctgttcgcctttgactacacgggctatgacgcatctctcagtcctgcctggttc

SEQ ID NO: 81707 - DNA, 75 bp, Artificial Sequence
  Synthetic
gtgtgacccagatttgttttggagtaagatacccgttttaatggaagagaaactcttcgcttttgattacaccgg

SEQ ID NO: 81708 - DNA, 75 bp, Artificial Sequence
  Synthetic
aagatacccgttttaatggaagagaaactcttcgcttttgattacaccggatatgatgcttcacttagcccagcg

SEQ ID NO: 81709 - DNA, 75 bp, Artificial Sequence
  Synthetic
cactcccaccacctttacaaaaacaaaacttattgtgttaagggcggcatgccatctggctgctccggcacctca

SEQ ID NO: 81710 - DNA, 75 bp, Artificial Sequence
  Synthetic
aaacttattgtgttaagggcggcatgccatctggctgctccggcacctcaatctttaattcaatgatcaataatt

SEQ ID NO: 81711 - DNA, 75 bp, Artificial Sequence
  Synthetic
ggaaaagactacggactaaccatgactccagctgacaagtcagctacatttgagacagtcacatgggaaaatgta

SEQ ID NO: 81712 - DNA, 75 bp, Artificial Sequence
  Synthetic
atgatgtaattgcttcctacccccatgaagtcgacgctagtctcctagcccaatcaggaaaagactacggactga

SEQ ID NO: 81713 - DNA, 75 bp, Artificial Sequence
  Synthetic
tgaagtcgacgctagtctcctagcccaatcaggaaaagactacggactgaccatgacaccagctgacaagtcagc

SEQ ID NO: 81714 - DNA, 75 bp, Artificial Sequence
  Synthetic
attcacgaatcaatcagatggacaaaagatcctagaaatacccaggatcacgttcgctctttgtgcctattggcc

SEQ ID NO: 81715 - DNA, 75 bp, Artificial Sequence
  Synthetic
ggaccaaagatccaagaaatacccaggatcacgttcgctcgttgtgcttattggcatggcacaatggtgaagaag

SEQ ID NO: 81716 - DNA, 75 bp, Artificial Sequence
  Synthetic
cagcaccaccacgaacaagcacttctgtttccccggtgatgtcgtataagctgtacccacggctgaaggcgacgg

SEQ ID NO: 81717 - DNA, 75 bp, Artificial Sequence
  Synthetic
tatgtatggctgcttatggtgacaatcaaaggttgttaccataaagcaatttggattggccatccggtgagaatc

SEQ ID NO: 81718 - DNA, 75 bp, Artificial Sequence
  Synthetic
tcaaaggttgttaccataaagcaatttggattggccatccggtgagaatcaaacatattatctacctgtttgttg

SEQ ID NO: 81719 - DNA, 75 bp, Artificial Sequence
  Synthetic
ggggcgcaagtttcatcccaaaaagttggagcgcatgagaattctaatagggcgtacggtggttccaccatcaac

SEQ ID NO: 81720 - DNA, 75 bp, Artificial Sequence
  Synthetic
ttggagcgcatgagaattctaatagggcgtacggtggttccaccatcaactacaccaccattaactactacaagg

SEQ ID NO: 81721 - DNA, 75 bp, Artificial Sequence
  Synthetic
tattgattaagacggcaccagctctcaactctccaaatgttgaggcatgtgggtacagtgacagggtgctgcaac

SEQ ID NO: 81722 - DNA, 75 bp, Artificial Sequence
  Synthetic
caactctccaaatgttgaggcatgtgggtacagtgacagggtgctgcaactgaccttgggcaactccactataac

SEQ ID NO: 81723 - DNA, 75 bp, Artificial Sequence
  Synthetic
agtggatcaaccaacagagccggatgtggcaacttgtaggttctacacattagacacagtcatgtggggcaagga

SEQ ID NO: 81724 - DNA, 75 bp, Artificial Sequence
  Synthetic
gtggcaacttgtaggttctacacattagacacagtcatgtggggcaaggaatccaaggggtggtggtggaagcta

SEQ ID NO: 81725 - DNA, 75 bp, Artificial Sequence
  Synthetic
gtgcacgtccagtgcaatgcatctaaattccatcagggctcgctgggagtgtttgctataccagaatattgtctg

SEQ ID NO: 81726 - DNA, 75 bp, Artificial Sequence
  Synthetic
aattccatcagggctcgctgggagtgtttgctataccagaatattgtctggccggggatagtgacaagcagagat

SEQ ID NO: 81727 - DNA, 75 bp, Artificial Sequence
  Synthetic
tcacttctccaaaaagggagttttgcccagtagactacctattgggttgtggggtgttagtgggaaatgcttttg

SEQ ID NO: 81728 - DNA, 75 bp, Artificial Sequence
  Synthetic
cccagtagactacctattgggttgtggggtgttagtgggaaatgcttttgcgtttcctcaccaaatcattaactt

SEQ ID NO: 81729 - DNA, 75 bp, Artificial Sequence
  Synthetic
caactggggcattgccatcctccccctgtcaccattggattttgcacaggattcatcagtggagatacccatcac

SEQ ID NO: 81730 - DNA, 75 bp, Artificial Sequence
  Synthetic
ctgtcaccattggattttgcacaggattcatcagtggagatacccatcacagttacgatagctccaatgtgcagt

SEQ ID NO: 81731 - DNA, 75 bp, Artificial Sequence
  Synthetic
cagtacctgacctcagacaatcatcagtccccgtgtgctataccagaatttgatgttacgccaccgattgacatt

SEQ ID NO: 81732 - DNA, 75 bp, Artificial Sequence
  Synthetic
agtccccgtgtgctataccagaatttgatgttacgccaccgattgacattcccggagaggtcaaaaatatgatgg

SEQ ID NO: 81733 - DNA, 75 bp, Artificial Sequence
  Synthetic
ttaggttgagcgatagtgccaacttgagtgatccaatcttgtgtctgtctttgtcaccggcggccgatccacgtt

SEQ ID NO: 81734 - DNA, 75 bp, Artificial Sequence
  Synthetic
ccccgtaacttagaagcataaaaccaagttcagtaggaaggggtgcaaaccagtacctctatgaacaagcacttc

SEQ ID NO: 81735 - DNA, 75 bp, Artificial Sequence
  Synthetic
gagtgatccaatcttgtgtctgtctttgtcaccggcggccgatccacgtttgtcacacaccatgctaggagaggt

SEQ ID NO: 81736 - DNA, 75 bp, Artificial Sequence
  Synthetic
aaagttattggtcgcctacgcccctccaggagcgcaaccaccgaccagccgtaaggaggctatgctaggaacaca

SEQ ID NO: 81737 - DNA, 75 bp, Artificial Sequence
  Synthetic
ccaggagcgcaaccaccgaccagccgtaaggaggctatgctaggaacacatgttatctgggacttgggtttgcag

SEQ ID NO: 81738 - DNA, 75 bp, Artificial Sequence
  Synthetic
ggaggatacattagcatgttttaccagactagaattgtggttcctttatcaaccccaaaggctatggatatgcta

SEQ ID NO: 81739 - DNA, 75 bp, Artificial Sequence
  Synthetic
agactagaattgtggttcctttatcaaccccaaaggctatggatatgctaggctttgtgtcagcgtgcaacgact

SEQ ID NO: 81740 - DNA, 75 bp, Artificial Sequence
  Synthetic
ttatcatggctgcttatggtgacaatctgtgattgttatcataaagcgatttggattggccatccggtgagtgtt

SEQ ID NO: 81741 - DNA, 75 bp, Artificial Sequence
  Synthetic
tctgtgattgttatcataaagcgatttggattggccatccggtgagtgttgtatcgaatacttgactgtttgaca

SEQ ID NO: 81742 - DNA, 75 bp, Artificial Sequence
  Synthetic
ctgaagtggcacaaagtgccctggctctttcactccccaagccacaaaacagtctccctgacaccaaagccagcg

SEQ ID NO: 81743 - DNA, 75 bp, Artificial Sequence
  Synthetic
tctttcactccccaagccacaaaacagtctccctgacaccaaagccagcgggcccgctcattccaaagaggttcc

SEQ ID NO: 81744 - DNA, 75 bp, Artificial Sequence
  Synthetic
aaggtcggagcccatgaaaattcaaacagagcctacggcgggtctaccattaactatactacaatcaattattat

SEQ ID NO: 81745 - DNA, 75 bp, Artificial Sequence
  Synthetic
tcagcaacgcagcaggaccgagtccaccattgaatccttctttgcgagaggggcatgcgtcgccataatcgaagt

SEQ ID NO: 81746 - DNA, 75 bp, Artificial Sequence
  Synthetic
accattgaatccttctttgcgagaggggcatgcgtcgccataatcgaagtagacaatgaacagccaaccaccagg

SEQ ID NO: 81747 - DNA, 75 bp, Artificial Sequence
  Synthetic
agggactccgctagcaatgcagcaaacaagcaggactttgcacaggatccgtccaagttcaccgaacccataaag

SEQ ID NO: 81748 - DNA, 75 bp, Artificial Sequence
  Synthetic
acctactcccgctttgacatggagttcacatttgtggtgactgccaacttcaccaactcaaacaacggacatgct

SEQ ID NO: 81749 - DNA, 75 bp, Artificial Sequence
  Synthetic
tcacatttgtggtgactgccaacttcaccaactcaaacaacggacatgctctcaaccaggtgtaccagataatgt

SEQ ID NO: 81750 - DNA, 75 bp, Artificial Sequence
  Synthetic
acattagacactgtcacctggaaaaaagaatccagagggtggtggtggaaactaccagacgctttaaaagacatg

SEQ ID NO: 81751 - DNA, 75 bp, Artificial Sequence
  Synthetic
tctacacgtacggtgctgccccagcccgaatatctgtgccctatgtgggtttggccaatgcctactcacactttt

SEQ ID NO: 81752 - DNA, 75 bp, Artificial Sequence
  Synthetic
aagaatccagagggtggtggtggaaactaccagacgctttaaaagacatgggattattcggtcagaatatgttct

SEQ ID NO: 81753 - DNA, 75 bp, Artificial Sequence
  Synthetic
ccgaatatctgtgccctatgtgggtttggccaatgcctactcacacttttacgacggttttgccaaagtaccatt

SEQ ID NO: 81754 - DNA, 75 bp, Artificial Sequence
  Synthetic
gagtgtttgcagttccagagatgtgtttagctggtgacagtacaactcacatgttcacaaagtatgagaatgcta

SEQ ID NO: 81755 - DNA, 75 bp, Artificial Sequence
  Synthetic
cataagagtggtcaatgatcacaatcctacaaaagtcacatcaaaggtgcgaatttacatgaaacccaagcatgt

SEQ ID NO: 81756 - DNA, 75 bp, Artificial Sequence
  Synthetic
cctacaaaagtcacatcaaaggtgcgaatttacatgaaacccaagcatgtgagagtgtggtgtccgcgacccccg

SEQ ID NO: 81757 - DNA, 75 bp, Artificial Sequence
  Synthetic
atccaggtgaaaaagggggtgtattcacaggaagttttactcttgataacaacgctgacagccctgcacggaaat

SEQ ID NO: 81758 - DNA, 75 bp, Artificial Sequence
  Synthetic
acttatggctatgggcaccagaacaaggcagtgtacacagctgggtataagatctgtaattaccacctagcttct

SEQ ID NO: 81759 - DNA, 75 bp, Artificial Sequence
  Synthetic
aggcagtgtacacagctgggtataagatctgtaattaccacctagcttctcaggaagacatccagaacgccgtaa

SEQ ID NO: 81760 - DNA, 75 bp, Artificial Sequence
  Synthetic
gctagtattgccttatgtaaactcactctcaatagatagcatgacaaagcacaacaattggggaattgccatcct

SEQ ID NO: 81761 - DNA, 75 bp, Artificial Sequence
  Synthetic
gtaatacaggggtgtactattgtgaatcaagaaggaagtactacccagtatcttttgttgggcccacttttcagt

SEQ ID NO: 81762 - DNA, 75 bp, Artificial Sequence
  Synthetic
atcaagaaggaagtactacccagtatcttttgttgggcccacttttcagtatatggaagccaacgactactatcc

SEQ ID NO: 81763 - DNA, 75 bp, Artificial Sequence
  Synthetic
ctgcgagttcaacggtttacgcaacatcactgtgccaagaacccaagggttaccagtcctgaacacaccagggag

SEQ ID NO: 81764 - DNA, 75 bp, Artificial Sequence
  Synthetic
atcactgtgccaagaacccaagggttaccagtcctgaacacaccagggagcaaccaatatcttactgcagacaat

SEQ ID NO: 81765 - DNA, 75 bp, Artificial Sequence
  Synthetic
ccaacatggagtcataggcataattacagctggtggggaaggccttgtggcgttctcagacattagagatcttta

SEQ ID NO: 81766 - DNA, 75 bp, Artificial Sequence
  Synthetic
acagctggtggggaaggccttgtggcgttctcagacattagagatctttatgcatatgaagaggaagccatggaa

SEQ ID NO: 81767 - DNA, 75 bp, Artificial Sequence
  Synthetic
gcgcaagaacacaatggacatgtatagagtcgagctgagcgactcggctcacgctgacgctccaatcttgtgcct

SEQ ID NO: 81768 - DNA, 75 bp, Artificial Sequence
  Synthetic
atatcagagttaaccagcatggtcaccagtaccatcacggagaagttactcaaaaatctgattaagataatttca

SEQ ID NO: 81769 - DNA, 75 bp, Artificial Sequence
  Synthetic
ccagtaccatcacggagaagttactcaaaaatctgattaagataatttcatcactggtaataataaccaggaact

SEQ ID NO: 81770 - DNA, 75 bp, Artificial Sequence
  Synthetic
agtcgcaaggaggcaatgctcggaacacatgtagtatgggacattgggttgcagtcttcatgcaccatggtagta

SEQ ID NO: 81771 - DNA, 75 bp, Artificial Sequence
  Synthetic
agaaggcgtgtgacatcttagaaataccttatgtcatccgccaaggagatagctggcttaaaaagttcacagatg

SEQ ID NO: 81772 - DNA, 75 bp, Artificial Sequence
  Synthetic
accttatgtcatccgccaaggagatagctggcttaaaaagttcacagatgcttgtaatgctgccaaaggtttgga

SEQ ID NO: 81773 - DNA, 75 bp, Artificial Sequence
  Synthetic
tatcaaaccaaggttgttgtcccgttgtctacacccagaaagatggatatcttgggttttgtgtcagcttgtaat

SEQ ID NO: 81774 - DNA, 75 bp, Artificial Sequence
  Synthetic
tgagtttgtaactaagctcaagcaactcgaaatgctagagaatcaaatctcaactatccaccagtcctgtccaag

SEQ ID NO: 81775 - DNA, 75 bp, Artificial Sequence
  Synthetic
ctcgaaatgctagagaatcaaatctcaactatccaccagtcctgtccaagtcaggaacaccaggagatactcttc

SEQ ID NO: 81776 - DNA, 75 bp, Artificial Sequence
  Synthetic
catgccacaaggaattggtgatgtgatcgagggggccattgaagggatcaccaaaaacgcactagtccccctggc

SEQ ID NO: 81777 - DNA, 75 bp, Artificial Sequence
  Synthetic
aaattagagcacacaattaacaattacatacagttcaagagcaaacaccgtattgaaccagtatgcttgttagtg

SEQ ID NO: 81778 - DNA, 75 bp, Artificial Sequence
  Synthetic
acatacagttcaagagcaaacaccgtattgaaccagtatgcttgttagtgcatggtagtccagggacgggcaaat

SEQ ID NO: 81779 - DNA, 75 bp, Artificial Sequence
  Synthetic
ggagacaggagccaccaatccgttggagccatcagacaccgtgcaaacacgtcacgtcatccagaggcgaacgcg

SEQ ID NO: 81780 - DNA, 75 bp, Artificial Sequence
  Synthetic
gtcacgtcatccagaggcgaacgcgatcggagtccacggtggaatcgttcttcgcgagaggggcctgtgtggcta

SEQ ID NO: 81781 - DNA, 75 bp, Artificial Sequence
  Synthetic
cttcccattttgatgggtacaaacagcagggagtggttatcatggatgatcttaatcaaaatcctgatggtgcgg

SEQ ID NO: 81782 - DNA, 75 bp, Artificial Sequence
  Synthetic
gcagggagtggttatcatggatgatcttaatcaaaatcctgatggtgcggatatgaaactcttttgtcagatggt

SEQ ID NO: 81783 - DNA, 75 bp, Artificial Sequence
  Synthetic
ggcctcaaccaattctagccgaatcactccacccacagtggcacacagtgatgcactggccagacggttcgcttt

SEQ ID NO: 81784 - DNA, 75 bp, Artificial Sequence
  Synthetic
cctcaaattatactgatgcaaataacgggcatgcattgaaccaagtttatcagataatgtacataccacctggtg

SEQ ID NO: 81785 - DNA, 75 bp, Artificial Sequence
  Synthetic
actccacccacagtggcacacagtgatgcactggccagacggttcgcttttgatatggacattcaagtgatggga

SEQ ID NO: 81786 - DNA, 75 bp, Artificial Sequence
  Synthetic
ttcaagagatgttgcccattagtgtgtggaaaggcaattcaactgatggacaagtcatctagagttaggtacagc

SEQ ID NO: 81787 - DNA, 75 bp, Artificial Sequence
  Synthetic
gtggaaaggcaattcaactgatggacaagtcatctagagttaggtacagcattgaccagattaccaccatgatca

SEQ ID NO: 81788 - DNA, 75 bp, Artificial Sequence
  Synthetic
aactgaaggcgactcgctatacggtgctgcctcactgaatgactttggatcactagccgttcgcgtggtaaatga

SEQ ID NO: 81789 - DNA, 75 bp, Artificial Sequence
  Synthetic
acctgaaaattgacatcaaaacgacaccacctccagagtgcattaatgacttgcttcaagcagttgactcccagg

SEQ ID NO: 81790 - DNA, 75 bp, Artificial Sequence
  Synthetic
ttgcttcaagcagttgactcccaggaggtcagagactattgtgagaagaaagggtggattgtcaacattaccagc

SEQ ID NO: 81791 - DNA, 75 bp, Artificial Sequence
  Synthetic
ggaccaggtgtcgattataaagatgagctcaccccactaccagaaaagggattgacaacttatggatttggacac

SEQ ID NO: 81792 - DNA, 75 bp, Artificial Sequence
  Synthetic
ggagtggtgtatgtgatgtacaaactgtttgcaggacaccaaggggcttacacaggacttccaaataaaaaaccc

SEQ ID NO: 81793 - DNA, 75 bp, Artificial Sequence
  Synthetic
tccagtttctttcatagggcccactttccaattcatggaagccaatgattattacccggccagatatcaatcaca

SEQ ID NO: 81794 - DNA, 75 bp, Artificial Sequence
  Synthetic
atcctcacagcaatcactagcaaaggggagtttacaatgcttggggtacatgacaacatagccattctgccaact

SEQ ID NO: 81795 - DNA, 75 bp, Artificial Sequence
  Synthetic
gggagtttacaatgcttggggtacatgacaacatagccattctgccaactcacgcctcaccaggagaaacgatag

SEQ ID NO: 81796 - DNA, 75 bp, Artificial Sequence
  Synthetic
caatcgtcaccctcaaaaggaatgagaaattcagagacattagaccacacattcccactcaaatcactgagacca

SEQ ID NO: 81797 - DNA, 75 bp, Artificial Sequence
  Synthetic
gaaattcagagacattagaccacacattcccactcaaatcactgagaccaatgatggagtgttgatcgtgaacac

SEQ ID NO: 81798 - DNA, 75 bp, Artificial Sequence
  Synthetic
tgataaggtttctgagctagctaacatggtcactagtactattacagagaagctgcttaagaacttgatcaaaat

SEQ ID NO: 81799 - DNA, 75 bp, Artificial Sequence
  Synthetic
aaccgcacgcaccttgatgtacaatttcccaactagagcagggcagtgcggcggtgtcatcacatgcacaggcaa

SEQ ID NO: 81800 - DNA, 75 bp, Artificial Sequence
  Synthetic
tatttcatctcttgtgatcattaccaggaactatgaagacaccactacagtgcttgccaccctcgctctccttgg

SEQ ID NO: 81801 - DNA, 75 bp, Artificial Sequence
  Synthetic
ttcccaactagagcagggcagtgcggcggtgtcatcacatgcacaggcaaagtcatcggaatgcatgttggtggg

SEQ ID NO: 81802 - DNA, 75 bp, Artificial Sequence
  Synthetic
aagccgtctaaggaggtggggtatccaatcatcaatgctccttctaaaaccaaattagaacccagtgcatttcac

SEQ ID NO: 81803 - DNA, 75 bp, Artificial Sequence
  Synthetic
caatcatcaatgctccttctaaaaccaaattagaacccagtgcatttcaccacgtgtttgagggagtgaaagaac

SEQ ID NO: 81804 - DNA, 75 bp, Artificial Sequence
  Synthetic
gactggagtgggtgtccaacaagatatccaaattcattagttggttgcaagacaaaatcatcccacaagcgaggg

SEQ ID NO: 81805 - DNA, 75 bp, Artificial Sequence
  Synthetic
acaggatcaccgaggtggatgaatacatgaaggaggctgtggaccactacgcaggtcaactcatgtcattggaca

SEQ ID NO: 81806 - DNA, 75 bp, Artificial Sequence
  Synthetic
gcccaagtcaggaacaccaggagattttgttcaacaatgtgcggtggctctctattcagtccaagaggtttgcgc

SEQ ID NO: 81807 - DNA, 75 bp, Artificial Sequence
  Synthetic
catgaaggaggctgtggaccactacgcaggtcaactcatgtcattggacatcaacacagaacaaatgtgtcttga

SEQ ID NO: 81808 - DNA, 75 bp, Artificial Sequence
  Synthetic
gggaaagaaaaagagagacatcctaaacaaacaaaccagagacaccaaagagatgcaaaaactcttggacactta

SEQ ID NO: 81809 - DNA, 75 bp, Artificial Sequence
  Synthetic
aacaaacaaaccagagacaccaaagagatgcaaaaactcttggacacttacggaatcaacttaccgctggtcacc

SEQ ID NO: 81810 - DNA, 75 bp, Artificial Sequence
  Synthetic
acaagcaacagggcgtggttataatggatgacctaaaccagaatccagatggagcagatatgaaacttttttgtc

SEQ ID NO: 81811 - DNA, 75 bp, Artificial Sequence
  Synthetic
aatgattccgtggcaatgagaatggcctttggaaacctatacgcagcattccacaagaatccaggtgtggtgaca

SEQ ID NO: 81812 - DNA, 75 bp, Artificial Sequence
  Synthetic
ggatgacctaaaccagaatccagatggagcagatatgaaacttttttgtcaaatggtgtccactgtagaattcat

SEQ ID NO: 81813 - DNA, 75 bp, Artificial Sequence
  Synthetic
cctttggaaacctatacgcagcattccacaagaatccaggtgtggtgacaggttcagcggttgggtgcgatcctg

SEQ ID NO: 81814 - DNA, 75 bp, Artificial Sequence
  Synthetic
cactcagcccagcctggtttgaagcactcaagatggtgttggaaaaaattggatttggtgacagggtagattaca

SEQ ID NO: 81815 - DNA, 75 bp, Artificial Sequence
  Synthetic
catgagcgagtactccagagacggaaagctcaacatggcaatggccactgaattgtgtaagaactgtcatcaacc

SEQ ID NO: 81816 - DNA, 75 bp, Artificial Sequence
  Synthetic
aagctcaacatggcaatggccactgaattgtgtaagaactgtcatcaaccggcgaacttcaaaagatgctgcccc

SEQ ID NO: 81817 - DNA, 75 bp, Artificial Sequence
  Synthetic
ggatttggtgacagggtagattacattgattatctgaaccactcacaccatctatacaaaaacaaaacatactgt

SEQ ID NO: 81818 - DNA, 75 bp, Artificial Sequence
  Synthetic
atgattattaatgagagaaacagaagatcaaacattggcaattgtatggaagccctattccagggaccactgcaa

SEQ ID NO: 81819 - DNA, 75 bp, Artificial Sequence
  Synthetic
agccctattccagggaccactgcaatacagagatctaaaaatagatgttaaaaccagtccccctccagagtgcat

SEQ ID NO: 81820 - DNA, 75 bp, Artificial Sequence
  Synthetic
aactagtcaggttcaaacagagaggaacatcaaccgggcgatgaccattctacaagcagtgaccactttcgctgc

SEQ ID NO: 81821 - DNA, 75 bp, Artificial Sequence
  Synthetic
aacatcaaccgggcgatgaccattctacaagcagtgaccactttcgctgcggtagccggtgtcgtgtacgttatg

SEQ ID NO: 81822 - DNA, 75 bp, Artificial Sequence
  Synthetic
cagtaatgccaatgaaagaaattcatgaatcaatcagatggaccaaggatccaagaaacacacaagatcatgttc

SEQ ID NO: 81823 - DNA, 75 bp, Artificial Sequence
  Synthetic
gggttcatgataatgtagctatcttgccaactcacgcctcacccggtgggagcatcgtgattgacggcaaagaag

SEQ ID NO: 81824 - DNA, 75 bp, Artificial Sequence
  Synthetic
aaggataagctatttgcagtgtggaagatcacttataaagatactgtccagttacggaggaaattggagttcttc

SEQ ID NO: 81825 - DNA, 75 bp, Artificial Sequence
  Synthetic
gaacaggggtaccttaatcttggtggacgacaaaccgctcgcacactaatgtacaactttccaactagagcgggt

SEQ ID NO: 81826 - DNA, 75 bp, Artificial Sequence
  Synthetic
tggcgggaacggttcgcatgggttcgcggcggccctgaaacgatcatacttcactcaggaccaaggtgagataca

SEQ ID NO: 81827 - DNA, 75 bp, Artificial Sequence
  Synthetic
ttttcactacgtgtttgaaggggtgaaggaaccagcggtcctcactaaaaatgatcccaggctcaagactgactt

SEQ ID NO: 81828 - DNA, 75 bp, Artificial Sequence
  Synthetic
cgatggcctagaagcacttgatttgtccaccagtgctggttacccatatgtagcaatgggaaagaaaaagagaga

SEQ ID NO: 81829 - DNA, 75 bp, Artificial Sequence
  Synthetic
tagcaatgggaaagaaaaagagagacatcttgaacaagcagaccagagacaccaaggaaatgcagagactcttag

SEQ ID NO: 81830 - DNA, 75 bp, Artificial Sequence
  Synthetic
catcttgaacaagcagaccagagacaccaaggaaatgcagagactcttagacacatatggaatcaacttgccact

SEQ ID NO: 81831 - DNA, 75 bp, Artificial Sequence
  Synthetic
cagtttgaatgattcagtggccatgagaatggcatttggaaatctttatgcatcatttcacaaaaacccaggaat

SEQ ID NO: 81832 - DNA, 75 bp, Artificial Sequence
  Synthetic
agaatggcatttggaaatctttatgcatcatttcacaaaaacccaggaattgtcactggcagcgcagttggttgt

SEQ ID NO: 81833 - DNA, 75 bp, Artificial Sequence
  Synthetic
gacccagatctattctggagtaagatcccagtattgatggaagagaagctcttcgcatttgattacacaggatat

SEQ ID NO: 81834 - DNA, 75 bp, Artificial Sequence
  Synthetic
actaaacctaattagaattaccttgttaattagacattattatcacaatgggtgcacaagtgtcttcccagaagg

SEQ ID NO: 81835 - DNA, 75 bp, Artificial Sequence
  Synthetic
cacaccatctgtacaagaacaagacatactgtgtcaagggcggcatgccatctggctgctcaggcacttcaattt

SEQ ID NO: 81836 - DNA, 75 bp, Artificial Sequence
  Synthetic
atactgtgtcaagggcggcatgccatctggctgctcaggcacttcaattttcaactcaatgatcaacaatttgat

SEQ ID NO: 81837 - DNA, 75 bp, Artificial Sequence
  Synthetic
tcaactcaatgatcaacaatttgattatcaggacactcttactgaaaacctacaagggcatagatttagaccacc

SEQ ID NO: 81838 - DNA, 75 bp, Artificial Sequence
  Synthetic
attcagctagtaatgcagcctctaaacaggacttctcacaagacccatcgaagttcacagagccagttaaggaca

SEQ ID NO: 81839 - DNA, 75 bp, Artificial Sequence
  Synthetic
acaggacttctcacaagacccatcgaagttcacagagccagttaaggacatcatgctgaagtcagccccagctct

SEQ ID NO: 81840 - DNA, 75 bp, Artificial Sequence
  Synthetic
atctcaagaagctgcgaattcggtagttgcttacggggagtggccatcttatctaactgataaggaggcgaaccc

SEQ ID NO: 81841 - DNA, 75 bp, Artificial Sequence
  Synthetic
gttgcttacggggagtggccatcttatctaactgataaggaggcgaacccagtcgaccaaccaaccgagccagat

SEQ ID NO: 81842 - DNA, 75 bp, Artificial Sequence
  Synthetic
ggcagatgagaaatacccatttcttgttcacccagtaatgccaatgaaggaaattcatgaatcaattagatggac

SEQ ID NO: 81843 - DNA, 75 bp, Artificial Sequence
  Synthetic
ccagatgcattaaaggatatgggtctgttcgggcaaaacatgtactatcattacttaggacgctctggttataca

SEQ ID NO: 81844 - DNA, 75 bp, Artificial Sequence
  Synthetic
tgttcgggcaaaacatgtactatcattacttaggacgctctggttatacagtgcatgtgcaatgtaatgcatcca

SEQ ID NO: 81845 - DNA, 75 bp, Artificial Sequence
  Synthetic
tgctcccagagtactcaacattgtaccgccgttggcttgactcattttagcaaccctacttcagtcgaattggat

SEQ ID NO: 81846 - DNA, 75 bp, Artificial Sequence
  Synthetic
actatgtcagttatgtacaggcaaacccaggtgaagctggtggtgtattcactgacacgtacaaccctagcactg

SEQ ID NO: 81847 - DNA, 75 bp, Artificial Sequence
  Synthetic
cccaggtgaagctggtggtgtattcactgacacgtacaaccctagcactgacacaacaggagcacgtaagttcgc

SEQ ID NO: 81848 - DNA, 75 bp, Artificial Sequence
  Synthetic
cccagtactgctatgaacaagcacttctgttaccccggtgagattgcataagctgtccccacggctaaaagcgat

SEQ ID NO: 81849 - DNA, 75 bp, Artificial Sequence
  Synthetic
gcgtaccaacaactgtgccactttagtcctgccctacgtaaactccatggcaatcgattgcatggccaagcacaa

SEQ ID NO: 81850 - DNA, 75 bp, Artificial Sequence
  Synthetic
gtcctgccctacgtaaactccatggcaatcgattgcatggccaagcacaacaactggggaattgccatattgccc

SEQ ID NO: 81851 - DNA, 75 bp, Artificial Sequence
  Synthetic
gagttcaacggtttgagaaatctaactagccccgccaaacagggtttaccagtcatgaatgtaccgggcagtaac

SEQ ID NO: 81852 - DNA, 75 bp, Artificial Sequence
  Synthetic
gagcctattgagctacaagagagtcctccggcccctgaatgcggctaatcccaaccacggagcaggtgattgcaa

SEQ ID NO: 81853 - DNA, 75 bp, Artificial Sequence
  Synthetic
ctagccccgccaaacagggtttaccagtcatgaatgtaccgggcagtaaccagtttctatcatctgacaacttcc

SEQ ID NO: 81854 - DNA, 75 bp, Artificial Sequence
  Synthetic
aattggccgaaataggcactctaatcccaatggacctcagtgacactaagaagaatacaatgggtatgtacagag

SEQ ID NO: 81855 - DNA, 75 bp, Artificial Sequence
  Synthetic
atcacagattgttgtcataaagcgaattggattggccatccggtgagaattaaaacgattatttacttgtttgtt

SEQ ID NO: 81856 - DNA, 75 bp, Artificial Sequence
  Synthetic
cccaatggacctcagtgacactaagaagaatacaatgggtatgtacagagtagaactgggttctgccaaatcatt

SEQ ID NO: 81857 - DNA, 75 bp, Artificial Sequence
  Synthetic
tttgaactattacactcattggagtgggtctctcaaattcactttcctgttctgtggtagcatgatggcaacagg

SEQ ID NO: 81858 - DNA, 75 bp, Artificial Sequence
  Synthetic
gggtctctcaaattcactttcctgttctgtggtagcatgatggcaacagggaaaattctaatatcatacgcacca

SEQ ID NO: 81859 - DNA, 75 bp, Artificial Sequence
  Synthetic
tcctcagccacaatggtcgtgccctggattagtaatgtcatgtatcgaaggtgtgtcaaggacgacttcaccgag

SEQ ID NO: 81860 - DNA, 75 bp, Artificial Sequence
  Synthetic
ggattagtaatgtcatgtatcgaaggtgtgtcaaggacgacttcaccgaggggggctatatttcaatgttctacc

SEQ ID NO: 81861 - DNA, 75 bp, Artificial Sequence
  Synthetic
tcactgtgcgattgttaagagacactacacacatctcacaaacaaccgagatcaaaacgcaagggcctattgagg

SEQ ID NO: 81862 - DNA, 75 bp, Artificial Sequence
  Synthetic
tcactgtgcgattgttaagagacactacacacatctcacaaacaaccgagatcaatacgcaagggcctattgagg

SEQ ID NO: 81863 - DNA, 75 bp, Artificial Sequence
  Synthetic
tcactgtgcgattgttaagagacactacacacatctcacaaacaaccgagatcaacacgcaagggcctattgagg

SEQ ID NO: 81864 - DNA, 75 bp, Artificial Sequence
  Synthetic
tcactgtgcgattgttaagagacactacacacatctcacaaacaaccgagatcaagacgcaagggcctattgagg

SEQ ID NO: 81865 - DNA, 75 bp, Artificial Sequence
  Synthetic
tacacacatctcacaaacaaccgagatcaaaacgcaagggcctattgaggaaatcatctcaactgttgctagtaa

SEQ ID NO: 81866 - DNA, 75 bp, Artificial Sequence
  Synthetic
tacacacatctcacaaacaaccgagatcaatacgcaagggcctattgaggaaatcatctcaactgttgctagtaa

SEQ ID NO: 81867 - DNA, 75 bp, Artificial Sequence
  Synthetic
tacacacatctcacaaacaaccgagatcaacacgcaagggcctattgaggaaatcatctcaactgttgctagtaa

SEQ ID NO: 81868 - DNA, 75 bp, Artificial Sequence
  Synthetic
tacacacatctcacaaacaaccgagatcaagacgcaagggcctattgaggaaatcatctcaactgttgctagtaa

SEQ ID NO: 81869 - DNA, 75 bp, Artificial Sequence
  Synthetic
aaattccatcaaggggccttgggagtttttgccataccagaatatgtcatggcctgcaacactgaagccaagact

SEQ ID NO: 81870 - DNA, 75 bp, Artificial Sequence
  Synthetic
tcaagaagtaccggcactaacagcagtggaaactggagcaacgagtgatgtggtgccggctgacctagtacaaac

SEQ ID NO: 81871 - DNA, 75 bp, Artificial Sequence
  Synthetic
gtggaaactggagcaacgagtgatgtggtgccggctgacctagtacaaaccagacatgtagtgaacgtcaagtct

SEQ ID NO: 81872 - DNA, 75 bp, Artificial Sequence
  Synthetic
gctaccacaatggatgataagaaaaagttatttgcaaagtgggccattacatatacagacactgtacaactgagg

SEQ ID NO: 81873 - DNA, 75 bp, Artificial Sequence
  Synthetic
agttatttgcaaagtgggccattacatatacagacactgtacaactgaggcgaaaattggagtttttcacctact

SEQ ID NO: 81874 - DNA, 75 bp, Artificial Sequence
  Synthetic
aggtgtatcagatcatgtacgtccctccaggtgcaccaacacccggtgcacgggatgattatacatggcagacat

SEQ ID NO: 81875 - DNA, 75 bp, Artificial Sequence
  Synthetic
tccaggtgcaccaacacccggtgcacgggatgattatacatggcagacatcctccaatccatcaattttctttac

SEQ ID NO: 81876 - DNA, 75 bp, Artificial Sequence
  Synthetic
ctttagcagggtgcctttggaaggagaaacaactgactcaggggacacatactacggtttaacctccatcaatga

SEQ ID NO: 81877 - DNA, 75 bp, Artificial Sequence
  Synthetic
gaaacaactgactcaggggacacatactacggtttaacctccatcaatgatttcgggacgcttgctgtcagagtc

SEQ ID NO: 81878 - DNA, 75 bp, Artificial Sequence
  Synthetic
tgtccacggcctcctagggctgtgagctacagaggacctggcgtggatcttttatccacttctgtgacgcccttg

SEQ ID NO: 81879 - DNA, 75 bp, Artificial Sequence
  Synthetic
gctacagaggacctggcgtggatcttttatccacttctgtgacgcccttgtccaaacatgacctgactacatacg

SEQ ID NO: 81880 - DNA, 75 bp, Artificial Sequence
  Synthetic
atctagaaaatgcggttagcgttttgtggaacagggatctcttaattgctgagtccagagctcaaggaatagaca

SEQ ID NO: 81881 - DNA, 75 bp, Artificial Sequence
  Synthetic
gtggaacagggatctcttaattgctgagtccagagctcaaggaatagacacaatagccaggtgctcgtgcaacac

SEQ ID NO: 81882 - DNA, 75 bp, Artificial Sequence
  Synthetic
agccaatgactactatccagctaggtaccagtctcatatgctcattggacatggtttcgcctcaccaggagactg

SEQ ID NO: 81883 - DNA, 75 bp, Artificial Sequence
  Synthetic
agccaatgactactatccagctaggtaccagtctcatatgctcattggacatggtttcgcctcaccaggtgactg

SEQ ID NO: 81884 - DNA, 75 bp, Artificial Sequence
  Synthetic
agccaatgactactatccagctaggtaccagtctcatatgctcattggacatggtttcgcctcaccaggcgactg

SEQ ID NO: 81885 - DNA, 75 bp, Artificial Sequence
  Synthetic
agccaatgactactatccagctaggtaccagtctcatatgctcattggacatggtttcgcctcaccaggggactg

SEQ ID NO: 81886 - DNA, 75 bp, Artificial Sequence
  Synthetic
taccagtctcatatgctcattggacatggtttcgcctcaccaggagactgtggaggaatgctcagatgtcagcat

SEQ ID NO: 81887 - DNA, 75 bp, Artificial Sequence
  Synthetic
taccagtctcatatgctcattggacatggtttcgcctcaccaggagactgtggaggtatgctcagatgtcagcat

SEQ ID NO: 81888 - DNA, 75 bp, Artificial Sequence
  Synthetic
taccagtctcatatgctcattggacatggtttcgcctcaccaggagactgtggaggcatgctcagatgtcagcat

SEQ ID NO: 81889 - DNA, 75 bp, Artificial Sequence
  Synthetic
taccagtctcatatgctcattggacatggtttcgcctcaccaggagactgtggagggatgctcagatgtcagcat

SEQ ID NO: 81890 - DNA, 75 bp, Artificial Sequence
  Synthetic
taccagtctcatatgctcattggacatggtttcgcctcaccaggagactgtggtggaatgctcagatgtcagcat

SEQ ID NO: 81891 - DNA, 75 bp, Artificial Sequence
  Synthetic
taccagtctcatatgctcattggacatggtttcgcctcaccaggagactgtggtggtatgctcagatgtcagcat

SEQ ID NO: 81892 - DNA, 75 bp, Artificial Sequence
  Synthetic
taccagtctcatatgctcattggacatggtttcgcctcaccaggagactgtggtggcatgctcagatgtcagcat

SEQ ID NO: 81893 - DNA, 75 bp, Artificial Sequence
  Synthetic
taccagtctcatatgctcattggacatggtttcgcctcaccaggagactgtggtgggatgctcagatgtcagcat

SEQ ID NO: 81894 - DNA, 75 bp, Artificial Sequence
  Synthetic
taccagtctcatatgctcattggacatggtttcgcctcaccaggagactgtggcggaatgctcagatgtcagcat

SEQ ID NO: 81895 - DNA, 75 bp, Artificial Sequence
  Synthetic
taccagtctcatatgctcattggacatggtttcgcctcaccaggagactgtggcggtatgctcagatgtcagcat

SEQ ID NO: 81896 - DNA, 75 bp, Artificial Sequence
  Synthetic
taccagtctcatatgctcattggacatggtttcgcctcaccaggagactgtggcggcatgctcagatgtcagcat

SEQ ID NO: 81897 - DNA, 75 bp, Artificial Sequence
  Synthetic
taccagtctcatatgctcattggacatggtttcgcctcaccaggagactgtggcgggatgctcagatgtcagcat

SEQ ID NO: 81898 - DNA, 75 bp, Artificial Sequence
  Synthetic
taccagtctcatatgctcattggacatggtttcgcctcaccaggagactgtgggggaatgctcagatgtcagcat

SEQ ID NO: 81899 - DNA, 75 bp, Artificial Sequence
  Synthetic
taccagtctcatatgctcattggacatggtttcgcctcaccaggagactgtgggggtatgctcagatgtcagcat

SEQ ID NO: 81900 - DNA, 75 bp, Artificial Sequence
  Synthetic
taccagtctcatatgctcattggacatggtttcgcctcaccaggagactgtgggggcatgctcagatgtcagcat

SEQ ID NO: 81901 - DNA, 75 bp, Artificial Sequence
  Synthetic
taccagtctcatatgctcattggacatggtttcgcctcaccaggagactgtggggggatgctcagatgtcagcat

SEQ ID NO: 81902 - DNA, 75 bp, Artificial Sequence
  Synthetic
taccagtctcatatgctcattggacatggtttcgcctcaccaggtgactgtggaggaatgctcagatgtcagcat

SEQ ID NO: 81903 - DNA, 75 bp, Artificial Sequence
  Synthetic
taccagtctcatatgctcattggacatggtttcgcctcaccaggtgactgtggaggtatgctcagatgtcagcat

SEQ ID NO: 81904 - DNA, 75 bp, Artificial Sequence
  Synthetic
taccagtctcatatgctcattggacatggtttcgcctcaccaggtgactgtggaggcatgctcagatgtcagcat

SEQ ID NO: 81905 - DNA, 75 bp, Artificial Sequence
  Synthetic
taccagtctcatatgctcattggacatggtttcgcctcaccaggtgactgtggagggatgctcagatgtcagcat

SEQ ID NO: 81906 - DNA, 75 bp, Artificial Sequence
  Synthetic
taccagtctcatatgctcattggacatggtttcgcctcaccaggtgactgtggtggaatgctcagatgtcagcat

SEQ ID NO: 81907 - DNA, 75 bp, Artificial Sequence
  Synthetic
taccagtctcatatgctcattggacatggtttcgcctcaccaggtgactgtggtggtatgctcagatgtcagcat

SEQ ID NO: 81908 - DNA, 75 bp, Artificial Sequence
  Synthetic
taccagtctcatatgctcattggacatggtttcgcctcaccaggtgactgtggtggcatgctcagatgtcagcat

SEQ ID NO: 81909 - DNA, 75 bp, Artificial Sequence
  Synthetic
taccagtctcatatgctcattggacatggtttcgcctcaccaggtgactgtggtgggatgctcagatgtcagcat

SEQ ID NO: 81910 - DNA, 75 bp, Artificial Sequence
  Synthetic
taccagtctcatatgctcattggacatggtttcgcctcaccaggtgactgtggcggaatgctcagatgtcagcat

SEQ ID NO: 81911 - DNA, 75 bp, Artificial Sequence
  Synthetic
taccagtctcatatgctcattggacatggtttcgcctcaccaggtgactgtggcggtatgctcagatgtcagcat

SEQ ID NO: 81912 - DNA, 75 bp, Artificial Sequence
  Synthetic
taccagtctcatatgctcattggacatggtttcgcctcaccaggtgactgtggcggcatgctcagatgtcagcat

SEQ ID NO: 81913 - DNA, 75 bp, Artificial Sequence
  Synthetic
taccagtctcatatgctcattggacatggtttcgcctcaccaggtgactgtggcgggatgctcagatgtcagcat

SEQ ID NO: 81914 - DNA, 75 bp, Artificial Sequence
  Synthetic
taccagtctcatatgctcattggacatggtttcgcctcaccaggtgactgtgggggaatgctcagatgtcagcat

SEQ ID NO: 81915 - DNA, 75 bp, Artificial Sequence
  Synthetic
taccagtctcatatgctcattggacatggtttcgcctcaccaggtgactgtgggggtatgctcagatgtcagcat

SEQ ID NO: 81916 - DNA, 75 bp, Artificial Sequence
  Synthetic
taccagtctcatatgctcattggacatggtttcgcctcaccaggtgactgtgggggcatgctcagatgtcagcat

SEQ ID NO: 81917 - DNA, 75 bp, Artificial Sequence
  Synthetic
taccagtctcatatgctcattggacatggtttcgcctcaccaggtgactgtggggggatgctcagatgtcagcat

SEQ ID NO: 81918 - DNA, 75 bp, Artificial Sequence
  Synthetic
taccagtctcatatgctcattggacatggtttcgcctcaccaggcgactgtggaggaatgctcagatgtcagcat

SEQ ID NO: 81919 - DNA, 75 bp, Artificial Sequence
  Synthetic
taccagtctcatatgctcattggacatggtttcgcctcaccaggcgactgtggaggtatgctcagatgtcagcat

SEQ ID NO: 81920 - DNA, 75 bp, Artificial Sequence
  Synthetic
taccagtctcatatgctcattggacatggtttcgcctcaccaggcgactgtggaggcatgctcagatgtcagcat

SEQ ID NO: 81921 - DNA, 75 bp, Artificial Sequence
  Synthetic
taccagtctcatatgctcattggacatggtttcgcctcaccaggcgactgtggagggatgctcagatgtcagcat

SEQ ID NO: 81922 - DNA, 75 bp, Artificial Sequence
  Synthetic
taccagtctcatatgctcattggacatggtttcgcctcaccaggcgactgtggtggaatgctcagatgtcagcat

SEQ ID NO: 81923 - DNA, 75 bp, Artificial Sequence
  Synthetic
taccagtctcatatgctcattggacatggtttcgcctcaccaggcgactgtggtggtatgctcagatgtcagcat

SEQ ID NO: 81924 - DNA, 75 bp, Artificial Sequence
  Synthetic
taccagtctcatatgctcattggacatggtttcgcctcaccaggcgactgtggtggcatgctcagatgtcagcat

SEQ ID NO: 81925 - DNA, 75 bp, Artificial Sequence
  Synthetic
taccagtctcatatgctcattggacatggtttcgcctcaccaggcgactgtggtgggatgctcagatgtcagcat

SEQ ID NO: 81926 - DNA, 75 bp, Artificial Sequence
  Synthetic
taccagtctcatatgctcattggacatggtttcgcctcaccaggcgactgtggcggaatgctcagatgtcagcat

SEQ ID NO: 81927 - DNA, 75 bp, Artificial Sequence
  Synthetic
taccagtctcatatgctcattggacatggtttcgcctcaccaggcgactgtggcggtatgctcagatgtcagcat

SEQ ID NO: 81928 - DNA, 75 bp, Artificial Sequence
  Synthetic
taccagtctcatatgctcattggacatggtttcgcctcaccaggcgactgtggcggcatgctcagatgtcagcat

SEQ ID NO: 81929 - DNA, 75 bp, Artificial Sequence
  Synthetic
taccagtctcatatgctcattggacatggtttcgcctcaccaggcgactgtggcgggatgctcagatgtcagcat

SEQ ID NO: 81930 - DNA, 75 bp, Artificial Sequence
  Synthetic
taccagtctcatatgctcattggacatggtttcgcctcaccaggcgactgtgggggaatgctcagatgtcagcat

SEQ ID NO: 81931 - DNA, 75 bp, Artificial Sequence
  Synthetic
taccagtctcatatgctcattggacatggtttcgcctcaccaggcgactgtgggggtatgctcagatgtcagcat

SEQ ID NO: 81932 - DNA, 75 bp, Artificial Sequence
  Synthetic
taccagtctcatatgctcattggacatggtttcgcctcaccaggcgactgtgggggcatgctcagatgtcagcat

SEQ ID NO: 81933 - DNA, 75 bp, Artificial Sequence
  Synthetic
taccagtctcatatgctcattggacatggtttcgcctcaccaggcgactgtggggggatgctcagatgtcagcat

SEQ ID NO: 81934 - DNA, 75 bp, Artificial Sequence
  Synthetic
taccagtctcatatgctcattggacatggtttcgcctcaccaggggactgtggaggaatgctcagatgtcagcat

SEQ ID NO: 81935 - DNA, 75 bp, Artificial Sequence
  Synthetic
taccagtctcatatgctcattggacatggtttcgcctcaccaggggactgtggaggtatgctcagatgtcagcat

SEQ ID NO: 81936 - DNA, 75 bp, Artificial Sequence
  Synthetic
taccagtctcatatgctcattggacatggtttcgcctcaccaggggactgtggaggcatgctcagatgtcagcat

SEQ ID NO: 81937 - DNA, 75 bp, Artificial Sequence
  Synthetic
taccagtctcatatgctcattggacatggtttcgcctcaccaggggactgtggagggatgctcagatgtcagcat

SEQ ID NO: 81938 - DNA, 75 bp, Artificial Sequence
  Synthetic
taccagtctcatatgctcattggacatggtttcgcctcaccaggggactgtggtggaatgctcagatgtcagcat

SEQ ID NO: 81939 - DNA, 75 bp, Artificial Sequence
  Synthetic
taccagtctcatatgctcattggacatggtttcgcctcaccaggggactgtggtggtatgctcagatgtcagcat

SEQ ID NO: 81940 - DNA, 75 bp, Artificial Sequence
  Synthetic
taccagtctcatatgctcattggacatggtttcgcctcaccaggggactgtggtggcatgctcagatgtcagcat

SEQ ID NO: 81941 - DNA, 75 bp, Artificial Sequence
  Synthetic
taccagtctcatatgctcattggacatggtttcgcctcaccaggggactgtggtgggatgctcagatgtcagcat

SEQ ID NO: 81942 - DNA, 75 bp, Artificial Sequence
  Synthetic
taccagtctcatatgctcattggacatggtttcgcctcaccaggggactgtggcggaatgctcagatgtcagcat

SEQ ID NO: 81943 - DNA, 75 bp, Artificial Sequence
  Synthetic
taccagtctcatatgctcattggacatggtttcgcctcaccaggggactgtggcggtatgctcagatgtcagcat

SEQ ID NO: 81944 - DNA, 75 bp, Artificial Sequence
  Synthetic
taccagtctcatatgctcattggacatggtttcgcctcaccaggggactgtggcggcatgctcagatgtcagcat

SEQ ID NO: 81945 - DNA, 75 bp, Artificial Sequence
  Synthetic
taccagtctcatatgctcattggacatggtttcgcctcaccaggggactgtggcgggatgctcagatgtcagcat

SEQ ID NO: 81946 - DNA, 75 bp, Artificial Sequence
  Synthetic
taccagtctcatatgctcattggacatggtttcgcctcaccaggggactgtgggggaatgctcagatgtcagcat

SEQ ID NO: 81947 - DNA, 75 bp, Artificial Sequence
  Synthetic
taccagtctcatatgctcattggacatggtttcgcctcaccaggggactgtgggggtatgctcagatgtcagcat

SEQ ID NO: 81948 - DNA, 75 bp, Artificial Sequence
  Synthetic
taccagtctcatatgctcattggacatggtttcgcctcaccaggggactgtgggggcatgctcagatgtcagcat

SEQ ID NO: 81949 - DNA, 75 bp, Artificial Sequence
  Synthetic
taccagtctcatatgctcattggacatggtttcgcctcaccaggggactgtggggggatgctcagatgtcagcat

SEQ ID NO: 81950 - DNA, 75 bp, Artificial Sequence
  Synthetic
gaggaggaggctatggaacagggcattaccaactacattgaatctctgggagctgcctttgggagtgggtttaca

SEQ ID NO: 81951 - DNA, 75 bp, Artificial Sequence
  Synthetic
ttaccaactacattgaatctctgggagctgcctttgggagtgggtttacacagcaaattggagacaaagtttccg

SEQ ID NO: 81952 - DNA, 75 bp, Artificial Sequence
  Synthetic
tcatcatcaccagaaactatgaggatactaccacagtattggccactctagcactccttggatgcgatgtgtcac

SEQ ID NO: 81953 - DNA, 75 bp, Artificial Sequence
  Synthetic
tactaccacagtattggccactctagcactccttggatgcgatgtgtcaccatggcaatggctcaagaagaaggc

SEQ ID NO: 81954 - DNA, 75 bp, Artificial Sequence
  Synthetic
tgcagcaaaaggattggagtgggtttccaacaagatatccaaattcatcgattggcttaaagagaaaatcatccc

SEQ ID NO: 81955 - DNA, 75 bp, Artificial Sequence
  Synthetic
tccaacaagatatccaaattcatcgattggcttaaagagaaaatcatcccacaagctagggataaattggagttc

SEQ ID NO: 81956 - DNA, 75 bp, Artificial Sequence
  Synthetic
catcaagagatcttgttcaacaacgttagatggttatccatacaatcaaaaaggttcgctcctctctatgcagtg

SEQ ID NO: 81957 - DNA, 75 bp, Artificial Sequence
  Synthetic
ttagatggttatccatacaatcaaaaaggttcgctcctctctatgcagtggaggcaaagagaattcaaaagttag

SEQ ID NO: 81958 - DNA, 75 bp, Artificial Sequence
  Synthetic
aacgcgtactcgcacttttacgacgggttcgcgcgtgttcctttgaaggatgagactgttgactctggagacaca

SEQ ID NO: 81959 - DNA, 75 bp, Artificial Sequence
  Synthetic
gtcccgggactggtaaatcagtagccaccaatttaatagccagagcaattgcagagaaagagaatacttccactt

SEQ ID NO: 81960 - DNA, 75 bp, Artificial Sequence
  Synthetic
caccaatttaatagccagagcaattgcagagaaagagaatacttccacttactcgctacctcctgacccatctca

SEQ ID NO: 81961 - DNA, 75 bp, Artificial Sequence
  Synthetic
attgttctgtcaaatggtctccacagttgaattcataccacccatggcgtcactagaggaaaaaggcattttgtt

SEQ ID NO: 81962 - DNA, 75 bp, Artificial Sequence
  Synthetic
attgttctgtcatatggtctccacagttgaattcataccacccatggcgtcactagaggaaaaaggcattttgtt

SEQ ID NO: 81963 - DNA, 75 bp, Artificial Sequence
  Synthetic
attgttctgtcacatggtctccacagttgaattcataccacccatggcgtcactagaggaaaaaggcattttgtt

SEQ ID NO: 81964 - DNA, 75 bp, Artificial Sequence
  Synthetic
attgttctgtcagatggtctccacagttgaattcataccacccatggcgtcactagaggaaaaaggcattttgtt

SEQ ID NO: 81965 - DNA, 75 bp, Artificial Sequence
  Synthetic
tttggaggatttggacaccagaatatggcggtgtatgttgcaggttacaagatatgcaactatcatctggccacc

SEQ ID NO: 81966 - DNA, 75 bp, Artificial Sequence
  Synthetic
gttgaattcataccacccatggcgtcactagaggaaaaaggcattttgttcacttccaattacgttctggcttcc

SEQ ID NO: 81967 - DNA, 75 bp, Artificial Sequence
  Synthetic
gatatacaagttatgaatgaatactccagagatgggaagctgaacatggctatggctactgagatgtgtaagaat

SEQ ID NO: 81968 - DNA, 75 bp, Artificial Sequence
  Synthetic
ccagagatgggaagctgaacatggctatggctactgagatgtgtaagaattgccatcaaccatcaaatttcaaaa

SEQ ID NO: 81969 - DNA, 75 bp, Artificial Sequence
  Synthetic
aaattactaccatgattatcaatgaaagaaacagaaggtcaaacattggtaactgcatggaggcactgttccaag

SEQ ID NO: 81970 - DNA, 75 bp, Artificial Sequence
  Synthetic
acagcaggtggtaatgggattgttgcttttgcagatatcagagacttgtgggtgtatgaggaagaagcaatggaa

SEQ ID NO: 81971 - DNA, 75 bp, Artificial Sequence
  Synthetic
aagaaacagaaggtcaaacattggtaactgcatggaggcactgttccaaggtccactccagtacaaagatctcaa

SEQ ID NO: 81972 - DNA, 75 bp, Artificial Sequence
  Synthetic
agattactgtgaaaagaagggatggatagtggacatcactagtcaggtccagactgaaaggaatatcaacagagc

SEQ ID NO: 81973 - DNA, 75 bp, Artificial Sequence
  Synthetic
atagtggacatcactagtcaggtccagactgaaaggaatatcaacagagcaatgaccatactacaggctgtcacc

SEQ ID NO: 81974 - DNA, 75 bp, Artificial Sequence
  Synthetic
ctcccaaacaaaagacccaacatcccgacaatcagaactgccaaagtccagggacccggatttgactatgcagtg

SEQ ID NO: 81975 - DNA, 75 bp, Artificial Sequence
  Synthetic
cgacaatcagaactgccaaagtccagggacccggatttgactatgcagtggcaatggccaaaaggaacattctca

SEQ ID NO: 81976 - DNA, 75 bp, Artificial Sequence
  Synthetic
agctggatgaagaaatttactgaagcctgtaatgctgccaaagggttagaatggatctccaataagatttccaaa

SEQ ID NO: 81977 - DNA, 75 bp, Artificial Sequence
  Synthetic
cctgtaatgctgccaaagggttagaatggatctccaataagatttccaaatttattgattggttgaaagagaaga

SEQ ID NO: 81978 - DNA, 75 bp, Artificial Sequence
  Synthetic
caccaggtgaaacaatagtcatagatggaaaggaggtggaggttctggatgccaaagcattggaggatcaagcag

SEQ ID NO: 81979 - DNA, 75 bp, Artificial Sequence
  Synthetic
aaattggaaaacaccatcaacaactacatccagttcaagagcaaacaccgtattgaaccagtatgcatgttgata

SEQ ID NO: 81980 - DNA, 75 bp, Artificial Sequence
  Synthetic
catggctccccaggaacaggaaagtccattgccacatcattgattggtagggcgatagctgaaaaagaaaatacc

SEQ ID NO: 81981 - DNA, 75 bp, Artificial Sequence
  Synthetic
ctagagcaggccagtgtggtggagtcatcacatgcactggcaaggtcattgggatgcacgttggtgggaacggtt

SEQ ID NO: 81982 - DNA, 75 bp, Artificial Sequence
  Synthetic
catcacatgcactggcaaggtcattgggatgcacgttggtgggaacggttcgcaagggtttgcagcagccctaaa

SEQ ID NO: 81983 - DNA, 75 bp, Artificial Sequence
  Synthetic
catcacatgcactggcaaggtcattgggatgcacgttggtgggaacggttcgcatgggtttgcagcagccctaaa

SEQ ID NO: 81984 - DNA, 75 bp, Artificial Sequence
  Synthetic
catcacatgcactggcaaggtcattgggatgcacgttggtgggaacggttcgcacgggtttgcagcagccctaaa

SEQ ID NO: 81985 - DNA, 75 bp, Artificial Sequence
  Synthetic
catcacatgcactggcaaggtcattgggatgcacgttggtgggaacggttcgcaggggtttgcagcagccctaaa

SEQ ID NO: 81986 - DNA, 75 bp, Artificial Sequence
  Synthetic
taacgctccctctaaaactaaactagaacctagtgccttccaccatgtgatcgagggagtcaaagagccagctgt

SEQ ID NO: 81987 - DNA, 75 bp, Artificial Sequence
  Synthetic
taacgctccctctaaaactaaactagaacctagtgccttccaccatgtgttcgagggagtcaaagagccagctgt

SEQ ID NO: 81988 - DNA, 75 bp, Artificial Sequence
  Synthetic
taacgctccctctaaaactaaactagaacctagtgccttccaccatgtgctcgagggagtcaaagagccagctgt

SEQ ID NO: 81989 - DNA, 75 bp, Artificial Sequence
  Synthetic
taacgctccctctaaaactaaactagaacctagtgccttccaccatgtggtcgagggagtcaaagagccagctgt

SEQ ID NO: 81990 - DNA, 75 bp, Artificial Sequence
  Synthetic
atggcatccttggaagaaaaggggattctttttacttcagactatgtgttggcctcaacaaactcacataccatt

SEQ ID NO: 81991 - DNA, 75 bp, Artificial Sequence
  Synthetic
gaacctagtgccttccaccatgtgatcgagggagtcaaagagccagctgtactcactaagaatgatcccagactg

SEQ ID NO: 81992 - DNA, 75 bp, Artificial Sequence
  Synthetic
gaacctagtgccttccaccatgtgttcgagggagtcaaagagccagctgtactcactaagaatgatcccagactg

SEQ ID NO: 81993 - DNA, 75 bp, Artificial Sequence
  Synthetic
gaacctagtgccttccaccatgtgctcgagggagtcaaagagccagctgtactcactaagaatgatcccagactg

SEQ ID NO: 81994 - DNA, 75 bp, Artificial Sequence
  Synthetic
gaacctagtgccttccaccatgtggtcgagggagtcaaagagccagctgtactcactaagaatgatcccagactg

SEQ ID NO: 81995 - DNA, 75 bp, Artificial Sequence
  Synthetic
gaagcagtggaccattacgctggccagttaatgtctttggacataaacacagagcagatgtgccttgaagatgca

SEQ ID NO: 81996 - DNA, 75 bp, Artificial Sequence
  Synthetic
caaggattgtccacaaccagctaattttaagaagtgttgcccattggtttgtggaaaggctctacaattaatgga

SEQ ID NO: 81997 - DNA, 75 bp, Artificial Sequence
  Synthetic
agttaatgtctttggacataaacacagagcagatgtgccttgaagatgcaatgtacggcacggatggccttgaag

SEQ ID NO: 81998 - DNA, 75 bp, Artificial Sequence
  Synthetic
cattgggaattgcatggaggcattgtttcaaggccctatacagtacagagatttgaagattgacattaaagagac

SEQ ID NO: 81999 - DNA, 75 bp, Artificial Sequence
  Synthetic
aaactagagacaccaaggaaatgcaaagattgctagacacttatggtataaacctccctctagtcacttatgtta

SEQ ID NO: 82000 - DNA, 75 bp, Artificial Sequence
  Synthetic
atttgaagattgacattaaagagacacctgccccagactacattaatgatcttcttcaatcagtggacagccaag

SEQ ID NO: 82001 - DNA, 75 bp, Artificial Sequence
  Synthetic
aagattgctagacacttatggtataaacctccctctagtcacttatgttaaagatgagcttaggtccaaaactaa

SEQ ID NO: 82002 - DNA, 75 bp, Artificial Sequence
  Synthetic
acctgccccagactacattaatgatcttcttcaatcagtggacagccaagagctcagggactactgcgagaaaaa

SEQ ID NO: 82003 - DNA, 75 bp, Artificial Sequence
  Synthetic
agctcagggactactgcgagaaaaagggatggatcgtcaagcttaataacgacctagtggtagaaagaaacctaa

SEQ ID NO: 82004 - DNA, 75 bp, Artificial Sequence
  Synthetic
aaacctctatgctgcatttcacaaaaatccaggtgtggtgacaggttcagctgttggttgcgatccagatttgtt

SEQ ID NO: 82005 - DNA, 75 bp, Artificial Sequence
  Synthetic
gacctagtggtagaaagaaacctaaacagggccatgactgttttacaggctgtgactacatttgccgctgtggct

SEQ ID NO: 82006 - DNA, 75 bp, Artificial Sequence
  Synthetic
ctgttggttgcgatccagatttgttttggagcaagataccagtgttaatggaagagaaactttttgcatttgatt

SEQ ID NO: 82007 - DNA, 75 bp, Artificial Sequence
  Synthetic
ctgttggttgcgatccagatttgttttggagcatgataccagtgttaatggaagagaaactttttgcatttgatt

SEQ ID NO: 82008 - DNA, 75 bp, Artificial Sequence
  Synthetic
ctgttggttgcgatccagatttgttttggagcacgataccagtgttaatggaagagaaactttttgcatttgatt

SEQ ID NO: 82009 - DNA, 75 bp, Artificial Sequence
  Synthetic
ctgttggttgcgatccagatttgttttggagcaggataccagtgttaatggaagagaaactttttgcatttgatt

SEQ ID NO: 82010 - DNA, 75 bp, Artificial Sequence
  Synthetic
agtgttcccaccattagaacagcaaaggtgcaagggcccgggtttgattatgcagtagcaatggccaagagaaat

SEQ ID NO: 82011 - DNA, 75 bp, Artificial Sequence
  Synthetic
gtgacagagtagattacatagactatctaaaccactcacaccatctttacaaaaacaaaacatactgtgtcaagg

SEQ ID NO: 82012 - DNA, 75 bp, Artificial Sequence
  Synthetic
aaaaacaaaacatactgtgtcaagggtggcatgccatctggctgctcaggcacttcaatttttaattcaatgatt

SEQ ID NO: 82013 - DNA, 75 bp, Artificial Sequence
  Synthetic
cacttcaatttttaattcaatgattaacaacttgatcattaggacactcttaatgaaaacctacaagggcataga

SEQ ID NO: 82014 - DNA, 75 bp, Artificial Sequence
  Synthetic
cacttcaatttttaattcaatgattaacaacttgatcattaggacactcttattgaaaacctacaagggcataga

SEQ ID NO: 82015 - DNA, 75 bp, Artificial Sequence
  Synthetic
cacttcaatttttaattcaatgattaacaacttgatcattaggacactcttactgaaaacctacaagggcataga

SEQ ID NO: 82016 - DNA, 75 bp, Artificial Sequence
  Synthetic
cacttcaatttttaattcaatgattaacaacttgatcattaggacactcttagtgaaaacctacaagggcataga

SEQ ID NO: 82017 - DNA, 75 bp, Artificial Sequence
  Synthetic
cctagatgctgaggcattggaagatcagtcaggtataaatttggaaattaccatagtaaaactaaaaagaaatga

SEQ ID NO: 82018 - DNA, 75 bp, Artificial Sequence
  Synthetic
cctgtaggtgctgtgaccgaacaggggtatcttaatcttggtggccgacaaactgctcgtactttaatgtaccac

SEQ ID NO: 82019 - DNA, 75 bp, Artificial Sequence
  Synthetic
gccaatgaaagagattcatgaatcaattagatggacaaaggatcctagaaacacccaggaccacgttcgctcact

SEQ ID NO: 82020 - DNA, 75 bp, Artificial Sequence
  Synthetic
gagccaaggtgagatccaatggatgagaccatcaaaagaggtagggtacccggtgattaacgcaccaagtaaaac

SEQ ID NO: 82021 - DNA, 75 bp, Artificial Sequence
  Synthetic
caggctaaagacagactttgaagaggccattttctctaagtatgtgggtaacaagatcacagaagttgacgagta

SEQ ID NO: 82022 - DNA, 75 bp, Artificial Sequence
  Synthetic
gccattttctctaagtatgtgggtaacaagatcacagaagttgacgagtacatgaaggaagccgtcgatcactat

SEQ ID NO: 82023 - DNA, 75 bp, Artificial Sequence
  Synthetic
gtactctggtatcgcggtaccttagtatgcctgttttatgtctcctttcccccgcaactttagaagtaatcaagt

SEQ ID NO: 82024 - DNA, 75 bp, Artificial Sequence
  Synthetic
tatgcctgttttatgtctcctttcccccgcaactttagaagtaatcaagttatggctcaacagtcgccacacccc

SEQ ID NO: 82025 - DNA, 75 bp, Artificial Sequence
  Synthetic
tttaaaacagcctgggggttgttcccacccccagggcccactgggcgttagtactctggtatcgcggtaccttag

SEQ ID NO: 82026 - DNA, 75 bp, Artificial Sequence
  Synthetic
atcgttatccgctcaactactacgggaagcctagtaccaccatggattgacctgaaagttgcgttcagcgcaccc

SEQ ID NO: 82027 - DNA, 75 bp, Artificial Sequence
  Synthetic
gaagcctagtaccaccatggattgacctgaaagttgcgttcagcgcacccccagcgcagctcaggccgatgaggc

SEQ ID NO: 82028 - DNA, 75 bp, Artificial Sequence
  Synthetic
tttcatgacatggtgcgaagagcctactgtgctagttgagagtcctccggcccctgaatgtggataatcctaacc

SEQ ID NO: 82029 - DNA, 75 bp, Artificial Sequence
  Synthetic
actgtgctagttgagagtcctccggcccctgaatgtggataatcctaaccactgaacctacgggcgcaaaccagc

SEQ ID NO: 82030 - DNA, 75 bp, Artificial Sequence
  Synthetic
acttgttttggagtaaaataccagttttgatggaagaaaagctgtttgcttttgattacacaggctatgatgctt

SEQ ID NO: 82031 - DNA, 75 bp, Artificial Sequence
  Synthetic
gaatgtttatggtgacaattgttgtgtacagttgttaccatagtttgcattcagaaataaacctaacactttcca

SEQ ID NO: 82032 - DNA, 75 bp, Artificial Sequence
  Synthetic
gtacagttgttaccatagtttgcattcagaaataaacctaacactttccaattatttgttacaatgggtgctcaa

SEQ ID NO: 82033 - DNA, 75 bp, Artificial Sequence
  Synthetic
ataaactattataaagacagcgccagtaacgcggcgtccaagttagatttctctcaggacccttccaaattcact

SEQ ID NO: 82034 - DNA, 75 bp, Artificial Sequence
  Synthetic
gtaacgcggcgtccaagttagatttctctcaggacccttccaaattcactgaaccagttaaggatgtgatgatta

SEQ ID NO: 82035 - DNA, 75 bp, Artificial Sequence
  Synthetic
acactcttactgaaaacctacaagggcatagatttagaccacctaaagatgattgcctatggtgatgatgtgatt

SEQ ID NO: 82036 - DNA, 75 bp, Artificial Sequence
  Synthetic
gtaattccacaattactactcaagaagcagctaacgcagtgattggatatggtgagtggccgcaatttcttaatt

SEQ ID NO: 82037 - DNA, 75 bp, Artificial Sequence
  Synthetic
agcagctaacgcagtgattggatatggtgagtggccgcaatttcttaattcggccgatgcaaacccagtagatgc

SEQ ID NO: 82038 - DNA, 75 bp, Artificial Sequence
  Synthetic
tgaatcaattagatggaccaaggatcctaggaacacccaggatcatgttcgctcattgtgcttattggcttggca

SEQ ID NO: 82039 - DNA, 75 bp, Artificial Sequence
  Synthetic
ctggtggtggaagcttcccgacgcccttaaagatatgggtatgtttgggcaaaacatgtactatcactacctggg

SEQ ID NO: 82040 - DNA, 75 bp, Artificial Sequence
  Synthetic
cttaaagatatgggtatgtttgggcaaaacatgtactatcactacctgggcagggctggttacacagttcacgtt

SEQ ID NO: 82041 - DNA, 75 bp, Artificial Sequence
  Synthetic
tcggcagatcagactggtggaatcacctacgaaaaggccaaccctggagaggctggtggcaaattccaagcctcg

SEQ ID NO: 82042 - DNA, 75 bp, Artificial Sequence
  Synthetic
cctacgaaaaggccaaccctggagaggctggtggcaaattccaagcctcgttcactccatccgcagaggacggga

SEQ ID NO: 82043 - DNA, 75 bp, Artificial Sequence
  Synthetic
accaaattataaacttacgcacaaacaactgtgccacgctggtgctaccatacgtgaactcatcagcaaccgact

SEQ ID NO: 82044 - DNA, 75 bp, Artificial Sequence
  Synthetic
caactgtgccacgctggtgctaccatacgtgaactcatcagcaaccgactcgatggcaaagcacaataattgggg

SEQ ID NO: 82045 - DNA, 75 bp, Artificial Sequence
  Synthetic
cagagtgtagcttaggctgatgagtctggacatccctcaccggtgacggtggtccaggctgcgttggcggcctac

SEQ ID NO: 82046 - DNA, 75 bp, Artificial Sequence
  Synthetic
tgctcccatgtgttgtgagttcaatgggctcagagcgcagacaaaccctgttttacaagggctgcctgtccttaa

SEQ ID NO: 82047 - DNA, 75 bp, Artificial Sequence
  Synthetic
gggctcagagcgcagacaaaccctgttttacaagggctgcctgtccttaacactccagggtccaatcaattccta

SEQ ID NO: 82048 - DNA, 75 bp, Artificial Sequence
  Synthetic
gtgcgaaacatgatggaactagcggaaatagacagtgttattccaatgaacgcagtagcaggtaaagtcaacaca

SEQ ID NO: 82049 - DNA, 75 bp, Artificial Sequence
  Synthetic
aaatagacagtgttattccaatgaacgcagtagcaggtaaagtcaacacaatggaggcatacccaattccattga

SEQ ID NO: 82050 - DNA, 75 bp, Artificial Sequence
  Synthetic
gcactctgttgggcgagatattgaactattacacccattgggctgggtccatcaaatttacattcctattttgtg

SEQ ID NO: 82051 - DNA, 75 bp, Artificial Sequence
  Synthetic
ctattacacccattgggctgggtccatcaaatttacattcctattttgtgggagcatgatggccactggcaagat

SEQ ID NO: 82052 - DNA, 75 bp, Artificial Sequence
  Synthetic
ctgggacataggactgcagtctagtgtcacactagtggcgccatggatttcaaacacggactatcggcggagtac

SEQ ID NO: 82053 - DNA, 75 bp, Artificial Sequence
  Synthetic
gtcacactagtggcgccatggatttcaaacacggactatcggcggagtacaaaagacgacttcactgagggtggc

SEQ ID NO: 82054 - DNA, 75 bp, Artificial Sequence
  Synthetic
gagggtggtggtggaagttgcctgatgcactgcgggacatgggactctttggccaaaatatgtactaccactacc

SEQ ID NO: 82055 - DNA, 75 bp, Artificial Sequence
  Synthetic
gtgagcgcttgtaacgatttttccgccaggttgctacgtgacacgccttttgtccgtcagctcgcaagtgcatgg

SEQ ID NO: 82056 - DNA, 75 bp, Artificial Sequence
  Synthetic
ccaggttgctacgtgacacgccttttgtccgtcagctcgcaagtgcatggaaccagggtgtggacgacaaaattg

SEQ ID NO: 82057 - DNA, 75 bp, Artificial Sequence
  Synthetic
caaaggaggtcccagcactaacagctgtggagactggagcaactagtaaagtggtcccatccgacctcattgaga

SEQ ID NO: 82058 - DNA, 75 bp, Artificial Sequence
  Synthetic
tgtggagactggagcaactagtaaagtggtcccatccgacctcattgagacccggcacgttataaataagagaca

SEQ ID NO: 82059 - DNA, 75 bp, Artificial Sequence
  Synthetic
tcccaccagcgacaacgccaaggatctcttcgccacatggaaaatatcttaccactacgcatatcagttgcgtag

SEQ ID NO: 82060 - DNA, 75 bp, Artificial Sequence
  Synthetic
ctcttcgccacatggaaaatatcttaccactacgcatatcagttgcgtaggaaattggaaatgttcacctattct

SEQ ID NO: 82061 - DNA, 75 bp, Artificial Sequence
  Synthetic
gtgtaccagattatgtacataccaccaggcgcgcccataccacaagcttgggatgatttcacgtggcagacctca

SEQ ID NO: 82062 - DNA, 75 bp, Artificial Sequence
  Synthetic
caggcgcgcccataccacaagcttgggatgatttcacgtggcagacctcaaccaatccctcagtcttttacacca

SEQ ID NO: 82063 - DNA, 75 bp, Artificial Sequence
  Synthetic
tttccctggtgccacacactcaatttgacgcaggggccaccaacaaatatgggtacaatagtattaatgactttg

SEQ ID NO: 82064 - DNA, 75 bp, Artificial Sequence
  Synthetic
tgacgcaggggccaccaacaaatatgggtacaatagtattaatgactttggcactgtggctgtgcgggttgtaaa

SEQ ID NO: 82065 - DNA, 75 bp, Artificial Sequence
  Synthetic
caggccacctagagttgtggattacaccggcccgtcagtggattacaagcaaactaacaaagttatgacccaagt

SEQ ID NO: 82066 - DNA, 75 bp, Artificial Sequence
  Synthetic
accggcccgtcagtggattacaagcaaactaacaaagttatgacccaagttgcatccatacgaacctacgggttt

SEQ ID NO: 82067 - DNA, 75 bp, Artificial Sequence
  Synthetic
gaacacgcagtagccgtgatgtgggaccgggacctcatggtagcagagagtcgagcccagggaattgacaccatt

SEQ ID NO: 82068 - DNA, 75 bp, Artificial Sequence
  Synthetic
accgggacctcatggtagcagagagtcgagcccagggaattgacaccattgctaggtgttcttgcaagtgtggcg

SEQ ID NO: 82069 - DNA, 75 bp, Artificial Sequence
  Synthetic
acgagtattaccccgctcgataccaatcgcatatgcttataggagccgggtttgcaatgccaggcgactgtggag

SEQ ID NO: 82070 - DNA, 75 bp, Artificial Sequence
  Synthetic
atcgcatatgcttataggagccgggtttgcaatgccaggcgactgtggagggatcctacgatgcacccacggggt

SEQ ID NO: 82071 - DNA, 75 bp, Artificial Sequence
  Synthetic
agaggccatggaacaaggcattactgattacatcagtgggttgggagcagcctttggagcaggtttcagcactga

SEQ ID NO: 82072 - DNA, 75 bp, Artificial Sequence
  Synthetic
gattacatcagtgggttgggagcagcctttggagcaggtttcagcactgagatttctagcgggatacaagaactg

SEQ ID NO: 82073 - DNA, 75 bp, Artificial Sequence
  Synthetic
gtggcaaggaactatgaagattccataactgtgctggccaccctcagcttattgggatgcgactcctcaccatgg

SEQ ID NO: 82074 - DNA, 75 bp, Artificial Sequence
  Synthetic
taactgtgctggccaccctcagcttattgggatgcgactcctcaccatggcattggttaaaagagaaggtttgca

SEQ ID NO: 82075 - DNA, 75 bp, Artificial Sequence
  Synthetic
ccaagggccttgaatggatttcacagaagataggcaagtttattgactggataaaaaccaaaattttaccagagg

SEQ ID NO: 82076 - DNA, 75 bp, Artificial Sequence
  Synthetic
gaagataggcaagtttattgactggataaaaaccaaaattttaccagaggcacaagacaaagtagaatacttgtc

SEQ ID NO: 82077 - DNA, 75 bp, Artificial Sequence
  Synthetic
agaaacactgttcaacaacattcgttggctagctataaaggcgagaaaatttgctcccttgtatgccagcgaggc

SEQ ID NO: 82078 - DNA, 75 bp, Artificial Sequence
  Synthetic
tggctagctataaaggcgagaaaatttgctcccttgtatgccagcgaggcacgtcgcattttcaaaatggagagc

SEQ ID NO: 82079 - DNA, 75 bp, Artificial Sequence
  Synthetic
ggcactggtaagtctatagcgacaggactaataggtagagcaattgccaagcaggctaacactagtacttactct

SEQ ID NO: 82080 - DNA, 75 bp, Artificial Sequence
  Synthetic
gactaataggtagagcaattgccaagcaggctaacactagtacttactctctccccccagacccctctcactttg

SEQ ID NO: 82081 - DNA, 75 bp, Artificial Sequence
  Synthetic
tttgccagatggtgtcgacagtggaatttgtgccaccgatggccagtttggaggagaaaggaatattgtttacat

SEQ ID NO: 82082 - DNA, 75 bp, Artificial Sequence
  Synthetic
atttgtgccaccgatggccagtttggaggagaaaggaatattgtttacatcagactacgtccttgcatccactaa

SEQ ID NO: 82083 - DNA, 75 bp, Artificial Sequence
  Synthetic
tgaagtgatgtcacaatacaacaacaaaggacacctaaacatggcaactgctactaaggcatgcacagactgtca

SEQ ID NO: 82084 - DNA, 75 bp, Artificial Sequence
  Synthetic
aaaggacacctaaacatggcaactgctactaaggcatgcacagactgtcataaaccagcgaatttctccagctgt

SEQ ID NO: 82085 - DNA, 75 bp, Artificial Sequence
  Synthetic
accactttgattgtgaatgagaggaatagaagatacaacattggtaactgtttggaagccttgtttcaaggtcca

SEQ ID NO: 82086 - DNA, 75 bp, Artificial Sequence
  Synthetic
atagaagatacaacattggtaactgtttggaagccttgtttcaaggtccactggaatttaaggagcctaggattg

SEQ ID NO: 82087 - DNA, 75 bp, Artificial Sequence
  Synthetic
attgcaccaagcaaggctgggtcaccgagctgccatcatcatcacttgtggtggagagacaccttaaccgagcca

SEQ ID NO: 82088 - DNA, 75 bp, Artificial Sequence
  Synthetic
acaactagaaatgctggaaaaccaaatctcaactatacaccaatcatgccctagtcaggaacaccaggaaattct

SEQ ID NO: 82089 - DNA, 75 bp, Artificial Sequence
  Synthetic
cgagctgccatcatcatcacttgtggtggagagacaccttaaccgagccatgacgattgtgcaggccatatcttc

SEQ ID NO: 82090 - DNA, 75 bp, Artificial Sequence
  Synthetic
acctaacccaaagcccaaggtccccacgttgcgtgcagccaaggtacaaggtccagcgtttgactatgcggttgc

SEQ ID NO: 82091 - DNA, 75 bp, Artificial Sequence
  Synthetic
acgttgcgtgcagccaaggtacaaggtccagcgtttgactatgcggttgccatggcgaggcgtaatatactaact

SEQ ID NO: 82092 - DNA, 75 bp, Artificial Sequence
  Synthetic
gatccatcacactttgacggatacaaacaacagggagtggtgattatggacgacctgaatcaaaacccagatggt

SEQ ID NO: 82093 - DNA, 75 bp, Artificial Sequence
  Synthetic
cccggtgatacagtggttatagctgggaaggaagtgaaggtcaaagacgccaggcgtcttgtggacaccaatgat

SEQ ID NO: 82094 - DNA, 75 bp, Artificial Sequence
  Synthetic
ggaaggaagtgaaggtcaaagacgccaggcgtcttgtggacaccaatgatgtgaatttagaagtaaccattgttg

SEQ ID NO: 82095 - DNA, 75 bp, Artificial Sequence
  Synthetic
tactggcagtaaacaccacgcggttcccaaacatgtacatcccagttggagctgtcgctgagcaagggatgctaa

SEQ ID NO: 82096 - DNA, 75 bp, Artificial Sequence
  Synthetic
cccaaacatgtacatcccagttggagctgtcgctgagcaagggatgctaaacctggggggtaggcctaccaaccg

SEQ ID NO: 82097 - DNA, 75 bp, Artificial Sequence
  Synthetic
catacacgtggggggtaatggctcccatgggttcgccgctgcactgaaaagatcgtactttaccagtgaacaagg

SEQ ID NO: 82098 - DNA, 75 bp, Artificial Sequence
  Synthetic
catgggttcgccgctgcactgaaaagatcgtactttaccagtgaacaaggtgaaatacaatggatgagacccagc

SEQ ID NO: 82099 - DNA, 75 bp, Artificial Sequence
  Synthetic
ccgggtgttaaggaacccgcggtcctgacaaaatcagatcctagacttgaagttgactttgaagaggctattttc

SEQ ID NO: 82100 - DNA, 75 bp, Artificial Sequence
  Synthetic
tgacaaaatcagatcctagacttgaagttgactttgaagaggctattttctccaaatacgtgggtaatgctatca

SEQ ID NO: 82101 - DNA, 75 bp, Artificial Sequence
  Synthetic
agcagatgtgtttggatgaggctttgtacgggactgaaggtcttgaagccctagacctcacaactagtgccggct

SEQ ID NO: 82102 - DNA, 75 bp, Artificial Sequence
  Synthetic
gtacgggactgaaggtcttgaagccctagacctcacaactagtgccggctacccttacgttaccatggggaaaag

SEQ ID NO: 82103 - DNA, 75 bp, Artificial Sequence
  Synthetic
tctaccattggtcacgtacgtgaaggacgagttgcgtaagccatctaagatcaaagcagggaagtccaggttgat

SEQ ID NO: 82104 - DNA, 75 bp, Artificial Sequence
  Synthetic
gacgagttgcgtaagccatctaagatcaaagcagggaagtccaggttgatagaggccagttcgctgaacgactca

SEQ ID NO: 82105 - DNA, 75 bp, Artificial Sequence
  Synthetic
gtagggtgcgaccctgatattttctggagtaagataccagtcatgcttgacggtcacctatttgcctttgactat

SEQ ID NO: 82106 - DNA, 75 bp, Artificial Sequence
  Synthetic
ggagtaagataccagtcatgcttgacggtcacctatttgcctttgactatactggttatgatgcctctctttcac

SEQ ID NO: 82107 - DNA, 75 bp, Artificial Sequence
  Synthetic
tcaatcactctcaccacctgtacaagaataaattatactgtgtcaagggggggatgccatctggatgctctggca

SEQ ID NO: 82108 - DNA, 75 bp, Artificial Sequence
  Synthetic
ctgggcaattcaacgatcaccacccaagaagcggccaattctgttgttgcctacggtagatggcctgaatacatc

SEQ ID NO: 82109 - DNA, 75 bp, Artificial Sequence
  Synthetic
tacgcctgttttatactccctttccccgtaacttagaagcaatgaaaccaagttcaatagaaagggggtacaaac

SEQ ID NO: 82110 - DNA, 75 bp, Artificial Sequence
  Synthetic
atccgttatccgctcttgtacttcgagaagcctagtaccaccttggaatcttcgatgcgttgcgctcagcactca

SEQ ID NO: 82111 - DNA, 75 bp, Artificial Sequence
  Synthetic
gagtctggacattccccaccggcgacggtggtccaggctgcgttggcggcctacctgtggcccaaagccacagga

SEQ ID NO: 82112 - DNA, 75 bp, Artificial Sequence
  Synthetic
cgctagttgtgaacaaggtgtgaagagcctattgagctacatgagagtcctccggcccctgaatgcggctaatcc

SEQ ID NO: 82113 - DNA, 75 bp, Artificial Sequence
  Synthetic
tagatcgatcatctacctttttgttggatttacacctttaaaaccacacagcttgaatctcatcaaaattgtatt

SEQ ID NO: 82114 - DNA, 75 bp, Artificial Sequence
  Synthetic
tcgccaccggtggatctactgtaaactacacaaccatcaattattataaagattcggccagtaatgcggcctcta

SEQ ID NO: 82115 - DNA, 75 bp, Artificial Sequence
  Synthetic
ctacacaaccatcaattattataaagattcggccagtaatgcggcctctaaacaagatttctcccaggacccatc

SEQ ID NO: 82116 - DNA, 75 bp, Artificial Sequence
  Synthetic
tggatatagtgacagagtaatgcaattgaccctaggaaactctactattacaacacaagaggcagccaactcagt

SEQ ID NO: 82117 - DNA, 75 bp, Artificial Sequence
  Synthetic
ttcacttttgtggtcacctcaaactacactgatgcaaataacggacatgcattgaaccaagtttatcagataatg

SEQ ID NO: 82118 - DNA, 75 bp, Artificial Sequence
  Synthetic
tacttgagtgacaaggatgcgaatcccgtagaccaacctactgagccagatgtgtcagcttgtagattttacact

SEQ ID NO: 82119 - DNA, 75 bp, Artificial Sequence
  Synthetic
ccgtagaccaacctactgagccagatgtgtcagcttgtagattttacactcttgacaccgtggagtggggcaagg

SEQ ID NO: 82120 - DNA, 75 bp, Artificial Sequence
  Synthetic
actacttgggaagatcaggttacacagtgcacgtccagtgtaacgcttcaaaatttcatcagggcacgttggggg

SEQ ID NO: 82121 - DNA, 75 bp, Artificial Sequence
  Synthetic
agtgcacgtccagtgtaacgcttcaaaatttcatcagggcacgttgggggtattcgctgtgcctgagtactgcct

SEQ ID NO: 82122 - DNA, 75 bp, Artificial Sequence
  Synthetic
cgtttcgacgttcacaccggacaacagtgacaaaccaaagagggagttccaaccagtagattacttgttcgggtg

SEQ ID NO: 82123 - DNA, 75 bp, Artificial Sequence
  Synthetic
aaccagtagattacttgttcgggtgtggtgtgttggctgggaacgcctttgtttttccgcatcaaataataaact

SEQ ID NO: 82124 - DNA, 75 bp, Artificial Sequence
  Synthetic
acaattggggaatcgtgatcctgccattatccaaattagactacaacccagatgccagcaccaaactacccatca

SEQ ID NO: 82125 - DNA, 75 bp, Artificial Sequence
  Synthetic
ctagaagaaagtactatccagtcacattcattggcccaacttttcaatacatggaagcaaatgagtactaccctg

SEQ ID NO: 82126 - DNA, 75 bp, Artificial Sequence
  Synthetic
attcattggcccaacttttcaatacatggaagcaaatgagtactaccctgccagatatcaatcccacatgctaat

SEQ ID NO: 82127 - DNA, 75 bp, Artificial Sequence
  Synthetic
tgaattcaatggcctcagaaatctgaccattcctgctacccagggactcccagtaatgaacaccccaggtagtaa

SEQ ID NO: 82128 - DNA, 75 bp, Artificial Sequence
  Synthetic
agccggtggtgaaggcttggttgcattctcagacattagggacctttatgcctatgaggaggaagccatggaaca

SEQ ID NO: 82129 - DNA, 75 bp, Artificial Sequence
  Synthetic
accaggcgaggtgaaaaacatgatggagttagcagagatagacacaatgatccccatggatttgagtgatgggaa

SEQ ID NO: 82130 - DNA, 75 bp, Artificial Sequence
  Synthetic
gagttagcagagatagacacaatgatccccatggatttgagtgatgggaagaggaatacaatggatatgtataga

SEQ ID NO: 82131 - DNA, 75 bp, Artificial Sequence
  Synthetic
ttctcagacattagggacctttatgcctatgaggaggaagccatggaacaaggcatttccaactacatcgaatct

SEQ ID NO: 82132 - DNA, 75 bp, Artificial Sequence
  Synthetic
agtacaatcactgaaaaattgttgaaaaacctcataaagataatctcatctttggtcatcataactagaaattac

SEQ ID NO: 82133 - DNA, 75 bp, Artificial Sequence
  Synthetic
ttgtcttataccatgttaggagagatcctgaactattacacccactgggcaggttcattgaagttttcattccta

SEQ ID NO: 82134 - DNA, 75 bp, Artificial Sequence
  Synthetic
tcctgaactattacacccactgggcaggttcattgaagttttcattcctattctgtggatccatgatggctactg

SEQ ID NO: 82135 - DNA, 75 bp, Artificial Sequence
  Synthetic
aaaacctcataaagataatctcatctttggtcatcataactagaaattacgaagacacgactacagtgctcgcca

SEQ ID NO: 82136 - DNA, 75 bp, Artificial Sequence
  Synthetic
cgtatgttatgcgccagggtgatagttggctaaagaaattcacagaggcatgcaatgctgccaaggggttagaat

SEQ ID NO: 82137 - DNA, 75 bp, Artificial Sequence
  Synthetic
atgtgatttgggacataggtctccaatcatcatgcacaatggtggtgccgtggattagcaacaccagctaccgcc

SEQ ID NO: 82138 - DNA, 75 bp, Artificial Sequence
  Synthetic
ttggctaaagaaattcacagaggcatgcaatgctgccaaggggttagaatgggtctcaaacaaaatttccaagtt

SEQ ID NO: 82139 - DNA, 75 bp, Artificial Sequence
  Synthetic
cagactcgcattgttgttccagcttcaacacccacctcaatggatattctgtgttttgtgtctgcttgtaatgac

SEQ ID NO: 82140 - DNA, 75 bp, Artificial Sequence
  Synthetic
ggaaatgttagaaaatcaaattgcaacaatccatcaatcgtgccctagtcaagaacatcaagagatcctatttaa

SEQ ID NO: 82141 - DNA, 75 bp, Artificial Sequence
  Synthetic
caacacccacctcaatggatattctgtgttttgtgtctgcttgtaatgacttcacagtaagattacttagggata

SEQ ID NO: 82142 - DNA, 75 bp, Artificial Sequence
  Synthetic
acaatccatcaatcgtgccctagtcaagaacatcaagagatcctatttaacaatgtgagatggttgtccatacag

SEQ ID NO: 82143 - DNA, 75 bp, Artificial Sequence
  Synthetic
aactgtcccaacctactagaccagcccttccaccagcagaacaaagtgtgccgaacaccacgcaatcttccccag

SEQ ID NO: 82144 - DNA, 75 bp, Artificial Sequence
  Synthetic
atacagtttaagagcaaacaccgtattgaaccagtatgtttgttggtacacggcagccctgggacaggcaaatca

SEQ ID NO: 82145 - DNA, 75 bp, Artificial Sequence
  Synthetic
ccttccaccagcagaacaaagtgtgccgaacaccacgcaatcttccccagaacactctaagaaggtgccagctct

SEQ ID NO: 82146 - DNA, 75 bp, Artificial Sequence
  Synthetic
ttgaaccagtatgtttgttggtacacggcagccctgggacaggcaaatcagtggctactaatctaattgctagag

SEQ ID NO: 82147 - DNA, 75 bp, Artificial Sequence
  Synthetic
aagatccagaagtgaatctactattgaatcattctttgcgcggggcgcttgtgtcaccattatgagtgtggacaa

SEQ ID NO: 82148 - DNA, 75 bp, Artificial Sequence
  Synthetic
agggggttgtaataatggatgatttaaatcagaacccagatggggccgacatgaagttgttttgccaaatggtct

SEQ ID NO: 82149 - DNA, 75 bp, Artificial Sequence
  Synthetic
aaatcagaacccagatggggccgacatgaagttgttttgccaaatggtctccaccgtggaatttattccaccaat

SEQ ID NO: 82150 - DNA, 75 bp, Artificial Sequence
  Synthetic
tcaacttaggagaaagttagaaatgtttacatactccaggtttgacatcgagttcacttttgttgtgacggaacg

SEQ ID NO: 82151 - DNA, 75 bp, Artificial Sequence
  Synthetic
tttacatactccaggtttgacatcgagttcacttttgttgtgacggaacggtactattcatctaattctggtcat

SEQ ID NO: 82152 - DNA, 75 bp, Artificial Sequence
  Synthetic
tccacccaccgtagcccatagtgacgcccttgccagacgctttgcatttgacatggacattcaagtaatgggcga

SEQ ID NO: 82153 - DNA, 75 bp, Artificial Sequence
  Synthetic
gcccttgccagacgctttgcatttgacatggacattcaagtaatgggcgagtattctagagatggcaaattgaac

SEQ ID NO: 82154 - DNA, 75 bp, Artificial Sequence
  Synthetic
tggcaaacttcctcgaatccatccatcttctatacctatggcacagcaccacccagaatctcactaccttacatc

SEQ ID NO: 82155 - DNA, 75 bp, Artificial Sequence
  Synthetic
tcttctatacctatggcacagcaccacccagaatctcactaccttacatcggtattgctaatgcttactctcact

SEQ ID NO: 82156 - DNA, 75 bp, Artificial Sequence
  Synthetic
ggaaaagccatccaactaatggacaaatcgtccagggttaggtacagtattgaccaaatcactactatgatcatc

SEQ ID NO: 82157 - DNA, 75 bp, Artificial Sequence
  Synthetic
aatcgtccagggttaggtacagtattgaccaaatcactactatgatcatcaatgagaggaacagaagatccaata

SEQ ID NO: 82158 - DNA, 75 bp, Artificial Sequence
  Synthetic
ctatcaatgactttggccttctcgcagttcgggtggtcaatgagcacaacccagtcagagtgtcatcaaagatta

SEQ ID NO: 82159 - DNA, 75 bp, Artificial Sequence
  Synthetic
ccccgcctgagtgtatcaatgatctgctacaatcagtggattctcaagaagtaagggattattgtgagaaaaagg

SEQ ID NO: 82160 - DNA, 75 bp, Artificial Sequence
  Synthetic
gctacaatcagtggattctcaagaagtaagggattattgtgagaaaaagggatggatagtcaacatcactagtca

SEQ ID NO: 82161 - DNA, 75 bp, Artificial Sequence
  Synthetic
cagagtgtggtgtccacgcccaccgcgtgctgtggagtattacggacctggagtagattacaaggcagatacatt

SEQ ID NO: 82162 - DNA, 75 bp, Artificial Sequence
  Synthetic
cgtggtgtacgtgatgtacaagcttttcgcagggcaacagggcgcctacacaggactcccaaacaagagacccaa

SEQ ID NO: 82163 - DNA, 75 bp, Artificial Sequence
  Synthetic
caagatagtgaattaccacttggccacggcagaagattataggcactgtgttagaagcatgtgggagcgtgacat

SEQ ID NO: 82164 - DNA, 75 bp, Artificial Sequence
  Synthetic
ttcgcagggcaacagggcgcctacacaggactcccaaacaagagacccaacatccccaccatcagaactgctaag

SEQ ID NO: 82165 - DNA, 75 bp, Artificial Sequence
  Synthetic
catggtggtggagtccaaagcacaggggattgaccaaattgctcgatgtgcgtgtcggacaggtgtatacttctg

SEQ ID NO: 82166 - DNA, 75 bp, Artificial Sequence
  Synthetic
gagtttacaatgcttggggtgcatgacaacgtggccattttgccaacccatgcgtcaccaggagagacaatagtt

SEQ ID NO: 82167 - DNA, 75 bp, Artificial Sequence
  Synthetic
cccagcacgctaccaatcacacataactatcggttgtggttacgcagcccctggggactgtggtggcatcctacg

SEQ ID NO: 82168 - DNA, 75 bp, Artificial Sequence
  Synthetic
gttgatggtaaagaagtagaagtgctagatgctaaggcactggaagatcaagctggaaccaatttggagatcacc

SEQ ID NO: 82169 - DNA, 75 bp, Artificial Sequence
  Synthetic
tggcgtttgcagacgtcagagatctctatgtcgaggatgaggctatggagcaaggaatcacttcgtacattgagt

SEQ ID NO: 82170 - DNA, 75 bp, Artificial Sequence
  Synthetic
ctatgtcgaggatgaggctatggagcaaggaatcacttcgtacattgagtcccttggcgccgctttcggtagcgg

SEQ ID NO: 82171 - DNA, 75 bp, Artificial Sequence
  Synthetic
caaaaacttgatcaaactagtgagcagtctggtgataattgtcagaaattatgaggacaccactaccgtgttagc

SEQ ID NO: 82172 - DNA, 75 bp, Artificial Sequence
  Synthetic
agtctggtgataattgtcagaaattatgaggacaccactaccgtgttagccacactggccttgctaggatgtgat

SEQ ID NO: 82173 - DNA, 75 bp, Artificial Sequence
  Synthetic
cggttcacatgggtttgcagcggccctaaagcgatcatacttcactcagagtcaaggtgaaatccagtggatgag

SEQ ID NO: 82174 - DNA, 75 bp, Artificial Sequence
  Synthetic
tcttggatgaagaaatttacagaagcttgcaaagctgccaaaggactagagtggatcagcaataagatttctaaa

SEQ ID NO: 82175 - DNA, 75 bp, Artificial Sequence
  Synthetic
tcttggatgaagaaatttacagaagcttgcaatgctgccaaaggactagagtggatcagcaataagatttctaaa

SEQ ID NO: 82176 - DNA, 75 bp, Artificial Sequence
  Synthetic
tcttggatgaagaaatttacagaagcttgcaacgctgccaaaggactagagtggatcagcaataagatttctaaa

SEQ ID NO: 82177 - DNA, 75 bp, Artificial Sequence
  Synthetic
tcttggatgaagaaatttacagaagcttgcaaggctgccaaaggactagagtggatcagcaataagatttctaaa

SEQ ID NO: 82178 - DNA, 75 bp, Artificial Sequence
  Synthetic
tgtgtttgaaggtgtgaaagaaccagcagttttgaccaaaaatgatcccagacttaaagtggactttgaagatgc

SEQ ID NO: 82179 - DNA, 75 bp, Artificial Sequence
  Synthetic
gcagttttgaccaaaaatgatcccagacttaaagtggactttgaagatgcaatattctccaagtatgttggcaac

SEQ ID NO: 82180 - DNA, 75 bp, Artificial Sequence
  Synthetic
cttggtatgttggaaaatcaaataaatacaatacatcagtcatgtcccagccaggaacagcaggagatactcttt

SEQ ID NO: 82181 - DNA, 75 bp, Artificial Sequence
  Synthetic
aacacagaccaaatgtgcttggaagatgccatgtacggcactgacggtctagaagctctggacctgacaactagt

SEQ ID NO: 82182 - DNA, 75 bp, Artificial Sequence
  Synthetic
atgccatgtacggcactgacggtctagaagctctggacctgacaactagtgcaggatatccttatgtagctttgg

SEQ ID NO: 82183 - DNA, 75 bp, Artificial Sequence
  Synthetic
acatacagttcaagagcaaacaccgtattgaaccagtatgtgttttgatacatggcagtccgggcaccggaaaat

SEQ ID NO: 82184 - DNA, 75 bp, Artificial Sequence
  Synthetic
tattgaaccagtatgtgttttgatacatggcagtccgggcaccggaaaatcggttgccactagcctgatgggacg

SEQ ID NO: 82185 - DNA, 75 bp, Artificial Sequence
  Synthetic
gcatcaacctccccttggttacctatgtcaaagatgaacttagatctaaaagtaaagttgaacagggaaagtcaa

SEQ ID NO: 82186 - DNA, 75 bp, Artificial Sequence
  Synthetic
tgtcaaagatgaacttagatctaaaagtaaagttgaacagggaaagtcaaggcttattgaagcatccagtcttaa

SEQ ID NO: 82187 - DNA, 75 bp, Artificial Sequence
  Synthetic
acaaggcgtggtgattatggatgacctgaatcaaaatccagatggtcttgacatgaaactgttttgccaaatggt

SEQ ID NO: 82188 - DNA, 75 bp, Artificial Sequence
  Synthetic
ctgaatcaaaatccagatggtcttgacatgaaactgttttgccaaatggtatccacagtagaattcataccgccc

SEQ ID NO: 82189 - DNA, 75 bp, Artificial Sequence
  Synthetic
tagtgcggttggttgtgatccagatctgttttggagcaagatcccagttctcatggaggagaagttgttcgcctt

SEQ ID NO: 82190 - DNA, 75 bp, Artificial Sequence
  Synthetic
ctgttttggagcaagatcccagttctcatggaggagaagttgttcgcctttgattacaccggatacgacgcctcc

SEQ ID NO: 82191 - DNA, 75 bp, Artificial Sequence
  Synthetic
acaccgccaacagtggctcacagtgatgccttaaaccgaagatttgcctttgacatggaaatttgtcccatgtca

SEQ ID NO: 82192 - DNA, 75 bp, Artificial Sequence
  Synthetic
atgccttaaaccgaagatttgcctttgacatggaaatttgtcccatgtcacaatacacaatcaaaggtaaattga

SEQ ID NO: 82193 - DNA, 75 bp, Artificial Sequence
  Synthetic
gattatctcaatcattcacaccatttgtacaaaaataagacatattgtgttaagggtggcatgccatctggctgc

SEQ ID NO: 82194 - DNA, 75 bp, Artificial Sequence
  Synthetic
gtggtaaagcaattcagctgatggataaatacaccagacaaagatttagtgtggatgaactgacaactttggtca

SEQ ID NO: 82195 - DNA, 75 bp, Artificial Sequence
  Synthetic
taaatacaccagacaaagatttagtgtggatgaactgacaactttggtcatcaatgagaagattagaagggccaa

SEQ ID NO: 82196 - DNA, 75 bp, Artificial Sequence
  Synthetic
tagcctatggtgatgacgtgattgcatcctacccccatgaagtagacgctagtctcctagcccaatcaggaaaag

SEQ ID NO: 82197 - DNA, 75 bp, Artificial Sequence
  Synthetic
tgacaaatctgcaacttttgagcaagtcacatgggagaacgtaacattcttgaaaagattcttcagagcagatga

SEQ ID NO: 82198 - DNA, 75 bp, Artificial Sequence
  Synthetic
cccaccccctgactgcattaatgatttgctccaatcagtggactcacaggaggttagggattactgtgaaaagaa

SEQ ID NO: 82199 - DNA, 75 bp, Artificial Sequence
  Synthetic
ttgctccaatcagtggactcacaggaggttagggattactgtgaaaagaaaggctggattgttaacatttcaagt

SEQ ID NO: 82200 - DNA, 75 bp, Artificial Sequence
  Synthetic
aatcaatcagatggactaaagatcctagaaatacacaagatcatgtacgctccctgtgcttattggcgtggcaca

SEQ ID NO: 82201 - DNA, 75 bp, Artificial Sequence
  Synthetic
ggcgtggtttacgtcatgtacagattgttcgccggtcagcagggagcatacactggtttacccaacaagaaaccc

SEQ ID NO: 82202 - DNA, 75 bp, Artificial Sequence
  Synthetic
tgttcgccggtcagcagggagcatacactggtttacccaacaagaaacccaatattcccacaatcagaacagcaa

SEQ ID NO: 82203 - DNA, 75 bp, Artificial Sequence
  Synthetic
gagaattcaccatgcttggagtccatgacaacgtcgctatcttaccaacacactcatacccaggagaaactatag

SEQ ID NO: 82204 - DNA, 75 bp, Artificial Sequence
  Synthetic
cattgatgccaaagcccttgaagatcaagccggtactaatttggagattaccattgttaccctgaagagaaatga

SEQ ID NO: 82205 - DNA, 75 bp, Artificial Sequence
  Synthetic
ccagttggtgctgtgaccgaacagggatatctcaatctcggtggccgacagactgctcgtacgttgatgtacaac

SEQ ID NO: 82206 - DNA, 75 bp, Artificial Sequence
  Synthetic
aacggttcacacgggttcgcagcagccctgaagcgatcatacttcacccagagtcaaggtgagatccagtggatg

SEQ ID NO: 82207 - DNA, 75 bp, Artificial Sequence
  Synthetic
ccctgaagcgatcatacttcacccagagtcaaggtgagatccagtggatgagaccatcaaaggaagtgggatacc

SEQ ID NO: 82208 - DNA, 75 bp, Artificial Sequence
  Synthetic
cagctgtgctcaccaagagcgatcccagactgaaaacagactttgaggaggctattttctccaagtatgtaggga

SEQ ID NO: 82209 - DNA, 75 bp, Artificial Sequence
  Synthetic
cagactgaaaacagactttgaggaggctattttctccaagtatgtagggaataagatcacagaggtggacgagta

SEQ ID NO: 82210 - DNA, 75 bp, Artificial Sequence
  Synthetic
agacgcaatgtatgggactgatggccttgaagcattagacctcagcaccagtgctggctacccctatgtggcaat

SEQ ID NO: 82211 - DNA, 75 bp, Artificial Sequence
  Synthetic
cttgaagcattagacctcagcaccagtgctggctacccctatgtggcaatgggaaagaagaaaagggacattctg

SEQ ID NO: 82212 - DNA, 75 bp, Artificial Sequence
  Synthetic
catagcgaggtgcaactgcagatgtggggtgtactactgtgagtcaatgaggaggtactacccagttaccgtaac

SEQ ID NO: 82213 - DNA, 75 bp, Artificial Sequence
  Synthetic
tatgtcaaagatgaactcagatccaaaactaaagtggaacagggtaagtctagattgatagaagcttcaagtcta

SEQ ID NO: 82214 - DNA, 75 bp, Artificial Sequence
  Synthetic
aaactaaagtggaacagggtaagtctagattgatagaagcttcaagtctaaatgactcagtggccatgagaatgg

SEQ ID NO: 82215 - DNA, 75 bp, Artificial Sequence
  Synthetic
acgtctgactatgtcctagcctcaaccaactcacacaccattaccccccctacaatatcagcttcagatgcattg

SEQ ID NO: 82216 - DNA, 75 bp, Artificial Sequence
  Synthetic
atttattttggagcaagataccagtgttgatggaggagaagctctttgcatttgattacactggttatgatgcat

SEQ ID NO: 82217 - DNA, 75 bp, Artificial Sequence
  Synthetic
ttgattacctaaaccactcacatcacctttacaaaaataaaacatactgtgttaagggcggtatgccatctggct

SEQ ID NO: 82218 - DNA, 75 bp, Artificial Sequence
  Synthetic
tagcgaccctcgcattgctggggtgtgatgtctcaccatggcaatggctcaagaagaaggcttgtgacatattag

SEQ ID NO: 82219 - DNA, 75 bp, Artificial Sequence
  Synthetic
tgatgtctcaccatggcaatggctcaagaagaaggcttgtgacatattagaggtcccgtatgttatccgccaagg

SEQ ID NO: 82220 - DNA, 75 bp, Artificial Sequence
  Synthetic
aaaattcatcgattggttaaaggagaaaataatccctcaagcgagagataagttggaatttgtcacaaagctcaa

SEQ ID NO: 82221 - DNA, 75 bp, Artificial Sequence
  Synthetic
catagattgttatcataaagcgaattggattggccatccggtgaaaatcaagcatattgtattcttgtttgttgg

SEQ ID NO: 82222 - DNA, 75 bp, Artificial Sequence
  Synthetic
gcaattagagatgttggaaaatcaaatttccacaatacaccagtcctgtccgagccaggaacaccaagaaatact

SEQ ID NO: 82223 - DNA, 75 bp, Artificial Sequence
  Synthetic
gtgcgcaagtttcatcacagaaggtaggtgctcatgagaataccaatgtagccactggcgggtcaacagttaatt

SEQ ID NO: 82224 - DNA, 75 bp, Artificial Sequence
  Synthetic
tcagaaattggagcacactattaacaattacatacaattcaagagcaaacaccgtattgaaccagtatgtctatt

SEQ ID NO: 82225 - DNA, 75 bp, Artificial Sequence
  Synthetic
aattacatacaattcaagagcaaacaccgtattgaaccagtatgtctattggtgcacggcagcccagggacaggc

SEQ ID NO: 82226 - DNA, 75 bp, Artificial Sequence
  Synthetic
aggtgctcatgagaataccaatgtagccactggcgggtcaacagttaattacaccactattaactactacaagga

SEQ ID NO: 82227 - DNA, 75 bp, Artificial Sequence
  Synthetic
catgctgaaatccgctccagccctgaattctccaaatatagaagcttgcggttacagtgatagagtgatgcagct

SEQ ID NO: 82228 - DNA, 75 bp, Artificial Sequence
  Synthetic
gatccttcacattttgacgggtacaagcaacaaggagtggtcattatggatgatttaaaccaaaacccagatgga

SEQ ID NO: 82229 - DNA, 75 bp, Artificial Sequence
  Synthetic
agcaacaaggagtggtcattatggatgatttaaaccaaaacccagatggagctgacatgaaattgttctgccaga

SEQ ID NO: 82230 - DNA, 75 bp, Artificial Sequence
  Synthetic
aattctccaaatatagaagcttgcggttacagtgatagagtgatgcagcttactctaggaaactccaccattacg

SEQ ID NO: 82231 - DNA, 75 bp, Artificial Sequence
  Synthetic
gtagatcaacccacggaacccgatgtggccgcatgtaggttctatacattggacaccgtaacatggagtaagagt

SEQ ID NO: 82232 - DNA, 75 bp, Artificial Sequence
  Synthetic
tgctagcctccaccaactccagtagaatatcacccccaactgtggctcacagtgacgccttagctaggaggtttg

SEQ ID NO: 82233 - DNA, 75 bp, Artificial Sequence
  Synthetic
aatatcacccccaactgtggctcacagtgacgccttagctaggaggtttgccttcgacatggacatccaggtcat

SEQ ID NO: 82234 - DNA, 75 bp, Artificial Sequence
  Synthetic
tggccgcatgtaggttctatacattggacaccgtaacatggagtaagagttccaaagggtggtggtggaaactcc

SEQ ID NO: 82235 - DNA, 75 bp, Artificial Sequence
  Synthetic
tgcatgtgcaatgtaatgcctccaaattccatcagggcgctctcggggtctttgcgatacccgaatattgcatgg

SEQ ID NO: 82236 - DNA, 75 bp, Artificial Sequence
  Synthetic
aaatttcaaaagatgttgtcccttggtgtgtggcaaagcaattcagttgatggacaagtcgtctagagtcagata

SEQ ID NO: 82237 - DNA, 75 bp, Artificial Sequence
  Synthetic
attccatcagggcgctctcggggtctttgcgatacccgaatattgcatggcgtgcaacacagacgccaaaaccaa

SEQ ID NO: 82238 - DNA, 75 bp, Artificial Sequence
  Synthetic
tggacaagtcgtctagagtcagatacagcattgaccaaatcactaccatgatcatcaacgagagaaatagacgat

SEQ ID NO: 82239 - DNA, 75 bp, Artificial Sequence
  Synthetic
gacaactggtgcacgcaagtttgctgcagtggactacttgttgggatgtggtgtgttggctgggaatgcatttgt

SEQ ID NO: 82240 - DNA, 75 bp, Artificial Sequence
  Synthetic
aaagatctcaagatagacatcaaaactacccctccaccagactgcataaatgatttgctgcaggctgtcgattct

SEQ ID NO: 82241 - DNA, 75 bp, Artificial Sequence
  Synthetic
ctacccctccaccagactgcataaatgatttgctgcaggctgtcgattctcaggaggttagggactactgtgaga

SEQ ID NO: 82242 - DNA, 75 bp, Artificial Sequence
  Synthetic
gcagtggactacttgttgggatgtggtgtgttggctgggaatgcatttgtgttccctcaccagatcattaaccta

SEQ ID NO: 82243 - DNA, 75 bp, Artificial Sequence
  Synthetic
aattggggaattgccatcctaccactagcagagctagattttgccgaggcttcttcaacagaagtacccatcacc

SEQ ID NO: 82244 - DNA, 75 bp, Artificial Sequence
  Synthetic
aggctgtcactaccttcgctgctgtggctggtgtggtctatgttatgtacaagctctttgctggatatcaagggg

SEQ ID NO: 82245 - DNA, 75 bp, Artificial Sequence
  Synthetic
ggctggtgtggtctatgttatgtacaagctctttgctggatatcaaggggcgtacactggacttcccaacaagaa

SEQ ID NO: 82246 - DNA, 75 bp, Artificial Sequence
  Synthetic
tagcagagctagattttgccgaggcttcttcaacagaagtacccatcaccatcacaatcgccccaatgtgttgcg

SEQ ID NO: 82247 - DNA, 75 bp, Artificial Sequence
  Synthetic
agtttctgtcgtcagataactttcagtctccctgcgcactgccagaatttgatgtaacacccccgatccacatcc

SEQ ID NO: 82248 - DNA, 75 bp, Artificial Sequence
  Synthetic
aaatattgtcaccgccaccaccagtaagggggaattcacgatgctcggggtacatgataacgtggctgtgctccc

SEQ ID NO: 82249 - DNA, 75 bp, Artificial Sequence
  Synthetic
gtctccctgcgcactgccagaatttgatgtaacacccccgatccacatcccaggtgaggtgcgcaacatgatgga

SEQ ID NO: 82250 - DNA, 75 bp, Artificial Sequence
  Synthetic
aacacacgcctcaccgggagagaccatagtcattgatggaaaggaggttgaggtgttggacgccaaggcactgga

SEQ ID NO: 82251 - DNA, 75 bp, Artificial Sequence
  Synthetic
tgagctagggtctagtaagtcacaaactgaccccatcctgtgcctcagtttgagtcccgctagtgaacagagatt

SEQ ID NO: 82252 - DNA, 75 bp, Artificial Sequence
  Synthetic
actgaccccatcctgtgcctcagtttgagtcccgctagtgaacagagattgggattcactatgctaggtgaaata

SEQ ID NO: 82253 - DNA, 75 bp, Artificial Sequence
  Synthetic
acactagtaagtaccctaacatgtatgtacccgtcggtgcagtaaccgaacaagggtacttaaacttgggtgggc

SEQ ID NO: 82254 - DNA, 75 bp, Artificial Sequence
  Synthetic
aaattacttatctcctatgccccgcccggggccaaaccacccaaaacacgtaaggaagccatgctgggtacgcac

SEQ ID NO: 82255 - DNA, 75 bp, Artificial Sequence
  Synthetic
ccggggccaaaccacccaaaacacgtaaggaagccatgctgggtacgcacatcatttgggatattggattgcaat

SEQ ID NO: 82256 - DNA, 75 bp, Artificial Sequence
  Synthetic
gcaaggtgattggaatgcatgttggagggaacggttcacatgggtttgctgcagccctgaagcggtcttacttca

SEQ ID NO: 82257 - DNA, 75 bp, Artificial Sequence
  Synthetic
ggggctatatttcaatgttttaccagaccaagatagtggtcccgctgtcaacacccactaccatgacaatgttaa

SEQ ID NO: 82258 - DNA, 75 bp, Artificial Sequence
  Synthetic
gaccaagatagtggtcccgctgtcaacacccactaccatgacaatgttaagctttgtgtcagcgtgcaatgattt

SEQ ID NO: 82259 - DNA, 75 bp, Artificial Sequence
  Synthetic
agactaaactcgaacccagtgctttccactacatctttgaaggagtgaaagaacccgcagtgttaacaaaaaatg

SEQ ID NO: 82260 - DNA, 75 bp, Artificial Sequence
  Synthetic
ccactacatctttgaaggagtgaaagaacccgcagtgttaacaaaaaatgaccctagactaaaaactgattttga

SEQ ID NO: 82261 - DNA, 75 bp, Artificial Sequence
  Synthetic
aataatctccactgtggcaagcaatgcgttggccttgagtcaaccgaaaccagtagacaacacagtgcaaaacac

SEQ ID NO: 82262 - DNA, 75 bp, Artificial Sequence
  Synthetic
gcgttggccttgagtcaaccgaaaccagtagacaacacagtgcaaaacactcaacagagtgcgccagttcatagc

SEQ ID NO: 82263 - DNA, 75 bp, Artificial Sequence
  Synthetic
ttatgcgggacaactcatgtctttagacatcaacacggaacaaatgtgtttggaagacgccatgtacggaactga

SEQ ID NO: 82264 - DNA, 75 bp, Artificial Sequence
  Synthetic
gacatcaacacggaacaaatgtgtttggaagacgccatgtacggaactgatggacttgaagctttagatctcact

SEQ ID NO: 82265 - DNA, 75 bp, Artificial Sequence
  Synthetic
agacatgtgatcaacgtgaaatcgcgttcagaatctaccattgagtctttctttgctcgggccgcttgcgtcaca

SEQ ID NO: 82266 - DNA, 75 bp, Artificial Sequence
  Synthetic
gttcagaatctaccattgagtctttctttgctcgggccgcttgcgtcacaataatgcaagttgataatttcaatg

SEQ ID NO: 82267 - DNA, 75 bp, Artificial Sequence
  Synthetic
aaagaaatgcagcgactcttggacacctatggcattaatctaccgctggttacttatgtaaaggatgagctcagg

SEQ ID NO: 82268 - DNA, 75 bp, Artificial Sequence
  Synthetic
cctatggcattaatctaccgctggttacttatgtaaaggatgagctcaggagcaggagtaaggtggaacagggga

SEQ ID NO: 82269 - DNA, 75 bp, Artificial Sequence
  Synthetic
gaaaactagagttctttacatattcaagatttgatttggaaatgaccttcgtgttgacagagaggtactacagcc

SEQ ID NO: 82270 - DNA, 75 bp, Artificial Sequence
  Synthetic
aagatttgatttggaaatgaccttcgtgttgacagagaggtactacagccaaaactcgggacatgccagatcgca

SEQ ID NO: 82271 - DNA, 75 bp, Artificial Sequence
  Synthetic
ctttccacaaaaacccaggagtagtcactggttcagctgtggggtgtgacccagatttgttttggagcaagattc

SEQ ID NO: 82272 - DNA, 75 bp, Artificial Sequence
  Synthetic
cactggttcagctgtggggtgtgacccagatttgttttggagcaagattccagtactaatggaagaaaaactttt

SEQ ID NO: 82273 - DNA, 75 bp, Artificial Sequence
  Synthetic
atcaaacccttcaatattcttcaccacaggaaacgcaccaccacgtatttccatcccatttgtaggaattgcaaa

SEQ ID NO: 82274 - DNA, 75 bp, Artificial Sequence
  Synthetic
acaggaaacgcaccaccacgtatttccatcccatttgtaggaattgcaaatgcttattcccacttctatgacgga

SEQ ID NO: 82275 - DNA, 75 bp, Artificial Sequence
  Synthetic
aatcggatttggtgatagagtagattacattgattacttgaaccactctcatcatctctacaaaaacaaaactta

SEQ ID NO: 82276 - DNA, 75 bp, Artificial Sequence
  Synthetic
tttggcaccttggccgtgagagtagttaatgattacaatccagctcgcgtagagaccagaattcgggtctacatg

SEQ ID NO: 82277 - DNA, 75 bp, Artificial Sequence
  Synthetic
ttaatgattacaatccagctcgcgtagagaccagaattcgggtctacatgaaaccaaaacatgtgagggtttggt

SEQ ID NO: 82278 - DNA, 75 bp, Artificial Sequence
  Synthetic
agatgattgcctatggtgatgatgtaatagcttcctacccccatgaggttgacgctagtctcctagcccaatcag

SEQ ID NO: 82279 - DNA, 75 bp, Artificial Sequence
  Synthetic
caaagcacgatctcacaacatacggctttggacatcaaaacaaagctgtctatacagctggttacaaaatctgta

SEQ ID NO: 82280 - DNA, 75 bp, Artificial Sequence
  Synthetic
ctttggacatcaaaacaaagctgtctatacagctggttacaaaatctgtaactaccacttggccactcaagatga

SEQ ID NO: 82281 - DNA, 75 bp, Artificial Sequence
  Synthetic
catccagtaatgccaatgaaggaaattcatgaatcaattagatggaccaaagatcccagaaatactcaggatcat

SEQ ID NO: 82282 - DNA, 75 bp, Artificial Sequence
  Synthetic
catcgctagatgcaactgcaacacgggtgtatactactgtgagtctagaagaaagtattacccagtctccttcgt

SEQ ID NO: 82283 - DNA, 75 bp, Artificial Sequence
  Synthetic
ggtgtatactactgtgagtctagaagaaagtattacccagtctccttcgttggtcccaccttccagtacatggaa

SEQ ID NO: 82284 - DNA, 75 bp, Artificial Sequence
  Synthetic
gtgccgatcggaagagccttgttgctccctgagtactctacactgtaccgccgatggcttgactcattttagtaa

SEQ ID NO: 82285 - DNA, 75 bp, Artificial Sequence
  Synthetic
ggaggaattctcaggtgtcaacatggagttataggtatagtcactgcaggaggggaaggcctcgttgcattctca

SEQ ID NO: 82286 - DNA, 75 bp, Artificial Sequence
  Synthetic
gagttataggtatagtcactgcaggaggggaaggcctcgttgcattctcagacattagagacctctatgcctatg

SEQ ID NO: 82287 - DNA, 75 bp, Artificial Sequence
  Synthetic
aacaaattggggataaaatctcggagttgactagcatggtcaccagtactattacagagaagttactcaaaaatt

SEQ ID NO: 82288 - DNA, 75 bp, Artificial Sequence
  Synthetic
gttgactagcatggtcaccagtactattacagagaagttactcaaaaatttgattaaaatcatttcatctttagt

SEQ ID NO: 82289 - DNA, 75 bp, Artificial Sequence
  Synthetic
atggcaatggttgaaaaagaaagcatgtgacattttggaaatcccatatgttgttcgccagggagatagttggct

SEQ ID NO: 82290 - DNA, 75 bp, Artificial Sequence
  Synthetic
tgtgacattttggaaatcccatatgttgttcgccagggagatagttggctcaagaaattcacagaagcatgtaat

SEQ ID NO: 82291 - DNA, 75 bp, Artificial Sequence
  Synthetic
caagcaagagataagcttgaatttgtgacgaaactcaagcagttggaaatgcttgagaatcaaatttccaccatc

SEQ ID NO: 82292 - DNA, 75 bp, Artificial Sequence
  Synthetic
tgacgaaactcaagcagttggaaatgcttgagaatcaaatttccaccatccaccagtcctgcccaagtcaagaac

SEQ ID NO: 82293 - DNA, 75 bp, Artificial Sequence
  Synthetic
aggcaaagagaattcaaaaattggaacatacaataaacaattacatacagttcaagagcaaacaccgtattgaac

SEQ ID NO: 82294 - DNA, 75 bp, Artificial Sequence
  Synthetic
acatacaataaacaattacatacagttcaagagcaaacaccgtattgaaccagtatgtttattagtacatggcag

SEQ ID NO: 82295 - DNA, 75 bp, Artificial Sequence
  Synthetic
ctccctcccaccagacccctctcacttcgatggctacaaacagcaaggagtggtgatcatggatgacttgaatca

SEQ ID NO: 82296 - DNA, 75 bp, Artificial Sequence
  Synthetic
ttcgatggctacaaacagcaaggagtggtgatcatggatgacttgaatcagaatccagatggcgcagacatgaag

SEQ ID NO: 82297 - DNA, 75 bp, Artificial Sequence
  Synthetic
acttccaactacgtcctagcttctaccaattcaagcaggatagcaccaccgacagtagcacatagtgacgcattg

SEQ ID NO: 82298 - DNA, 75 bp, Artificial Sequence
  Synthetic
ccaattcaagcaggatagcaccaccgacagtagcacatagtgacgcattgtccagaaggttcgcatttgatatgg

SEQ ID NO: 82299 - DNA, 75 bp, Artificial Sequence
  Synthetic
gtcaccagcccgcaaacttcaagagatgctgtcctcttgtgtgtggtaaagcaatccaactcatggacaagtcgt

SEQ ID NO: 82300 - DNA, 75 bp, Artificial Sequence
  Synthetic
atgctgtcctcttgtgtgtggtaaagcaatccaactcatggacaagtcgtctagagtcagatacagtgtagacca

SEQ ID NO: 82301 - DNA, 75 bp, Artificial Sequence
  Synthetic
gccactacaatataaagatcttaaagtagacattaagactacacccccaccagagtgcatcactgatctactaca

SEQ ID NO: 82302 - DNA, 75 bp, Artificial Sequence
  Synthetic
acactggtatcgcggtacctttgtacgcctgttttatatccccttccccgcaactttagaagtatcaaaagtacc

SEQ ID NO: 82303 - DNA, 75 bp, Artificial Sequence
  Synthetic
gtagacattaagactacacccccaccagagtgcatcactgatctactacaagctgttgactcacaggaagtcagg

SEQ ID NO: 82304 - DNA, 75 bp, Artificial Sequence
  Synthetic
atgacaattcttcaggcagtcaccacatttgctgcagtagccggagtagtttatgtgatgtataaactttttgca

SEQ ID NO: 82305 - DNA, 75 bp, Artificial Sequence
  Synthetic
catttgctgcagtagccggagtagtttatgtgatgtataaactttttgcaggccaccaaggagcatatactggtc

SEQ ID NO: 82306 - DNA, 75 bp, Artificial Sequence
  Synthetic
ggtgtagctcaggctgatgaggctcagaatcccccacaggtaactgtgtctgagcctgcgttggcggcctgccct

SEQ ID NO: 82307 - DNA, 75 bp, Artificial Sequence
  Synthetic
acatgacatggtgcgaagagtctactgtgctatacaagagtcctccggcccctgaatgtggataatcctaaccac

SEQ ID NO: 82308 - DNA, 75 bp, Artificial Sequence
  Synthetic
ccatggcaaagagaaacatcgtcacagcaaccaccagcaagggggaatttaccatgctcggagtgcacgacaatg

SEQ ID NO: 82309 - DNA, 75 bp, Artificial Sequence
  Synthetic
ggcaaagagattgaggtattggacgctaaagcattagaggatcaggctggtacaaatctggaaatcaccattgtc

SEQ ID NO: 82310 - DNA, 75 bp, Artificial Sequence
  Synthetic
ctcgaccattaactataccaccataaactattacaaggacagtgccagtaatgcggccaccaaaatggacttttc

SEQ ID NO: 82311 - DNA, 75 bp, Artificial Sequence
  Synthetic
tgcagtgaccgaacaagggtacttaaacttgggcgggcgccaaactgctcgcaccctaatgtacaacttcccaac

SEQ ID NO: 82312 - DNA, 75 bp, Artificial Sequence
  Synthetic
ccagttaaggatgtgatgattaaaacagctcctgctcttaactccccgaacattgaggcgtgcggttatagtgac

SEQ ID NO: 82313 - DNA, 75 bp, Artificial Sequence
  Synthetic
acatgggttcgctgcggccctgaaacgctcatacttcactcagagtcaaggtgaaatacagtggatgaggccatc

SEQ ID NO: 82314 - DNA, 75 bp, Artificial Sequence
  Synthetic
attccaccataaccacccaggaagcagccaatgcagtgattgggtatggtgaatggccacagttccttaacccga

SEQ ID NO: 82315 - DNA, 75 bp, Artificial Sequence
  Synthetic
tgaaggagtaaaggaacctgcagtgttaaccaaaaatgaccccagattgaagacagattttgaagaggccatctt

SEQ ID NO: 82316 - DNA, 75 bp, Artificial Sequence
  Synthetic
cgattttacacccttgagagtgttgagtggcaagagtcgtcccgtggctggtggtggaagctccccgatgcactt

SEQ ID NO: 82317 - DNA, 75 bp, Artificial Sequence
  Synthetic
ttaaccaaaaatgaccccagattgaagacagattttgaagaggccatcttctcaaagtatgtgggaaacaagatt

SEQ ID NO: 82318 - DNA, 75 bp, Artificial Sequence
  Synthetic
agtggcaagagtcgtcccgtggctggtggtggaagctccccgatgcacttaaggatatgggcatgtttggacaaa

SEQ ID NO: 82319 - DNA, 75 bp, Artificial Sequence
  Synthetic
aaggatatgggcatgtttggacaaaacatgtattaccattacctaggtagagctgggtacacagtacacgtacaa

SEQ ID NO: 82320 - DNA, 75 bp, Artificial Sequence
  Synthetic
gaacagatgtgcctcgaggatgccatgtatggcactgatggcttagaggctctagacttgagtactagtgctggg

SEQ ID NO: 82321 - DNA, 75 bp, Artificial Sequence
  Synthetic
tgtatggcactgatggcttagaggctctagacttgagtactagtgctgggtacccttatgtggccatgggtaaga

SEQ ID NO: 82322 - DNA, 75 bp, Artificial Sequence
  Synthetic
agaacacctttgctccagtggactggttattgggatgcggtgtgctagctggtaacatcacggtgttcccgcacc

SEQ ID NO: 82323 - DNA, 75 bp, Artificial Sequence
  Synthetic
acttgcccttagttacttatgtgaaagatgaactcagatcaaaaacaaaggtggagcaaggcaaatccagactga

SEQ ID NO: 82324 - DNA, 75 bp, Artificial Sequence
  Synthetic
gttattgggatgcggtgtgctagctggtaacatcacggtgttcccgcaccaaattataaacttgcgtaccaacaa

SEQ ID NO: 82325 - DNA, 75 bp, Artificial Sequence
  Synthetic
agatgaactcagatcaaaaacaaaggtggagcaaggcaaatccagactgatcgaggcttcgagtcttaacgactc

SEQ ID NO: 82326 - DNA, 75 bp, Artificial Sequence
  Synthetic
tgtaattttacccttcgtgccacttaaatatgagaccggcgcgtcaacagcaatccccataaccgtcactgtagc

SEQ ID NO: 82327 - DNA, 75 bp, Artificial Sequence
  Synthetic
tgttgggtgtgatccagatttgttttggagtaaaataccagttttaatggaggaaaaactcttcgcatttgatta

SEQ ID NO: 82328 - DNA, 75 bp, Artificial Sequence
  Synthetic
aaatatgagaccggcgcgtcaacagcaatccccataaccgtcactgtagctcctatgtgctgtgagtttaacggg

SEQ ID NO: 82329 - DNA, 75 bp, Artificial Sequence
  Synthetic
tacaggctatgatgcatccctcagtccagcttggtttgaggctctcaaaatggtactggagaaaatcggattcgg

SEQ ID NO: 82330 - DNA, 75 bp, Artificial Sequence
  Synthetic
acaaacaactttcactccccgagtatagacccaaattatgatgtgacggctccaatccatatacccggcgaactg

SEQ ID NO: 82331 - DNA, 75 bp, Artificial Sequence
  Synthetic
tccaatccatatacccggcgaactgcacaatataatggaactggcagaaattgatagtgtcatacctatgaatgc

SEQ ID NO: 82332 - DNA, 75 bp, Artificial Sequence
  Synthetic
cccccatgaggttgacgctagtctcctagcccaatcaggaaaagactatggactaaccatgacaccagctgacaa

SEQ ID NO: 82333 - DNA, 75 bp, Artificial Sequence
  Synthetic
gcatgatggctactggcaaaatactacttagttactcaccacctggtgcagcccccccgagaacacgaaaggatg

SEQ ID NO: 82334 - DNA, 75 bp, Artificial Sequence
  Synthetic
cccatttttagtacacccagtgatgcccatgaaagagatacacgaatcaatcagatggaccaaagatcctagaaa

SEQ ID NO: 82335 - DNA, 75 bp, Artificial Sequence
  Synthetic
acttagttactcaccacctggtgcagcccccccgagaacacgaaaggatgccatgttagggacacacgtaatctg

SEQ ID NO: 82336 - DNA, 75 bp, Artificial Sequence
  Synthetic
acccttgtggccccgtggatctctaacaccgactatcgacgcagcgccaaggatgactttaccgagggaggatac

SEQ ID NO: 82337 - DNA, 75 bp, Artificial Sequence
  Synthetic
aggaagaatacaacaaatttctagctaaaattaggagtgtgccaattggaagagctttattgctccccgagtact

SEQ ID NO: 82338 - DNA, 75 bp, Artificial Sequence
  Synthetic
gtctctggatacggtccagaacacgatggccagtgggtctgtacactcaaaggaagttcctgcactgactgccgt

SEQ ID NO: 82339 - DNA, 75 bp, Artificial Sequence
  Synthetic
tttgccacatggaagattagctactaccacgcataccaattgcgcaggaagcttgagatgttcacctattccaga

SEQ ID NO: 82340 - DNA, 75 bp, Artificial Sequence
  Synthetic
accacgcataccaattgcgcaggaagcttgagatgttcacctattccagatttgatattgagctcacctttgtca

SEQ ID NO: 82341 - DNA, 75 bp, Artificial Sequence
  Synthetic
caaattatgtatatacccccgggggccccggtgccgagaaagtgggatgattttacgtggcaaacttccacaaac

SEQ ID NO: 82342 - DNA, 75 bp, Artificial Sequence
  Synthetic
cagtgccacatgacagcattagtgctggagcaacaaacaagtacggttacaacaccattaatgactttgggaccg

SEQ ID NO: 82343 - DNA, 75 bp, Artificial Sequence
  Synthetic
aacaccattaatgactttgggaccgtggctgtacgtatcgtgaatgagcatgacccagttaaaatagagtcaaaa

SEQ ID NO: 82344 - DNA, 75 bp, Artificial Sequence
  Synthetic
gatacaagatttgtaactaccatttagccactcaagaggacatggaacatgcagtagccgtgatgtgggaccgag

SEQ ID NO: 82345 - DNA, 75 bp, Artificial Sequence
  Synthetic
cccagtaactgtggagggtccaacttttaggtacatggatgcaaatgagtactaccccgcccgataccaatcgca

SEQ ID NO: 82346 - DNA, 75 bp, Artificial Sequence
  Synthetic
cttgattactgctggtggtgaaggggttgttgcatttgcggacgtgagagatctgtttgcgtatgaagaagaggc

SEQ ID NO: 82347 - DNA, 75 bp, Artificial Sequence
  Synthetic
gagcaggtttcagtactgagatctctggcaggatacaggaactgcaggagaccgtccagaatgttatcactgaga

SEQ ID NO: 82348 - DNA, 75 bp, Artificial Sequence
  Synthetic
tactggccaccctcagcttgctggggtgtgacgcctctccatggcattggttaaaagagaaagtttgcaacatac

SEQ ID NO: 82349 - DNA, 75 bp, Artificial Sequence
  Synthetic
accaaaattttgccagaagcacaagataaagtagagtatttgtctaaattgaaacacctagacacacttgaaaat

SEQ ID NO: 82350 - DNA, 75 bp, Artificial Sequence
  Synthetic
gctgttcaacaacattcgctggttggccataaaggcaagaaagtttgctcccttgtacgccagcgaggcccgtcg

SEQ ID NO: 82351 - DNA, 75 bp, Artificial Sequence
  Synthetic
cattttcaaaatggagagtaccatcaacaattacatacagttcaagaccaaacaccgcattgaacctgtatgttt

SEQ ID NO: 82352 - DNA, 75 bp, Artificial Sequence
  Synthetic
acgtcctcgcgtccaccaactcatacaccatatcgccaccaacgatatcagcctcagacgcgttggccagacgct

SEQ ID NO: 82353 - DNA, 75 bp, Artificial Sequence
  Synthetic
caccatatcgccaccaacgatatcagcctcagacgcgttggccagacgctttgcgtttgacgtggacattgaggt

SEQ ID NO: 82354 - DNA, 75 bp, Artificial Sequence
  Synthetic
agcaaacttttccagttgttgccctctagtgtgtggaaaggccattcaatttgtagataaaatgacacgcaccag

SEQ ID NO: 82355 - DNA, 75 bp, Artificial Sequence
  Synthetic
ctagtgtgtggaaaggccattcaatttgtagataaaatgacacgcaccagatacaccgtagacgagctgaccact

SEQ ID NO: 82356 - DNA, 75 bp, Artificial Sequence
  Synthetic
ttcaaggaacccaggattgacataaagacaacacctccaccacccgccatagcggatttgcttcgatctgttgat

SEQ ID NO: 82357 - DNA, 75 bp, Artificial Sequence
  Synthetic
agacacctcaaccgggccatgacaattgtgcaggctgtttcttcctttgtggttgtctctggtatgttattcatt

SEQ ID NO: 82358 - DNA, 75 bp, Artificial Sequence
  Synthetic
ttgtgcaggctgtttcttcctttgtggttgtctctggtatgttattcattatctacaaattgtttgctaacttcc

SEQ ID NO: 82359 - DNA, 75 bp, Artificial Sequence
  Synthetic
cgtttgactacgcagttgctatggcgaagcgcaatatactgactgcaacaacggacaagggcgagtttactatgc

SEQ ID NO: 82360 - DNA, 75 bp, Artificial Sequence
  Synthetic
acttgtggacaccaacgatgtgaacctagaaataaccattgttgaacttgacaggaatgaaaaatttagggacat

SEQ ID NO: 82361 - DNA, 75 bp, Artificial Sequence
  Synthetic
ctagaaataaccattgttgaacttgacaggaatgaaaaatttagggacatcagggcacacatacccacaactata

SEQ ID NO: 82362 - DNA, 75 bp, Artificial Sequence
  Synthetic
ggtcagtgtggtggcgtggtgatgtctacaggcaaagtcattggcattcacgtggggggtaatggttcccatggg

SEQ ID NO: 82363 - DNA, 75 bp, Artificial Sequence
  Synthetic
gctggctacccggttattaacacccccaacaaaaccaagctacaacctagcgtgttttacagcgtgttcccgggt

SEQ ID NO: 82364 - DNA, 75 bp, Artificial Sequence
  Synthetic
ccaacaaaaccaagctacaacctagcgtgttttacagcgtgttcccgggtgttaaggagcctgcggttttgtcaa

SEQ ID NO: 82365 - DNA, 75 bp, Artificial Sequence
  Synthetic
tgctccctgagtactctacattgtaccgccgttggcttgactcattttagtaaccctacctcagtcgaattggat

SEQ ID NO: 82366 - DNA, 75 bp, Artificial Sequence
  Synthetic
cttacaactagtgccggctacccctatgtgaccatggggaaaaggaagagagaaattctgaacaaggaaacacgt

SEQ ID NO: 82367 - DNA, 75 bp, Artificial Sequence
  Synthetic
gctggtcacgtacgtgaaggacgagttgcgtaaaccatcaaaaattaagacagggaagtccagattgatagaggc

SEQ ID NO: 82368 - DNA, 75 bp, Artificial Sequence
  Synthetic
catagtgaccggcagtgccgtggggtgtgaccctgacatcttttggagcaagataccagtcatgcttgatggcca

SEQ ID NO: 82369 - DNA, 75 bp, Artificial Sequence
  Synthetic
agagaaaatagggtatggtgatcgcgtggattacatagattacctcaatcactctcaccacctgtacaagaataa

SEQ ID NO: 82370 - DNA, 75 bp, Artificial Sequence
  Synthetic
aatcattaggaccctcttacttaaaacatataaaggggtggatcttgattcgcttcgaatgatcgcctatggcga

SEQ ID NO: 82371 - DNA, 75 bp, Artificial Sequence
  Synthetic
aatgactccagcggacaagggagctacctttgaggctgtcacttgggaaacagcaacgttcttgaaacggttttt

SEQ ID NO: 82372 - DNA, 75 bp, Artificial Sequence
  Synthetic
gactaaagacccaaagaatacacaagatcatgtgcggtctctatgcctattggcttggcacaacggggccgtgga

SEQ ID NO: 82373 - DNA, 75 bp, Artificial Sequence
  Synthetic
gcgccgccgctggctggactctttttgattaaccatacctcactcgaattggtctgagagatagtgggatatggg

SEQ ID NO: 82374 - DNA, 75 bp, Artificial Sequence
  Synthetic
ttaaaacagcttgggggttgttcccacccccagggtccaatggacgctagtacaccggtatcacggtacccttgt

SEQ ID NO: 82375 - DNA, 75 bp, Artificial Sequence
  Synthetic
ccgtaacattagaagcacaaaagcaaccgctcaatagacaccatacatccagtgtggttacgagcaagcacttct

SEQ ID NO: 82376 - DNA, 75 bp, Artificial Sequence
  Synthetic
accgctcaatagacaccatacatccagtgtggttacgagcaagcacttctgtctccccggttgcgccctatatgc

SEQ ID NO: 82377 - DNA, 75 bp, Artificial Sequence
  Synthetic
tttgagagttgcgttcagcgccttacccccggcgtagctcaggctgatgaggctccgaacaccccacaggcgact

SEQ ID NO: 82378 - DNA, 75 bp, Artificial Sequence
  Synthetic
cccccggcgtagctcaggctgatgaggctccgaacaccccacaggcgactgtgtcggagcctgcgttggcggcct

SEQ ID NO: 82379 - DNA, 75 bp, Artificial Sequence
  Synthetic
cggcccctgaatgtggataatcccaaccactgatcctacgttcgcaatccagcgttcagtaggtcgtaacgcgca

SEQ ID NO: 82380 - DNA, 75 bp, Artificial Sequence
  Synthetic
cacgttcagtgcacaattacaaaaacgagattttctgtcataatgggtgctcaggtatctgctcagaacaatgga

SEQ ID NO: 82381 - DNA, 75 bp, Artificial Sequence
  Synthetic
acacacgaaaacaaaaacacagccactggtggttcaaccattaactacactactattaattactacaaagacagt

SEQ ID NO: 82382 - DNA, 75 bp, Artificial Sequence
  Synthetic
tactattaattactacaaagacagtgctagtaatgcggcaacaaagatggacttttctcaagatccctctaaatt

SEQ ID NO: 82383 - DNA, 75 bp, Artificial Sequence
  Synthetic
gctagtaatgcggcaacaaagatggacttttctcaagatccctctaaatttacagagccagttaaagatgtaatg

SEQ ID NO: 82384 - DNA, 75 bp, Artificial Sequence
  Synthetic
caccaaacattgaggcgtgtggttacagtgaccgtgtactacaacttaccttagggaactcaaccattaccacac

SEQ ID NO: 82385 - DNA, 75 bp, Artificial Sequence
  Synthetic
cagtgaccgtgtactacaacttaccttagggaactcaaccattaccacacaagaagcggctaatgccgtagttgg

SEQ ID NO: 82386 - DNA, 75 bp, Artificial Sequence
  Synthetic
ttagggaactcaaccattaccacacaagaagcggctaatgccgtagttgggtatggtgaatggccaacactgctc

SEQ ID NO: 82387 - DNA, 75 bp, Artificial Sequence
  Synthetic
gttcctaccattagaacagcaaaggtgcaagggcccgggtttgattatgcagtagcaatggctaaaagaaatgtt

SEQ ID NO: 82388 - DNA, 75 bp, Artificial Sequence
  Synthetic
agcgtggactgggagaagacttcgcgcggctggtggtggaagctacccgatgcactcaaggatatgggaatgttt

SEQ ID NO: 82389 - DNA, 75 bp, Artificial Sequence
  Synthetic
cgtacagtgcaacgcgtctaagtttcatcaaggaacactctttgttgcagccatccctgagtttatgatggccag

SEQ ID NO: 82390 - DNA, 75 bp, Artificial Sequence
  Synthetic
ggttcacatgggtttgcagcagccctgaaacgatcttacttcactcagagccaaggtgagatccaatggatgaga

SEQ ID NO: 82391 - DNA, 75 bp, Artificial Sequence
  Synthetic
atcacttacgagcgggccaaccccggtgaagcgggaggcaagtttcagaagagttttaccccctcaagcactgcg

SEQ ID NO: 82392 - DNA, 75 bp, Artificial Sequence
  Synthetic
ccccaccaaataatcaacctgcgcacaaataattgcgccaccttggtgctgccctatgttaattccacctccacc

SEQ ID NO: 82393 - DNA, 75 bp, Artificial Sequence
  Synthetic
caaataattgcgccaccttggtgctgccctatgttaattccacctccaccgattcaatggtgaaacacaacaact

SEQ ID NO: 82394 - DNA, 75 bp, Artificial Sequence
  Synthetic
ccgttgcaccgatgtgctgtgaatttaatggacttagatcgctgaccgtcccagtgacacaagggttgcccacac

SEQ ID NO: 82395 - DNA, 75 bp, Artificial Sequence
  Synthetic
taatggacttagatcgctgaccgtcccagtgacacaagggttgcccacacttgccactcctggttccaaccaatt

SEQ ID NO: 82396 - DNA, 75 bp, Artificial Sequence
  Synthetic
tgaggtcaagaacataatggagctagcagagattgatagtgtcattccaatgaatgctgtggcgacaaaggtcaa

SEQ ID NO: 82397 - DNA, 75 bp, Artificial Sequence
  Synthetic
gcagagattgatagtgtcattccaatgaatgctgtggcgacaaaggtcaatcaaatggaagcataccccatccct

SEQ ID NO: 82398 - DNA, 75 bp, Artificial Sequence
  Synthetic
tcacgcacgttgttaggtgagattctcaactactacacccactggactgggtctttaaagtttacctttctcttc

SEQ ID NO: 82399 - DNA, 75 bp, Artificial Sequence
  Synthetic
acagcaattgttgtgccggcgggggctccaaagaacatgagcatgctagcgttcatcagtgcatgcaatgatttt

SEQ ID NO: 82400 - DNA, 75 bp, Artificial Sequence
  Synthetic
tcagcccggttgttgaaagacacaccatttgttagacaactgggtctcataacaccacagggtatagaagataca

SEQ ID NO: 82401 - DNA, 75 bp, Artificial Sequence
  Synthetic
cattccaaggaagtgccagcattgacagctgtagagaccggtgccaccagtcaggtcgagccgtcggatctaata

SEQ ID NO: 82402 - DNA, 75 bp, Artificial Sequence
  Synthetic
gccttaggtcagagtgcaccatagaatcatttcttggtagagcagcatgtgttgcagtcataggacttagcaaca

SEQ ID NO: 82403 - DNA, 75 bp, Artificial Sequence
  Synthetic
gttgcagtcataggacttagcaacaaagaaccaaccgatggcaatgcaaaggacttgtttgccaagtggaagatt

SEQ ID NO: 82404 - DNA, 75 bp, Artificial Sequence
  Synthetic
ctcacgatttgatgtggagctcacctttgtgataaccgagcggtttgccaccgggggggacgctgcggcacgcca

SEQ ID NO: 82405 - DNA, 75 bp, Artificial Sequence
  Synthetic
ccgggggggacgctgcggcacgccattacgtgtaccaaattatgtacataccacctggcgccccggagccacaag

SEQ ID NO: 82406 - DNA, 75 bp, Artificial Sequence
  Synthetic
cagtggatgctggagctagtaacaagtatggatactcctcaataaatgattttgggaccctagctgtgcggattg

SEQ ID NO: 82407 - DNA, 75 bp, Artificial Sequence
  Synthetic
tgaatgagcatgatccaacaccagttgacgccaaggtaagagtttacatgaagcccaaacacattcgcgtatggt

SEQ ID NO: 82408 - DNA, 75 bp, Artificial Sequence
  Synthetic
ccgcagctgacatacgcacctatggatttggtcaccagaacaaggccgtgtatgttgccgggtacaaaatatgta

SEQ ID NO: 82409 - DNA, 75 bp, Artificial Sequence
  Synthetic
gggggtatattaagatgcacccacggtgtgatggggctcattacagcaggtggtgagggagtggtggcctttgct

SEQ ID NO: 82410 - DNA, 75 bp, Artificial Sequence
  Synthetic
tccattaccgtgctggccaccctcagccttttgggatgtgatgcttcgccatggcaatggcttaaagaaaaagtt

SEQ ID NO: 82411 - DNA, 75 bp, Artificial Sequence
  Synthetic
atggcaatggcttaaagaaaaagtttgcaacatccttggcataccattcgtaatgaagcagggggattcatggat

SEQ ID NO: 82412 - DNA, 75 bp, Artificial Sequence
  Synthetic
ctggatcaaggctaaagtgttaccagaggctcaggacaaagttgagtacctgtctaagctaaagcaccttgacac

SEQ ID NO: 82413 - DNA, 75 bp, Artificial Sequence
  Synthetic
aaattttgtccactctacgccatggaagcgcgtcgtattttcaaaatggaagccaccattaacaattacatacag

SEQ ID NO: 82414 - DNA, 75 bp, Artificial Sequence
  Synthetic
accggtctcatagggcgggccattgccaagcaagccaacacaagcacatactccctgccgcccgacccgtcgcac

SEQ ID NO: 82415 - DNA, 75 bp, Artificial Sequence
  Synthetic
ccaagcaagccaacacaagcacatactccctgccgcccgacccgtcgcactttgatgggtacaagcagcagggag

SEQ ID NO: 82416 - DNA, 75 bp, Artificial Sequence
  Synthetic
ttattctgtcagatggtgtcaactgttgagttcataccccccatggctagcttagaagagaagggcattctgttt

SEQ ID NO: 82417 - DNA, 75 bp, Artificial Sequence
  Synthetic
acatccgactatgtcctagcctcaaccaactcacacaccatcaccccccctacaatatcagcttcagatgcattg

SEQ ID NO: 82418 - DNA, 75 bp, Artificial Sequence
  Synthetic
ctggctacccaaaagtgcaaggactgccacaagcctgcaaatttctcaacatgctgcccccttgtgtgtggtaag

SEQ ID NO: 82419 - DNA, 75 bp, Artificial Sequence
  Synthetic
gccacaagcctgcaaatttctcaacatgctgcccccttgtgtgtggtaaggcaattcagttgatggacaaaacca

SEQ ID NO: 82420 - DNA, 75 bp, Artificial Sequence
  Synthetic
gttgtcttgaagctctgttccaaggcccactagtgtttaaagagcccaagatcgacataaaaaacacgccaccgc

SEQ ID NO: 82421 - DNA, 75 bp, Artificial Sequence
  Synthetic
cccactagtgtttaaagagcccaagatcgacataaaaaacacgccaccgccacctgccatagcagatctgctacg

SEQ ID NO: 82422 - DNA, 75 bp, Artificial Sequence
  Synthetic
gctaactttcaaggagcatacactggcatgcctaaccctaaaccaaaggttccaacattgagagctgccaaggtc

SEQ ID NO: 82423 - DNA, 75 bp, Artificial Sequence
  Synthetic
tccaacattgagagctgccaaggtccaaggcccagtctttgattacgcggttgccatggcacggcgcaacattct

SEQ ID NO: 82424 - DNA, 75 bp, Artificial Sequence
  Synthetic
ttcaccatgcttggcatttatgaccgagttgcagttttgcccacacactccaacccaggagacaccatagtactg

SEQ ID NO: 82425 - DNA, 75 bp, Artificial Sequence
  Synthetic
gagttgcagttttgcccacacactccaacccaggagacaccatagtactggcagggcgtgaggttaagataatag

SEQ ID NO: 82426 - DNA, 75 bp, Artificial Sequence
  Synthetic
gcagtactagccgttaacaccagtaagtaccccaacatgtttattcccgttggcgcggtgtcagagcagggaatg

SEQ ID NO: 82427 - DNA, 75 bp, Artificial Sequence
  Synthetic
tggcgcggtgtcagagcagggaatgctaaaccttggtggtagaccaaccaaccgcaccctcatgtacaacttccc

SEQ ID NO: 82428 - DNA, 75 bp, Artificial Sequence
  Synthetic
gtggttatggccacaggaaaagtgattggaatacacgtgggtggcaacggatcccacggctttgctgcggccctg

SEQ ID NO: 82429 - DNA, 75 bp, Artificial Sequence
  Synthetic
tttctcaaagtacattggcaattccatcttagaagtggatgagtatatgagggaggccgttgaccactacgcggg

SEQ ID NO: 82430 - DNA, 75 bp, Artificial Sequence
  Synthetic
atcttagaagtggatgagtatatgagggaggccgttgaccactacgcggggcagctaatgtctttggatatcccc

SEQ ID NO: 82431 - DNA, 75 bp, Artificial Sequence
  Synthetic
gggtacccctatgtggcaattgggaaaaagaagaggcagatacttaacaaggaaaccagagacactaaggagatg

SEQ ID NO: 82432 - DNA, 75 bp, Artificial Sequence
  Synthetic
ggaaaccagagacactaaggagatgaagaagatgctggacaaatatggcataaacctacccttggtgacctatgt

SEQ ID NO: 82433 - DNA, 75 bp, Artificial Sequence
  Synthetic
gaaagatgagttgagacccaggagcaaggtggaagcaggcaaatcgcgcctaattgaagccagctctttaaatga

SEQ ID NO: 82434 - DNA, 75 bp, Artificial Sequence
  Synthetic
ttacactggatatgatgcttcattgtcaccagcatggttcgaggccctcaagatggtactggagaaaattgggta

SEQ ID NO: 82435 - DNA, 75 bp, Artificial Sequence
  Synthetic
aggaggtatgccatctgggtgttctggcacttcaatcttcaattcaatgattaacaacataataattaggacatt

SEQ ID NO: 82436 - DNA, 75 bp, Artificial Sequence
  Synthetic
ttatcctcacaaaatagatgcaggcctcctagcccaaacaggaaaagagtacggcctgcgcatgacacccgcaga

SEQ ID NO: 82437 - DNA, 75 bp, Artificial Sequence
  Synthetic
ctcctagcccaaacaggaaaagagtacggcctgcgcatgacacccgcagacaagggggaaagctttgatgatgtc

SEQ ID NO: 82438 - DNA, 75 bp, Artificial Sequence
  Synthetic
atgcccatgagagaaatccatgagtcaattagatggacaaaggatcctagaaacacgcaggaccatgtccgctcc

SEQ ID NO: 82439 - DNA, 75 bp, Artificial Sequence
  Synthetic
caattagatggacaaaggatcctagaaacacgcaggaccatgtccgctccctgtgcctattggcctggcataatg

SEQ ID NO: 82440 - DNA, 75 bp, Artificial Sequence
  Synthetic
attcaactctgcgccgtcgctggctggactcattttgattaaccatgccccactcgaattggtttgggatatagt

SEQ ID NO: 82441 - DNA, 75 bp, Artificial Sequence
  Synthetic
ggactcattttgattaaccatgccccactcgaattggtttgggatatagtgtggcatgggtaaattttcttttaa

SEQ ID NO: 82442 - DNA, 75 bp, Artificial Sequence
  Synthetic
caagaggggcttgcgtggctatcattgaggtggacaatgatgcaccgacaaagcgcgccagcagattgttttcgg

SEQ ID NO: 82443 - DNA, 75 bp, Artificial Sequence
  Synthetic
atgaaaccatcaaaagaagtgggatacccgatcataaatgctccgtccaaaaccaaacttgaacccagcgctttt

SEQ ID NO: 82444 - DNA, 75 bp, Artificial Sequence
  Synthetic
gaagcaatattctctaagtatgtaggcaacaaaatcactgatgtggatgagtacatgaaagaggcagtggatcat

SEQ ID NO: 82445 - DNA, 75 bp, Artificial Sequence
  Synthetic
tttaaaacagcttgagggttgttcccaccctcaaggcctactgggcgctagtacaccggtatctcggtacccttg

SEQ ID NO: 82446 - DNA, 75 bp, Artificial Sequence
  Synthetic
gtacaccggtatctcggtacccttgtacgcctgttttatcttccctccccaaaagtaactttagaagcaagtaaa

SEQ ID NO: 82447 - DNA, 75 bp, Artificial Sequence
  Synthetic
tacgcctgttttatcttccctccccaaaagtaactttagaagcaagtaaactcacagctcaatagccgtcgcacc

SEQ ID NO: 82448 - DNA, 75 bp, Artificial Sequence
  Synthetic
aatatcgttacccgcttatctactacgggaagcctagtaacaccattgaacactttgagggttgcgttcagcgcc

SEQ ID NO: 82449 - DNA, 75 bp, Artificial Sequence
  Synthetic
cgggaagcctagtaacaccattgaacactttgagggttgcgttcagcgccaaacccggcgtagctcaggccgatg

SEQ ID NO: 82450 - DNA, 75 bp, Artificial Sequence
  Synthetic
ctcaatttgtgacatggtgcgaagagcctactgtgctaggtgagagtcctccggcccctgaatgtggctaatccc

SEQ ID NO: 82451 - DNA, 75 bp, Artificial Sequence
  Synthetic
gcctactgtgctaggtgagagtcctccggcccctgaatgtggctaatcccaaccaccgaacccgtggttgcaatc

SEQ ID NO: 82452 - DNA, 75 bp, Artificial Sequence
  Synthetic
ttatattgcaattttatggtgacatttatagtatttaagtgttaccatatattgcgcaaacatattgtaataata

SEQ ID NO: 82453 - DNA, 75 bp, Artificial Sequence
  Synthetic
ttatagtatttaagtgttaccatatattgcgcaaacatattgtaataatacagagttactactgcagaaatcatg

SEQ ID NO: 82454 - DNA, 75 bp, Artificial Sequence
  Synthetic
tacacgaccattaattattataaagatagtgccagtaatgcggccactaaaatggatttttcacaagatccctct

SEQ ID NO: 82455 - DNA, 75 bp, Artificial Sequence
  Synthetic
atagtgccagtaatgcggccactaaaatggatttttcacaagatccctctaaattcactgagccagtaaaggatg

SEQ ID NO: 82456 - DNA, 75 bp, Artificial Sequence
  Synthetic
tcacgctaggcaattccaccatcaccacgcaagaggcagctaatgccgtggttgcctatggtgaatggccctcct

SEQ ID NO: 82457 - DNA, 75 bp, Artificial Sequence
  Synthetic
cacgcaagaggcagctaatgccgtggttgcctatggtgaatggccctccttcctaaacccacaagaggcaaaccc

SEQ ID NO: 82458 - DNA, 75 bp, Artificial Sequence
  Synthetic
ctccaggggatggtggtggaaactaccagatgcactaaaggatatggggatgttcggccaaaacatgtaccatca

SEQ ID NO: 82459 - DNA, 75 bp, Artificial Sequence
  Synthetic
ccagatgcactaaaggatatggggatgttcggccaaaacatgtaccatcactaccttggacgggcagggtacact

SEQ ID NO: 82460 - DNA, 75 bp, Artificial Sequence
  Synthetic
gcaagtaactcagccgactccactggagggatcacgtacgagaaggccaatccaggcgaggcgggtggtaagttc

SEQ ID NO: 82461 - DNA, 75 bp, Artificial Sequence
  Synthetic
gagggatcacgtacgagaaggccaatccaggcgaggcgggtggtaagttccaacccaccttcactccatctagcg

SEQ ID NO: 82462 - DNA, 75 bp, Artificial Sequence
  Synthetic
tgttcccccaccaaattatcaacttacgcaccaacaactgcgcaacgttggtgcttccgtatgtgaactccactt

SEQ ID NO: 82463 - DNA, 75 bp, Artificial Sequence
  Synthetic
acgcaccaacaactgcgcaacgttggtgcttccgtatgtgaactccacttccacggattctatggctaaacacaa

SEQ ID NO: 82464 - DNA, 75 bp, Artificial Sequence
  Synthetic
agtcaccattgccccgatgtgctgcgagtttaatgggctacgctcaatgacaaaccctgttgcccaaggcctacc

SEQ ID NO: 82465 - DNA, 75 bp, Artificial Sequence
  Synthetic
gagtttaatgggctacgctcaatgacaaaccctgttgcccaaggcctaccaacattgtcaactccagggtctaac

SEQ ID NO: 82466 - DNA, 75 bp, Artificial Sequence
  Synthetic
ccaggcgaagtcaaaaatattatggaactggcagagattgacacagtcataccaatgaatgcagtgccaggtaag

SEQ ID NO: 82467 - DNA, 75 bp, Artificial Sequence
  Synthetic
aactggcagagattgacacagtcataccaatgaatgcagtgccaggtaaggtgaacaaaatggaagcgtacccta

SEQ ID NO: 82468 - DNA, 75 bp, Artificial Sequence
  Synthetic
gcctttcccgaacaatgctgggtgaaatcctcaattactacacacattgggcgggttccttgaaattcacatttt

SEQ ID NO: 82469 - DNA, 75 bp, Artificial Sequence
  Synthetic
aatcctcaattactacacacattgggcgggttccttgaaattcacatttttgttttgcggtagtatgatggctac

SEQ ID NO: 82470 - DNA, 75 bp, Artificial Sequence
  Synthetic
acatctgatatgggatatagggctccagtctagtgcgacacttgttgcaccctggatttcaaatgtcaactatag

SEQ ID NO: 82471 - DNA, 75 bp, Artificial Sequence
  Synthetic
cagtctagtgcgacacttgttgcaccctggatttcaaatgtcaactatagaaggtgtgccaaggacgatttctcg

SEQ ID NO: 82472 - DNA, 75 bp, Artificial Sequence
  Synthetic
ctggcctttgttagtgcgtgcaatgatttctcagctaggttgttgaaagacaccccgtttgtgagacagttaggt

SEQ ID NO: 82473 - DNA, 75 bp, Artificial Sequence
  Synthetic
atttctcagctaggttgttgaaagacaccccgtttgtgagacagttaggtctaatacagcctcaggggattgagg

SEQ ID NO: 82474 - DNA, 75 bp, Artificial Sequence
  Synthetic
cggtccattcaaaagaagttccagccctgacagcggttgaaaccggggccacaagtcaggtcgtacctgctgatc

SEQ ID NO: 82475 - DNA, 75 bp, Artificial Sequence
  Synthetic
cctgacagcggttgaaaccggggccacaagtcaggtcgtacctgctgatctcattgagacaagacacgtggtcaa

SEQ ID NO: 82476 - DNA, 75 bp, Artificial Sequence
  Synthetic
aaatgatgaacccaccgctagcaatgctaaggacctgtttgccacctggaagatcagctacttgaatgcatacca

SEQ ID NO: 82477 - DNA, 75 bp, Artificial Sequence
  Synthetic
gctaaggacctgtttgccacctggaagatcagctacttgaatgcataccagctgcggcgtaaacttgagatgttc

SEQ ID NO: 82478 - DNA, 75 bp, Artificial Sequence
  Synthetic
agacactacgtgtatcagataatgtacattccccccggggctccactcccattaaaatgggatgactacacgtgg

SEQ ID NO: 82479 - DNA, 75 bp, Artificial Sequence
  Synthetic
acattccccccggggctccactcccattaaaatgggatgactacacgtggcagagctcaaccaacccatcagtat

SEQ ID NO: 82480 - DNA, 75 bp, Artificial Sequence
  Synthetic
atgatgggttttccatagttccacatgataacatcagtgccggcgcgtttaataagtacggttacaacagcataa

SEQ ID NO: 82481 - DNA, 75 bp, Artificial Sequence
  Synthetic
tgataacatcagtgccggcgcgtttaataagtacggttacaacagcataaacgactttggaaccctggctgtgcg

SEQ ID NO: 82482 - DNA, 75 bp, Artificial Sequence
  Synthetic
ttggtgtccccggcccccgcgtgcagcagaatacactggaccttctgtggactacaagaaagatgaccaggtgat

SEQ ID NO: 82483 - DNA, 75 bp, Artificial Sequence
  Synthetic
gcagaatacactggaccttctgtggactacaagaaagatgaccaggtgatgacccacgtggcagacattagaacc

SEQ ID NO: 82484 - DNA, 75 bp, Artificial Sequence
  Synthetic
gaggacatgcaaaatgcggtggcggttatgtgggaccgcgatctcctggttgctgagagcagggcgcagggtatt

SEQ ID NO: 82485 - DNA, 75 bp, Artificial Sequence
  Synthetic
ttatgtgggaccgcgatctcctggttgctgagagcagggcgcagggtattgacaccattgcccgatgtaactgca

SEQ ID NO: 82486 - DNA, 75 bp, Artificial Sequence
  Synthetic
tggaagccaacgactactacccagcaaggtaccaatcacacatgctcattggctcggggtttgcaatgccaggtg

SEQ ID NO: 82487 - DNA, 75 bp, Artificial Sequence
  Synthetic
aaggtaccaatcacacatgctcattggctcggggtttgcaatgccaggtgactgcgggggtatactgaggtgcac

SEQ ID NO: 82488 - DNA, 75 bp, Artificial Sequence
  Synthetic
ctacgaggaagaagcaatggagcaaggtattactgattacgtcagtaggctaggaaacgcctttggtgctgggtt

SEQ ID NO: 82489 - DNA, 75 bp, Artificial Sequence
  Synthetic
ggtattactgattacgtcagtaggctaggaaacgcctttggtgctgggttcagtgctgaaattgctagcaggatt

SEQ ID NO: 82490 - DNA, 75 bp, Artificial Sequence
  Synthetic
ttagttatcgtggcgcgaaactacgaagactccatcactgtgttggccaccctcagcctattgggctgtgatgca

SEQ ID NO: 82491 - DNA, 75 bp, Artificial Sequence
  Synthetic
aagactccatcactgtgttggccaccctcagcctattgggctgtgatgcatcaccatggcaatggctgaaggaaa

SEQ ID NO: 82492 - DNA, 75 bp, Artificial Sequence
  Synthetic
gcaatgccgccaaagggttggagtggattgctaccaagattagtaagtttattgattggattaagaccaaagtac

SEQ ID NO: 82493 - DNA, 75 bp, Artificial Sequence
  Synthetic
aagattacagagctcactaacatggttacaagtaccataacagaaaagctcctcaaaaatttggtaaaaataatc

SEQ ID NO: 82494 - DNA, 75 bp, Artificial Sequence
  Synthetic
ttacaagtaccataacagaaaagctcctcaaaaatttggtaaaaataatctcctccctcgtcataattactagga

SEQ ID NO: 82495 - DNA, 75 bp, Artificial Sequence
  Synthetic
gacactctagagaatcaagtggcaaccctccatcagtcatgcccaagtcaggaagaccaagaagtactgttcaat

SEQ ID NO: 82496 - DNA, 75 bp, Artificial Sequence
  Synthetic
agaagaaagcttgtgacatcttggaaatcccatatgtggtcaggcagggtgatagttggttgaagaaattcacgg

SEQ ID NO: 82497 - DNA, 75 bp, Artificial Sequence
  Synthetic
atggaagccaccatcaacaattacatacagttcaagaccaaacaccgcattgaaccagtttgtttgttgatccat

SEQ ID NO: 82498 - DNA, 75 bp, Artificial Sequence
  Synthetic
tacagttcaagaccaaacaccgcattgaaccagtttgtttgttgatccatggggaccccggcactggtaaatcga

SEQ ID NO: 82499 - DNA, 75 bp, Artificial Sequence
  Synthetic
aatcccatatgtggtcaggcagggtgatagttggttgaagaaattcacggaagcatgcaatgcagccaagggatt

SEQ ID NO: 82500 - DNA, 75 bp, Artificial Sequence
  Synthetic
actggaatttgtaaccaaattaaagcaattagaaatgctggagaaccagattgcaactatccaccagtcatgtcc

SEQ ID NO: 82501 - DNA, 75 bp, Artificial Sequence
  Synthetic
cgcactttgacgggtacaagcagcaaggagtggtaatcatggatgatttaaatcagaacccggatggtgaggata

SEQ ID NO: 82502 - DNA, 75 bp, Artificial Sequence
  Synthetic
ttgcaactatccaccagtcatgtccaagtcaagaacatcaagagatccttttcaataatgtaaggtggttgtcca

SEQ ID NO: 82503 - DNA, 75 bp, Artificial Sequence
  Synthetic
aggagtggtaatcatggatgatttaaatcagaacccggatggtgaggatatgaaattgttctgtcagatggtgtc

SEQ ID NO: 82504 - DNA, 75 bp, Artificial Sequence
  Synthetic
ctcaaccaactcacatactatcaccccccctacgatctcagcttcagacgcgctatccaggagatttgcttttga

SEQ ID NO: 82505 - DNA, 75 bp, Artificial Sequence
  Synthetic
ccgtattgaaccagtgtgtttgttggtgcatggcagccctgggacaggtaaatcagtggcaaccaatttaattgc

SEQ ID NO: 82506 - DNA, 75 bp, Artificial Sequence
  Synthetic
ccccctacgatctcagcttcagacgcgctatccaggagatttgcttttgacactgacatttgcccaatgtcagaa

SEQ ID NO: 82507 - DNA, 75 bp, Artificial Sequence
  Synthetic
tcaacatgctgcccccttgtgtgcggtaaggcaattcagttgatggataaaactacccgcactagatacaccttg

SEQ ID NO: 82508 - DNA, 75 bp, Artificial Sequence
  Synthetic
gcaacaaggagttgtgataatggatgatttaaaccaaaaccctgatggagctgatatgaaattgttctgccaaat

SEQ ID NO: 82509 - DNA, 75 bp, Artificial Sequence
  Synthetic
gatttaaaccaaaaccctgatggagctgatatgaaattgttctgccaaatggtttccaccgttgagttcatacca

SEQ ID NO: 82510 - DNA, 75 bp, Artificial Sequence
  Synthetic
atcaccccacccactgttgcccacagtgatgcccttgccagacgcttcgcgtttgacatggacattcaggtaatg

SEQ ID NO: 82511 - DNA, 75 bp, Artificial Sequence
  Synthetic
gtgatgcccttgccagacgcttcgcgtttgacatggacattcaggtaatgagtgagtactctagagacggcaagc

SEQ ID NO: 82512 - DNA, 75 bp, Artificial Sequence
  Synthetic
ccaagatcgacataaagaacacaccgccaccacctgccatagcagacctactacggtctgttgacagtgaggaag

SEQ ID NO: 82513 - DNA, 75 bp, Artificial Sequence
  Synthetic
ctcgagcactcactatagtccaagcagtgtcatcatttgtggtggtttcagggatgttatatatgatctataggc

SEQ ID NO: 82514 - DNA, 75 bp, Artificial Sequence
  Synthetic
tgtgtggaaaggccatccaattaatggataagtcatccagagttaggtacagtatagaccaaattaccacgatga

SEQ ID NO: 82515 - DNA, 75 bp, Artificial Sequence
  Synthetic
agtgtcatcatttgtggtggtttcagggatgttatatatgatctataggctttttgccaatttccaaggagcata

SEQ ID NO: 82516 - DNA, 75 bp, Artificial Sequence
  Synthetic
ggataagtcatccagagttaggtacagtatagaccaaattaccacgatgataattaatgaaagaaacagaagatc

SEQ ID NO: 82517 - DNA, 75 bp, Artificial Sequence
  Synthetic
cgcagttgccatggcacggcgcaacatccttaccgctacaacgtccaagggggaattcaccatgcttggtattta

SEQ ID NO: 82518 - DNA, 75 bp, Artificial Sequence
  Synthetic
aacacctccacctgagtgcatcaacgatctactacaagcagtggactcccaggaggtcagagattactgcgtgag

SEQ ID NO: 82519 - DNA, 75 bp, Artificial Sequence
  Synthetic
atccttaccgctacaacgtccaagggggaattcaccatgcttggtatttatgaccgagttgcagtcttgcccacg

SEQ ID NO: 82520 - DNA, 75 bp, Artificial Sequence
  Synthetic
gatctactacaagcagtggactcccaggaggtcagagattactgcgtgagtaagggatggatagtcaacatcacc

SEQ ID NO: 82521 - DNA, 75 bp, Artificial Sequence
  Synthetic
agcaacgatgtgaaccttgaaatcacagtggtcacccttgataggaatgagaagttcagagatattcgagcccat

SEQ ID NO: 82522 - DNA, 75 bp, Artificial Sequence
  Synthetic
gctggtgtggtgtatgtgatgtacaagctctttgcagggcaacagggggcttatacaggactccccaataagaga

SEQ ID NO: 82523 - DNA, 75 bp, Artificial Sequence
  Synthetic
cagtggtcacccttgataggaatgagaagttcagagatattcgagcccatttgcctaccacaattcaggaaacca

SEQ ID NO: 82524 - DNA, 75 bp, Artificial Sequence
  Synthetic
agctctttgcagggcaacagggggcttatacaggactccccaataagagacccaatgtgcccacaattaggacag

SEQ ID NO: 82525 - DNA, 75 bp, Artificial Sequence
  Synthetic
ggatgctaaaccttggtggaagaccaaccaaccgcaccctaatgtataacttccccaccaaggctggacagtgcg

SEQ ID NO: 82526 - DNA, 75 bp, Artificial Sequence
  Synthetic
aaggagaatttaccatgcttggagtacatgacaatgtagccatactgccaacccatgcctcaccaggagaaacaa

SEQ ID NO: 82527 - DNA, 75 bp, Artificial Sequence
  Synthetic
aaccaaccgcaccctaatgtataacttccccaccaaggctggacagtgcggtggtgtggttatggccactggaaa

SEQ ID NO: 82528 - DNA, 75 bp, Artificial Sequence
  Synthetic
acatgacaatgtagccatactgccaacccatgcctcaccaggagaaacaatagtcattgatggtaaggaagtgga

SEQ ID NO: 82529 - DNA, 75 bp, Artificial Sequence
  Synthetic
ggagcaaggggagatacaatggatgagacctagtaaggatgccggatatccggtaataaatgctccctccaaaac

SEQ ID NO: 82530 - DNA, 75 bp, Artificial Sequence
  Synthetic
tgagaaattcagggacatcagacctcacatacccacccagatcactgagaccaatgatggagttttgatcgtgaa

SEQ ID NO: 82531 - DNA, 75 bp, Artificial Sequence
  Synthetic
agacctagtaaggatgccggatatccggtaataaatgctccctccaaaactaagctcgaaccaagtgtatttcat

SEQ ID NO: 82532 - DNA, 75 bp, Artificial Sequence
  Synthetic
agggatatctcaatcttggtggacgccagactgctcgtacattaatgtacaattttccaacaagagcaggccagt

SEQ ID NO: 82533 - DNA, 75 bp, Artificial Sequence
  Synthetic
gcaatcttctcaaaatacatcggcaattccatcttagaagtggacgagtacatgagggaggctgtggaccattat

SEQ ID NO: 82534 - DNA, 75 bp, Artificial Sequence
  Synthetic
attccatcttagaagtggacgagtacatgagggaggctgtggaccattatgcaggacagctgatgtccctggata

SEQ ID NO: 82535 - DNA, 75 bp, Artificial Sequence
  Synthetic
cagccctaaaacggtcgtacttcactcaaagtcaaggtgagatacagtggatgagaccgtctaaggaggtcggat

SEQ ID NO: 82536 - DNA, 75 bp, Artificial Sequence
  Synthetic
gtgctggatatccctatgtggcaattgggaaaaagaagagacagatacttaacaaggaaactagagacactaagg

SEQ ID NO: 82537 - DNA, 75 bp, Artificial Sequence
  Synthetic
tgggaaaaagaagagacagatacttaacaaggaaactagagacactaaggagatgaagaggatgctagacaaata

SEQ ID NO: 82538 - DNA, 75 bp, Artificial Sequence
  Synthetic
aaccagcggtcctaaccaagaatgatcctaggcttaaagtggactttgaggaagcaatattctccaagtatgttg

SEQ ID NO: 82539 - DNA, 75 bp, Artificial Sequence
  Synthetic
tcctaggcttaaagtggactttgaggaagcaatattctccaagtatgttggtaataagatcactgaagtggatga

SEQ ID NO: 82540 - DNA, 75 bp, Artificial Sequence
  Synthetic
gcgcttaattgaagccagctctctaaatgactcagtagcaatgaggcaagcatttggaaatttgtacgcaacctt

SEQ ID NO: 82541 - DNA, 75 bp, Artificial Sequence
  Synthetic
aatgactcagtagcaatgaggcaagcatttggaaatttgtacgcaaccttccataagaaccccggcactattaca

SEQ ID NO: 82542 - DNA, 75 bp, Artificial Sequence
  Synthetic
ggaagatgccatgtacggcactgatggcttagaagccctggacctcacaactagcgcagggtatccttatgtggc

SEQ ID NO: 82543 - DNA, 75 bp, Artificial Sequence
  Synthetic
ggcttagaagccctggacctcacaactagcgcagggtatccttatgtggcacttgggaagaagaaaagggacatc

SEQ ID NO: 82544 - DNA, 75 bp, Artificial Sequence
  Synthetic
tttgactacactgggtatgatgcctcgttgtcaccagcatggttcgaggcccttaagatggtactagagaaaatt

SEQ ID NO: 82545 - DNA, 75 bp, Artificial Sequence
  Synthetic
acatatgtaaaggatgagctcaggtcaaggaacaaggttgagcagggaaaatcaagacttattgaagcatccagt

SEQ ID NO: 82546 - DNA, 75 bp, Artificial Sequence
  Synthetic
caaggaacaaggttgagcagggaaaatcaagacttattgaagcatccagtcttaatgattcagtggcaatgagga

SEQ ID NO: 82547 - DNA, 75 bp, Artificial Sequence
  Synthetic
gtgaaaggaggtatgccatctgggtgctctggcacttcaatcttcaattcaatgattaacaatataataattagg

SEQ ID NO: 82548 - DNA, 75 bp, Artificial Sequence
  Synthetic
ctgacctgttttggagtaagatcccggttctcatggaagagaagttgtttgcctttgactacacagggtacgatg

SEQ ID NO: 82549 - DNA, 75 bp, Artificial Sequence
  Synthetic
agagtacggcctgcgcatgacacccgcagataagggggaaagctttgatgaggtcacttgggaaacagcgacgtt

SEQ ID NO: 82550 - DNA, 75 bp, Artificial Sequence
  Synthetic
atcggctttggtgacagggtggactacatagattatctcaaccattcacaccatctatacaaaaacaagacttat

SEQ ID NO: 82551 - DNA, 75 bp, Artificial Sequence
  Synthetic
tgagtcaattagatggacaaaggaccctagaaacacacaggaccatgtccgctctttgtgcttattggcctggca

SEQ ID NO: 82552 - DNA, 75 bp, Artificial Sequence
  Synthetic
acgctagtctcctagcccaatcaggaaaagactatggactcactatgacaccagctgacaaatctgcaacttttg

SEQ ID NO: 82553 - DNA, 75 bp, Artificial Sequence
  Synthetic
agcaagtcacatgggaaaatgtaacattcttgaagagattctttagagcagatgagaagtatccattccttgtgc

SEQ ID NO: 82554 - DNA, 75 bp, Artificial Sequence
  Synthetic
gatgagaagtatccattccttgtgcatccagtgatgccaatgaaagaaattcatgaatcaatcagatggaccaaa

SEQ ID NO: 82555 - DNA, 75 bp, Artificial Sequence
  Synthetic
tccgctccttgtgtctattggcttggcacaatggggaggaagagtacaataaatttttagctaagatcaggagtg

SEQ ID NO: 82556 - DNA, 75 bp, Artificial Sequence
  Synthetic
attgagctacataagagtcctccggcccctgaatgcggctaatcctaaccacggagcaggcggtcgcaaaccagc

SEQ ID NO: 82557 - DNA, 75 bp, Artificial Sequence
  Synthetic
gcgcaccaacaactgtgctacgctagtattgccctatgtaaactcactctcaatagatagcatgacaaagcacaa

SEQ ID NO: 82558 - DNA, 75 bp, Artificial Sequence
  Synthetic
gtggcggagtcatcacatgtactgggaaagtcatcgggatgcatgttggtgggaacggttcacacgggtttgcag

SEQ ID NO: 82559 - DNA, 75 bp, Artificial Sequence
  Synthetic
ggaacaaggcatcaccaattacatagagtcacttggggccgcatttggaagtggatttactcagcagattggaga

SEQ ID NO: 82560 - DNA, 75 bp, Artificial Sequence
  Synthetic
aagtctgtggcggaaccgactactttgggtgtccgtgtttccttttaattttattgctggctgcttatggtgaca

SEQ ID NO: 82561 - DNA, 75 bp, Artificial Sequence
  Synthetic
ggatttaccacactatctacgtacactccagacttaatccgcatagtacttttaattagaagatcttatcattat

SEQ ID NO: 82562 - DNA, 75 bp, Artificial Sequence
  Synthetic
tgggaacggttcacacgggtttgcagcggccctgaagcgatcatacttcactcagaatcaaggtgaaatccagtg

SEQ ID NO: 82563 - DNA, 75 bp, Artificial Sequence
  Synthetic
tacaaagactcagctagtaatgctgcctccaaacaggatttctctcaagacccttctaaatttactgagccagtc

SEQ ID NO: 82564 - DNA, 75 bp, Artificial Sequence
  Synthetic
agacagatcactcttggaaattccaccataaccacacaggaagctgccaacgcagtggttgcgtacggtaggtgg

SEQ ID NO: 82565 - DNA, 75 bp, Artificial Sequence
  Synthetic
ctaatccagtggatgcccccactgaaccagatgtcagctcaaataggttttacacactagagtcagtgcagtggt

SEQ ID NO: 82566 - DNA, 75 bp, Artificial Sequence
  Synthetic
tctatcactacctgggcagaagtgggtacacagtccacgtgcagtgcaatgcatcaaaattccaccagggagccc

SEQ ID NO: 82567 - DNA, 75 bp, Artificial Sequence
  Synthetic
atgcaaaccccggggaaagtggtggcacatttactgatagctacaacccatctacggaggctgatcaaggaaggg

SEQ ID NO: 82568 - DNA, 75 bp, Artificial Sequence
  Synthetic
tcaatttaagaaccaacaatagtgccactctggtactaccgtatgtcaactcactagccattgattgcatggcta

SEQ ID NO: 82569 - DNA, 75 bp, Artificial Sequence
  Synthetic
tttacccttggaacctttagcttacgcaccacaggcatccacacaaatccccattacggtaaccattgcaccaat

SEQ ID NO: 82570 - DNA, 75 bp, Artificial Sequence
  Synthetic
ttcgagccaatatctcacctcagatgatttccagtcaccgtgtgcgctgccaaatttcgacgtcacaccaccaat

SEQ ID NO: 82571 - DNA, 75 bp, Artificial Sequence
  Synthetic
gatttccagtcaccgtgtgcgctgccaaatttcgacgtcacaccaccaattgacattcctggcgaagtgaagaat

SEQ ID NO: 82572 - DNA, 75 bp, Artificial Sequence
  Synthetic
gtcatactgctgtaggggtaaatttttctttaattcggagaaaaaaaaaaaaaaaaaaaaaaaaaaaaaaaaaaa

SEQ ID NO: 82573 - DNA, 75 bp, Artificial Sequence
  Synthetic
tacagaattccactaaacacagatggtagcaaaggtcccatattttgtttgagcctctcccccgcctcagatcaa

SEQ ID NO: 82574 - DNA, 75 bp, Artificial Sequence
  Synthetic
gtagcaaaggtcccatattttgtttgagcctctcccccgcctcagatcaacgtctacaatacactatgttgggag

SEQ ID NO: 82575 - DNA, 75 bp, Artificial Sequence
  Synthetic
ctggaaagctgatcctgacatattcaccaccgggagcatcccccccaaagagcagaaaggatgccatgctcggta

SEQ ID NO: 82576 - DNA, 75 bp, Artificial Sequence
  Synthetic
accaccgggagcatcccccccaaagagcagaaaggatgccatgctcggtactcacatcatatgggatttggggtt

SEQ ID NO: 82577 - DNA, 75 bp, Artificial Sequence
  Synthetic
agaagggggctacataacatgcttctaccagactcgcattgtcgtcccagctagtacaccaactaacatggctat

SEQ ID NO: 82578 - DNA, 75 bp, Artificial Sequence
  Synthetic
gctcgcatttgtgagcgcatgcccagacttcagcgtgcgattgctgagggataccactcacatcagtcagtcagc

SEQ ID NO: 82579 - DNA, 75 bp, Artificial Sequence
  Synthetic
actcctagcacaagcggtgtgaacagccaggaagtaccagcattgacagctgttgagaccggagcctcgggacag

SEQ ID NO: 82580 - DNA, 75 bp, Artificial Sequence
  Synthetic
ttctttggcagatcagcgtgcgtcaccatattggaagtggaaaatttcaatgcaacagatgcaacagacagaaag

SEQ ID NO: 82581 - DNA, 75 bp, Artificial Sequence
  Synthetic
catacaccaatacagtccaactaagaaggaaacttgagtttttcacctactccaggtttgatttagagatgactt

SEQ ID NO: 82582 - DNA, 75 bp, Artificial Sequence
  Synthetic
tgaagctacagattctggcgacacctattatggactagtttcaatcaatgactttggaaccttggcaattagagt

SEQ ID NO: 82583 - DNA, 75 bp, Artificial Sequence
  Synthetic
tattatggactagtttcaatcaatgactttggaaccttggcaattagagtggtgaatgagttcaaccccgctcgc

SEQ ID NO: 82584 - DNA, 75 bp, Artificial Sequence
  Synthetic
ccttacagaggagaaggagtggatttaaagcagggaagcatcacaccactaaccccagtaagtagcatcacaaca

SEQ ID NO: 82585 - DNA, 75 bp, Artificial Sequence
  Synthetic
taaagcagggaagcatcacaccactaaccccagtaagtagcatcacaacatatggttttgggcaccggaaccaag

SEQ ID NO: 82586 - DNA, 75 bp, Artificial Sequence
  Synthetic
ccatgtgggaaagggacttattagtggtggaatccagagcacagggtgttgatcaaattgccagatgttcatgca

SEQ ID NO: 82587 - DNA, 75 bp, Artificial Sequence
  Synthetic
ggtggaatccagagcacagggtgttgatcaaattgccagatgttcatgcacaactggagtttattattgcttgtc

SEQ ID NO: 82588 - DNA, 75 bp, Artificial Sequence
  Synthetic
caggtatcagtcacacatgaccatgggttgtggctttgccgaaccaggcgattgcggtggtattcttagatgtca

SEQ ID NO: 82589 - DNA, 75 bp, Artificial Sequence
  Synthetic
acatggagtaatggggctcatcactgctggtggcaatggaatagtcgcctttgctgatattagagacctgtatgt

SEQ ID NO: 82590 - DNA, 75 bp, Artificial Sequence
  Synthetic
cagtcagataagcgaaaaggtcacagaaatcgcctcaatggtcaatagtgtcgtcacagagaagttgctgaaaaa

SEQ ID NO: 82591 - DNA, 75 bp, Artificial Sequence
  Synthetic
ggaagcaaagcgcatttcaaaactggaaaacacaatcaacaattacatacaattcaagagcaaacaccgtattga

SEQ ID NO: 82592 - DNA, 75 bp, Artificial Sequence
  Synthetic
agtcctggcacagggaaatccattgtcacttccttagtcggtagagctatagcagagagagagaatacatccgtt

SEQ ID NO: 82593 - DNA, 75 bp, Artificial Sequence
  Synthetic
caactgccacggtgctgtgtaaggagtgccccaaaccagcaaatttcaagaagtgttgtcctttgatttgcggta

SEQ ID NO: 82594 - DNA, 75 bp, Artificial Sequence
  Synthetic
gtcactgctggtggggaaggcttggttgcattttcagacattagagacctttatgcatatgaagaggaagccatg

SEQ ID NO: 82595 - DNA, 75 bp, Artificial Sequence
  Synthetic
taactgcatggaagcactgttccagggaccaatacaatataaagatttgaagatagatatcaaaaccacccctcc

SEQ ID NO: 82596 - DNA, 75 bp, Artificial Sequence
  Synthetic
aaaatatcagagcttaccagcatggtcaccagcacaattacagagaaattactgaagaacttaataaaaattatc

SEQ ID NO: 82597 - DNA, 75 bp, Artificial Sequence
  Synthetic
gatagtgagtgttaacaatgaggttcaattagaacgcaatttgaacagggccatgaccattttacaggcaataac

SEQ ID NO: 82598 - DNA, 75 bp, Artificial Sequence
  Synthetic
ccatgaccattttacaggcaataaccacctttgccgcagttgctggcgttgtctatgtaatgtaccgcttatttg

SEQ ID NO: 82599 - DNA, 75 bp, Artificial Sequence
  Synthetic
gacgtctccccatggcagtggcttaagaagaaggcttgtgacattctagagatcccatacgtcatgcggcaaggt

SEQ ID NO: 82600 - DNA, 75 bp, Artificial Sequence
  Synthetic
agaagaaggcttgtgacattctagagatcccatacgtcatgcggcaaggtgacagctggcttaagaaattcacag

SEQ ID NO: 82601 - DNA, 75 bp, Artificial Sequence
  Synthetic
atgggaaggaggtcaagatcattgatgcacaggcgttagtggaccaagcaggtacaaatttagaaataactatca

SEQ ID NO: 82602 - DNA, 75 bp, Artificial Sequence
  Synthetic
tagccaggaacatcaggaaattctattcaacaatgtgaggtggttgtccatacagtcaaaaagatttgctccact

SEQ ID NO: 82603 - DNA, 75 bp, Artificial Sequence
  Synthetic
gagtcctgatcgtgaacactagtaagtaccccaacatgtatgtcccagtcggtgctgtgaccgagcagggatatc

SEQ ID NO: 82604 - DNA, 75 bp, Artificial Sequence
  Synthetic
ccgtattgaaccagtgtgtttattagtgcatggcagtcctggaacaggcaaatcagtggctactaacttgattgc

SEQ ID NO: 82605 - DNA, 75 bp, Artificial Sequence
  Synthetic
ggtgctgtgaccgagcagggatatctcaatctcggtggacgccagactgctcgtactctaatgtacaactttcca

SEQ ID NO: 82606 - DNA, 75 bp, Artificial Sequence
  Synthetic
gcaacagggagtagtaattatggatgacttaaatcaaaatcccgatggagctgacatgaaactcttttgtcagat

SEQ ID NO: 82607 - DNA, 75 bp, Artificial Sequence
  Synthetic
ggtttctacagtagagttcatcccaccaatggcttcactagaggaaaagggcattttgtttacgtcaaattacgt

SEQ ID NO: 82608 - DNA, 75 bp, Artificial Sequence
  Synthetic
ttttgaccaagaatgatcccaggttaaagacagactttgaagaagcaattttctcgaaatatgtgggaaacaaga

SEQ ID NO: 82609 - DNA, 75 bp, Artificial Sequence
  Synthetic
agcgaatactccagggatggaaagttgaacatggcgatggccacagagatgtgtaagaactgtcaccaaccagca

SEQ ID NO: 82610 - DNA, 75 bp, Artificial Sequence
  Synthetic
cagctcatgtcattggatattaatacagaacaaatgtgtcttgaagatgcaatgtatggcactgatggtctcgaa

SEQ ID NO: 82611 - DNA, 75 bp, Artificial Sequence
  Synthetic
agcattgaccagattaccacgatgatcattaatgagagaaacagaagatcgaacattggcaactgcatggaggcc

SEQ ID NO: 82612 - DNA, 75 bp, Artificial Sequence
  Synthetic
tcattaatgagagaaacagaagatcgaacattggcaactgcatggaggccctgtttcaaggtccgttacagtaca

SEQ ID NO: 82613 - DNA, 75 bp, Artificial Sequence
  Synthetic
aggaggtgagggaatattgtgagaagaaggggtggattgtcaatatcactggccaggtccaaactgaaaggaaca

SEQ ID NO: 82614 - DNA, 75 bp, Artificial Sequence
  Synthetic
aagtggaacagggcaaatccagactaattgaagcatctagtctaaatgactcagtagcaatgaggatggcttttg

SEQ ID NO: 82615 - DNA, 75 bp, Artificial Sequence
  Synthetic
gaaggggtggattgtcaatatcactggccaggtccaaactgaaaggaacattaacagagcaatgaccatactgca

SEQ ID NO: 82616 - DNA, 75 bp, Artificial Sequence
  Synthetic
ttacaccgggcttcccaacaaacgacccaatgtcccaactatcaggacggctaaggtgcaaggcccagggtttga

SEQ ID NO: 82617 - DNA, 75 bp, Artificial Sequence
  Synthetic
cccaatgtcccaactatcaggacggctaaggtgcaaggcccagggtttgattatgcagtggctatggccaaaaga

SEQ ID NO: 82618 - DNA, 75 bp, Artificial Sequence
  Synthetic
acccatgcctcaccaggagaaacaatagttattgatggaaaggaagtggaagtcctagacgctaaggcattagaa

SEQ ID NO: 82619 - DNA, 75 bp, Artificial Sequence
  Synthetic
agtcctagacgctaaggcattagaagatcaggccggaaccaacttggaaatcactattgttacccttaagagaaa

SEQ ID NO: 82620 - DNA, 75 bp, Artificial Sequence
  Synthetic
cactagtaagtaccccaacatgtatgttccagtcggtgctgtgaccgagcagggatatcttaatcttggtggcag

SEQ ID NO: 82621 - DNA, 75 bp, Artificial Sequence
  Synthetic
gagatttttcagagcagatgagaagtacccatttctagtacatccagtaatgccaatgaaagagattcatgaatc

SEQ ID NO: 82622 - DNA, 75 bp, Artificial Sequence
  Synthetic
tacccatttctagtacatccagtaatgccaatgaaagagattcatgaatcaatcagatggaccaaggatcctaga

SEQ ID NO: 82623 - DNA, 75 bp, Artificial Sequence
  Synthetic
gggaacggttcgcatgggtttgcagcggccctgaaacgatcatacttcactcagagtcaaggtgagatccagtgg

SEQ ID NO: 82624 - DNA, 75 bp, Artificial Sequence
  Synthetic
gctaaaattagaagtgtgccaatcggaagagctttactgctcccagagtactcaacactgtaccgccgttggctc

SEQ ID NO: 82625 - DNA, 75 bp, Artificial Sequence
  Synthetic
ctcaacactgtaccgccgttggctcgattctttttagtaaccctacctcagtcgaattggattgggttatactgt

SEQ ID NO: 82626 - DNA, 75 bp, Artificial Sequence
  Synthetic
cactatgtgtttgagggagtgaaagaaccagcagtgctcaccaagaatgaccccagactgaaaacagactttgag

SEQ ID NO: 82627 - DNA, 75 bp, Artificial Sequence
  Synthetic
aaccagcagtgctcaccaagaatgaccccagactgaaaacagactttgaggaggccattttctctaagtatgtag

SEQ ID NO: 82628 - DNA, 75 bp, Artificial Sequence
  Synthetic
acattaacacagagcagatgtgccttgaagatgcaatgtacggcacagatggccttgaagccctagatctcagca

SEQ ID NO: 82629 - DNA, 75 bp, Artificial Sequence
  Synthetic
tgaagatgcaatgtacggcacagatggccttgaagccctagatctcagcaccagtgccggatacccatatgtggc

SEQ ID NO: 82630 - DNA, 75 bp, Artificial Sequence
  Synthetic
ctacggtattaacctgcctttagtcacctatgtcaaagatgagctcagatccaaggccaaagtggaacaaggtaa

SEQ ID NO: 82631 - DNA, 75 bp, Artificial Sequence
  Synthetic
tggcatttggtaacctctacgcggcatttcacaagaacccgggcgtagtgacaggctcagctgttggctgtgacc

SEQ ID NO: 82632 - DNA, 75 bp, Artificial Sequence
  Synthetic
acgctagtctcctagcccaatcaggaaaagactatggactaaccatgactccagctgacaagtcagcgacatttg

SEQ ID NO: 82633 - DNA, 75 bp, Artificial Sequence
  Synthetic
aattcaaaaactggagcacacaatcaataactacatacagttcaagagcaaacaccgtattgagccagtatgttt

SEQ ID NO: 82634 - DNA, 75 bp, Artificial Sequence
  Synthetic
actagtgcatggtagcccggggacaggaaagtcagttgccacaaacttaattgctagagccatagcagagaaaga

SEQ ID NO: 82635 - DNA, 75 bp, Artificial Sequence
  Synthetic
ggatgacctgaatcaaaacccagacggtgctgacatgaagctgttttgccagatggtctctacagtggagttcat

SEQ ID NO: 82636 - DNA, 75 bp, Artificial Sequence
  Synthetic
agatggtctctacagtggagttcattccaccaatggcgtctttagaggagaagggaatactcttcacttccaact

SEQ ID NO: 82637 - DNA, 75 bp, Artificial Sequence
  Synthetic
tcgccttcgatatggacatccaggtcatgggcgaatattctagagatgggaagctgaatatggcaatggcaactg

SEQ ID NO: 82638 - DNA, 75 bp, Artificial Sequence
  Synthetic
catgggcgaatattctagagatgggaagctgaatatggcaatggcaactgagatgtgtaaaaactgccaccaacc

SEQ ID NO: 82639 - DNA, 75 bp, Artificial Sequence
  Synthetic
gtatagcatagaccaaataactaccatgattatcaatgaaagaaacaggcgctccaacattggaaattgcatgga

SEQ ID NO: 82640 - DNA, 75 bp, Artificial Sequence
  Synthetic
tacaaagacctcaaaatagacatcaaaaccacaccaccacctgagtgcataaatgacctattacaagcagtagac

SEQ ID NO: 82641 - DNA, 75 bp, Artificial Sequence
  Synthetic
agaggaaaggctggctggtgaacgtctcaagccaagttcagttggaacgcaacatcaacagagcaatgacaatcc

SEQ ID NO: 82642 - DNA, 75 bp, Artificial Sequence
  Synthetic
ctcaagccaagttcagttggaacgcaacatcaacagagcaatgacaatccttcaggctgttaccaccttcgccgc

SEQ ID NO: 82643 - DNA, 75 bp, Artificial Sequence
  Synthetic
gaaacccaatgttcccaccattagaacagcaaaggtgcaaggaccagggtttgactatgcagttgccatggcgaa

SEQ ID NO: 82644 - DNA, 75 bp, Artificial Sequence
  Synthetic
accgacccacgcttcaccaggcgaaactatattgatagatggtaaagaggtggaagtgttggacgcaaaggcact

SEQ ID NO: 82645 - DNA, 75 bp, Artificial Sequence
  Synthetic
actatattgatagatggtaaagaggtggaagtgttggacgcaaaggcacttgaggaccaagcaggcaccaatcta

SEQ ID NO: 82646 - DNA, 75 bp, Artificial Sequence
  Synthetic
accagctatcaaaatgccaatcctggcgagaaaggaggcactttcacgggtacgttcactcctgacaacaaccag

SEQ ID NO: 82647 - DNA, 75 bp, Artificial Sequence
  Synthetic
gagacgaatgatggagtactgatcgtgaacactagtaagtaccccaacatgtacgtgcccgtcggtgcagtgacc

SEQ ID NO: 82648 - DNA, 75 bp, Artificial Sequence
  Synthetic
tgaacactagtaagtaccccaacatgtacgtgcccgtcggtgcagtgaccgaacaagggtatttaaatctaggag

SEQ ID NO: 82649 - DNA, 75 bp, Artificial Sequence
  Synthetic
ctggcaaggtcattgggatgcatgttggcgggaacggttcacacgggttcgctgcagccctaaaacgatcgtatt

SEQ ID NO: 82650 - DNA, 75 bp, Artificial Sequence
  Synthetic
gtggatgagactttctaaagaggttggatacccagtgattaatgcgccaagtaagaccaaactagaacccagtgc

SEQ ID NO: 82651 - DNA, 75 bp, Artificial Sequence
  Synthetic
tgaagaggccatcttttctaagtatgtaggaaacaagattactgaagtggatgagtacatgaaagaagcggtgga

SEQ ID NO: 82652 - DNA, 75 bp, Artificial Sequence
  Synthetic
gtaggaaacaagattactgaagtggatgagtacatgaaagaagcggtggatcactatgctgggcaactcatatcc

SEQ ID NO: 82653 - DNA, 75 bp, Artificial Sequence
  Synthetic
accactagtgctggatacccttatgtcgcccttggcaagaaaaagagggacatactcaataagcgtacaagggac

SEQ ID NO: 82654 - DNA, 75 bp, Artificial Sequence
  Synthetic
tcgcccttggcaagaaaaagagggacatactcaataagcgtacaagggacaccaaggaaatgcaaaggttattgg

SEQ ID NO: 82655 - DNA, 75 bp, Artificial Sequence
  Synthetic
gcaaatccagactaattgaagcctccagcctgaacgactcagttgccatgagaatggcgtttggtaatttgtatg

SEQ ID NO: 82656 - DNA, 75 bp, Artificial Sequence
  Synthetic
ttccagtattaatggaagaaaaactttttgcgtttgattacaccggatacgatgcttctctcagtcccgcgtggt

SEQ ID NO: 82657 - DNA, 75 bp, Artificial Sequence
  Synthetic
gattacattgattacttgaaccactcccaccacctttacaaaaataagacatactgtgtcaagggcggcatgcca

SEQ ID NO: 82658 - DNA, 75 bp, Artificial Sequence
  Synthetic
gttgacgctagtctcctagcccaatcaggtaaagactatggactaactatgacaccagctgataaatcagcgaca

SEQ ID NO: 82659 - DNA, 75 bp, Artificial Sequence
  Synthetic
tgctccctgagtactctacattgtaccgccgttggcttgactcattttagcaaccctacctcagtcgaattggat

SEQ ID NO: 82660 - DNA, 75 bp, Artificial Sequence
  Synthetic
accccagaggcccacgtggcggctagtacactggtatcacggtacctttgtacgcctgttttatactccctcccc

SEQ ID NO: 82661 - DNA, 75 bp, Artificial Sequence
  Synthetic
tcgatgcgttgcgctcagcactcaaacccagagtgtagcttaggtcgatgagtctggacactcctcaccggtgac

SEQ ID NO: 82662 - DNA, 75 bp, Artificial Sequence
  Synthetic
accagagctcatttgattggcatttttgcttagacaattgtaccacaatgggagcacaagtctcatcgcaaaaag

SEQ ID NO: 82663 - DNA, 75 bp, Artificial Sequence
  Synthetic
ttgcttagacaattgtaccacaatgggagcacaagtctcatcgcaaaaagttggagcacacgaaaacactaatgt

SEQ ID NO: 82664 - DNA, 75 bp, Artificial Sequence
  Synthetic
acaagatttttctcaagatccatctaagttcactgaaccagtgaaagatataatgttaaaatccgccccagcact

SEQ ID NO: 82665 - DNA, 75 bp, Artificial Sequence
  Synthetic
aagttcactgaaccagtgaaagatataatgttaaaatccgccccagcactcaattccccaaacattgaggcatgt

SEQ ID NO: 82666 - DNA, 75 bp, Artificial Sequence
  Synthetic
gttgcttatggtgagtggccctcttacataaccccccaagaggcaaaccccgttgatgcccccacggaacctgat

SEQ ID NO: 82667 - DNA, 75 bp, Artificial Sequence
  Synthetic
acataaccccccaagaggcaaaccccgttgatgcccccacggaacctgatgtaagcagcaatagattctacacac

SEQ ID NO: 82668 - DNA, 75 bp, Artificial Sequence
  Synthetic
tattcgggcaaaatatgttttaccattacctaggaagatctggatatactgtgcatgtccagtgtaatgcgtcca

SEQ ID NO: 82669 - DNA, 75 bp, Artificial Sequence
  Synthetic
ttacctaggaagatctggatatactgtgcatgtccagtgtaatgcgtccaagttccaccaaggcgcgctggctgt

SEQ ID NO: 82670 - DNA, 75 bp, Artificial Sequence
  Synthetic
cccaggagaggcaggtggtacttttgagtcacagtacaaccccgggagtaccatcgaaacagcacgcaagttttg

SEQ ID NO: 82671 - DNA, 75 bp, Artificial Sequence
  Synthetic
gagtcacagtacaaccccgggagtaccatcgaaacagcacgcaagttttgcccaattgattacttgtttggttca

SEQ ID NO: 82672 - DNA, 75 bp, Artificial Sequence
  Synthetic
gtcctcccgtacgttaactcactgtccatagattgcatggccagacataataactggggtttggtcattattcca

SEQ ID NO: 82673 - DNA, 75 bp, Artificial Sequence
  Synthetic
ccatagattgcatggccagacataataactggggtttggtcattattccagttgttccattagattttgcagagg

SEQ ID NO: 82674 - DNA, 75 bp, Artificial Sequence
  Synthetic
caataccagccactcaaggattaccaacaatgttagtgccagggtccaatcaatttttaacatctgataattttc

SEQ ID NO: 82675 - DNA, 75 bp, Artificial Sequence
  Synthetic
aacaatgttagtgccagggtccaatcaatttttaacatctgataattttcagtcaccatgtgccttaccagaatt

SEQ ID NO: 82676 - DNA, 75 bp, Artificial Sequence
  Synthetic
acccatgaatgcagtctcagggaaagcaaacaccatggacatgtataggatccaattggacagcaactcaagtac

SEQ ID NO: 82677 - DNA, 75 bp, Artificial Sequence
  Synthetic
gcaaacaccatggacatgtataggatccaattggacagcaactcaagtacgccgaccgacccaattttctgcctc

SEQ ID NO: 82678 - DNA, 75 bp, Artificial Sequence
  Synthetic
actgggtctatcaggttcactttcttgttctgtggtagcatgatggcaactggcaaactacttctcagctatagt

SEQ ID NO: 82679 - DNA, 75 bp, Artificial Sequence
  Synthetic
tgttctgtggtagcatgatggcaactggcaaactacttctcagctatagtccgcctggcgcagcacctccaaaaa

SEQ ID NO: 82680 - DNA, 75 bp, Artificial Sequence
  Synthetic
catggatatccaatagtgtgtaccgcagatgtgttaaggatgattacacggcaggtggttacataacttgttttt

SEQ ID NO: 82681 - DNA, 75 bp, Artificial Sequence
  Synthetic
cagatgtgttaaggatgattacacggcaggtggttacataacttgtttttaccagactaagattgttgttcctct

SEQ ID NO: 82682 - DNA, 75 bp, Artificial Sequence
  Synthetic
caccacacatatcagtcaatctacacccattctaccccagggtttggaagatcttatagagacagtggctcataa

SEQ ID NO: 82683 - DNA, 75 bp, Artificial Sequence
  Synthetic
cccattctaccccagggtttggaagatcttatagagacagtggctcataatgccttacaactatcacaacccaga

SEQ ID NO: 82684 - DNA, 75 bp, Artificial Sequence
  Synthetic
cctgcactaactgcagtcgagacaggagctagcggacaagctgtgcctgctgatgttatagaaacaagaaaagtg

SEQ ID NO: 82685 - DNA, 75 bp, Artificial Sequence
  Synthetic
gagctagcggacaagctgtgcctgctgatgttatagaaacaagaaaagtgataaattacaagtccagaagtgaat

SEQ ID NO: 82686 - DNA, 75 bp, Artificial Sequence
  Synthetic
tgtggtggtatccttaggtgtcaacatggcgtcatcggaatcgtgacagctggtggagagggattagtcgcattc

SEQ ID NO: 82687 - DNA, 75 bp, Artificial Sequence
  Synthetic
caacagataggaaaaaattgtttagtgtctgggagatcaactacacagatacagtccagcttagaaggaaattgg

SEQ ID NO: 82688 - DNA, 75 bp, Artificial Sequence
  Synthetic
atggcgtcatcggaatcgtgacagctggtggagagggattagtcgcattctcagacatcagggatttatacgctt

SEQ ID NO: 82689 - DNA, 75 bp, Artificial Sequence
  Synthetic
tgtctgggagatcaactacacagatacagtccagcttagaaggaaattggaaatgtttacatactcgcgcttcga

SEQ ID NO: 82690 - DNA, 75 bp, Artificial Sequence
  Synthetic
cccagcaaataggggacaaaatatcagagttaactaatatggtcaccagcactatcacagagaaattactcaaaa

SEQ ID NO: 82691 - DNA, 75 bp, Artificial Sequence
  Synthetic
gataatgtacataccaccaggtgcaccaaggcccaccgcctgggatgattatacatggcaatcatcttctaaccc

SEQ ID NO: 82692 - DNA, 75 bp, Artificial Sequence
  Synthetic
agagttaactaatatggtcaccagcactatcacagagaaattactcaaaaatttgattaagatcatctcgtcttt

SEQ ID NO: 82693 - DNA, 75 bp, Artificial Sequence
  Synthetic
ccaaggcccaccgcctgggatgattatacatggcaatcatcttctaacccgtccatattctacacttacgggtgt

SEQ ID NO: 82694 - DNA, 75 bp, Artificial Sequence
  Synthetic
accatggcagtggttgaagaaaaaagcatgtgacatcctggagattccttatgtcatccgtcaaggtgacagttg

SEQ ID NO: 82695 - DNA, 75 bp, Artificial Sequence
  Synthetic
atacctattaaggacgaaagcacagacaatggtgatacatactacgggcagacctcgatcaatgactttggagcc

SEQ ID NO: 82696 - DNA, 75 bp, Artificial Sequence
  Synthetic
gcatgtgacatcctggagattccttatgtcatccgtcaaggtgacagttggctaaagaagtttactgaggcctgc

SEQ ID NO: 82697 - DNA, 75 bp, Artificial Sequence
  Synthetic
acaatggtgatacatactacgggcagacctcgatcaatgactttggagccattgctctcagagtggtcaatgagc

SEQ ID NO: 82698 - DNA, 75 bp, Artificial Sequence
  Synthetic
ccgcaagcaagagacaagttagaatttgtcaccaaactcaagcaacttgagatgttagagaaccaaatcgctacc

SEQ ID NO: 82699 - DNA, 75 bp, Artificial Sequence
  Synthetic
caccaagggctgtaccataccatggcacaggagtagatattaaacaagatacactagcccccattactccagttt

SEQ ID NO: 82700 - DNA, 75 bp, Artificial Sequence
  Synthetic
gatgttagagaaccaaatcgctaccattcaccagtcttgcccaagccaagaacatcaggagattctattcaataa

SEQ ID NO: 82701 - DNA, 75 bp, Artificial Sequence
  Synthetic
cacaggagtagatattaaacaagatacactagcccccattactccagtttcctcaatgacaacatatggttttgg

SEQ ID NO: 82702 - DNA, 75 bp, Artificial Sequence
  Synthetic
caacgcggtcaacatcatgtggaacagagatctcctggtggcacactcaaatgcacagggtacagacactatagc

SEQ ID NO: 82703 - DNA, 75 bp, Artificial Sequence
  Synthetic
cagttcaagagcaaacaccgtattgaaccagtatgtctgttagtgcatggtagcccggggactggtaaatcagtt

SEQ ID NO: 82704 - DNA, 75 bp, Artificial Sequence
  Synthetic
agagatctcctggtggcacactcaaatgcacagggtacagacactatagctcagtgcaattgtaggtgtggggtt

SEQ ID NO: 82705 - DNA, 75 bp, Artificial Sequence
  Synthetic
cactttgatgggtacaaacaacaaggagtggtcataatggatgacttaaatcaaaacccagacggagctgacatg

SEQ ID NO: 82706 - DNA, 75 bp, Artificial Sequence
  Synthetic
gattactacccagcacgctaccaaacccacatgctcttaggacatgggttcgcaaacccaggtgactgtggtgac

SEQ ID NO: 82707 - DNA, 75 bp, Artificial Sequence
  Synthetic
gagtggtcataatggatgacttaaatcaaaacccagacggagctgacatgaaattattttgccagatggtttcca

SEQ ID NO: 82708 - DNA, 75 bp, Artificial Sequence
  Synthetic
cccacatgctcttaggacatgggttcgcaaacccaggtgactgtggtgacatcctgcgttgcaatcacggggtga

SEQ ID NO: 82709 - DNA, 75 bp, Artificial Sequence
  Synthetic
ccaccaactctagtagaatcaccccacccacagttgctcatagtgatgcgctggccagaaggtttgcctttgaca

SEQ ID NO: 82710 - DNA, 75 bp, Artificial Sequence
  Synthetic
aagcaatggagcaaggagtgacagattatgtaaacagattgggtatggctttcggtgctggatttagcgcagaga

SEQ ID NO: 82711 - DNA, 75 bp, Artificial Sequence
  Synthetic
acccacagttgctcatagtgatgcgctggccagaaggtttgcctttgacatggatattcaagtcatgggagaata

SEQ ID NO: 82712 - DNA, 75 bp, Artificial Sequence
  Synthetic
ttatgtaaacagattgggtatggctttcggtgctggatttagcgcagagattgctaacaaagtctcagagatatc

SEQ ID NO: 82713 - DNA, 75 bp, Artificial Sequence
  Synthetic
gaggtgttgtccactcgtgtgtggcaaagcaattcagctaatggacaaatcttccagagttagatacagtgtgga

SEQ ID NO: 82714 - DNA, 75 bp, Artificial Sequence
  Synthetic
ggcaagaaactatgaggattctattacagttatggccaccctaagtttacttggatgtgatgctccaccatggca

SEQ ID NO: 82715 - DNA, 75 bp, Artificial Sequence
  Synthetic
aaagcaattcagctaatggacaaatcttccagagttagatacagtgtggaccagatcaccaccatgatcatcaat

SEQ ID NO: 82716 - DNA, 75 bp, Artificial Sequence
  Synthetic
acagttatggccaccctaagtttacttggatgtgatgctccaccatggcaatggcttaagcagaaagtgtgcaat

SEQ ID NO: 82717 - DNA, 75 bp, Artificial Sequence
  Synthetic
aagatagacattaaaactacaccaccaccagagtgtataagtgatttactacaggcggtggactcccaggaagtt

SEQ ID NO: 82718 - DNA, 75 bp, Artificial Sequence
  Synthetic
aaaggtctggaatggttggccaacaagatatccaaatttattgattgggttagagataaggtcataccagaagcc

SEQ ID NO: 82719 - DNA, 75 bp, Artificial Sequence
  Synthetic
caccagagtgtataagtgatttactacaggcggtggactcccaggaagttagggattattgtgagaagaaaggat

SEQ ID NO: 82720 - DNA, 75 bp, Artificial Sequence
  Synthetic
agatatccaaatttattgattgggttagagataaggtcataccagaagccaaagacaaattggagtacgttagta

SEQ ID NO: 82721 - DNA, 75 bp, Artificial Sequence
  Synthetic
ccacgttcgcggcagtggctggcgtcgtgtttgtaatgtacaaattatttgctggacatcaaggtgcctacactg

SEQ ID NO: 82722 - DNA, 75 bp, Artificial Sequence
  Synthetic
aggtgttgtttaacaacattaggtggttagcacttaaagccagaaaatttgcaccgttatatgcagctgaggcca

SEQ ID NO: 82723 - DNA, 75 bp, Artificial Sequence
  Synthetic
cgtgtttgtaatgtacaaattatttgctggacatcaaggtgcctacactgggttacctaacaagagaccaaacgt

SEQ ID NO: 82724 - DNA, 75 bp, Artificial Sequence
  Synthetic
gttagcacttaaagccagaaaatttgcaccgttatatgcagctgaggccagaagaatcttcagtctagagaataa

SEQ ID NO: 82725 - DNA, 75 bp, Artificial Sequence
  Synthetic
gacggccaccactagcaaaggagagttcaccatgctcggagttcacgataatgttgctgtgttgcctacacacgc

SEQ ID NO: 82726 - DNA, 75 bp, Artificial Sequence
  Synthetic
tactggcaagtcagtggccacaggtctcatcgggagagcactagctaaacaagaaaacaccagtgtatactcatt

SEQ ID NO: 82727 - DNA, 75 bp, Artificial Sequence
  Synthetic
ttcaccatgctcggagttcacgataatgttgctgtgttgcctacacacgcatcaccaggggagacaatcgtggtt

SEQ ID NO: 82728 - DNA, 75 bp, Artificial Sequence
  Synthetic
ctcatcgggagagcactagctaaacaagaaaacaccagtgtatactcattaccacctgatccttcccattttgat

SEQ ID NO: 82729 - DNA, 75 bp, Artificial Sequence
  Synthetic
gttactctcaaaagaagtgagaaattcagggacattagacctcacatccccactcaaatcactgagacaaatgac

SEQ ID NO: 82730 - DNA, 75 bp, Artificial Sequence
  Synthetic
tgtcaaatggtctccaccgtggagtttataccacccatggccagcctagaagagaagggcatattattcacttca

SEQ ID NO: 82731 - DNA, 75 bp, Artificial Sequence
  Synthetic
tcagggacattagacctcacatccccactcaaatcactgagacaaatgacggagtgttgatcgtgaacactagca

SEQ ID NO: 82732 - DNA, 75 bp, Artificial Sequence
  Synthetic
ttataccacccatggccagcctagaagagaagggcatattattcacttcagattatgtgctggcttcaaccaatt

SEQ ID NO: 82733 - DNA, 75 bp, Artificial Sequence
  Synthetic
ctcgcacccttatgtacaatttcccaacacgtgctgggcagtgtggtgggatcattacgtgcacaggcaaggtga

SEQ ID NO: 82734 - DNA, 75 bp, Artificial Sequence
  Synthetic
acacaatgtccgagtattcaacaaaaggtaagctaaatatggccatggctacacagttgtgtaaggattgtcaca

SEQ ID NO: 82735 - DNA, 75 bp, Artificial Sequence
  Synthetic
aacacgtgctgggcagtgtggtgggatcattacgtgcacaggcaaggtgattggtatgcacgtcggcgggaacgg

SEQ ID NO: 82736 - DNA, 75 bp, Artificial Sequence
  Synthetic
aggtaagctaaatatggccatggctacacagttgtgtaaggattgtcacaaaccagcaaatttttcatcatgctg

SEQ ID NO: 82737 - DNA, 75 bp, Artificial Sequence
  Synthetic
atcaaaagaagtcgggtaccccatcgtcaatgctcccagcaagaccaagctggagcccagtgctttccactatat

SEQ ID NO: 82738 - DNA, 75 bp, Artificial Sequence
  Synthetic
aacaatgatgatcaatgagaaaaacagaagacataacattggaagttgtcttgaagcccttttccaaggaccact

SEQ ID NO: 82739 - DNA, 75 bp, Artificial Sequence
  Synthetic
gtcaatgctcccagcaagaccaagctggagcccagtgctttccactatatctttgaaggagtaaaggagccagca

SEQ ID NO: 82740 - DNA, 75 bp, Artificial Sequence
  Synthetic
agaagacataacattggaagttgtcttgaagcccttttccaaggaccactagagttcaaagatttgaaaatagac

SEQ ID NO: 82741 - DNA, 75 bp, Artificial Sequence
  Synthetic
atcacagaggtggatgagtacatgaaagaggctgtggaccactatgcaggacaactgatgtcactagatataaac

SEQ ID NO: 82742 - DNA, 75 bp, Artificial Sequence
  Synthetic
tgcaaacagcaaggttggatagtggaggcaccatcaaactccataacaattgagagacacatatcaaaagctgct

SEQ ID NO: 82743 - DNA, 75 bp, Artificial Sequence
  Synthetic
aagaggctgtggaccactatgcaggacaactgatgtcactagatataaacaatgaccagatgtgtctagaggatg

SEQ ID NO: 82744 - DNA, 75 bp, Artificial Sequence
  Synthetic
aggcaccatcaaactccataacaattgagagacacatatcaaaagctgctaccatcttgcaggcaatctcagcat

SEQ ID NO: 82745 - DNA, 75 bp, Artificial Sequence
  Synthetic
agaaaaagagggatattctcaacaagcaaaccagagacaccaaggaaatgcaacgcctcctagatacttatggta

SEQ ID NO: 82746 - DNA, 75 bp, Artificial Sequence
  Synthetic
ctaatcataaaccaaaggtgccgaccataagagaggcaaaggtgcaaggcccagtctttgactatgccgtggcaa

SEQ ID NO: 82747 - DNA, 75 bp, Artificial Sequence
  Synthetic
gcaaaccagagacaccaaggaaatgcaacgcctcctagatacttatggtatcaatttaccactagtcacttatgt

SEQ ID NO: 82748 - DNA, 75 bp, Artificial Sequence
  Synthetic
cataagagaggcaaaggtgcaaggcccagtctttgactatgccgtggcaatggcaaagaagaacatattaactgc

SEQ ID NO: 82749 - DNA, 75 bp, Artificial Sequence
  Synthetic
ttctgtggcaatgagaatggcatttggcaacttatacgcggcctttcacaaaaacccaggagtagtgacaggatc

SEQ ID NO: 82750 - DNA, 75 bp, Artificial Sequence
  Synthetic
aggcgagaccattgtgattgctggtaaggaggtcagaattactgatgccaaaaggttagtggatcccaatggggt

SEQ ID NO: 82751 - DNA, 75 bp, Artificial Sequence
  Synthetic
aaggaggtcagaattactgatgccaaaaggttagtggatcccaatggggtaaaccttgaaatcacaatagtggaa

SEQ ID NO: 82752 - DNA, 75 bp, Artificial Sequence
  Synthetic
tggaagaaaagctgtttgctttcgactacacaggttatgatgcctcccttagtccagcctggtttgaggctctca

SEQ ID NO: 82753 - DNA, 75 bp, Artificial Sequence
  Synthetic
ttagcagtgaacactagcaagttccccaacatgtacataccagtagggtcagttaccgagcaggggatgcttaac

SEQ ID NO: 82754 - DNA, 75 bp, Artificial Sequence
  Synthetic
ccaacatgtacataccagtagggtcagttaccgagcaggggatgcttaacctagccggcaaagctacaaacagaa

SEQ ID NO: 82755 - DNA, 75 bp, Artificial Sequence
  Synthetic
acaaaaacaagacatactgtgtcaagggtggcatgccatctggctgctcaggcacatcaatttttaactcaatga

SEQ ID NO: 82756 - DNA, 75 bp, Artificial Sequence
  Synthetic
ttcatgttggtggaaacggtagtcacggttttgcagccgctctcaagaggtcttatttcacagaacaacaaggag

SEQ ID NO: 82757 - DNA, 75 bp, Artificial Sequence
  Synthetic
cggttttgcagccgctctcaagaggtcttatttcacagaacaacaaggagaaatccagtggatgagatcaagcaa

SEQ ID NO: 82758 - DNA, 75 bp, Artificial Sequence
  Synthetic
aggtgaaaaagaaccagcggttttgacaagaaatgatcccagattgaaagtggattttgaggaagcagtgttttc

SEQ ID NO: 82759 - DNA, 75 bp, Artificial Sequence
  Synthetic
acaagaaatgatcccagattgaaagtggattttgaggaagcagtgttttcaaaatacattggcaataaaattaca

SEQ ID NO: 82760 - DNA, 75 bp, Artificial Sequence
  Synthetic
caattagatggaccaaagatcctaggaatactcaggaccatgtacgctcgttgtgtttattggcttggcacaatg

SEQ ID NO: 82761 - DNA, 75 bp, Artificial Sequence
  Synthetic
gaatactcaggaccatgtacgctcgttgtgtttattggcttggcacaatggcgaagaggaatacaataaatttct

SEQ ID NO: 82762 - DNA, 75 bp, Artificial Sequence
  Synthetic
caaatgtgtttggaagacgcaatgtatggaacagatggtcttgaagctttggacctgtcaactagtgctggttat

SEQ ID NO: 82763 - DNA, 75 bp, Artificial Sequence
  Synthetic
atggaacagatggtcttgaagctttggacctgtcaactagtgctggttatccatacgtggccattggaaagaaaa

SEQ ID NO: 82764 - DNA, 75 bp, Artificial Sequence
  Synthetic
taccactggtgacttatgttaaagatgaacttagatccaaatcgaaagtagagcaaggcaaatctagattgattg

SEQ ID NO: 82765 - DNA, 75 bp, Artificial Sequence
  Synthetic
tgaacttagatccaaatcgaaagtagagcaaggcaaatctagattgattgaagcaagctccttaaatgactcagt

SEQ ID NO: 82766 - DNA, 75 bp, Artificial Sequence
  Synthetic
tacgcctgttttatacccccttcccccagaaacttagatgttatgaaaccaagttcaataggagggggcacaaac

SEQ ID NO: 82767 - DNA, 75 bp, Artificial Sequence
  Synthetic
gggttgtgatccagatgtcttttggagtaaggttccagtgatgttagatggagaactctttgcctttgactatac

SEQ ID NO: 82768 - DNA, 75 bp, Artificial Sequence
  Synthetic
agtaaggttccagtgatgttagatggagaactctttgcctttgactatacaggttatgatgcttcgctctcccca

SEQ ID NO: 82769 - DNA, 75 bp, Artificial Sequence
  Synthetic
aatcactcacaccatttatatagaaacaaattatactgtgtcaaaggtggaatgccttcagggtgctccggcacc

SEQ ID NO: 82770 - DNA, 75 bp, Artificial Sequence
  Synthetic
acaaattatactgtgtcaaaggtggaatgccttcagggtgctccggcacctcgattttcaattccatgatcaata

SEQ ID NO: 82771 - DNA, 75 bp, Artificial Sequence
  Synthetic
cctattgagctactcaagagtcctccggcccctgaatgcggctaatcctaaccatggagcaggtgctttcaatcc

SEQ ID NO: 82772 - DNA, 75 bp, Artificial Sequence
  Synthetic
ttgtatggctgcttatggtgacaatcacagattgttatcataaagcaaattggattggccatccggtgaaagtta

SEQ ID NO: 82773 - DNA, 75 bp, Artificial Sequence
  Synthetic
cacagattgttatcataaagcaaattggattggccatccggtgaaagttaagcacatcatttatctatttgttgg

SEQ ID NO: 82774 - DNA, 75 bp, Artificial Sequence
  Synthetic
atgaaagacatttatgaatcaattaggtggaccaaagatccgcgaaacacacaggatcatgtccgatcattgtgc

SEQ ID NO: 82775 - DNA, 75 bp, Artificial Sequence
  Synthetic
ggtggaccaaagatccgcgaaacacacaggatcatgtccgatcattgtgcttattggcgtggcacaatggagaag

SEQ ID NO: 82776 - DNA, 75 bp, Artificial Sequence
  Synthetic
gagcccaagtctcgtcacaaaaggttggagcgcatgagaataccaatgttgctaccggcgggtcaacagtgaatt

SEQ ID NO: 82777 - DNA, 75 bp, Artificial Sequence
  Synthetic
caggatttttcgcaagatccatccaaattcacagaaccagttaaggacgtactcataaagtcagcacctgctctt

SEQ ID NO: 82778 - DNA, 75 bp, Artificial Sequence
  Synthetic
tagcatatggagtttggccctcctatctcaatgaccaagatgccaacccagtagaccaaccaactgagccggacg

SEQ ID NO: 82779 - DNA, 75 bp, Artificial Sequence
  Synthetic
ctgttcccacggtcgaaagcgactgatccgttatccgctctggtacttcgggaagcctagtagcaccttgggatc

SEQ ID NO: 82780 - DNA, 75 bp, Artificial Sequence
  Synthetic
ctgatgccctgaaagacatgggactattcgggcaaaacatgttttaccactacttgggaagatcaggttacactg

SEQ ID NO: 82781 - DNA, 75 bp, Artificial Sequence
  Synthetic
tgcatgtccaatgtaatgcttccaagttccatcaaggaacgcttggtgtgtttgccgttcctgagtactgccttg

SEQ ID NO: 82782 - DNA, 75 bp, Artificial Sequence
  Synthetic
ttagtgcctttaacccagacacaggcgctgttcccaaacgccagttccaaccagtggactacttgtttgggtgtg

SEQ ID NO: 82783 - DNA, 75 bp, Artificial Sequence
  Synthetic
ttgggtgtccgtgtttccttttattttaaaaatggctgcttatggtgacaatcatagattgttatcataaagcga

SEQ ID NO: 82784 - DNA, 75 bp, Artificial Sequence
  Synthetic
ccagtggactacttgtttgggtgtggggttctggccggtaatgcatttgtctttccccatcagatcattaacttg

SEQ ID NO: 82785 - DNA, 75 bp, Artificial Sequence
  Synthetic
ctttccccatcagatcattaacttgagaaccaacaactgtgccaccctagtgttaccgtacgttaattcattggc

SEQ ID NO: 82786 - DNA, 75 bp, Artificial Sequence
  Synthetic
cttatcatctcattacgatcacactattgattagatcctgttaccacaatgggagctcaagtgtcatcacaaaag

SEQ ID NO: 82787 - DNA, 75 bp, Artificial Sequence
  Synthetic
attgattagatcctgttaccacaatgggagctcaagtgtcatcacaaaaggttggtgctcatgagaatactaatg

SEQ ID NO: 82788 - DNA, 75 bp, Artificial Sequence
  Synthetic
aacaggacttctctcaagatccatcaaagttcactgaaccagtgaaggatgtattgataaaatctgcacctgcgc

SEQ ID NO: 82789 - DNA, 75 bp, Artificial Sequence
  Synthetic
aaagttcactgaaccagtgaaggatgtattgataaaatctgcacctgcgctgaattctccaaacatcgaggcgtg

SEQ ID NO: 82790 - DNA, 75 bp, Artificial Sequence
  Synthetic
tgtagcttatggagtctggccctcctacctaagtgacaaggatgctaaccctgttgatcaacccaccgaacctga

SEQ ID NO: 82791 - DNA, 75 bp, Artificial Sequence
  Synthetic
agaacacaatggagatgtacagagttcaattgtctgacagcgccaaccgcgacaaaccaattttgtgcctgtcac

SEQ ID NO: 82792 - DNA, 75 bp, Artificial Sequence
  Synthetic
tacctaagtgacaaggatgctaaccctgttgatcaacccaccgaacctgatgtttcagcatgccgcttttacacg

SEQ ID NO: 82793 - DNA, 75 bp, Artificial Sequence
  Synthetic
ttatttggtcagaatatgttttatcattatctgggaagatcagggtatacagtacatgtgcagtgcaatgcatca

SEQ ID NO: 82794 - DNA, 75 bp, Artificial Sequence
  Synthetic
aagatactagtagcttattccccaccaggggcacaaccaccccagaatcgtaaggacgcaatgcttggaacacac

SEQ ID NO: 82795 - DNA, 75 bp, Artificial Sequence
  Synthetic
attatctgggaagatcagggtatacagtacatgtgcagtgcaatgcatcaaagtttcaccaaggcacacttggcg

SEQ ID NO: 82796 - DNA, 75 bp, Artificial Sequence
  Synthetic
acccgggagaggcggggggacagttcgtgtcaaatttcaatccagacactagcactacacctcaacgcaaatttc

SEQ ID NO: 82797 - DNA, 75 bp, Artificial Sequence
  Synthetic
gtggatacatcagcatgttctaccagactcgagtggtcgtgcctgcatcaacaccaacgaccatggacatcctcg

SEQ ID NO: 82798 - DNA, 75 bp, Artificial Sequence
  Synthetic
cgtgtcaaatttcaatccagacactagcactacacctcaacgcaaatttcaaccagttgattatcttttcggttg

SEQ ID NO: 82799 - DNA, 75 bp, Artificial Sequence
  Synthetic
ggtactgccatatgtgaattcactagcaatagattgcatggcaaagcacaacaactggggcatagtgatactacc

SEQ ID NO: 82800 - DNA, 75 bp, Artificial Sequence
  Synthetic
gcaatagattgcatggcaaagcacaacaactggggcatagtgatactacccttgtctaaacttgattacaatcca

SEQ ID NO: 82801 - DNA, 75 bp, Artificial Sequence
  Synthetic
acaattcctgccacacagggcctacctgtcatgaatacaccaggcagcaaccagtatctgacgtcggacaacttt

SEQ ID NO: 82802 - DNA, 75 bp, Artificial Sequence
  Synthetic
ctgtcatgaatacaccaggcagcaaccagtatctgacgtcggacaactttcaatcgccttgcgcattgcctgagt

SEQ ID NO: 82803 - DNA, 75 bp, Artificial Sequence
  Synthetic
gtaacaataatgtcactggacaactacaatgagtcatcaactacttcacctagtaccctgtttgcaaaatggaat

SEQ ID NO: 82804 - DNA, 75 bp, Artificial Sequence
  Synthetic
acaatgagtcatcaactacttcacctagtaccctgtttgcaaaatggaatatcacatacacagacactgtgcaat

SEQ ID NO: 82805 - DNA, 75 bp, Artificial Sequence
  Synthetic
taccaatggatctcagtgaggggaagaaaaactcaatggaaatgtacagagtgaaactcagtgatgctggagatc

SEQ ID NO: 82806 - DNA, 75 bp, Artificial Sequence
  Synthetic
gaaaaactcaatggaaatgtacagagtgaaactcagtgatgctggagatcgcgataaaccaattttgtgtctatc

SEQ ID NO: 82807 - DNA, 75 bp, Artificial Sequence
  Synthetic
aaaccaagtgtatcagattatgtatgttcctccaggtgccccaatacctaagaagtgggatgattacacatggca

SEQ ID NO: 82808 - DNA, 75 bp, Artificial Sequence
  Synthetic
tggttccttgaaattttcatttttgttttgtgggtcaatgatggccactggaaagctcttagtggcatactcacc

SEQ ID NO: 82809 - DNA, 75 bp, Artificial Sequence
  Synthetic
ttttgtgggtcaatgatggccactggaaagctcttagtggcatactcacctccaggcgcacagcctcctcaagat

SEQ ID NO: 82810 - DNA, 75 bp, Artificial Sequence
  Synthetic
tgctaatgcatattctcacttttatgacgggtatgccacagtgcccttaaaaggttcaacacaggactcaggtgc

SEQ ID NO: 82811 - DNA, 75 bp, Artificial Sequence
  Synthetic
gacgggtatgccacagtgcccttaaaaggttcaacacaggactcaggtgcagcctattatggagctgtatcaata

SEQ ID NO: 82812 - DNA, 75 bp, Artificial Sequence
  Synthetic
tggattagtaacaccagttaccgcagaacagtgaaagacgactttacagaaggaggttacataagcatgttctac

SEQ ID NO: 82813 - DNA, 75 bp, Artificial Sequence
  Synthetic
gaacagtgaaagacgactttacagaaggaggttacataagcatgttctaccagacacgcatagtcgtcccagcct

SEQ ID NO: 82814 - DNA, 75 bp, Artificial Sequence
  Synthetic
tatatgaaacccaaacatgtgcgcgtctggtgcccaaggccgcctcgtgcggtagagtattatggtagtggagtt

SEQ ID NO: 82815 - DNA, 75 bp, Artificial Sequence
  Synthetic
ggtagagtattatggtagtggagttgattacaaagccaacacacttgacatcctaccagaaaagacattaaccac

SEQ ID NO: 82816 - DNA, 75 bp, Artificial Sequence
  Synthetic
caacccacatcacccaagcagccctacctcaaggcatagatgaaataattcagcaagtggcatcaagcgctcttc

SEQ ID NO: 82817 - DNA, 75 bp, Artificial Sequence
  Synthetic
acctcaaggcatagatgaaataattcagcaagtggcatcaagcgctcttcagttgtcccaacctaatagaccagc

SEQ ID NO: 82818 - DNA, 75 bp, Artificial Sequence
  Synthetic
cgaagactacaggcactgtgtaaagagcatgtgggagagagatcttatggttgttgagtcacgtgcacagggaat

SEQ ID NO: 82819 - DNA, 75 bp, Artificial Sequence
  Synthetic
aacggcagttgagacaggagctaccaacccactagaaccaggcgacactgtccagaccaggcatgttattcagac

SEQ ID NO: 82820 - DNA, 75 bp, Artificial Sequence
  Synthetic
aacccactagaaccaggcgacactgtccagaccaggcatgttattcagaccagatccaggagcgagagcaccgta

SEQ ID NO: 82821 - DNA, 75 bp, Artificial Sequence
  Synthetic
aagacgggagtctattactgtgagtccagaaataagcattaccccattactataacatcccccacattccagtgg

SEQ ID NO: 82822 - DNA, 75 bp, Artificial Sequence
  Synthetic
caaaaatccacactctttgcaacctggaacataacctacacagacacagttcagctcaggaggaaattggagatg

SEQ ID NO: 82823 - DNA, 75 bp, Artificial Sequence
  Synthetic
ggaacataacctacacagacacagttcagctcaggaggaaattggagatgttcacctactccaggtttgacattg

SEQ ID NO: 82824 - DNA, 75 bp, Artificial Sequence
  Synthetic
tttgcagacattagagacctctatctagaggatgaggcaatggaacagggaattactaattacattgaaactttg

SEQ ID NO: 82825 - DNA, 75 bp, Artificial Sequence
  Synthetic
tgtatgtaccaccaggtgctccagtgccaaagaagtgggatgattatacttggcagacatcatcgaacccatcca

SEQ ID NO: 82826 - DNA, 75 bp, Artificial Sequence
  Synthetic
gccaaagaagtgggatgattatacttggcagacatcatcgaacccatccattttctacacatatggcactgcccc

SEQ ID NO: 82827 - DNA, 75 bp, Artificial Sequence
  Synthetic
atctaattaagttggttagtagtttagtcataatcactagaaattatgaagacaccaccacagtgttagcaacgt

SEQ ID NO: 82828 - DNA, 75 bp, Artificial Sequence
  Synthetic
actgaaatcagacacaactgactcaggcgcggcatactacggtgcggtgtccatcaatgactttggtcttttggc

SEQ ID NO: 82829 - DNA, 75 bp, Artificial Sequence
  Synthetic
ggcgcggcatactacggtgcggtgtccatcaatgactttggtcttttggcagtgcgtgtggtaaatgagcacaac

SEQ ID NO: 82830 - DNA, 75 bp, Artificial Sequence
  Synthetic
gttgaaaaaatttactgaggcttgtaacgcagcaaaaggactggaatgggtgagcaataaaatttcaaaatttat

SEQ ID NO: 82831 - DNA, 75 bp, Artificial Sequence
  Synthetic
cgcgctgtggaatactatggaccaggagttgactacaaaagcggtacgctacagccgctacccactaaaagcctg

SEQ ID NO: 82832 - DNA, 75 bp, Artificial Sequence
  Synthetic
gagttgactacaaaagcggtacgctacagccgctacccactaaaagcctgaccacttacgggtttggacaccaaa

SEQ ID NO: 82833 - DNA, 75 bp, Artificial Sequence
  Synthetic
catgctggagaaccaaatcaacacgattcaccaatcatgccccagccaagaacaacaggaaatattgttcaacaa

SEQ ID NO: 82834 - DNA, 75 bp, Artificial Sequence
  Synthetic
attcaccaatcatgccccagccaagaacaacaggaaatattgttcaacaatgttaggtggctggccattcaatca

SEQ ID NO: 82835 - DNA, 75 bp, Artificial Sequence
  Synthetic
tgaggagcttgtgggaacgtgacatcatggttgtggagtctagagcacaaggagtggacactattgctagatgtt

SEQ ID NO: 82836 - DNA, 75 bp, Artificial Sequence
  Synthetic
catggttgtggagtctagagcacaaggagtggacactattgctagatgttcatgcaagaccggggtgtattattg

SEQ ID NO: 82837 - DNA, 75 bp, Artificial Sequence
  Synthetic
cagttcaagagcaaacaccgtattgaaccagtatgtatgctgattcacgggactcccggtacaggtaaatcagtg

SEQ ID NO: 82838 - DNA, 75 bp, Artificial Sequence
  Synthetic
gccacatcccttattgggagagcaattgcagaaaaagaaaacacctcagtgtactcactgccacctgaccccact

SEQ ID NO: 82839 - DNA, 75 bp, Artificial Sequence
  Synthetic
cccagcacgctaccaatctcacatgactatgggcagtggattcgccgcccctggggactgtggtggcatcttgcg

SEQ ID NO: 82840 - DNA, 75 bp, Artificial Sequence
  Synthetic
actatgggcagtggattcgccgcccctggggactgtggtggcatcttgcggtgtcaacacggtgtcatgggcctt

SEQ ID NO: 82841 - DNA, 75 bp, Artificial Sequence
  Synthetic
ttgcagaaaaagaaaacacctcagtgtactcactgccacctgaccccactcactttgatggatacaaacaacagg

SEQ ID NO: 82842 - DNA, 75 bp, Artificial Sequence
  Synthetic
caaggaatcacttcatacattgaatcattaggagcagcctttggaaatggtttcaccagtcaaataggggagaaa

SEQ ID NO: 82843 - DNA, 75 bp, Artificial Sequence
  Synthetic
ttcacctcagattatgttttggcatccaccaactccagtacaatcacaccacccaccatagcccatagtgatgct

SEQ ID NO: 82844 - DNA, 75 bp, Artificial Sequence
  Synthetic
cattaggagcagcctttggaaatggtttcaccagtcaaataggggagaaaattaatgagatttcatccatggtca

SEQ ID NO: 82845 - DNA, 75 bp, Artificial Sequence
  Synthetic
atgaagatacaaccacagttctagctacattggctttgctagggtgtgatgtgtcaccatgggcctggctgaaaa

SEQ ID NO: 82846 - DNA, 75 bp, Artificial Sequence
  Synthetic
tacattggctttgctagggtgtgatgtgtcaccatgggcctggctgaaaaagaaagtttgtgacatcctggaaat

SEQ ID NO: 82847 - DNA, 75 bp, Artificial Sequence
  Synthetic
tgagattaccacgctcataattaatgaaaagaataggagagcgagtattggcaattgcatggaagctttgtttca

SEQ ID NO: 82848 - DNA, 75 bp, Artificial Sequence
  Synthetic
atggatcagtaataaaatatccaaatttgttgaatggatcaagaacaagatcattcctgaagcgagagacaaagt

SEQ ID NO: 82849 - DNA, 75 bp, Artificial Sequence
  Synthetic
tttgttgaatggatcaagaacaagatcattcctgaagcgagagacaaagtggagtatgtctccaaactcaaacag

SEQ ID NO: 82850 - DNA, 75 bp, Artificial Sequence
  Synthetic
tcagtcagtagattcccaagaagtcagagattactgcgaaaagaaaggttggatagtcaatgtaaccagtgaagt

SEQ ID NO: 82851 - DNA, 75 bp, Artificial Sequence
  Synthetic
agagattactgcgaaaagaaaggttggatagtcaatgtaaccagtgaagttcaaacagagagaaacctcaatagg

SEQ ID NO: 82852 - DNA, 75 bp, Artificial Sequence
  Synthetic
aacaatgtcaggtggttggcaatacaatccagacgttttgcaccactctacgcgacagaggcaaaaagaatcagt

SEQ ID NO: 82853 - DNA, 75 bp, Artificial Sequence
  Synthetic
aatccagacgttttgcaccactctacgcgacagaggcaaaaagaatcagtaaactagaaaataccatcaacaatt

SEQ ID NO: 82854 - DNA, 75 bp, Artificial Sequence
  Synthetic
gctgggcaacagggtccatacacaggtctaccaaacaagaaacccaacattcccactatcaggacagcaaaagta

SEQ ID NO: 82855 - DNA, 75 bp, Artificial Sequence
  Synthetic
ccgttgccaccagcttgatgggacgcgccattgcagagaaagagaacacttcaacatactcacttcccccagacc

SEQ ID NO: 82856 - DNA, 75 bp, Artificial Sequence
  Synthetic
caaggaccaggatttgactatgcagttgctatggccaaaaggaatattgttaccgccactactagtaaaggtgag

SEQ ID NO: 82857 - DNA, 75 bp, Artificial Sequence
  Synthetic
cgccattgcagagaaagagaacacttcaacatactcacttcccccagacccagcacatttcgacggttacaagca

SEQ ID NO: 82858 - DNA, 75 bp, Artificial Sequence
  Synthetic
ctctactgtagagttcatccctccaatggcttcactagaggaaaagggcattctgtttacatcagactatgtatt

SEQ ID NO: 82859 - DNA, 75 bp, Artificial Sequence
  Synthetic
atggcttcactagaggaaaagggcattctgtttacatcagactatgtattagcttcaacaaattccagcactatc

SEQ ID NO: 82860 - DNA, 75 bp, Artificial Sequence
  Synthetic
cagtacaccataaagggcaaacttaatatggctgaagcaacacgaatatgcaaggagtgccctcaaccagccaat

SEQ ID NO: 82861 - DNA, 75 bp, Artificial Sequence
  Synthetic
atatggctgaagcaacacgaatatgcaaggagtgccctcaaccagccaattttaaaaagtgctgcccgttggtgt

SEQ ID NO: 82862 - DNA, 75 bp, Artificial Sequence
  Synthetic
ttggaatgcatgttggtgggaacggttcacatgggttcgctgcggccctaaaacgatcatacttcactcagagtc

SEQ ID NO: 82863 - DNA, 75 bp, Artificial Sequence
  Synthetic
tcaatgagaaaattaggagagccaacattgggaactgcatggaagcactatttcagggaccactacaatacaagg

SEQ ID NO: 82864 - DNA, 75 bp, Artificial Sequence
  Synthetic
cattgggaactgcatggaagcactatttcagggaccactacaatacaaggatcttaaaattgacatcaaaactag

SEQ ID NO: 82865 - DNA, 75 bp, Artificial Sequence
  Synthetic
atcaaaagaggttggttatccagtaattaatgcacccagtaaaaccaaattggaaccaagtgcctttcattatgt

SEQ ID NO: 82866 - DNA, 75 bp, Artificial Sequence
  Synthetic
agggtggatagtaaacatttcaagtgatgtcactattgaaagaaacctcaacagggccatgaccatcctgcaagc

SEQ ID NO: 82867 - DNA, 75 bp, Artificial Sequence
  Synthetic
cttctccaaatatgtgggaaacaagattactgaggtggatgaatacatgaaggaagcagtagatcactatgctgg

SEQ ID NO: 82868 - DNA, 75 bp, Artificial Sequence
  Synthetic
gatgtcactattgaaagaaacctcaacagggccatgaccatcctgcaagcattgacaaccttcgcggctgtagct

SEQ ID NO: 82869 - DNA, 75 bp, Artificial Sequence
  Synthetic
attactgaggtggatgaatacatgaaggaagcagtagatcactatgctggacagctaatgtcgctggacatcagt

SEQ ID NO: 82870 - DNA, 75 bp, Artificial Sequence
  Synthetic
aatgttcctacaatcaggaccgcaaaggtacaaggtccaggttttgattatgctgtggcaatggcaaaaagaaat

SEQ ID NO: 82871 - DNA, 75 bp, Artificial Sequence
  Synthetic
aatgttcctacaatcaggaccgcaaaggtacaaggtccaggttttgattatgctgtggctatggcaaaaagaaat

SEQ ID NO: 82872 - DNA, 75 bp, Artificial Sequence
  Synthetic
aatgttcctacaatcaggaccgcaaaggtacaaggtccaggttttgattatgctgtggccatggcaaaaagaaat

SEQ ID NO: 82873 - DNA, 75 bp, Artificial Sequence
  Synthetic
aatgttcctacaatcaggaccgcaaaggtacaaggtccaggttttgattatgctgtggcgatggcaaaaagaaat

SEQ ID NO: 82874 - DNA, 75 bp, Artificial Sequence
  Synthetic
aggtacaaggtccaggttttgattatgctgtggcaatggcaaaaagaaatatcatcacagctaccacttgcaaag

SEQ ID NO: 82875 - DNA, 75 bp, Artificial Sequence
  Synthetic
aggtacaaggtccaggttttgattatgctgtggctatggcaaaaagaaatatcatcacagctaccacttgcaaag

SEQ ID NO: 82876 - DNA, 75 bp, Artificial Sequence
  Synthetic
aggtacaaggtccaggttttgattatgctgtggccatggcaaaaagaaatatcatcacagctaccacttgcaaag

SEQ ID NO: 82877 - DNA, 75 bp, Artificial Sequence
  Synthetic
aggtacaaggtccaggttttgattatgctgtggcgatggcaaaaagaaatatcatcacagctaccacttgcaaag

SEQ ID NO: 82878 - DNA, 75 bp, Artificial Sequence
  Synthetic
ttaacctacccctagtcacttatgtaaaagatgaattgagaagtaaaagcaaggtggaacagggaaagtccagat

SEQ ID NO: 82879 - DNA, 75 bp, Artificial Sequence
  Synthetic
taatcgatggtaaggaggtggaagttatagatgccaaagcgttagaagatcaagcagggactaatttggagataa

SEQ ID NO: 82880 - DNA, 75 bp, Artificial Sequence
  Synthetic
atgatggagtgttgatcgtgaatactagtaagtaccccaatatgtatgtgcccgttggtgctgtgactgaacagg

SEQ ID NO: 82881 - DNA, 75 bp, Artificial Sequence
  Synthetic
tagtaagtaccccaatatgtatgtgcccgttggtgctgtgactgaacagggatatctcaatctcggtggccgcca

SEQ ID NO: 82882 - DNA, 75 bp, Artificial Sequence
  Synthetic
agtccagcatggtttgaggctctcaagatggtgttagagaaaattggctttggagacagagtggattacattgat

SEQ ID NO: 82883 - DNA, 75 bp, Artificial Sequence
  Synthetic
aacggttcacatgggtttgcagcagccctgaaacgatcatacttcacccaaaatcaaggtgagattcagtggatg

SEQ ID NO: 82884 - DNA, 75 bp, Artificial Sequence
  Synthetic
ggcacttcaatttttaattcaatgattaacaatctaatcatcaggacactcttactgaaaacctacaagggcata

SEQ ID NO: 82885 - DNA, 75 bp, Artificial Sequence
  Synthetic
tatgtgtttgaaggggttaaggaaccagcagtgcttaccaagaatgatcccaggctaaaaactgactttgaggag

SEQ ID NO: 82886 - DNA, 75 bp, Artificial Sequence
  Synthetic
cagcagtgcttaccaagaatgatcccaggctaaaaactgactttgaggaggccatcttctctaagtacgtgggca

SEQ ID NO: 82887 - DNA, 75 bp, Artificial Sequence
  Synthetic
acatgggagaatgtaacattcttgaaaagattcttcagagcagatgaaaagtacccgttcttggtacacccagtt

SEQ ID NO: 82888 - DNA, 75 bp, Artificial Sequence
  Synthetic
tcaatactgagcaaatgtgcttagaggatgccatgtatggaactgatggtctcgaggctttggacctcagcacca

SEQ ID NO: 82889 - DNA, 75 bp, Artificial Sequence
  Synthetic
ggatgccatgtatggaactgatggtctcgaggctttggacctcagcaccagtgctggttatccctatgtagcact

SEQ ID NO: 82890 - DNA, 75 bp, Artificial Sequence
  Synthetic
tggtatcaacctaccactagtaacatatgtgaaagatgaacttacgtctaagacaaaagtggagcaagggaaatc

SEQ ID NO: 82891 - DNA, 75 bp, Artificial Sequence
  Synthetic
tatgtgaaagatgaacttacgtctaagacaaaagtggagcaagggaaatccaggttaattgaggcatctagtcta

SEQ ID NO: 82892 - DNA, 75 bp, Artificial Sequence
  Synthetic
ttttagtaaccctacctcagtcgaattggattgggttatactgttgtaggggtaaatttttctttaattcggaga

SEQ ID NO: 82893 - DNA, 75 bp, Artificial Sequence
  Synthetic
cgactcgttttagtaaccctacctcagtcgaattggattgggttatactgttgtaggggtaaatttttctttaat

SEQ ID NO: 82894 - DNA, 75 bp, Artificial Sequence
  Synthetic
tacgcctgttttacaccccttcccctgtgcaactttagaagcaaatcacaaagttcaatagagggggtgcaaacc

SEQ ID NO: 82895 - DNA, 75 bp, Artificial Sequence
  Synthetic
gggtcagcagttggttgtgatccagacttgttttggagcaaaataccagtgctcatggaggaaaaactatttgcc

SEQ ID NO: 82896 - DNA, 75 bp, Artificial Sequence
  Synthetic
tccgttatccgcttgagtacttcgagaagcctagtaccaccttggaatcttcgatgtgttgcgctcagcactcta

SEQ ID NO: 82897 - DNA, 75 bp, Artificial Sequence
  Synthetic
ggatttggtgatagggttgactacattgattacttgaatcattcgcaccatttgtataaaaacaaaacttactgc

SEQ ID NO: 82898 - DNA, 75 bp, Artificial Sequence
  Synthetic
acgcttttactgaaaacctacaagggcatagatttagaccacctaaagatgatagcctatggtgatgatgtaatt

SEQ ID NO: 82899 - DNA, 75 bp, Artificial Sequence
  Synthetic
ggtgtccgtgtttccttttatttttattgtggctgcttatggtgacaatctaagattgttatcatatagcttttg

SEQ ID NO: 82900 - DNA, 75 bp, Artificial Sequence
  Synthetic
gagaagtatccctttctgatacacccagtaatgcctatgaaggaaattcatgaatcaatcagatggaccaaagat

SEQ ID NO: 82901 - DNA, 75 bp, Artificial Sequence
  Synthetic
gcactaacataatgggagctcaagtatctactcaaaaatcagggtcacacgagaatcaaaatgtggccgctggtg

SEQ ID NO: 82902 - DNA, 75 bp, Artificial Sequence
  Synthetic
atctactcaaaaatcagggtcacacgagaatcaaaatgtggccgctggtggttccaccattaattacactaccat

SEQ ID NO: 82903 - DNA, 75 bp, Artificial Sequence
  Synthetic
accagtaaaagacataatgatcaaaagcgccccagcactgaactcacctaatatagaagcgtgtgggtacagtga

SEQ ID NO: 82904 - DNA, 75 bp, Artificial Sequence
  Synthetic
agcgccccagcactgaactcacctaatatagaagcgtgtgggtacagtgacagagtactacaattgacactgggt

SEQ ID NO: 82905 - DNA, 75 bp, Artificial Sequence
  Synthetic
actgaagccaacccagtggatgcacccaccgaaccagacgcctcagccaatagattctacaccttagagagtgtt

SEQ ID NO: 82906 - DNA, 75 bp, Artificial Sequence
  Synthetic
ccaccgaaccagacgcctcagccaatagattctacaccttagagagtgttaactggaccaccacatctagaggtt

SEQ ID NO: 82907 - DNA, 75 bp, Artificial Sequence
  Synthetic
gcgccggttacactgttcacgtgcagtgtaatgcctcaaaattccatcagggtgccttgattgttgcagcaattc

SEQ ID NO: 82908 - DNA, 75 bp, Artificial Sequence
  Synthetic
gtgtaatgcctcaaaattccatcagggtgccttgattgttgcagcaattccagaattcatgatggcgagcaactc

SEQ ID NO: 82909 - DNA, 75 bp, Artificial Sequence
  Synthetic
tgttccatccactagtggtgagtcaaagaacaagtttgccccatgggactggctgctaggatgtggagttatggc

SEQ ID NO: 82910 - DNA, 75 bp, Artificial Sequence
  Synthetic
aagaacaagtttgccccatgggactggctgctaggatgtggagttatggcgggtaacatcacagtgtatccacac

SEQ ID NO: 82911 - DNA, 75 bp, Artificial Sequence
  Synthetic
atggctaaacataataattggggtctagtcgtgatgccctttgtcaagttgggcgctgtggctggtgcaacacaa

SEQ ID NO: 82912 - DNA, 75 bp, Artificial Sequence
  Synthetic
tagtcgtgatgccctttgtcaagttgggcgctgtggctggtgcaacacaacaagtacctattacagtgaccatag

SEQ ID NO: 82913 - DNA, 75 bp, Artificial Sequence
  Synthetic
cacctgggtcaaatcagtttctaacctcagatgattttcaatcgccatgtgctctaccaaattttgatgttactc

SEQ ID NO: 82914 - DNA, 75 bp, Artificial Sequence
  Synthetic
ctcagatgattttcaatcgccatgtgctctaccaaattttgatgttactccagagatccacatccctggtgaggt

SEQ ID NO: 82915 - DNA, 75 bp, Artificial Sequence
  Synthetic
ggaagcctacccaattcccctcaaagcttctgaaaacaatgccaacgagtccatcttttcaatctccctaagtcc

SEQ ID NO: 82916 - DNA, 75 bp, Artificial Sequence
  Synthetic
gcttctgaaaacaatgccaacgagtccatcttttcaatctccctaagtcctgcagcagataacagattatctcac

SEQ ID NO: 82917 - DNA, 75 bp, Artificial Sequence
  Synthetic
agtatgatggcaactggtaagattttagttagctacagcccaccaggggctaaaccaccaacaaccaggaaagag

SEQ ID NO: 82918 - DNA, 75 bp, Artificial Sequence
  Synthetic
tagttagctacagcccaccaggggctaaaccaccaacaaccaggaaagaggcaatgttgggcacacatgtgattt

SEQ ID NO: 82919 - DNA, 75 bp, Artificial Sequence
  Synthetic
aagatgatttcacggagggtgggtacatatgtgccttttaccagactgcaataatagtccctccaaacacaccaa

SEQ ID NO: 82920 - DNA, 75 bp, Artificial Sequence
  Synthetic
catatgtgccttttaccagactgcaataatagtccctccaaacacaccaacagacatgtcaatgttagcatttgt

SEQ ID NO: 82921 - DNA, 75 bp, Artificial Sequence
  Synthetic
gtttctttcattgggcccaccttccaatacatggaagccaatgactattatccagctagataccagtcccacatg

SEQ ID NO: 82922 - DNA, 75 bp, Artificial Sequence
  Synthetic
acaaggtatagaagacaccatcgagaaagttgttggagacgctctggcaatctcaatgccaaaggtagccgacac

SEQ ID NO: 82923 - DNA, 75 bp, Artificial Sequence
  Synthetic
aaagttgttggagacgctctggcaatctcaatgccaaaggtagccgacacaaaaccatccggcccagtcaattct

SEQ ID NO: 82924 - DNA, 75 bp, Artificial Sequence
  Synthetic
attacagctgggggagagggcttggtagctttctcagatatcagagacctatacgcctacgaggaggaagcaatg

SEQ ID NO: 82925 - DNA, 75 bp, Artificial Sequence
  Synthetic
tagctttctcagatatcagagacctatacgcctacgaggaggaagcaatggagcaaggtatttccaactacatcg

SEQ ID NO: 82926 - DNA, 75 bp, Artificial Sequence
  Synthetic
agacatgtggcaaaccaaaagttgcgcactgaatgtaccatcgaatctttctttggacgcagtgcgtgtgtggct

SEQ ID NO: 82927 - DNA, 75 bp, Artificial Sequence
  Synthetic
gcactgaatgtaccatcgaatctttctttggacgcagtgcgtgtgtggctatcttgagtgtggctaataagaaac

SEQ ID NO: 82928 - DNA, 75 bp, Artificial Sequence
  Synthetic
tcactagtaccataactgaaaagttattgaaaaacctcattaaaataatttcatcacttgtcatcatcactagaa

SEQ ID NO: 82929 - DNA, 75 bp, Artificial Sequence
  Synthetic
attgaaaaacctcattaaaataatttcatcacttgtcatcatcactagaaattatgaagacaccaccacagtact

SEQ ID NO: 82930 - DNA, 75 bp, Artificial Sequence
  Synthetic
aattagaattgttcacatactctaggtttgatttagagatgacctttgtgataacagaaagatactactcaggta

SEQ ID NO: 82931 - DNA, 75 bp, Artificial Sequence
  Synthetic
gtttgatttagagatgacctttgtgataacagaaagatactactcaggtaccggtgcaaccacgaggaactatgt

SEQ ID NO: 82932 - DNA, 75 bp, Artificial Sequence
  Synthetic
aatcccatacgtcatgcgccaaggcgacagctggttgaagaaattcactgaggcatgtaatgctgccaagggctt

SEQ ID NO: 82933 - DNA, 75 bp, Artificial Sequence
  Synthetic
caacccttcagtattttacactacaggcaatgccaaccccagaatgtcaataccttttgttgggataggtgcagc

SEQ ID NO: 82934 - DNA, 75 bp, Artificial Sequence
  Synthetic
ggcaatgccaaccccagaatgtcaataccttttgttgggataggtgcagcatactcccatttttatgacggtttt

SEQ ID NO: 82935 - DNA, 75 bp, Artificial Sequence
  Synthetic
actagagtttgtcacaaagttgaaacagttggagatgttggagaaccagattgcaacaatccaccaatcctgccc

SEQ ID NO: 82936 - DNA, 75 bp, Artificial Sequence
  Synthetic
cagttggagatgttggagaaccagattgcaacaatccaccaatcctgcccgagtcaagaacaccaggaaatcctg

SEQ ID NO: 82937 - DNA, 75 bp, Artificial Sequence
  Synthetic
actctggctgtaagaattgtgaatgaatatgacccagtgaccattgaagccaaagttagggtttacatgaaaccg

SEQ ID NO: 82938 - DNA, 75 bp, Artificial Sequence
  Synthetic
aatatgacccagtgaccattgaagccaaagttagggtttacatgaaaccgaagcacataaaagtgtggtgcccca

SEQ ID NO: 82939 - DNA, 75 bp, Artificial Sequence
  Synthetic
attacatacagttcaagagcaaacaccgtattgaaccagtatgtttgttggtgcacggtagtcccggtacaggta

SEQ ID NO: 82940 - DNA, 75 bp, Artificial Sequence
  Synthetic
cgtctattaggacatatggatttggacaccagaacaaagcagtttacacagctggttacaaaatctgcaactacc

SEQ ID NO: 82941 - DNA, 75 bp, Artificial Sequence
  Synthetic
acaccagaacaaagcagtttacacagctggttacaaaatctgcaactaccatctagccactccagaagacatgga

SEQ ID NO: 82942 - DNA, 75 bp, Artificial Sequence
  Synthetic
acccgtcccatttcgatggatacaagcagcaaggagtggtaattatggatgatctaaaccagaatccagacggtg

SEQ ID NO: 82943 - DNA, 75 bp, Artificial Sequence
  Synthetic
gcagcaaggagtggtaattatggatgatctaaaccagaatccagacggtgctgacatgaagcttttctgtcaaat

SEQ ID NO: 82944 - DNA, 75 bp, Artificial Sequence
  Synthetic
cagatgctcatgcaaaacaggaatttattactgtgaatcaaagagaaagtactatcctatttcagtgtgtggacc

SEQ ID NO: 82945 - DNA, 75 bp, Artificial Sequence
  Synthetic
tattactgtgaatcaaagagaaagtactatcctatttcagtgtgtggaccaacattccagtacatggaagccaat

SEQ ID NO: 82946 - DNA, 75 bp, Artificial Sequence
  Synthetic
cctggcttcaaccaactccagtcgtatcacaccacctacagttgcacatagtgatgccttagccagacgctttgc

SEQ ID NO: 82947 - DNA, 75 bp, Artificial Sequence
  Synthetic
atcacaccacctacagttgcacatagtgatgccttagccagacgctttgcatttgacatggacattcaagtcatg

SEQ ID NO: 82948 - DNA, 75 bp, Artificial Sequence
  Synthetic
attctcaggtgccaacatggtgtaatgggtatcatcactgctggtggtgaaggggttgtggcttttgcagacatt

SEQ ID NO: 82949 - DNA, 75 bp, Artificial Sequence
  Synthetic
tgggtatcatcactgctggtggtgaaggggttgtggcttttgcagacattagagacctctacatgtatgaggagg

SEQ ID NO: 82950 - DNA, 75 bp, Artificial Sequence
  Synthetic
aatttcaaaaggtgctgtccactagtgtgtggaaaagcaattcagctaatggacaaatcctctagagttaggtac

SEQ ID NO: 82951 - DNA, 75 bp, Artificial Sequence
  Synthetic
tgtgtggaaaagcaattcagctaatggacaaatcctctagagttaggtacagtattgaccaaattacaacaatga

SEQ ID NO: 82952 - DNA, 75 bp, Artificial Sequence
  Synthetic
tggccaacaaaatttcagaaattcaaagcaccgtacagagtgttcttacagaaaaactccttaagaatttgatta

SEQ ID NO: 82953 - DNA, 75 bp, Artificial Sequence
  Synthetic
aagcaccgtacagagtgttcttacagaaaaactccttaagaatttgattaaaattgtctccgcccttgtagttgt

SEQ ID NO: 82954 - DNA, 75 bp, Artificial Sequence
  Synthetic
aggacttgaaaatagacatcaagacctcacccccacctgagtgcataaacgatctgttacaagcagtggattcac

SEQ ID NO: 82955 - DNA, 75 bp, Artificial Sequence
  Synthetic
ctcacccccacctgagtgcataaacgatctgttacaagcagtggattcacaggaggtgagagattactgtgagaa

SEQ ID NO: 82956 - DNA, 75 bp, Artificial Sequence
  Synthetic
atggctcaaggaaaaattatgtaatatgattggaattccttgtgtgatgagacagggagactcctggttaaaaaa

SEQ ID NO: 82957 - DNA, 75 bp, Artificial Sequence
  Synthetic
atgattggaattccttgtgtgatgagacagggagactcctggttaaaaaaatttacagaagcttgtaatgctgct

SEQ ID NO: 82958 - DNA, 75 bp, Artificial Sequence
  Synthetic
ggctgtcaccacttttgcagcggttgctggggttgtgtacgtaatgtacaaactctttgcaggtcaacaaggtgc

SEQ ID NO: 82959 - DNA, 75 bp, Artificial Sequence
  Synthetic
gctggggttgtgtacgtaatgtacaaactctttgcaggtcaacaaggtgcatacacaggactccctaataaaaga

SEQ ID NO: 82960 - DNA, 75 bp, Artificial Sequence
  Synthetic
aaagacaagttagagtacctgtccaaattgaaacaacttgagatgatagagaaccaaatggccacactacaccaa

SEQ ID NO: 82961 - DNA, 75 bp, Artificial Sequence
  Synthetic
aattgaaacaacttgagatgatagagaaccaaatggccacactacaccaatcatgccccagtcaagaggaacagg

SEQ ID NO: 82962 - DNA, 75 bp, Artificial Sequence
  Synthetic
aacattctcacagcaaccacttgtaagggagaattcactatgctaggggttcacgacaatgtggccattctacca

SEQ ID NO: 82963 - DNA, 75 bp, Artificial Sequence
  Synthetic
gtagaattttcaaactggaaacatccatcaacagctatgtacagttcaagaccaaacaccgcattgaaccagtat

SEQ ID NO: 82964 - DNA, 75 bp, Artificial Sequence
  Synthetic
agtattggatgctaaagcgctggaagatcaggctggaaccaacctggaaattacaattgtcaccctgaagagaaa

SEQ ID NO: 82965 - DNA, 75 bp, Artificial Sequence
  Synthetic
catcaacagctatgtacagttcaagaccaaacaccgcattgaaccagtatgtttgttaattcatggaacaccagg

SEQ ID NO: 82966 - DNA, 75 bp, Artificial Sequence
  Synthetic
accaccagacccttcgcactttgatggttataaacagcaaggagtcgtgattatggatgacctaaatcaaaatcc

SEQ ID NO: 82967 - DNA, 75 bp, Artificial Sequence
  Synthetic
ggttataaacagcaaggagtcgtgattatggatgacctaaatcaaaatccagacggagaggacatgaagttattt

SEQ ID NO: 82968 - DNA, 75 bp, Artificial Sequence
  Synthetic
gattacgtccttgcctccactaactctaatacaataacacccccaacggtgtcagcatctgatgcactatccagg

SEQ ID NO: 82969 - DNA, 75 bp, Artificial Sequence
  Synthetic
ctaatacaataacacccccaacggtgtcagcatctgatgcactatccaggaggtttgcttttgacatggacatat

SEQ ID NO: 82970 - DNA, 75 bp, Artificial Sequence
  Synthetic
cattatgtgtttgagggcgtgaaagagccagcagtcctgactaaaaatgaccccagactcaaggtggactttgaa

SEQ ID NO: 82971 - DNA, 75 bp, Artificial Sequence
  Synthetic
agccagcagtcctgactaaaaatgaccccagactcaaggtggactttgaagaagcaatcttttccaagtacgtgg

SEQ ID NO: 82972 - DNA, 75 bp, Artificial Sequence
  Synthetic
aaccagcaaacttctctacttgttgccccctagtgtgtggcaaggctatccagttaatggacaaaaacaccagaa

SEQ ID NO: 82973 - DNA, 75 bp, Artificial Sequence
  Synthetic
ccccctagtgtgtggcaaggctatccagttaatggacaaaaacaccagaatgaggtactcattagaccaaattac

SEQ ID NO: 82974 - DNA, 75 bp, Artificial Sequence
  Synthetic
acatcaacactgatcagatgtgcctggaagatgccatgtatggtactgatggattggaggctctagatctcacca

SEQ ID NO: 82975 - DNA, 75 bp, Artificial Sequence
  Synthetic
ggaagatgccatgtatggtactgatggattggaggctctagatctcaccaccagcgcaggttacccttacgtcgc

SEQ ID NO: 82976 - DNA, 75 bp, Artificial Sequence
  Synthetic
tgaattcagagaccttaaaattgatgtagtttcaacaccaccaccctcagcgatttcagacctgcttaaatcagt

SEQ ID NO: 82977 - DNA, 75 bp, Artificial Sequence
  Synthetic
gtagtttcaacaccaccaccctcagcgatttcagacctgcttaaatcagtggataatcaagaagttagggactat

SEQ ID NO: 82978 - DNA, 75 bp, Artificial Sequence
  Synthetic
gtatggaatcaatctcccattagtcacttatgtaaaagatgaattgaggtcgaggagcaaagttgaacaagggaa

SEQ ID NO: 82979 - DNA, 75 bp, Artificial Sequence
  Synthetic
acttatgtaaaagatgaattgaggtcgaggagcaaagttgaacaagggaaatctagactgattgaagcatccagc

SEQ ID NO: 82980 - DNA, 75 bp, Artificial Sequence
  Synthetic
agcatcttgcaatctctctctacctttgcagtggtagcaggaatggtctatgtagtctacaagctctttgctgga

SEQ ID NO: 82981 - DNA, 75 bp, Artificial Sequence
  Synthetic
ttgcagtggtagcaggaatggtctatgtagtctacaagctctttgctggattccagggtgcatacacaggtcttc

SEQ ID NO: 82982 - DNA, 75 bp, Artificial Sequence
  Synthetic
actggtagtgcagtgggttgtgacccggacttgttttggagtaagatcccagttctcatggaggagaaattattt

SEQ ID NO: 82983 - DNA, 75 bp, Artificial Sequence
  Synthetic
cggacttgttttggagtaagatcccagttctcatggaggagaaattatttgcttttgactacactggctatgatg

SEQ ID NO: 82984 - DNA, 75 bp, Artificial Sequence
  Synthetic
tggccaagaaaaatattctcactgccaccacagagaaaggtgaattcacaatgttgggtgtgtacgaccgggtag

SEQ ID NO: 82985 - DNA, 75 bp, Artificial Sequence
  Synthetic
caccacagagaaaggtgaattcacaatgttgggtgtgtacgaccgggtagcggtactaccaacccactcaaaccc

SEQ ID NO: 82986 - DNA, 75 bp, Artificial Sequence
  Synthetic
atatagattacctcaaccactctcaccacctgtacaaaaataaagtatattgtgtcaagggcggcatgccatctg

SEQ ID NO: 82987 - DNA, 75 bp, Artificial Sequence
  Synthetic
taacctggagatcactgttgtgactttagaaagaaatgagaagtttagagacattagaactcacttaccaactca

SEQ ID NO: 82988 - DNA, 75 bp, Artificial Sequence
  Synthetic
tgtgtcaagggcggcatgccatctggctgctcaggcacgtcaatcttcaattctatgattaataacattataatc

SEQ ID NO: 82989 - DNA, 75 bp, Artificial Sequence
  Synthetic
ttagaaagaaatgagaagtttagagacattagaactcacttaccaactcaaatccatgaaactaatgatgcagtt

SEQ ID NO: 82990 - DNA, 75 bp, Artificial Sequence
  Synthetic
cttgggggtaagccaaccaacagaacactcatgtacaatttcccaacaaaagcaggacaatgtggaggagtgctg

SEQ ID NO: 82991 - DNA, 75 bp, Artificial Sequence
  Synthetic
cactcatgtacaatttcccaacaaaagcaggacaatgtggaggagtgctgatggctaccggtaaagttataggga

SEQ ID NO: 82992 - DNA, 75 bp, Artificial Sequence
  Synthetic
aaatccagtggatgagaccaagcaaagacgcaggttatcccatgataaatgcaccatcaaaaacaaagttagaac

SEQ ID NO: 82993 - DNA, 75 bp, Artificial Sequence
  Synthetic
tcatgaatcaattagatggaccaaagatcccagaaacacacaggatcatgtacgatccctatgcctattagcctg

SEQ ID NO: 82994 - DNA, 75 bp, Artificial Sequence
  Synthetic
tacgatccctatgcctattagcctggcacaatggggaagaagagtacaataaatttctagctaaaatcagaagtg

SEQ ID NO: 82995 - DNA, 75 bp, Artificial Sequence
  Synthetic
agacgcaggttatcccatgataaatgcaccatcaaaaacaaagttagaaccaagtgtcttctttgatgtcttccc

SEQ ID NO: 82996 - DNA, 75 bp, Artificial Sequence
  Synthetic
caaatacatcggaaataagatcacagaggtggatgaatacatgaaagaagccgttgaccactatgcaggtcaact

SEQ ID NO: 82997 - DNA, 75 bp, Artificial Sequence
  Synthetic
gaggtggatgaatacatgaaagaagccgttgaccactatgcaggtcaactgatgtcccttgacatacccacggaa

SEQ ID NO: 82998 - DNA, 75 bp, Artificial Sequence
  Synthetic
ccatatgtagctattgggaagaagaaaagagacattctcaataaacaaacaagagacactaaagaaatgcagaaa

SEQ ID NO: 82999 - DNA, 75 bp, Artificial Sequence
  Synthetic
ccatatgtagctattgggaagaagaaaagagacattctcaataaacaaacaagagacactaatgaaatgcagaaa

SEQ ID NO: 83000 - DNA, 75 bp, Artificial Sequence
  Synthetic
ccatatgtagctattgggaagaagaaaagagacattctcaataaacaaacaagagacactaacgaaatgcagaaa

SEQ ID NO: 83001 - DNA, 75 bp, Artificial Sequence
  Synthetic
ccatatgtagctattgggaagaagaaaagagacattctcaataaacaaacaagagacactaaggaaatgcagaaa

SEQ ID NO: 83002 - DNA, 75 bp, Artificial Sequence
  Synthetic
aaagagacattctcaataaacaaacaagagacactaaagaaatgcagaaaatgctagataaatatggaataaacc

SEQ ID NO: 83003 - DNA, 75 bp, Artificial Sequence
  Synthetic
aaagagacattctcaataaacaaacaagagacactaatgaaatgcagaaaatgctagataaatatggaataaacc

SEQ ID NO: 83004 - DNA, 75 bp, Artificial Sequence
  Synthetic
aaagagacattctcaataaacaaacaagagacactaacgaaatgcagaaaatgctagataaatatggaataaacc

SEQ ID NO: 83005 - DNA, 75 bp, Artificial Sequence
  Synthetic
aaagagacattctcaataaacaaacaagagacactaaggaaatgcagaaaatgctagataaatatggaataaacc

SEQ ID NO: 83006 - DNA, 75 bp, Artificial Sequence
  Synthetic
aagcaagctccctgaatgactcagtcgctatgagacaggcctttgggcatttgtatgccaaattccaccaaaacc

SEQ ID NO: 83007 - DNA, 75 bp, Artificial Sequence
  Synthetic
cgctatgagacaggcctttgggcatttgtatgccaaattccaccaaaacccaggtataataacaggttcagcagt

SEQ ID NO: 83008 - DNA, 75 bp, Artificial Sequence
  Synthetic
ggctgcttatggtgacaatcacagattgttatcataaagcgaattggattggccatccggtgaaagtgagactca

SEQ ID NO: 83009 - DNA, 75 bp, Artificial Sequence
  Synthetic
gggttatgatgcttcactctctccagcttggttcgaagccttaaaaatggtattagaaaagattggcttcggtga

SEQ ID NO: 83010 - DNA, 75 bp, Artificial Sequence
  Synthetic
tatgccctcagggtgttctggcacctcaatctttaactctatgattaacaacttgataatcagaacactaatgct

SEQ ID NO: 83011 - DNA, 75 bp, Artificial Sequence
  Synthetic
gcccaagcaggaaaagattatggattagtcatgacaccagcagacaagggtgctaccttcacagatgtagattgg

SEQ ID NO: 83012 - DNA, 75 bp, Artificial Sequence
  Synthetic
ggtggaccaaagatccgcgtaacacacaggatcatgtccgatcattgtgcttattggcttggcacaatggagaag

SEQ ID NO: 83013 - DNA, 75 bp, Artificial Sequence
  Synthetic
cgttcactcctgacaacaaccagacatcacctgcccgcagttctgcccggtggattacctccttggaaatggcac

SEQ ID NO: 83014 - DNA, 75 bp, Artificial Sequence
  Synthetic
aaagaggccatgcttggtacccacttaatatgggacattgggctacagtccagtgcaacattagtagccccatgg

SEQ ID NO: 83015 - DNA, 75 bp, Artificial Sequence
  Synthetic
atagagcaaaaagcgctagcacaggggttaggtcagatgcttgaaagcatgattgacaacacagtccgtgaaacg

SEQ ID NO: 83016 - DNA, 75 bp, Artificial Sequence
  Synthetic
aagatggcttgctataaaagctcgcaaattttgtccactctacgccatggaagcgcgtcgcattttcaaaatgga

SEQ ID NO: 83017 - DNA, 75 bp, Artificial Sequence
  Synthetic
ccctggcacgggtaagtcgatcgccaccggtctcatagggcgggccattgctaagcaagccaacacaagcacata

SEQ ID NO: 83018 - DNA, 75 bp, Artificial Sequence
  Synthetic
caacgcaggggtgtactactgcgagtctagaaggaaatactacccagtatccttcgttggcccaacgttccagta

SEQ ID NO: 83019 - DNA, 75 bp, Artificial Sequence
  Synthetic
cgtgatagaacggcacattactcgagcacttactatagttcaagcagtgtcatcatttgtagtagtctcagggat

SEQ ID NO: 83020 - DNA, 75 bp, Artificial Sequence
  Synthetic
ataaacgccccctccaaaaccaagctagaaccaagtgtatttcatgatgtgtttgagggtaccaaggaaccagcg

SEQ ID NO: 83021 - DNA, 75 bp, Artificial Sequence
  Synthetic
ttcggtggccatgaggcaagcatttggcaacttgtacgcaaccttccacaagaaccccggtactatcacaggaag

SEQ ID NO: 83022 - DNA, 75 bp, Artificial Sequence
  Synthetic
gccgacagaaccagacgtcgctgcatgtaggttttatacgctagacaccgtgtcttggacgaaagagtcgcgagg

SEQ ID NO: 83023 - DNA, 75 bp, Artificial Sequence
  Synthetic
ctgctggtggggaaggcttggttgcattttcagacattagagacctgtatgcttatgaggaagaagctatggagc

SEQ ID NO: 83024 - DNA, 75 bp, Artificial Sequence
  Synthetic
tggagtcatcacatgtactgggaagtcatcgggatgcatgttggtggacggttcacacgggtttgcagcggccct

SEQ ID NO: 83025 - DNA, 75 bp, Artificial Sequence
  Synthetic
gggtgtccgtgtttccttttttacttttgtatggctgcttatggtgacaatcacagattgttatcataaagcgaa

SEQ ID NO: 83026 - DNA, 75 bp, Artificial Sequence
  Synthetic
aagcacatcatctatctatttgttggattcactccaatcacttccaaaacacttcagttgatacgtgtagtatta

SEQ ID NO: 83027 - DNA, 75 bp, Artificial Sequence
  Synthetic
tgccactggtgggtcaacggtgaattacactaccataaattattataaagactcagctagtaacgctgcctcaaa

SEQ ID NO: 83028 - DNA, 75 bp, Artificial Sequence
  Synthetic
cacccaggaggcagctaattcagttgtagcatatggagtttggccctcctatctcaatgatcatgatgctaaccc

SEQ ID NO: 83029 - DNA, 75 bp, Artificial Sequence
  Synthetic
gtccaagggttggtggtggaaactccctgatgccctgaaagatatgggactgtttggacaaaacatgttctatca

SEQ ID NO: 83030 - DNA, 75 bp, Artificial Sequence
  Synthetic
tagctaaaatcaggagtgtgccaattggaagagctttattgctcccagagtactcaacattgtaccgccgttggc

SEQ ID NO: 83031 - DNA, 75 bp, Artificial Sequence
  Synthetic
gtttgccgttcctgagtactgccttgctggtgattctaattctaagactaattacaccagctatgtaaatgctaa

SEQ ID NO: 83032 - DNA, 75 bp, Artificial Sequence
  Synthetic
gagaaccaacaactgtgccactttagtgttaccgtacgttaattcattggcaattgactgtatggcaaaacacaa

SEQ ID NO: 83033 - DNA, 75 bp, Artificial Sequence
  Synthetic
acctctcaacttggctacggggaagaaaaatacaatggagatgtacagagttcaattgtctgacagcgccaaccg

SEQ ID NO: 83034 - DNA, 75 bp, Artificial Sequence
  Synthetic
aacaggtggcatccaatgcacttcagttatcgcaacccactaggcccgcgttacctccatcagagcagagtgtcc

SEQ ID NO: 83035 - DNA, 75 bp, Artificial Sequence
  Synthetic
ttacctccatcagagcagagtgtcccaaatacaaaccaaagcacaccagcacattctcaagaggtgccagcactg

SEQ ID NO: 83036 - DNA, 75 bp, Artificial Sequence
  Synthetic
agatcgcggagtgaaagcacaattgaatcctttttcgcacgcggggcctgtgtaacaataatgtcactggacaac

SEQ ID NO: 83037 - DNA, 75 bp, Artificial Sequence
  Synthetic
tacaatgagtcatcaaccacttcacccagtaccctgtttgcaaaatggaatattacatacacagacactgtgcaa

SEQ ID NO: 83038 - DNA, 75 bp, Artificial Sequence
  Synthetic
cggatctccattccatttgtgggaatcgccaatgcatattctcacttttacgacgggtatgctacagtgccctta

SEQ ID NO: 83039 - DNA, 75 bp, Artificial Sequence
  Synthetic
cagcctactatggagctgtatcaataaatgactttgggctgttggcagtcagggtagtgaatgaatacaacccag

SEQ ID NO: 83040 - DNA, 75 bp, Artificial Sequence
  Synthetic
ctacatgaaacccaagcatgtgcgcgtctggtgcccaaggccgccccgcgcggtggagtattatggtagtggagt

SEQ ID NO: 83041 - DNA, 75 bp, Artificial Sequence
  Synthetic
gtctggtgcccaaggccgccccgcgcggtggagtattatggtagtggagttgattacaaagccaacacgcttgac

SEQ ID NO: 83042 - DNA, 75 bp, Artificial Sequence
  Synthetic
gagcatgtgggagagagatcttatggttgttgagtcacgtgcacaagggatagacaccatcgcgcggtgctgttg

SEQ ID NO: 83043 - DNA, 75 bp, Artificial Sequence
  Synthetic
gatggagaaaaatgacttctaccccgccaggtaccaaactcacctaactattggcagcggttttgcggcccctgg

SEQ ID NO: 83044 - DNA, 75 bp, Artificial Sequence
  Synthetic
acttcacaaattggagaaaagatcagtgagataactaacatggtcacttccaccatcacagaaaaattacttaag

SEQ ID NO: 83045 - DNA, 75 bp, Artificial Sequence
  Synthetic
tgagtctggacgttccccactggtgacagtggtccaggctgcgttggcggcctacctgtggtccaaagccacagg

SEQ ID NO: 83046 - DNA, 75 bp, Artificial Sequence
  Synthetic
tatatcatcaagcagggagactcctggttgaaaaaatttactgaagcttgtaacgcagcgaaaggattggaatgg

SEQ ID NO: 83047 - DNA, 75 bp, Artificial Sequence
  Synthetic
tacattaccaaacttaggcaactaggcatgctggagaaccaaatcaacacaattcatcaatcatgtcccagccaa

SEQ ID NO: 83048 - DNA, 75 bp, Artificial Sequence
  Synthetic
atgttagatggttggccatacaatcacgcagatttgcaccgttgtatgcggtagaagccaaaaggatcagtaaat

SEQ ID NO: 83049 - DNA, 75 bp, Artificial Sequence
  Synthetic
gtagaagccaaaaggatcagtaaattggaaagtaccatcaacaactacatacagttcaagagcaaacaccgtatt

SEQ ID NO: 83050 - DNA, 75 bp, Artificial Sequence
  Synthetic
attgcggaaagagaaaacacttcagtgtattcactgccacctgaccccacccactttgacgggtacaaacaacag

SEQ ID NO: 83051 - DNA, 75 bp, Artificial Sequence
  Synthetic
acagtagagtttataccaccaatggcatccttagaggagaaaggaattctattcacttcagattatgttttggca

SEQ ID NO: 83052 - DNA, 75 bp, Artificial Sequence
  Synthetic
catccttagaggagaaaggaattctattcacttcagattatgttttggcatccaccaattccagcacaatcacac

SEQ ID NO: 83053 - DNA, 75 bp, Artificial Sequence
  Synthetic
attcacttcagattatgttttggcatccaccaattccagcacaatcacaccacccactatagcccatagtgatgc

SEQ ID NO: 83054 - DNA, 75 bp, Artificial Sequence
  Synthetic
ccaggcgaaaaaggaggtgagtttaaagggagcttcaccctggacaccaacgccactaaccctgcacggaacttt

SEQ ID NO: 83055 - DNA, 75 bp, Artificial Sequence
  Synthetic
ggccatgaccatactccaggcactaaccacatttgctgcagtagcaggagtagtatatgtgatgtacaagctgtt

SEQ ID NO: 83056 - DNA, 75 bp, Artificial Sequence
  Synthetic
acaagggccaggatttgactatgcagttgctatggccaaaaggaacatcgttaccgccactactagtaaaggtga

SEQ ID NO: 83057 - DNA, 75 bp, Artificial Sequence
  Synthetic
acactaaccattgctcccatgtgctgtgaattcaatggtttacgcaatatcactgtaccaagaacccaaggatta

SEQ ID NO: 83058 - DNA, 75 bp, Artificial Sequence
  Synthetic
tgatggcagagaaattgaggtagttgatgccaaagctcttgaagatcaggctggtaccaacctagaaatcactat

SEQ ID NO: 83059 - DNA, 75 bp, Artificial Sequence
  Synthetic
tttcagtgtgcgtttgttgcgagacacgacgcacattagtcaagaggctatgccacaaggaattggtgacgtgat

SEQ ID NO: 83060 - DNA, 75 bp, Artificial Sequence
  Synthetic
aaggaagcagtagatcactatgctggacagctaatgtcactggatatcagtactgagcagatgtgtctagaggat

SEQ ID NO: 83061 - DNA, 75 bp, Artificial Sequence
  Synthetic
tggatacccttatgtagcactaggcaagaagaaaagagacatcctcaacaaacagaccagagacacgaaagaaat

SEQ ID NO: 83062 - DNA, 75 bp, Artificial Sequence
  Synthetic
aagaagaaaagagacatcctcaacaaacagaccagagacacgaaagaaatgcagagactactagatacctatgga

SEQ ID NO: 83063 - DNA, 75 bp, Artificial Sequence
  Synthetic
ctaattgaggcttctagcctgaatgactcagtggctatgagaatggcctttggtaatctctatgctgcctttcac

SEQ ID NO: 83064 - DNA, 75 bp, Artificial Sequence
  Synthetic
attgaggtggacaatgatgcaccaacaaagcgcgccagcagactgttctcggtttggaaaataacatacaaagat

SEQ ID NO: 83065 - DNA, 75 bp, Artificial Sequence
  Synthetic
actcagtggctatgagaatggcctttggtaatctctatgctgcctttcacaagaacccaggcgttgtcaccggtt

SEQ ID NO: 83066 - DNA, 75 bp, Artificial Sequence
  Synthetic
tcaaactatactgatgcaaacaacgggcatgcattaaatcaagtttatcagataatgtatataccacctggagcg

SEQ ID NO: 83067 - DNA, 75 bp, Artificial Sequence
  Synthetic
actacaccggttatgatgcctcactcagtccagcttggtttgaagcacttaaaatggtattggagaaaattggat

SEQ ID NO: 83068 - DNA, 75 bp, Artificial Sequence
  Synthetic
ttggagacagagtggactatatcgactacctaaatcactctcaccacctctacaaaaacaaaacttactgtgtca

SEQ ID NO: 83069 - DNA, 75 bp, Artificial Sequence
  Synthetic
aatgccaatgaaagaaattcatgaatcaattagatggaccaaggatcctagaaacacacaggatcatgttcgctc

SEQ ID NO: 83070 - DNA, 75 bp, Artificial Sequence
  Synthetic
aaacaaagccgtgtatacagctggctacaaaatttgcaattaccacctggctacacaagaagatctgcaaaatgc

SEQ ID NO: 83071 - DNA, 75 bp, Artificial Sequence
  Synthetic
caattgcaataccggtgtgtattactgtgagtccaggagaaaatattatcctgtttctttcattggcccaacctt

SEQ ID NO: 83072 - DNA, 75 bp, Artificial Sequence
  Synthetic
tgtgagtccaggagaaaatattatcctgtttctttcattggcccaacctttcagtacatggaagcaaacgactac

SEQ ID NO: 83073 - DNA, 75 bp, Artificial Sequence
  Synthetic
cgatgccaacacggggtaattggaatcatcacagctgggggagaaggcctggtagccttctcagacattagagac

SEQ ID NO: 83074 - DNA, 75 bp, Artificial Sequence
  Synthetic
tcatcacagctgggggagaaggcctggtagccttctcagacattagagacctctatgcatatgaggaggaagcca

SEQ ID NO: 83075 - DNA, 75 bp, Artificial Sequence
  Synthetic
acaaaatttcagaactaactagtatggtcaccagcacaatcactgaaaaactgttgaaaaacctaataaagatca

SEQ ID NO: 83076 - DNA, 75 bp, Artificial Sequence
  Synthetic
ggtcaccagcacaatcactgaaaaactgttgaaaaacctaataaagatcatatcctccctagtcattatcaccag

SEQ ID NO: 83077 - DNA, 75 bp, Artificial Sequence
  Synthetic
caagaagaaagcttgtgatatactagagatcccttgtgtcatgcgtcaaggtgacagttggttgaagaaattcac

SEQ ID NO: 83078 - DNA, 75 bp, Artificial Sequence
  Synthetic
gagatcccttgtgtcatgcgtcaaggtgacagttggttgaagaaattcacagaagcatgtaacgctgctaaggga

SEQ ID NO: 83079 - DNA, 75 bp, Artificial Sequence
  Synthetic
aagttggaatttgttacaaagttaaagcaactagaaatgttagagaatcaaattgcaaccatccatcaatcatgt

SEQ ID NO: 83080 - DNA, 75 bp, Artificial Sequence
  Synthetic
acatagattacttgaaccactcacaccacctttacaaaaataaaacatactgcgtcaagggcggcatgccatctg

SEQ ID NO: 83081 - DNA, 75 bp, Artificial Sequence
  Synthetic
agcaactagaaatgttagagaatcaaattgcaaccatccatcaatcatgtccaagccaggaacaccaggagattt

SEQ ID NO: 83082 - DNA, 75 bp, Artificial Sequence
  Synthetic
aggacacttttattgaaaacctacaagggcatagatttggaccacttaaaaatgattgcctatggtgatgatgta

SEQ ID NO: 83083 - DNA, 75 bp, Artificial Sequence
  Synthetic
ttcagaagttagaacatacaattaataattacatacaattcaagagcaaacaccgtattgaaccagtatgtttat

SEQ ID NO: 83084 - DNA, 75 bp, Artificial Sequence
  Synthetic
aatgattgcctatggtgatgatgtaattgcttcctacccccatgaggttgacgctagtctcctagcccaatcagg

SEQ ID NO: 83085 - DNA, 75 bp, Artificial Sequence
  Synthetic
taattacatacaattcaagagcaaacaccgtattgaaccagtatgtttattagtgcatggcagtcctggtacagg

SEQ ID NO: 83086 - DNA, 75 bp, Artificial Sequence
  Synthetic
agatccttcccactttgacgggtacaagcaacagggtgtagtgatcatggatgatttgaaccagaatccagatgg

SEQ ID NO: 83087 - DNA, 75 bp, Artificial Sequence
  Synthetic
aagcaacagggtgtagtgatcatggatgatttgaaccagaatccagatggggccgatatgaaattattctgtcag

SEQ ID NO: 83088 - DNA, 75 bp, Artificial Sequence
  Synthetic
atccagttatgccaatgaaggagattcatgaatcaattagatggacaaaagatcctagaaatacacaggatcatg

SEQ ID NO: 83089 - DNA, 75 bp, Artificial Sequence
  Synthetic
tcatgaatcaattagatggacaaaagatcctagaaatacacaggatcatgttcgctcattatgcttattggcctg

SEQ ID NO: 83090 - DNA, 75 bp, Artificial Sequence
  Synthetic
gttctggcctccaccaactctagtcgcatcacaccacccacagtcgcacacagtgacgcactagctaggcgcttc

SEQ ID NO: 83091 - DNA, 75 bp, Artificial Sequence
  Synthetic
gcatcacaccacccacagtcgcacacagtgacgcactagctaggcgcttcgcatttgacatggacatacaagtca

SEQ ID NO: 83092 - DNA, 75 bp, Artificial Sequence
  Synthetic
caaactttaaaagatgctgcccacttgtatgtggaaaggccatccagttgatggataagtcatctagggttagat

SEQ ID NO: 83093 - DNA, 75 bp, Artificial Sequence
  Synthetic
tgtatgtggaaaggccatccagttgatggataagtcatctagggttagatatagcattgaccaaattactacaat

SEQ ID NO: 83094 - DNA, 75 bp, Artificial Sequence
  Synthetic
agtgtacatgaagccaaagcatgtcagggtctggtgcccacgacctccacgagcagtcccatacttcggaccagg

SEQ ID NO: 83095 - DNA, 75 bp, Artificial Sequence
  Synthetic
caaagacttgaagattgacatcaagaccacacccccccctgagtgtattaatgatttgctccaagctgtggattc

SEQ ID NO: 83096 - DNA, 75 bp, Artificial Sequence
  Synthetic
accacacccccccctgagtgtattaatgatttgctccaagctgtggattcccaagaggtgagagactactgtgag

SEQ ID NO: 83097 - DNA, 75 bp, Artificial Sequence
  Synthetic
ttaaaacagctctggggttgttcccaccccagaggcccacgtggcggctagtactctggtatcgcggtacctttg

SEQ ID NO: 83098 - DNA, 75 bp, Artificial Sequence
  Synthetic
caggcagttacaacatttgctgcagtcgctggagtggtgtacgtaatgtacaaactatttgcaggtcaccaaggg

SEQ ID NO: 83099 - DNA, 75 bp, Artificial Sequence
  Synthetic
tcgctggagtggtgtacgtaatgtacaaactatttgcaggtcaccaaggggcttatacaggactcccaaacaaaa

SEQ ID NO: 83100 - DNA, 75 bp, Artificial Sequence
  Synthetic
gcaccaccacgaacaagcacttctgtaaccccggtgaccttgtatatgctgtacccacggctgaaagcgagtgat

SEQ ID NO: 83101 - DNA, 75 bp, Artificial Sequence
  Synthetic
gaaatattctcacagctactaccagtaagggtgaattcacaatgctaggagtacatgataatgtggccatcctac

SEQ ID NO: 83102 - DNA, 75 bp, Artificial Sequence
  Synthetic
caactcatgctgcaccaggtgagacaatagtgattgatggtaaagaagtggaggtgttggatgctaaggccctag

SEQ ID NO: 83103 - DNA, 75 bp, Artificial Sequence
  Synthetic
gacaaatgatggagttttgatcgtgaacactagtaagtaccccaacatgtatgttcctgtcggtgctgtgactga

SEQ ID NO: 83104 - DNA, 75 bp, Artificial Sequence
  Synthetic
atgttcctgtcggtgctgtgactgaacagggatatcttaatcttggtggacggcagacagctcgtaccttgatgt

SEQ ID NO: 83105 - DNA, 75 bp, Artificial Sequence
  Synthetic
atatggctgcttatggtgacaatcatagattgttatcataaagcgacttggattggccatccggtaagatacaaa

SEQ ID NO: 83106 - DNA, 75 bp, Artificial Sequence
  Synthetic
gtgggaacggttcacatgggttcgcagcggccctgaaacgatcatatttcactcagagtcaaggtgaaatccaat

SEQ ID NO: 83107 - DNA, 75 bp, Artificial Sequence
  Synthetic
attagacattactatcacaatgggcgcccaggtttcgtcccagaaagttggcgctcatgaaaactcgaatagggc

SEQ ID NO: 83108 - DNA, 75 bp, Artificial Sequence
  Synthetic
gcccaggtttcgtcccagaaagttggcgctcatgaaaactcgaatagggcatatggaggttcaaccatcaactat

SEQ ID NO: 83109 - DNA, 75 bp, Artificial Sequence
  Synthetic
agcggccctgaaacgatcatatttcactcagagtcaaggtgaaatccaatggatgagaccatccaaggaagtggg

SEQ ID NO: 83110 - DNA, 75 bp, Artificial Sequence
  Synthetic
ggaaccagccgtgctcactagaaatgaccctagattgaaagcagactttgaagaggctatcttttccaagtatgt

SEQ ID NO: 83111 - DNA, 75 bp, Artificial Sequence
  Synthetic
tttactgaacccataaaagatgttttaataaagactgccccaatgctaaactctcccaacattgaagcctgcgga

SEQ ID NO: 83112 - DNA, 75 bp, Artificial Sequence
  Synthetic
taataaagactgccccaatgctaaactctcccaacattgaagcctgcggatatagtgacagagttttgcagttaa

SEQ ID NO: 83113 - DNA, 75 bp, Artificial Sequence
  Synthetic
gaccctagattgaaagcagactttgaagaggctatcttttccaagtatgtgggaaacaaaatcactgaggtggat

SEQ ID NO: 83114 - DNA, 75 bp, Artificial Sequence
  Synthetic
cttgaggatgcaatgtacggcacagatgggcttgaggccctggatctcagcaccagcgcagggtatccctatgtg

SEQ ID NO: 83115 - DNA, 75 bp, Artificial Sequence
  Synthetic
tgagggatagtgaggctaatccagttgaccaaccgaccgagccggatgttgcagcgtgcagattctacacgcttg

SEQ ID NO: 83116 - DNA, 75 bp, Artificial Sequence
  Synthetic
tgaccaaccgaccgagccggatgttgcagcgtgcagattctacacgcttgaaacagtctcttggacaaaagaatc

SEQ ID NO: 83117 - DNA, 75 bp, Artificial Sequence
  Synthetic
atgggcttgaggccctggatctcagcaccagcgcagggtatccctatgtggcaatgggtaagaaaaagagagata

SEQ ID NO: 83118 - DNA, 75 bp, Artificial Sequence
  Synthetic
tcacttatgtaaaggatgagcttagatcaaagactaaagtagagcaaggtaaatccagattgattgaagcttcaa

SEQ ID NO: 83119 - DNA, 75 bp, Artificial Sequence
  Synthetic
cctaggtagatcaggttatacagtgcacgtgcagtgcaatgcgtccaaatttcatcagggagcgctcggtgtgtt

SEQ ID NO: 83120 - DNA, 75 bp, Artificial Sequence
  Synthetic
cacgtgcagtgcaatgcgtccaaatttcatcagggagcgctcggtgtgtttgctgtgccggaaatgtgtttggct

SEQ ID NO: 83121 - DNA, 75 bp, Artificial Sequence
  Synthetic
atcaaagactaaagtagagcaaggtaaatccagattgattgaagcttcaagtttgaatgactcagtggctatgag

SEQ ID NO: 83122 - DNA, 75 bp, Artificial Sequence
  Synthetic
cccagacctgttttggagcaagataccagttctaatggaagagaagctctttgcatttgactacacaggttatga

SEQ ID NO: 83123 - DNA, 75 bp, Artificial Sequence
  Synthetic
ggcacgtttacaccagacaacaaccaaacaacacccgcccgcaaattctgcccagtggactatctcttcggcaat

SEQ ID NO: 83124 - DNA, 75 bp, Artificial Sequence
  Synthetic
aaacaacacccgcccgcaaattctgcccagtggactatctcttcggcaatggtactctactaggtaacgcgtttg

SEQ ID NO: 83125 - DNA, 75 bp, Artificial Sequence
  Synthetic
ccagttctaatggaagagaagctctttgcatttgactacacaggttatgatgcctcactcagtccagcttggttt

SEQ ID NO: 83126 - DNA, 75 bp, Artificial Sequence
  Synthetic
caccacctttacaaaaacaaaacatattgtgtcaagggcggcatgccatctggctgctcaggcacttcaattttc

SEQ ID NO: 83127 - DNA, 75 bp, Artificial Sequence
  Synthetic
caatagacagtatggtgaagcacaacaactgggggattgctataataccgttggctcctttgaatttcgccaatg

SEQ ID NO: 83128 - DNA, 75 bp, Artificial Sequence
  Synthetic
caactgggggattgctataataccgttggctcctttgaatttcgccaatgaatcatccccggagattcccattac

SEQ ID NO: 83129 - DNA, 75 bp, Artificial Sequence
  Synthetic
tgtcatgaacacccctggtagtaatcagtaccttactgccgacaactttcaatccccgtgtgcgctacctgagtt

SEQ ID NO: 83130 - DNA, 75 bp, Artificial Sequence
  Synthetic
cagtaccttactgccgacaactttcaatccccgtgtgcgctacctgagtttgatgtcaccccacccattgacata

SEQ ID NO: 83131 - DNA, 75 bp, Artificial Sequence
  Synthetic
acatccagtaatgccaatgaaagaaattcatgaatcaatcagatggaccaaagaccctaggaacacccaggatca

SEQ ID NO: 83132 - DNA, 75 bp, Artificial Sequence
  Synthetic
aagaataccatggaaatgtatagggttcaactaagcgataaaccgcacacagacgatccaatactatgcctgtcg

SEQ ID NO: 83133 - DNA, 75 bp, Artificial Sequence
  Synthetic
ttcaactaagcgataaaccgcacacagacgatccaatactatgcctgtcgttatcaccagcttcagaccccaggt

SEQ ID NO: 83134 - DNA, 75 bp, Artificial Sequence
  Synthetic
tgtgccaatcggaagagctttattgctccctgagtactctacattgtaccgccgttggctcgactcattttagta

SEQ ID NO: 83135 - DNA, 75 bp, Artificial Sequence
  Synthetic
ctccctgagtactctacattgtaccgccgttggctcgactcattttagtaaccctacctcagtcgaattggattg

SEQ ID NO: 83136 - DNA, 75 bp, Artificial Sequence
  Synthetic
tttgcggttccatgatggcaactggaaagctgttggtgtcctatgctcccccaggtgctgacccgccaaagaagc

SEQ ID NO: 83137 - DNA, 75 bp, Artificial Sequence
  Synthetic
aaagctgttggtgtcctatgctcccccaggtgctgacccgccaaagaagcgaaaagaggcgatgttaggaacaca

SEQ ID NO: 83138 - DNA, 75 bp, Artificial Sequence
  Synthetic
aaccattgacgacagcttcactgaaggtggttacattagtgtgttctatcaaactagaatagtggtgcctctatc

SEQ ID NO: 83139 - DNA, 75 bp, Artificial Sequence
  Synthetic
tacacccagagaaatggacatccttgggtttgtgtcagcctgtaatgatttcagtgtgcgcttactgcgtgacac

SEQ ID NO: 83140 - DNA, 75 bp, Artificial Sequence
  Synthetic
cgagacagtggggacatcagcctctagggacgctctcccaaacactgaatccagcggaccagcacactctaaaga

SEQ ID NO: 83141 - DNA, 75 bp, Artificial Sequence
  Synthetic
agggacgctctcccaaacactgaatccagcggaccagcacactctaaagaaatccctgcgctcaccgcggtagaa

SEQ ID NO: 83142 - DNA, 75 bp, Artificial Sequence
  Synthetic
gagtccagtgttgagtcctttttcgcgcgtggtgcgtgcgtaaccataatgactgtagacaattccgcctccact

SEQ ID NO: 83143 - DNA, 75 bp, Artificial Sequence
  Synthetic
cgcgtggtgcgtgcgtaaccataatgactgtagacaattccgcctccactacatcaaaagacaaattgttctcag

SEQ ID NO: 83144 - DNA, 75 bp, Artificial Sequence
  Synthetic
tggagttcacttttgtggtcacggcaaacttcacggaaaccaacaacggacatgcgttgaatcaagtgtaccaaa

SEQ ID NO: 83145 - DNA, 75 bp, Artificial Sequence
  Synthetic
aaacttcacggaaaccaacaacggacatgcgttgaatcaagtgtaccaaattatgtatgtaccaccgggcgcacc

SEQ ID NO: 83146 - DNA, 75 bp, Artificial Sequence
  Synthetic
accagcccgtatttccgtgccgtacgttggtatatcaaatgcctactcacacttctatgacgggttttccaaaat

SEQ ID NO: 83147 - DNA, 75 bp, Artificial Sequence
  Synthetic
gttggtatatcaaatgcctactcacacttctatgacgggttttccaaaataccgttgaaagatcagtcagttgaa

SEQ ID NO: 83148 - DNA, 75 bp, Artificial Sequence
  Synthetic
aatccaaccaaggtcacttctaaggtcagagtatacttaaagcccaagcacatcagagtgtggtgccctcgccca

SEQ ID NO: 83149 - DNA, 75 bp, Artificial Sequence
  Synthetic
tcagagtatacttaaagcccaagcacatcagagtgtggtgccctcgcccaccgagagcagtggcatactatggtc

SEQ ID NO: 83150 - DNA, 75 bp, Artificial Sequence
  Synthetic
acaaaccataatgggggctcaagtgtctacacaaaagtctggatcacatgagaaccagaatattgctgctggtgg

SEQ ID NO: 83151 - DNA, 75 bp, Artificial Sequence
  Synthetic
tctacacaaaagtctggatcacatgagaaccagaatattgctgctggtggttctactatcaactataccaccata

SEQ ID NO: 83152 - DNA, 75 bp, Artificial Sequence
  Synthetic
aaaacaaagcagtgtacacagccgggtataaaatttgcaactaccatttagccacacaagaggacctccaaaacg

SEQ ID NO: 83153 - DNA, 75 bp, Artificial Sequence
  Synthetic
gtataaaatttgcaactaccatttagccacacaagaggacctccaaaacgcggtaaacgttatgtggaacagaga

SEQ ID NO: 83154 - DNA, 75 bp, Artificial Sequence
  Synthetic
ccagtgaaagacataatgattaaaagtgctccagcattgaactcacctaacattgaagcttgtggatatagtgat

SEQ ID NO: 83155 - DNA, 75 bp, Artificial Sequence
  Synthetic
gtgctccagcattgaactcacctaacattgaagcttgtggatatagtgatagggtgttacaactaacattaggta

SEQ ID NO: 83156 - DNA, 75 bp, Artificial Sequence
  Synthetic
ttgtgaatccagaagaaaatactacccagtcacttttgttggtcccaccttccaatatatggaggcaaacgatta

SEQ ID NO: 83157 - DNA, 75 bp, Artificial Sequence
  Synthetic
ccagtcacttttgttggtcccaccttccaatatatggaggcaaacgattattacccagccaggtatcaatcacat

SEQ ID NO: 83158 - DNA, 75 bp, Artificial Sequence
  Synthetic
acgaagccaatccagtggatgcacctacagaaccagacgcctcagctaatagattctataccttagagagcgtca

SEQ ID NO: 83159 - DNA, 75 bp, Artificial Sequence
  Synthetic
tacagaaccagacgcctcagctaatagattctataccttagagagcgtcaactggaccaccacttccaggggttg

SEQ ID NO: 83160 - DNA, 75 bp, Artificial Sequence
  Synthetic
ataatcactgcaggaggagaaggccttgtcgcattctcagacattagagacctctatgcctatgaagaagaggcc

SEQ ID NO: 83161 - DNA, 75 bp, Artificial Sequence
  Synthetic
ttgtcgcattctcagacattagagacctctatgcctatgaagaagaggccatggagcaaggaatttctaactaca

SEQ ID NO: 83162 - DNA, 75 bp, Artificial Sequence
  Synthetic
tgctggttatactgttcatgtacaatgcaatgcctcaaaattccaccaaggtgctttaattgtagcagcaattcc

SEQ ID NO: 83163 - DNA, 75 bp, Artificial Sequence
  Synthetic
tgcaatgcctcaaaattccaccaaggtgctttaattgtagcagcaattccagagttcatgatggcgagtaattca

SEQ ID NO: 83164 - DNA, 75 bp, Artificial Sequence
  Synthetic
tggtcaccagcaccattacagaaaaattgctaaagaacctaatcaagatcatttcgtccttggtaattatcacta

SEQ ID NO: 83165 - DNA, 75 bp, Artificial Sequence
  Synthetic
attgctaaagaacctaatcaagatcatttcgtccttggtaattatcactagaaattatgaggacaccaccaccgt

SEQ ID NO: 83166 - DNA, 75 bp, Artificial Sequence
  Synthetic
gtgccttctaccagtgatgagtcaaagaataagtttgctccatgggactggttattgggatgtggagttatggct

SEQ ID NO: 83167 - DNA, 75 bp, Artificial Sequence
  Synthetic
agaataagtttgctccatgggactggttattgggatgtggagttatggctggtaacatcacggtatacccacatc

SEQ ID NO: 83168 - DNA, 75 bp, Artificial Sequence
  Synthetic
ggaaatcccgtatgttattcgccaaggggatagctggctcaagaagtttacagaagcctgcaatgcagcaaaagg

SEQ ID NO: 83169 - DNA, 75 bp, Artificial Sequence
  Synthetic
ggggatagctggctcaagaagtttacagaagcctgcaatgcagcaaaagggcttgagtgggtttcaaacaaaatt

SEQ ID NO: 83170 - DNA, 75 bp, Artificial Sequence
  Synthetic
tggccaaacataataattggggcttagttgttatgccttttgttaaattgggcgctgtagctggtgcaacccaac

SEQ ID NO: 83171 - DNA, 75 bp, Artificial Sequence
  Synthetic
agttgttatgccttttgttaaattgggcgctgtagctggtgcaacccaacaagtacccataacagtaaccatagc

SEQ ID NO: 83172 - DNA, 75 bp, Artificial Sequence
  Synthetic
aagcagttggagatgttggagaaccaaatttctaccatacaccagtcttgtccaagtcaggagcatcaagagatt

SEQ ID NO: 83173 - DNA, 75 bp, Artificial Sequence
  Synthetic
aaatttctaccatacaccagtcttgtccaagtcaggagcatcaagagattctttttaataatgtcagatggctgt

SEQ ID NO: 83174 - DNA, 75 bp, Artificial Sequence
  Synthetic
acccgggtcaaatcagtttctaacttcagatgacttccaatcaccgtgtgcactaccaagctttgatgtcactcc

SEQ ID NO: 83175 - DNA, 75 bp, Artificial Sequence
  Synthetic
tcagatgacttccaatcaccgtgtgcactaccaagctttgatgtcactccagaaattcatattcctggtgaagtg

SEQ ID NO: 83176 - DNA, 75 bp, Artificial Sequence
  Synthetic
acaactacgtacagttcaagagcaaacatcgtattgaaccagtatgtctacttgtgcacggtagcccaggaacag

SEQ ID NO: 83177 - DNA, 75 bp, Artificial Sequence
  Synthetic
acatcgtattgaaccagtatgtctacttgtgcacggtagcccaggaacagggaaatcagttgcaacgaacttgat

SEQ ID NO: 83178 - DNA, 75 bp, Artificial Sequence
  Synthetic
gaggcctacccaatccccctcaaagcttcagaaaacaatgctaatgagtccatcttttctatatcattgagtcct

SEQ ID NO: 83179 - DNA, 75 bp, Artificial Sequence
  Synthetic
cttcagaaaacaatgctaatgagtccatcttttctatatcattgagtcctgcagcagacaacaggttgtcccata

SEQ ID NO: 83180 - DNA, 75 bp, Artificial Sequence
  Synthetic
taagcaacaaggggtagtaattatggacgatttgaaccagaacccagatggtgctgacatgaagctattctgcca

SEQ ID NO: 83181 - DNA, 75 bp, Artificial Sequence
  Synthetic
gacgatttgaaccagaacccagatggtgctgacatgaagctattctgccaaatggtttcaacagtggaattcatt

SEQ ID NO: 83182 - DNA, 75 bp, Artificial Sequence
  Synthetic
gcatgatggcaacagggaaaattttagttagttacagtccgccaggagcacaaccaccaacaactaggaaagagg

SEQ ID NO: 83183 - DNA, 75 bp, Artificial Sequence
  Synthetic
agttagttacagtccgccaggagcacaaccaccaacaactaggaaagaggccatgctgggtacccatgtaatttg

SEQ ID NO: 83184 - DNA, 75 bp, Artificial Sequence
  Synthetic
agaataaccccacccaccgtggcacatagtgacgctttgacaagaagattcgcctttgacatggacattcagatt

SEQ ID NO: 83185 - DNA, 75 bp, Artificial Sequence
  Synthetic
atagtgacgctttgacaagaagattcgcctttgacatggacattcagattatgggagaatattccagagacggaa

SEQ ID NO: 83186 - DNA, 75 bp, Artificial Sequence
  Synthetic
ggatgatttcacagaaggtggatatatttgtgctttctatcaaacagcaataatagttcccccaaatactccaac

SEQ ID NO: 83187 - DNA, 75 bp, Artificial Sequence
  Synthetic
atttgtgctttctatcaaacagcaataatagttcccccaaatactccaacagacatgtcaatgctggcgtttgtc

SEQ ID NO: 83188 - DNA, 75 bp, Artificial Sequence
  Synthetic
tagtgtgtggcaaagcaatccaactaatggacaaatcatccagagtcagatacagtattgaccaaatcaccacca

SEQ ID NO: 83189 - DNA, 75 bp, Artificial Sequence
  Synthetic
aatggacaaatcatccagagtcagatacagtattgaccaaatcaccaccatgattataaatgaaagaaacaggcg

SEQ ID NO: 83190 - DNA, 75 bp, Artificial Sequence
  Synthetic
caaggcatagaagacacaatcgaaaaagttgtgggggatgctctcgccatctcaatgccaaaagtggctgacaca

SEQ ID NO: 83191 - DNA, 75 bp, Artificial Sequence
  Synthetic
aagttgtgggggatgctctcgccatctcaatgccaaaagtggctgacacaaaaccctctggtccagttaattcaa

SEQ ID NO: 83192 - DNA, 75 bp, Artificial Sequence
  Synthetic
gactaccccaccaccagagtgcataaacgatctattacaagctgtggattcccaagaggtcagggattactgtga

SEQ ID NO: 83193 - DNA, 75 bp, Artificial Sequence
  Synthetic
aacgatctattacaagctgtggattcccaagaggtcagggattactgtgagaaaaagggttggctggtcaacatc

SEQ ID NO: 83194 - DNA, 75 bp, Artificial Sequence
  Synthetic
gacatgtggcaaatcagaggctgcgctcagaatgcactatcgaatcattctttggacgcagcgcttgcgtggcca

SEQ ID NO: 83195 - DNA, 75 bp, Artificial Sequence
  Synthetic
ctcagaatgcactatcgaatcattctttggacgcagcgcttgcgtggccatcctgagtgtagctaacaagaaacc

SEQ ID NO: 83196 - DNA, 75 bp, Artificial Sequence
  Synthetic
gtcgctggagtggtatacgtcatgtacaaactttttgcaggtcatcaaggtgcatacacaggactccccaacaag

SEQ ID NO: 83197 - DNA, 75 bp, Artificial Sequence
  Synthetic
attagaactgtttacatattccagatttgatttggaaatgacctttgtgataactgagaggtactactcaggtac

SEQ ID NO: 83198 - DNA, 75 bp, Artificial Sequence
  Synthetic
cagccaaggtacagggacctggatttgattatgctgtcgctatggctaagaggaacatcgtcactgctaccacca

SEQ ID NO: 83199 - DNA, 75 bp, Artificial Sequence
  Synthetic
tttgatttggaaatgacctttgtgataactgagaggtactactcaggtactggagccactaccaggaactatgta

SEQ ID NO: 83200 - DNA, 75 bp, Artificial Sequence
  Synthetic
ccatagtcattgatggcaaagaggttgaggtccaagatgctaaggcactagaggatcaggccggtaccaacctgg

SEQ ID NO: 83201 - DNA, 75 bp, Artificial Sequence
  Synthetic
aatccatcagtgttttatactacaggtaacgctaatcccagaatgtctataccatttgtaggaataggagctgca

SEQ ID NO: 83202 - DNA, 75 bp, Artificial Sequence
  Synthetic
tgaggtccaagatgctaaggcactagaggatcaggccggtaccaacctggagatcactattgtcacccttaaaag

SEQ ID NO: 83203 - DNA, 75 bp, Artificial Sequence
  Synthetic
gtaacgctaatcccagaatgtctataccatttgtaggaataggagctgcatattcacacttttatgatggtttca

SEQ ID NO: 83204 - DNA, 75 bp, Artificial Sequence
  Synthetic
gaacactagtaagtaccccaacatgtatgtacccgtcggggcagtaaccgagcaagggtaccttaatttaggcgg

SEQ ID NO: 83205 - DNA, 75 bp, Artificial Sequence
  Synthetic
ccttggctgttaggatagttaatgaatatgacccagtaaccattgaggccaaagttagagtttacatgaaaccaa

SEQ ID NO: 83206 - DNA, 75 bp, Artificial Sequence
  Synthetic
agcaagggtaccttaatttaggcgggcgccaaacagcccgcacactaatgtacaacttcccaacccgtgctggtc

SEQ ID NO: 83207 - DNA, 75 bp, Artificial Sequence
  Synthetic
atatgacccagtaaccattgaggccaaagttagagtttacatgaaaccaaaacacatcaaagtatggtgtcctag

SEQ ID NO: 83208 - DNA, 75 bp, Artificial Sequence
  Synthetic
gtcaatcagaacatacggtttcgggcatcaaaataaagcagtatacacagccggttacaagatatgtaattacca

SEQ ID NO: 83209 - DNA, 75 bp, Artificial Sequence
  Synthetic
ctgcagccctgaagcgatcatacttcacccagaaccaaggtgaaatacagtggatgagaccatccaaggaggttg

SEQ ID NO: 83210 - DNA, 75 bp, Artificial Sequence
  Synthetic
cacccagaaccaaggtgaaatacagtggatgagaccatccaaggaggttggatacccagtcattaacgcaccaag

SEQ ID NO: 83211 - DNA, 75 bp, Artificial Sequence
  Synthetic
catcaaaataaagcagtatacacagccggttacaagatatgtaattaccatctagccaccccagaagatatggaa

SEQ ID NO: 83212 - DNA, 75 bp, Artificial Sequence
  Synthetic
aggtgttcatgtaaagcaggaatctactactgtgagtccaagagaaaatactaccccatcacagtttgtgggcca

SEQ ID NO: 83213 - DNA, 75 bp, Artificial Sequence
  Synthetic
tgaccccagattgaagacagactttgaagaggcaatcttctcaaaatatgtgggaaacaagattaccgaagtgga

SEQ ID NO: 83214 - DNA, 75 bp, Artificial Sequence
  Synthetic
gaagaggcaatcttctcaaaatatgtgggaaacaagattaccgaagtggatgagtacatgaaggaggctgtagat

SEQ ID NO: 83215 - DNA, 75 bp, Artificial Sequence
  Synthetic
actactgtgagtccaagagaaaatactaccccatcacagtttgtgggccaacattccagtacatggaggctaacg

SEQ ID NO: 83216 - DNA, 75 bp, Artificial Sequence
  Synthetic
tcctcagatgccaacatggagtgatgggcatcatcactgccggtggtgaaggagttgtggcttttgcagatatta

SEQ ID NO: 83217 - DNA, 75 bp, Artificial Sequence
  Synthetic
gatggactcgaagccttggacctcaccactagcgcagggtacccctacgtagcacttggtaagaagaagagggac

SEQ ID NO: 83218 - DNA, 75 bp, Artificial Sequence
  Synthetic
ccactagcgcagggtacccctacgtagcacttggtaagaagaagagggacattctaaataaacaaactagagaca

SEQ ID NO: 83219 - DNA, 75 bp, Artificial Sequence
  Synthetic
gggcatcatcactgccggtggtgaaggagttgtggcttttgcagatattagagacttatacatgtatgaggaaga

SEQ ID NO: 83220 - DNA, 75 bp, Artificial Sequence
  Synthetic
ggcaaacaaaatttcagagattcaaaacacagtccaaagtgtcctcacagaaaagcttctgaaaaatcttataaa

SEQ ID NO: 83221 - DNA, 75 bp, Artificial Sequence
  Synthetic
gaagtaagagcaaggtggaacagggaaaatccaggttgatagaggcttccagcttgaatgattcagtggcgatga

SEQ ID NO: 83222 - DNA, 75 bp, Artificial Sequence
  Synthetic
aaaatccaggttgatagaggcttccagcttgaatgattcagtggcgatgagaatggcttttggaaatttatacgc

SEQ ID NO: 83223 - DNA, 75 bp, Artificial Sequence
  Synthetic
aacacagtccaaagtgtcctcacagaaaagcttctgaaaaatcttataaaaattgtttcagctcttgttatagtg

SEQ ID NO: 83224 - DNA, 75 bp, Artificial Sequence
  Synthetic
tggctcaaggaaaaactctgcaatatgattggcgttccttacgtcatgaggcaaggagactcttggttgaagaag

SEQ ID NO: 83225 - DNA, 75 bp, Artificial Sequence
  Synthetic
tccagtgttgatggaggagaaactttttgcttttgattatacaggttatgatgcttctctcagtccagcatggtt

SEQ ID NO: 83226 - DNA, 75 bp, Artificial Sequence
  Synthetic
tttgcttttgattatacaggttatgatgcttctctcagtccagcatggttcgaggctctcaagatggtgctagag

SEQ ID NO: 83227 - DNA, 75 bp, Artificial Sequence
  Synthetic
tgattggcgttccttacgtcatgaggcaaggagactcttggttgaagaagttcacagaagcttgcaatgctgcaa

SEQ ID NO: 83228 - DNA, 75 bp, Artificial Sequence
  Synthetic
aagacaaattggaatacctttctaaattaaaacagcttgaaatgatagaaaaccaaatggccactttacatcaat

SEQ ID NO: 83229 - DNA, 75 bp, Artificial Sequence
  Synthetic
attaaaacagcttgaaatgatagaaaaccaaatggccactttacatcaatcatgccccagccaagaggaacagga

SEQ ID NO: 83230 - DNA, 75 bp, Artificial Sequence
  Synthetic
tagaatatttaaactggaaacatccattaacaattatgtacaattcaagaccaaacaccgcattgaaccagtatg

SEQ ID NO: 83231 - DNA, 75 bp, Artificial Sequence
  Synthetic
attaacaattatgtacaattcaagaccaaacaccgcattgaaccagtatgtttgttgattcatgggacccccggt

SEQ ID NO: 83232 - DNA, 75 bp, Artificial Sequence
  Synthetic
tacatccagtaatgccaatgaatgaaattcatgaatcaattagatggacaaaggatcctagaaacacccaggatc

SEQ ID NO: 83233 - DNA, 75 bp, Artificial Sequence
  Synthetic
cctccagatccctcacacttcgatggctacaagcaacagggagttgttatcatggatgacctgaatcagaaccca

SEQ ID NO: 83234 - DNA, 75 bp, Artificial Sequence
  Synthetic
gctacaagcaacagggagttgttatcatggatgacctgaatcagaacccagatggagaggatatgaaattgtttt

SEQ ID NO: 83235 - DNA, 75 bp, Artificial Sequence
  Synthetic
gcgtgccaattggaagagctttattgctccccgagtactcgacactgtaccgccgttggctcgattctttttagt

SEQ ID NO: 83236 - DNA, 75 bp, Artificial Sequence
  Synthetic
actatgtgcttgcttccaccaactccaacacaataacgcctcccacagtgtcagcttctgatgcgttatccagaa

SEQ ID NO: 83237 - DNA, 75 bp, Artificial Sequence
  Synthetic
caacacaataacgcctcccacagtgtcagcttctgatgcgttatccagaagattcgcttttgacatggacatata

SEQ ID NO: 83238 - DNA, 75 bp, Artificial Sequence
  Synthetic
accggcaaacttttccacttgttgccccttggtatgtgggaaagctattcagctgatggacaaaaacaccagaat

SEQ ID NO: 83239 - DNA, 75 bp, Artificial Sequence
  Synthetic
cccttggtatgtgggaaagctattcagctgatggacaaaaacaccagaatgaggtactcattggaccagattacc

SEQ ID NO: 83240 - DNA, 75 bp, Artificial Sequence
  Synthetic
gaattcaaagaccttaagattgacgtggtttccacgccaccaccctcagcaatatcagacctgctcaaatcagta

SEQ ID NO: 83241 - DNA, 75 bp, Artificial Sequence
  Synthetic
tggtttccacgccaccaccctcagcaatatcagacctgctcaaatcagtagataatcaagaagttagggattatt

SEQ ID NO: 83242 - DNA, 75 bp, Artificial Sequence
  Synthetic
gtatcctacaatcactctctacttttgcagtggtggcgggcatggtctatgtagtttacaagctttttgcaggat

SEQ ID NO: 83243 - DNA, 75 bp, Artificial Sequence
  Synthetic
tgcagtggtggcgggcatggtctatgtagtttacaagctttttgcaggattccagggcgcatacacaggactccc

SEQ ID NO: 83244 - DNA, 75 bp, Artificial Sequence
  Synthetic
ggctaaaaagaacatactcactgctaccacagagaagggtgagttcacaatgttgggtgtttatgacagggtagc

SEQ ID NO: 83245 - DNA, 75 bp, Artificial Sequence
  Synthetic
accacagagaagggtgagttcacaatgttgggtgtttatgacagggtagctgtactccccactcactcaaaccca

SEQ ID NO: 83246 - DNA, 75 bp, Artificial Sequence
  Synthetic
aatcttgaaattacaattgtaaccttagataggaatgaaaagtttagggatattagaactcacttaccaacccaa

SEQ ID NO: 83247 - DNA, 75 bp, Artificial Sequence
  Synthetic
tagataggaatgaaaagtttagggatattagaactcacttaccaacccaaatccatgagaccaatgatgcagttc

SEQ ID NO: 83248 - DNA, 75 bp, Artificial Sequence
  Synthetic
ttggaggtaagcccacaaacaggaccctaatgtataacttcccaaccaaggcaggacagtgtggtggtgtcctga

SEQ ID NO: 83249 - DNA, 75 bp, Artificial Sequence
  Synthetic
cctaatgtataacttcccaaccaaggcaggacagtgtggtggtgtcctgatggccaccggcaaagtgattggcat

SEQ ID NO: 83250 - DNA, 75 bp, Artificial Sequence
  Synthetic
gatccagtggatgagaccaagtaaagatgcaggctatcccatgattaatgcaccctcaaagacaaaattagaacc

SEQ ID NO: 83251 - DNA, 75 bp, Artificial Sequence
  Synthetic
gatgcaggctatcccatgattaatgcaccctcaaagacaaaattagaacctagtgttttctttgatgtcttccca

SEQ ID NO: 83252 - DNA, 75 bp, Artificial Sequence
  Synthetic
aaatacatcgggaacaaaattacagaggtggatgaatacatgaaggaagctgttgatcactacgctggtcagtta

SEQ ID NO: 83253 - DNA, 75 bp, Artificial Sequence
  Synthetic
aggtggatgaatacatgaaggaagctgttgatcactacgctggtcagttaatgtcccttgatatacccacagaac

SEQ ID NO: 83254 - DNA, 75 bp, Artificial Sequence
  Synthetic
aaactagggttgttgttccgttgtccacacccagaaagatggacatcctgggttttgtgtcagcttgcaatgact

SEQ ID NO: 83255 - DNA, 75 bp, Artificial Sequence
  Synthetic
cttatgtggctattggaaagaaaaagagagacattctcaacaaacaaacacgagataccaaggaaatgcagaaaa

SEQ ID NO: 83256 - DNA, 75 bp, Artificial Sequence
  Synthetic
gagagacattctcaacaaacaaacacgagataccaaggaaatgcagaaaatgttagacaagtatggaataaatct

SEQ ID NO: 83257 - DNA, 75 bp, Artificial Sequence
  Synthetic
agcgagctctttgaatgattcagttgctatgagacaggcttttggtcacctatacgccaagtttcatcagaaccc

SEQ ID NO: 83258 - DNA, 75 bp, Artificial Sequence
  Synthetic
gctatgagacaggcttttggtcacctatacgccaagtttcatcagaacccagggataataacaggctcagcagta

SEQ ID NO: 83259 - DNA, 75 bp, Artificial Sequence
  Synthetic
ggctatgacgcttcactctccccagcttggtttgaagccttgaaaatggtattggaaaagattggctttggtgat

SEQ ID NO: 83260 - DNA, 75 bp, Artificial Sequence
  Synthetic
atttgacatggatattcaagtcatgggcgaatactccagggatggaaagttgaacatggcgatggccacagagat

SEQ ID NO: 83261 - DNA, 75 bp, Artificial Sequence
  Synthetic
taaattgtactgtgttaaaggtggaatgccctcagggtgctccggcacctcaatttttaattcaatgatcaacaa

SEQ ID NO: 83262 - DNA, 75 bp, Artificial Sequence
  Synthetic
aatgattgcctatggtgatgatgtaattgcttcctatccccatgaggttgacgctagtctcctagcccaatcagg

SEQ ID NO: 83263 - DNA, 75 bp, Artificial Sequence
  Synthetic
tgccaatcggaagagctttattgctccctgagtactctacgttgtaccgccgttggctcgactcattttagtaac

SEQ ID NO: 83264 - DNA, 75 bp, Artificial Sequence
  Synthetic
ccagtgtggtttcgagcaagcacttctgttttcccggttgcgtcccatatgctgtgcaaacggcaaaaaggggca

SEQ ID NO: 83265 - DNA, 75 bp, Artificial Sequence
  Synthetic
gctgtgcaaacggcaaaaaggggcaatatcgttacccgcttgtatactacgggaaacctagtaccaccattgatt

SEQ ID NO: 83266 - DNA, 75 bp, Artificial Sequence
  Synthetic
ttccccggtgtagctcaggccgatgaggctcagaatcccccacaggtgactgtgtctgagcctgcgctggcggcc

SEQ ID NO: 83267 - DNA, 75 bp, Artificial Sequence
  Synthetic
aaccactgatcccacgcacgcaaaccagtgtgtagtgggtcgtaacgcgcaagtcggtggcggaaccaactactt

SEQ ID NO: 83268 - DNA, 75 bp, Artificial Sequence
  Synthetic
aagtcggtggcggaaccaactactttgggtgaccgtgtttcctttattacctattgaatgtttatggtgacaatt

SEQ ID NO: 83269 - DNA, 75 bp, Artificial Sequence
  Synthetic
accaaggggccctttttgtggctgcaatcccggagtttatgatggccagcaactcagcagataggactggtggta

SEQ ID NO: 83270 - DNA, 75 bp, Artificial Sequence
  Synthetic
aatcccggagtttatgatggccagcaactcagcagataggactggtggtattacctatgagaaagccaaccccgg

SEQ ID NO: 83271 - DNA, 75 bp, Artificial Sequence
  Synthetic
actcaatggtaaaacataacaattgggggattgtaattttacccttcgtgccacttaaatatgaggtcggtgcgt

SEQ ID NO: 83272 - DNA, 75 bp, Artificial Sequence
  Synthetic
gaatacaccgggttctaaccagtttcttaccacagacaactttcagtccccgtgtatagtcccgaattacgatgt

SEQ ID NO: 83273 - DNA, 75 bp, Artificial Sequence
  Synthetic
gaatgctacgccaggtaacattaataaaatggaggcgtaccccattccactcgctcagggtgctccagcaaagga

SEQ ID NO: 83274 - DNA, 75 bp, Artificial Sequence
  Synthetic
tcaagcaatatttgccttaagcctgagcccggcctctgataaaaggttgtcacgcacacttttgggcgagattct

SEQ ID NO: 83275 - DNA, 75 bp, Artificial Sequence
  Synthetic
tttgttagcgcgtgcaatgatttttcagcgagacttctacgtgattccccctttgtgcgacagcttgagacggcg

SEQ ID NO: 83276 - DNA, 75 bp, Artificial Sequence
  Synthetic
cagcgagacttctacgtgattccccctttgtgcgacagcttgagacggcgtggaaacaaggtgtagaggacaagc

SEQ ID NO: 83277 - DNA, 75 bp, Artificial Sequence
  Synthetic
agacccgacatgtgataaacaaaaggcaaagatcagagtgcactgtggagtccttcttggggagggctgcgttag

SEQ ID NO: 83278 - DNA, 75 bp, Artificial Sequence
  Synthetic
gttactactacgcataccaactgcgcaggaagcttgaaatgttcacctattccagatttgatatcgagcttacct

SEQ ID NO: 83279 - DNA, 75 bp, Artificial Sequence
  Synthetic
cgggggccccggtgccgagtaagtgggatgatttcacatggcaaacctccacaaacccatctgtattttacacca

SEQ ID NO: 83280 - DNA, 75 bp, Artificial Sequence
  Synthetic
gcttattcgcacttttatgatgggttttccgcagtgccacatgacagcattagcgctggagcaacaaacaagtac

SEQ ID NO: 83281 - DNA, 75 bp, Artificial Sequence
  Synthetic
ggttacaacaccattaatgactttggaaccgtggctgtgcgtattgtgaatgagcatgacccagttaaaatagaa

SEQ ID NO: 83282 - DNA, 75 bp, Artificial Sequence
  Synthetic
ttaaaaaaacttggggggtttttccccccccggggttccccgggagtccgtaccccggcatcctggggcccttgt

SEQ ID NO: 83283 - DNA, 75 bp, Artificial Sequence
  Synthetic
accgggccatcggttgactacaaacaaaacaacactgtgatggagcaggtcgcaactatacgcacctttggtttt

SEQ ID NO: 83284 - DNA, 75 bp, Artificial Sequence
  Synthetic
atactacccagtaactgtggagggtccaacttttaggtacatggatgctaatgagtactaccccgcccgatacca

SEQ ID NO: 83285 - DNA, 75 bp, Artificial Sequence
  Synthetic
tttgcaatgccgggcgactgtggaggaattctacgatgcacccatggggtaatgggcttgattactgctggtggt

SEQ ID NO: 83286 - DNA, 75 bp, Artificial Sequence
  Synthetic
gaaggggttgttgcattcgcagatgtgagagacctgtttgcatatgaagaagaggccatggaacaaggtatcact

SEQ ID NO: 83287 - DNA, 75 bp, Artificial Sequence
  Synthetic
caagtaatgcggctacaaaaatggatttttctcaagacccgtctaagttcacggaaccggtgaaggacgtgatga

SEQ ID NO: 83288 - DNA, 75 bp, Artificial Sequence
  Synthetic
caggaaactgttcagaatgttatcactgagaagttgctcaagaacctagttaagatagtgtccgcactagtgata

SEQ ID NO: 83289 - DNA, 75 bp, Artificial Sequence
  Synthetic
acatactaggcattccatatgcaataaaacagggtgattcctggatgaagaagttttcagatgcatgcaacgcgg

SEQ ID NO: 83290 - DNA, 75 bp, Artificial Sequence
  Synthetic
gaaaataggcaagtttattgattggataaaaaccaaaattttgccagaagcacaagataaagtagagtatttgtc

SEQ ID NO: 83291 - DNA, 75 bp, Artificial Sequence
  Synthetic
tggttggccataaaggcgagaaagtttgctcccttatacgccagcgaggcacgtcgcatttttaagatggagagt

SEQ ID NO: 83292 - DNA, 75 bp, Artificial Sequence
  Synthetic
agaccaaacaccgcattgaacctgtatgtttgctaatccacggaacacctggtactggtaagtctatagcaacgg

SEQ ID NO: 83293 - DNA, 75 bp, Artificial Sequence
  Synthetic
gattatggatgatctcaatcaaaacccagacggggaggatatgaaacttttctgtcagatggtgtcgacggtgga

SEQ ID NO: 83294 - DNA, 75 bp, Artificial Sequence
  Synthetic
ctcatacaccatatcaccaccaacgatatcagcctcagatgcgttgaccagacgctttgcgtttgacgtagacat

SEQ ID NO: 83295 - DNA, 75 bp, Artificial Sequence
  Synthetic
atatcagcctcagatgcgttgaccagacgctttgcgtttgacgtagacattgaggtgatgtcacaatacaataac

SEQ ID NO: 83296 - DNA, 75 bp, Artificial Sequence
  Synthetic
tgccctttagtgtgtggaaaggccatccaatttgtagacaaaatgacacgcaccagatacaccatagatgagctg

SEQ ID NO: 83297 - DNA, 75 bp, Artificial Sequence
  Synthetic
tccaatttgtagacaaaatgacacgcaccagatacaccatagatgagctgaccacattgatcataaacgagagga

SEQ ID NO: 83298 - DNA, 75 bp, Artificial Sequence
  Synthetic
acataaagacaacacccccaccacccgctatagcggacttgctccgatctgttgacagtgatcaggtgcgagagt

SEQ ID NO: 83299 - DNA, 75 bp, Artificial Sequence
  Synthetic
tgacaattgtgcaggccatttcttcctttgtggttgtctctggcatgttgtttattatttacaaattgtttgcca

SEQ ID NO: 83300 - DNA, 75 bp, Artificial Sequence
  Synthetic
ctttgtggttgtctctggcatgttgtttattatttacaaattgtttgccaacttccaaggggcgtacacgggttt

SEQ ID NO: 83301 - DNA, 75 bp, Artificial Sequence
  Synthetic
gcaacaacggacaagggcgagtttactatgctgggtatttatgaccgagtagctgtgttaccaacccattccagc

SEQ ID NO: 83302 - DNA, 75 bp, Artificial Sequence
  Synthetic
tgtctccccggtgaggttacatagactgtccccgcggttgaaagtaaccgatccgttatccgctcttgtccttcg

SEQ ID NO: 83303 - DNA, 75 bp, Artificial Sequence
  Synthetic
cccaaacatgtatatcccagtaggagctgtcactgagcaaggaatgctaaatttggggggtagacccaccaaccg

SEQ ID NO: 83304 - DNA, 75 bp, Artificial Sequence
  Synthetic
gctgtcactgagcaaggaatgctaaatttggggggtagacccaccaaccgaactttgatgtacaacttccccact

SEQ ID NO: 83305 - DNA, 75 bp, Artificial Sequence
  Synthetic
agcctattgagctacaagagagtcctccggcccctgaatgcggctaatcccaaccacggagcaggtgacttcaag

SEQ ID NO: 83306 - DNA, 75 bp, Artificial Sequence
  Synthetic
catgggttcgccgccgcactgaaaaggtcatatttcaccagtgaacaaggtgaaatacaatggatgaggcccagt

SEQ ID NO: 83307 - DNA, 75 bp, Artificial Sequence
  Synthetic
acacccccaacaaaaccaagctacagcctagcgtgttttacaatgtgttcccgggcgttaaggaacctgcagttt

SEQ ID NO: 83308 - DNA, 75 bp, Artificial Sequence
  Synthetic
attggattggccatccggtgagaatcagatcagttacttacctgtttgttggattcactccgttgacactttaca

SEQ ID NO: 83309 - DNA, 75 bp, Artificial Sequence
  Synthetic
cagaagtggatgaatatatgaaggaagccgtagaccattatgctggtcagctaatgtcactggacatccccacag

SEQ ID NO: 83310 - DNA, 75 bp, Artificial Sequence
  Synthetic
attatcataatgggtgctcaggtatcatcacaaaaagtcggtgctcatgagaatactaatgtggccactggcggg

SEQ ID NO: 83311 - DNA, 75 bp, Artificial Sequence
  Synthetic
catcacaaaaagtcggtgctcatgagaatactaatgtggccactggcgggtcgacagtcaactatactaccatca

SEQ ID NO: 83312 - DNA, 75 bp, Artificial Sequence
  Synthetic
cagttaaagacataatgttgaaatcagccccggctctgaattcgcctaacattgaggcctgtgggtacagtgata

SEQ ID NO: 83313 - DNA, 75 bp, Artificial Sequence
  Synthetic
agccccggctctgaattcgcctaacattgaggcctgtgggtacagtgatagagtaatgcaattgacacttgggaa

SEQ ID NO: 83314 - DNA, 75 bp, Artificial Sequence
  Synthetic
ggaagctaaccctgttgatcaaccaactgagccggacgtgtccgcatgtcgtttttacacattggacacagtcaa

SEQ ID NO: 83315 - DNA, 75 bp, Artificial Sequence
  Synthetic
actgagccggacgtgtccgcatgtcgtttttacacattggacacagtcaattggaacaaggcttcgaggggatgg

SEQ ID NO: 83316 - DNA, 75 bp, Artificial Sequence
  Synthetic
tcaggatacactgtacatgtgcaatgcaatgcatccaaattccatcaaggagcactaggagttttcgccatccca

SEQ ID NO: 83317 - DNA, 75 bp, Artificial Sequence
  Synthetic
cagcttggtttgaagccctcaaaatggtgctagagaagatagggtatggtgatcgcgtggattacatagattacc

SEQ ID NO: 83318 - DNA, 75 bp, Artificial Sequence
  Synthetic
gcaatgcatccaaattccatcaaggagcactaggagttttcgccatcccagaatactgcatggcgtgcaacactg

SEQ ID NO: 83319 - DNA, 75 bp, Artificial Sequence
  Synthetic
catccattttcaacacaatgattaacaacataatcattagaactctcctacttaaaacatacaaaggggtagacc

SEQ ID NO: 83320 - DNA, 75 bp, Artificial Sequence
  Synthetic
atcccagcaataacatcacgggggcacgcaaatttgcagcagtggactacttattaggttgtggtgttctagccg

SEQ ID NO: 83321 - DNA, 75 bp, Artificial Sequence
  Synthetic
acgcaaatttgcagcagtggactacttattaggttgtggtgttctagccggcaacgcctttgtctttccacacca

SEQ ID NO: 83322 - DNA, 75 bp, Artificial Sequence
  Synthetic
ggccaaacacaataactggggaattgcaatattaccactagctgagcttgattttgccgaggcttcttcaaccga

SEQ ID NO: 83323 - DNA, 75 bp, Artificial Sequence
  Synthetic
gcaatattaccactagctgagcttgattttgccgaggcttcttcaaccgaggtgcccattacaatcaccattgcg

SEQ ID NO: 83324 - DNA, 75 bp, Artificial Sequence
  Synthetic
gtttttccgtgctgatgaacaattcccttacctaatacacccagttatgccaatgacagaaatacaagagtcaat

SEQ ID NO: 83325 - DNA, 75 bp, Artificial Sequence
  Synthetic
tcgttggactaaagatccaaagaatacacaagatcacgtgcgttctctatgcctactggcttggcacaatggagc

SEQ ID NO: 83326 - DNA, 75 bp, Artificial Sequence
  Synthetic
cctggtagtaatcagtttttgtcatctgacaactttcagtcaccgtgtgcactaccagaatttgatgtgacacca

SEQ ID NO: 83327 - DNA, 75 bp, Artificial Sequence
  Synthetic
ctgacaactttcagtcaccgtgtgcactaccagaatttgatgtgacaccacccatccatataccaggtgaagtca

SEQ ID NO: 83328 - DNA, 75 bp, Artificial Sequence
  Synthetic
cacaacactgcgccgccgctggctagactctttctgatcaaccatacctcactcgaattggtctgagagatagtg

SEQ ID NO: 83329 - DNA, 75 bp, Artificial Sequence
  Synthetic
gaatgtacagagttgagttgggtacttccaaatcacaaacagcacccatattgtgcctcagtttgagcccagcca

SEQ ID NO: 83330 - DNA, 75 bp, Artificial Sequence
  Synthetic
ttccaaatcacaaacagcacccatattgtgcctcagtttgagcccagccagtgaacaacgcttggggtacaccat

SEQ ID NO: 83331 - DNA, 75 bp, Artificial Sequence
  Synthetic
gatggcaacgggtaagatcctgatttcatatgcaccaccaggtgcaaaaccacccaagaccaggaaggaagccat

SEQ ID NO: 83332 - DNA, 75 bp, Artificial Sequence
  Synthetic
tcatatgcaccaccaggtgcaaaaccacccaagaccaggaaggaagccatgcttggcacacacatcatttgggac

SEQ ID NO: 83333 - DNA, 75 bp, Artificial Sequence
  Synthetic
gatttcactgaaggaggttacatctcaatgttctaccagacaaaaatagtagtgcccctatcaacaccaacaacc

SEQ ID NO: 83334 - DNA, 75 bp, Artificial Sequence
  Synthetic
caatgttctaccagacaaaaatagtagtgcccctatcaacaccaacaaccatgacactcctcagcttcgtgtcgg

SEQ ID NO: 83335 - DNA, 75 bp, Artificial Sequence
  Synthetic
ggccaatagaggagatcatctcgaccgtcgccagcaatgcacttgccctcagtcagcctaaaccggtggataatt

SEQ ID NO: 83336 - DNA, 75 bp, Artificial Sequence
  Synthetic
cgtcgccagcaatgcacttgccctcagtcagcctaaaccggtggataattctgtacaaaacacccaacagagcgc

SEQ ID NO: 83337 - DNA, 75 bp, Artificial Sequence
  Synthetic
tctagtgcaaaccaggcatgtagtgaatgtcaagtccagatctgagtccactatcgagtcgttctttgcaagagc

SEQ ID NO: 83338 - DNA, 75 bp, Artificial Sequence
  Synthetic
aatgtcaagtccagatctgagtccactatcgagtcgttctttgcaagagctgcctgcgtgactattatgcaggtt

SEQ ID NO: 83339 - DNA, 75 bp, Artificial Sequence
  Synthetic
gtacaattgaggaggaaattggaatttttcacgtactccaggttcgatcttgagatgactttcgtgctaactgaa

SEQ ID NO: 83340 - DNA, 75 bp, Artificial Sequence
  Synthetic
ttttcacgtactccaggttcgatcttgagatgactttcgtgctaactgaaagatactattctcagagctcgggac

SEQ ID NO: 83341 - DNA, 75 bp, Artificial Sequence
  Synthetic
cgtggcagacgtcttctaacccatcaattttcttcaccactggtaacgcacccccacgggtttcaatcccatttg

SEQ ID NO: 83342 - DNA, 75 bp, Artificial Sequence
  Synthetic
aattttcttcaccactggtaacgcacccccacgggtttcaatcccatttgtgggcattgcaaatgcttactcaca

SEQ ID NO: 83343 - DNA, 75 bp, Artificial Sequence
  Synthetic
ttctatcaatgactttggaacacttgcagtaagagtggtcaatgactacaacccagcgagagtggagacaaggat

SEQ ID NO: 83344 - DNA, 75 bp, Artificial Sequence
  Synthetic
gcagtaagagtggtcaatgactacaacccagcgagagtggagacaaggatcagagtctacatgaaacctaagcat

SEQ ID NO: 83345 - DNA, 75 bp, Artificial Sequence
  Synthetic
gtgacgcccctatctaagcatgaattgacaacgtacggattcggacaccagaacaaggcagtatacacagcaggt

SEQ ID NO: 83346 - DNA, 75 bp, Artificial Sequence
  Synthetic
tgacaacgtacggattcggacaccagaacaaggcagtatacacagcaggttacaaaatttgcaattaccatctag

SEQ ID NO: 83347 - DNA, 75 bp, Artificial Sequence
  Synthetic
aaggcactgactcaatagccagatgtacttgtaacgcaggtgtatattactgtgaatcaaggagaaaatactacc

SEQ ID NO: 83348 - DNA, 75 bp, Artificial Sequence
  Synthetic
tacttgtaacgcaggtgtatattactgtgaatcaaggagaaaatactacccagtgtccttcgtgggtcccacttt

SEQ ID NO: 83349 - DNA, 75 bp, Artificial Sequence
  Synthetic
accgggggactgtggcggcatcctcaggtgtcaacatggagtgataggaattattacagctggaggagagggact

SEQ ID NO: 83350 - DNA, 75 bp, Artificial Sequence
  Synthetic
aggtgtcaacatggagtgataggaattattacagctggaggagagggactggttgcattttcagacattagagat

SEQ ID NO: 83351 - DNA, 75 bp, Artificial Sequence
  Synthetic
agtggattcacacaacagattggggataagatctcagaactcaccagcatggtcacaagcactatcacagagaag

SEQ ID NO: 83352 - DNA, 75 bp, Artificial Sequence
  Synthetic
ataagatctcagaactcaccagcatggtcacaagcactatcacagagaagctacttaagaacttgatcaaaataa

SEQ ID NO: 83353 - DNA, 75 bp, Artificial Sequence
  Synthetic
ccagggccattgctgagaaagaaaacacctccacttactcgctacctccagacccctcacactttgatggttaca

SEQ ID NO: 83354 - DNA, 75 bp, Artificial Sequence
  Synthetic
gtgacatgtctccatggcagtggcttaaaaagaaagcctgtgacatcttggaaatcccgtacgtggttagacaag

SEQ ID NO: 83355 - DNA, 75 bp, Artificial Sequence
  Synthetic
taaaaagaaagcctgtgacatcttggaaatcccgtacgtggttagacaaggagatagttggttgaagaaatttac

SEQ ID NO: 83356 - DNA, 75 bp, Artificial Sequence
  Synthetic
ctgaatatggccatggccaccgagatgtgcaaaaattgtcatcaaccagcaaacttcaagaggtgttgtcctcta

SEQ ID NO: 83357 - DNA, 75 bp, Artificial Sequence
  Synthetic
aaagattataccgcaagctagagataaattggaatttgtgaccaagctcaagcaattagaaatgttggaaaacca

SEQ ID NO: 83358 - DNA, 75 bp, Artificial Sequence
  Synthetic
aaattggaatttgtgaccaagctcaagcaattagaaatgttggaaaaccagatttctactatccatcaatcatgt

SEQ ID NO: 83359 - DNA, 75 bp, Artificial Sequence
  Synthetic
ctttatgcagttgaggcaaagagaatacaaaaattggagcacaccataaacaactacatacagttcaagagcaaa

SEQ ID NO: 83360 - DNA, 75 bp, Artificial Sequence
  Synthetic
tacaaaaattggagcacaccataaacaactacatacagttcaagagcaaacaccgtattgagccagtatgtttat

SEQ ID NO: 83361 - DNA, 75 bp, Artificial Sequence
  Synthetic
aagcagtgacaaccttcgctgcagtggccggtgttgtgtacgttatgtacaaattgtttgctggacaccagggtg

SEQ ID NO: 83362 - DNA, 75 bp, Artificial Sequence
  Synthetic
acacatcaacatactcgttgccccccgacccctcacacttcgatggatacaaacagcaaggagtagtgattatgg

SEQ ID NO: 83363 - DNA, 75 bp, Artificial Sequence
  Synthetic
cgacccctcacacttcgatggatacaaacagcaaggagtagtgattatggatgacttgaaccaaaacccagatgg

SEQ ID NO: 83364 - DNA, 75 bp, Artificial Sequence
  Synthetic
acacatacccacacaaatcactgagacaaatgatggagttttgatcgtgaacactagtaagtaccccaacatgta

SEQ ID NO: 83365 - DNA, 75 bp, Artificial Sequence
  Synthetic
acaaatgatggagttttgatcgtgaacactagtaagtaccccaacatgtatgtcccagttggtgctgtgaccgaa

SEQ ID NO: 83366 - DNA, 75 bp, Artificial Sequence
  Synthetic
aggcatattgttcacctcaaattatgtcctggcctccaccaattcgagtaggatcgcaccacccacagtagcaca

SEQ ID NO: 83367 - DNA, 75 bp, Artificial Sequence
  Synthetic
gtcctggcctccaccaattcgagtaggatcgcaccacccacagtagcacacagtgatgcattggccaggcgcttt

SEQ ID NO: 83368 - DNA, 75 bp, Artificial Sequence
  Synthetic
acccaagactcaaaacagagtttgaagaggctatcttttccaagtatgtaggaaacaagatcactgaggtggacg

SEQ ID NO: 83369 - DNA, 75 bp, Artificial Sequence
  Synthetic
atgtgcaaaaattgtcatcaaccggcaaacttcaaaagatgttgcccactggtgtgtggaaaagccatacagcta

SEQ ID NO: 83370 - DNA, 75 bp, Artificial Sequence
  Synthetic
caaacttcaaaagatgttgcccactggtgtgtggaaaagccatacagctaatggataaggcatccagagtcaggt

SEQ ID NO: 83371 - DNA, 75 bp, Artificial Sequence
  Synthetic
cactctttcaaggtcctcttcaatacaaagacttgaaaatagacatcaagaccacacctccccccgagtgtatca

SEQ ID NO: 83372 - DNA, 75 bp, Artificial Sequence
  Synthetic
caaagacttgaaaatagacatcaagaccacacctccccccgagtgtatcaatgatctgctccaggcggtcgattc

SEQ ID NO: 83373 - DNA, 75 bp, Artificial Sequence
  Synthetic
tatcaacagggcaatgaccatcctgcaagcagtcacaacatttgccgcggttgctggagtggtgtatgtgatgta

SEQ ID NO: 83374 - DNA, 75 bp, Artificial Sequence
  Synthetic
caagcagtcacaacatttgccgcggttgctggagtggtgtatgtgatgtacaagctcttcgcagggcaccaagga

SEQ ID NO: 83375 - DNA, 75 bp, Artificial Sequence
  Synthetic
gactatgcagtagccatggcaaagaggaacattctcacagcaactaccagtaagggagaattcacaatgcttgga

SEQ ID NO: 83376 - DNA, 75 bp, Artificial Sequence
  Synthetic
gaggtgttggatgccaaggctctggaggaccaggccgggaccaacctagaaattaccattatcactcttaaaaga

SEQ ID NO: 83377 - DNA, 75 bp, Artificial Sequence
  Synthetic
atgttcctgttggtgctgtgactgagcagggatatctcaatctcggtggacgccagactgctcgcaccctgatgt

SEQ ID NO: 83378 - DNA, 75 bp, Artificial Sequence
  Synthetic
gtgggaacggttcacatgggttcgcagcagccctaaaacgatcctatttcactcagagtcaaggtgagatccagt

SEQ ID NO: 83379 - DNA, 75 bp, Artificial Sequence
  Synthetic
aaaaccaaactggagcccagtgcattccactatgtgtttgaaggtgttaaggagccagctgtccttaccaaaaat

SEQ ID NO: 83380 - DNA, 75 bp, Artificial Sequence
  Synthetic
gccatgggaaagaagaaaagagacatcttaaataaacagaccagggacactaaagaaatgcagaggttactggac

SEQ ID NO: 83381 - DNA, 75 bp, Artificial Sequence
  Synthetic
aaatccaggttgatagaagcctcaagtttgaatgactcggtggcaatgagaatggcatttggtaacttgtatgca

SEQ ID NO: 83382 - DNA, 75 bp, Artificial Sequence
  Synthetic
gtttgaatgactcggtggcaatgagaatggcatttggtaacttgtatgcagctttccacaagaatccaggtgtgg

SEQ ID NO: 83383 - DNA, 75 bp, Artificial Sequence
  Synthetic
ttgcatttgattacacaggatatgatgcatcactcagtcccgcttggtttgaggctctcaaaatggtattagaga

SEQ ID NO: 83384 - DNA, 75 bp, Artificial Sequence
  Synthetic
agattggatttggtgatagggtggactacatagattatctaaatcactctcaccacctctacaaaaacaaaacct

SEQ ID NO: 83385 - DNA, 75 bp, Artificial Sequence
  Synthetic
tcaggacacttttactgaaaacctacaagggcatagatttagaccacctaaaaatgatagcctatggtgatgatg

SEQ ID NO: 83386 - DNA, 75 bp, Artificial Sequence
  Synthetic
aaaatgatagcctatggtgatgatgtaattgcttcctacccccatgaggttgacgctagtctcctagcccaatca

SEQ ID NO: 83387 - DNA, 75 bp, Artificial Sequence
  Synthetic
caaccacccgggcacagaaactatttgccacgtggcgcattacatacaaagatacagtgcagttgcgccgtaagt

SEQ ID NO: 83388 - DNA, 75 bp, Artificial Sequence
  Synthetic
ttttgatcagttgttgccattgctcgcattcagtgtgcaattacaaaaacaaaactatcagttgttaccatccct

SEQ ID NO: 83389 - DNA, 75 bp, Artificial Sequence
  Synthetic
ctggtggctcaaccatcaactacactactattaattactacaaagacagtgctagtaatgcggcgacaaagatgg

SEQ ID NO: 83390 - DNA, 75 bp, Artificial Sequence
  Synthetic
aatcaacaattacatacagttcaagagcaaacaccgtattgaaccagtatgtttattggtgcacggcagtcctgg

SEQ ID NO: 83391 - DNA, 75 bp, Artificial Sequence
  Synthetic
atcacttacgagcgggccaaccccggtgaagcgggaggtaagtttcagaaaagctttaccccctcaagtactgcg

SEQ ID NO: 83392 - DNA, 75 bp, Artificial Sequence
  Synthetic
ggaaaagggcattttgttcacgtcgaattacgtcttggcttccaccaattctagccgcattacaccaccaacagt

SEQ ID NO: 83393 - DNA, 75 bp, Artificial Sequence
  Synthetic
aaggaggccatgcttggtacacacctaatatgggacattgggctacagtccagtgcaacattagtagccccatgg

SEQ ID NO: 83394 - DNA, 75 bp, Artificial Sequence
  Synthetic
aaggaggccatgcttggtactcacctaatatgggacattgggctacagtccagtgcaacattagtagccccatgg

SEQ ID NO: 83395 - DNA, 75 bp, Artificial Sequence
  Synthetic
aaggaggccatgcttggtacccacctaatatgggacattgggctacagtccagtgcaacattagtagccccatgg

SEQ ID NO: 83396 - DNA, 75 bp, Artificial Sequence
  Synthetic
aaggaggccatgcttggtacgcacctaatatgggacattgggctacagtccagtgcaacattagtagccccatgg

SEQ ID NO: 83397 - DNA, 75 bp, Artificial Sequence
  Synthetic
gttgcagtcataggacttagcaacaaagaaccaaccgatggtaacgcaaaggacctgtttgccaagtggaagatt

SEQ ID NO: 83398 - DNA, 75 bp, Artificial Sequence
  Synthetic
gtttgcagcggccctaaagcgatcatacttcactcaaagtcaaggtgaaattcaatggataagaccttccaaaga

SEQ ID NO: 83399 - DNA, 75 bp, Artificial Sequence
  Synthetic
attttgaagaagccattttctcaaaatatgtaggcaacaagatcacagaggtggatgaatacatgagggaagcag

SEQ ID NO: 83400 - DNA, 75 bp, Artificial Sequence
  Synthetic
gcactgatggtcttgaagcattagatctcagcactagcgctggttatccttatgtggcaatgggaaagaagaaaa

SEQ ID NO: 83401 - DNA, 75 bp, Artificial Sequence
  Synthetic
gggggtatattaagatgcacccacggtgtgatgggactcattacagcaggtggtgaaggagtagtagcctttgct

SEQ ID NO: 83402 - DNA, 75 bp, Artificial Sequence
  Synthetic
caatcaggaaaagactatggactaaccatgactccagctgataaatcagcaacctttgaaaaagtcacatgggag

SEQ ID NO: 83403 - DNA, 75 bp, Artificial Sequence
  Synthetic
tgtaccgccgttggctcgactctttttagtaaccctacctcagtcgaattggattgggtcatactgttgtagggg

SEQ ID NO: 83404 - DNA, 75 bp, Artificial Sequence
  Synthetic
taccaccacgaacaagcatttctgtttccccggtgatgttgtatagactgcccgcgcggttgaaagcaacggatc

SEQ ID NO: 83405 - DNA, 75 bp, Artificial Sequence
  Synthetic
tggtccaggctgcgttggcggcctacctatggctaacgccataggacgctagttgtgaacaaggtgtgaagagcc

SEQ ID NO: 83406 - DNA, 75 bp, Artificial Sequence
  Synthetic
gtgtccgtgtttccttttatttttattatggctgcttatggtgacaatcattgattgttatcataaagcgaattg

SEQ ID NO: 83407 - DNA, 75 bp, Artificial Sequence
  Synthetic
ttatggctgcttatggtgacaatcattgattgttatcataaagcgaattggattggccatccggtgaaagcgaga

SEQ ID NO: 83408 - DNA, 75 bp, Artificial Sequence
  Synthetic
ttgattgttatcataaagcgaattggattggccatccggtgaaagcgagacttactatttacttacttgttggac

SEQ ID NO: 83409 - DNA, 75 bp, Artificial Sequence
  Synthetic
gcgcaagtttcatcacagaaagtgggtgcacacgagaacactaatgttgcaaccggcggatcaaccgtgaactac

SEQ ID NO: 83410 - DNA, 75 bp, Artificial Sequence
  Synthetic
gtgcacacgagaacactaatgttgcaaccggcggatcaaccgtgaactacacaactatcaactactacaaggaca

SEQ ID NO: 83411 - DNA, 75 bp, Artificial Sequence
  Synthetic
tgctgaagtcggcacctgcgttgaattcacccaacgtagaagcctgcgggtacagcgatagagttttgcagttga

SEQ ID NO: 83412 - DNA, 75 bp, Artificial Sequence
  Synthetic
ttcacccaacgtagaagcctgcgggtacagcgatagagttttgcagttgacattgggaaattccaccatcaccac

SEQ ID NO: 83413 - DNA, 75 bp, Artificial Sequence
  Synthetic
ggaccagccaactgaaccagatgtgtcagcttgtcgattttacacgctgcaatcggtcgagtggaagactgaatc

SEQ ID NO: 83414 - DNA, 75 bp, Artificial Sequence
  Synthetic
tcagcttgtcgattttacacgctgcaatcggtcgagtggaagactgaatccaagggatggtggtggaaattacca

SEQ ID NO: 83415 - DNA, 75 bp, Artificial Sequence
  Synthetic
ttagggatattcgtgcccacttgcccaccacaatccaggaaaccaatgatgcagtactagccgttaacaccagta

SEQ ID NO: 83416 - DNA, 75 bp, Artificial Sequence
  Synthetic
caccacaatccaggaaaccaatgatgcagtactagccgttaacaccagtaagtaccctaacatgttcattcccgt

SEQ ID NO: 83417 - DNA, 75 bp, Artificial Sequence
  Synthetic
cacgtacagtgcaatgcttcaaaattccaccaaggtgcactgggtgtatttgccgtgcctgagtattgtttggca

SEQ ID NO: 83418 - DNA, 75 bp, Artificial Sequence
  Synthetic
tccaccaaggtgcactgggtgtatttgccgtgcctgagtattgtttggcaggggatagtgatgtcaaaaactcat

SEQ ID NO: 83419 - DNA, 75 bp, Artificial Sequence
  Synthetic
caacaagaaagttctgccccattgattatttgtttgggtgcggtgtgttaactggcaacgcctttgtgtttcctc

SEQ ID NO: 83420 - DNA, 75 bp, Artificial Sequence
  Synthetic
ttatttgtttgggtgcggtgtgttaactggcaacgcctttgtgtttcctcatcaaattatcaacctgaggacgaa

SEQ ID NO: 83421 - DNA, 75 bp, Artificial Sequence
  Synthetic
actcgccattatcccactgagtaaattgcaattccccgatacttccagcactgaaattccaatcacagtgacaat

SEQ ID NO: 83422 - DNA, 75 bp, Artificial Sequence
  Synthetic
ttgcaattccccgatacttccagcactgaaattccaatcacagtgacaattgcaccaatgtgctgtgaatttaat

SEQ ID NO: 83423 - DNA, 75 bp, Artificial Sequence
  Synthetic
acatcagacaacttccaatcaccttgtgccctgcccgagtttgatgtcacacaagccattaacattcctggggag

SEQ ID NO: 83424 - DNA, 75 bp, Artificial Sequence
  Synthetic
gtgccctgcccgagtttgatgtcacacaagccattaacattcctggggaggtgaaaaacattatggagatagctg

SEQ ID NO: 83425 - DNA, 75 bp, Artificial Sequence
  Synthetic
ccaccagtgcagatctggacaaacctattctgtgtttgtctttatcaccagcatcagatgagaggctatcttaca

SEQ ID NO: 83426 - DNA, 75 bp, Artificial Sequence
  Synthetic
tattctgtgtttgtctttatcaccagcatcagatgagaggctatcttacaccatgctgggtgaaattttgaacta

SEQ ID NO: 83427 - DNA, 75 bp, Artificial Sequence
  Synthetic
gatagcgtacgcgcccccgggtgcaaaaccaccaagaaccagaaaggaagcaatgctgggcacccatgttatctg

SEQ ID NO: 83428 - DNA, 75 bp, Artificial Sequence
  Synthetic
aaaccaccaagaaccagaaaggaagcaatgctgggcacccatgttatctgggatgtaggactacaatcatcatgt

SEQ ID NO: 83429 - DNA, 75 bp, Artificial Sequence
  Synthetic
atctcaatgttttatcagaccaaaattgtggttccagcttccacaccgacaaatatggacattttgggatttgcg

SEQ ID NO: 83430 - DNA, 75 bp, Artificial Sequence
  Synthetic
ttgtggttccagcttccacaccgacaaatatggacattttgggatttgcgtccgcatgtaatgacttttcagtgc

SEQ ID NO: 83431 - DNA, 75 bp, Artificial Sequence
  Synthetic
caagcaacgctctgaagttgtcacaaccaaaacccagcacacaacagagtttaccaaacactagtagctcagaac

SEQ ID NO: 83432 - DNA, 75 bp, Artificial Sequence
  Synthetic
accaaaacccagcacacaacagagtttaccaaacactagtagctcagaaccaactcactctcaggaagcgccggc

SEQ ID NO: 83433 - DNA, 75 bp, Artificial Sequence
  Synthetic
aacacgtagccgaagtgagtctacagttgagtcattctttgctcggggggcgtgtgtaacaatcatgtcagtgga

SEQ ID NO: 83434 - DNA, 75 bp, Artificial Sequence
  Synthetic
gttgagtcattctttgctcggggggcgtgtgtaacaatcatgtcagtggaaaattacaatgaaaccgctatcgca

SEQ ID NO: 83435 - DNA, 75 bp, Artificial Sequence
  Synthetic
acatactccagatttgatattgagttcacatttgtggtgactgagcgttaccactccgcaaactcaggtcatgca

SEQ ID NO: 83436 - DNA, 75 bp, Artificial Sequence
  Synthetic
tcacatttgtggtgactgagcgttaccactccgcaaactcaggtcatgcactaaatcaagtttaccagatcatgt

SEQ ID NO: 83437 - DNA, 75 bp, Artificial Sequence
  Synthetic
tttatacctatggtacagcaccagccagaatatcgattccatatgtaggcatagccaatgcctactcgcattttt

SEQ ID NO: 83438 - DNA, 75 bp, Artificial Sequence
  Synthetic
cagaatatcgattccatatgtaggcatagccaatgcctactcgcatttttatgatggcttcgccaaagtgcccat

SEQ ID NO: 83439 - DNA, 75 bp, Artificial Sequence
  Synthetic
acgtgtggtcaacgaacacaatccagtgcaagtttcttccaagattagagtgttcatgaaacctaaacatgtgcg

SEQ ID NO: 83440 - DNA, 75 bp, Artificial Sequence
  Synthetic
gtgcaagtttcttccaagattagagtgttcatgaaacctaaacatgtgcgcgtttggtgtcccagaccacctaga

SEQ ID NO: 83441 - DNA, 75 bp, Artificial Sequence
  Synthetic
acctatggatttggtcaccaaaataaagcagtttacacagctggttacaagatttgcaattaccaccttgccacc

SEQ ID NO: 83442 - DNA, 75 bp, Artificial Sequence
  Synthetic
aagcagtttacacagctggttacaagatttgcaattaccaccttgccacccaggaggatttacaaaatgctgtga

SEQ ID NO: 83443 - DNA, 75 bp, Artificial Sequence
  Synthetic
gcaaagcaggagtgtactactgtgagtccaagagaaagtactatcctgtgtcatttgtagggcccaccttccaat

SEQ ID NO: 83444 - DNA, 75 bp, Artificial Sequence
  Synthetic
gtccaagagaaagtactatcctgtgtcatttgtagggcccaccttccaatatatggaggctaatgactactaccc

SEQ ID NO: 83445 - DNA, 75 bp, Artificial Sequence
  Synthetic
tcaacacggtgtcatcggaatcataacagctggtggggagggtttagtcgcattctctgacataagggacctgta

SEQ ID NO: 83446 - DNA, 75 bp, Artificial Sequence
  Synthetic
acagctggtggggagggtttagtcgcattctctgacataagggacctgtatgcttatgaagaagaagccatggag

SEQ ID NO: 83447 - DNA, 75 bp, Artificial Sequence
  Synthetic
atatcagaactaactagtatggtttccagcacaattacagagaagctactcaaaaacttaatcaaaattatctca

SEQ ID NO: 83448 - DNA, 75 bp, Artificial Sequence
  Synthetic
ccagcacaattacagagaagctactcaaaaacttaatcaaaattatctcatccctagtgatcatcactaggaatt

SEQ ID NO: 83449 - DNA, 75 bp, Artificial Sequence
  Synthetic
ggatcctaggaacacccaggatcatgttcgctcactgtgcctattggcttggcacaatggcgaagaagaatacaa

SEQ ID NO: 83450 - DNA, 75 bp, Artificial Sequence
  Synthetic
agaaagcatgtgatatattggaaattccctacgttatcagacagggtgatagttggttaaagaaattcactgaag

SEQ ID NO: 83451 - DNA, 75 bp, Artificial Sequence
  Synthetic
tccctacgttatcagacagggtgatagttggttaaagaaattcactgaagcatgtaatgctgctaagggtttgga

SEQ ID NO: 83452 - DNA, 75 bp, Artificial Sequence
  Synthetic
gggttgttcccaccccagaggcccacgtggcggctagtactccggtatcacggtacccttgtacgcctgttttat

SEQ ID NO: 83453 - DNA, 75 bp, Artificial Sequence
  Synthetic
cgagtttgtgaccaaattgaagcaattagagatgcttgaaaatcagatagctacaatacaccagtcttgcccaag

SEQ ID NO: 83454 - DNA, 75 bp, Artificial Sequence
  Synthetic
ttagagatgcttgaaaatcagatagctacaatacaccagtcttgcccaagccaagaacaccaggagattttattc

SEQ ID NO: 83455 - DNA, 75 bp, Artificial Sequence
  Synthetic
aaattggaacacaccatcaacaattacatacagttcaagagcaaacaccgtattgagccagtatgcctattggtg

SEQ ID NO: 83456 - DNA, 75 bp, Artificial Sequence
  Synthetic
acatacagttcaagagcaaacaccgtattgagccagtatgcctattggtgcatggaagtccaggtacagggaaat

SEQ ID NO: 83457 - DNA, 75 bp, Artificial Sequence
  Synthetic
catctcattttgatggctacaagcaacaaggtgtagtcatcatggacgatcttaaccagaaccctgatggcgccg

SEQ ID NO: 83458 - DNA, 75 bp, Artificial Sequence
  Synthetic
acaaggtgtagtcatcatggacgatcttaaccagaaccctgatggcgccgacatgaaactcttctgccaaatggt

SEQ ID NO: 83459 - DNA, 75 bp, Artificial Sequence
  Synthetic
agcttccaccaactccagtcgtatcacaccacctacggtagctcacagcgatgcactggctaggagattcgcctt

SEQ ID NO: 83460 - DNA, 75 bp, Artificial Sequence
  Synthetic
acaccacctacggtagctcacagcgatgcactggctaggagattcgccttcgacatggatatccaggtgatgggc

SEQ ID NO: 83461 - DNA, 75 bp, Artificial Sequence
  Synthetic
tttaaaagatgctgtcctttagtgtgtggtaaagcaatccaattgatggacaaatcttccagagtcagatacagc

SEQ ID NO: 83462 - DNA, 75 bp, Artificial Sequence
  Synthetic
gtggtaaagcaatccaattgatggacaaatcttccagagtcagatacagcattgaccagatcactacaatgattg

SEQ ID NO: 83463 - DNA, 75 bp, Artificial Sequence
  Synthetic
atttgaaaattgacatcaagacgagccctcctcctgaatgcatcaacgatttgcttcaagcagtcgactcccagg

SEQ ID NO: 83464 - DNA, 75 bp, Artificial Sequence
  Synthetic
ccctcctcctgaatgcatcaacgatttgcttcaagcagtcgactcccaggaggtaagggattactgtgagaagaa

SEQ ID NO: 83465 - DNA, 75 bp, Artificial Sequence
  Synthetic
agtgacgacctttgctgcggtggctggtgtcgtgtatgttatgtataagttattcgctggacaccagggagcata

SEQ ID NO: 83466 - DNA, 75 bp, Artificial Sequence
  Synthetic
ggtgtcgtgtatgttatgtataagttattcgctggacaccagggagcatacactggtttgccaaataaaagaccc

SEQ ID NO: 83467 - DNA, 75 bp, Artificial Sequence
  Synthetic
taggggaggtattgaactactacacacactgggctggatccctgaagttcactttcttattctgtggctctatga

SEQ ID NO: 83468 - DNA, 75 bp, Artificial Sequence
  Synthetic
atcgttacagcaaccaccagcaaaggagagtttacgatgctaggtgttcacgataacgtggccatcttaccaact

SEQ ID NO: 83469 - DNA, 75 bp, Artificial Sequence
  Synthetic
actttcttattctgtggctctatgatggctactggaaagctgttagtcgcttacgcccctccgggagcacagcca

SEQ ID NO: 83470 - DNA, 75 bp, Artificial Sequence
  Synthetic
cctagacgccaaagcccttgaagatcaagcaggaacaaatctggaaatcaccataatcacactcaaaagaaatga

SEQ ID NO: 83471 - DNA, 75 bp, Artificial Sequence
  Synthetic
ggtcatcgggatgcatgttggtgggaacggttcacatgggtttgcagcggccctgaagcgatcgtacttcactca

SEQ ID NO: 83472 - DNA, 75 bp, Artificial Sequence
  Synthetic
gacatggaatttacctttgtggtgacagccaacttcaccaactcaaacaacgggcatgctctaaaccaggtgtac

SEQ ID NO: 83473 - DNA, 75 bp, Artificial Sequence
  Synthetic
tatgtgtttgagggagtgaaagaaccagcggtcctcgctaagaacgatcctagacttaagacagattttgaagag

SEQ ID NO: 83474 - DNA, 75 bp, Artificial Sequence
  Synthetic
cagcggtcctcgctaagaacgatcctagacttaagacagattttgaagaggcaatcttctctaagtatgtgggca

SEQ ID NO: 83475 - DNA, 75 bp, Artificial Sequence
  Synthetic
tcaacacagaacaaatgtgcctagaggacgcaatgtacggcactgatggcttagaggccctcgatctatcaacta

SEQ ID NO: 83476 - DNA, 75 bp, Artificial Sequence
  Synthetic
ggacgcaatgtacggcactgatggcttagaggccctcgatctatcaactagtgctgggtacccctatgtgacaat

SEQ ID NO: 83477 - DNA, 75 bp, Artificial Sequence
  Synthetic
agctcagggcatagattctatcgccagatgcaattgcagcactggcgtgtattattgtgaatccagaaggaggta

SEQ ID NO: 83478 - DNA, 75 bp, Artificial Sequence
  Synthetic
tggaattaatttaccactggtgacttatgttaaagatgagctaaggtccaagacaaaagtggaacagggaaaatc

SEQ ID NO: 83479 - DNA, 75 bp, Artificial Sequence
  Synthetic
tatgttaaagatgagctaaggtccaagacaaaagtggaacagggaaaatccaggttgattgaagcctctagttta

SEQ ID NO: 83480 - DNA, 75 bp, Artificial Sequence
  Synthetic
ggtagtgcagttggttgtgatccagatctattttggagtaagattccagtgctgatggaggagaagctctttgcc

SEQ ID NO: 83481 - DNA, 75 bp, Artificial Sequence
  Synthetic
gggtttggtgacagagtggactatattgattatctcaaccactcacaccacttgtacaaaaataaaatgtactgt

SEQ ID NO: 83482 - DNA, 75 bp, Artificial Sequence
  Synthetic
gaaaagtacccgtttcttattcatccagtaatgccaatgaaggagatttatgaatcaatcagatggactaaagat

SEQ ID NO: 83483 - DNA, 75 bp, Artificial Sequence
  Synthetic
tcaagaccactcccccacccgagtgcataaacgacttgctccaggccgttgactctcaagaagtgagggactact

SEQ ID NO: 83484 - DNA, 75 bp, Artificial Sequence
  Synthetic
ctgttagagtagtcaatgatcacaacccgaccaaggtcacctccaaaatcagagtgtatctaaaacccaagcaca

SEQ ID NO: 83485 - DNA, 75 bp, Artificial Sequence
  Synthetic
tactgaatgcttatggtgacaattgttttgatcagttgttgccattgctcgcgttcagtgtgtaattacaaaaac

SEQ ID NO: 83486 - DNA, 75 bp, Artificial Sequence
  Synthetic
ttttgatcagttgttgccattgctcgcgttcagtgtgtaattacaaaaacaagactatcagttgttaccaccccc

SEQ ID NO: 83487 - DNA, 75 bp, Artificial Sequence
  Synthetic
acccacgaaaacaaaaacacagccactggtggttcaaccatcaattacactactattaattactacaaagacagt

SEQ ID NO: 83488 - DNA, 75 bp, Artificial Sequence
  Synthetic
ggccagaatatgtatcaccattatttagggcgtgcaggctacaccattcatgtgcagtgcaacgcgtctaagttt

SEQ ID NO: 83489 - DNA, 75 bp, Artificial Sequence
  Synthetic
accaccggaaacgccaacccccgcatatcggttccatttgttggtattggcgcagcgtactcccacttctatgat

SEQ ID NO: 83490 - DNA, 75 bp, Artificial Sequence
  Synthetic
tgaatgagcatgacccaacaccggttgatgctaaggtaagagtttacatgaagcccaaacacattcgcgtatggt

SEQ ID NO: 83491 - DNA, 75 bp, Artificial Sequence
  Synthetic
tatgcagaatgcagttgcagtgatgtgggatcgcgacttgttagtcgctgagagcagggcacaaggcatagacac

SEQ ID NO: 83492 - DNA, 75 bp, Artificial Sequence
  Synthetic
aggccccacatttaggtacatggaagctaatgattattatccagcaagataccaatcccacatgcttattggctc

SEQ ID NO: 83493 - DNA, 75 bp, Artificial Sequence
  Synthetic
aatgcatttggtgctggatttagtgctgagattgccagcagaattgaacagttacaagacactgtgcagaatgtc

SEQ ID NO: 83494 - DNA, 75 bp, Artificial Sequence
  Synthetic
acttatggctgcttatggtgacaatcatagattgttatcataacgcgaattggattggccatccggtgatataca

SEQ ID NO: 83495 - DNA, 75 bp, Artificial Sequence
  Synthetic
catagattgttatcataacgcgaattggattggccatccggtgatatacaaacacattgtttacctatttattgg

SEQ ID NO: 83496 - DNA, 75 bp, Artificial Sequence
  Synthetic
gagctcaggtatcatcacagaaagttggagctcatgagaacactaatgtggcaactggtggctcaactgtaaatt

SEQ ID NO: 83497 - DNA, 75 bp, Artificial Sequence
  Synthetic
tggagctcatgagaacactaatgtggcaactggtggctcaactgtaaattataccaccatcaattattacaagga

SEQ ID NO: 83498 - DNA, 75 bp, Artificial Sequence
  Synthetic
catgctgaagtccgctccagcactaaactctccaaacgttgaggcatgtgggtatagtgacagagtcagacaaat

SEQ ID NO: 83499 - DNA, 75 bp, Artificial Sequence
  Synthetic
aactctccaaacgttgaggcatgtgggtatagtgacagagtcagacaaatcacactcggcaattcgacaataact

SEQ ID NO: 83500 - DNA, 75 bp, Artificial Sequence
  Synthetic
cccgctagtgtttaaagagcccaagatcgacataaagaacacaccgccgccacctgccatagcagatctactacg

SEQ ID NO: 83501 - DNA, 75 bp, Artificial Sequence
  Synthetic
gttgatgcaccaactgaacccgacgtgagcagtaacagattctacacactggagtcagtgcagtggggtaaggag

SEQ ID NO: 83502 - DNA, 75 bp, Artificial Sequence
  Synthetic
cacctgccatagcagatctactacggtctgttgacagtgaggaagtcagagagtactgtaaaggtcaagggtggg

SEQ ID NO: 83503 - DNA, 75 bp, Artificial Sequence
  Synthetic
tgagcagtaacagattctacacactggagtcagtgcagtggggtaaggagtccaaaggttggtggtggaaactgc

SEQ ID NO: 83504 - DNA, 75 bp, Artificial Sequence
  Synthetic
tacacgttcagtgcaacgcatccaagtttcaccagggtgctttagccgtgttcgccgtccctgagtgcgtgtttt

SEQ ID NO: 83505 - DNA, 75 bp, Artificial Sequence
  Synthetic
gtttcaccagggtgctttagccgtgttcgccgtccctgagtgcgtgttttcaggaaattcaaaggataagaccaa

SEQ ID NO: 83506 - DNA, 75 bp, Artificial Sequence
  Synthetic
caccgacactgcaagagagttttgtccaattgattacttgtttgggtcaggtgtgttgtttggaaacgcatttgt

SEQ ID NO: 83507 - DNA, 75 bp, Artificial Sequence
  Synthetic
ccaattgattacttgtttgggtcaggtgtgttgtttggaaacgcatttgtttacccacatcagatcgttaactta

SEQ ID NO: 83508 - DNA, 75 bp, Artificial Sequence
  Synthetic
aactgggggatcgtcatcatcccagtggtcccattggactttactgatgccagtaacacccagataccaatcaca

SEQ ID NO: 83509 - DNA, 75 bp, Artificial Sequence
  Synthetic
tggtcccattggactttactgatgccagtaacacccagataccaatcacagtcacaattgcaccaatgtacactg

SEQ ID NO: 83510 - DNA, 75 bp, Artificial Sequence
  Synthetic
agttcctgacatctgacaactttcaatcaccgtgtgcattgcctgagtttgacgtgacgccccccatacacattc

SEQ ID NO: 83511 - DNA, 75 bp, Artificial Sequence
  Synthetic
atcaccgtgtgcattgcctgagtttgacgtgacgccccccatacacattcctggtgaggtgaagaacatgatgga

SEQ ID NO: 83512 - DNA, 75 bp, Artificial Sequence
  Synthetic
aaccaaggccgggcagtgcggcggcgtggttatggccacaggaaaagtgattggaatacacgtgggtggcaacgg

SEQ ID NO: 83513 - DNA, 75 bp, Artificial Sequence
  Synthetic
tggattggatagcaatgcatccgacttgaacaacccaatattctgtctctctctatctcccgctagtgatcaaag

SEQ ID NO: 83514 - DNA, 75 bp, Artificial Sequence
  Synthetic
tagtaaggatgctggatatccggtaataaacgccccctccaaaactaagctagaaccaagtgtatttcatgatgt

SEQ ID NO: 83515 - DNA, 75 bp, Artificial Sequence
  Synthetic
ttgaacaacccaatattctgtctctctctatctcccgctagtgatcaaagattgcaattcacgttgttgggagaa

SEQ ID NO: 83516 - DNA, 75 bp, Artificial Sequence
  Synthetic
ggtaagctgctacttagctacagtccccctggtgcagcccccccaaaaacgcggaaggaagcaatgctaggcacc

SEQ ID NO: 83517 - DNA, 75 bp, Artificial Sequence
  Synthetic
cccctggtgcagcccccccaaaaacgcggaaggaagcaatgctaggcacccaccttatctgggatcttggcttac

SEQ ID NO: 83518 - DNA, 75 bp, Artificial Sequence
  Synthetic
ggaaaccagagacactaaggagatgaagaggatgctggacaaatatggcataaaccttcccttggtgacctatgt

SEQ ID NO: 83519 - DNA, 75 bp, Artificial Sequence
  Synthetic
caggtggctacattacatgtttctaccaaaccaaagttgttgtaccactgcacacaccgactaaaatggatatgt

SEQ ID NO: 83520 - DNA, 75 bp, Artificial Sequence
  Synthetic
ccaaaccaaagttgttgtaccactgcacacaccgactaaaatggatatgttggcatttgtaagcgcttgccctga

SEQ ID NO: 83521 - DNA, 75 bp, Artificial Sequence
  Synthetic
ttcggtggccatgaggcaagcatttggcaacttgtatgcaaccttccataagaaccccggtactatcacaggaag

SEQ ID NO: 83522 - DNA, 75 bp, Artificial Sequence
  Synthetic
tctcattgagtcagtggcccagaatgctctccagatttcccagccgagaccaccccagagaccagcaatcaccaa

SEQ ID NO: 83523 - DNA, 75 bp, Artificial Sequence
  Synthetic
gctctccagatttcccagccgagaccaccccagagaccagcaatcaccaatacagctgcagataccccagcaaca

SEQ ID NO: 83524 - DNA, 75 bp, Artificial Sequence
  Synthetic
gatgttatagagaccagaaaggtgattaactacaaaaccagaagtgagtccaccattgaaagtttctttggacgg

SEQ ID NO: 83525 - DNA, 75 bp, Artificial Sequence
  Synthetic
ttaactacaaaaccagaagtgagtccaccattgaaagtttctttggacggtccgcttgcatcacaataatgtcag

SEQ ID NO: 83526 - DNA, 75 bp, Artificial Sequence
  Synthetic
ctgtacaactcagaagaaagctggagatgttcacatactcacgctttgacacagagtttacctttgtgttaactg

SEQ ID NO: 83527 - DNA, 75 bp, Artificial Sequence
  Synthetic
gatgttcacatactcacgctttgacacagagtttacctttgtgttaactgaaaggtactacacccagaattcagg

SEQ ID NO: 83528 - DNA, 75 bp, Artificial Sequence
  Synthetic
ggaaggatgaatatgataaattcttaaatcaagtgaggtcagtaccagttggtcgagcgctactattacctgagt

SEQ ID NO: 83529 - DNA, 75 bp, Artificial Sequence
  Synthetic
cacatggcaatcatcatcaaatccatccatcttctacacatatggttgtgcaccaccaagaatgtccgtgccatt

SEQ ID NO: 83530 - DNA, 75 bp, Artificial Sequence
  Synthetic
tccatcttctacacatatggttgtgcaccaccaagaatgtccgtgccatttgttgggattgctaatgcttacagc

SEQ ID NO: 83531 - DNA, 75 bp, Artificial Sequence
  Synthetic
acatcgatcaatgattttggagcaatcgcccttagagtggttaatgagcataacccagcgcgaattacatcacgc

SEQ ID NO: 83532 - DNA, 75 bp, Artificial Sequence
  Synthetic
tcgcccttagagtggttaatgagcataacccagcgcgaattacatcacgcatgaggatatatatgaaacccaaac

SEQ ID NO: 83533 - DNA, 75 bp, Artificial Sequence
  Synthetic
gcaccaccacgaacaagcacttctgtttccccggtgaagccacataaactgtacccacggttgaaagtggtagat

SEQ ID NO: 83534 - DNA, 75 bp, Artificial Sequence
  Synthetic
ctttggcacccatcacaccagttacctctatgaccacatacgggtttggacatcagaacaaagctgtgtatgtcg

SEQ ID NO: 83535 - DNA, 75 bp, Artificial Sequence
  Synthetic
ctctatgaccacatacgggtttggacatcagaacaaagctgtgtatgtcgctgggtacaaaatttgcaactacca

SEQ ID NO: 83536 - DNA, 75 bp, Artificial Sequence
  Synthetic
cccgagtgtagcttaggtcgatgagtctgggcataccccaccggcgacggtggcccaggctgcgttggcggccta

SEQ ID NO: 83537 - DNA, 75 bp, Artificial Sequence
  Synthetic
agttgtgaacaaggtgcgaagagcctattgagctacttgggagtcctccggcccctgaatgcggctaatcccaac

SEQ ID NO: 83538 - DNA, 75 bp, Artificial Sequence
  Synthetic
agctcagggaaccgacaccatagccaggtgcggctgcaagatgggtgtgtactactgtgaatctagaagaaagta

SEQ ID NO: 83539 - DNA, 75 bp, Artificial Sequence
  Synthetic
tattgagctacttgggagtcctccggcccctgaatgcggctaatcccaaccacggagcaagtgcctgcacgccag

SEQ ID NO: 83540 - DNA, 75 bp, Artificial Sequence
  Synthetic
aggtgcggctgcaagatgggtgtgtactactgtgaatctagaagaaagtattacccagtaacagttacagggcct

SEQ ID NO: 83541 - DNA, 75 bp, Artificial Sequence
  Synthetic
attatggctgcttatggtgacaatcgtagattgttatcataaagcgacttggattggccatccggtgaagtataa

SEQ ID NO: 83542 - DNA, 75 bp, Artificial Sequence
  Synthetic
gctgaaccaggtgactgtggtggtatcttaagatgcaaccatggagtgatgggcatcatcacagctggaggagaa

SEQ ID NO: 83543 - DNA, 75 bp, Artificial Sequence
  Synthetic
gtagattgttatcataaagcgacttggattggccatccggtgaagtataaacatattatttacttgtttgttgga

SEQ ID NO: 83544 - DNA, 75 bp, Artificial Sequence
  Synthetic
tcttaagatgcaaccatggagtgatgggcatcatcacagctggaggagaagggattgtggcctttgccgacatca

SEQ ID NO: 83545 - DNA, 75 bp, Artificial Sequence
  Synthetic
ggcacaagtgtcgtctcagaaggtaggcgcccatgaaaacactaatgtagccactggcggatcaacagtaaatta

SEQ ID NO: 83546 - DNA, 75 bp, Artificial Sequence
  Synthetic
tcggctcgggattcaccaatcagatcggggaaaaagttgctgagctaaccagcatggtcaccagttcaatcactg

SEQ ID NO: 83547 - DNA, 75 bp, Artificial Sequence
  Synthetic
ggcgcccatgaaaacactaatgtagccactggcggatcaacagtaaattacaccactatcaattactacaaggat

SEQ ID NO: 83548 - DNA, 75 bp, Artificial Sequence
  Synthetic
cggggaaaaagttgctgagctaaccagcatggtcaccagttcaatcactgaaaagttgttaaagacacttgtgaa

SEQ ID NO: 83549 - DNA, 75 bp, Artificial Sequence
  Synthetic
atgttaaaatccgctccagcactaaactccccaaatatagaagcatgtggctacagtgacagggtgatgcaactc

SEQ ID NO: 83550 - DNA, 75 bp, Artificial Sequence
  Synthetic
tggttgtgattgctccccttggcagtggatcaagaaaaaggcgtgtgacattcttgagatcccttacgtcatgag

SEQ ID NO: 83551 - DNA, 75 bp, Artificial Sequence
  Synthetic
actccccaaatatagaagcatgtggctacagtgacagggtgatgcaactcacgttgggtaactctacaataacca

SEQ ID NO: 83552 - DNA, 75 bp, Artificial Sequence
  Synthetic
tggatcaagaaaaaggcgtgtgacattcttgagatcccttacgtcatgagacaaggtgacagttggttaaagaaa

SEQ ID NO: 83553 - DNA, 75 bp, Artificial Sequence
  Synthetic
tagatcaaccaactgaacctgacgtggccgcgtgccgattttacacgctagaatcagtcatgtggagcaaggaat

SEQ ID NO: 83554 - DNA, 75 bp, Artificial Sequence
  Synthetic
aaggaaaagataatcccggaagctaaagacaaagtggaatacatcactaagctaaagcagttagggatgttggaa

SEQ ID NO: 83555 - DNA, 75 bp, Artificial Sequence
  Synthetic
ggccgcgtgccgattttacacgctagaatcagtcatgtggagcaaggaatctagagggtggtggtggaaattacc

SEQ ID NO: 83556 - DNA, 75 bp, Artificial Sequence
  Synthetic
aagacaaagtggaatacatcactaagctaaagcagttagggatgttggaaaatcagattaacaccatccaccaat

SEQ ID NO: 83557 - DNA, 75 bp, Artificial Sequence
  Synthetic
tcatgttcaatgcaacgcctcaaagtttcaccaaggcacattgggagtgtttgcaattccagaattctgtctagc

SEQ ID NO: 83558 - DNA, 75 bp, Artificial Sequence
  Synthetic
ccccgttgtatgctacagaagctaaaagaattcttaagctggaaaacaccatcaacaattacatacagttcaaga

SEQ ID NO: 83559 - DNA, 75 bp, Artificial Sequence
  Synthetic
tttcaccaaggcacattgggagtgtttgcaattccagaattctgtctagcaggtgattctgatgttaaaaactct

SEQ ID NO: 83560 - DNA, 75 bp, Artificial Sequence
  Synthetic
aagaattcttaagctggaaaacaccatcaacaattacatacagttcaagagcaaacaccgtattgagccagtatg

SEQ ID NO: 83561 - DNA, 75 bp, Artificial Sequence
  Synthetic
accagcccttcgcgcaaattctgtgctgtagattacctcttaggatgtggagtgcttgctgggaatgcgtttgtg

SEQ ID NO: 83562 - DNA, 75 bp, Artificial Sequence
  Synthetic
ggaaagcacatctgtctattcgctaccaccagatcccactcactttgatgggtataaacaacaaggagtggtcat

SEQ ID NO: 83563 - DNA, 75 bp, Artificial Sequence
  Synthetic
ctgtagattacctcttaggatgtggagtgcttgctgggaatgcgtttgtgttcccacaccaaattattaacttgc

SEQ ID NO: 83564 - DNA, 75 bp, Artificial Sequence
  Synthetic
ccaccagatcccactcactttgatgggtataaacaacaaggagtggtcataatggacgacttgaaccaaaaccct

SEQ ID NO: 83565 - DNA, 75 bp, Artificial Sequence
  Synthetic
actggggaattgcaatcatccccttgtccaaattggacttcgccccagacgcatcagtagagttgccaataacgg

SEQ ID NO: 83566 - DNA, 75 bp, Artificial Sequence
  Synthetic
gagaagggcattttgtttacatcagattatgtcctagcatccacaaattccagcaccatagccccacccacagta

SEQ ID NO: 83567 - DNA, 75 bp, Artificial Sequence
  Synthetic
gtccaaattggacttcgccccagacgcatcagtagagttgccaataacggtcaccatagcacctatgtgctgtga

SEQ ID NO: 83568 - DNA, 75 bp, Artificial Sequence
  Synthetic
attatgtcctagcatccacaaattccagcaccatagccccacccacagtagcccacagtgatgcacttgccagga

SEQ ID NO: 83569 - DNA, 75 bp, Artificial Sequence
  Synthetic
atatttgactgctgacaacttccaatcaccatgcgcactcccagaatttgatgtgacacagccaattgacatacc

SEQ ID NO: 83570 - DNA, 75 bp, Artificial Sequence
  Synthetic
cacaattatgcaaagattgcccaaaaccagcaaatttcaagaagtgttgccctttggtttgtggaaaggctttac

SEQ ID NO: 83571 - DNA, 75 bp, Artificial Sequence
  Synthetic
tcaccatgcgcactcccagaatttgatgtgacacagccaattgacataccgggggaagtaaagaatttaatggag

SEQ ID NO: 83572 - DNA, 75 bp, Artificial Sequence
  Synthetic
accagcaaatttcaagaagtgttgccctttggtttgtggaaaggctttacaacttatggacaagaacactaggca

SEQ ID NO: 83573 - DNA, 75 bp, Artificial Sequence
  Synthetic
cagcttcaggctgcgcccagtaacagagaagcccctatactgtgtttgtcactgtcccctgcaagtgaccctaga

SEQ ID NO: 83574 - DNA, 75 bp, Artificial Sequence
  Synthetic
ggaagcgttatttcaaggaccgctccagtacaaggacatcaaaatagacatcaaagaaacccccgctccagagta

SEQ ID NO: 83575 - DNA, 75 bp, Artificial Sequence
  Synthetic
gagaagcccctatactgtgtttgtcactgtcccctgcaagtgaccctagattgtcatacacaatgctgggagaaa

SEQ ID NO: 83576 - DNA, 75 bp, Artificial Sequence
  Synthetic
cagtacaaggacatcaaaatagacatcaaagaaacccccgctccagagtacataaatgatttgctccaagcagtt

SEQ ID NO: 83577 - DNA, 75 bp, Artificial Sequence
  Synthetic
gaaagatccttgtatcatacgcaccaccaggggcacaacccccaaagactcgcaaagatgctatgctgggcacgc

SEQ ID NO: 83578 - DNA, 75 bp, Artificial Sequence
  Synthetic
cgcaacttgaatagagcaatgacaatcctgcaagccgtaaccacttttgcagcagttgctggggtggtgtacgtg

SEQ ID NO: 83579 - DNA, 75 bp, Artificial Sequence
  Synthetic
accaggggcacaacccccaaagactcgcaaagatgctatgctgggcacgcacttgatctgggacatcggactaca

SEQ ID NO: 83580 - DNA, 75 bp, Artificial Sequence
  Synthetic
tcctgcaagccgtaaccacttttgcagcagttgctggggtggtgtacgtgatgtacaaactgttcgccggacagc

SEQ ID NO: 83581 - DNA, 75 bp, Artificial Sequence
  Synthetic
agggggttacattagcatgttctatcagactaaaatagttgtcccagcatcaaccccaacaacaatggatatcat

SEQ ID NO: 83582 - DNA, 75 bp, Artificial Sequence
  Synthetic
gatttgactatgcggtagcaatggctaagaggaacatcttaacggctaccaccagtaagggagaattcacaatgt

SEQ ID NO: 83583 - DNA, 75 bp, Artificial Sequence
  Synthetic
cagactaaaatagttgtcccagcatcaaccccaacaacaatggatatcataggctttgtctcagcttgcaatgac

SEQ ID NO: 83584 - DNA, 75 bp, Artificial Sequence
  Synthetic
taagaggaacatcttaacggctaccaccagtaagggagaattcacaatgttaggggtgtatgataatgtggcaat

SEQ ID NO: 83585 - DNA, 75 bp, Artificial Sequence
  Synthetic
caacaagttgcgtccaatgccttacaaatttcacaaccaacgcgccccgcgctgccctcaagtgaaagtctcccc

SEQ ID NO: 83586 - DNA, 75 bp, Artificial Sequence
  Synthetic
gcttgaagatcaatcagggattaaccttgagatcaccattgttagattgaagagaaatgaaaagtttagagacat

SEQ ID NO: 83587 - DNA, 75 bp, Artificial Sequence
  Synthetic
aaatttcacaaccaacgcgccccgcgctgccctcaagtgaaagtctccccaacacacaacagtcagcgcctgcac

SEQ ID NO: 83588 - DNA, 75 bp, Artificial Sequence
  Synthetic
cttgagatcaccattgttagattgaagagaaatgaaaagtttagagacatcagacctcacatacccactcagatc

SEQ ID NO: 83589 - DNA, 75 bp, Artificial Sequence
  Synthetic
agactagacatgtaatacaaaccagatcacgatcagaatcgactgtggagtccttctttgctcgtggtgcctgcg

SEQ ID NO: 83590 - DNA, 75 bp, Artificial Sequence
  Synthetic
accgagcagggatacctcaacctcggtggtcgccaaacagcgcgcacgttaatgtacaacttccccacgcgtgct

SEQ ID NO: 83591 - DNA, 75 bp, Artificial Sequence
  Synthetic
atcacgatcagaatcgactgtggagtccttctttgctcgtggtgcctgcgttactatcatgacagtggaaaattt

SEQ ID NO: 83592 - DNA, 75 bp, Artificial Sequence
  Synthetic
gtggtcgccaaacagcgcgcacgttaatgtacaacttccccacgcgtgctggtcagtgtggtggagttatcacat

SEQ ID NO: 83593 - DNA, 75 bp, Artificial Sequence
  Synthetic
caggagaaaattggaaatgttcacatattctcgatttgacgtcgaattcacgttcgtcaccacagagaggtatta

SEQ ID NO: 83594 - DNA, 75 bp, Artificial Sequence
  Synthetic
acttcactcaaagtcaaggtgagatacagtggatgagaccatctaaggaagttggatacccagtcatcaatgccc

SEQ ID NO: 83595 - DNA, 75 bp, Artificial Sequence
  Synthetic
tattctcgatttgacgtcgaattcacgttcgtcaccacagagaggtattacactagcaactcaggacatgcccga

SEQ ID NO: 83596 - DNA, 75 bp, Artificial Sequence
  Synthetic
acagtggatgagaccatctaaggaagttggatacccagtcatcaatgccccaagcaaaaccaagcttgagcccag

SEQ ID NO: 83597 - DNA, 75 bp, Artificial Sequence
  Synthetic
acatcctgcaacccatcagtgttttacacatatggcgacgctcccgcacgcatttctataccgtttgtgggcatt

SEQ ID NO: 83598 - DNA, 75 bp, Artificial Sequence
  Synthetic
tttcgaagaggcgatcttctcaaagtatgtggggaacaaaatcactgaggtggatgagtacatgaaagaagccgt

SEQ ID NO: 83599 - DNA, 75 bp, Artificial Sequence
  Synthetic
acacatatggcgacgctcccgcacgcatttctataccgtttgtgggcattgcaaacgcctactctcacttttatg

SEQ ID NO: 83600 - DNA, 75 bp, Artificial Sequence
  Synthetic
tatgtggggaacaaaatcactgaggtggatgagtacatgaaagaagccgtggaccactacgcagggcagctcatg

SEQ ID NO: 83601 - DNA, 75 bp, Artificial Sequence
  Synthetic
acgacttcgggatgctggcagtgagagttgtcaatgaattcaacccagcaaggatcacatcaaaagtgagggtgt

SEQ ID NO: 83602 - DNA, 75 bp, Artificial Sequence
  Synthetic
ctttccactagtgcaggctatccttatgtggcactaggaaagaagaagagggacatccttaacaaacaaaccaga

SEQ ID NO: 83603 - DNA, 75 bp, Artificial Sequence
  Synthetic
agttgtcaatgaattcaacccagcaaggatcacatcaaaagtgagggtgtacatgaaaccaaagcatgttagagt

SEQ ID NO: 83604 - DNA, 75 bp, Artificial Sequence
  Synthetic
atgtggcactaggaaagaagaagagggacatccttaacaaacaaaccagagacactaaggaaatgcagaggcttc

SEQ ID NO: 83605 - DNA, 75 bp, Artificial Sequence
  Synthetic
atccaccaaaaatcttacaacgtatggctttggccaccaaaacaaagcagtctacacggctggctataaaatctg

SEQ ID NO: 83606 - DNA, 75 bp, Artificial Sequence
  Synthetic
aaggcaaatccaggttgatcgaagcttcgagcctgaatgattcagtggccatgaggatggcttttggcaatctat

SEQ ID NO: 83607 - DNA, 75 bp, Artificial Sequence
  Synthetic
ggctttggccaccaaaacaaagcagtctacacggctggctataaaatctgtaactaccacctagccacacaagaa

SEQ ID NO: 83608 - DNA, 75 bp, Artificial Sequence
  Synthetic
acaattgcaagatgcacttgcaatactggagtgtattactgtgagtccaggaggaaatactaccctgtttccttt

SEQ ID NO: 83609 - DNA, 75 bp, Artificial Sequence
  Synthetic
aaataccagtactgatggaagaaaagctttttgcatttgactacacgggctatgacgcttcactcagccctgcgt

SEQ ID NO: 83610 - DNA, 75 bp, Artificial Sequence
  Synthetic
ctggagtgtattactgtgagtccaggaggaaatactaccctgtttcctttgtgggccccactttccagtacatgg

SEQ ID NO: 83611 - DNA, 75 bp, Artificial Sequence
  Synthetic
gctttttgcatttgactacacgggctatgacgcttcactcagccctgcgtggtttgaagcgcttaagatggtcct

SEQ ID NO: 83612 - DNA, 75 bp, Artificial Sequence
  Synthetic
gtggtggaattcttagatgccaacatggaatcataggcataatcactgcaggaggggaaggtctcgttgcatttt

SEQ ID NO: 83613 - DNA, 75 bp, Artificial Sequence
  Synthetic
tggaatcataggcataatcactgcaggaggggaaggtctcgttgcattttcagatatcagagatctctacgcata

SEQ ID NO: 83614 - DNA, 75 bp, Artificial Sequence
  Synthetic
acaacagattggagacaaaatttcagagctaaccagcatggtcaccagcaccattacagagaagctattgaaaaa

SEQ ID NO: 83615 - DNA, 75 bp, Artificial Sequence
  Synthetic
gagctaaccagcatggtcaccagcaccattacagagaagctattgaaaaacttgataaagattgttgcgtctcta

SEQ ID NO: 83616 - DNA, 75 bp, Artificial Sequence
  Synthetic
ttagtacatccagtcatgccaatgaaagagattcatgaatccattagatggacaaaagatcccagaaacactcag

SEQ ID NO: 83617 - DNA, 75 bp, Artificial Sequence
  Synthetic
ccctggcaatggcttaagaagaaggcttgtgacattttggagattccatatgttattcatcaaggggatagctgg

SEQ ID NO: 83618 - DNA, 75 bp, Artificial Sequence
  Synthetic
gacaaaagatcccagaaacactcaggatcatgttcgctcgttatgcctattggcttggcataacggcgaagaaga

SEQ ID NO: 83619 - DNA, 75 bp, Artificial Sequence
  Synthetic
cttgtgacattttggagattccatatgttattcatcaaggggatagctggctcaaaaagtttacagaagcatgta

SEQ ID NO: 83620 - DNA, 75 bp, Artificial Sequence
  Synthetic
cccaagcaagagacaagttagaatttgtgacaaaactcaagcaattggagatgttagagaaccagatttccacta

SEQ ID NO: 83621 - DNA, 75 bp, Artificial Sequence
  Synthetic
tgtgacaaaactcaagcaattggagatgttagagaaccagatttccactatacaccagtcttgtccaagtcagga

SEQ ID NO: 83622 - DNA, 75 bp, Artificial Sequence
  Synthetic
actacgggaagcctagtaacaccattgaacactttgagagttgcgttcagcgcctaacccagcgtagctcaggcc

SEQ ID NO: 83623 - DNA, 75 bp, Artificial Sequence
  Synthetic
tgaagcaaagagaatccagaagctggagcataccattaacaattacatacagttcaagagcaaacaccgtattga

SEQ ID NO: 83624 - DNA, 75 bp, Artificial Sequence
  Synthetic
gagcataccattaacaattacatacagttcaagagcaaacaccgtattgaaccagtatgtttactggtgcatggc

SEQ ID NO: 83625 - DNA, 75 bp, Artificial Sequence
  Synthetic
aagagcctactgtgctaggtaagagtcctccggcccctgaatgtggctaatcctaaccaccgaacccatggttgc

SEQ ID NO: 83626 - DNA, 75 bp, Artificial Sequence
  Synthetic
tactcactgccaccagacccttcccacttcgatggttacaaacaacaaggagtggtgatcatggatgatttaaat

SEQ ID NO: 83627 - DNA, 75 bp, Artificial Sequence
  Synthetic
acttcgatggttacaaacaacaaggagtggtgatcatggatgatttaaatcaaaatccagatggagctgacatga

SEQ ID NO: 83628 - DNA, 75 bp, Artificial Sequence
  Synthetic
tttcctatattgcaagtttatggtgacatttatagtatttaagtgttaccatatactgcgaaaatatattgtaat

SEQ ID NO: 83629 - DNA, 75 bp, Artificial Sequence
  Synthetic
acatttatagtatttaagtgttaccatatactgcgaaaatatattgtaataacacagaattaatactgcagaaat

SEQ ID NO: 83630 - DNA, 75 bp, Artificial Sequence
  Synthetic
tcacatccaactacgtgctggcctccactaactccagtaggataacaccccctaccgtagcccatagtgatgctc

SEQ ID NO: 83631 - DNA, 75 bp, Artificial Sequence
  Synthetic
caactacacgaccataaattattacaaagatagtgctagtaatgcagctactaaaatggatttttcgcaagaccc

SEQ ID NO: 83632 - DNA, 75 bp, Artificial Sequence
  Synthetic
aaagatagtgctagtaatgcagctactaaaatggatttttcgcaagacccttctaaattcactgagccagtaaag

SEQ ID NO: 83633 - DNA, 75 bp, Artificial Sequence
  Synthetic
ccatggctaccgagatgtgcaagaactgtcaccaacctgcgaattttaaaagatgctgccccctcgtgtgcggca

SEQ ID NO: 83634 - DNA, 75 bp, Artificial Sequence
  Synthetic
cagctcacgctgggtaattccactattaccacacaagaagcagccaatgccgtggttgcctatggagagtggcct

SEQ ID NO: 83635 - DNA, 75 bp, Artificial Sequence
  Synthetic
ttaccacacaagaagcagccaatgccgtggttgcctatggagagtggccttctttcctcaacccacaggaggcga

SEQ ID NO: 83636 - DNA, 75 bp, Artificial Sequence
  Synthetic
agagaaacaggcgttcaaacattggcaattgtatggaagcattgttccaaggaccactccagtacaaagacctca

SEQ ID NO: 83637 - DNA, 75 bp, Artificial Sequence
  Synthetic
agacttcaagggggtggtggtggaagctgccagatgcactaaaggacatgggaatgttcggccaaaacatgtacc

SEQ ID NO: 83638 - DNA, 75 bp, Artificial Sequence
  Synthetic
gctgccagatgcactaaaggacatgggaatgttcggccaaaacatgtaccatcactaccttggacgtgcagggta

SEQ ID NO: 83639 - DNA, 75 bp, Artificial Sequence
  Synthetic
gggagtactgtgaaaagaagggttggttggtaaatatctcgagccaggttcagttagagcggaacatcaatagag

SEQ ID NO: 83640 - DNA, 75 bp, Artificial Sequence
  Synthetic
gttggtaaatatctcgagccaggttcagttagagcggaacatcaatagagctatgaccatccttcaagctgttac

SEQ ID NO: 83641 - DNA, 75 bp, Artificial Sequence
  Synthetic
gatggcaagcaattcggccgactccactggaggaattacatacgaaaaggccaatccaggtgagacaggtggtaa

SEQ ID NO: 83642 - DNA, 75 bp, Artificial Sequence
  Synthetic
actggaggaattacatacgaaaaggccaatccaggtgagacaggtggtaagtttcagcccaccttcaccccatcc

SEQ ID NO: 83643 - DNA, 75 bp, Artificial Sequence
  Synthetic
tctccccaacaagaaacctaacattcccaccatcagaactgccaaagtgcaaggacctgggtttgattatgcagt

SEQ ID NO: 83644 - DNA, 75 bp, Artificial Sequence
  Synthetic
cccaccatcagaactgccaaagtgcaaggacctgggtttgattatgcagttgccatggctaaaagaaacatcgtt

SEQ ID NO: 83645 - DNA, 75 bp, Artificial Sequence
  Synthetic
acggtgtttccccaccagattatcaacttgcgcaccaacaactgcgcaacgctagtgctcccgtatgtgaactca

SEQ ID NO: 83646 - DNA, 75 bp, Artificial Sequence
  Synthetic
acttgcgcaccaacaactgcgcaacgctagtgctcccgtatgtgaactcaacttccacggattccatggccaagc

SEQ ID NO: 83647 - DNA, 75 bp, Artificial Sequence
  Synthetic
tcaccaggagagacaatatttattgatggtagagaagttgaagtgttggacgccagagcactcgaagatcaagct

SEQ ID NO: 83648 - DNA, 75 bp, Artificial Sequence
  Synthetic
atggtagagaagttgaagtgttggacgccagagcactcgaagatcaagctggtaccaatttggagatcaccattg

SEQ ID NO: 83649 - DNA, 75 bp, Artificial Sequence
  Synthetic
ttacagtcaccattgccccaatgtgctgcgagttcaacgggctacgctcgatgacgaacccagtcgctcaaggcc

SEQ ID NO: 83650 - DNA, 75 bp, Artificial Sequence
  Synthetic
ctgcgagttcaacgggctacgctcgatgacgaacccagtcgctcaaggcctaccaacattgtcgaccccagggtc

SEQ ID NO: 83651 - DNA, 75 bp, Artificial Sequence
  Synthetic
gggtattgatcgtgaacactagtaagtaccccaacatgtacgtacccgtcggggcagtaaccgagcaggggtacc

SEQ ID NO: 83652 - DNA, 75 bp, Artificial Sequence
  Synthetic
tcaacctgggcgggcgccaaacggcccgcacgctcatgtataacttcccaacccgcgccggtcagtgtggtggta

SEQ ID NO: 83653 - DNA, 75 bp, Artificial Sequence
  Synthetic
catcccaggtgaggtcaaaaatattatggagctggcagagatcgacacagttatacctatgaacgcagtgccagg

SEQ ID NO: 83654 - DNA, 75 bp, Artificial Sequence
  Synthetic
atggagctggcagagatcgacacagttatacctatgaacgcagtgccaggtaaagtgaataaaatggaagcatac

SEQ ID NO: 83655 - DNA, 75 bp, Artificial Sequence
  Synthetic
agcgatcatacttcactcagaatcaaggtgaaatacagtggatgagaccatccaaggaggttgggtacccaatca

SEQ ID NO: 83656 - DNA, 75 bp, Artificial Sequence
  Synthetic
acccgcctctcccgaacaatgctaggtgaaatcctcaactactacacacactgggcaggttctttgaaattcaca

SEQ ID NO: 83657 - DNA, 75 bp, Artificial Sequence
  Synthetic
gtgaaatcctcaactactacacacactgggcaggttctttgaaattcacatttttgttttgcggtagtatgatgg

SEQ ID NO: 83658 - DNA, 75 bp, Artificial Sequence
  Synthetic
tacttgcaaagaatgaccctagattaaaaactgattttgaagaagcaatcttttcaaaatatgtgggaaataaaa

SEQ ID NO: 83659 - DNA, 75 bp, Artificial Sequence
  Synthetic
aaaaactgattttgaagaagcaatcttttcaaaatatgtgggaaataaaatcactgaggtggatgaatacatgaa

SEQ ID NO: 83660 - DNA, 75 bp, Artificial Sequence
  Synthetic
gcacacatttgatatgggatatagggctccagtctagtgcaacgcttgttgcgccctggatttcaaacgtcaact

SEQ ID NO: 83661 - DNA, 75 bp, Artificial Sequence
  Synthetic
gctccagtctagtgcaacgcttgttgcgccctggatttcaaacgtcaactatagaaggtgtgctaaggatgactt

SEQ ID NO: 83662 - DNA, 75 bp, Artificial Sequence
  Synthetic
catgtatggtactgatggtctggaagctctggatttgaccactagtgctggatacccatatgtggcactaggcaa

SEQ ID NO: 83663 - DNA, 75 bp, Artificial Sequence
  Synthetic
gctctggatttgaccactagtgctggatacccatatgtggcactaggcaagaagaaaagagacatcctcaataaa

SEQ ID NO: 83664 - DNA, 75 bp, Artificial Sequence
  Synthetic
catgttggcctttgttagcgcgtgtaatgacttctcagctaggttattgaaggacaccccatttgtgagacagct

SEQ ID NO: 83665 - DNA, 75 bp, Artificial Sequence
  Synthetic
aatgacttctcagctaggttattgaaggacaccccatttgtgagacagctaggcttaatacagccccaggggatt

SEQ ID NO: 83666 - DNA, 75 bp, Artificial Sequence
  Synthetic
aaagatgagctgaggagtaagagcaaagtagaacagggcaagtctagactgattgaagcctccagtctgaacgac

SEQ ID NO: 83667 - DNA, 75 bp, Artificial Sequence
  Synthetic
aagtagaacagggcaagtctagactgattgaagcctccagtctgaacgactcggtggcgatgagaatggccttcg

SEQ ID NO: 83668 - DNA, 75 bp, Artificial Sequence
  Synthetic
ggtccggtccactcaaaagaagtcccagccctgacagcagtcgagactggggccacaagtcaggtagtgcctgct

SEQ ID NO: 83669 - DNA, 75 bp, Artificial Sequence
  Synthetic
cagccctgacagcagtcgagactggggccacaagtcaggtagtgcctgctgatctcattgaaacaagacacgtgg

SEQ ID NO: 83670 - DNA, 75 bp, Artificial Sequence
  Synthetic
tctggagcaagatcccagtgttaatggaggagaaactctttgcatttgactacaccgggtacgatgcttctctca

SEQ ID NO: 83671 - DNA, 75 bp, Artificial Sequence
  Synthetic
ttaaaaacgatgcacccactgctagcaacaccaaagacctattcgctacctggaagattagctacttgaatgcat

SEQ ID NO: 83672 - DNA, 75 bp, Artificial Sequence
  Synthetic
ggggacagagttgactacattgactacctgaaccattcacaccacctctacaagaacaaaacatattgtgtcaaa

SEQ ID NO: 83673 - DNA, 75 bp, Artificial Sequence
  Synthetic
caacaccaaagacctattcgctacctggaagattagctacttgaatgcatatcaactgcggcgtaaacttgagat

SEQ ID NO: 83674 - DNA, 75 bp, Artificial Sequence
  Synthetic
tggcaggcattatgtgtatcagataatgtatatacccccaggggcgccactcccattaaaatgggacgactacac

SEQ ID NO: 83675 - DNA, 75 bp, Artificial Sequence
  Synthetic
atgtatatacccccaggggcgccactcccattaaaatgggacgactacacgtggcagagttcaactaacccgtca

SEQ ID NO: 83676 - DNA, 75 bp, Artificial Sequence
  Synthetic
ttttatgacgggttttccatagttccacatgacagcattagtgccggcgcatttaacaagtacggttacaacagc

SEQ ID NO: 83677 - DNA, 75 bp, Artificial Sequence
  Synthetic
cacatgacagcattagtgccggcgcatttaacaagtacggttacaacagcataaacgactttggaaccctggcag

SEQ ID NO: 83678 - DNA, 75 bp, Artificial Sequence
  Synthetic
aatactcaggatcatgttcgctcgttgtgcttattggcttggcacaatggcgaagaagaatataacaaattttta

SEQ ID NO: 83679 - DNA, 75 bp, Artificial Sequence
  Synthetic
gggtttggtgtccccgtcccccacgtgcagcagaatacactggaccatcggtggattacaagaaagatgatcagg

SEQ ID NO: 83680 - DNA, 75 bp, Artificial Sequence
  Synthetic
tgcagcagaatacactggaccatcggtggattacaagaaagatgatcaggtaatgacccatgtggcagacattag

SEQ ID NO: 83681 - DNA, 75 bp, Artificial Sequence
  Synthetic
acaagaggacatgcaaaatgcagtggcgatcatgtgggaccgtgatctcctggttgctgagagcagagcgcaggg

SEQ ID NO: 83682 - DNA, 75 bp, Artificial Sequence
  Synthetic
gcgatcatgtgggaccgtgatctcctggttgctgagagcagagcgcagggtattgacaccattgcccgatgtaac

SEQ ID NO: 83683 - DNA, 75 bp, Artificial Sequence
  Synthetic
tacatggaagccaacgactactacccagcaaggtaccaatctcacatgcttgttggctcagggtttgcaatgcca

SEQ ID NO: 83684 - DNA, 75 bp, Artificial Sequence
  Synthetic
cagcaaggtaccaatctcacatgcttgttggctcagggtttgcaatgccaggtgactgcgggggcatactaaggt

SEQ ID NO: 83685 - DNA, 75 bp, Artificial Sequence
  Synthetic
ccagtgtggtttcgagcaagcacttctgtttccccggccgcgccctatatgctgtgcaaacggcagaaaggggca

SEQ ID NO: 83686 - DNA, 75 bp, Artificial Sequence
  Synthetic
gctgtgcaaacggcagaaaggggcaacgtcgttacccgcttgcatactacgggaaacccagtaccaccattgatt

SEQ ID NO: 83687 - DNA, 75 bp, Artificial Sequence
  Synthetic
acgtcgttacccgcttgcatactacgggaaacccagtaccaccattgattgtattgagagttgcgttcagcgcct

SEQ ID NO: 83688 - DNA, 75 bp, Artificial Sequence
  Synthetic
tcgcttatgaggaagaggcaatggagcaaggtattaccgactatgttagtaggttgggaaatgcctttggtgctg

SEQ ID NO: 83689 - DNA, 75 bp, Artificial Sequence
  Synthetic
gcaaggtattaccgactatgttagtaggttgggaaatgcctttggtgctggatttagtgcagagattgctagcag

SEQ ID NO: 83690 - DNA, 75 bp, Artificial Sequence
  Synthetic
gcctgcccgcacctcttggtgtgggacgcttaatacatgacatggtgcgaagagtctactgtgctatgtaagatt

SEQ ID NO: 83691 - DNA, 75 bp, Artificial Sequence
  Synthetic
ggccttggtcattgtggcgcgaaactatgaagactccatcaccgtactggccacccttagtcttttgggctgtga

SEQ ID NO: 83692 - DNA, 75 bp, Artificial Sequence
  Synthetic
tatgaagactccatcaccgtactggccacccttagtcttttgggctgtgatgcatcaccatggcaatggctgaag

SEQ ID NO: 83693 - DNA, 75 bp, Artificial Sequence
  Synthetic
gcctgcaatgccgccaaggggttagagtggattgccaccaagattagcaaatttattgactggattaaggctaaa

SEQ ID NO: 83694 - DNA, 75 bp, Artificial Sequence
  Synthetic
ggtacccacgagaactccaatagtgcaaatggaggctcgaccataaactacactactataaactattacaaagac

SEQ ID NO: 83695 - DNA, 75 bp, Artificial Sequence
  Synthetic
ccttgacactcttgagaatcaagtggcaaccctccaccagtcgtgcccgagccaggaggaccaggaggtgctgtt

SEQ ID NO: 83696 - DNA, 75 bp, Artificial Sequence
  Synthetic
caaatggaggctcgaccataaactacactactataaactattacaaagacagtgccagcaatgctgccactaaga

SEQ ID NO: 83697 - DNA, 75 bp, Artificial Sequence
  Synthetic
actccccgaacattgaggcatgtgggtacagcgatcgggtgatgcaactcacactgggtaattccaccataacca

SEQ ID NO: 83698 - DNA, 75 bp, Artificial Sequence
  Synthetic
gtacagcgatcgggtgatgcaactcacactgggtaattccaccataaccactcaagaggcggccaacgcagtgat

SEQ ID NO: 83699 - DNA, 75 bp, Artificial Sequence
  Synthetic
tacatacagttcaagaccaaacaccgcattgaaccagtttgtttgttgatccacggggaccccggtaccggtaaa

SEQ ID NO: 83700 - DNA, 75 bp, Artificial Sequence
  Synthetic
ttcgagcaaccggttctacactctcgagagtgttgaatggcaggagtcgtctcgaggctggtggtggaaactccc

SEQ ID NO: 83701 - DNA, 75 bp, Artificial Sequence
  Synthetic
ccatcacacttcgacgggtataaacaacaaggagtggtcatcatggatgatttaaatcagaacccggatggtgag

SEQ ID NO: 83702 - DNA, 75 bp, Artificial Sequence
  Synthetic
gagagtgttgaatggcaggagtcgtctcgaggctggtggtggaaactccctgatgccctcaaagatatgggtatg

SEQ ID NO: 83703 - DNA, 75 bp, Artificial Sequence
  Synthetic
aacaaggagtggtcatcatggatgatttaaatcagaacccggatggtgaggatatgaaattgttctgccaaatgg

SEQ ID NO: 83704 - DNA, 75 bp, Artificial Sequence
  Synthetic
ttccaccaagggaccctatttgtggctgctatcccagaatttatgatggctagcaactcagcagatagaactggt

SEQ ID NO: 83705 - DNA, 75 bp, Artificial Sequence
  Synthetic
ctgctatcccagaatttatgatggctagcaactcagcagatagaactggtggcatcacctatgaaaaagccaatc

SEQ ID NO: 83706 - DNA, 75 bp, Artificial Sequence
  Synthetic
cggtggactggttgttggggtgtggcgtgttagctggcaacatcacagtgttcccgcaccaaattataaacttgc

SEQ ID NO: 83707 - DNA, 75 bp, Artificial Sequence
  Synthetic
cgtgttagctggcaacatcacagtgttcccgcaccaaattataaacttgcgcaccaacaattgtgccacactagt

SEQ ID NO: 83708 - DNA, 75 bp, Artificial Sequence
  Synthetic
cttggatgagcttacaaccttaatgattaatgagagaaacagaagacataacatcgggggttgtcttgaagctct

SEQ ID NO: 83709 - DNA, 75 bp, Artificial Sequence
  Synthetic
tgtgccacttaagtacgaggccggcgcgtcaacagcaatccccataaccgtcaccgtggcccccatgtgttgtga

SEQ ID NO: 83710 - DNA, 75 bp, Artificial Sequence
  Synthetic
gagcccaagatcgacataaaaaacacgccgccgccacctgccatagcagatctactgcggtctgttgatagtgag

SEQ ID NO: 83711 - DNA, 75 bp, Artificial Sequence
  Synthetic
gcgtcaacagcaatccccataaccgtcaccgtggcccccatgtgttgtgagttcaacggacttcggtcaatgaca

SEQ ID NO: 83712 - DNA, 75 bp, Artificial Sequence
  Synthetic
tcaccatgtatagtcccaaactatgatgtgacagctccgatccacatacctggtgaagtgcacaacatgatggaa

SEQ ID NO: 83713 - DNA, 75 bp, Artificial Sequence
  Synthetic
atgtgacagctccgatccacatacctggtgaagtgcacaacatgatggaattggcagagattgatagtgttatac

SEQ ID NO: 83714 - DNA, 75 bp, Artificial Sequence
  Synthetic
aggatcaagcaatatttgccctgagcctaagtccagcttcggacaaaaggttgtcgcgtacactcctgggtgaga

SEQ ID NO: 83715 - DNA, 75 bp, Artificial Sequence
  Synthetic
cctaagtccagcttcggacaaaaggttgtcgcgtacactcctgggtgagattttgaattactacacacactgggc

SEQ ID NO: 83716 - DNA, 75 bp, Artificial Sequence
  Synthetic
acctggcgcagcccccccaagaacaagaaaagatgccatgttggggacgcacgtaatctgggatattggattgca

SEQ ID NO: 83717 - DNA, 75 bp, Artificial Sequence
  Synthetic
agaaaagatgccatgttggggacgcacgtaatctgggatattggattgcaatccagcgccacacttgtagcacca

SEQ ID NO: 83718 - DNA, 75 bp, Artificial Sequence
  Synthetic
caaacagccatagtggtcccttcaggtgcacccaaaacaatgagtatgttagccttcgtcagtgcatgcaatgat

SEQ ID NO: 83719 - DNA, 75 bp, Artificial Sequence
  Synthetic
gtgcacccaaaacaatgagtatgttagccttcgtcagtgcatgcaatgatttttcggcgaggcttctgcgcgact

SEQ ID NO: 83720 - DNA, 75 bp, Artificial Sequence
  Synthetic
tggtcaacatgtcactggacacagttcaaaacacgatggctagtggatctgtgcactcaaaggaggtccccgcgc

SEQ ID NO: 83721 - DNA, 75 bp, Artificial Sequence
  Synthetic
tcaaaacacgatggctagtggatctgtgcactcaaaggaggtccccgcgctgaccgctgttgaaacaggcgcgac

SEQ ID NO: 83722 - DNA, 75 bp, Artificial Sequence
  Synthetic
agagtcctttttggggagggccgcgctggtgacgattatgagcttgcacaatgcggcccccactgttcaaaacac

SEQ ID NO: 83723 - DNA, 75 bp, Artificial Sequence
  Synthetic
ctggtgacgattatgagcttgcacaatgcggcccccactgttcaaaacaccaacgacctctttgccacgtggaag

SEQ ID NO: 83724 - DNA, 75 bp, Artificial Sequence
  Synthetic
accttcgtcattaccgagcggtttgcagctagcggaagctccagtagacattatgtgtaccagatcatgtacata

SEQ ID NO: 83725 - DNA, 75 bp, Artificial Sequence
  Synthetic
acttaacaaggaaaccagagacactaaggagatgaagaagatgctggacaaatatggcataaacctacccttggt

SEQ ID NO: 83726 - DNA, 75 bp, Artificial Sequence
  Synthetic
agtgggatgattttacgtggcaaacttccacgaacccatctgtgttttacaccacaggaaatgccccaccaagag

SEQ ID NO: 83727 - DNA, 75 bp, Artificial Sequence
  Synthetic
gtatgggtacaacaccattagtgactttgggaccgtggctgtgcgtattgtgaatgaacatgacccagttaaaat

SEQ ID NO: 83728 - DNA, 75 bp, Artificial Sequence
  Synthetic
gtacaccggaccgtcagttgactacaagcaaagtaattctgtaatggaacaggtagccgacatacgcacttttgg

SEQ ID NO: 83729 - DNA, 75 bp, Artificial Sequence
  Synthetic
aagcaaagtaattctgtaatggaacaggtagccgacatacgcacttttggcttcggacaccagaacaaggccatt

SEQ ID NO: 83730 - DNA, 75 bp, Artificial Sequence
  Synthetic
tgggaccgagacctcatggtggtggagagtcgtgctcaagggattgatactattgccagatgttcctgtaagtgc

SEQ ID NO: 83731 - DNA, 75 bp, Artificial Sequence
  Synthetic
agagtcgtgctcaagggattgatactattgccagatgttcctgtaagtgcggcgtgtactactgtgaatccatgc

SEQ ID NO: 83732 - DNA, 75 bp, Artificial Sequence
  Synthetic
accagtctcacatgctcataggagccgggtttgcgatgccaggtgactgtggaggaattctgcggtgcactcacg

SEQ ID NO: 83733 - DNA, 75 bp, Artificial Sequence
  Synthetic
cgggtttgcgatgccaggtgactgtggaggaattctgcggtgcactcacggggtgatgggtctaattacagctgg

SEQ ID NO: 83734 - DNA, 75 bp, Artificial Sequence
  Synthetic
tactgactacataagcgggctgggagcggcttttggagcaggctttagtactgagatttctggtagaatacaaga

SEQ ID NO: 83735 - DNA, 75 bp, Artificial Sequence
  Synthetic
gcggcttttggagcaggctttagtactgagatttctggtagaatacaagaactgcaagaaactgttcaaaatgtc

SEQ ID NO: 83736 - DNA, 75 bp, Artificial Sequence
  Synthetic
tctgtaacggtgttggccaccctcagcttactagggtgtgacgcctcgccgtggcactggttgaaggagaaggtc

SEQ ID NO: 83737 - DNA, 75 bp, Artificial Sequence
  Synthetic
gcttactagggtgtgacgcctcgccgtggcactggttgaaggagaaggtctgtaatatattgggcattccatatg

SEQ ID NO: 83738 - DNA, 75 bp, Artificial Sequence
  Synthetic
cacagaaaataggtaaatttattgattggataaagaccaagattctaccagaagcacaggacaaagtggagtact

SEQ ID NO: 83739 - DNA, 75 bp, Artificial Sequence
  Synthetic
ttggataaagaccaagattctaccagaagcacaggacaaagtggagtacttgtcaaaactgaaacacctagacac

SEQ ID NO: 83740 - DNA, 75 bp, Artificial Sequence
  Synthetic
tcgctggttggctataaaggctcgaaagtttgcacccttgtacgccagtgaagcgcgtcgcatcttcaagatgga

SEQ ID NO: 83741 - DNA, 75 bp, Artificial Sequence
  Synthetic
aagtttgcacccttgtacgccagtgaagcgcgtcgcatcttcaagatggagagcaccgtcaacaattacatacag

SEQ ID NO: 83742 - DNA, 75 bp, Artificial Sequence
  Synthetic
acagggcttataggtagagcaattgccaagcaagccaacaccagtacctactctcttcccccggatccctcccat

SEQ ID NO: 83743 - DNA, 75 bp, Artificial Sequence
  Synthetic
ccaagcaagccaacaccagtacctactctcttcccccggatccctcccattttgatggatataagcagcaagggg

SEQ ID NO: 83744 - DNA, 75 bp, Artificial Sequence
  Synthetic
tagagtttgtgccgccgatggctagcttagaagaaaaagggattctattcacatcagattatgtactggcatcca

SEQ ID NO: 83745 - DNA, 75 bp, Artificial Sequence
  Synthetic
acatcagattatgtactggcatccaccaactcatataccatagcaccgccgacaatttcagcctcagacgcgttg

SEQ ID NO: 83746 - DNA, 75 bp, Artificial Sequence
  Synthetic
cagcaggggacacttgaacatggcaactgctaccaaggcatgtgtggactgtcataaaccagcaaacttctccag

SEQ ID NO: 83747 - DNA, 75 bp, Artificial Sequence
  Synthetic
actgctaccaaggcatgtgtggactgtcataaaccagcaaacttctccagttgttgccctttagtatgtgggaag

SEQ ID NO: 83748 - DNA, 75 bp, Artificial Sequence
  Synthetic
agaaacagaagatacaacattggcaactgtttggaagccctgttccaaggcccagtggaatttaaggaacctagg

SEQ ID NO: 83749 - DNA, 75 bp, Artificial Sequence
  Synthetic
attgacataaagacaacacccccaccacctgctatagcggatttgcttcggtctgtcgacagtgatcaagtgcga

SEQ ID NO: 83750 - DNA, 75 bp, Artificial Sequence
  Synthetic
cgagcaatgacgattgtgcaagctgtgtcttcatttgtggttgtctctggtatgttatacatcatctataagttg

SEQ ID NO: 83751 - DNA, 75 bp, Artificial Sequence
  Synthetic
tgtcttcatttgtggttgtctctggtatgttatacatcatctataagttgtttgccaattttcaaggggcgtaca

SEQ ID NO: 83752 - DNA, 75 bp, Artificial Sequence
  Synthetic
ccgtcgctatggcgaagcgcaacatactgaccgcggcaacggacaggggcgagtttaccatgctaggtatttatg

SEQ ID NO: 83753 - DNA, 75 bp, Artificial Sequence
  Synthetic
actgaccgcggcaacggacaggggcgagtttaccatgctaggtatttatgaccgaatagctgtcctgcccactca

SEQ ID NO: 83754 - DNA, 75 bp, Artificial Sequence
  Synthetic
taatgatgtaaacctggaaataactattgttgagcttgacagaaatgagaagttcagagacattagagcacacat

SEQ ID NO: 83755 - DNA, 75 bp, Artificial Sequence
  Synthetic
attgttgagcttgacagaaatgagaagttcagagacattagagcacacatacccacaaccatatgtgagaccaat

SEQ ID NO: 83756 - DNA, 75 bp, Artificial Sequence
  Synthetic
atgttgaacctaggaggtaaacccaccaatcgaaccctgatgtacaattttcccaccaaagcaggtcagtgtggt

SEQ ID NO: 83757 - DNA, 75 bp, Artificial Sequence
  Synthetic
ccaatcgaaccctgatgtacaattttcccaccaaagcaggtcagtgtggtggtgtggtgatgtctacaggtaaag

SEQ ID NO: 83758 - DNA, 75 bp, Artificial Sequence
  Synthetic
agcagggcgagatacaatggatgagacctagtaaggatgctggctacccggtgattaacgcacctagcaaaacca

SEQ ID NO: 83759 - DNA, 75 bp, Artificial Sequence
  Synthetic
acctagtaaggatgctggctacccggtgattaacgcacctagcaaaaccaagctacaacctagcgtgttccacag

SEQ ID NO: 83760 - DNA, 75 bp, Artificial Sequence
  Synthetic
catcttttccaagtatgtaggtaatgctattacagaggtggatgaatacatgaaagaggctgttgaccactacgc

SEQ ID NO: 83761 - DNA, 75 bp, Artificial Sequence
  Synthetic
gctattacagaggtggatgaatacatgaaagaggctgttgaccactacgctgggcagttaatgtcattggacata

SEQ ID NO: 83762 - DNA, 75 bp, Artificial Sequence
  Synthetic
gccggctacccgtatgtgaccatggggaagagaaagagggagatcttgaacaaagagacacgagacaccaaggag

SEQ ID NO: 83763 - DNA, 75 bp, Artificial Sequence
  Synthetic
ggaagagaaagagggagatcttgaacaaagagacacgagacaccaaggagatgcaacgtatgcttgacgagtacg

SEQ ID NO: 83764 - DNA, 75 bp, Artificial Sequence
  Synthetic
ggctgatagaggctagctcgctgaacgattcagttgccatgcgtcaggcctttgggcatctgtacgctaaatttc

SEQ ID NO: 83765 - DNA, 75 bp, Artificial Sequence
  Synthetic
cgattcagttgccatgcgtcaggcctttgggcatctgtacgctaaatttcatcaaaatcccggaatagtaactgg

SEQ ID NO: 83766 - DNA, 75 bp, Artificial Sequence
  Synthetic
tgattacactagttatgatgcttccctctcacccgcctggtttgaagctctgaaaatggtgttagaaaagatagg

SEQ ID NO: 83767 - DNA, 75 bp, Artificial Sequence
  Synthetic
tgtacaaaaacaaattgtactgtgtgaaagggggaatgccatctggatgttctggtacatccatctttaacacta

SEQ ID NO: 83768 - DNA, 75 bp, Artificial Sequence
  Synthetic
cagctacccacaccaaatagacgcaggcctcctagctcagacaggaaaagattacggtctgctgatgacaccagc

SEQ ID NO: 83769 - DNA, 75 bp, Artificial Sequence
  Synthetic
gcaatacccatacttggtacacccggtcatgccaatggcagagatacatgagtcaattcgctggactaaggatcc

SEQ ID NO: 83770 - DNA, 75 bp, Artificial Sequence
  Synthetic
gtcggtcgcgcattactcctcccagagtacacaacgctgcgccgtcgttggctagattctttctgattaaccata

SEQ ID NO: 83771 - DNA, 75 bp, Artificial Sequence
  Synthetic
tggagtgggtgtccaacaaaatttccaaattcattgactggttgaaggagaaaattatcccacaagcgagggaca

SEQ ID NO: 83772 - DNA, 75 bp, Artificial Sequence
  Synthetic
ctagtcaggaacatcaagaagtcttattcaacaatgttcgctggttatccattcaatcaaaaagattcgcaccac

SEQ ID NO: 83773 - DNA, 75 bp, Artificial Sequence
  Synthetic
tggacaaatcatccagggtcagatacagcattgaccaaatcaccaccatgatcattaatgaaagaaacagaagat

SEQ ID NO: 83774 - DNA, 75 bp, Artificial Sequence
  Synthetic
agaggctatcttttccaagtatgtaggaaacaagatcactgaagtggatgaatacatgaaagaagcagtggacca

SEQ ID NO: 83775 - DNA, 75 bp, Artificial Sequence
  Synthetic
caactaactctgggcaactcaacgatcactacccaagaagcggccaattctattgttgcctacggtagatggcct

SEQ ID NO: 83776 - DNA, 75 bp, Artificial Sequence
  Synthetic
tggtcttgaagctttagaccttagcaccagtgctggctacccctatgtagccatgggaaagaagaaaagagacat

SEQ ID NO: 83777 - DNA, 75 bp, Artificial Sequence
  Synthetic
accagtgctggctacccctatgtagccatgggaaagaagaaaagagacattcttaacaaacaaaccagggacacc

SEQ ID NO: 83778 - DNA, 75 bp, Artificial Sequence
  Synthetic
aagaatccagagggtggtggtggaaactaccagatgctttaaaagacatgggattgtttggtcagaacatgtttt

SEQ ID NO: 83779 - DNA, 75 bp, Artificial Sequence
  Synthetic
tccaaagccaaaatagaacaaggaaaatccaggttgatcgaagcatcaagcttgaatgactctgtggccatgaga

SEQ ID NO: 83780 - DNA, 75 bp, Artificial Sequence
  Synthetic
aatccaggttgatcgaagcatcaagcttgaatgactctgtggccatgagaatggcatttggaaatttgtatgcag

SEQ ID NO: 83781 - DNA, 75 bp, Artificial Sequence
  Synthetic
gagtgtttgcagttccagagatgtgcttagctggtgacagtatgacccacatgttcacaaagtatgagaatgcta

SEQ ID NO: 83782 - DNA, 75 bp, Artificial Sequence
  Synthetic
cttagctggtgacagtatgacccacatgttcacaaagtatgagaatgctaatccaggtgaaaaagggggtgaatt

SEQ ID NO: 83783 - DNA, 75 bp, Artificial Sequence
  Synthetic
cagttttaatggaagagaagcttttcgcatttgactacactggctatgatgcttcacttagtccagcttggtttg

SEQ ID NO: 83784 - DNA, 75 bp, Artificial Sequence
  Synthetic
cgcatttgactacactggctatgatgcttcacttagtccagcttggtttgaagctctcaaaatggttctagagaa

SEQ ID NO: 83785 - DNA, 75 bp, Artificial Sequence
  Synthetic
gagtggggtgttggcagggaacgcatttgtttacccacatcaaataataaacctgcgcaccaacaactgtgctac

SEQ ID NO: 83786 - DNA, 75 bp, Artificial Sequence
  Synthetic
actagtgttgccttacgtgaactcactctcaatagacagcatgacaaagcacaacaactgggggatcgccatcct

SEQ ID NO: 83787 - DNA, 75 bp, Artificial Sequence
  Synthetic
ttgtgtcaagggcggcatgccatctggctgctcaggcacctcaatttttaattcaatgatcaacaacttaataat

SEQ ID NO: 83788 - DNA, 75 bp, Artificial Sequence
  Synthetic
gatgctagtctcctagcccaatcaggaaaagactatggactaaccatgacaccagctgacaagtcagcaactttt

SEQ ID NO: 83789 - DNA, 75 bp, Artificial Sequence
  Synthetic
cataccaggggaagtgcacaacatgatggaactggcggaaatagacaccatgataccactcaacttgacaagcaa

SEQ ID NO: 83790 - DNA, 75 bp, Artificial Sequence
  Synthetic
cacccagtaatgccaatgaaagaaattcatgaatcaattagatggaccaaagatcctagaaacactcaggatcat

SEQ ID NO: 83791 - DNA, 75 bp, Artificial Sequence
  Synthetic
ctcgttgtcccccgcttcagatcccagactggcacacaccatgttgggtgagatattaaattactacacacactg

SEQ ID NO: 83792 - DNA, 75 bp, Artificial Sequence
  Synthetic
agactggcacacaccatgttgggtgagatattaaattactacacacactgggcgggatccttgaaattcaccttt

SEQ ID NO: 83793 - DNA, 75 bp, Artificial Sequence
  Synthetic
gtgccaatcggaagagcattgttgctccctgagtactcaaccttgtaccgccgttggctcgactcattttagtaa

SEQ ID NO: 83794 - DNA, 75 bp, Artificial Sequence
  Synthetic
agtcgcaaagaggcaatgcttgggacacacataatatgggacattgggttgcagtcttcatgcaccatggtagta

SEQ ID NO: 83795 - DNA, 75 bp, Artificial Sequence
  Synthetic
tgtccacacccagaaagatggtcatcctgggttttgtgtcagcttgcaatgatttcagtgtacgcttgttgcgag

SEQ ID NO: 83796 - DNA, 75 bp, Artificial Sequence
  Synthetic
gctccattgagtgtgtttactctaagtacaatttcaacagctatttcaatcagacaattgtatcataatgggtgc

SEQ ID NO: 83797 - DNA, 75 bp, Artificial Sequence
  Synthetic
tcaggtttcatcacagaaagtgggcgcacatgaaaactcaaatagagcgtatggtggttctaccattaattacac

SEQ ID NO: 83798 - DNA, 75 bp, Artificial Sequence
  Synthetic
gcacatgaaaactcaaatagagcgtatggtggttctaccattaattacaccaccattaattattatagagattca

SEQ ID NO: 83799 - DNA, 75 bp, Artificial Sequence
  Synthetic
ccaaaaatgcattagtacccctagcttccaccagtagtttacctgatacaaagttgagtggaccagcccactcca

SEQ ID NO: 83800 - DNA, 75 bp, Artificial Sequence
  Synthetic
ttccaccagtagtttacctgatacaaagttgagtggaccagcccactccaaggaaatacctgcattgacagcagt

SEQ ID NO: 83801 - DNA, 75 bp, Artificial Sequence
  Synthetic
gtcagaatccacagttgagtcatttttcgcgagaggggcctgtgtggctatcatcgaggtggacaatgacgcacc

SEQ ID NO: 83802 - DNA, 75 bp, Artificial Sequence
  Synthetic
ttcgcgagaggggcctgtgtggctatcatcgaggtggacaatgacgcaccaacaaagcgcaccagcaagttgttt

SEQ ID NO: 83803 - DNA, 75 bp, Artificial Sequence
  Synthetic
gacatggaattcacctttgtggtcacctcaaattacactgatgcaaacaacggacacgcactgaaccaagtttat

SEQ ID NO: 83804 - DNA, 75 bp, Artificial Sequence
  Synthetic
gctgcctcactgaatgattttggatcactggctgttcgcgtggtaaacgaccacaaccccacgcgacttacctcc

SEQ ID NO: 83805 - DNA, 75 bp, Artificial Sequence
  Synthetic
tgaccatagcccctatgtgctgtgagttcaatggattaagaaacatcaccctgccacgcttacagggcctgccgg

SEQ ID NO: 83806 - DNA, 75 bp, Artificial Sequence
  Synthetic
agctcaccccattaccagaaaagggattgacaacttatggatttggacaccaaaacaaggctgtgtatacagctg

SEQ ID NO: 83807 - DNA, 75 bp, Artificial Sequence
  Synthetic
atctcctggtagtcgaatcaaaggcccccggcaccgactcgattgcaaggtgcagctgcaacgcgggtgtgtatt

SEQ ID NO: 83808 - DNA, 75 bp, Artificial Sequence
  Synthetic
gaacaccatggaaatgtatagggttcggttaagtgacaaaccacatacagacgatcccatactctgcctgtcact

SEQ ID NO: 83809 - DNA, 75 bp, Artificial Sequence
  Synthetic
cggttaagtgacaaaccacatacagacgatcccatactctgcctgtcactctctccagcttcagatcctaggttg

SEQ ID NO: 83810 - DNA, 75 bp, Artificial Sequence
  Synthetic
ccccggcaccgactcgattgcaaggtgcagctgcaacgcgggtgtgtattactgtgagtccagaagaaaatacta

SEQ ID NO: 83811 - DNA, 75 bp, Artificial Sequence
  Synthetic
catgctcattggtcatgggtttgcatcgccaggtgattgtggtggaatacttagatgtcaacacggagtgatagg

SEQ ID NO: 83812 - DNA, 75 bp, Artificial Sequence
  Synthetic
tcgccaggtgattgtggtggaatacttagatgtcaacacggagtgatagggataatcaccgctggtggggaaggc

SEQ ID NO: 83813 - DNA, 75 bp, Artificial Sequence
  Synthetic
attgagtcactcggtgctgcattcggcagtggattcacccaacaaattggtgacaaagtttccgagctagccagc

SEQ ID NO: 83814 - DNA, 75 bp, Artificial Sequence
  Synthetic
agttgcttaagaacctgatcaaaatcatttcatcacttgtgatcattaccaggaactatgaagacaccaccacag

SEQ ID NO: 83815 - DNA, 75 bp, Artificial Sequence
  Synthetic
gattggagtgggtgtccaacaagatatccaaattcatcagctggctacaggataagattatcccacaagcgagag

SEQ ID NO: 83816 - DNA, 75 bp, Artificial Sequence
  Synthetic
aacaattacgtacagttcaagagcaaacaccgtattgaaccagtatgtttgttagtgcatggtagtccggggaca

SEQ ID NO: 83817 - DNA, 75 bp, Artificial Sequence
  Synthetic
ttgctagagcaatagctgagaaagagaacacctccacttactcactgccacctgacccgtctcactttgacggtt

SEQ ID NO: 83818 - DNA, 75 bp, Artificial Sequence
  Synthetic
aacatcaaccgggcgatgaccattctacaggcagtgaccacttttgctgcggtggccggtgtcgtgtacgttatg

SEQ ID NO: 83819 - DNA, 75 bp, Artificial Sequence
  Synthetic
acggcaaaggtgcaaggtcccggttttgattacgcggtggccatggctaaaagaaacattgttacagcaaccacc

SEQ ID NO: 83820 - DNA, 75 bp, Artificial Sequence
  Synthetic
gggttcatgataatgtagccatcttaccaactcatgcttcacctggtgagagcatcgtgatcgacggcaaagaag

SEQ ID NO: 83821 - DNA, 75 bp, Artificial Sequence
  Synthetic
tcattacgctggtcaactcatgtctctagacatcaacacagaacaaatgtgcttggaggacgccatgtacggtac

SEQ ID NO: 83822 - DNA, 75 bp, Artificial Sequence
  Synthetic
agtgtgccaattggaagagctttgttgctcccagagtactcaacactgtaccgccgttggctcgactcattttag

SEQ ID NO: 83823 - DNA, 75 bp, Artificial Sequence
  Synthetic
agctgttgaaaacattaatacttttggagggtttggacaccagaacatggcggtgtatgttgcaggttacaagat

SEQ ID NO: 83824 - DNA, 75 bp, Artificial Sequence
  Synthetic
ttcccccggtgaggtcacatagactgtccccacggtcaaaagtgactgatccgttatccgctcacgtacttcgga

SEQ ID NO: 83825 - DNA, 75 bp, Artificial Sequence
  Synthetic
acctgtggtccacaaccacaggacgctagtagtgaacaagatgtgaagagcccactgagctacctgagaatcctc

SEQ ID NO: 83826 - DNA, 75 bp, Artificial Sequence
  Synthetic
catagattgttatcataaagcaaattggattggccatccggagtgagctaaactatctatttctctgagtgttgg

SEQ ID NO: 83827 - DNA, 75 bp, Artificial Sequence
  Synthetic
tctccccggtgatattgcatagactgctcacgcggttgaaagcgattgatccgtcatccgcttgtgtacttcgag

SEQ ID NO: 83828 - DNA, 75 bp, Artificial Sequence
  Synthetic
cgacgcgttgcgctcagcacccgaccccggggtgtagcttgggctgatgagtctggacgctcctcaccggcgacg

SEQ ID NO: 83829 - DNA, 75 bp, Artificial Sequence
  Synthetic
gtttgggcaaaatatgtactaccactacctaggtaggtccgggtacactgtacatgtacagtgtaatgcctccaa

SEQ ID NO: 83830 - DNA, 75 bp, Artificial Sequence
  Synthetic
gttagtcaaacagagctcagatagagtaaaacatcattaacgcgatgggtgctcaagtttcatcacaaaaggttg

SEQ ID NO: 83831 - DNA, 75 bp, Artificial Sequence
  Synthetic
cctggcgagaaaggaggcactttcacaggtacgttcacccctgacaacaaccagatatcacctgcccgcaggttt

SEQ ID NO: 83832 - DNA, 75 bp, Artificial Sequence
  Synthetic
gagcccacgaaaactcaaacagagcctatggcgggtctaccattaattacacaacaatcaactactatagggact

SEQ ID NO: 83833 - DNA, 75 bp, Artificial Sequence
  Synthetic
ttacggaccaataactgtgccacattggtgctcccttacgtgaactccctctcgatagatagtatggtgaagcac

SEQ ID NO: 83834 - DNA, 75 bp, Artificial Sequence
  Synthetic
ttatcaaaactgctcctatgttaaactccccgaacattgaggcgtgcggatacagcgatagagtgatgcaactaa

SEQ ID NO: 83835 - DNA, 75 bp, Artificial Sequence
  Synthetic
gcctacggtaggtggcccgaatacatcagagacactgaggcaaaccctgtagaccagccaaccgagcccgatgta

SEQ ID NO: 83836 - DNA, 75 bp, Artificial Sequence
  Synthetic
gatgctttaaaagacatggggttgtttggtcaaaacatgttttatcactaccttgggagagctggttatacagtg

SEQ ID NO: 83837 - DNA, 75 bp, Artificial Sequence
  Synthetic
ggtgatagcacaactcacatgttcacaaagtacgagaacgcaaacccaggtgagaaaggaggtatattcaaggga

SEQ ID NO: 83838 - DNA, 75 bp, Artificial Sequence
  Synthetic
agctttacccttgacaacaatgccactaaccctacacgaaacttctgtccagttgattaccttttcgggagtgga

SEQ ID NO: 83839 - DNA, 75 bp, Artificial Sequence
  Synthetic
ctaccttatgtaaactcactctcaatagacagcatgacaaagcacaacaattggggtatcgcaatcctccccttg

SEQ ID NO: 83840 - DNA, 75 bp, Artificial Sequence
  Synthetic
tagacagcatgacaaagcacaacaattggggtatcgcaatcctccccttggcaccactagactttgccactgaat

SEQ ID NO: 83841 - DNA, 75 bp, Artificial Sequence
  Synthetic
aaggcggatacatcagcgtcttctaccaaaccagaatagtggtgcccctttcgacgcccagggagatggacatcc

SEQ ID NO: 83842 - DNA, 75 bp, Artificial Sequence
  Synthetic
ttccaagagctcaagggttgccagttctaagtacaccaggaagcaaccagtatctaactgcagacaattaccaat

SEQ ID NO: 83843 - DNA, 75 bp, Artificial Sequence
  Synthetic
tctaagtacaccaggaagcaaccagtatctaactgcagacaattaccaatctccgtgtgcgatccccgaattcga

SEQ ID NO: 83844 - DNA, 75 bp, Artificial Sequence
  Synthetic
aaactggggctacaaatccactagtcccttctgacacagtgcaaaccagacatgttatacaacacaggtctaggt

SEQ ID NO: 83845 - DNA, 75 bp, Artificial Sequence
  Synthetic
tctcaacctgacaagccaacgcagaaacacaatggacatgtacagggttgagttgagtgacactgcacgccttga

SEQ ID NO: 83846 - DNA, 75 bp, Artificial Sequence
  Synthetic
aacacaatggacatgtacagggttgagttgagtgacactgcacgccttgaagatccgatcctgtgtctctcgttg

SEQ ID NO: 83847 - DNA, 75 bp, Artificial Sequence
  Synthetic
ccacaaacaaggacaagctattttcagtgtggaaaatcacgtataaagacactgttcagttacggaggaaattgg

SEQ ID NO: 83848 - DNA, 75 bp, Artificial Sequence
  Synthetic
tccattaagttcacttttctcttttgcggttcaatgatggccaccggaaagttgttggtctcttatgcaccacct

SEQ ID NO: 83849 - DNA, 75 bp, Artificial Sequence
  Synthetic
ggagcagatcctcctaagaatcgcaaagaggcaatgctcgggacacacttgatatgggatattggattgcaatcc

SEQ ID NO: 83850 - DNA, 75 bp, Artificial Sequence
  Synthetic
ggttacattagcatgttctatcaaaccaaggtagttgtcccgttgtccacacccagaaaaatggacatcttgggt

SEQ ID NO: 83851 - DNA, 75 bp, Artificial Sequence
  Synthetic
ccaaggtagttgtcccgttgtccacacccagaaaaatggacatcttgggttttgtgtcagcttgcaatgatttca

SEQ ID NO: 83852 - DNA, 75 bp, Artificial Sequence
  Synthetic
gggccattgaggggattaccaaaagtgcactggttcccttgggttccaccaacggcgtgcctgatacacagccga

SEQ ID NO: 83853 - DNA, 75 bp, Artificial Sequence
  Synthetic
tgcactggttcccttgggttccaccaacggcgtgcctgatacacagccgagcggtccagctcattccaaggaaat

SEQ ID NO: 83854 - DNA, 75 bp, Artificial Sequence
  Synthetic
catccagaggcgcacgcgttcagagtccacagtcgaatcattctttgcaagaggggcttgtgtggctatcattga

SEQ ID NO: 83855 - DNA, 75 bp, Artificial Sequence
  Synthetic
tccacagtcgaatcattctttgcaagaggggcttgtgtggctatcattgaggtggacaacgatgcaccaacacag

SEQ ID NO: 83856 - DNA, 75 bp, Artificial Sequence
  Synthetic
gtgcagttgtaatgcaggagtgtattactgcgagtccagaaggaaatactacccaatctccttcgtcggccccac

SEQ ID NO: 83857 - DNA, 75 bp, Artificial Sequence
  Synthetic
tactgcgagtccagaaggaaatactacccaatctccttcgtcggccccactttccagtatatggaggccaacgac

SEQ ID NO: 83858 - DNA, 75 bp, Artificial Sequence
  Synthetic
ttcacatattcaagatttgatatggagttcacctttgtgatcacctcaaattacaccgaggcaaacaacgggcac

SEQ ID NO: 83859 - DNA, 75 bp, Artificial Sequence
  Synthetic
agttcacctttgtgatcacctcaaattacaccgaggcaaacaacgggcacgcactgaaccaagtttatcaaataa

SEQ ID NO: 83860 - DNA, 75 bp, Artificial Sequence
  Synthetic
ctcaggtgtcaacatggtgtcatcgggattgtgacagctggtggagagggtttggtcgcgttctctgacataagg

SEQ ID NO: 83861 - DNA, 75 bp, Artificial Sequence
  Synthetic
tgttttacacctatggagctccccctgcaagaatatcagtgccctatgtggggattgctaatgcatactcccact

SEQ ID NO: 83862 - DNA, 75 bp, Artificial Sequence
  Synthetic
ggattgtgacagctggtggagagggtttggtcgcgttctctgacataagggacctatatgcttatgaggaggaag

SEQ ID NO: 83863 - DNA, 75 bp, Artificial Sequence
  Synthetic
tgcaagaatatcagtgccctatgtggggattgctaatgcatactcccacttctatgacggatttgccaaagtgcc

SEQ ID NO: 83864 - DNA, 75 bp, Artificial Sequence
  Synthetic
gggataagatatcagaactaactagcatggtaaccagcacaatcacagagaaactactaaaaaatctaatcaaaa

SEQ ID NO: 83865 - DNA, 75 bp, Artificial Sequence
  Synthetic
agttcgcgtggtgaatgatcacaaccccacgcgactcacttccaaagtcagggtgtacatgaagcccaaacacgt

SEQ ID NO: 83866 - DNA, 75 bp, Artificial Sequence
  Synthetic
catggtaaccagcacaatcacagagaaactactaaaaaatctaatcaaaattatttcatctctggtgataatcac

SEQ ID NO: 83867 - DNA, 75 bp, Artificial Sequence
  Synthetic
cccacgcgactcacttccaaagtcagggtgtacatgaagcccaaacacgtcagggtctggtgcccgcgacctccg

SEQ ID NO: 83868 - DNA, 75 bp, Artificial Sequence
  Synthetic
gttgaagaagaaggcatgtgacatcttggagattccctatgttattaaacagggtgatagttggttaaagaaatt

SEQ ID NO: 83869 - DNA, 75 bp, Artificial Sequence
  Synthetic
acatatgggtctggacaccagaacaaagctgtgtacaccactgggtacaagatctgcaattaccatctcgccact

SEQ ID NO: 83870 - DNA, 75 bp, Artificial Sequence
  Synthetic
ttggagattccctatgttattaaacagggtgatagttggttaaagaaattcactgaggcatgtaacgcagccaag

SEQ ID NO: 83871 - DNA, 75 bp, Artificial Sequence
  Synthetic
aagctgtgtacaccactgggtacaagatctgcaattaccatctcgccactacagaagatctacaaaatgctgtga

SEQ ID NO: 83872 - DNA, 75 bp, Artificial Sequence
  Synthetic
gacaagcttgaatttgtaaccaaattgaaacagttggaaatgcttgagaatcaaatatccacaatacaccagtcc

SEQ ID NO: 83873 - DNA, 75 bp, Artificial Sequence
  Synthetic
gcagggcaggagtgtactattgcgagtccaggaggaaatactaccctgtgtcgtttgtgggacccaccttccaat

SEQ ID NO: 83874 - DNA, 75 bp, Artificial Sequence
  Synthetic
tgaaacagttggaaatgcttgagaatcaaatatccacaatacaccagtcctgcccaagtcaggaacaccaggaag

SEQ ID NO: 83875 - DNA, 75 bp, Artificial Sequence
  Synthetic
gtccaggaggaaatactaccctgtgtcgtttgtgggacccaccttccaatacatggaggcaaacgaatattaccc

SEQ ID NO: 83876 - DNA, 75 bp, Artificial Sequence
  Synthetic
gaatacaaaagctggaacacaccattaataactacatacagttcaagagcaaacaccgtattgaaccagtatgtt

SEQ ID NO: 83877 - DNA, 75 bp, Artificial Sequence
  Synthetic
tcaacatggtgtcatcggaatcgtgacggctggtggtgaaggactggtcgcgttctctgacataagggacttgca

SEQ ID NO: 83878 - DNA, 75 bp, Artificial Sequence
  Synthetic
taataactacatacagttcaagagcaaacaccgtattgaaccagtatgtttgttggtgcatgggagcccaggcac

SEQ ID NO: 83879 - DNA, 75 bp, Artificial Sequence
  Synthetic
acggctggtggtgaaggactggtcgcgttctctgacataagggacttgcacgcttacgaagaggaagccatggaa

SEQ ID NO: 83880 - DNA, 75 bp, Artificial Sequence
  Synthetic
accagatccgtctcactttgatggctataaacaacaaggcgtggttattatggatgacctgaaccaaaacccaga

SEQ ID NO: 83881 - DNA, 75 bp, Artificial Sequence
  Synthetic
atatcagaactaaccagcatggtaaccagcacaatcacagagaagttgctaaagaatttgataaagataatttca

SEQ ID NO: 83882 - DNA, 75 bp, Artificial Sequence
  Synthetic
tataaacaacaaggcgtggttattatggatgacctgaaccaaaacccagacggggcagacatgaagctcttctgt

SEQ ID NO: 83883 - DNA, 75 bp, Artificial Sequence
  Synthetic
ccagcacaatcacagagaagttgctaaagaatttgataaagataatttcatccctagtgatcatcactagaaact

SEQ ID NO: 83884 - DNA, 75 bp, Artificial Sequence
  Synthetic
tatgtcttagcctctaccaactccagtcgtatcacaccacccacagtagctcacagtgacgcgctggcccggaga

SEQ ID NO: 83885 - DNA, 75 bp, Artificial Sequence
  Synthetic
aaaaggcatgtgacattctggagattccctatgtcattaaacaaggtgatagttggttgaagaaattcaccgagg

SEQ ID NO: 83886 - DNA, 75 bp, Artificial Sequence
  Synthetic
tccctatgtcattaaacaaggtgatagttggttgaagaaattcaccgaggcgtgcaacgcagccaaggggctgga

SEQ ID NO: 83887 - DNA, 75 bp, Artificial Sequence
  Synthetic
tgatgggcgaatactccagagatggtaaactcaatatggcaatggctacagaaatgtgcaagaactgccaccaac

SEQ ID NO: 83888 - DNA, 75 bp, Artificial Sequence
  Synthetic
tgagttcgtaaccaaattgaagcagcttgagatgctggagaaccagatatccaccatacaccagtcatgtccaag

SEQ ID NO: 83889 - DNA, 75 bp, Artificial Sequence
  Synthetic
ccaccatacaccagtcatgtccaagccaggaacaccaagagattttattcaacaatgtgcgctggctgtccattc

SEQ ID NO: 83890 - DNA, 75 bp, Artificial Sequence
  Synthetic
ttaatgatttgctccaagcagttgactcccaggaagtgagggattattgcgaaaagaaaggttggatcgtcaata

SEQ ID NO: 83891 - DNA, 75 bp, Artificial Sequence
  Synthetic
ctcccaggaagtgagggattattgcgaaaagaaaggttggatcgtcaatattactagtcaagtgcaaacagagag

SEQ ID NO: 83892 - DNA, 75 bp, Artificial Sequence
  Synthetic
tattgaaccagtatgtctgctagtgcatggaagcccaggcacagggaaatcagttgccactaatctaattgccag

SEQ ID NO: 83893 - DNA, 75 bp, Artificial Sequence
  Synthetic
acaaggtgtggttatcatggatgacctaaaccagaacccggatggggcagacatgaaactcttttgccaaatggt

SEQ ID NO: 83894 - DNA, 75 bp, Artificial Sequence
  Synthetic
ctaaaccagaacccggatggggcagacatgaaactcttttgccaaatggtgtccactgtggaatttataccacct

SEQ ID NO: 83895 - DNA, 75 bp, Artificial Sequence
  Synthetic
aacagcaaaagtgcaaggacctgggtttgactacgcagtggctatggctaaaagaaacattgttacagcaactac

SEQ ID NO: 83896 - DNA, 75 bp, Artificial Sequence
  Synthetic
acaccaccaacagtggcacacagtgatgctctggccaggaggttcgcattcgacatggacattcaagtgatgagt

SEQ ID NO: 83897 - DNA, 75 bp, Artificial Sequence
  Synthetic
atgctctggccaggaggttcgcattcgacatggacattcaagtgatgagtgaatactccagagatggtaagttaa

SEQ ID NO: 83898 - DNA, 75 bp, Artificial Sequence
  Synthetic
gagtatcgtgattgatggcaaagaggttgagattctggacgctaaagccctcgaagaccaggcaggtactaatct

SEQ ID NO: 83899 - DNA, 75 bp, Artificial Sequence
  Synthetic
gtggtaaggcaatccagttgatggataaatcttctagagttagatatagtgtagaccaaataactacaatgatca

SEQ ID NO: 83900 - DNA, 75 bp, Artificial Sequence
  Synthetic
gtgaacactagtaagtaccccaatatgtatgttcctgtcggtgctgtgactgagcagggatatctaaatctcggt

SEQ ID NO: 83901 - DNA, 75 bp, Artificial Sequence
  Synthetic
tcaatgagagaaacagaagatccaacattggcaattgcatggaagccttgttccaaggacctctccaatataagg

SEQ ID NO: 83902 - DNA, 75 bp, Artificial Sequence
  Synthetic
aagtgagagattactgtgaaaagaaagggtggatagttaacattaccagtcaagttcaaacagaaaggaacatca

SEQ ID NO: 83903 - DNA, 75 bp, Artificial Sequence
  Synthetic
gcagggcaatgacgatcctacaagcagtcacaactttcgccgccgtggctggagttgtctatgttatgtataagc

SEQ ID NO: 83904 - DNA, 75 bp, Artificial Sequence
  Synthetic
gaaggaaccagcagtccttaccaaaaacgatcccaggcttaaaacagactttgaggaggcaattttctccaagta

SEQ ID NO: 83905 - DNA, 75 bp, Artificial Sequence
  Synthetic
aacgatcccaggcttaaaacagactttgaggaggcaattttctccaagtacgtgggcaacaagatcactgaagtg

SEQ ID NO: 83906 - DNA, 75 bp, Artificial Sequence
  Synthetic
aggtgcagggaccagggtttgattacgcagtggcaatggctaaaaggaatattgttacagcaacaactagtaaag

SEQ ID NO: 83907 - DNA, 75 bp, Artificial Sequence
  Synthetic
tgtttggaggatgccatgtatggcactgatggtctggaagcacttgatttatccactagtgctggctacccttat

SEQ ID NO: 83908 - DNA, 75 bp, Artificial Sequence
  Synthetic
tgatcgatggcaaggaaattgagatcttggacgccaaagcactcgaagaccaggcagggaccaaccttgaaatca

SEQ ID NO: 83909 - DNA, 75 bp, Artificial Sequence
  Synthetic
ctgatggtctggaagcacttgatttatccactagtgctggctacccttatgtaacaatgggaaagaagaaaagag

SEQ ID NO: 83910 - DNA, 75 bp, Artificial Sequence
  Synthetic
atgatggagttttgatcgtgaacactagcaagtaccccaatatgtatgtccctgtcggtgctgtgactgagcagg

SEQ ID NO: 83911 - DNA, 75 bp, Artificial Sequence
  Synthetic
tagtaacgtatgtcaaagatgagctaaggtctaagaccaaagtggagcagggaaaatccagattgattgaagcct

SEQ ID NO: 83912 - DNA, 75 bp, Artificial Sequence
  Synthetic
aaggtctaagaccaaagtggagcagggaaaatccagattgattgaagcctccagcttaaatgattcagtagctat

SEQ ID NO: 83913 - DNA, 75 bp, Artificial Sequence
  Synthetic
tagcaagtaccccaatatgtatgtccctgtcggtgctgtgactgagcaggggtatcttaatctcggtggccgcca

SEQ ID NO: 83914 - DNA, 75 bp, Artificial Sequence
  Synthetic
tgacccagatctgttctggagcaagattccagtactgatggaagaaaagcttttcgcctttgactatacaggcta

SEQ ID NO: 83915 - DNA, 75 bp, Artificial Sequence
  Synthetic
ggactacattgactacctcaatcattcacaccacttgtacaagaacaaaacatactgtgtcaagggcggcatgcc

SEQ ID NO: 83916 - DNA, 75 bp, Artificial Sequence
  Synthetic
caagcttgaacccagcgctttccactatgtgtttgagggggtaaaggaaccagcagtcctcaccaaaaacgaccc

SEQ ID NO: 83917 - DNA, 75 bp, Artificial Sequence
  Synthetic
cagactcaagacagattttgaggaggcaattttctccaagtatgtgggtaacaaaatcacagaagtggatgagta

SEQ ID NO: 83918 - DNA, 75 bp, Artificial Sequence
  Synthetic
ttaacacagaacagatgtgcctagaagatgccatgtacggcaccgatggtctagaggcactcgacttatccacta

SEQ ID NO: 83919 - DNA, 75 bp, Artificial Sequence
  Synthetic
gtgccggatacccctatgtggcaatgggaaagaagaagagagacatcttgaacaagcagaccagagacacaaaag

SEQ ID NO: 83920 - DNA, 75 bp, Artificial Sequence
  Synthetic
tattcatccagtaatgccaatgaaggaaattcatgaatcaatcagatggaccaaggatcctagaaacacacagga

SEQ ID NO: 83921 - DNA, 75 bp, Artificial Sequence
  Synthetic
aaaccaaagttgagcaagggaagtctagactgattgaagcatctagtttaaatgactcagtggcaatgaggatgg

SEQ ID NO: 83922 - DNA, 75 bp, Artificial Sequence
  Synthetic
ccaaggatcctagaaacacacaggatcacgtacgctctttgtgcttattggcttggcacaatggagaagaagaat

SEQ ID NO: 83923 - DNA, 75 bp, Artificial Sequence
  Synthetic
aatgactcagtggcaatgaggatggcttttgggaacttgtacgctgctttccacaagaacccgggggtggtaaca

SEQ ID NO: 83924 - DNA, 75 bp, Artificial Sequence
  Synthetic
gttgatggaggaaaagctgtttgccttcgattacactgggtacgatgcatccctcagccctgcatggttcgaggc

SEQ ID NO: 83925 - DNA, 75 bp, Artificial Sequence
  Synthetic
ttgactacctaaaccactcacaccacctgtataaaaacaaaacatactgtgtcaagggcggcatgccatctggct

SEQ ID NO: 83926 - DNA, 75 bp, Artificial Sequence
  Synthetic
ctagtctcctagcccaatcaggaaaagactacggattgacaatgaccccagctgacaagtcagctacatttgaaa

SEQ ID NO: 83927 - DNA, 75 bp, Artificial Sequence
  Synthetic
aagtcacatgggagaatgtaacattcttgaagagatttttcagggcagatgaaaagtacccgtttcttgtgcacc

SEQ ID NO: 83928 - DNA, 75 bp, Artificial Sequence
  Synthetic
attcacccctctgattacacatactcttggcttgattaggattgttgcattgataagacactattgttgcaatgg

SEQ ID NO: 83929 - DNA, 75 bp, Artificial Sequence
  Synthetic
cttggcttgattaggattgttgcattgataagacactattgttgcaatgggtgctcaagtttcatcccaaaaagt

SEQ ID NO: 83930 - DNA, 75 bp, Artificial Sequence
  Synthetic
atttcatcagggctcgttgggagtatttgccataccagaattttgcctggctggggatagtgataagcaaagata

SEQ ID NO: 83931 - DNA, 75 bp, Artificial Sequence
  Synthetic
gtgttttggtagggaacgcttttgtgttcccccaccagattattaacttaagaaccaacaacagtgccaccctag

SEQ ID NO: 83932 - DNA, 75 bp, Artificial Sequence
  Synthetic
gtcacaatagctccgatgtgcagtgagttcaatggtttgcgcaatgttacagccccaaagcttcaaggattgcca

SEQ ID NO: 83933 - DNA, 75 bp, Artificial Sequence
  Synthetic
ggtaaggagacactattataatgggagcacaagtatcatctcagaaggtgggcgctcatgagaacaccaatgtgg

SEQ ID NO: 83934 - DNA, 75 bp, Artificial Sequence
  Synthetic
agcacaagtatcatctcagaaggtgggcgctcatgagaacaccaatgtggcgactggtggatcaacagtcaacta

SEQ ID NO: 83935 - DNA, 75 bp, Artificial Sequence
  Synthetic
cctctgaatttagagaacaccaggaggaataccatggacatgtacagagtgaggttgagtgacagcgccaacctg

SEQ ID NO: 83936 - DNA, 75 bp, Artificial Sequence
  Synthetic
gttcactgagcctgttaaggatatcatgctcaaatctgcaccagcattaaactccccaaatgtagaagcttgtgg

SEQ ID NO: 83937 - DNA, 75 bp, Artificial Sequence
  Synthetic
atgctcaaatctgcaccagcattaaactccccaaatgtagaagcttgtggttacagtgacagagttatgcaatta

SEQ ID NO: 83938 - DNA, 75 bp, Artificial Sequence
  Synthetic
ctaaatgccaaagatgccaacccagtcgaccaacccacagaaccagatgtggctgcgtgccgcttctacaccctt

SEQ ID NO: 83939 - DNA, 75 bp, Artificial Sequence
  Synthetic
tcgaccaacccacagaaccagatgtggctgcgtgccgcttctacacccttcagtcagtcaattggaagacagaat

SEQ ID NO: 83940 - DNA, 75 bp, Artificial Sequence
  Synthetic
cctcatgtacgatggttgtaccgtggatcagcaatgtaacgtacagacagactacacaggacagttttactgaag

SEQ ID NO: 83941 - DNA, 75 bp, Artificial Sequence
  Synthetic
acttaggtagatcaggttacacggtacatgtgcagtgtaacgcctccaagtttcaccaaggcacgttgggtgtgt

SEQ ID NO: 83942 - DNA, 75 bp, Artificial Sequence
  Synthetic
acatgtgcagtgtaacgcctccaagtttcaccaaggcacgttgggtgtgtttgccgttcccgaatactgccttgc

SEQ ID NO: 83943 - DNA, 75 bp, Artificial Sequence
  Synthetic
ggtttgtttcagcgtgcaatgatttcagtgtacggttactgcgcgacacaacgcacatttcgcagacggccatgc

SEQ ID NO: 83944 - DNA, 75 bp, Artificial Sequence
  Synthetic
cacaaggggtggatgatctgataaccgaggtggcgcaaaatgctttagctctctcactccccaagccacaaaaca

SEQ ID NO: 83945 - DNA, 75 bp, Artificial Sequence
  Synthetic
aagttccttcacagccgcaacgcaagcctcacgcaagttctgccctatcgactacctgtttggctgcggagtgct

SEQ ID NO: 83946 - DNA, 75 bp, Artificial Sequence
  Synthetic
gcctcacgcaagttctgccctatcgactacctgtttggctgcggagtgcttgttggaaatgcttttgtgtttccg

SEQ ID NO: 83947 - DNA, 75 bp, Artificial Sequence
  Synthetic
ccaccaatccacttgttccatcagacaccgtgcagacgcgacatgtcatacagcagcgtagcaggactgagtcaa

SEQ ID NO: 83948 - DNA, 75 bp, Artificial Sequence
  Synthetic
tgcatggccaaacataataattgggggctggcaataataccactgagcgaactgaaatttccagatacttccagc

SEQ ID NO: 83949 - DNA, 75 bp, Artificial Sequence
  Synthetic
ggctggcaataataccactgagcgaactgaaatttccagatacttccagcactgaaattcctatcactgtgacta

SEQ ID NO: 83950 - DNA, 75 bp, Artificial Sequence
  Synthetic
cccaaaaactgttcgccacatggcgaatcacctataaggacacggtacaattgcgccggaagttagagtttttca

SEQ ID NO: 83951 - DNA, 75 bp, Artificial Sequence
  Synthetic
atgtaccgggaagtaatcaatatttgacttcagacaacttccagtctccttgtgcactaccagaatttgatgtaa

SEQ ID NO: 83952 - DNA, 75 bp, Artificial Sequence
  Synthetic
gacttcagacaacttccagtctccttgtgcactaccagaatttgatgtaacacagcccataaatataccaggtga

SEQ ID NO: 83953 - DNA, 75 bp, Artificial Sequence
  Synthetic
aaacttcttcaaacccatccatattctacacctacggtgctgccccggcccggatttccgtaccatatgtgggat

SEQ ID NO: 83954 - DNA, 75 bp, Artificial Sequence
  Synthetic
catgggtatgtacagagtgcctttgagtaccagcgctgatttagacttgcctatcttatgtctatcactgtcacc

SEQ ID NO: 83955 - DNA, 75 bp, Artificial Sequence
  Synthetic
agtaccagcgctgatttagacttgcctatcttatgtctatcactgtcaccagccagtgatgaaagactgtcttac

SEQ ID NO: 83956 - DNA, 75 bp, Artificial Sequence
  Synthetic
gggattcactctacagcgccatgactgtggatgatttcggtgtcctcgccataagagtggtcaatgatcacaacc

SEQ ID NO: 83957 - DNA, 75 bp, Artificial Sequence
  Synthetic
tctatgatggcaactgggaagcttctagtcgcatacgcgccacccggtgcaaagcctccaaccacacgcaaagag

SEQ ID NO: 83958 - DNA, 75 bp, Artificial Sequence
  Synthetic
tagtcgcatacgcgccacccggtgcaaagcctccaaccacacgcaaagaggccatgttaggcactcacgtaatct

SEQ ID NO: 83959 - DNA, 75 bp, Artificial Sequence
  Synthetic
aagatgatttcactgagggtggctacatctctatgttttaccaaaccaaaatagttgtgccagcttccaccccaa

SEQ ID NO: 83960 - DNA, 75 bp, Artificial Sequence
  Synthetic
catctctatgttttaccaaaccaaaatagttgtgccagcttccaccccaacagagatggacattttaggctttgt

SEQ ID NO: 83961 - DNA, 75 bp, Artificial Sequence
  Synthetic
cctagaggatttgattgcagaggtggcgtccaacgcgttggcgatctcgcaacccaggccaccaagtgcacaaca

SEQ ID NO: 83962 - DNA, 75 bp, Artificial Sequence
  Synthetic
gcgtccaacgcgttggcgatctcgcaacccaggccaccaagtgcacaacaaagcttaccagacaccaatcagtca

SEQ ID NO: 83963 - DNA, 75 bp, Artificial Sequence
  Synthetic
gacttagtacaaacaaggcatgttgtgcagacacgcagcaggagtgaatctacggtggagtctttcttcgcaaga

SEQ ID NO: 83964 - DNA, 75 bp, Artificial Sequence
  Synthetic
tgcagacacgcagcaggagtgaatctacggtggagtctttcttcgcaagaggagcatgcgtcaccatcatgtctg

SEQ ID NO: 83965 - DNA, 75 bp, Artificial Sequence
  Synthetic
cggtgcaactaaggagaaaattggaaatgtttacgtactctagatttgacatggagtttacatttgtaatgacag

SEQ ID NO: 83966 - DNA, 75 bp, Artificial Sequence
  Synthetic
aatgtttacgtactctagatttgacatggagtttacatttgtaatgacagagaggtactttaatgctggtaatgc

SEQ ID NO: 83967 - DNA, 75 bp, Artificial Sequence
  Synthetic
aagaacctgataaagattatatcctccctagtcatcattaccagaaactacgaggatacaactacagtgctggct

SEQ ID NO: 83968 - DNA, 75 bp, Artificial Sequence
  Synthetic
ccctagtcatcattaccagaaactacgaggatacaactacagtgctggctaccctggcactcctcgggtgtgatg

SEQ ID NO: 83969 - DNA, 75 bp, Artificial Sequence
  Synthetic
gcaaacgtcctcaaatccatccattttctatacttacggggctgcaccagcaaggatttccatcccatacgttgg

SEQ ID NO: 83970 - DNA, 75 bp, Artificial Sequence
  Synthetic
ttctatacttacggggctgcaccagcaaggatttccatcccatacgttggcattgccaatgcgtattcccatttt

SEQ ID NO: 83971 - DNA, 75 bp, Artificial Sequence
  Synthetic
gctggctgaagaaatttacagaggcatgcaacgctgccaagggattggaatgggtgtccaataagatatctaagt

SEQ ID NO: 83972 - DNA, 75 bp, Artificial Sequence
  Synthetic
atgcaacgctgccaagggattggaatgggtgtccaataagatatctaagttcattgactggttgaaggagaaaat

SEQ ID NO: 83973 - DNA, 75 bp, Artificial Sequence
  Synthetic
atcaatgactttgggattctagcagtgagagttgttaatgaatacaacccagtacagatctcatcaaaaatcaga

SEQ ID NO: 83974 - DNA, 75 bp, Artificial Sequence
  Synthetic
tgagagttgttaatgaatacaacccagtacagatctcatcaaaaatcagagtttacatgaagcccaagcatgtac

SEQ ID NO: 83975 - DNA, 75 bp, Artificial Sequence
  Synthetic
aaccatacaccagtcgtgcccaagccaggagcaccaagaaatcctgtttaacaatgtgaggtggctatctataca

SEQ ID NO: 83976 - DNA, 75 bp, Artificial Sequence
  Synthetic
caggagcaccaagaaatcctgtttaacaatgtgaggtggctatctatacagtcaaaaagatttgccccactctac

SEQ ID NO: 83977 - DNA, 75 bp, Artificial Sequence
  Synthetic
caccactcagtaagaaagggttaaccacgtacggattcgggcatcagaacaaagcagtgtacacagctggttaca

SEQ ID NO: 83978 - DNA, 75 bp, Artificial Sequence
  Synthetic
cacgtacggattcgggcatcagaacaaagcagtgtacacagctggttacaaaatatgcaattaccatttagcaac

SEQ ID NO: 83979 - DNA, 75 bp, Artificial Sequence
  Synthetic
attgaaccagtatgtttgttagtgcatggcagtccaggaacaggcaagtcagtagccactaacctgatagccaga

SEQ ID NO: 83980 - DNA, 75 bp, Artificial Sequence
  Synthetic
atggcagtccaggaacaggcaagtcagtagccactaacctgatagccagagcaattgcagagaaggagaacacct

SEQ ID NO: 83981 - DNA, 75 bp, Artificial Sequence
  Synthetic
gacagattctattgctaggtgcaattgtaacacaggagtgtactattgtgagtccagaagaaagtactatccaat

SEQ ID NO: 83982 - DNA, 75 bp, Artificial Sequence
  Synthetic
tgtaacacaggagtgtactattgtgagtccagaagaaagtactatccaatctcttttgtgggccccacttttcaa

SEQ ID NO: 83983 - DNA, 75 bp, Artificial Sequence
  Synthetic
taaatcaaaacccagatggagctgatatgaagcttttctgtcaaatggtttccaccgtggagtttattccaccaa

SEQ ID NO: 83984 - DNA, 75 bp, Artificial Sequence
  Synthetic
tatgaagcttttctgtcaaatggtttccaccgtggagtttattccaccaatggcttcactagaagagaagggtat

SEQ ID NO: 83985 - DNA, 75 bp, Artificial Sequence
  Synthetic
ggggattgtggaggaatcctgagatgccagcatggagtcataggtattataactgcaggaggggaggggcttgtc

SEQ ID NO: 83986 - DNA, 75 bp, Artificial Sequence
  Synthetic
gccagcatggagtcataggtattataactgcaggaggggaggggcttgtcgcattctcagacgtcagggatctat

SEQ ID NO: 83987 - DNA, 75 bp, Artificial Sequence
  Synthetic
cgccctagccaggcgttttgcatttgacatggatattcaagttatgggtgagtactccagggacgggaagctaaa

SEQ ID NO: 83988 - DNA, 75 bp, Artificial Sequence
  Synthetic
gacatggatattcaagttatgggtgagtactccagggacgggaagctaaacatggcgatggcaaccgagatgtgt

SEQ ID NO: 83989 - DNA, 75 bp, Artificial Sequence
  Synthetic
gcttcacacaacaaattggagacaaaatctcagaactaaccaacatggttaccagtaccattacagaaaaactac

SEQ ID NO: 83990 - DNA, 75 bp, Artificial Sequence
  Synthetic
aatctcagaactaaccaacatggttaccagtaccattacagaaaaactactaaaaaatttgatcaaaatcatttc

SEQ ID NO: 83991 - DNA, 75 bp, Artificial Sequence
  Synthetic
aaatcttccagagttaggtacagcattgaccagattactaccatgattattaatgagaagaataggaggtccaat

SEQ ID NO: 83992 - DNA, 75 bp, Artificial Sequence
  Synthetic
ttgaccagattactaccatgattattaatgagaagaataggaggtccaatattggaaattgcatggaagcactat

SEQ ID NO: 83993 - DNA, 75 bp, Artificial Sequence
  Synthetic
tgtttccccctggcaatggctcaagaaaaaggcctgtgatattttggaaattccatacgtcattcgtcaaggaga

SEQ ID NO: 83994 - DNA, 75 bp, Artificial Sequence
  Synthetic
aaaaaggcctgtgatattttggaaattccatacgtcattcgtcaaggagatagctggctgaagaagtttacagag

SEQ ID NO: 83995 - DNA, 75 bp, Artificial Sequence
  Synthetic
tacttcaggctgtggactcccaagaagtgagggactattgtgagaaaaagggatggattgtaaacatcactagtg

SEQ ID NO: 83996 - DNA, 75 bp, Artificial Sequence
  Synthetic
agtgagggactattgtgagaaaaagggatggattgtaaacatcactagtgcagtccagactgagaggaacatcaa

SEQ ID NO: 83997 - DNA, 75 bp, Artificial Sequence
  Synthetic
atcatcccccaggcaagagacaaacttgagtttgtgacaaaacttaagcagttggaaatgttggagaaccaaata

SEQ ID NO: 83998 - DNA, 75 bp, Artificial Sequence
  Synthetic
ttgagtttgtgacaaaacttaagcagttggaaatgttggagaaccaaatatccacaatccaccaatcgtgcccaa

SEQ ID NO: 83999 - DNA, 75 bp, Artificial Sequence
  Synthetic
ctttgcaggacaccagggtgcttacacaggacttcccaacaagagacctaatgttcccaccattagaaccgcgaa

SEQ ID NO: 84000 - DNA, 75 bp, Artificial Sequence
  Synthetic
acaggacttcccaacaagagacctaatgttcccaccattagaaccgcgaaagttcagggtccaggatttgactac

SEQ ID NO: 84001 - DNA, 75 bp, Artificial Sequence
  Synthetic
acgcagtagaggctaaaagaattcaaaaactggaacacacaattaataattacatacagttcaagagcaaacacc

SEQ ID NO: 84002 - DNA, 75 bp, Artificial Sequence
  Synthetic
aaaactggaacacacaattaataattacatacagttcaagagcaaacaccgtattgaaccagtatgtctactagt

SEQ ID NO: 84003 - DNA, 75 bp, Artificial Sequence
  Synthetic
gataatgttgccatcctaccaactcacgcctcgccaggtgaaacactagttattgatggcaaagaggtggtagtg

SEQ ID NO: 84004 - DNA, 75 bp, Artificial Sequence
  Synthetic
acgcctcgccaggtgaaacactagttattgatggcaaagaggtggtagtgctggatgccaaggctctagaggacc

SEQ ID NO: 84005 - DNA, 75 bp, Artificial Sequence
  Synthetic
gtccacttactctctcccaccagatccttctcattttgatggctataagcaacaaggggtagtaattatggatga

SEQ ID NO: 84006 - DNA, 75 bp, Artificial Sequence
  Synthetic
ccttctcattttgatggctataagcaacaaggggtagtaattatggatgatttaaatcagaacccggatggtgct

SEQ ID NO: 84007 - DNA, 75 bp, Artificial Sequence
  Synthetic
tccccacccagattaccgagaccaacgatggagtgctgatcgtgaacactagtaagtaccccaacatgtatgttc

SEQ ID NO: 84008 - DNA, 75 bp, Artificial Sequence
  Synthetic
cgatggagtgctgatcgtgaacactagtaagtaccccaacatgtatgttcctgtcggtgctgtgaccgagcaggg

SEQ ID NO: 84009 - DNA, 75 bp, Artificial Sequence
  Synthetic
atactctttacatccaactacgtattggcttctactaattccagcagaataactccacctactgtggcacacagt

SEQ ID NO: 84010 - DNA, 75 bp, Artificial Sequence
  Synthetic
tggcttctactaattccagcagaataactccacctactgtggcacacagtgatgccctggcgaggagatttgctt

SEQ ID NO: 84011 - DNA, 75 bp, Artificial Sequence
  Synthetic
cggagtcatcacgtgtactggcaaagttatcgggatgcatgttggtgggaacggttcgcatgggttcgcagcggc

SEQ ID NO: 84012 - DNA, 75 bp, Artificial Sequence
  Synthetic
gttatcgggatgcatgttggtgggaacggttcgcatgggttcgcagcggccctgaaacggtcatacttcacccag

SEQ ID NO: 84013 - DNA, 75 bp, Artificial Sequence
  Synthetic
gcaagaactgccaccaaccagccaattttaaaaagtgttgcccactggtgtgtggaaaggcaattcagttgatgg

SEQ ID NO: 84014 - DNA, 75 bp, Artificial Sequence
  Synthetic
ttttaaaaagtgttgcccactggtgtgtggaaaggcaattcagttgatggacaagtcctctagagttagatacag

SEQ ID NO: 84015 - DNA, 75 bp, Artificial Sequence
  Synthetic
aaactggagcccagtgctttccactatgtatttgatggagtcaaagaaccagctgtacttaccaagagcgaccct

SEQ ID NO: 84016 - DNA, 75 bp, Artificial Sequence
  Synthetic
atgtatttgatggagtcaaagaaccagctgtacttaccaagagcgaccctaggttaaagacagactttgaggaag

SEQ ID NO: 84017 - DNA, 75 bp, Artificial Sequence
  Synthetic
attccagggaccactccaatataaggatctcaagatagacatcaagaccactcctccacccgagtgtataagtga

SEQ ID NO: 84018 - DNA, 75 bp, Artificial Sequence
  Synthetic
gatctcaagatagacatcaagaccactcctccacccgagtgtataagtgacctgctacaagcagttgattcacaa

SEQ ID NO: 84019 - DNA, 75 bp, Artificial Sequence
  Synthetic
caggccagctcatgtccttggacatcaacacagaacaaatgtgccttgaggatgccatgtacgggactgatggat

SEQ ID NO: 84020 - DNA, 75 bp, Artificial Sequence
  Synthetic
caacacagaacaaatgtgccttgaggatgccatgtacgggactgatggattggaggccctagatctcagcacgag

SEQ ID NO: 84021 - DNA, 75 bp, Artificial Sequence
  Synthetic
aacagagctatgacaattttgcaggccgtcaccacctttgctgcagtcgccggagtggtgtacgtcatgtacaag

SEQ ID NO: 84022 - DNA, 75 bp, Artificial Sequence
  Synthetic
ccgtcaccacctttgctgcagtcgccggagtggtgtacgtcatgtacaagctctttgcgggataccagggcgcat

SEQ ID NO: 84023 - DNA, 75 bp, Artificial Sequence
  Synthetic
gatgcaaagacttctagatacctacgggattaatttaccactggtcacttatgtgaaggatgaactcagatccaa

SEQ ID NO: 84024 - DNA, 75 bp, Artificial Sequence
  Synthetic
gggattaatttaccactggtcacttatgtgaaggatgaactcagatccaaaactaaagtggagcaaggcaaatcc

SEQ ID NO: 84025 - DNA, 75 bp, Artificial Sequence
  Synthetic
acgcagttgctatggcaaaaagaaacattgttaccgccaccactagcaaaggagaattcacaatgcttggagtgc

SEQ ID NO: 84026 - DNA, 75 bp, Artificial Sequence
  Synthetic
cacaaaaatccaggtgttgtgacaggctcagcggttggttgtgacccagatttgttttggagcaagataccagtc

SEQ ID NO: 84027 - DNA, 75 bp, Artificial Sequence
  Synthetic
gctcagcggttggttgtgacccagatttgttttggagcaagataccagtcttgatggaggagaagctctttgcat

SEQ ID NO: 84028 - DNA, 75 bp, Artificial Sequence
  Synthetic
gttattgatggaaaagaggttgaggtgctggacgctaaagcgcttgaggatcaggccggaaccaacttagagatt

SEQ ID NO: 84029 - DNA, 75 bp, Artificial Sequence
  Synthetic
gtttcggagacagagtggattacattgactacttgaaccattcacatcatctatacaaaaataaaacatattgtg

SEQ ID NO: 84030 - DNA, 75 bp, Artificial Sequence
  Synthetic
aatgatggagtgttgatcgtgaacactagtaagtaccccaatatgtatgtacctgtcggtgcagtgaccgaacaa

SEQ ID NO: 84031 - DNA, 75 bp, Artificial Sequence
  Synthetic
ctagtaagtaccccaatatgtatgtacctgtcggtgcagtgaccgaacaagggtacttgaacttgggcgggcgtc

SEQ ID NO: 84032 - DNA, 75 bp, Artificial Sequence
  Synthetic
gaacggttcacatgggttcgctgcggccctgaagcggtcatacttcactcagagtcaaggtgaaatacagtggat

SEQ ID NO: 84033 - DNA, 75 bp, Artificial Sequence
  Synthetic
tagcctcctagcccaatcaggaaaggactatggattaaccatgacaccagctgacaaatcagccacattcgaaac

SEQ ID NO: 84034 - DNA, 75 bp, Artificial Sequence
  Synthetic
gccctgaagcggtcatacttcactcagagtcaaggtgaaatacagtggatgagaccatcaaaagaggttggttac

SEQ ID NO: 84035 - DNA, 75 bp, Artificial Sequence
  Synthetic
agtaatgccaatgaaggaaattcatgaatcaattagatggacaaaagatcctagaaacactcaggatcacgtgcg

SEQ ID NO: 84036 - DNA, 75 bp, Artificial Sequence
  Synthetic
cccgcagtgttgactaagaatgaccctagattgagaacagattttgaagaggccattttctcgaagtatgtgggg

SEQ ID NO: 84037 - DNA, 75 bp, Artificial Sequence
  Synthetic
ctagattgagaacagattttgaagaggccattttctcgaagtatgtggggaataagatcactgaagttgatgaat

SEQ ID NO: 84038 - DNA, 75 bp, Artificial Sequence
  Synthetic
gaatcaattagatggacaaaagatcctagaaacactcaggatcacgtgcgctcactgtgcttattggcttggcac

SEQ ID NO: 84039 - DNA, 75 bp, Artificial Sequence
  Synthetic
aagacgccatgtatggcactgatggtttagaagctctagacctcactaccagtgcaggctacccctatgtggcgc

SEQ ID NO: 84040 - DNA, 75 bp, Artificial Sequence
  Synthetic
tttagaagctctagacctcactaccagtgcaggctacccctatgtggcgcttgggaaaaagaagagggacatttt

SEQ ID NO: 84041 - DNA, 75 bp, Artificial Sequence
  Synthetic
ttatgtcaaggatgaactgaggagcaaaagcaaggtagagcaagggaaatccaggctgattgaggcttcaagctt

SEQ ID NO: 84042 - DNA, 75 bp, Artificial Sequence
  Synthetic
aaaagcaaggtagagcaagggaaatccaggctgattgaggcttcaagcttgaatgattctgtggcaatgagaatg

SEQ ID NO: 84043 - DNA, 75 bp, Artificial Sequence
  Synthetic
cagacaattgtaccataatgggtgctcaggtttcatcacagaaagtgggcgcacatgaaaactcaaatagagcgt

SEQ ID NO: 84044 - DNA, 75 bp, Artificial Sequence
  Synthetic
gatttattttggagtaagattccagtactaatggaagataaactctttgcattcgattacactggctatgacgct

SEQ ID NO: 84045 - DNA, 75 bp, Artificial Sequence
  Synthetic
attgattacctcaaccactcacaccatctctacaaaaacaagacctattgtgttaagggcggtatgccatctggc

SEQ ID NO: 84046 - DNA, 75 bp, Artificial Sequence
  Synthetic
ccagtgatgccaatgaaggaaattcatgaatcaatcagatggacaaaggatcctagaaacacacaggaccacgtt

SEQ ID NO: 84047 - DNA, 75 bp, Artificial Sequence
  Synthetic
tcctagaaacacacaggaccacgttcgctcattgtgcctgttggcttggcacaatggcgaggaagagtacaacaa

SEQ ID NO: 84048 - DNA, 75 bp, Artificial Sequence
  Synthetic
tctgtttccccggtgaagttgtatatgctgtacccacggcaaaaaacgaccgatccgttatccgcttaggtactt

SEQ ID NO: 84049 - DNA, 75 bp, Artificial Sequence
  Synthetic
atgagtctggacgttccccactggcgacagtggtccaggctgcgttggcggcccacctgcggcccaaagccgcag

SEQ ID NO: 84050 - DNA, 75 bp, Artificial Sequence
  Synthetic
tcttagtcacagaatcaagggcccagggcaccgattcgatcgcaaggtgcaattgcaacgcaggagtgtattact

SEQ ID NO: 84051 - DNA, 75 bp, Artificial Sequence
  Synthetic
gacttggattggccatccggtgagagttagatcaatcgtttacttgtttgttggttttacctcgataacacccta

SEQ ID NO: 84052 - DNA, 75 bp, Artificial Sequence
  Synthetic
gttagatcaatcgtttacttgtttgttggttttacctcgataacaccctacacaccaaccattttgagaattgta

SEQ ID NO: 84053 - DNA, 75 bp, Artificial Sequence
  Synthetic
cgttgctactggtgggtcaaccgttaattacactaccataaattactataaggactcagctagcaatgcagcttc

SEQ ID NO: 84054 - DNA, 75 bp, Artificial Sequence
  Synthetic
aattacactaccataaattactataaggactcagctagcaatgcagcttccaagctggacttctcacaagaccct

SEQ ID NO: 84055 - DNA, 75 bp, Artificial Sequence
  Synthetic
tgtgggtatagtgacagagttagacaaattactctaggaaactccacgatcaccacccaagaggcagcaaatgcg

SEQ ID NO: 84056 - DNA, 75 bp, Artificial Sequence
  Synthetic
aaattactctaggaaactccacgatcaccacccaagaggcagcaaatgcggtggttgcttacggggagtggccaa

SEQ ID NO: 84057 - DNA, 75 bp, Artificial Sequence
  Synthetic
ccttggactctgtgcaatggacaagcactagtagaggatggtggtggaagctaccagatgccttaaaggacatgg

SEQ ID NO: 84058 - DNA, 75 bp, Artificial Sequence
  Synthetic
cactagtagaggatggtggtggaagctaccagatgccttaaaggacatgggtatgtttggccagaacatgtacta

SEQ ID NO: 84059 - DNA, 75 bp, Artificial Sequence
  Synthetic
ggtttttgctataccagagtatgttatggcctgcaacacagaagctaaaacttcttatgtgtcatacattaatgc

SEQ ID NO: 84060 - DNA, 75 bp, Artificial Sequence
  Synthetic
atggcctgcaacacagaagctaaaacttcttatgtgtcatacattaatgccaatccaggtgagaaggggggggtg

SEQ ID NO: 84061 - DNA, 75 bp, Artificial Sequence
  Synthetic
tgcggggttttggcagggaatgcctttgtgtaccctcatcagataattaatcttaggacaaacaattcagcaacc

SEQ ID NO: 84062 - DNA, 75 bp, Artificial Sequence
  Synthetic
ttgtgtaccctcatcagataattaatcttaggacaaacaattcagcaacccttgtgttaccctatgtaaactctc

SEQ ID NO: 84063 - DNA, 75 bp, Artificial Sequence
  Synthetic
cgaactcatccacggagatccccataacagtgaccattgcaccgatgttcacagaatttaacgggcttaggaaca

SEQ ID NO: 84064 - DNA, 75 bp, Artificial Sequence
  Synthetic
aacagtgaccattgcaccgatgttcacagaatttaacgggcttaggaacataaccgtaccagctactcaaggtct

SEQ ID NO: 84065 - DNA, 75 bp, Artificial Sequence
  Synthetic
ctttgatgtgacgccaccaatacacataccaggagaggtatttaacatgatggaattggccgagattgactcaat

SEQ ID NO: 84066 - DNA, 75 bp, Artificial Sequence
  Synthetic
ataccaggagaggtatttaacatgatggaattggccgagattgactcaatgatcccaatgaactcagtaaccggc

SEQ ID NO: 84067 - DNA, 75 bp, Artificial Sequence
  Synthetic
cttagtccggcttctgacaagagattacagtacaccatgctgggggagattctcaattattacacccactggact

SEQ ID NO: 84068 - DNA, 75 bp, Artificial Sequence
  Synthetic
tacagtacaccatgctgggggagattctcaattattacacccactggactggctcactgagattcaccttcctgt

SEQ ID NO: 84069 - DNA, 75 bp, Artificial Sequence
  Synthetic
gaaaggatgcgatgctgggcacgcatataatatgggatcttgggcttcagtcctcatgtaccatgttggcccctt

SEQ ID NO: 84070 - DNA, 75 bp, Artificial Sequence
  Synthetic
tataatatgggatcttgggcttcagtcctcatgtaccatgttggccccttggatctccaacaccgtctacagaag

SEQ ID NO: 84071 - DNA, 75 bp, Artificial Sequence
  Synthetic
cacaccaacgtcgatgttcatgttggcttttgtgagtgcctgcccagatttcagtgtgcgtctgttgagagacac

SEQ ID NO: 84072 - DNA, 75 bp, Artificial Sequence
  Synthetic
gcttttgtgagtgcctgcccagatttcagtgtgcgtctgttgagagacactaaccacatctcacaaagaactttg

SEQ ID NO: 84073 - DNA, 75 bp, Artificial Sequence
  Synthetic
ccgcagaaacaactcacggcccaatcgacaccgtccaccagtggagtgaattcacaggaagtgcctgcactcact

SEQ ID NO: 84074 - DNA, 75 bp, Artificial Sequence
  Synthetic
cgacaccgtccaccagtggagtgaattcacaggaagtgcctgcactcactgcggtggagactggtgtatccggcc

SEQ ID NO: 84075 - DNA, 75 bp, Artificial Sequence
  Synthetic
ctttctttggaaggtctgcctgcgttaccatgctggaggtggaaaatttcaacgccacgaccgaagctgacaaga

SEQ ID NO: 84076 - DNA, 75 bp, Artificial Sequence
  Synthetic
taccatgctggaggtggaaaatttcaacgccacgaccgaagctgacaagaagaagcaattcaccacgtgggccat

SEQ ID NO: 84077 - DNA, 75 bp, Artificial Sequence
  Synthetic
ttttgtcataacagaaaggtattacaccagcaacacagggtatgccaggaaccaagtctaccaactcatgtacat

SEQ ID NO: 84078 - DNA, 75 bp, Artificial Sequence
  Synthetic
accagcaacacagggtatgccaggaaccaagtctaccaactcatgtacataccacctggtgctccacgacccaca

SEQ ID NO: 84079 - DNA, 75 bp, Artificial Sequence
  Synthetic
atatccatcccttatgttggtattgcaaacgcgtactcgcatttttatgacgggttcgcacgagtccccttgaag

SEQ ID NO: 84080 - DNA, 75 bp, Artificial Sequence
  Synthetic
caaacgcgtactcgcatttttatgacgggttcgcacgagtccccttgaaggatgagactgttgactctggagaca

SEQ ID NO: 84081 - DNA, 75 bp, Artificial Sequence
  Synthetic
gcattatatctaaaataagagtgtacatgaaacccaaacatgtaaggtgttggtgtcccaggccacctcgcgcag

SEQ ID NO: 84082 - DNA, 75 bp, Artificial Sequence
  Synthetic
catgaaacccaaacatgtaaggtgttggtgtcccaggccacctcgcgcagttccataccgaggtgaaggtgtcga

SEQ ID NO: 84083 - DNA, 75 bp, Artificial Sequence
  Synthetic
catggcagtgtacgttgcaggctacaagatctgtaactatcacttagccacccctgaagaccatgacaacgccgt

SEQ ID NO: 84084 - DNA, 75 bp, Artificial Sequence
  Synthetic
aagatctgtaactatcacttagccacccctgaagaccatgacaacgccgtgagggtgctatggaatagagatctc

SEQ ID NO: 84085 - DNA, 75 bp, Artificial Sequence
  Synthetic
aagtcaatgaagaagtactacccagttaccgtcacagaacccaccttccaatatatggaagccaatgattattac

SEQ ID NO: 84086 - DNA, 75 bp, Artificial Sequence
  Synthetic
ttaccgtcacagaacccaccttccaatatatggaagccaatgattattacccagccagatatcaaacacacatgc

SEQ ID NO: 84087 - DNA, 75 bp, Artificial Sequence
  Synthetic
tgacagcaggtggtaacggaattgttgcgtttgcagacatcagggacctgtgggtgtacgaggaggaagcaatgg

SEQ ID NO: 84088 - DNA, 75 bp, Artificial Sequence
  Synthetic
tgcgtttgcagacatcagggacctgtgggtgtacgaggaggaagcaatggaacagggcatcaccagttacatcga

SEQ ID NO: 84089 - DNA, 75 bp, Artificial Sequence
  Synthetic
tactagctccattacagagaaattgctaaaaacactcataaagattatctccaccctagtgataattagcaggaa

SEQ ID NO: 84090 - DNA, 75 bp, Artificial Sequence
  Synthetic
ctaaaaacactcataaagattatctccaccctagtgataattagcaggaactatgaagacaccaccacggtgtta

SEQ ID NO: 84091 - DNA, 75 bp, Artificial Sequence
  Synthetic
ctcccttatgtgatgagacagggggacagttggttgaagaaattcactgaggcttgtaatgctgcaaaagggttg

SEQ ID NO: 84092 - DNA, 75 bp, Artificial Sequence
  Synthetic
tccccggtgacattgtatagactgtacccacggttgaaaacaatagatccgttatccgcttttgtacttcgagaa

SEQ ID NO: 84093 - DNA, 75 bp, Artificial Sequence
  Synthetic
gttgagtttattaccaagcttaagcaattgggaatattggaaaaccaaattaatactatacatcaatcatgtccg

SEQ ID NO: 84094 - DNA, 75 bp, Artificial Sequence
  Synthetic
ctaaattggaaaacaccattaacaactatatccagttcaagagcaaacaccgtattgaaccagtatgtatgttga

SEQ ID NO: 84095 - DNA, 75 bp, Artificial Sequence
  Synthetic
ttatggctgcttatggtgacaatcatagattgttgtcataaagcgaattggattggccatccggtgaaagtcaaa

SEQ ID NO: 84096 - DNA, 75 bp, Artificial Sequence
  Synthetic
cctcgacatactcacttccacctgatcccacacactttgatgggtataagcaacaaggagttgtcatcatggacg

SEQ ID NO: 84097 - DNA, 75 bp, Artificial Sequence
  Synthetic
tcccacacactttgatgggtataagcaacaaggagttgtcatcatggacgatctcaaccagaatcctgacggcaa

SEQ ID NO: 84098 - DNA, 75 bp, Artificial Sequence
  Synthetic
atcagacagtggtatcaccatgggggctcaagtttcatcacagaaagttggagcccatgagaacaccaatgtggc

SEQ ID NO: 84099 - DNA, 75 bp, Artificial Sequence
  Synthetic
gctcaagtttcatcacagaaagttggagcccatgagaacaccaatgtggcaactggtggctcaactgtaaattac

SEQ ID NO: 84100 - DNA, 75 bp, Artificial Sequence
  Synthetic
gatccttttcacttcagactatgttctagcctcgacaaactcacacaccatcacacccccaacggtttcacatag

SEQ ID NO: 84101 - DNA, 75 bp, Artificial Sequence
  Synthetic
ctagcctcgacaaactcacacaccatcacacccccaacggtttcacatagtgacgctctaaacaggagattcgcc

SEQ ID NO: 84102 - DNA, 75 bp, Artificial Sequence
  Synthetic
tttacggagcctgtaaaagacatcatgctgaaatctgccccggcattaaattccccaaatgttgaggcgtgtgga

SEQ ID NO: 84103 - DNA, 75 bp, Artificial Sequence
  Synthetic
tgctgaaatctgccccggcattaaattccccaaatgttgaggcgtgtggatttagcgacagggtaaggcagatca

SEQ ID NO: 84104 - DNA, 75 bp, Artificial Sequence
  Synthetic
tgcaaagattgtccacagccagctaatttcaaaaagtgttgtccattagtttgtggaaaagccttacagttgatg

SEQ ID NO: 84105 - DNA, 75 bp, Artificial Sequence
  Synthetic
atttcaaaaagtgttgtccattagtttgtggaaaagccttacagttgatggataaaaacacccggcagcgcttca

SEQ ID NO: 84106 - DNA, 75 bp, Artificial Sequence
  Synthetic
ttgccccaagcgaagccaacccagttgatgcgccaacagaacccgatgtgagtagtaacaggttttatacattgg

SEQ ID NO: 84107 - DNA, 75 bp, Artificial Sequence
  Synthetic
tgatgcgccaacagaacccgatgtgagtagtaacaggttttatacattggagtcggtacagtggaaaaaggaatc

SEQ ID NO: 84108 - DNA, 75 bp, Artificial Sequence
  Synthetic
tgtttcaaggccctatacaatatagagatgtgatgattgatattaaagaaacacctgccccagattatattaatg

SEQ ID NO: 84109 - DNA, 75 bp, Artificial Sequence
  Synthetic
agatgtgatgattgatattaaagaaacacctgccccagattatattaatgaccttttacagtcagtggacagcca

SEQ ID NO: 84110 - DNA, 75 bp, Artificial Sequence
  Synthetic
cctgggtagatcaggctacactgtacatgtccaatgtaatgcgtctaaattccatcaaggcgctttagctgtgtt

SEQ ID NO: 84111 - DNA, 75 bp, Artificial Sequence
  Synthetic
catgtccaatgtaatgcgtctaaattccatcaaggcgctttagctgtgttcgccgttccagagtgtgtgttctca

SEQ ID NO: 84112 - DNA, 75 bp, Artificial Sequence
  Synthetic
gaacagggctatgaccattttacaagctgtaaccacattcgccgccgtggctgcagttgtttacgtaatgtacaa

SEQ ID NO: 84113 - DNA, 75 bp, Artificial Sequence
  Synthetic
gctgtaaccacattcgccgccgtggctgcagttgtttacgtaatgtacaaactgtttgctgggcaccaaggagcc

SEQ ID NO: 84114 - DNA, 75 bp, Artificial Sequence
  Synthetic
tcacagtacacaccgggcaccaccactgaagatgcaagaacattcagccccattgattacctgttcggatcaggc

SEQ ID NO: 84115 - DNA, 75 bp, Artificial Sequence
  Synthetic
ctgaagatgcaagaacattcagccccattgattacctgttcggatcaggcgtgttattcggaaatgcattcattt

SEQ ID NO: 84116 - DNA, 75 bp, Artificial Sequence
  Synthetic
tatgcagtagcaatggctaaaagaaacattttgacagctaccaccagcaagggtgagttcaccatgcttggtgtt

SEQ ID NO: 84117 - DNA, 75 bp, Artificial Sequence
  Synthetic
ttgattgcatggctagacacaataattggggaatagtaatcatcccagtggttccgttggatttcgctgatgcta

SEQ ID NO: 84118 - DNA, 75 bp, Artificial Sequence
  Synthetic
ttggggaatagtaatcatcccagtggttccgttggatttcgctgatgctagtagcacacaaataccaatcacagt

SEQ ID NO: 84119 - DNA, 75 bp, Artificial Sequence
  Synthetic
gtcttggacgctgaggcgctagaagaccaatcaggcacaaatctggagatcactatagtaaaactcaagagaaac

SEQ ID NO: 84120 - DNA, 75 bp, Artificial Sequence
  Synthetic
tatgctagtgcccggatcaaaccagttcttaacatctgataacttccaatcaccatgtgcactgcctgaatttga

SEQ ID NO: 84121 - DNA, 75 bp, Artificial Sequence
  Synthetic
ttcttaacatctgataacttccaatcaccatgtgcactgcctgaatttgatgtgacacctcccattcacatacct

SEQ ID NO: 84122 - DNA, 75 bp, Artificial Sequence
  Synthetic
ttcctgtaggtgctgtgaccgaacagggatatctcaatctcggtggccggcaaactgctcgcacgttgatgtaca

SEQ ID NO: 84123 - DNA, 75 bp, Artificial Sequence
  Synthetic
aacacaatggacatgtacagaatcggattggatagtaatgaatccaaactgaatgcaccaattttctgcctctct

SEQ ID NO: 84124 - DNA, 75 bp, Artificial Sequence
  Synthetic
ggaacggttcacatgggttcgcagcagccctgaagcggtcctacttcactcagagtcaaggtgaaattcagtgga

SEQ ID NO: 84125 - DNA, 75 bp, Artificial Sequence
  Synthetic
agccctgaagcggtcctacttcactcagagtcaaggtgaaattcagtggatgagaccatcaaaagaagtgggcta

SEQ ID NO: 84126 - DNA, 75 bp, Artificial Sequence
  Synthetic
gattggatagtaatgaatccaaactgaatgcaccaattttctgcctctctctttcccctgctagtgatcaaagat

SEQ ID NO: 84127 - DNA, 75 bp, Artificial Sequence
  Synthetic
tctgtggtagtatgatggccacaggcaaattactactcagttacagcccccctggtgcagcacctccaagaacac

SEQ ID NO: 84128 - DNA, 75 bp, Artificial Sequence
  Synthetic
accagccgtccttaccaagaatgaccccagactcaagacagactttgaggaggccatcttttccaagtatgtggg

SEQ ID NO: 84129 - DNA, 75 bp, Artificial Sequence
  Synthetic
cccagactcaagacagactttgaggaggccatcttttccaagtatgtgggcaataagattactgaggtggatgag

SEQ ID NO: 84130 - DNA, 75 bp, Artificial Sequence
  Synthetic
caaattactactcagttacagcccccctggtgcagcacctccaagaacacggaaagaggcgatgcttggcactca

SEQ ID NO: 84131 - DNA, 75 bp, Artificial Sequence
  Synthetic
atgtgttaaagatgattacactgctggtggttacattacatgcttctaccaaaccaaagttgtagtacccctgag

SEQ ID NO: 84132 - DNA, 75 bp, Artificial Sequence
  Synthetic
gaggatgcaatgtatgggactgatggtctagaggctctcgatctctcaactagtgcagggtatccttatgtagca

SEQ ID NO: 84133 - DNA, 75 bp, Artificial Sequence
  Synthetic
gtctagaggctctcgatctctcaactagtgcagggtatccttatgtagcaatgggcaagaagaagagagatatcc

SEQ ID NO: 84134 - DNA, 75 bp, Artificial Sequence
  Synthetic
ggtggttacattacatgcttctaccaaaccaaagttgtagtacccctgagcacaccaaccagaatggacatgttg

SEQ ID NO: 84135 - DNA, 75 bp, Artificial Sequence
  Synthetic
atacaaccacaaggcctggaggacctcattgaatcagtggctcagaatgctcttcaaatttcccaaccgagacca

SEQ ID NO: 84136 - DNA, 75 bp, Artificial Sequence
  Synthetic
cctatgtgaaggatgaactcagatccaagaccaaggtggaacaaggcaaatccagattgattgaagcttcaagtt

SEQ ID NO: 84137 - DNA, 75 bp, Artificial Sequence
  Synthetic
caagaccaaggtggaacaaggcaaatccagattgattgaagcttcaagtttgaatgattctgtggcaatgagaat

SEQ ID NO: 84138 - DNA, 75 bp, Artificial Sequence
  Synthetic
tcattgaatcagtggctcagaatgctcttcaaatttcccaaccgagaccaactcagagaccatcaatcaccaata

SEQ ID NO: 84139 - DNA, 75 bp, Artificial Sequence
  Synthetic
ccagcgggcaagcagtaccttcagatgttatagaaactaggaaagtgattaactacaaaactaggagtgagtcaa

SEQ ID NO: 84140 - DNA, 75 bp, Artificial Sequence
  Synthetic
agacttattttggagcaaaataccagtcttgatggaagagaaacttttcgcatttgactacacaggttatgatgc

SEQ ID NO: 84141 - DNA, 75 bp, Artificial Sequence
  Synthetic
tgttatagaaactaggaaagtgattaactacaaaactaggagtgagtcaaccattgaaagcttctttggacgatc

SEQ ID NO: 84142 - DNA, 75 bp, Artificial Sequence
  Synthetic
gtgggagattaactacacagacactgtccaactcagacggaagctggagatgtttacatactcacgctttgacac

SEQ ID NO: 84143 - DNA, 75 bp, Artificial Sequence
  Synthetic
cattgattacctgaaccattcgcaccacctttacaaaaacaaaacatattgtgtcaagggcgggatgccatccgg

SEQ ID NO: 84144 - DNA, 75 bp, Artificial Sequence
  Synthetic
gtccaactcagacggaagctggagatgtttacatactcacgctttgacacggaatttaccttcgtgttgaccgaa

SEQ ID NO: 84145 - DNA, 75 bp, Artificial Sequence
  Synthetic
agacccagtgcatgggacgactacacatggcaatcctcatcaaatccttcaatcttctacacctatggttgtgca

SEQ ID NO: 84146 - DNA, 75 bp, Artificial Sequence
  Synthetic
catggcaatcctcatcaaatccttcaatcttctacacctatggttgtgcaccaccgagaatgtctgtgccgttcg

SEQ ID NO: 84147 - DNA, 75 bp, Artificial Sequence
  Synthetic
ctggagacacatactatggccagacatcaatcaatgattttggagcaatagccctcagagtagtcaatgagcaca

SEQ ID NO: 84148 - DNA, 75 bp, Artificial Sequence
  Synthetic
tccagtcatgccaatgaaagaaattcatgaatcaattagatggacaaaggatcctagaaacactcaggaccatgt

SEQ ID NO: 84149 - DNA, 75 bp, Artificial Sequence
  Synthetic
atcaatcaatgattttggagcaatagccctcagagtagtcaatgagcacaacccagcacggattacatcgcgcat

SEQ ID NO: 84150 - DNA, 75 bp, Artificial Sequence
  Synthetic
catgaatcaattagatggacaaaggatcctagaaacactcaggaccatgtccgctcactgtgcctattggcttgg

SEQ ID NO: 84151 - DNA, 75 bp, Artificial Sequence
  Synthetic
tggggtggatataaaagaaggcactttggcccctattacaccagtcacatctatgaccacttatggatttgggca

SEQ ID NO: 84152 - DNA, 75 bp, Artificial Sequence
  Synthetic
ttggcccctattacaccagtcacatctatgaccacttatggatttgggcaccggaacaaagctgtctacgttgct

SEQ ID NO: 84153 - DNA, 75 bp, Artificial Sequence
  Synthetic
gatttaatggtggctgaatccagagctcaaggtaccgacaccatagccagatgtaattgtagaacaggtgtatac

SEQ ID NO: 84154 - DNA, 75 bp, Artificial Sequence
  Synthetic
ctcaaggtaccgacaccatagccagatgtaattgtagaacaggtgtatactattgtgagtccagaagaaagtact

SEQ ID NO: 84155 - DNA, 75 bp, Artificial Sequence
  Synthetic
acatgttactcggacatggatttgcagaacctggtgattgtggtggaattttgagatgtaatcatggtgtgattg

SEQ ID NO: 84156 - DNA, 75 bp, Artificial Sequence
  Synthetic
agaacctggtgattgtggtggaattttgagatgtaatcatggtgtgattggcattatcacagctggagggaatgg

SEQ ID NO: 84157 - DNA, 75 bp, Artificial Sequence
  Synthetic
catcgaatccctgggtgctgcattcggttcaggattcaccaatcaaattggagaaaaagtcgctgaactaaccag

SEQ ID NO: 84158 - DNA, 75 bp, Artificial Sequence
  Synthetic
ggttcaggattcaccaatcaaattggagaaaaagtcgctgaactaaccagcatggtcaccagcacaatcactgaa

SEQ ID NO: 84159 - DNA, 75 bp, Artificial Sequence
  Synthetic
gttctggcgacattggctctcctcggctgtgactgctccccctggcagtggatcaagaagaaggcatgtgacata

SEQ ID NO: 84160 - DNA, 75 bp, Artificial Sequence
  Synthetic
gctgtgactgctccccctggcagtggatcaagaagaaggcatgtgacatactcgagattccttatgttatgagac

SEQ ID NO: 84161 - DNA, 75 bp, Artificial Sequence
  Synthetic
tttctaagttcattgattggctgaaagagaaagttatcccagaggccagagataaagtggaatatgttaccaaac

SEQ ID NO: 84162 - DNA, 75 bp, Artificial Sequence
  Synthetic
tcagatcaacaccatccaccaatcgtgtccgagccaagagcaacaggaagtgctcttcaataatgtgaggtggct

SEQ ID NO: 84163 - DNA, 75 bp, Artificial Sequence
  Synthetic
accagatcccacccattttgatgggtataaacaacaaggggttgtcataatggatgacttgaatcagaatcctga

SEQ ID NO: 84164 - DNA, 75 bp, Artificial Sequence
  Synthetic
tataaacaacaaggggttgtcataatggatgacttgaatcagaatcctgacggaaatgacatgaaactgttctgc

SEQ ID NO: 84165 - DNA, 75 bp, Artificial Sequence
  Synthetic
gttgaaaaaatttactgaggcgtgcaacgcagctaaggggttggaatgggtgtccaacaaaatctcaaaatttat

SEQ ID NO: 84166 - DNA, 75 bp, Artificial Sequence
  Synthetic
tacgttttggcatccacaaactctagcactatagccccacccacagtggctcacagtgatgccttgaccagaaga

SEQ ID NO: 84167 - DNA, 75 bp, Artificial Sequence
  Synthetic
gcactatagccccacccacagtggctcacagtgatgccttgaccagaagattcgctttcgatatggaggtgtaca

SEQ ID NO: 84168 - DNA, 75 bp, Artificial Sequence
  Synthetic
cagcaaatttcaagaaatgttgtcctttaatttgtggaaaggctttacaactcatggacaagaacactagacaaa

SEQ ID NO: 84169 - DNA, 75 bp, Artificial Sequence
  Synthetic
gccatggctactgaaatgtgtaagaactgtcaccaaccagcaaactttaagagatgctgtcctttagtgtgtggt

SEQ ID NO: 84170 - DNA, 75 bp, Artificial Sequence
  Synthetic
tttaatttgtggaaaggctttacaactcatggacaagaacactagacaaaggttcaccctggacgagattaccac

SEQ ID NO: 84171 - DNA, 75 bp, Artificial Sequence
  Synthetic
gagagaaacagaagatccaacattggcaattgtatggaggctttgttccaaggaccactccagtataaagacttg

SEQ ID NO: 84172 - DNA, 75 bp, Artificial Sequence
  Synthetic
gtacaaggacatcaagatagatatcaaggagactcccgccccagagtatataaatgacctactccaagcagttga

SEQ ID NO: 84173 - DNA, 75 bp, Artificial Sequence
  Synthetic
aaggagactcccgccccagagtatataaatgacctactccaagcagttgatagccaagaggtgagggactactgc

SEQ ID NO: 84174 - DNA, 75 bp, Artificial Sequence
  Synthetic
ttgcaagctgtgaccacattcgcagcagttgctggggtggtgtatgtgatgtataagttgtttgccggacagcag

SEQ ID NO: 84175 - DNA, 75 bp, Artificial Sequence
  Synthetic
cagttgctggggtggtgtatgtgatgtataagttgtttgccggacagcagggcgcatacactgggttgccaaaca

SEQ ID NO: 84176 - DNA, 75 bp, Artificial Sequence
  Synthetic
aaagaaacattttgactgctacgaccagcaaaggagaattcactatgcttggagttcatgataacgtagcaattc

SEQ ID NO: 84177 - DNA, 75 bp, Artificial Sequence
  Synthetic
cagcaaaggagaattcactatgcttggagttcatgataacgtagcaattctgcccacacactcacacccaggaga

SEQ ID NO: 84178 - DNA, 75 bp, Artificial Sequence
  Synthetic
ggaaattactatagtcactctaaaaagaaacgaaaagttcagagacatcaggccacacattcctacccaaattac

SEQ ID NO: 84179 - DNA, 75 bp, Artificial Sequence
  Synthetic
agaaacgaaaagttcagagacatcaggccacacattcctacccaaattactgagactaatgatggagtgttaatt

SEQ ID NO: 84180 - DNA, 75 bp, Artificial Sequence
  Synthetic
ggccgacagaccgctcgcacactcatgtacaatttcccaacgcgggcaggccagtgtggaggagttatcacgtgc

SEQ ID NO: 84181 - DNA, 75 bp, Artificial Sequence
  Synthetic
tgtacaatttcccaacgcgggcaggccagtgtggaggagttatcacgtgcactggtaaggtcatcgggatgcatg

SEQ ID NO: 84182 - DNA, 75 bp, Artificial Sequence
  Synthetic
ccagctcatgtcactagacatcaacacagaacaaatgtgcttggaggatgccatgtatggcactgatggtctaga

SEQ ID NO: 84183 - DNA, 75 bp, Artificial Sequence
  Synthetic
agaagaagagagatatcttgaacaaacaaaccagagacactaaggaaatgcaaaaactgctcgacacatatggaa

SEQ ID NO: 84184 - DNA, 75 bp, Artificial Sequence
  Synthetic
aatggatgaggccatctaaagaagtagggtaccccatcattaatgctcctagcaaaaccaaacttgagcctagtg

SEQ ID NO: 84185 - DNA, 75 bp, Artificial Sequence
  Synthetic
agggtaccccatcattaatgctcctagcaaaaccaaacttgagcctagtgcatttcactacatatttgagggagt

SEQ ID NO: 84186 - DNA, 75 bp, Artificial Sequence
  Synthetic
cgtaggtaataaaattactgaggtagatgaatacatgaaagaagcagtggaccattatgccgggcaactaatgtc

SEQ ID NO: 84187 - DNA, 75 bp, Artificial Sequence
  Synthetic
gatgaatacatgaaagaagcagtggaccattatgccgggcaactaatgtcattggatatcaacactgaacagatg

SEQ ID NO: 84188 - DNA, 75 bp, Artificial Sequence
  Synthetic
tacctaaaccactcacaccacctgtacaagaataaaacatactgtgtcaagggcggtatgccatctggttgctca

SEQ ID NO: 84189 - DNA, 75 bp, Artificial Sequence
  Synthetic
gttgcgatgggcaagaagaaaagggacatcttgaacaaacaaaccagggataccaaggaaatgcaaagattatta

SEQ ID NO: 84190 - DNA, 75 bp, Artificial Sequence
  Synthetic
acatcttgaacaaacaaaccagggataccaaggaaatgcaaagattattagatacttatgggatcaacctgccac

SEQ ID NO: 84191 - DNA, 75 bp, Artificial Sequence
  Synthetic
ctagtttgaatgattctgtggccatgagaatggcgtttggtaacttgtatgcagcttttcacaaaaacccaggag

SEQ ID NO: 84192 - DNA, 75 bp, Artificial Sequence
  Synthetic
tatttgcatttgattatacagggtatgacgcctcattgagtccagcttggtttgaggcactaaaaatggtattgg

SEQ ID NO: 84193 - DNA, 75 bp, Artificial Sequence
  Synthetic
catattgtgtcaagggcggcatgccatctggctgctcaggcacttcaatcttcaattcaatgattaacaacttga

SEQ ID NO: 84194 - DNA, 75 bp, Artificial Sequence
  Synthetic
atgattatcaacgagagaaacaggcgttcaaacattggcaattgtatggaagcattgtttcagggaccactccag

SEQ ID NO: 84195 - DNA, 75 bp, Artificial Sequence
  Synthetic
gttcaaacattggcaattgtatggaagcattgtttcagggaccactccagtacaaagatctcaagatagatatca

SEQ ID NO: 84196 - DNA, 75 bp, Artificial Sequence
  Synthetic
agaagaaaggttggctagtcaacatttcaagccaggtgcagttagaacgcaacatcaatagggctatgactatcc

SEQ ID NO: 84197 - DNA, 75 bp, Artificial Sequence
  Synthetic
ttcaagccaggtgcagttagaacgcaacatcaatagggctatgactatcctccaggccgtcaccacctttgctgc

SEQ ID NO: 84198 - DNA, 75 bp, Artificial Sequence
  Synthetic
gagcggacgagaagtacccctttctagtacacccagtcatgcccatgaaggagatacatgagtcaattagatgga

SEQ ID NO: 84199 - DNA, 75 bp, Artificial Sequence
  Synthetic
ataacaaatttttagctaaaatcagaagcgtgccaatcggaagagcattgttgctccctgagtactccacactgt

SEQ ID NO: 84200 - DNA, 75 bp, Artificial Sequence
  Synthetic
gaagccaaacattcccaccattaggactgctaaagtgcaaggacctggatttgattatgcagttgctatggctaa

SEQ ID NO: 84201 - DNA, 75 bp, Artificial Sequence
  Synthetic
accgccgctggctcgattctttttagtgaccctacctcagtcgaattggattggggttatactgttgtaggggta

SEQ ID NO: 84202 - DNA, 75 bp, Artificial Sequence
  Synthetic
gagtgcacgacaacgtggccgtgttgccaacccacgcttcaccaggagaaactatagttatagatggaaaagaag

SEQ ID NO: 84203 - DNA, 75 bp, Artificial Sequence
  Synthetic
ttgaggtgttagacgccaaggcgcttgaagaccaagcgggcaccaatttggaaatcaccatagtcactctcaaga

SEQ ID NO: 84204 - DNA, 75 bp, Artificial Sequence
  Synthetic
ctgttaccccggtgagattgcataagctgtccccacggctaaaagcgattgatccgttatccgctcttgtacttc

SEQ ID NO: 84205 - DNA, 75 bp, Artificial Sequence
  Synthetic
caatgcggtggtatcatcacgtgtactggtaaggttattggaatgcatgttggagggaacggttcacatgggttc

SEQ ID NO: 84206 - DNA, 75 bp, Artificial Sequence
  Synthetic
tggagggaacggttcacatgggttcgctgcggccctgaagcgatcatactttactcagaatcaaggtgagataca

SEQ ID NO: 84207 - DNA, 75 bp, Artificial Sequence
  Synthetic
taaaacaattatctacttgtttgttggatttgttcctatacacacccatacaccttgcttgattgaagtaattct

SEQ ID NO: 84208 - DNA, 75 bp, Artificial Sequence
  Synthetic
tttccactatgtttttgagggggtgaaggaacctgcagtgctgacaaagaatgatcctagattgaaaactgactt

SEQ ID NO: 84209 - DNA, 75 bp, Artificial Sequence
  Synthetic
aaggaacctgcagtgctgacaaagaatgatcctagattgaaaactgactttgaggaggcaatcttctcaaagtac

SEQ ID NO: 84210 - DNA, 75 bp, Artificial Sequence
  Synthetic
ttagacataaacacagagcagatgtgtctagaggatgccatgtatgggactgatggactcgaggctttggatctc

SEQ ID NO: 84211 - DNA, 75 bp, Artificial Sequence
  Synthetic
tagcaatgggcaagaagaagagagacatcttgaacaaacagaccagagacacaaaagaaatgcagagacttctgg

SEQ ID NO: 84212 - DNA, 75 bp, Artificial Sequence
  Synthetic
gtaagtccaggttgattgaggcttctagcttgaatgactctgtagcaatgaggatggcatttggtaatctatatg

SEQ ID NO: 84213 - DNA, 75 bp, Artificial Sequence
  Synthetic
tagcttgaatgactctgtagcaatgaggatggcatttggtaatctatatgcagctttccataaaaacccaggtgt

SEQ ID NO: 84214 - DNA, 75 bp, Artificial Sequence
  Synthetic
gccagatgccttaaaagacatgggcatgtttggccaaaacatgtattaccactacctaggcaggtctggctacac

SEQ ID NO: 84215 - DNA, 75 bp, Artificial Sequence
  Synthetic
ctttgcatttgactatacaggttatgatgcttcccttagccccgcttggtttgaggctctcaaaatggttcttga

SEQ ID NO: 84216 - DNA, 75 bp, Artificial Sequence
  Synthetic
ctcaccatctttacaaaaacaaaacatattgcgtcaagggtggcatgccatctggctgctctggcacttcaattt

SEQ ID NO: 84217 - DNA, 75 bp, Artificial Sequence
  Synthetic
cagtgactattgcaccaatgttcacagaattcaatgggctcaggaacattaccgtgcccgctactcaaggattgc

SEQ ID NO: 84218 - DNA, 75 bp, Artificial Sequence
  Synthetic
agcagatgagaagtatccatttttgatacacccagtaatgccaatgaaggaaattcatgaatcaattagatggac

SEQ ID NO: 84219 - DNA, 75 bp, Artificial Sequence
  Synthetic
aaattcatgaatcaattagatggaccaaggatcccaggaacacccaggatcacgttcgctcgctgtgcttattgg

SEQ ID NO: 84220 - DNA, 75 bp, Artificial Sequence
  Synthetic
cacgttcgctcgctgtgcttattggcctggcacaacggcgaagaggaatacaataaatttttagctaaaataagg

SEQ ID NO: 84221 - DNA, 75 bp, Artificial Sequence
  Synthetic
ttcaccaggagggggtacaaaccagtaccaccacgaacaagcacttctgtttccccggtgacgttgcatagactg

SEQ ID NO: 84222 - DNA, 75 bp, Artificial Sequence
  Synthetic
ggcccctgaatgcggctaatcccaaccacggagcaagtgctcacaaaccagtgagtggcttgtcgtaacgggtaa

SEQ ID NO: 84223 - DNA, 75 bp, Artificial Sequence
  Synthetic
attacactacaatcaattactatagggactctgcaagcaatgcagcaagcaaacaagattttgcacaagatccgt

SEQ ID NO: 84224 - DNA, 75 bp, Artificial Sequence
  Synthetic
gtggttatagtgacagggtaatgcagctaactctgggcaattcaacgatcaccacccaagaagcggccaattctg

SEQ ID NO: 84225 - DNA, 75 bp, Artificial Sequence
  Synthetic
accctagtgataattaacagaaactatgaggataccaccacagtattggcgacactggccctattgggatgcgac

SEQ ID NO: 84226 - DNA, 75 bp, Artificial Sequence
  Synthetic
tcgcaaagaagcaatgcttgggacacatgtgatatgggacattgggttgcagtcttcatgcactatggtggtacc

SEQ ID NO: 84227 - DNA, 75 bp, Artificial Sequence
  Synthetic
ggcaatagctgaaaaagaaaatacctcaacatactcgctcccaccagatcccacgcactttgatgggtacaagca

SEQ ID NO: 84228 - DNA, 75 bp, Artificial Sequence
  Synthetic
gctcaacatggcgatggctactgaaatgtgcaaaaactgtcatcaaccagcaaacttcaaaagatgttgtccttt

SEQ ID NO: 84229 - DNA, 75 bp, Artificial Sequence
  Synthetic
agtgtgtggcaaggcaattcagttaatggataaatcttccagggttagatacagcattgaccagatcactacaat

SEQ ID NO: 84230 - DNA, 75 bp, Artificial Sequence
  Synthetic
gtgggaacggttcacacgggttcgcagcagccctaaaacgatcatacttcactcagagtcaaggtgaaatccagt

SEQ ID NO: 84231 - DNA, 75 bp, Artificial Sequence
  Synthetic
agcagccctaaaacgatcatacttcactcagagtcaaggtgaaatccagtggatgagatcatcaaaagaagtcgg

SEQ ID NO: 84232 - DNA, 75 bp, Artificial Sequence
  Synthetic
agagccagcagttttaactaagaatgatcccaggctcaaggtggattttgaggaggcgatattctccaagtatgt

SEQ ID NO: 84233 - DNA, 75 bp, Artificial Sequence
  Synthetic
gatcccaggctcaaggtggattttgaggaggcgatattctccaagtatgtgggtaacaaaatcacagaggtggat

SEQ ID NO: 84234 - DNA, 75 bp, Artificial Sequence
  Synthetic
ttggaggatgcaatgtatggcactgatggtttggaagcacttgatcttacaactagtgcaggatacccttatgta

SEQ ID NO: 84235 - DNA, 75 bp, Artificial Sequence
  Synthetic
atggtttggaagcacttgatcttacaactagtgcaggatacccttatgtagctttagggaagaagaaaagggaca

SEQ ID NO: 84236 - DNA, 75 bp, Artificial Sequence
  Synthetic
tcacttatgttaaggatgagcttaggtccaaaagcaaagttgagcaagggaaatcaaggcttatcgaagcatcta

SEQ ID NO: 84237 - DNA, 75 bp, Artificial Sequence
  Synthetic
gtccaaaagcaaagttgagcaagggaaatcaaggcttatcgaagcatctagcctcaatgattcagtggcaatgag

SEQ ID NO: 84238 - DNA, 75 bp, Artificial Sequence
  Synthetic
cccagacatattttggagcaagattccagtcctcatggaggaaaagttgttcgcctttgattacaccgggtacga

SEQ ID NO: 84239 - DNA, 75 bp, Artificial Sequence
  Synthetic
agatagggtttggtgatagagtagactacatagattatcttaaccactctcaccacctatacaaaaacaaaacat

SEQ ID NO: 84240 - DNA, 75 bp, Artificial Sequence
  Synthetic
taattgcttcctacccccatgaagtggacgctagtctcctagcccaatcaggaaaagactacggactcacgatga

SEQ ID NO: 84241 - DNA, 75 bp, Artificial Sequence
  Synthetic
cagatgaaaagtatccattcctcatacatccagtgatgccaatgaaggaaattcatgaatcaatcagatggacca

SEQ ID NO: 84242 - DNA, 75 bp, Artificial Sequence
  Synthetic
aggatcccagaaacacccaggatcatgttcgctccttgtgcttattggcttggcacaacggagaagaagaataca

SEQ ID NO: 84243 - DNA, 75 bp, Artificial Sequence
  Synthetic
gtacaccggtatcacggtacccttgtacgcctgttttatattcccttccccgtaacttagaagcaataaactcaa

SEQ ID NO: 84244 - DNA, 75 bp, Artificial Sequence
  Synthetic
gtccccacggttgaaagcgattgatccgttaaccgctcttgtacttcgagaagcctagtaccatcctggaatcta

SEQ ID NO: 84245 - DNA, 75 bp, Artificial Sequence
  Synthetic
aagcctagtaccatcctggaatctacgatgcgttgcgctcagcactcaatcccagagtgtagcttaggtcgatga

SEQ ID NO: 84246 - DNA, 75 bp, Artificial Sequence
  Synthetic
agtctgtggcggaaccgactactttgggtgtccgtgtttccttttatttttataatggctgcttatggtgacaat

SEQ ID NO: 84247 - DNA, 75 bp, Artificial Sequence
  Synthetic
gggtgtccgtgtttccttttatttttataatggctgcttatggtgacaatcattgattgttatcataaagcgact

SEQ ID NO: 84248 - DNA, 75 bp, Artificial Sequence
  Synthetic
ccaaacttaattagaatcactttattgattaggtatcattatcacgatgggtgctcaagtgtcttcacagaaggt

SEQ ID NO: 84249 - DNA, 75 bp, Artificial Sequence
  Synthetic
tgattaggtatcattatcacgatgggtgctcaagtgtcttcacagaaggtaagtgctcaggaaaacaccaacgtg

SEQ ID NO: 84250 - DNA, 75 bp, Artificial Sequence
  Synthetic
caagacttttcacaagacccatcaaagttcacagaaccagttaaggacattatgctcaagtcagccccagcccta

SEQ ID NO: 84251 - DNA, 75 bp, Artificial Sequence
  Synthetic
agttcacagaaccagttaaggacattatgctcaagtcagccccagccctaaactcacccaacatcgaggcctgtg

SEQ ID NO: 84252 - DNA, 75 bp, Artificial Sequence
  Synthetic
ttgcttacggggaatggccatcctatcttactgataaggaagctaacccagtggaccagccaaccgaaccagatg

SEQ ID NO: 84253 - DNA, 75 bp, Artificial Sequence
  Synthetic
tcttactgataaggaagctaacccagtggaccagccaaccgaaccagatgtgtcggcgtgccgcttttacacact

SEQ ID NO: 84254 - DNA, 75 bp, Artificial Sequence
  Synthetic
gtttggacaaaacatgttctatcattacttagggcgctctggctatacagtgcatgttcaatgcaatgcttccaa

SEQ ID NO: 84255 - DNA, 75 bp, Artificial Sequence
  Synthetic
tacttagggcgctctggctatacagtgcatgttcaatgcaatgcttccaaattccaccaaggagcactgggagtc

SEQ ID NO: 84256 - DNA, 75 bp, Artificial Sequence
  Synthetic
ccaggcgaaactggtggtgtattcactgacacatacaaccctagcactgacacgacaggagcacgcaaatttgca

SEQ ID NO: 84257 - DNA, 75 bp, Artificial Sequence
  Synthetic
ctgacacatacaaccctagcactgacacgacaggagcacgcaaatttgcagctgtggattacttgctcggatgtg

SEQ ID NO: 84258 - DNA, 75 bp, Artificial Sequence
  Synthetic
ttctaccctatgtgaattccatggcaatcgattgcatggccaaacacaacaactggggaatcgccatactgcccc

SEQ ID NO: 84259 - DNA, 75 bp, Artificial Sequence
  Synthetic
aatcgattgcatggccaaacacaacaactggggaatcgccatactgccccttgctgaattggactttgcagaggc

SEQ ID NO: 84260 - DNA, 75 bp, Artificial Sequence
  Synthetic
caaccccgccagacagggtttaccagttatgaatgtaccgggcagtaaccaatttttatcgtctgacaacttcca

SEQ ID NO: 84261 - DNA, 75 bp, Artificial Sequence
  Synthetic
gttatgaatgtaccgggcagtaaccaatttttatcgtctgacaacttccagtctccatgtgctctgcccgaattt

SEQ ID NO: 84262 - DNA, 75 bp, Artificial Sequence
  Synthetic
ccaatggaccttagtgacacaaaaaagaacacaatgggtatgtacagagttgaactgggttcttctaaatcacta

SEQ ID NO: 84263 - DNA, 75 bp, Artificial Sequence
  Synthetic
agaacacaatgggtatgtacagagttgaactgggttcttctaaatcactaacagatccaattctgtgtctcagct

SEQ ID NO: 84264 - DNA, 75 bp, Artificial Sequence
  Synthetic
gatctctcaaattcacatttttgttctgtggtagcatgatggcaactgggaaaattttaatatcatatgcaccac

SEQ ID NO: 84265 - DNA, 75 bp, Artificial Sequence
  Synthetic
ctgtggtagcatgatggcaactgggaaaattttaatatcatatgcaccaccaggagcaaaacccccaaaaaccag

SEQ ID NO: 84266 - DNA, 75 bp, Artificial Sequence
  Synthetic
gattagtaatgtcatgtaccgaaggtgcgtgaaggatgacttcactgaagggggttacatctcaatgttctacca

SEQ ID NO: 84267 - DNA, 75 bp, Artificial Sequence
  Synthetic
tgcgtgaaggatgacttcactgaagggggttacatctcaatgttctaccaaacaaagattgtggtgcccttgtcc

SEQ ID NO: 84268 - DNA, 75 bp, Artificial Sequence
  Synthetic
gttcccccggtgaggttgtatagactgtgcccacggttgaaagcgaccgatccgttatccgctcttgtacttcga

SEQ ID NO: 84269 - DNA, 75 bp, Artificial Sequence
  Synthetic
acccacatttcacagacaaccaggatcaacactcaaggacccattgaagaaattatttcaactgtcgctagcaac

SEQ ID NO: 84270 - DNA, 75 bp, Artificial Sequence
  Synthetic
tcaacactcaaggacccattgaagaaattatttcaactgtcgctagcaacgcactagctctcagccaacctaaac

SEQ ID NO: 84271 - DNA, 75 bp, Artificial Sequence
  Synthetic
tagaaactggagcaacgagtgacgtggtgccatcagatttggtgcaaaccagacacgtggtgaacgtcaaatcca

SEQ ID NO: 84272 - DNA, 75 bp, Artificial Sequence
  Synthetic
ggtgccatcagatttggtgcaaaccagacacgtggtgaacgtcaaatccagatcagagtccacaattgagtcatt

SEQ ID NO: 84273 - DNA, 75 bp, Artificial Sequence
  Synthetic
tgggtgtccgtgtttccttttatctttataatggctgcttatggtgacaatcattgattgttgccataaagcgac

SEQ ID NO: 84274 - DNA, 75 bp, Artificial Sequence
  Synthetic
gttgtttgctaagtgggctatcacatatacagatacagtgcaattgaggcgaaagttagaattcttcacctactc

SEQ ID NO: 84275 - DNA, 75 bp, Artificial Sequence
  Synthetic
tatacagatacagtgcaattgaggcgaaagttagaattcttcacctactccagattcgatcttgaaatgaccttt

SEQ ID NO: 84276 - DNA, 75 bp, Artificial Sequence
  Synthetic
gctaagtttgatcagagtcaccttgttaattagatattattaccacgatgggtgcacaagtgtcctcacagaagg

SEQ ID NO: 84277 - DNA, 75 bp, Artificial Sequence
  Synthetic
ccaggagcaccaacacccaatgctcgggatgattacacatggcagacatcctccaacccgtcaattttctttacc

SEQ ID NO: 84278 - DNA, 75 bp, Artificial Sequence
  Synthetic
gggatgattacacatggcagacatcctccaacccgtcaattttctttaccacagggaatgcgcctccacggatct

SEQ ID NO: 84279 - DNA, 75 bp, Artificial Sequence
  Synthetic
aaaatactgactcaggggacacttattatggcctcacctccatcaacgatttcgggacacttgctgtcagagttg

SEQ ID NO: 84280 - DNA, 75 bp, Artificial Sequence
  Synthetic
ttatggcctcacctccatcaacgatttcgggacacttgctgtcagagttgtcaatgattataacccagcaagagt

SEQ ID NO: 84281 - DNA, 75 bp, Artificial Sequence
  Synthetic
aactcaagaagctgcgaactcggtagttgcttacggggaatggccatcctatctcaccgataaggaagcaaaccc

SEQ ID NO: 84282 - DNA, 75 bp, Artificial Sequence
  Synthetic
gttgcttacggggaatggccatcctatctcaccgataaggaagcaaacccagtggaccaaccaactgagccagat

SEQ ID NO: 84283 - DNA, 75 bp, Artificial Sequence
  Synthetic
ttacagggggcctggtgtagatctcttgtccacctccataacaccactgtctaaacatgacctgacaacatacgg

SEQ ID NO: 84284 - DNA, 75 bp, Artificial Sequence
  Synthetic
ttgtccacctccataacaccactgtctaaacatgacctgacaacatacggatttggacaccaaaacaaggcagtg

SEQ ID NO: 84285 - DNA, 75 bp, Artificial Sequence
  Synthetic
ccagatgcattgaaggacatgggtctattcgggcaaaatatgtattaccattacttgggccgttccggctacact

SEQ ID NO: 84286 - DNA, 75 bp, Artificial Sequence
  Synthetic
tattcgggcaaaatatgtattaccattacttgggccgttccggctacactgtgcacgtgcagtgtaatgcgtcta

SEQ ID NO: 84287 - DNA, 75 bp, Artificial Sequence
  Synthetic
tggaatagagatcttttgattacagagtctagggctcagggaatagacacaatagccagatgctcatgcaacacg

SEQ ID NO: 84288 - DNA, 75 bp, Artificial Sequence
  Synthetic
agtctagggctcagggaatagacacaatagccagatgctcatgcaacacgggtgtgtattactgtgaatccaaaa

SEQ ID NO: 84289 - DNA, 75 bp, Artificial Sequence
  Synthetic
actatgttagttatgtgcaggcaaacccgggcgaagctggtggtgtattcactgacacatacaaccctagtacag

SEQ ID NO: 84290 - DNA, 75 bp, Artificial Sequence
  Synthetic
cccgggcgaagctggtggtgtattcactgacacatacaaccctagtacagaaacaacaggggcgcgtaaatttgc

SEQ ID NO: 84291 - DNA, 75 bp, Artificial Sequence
  Synthetic
accagtcccacatgctcattgggcatggtttcgcctcaccaggggattgtggtggtattcttagatgccagcatg

SEQ ID NO: 84292 - DNA, 75 bp, Artificial Sequence
  Synthetic
tggtttcgcctcaccaggggattgtggtggtattcttagatgccagcatggagttattggcataataacagccgg

SEQ ID NO: 84293 - DNA, 75 bp, Artificial Sequence
  Synthetic
gcgcactaacaattgcgccactttggtattaccctatgtgaactccatggcaatcgattgcatggccaagcacaa

SEQ ID NO: 84294 - DNA, 75 bp, Artificial Sequence
  Synthetic
gtattaccctatgtgaactccatggcaatcgattgcatggccaagcacaacaattgggggatagccatattgcct

SEQ ID NO: 84295 - DNA, 75 bp, Artificial Sequence
  Synthetic
caccaactacattgaatctctaggtgccgccttcggaagtgggtttacacaacaaatcggggacaaagtctctga

SEQ ID NO: 84296 - DNA, 75 bp, Artificial Sequence
  Synthetic
gccgccttcggaagtgggtttacacaacaaatcggggacaaagtctctgagattaccagtatgataactagcacc

SEQ ID NO: 84297 - DNA, 75 bp, Artificial Sequence
  Synthetic
gagttcaatggcctgagaaacttaaccagtcccgccaaacaaggtttacctgtgatgaatgtacccggcagtaac

SEQ ID NO: 84298 - DNA, 75 bp, Artificial Sequence
  Synthetic
ccagtcccgccaaacaaggtttacctgtgatgaatgtacccggcagtaaccagtttttatcatctgacaatttcc

SEQ ID NO: 84299 - DNA, 75 bp, Artificial Sequence
  Synthetic
actaccacggtcttggccactctagcactccttgggtgcgatgtgtcaccgtggcagtggctcaagaaaaaggct

SEQ ID NO: 84300 - DNA, 75 bp, Artificial Sequence
  Synthetic
cactccttgggtgcgatgtgtcaccgtggcagtggctcaagaaaaaggcttgtgacattctggaaataccatatg

SEQ ID NO: 84301 - DNA, 75 bp, Artificial Sequence
  Synthetic
agttagccgagatagatacattaattccaatggacctcagtgacaccaagaaaaacacaatgggcatgtataggg

SEQ ID NO: 84302 - DNA, 75 bp, Artificial Sequence
  Synthetic
tccaatggacctcagtgacaccaagaaaaacacaatgggcatgtatagggtagagttgggttcttctaagtcaca

SEQ ID NO: 84303 - DNA, 75 bp, Artificial Sequence
  Synthetic
ctaacaagatctctaaattcatcgattggctaaaagagaagatcatcccacaggctagagacaaattggaattcg

SEQ ID NO: 84304 - DNA, 75 bp, Artificial Sequence
  Synthetic
ttggctaaaagagaagatcatcccacaggctagagacaaattggaattcgttactaagcttaaacagctagaaat

SEQ ID NO: 84305 - DNA, 75 bp, Artificial Sequence
  Synthetic
actgaattattacacccattggagtggatctctcaaattcacatttttattttgtggcagcatgatggcaactgg

SEQ ID NO: 84306 - DNA, 75 bp, Artificial Sequence
  Synthetic
ggatctctcaaattcacatttttattttgtggcagcatgatggcaactgggaaaatcttaatatcttatgcacca

SEQ ID NO: 84307 - DNA, 75 bp, Artificial Sequence
  Synthetic
taggtggctatccatacagtcaaagagattcgctcccctctatgcagcggaggcaaagagaattcagaaattgga

SEQ ID NO: 84308 - DNA, 75 bp, Artificial Sequence
  Synthetic
agattcgctcccctctatgcagcggaggcaaagagaattcagaaattggagcacaccataaacaattacatacag

SEQ ID NO: 84309 - DNA, 75 bp, Artificial Sequence
  Synthetic
tcctcagctactatggttgtgccctggattagcaatgtcatgtatcgaaggtgtgttaaggatgacttcaccgaa

SEQ ID NO: 84310 - DNA, 75 bp, Artificial Sequence
  Synthetic
ggattagcaatgtcatgtatcgaaggtgtgttaaggatgacttcaccgaaggtggctatatctcaatgttttacc

SEQ ID NO: 84311 - DNA, 75 bp, Artificial Sequence
  Synthetic
accaacttgatagctagagcaattgcggagaaagagaacacatccacctactcgttacctcccgacccatcccac

SEQ ID NO: 84312 - DNA, 75 bp, Artificial Sequence
  Synthetic
cggagaaagagaacacatccacctactcgttacctcccgacccatcccactttgacggatacaaacaacagggag

SEQ ID NO: 84313 - DNA, 75 bp, Artificial Sequence
  Synthetic
tcactgtgcgtctactaagagacactacccacatttcacagaccacccagattaacacgcagggacctattgagg

SEQ ID NO: 84314 - DNA, 75 bp, Artificial Sequence
  Synthetic
tacccacatttcacagaccacccagattaacacgcagggacctattgaggaaatcatctcaactgttgctagtaa

SEQ ID NO: 84315 - DNA, 75 bp, Artificial Sequence
  Synthetic
ttgaatttataccaccaatggcttcactagaagaaaaaggcattctatttacctctaattatgtcctagcctcca

SEQ ID NO: 84316 - DNA, 75 bp, Artificial Sequence
  Synthetic
actagaagaaaaaggcattctatttacctctaattatgtcctagcctccactaactcaagcagaatcgcaccacc

SEQ ID NO: 84317 - DNA, 75 bp, Artificial Sequence
  Synthetic
tcaagaggtgccggcactaacagcagtagaaactggagcgacgagtgatgtggtgccggccgatttagtgcaaac

SEQ ID NO: 84318 - DNA, 75 bp, Artificial Sequence
  Synthetic
gtagaaactggagcgacgagtgatgtggtgccggccgatttagtgcaaactagacatgtggtgaatgtcaagtct

SEQ ID NO: 84319 - DNA, 75 bp, Artificial Sequence
  Synthetic
cagagatgggaaattgaacatggctatggccactgagatgtgcaagaattgccatcaaccagcgaacttcaaaaa

SEQ ID NO: 84320 - DNA, 75 bp, Artificial Sequence
  Synthetic
gccaccacagtggaggacaagaaaaagttatttgctaagtgggccatcacatacacagacactgtgcaactgagg

SEQ ID NO: 84321 - DNA, 75 bp, Artificial Sequence
  Synthetic
gccatccagctgatggataaatcctctagggtcaggtatagtattgaccaaattactacaatgatcatcaatgaa

SEQ ID NO: 84322 - DNA, 75 bp, Artificial Sequence
  Synthetic
agttatttgctaagtgggccatcacatacacagacactgtgcaactgaggcgcaaactggaatttttcacctact

SEQ ID NO: 84323 - DNA, 75 bp, Artificial Sequence
  Synthetic
atagatattaagaccacacccccccctgagtgtatcaatgacttgcttcaagcagttgactcacaagaggtgagg

SEQ ID NO: 84324 - DNA, 75 bp, Artificial Sequence
  Synthetic
aggtgtatcagattatgtatgtccctccaggagcgccaacacccaatgcaagggatgattacacatggcagacat

SEQ ID NO: 84325 - DNA, 75 bp, Artificial Sequence
  Synthetic
ctgagtgtatcaatgacttgcttcaagcagttgactcacaagaggtgagggactattgtgagaaaaaggggtgga

SEQ ID NO: 84326 - DNA, 75 bp, Artificial Sequence
  Synthetic
tccaggagcgccaacacccaatgcaagggatgattacacatggcagacatcttccaacccatcaattttctttac

SEQ ID NO: 84327 - DNA, 75 bp, Artificial Sequence
  Synthetic
cttttgcagcagttgctggagtggtatatgtgatgtataaactgttcgccggacaccaaggcgcttatacagggc

SEQ ID NO: 84328 - DNA, 75 bp, Artificial Sequence
  Synthetic
atatgtgatgtataaactgttcgccggacaccaaggcgcttatacagggctcccaaataagaaacccaacatccc

SEQ ID NO: 84329 - DNA, 75 bp, Artificial Sequence
  Synthetic
gaaacaactgactcaggggacacatactacggactaacctccatcaatgatttcgggacgcttgctgttagagtc

SEQ ID NO: 84330 - DNA, 75 bp, Artificial Sequence
  Synthetic
ggcaactaccagtgagggagaattcaccatgcttggagttcacgacaacgtggctatcctaccaacgcactcaca

SEQ ID NO: 84331 - DNA, 75 bp, Artificial Sequence
  Synthetic
tgtccacgacctcctagggctgtgagctacagaggacccggtgtggatcttttgtccacttctgtgacacctttg

SEQ ID NO: 84332 - DNA, 75 bp, Artificial Sequence
  Synthetic
gctacagaggacccggtgtggatcttttgtccacttctgtgacacctttgtccaagcatgacctgacaacatacg

SEQ ID NO: 84333 - DNA, 75 bp, Artificial Sequence
  Synthetic
cccaggagataccatagtcattgatggtaaggaaatagaggttattgacgccaaggccctggaggatcaagcagg

SEQ ID NO: 84334 - DNA, 75 bp, Artificial Sequence
  Synthetic
atctagaaaacgcggttagcgttttgtggaacagggatctcttaattactgagtccagagctcaagggatagaca

SEQ ID NO: 84335 - DNA, 75 bp, Artificial Sequence
  Synthetic
gtggaacagggatctcttaattactgagtccagagctcaagggatagacacaatagccagatgttcatgcaatac

SEQ ID NO: 84336 - DNA, 75 bp, Artificial Sequence
  Synthetic
ggccaatgactactatccagctaggtatcagtctcacatgctcattgggcatggtttcgcctcaccaggggattg

SEQ ID NO: 84337 - DNA, 75 bp, Artificial Sequence
  Synthetic
tatcagtctcacatgctcattgggcatggtttcgcctcaccaggggattgtggaggcattctcaggtgccaggat

SEQ ID NO: 84338 - DNA, 75 bp, Artificial Sequence
  Synthetic
atcacgtgcactggaaaggtcatcgggatgcatgttggtgggaacggttcacatgggtttgcagcagccctgaag

SEQ ID NO: 84339 - DNA, 75 bp, Artificial Sequence
  Synthetic
ggatgcatgttggtgggaacggttcacatgggtttgcagcagccctgaagcggtcttacttcactcaaagtcaag

SEQ ID NO: 84340 - DNA, 75 bp, Artificial Sequence
  Synthetic
gaggaggaggctatggagcagggtatcaccaattacatcgaatctctaggagctgccttcgggagtggatttaca

SEQ ID NO: 84341 - DNA, 75 bp, Artificial Sequence
  Synthetic
tcaccaattacatcgaatctctaggagctgccttcgggagtggatttacacagcaaattggggacaaagtttctg

SEQ ID NO: 84342 - DNA, 75 bp, Artificial Sequence
  Synthetic
agcctagtgcatttcattatgtgtttgagggggttaaagagcctgcagtgctgtccaaaaacgatcccaggttaa

SEQ ID NO: 84343 - DNA, 75 bp, Artificial Sequence
  Synthetic
tgagggggttaaagagcctgcagtgctgtccaaaaacgatcccaggttaataacagattttgaggaagccatctt

SEQ ID NO: 84344 - DNA, 75 bp, Artificial Sequence
  Synthetic
ttatcatcaccagaaattatgaggataccactacagtactggccactttagcactcctcggatgtgatgtgtcac

SEQ ID NO: 84345 - DNA, 75 bp, Artificial Sequence
  Synthetic
taccactacagtactggccactttagcactcctcggatgtgatgtgtcaccatggcagtggctcaagaaaaaggc

SEQ ID NO: 84346 - DNA, 75 bp, Artificial Sequence
  Synthetic
attgatgtcactggacatcaatacagaacagatgtgccttgaagacgccatgtatggcactgatggtttagaagc

SEQ ID NO: 84347 - DNA, 75 bp, Artificial Sequence
  Synthetic
gaacagatgtgccttgaagacgccatgtatggcactgatggtttagaagcccttgatcttagcacaagtgcaggg

SEQ ID NO: 84348 - DNA, 75 bp, Artificial Sequence
  Synthetic
tgcagcaaaagggttggagtgggtttcaaacaagatatccaaattcattgattggctgaaagagaaaattatccc

SEQ ID NO: 84349 - DNA, 75 bp, Artificial Sequence
  Synthetic
tcaaacaagatatccaaattcattgattggctgaaagagaaaattatcccgcaagctagagataaattggaattt

SEQ ID NO: 84350 - DNA, 75 bp, Artificial Sequence
  Synthetic
agactcctagacacttatggaattaacctaccattagtcacctatgtaaaggatgaacttagatccaaaacaaaa

SEQ ID NO: 84351 - DNA, 75 bp, Artificial Sequence
  Synthetic
acctaccattagtcacctatgtaaaggatgaacttagatccaaaacaaaagtggagcaaggtaagtctagattaa

SEQ ID NO: 84352 - DNA, 75 bp, Artificial Sequence
  Synthetic
caccaagagatcttgttcaacaacgttagatggttgtctatacattcaaagaagtttgccccactctatgcagtg

SEQ ID NO: 84353 - DNA, 75 bp, Artificial Sequence
  Synthetic
ttagatggttgtctatacattcaaagaagtttgccccactctatgcagtggaggcaaagagaattcagaagttgg

SEQ ID NO: 84354 - DNA, 75 bp, Artificial Sequence
  Synthetic
acccaggtgtagtgactggatcagctgttggatgtgatcccgatttgttctggagcaaaataccagtgttgatgg

SEQ ID NO: 84355 - DNA, 75 bp, Artificial Sequence
  Synthetic
aggagaggctctttgcattcgattacacagggtatgatgcatctctcagtccagcttggtttgaggcactcaaga

SEQ ID NO: 84356 - DNA, 75 bp, Artificial Sequence
  Synthetic
gtcccggaaccggtaaatcagtagctactaatttgatagccagagcaatcgcagagaaagaaaacacctccacct

SEQ ID NO: 84357 - DNA, 75 bp, Artificial Sequence
  Synthetic
tactaatttgatagccagagcaatcgcagagaaagaaaacacctccacctactcgctacctcctgacccgtctca

SEQ ID NO: 84358 - DNA, 75 bp, Artificial Sequence
  Synthetic
attgttctgtcagatggtctccactgttgaatttataccacccatggcctcactggaagagaaaggcattttatt

SEQ ID NO: 84359 - DNA, 75 bp, Artificial Sequence
  Synthetic
gttgaatttataccacccatggcctcactggaagagaaaggcattttattcacctccaattacgtcctggcctcc

SEQ ID NO: 84360 - DNA, 75 bp, Artificial Sequence
  Synthetic
gacattcaagtcatgaatgaatactccagggatgggaggctgaacatggccatggccactgagatgtgcaagaac

SEQ ID NO: 84361 - DNA, 75 bp, Artificial Sequence
  Synthetic
agccatccagttgatggacaagtcctctagagtcagatacagcattgaccaaatcacaaccatgatcatcaatga

SEQ ID NO: 84362 - DNA, 75 bp, Artificial Sequence
  Synthetic
taaaattagaagcgtgccaatcggaagagcattgttgctccctgagtactctacattgtaccgccgttggctcga

SEQ ID NO: 84363 - DNA, 75 bp, Artificial Sequence
  Synthetic
cctgaatgtatcaatgacttgcttcaagcagttgactcacaagaggtgagggactattgtgagaagaagggatgg

SEQ ID NO: 84364 - DNA, 75 bp, Artificial Sequence
  Synthetic
acttttgcagcggtcgccggagtggtgtacgtgatgtacaagctgtttgcaggacaccaaggtgcttacacagga

SEQ ID NO: 84365 - DNA, 75 bp, Artificial Sequence
  Synthetic
tgtacgtgatgtacaagctgtttgcaggacaccaaggtgcttacacaggactcccaagcaggaaacctaacgtcc

SEQ ID NO: 84366 - DNA, 75 bp, Artificial Sequence
  Synthetic
cagcgaccactagcaagggagaattcactatgctcggggtccacgataatgtcgctatcctgccaacacactcac

SEQ ID NO: 84367 - DNA, 75 bp, Artificial Sequence
  Synthetic
tggtaaagaagtggaggtcgttgatgccaaagctttagaagatcaagccggcacaaatctggaaataaccattgt

SEQ ID NO: 84368 - DNA, 75 bp, Artificial Sequence
  Synthetic
taccccaacatgtatgtcccagtcggtgctgtgactgaacagggatatcttaatctcggtggcaggcaaactgct

SEQ ID NO: 84369 - DNA, 75 bp, Artificial Sequence
  Synthetic
gggatgcatgttggagggaatggttcgcacgggttcgcagcagccctgaaacggtcgtacttcactcagagtcaa

SEQ ID NO: 84370 - DNA, 75 bp, Artificial Sequence
  Synthetic
cgcacgggttcgcagcagccctgaaacggtcgtacttcactcagagtcaaggtgagatccaatggatgagaccat

SEQ ID NO: 84371 - DNA, 75 bp, Artificial Sequence
  Synthetic
ttgaaggtgtaaaagaaccagccgtgctcaccaaaaacgaccccagattgaaaacagatttcgaggaggccattt

SEQ ID NO: 84372 - DNA, 75 bp, Artificial Sequence
  Synthetic
gctcaccaaaaacgaccccagattgaaaacagatttcgaggaggccattttctctaagtatgtgggaaacaaaat

SEQ ID NO: 84373 - DNA, 75 bp, Artificial Sequence
  Synthetic
agaacagatgtgtttggaagatgcaatgtatggcaccgatggtctcgaagctttagatctcagcactagtgctgg

SEQ ID NO: 84374 - DNA, 75 bp, Artificial Sequence
  Synthetic
atgtatggcaccgatggtctcgaagctttagatctcagcactagtgctggctacccctatgtggcaatgggtaag

SEQ ID NO: 84375 - DNA, 75 bp, Artificial Sequence
  Synthetic
aacctacctttagtcacctatgttaaagatgaactcagatccaaggtaaaagtagaacagggtaaatccagattg

SEQ ID NO: 84376 - DNA, 75 bp, Artificial Sequence
  Synthetic
aagatgaactcagatccaaggtaaaagtagaacagggtaaatccagattgatagaagcctcaagtttgaatgatt

SEQ ID NO: 84377 - DNA, 75 bp, Artificial Sequence
  Synthetic
ctgttggttgtgacccagatctgttttggagcaaaataccagtgttgatggaggagaggctctttgcatttgact

SEQ ID NO: 84378 - DNA, 75 bp, Artificial Sequence
  Synthetic
gagacagagtggattacatagattatctgaaccattcgcaccatctttacaaaaacaaaacatactgtgtcaagg

SEQ ID NO: 84379 - DNA, 75 bp, Artificial Sequence
  Synthetic
gtttccccggtgatgttgtatagactgtttccacggttgaaagcgactgatccgttatccgctcaagtacttcgg

SEQ ID NO: 84380 - DNA, 75 bp, Artificial Sequence
  Synthetic
agggtttgcaatgcccggtgactgtgggggtatattaagatgcacccacggtgtgatggggctcattacagcagg

SEQ ID NO: 84381 - DNA, 75 bp, Artificial Sequence
  Synthetic
ttgagttcataccccccatggctagcttagaagagaagggcattctgtttacatctgactatgtcctagcctcaa

SEQ ID NO: 84382 - DNA, 75 bp, Artificial Sequence
  Synthetic
cagcagttggcctgtcgtaacgcgcaagtctgtggcggaaccgactactttgggtgtccgtgtttccttttattt

SEQ ID NO: 84383 - DNA, 75 bp, Artificial Sequence
  Synthetic
gttttactcctataacagcaaatacccttcatcttatcaccatcacactactgattagatatcactaccacaatg

SEQ ID NO: 84384 - DNA, 75 bp, Artificial Sequence
  Synthetic
ccttcatcttatcaccatcacactactgattagatatcactaccacaatgggcgctcaggtatcatcccaaaaag

SEQ ID NO: 84385 - DNA, 75 bp, Artificial Sequence
  Synthetic
actccgctagtaatgcggcctcaaaacaagatttttctcaggatccatcaaaattcacagaacctgtgaaggatg

SEQ ID NO: 84386 - DNA, 75 bp, Artificial Sequence
  Synthetic
acaagatttttctcaggatccatcaaaattcacagaacctgtgaaggatgttttaataaaatcagcaccagcact

SEQ ID NO: 84387 - DNA, 75 bp, Artificial Sequence
  Synthetic
cactcaggaagcagctaactctgttgttgcgtacggagtgtggccctcttatttaagtgataaagacgccaaccc

SEQ ID NO: 84388 - DNA, 75 bp, Artificial Sequence
  Synthetic
gttgcgtacggagtgtggccctcttatttaagtgataaagacgccaacccagttgaccaacccaccgaacctgat

SEQ ID NO: 84389 - DNA, 75 bp, Artificial Sequence
  Synthetic
ccagacgccttgaaagacatgggattgtttggtcagaacatgttctatcattacttgggaaggtcaggatataca

SEQ ID NO: 84390 - DNA, 75 bp, Artificial Sequence
  Synthetic
tgtttggtcagaacatgttctatcattacttgggaaggtcaggatatacagtacatgtacaatgcaatgcctcaa

SEQ ID NO: 84391 - DNA, 75 bp, Artificial Sequence
  Synthetic
attacactagctatgtaaatgccaacccaggagaggctggaggaaagtttgtgtccaccttcatcccagacacta

SEQ ID NO: 84392 - DNA, 75 bp, Artificial Sequence
  Synthetic
cccaggagaggctggaggaaagtttgtgtccaccttcatcccagacactagcacatcacctaagcgtgagttcca

SEQ ID NO: 84393 - DNA, 75 bp, Artificial Sequence
  Synthetic
acgcacaaataattgtgctacactggtgttgccatacgtgaactcattggctattgattgcatggcaaagcacaa

SEQ ID NO: 84394 - DNA, 75 bp, Artificial Sequence
  Synthetic
gtgttgccatacgtgaactcattggctattgattgcatggcaaagcacaacaactggggcatagtcatattacct

SEQ ID NO: 84395 - DNA, 75 bp, Artificial Sequence
  Synthetic
gtccagagggtggtggtggaaactaccagatgctttaaaagacatggggttgtttggtcaaaacatgttttatca

SEQ ID NO: 84396 - DNA, 75 bp, Artificial Sequence
  Synthetic
gaatttaatggactaagaaacttaaccattccagccacgcaggggttacctattatgaacactccaggcagcaac

SEQ ID NO: 84397 - DNA, 75 bp, Artificial Sequence
  Synthetic
ccattccagccacgcaggggttacctattatgaacactccaggcagcaaccaatatttaacttcagataatttcc

SEQ ID NO: 84398 - DNA, 75 bp, Artificial Sequence
  Synthetic
acccctcaacttgacaagtcaacgcaagaacacaatggacatgtatagagtcgagttgaacgacgcggctcactc

SEQ ID NO: 84399 - DNA, 75 bp, Artificial Sequence
  Synthetic
aactggcagagattgacacaatgatccccatggatctcagtgaaagaaagaagaattcaatggaaatgtataggg

SEQ ID NO: 84400 - DNA, 75 bp, Artificial Sequence
  Synthetic
ccccatggatctcagtgaaagaaagaagaattcaatggaaatgtatagggtgaagctctccgacaatgcagattg

SEQ ID NO: 84401 - DNA, 75 bp, Artificial Sequence
  Synthetic
tctaaattactacacacactgggctggttctttgaagttctcattcttgttttgtgggtcgatgatggccactgg

SEQ ID NO: 84402 - DNA, 75 bp, Artificial Sequence
  Synthetic
ggttctttgaagttctcattcttgttttgtgggtcgatgatggccactggaaagctcctagtagcatactcacct

SEQ ID NO: 84403 - DNA, 75 bp, Artificial Sequence
  Synthetic
tcctcctgtactatggtggttccatggattagtaataccagttaccgcaggacagtgaaggatgatttcacagag

SEQ ID NO: 84404 - DNA, 75 bp, Artificial Sequence
  Synthetic
ggattagtaataccagttaccgcaggacagtgaaggatgatttcacagagggaggttatataagcatgttctacc

SEQ ID NO: 84405 - DNA, 75 bp, Artificial Sequence
  Synthetic
tcacagtccggcttttaagagacacaactcacatcacccaagcagccctaccccaaggcattgaggaaataatcc

SEQ ID NO: 84406 - DNA, 75 bp, Artificial Sequence
  Synthetic
aactcacatcacccaagcagccctaccccaaggcattgaggaaataatccagcaggtggcatcaaacgctcttca

SEQ ID NO: 84407 - DNA, 75 bp, Artificial Sequence
  Synthetic
gcactcaaaggaggtgcctgctttgacagcagttgaaacaggagccaccaacccactagagccaggtgacacagt

SEQ ID NO: 84408 - DNA, 75 bp, Artificial Sequence
  Synthetic
acagcagttgaaacaggagccaccaacccactagagccaggtgacacagtccagactaggcacgtcatccagacc

SEQ ID NO: 84409 - DNA, 75 bp, Artificial Sequence
  Synthetic
tataatgagactctcactggtgaccaaaagtctaagctcttttccacttggaatataacttacacagatacagtc

SEQ ID NO: 84410 - DNA, 75 bp, Artificial Sequence
  Synthetic
aaaagtctaagctcttttccacttggaatataacttacacagatacagtccagcttagaaggaaattggagatgt

SEQ ID NO: 84411 - DNA, 75 bp, Artificial Sequence
  Synthetic
cattgaaccaggtgtatcaaatcatgtacgtacctccaggtgctccagtaccaaagaagtgggacgattacacgt

SEQ ID NO: 84412 - DNA, 75 bp, Artificial Sequence
  Synthetic
gtacgtacctccaggtgctccagtaccaaagaagtgggacgattacacgtggcaaacatcatcaaatccatccat

SEQ ID NO: 84413 - DNA, 75 bp, Artificial Sequence
  Synthetic
ttacgacgggtataacacggttcctttgaagtccgacacaacagactcaggtgctgcgtactacggggcagtatc

SEQ ID NO: 84414 - DNA, 75 bp, Artificial Sequence
  Synthetic
ttgaagtccgacacaacagactcaggtgctgcgtactacggggcagtatccattaatgactttgggctcctggca

SEQ ID NO: 84415 - DNA, 75 bp, Artificial Sequence
  Synthetic
agagtatggtgtcccagaccaccacgcgctgttgagtattatggacctggagttgattacaaagctgatacatta

SEQ ID NO: 84416 - DNA, 75 bp, Artificial Sequence
  Synthetic
gcgctgttgagtattatggacctggagttgattacaaagctgatacattagcaccattacctacaaagaacctaa

SEQ ID NO: 84417 - DNA, 75 bp, Artificial Sequence
  Synthetic
caagtgaggacttcagaaggtgcgtgagaagtatgtgggaacgcgacatcatggttgtggagtcaaaagcacagg

SEQ ID NO: 84418 - DNA, 75 bp, Artificial Sequence
  Synthetic
gagaagtatgtgggaacgcgacatcatggttgtggagtcaaaagcacagggcacggatgcaattgccagatgttc

SEQ ID NO: 84419 - DNA, 75 bp, Artificial Sequence
  Synthetic
gtggatggagaagaatgaatattaccctgcacgttaccaatcccacatgacactcggtagcgggtttgctgcccc

SEQ ID NO: 84420 - DNA, 75 bp, Artificial Sequence
  Synthetic
cctgcacgttaccaatcccacatgacactcggtagcgggtttgctgcccctggggactgtggtggcattttgaga

SEQ ID NO: 84421 - DNA, 75 bp, Artificial Sequence
  Synthetic
tatgtagaagaagaagcaatggagcaagggattacctcatatattgagtctctaggggcagcttttggtagcggc

SEQ ID NO: 84422 - DNA, 75 bp, Artificial Sequence
  Synthetic
aagggattacctcatatattgagtctctaggggcagcttttggtagcggcttcactagtcaaattggtgagaaaa

SEQ ID NO: 84423 - DNA, 75 bp, Artificial Sequence
  Synthetic
gtctagtcataattgtcagaaactatgaagacacaaccacagtgctggccaccttggctctgcttgggtgtgatg

SEQ ID NO: 84424 - DNA, 75 bp, Artificial Sequence
  Synthetic
tgaagacacaaccacagtgctggccaccttggctctgcttgggtgtgatgtatcaccatggacttggttaaagaa

SEQ ID NO: 84425 - DNA, 75 bp, Artificial Sequence
  Synthetic
cggtggattacctctttggaaatggcacgttattggggaatgcctttgtgttcccgcaccagataataaacctac

SEQ ID NO: 84426 - DNA, 75 bp, Artificial Sequence
  Synthetic
ttgtaatgcagccaaaggactagagtggattagtaacaagatttccaagtttgttgagtggataaagaacaaaat

SEQ ID NO: 84427 - DNA, 75 bp, Artificial Sequence
  Synthetic
taggaatgttagaaaatcagattaacacaatacatcagtcctgccctagccaagagcagcaagaggtactattta

SEQ ID NO: 84428 - DNA, 75 bp, Artificial Sequence
  Synthetic
tggagccgacccaccaaagaagcgtaaggaggcgatgttgggaacacatgtgatctgggacataggactgcagtc

SEQ ID NO: 84429 - DNA, 75 bp, Artificial Sequence
  Synthetic
aactagagaacaccatcaataattacatacaattcaagagcaaacaccgtattgaaccagtatgtgttttgatac

SEQ ID NO: 84430 - DNA, 75 bp, Artificial Sequence
  Synthetic
catacaattcaagagcaaacaccgtattgaaccagtatgtgttttgatacatggtagccctggtacaggtaagtc

SEQ ID NO: 84431 - DNA, 75 bp, Artificial Sequence
  Synthetic
agctcactttgatggttacaaacaacaaggtgttgtgataatggatgaccttaatcaaaatcctgatggacttga

SEQ ID NO: 84432 - DNA, 75 bp, Artificial Sequence
  Synthetic
caaggtgttgtgataatggatgaccttaatcaaaatcctgatggacttgacatgaagttattctgccaaatggtc

SEQ ID NO: 84433 - DNA, 75 bp, Artificial Sequence
  Synthetic
gcatcaaccaattccagtaccatcacaccaccaacagtggcacacagtgatgcgttgagtcggagatttgcattt

SEQ ID NO: 84434 - DNA, 75 bp, Artificial Sequence
  Synthetic
caccaccaacagtggcacacagtgatgcgttgagtcggagatttgcatttgacatggagatatgcccgatgtcac

SEQ ID NO: 84435 - DNA, 75 bp, Artificial Sequence
  Synthetic
tcaaaaagtgctgcccactggtgtgtggaaaggccatacaactaatggacaagtacaccagacaaagattctcag

SEQ ID NO: 84436 - DNA, 75 bp, Artificial Sequence
  Synthetic
tggaaaggccatacaactaatggacaagtacaccagacaaagattctcagtagatgaactgaccaccctggttat

SEQ ID NO: 84437 - DNA, 75 bp, Artificial Sequence
  Synthetic
cctcaggatcgatatcaagactagtccgccccctgaatgtatcagtgatttattacaatcagttgactcccagga

SEQ ID NO: 84438 - DNA, 75 bp, Artificial Sequence
  Synthetic
agcccacgaaaattcaaacagagcctatggtgggtccaccatcaattacactacaatcaattactatagggactc

SEQ ID NO: 84439 - DNA, 75 bp, Artificial Sequence
  Synthetic
ccgccccctgaatgtatcagtgatttattacaatcagttgactcccaggaagttagagactattgtgaaaagaag

SEQ ID NO: 84440 - DNA, 75 bp, Artificial Sequence
  Synthetic
gttagtacactggtatcacggtacctttgtatgcctgttttataacccctcccctgcaactttagaagtatcaaa

SEQ ID NO: 84441 - DNA, 75 bp, Artificial Sequence
  Synthetic
ctcacaactttcgcagctgttgctggtgtcgtgtatgtcatgtacagactgtttgctggccaacagggaccgtac

SEQ ID NO: 84442 - DNA, 75 bp, Artificial Sequence
  Synthetic
gtgtcgtgtatgtcatgtacagactgtttgctggccaacagggaccgtacactgggctacccaacaagaagccaa

SEQ ID NO: 84443 - DNA, 75 bp, Artificial Sequence
  Synthetic
tcctcactgccacgacttgtaagggagagttcaccatgttaggggtgcacgacaacgtggcgatactaccaaccc

SEQ ID NO: 84444 - DNA, 75 bp, Artificial Sequence
  Synthetic
aatcgatggaaaggaagtggagattctagacgccaaggcccttgaagatcaggcagggactaatctggagatcac

SEQ ID NO: 84445 - DNA, 75 bp, Artificial Sequence
  Synthetic
ctgccctcgcctcacggcgtgggacgctcaatacatgacatggtgcgaagagtctactgtgctatacaagagtcc

SEQ ID NO: 84446 - DNA, 75 bp, Artificial Sequence
  Synthetic
ctgtcggtgctgtaactgaacagggatatctcaatctcggtggacgccagacagctcgcacactgatgtacaact

SEQ ID NO: 84447 - DNA, 75 bp, Artificial Sequence
  Synthetic
acggttcacatgggtttgcagcggccctaaaacgatcatacttcactcaaagtcaaggtgagatccagtggatga

SEQ ID NO: 84448 - DNA, 75 bp, Artificial Sequence
  Synthetic
taaactattacaaggacagtgccagtaatgcggccactaaaatggacttttcccaggacccttccaaatttactg

SEQ ID NO: 84449 - DNA, 75 bp, Artificial Sequence
  Synthetic
atgtatttgaaggggttaaagaaccagctgttcttaccaaaaatgaccccaggcttaaaactgactttgaggaag

SEQ ID NO: 84450 - DNA, 75 bp, Artificial Sequence
  Synthetic
agctgttcttaccaaaaatgaccccaggcttaaaactgactttgaggaagccatcttctccaagtatgtagggaa

SEQ ID NO: 84451 - DNA, 75 bp, Artificial Sequence
  Synthetic
accgggtcatgcaactcacactgggtaattccaccataaccacccaggaggcagccaatgcggtgattgggtatg

SEQ ID NO: 84452 - DNA, 75 bp, Artificial Sequence
  Synthetic
taattccaccataaccacccaggaggcagccaatgcggtgattgggtatggtgaatggccgcagtttctcaaccc

SEQ ID NO: 84453 - DNA, 75 bp, Artificial Sequence
  Synthetic
caacacagaacaaatgtgtctggaagatgctatgtacggtactgatggtcttgaagccttggacctaagtactag

SEQ ID NO: 84454 - DNA, 75 bp, Artificial Sequence
  Synthetic
gatgctatgtacggtactgatggtcttgaagccttggacctaagtactagtgccggttacccctacgttgcaatg

SEQ ID NO: 84455 - DNA, 75 bp, Artificial Sequence
  Synthetic
tgagtggcaagagtcgtcccgcggttggtggtggaagctccccgatgcccttaaggacatgggcatgtttgggca

SEQ ID NO: 84456 - DNA, 75 bp, Artificial Sequence
  Synthetic
tggtggtggaagctccccgatgcccttaaggacatgggcatgtttgggcaaaatatgtactaccactatctgggt

SEQ ID NO: 84457 - DNA, 75 bp, Artificial Sequence
  Synthetic
ggaatcaatcttccgctagtgacttatgtcaaagatgaactcagatcaaaaactaaagtggaacagggcaagtcc

SEQ ID NO: 84458 - DNA, 75 bp, Artificial Sequence
  Synthetic
atgtcaaagatgaactcagatcaaaaactaaagtggaacagggcaagtccaggttaattgaagcctcaagtctta

SEQ ID NO: 84459 - DNA, 75 bp, Artificial Sequence
  Synthetic
ccggagtttatgatggctagcaactcagcagataggaccggtggtattacctatgaaaaagccaaccccggtgag

SEQ ID NO: 84460 - DNA, 75 bp, Artificial Sequence
  Synthetic
cagcagataggaccggtggtattacctatgaaaaagccaaccccggtgagaaagggggcaagtttcaggcaagtt

SEQ ID NO: 84461 - DNA, 75 bp, Artificial Sequence
  Synthetic
gatctgcagttggttgtgacccagacctgttttggagcaaaattccagtactaatggaggacaaactttttgctt

SEQ ID NO: 84462 - DNA, 75 bp, Artificial Sequence
  Synthetic
ctggtaacgttacggtgttcccacaccaaattataaacttacgcaccaataactgtgctacactagtgctaccgt

SEQ ID NO: 84463 - DNA, 75 bp, Artificial Sequence
  Synthetic
ccaaattataaacttacgcaccaataactgtgctacactagtgctaccgtacgtaaactcatcagccacagactc

SEQ ID NO: 84464 - DNA, 75 bp, Artificial Sequence
  Synthetic
gctttggtgacagagttgattacattgattacctcaatcattcacaccacctgtacaaaaacaaaacctactgtg

SEQ ID NO: 84465 - DNA, 75 bp, Artificial Sequence
  Synthetic
agcaatccccataaccgtcactgtggcccccatgtgctgtgagttcaacggtcttcgatcactgacaacccccgt

SEQ ID NO: 84466 - DNA, 75 bp, Artificial Sequence
  Synthetic
gcccccatgtgctgtgagttcaacggtcttcgatcactgacaacccccgtcctacagggactgccagtgttgaat

SEQ ID NO: 84467 - DNA, 75 bp, Artificial Sequence
  Synthetic
gctccaatccacatacctggtgaggtacacaatatgatggaactggcagaaattgatagtgttatacccatgaac

SEQ ID NO: 84468 - DNA, 75 bp, Artificial Sequence
  Synthetic
agtgatgccaatgaaagagatccatgaatcaattagatggaccaaggatcctaggaacacccaggaccatgttcg

SEQ ID NO: 84469 - DNA, 75 bp, Artificial Sequence
  Synthetic
tcaaggcgctcccgtaaaggatcaagcaatatttgccttaagcttgagcccagcctcagataaaaggttgtcacg

SEQ ID NO: 84470 - DNA, 75 bp, Artificial Sequence
  Synthetic
gagtactcaacattgtaccgccgttggctcgactcattttagtaaccctacctcagtcgaattggattgggttat

SEQ ID NO: 84471 - DNA, 75 bp, Artificial Sequence
  Synthetic
aaggacgactttactgagggagggtacatcaccgcgttttaccaaacagccatagtggtcccttcaggtgcgcct

SEQ ID NO: 84472 - DNA, 75 bp, Artificial Sequence
  Synthetic
acatcaccgcgttttaccaaacagccatagtggtcccttcaggtgcgcctaaaacaatgagcatgttggcctttg

SEQ ID NO: 84473 - DNA, 75 bp, Artificial Sequence
  Synthetic
agcagggtgtggaggataagcttgatgccttggtggatgggatggtcaatatgtctctggatacggtccagaaca

SEQ ID NO: 84474 - DNA, 75 bp, Artificial Sequence
  Synthetic
tgccttggtggatgggatggtcaatatgtctctggatacggtccagaacacggtggctagtgggtctgtacactc

SEQ ID NO: 84475 - DNA, 75 bp, Artificial Sequence
  Synthetic
tctgtgattgttatcataaagcgatttggattggccatccggtgagtgttgtatcgaacatttgactgttcatca

SEQ ID NO: 84476 - DNA, 75 bp, Artificial Sequence
  Synthetic
ccgccatgtgataaacaaaagacaaagatcagagtgcactgtggagtccttcttggggagagctgcgctggtgac

SEQ ID NO: 84477 - DNA, 75 bp, Artificial Sequence
  Synthetic
agatcagagtgcactgtggagtccttcttggggagagctgcgctggtgacaattatgagtttgcacaatgcggct

SEQ ID NO: 84478 - DNA, 75 bp, Artificial Sequence
  Synthetic
acaagcaagactttgcacaggatccgtccaaattcaccgaacccataaaggatgttctcattaagactgctccta

SEQ ID NO: 84479 - DNA, 75 bp, Artificial Sequence
  Synthetic
aaacttgaaatgttcacctactccagatttgacatcgagctcacttttgtcattaccgagcgatttgcggccagc

SEQ ID NO: 84480 - DNA, 75 bp, Artificial Sequence
  Synthetic
gatttgacatcgagctcacttttgtcattaccgagcgatttgcggccagcggaagctccagtagacattatgtat

SEQ ID NO: 84481 - DNA, 75 bp, Artificial Sequence
  Synthetic
accctgtggaccaaccaaccgaacccgacgtagctacgtgcagattctacacattagatactgtcagttggaaca

SEQ ID NO: 84482 - DNA, 75 bp, Artificial Sequence
  Synthetic
acccatctgtattttacactacaggcaacgccccaccaagggtgtcagtaccatttatggggattagcggagctt

SEQ ID NO: 84483 - DNA, 75 bp, Artificial Sequence
  Synthetic
caacgccccaccaagggtgtcagtaccatttatggggattagcggagcttactcgcacttttatgatgggtttgc

SEQ ID NO: 84484 - DNA, 75 bp, Artificial Sequence
  Synthetic
cgtggccgtgcgcattgtgaatgagcatgatccagtcaaaatagagtcaaaagtaagggtctacttaaagcctaa

SEQ ID NO: 84485 - DNA, 75 bp, Artificial Sequence
  Synthetic
catgatccagtcaaaatagagtcaaaagtaagggtctacttaaagcctaaacatgtgagagtgtggtgccctagg

SEQ ID NO: 84486 - DNA, 75 bp, Artificial Sequence
  Synthetic
actatacgcacttttggtttcggacaccagaacaaagccatatacgtggcaggatataagatttgtaactaccac

SEQ ID NO: 84487 - DNA, 75 bp, Artificial Sequence
  Synthetic
ctggccactcaagaagacatggaacgtgcagtagctgtgatgtgggaccgagaccttatggtggtggaaagccgt

SEQ ID NO: 84488 - DNA, 75 bp, Artificial Sequence
  Synthetic
actgaatcttccactgagatacccatcacattgaccatagcaccaatgtgctgcgaattcaacggtttacgcaac

SEQ ID NO: 84489 - DNA, 75 bp, Artificial Sequence
  Synthetic
cataccaggggaggtgcacaacatgatggaattagcggaaatagacaccatgatacctctcaacttgacaagcaa

SEQ ID NO: 84490 - DNA, 75 bp, Artificial Sequence
  Synthetic
gggttgttgcatttgcagacgtgagagatctgtttgcatatgaagaagaggccatggaacaaggcatcactgatt

SEQ ID NO: 84491 - DNA, 75 bp, Artificial Sequence
  Synthetic
agaccgttcagaatgttattactgagaagctgcttaaaaacctagttaagatagtgtctgcactagtaatagtgg

SEQ ID NO: 84492 - DNA, 75 bp, Artificial Sequence
  Synthetic
gaagctgcttaaaaacctagttaagatagtgtctgcactagtaatagtggcaaggaactatgaagactctgtgac

SEQ ID NO: 84493 - DNA, 75 bp, Artificial Sequence
  Synthetic
agtcgcaaagaagcaatgcttgggacacatgtagtatgggacattgggttgcagtcttcgtgcaccatggtggtg

SEQ ID NO: 84494 - DNA, 75 bp, Artificial Sequence
  Synthetic
aaaccagaattttgccagaagcacaagacaaagtagagtatttgtccaaactgaaacacctagacacacttgaaa

SEQ ID NO: 84495 - DNA, 75 bp, Artificial Sequence
  Synthetic
tggccataaaggcaagaaagtttgcccccttgtacgccagcgaggcacgtcgtgttttcaagatggagagcacca

SEQ ID NO: 84496 - DNA, 75 bp, Artificial Sequence
  Synthetic
catgccacaagggattggtgatgtgatcgagggggccattgaaggaattactaaaaatgcactagtccccctggc

SEQ ID NO: 84497 - DNA, 75 bp, Artificial Sequence
  Synthetic
ccccttgtacgccagcgaggcacgtcgtgttttcaagatggagagcaccatcaataactacatacagttcaagac

SEQ ID NO: 84498 - DNA, 75 bp, Artificial Sequence
  Synthetic
tataggcagagcaatcgctaggcaagcaaacactagcacctactctctccccccggacccctctcactttgacgg

SEQ ID NO: 84499 - DNA, 75 bp, Artificial Sequence
  Synthetic
gcaaacactagcacctactctctccccccggacccctctcactttgacggatacaaacaacaaggggttgtgatc

SEQ ID NO: 84500 - DNA, 75 bp, Artificial Sequence
  Synthetic
gtgccgccaatggccagtttagaggaaaaaggaatcttgtttacgtcagattacgtccttgcatctaccaactcg

SEQ ID NO: 84501 - DNA, 75 bp, Artificial Sequence
  Synthetic
aaaaaggaatcttgtttacgtcagattacgtccttgcatctaccaactcgtacaccatatcaccaccaacaatat

SEQ ID NO: 84502 - DNA, 75 bp, Artificial Sequence
  Synthetic
ggcacttaaatatggcaactgccaccaaggcatgtgcagactgccacaagccagcaaatttctccagttgttgcc

SEQ ID NO: 84503 - DNA, 75 bp, Artificial Sequence
  Synthetic
caaggcatgtgcagactgccacaagccagcaaatttctccagttgttgccctctggtgtgcggaaaggccatcca

SEQ ID NO: 84504 - DNA, 75 bp, Artificial Sequence
  Synthetic
ccacaaccccacgcggctcacctccaagatcagagtgtacatgaagccaaaacatgtcagagtctggtgcccacg

SEQ ID NO: 84505 - DNA, 75 bp, Artificial Sequence
  Synthetic
aagatacaacattggcaactgcttggaagctttgtttcaaggccctctggagtttaaagaacccaggattgacat

SEQ ID NO: 84506 - DNA, 75 bp, Artificial Sequence
  Synthetic
gaagctttgtttcaaggccctctggagtttaaagaacccaggattgacataaaaacaacacctccaccacccgct

SEQ ID NO: 84507 - DNA, 75 bp, Artificial Sequence
  Synthetic
gccgtgagtgtcatgtgggacagagatctcctagtggttgaatcaagggcccccggcaccgattcgatcgcaagg

SEQ ID NO: 84508 - DNA, 75 bp, Artificial Sequence
  Synthetic
ctgccatcatctacactcgtggtggaaagacacctcaatcgggccatgacaattgtgcaggccatttcttccttt

SEQ ID NO: 84509 - DNA, 75 bp, Artificial Sequence
  Synthetic
aaagacacctcaatcgggccatgacaattgtgcaggccatttcttcctttgtggttgtttctggcatgttataca

SEQ ID NO: 84510 - DNA, 75 bp, Artificial Sequence
  Synthetic
tgcgtgcagcaaaggtgcagggtccagcatttgattacgcagttgctatggcgaagcgtaatatattgactgcaa

SEQ ID NO: 84511 - DNA, 75 bp, Artificial Sequence
  Synthetic
gcgaagcgtaatatattgactgcaacaacgaacaaaggtgagtttacaatgctgggtatttacgaccgagtggct

SEQ ID NO: 84512 - DNA, 75 bp, Artificial Sequence
  Synthetic
gtctacaggcaaagtcattggtattcacgtggggggtaatggctcccatgggttcgccgctgcactgaaaaggtc

SEQ ID NO: 84513 - DNA, 75 bp, Artificial Sequence
  Synthetic
ccccaacaaaaccaaattacaacccagtgtgttttacaatgtgttcccgggtgtcaaggaacctgcggttctggc

SEQ ID NO: 84514 - DNA, 75 bp, Artificial Sequence
  Synthetic
agtgtgttttacaatgtgttcccgggtgtcaaggaacctgcggttctggcaaagtcagatcctagacttgaagtc

SEQ ID NO: 84515 - DNA, 75 bp, Artificial Sequence
  Synthetic
gtagaccactatgctggtcaactgatgtcactggacatccccacagagcagatgtgcttggatgaggctttgtac

SEQ ID NO: 84516 - DNA, 75 bp, Artificial Sequence
  Synthetic
tgtcactggacatccccacagagcagatgtgcttggatgaggctttgtacgggactgagggcctcgaggccctag

SEQ ID NO: 84517 - DNA, 75 bp, Artificial Sequence
  Synthetic
gtgacaccaaggagatgcaacgcatgctggataagtacgggatcaatttaccgctggtcacgtacgtgaaggatg

SEQ ID NO: 84518 - DNA, 75 bp, Artificial Sequence
  Synthetic
ccgctggtcacgtacgtgaaggatgaattgcgtaaaccatcaaagattaagacagggaagtccaggctgatagag

SEQ ID NO: 84519 - DNA, 75 bp, Artificial Sequence
  Synthetic
agcaaacttcaaaagatgctgccccttagtgtgtggcaaggcaattcagttaatggataagtcttctagagttag

SEQ ID NO: 84520 - DNA, 75 bp, Artificial Sequence
  Synthetic
gctatgatgcctctctctcgccagcttggtttgaagcccttaaaatggtgctggagaagatagggtatggcgatc

SEQ ID NO: 84521 - DNA, 75 bp, Artificial Sequence
  Synthetic
tacagagatctaaaaatagatgtcaagaccagtccccctccagagtgcatcaatgatttactccaggcagttgac

SEQ ID NO: 84522 - DNA, 75 bp, Artificial Sequence
  Synthetic
accaaatagatgcaggcctcctagctcagacaggaaaagattatggcttgctaatgacaccagcagacaagggaa

SEQ ID NO: 84523 - DNA, 75 bp, Artificial Sequence
  Synthetic
tcagacaggaaaagattatggcttgctaatgacaccagcagacaagggaaccacatttgaggctgttacctggga

SEQ ID NO: 84524 - DNA, 75 bp, Artificial Sequence
  Synthetic
gacagaaatacaagagtcgattcgttggactaaagacccaaagaacacgcaagatcacgtgcgatctctatgcct

SEQ ID NO: 84525 - DNA, 75 bp, Artificial Sequence
  Synthetic
gggtccatgataatgtagccatcttaccaactcacgcctcacctggtgaaagcattgtgatcgacggcaaagaag

SEQ ID NO: 84526 - DNA, 75 bp, Artificial Sequence
  Synthetic
tggactaaagacccaaagaacacgcaagatcacgtgcgatctctatgcctattggcttggcataatggaactgtg

SEQ ID NO: 84527 - DNA, 75 bp, Artificial Sequence
  Synthetic
tgaacactagcaagtaccccaacatgtatgtccctgttggtgccgtgaccgagcaggggtaccttaatcttggtg

SEQ ID NO: 84528 - DNA, 75 bp, Artificial Sequence
  Synthetic
atccgttatccgcttgggtacttcgagaagcctagtaccacctttggatcttcgacgcgttgcgctcagcactct

SEQ ID NO: 84529 - DNA, 75 bp, Artificial Sequence
  Synthetic
gtatgtccctgttggtgccgtgaccgagcaggggtaccttaatcttggtggacgacaaaccgctcgcacgctaat

SEQ ID NO: 84530 - DNA, 75 bp, Artificial Sequence
  Synthetic
ttcgacgcgttgcgctcagcactctaccccgagtgtagcttaggtcgatgagtctgggcataccccaccggtgac

SEQ ID NO: 84531 - DNA, 75 bp, Artificial Sequence
  Synthetic
aggcgggaacggttcacacgggttcgcggcggccctgaagcgatcatacttcactcaggtccaaggtgagataca

SEQ ID NO: 84532 - DNA, 75 bp, Artificial Sequence
  Synthetic
gtgggtgaaaccatcaaaagaggtggggtacccgatcataaatgctccatccaaaaccaaacttgagcccagcgc

SEQ ID NO: 84533 - DNA, 75 bp, Artificial Sequence
  Synthetic
gagctcaagtctcatcacaaaaggttggggcgcatgagaataccaatgttgccactggcgggtcaacagtgaatt

SEQ ID NO: 84534 - DNA, 75 bp, Artificial Sequence
  Synthetic
actcataaagtcagcacctgctcttaactctccaaacattgaagcatgtggatatagtgacagagtcatgcaact

SEQ ID NO: 84535 - DNA, 75 bp, Artificial Sequence
  Synthetic
tacttgggaaggtcaggttacactgtgcacgtccaatgcaatgcttccaagttccaccaaggaacgcttggtgtg

SEQ ID NO: 84536 - DNA, 75 bp, Artificial Sequence
  Synthetic
tgcacgtccaatgcaatgcttccaagttccaccaaggaacgcttggtgtgtttgccgttcctgagtactgccttg

SEQ ID NO: 84537 - DNA, 75 bp, Artificial Sequence
  Synthetic
aactggggtttggtcatattgccactgtccaaacttgactatgctccagagtcatcaaccaaactgcccattact

SEQ ID NO: 84538 - DNA, 75 bp, Artificial Sequence
  Synthetic
tgtccaaacttgactatgctccagagtcatcaaccaaactgcccattactgttacagtagcccccatgtgttgtg

SEQ ID NO: 84539 - DNA, 75 bp, Artificial Sequence
  Synthetic
gttacagtagcccccatgtgttgtgagttcaatggattaagaaacatcacaattccagcaactcagggattacca

SEQ ID NO: 84540 - DNA, 75 bp, Artificial Sequence
  Synthetic
agtacctcacatctgacaacttccagtcaccttgtgccctaccggaatttgatgttacacaacccatattcattc

SEQ ID NO: 84541 - DNA, 75 bp, Artificial Sequence
  Synthetic
tacgcctgttttatactcccttccccgtaacttagaagaaataaaccaagttcaatagaagggggcacaaaccag

SEQ ID NO: 84542 - DNA, 75 bp, Artificial Sequence
  Synthetic
caggagcacaaccaccccagaatcgtaaggacgcaatgcttggaacacacttgatctgggacatagggctacaat

SEQ ID NO: 84543 - DNA, 75 bp, Artificial Sequence
  Synthetic
acaccaacgaccatggacatcctcggatttgtatcagcttgcaatgactttactgttagattgctaagggacacc

SEQ ID NO: 84544 - DNA, 75 bp, Artificial Sequence
  Synthetic
ttatcgcaacccactaggcccgcgttacctccatcagaacagagtgtcccaaacacaaaccaaagcacaccagca

SEQ ID NO: 84545 - DNA, 75 bp, Artificial Sequence
  Synthetic
acaatgagtcatcaaccgtttcacacagtaccctgtttgcaaaatggaatatcacatacacagacaccgtgcaat

SEQ ID NO: 84546 - DNA, 75 bp, Artificial Sequence
  Synthetic
aacctcatcaaatccttcaatattctacacttatggtactgctccagctcgaatctccattccatttgtgggaat

SEQ ID NO: 84547 - DNA, 75 bp, Artificial Sequence
  Synthetic
gaatctccattccatttgtgggaattgccaatgcatattctcacttttatgatgggtatgccacagtgcctttaa

SEQ ID NO: 84548 - DNA, 75 bp, Artificial Sequence
  Synthetic
agacaccatagcgcggtgctgttgtaagacgggagtctattactgtgagtccaaaaataagcattaccccattac

SEQ ID NO: 84549 - DNA, 75 bp, Artificial Sequence
  Synthetic
tggccttacttggctgtgatgtttcaccatgggcctggttaaagaagaaggcttgtgacattctggaaattccct

SEQ ID NO: 84550 - DNA, 75 bp, Artificial Sequence
  Synthetic
accatgggcctggttaaagaagaaggcttgtgacattctggaaattccctatgtcatcaagcagggagactcctg

SEQ ID NO: 84551 - DNA, 75 bp, Artificial Sequence
  Synthetic
ttgcagaaaaagaaaacacctcagtgtactcactgccacccgaccccacccactttgatgggtacaaacaacagg

SEQ ID NO: 84552 - DNA, 75 bp, Artificial Sequence
  Synthetic
cgcaatcagaggtaaactaaacatgtgtactgcaacccaaatgtgcaaggattgtccgcaaccagctaacttcaa

SEQ ID NO: 84553 - DNA, 75 bp, Artificial Sequence
  Synthetic
tgtactgcaacccaaatgtgcaaggattgtccgcaaccagctaacttcaaaagatgttgtcccttaatttgtgga

SEQ ID NO: 84554 - DNA, 75 bp, Artificial Sequence
  Synthetic
gtctaccaaacaaaaaacctaacattcccacaatcaggacagcaaaagtacaagggccaggatttgactatgcag

SEQ ID NO: 84555 - DNA, 75 bp, Artificial Sequence
  Synthetic
caagggccaggatttgactatgcagttgctatggctaaaaggaacattgttaccgccactaccagtaaaggtgag

SEQ ID NO: 84556 - DNA, 75 bp, Artificial Sequence
  Synthetic
taagggagagttcacaatgctcggtgtccatgacaacgtagccattctcccaacacatgcttcaccaggtgaaac

SEQ ID NO: 84557 - DNA, 75 bp, Artificial Sequence
  Synthetic
gtccatgacaacgtagccattctcccaacacatgcttcaccaggtgaaacaatagttattgatggcaaggaggtg

SEQ ID NO: 84558 - DNA, 75 bp, Artificial Sequence
  Synthetic
aatgaaaagttcagagacatcagaccacacatccctacccagatcactgagacaaatgatggagttttgattgtg

SEQ ID NO: 84559 - DNA, 75 bp, Artificial Sequence
  Synthetic
ggagtgttgatcgtgaacactagtaagtaccccaacatgtacgtgcccgtcggtgcagtgaccgaacaagggtac

SEQ ID NO: 84560 - DNA, 75 bp, Artificial Sequence
  Synthetic
acgttcctgttggtgctgtgactgaacagggatacctcaatcttggtggcagacaaactgctcgtactttgatgt

SEQ ID NO: 84561 - DNA, 75 bp, Artificial Sequence
  Synthetic
aactcgagccggtcagtgtggtggaatcatcacatgtactggtaaggtcattgggatgcatgttggtgggaacgg

SEQ ID NO: 84562 - DNA, 75 bp, Artificial Sequence
  Synthetic
ttcattatgtgtttgaaggtgtaaaagagcctgctgtcctgaccaagaacgatcctaggcttaaagtggattttg

SEQ ID NO: 84563 - DNA, 75 bp, Artificial Sequence
  Synthetic
agagcctgctgtcctgaccaagaacgatcctaggcttaaagtggattttgaggaagccatcttctccaagtacgt

SEQ ID NO: 84564 - DNA, 75 bp, Artificial Sequence
  Synthetic
agatatcaatacaaaccagatgtgtttggaagatgccatgtatggtacagatggtttggaagccttggatctaac

SEQ ID NO: 84565 - DNA, 75 bp, Artificial Sequence
  Synthetic
ttggaagatgccatgtatggtacagatggtttggaagccttggatctaacaaccagtgcagggtatccttatgta

SEQ ID NO: 84566 - DNA, 75 bp, Artificial Sequence
  Synthetic
acttacggcatcaacctccccttagtcacttatgtgaaggatgaattaagatccaaaagtaaggttgaacaagga

SEQ ID NO: 84567 - DNA, 75 bp, Artificial Sequence
  Synthetic
ttaacctacctctagttacttatgtgaaagatgagttgagaagtaagagcaaggtggaacaggggaagtccagat

SEQ ID NO: 84568 - DNA, 75 bp, Artificial Sequence
  Synthetic
tcacttatgtgaaggatgaattaagatccaaaagtaaggttgaacaaggaaagtccagactcatcgaagcatcca

SEQ ID NO: 84569 - DNA, 75 bp, Artificial Sequence
  Synthetic
taactggtagtgcagtaggctgtgatccagatctattttggagtaagatcccagttctcatggaagagaaattat

SEQ ID NO: 84570 - DNA, 75 bp, Artificial Sequence
  Synthetic
tccagatctattttggagtaagatcccagttctcatggaagagaaattatttgcctttgattacactggctatga

SEQ ID NO: 84571 - DNA, 75 bp, Artificial Sequence
  Synthetic
agatggtgctagagaaaattggttttggagacagagtggactatattgactacctcaatcactcacaccacttgt

SEQ ID NO: 84572 - DNA, 75 bp, Artificial Sequence
  Synthetic
ctatatagattatctcaaccactcacaccacttatacaaaaacaaaacatattgtgtcaagggtggcatgccatc

SEQ ID NO: 84573 - DNA, 75 bp, Artificial Sequence
  Synthetic
attgtgtcaagggtggcatgccatctggctgctcaggcacttcaatctttaactcgatgattaacaatatcataa

SEQ ID NO: 84574 - DNA, 75 bp, Artificial Sequence
  Synthetic
ctacccccatgaagtcgacgctagtctcctagcccaatcaggaaaagactacggactgaccatgacaccagctga

SEQ ID NO: 84575 - DNA, 75 bp, Artificial Sequence
  Synthetic
caccagctgacaaatctgcaacctttgagcaagtcacatgggaaaatgtaacattcttgaaaagattcttcagag

SEQ ID NO: 84576 - DNA, 75 bp, Artificial Sequence
  Synthetic
acatgggagaatgtaacattcttgaaaagattcttcagagcagatgagaagtacccgttcttggtgcatccagtt

SEQ ID NO: 84577 - DNA, 75 bp, Artificial Sequence
  Synthetic
aagatcccagaaacacacaggatcacgtgcgatccttgtgcctattggcctggcacaatggagaggaagaataca

SEQ ID NO: 84578 - DNA, 75 bp, Artificial Sequence
  Synthetic
ggcactgactcaattgccaggtgcacctgtaatgcaggggtgtactattgtgagtctagaaggaaatactaccca

SEQ ID NO: 84579 - DNA, 75 bp, Artificial Sequence
  Synthetic
cctgtaatgcaggggtgtactattgtgagtctagaaggaaatactacccagtctcattcatcggtccaactttcc

SEQ ID NO: 84580 - DNA, 75 bp, Artificial Sequence
  Synthetic
caggagattgtggcgggattctcaggtgccaacatggagtgataggtatcatcacagctggcggtgaaggcttgg

SEQ ID NO: 84581 - DNA, 75 bp, Artificial Sequence
  Synthetic
gtgccaacatggagtgataggtatcatcacagctggcggtgaaggcttggttgcattttcagacattagagacct

SEQ ID NO: 84582 - DNA, 75 bp, Artificial Sequence
  Synthetic
tgggttcacacaacagattggcgacaaaatctcagagctcaccagcatggtaaccagtaccatcactgaaaagtt

SEQ ID NO: 84583 - DNA, 75 bp, Artificial Sequence
  Synthetic
aaaatctcagagctcaccagcatggtaaccagtaccatcactgaaaagttgttgaagaaccttataaagataata

SEQ ID NO: 84584 - DNA, 75 bp, Artificial Sequence
  Synthetic
gacgtgtctccctggcagtggcttaagaagaaagcttgcgacattttggagatcccgtatgtgatgcgtcagggt

SEQ ID NO: 84585 - DNA, 75 bp, Artificial Sequence
  Synthetic
agaagaaagcttgcgacattttggagatcccgtatgtgatgcgtcagggtgacagctggttgaagaagtttacag

SEQ ID NO: 84586 - DNA, 75 bp, Artificial Sequence
  Synthetic
aaatcattcctcaggccagagacaagttggagtttgtcaccaaattaaagcaactggagatgttggagaatcaga

SEQ ID NO: 84587 - DNA, 75 bp, Artificial Sequence
  Synthetic
gttggagtttgtcaccaaattaaagcaactggagatgttggagaatcagatctcaacaatccaccagtcttgtcc

SEQ ID NO: 84588 - DNA, 75 bp, Artificial Sequence
  Synthetic
ctacgcagtagaagcaaagagaatccaaaagttagagcacactatcaacaattacatacagttcaagagcaaaca

SEQ ID NO: 84589 - DNA, 75 bp, Artificial Sequence
  Synthetic
caaaagttagagcacactatcaacaattacatacagttcaagagcaaacaccgtattgagccagtatgtttattg

SEQ ID NO: 84590 - DNA, 75 bp, Artificial Sequence
  Synthetic
acctccacttactcactgccaccagatccatcccactttgatggttacaagcagcaaggagttgtgataatggat

SEQ ID NO: 84591 - DNA, 75 bp, Artificial Sequence
  Synthetic
atccatcccactttgatggttacaagcagcaaggagttgtgataatggatgatttaaaccagaacccggacggtg

SEQ ID NO: 84592 - DNA, 75 bp, Artificial Sequence
  Synthetic
gaattttattcacttcaaattacgtcctggcatccaccaactcaagccgcatcactccacccactgttgctcata

SEQ ID NO: 84593 - DNA, 75 bp, Artificial Sequence
  Synthetic
cctggcatccaccaactcaagccgcatcactccacccactgttgctcatagcgacgccctcgctaggcgctttgc

SEQ ID NO: 84594 - DNA, 75 bp, Artificial Sequence
  Synthetic
gtgtaagaattgtcatcaaccagcgaattttaaaagatgctgccccttggtatgtggaaaggccatccagctgat

SEQ ID NO: 84595 - DNA, 75 bp, Artificial Sequence
  Synthetic
aattttaaaagatgctgccccttggtatgtggaaaggccatccagctgatggacaagtcatctagagttagatac

SEQ ID NO: 84596 - DNA, 75 bp, Artificial Sequence
  Synthetic
ttgtttcagggccctttacagtacaaagatctgaaaatagatattaagaccacacccccacccgagtgcatcaat

SEQ ID NO: 84597 - DNA, 75 bp, Artificial Sequence
  Synthetic
aagatctgaaaatagatattaagaccacacccccacccgagtgcatcaatgatctattacaagcagtggactctc

SEQ ID NO: 84598 - DNA, 75 bp, Artificial Sequence
  Synthetic
ttagcagagcaatgacaatactccaggccgtcaccacctttgcggcagttgctggggttgtgtacgtgatgtaca

SEQ ID NO: 84599 - DNA, 75 bp, Artificial Sequence
  Synthetic
ggccgtcaccacctttgcggcagttgctggggttgtgtacgtgatgtacaagctctttgcaggacaccagggtgc

SEQ ID NO: 84600 - DNA, 75 bp, Artificial Sequence
  Synthetic
ttacgcagtagctatggccaagagaaacattcttacagcaaccactagtaagggagagttcacaatgctcggggt

SEQ ID NO: 84601 - DNA, 75 bp, Artificial Sequence
  Synthetic
aacattcttacagcaaccactagtaagggagagttcacaatgctcggggtccatgacaacgtagccattttaccc

SEQ ID NO: 84602 - DNA, 75 bp, Artificial Sequence
  Synthetic
gaccaggccggcactaaccttgaaatcacaatagtaacactcaagagaaatgaaaagttcagagatatcagacct

SEQ ID NO: 84603 - DNA, 75 bp, Artificial Sequence
  Synthetic
atccctgttggtgctgtgatcgaacaagggtatctcaatcttggtggccgacaaactgctcggactctgatgtac

SEQ ID NO: 84604 - DNA, 75 bp, Artificial Sequence
  Synthetic
gggaacggttcacacgggtttgcagcggccctgaagcgatcatacttcactcaaagtcaaggtgaaatccagtgg

SEQ ID NO: 84605 - DNA, 75 bp, Artificial Sequence
  Synthetic
cggccctgaagcgatcatacttcactcaaagtcaaggtgaaatccagtggatgagaccatcaaaagaagtgggat

SEQ ID NO: 84606 - DNA, 75 bp, Artificial Sequence
  Synthetic
agccagcggttttaaccaaaaatgatcccagactcaaagtcgattttgaggaggcaatcttttccaagtatgtgg

SEQ ID NO: 84607 - DNA, 75 bp, Artificial Sequence
  Synthetic
tcccagactcaaagtcgattttgaggaggcaatcttttccaagtatgtgggtaataaaattactgaagtggatga

SEQ ID NO: 84608 - DNA, 75 bp, Artificial Sequence
  Synthetic
agaggatgccatgtacggcactgatggcctagaagctttagatctcacaactagtgctggatacccctacgttgc

SEQ ID NO: 84609 - DNA, 75 bp, Artificial Sequence
  Synthetic
ggcctagaagctttagatctcacaactagtgctggatacccctacgttgcccttgggaagaagaagagggatatc

SEQ ID NO: 84610 - DNA, 75 bp, Artificial Sequence
  Synthetic
acctacgtaaaagatgagttgagatcaaagaacaaagttgaacaaggaaaatctagacttattgaggcatccagt

SEQ ID NO: 84611 - DNA, 75 bp, Artificial Sequence
  Synthetic
caaagaacaaagttgaacaaggaaaatctagacttattgaggcatccagtctcaatgactcggtagcaatgagaa

SEQ ID NO: 84612 - DNA, 75 bp, Artificial Sequence
  Synthetic
cggatctattctggagcaaaatcccagtgctcatggaagaaaagttatttgcctttgactacacggggtatgatg

SEQ ID NO: 84613 - DNA, 75 bp, Artificial Sequence
  Synthetic
atatagattatctcaaccactcacaccacttgtacaaaaacaaaacttactgtgtcaagggcggcatgccatctg

SEQ ID NO: 84614 - DNA, 75 bp, Artificial Sequence
  Synthetic
atccagtgatgccaatgaaggaaattcatgaatcaatcagatggaccaaagatcctagaaacactcaggatcacg

SEQ ID NO: 84615 - DNA, 75 bp, Artificial Sequence
  Synthetic
tcatgaatcaatcagatggaccaaagatcctagaaacactcaggatcacgttcgctccttgtgcctattggcctg

SEQ ID NO: 84616 - DNA, 75 bp, Artificial Sequence
  Synthetic
acctctacgaacaagcacttctgtttccccggtgatatcacatagactgtacccacggtcaaaagtgattgatcc

SEQ ID NO: 84617 - DNA, 75 bp, Artificial Sequence
  Synthetic
tattaacatcacatttttaatcacaataaacagtgcaaatgggggctcaagtttcaacgcaaaagaccggtgcgc

SEQ ID NO: 84618 - DNA, 75 bp, Artificial Sequence
  Synthetic
gtaattccgctactagacaagacctctcccaagatccatcaaaattcacagaaccggttaaggacttaatgttga

SEQ ID NO: 84619 - DNA, 75 bp, Artificial Sequence
  Synthetic
ctcccaagatccatcaaaattcacagaaccggttaaggacttaatgttgaaaacagcaccagctctaaactcgcc

SEQ ID NO: 84620 - DNA, 75 bp, Artificial Sequence
  Synthetic
agcagccaatgctattgttgcttacggtgaatggcccacttacataaatgattcagaagctaatccggtagatgc

SEQ ID NO: 84621 - DNA, 75 bp, Artificial Sequence
  Synthetic
aaccggttttacaccctagaatcggtgtcttggaagaccacttcaaggggatggtggtggaagttaccagattgt

SEQ ID NO: 84622 - DNA, 75 bp, Artificial Sequence
  Synthetic
cagtgcaacgcttcaaaatttcaccaaggggcgttaggagttttcctgataccagagtttgtcatggcttgcaac

SEQ ID NO: 84623 - DNA, 75 bp, Artificial Sequence
  Synthetic
tacaatccgtcaaatacagacgccagtgagggcagaaagtttgcagcattggattatttgctgggttctggtgtt

SEQ ID NO: 84624 - DNA, 75 bp, Artificial Sequence
  Synthetic
gtgagggcagaaagtttgcagcattggattatttgctgggttctggtgttctagcaggaaacgcctttgtgtacc

SEQ ID NO: 84625 - DNA, 75 bp, Artificial Sequence
  Synthetic
attgtatggcaaaacacaataactggggcattgtcatattaccactggcacccttggcctttgccgcaacatcgt

SEQ ID NO: 84626 - DNA, 75 bp, Artificial Sequence
  Synthetic
gggcattgtcatattaccactggcacccttggcctttgccgcaacatcgtcaccacaggtgcctattacagtgac

SEQ ID NO: 84627 - DNA, 75 bp, Artificial Sequence
  Synthetic
gaacacacctggttccaatcaattccttacatctgatgacttccagtcgccctgtgccttacctaattttgatgt

SEQ ID NO: 84628 - DNA, 75 bp, Artificial Sequence
  Synthetic
ctgaaattgacacattgatcccaatgaacgcagtggacgggaaggtgaacacaatggagatgtatcaaataccat

SEQ ID NO: 84629 - DNA, 75 bp, Artificial Sequence
  Synthetic
ccatgttgggtgaaatcctaaattattacacccattggacggggtccatcaggttcacctttctattttgtggta

SEQ ID NO: 84630 - DNA, 75 bp, Artificial Sequence
  Synthetic
ttacacccattggacggggtccatcaggttcacctttctattttgtggtagtatgatggccactggtaaactgct

SEQ ID NO: 84631 - DNA, 75 bp, Artificial Sequence
  Synthetic
catactgtgtcaagggcggtatgccatctggttgctcaggcacttcaatttttaactcaatgattaacaacttga

SEQ ID NO: 84632 - DNA, 75 bp, Artificial Sequence
  Synthetic
ggacctagggttacaatccagttgttccatggttgcaccgtggatctccaacacagtgtacagacggtgtgcacg

SEQ ID NO: 84633 - DNA, 75 bp, Artificial Sequence
  Synthetic
gactgcttaaggacactccccatattagtcaatcgaaactaataggacgtacacaaggcattgaagacctcattg

SEQ ID NO: 84634 - DNA, 75 bp, Artificial Sequence
  Synthetic
atagccaggaggtgccagctctaactgctgtggaaacaggagcatctggtcaagcaatccccagtgatgtggtgg

SEQ ID NO: 84635 - DNA, 75 bp, Artificial Sequence
  Synthetic
gagtgtgccaattggaagagctttattgctcccagagtactcaacattgtaccgccgttggcttgactcatttta

SEQ ID NO: 84636 - DNA, 75 bp, Artificial Sequence
  Synthetic
aaactaggcacgtggtaaattacaaaaccaggtctgaatcgtgtcttgagtcattctttgggagagctgcgtgtg

SEQ ID NO: 84637 - DNA, 75 bp, Artificial Sequence
  Synthetic
ctccaagagcggagaggagaaaaagcatttcaacatatggaatattacatacaccgacactgtccagttacgcag

SEQ ID NO: 84638 - DNA, 75 bp, Artificial Sequence
  Synthetic
gttgcgctcagcactcaaccccggagtgtagcttgggccgatgagtctggacagtccccactggcgacagtggtc

SEQ ID NO: 84639 - DNA, 75 bp, Artificial Sequence
  Synthetic
tattcacagagaactatcctagtacagccagtggagaagtgcgaaaccaggtgtaccagatcatgtatattccac

SEQ ID NO: 84640 - DNA, 75 bp, Artificial Sequence
  Synthetic
atggaaatgcacctccacggatgtcaattccttacgtagggattgccaatgcctattcacacttctacgatggct

SEQ ID NO: 84641 - DNA, 75 bp, Artificial Sequence
  Synthetic
gcctattcacacttctacgatggctttgcacgggtgccacttgagggtgagaacaccgatgctggcgacacgttt

SEQ ID NO: 84642 - DNA, 75 bp, Artificial Sequence
  Synthetic
cacacatctgtgagagtgtacatgaaaccaaaacacattcggtgttggtgccccagacctcctcgagctgtatta

SEQ ID NO: 84643 - DNA, 75 bp, Artificial Sequence
  Synthetic
ccccagacctcctcgagctgtattatacaggggagagggagtggacatgatatccagtgcaattctacctctgac

SEQ ID NO: 84644 - DNA, 75 bp, Artificial Sequence
  Synthetic
gatcacttgaatgcaattagtatgttatgggacagggatttaatggtggtggaatctagagcccagggaactgat

SEQ ID NO: 84645 - DNA, 75 bp, Artificial Sequence
  Synthetic
tatgggacagggatttaatggtggtggaatctagagcccagggaactgataccatcgccagatgtagttgcaggt

SEQ ID NO: 84646 - DNA, 75 bp, Artificial Sequence
  Synthetic
aagcaaacgactactatccagcaagataccagtctcacatgctgatagggtgcggatttgcagaacccggggact

SEQ ID NO: 84647 - DNA, 75 bp, Artificial Sequence
  Synthetic
ataccagtctcacatgctgatagggtgcggatttgcagaacccggggactgcggtgggatactgaggtgcactca

SEQ ID NO: 84648 - DNA, 75 bp, Artificial Sequence
  Synthetic
tgaagaggaggccatggaacagggaataacaagctacatcgaatctctcggcacagcctttggcgcagggttcac

SEQ ID NO: 84649 - DNA, 75 bp, Artificial Sequence
  Synthetic
gtgattgttgtgagaaattatgaggacactaccacgatccttgcaacactagcactactcgggtgtgatatatct

SEQ ID NO: 84650 - DNA, 75 bp, Artificial Sequence
  Synthetic
ccttggcaatggttgaagaagaaggcatgtgacttactagagattccttatgtgatgcgccaaggtgatgggtgg

SEQ ID NO: 84651 - DNA, 75 bp, Artificial Sequence
  Synthetic
gattggttgaagtgtaaaattatcccagacgctaaggacaaggtggaatttctcaccaagttgaaacagctagac

SEQ ID NO: 84652 - DNA, 75 bp, Artificial Sequence
  Synthetic
tctcaccaagttgaaacagctagacatgttggaaaatcaaattgcaaccatccaccaatcttgccccagccaaga

SEQ ID NO: 84653 - DNA, 75 bp, Artificial Sequence
  Synthetic
ggaggcacgccgaattaacaaaatggagagcacaataaacaattatatacagttcaagagcaaacaccgtattga

SEQ ID NO: 84654 - DNA, 75 bp, Artificial Sequence
  Synthetic
tcaccagggacgggtaaatctatagctacttcattaataggtagagcaatagcagagaaggaaagcacatcagtc

SEQ ID NO: 84655 - DNA, 75 bp, Artificial Sequence
  Synthetic
caaaaccccgatggtatggacatgaaactgttttgccaaatggtatcaacagtggagtttattcctccaatggcc

SEQ ID NO: 84656 - DNA, 75 bp, Artificial Sequence
  Synthetic
cccacagtggctcacagtgatgccttaaccagacgatttgcatttgatgtggaggtttacacgatgtctgaacat

SEQ ID NO: 84657 - DNA, 75 bp, Artificial Sequence
  Synthetic
taaccagacgatttgcatttgatgtggaggtttacacgatgtctgaacattcagtcaaaggcaaactgaatatgg

SEQ ID NO: 84658 - DNA, 75 bp, Artificial Sequence
  Synthetic
ccctgagtgcatcagtgatttgttacaagcagtggattctcaagaggttagggattactgtgagaagaaaggctg

SEQ ID NO: 84659 - DNA, 75 bp, Artificial Sequence
  Synthetic
ccatgactatactccaagctgttaccacattcgcagcagtcgcaggagtagtgtatgtaatgtacaaactcttcg

SEQ ID NO: 84660 - DNA, 75 bp, Artificial Sequence
  Synthetic
aggggccaggatttgactacgcagtggcaatggcaaaaagaaacatagttactgcaaccaccaccaagggtgaat

SEQ ID NO: 84661 - DNA, 75 bp, Artificial Sequence
  Synthetic
atgggaaagaagtagagatcctagatgccagagccttagaagatcaagcgggaaccaatcttgagatcaccatta

SEQ ID NO: 84662 - DNA, 75 bp, Artificial Sequence
  Synthetic
tcatcacttgtactggcaaagtcattgggatgcatgttggcgggaacggttcacatgggtttgcagcagccctca

SEQ ID NO: 84663 - DNA, 75 bp, Artificial Sequence
  Synthetic
gggcgaaatccagtggatgaggtcatcaaaagaagtggggtaccccattataaatgccccatccaagacaaagtt

SEQ ID NO: 84664 - DNA, 75 bp, Artificial Sequence
  Synthetic
taaatgccccatccaagacaaagttagaacccagtgctttccactatgtttttgaaggtgttaaggaaccagctg

SEQ ID NO: 84665 - DNA, 75 bp, Artificial Sequence
  Synthetic
ttactgaagtggacgagtacatgaaagaagcagtggatcactatgcaggacagttaatgtcactggatatcaaca

SEQ ID NO: 84666 - DNA, 75 bp, Artificial Sequence
  Synthetic
gatatccttatgttgcaatggggaaaaagaaaagagacattctagataaacagaccagagatactaaggagatgc

SEQ ID NO: 84667 - DNA, 75 bp, Artificial Sequence
  Synthetic
aagtggaacaaggaaagtcaagattgattgaagcttccagccttaatgattcagttgcaatgagaatggcctttg

SEQ ID NO: 84668 - DNA, 75 bp, Artificial Sequence
  Synthetic
gattgaagcttccagccttaatgattcagttgcaatgagaatggcctttggcaatctttacgcagctttccacaa

SEQ ID NO: 84669 - DNA, 75 bp, Artificial Sequence
  Synthetic
ggaagaaaaactcttcgcttttgactacacagggtatgatgcctcactcagccctgcttggtttgaagctcttaa

SEQ ID NO: 84670 - DNA, 75 bp, Artificial Sequence
  Synthetic
gccctgcttggtttgaagctcttaaaatggtgttagaaaaaattggatttggcagtagagtagactatatagact

SEQ ID NO: 84671 - DNA, 75 bp, Artificial Sequence
  Synthetic
gcacctcaattttcaactcaatgattaacaacctgatcattaggacgcttttactgagaacctacaagggcatag

SEQ ID NO: 84672 - DNA, 75 bp, Artificial Sequence
  Synthetic
gtggctatctatccagtccaagaggtttgcaccactatatgcacatgaagctaaaaggattcaaaagctggagca

SEQ ID NO: 84673 - DNA, 75 bp, Artificial Sequence
  Synthetic
tcctagcccaatcaggaaaagactatggactaaccatgactccagcagataaatcagcaacctttgaaacagtca

SEQ ID NO: 84674 - DNA, 75 bp, Artificial Sequence
  Synthetic
tgccaatgaaagaaattcacgaatcaatcagatggaccaaggaccctagaaacacacaggatcacgtacgctcgt

SEQ ID NO: 84675 - DNA, 75 bp, Artificial Sequence
  Synthetic
gctaaaatcagaagtgtgccaatcggaagagctttattgctcccagagtactctacattgtaccgccgatggctc

SEQ ID NO: 84676 - DNA, 75 bp, Artificial Sequence
  Synthetic
accattagaacagcaaaagtgcaagggcctgggtttgactatgcagtggctatggctaaaagaaacattgttaca

SEQ ID NO: 84677 - DNA, 75 bp, Artificial Sequence
  Synthetic
tactgtgaaaagaaaggctggattgttaacattaccagtcaggttcaaacagagaggaacatcaaccgggcgatg

SEQ ID NO: 84678 - DNA, 75 bp, Artificial Sequence
  Synthetic
cagattaattgaagcttccagtttgaatgactcagtggcaatgagaatggcttttgggaacctatatgctgcttt

SEQ ID NO: 84679 - DNA, 75 bp, Artificial Sequence
  Synthetic
cagtggatcattacgctggccaactcatgtctctagacatcaacacagaacaaatgtgcttggaggacgccatgt

SEQ ID NO: 84680 - DNA, 75 bp, Artificial Sequence
  Synthetic
catgtctctagacatcaacacagaacaaatgtgcttggaggacgccatgtacggcaccgatggcctggaagcact

SEQ ID NO: 84681 - DNA, 75 bp, Artificial Sequence
  Synthetic
gttgtgaacaaggtgtgaagagcctattgagctacataagagtcctccggcccctgaatgcggctaatcccaacc

SEQ ID NO: 84682 - DNA, 75 bp, Artificial Sequence
  Synthetic
agagagacatcttgaataagcagactagagacaccaaggaaatgcggagactcttagatacttatggaattaact

SEQ ID NO: 84683 - DNA, 75 bp, Artificial Sequence
  Synthetic
aagcctccagtttgaatgattcagtggccatgagaatggcatttggaaatctctatgcagcatttcacaaaaacc

SEQ ID NO: 84684 - DNA, 75 bp, Artificial Sequence
  Synthetic
acttctctcaagacccttccaagttcaccgagcccatcaaggatgtcctgataaaaacagccccaatgctaaact

SEQ ID NO: 84685 - DNA, 75 bp, Artificial Sequence
  Synthetic
tggttgtgatccagatctattttggagcaagatcccagtgctaatggaagagaagctctttgcttttgactacac

SEQ ID NO: 84686 - DNA, 75 bp, Artificial Sequence
  Synthetic
gcccaatcaggaaaagactatggactaaccatgactccagcagacaagtcagctacctttgaaacagtcacatgg

SEQ ID NO: 84687 - DNA, 75 bp, Artificial Sequence
  Synthetic
acaaaatttgcaattaccacctagctacacaagaagacttgcaaaatgccgtgagtgtcatgtggaacagagacc

SEQ ID NO: 84688 - DNA, 75 bp, Artificial Sequence
  Synthetic
cgttcctgtcggtgctgtgactgagcagggatatctaaatctcggtgggcgccaaactgctcgtactctaatgta

SEQ ID NO: 84689 - DNA, 75 bp, Artificial Sequence
  Synthetic
taggtcagatgcttgaaagcatgattgacaatacggtccgtgaaacggtgggggcggcaatgtctagagacgctc

SEQ ID NO: 84690 - DNA, 75 bp, Artificial Sequence
  Synthetic
agtgcaaaccagacatgttatacaacataggtcaaggtcagagtctagcatagagtctttcttcgcgcggggtgc

SEQ ID NO: 84691 - DNA, 75 bp, Artificial Sequence
  Synthetic
ctggcccttcttgggtgtgatgtttcaccatggcagtggcttagaaagaaagcatgtgatgttctggagatacct

SEQ ID NO: 84692 - DNA, 75 bp, Artificial Sequence
  Synthetic
tacgcctgttttatatcccctccccatgcaactttagaagcaattcaacaagttcaatagaagggggtacaaacc

SEQ ID NO: 84693 - DNA, 75 bp, Artificial Sequence
  Synthetic
ggtgtccgtgtttccttttatctcttatatggctgcttatggtgacaatcatagattgttatcataaagcgaatt

SEQ ID NO: 84694 - DNA, 75 bp, Artificial Sequence
  Synthetic
tatatggctgcttatggtgacaatcatagattgttatcataaagcgaattggattggccatccggtgaagtacaa

SEQ ID NO: 84695 - DNA, 75 bp, Artificial Sequence
  Synthetic
aattagggaaatacaccacaatgggagcacaggtctcatctcaaaaagttggagctcatgaaaacaccaatgtgg

SEQ ID NO: 84696 - DNA, 75 bp, Artificial Sequence
  Synthetic
agcacaggtctcatctcaaaaagttggagctcatgaaaacaccaatgtggccacaggtggatcaactgtaaatta

SEQ ID NO: 84697 - DNA, 75 bp, Artificial Sequence
  Synthetic
gttcacagaaccagtcaaagatgtactcataaagtcagcacctgcgttgaattctccaaacattgaagcttgtgg

SEQ ID NO: 84698 - DNA, 75 bp, Artificial Sequence
  Synthetic
ctcataaagtcagcacctgcgttgaattctccaaacattgaagcttgtgggtatagtgatagagtgatgcaactc

SEQ ID NO: 84699 - DNA, 75 bp, Artificial Sequence
  Synthetic
ctaagcgataaagatgccaacccggttgaccaacccactgagcctgatgttgcggcctgccgattttatacacta

SEQ ID NO: 84700 - DNA, 75 bp, Artificial Sequence
  Synthetic
ttgaccaacccactgagcctgatgttgcggcctgccgattttatacactagaaactgtggaatgggacaaggaat

SEQ ID NO: 84701 - DNA, 75 bp, Artificial Sequence
  Synthetic
acttgggcaggtcaggctacacggtgcacgtacagtgcaatgcttcaaaatttcatcagggaaccctgggagttt

SEQ ID NO: 84702 - DNA, 75 bp, Artificial Sequence
  Synthetic
gcacgtacagtgcaatgcttcaaaatttcatcagggaaccctgggagtttttgctgtaccagaatattgcttggc

SEQ ID NO: 84703 - DNA, 75 bp, Artificial Sequence
  Synthetic
ctccaccttcacaccagataccagtgcggcacccaagcgtaaattccaaccagttgactacctgtttgggtgtgg

SEQ ID NO: 84704 - DNA, 75 bp, Artificial Sequence
  Synthetic
gcggcacccaagcgtaaattccaaccagttgactacctgtttgggtgtggagtaatggccggaaatgcatttgtg

SEQ ID NO: 84705 - DNA, 75 bp, Artificial Sequence
  Synthetic
attgactgcatggccaagcacaacaattggggtatagtaatattgccactatcaaagcttgattacaatccagat

SEQ ID NO: 84706 - DNA, 75 bp, Artificial Sequence
  Synthetic
attggggtatagtaatattgccactatcaaagcttgattacaatccagatgcaagcacgaaattgcccattacag

SEQ ID NO: 84707 - DNA, 75 bp, Artificial Sequence
  Synthetic
ttatgaatacaccagggagtaaccagtatctgacatcagataactttcaatctccttgtgccctacctgaatttg

SEQ ID NO: 84708 - DNA, 75 bp, Artificial Sequence
  Synthetic
gtatctgacatcagataactttcaatctccttgtgccctacctgaatttgatgtcacccagcccatattcattcc

SEQ ID NO: 84709 - DNA, 75 bp, Artificial Sequence
  Synthetic
aaattcaatggaaatgtacagggttaagctatctgatgcgggtgaccgtgcgaaaccaatcttatgcctatccct

SEQ ID NO: 84710 - DNA, 75 bp, Artificial Sequence
  Synthetic
gatgtcacgccaccaatcgacatacctggggaagtcaaaaatgtgatggaattggctgaaatagacactatgatt

SEQ ID NO: 84711 - DNA, 75 bp, Artificial Sequence
  Synthetic
aagctatctgatgcgggtgaccgtgcgaaaccaatcttatgcctatccctatccccagcctcagaccctagactt

SEQ ID NO: 84712 - DNA, 75 bp, Artificial Sequence
  Synthetic
tgtggctcaatgatggctacaggaaagttgctagttgcttattcaccgccaggcgcgcaacctccccaggacaga

SEQ ID NO: 84713 - DNA, 75 bp, Artificial Sequence
  Synthetic
agttgctagttgcttattcaccgccaggcgcgcaacctccccaggacagaaaggctgctatgttgggtacccatg

SEQ ID NO: 84714 - DNA, 75 bp, Artificial Sequence
  Synthetic
cagtgaaagacgactttactgagggtggttacattagtatgttttaccaaacccgtatagtcgtgcctgcatcaa

SEQ ID NO: 84715 - DNA, 75 bp, Artificial Sequence
  Synthetic
tggttacattagtatgttttaccaaacccgtatagtcgtgcctgcatcaacaccaactagcatggatatactgtg

SEQ ID NO: 84716 - DNA, 75 bp, Artificial Sequence
  Synthetic
acagggtatcgaagatataatccaacaagtagcctctaatgcactacaaatgtcccaacccaccagaccagcttt

SEQ ID NO: 84717 - DNA, 75 bp, Artificial Sequence
  Synthetic
caagtagcctctaatgcactacaaatgtcccaacccaccagaccagctttaccaccagcagagcaaagcgtgcca

SEQ ID NO: 84718 - DNA, 75 bp, Artificial Sequence
  Synthetic
cctttggagcccagtgacacagtacagacaagacatgtcattcaaacaaggtccagaagtgaaagcacagtggaa

SEQ ID NO: 84719 - DNA, 75 bp, Artificial Sequence
  Synthetic
agacaagacatgtcattcaaacaaggtccagaagtgaaagcacagtggaatccttctttgcacgaggtgcgtgtg

SEQ ID NO: 84720 - DNA, 75 bp, Artificial Sequence
  Synthetic
ccactaatccacttgttccatcagacaccgtgcagacgcgacacgtcatacagcagcgtagcaggtctgagtcaa

SEQ ID NO: 84721 - DNA, 75 bp, Artificial Sequence
  Synthetic
atatcacgtacacagatacagtgcaattgagaaggaaattggagatgttcacttactccagatttgacatcgaat

SEQ ID NO: 84722 - DNA, 75 bp, Artificial Sequence
  Synthetic
attgagaaggaaattggagatgttcacttactccagatttgacatcgaatttacatttgtagtgaccgagcgtta

SEQ ID NO: 84723 - DNA, 75 bp, Artificial Sequence
  Synthetic
tccaaaaactgttcgccacatggcgaatcacctataaggacacggtgcagttgcgccggaaattagagttcttca

SEQ ID NO: 84724 - DNA, 75 bp, Artificial Sequence
  Synthetic
aaagaaatgggatgattacacgtggcagacatcatccaatccatcaattttctacacctatgggacagccccacc

SEQ ID NO: 84725 - DNA, 75 bp, Artificial Sequence
  Synthetic
cagacatcatccaatccatcaattttctacacctatgggacagccccacctagaatctccattccatttgtgggt

SEQ ID NO: 84726 - DNA, 75 bp, Artificial Sequence
  Synthetic
gcggcttattatggggcagtatcaattaatgattttggtctgctggctgttagggtagtgaatgaatacaatcca

SEQ ID NO: 84727 - DNA, 75 bp, Artificial Sequence
  Synthetic
ttaatgattttggtctgctggctgttagggtagtgaatgaatacaatccagttagagtgtcctccaaaatacgag

SEQ ID NO: 84728 - DNA, 75 bp, Artificial Sequence
  Synthetic
ttgactacaaggcagacaccctaacccccctccccaccaagggcctgaccacttatggttttggacaccaaaaca

SEQ ID NO: 84729 - DNA, 75 bp, Artificial Sequence
  Synthetic
ccccctccccaccaagggcctgaccacttatggttttggacaccaaaacaaggcagtgtacgtggccggttacaa

SEQ ID NO: 84730 - DNA, 75 bp, Artificial Sequence
  Synthetic
ggtggttgaatccaaggcacaagggactgatcaaatagcccgatgcaactgtaaaacaggagtgtactactgtga

SEQ ID NO: 84731 - DNA, 75 bp, Artificial Sequence
  Synthetic
actgatcaaatagcccgatgcaactgtaaaacaggagtgtactactgtgagtcaagggacaagtactaccctata

SEQ ID NO: 84732 - DNA, 75 bp, Artificial Sequence
  Synthetic
ctaggcagtggtttcgcagccccaggcgactgtggtggcattttacgatgtcaacacggtgtcatgggcctagtc

SEQ ID NO: 84733 - DNA, 75 bp, Artificial Sequence
  Synthetic
gcgactgtggtggcattttacgatgtcaacacggtgtcatgggcctagtcaccgctggtggaaatggtgtggtag

SEQ ID NO: 84734 - DNA, 75 bp, Artificial Sequence
  Synthetic
tcggagcagcgtttgggagtggttttacaaaccaaattagtgagaaggttagtgaaataacctctatggtaactt

SEQ ID NO: 84735 - DNA, 75 bp, Artificial Sequence
  Synthetic
tacaaaccaaattagtgagaaggttagtgaaataacctctatggtaacttctgtggtttcagagaaattattgaa

SEQ ID NO: 84736 - DNA, 75 bp, Artificial Sequence
  Synthetic
ccttggagcagcatttggaagcgggttcacccagcaaatcggggataaaattattgagctaaccggcatggtcac

SEQ ID NO: 84737 - DNA, 75 bp, Artificial Sequence
  Synthetic
actagcactcctagggtgtgatgtgtcaccatggtcatggctcaaaaagaaagtgtgtgacattctcgaaatccc

SEQ ID NO: 84738 - DNA, 75 bp, Artificial Sequence
  Synthetic
tcaccatggtcatggctcaaaaagaaagtgtgtgacattctcgaaatcccgtttgttttgaagcaaggagattca

SEQ ID NO: 84739 - DNA, 75 bp, Artificial Sequence
  Synthetic
attgaatggttgaaaaacaaagttattccagaggccaaggataaagtggaatatgtgtccaagttgaagcaacta

SEQ ID NO: 84740 - DNA, 75 bp, Artificial Sequence
  Synthetic
ttccagaggccaaggataaagtggaatatgtgtccaagttgaagcaactaggcatgttggagaatcaaataaaca

SEQ ID NO: 84741 - DNA, 75 bp, Artificial Sequence
  Synthetic
caaggcgatttgcgcccttgtatgctgttgaggccaagagaatcagcaagctagaaaacactattaataactaca

SEQ ID NO: 84742 - DNA, 75 bp, Artificial Sequence
  Synthetic
tgttgaggccaagagaatcagcaagctagaaaacactattaataactacatacagttcaagagcaaacaccggat

SEQ ID NO: 84743 - DNA, 75 bp, Artificial Sequence
  Synthetic
agttggaacacacgattaacaattacatacagttcaagagcaaacaccgtattgaaccagtatgtttgttagtac

SEQ ID NO: 84744 - DNA, 75 bp, Artificial Sequence
  Synthetic
aatcgccgagaaagaaaacacttccacatactcattgcctccagacccagcacactttgatggatacaaacaaca

SEQ ID NO: 84745 - DNA, 75 bp, Artificial Sequence
  Synthetic
acatactcattgcctccagacccagcacactttgatggatacaaacaacaaggcgttgtaattatggatgatctc

SEQ ID NO: 84746 - DNA, 75 bp, Artificial Sequence
  Synthetic
gcttccttagaggagaagggcatattgttcacttcagattatgtgctggcatccactaactctagcacaatcaca

SEQ ID NO: 84747 - DNA, 75 bp, Artificial Sequence
  Synthetic
tgttcacttcagattatgtgctggcatccactaactctagcacaatcacacccccaacagttgctcacagtgatg

SEQ ID NO: 84748 - DNA, 75 bp, Artificial Sequence
  Synthetic
tggcggaagcaaccagattgtgcaaagactgtcaccaaccagccaactttaaaaagtgctgccctcttgtgtgtg

SEQ ID NO: 84749 - DNA, 75 bp, Artificial Sequence
  Synthetic
agactgtcaccaaccagccaactttaaaaagtgctgccctcttgtgtgtggcaaagccatccaactcatggacaa

SEQ ID NO: 84750 - DNA, 75 bp, Artificial Sequence
  Synthetic
tggcaattgtatggaggctctcttccaaggtcccttaacatacaaagacttgaaaattgatatcaagaccagtcc

SEQ ID NO: 84751 - DNA, 75 bp, Artificial Sequence
  Synthetic
caaggtcccttaacatacaaagacttgaaaattgatatcaagaccagtccccccccagagtgtataaatgacctt

SEQ ID NO: 84752 - DNA, 75 bp, Artificial Sequence
  Synthetic
atcataattgaaagaaatttaaacagagccatgaccatcctacaggctttgaccaccttcgctgcagttgcaggc

SEQ ID NO: 84753 - DNA, 75 bp, Artificial Sequence
  Synthetic
gagccatgaccatcctacaggctttgaccaccttcgctgcagttgcaggcgttgtttatgtaatgtacaggttat

SEQ ID NO: 84754 - DNA, 75 bp, Artificial Sequence
  Synthetic
ttcaaggtccaggctttgattatgcagtggctatggctaaaagaaacatcgtcaccgccaccacctccaaaggag

SEQ ID NO: 84755 - DNA, 75 bp, Artificial Sequence
  Synthetic
ttgatggtaaagaagttgaagtgttagacgccaaggctttagaagaccaggctggtactaatttagaaatcacta

SEQ ID NO: 84756 - DNA, 75 bp, Artificial Sequence
  Synthetic
agacgccaaggctttagaagaccaggctggtactaatttagaaatcactattgtcaccctcaaaagaaatgaaaa

SEQ ID NO: 84757 - DNA, 75 bp, Artificial Sequence
  Synthetic
caagtaccccaacatgtacgtacctgtcggtgcagtgaccgagcaagggtaccttaatttgggtgggcgtcaaac

SEQ ID NO: 84758 - DNA, 75 bp, Artificial Sequence
  Synthetic
ggttcacatgggttcgctgcggccctaaaacgatcatacttcactcaaagtcaaggtgagattcagtggatgaga

SEQ ID NO: 84759 - DNA, 75 bp, Artificial Sequence
  Synthetic
atttttgaaggtgtaaaggaacctgcagtattgactaaaaatgatcccagacttaagactgattttgaagaggcc

SEQ ID NO: 84760 - DNA, 75 bp, Artificial Sequence
  Synthetic
cagtattgactaaaaatgatcccagacttaagactgattttgaagaggccatcttctcaaaatatgttggaaaca

SEQ ID NO: 84761 - DNA, 75 bp, Artificial Sequence
  Synthetic
acacagagcaaatgtgtctggaggacgccatgtatggtacagatggattagaagctttggatctcagtaccagcg

SEQ ID NO: 84762 - DNA, 75 bp, Artificial Sequence
  Synthetic
cgccatgtatggtacagatggattagaagctttggatctcagtaccagcgctggctatccatacgtggcacttgg

SEQ ID NO: 84763 - DNA, 75 bp, Artificial Sequence
  Synthetic
gatcaacctgcccctggttacttatgtgaaggatgagctgagaagcaagagcaaggtggaacagggcaaatccag

SEQ ID NO: 84764 - DNA, 75 bp, Artificial Sequence
  Synthetic
gtgaaggatgagctgagaagcaagagcaaggtggaacagggcaaatccagactgattgaagcctctagtttgaat

SEQ ID NO: 84765 - DNA, 75 bp, Artificial Sequence
  Synthetic
tcagctgtagggtgtgacccagatttgttttggagcaagattccagtgctgatggaagagaaactttttgctttc

SEQ ID NO: 84766 - DNA, 75 bp, Artificial Sequence
  Synthetic
taaaatggttttggaaaaaattggatttggagacagggtagactacattgattatttaaaccactcacaccatct

SEQ ID NO: 84767 - DNA, 75 bp, Artificial Sequence
  Synthetic
ctttacaaaaacaaaacatattgtgtcaagggtggcatgccatctggctgctctggcacctctattttcaactca

SEQ ID NO: 84768 - DNA, 75 bp, Artificial Sequence
  Synthetic
taatgccaatgaaagagattcatgaatcaattagatggacaaaggatcccaggaacacccaggatcatgttcgct

SEQ ID NO: 84769 - DNA, 75 bp, Artificial Sequence
  Synthetic
atcaattagatggacaaaggatcccaggaacacccaggatcatgttcgctctttgtgcctattggcatggcataa

SEQ ID NO: 84770 - DNA, 75 bp, Artificial Sequence
  Synthetic
gttcaatagaaggtggtacaaaccagtatcgccacgaacaagcacttctgttgccccggtgaaattgcataagct

SEQ ID NO: 84771 - DNA, 75 bp, Artificial Sequence
  Synthetic
taccaccacgaacaagcacttctgttaccccggtgatgttgcatagactgttcccacggtcaaaagcgattgatc

SEQ ID NO: 84772 - DNA, 75 bp, Artificial Sequence
  Synthetic
tacattggctgcttatggtgacaatcttagattgttatcataaagcaagttggattggccatccggtgaaagtca

SEQ ID NO: 84773 - DNA, 75 bp, Artificial Sequence
  Synthetic
cttagattgttatcataaagcaagttggattggccatccggtgaaagtcaaagttactatctatttatctgttgg

SEQ ID NO: 84774 - DNA, 75 bp, Artificial Sequence
  Synthetic
gtgcccaagtttcatcacaaaaggttggtgcacatgaaaacaccaacgtggcaactggtgggtctacagtgaatt

SEQ ID NO: 84775 - DNA, 75 bp, Artificial Sequence
  Synthetic
tggtgcacatgaaaacaccaacgtggcaactggtgggtctacagtgaattataccactattaattattataagga

SEQ ID NO: 84776 - DNA, 75 bp, Artificial Sequence
  Synthetic
tatgttaaaatctgcaccggcattaaattccccaaacatcgaagcatgcggttacagtgatagggtaaggcaaat

SEQ ID NO: 84777 - DNA, 75 bp, Artificial Sequence
  Synthetic
aattccccaaacatcgaagcatgcggttacagtgatagggtaaggcaaatcacattaggaaattctacaataact

SEQ ID NO: 84778 - DNA, 75 bp, Artificial Sequence
  Synthetic
cgaagattgttatcataaagcgaattggattggccatccggtgaaagtaaaacacattatttacctttttgttgg

SEQ ID NO: 84779 - DNA, 75 bp, Artificial Sequence
  Synthetic
gttgatgcacccacggaaccagacgtgagcagtaacaggttttacacattagaatcagtacagtggagtaagacc

SEQ ID NO: 84780 - DNA, 75 bp, Artificial Sequence
  Synthetic
tgagcagtaacaggttttacacattagaatcagtacagtggagtaagacctcaaaaggctggtggtggaagttac

SEQ ID NO: 84781 - DNA, 75 bp, Artificial Sequence
  Synthetic
tgaattacaccactataaattactacaaagactcagctagtaatgctgcctccaaacaggatttctctcaagatc

SEQ ID NO: 84782 - DNA, 75 bp, Artificial Sequence
  Synthetic
caaagactcagctagtaatgctgcctccaaacaggatttctctcaagatccctctaaattcactgaaccagtcaa

SEQ ID NO: 84783 - DNA, 75 bp, Artificial Sequence
  Synthetic
tgcatgtacagtgcaacgcttccaaatttcaccagggggcgctggccgtctttgcagtgcctgagtgtgtgttct

SEQ ID NO: 84784 - DNA, 75 bp, Artificial Sequence
  Synthetic
atttcaccagggggcgctggccgtctttgcagtgcctgagtgtgtgttctcaggaaactcgaaggagaagacaaa

SEQ ID NO: 84785 - DNA, 75 bp, Artificial Sequence
  Synthetic
acagatcacccttggaaattccaccataaccacacaggaagctgccaatgcagtggttgcatacggcaggtggcc

SEQ ID NO: 84786 - DNA, 75 bp, Artificial Sequence
  Synthetic
aactgacgatgctagagagttttgccctattgactacttgtttggatcaggtgttttatttgggaatgcattcat

SEQ ID NO: 84787 - DNA, 75 bp, Artificial Sequence
  Synthetic
aatccagtagatgcccccactgagccagatgtcagttcaaataggttttacacactagaatcggtgcagtggtcc

SEQ ID NO: 84788 - DNA, 75 bp, Artificial Sequence
  Synthetic
cctattgactacttgtttggatcaggtgttttatttgggaatgcattcatttatccacaccaaattatcaacctt

SEQ ID NO: 84789 - DNA, 75 bp, Artificial Sequence
  Synthetic
aactggggtatagtcataattccagtggtccctcttgatttcgcggacgctagtagcgttcagatcccaattaca

SEQ ID NO: 84790 - DNA, 75 bp, Artificial Sequence
  Synthetic
acacagtccacgtgcagtgcaatgcatcaaaattccaccagggggccctcggtgtctttgctatacctgaatacg

SEQ ID NO: 84791 - DNA, 75 bp, Artificial Sequence
  Synthetic
tggtccctcttgatttcgcggacgctagtagcgttcagatcccaattacagttacaatagctccaatgtacactg

SEQ ID NO: 84792 - DNA, 75 bp, Artificial Sequence
  Synthetic
aatttctgacatcagacaattttcagtcgccgtgtgcactaccagagtttgatgtgacaccacccattcacatcc

SEQ ID NO: 84793 - DNA, 75 bp, Artificial Sequence
  Synthetic
catttaccaatagttacaacccatctgcggaggctgatcaaggtagggcgtttgcagctgtcgattacttgcttg

SEQ ID NO: 84794 - DNA, 75 bp, Artificial Sequence
  Synthetic
gtcgccgtgtgcactaccagagtttgatgtgacaccacccattcacatcccaggtgaagtgaaaaacatgatgga

SEQ ID NO: 84795 - DNA, 75 bp, Artificial Sequence
  Synthetic
tgcggaggctgatcaaggtagggcgtttgcagctgtcgattacttgcttggatgtggtgtccttgcaggcaatgc

SEQ ID NO: 84796 - DNA, 75 bp, Artificial Sequence
  Synthetic
tggattggacagtgcagcatcaaatttaaatgacccaatattctgtctgtctttatcacccgctagtgatcagag

SEQ ID NO: 84797 - DNA, 75 bp, Artificial Sequence
  Synthetic
attagctattgattgcatggccaaacacaataactggggactagtgattctgcccttggaacccttggcctacgc

SEQ ID NO: 84798 - DNA, 75 bp, Artificial Sequence
  Synthetic
tgcccttggaacccttggcctacgcaccacaggcatctacacaaatccctattacagtgaccattgcaccaatgt

SEQ ID NO: 84799 - DNA, 75 bp, Artificial Sequence
  Synthetic
ttaaatgacccaatattctgtctgtctttatcacccgctagtgatcagaggttgcaatacaccttgttaggggaa

SEQ ID NO: 84800 - DNA, 75 bp, Artificial Sequence
  Synthetic
ggtaagttgctccttagctacagtccaccaggcgcggcaccgcctaaaacgcgaaaagatgctatgctggggact

SEQ ID NO: 84801 - DNA, 75 bp, Artificial Sequence
  Synthetic
caccaggcgcggcaccgcctaaaacgcgaaaagatgctatgctggggactcacctaatttgggacttaggactgc

SEQ ID NO: 84802 - DNA, 75 bp, Artificial Sequence
  Synthetic
gatggagttagcagaaattgacactttgataccaatgaacagcgtttcaggcaaggcaaacaccatggacatgta

SEQ ID NO: 84803 - DNA, 75 bp, Artificial Sequence
  Synthetic
ctgggggctacataacttgtttctaccaaaccaaaattgtcgtgcccttgagtactccaactaaaatggatatgt

SEQ ID NO: 84804 - DNA, 75 bp, Artificial Sequence
  Synthetic
ccaaaccaaaattgtcgtgcccttgagtactccaactaaaatggatatgttagcgtttgtgagtgcttgtcccga

SEQ ID NO: 84805 - DNA, 75 bp, Artificial Sequence
  Synthetic
catcattgagacagtagcccaaaatgcactccaattgtcacaacccagacctactcaaagacccgctctcactaa

SEQ ID NO: 84806 - DNA, 75 bp, Artificial Sequence
  Synthetic
gcactccaattgtcacaacccagacctactcaaagacccgctctcactaattctgctgccagtactccagctaca

SEQ ID NO: 84807 - DNA, 75 bp, Artificial Sequence
  Synthetic
cacgtcatatgggacttagggttacagtctagctgcactatggtagcaccttggatctccaataccgtctacagg

SEQ ID NO: 84808 - DNA, 75 bp, Artificial Sequence
  Synthetic
agtctagctgcactatggtagcaccttggatctccaataccgtctacaggaggtgcgtgaaggacgacttcacag

SEQ ID NO: 84809 - DNA, 75 bp, Artificial Sequence
  Synthetic
gatgtcatagaaaccaggaaagtcataaattacaaaactcggagtgaatcaaccattgagagctttttcgggaga

SEQ ID NO: 84810 - DNA, 75 bp, Artificial Sequence
  Synthetic
taaattacaaaactcggagtgaatcaaccattgagagctttttcgggagatcagcctgcattacaatcatgtcag

SEQ ID NO: 84811 - DNA, 75 bp, Artificial Sequence
  Synthetic
ttgcatttgtgagcgcgtgtccagacttcagtgtgcgattgctgagggataccactcacatcagccagtcagctc

SEQ ID NO: 84812 - DNA, 75 bp, Artificial Sequence
  Synthetic
cttcagtgtgcgattgctgagggataccactcacatcagccagtcagctctgatagcccaaacccaaggcattga

SEQ ID NO: 84813 - DNA, 75 bp, Artificial Sequence
  Synthetic
ccgtgcaacttcgcaggaagttggagatgttcacatactcacgctttgacaccgagttcacttttgtgttaactg

SEQ ID NO: 84814 - DNA, 75 bp, Artificial Sequence
  Synthetic
gatgttcacatactcacgctttgacaccgagttcacttttgtgttaactgagagatattacacccaaaattccgg

SEQ ID NO: 84815 - DNA, 75 bp, Artificial Sequence
  Synthetic
tcctagcacaagcggtgtgaacagccaggaggtaccagcattaacagctgttgagaccggagcctcagggcaggc

SEQ ID NO: 84816 - DNA, 75 bp, Artificial Sequence
  Synthetic
caggaggtaccagcattaacagctgttgagaccggagcctcagggcaggcggtgccatctgacgtcattgagact

SEQ ID NO: 84817 - DNA, 75 bp, Artificial Sequence
  Synthetic
cacttggcaatcgtcatcaaacccatccatcttttacacctatggatgtgcaccaccaagaatgtccgtgccttt

SEQ ID NO: 84818 - DNA, 75 bp, Artificial Sequence
  Synthetic
tccatcttttacacctatggatgtgcaccaccaagaatgtccgtgcctttcgtgggtattgcaaacgcgtacagc

SEQ ID NO: 84819 - DNA, 75 bp, Artificial Sequence
  Synthetic
atattggaagtggaaaacttcaatgcaacaagtacagatgacaaaaagaagcaatttactgtgtggccaatcaca

SEQ ID NO: 84820 - DNA, 75 bp, Artificial Sequence
  Synthetic
caacaagtacagatgacaaaaagaagcaatttactgtgtggccaatcacatacaccaatacagtccaactaagaa

SEQ ID NO: 84821 - DNA, 75 bp, Artificial Sequence
  Synthetic
acatccatcaatgattttggagcaatagccctcagggtcgtcaatgaacacaatccagccaggataacttcacgc

SEQ ID NO: 84822 - DNA, 75 bp, Artificial Sequence
  Synthetic
tagccctcagggtcgtcaatgaacacaatccagccaggataacttcacgcatgcgggtgtacatgaagcctaagc

SEQ ID NO: 84823 - DNA, 75 bp, Artificial Sequence
  Synthetic
gcaactctgggcacgccaggaattcagtttatcaaattatgtacatacctccaggagcacctagaccaagtgcat

SEQ ID NO: 84824 - DNA, 75 bp, Artificial Sequence
  Synthetic
agtttatcaaattatgtacatacctccaggagcacctagaccaagtgcatgggacgattacacctggcagtcatc

SEQ ID NO: 84825 - DNA, 75 bp, Artificial Sequence
  Synthetic
agctaaccccaatcactcctgttaccgcaatgactacatacgggtttggacatcaaaataaggcagtgtatgttg

SEQ ID NO: 84826 - DNA, 75 bp, Artificial Sequence
  Synthetic
cgcaatgactacatacgggtttggacatcaaaataaggcagtgtatgttgcaggttataagatttgcaattacca

SEQ ID NO: 84827 - DNA, 75 bp, Artificial Sequence
  Synthetic
tgcatactcacacttttatgatggctttgcgcgagtgccactgaaggatgaaaccgcggactccggcgacactta

SEQ ID NO: 84828 - DNA, 75 bp, Artificial Sequence
  Synthetic
tttgcgcgagtgccactgaaggatgaaaccgcggactccggcgacacttactacggattagtttcaatcaatgac

SEQ ID NO: 84829 - DNA, 75 bp, Artificial Sequence
  Synthetic
tgcacagggcacggacacaattgcacgctgccagtgtagaaccggagtatactactgtgagtcacaaagaaaata

SEQ ID NO: 84830 - DNA, 75 bp, Artificial Sequence
  Synthetic
cgctgccagtgtagaaccggagtatactactgtgagtcacaaagaaaatactacccagttacagtcacagggcca

SEQ ID NO: 84831 - DNA, 75 bp, Artificial Sequence
  Synthetic
aaaccaaaacatatacgctgttggtgtccccgaccaccacgagcggtaccttacagaggagaaggagtggattta

SEQ ID NO: 84832 - DNA, 75 bp, Artificial Sequence
  Synthetic
gtccccgaccaccacgagcggtaccttacagaggagaaggagtggatttaaagcagggaagtatcacaccactaa

SEQ ID NO: 84833 - DNA, 75 bp, Artificial Sequence
  Synthetic
gcacaaccaggcgactgcggaggcattctacgctgtaatcatggtgtgatggggataatcactgcaggaggagag

SEQ ID NO: 84834 - DNA, 75 bp, Artificial Sequence
  Synthetic
ttctacgctgtaatcatggtgtgatggggataatcactgcaggaggagagggaatagttgccttcgcagatatca

SEQ ID NO: 84835 - DNA, 75 bp, Artificial Sequence
  Synthetic
tgaattaccacctcgccactgcagaagacttcagacgctgtgtaaggtccatgtgggagagggacttgatagtgg

SEQ ID NO: 84836 - DNA, 75 bp, Artificial Sequence
  Synthetic
tcggtgccggcttcagtgccgagattgccaacaagatctcagaaatttcagctagtgtgcagagtgtaatcacag

SEQ ID NO: 84837 - DNA, 75 bp, Artificial Sequence
  Synthetic
tcaaattgccaggtgttcgtgcacaaccggagtttactattgctcgtcacgaggtaagtattatccaatcactgt

SEQ ID NO: 84838 - DNA, 75 bp, Artificial Sequence
  Synthetic
tgccaacaagatctcagaaatttcagctagtgtgcagagtgtaatcacagataagttactgaaaagtctaatcaa

SEQ ID NO: 84839 - DNA, 75 bp, Artificial Sequence
  Synthetic
agggtgtgatgcttcaccatggcagtggctcaagcaaaaggtttgcaacatgctggaactcccatatgtatatag

SEQ ID NO: 84840 - DNA, 75 bp, Artificial Sequence
  Synthetic
tggctcaagcaaaaggtttgcaacatgctggaactcccatatgtatatagacagagtgactcttggttaaagaaa

SEQ ID NO: 84841 - DNA, 75 bp, Artificial Sequence
  Synthetic
atggagcaatgggaatcatcactgctggtggtaatggaatagtcgcctttgccgatatcagagacctgtatgtgg

SEQ ID NO: 84842 - DNA, 75 bp, Artificial Sequence
  Synthetic
aaagataaggtcatcccagaagcgagagacaaattggagtacgtaaataaattgaaacagttagagttgattgaa

SEQ ID NO: 84843 - DNA, 75 bp, Artificial Sequence
  Synthetic
gagacaaattggagtacgtaaataaattgaaacagttagagttgattgaaaaccaaatgtctgtattgcaccagt

SEQ ID NO: 84844 - DNA, 75 bp, Artificial Sequence
  Synthetic
caccattatacgcaacagaggctaggagaatcttcagtctcgagaacaagatcaacaattacatacagttcaaga

SEQ ID NO: 84845 - DNA, 75 bp, Artificial Sequence
  Synthetic
ctctcctggggtgcgatgtgtcaccatggtcttggctcagaaagaaagcatgcgatatcctagaactaccctatg

SEQ ID NO: 84846 - DNA, 75 bp, Artificial Sequence
  Synthetic
gagaatcttcagtctcgagaacaagatcaacaattacatacagttcaagaccaaacaccgcattgagccagtatg

SEQ ID NO: 84847 - DNA, 75 bp, Artificial Sequence
  Synthetic
gcaataaattgtccaagtttatagattggctcaaaaacaaaataatacctgaagctagagacaaggtagagtacg

SEQ ID NO: 84848 - DNA, 75 bp, Artificial Sequence
  Synthetic
ggaaaacaccagtgtttattcgcttcccccagacccctcccactttgacgggtataaacaacagggggttgtcat

SEQ ID NO: 84849 - DNA, 75 bp, Artificial Sequence
  Synthetic
cccccagacccctcccactttgacgggtataaacaacagggggttgtcattatggatgacttaaatcaaaatcca

SEQ ID NO: 84850 - DNA, 75 bp, Artificial Sequence
  Synthetic
tcaccaaattaaagcaactgaccatgctcgagaatcagattagcacaattcaccaatcttgcccaagccaagaac

SEQ ID NO: 84851 - DNA, 75 bp, Artificial Sequence
  Synthetic
gaaaagggtatactgttcacatcagattatgtgcttgcctcaaccaactcaaatacaatcacaccaccaaccgtg

SEQ ID NO: 84852 - DNA, 75 bp, Artificial Sequence
  Synthetic
attatgtgcttgcctcaaccaactcaaatacaatcacaccaccaaccgtgtctgctagtgacgctctcgcacgca

SEQ ID NO: 84853 - DNA, 75 bp, Artificial Sequence
  Synthetic
ttcaagagcaaacaccgtattgaaccagtatgtatgctgatacatggaagtcctggcacagggaagtccattatc

SEQ ID NO: 84854 - DNA, 75 bp, Artificial Sequence
  Synthetic
tcctggcacagggaagtccattatcacctccctggtcggtagagctattgcagatagagagaacacgtccgtcta

SEQ ID NO: 84855 - DNA, 75 bp, Artificial Sequence
  Synthetic
cccagttgtgcaaggattgtcataaaccagcaaacttctcatcatgttgtcctttagtgtgtggtaaggcgatac

SEQ ID NO: 84856 - DNA, 75 bp, Artificial Sequence
  Synthetic
accagcaaacttctcatcatgttgtcctttagtgtgtggtaaggcgatacagttgatggatagacacacgagagt

SEQ ID NO: 84857 - DNA, 75 bp, Artificial Sequence
  Synthetic
ctcttttgccagatggtttccacagtagaatttatccccccaatggcatcactagaagagaaagggatcctattc

SEQ ID NO: 84858 - DNA, 75 bp, Artificial Sequence
  Synthetic
tgaggcgctatttcagggacctttggaattcaaagacttaaaaatagatgtgaaatcaacacctccaccctcagc

SEQ ID NO: 84859 - DNA, 75 bp, Artificial Sequence
  Synthetic
gaattcaaagacttaaaaatagatgtgaaatcaacacctccaccctcagcaatctcagacttattgaaagcagta

SEQ ID NO: 84860 - DNA, 75 bp, Artificial Sequence
  Synthetic
agtagaagattcgcttttgacatggacgtgtataccatgtccgagcactccattaaagggaaactgaacatggca

SEQ ID NO: 84861 - DNA, 75 bp, Artificial Sequence
  Synthetic
gagagacacatttcgaaagctgccaccatattacaagctatctcagcctttgcagttacagcagggatggtgtat

SEQ ID NO: 84862 - DNA, 75 bp, Artificial Sequence
  Synthetic
actgccacagtgctgtgtaaggagtgccccaaaccagcaaatttcaaaaagtgttgtcctttgatttgcggtaag

SEQ ID NO: 84863 - DNA, 75 bp, Artificial Sequence
  Synthetic
ccatattacaagctatctcagcctttgcagttacagcagggatggtgtatgttgtgtacaaactctttgcaggat

SEQ ID NO: 84864 - DNA, 75 bp, Artificial Sequence
  Synthetic
aagattagacgggccaacattggtaactgcatggaagcactgttccagggaccgatacaatataaagatttgaag

SEQ ID NO: 84865 - DNA, 75 bp, Artificial Sequence
  Synthetic
cagtatttgattatgctgttgcgatggccaagaagaatatcctaactgccaccaccatgaaaggggagttcacca

SEQ ID NO: 84866 - DNA, 75 bp, Artificial Sequence
  Synthetic
ggccaagaagaatatcctaactgccaccaccatgaaaggggagttcaccatgctaggggtgcacgacagaattgc

SEQ ID NO: 84867 - DNA, 75 bp, Artificial Sequence
  Synthetic
tagtgaacgtcaataatgaggtccagttagaacgcaatttgaacagggccatgaccattttacaagcaataacca

SEQ ID NO: 84868 - DNA, 75 bp, Artificial Sequence
  Synthetic
aagactagtggaccccagtggggtgaacttggaaatcactatagtggaacttgacagaaatgagaaattcagaga

SEQ ID NO: 84869 - DNA, 75 bp, Artificial Sequence
  Synthetic
aacttggaaatcactatagtggaacttgacagaaatgagaaattcagagacattaggactcatttacctactcag

SEQ ID NO: 84870 - DNA, 75 bp, Artificial Sequence
  Synthetic
gttagaacgcaatttgaacagggccatgaccattttacaagcaataaccacctttgccgcagtcgctggcgttgt

SEQ ID NO: 84871 - DNA, 75 bp, Artificial Sequence
  Synthetic
gtcaccgaacaaggcatgctcaaccttgcaggtagggcgacaaacagaacattaatgtacaacttccctaccaaa

SEQ ID NO: 84872 - DNA, 75 bp, Artificial Sequence
  Synthetic
ggcccaggttttgactatgcagtagcaatggcaaaaagaaacatcttaacagctaccactgacaagggtgagttc

SEQ ID NO: 84873 - DNA, 75 bp, Artificial Sequence
  Synthetic
ttgcaggtagggcgacaaacagaacattaatgtacaacttccctaccaaagctgggcagtgtggtggagtcttga

SEQ ID NO: 84874 - DNA, 75 bp, Artificial Sequence
  Synthetic
gggaaggaggtcaagatcactgatgcacaggcgctagtggaccaagcaggcacaaatttagaaataaccattatc

SEQ ID NO: 84875 - DNA, 75 bp, Artificial Sequence
  Synthetic
catacttcacagaactacagggagagatccaatggatgaaaccaagcaaggatgcaggttaccctatgatcaatg

SEQ ID NO: 84876 - DNA, 75 bp, Artificial Sequence
  Synthetic
gatccaatggatgaaaccaagcaaggatgcaggttaccctatgatcaatgcaccctctaaaacaaaactggaacc

SEQ ID NO: 84877 - DNA, 75 bp, Artificial Sequence
  Synthetic
gttttgattgtgaacactagtaagtaccccaacatgtacgtcccagttggtgctgtgaccgagcaggggtatctc

SEQ ID NO: 84878 - DNA, 75 bp, Artificial Sequence
  Synthetic
tgactttgaggaagctgtgttttccaagtacattggaaacaaaatcacggaggtggatgagtacatgaaggaagc

SEQ ID NO: 84879 - DNA, 75 bp, Artificial Sequence
  Synthetic
aagtacattggaaacaaaatcacggaggtggatgagtacatgaaggaagctgttgaccattacgctggtcagtta

SEQ ID NO: 84880 - DNA, 75 bp, Artificial Sequence
  Synthetic
ggatgcacgttggagggaacggttcacatgggtttgcagcggccctgaaacggtcatacttcactcagagtcaag

SEQ ID NO: 84881 - DNA, 75 bp, Artificial Sequence
  Synthetic
gacttgacaactagtgctggatacccttatgtggccattggaaagaaaaagagagacattctcaacaaacaaaca

SEQ ID NO: 84882 - DNA, 75 bp, Artificial Sequence
  Synthetic
cttatgtggccattggaaagaaaaagagagacattctcaacaaacaaacaagagaaaccaaggaaatgcagaaaa

SEQ ID NO: 84883 - DNA, 75 bp, Artificial Sequence
  Synthetic
tgaaggagttaaggagccagcagttttgacaaagagtgatcctaggctgaaaacagactttgaagaggcaatttt

SEQ ID NO: 84884 - DNA, 75 bp, Artificial Sequence
  Synthetic
aacaaggtaagtctaggttaattgaagcaagctcattgaatgattcagttgctatgagacaggcttttggccact

SEQ ID NO: 84885 - DNA, 75 bp, Artificial Sequence
  Synthetic
agcaagctcattgaatgattcagttgctatgagacaggcttttggccacttgtatgccaagtttcatcagaatcc

SEQ ID NO: 84886 - DNA, 75 bp, Artificial Sequence
  Synthetic
agaactctttgcttttgattacacaggctatgatgcctcactttccccagcttggttcgaagccttgaaaatggt

SEQ ID NO: 84887 - DNA, 75 bp, Artificial Sequence
  Synthetic
caaattatactgtgttaaaggtggaatgccctcagggtgctccggcacctcaatttttaattctatgattaataa

SEQ ID NO: 84888 - DNA, 75 bp, Artificial Sequence
  Synthetic
ttgaagcatccagtctaaatgattcagtagcaatgaggatggcttttggcaatttatatgctgcttttcacaaga

SEQ ID NO: 84889 - DNA, 75 bp, Artificial Sequence
  Synthetic
ggatgatgtcattgcatcttacccacacaaaattgatgctggcctcctagcccaagcaggaaaagactatggatt

SEQ ID NO: 84890 - DNA, 75 bp, Artificial Sequence
  Synthetic
cacaaaattgatgctggcctcctagcccaagcaggaaaagactatggattagtcatgacaccagcagacaagggt

SEQ ID NO: 84891 - DNA, 75 bp, Artificial Sequence
  Synthetic
tcttcgcaggcgctggctcgattctttttagagtaaccctacctcacccgaattggcttgggttatggtgttgta

SEQ ID NO: 84892 - DNA, 75 bp, Artificial Sequence
  Synthetic
tagcgatagagtactgcaattaacactgggaaactccactataaccacacaggaggcggctaattcagtggttgc

SEQ ID NO: 84893 - DNA, 75 bp, Artificial Sequence
  Synthetic
agagctttactgctcccagagtactcaacactgtaccgccgttggctcgactctttttagtaaccctacctcagt

SEQ ID NO: 84894 - DNA, 75 bp, Artificial Sequence
  Synthetic
cggtggattacctctttggaaatggcacgttattggggaatgcttttgtgttcccgcaccagataataaacctac

SEQ ID NO: 84895 - DNA, 75 bp, Artificial Sequence
  Synthetic
tgcttaaaaatttgatcaagatcatctcatccttagttatcatcaccaggaattatgaggacactaccactgtac

SEQ ID NO: 84896 - DNA, 75 bp, Artificial Sequence
  Synthetic
acccaatgtgcccactattagaacagcaaaagtgcagggaccaggctttgattatgcagtggccatggctaagag

SEQ ID NO: 84897 - DNA, 75 bp, Artificial Sequence
  Synthetic
gacgttaacactgaacaaatgtgcttagaagatgcaatgtatggcacagatggtcttgaggctttagatttgagc

SEQ ID NO: 84898 - DNA, 75 bp, Artificial Sequence
  Synthetic
agtaccaccacgaacaagcacttctgtttccccggggcgatgatatagactgtgcccacggtcgaaagtcgtcaa

SEQ ID NO: 84899 - DNA, 75 bp, Artificial Sequence
  Synthetic
tacccatggttaacaccatgggacgctagagttgaacaaggtgtgaagagcatattgagctaccaaagagtcctc

SEQ ID NO: 84900 - DNA, 75 bp, Artificial Sequence
  Synthetic
tacccatggttaacaccatgggacgctagagttgaacaaggtgtgaagagcattttgagctaccaaagagtcctc

SEQ ID NO: 84901 - DNA, 75 bp, Artificial Sequence
  Synthetic
tacccatggttaacaccatgggacgctagagttgaacaaggtgtgaagagcatcttgagctaccaaagagtcctc

SEQ ID NO: 84902 - DNA, 75 bp, Artificial Sequence
  Synthetic
tacccatggttaacaccatgggacgctagagttgaacaaggtgtgaagagcatgttgagctaccaaagagtcctc

SEQ ID NO: 84903 - DNA, 75 bp, Artificial Sequence
  Synthetic
tacccatggttaacaccatgggacgctagagttgaacaaggtgtgaagagcttattgagctaccaaagagtcctc

SEQ ID NO: 84904 - DNA, 75 bp, Artificial Sequence
  Synthetic
tacccatggttaacaccatgggacgctagagttgaacaaggtgtgaagagctttttgagctaccaaagagtcctc

SEQ ID NO: 84905 - DNA, 75 bp, Artificial Sequence
  Synthetic
tacccatggttaacaccatgggacgctagagttgaacaaggtgtgaagagcttcttgagctaccaaagagtcctc

SEQ ID NO: 84906 - DNA, 75 bp, Artificial Sequence
  Synthetic
tacccatggttaacaccatgggacgctagagttgaacaaggtgtgaagagcttgttgagctaccaaagagtcctc

SEQ ID NO: 84907 - DNA, 75 bp, Artificial Sequence
  Synthetic
tacccatggttaacaccatgggacgctagagttgaacaaggtgtgaagagcctattgagctaccaaagagtcctc

SEQ ID NO: 84908 - DNA, 75 bp, Artificial Sequence
  Synthetic
tacccatggttaacaccatgggacgctagagttgaacaaggtgtgaagagccttttgagctaccaaagagtcctc

SEQ ID NO: 84909 - DNA, 75 bp, Artificial Sequence
  Synthetic
tacccatggttaacaccatgggacgctagagttgaacaaggtgtgaagagcctcttgagctaccaaagagtcctc

SEQ ID NO: 84910 - DNA, 75 bp, Artificial Sequence
  Synthetic
tacccatggttaacaccatgggacgctagagttgaacaaggtgtgaagagcctgttgagctaccaaagagtcctc

SEQ ID NO: 84911 - DNA, 75 bp, Artificial Sequence
  Synthetic
tacccatggttaacaccatgggacgctagagttgaacaaggtgtgaagagcgtattgagctaccaaagagtcctc

SEQ ID NO: 84912 - DNA, 75 bp, Artificial Sequence
  Synthetic
tacccatggttaacaccatgggacgctagagttgaacaaggtgtgaagagcgttttgagctaccaaagagtcctc

SEQ ID NO: 84913 - DNA, 75 bp, Artificial Sequence
  Synthetic
tacccatggttaacaccatgggacgctagagttgaacaaggtgtgaagagcgtcttgagctaccaaagagtcctc

SEQ ID NO: 84914 - DNA, 75 bp, Artificial Sequence
  Synthetic
tacccatggttaacaccatgggacgctagagttgaacaaggtgtgaagagcgtgttgagctaccaaagagtcctc

SEQ ID NO: 84915 - DNA, 75 bp, Artificial Sequence
  Synthetic
gggtgtccgtgtttccttttatttttattatggctgcttatggtgacaatctcagattgttatcatatagcgatt

SEQ ID NO: 84916 - DNA, 75 bp, Artificial Sequence
  Synthetic
cagatttaattaaagcagttttgttaattagatctacataccacaatgggtgcacaagtttcatctcaaaaggtg

SEQ ID NO: 84917 - DNA, 75 bp, Artificial Sequence
  Synthetic
aattagatctacataccacaatgggtgcacaagtttcatctcaaaaggtgggagcacacgagaacaccaatgtgg

SEQ ID NO: 84918 - DNA, 75 bp, Artificial Sequence
  Synthetic
aagatttttcacaagacccttccaaatttactgaaccagtaaaggatataatgttgaaatcagcaccagcgctaa

SEQ ID NO: 84919 - DNA, 75 bp, Artificial Sequence
  Synthetic
ggtggattacctctttggaaatggcacgttattggggaacgcctttgtgtttccgcaccagataataaacctacg

SEQ ID NO: 84920 - DNA, 75 bp, Artificial Sequence
  Synthetic
atttactgaaccagtaaaggatataatgttgaaatcagcaccagcgctaaactcaccaaatgttgaggcgtgtgg

SEQ ID NO: 84921 - DNA, 75 bp, Artificial Sequence
  Synthetic
tgcatatggcagatggccctcttatttgaaacctactgaagccaacccagtcgatgcccccactgagccagatgt

SEQ ID NO: 84922 - DNA, 75 bp, Artificial Sequence
  Synthetic
ttgaaacctactgaagccaacccagtcgatgcccccactgagccagatgttagttcaaacaggttttacactttg

SEQ ID NO: 84923 - DNA, 75 bp, Artificial Sequence
  Synthetic
ttcggtcaaaatatgttctaccactacttgggaaggagtgggtacacagtgcacgtgcagtgtaacgcttccaaa

SEQ ID NO: 84924 - DNA, 75 bp, Artificial Sequence
  Synthetic
acttgggaaggagtgggtacacagtgcacgtgcagtgtaacgcttccaaattccaccagggagcattgggggttt

SEQ ID NO: 84925 - DNA, 75 bp, Artificial Sequence
  Synthetic
caggagagacaggtggtacattcacagacaagtataatccatccactgatgccaatgatgggagaacctttgcag

SEQ ID NO: 84926 - DNA, 75 bp, Artificial Sequence
  Synthetic
agacaagtataatccatccactgatgccaatgatgggagaacctttgcagcagtagattacttactaggatgtgg

SEQ ID NO: 84927 - DNA, 75 bp, Artificial Sequence
  Synthetic
tttaccatatgttaattcattagctattgactgcatggcaaaacacaacaactggggactcgtaatactgccact

SEQ ID NO: 84928 - DNA, 75 bp, Artificial Sequence
  Synthetic
attgactgcatggcaaaacacaacaactggggactcgtaatactgccacttgaaccactggcgtttgcaccagaa

SEQ ID NO: 84929 - DNA, 75 bp, Artificial Sequence
  Synthetic
gtgccagcaactcaaggtttaccagtcctagtcactccaggatccagccaatatttgacatctgatgacttccag

SEQ ID NO: 84930 - DNA, 75 bp, Artificial Sequence
  Synthetic
tcctagtcactccaggatccagccaatatttgacatctgatgacttccagtctccatgtgccttaccaaatttcg

SEQ ID NO: 84931 - DNA, 75 bp, Artificial Sequence
  Synthetic
caatgaacagcgtctctgggaaagctaacactatggatatgtacaggattccactaaacaccacaggcacaacag

SEQ ID NO: 84932 - DNA, 75 bp, Artificial Sequence
  Synthetic
taacactatggatatgtacaggattccactaaacaccacaggcacaacagacccaattttctgtttaagtctctc

SEQ ID NO: 84933 - DNA, 75 bp, Artificial Sequence
  Synthetic
cctcaggtttacattcctgttctgtggtagcatgatggcaacaggaaagttgatactcacatactcccctccagg

SEQ ID NO: 84934 - DNA, 75 bp, Artificial Sequence
  Synthetic
ggtagcatgatggcaacaggaaagttgatactcacatactcccctccaggagcagcccctccaaaaagccgaaaa

SEQ ID NO: 84935 - DNA, 75 bp, Artificial Sequence
  Synthetic
tcaaacacagtatatagaaggtgcgtcaaagatgacttcactgagggagggtacataacgtgtttctaccaaaca

SEQ ID NO: 84936 - DNA, 75 bp, Artificial Sequence
  Synthetic
tcaaagatgacttcactgagggagggtacataacgtgtttctaccaaacacgcattgtagtacctgccagtaccc

SEQ ID NO: 84937 - DNA, 75 bp, Artificial Sequence
  Synthetic
acataagtcaaagtgccttgatcgcatcaacacagggcattgatgacgtcattgacaaggtgataaacaatgcat

SEQ ID NO: 84938 - DNA, 75 bp, Artificial Sequence
  Synthetic
atcaacacagggcattgatgacgtcattgacaaggtgataaacaatgcattacagctctcgcaaccaacccggcc

SEQ ID NO: 84939 - DNA, 75 bp, Artificial Sequence
  Synthetic
ggtgactccctctatggtgcagcatctctaaatgacttcggtattttggctgttagagtagtcaatgatcacaac

SEQ ID NO: 84940 - DNA, 75 bp, Artificial Sequence
  Synthetic
cggtgcttcgggacaggctatcccttctgatgtggttgagactaggcatgtggttaattacaagacaagatctga

SEQ ID NO: 84941 - DNA, 75 bp, Artificial Sequence
  Synthetic
tctgatgtggttgagactaggcatgtggttaattacaagacaagatctgagagtacattagaatctttctttggt

SEQ ID NO: 84942 - DNA, 75 bp, Artificial Sequence
  Synthetic
actgtgtggcctataacttatacaaacactgttcaactcagaagaaagttagagttcttcacgtactccaggttt

SEQ ID NO: 84943 - DNA, 75 bp, Artificial Sequence
  Synthetic
acactgttcaactcagaagaaagttagagttcttcacgtactccaggtttgatcttgagatgacgtttgtcataa

SEQ ID NO: 84944 - DNA, 75 bp, Artificial Sequence
  Synthetic
cttagtcacagaatcgagagcccagggcactgacacaattgcaaggtgcagttgcaacgcaggggtgtactactg

SEQ ID NO: 84945 - DNA, 75 bp, Artificial Sequence
  Synthetic
caccacttccaaatgcatgggatgattatacatggcagtcatcatccaacccgtcaatattttacacttacgggt

SEQ ID NO: 84946 - DNA, 75 bp, Artificial Sequence
  Synthetic
ttatacatggcagtcatcatccaacccgtcaatattttacacttacgggtgtgcaccggcacgcatttccattcc

SEQ ID NO: 84947 - DNA, 75 bp, Artificial Sequence
  Synthetic
agactcaggggatgcattctatgggttagtgtccataaatgactttggagccctagctgttagagtggtcaatga

SEQ ID NO: 84948 - DNA, 75 bp, Artificial Sequence
  Synthetic
ttagtgtccataaatgactttggagccctagctgttagagtggtcaatgagtttaatcccgcccgcataactgct

SEQ ID NO: 84949 - DNA, 75 bp, Artificial Sequence
  Synthetic
ggagatggagtggatttgaaacaagaagccattacaccgttgactccagtgaacagcatcacaacctatggattt

SEQ ID NO: 84950 - DNA, 75 bp, Artificial Sequence
  Synthetic
aagccattacaccgttgactccagtgaacagcatcacaacctatggatttggacatcagaatcaagcagtatacg

SEQ ID NO: 84951 - DNA, 75 bp, Artificial Sequence
  Synthetic
agagagacctaatggtagtagaatctaaagctcagggtactgatcaaattgccaggtgctcatgtgtaaatggtg

SEQ ID NO: 84952 - DNA, 75 bp, Artificial Sequence
  Synthetic
taaagctcagggtactgatcaaattgccaggtgctcatgtgtaaatggtgtgtattactgctcctctcgccgcaa

SEQ ID NO: 84953 - DNA, 75 bp, Artificial Sequence
  Synthetic
atctcacatgacaatgggtcatggttttgctgagccaggtgattgtggtggcatcctcagatgccaacacggagt

SEQ ID NO: 84954 - DNA, 75 bp, Artificial Sequence
  Synthetic
tttgctgagccaggtgattgtggtggcatcctcagatgccaacacggagtgatgggtttgatcacagctgggggt

SEQ ID NO: 84955 - DNA, 75 bp, Artificial Sequence
  Synthetic
tatatgaaatctttgggtgcagcatttgggtgtggattcaccagccaaattagtgagaaagttgccgagatttca

SEQ ID NO: 84956 - DNA, 75 bp, Artificial Sequence
  Synthetic
tatatgtaatctttgggtgcagcatttgggtgtggattcaccagccaaattagtgagaaagttgccgagatttca

SEQ ID NO: 84957 - DNA, 75 bp, Artificial Sequence
  Synthetic
tatatgcaatctttgggtgcagcatttgggtgtggattcaccagccaaattagtgagaaagttgccgagatttca

SEQ ID NO: 84958 - DNA, 75 bp, Artificial Sequence
  Synthetic
tatatggaatctttgggtgcagcatttgggtgtggattcaccagccaaattagtgagaaagttgccgagatttca

SEQ ID NO: 84959 - DNA, 75 bp, Artificial Sequence
  Synthetic
ttgggtgtggattcaccagccaaattagtgagaaagttgccgagatttcaacgatggtgagtagtgttattactg

SEQ ID NO: 84960 - DNA, 75 bp, Artificial Sequence
  Synthetic
cagtacttgccactctcgccctgctgggatgtgacgtttccccctggtcctggctcagaaagaaggcatgtgaca

SEQ ID NO: 84961 - DNA, 75 bp, Artificial Sequence
  Synthetic
gggatgtgacgtttccccctggtcctggctcagaaagaaggcatgtgacatcttagagctaccctacgtgtgcaa

SEQ ID NO: 84962 - DNA, 75 bp, Artificial Sequence
  Synthetic
aatttcaaagttcattgattggcttaaaaccaaggtaataccagaggctagagacaaagtagaatatgttactaa

SEQ ID NO: 84963 - DNA, 75 bp, Artificial Sequence
  Synthetic
aaaaccaaggtaataccagaggctagagacaaagtagaatatgttactaaacagaagcagttggggatgcttgaa

SEQ ID NO: 84964 - DNA, 75 bp, Artificial Sequence
  Synthetic
aaaaccaaggtaataccagaggctagagacaaagtagaatatgttactaaacagtagcagttggggatgcttgaa

SEQ ID NO: 84965 - DNA, 75 bp, Artificial Sequence
  Synthetic
aaaaccaaggtaataccagaggctagagacaaagtagaatatgttactaaacagcagcagttggggatgcttgaa

SEQ ID NO: 84966 - DNA, 75 bp, Artificial Sequence
  Synthetic
aaaaccaaggtaataccagaggctagagacaaagtagaatatgttactaaacaggagcagttggggatgcttgaa

SEQ ID NO: 84967 - DNA, 75 bp, Artificial Sequence
  Synthetic
aaaaccaaggtaataccagaggctagagacaaagtagaatatgttactaaactgaagcagttggggatgcttgaa

SEQ ID NO: 84968 - DNA, 75 bp, Artificial Sequence
  Synthetic
aaaaccaaggtaataccagaggctagagacaaagtagaatatgttactaaactgtagcagttggggatgcttgaa

SEQ ID NO: 84969 - DNA, 75 bp, Artificial Sequence
  Synthetic
aaaaccaaggtaataccagaggctagagacaaagtagaatatgttactaaactgcagcagttggggatgcttgaa

SEQ ID NO: 84970 - DNA, 75 bp, Artificial Sequence
  Synthetic
aaaaccaaggtaataccagaggctagagacaaagtagaatatgttactaaactggagcagttggggatgcttgaa

SEQ ID NO: 84971 - DNA, 75 bp, Artificial Sequence
  Synthetic
aaaaccaaggtaataccagaggctagagacaaagtagaatatgttactaaaccgaagcagttggggatgcttgaa

SEQ ID NO: 84972 - DNA, 75 bp, Artificial Sequence
  Synthetic
aaaaccaaggtaataccagaggctagagacaaagtagaatatgttactaaaccgtagcagttggggatgcttgaa

SEQ ID NO: 84973 - DNA, 75 bp, Artificial Sequence
  Synthetic
aaaaccaaggtaataccagaggctagagacaaagtagaatatgttactaaaccgcagcagttggggatgcttgaa

SEQ ID NO: 84974 - DNA, 75 bp, Artificial Sequence
  Synthetic
aaaaccaaggtaataccagaggctagagacaaagtagaatatgttactaaaccggagcagttggggatgcttgaa

SEQ ID NO: 84975 - DNA, 75 bp, Artificial Sequence
  Synthetic
aaaaccaaggtaataccagaggctagagacaaagtagaatatgttactaaacggaagcagttggggatgcttgaa

SEQ ID NO: 84976 - DNA, 75 bp, Artificial Sequence
  Synthetic
aaaaccaaggtaataccagaggctagagacaaagtagaatatgttactaaacggtagcagttggggatgcttgaa

SEQ ID NO: 84977 - DNA, 75 bp, Artificial Sequence
  Synthetic
aaaaccaaggtaataccagaggctagagacaaagtagaatatgttactaaacggcagcagttggggatgcttgaa

SEQ ID NO: 84978 - DNA, 75 bp, Artificial Sequence
  Synthetic
aaaaccaaggtaataccagaggctagagacaaagtagaatatgttactaaacgggagcagttggggatgcttgaa

SEQ ID NO: 84979 - DNA, 75 bp, Artificial Sequence
  Synthetic
ttagcaattcaatcacggcgctttgcacctttatatgctgtagaagcaaagcgcatttccaaattagaaaacact

SEQ ID NO: 84980 - DNA, 75 bp, Artificial Sequence
  Synthetic
cacctttatatgctgtagaagcaaagcgcatttccaaattagaaaacactatcaataactacatacagttcaaga

SEQ ID NO: 84981 - DNA, 75 bp, Artificial Sequence
  Synthetic
tagtaggtcgaactatcgcagagagagagaacacctcagtctactccctcccaccagacccagcacactttgatg

SEQ ID NO: 84982 - DNA, 75 bp, Artificial Sequence
  Synthetic
tagtaggtcgatctatcgcagagagagagaacacctcagtctactccctcccaccagacccagcacactttgatg

SEQ ID NO: 84983 - DNA, 75 bp, Artificial Sequence
  Synthetic
tagtaggtcgacctatcgcagagagagagaacacctcagtctactccctcccaccagacccagcacactttgatg

SEQ ID NO: 84984 - DNA, 75 bp, Artificial Sequence
  Synthetic
tagtaggtcgagctatcgcagagagagagaacacctcagtctactccctcccaccagacccagcacactttgatg

SEQ ID NO: 84985 - DNA, 75 bp, Artificial Sequence
  Synthetic
agagaacacctcagtctactccctcccaccagacccagcacactttgatggatacaaacaacaaggagtagtcat

SEQ ID NO: 84986 - DNA, 75 bp, Artificial Sequence
  Synthetic
aggaggtgagagattactgtgagaagaagggttggataattaacatcaccagccaggttcaaacagaaaggaaca

SEQ ID NO: 84987 - DNA, 75 bp, Artificial Sequence
  Synthetic
cattccgccaatggcgtcactagaggaaaagggaattctttttacttcagattatgttcttgcctcaaccaactc

SEQ ID NO: 84988 - DNA, 75 bp, Artificial Sequence
  Synthetic
gaaaagggaattctttttacttcagattatgttcttgcctcaaccaactctggtagcatagtgccaccaacagtt

SEQ ID NO: 84989 - DNA, 75 bp, Artificial Sequence
  Synthetic
gggaaattaaacatggccactgctacagtattgtgcaaagagtgtccaaaaccagccaactttaaaaagtgttgc

SEQ ID NO: 84990 - DNA, 75 bp, Artificial Sequence
  Synthetic
gggaaattaaacatggccactgctacagtattgtgcaaagagtgtcctaaaccagccaactttaaaaagtgttgc

SEQ ID NO: 84991 - DNA, 75 bp, Artificial Sequence
  Synthetic
gggaaattaaacatggccactgctacagtattgtgcaaagagtgtcccaaaccagccaactttaaaaagtgttgc

SEQ ID NO: 84992 - DNA, 75 bp, Artificial Sequence
  Synthetic
gggaaattaaacatggccactgctacagtattgtgcaaagagtgtccgaaaccagccaactttaaaaagtgttgc

SEQ ID NO: 84993 - DNA, 75 bp, Artificial Sequence
  Synthetic
cagtattgtgcaaagagtgtccaaaaccagccaactttaaaaagtgttgccccctaatttgtggtaaggccattc

SEQ ID NO: 84994 - DNA, 75 bp, Artificial Sequence
  Synthetic
cagtattgtgcaaagagtgtcctaaaccagccaactttaaaaagtgttgccccctaatttgtggtaaggccattc

SEQ ID NO: 84995 - DNA, 75 bp, Artificial Sequence
  Synthetic
cagtattgtgcaaagagtgtcccaaaccagccaactttaaaaagtgttgccccctaatttgtggtaaggccattc

SEQ ID NO: 84996 - DNA, 75 bp, Artificial Sequence
  Synthetic
cagtattgtgcaaagagtgtccgaaaccagccaactttaaaaagtgttgccccctaatttgtggtaaggccattc

SEQ ID NO: 84997 - DNA, 75 bp, Artificial Sequence
  Synthetic
agagagctaacattggaaattgtatggaagcgctattccaaggcccattgcaatacaaagacttgaagatagata

SEQ ID NO: 84998 - DNA, 75 bp, Artificial Sequence
  Synthetic
tgagagctaacattggaaattgtatggaagcgctattccaaggcccattgcaatacaaagacttgaagatagata

SEQ ID NO: 84999 - DNA, 75 bp, Artificial Sequence
  Synthetic
cgagagctaacattggaaattgtatggaagcgctattccaaggcccattgcaatacaaagacttgaagatagata

SEQ ID NO: 85000 - DNA, 75 bp, Artificial Sequence
  Synthetic
ggagagctaacattggaaattgtatggaagcgctattccaaggcccattgcaatacaaagacttgaagatagata

SEQ ID NO: 85001 - DNA, 75 bp, Artificial Sequence
  Synthetic
ggaagcgctattccaaggcccattgcaatacaaagacttgaagatagatataaagaccacaccacccccagaatg

SEQ ID NO: 85002 - DNA, 75 bp, Artificial Sequence
  Synthetic
tgtcaacagcgagattcagttagagcgcaatctaaatagagccatgaccatcttacaagcaataaccacgtttgc

SEQ ID NO: 85003 - DNA, 75 bp, Artificial Sequence
  Synthetic
cgcaatctaaatagagccatgaccatcttacaagcaataaccacgtttgccgcagtcgcaggagttgtgtatgtg

SEQ ID NO: 85004 - DNA, 75 bp, Artificial Sequence
  Synthetic
agaacagctaaagttcagggaccaggatttgattatgccgttgccatggcaaagaggaacatcctcactgcaaca

SEQ ID NO: 85005 - DNA, 75 bp, Artificial Sequence
  Synthetic
gagaccttggtaattgatggaagggagattaaaattctcgacgcacaagccctagtggaccaggctggtaccaat

SEQ ID NO: 85006 - DNA, 75 bp, Artificial Sequence
  Synthetic
tatgccggccagctcatgtcgctagatatcaacacagagcaaatgtgcttggaggatgccatgtatggcactgat

SEQ ID NO: 85007 - DNA, 75 bp, Artificial Sequence
  Synthetic
actgagacaaatgatggagtgttgatcgtgaacactagtaagtaccccaacatgtatattcctgtcggagcagtg

SEQ ID NO: 85008 - DNA, 75 bp, Artificial Sequence
  Synthetic
ggacaatgcggtggcgttgtcacttgcaccggaaaggttataggtattcatgttggcgggaacggttcacacggg

SEQ ID NO: 85009 - DNA, 75 bp, Artificial Sequence
  Synthetic
gcaccggaaaggttataggtattcatgttggcgggaacggttcacacgggtttgctgcagccctaaaacgatcat

SEQ ID NO: 85010 - DNA, 75 bp, Artificial Sequence
  Synthetic
ccactaaaacaaaacttgaacccagtgctttccactacgtgtttgaaggggtaaaagagccagctgtcctgtcca

SEQ ID NO: 85011 - DNA, 75 bp, Artificial Sequence
  Synthetic
tgctttccactacgtgtttgaaggggtaaaagagccagctgtcctgtccaaaaatgatccaagactcaaggtgga

SEQ ID NO: 85012 - DNA, 75 bp, Artificial Sequence
  Synthetic
ggatcactatgcaggccaactaatgtctttggacattaacacagaacaaatgtgcttggaggatgccatgtacgg

SEQ ID NO: 85013 - DNA, 75 bp, Artificial Sequence
  Synthetic
tctttggacattaacacagaacaaatgtgcttggaggatgccatgtacggcactgatgggctggaggcattggac

SEQ ID NO: 85014 - DNA, 75 bp, Artificial Sequence
  Synthetic
gacacaaaagaaatgcaaaggcttttagatacttatggaattaacctacctctagtcacctatgttaaagatgag

SEQ ID NO: 85015 - DNA, 75 bp, Artificial Sequence
  Synthetic
tagatacttatggaattaacctacctctagtcacctatgttaaagatgagcttaggtccaaaactaaagtagagc

SEQ ID NO: 85016 - DNA, 75 bp, Artificial Sequence
  Synthetic
atgcagcattccataaaaatccaggagtggtgacaggatcagctgttgggtgtgatccggatttgttctggagca

SEQ ID NO: 85017 - DNA, 75 bp, Artificial Sequence
  Synthetic
aaataccagtgctaatggaggataagctcttcgcatttgactatacaggttatgatgcatccctcagcccagctt

SEQ ID NO: 85018 - DNA, 75 bp, Artificial Sequence
  Synthetic
aaataccagtgctaatggaggataagctcttcgcatttgactatactggttatgatgcatccctcagcccagctt

SEQ ID NO: 85019 - DNA, 75 bp, Artificial Sequence
  Synthetic
aaataccagtgctaatggaggataagctcttcgcatttgactataccggttatgatgcatccctcagcccagctt

SEQ ID NO: 85020 - DNA, 75 bp, Artificial Sequence
  Synthetic
aaataccagtgctaatggaggataagctcttcgcatttgactatacgggttatgatgcatccctcagcccagctt

SEQ ID NO: 85021 - DNA, 75 bp, Artificial Sequence
  Synthetic
aaataccagtgctaatggaggttaagctcttcgcatttgactatacaggttatgatgcatccctcagcccagctt

SEQ ID NO: 85022 - DNA, 75 bp, Artificial Sequence
  Synthetic
aaataccagtgctaatggaggttaagctcttcgcatttgactatactggttatgatgcatccctcagcccagctt

SEQ ID NO: 85023 - DNA, 75 bp, Artificial Sequence
  Synthetic
aaataccagtgctaatggaggttaagctcttcgcatttgactataccggttatgatgcatccctcagcccagctt

SEQ ID NO: 85024 - DNA, 75 bp, Artificial Sequence
  Synthetic
aaataccagtgctaatggaggttaagctcttcgcatttgactatacgggttatgatgcatccctcagcccagctt

SEQ ID NO: 85025 - DNA, 75 bp, Artificial Sequence
  Synthetic
aaataccagtgctaatggaggctaagctcttcgcatttgactatacaggttatgatgcatccctcagcccagctt

SEQ ID NO: 85026 - DNA, 75 bp, Artificial Sequence
  Synthetic
aaataccagtgctaatggaggctaagctcttcgcatttgactatactggttatgatgcatccctcagcccagctt

SEQ ID NO: 85027 - DNA, 75 bp, Artificial Sequence
  Synthetic
aaataccagtgctaatggaggctaagctcttcgcatttgactataccggttatgatgcatccctcagcccagctt

SEQ ID NO: 85028 - DNA, 75 bp, Artificial Sequence
  Synthetic
aaataccagtgctaatggaggctaagctcttcgcatttgactatacgggttatgatgcatccctcagcccagctt

SEQ ID NO: 85029 - DNA, 75 bp, Artificial Sequence
  Synthetic
aaataccagtgctaatggagggtaagctcttcgcatttgactatacaggttatgatgcatccctcagcccagctt

SEQ ID NO: 85030 - DNA, 75 bp, Artificial Sequence
  Synthetic
aaataccagtgctaatggagggtaagctcttcgcatttgactatactggttatgatgcatccctcagcccagctt

SEQ ID NO: 85031 - DNA, 75 bp, Artificial Sequence
  Synthetic
aaataccagtgctaatggagggtaagctcttcgcatttgactataccggttatgatgcatccctcagcccagctt

SEQ ID NO: 85032 - DNA, 75 bp, Artificial Sequence
  Synthetic
aaataccagtgctaatggagggtaagctcttcgcatttgactatacgggttatgatgcatccctcagcccagctt

SEQ ID NO: 85033 - DNA, 75 bp, Artificial Sequence
  Synthetic
actcacaccacctttacaaaaataaaacttattgtgtcaagggcggcatgccatctggctgctcaggcacttcaa

SEQ ID NO: 85034 - DNA, 75 bp, Artificial Sequence
  Synthetic
atacaacaaatttctagctaaaatcagaagcgtgccaatcggaagagcattattgctccctgagtactccacact

SEQ ID NO: 85035 - DNA, 75 bp, Artificial Sequence
  Synthetic
ggagcataccataaataattacgtacagttcaagagcaagcaccgtattgagccagtatgtttgttagtacatgg

SEQ ID NO: 85036 - DNA, 75 bp, Artificial Sequence
  Synthetic
cagtccccctccggagtgtatcaacgatttgctccaggcagttgattcccaggaagttagagactattgtgagaa

SEQ ID NO: 85037 - DNA, 75 bp, Artificial Sequence
  Synthetic
agccgtcacaactttcgcagcagttgctggggtagtgtatgtgatgtacaagctctttgcaggtcaccagggtgc

SEQ ID NO: 85038 - DNA, 75 bp, Artificial Sequence
  Synthetic
gctggggtagtgtatgtgatgtacaagctctttgcaggtcaccagggtgcttacacaggacttcccaacaaaagg

SEQ ID NO: 85039 - DNA, 75 bp, Artificial Sequence
  Synthetic
aatatccttacagcaaccacttgcaagggggagttcacaatgcttggagttcatgataatgtggctattttacca

SEQ ID NO: 85040 - DNA, 75 bp, Artificial Sequence
  Synthetic
agggggagttcacaatgcttggagttcatgataatgtggctattttaccaacacatgcttcaccaggtgaaacaa

SEQ ID NO: 85041 - DNA, 75 bp, Artificial Sequence
  Synthetic
tcaccattgtgactctcaagaggaacgagaagttcagggacatcagaccacatattccaactcagatcactgaga

SEQ ID NO: 85042 - DNA, 75 bp, Artificial Sequence
  Synthetic
gtccctgtaggtgctgtgactgaacagggatatctcaacctcggtggtcgccaaactgcccgtacattaatgtac

SEQ ID NO: 85043 - DNA, 75 bp, Artificial Sequence
  Synthetic
gcgatgactatcctacaagcagtaactactttcgctgcagtagccggtgtcgtgtacgttatgtacaagctgttc

SEQ ID NO: 85044 - DNA, 75 bp, Artificial Sequence
  Synthetic
gggaacggttcacacgggtttgcagcagccctaaagcgatcatacttcactcagagtcaaggtgaaattcagtgg

SEQ ID NO: 85045 - DNA, 75 bp, Artificial Sequence
  Synthetic
cagccctaaagcgatcatacttcactcagagtcaaggtgaaattcagtggatgaaaccgtccaaagaggtcggtt

SEQ ID NO: 85046 - DNA, 75 bp, Artificial Sequence
  Synthetic
aaccagcagtcttgaccaagaatgaccccaggcttaaagtggattttgaagaagccatcttctcaaagtatgtgg

SEQ ID NO: 85047 - DNA, 75 bp, Artificial Sequence
  Synthetic
ccccaggcttaaagtggattttgaagaagccatcttctcaaagtatgtgggcaataagattactgaggtagatga

SEQ ID NO: 85048 - DNA, 75 bp, Artificial Sequence
  Synthetic
acgccaaagcccttgaagatcaggcaggaactaatcttgaaattaccataattacactaaagaggaacgagaagt

SEQ ID NO: 85049 - DNA, 75 bp, Artificial Sequence
  Synthetic
ggaagatgcaatgtatggcactgatggcttagaagctctagacctcacgaccagcgcagggtatccttatgtggc

SEQ ID NO: 85050 - DNA, 75 bp, Artificial Sequence
  Synthetic
ggcttagaagctctagacctcacgaccagcgcagggtatccttatgtggcccttgggaaaaagaaaagagacatc

SEQ ID NO: 85051 - DNA, 75 bp, Artificial Sequence
  Synthetic
agtaccccaacatgtatgttcccgttggtgctgtgaccgaacaggggtatcttaatctcggtggacgacaaaccg

SEQ ID NO: 85052 - DNA, 75 bp, Artificial Sequence
  Synthetic
acttatgtaaaggatgagttgagatccaaaagcaaagttgaacaggggaaatccaggctcattgaagcttccagc

SEQ ID NO: 85053 - DNA, 75 bp, Artificial Sequence
  Synthetic
ccaaaagcaaagttgaacaggggaaatccaggctcattgaagcttccagccttaatgactctgtggccatgagaa

SEQ ID NO: 85054 - DNA, 75 bp, Artificial Sequence
  Synthetic
ttgaacccagcgcttttcactatgtgtttgaaggggtgaaggaaccagcagtcctcaccaaaaatgatcccaggc

SEQ ID NO: 85055 - DNA, 75 bp, Artificial Sequence
  Synthetic
cagacttattttggagtaagattccagttctcatggaggaaaagttgtttgccttcgactataccggctacgacg

SEQ ID NO: 85056 - DNA, 75 bp, Artificial Sequence
  Synthetic
gtttgaaggggtgaaggaaccagcagtcctcaccaaaaatgatcccaggctcaggacagactttgaagaagcaat

SEQ ID NO: 85057 - DNA, 75 bp, Artificial Sequence
  Synthetic
acatagactacctcaaccattcacaccacttatacaagaacaaaacctattgtgtcaagggcggcatgccatctg

SEQ ID NO: 85058 - DNA, 75 bp, Artificial Sequence
  Synthetic
tcatgaatcaatcagatggaccaaagatcccagaaacacacaggaccatgttcgctccctatgcctattggcttg

SEQ ID NO: 85059 - DNA, 75 bp, Artificial Sequence
  Synthetic
ataccccttcctcatacatccagtaatgccaatgaaggaaattcatgaatcaatcagatggacaaaagatcctcg

SEQ ID NO: 85060 - DNA, 75 bp, Artificial Sequence
  Synthetic
ggacgtcagtacaccggcattgcggtgcccttgtatgcctgttttatattccccccctgtaactctagaagaaaa

SEQ ID NO: 85061 - DNA, 75 bp, Artificial Sequence
  Synthetic
cgtttccagcgtgactacgagcaagcacttctgtttccccggttgcgccctatatgctgtgtgaacggcagaaag

SEQ ID NO: 85062 - DNA, 75 bp, Artificial Sequence
  Synthetic
gaccgtgtcggagcctgcgttggcggcctaccctcgcctcacggtgagggacgctcacttcatgacatggtgcga

SEQ ID NO: 85063 - DNA, 75 bp, Artificial Sequence
  Synthetic
cgcaagtcggtggcggaaccgactactttgggtgtccgtgtttcctttatttccttattgaatgtttatggtgac

SEQ ID NO: 85064 - DNA, 75 bp, Artificial Sequence
  Synthetic
ggagctcaagtatcagcccaacacaacggtactcatcagaattccaacagtgctagtgaagggtccaccattaat

SEQ ID NO: 85065 - DNA, 75 bp, Artificial Sequence
  Synthetic
acagcgccagtaatgcggcgacaaaaatggacttctctcaagacccgtctaagttcacagagccggtgaaggacg

SEQ ID NO: 85066 - DNA, 75 bp, Artificial Sequence
  Synthetic
ttgagagtgtggagtgggaagaggggtcccgtggctggtggtggaagctaccagatgctttaaaagacatgggga

SEQ ID NO: 85067 - DNA, 75 bp, Artificial Sequence
  Synthetic
gttcacgtgcaatgtaacgcctccaagtttcatcagggggccttggtagttgccgccattccagaatttatgatg

SEQ ID NO: 85068 - DNA, 75 bp, Artificial Sequence
  Synthetic
gctagtaactcaagggatagtacaggcgggatcacttacgagaaagcgaaccccggcgagaaaggggggaaattt

SEQ ID NO: 85069 - DNA, 75 bp, Artificial Sequence
  Synthetic
tctacccccaccagattatcaatttgcggacaaacaattgtgcgacgctggtgttgccatatgtcaactcgtctt

SEQ ID NO: 85070 - DNA, 75 bp, Artificial Sequence
  Synthetic
gtgcctcaactaagataccaattacagttaccattgcccccatgtgctgtgaattcaatggactgcgcgccatga

SEQ ID NO: 85071 - DNA, 75 bp, Artificial Sequence
  Synthetic
agttaccattgcccccatgtgctgtgaattcaatggactgcgcgccatgactgccccagtcactcagggtttgcc

SEQ ID NO: 85072 - DNA, 75 bp, Artificial Sequence
  Synthetic
tgacgtctccccacctatacacatacccggtgaagtccgcaatatgatggaaattgccgaggttgatagcattat

SEQ ID NO: 85073 - DNA, 75 bp, Artificial Sequence
  Synthetic
taaggagcagtctatattctctttgagtctcagtccagctgctgaccccagactgtcacgcacactgttgggcga

SEQ ID NO: 85074 - DNA, 75 bp, Artificial Sequence
  Synthetic
agtctcagtccagctgctgaccccagactgtcacgcacactgttgggcgaaatcttaaattactacacacactgg

SEQ ID NO: 85075 - DNA, 75 bp, Artificial Sequence
  Synthetic
caaggaaagatgccatgcttggcacacatttaatatgggacatcggccttcaatccagtgcaacactagtggctc

SEQ ID NO: 85076 - DNA, 75 bp, Artificial Sequence
  Synthetic
accaaactgccatagtggtcccaagtggagcaccaaaggacatgagtatgttagcgtttgtcagtgcctgtaatg

SEQ ID NO: 85077 - DNA, 75 bp, Artificial Sequence
  Synthetic
tggagcaccaaaggacatgagtatgttagcgtttgtcagtgcctgtaatgatttctccgccaggctgctaaagga

SEQ ID NO: 85078 - DNA, 75 bp, Artificial Sequence
  Synthetic
catggtgggtttacaaatagacaccgtgaaaaacacattgccaagcgggccagtacactcgcaacaagtgccagc

SEQ ID NO: 85079 - DNA, 75 bp, Artificial Sequence
  Synthetic
gtgaaaaacacattgccaagcgggccagtacactcgcaacaagtgccagctcttaccgccgttgagacgggcact

SEQ ID NO: 85080 - DNA, 75 bp, Artificial Sequence
  Synthetic
gttgagtccttcctagggagatctgcgtgtgtagccataattggactcaaaaatgacgacccagataccactgct

SEQ ID NO: 85081 - DNA, 75 bp, Artificial Sequence
  Synthetic
cgtgtgtagccataattggactcaaaaatgacgacccagataccactgctgcaaacgagttgttcgccacgtgga

SEQ ID NO: 85082 - DNA, 75 bp, Artificial Sequence
  Synthetic
tcacgtttgtgatcactgaacgattcgctgcgagtggggactgttctgggcgacactatgtgtatcagataatgt

SEQ ID NO: 85083 - DNA, 75 bp, Artificial Sequence
  Synthetic
cgctgcgagtggggactgttctgggcgacactatgtgtatcagataatgtacataccaccaggcgctcccaagcc

SEQ ID NO: 85084 - DNA, 75 bp, Artificial Sequence
  Synthetic
gcgcatatcaatacccttcatgggagtaagtggtgcctactcacatttctacgacgggtttgccattgttcccca

SEQ ID NO: 85085 - DNA, 75 bp, Artificial Sequence
  Synthetic
gtaagtggtgcctactcacatttctacgacgggtttgccattgttccccacacaacatttgatgctagcgcattc

SEQ ID NO: 85086 - DNA, 75 bp, Artificial Sequence
  Synthetic
cccatagatgctaaagtgaggatttatatgaagcccaagcacattcgagcgtggtgcccgagacctcctagagct

SEQ ID NO: 85087 - DNA, 75 bp, Artificial Sequence
  Synthetic
atatgaagcccaagcacattcgagcgtggtgcccgagacctcctagagctgctgagtacaccgggccgtcagtgg

SEQ ID NO: 85088 - DNA, 75 bp, Artificial Sequence
  Synthetic
ctgtctacgtggctggttacaagatttgcaattaccacttagcaacacaggaagacatgagcaatgcagttgctg

SEQ ID NO: 85089 - DNA, 75 bp, Artificial Sequence
  Synthetic
ttgcaattaccacttagcaacacaggaagacatgagcaatgcagttgctgttatgtgggaccgcgacctaatggt

SEQ ID NO: 85090 - DNA, 75 bp, Artificial Sequence
  Synthetic
catgagaaaatactacccaattactgtgaccgggcccacgttccggtacatggaagcaaatgattactaccctgc

SEQ ID NO: 85091 - DNA, 75 bp, Artificial Sequence
  Synthetic
gtgaccgggcccacgttccggtacatggaagcaaatgattactaccctgcaagatatcaatcgcacatgctaata

SEQ ID NO: 85092 - DNA, 75 bp, Artificial Sequence
  Synthetic
gctggcggtgatggtgttgttgcctttgcagatattagagacttgtttgcctatgaagaggaggccatggaacaa

SEQ ID NO: 85093 - DNA, 75 bp, Artificial Sequence
  Synthetic
ttgcagatattagagacttgtttgcctatgaagaggaggccatggaacaaggaataacagattacatcagtggtc

SEQ ID NO: 85094 - DNA, 75 bp, Artificial Sequence
  Synthetic
gtgttattacagaaaaactgcttaagaacttggttaaaatagtgtctgcgctagtaatagtggcaagaaactacg

SEQ ID NO: 85095 - DNA, 75 bp, Artificial Sequence
  Synthetic
gaacttggttaaaatagtgtctgcgctagtaatagtggcaagaaactacgaagactcgataactgtgctggcaac

SEQ ID NO: 85096 - DNA, 75 bp, Artificial Sequence
  Synthetic
atatgtgatgaaacagggtgagtcctggatgaaaaagttttctgatgcgtgcaacgcagccaaggggttggagtg

SEQ ID NO: 85097 - DNA, 75 bp, Artificial Sequence
  Synthetic
atatttgtctaaacttaagcacctggacacattagaaaaccaagttgccacactacaccaatcatgtccgagtca

SEQ ID NO: 85098 - DNA, 75 bp, Artificial Sequence
  Synthetic
gacacattagaaaaccaagttgccacactacaccaatcatgtccgagtcaggaagaccaggaagtaatattcaat

SEQ ID NO: 85099 - DNA, 75 bp, Artificial Sequence
  Synthetic
gtaccaccatgaacaagcacttctgtttccccggtgaggctacataaactgtacccacggttgaaagtggctaat

SEQ ID NO: 85100 - DNA, 75 bp, Artificial Sequence
  Synthetic
atggaagctaccattaacaattacatacaattcaagaccaaacaccgcattgaacctgtatgtttgttgatacat

SEQ ID NO: 85101 - DNA, 75 bp, Artificial Sequence
  Synthetic
tacaattcaagaccaaacaccgcattgaacctgtatgtttgttgatacatggtacaccgggtaccggcaagtcta

SEQ ID NO: 85102 - DNA, 75 bp, Artificial Sequence
  Synthetic
cacactttgatggttataaacaacagggtgtagtgattatggatgatcttaatcaaaacccagacggggaggata

SEQ ID NO: 85103 - DNA, 75 bp, Artificial Sequence
  Synthetic
gggtgtagtgattatggatgatcttaatcaaaacccagacggggaggatatgaagctgttttgtcagatggtatc

SEQ ID NO: 85104 - DNA, 75 bp, Artificial Sequence
  Synthetic
gtgtccgtgtttccttttatttttatcatggctgcttatggtgacaatctaagattgttatcatatagcttttgg

SEQ ID NO: 85105 - DNA, 75 bp, Artificial Sequence
  Synthetic
ttccaccaactcatatactatatcaccaccaacagtgtctgcctcggacgcgctggctcgtcgctttgcgtttga

SEQ ID NO: 85106 - DNA, 75 bp, Artificial Sequence
  Synthetic
tcctatttgttcataatgggagctcaagtttctactcagaaatctgggtctcatgaaaaccagaatattgctgcc

SEQ ID NO: 85107 - DNA, 75 bp, Artificial Sequence
  Synthetic
aagtttctactcagaaatctgggtctcatgaaaaccagaatattgctgccagcggttccaccatcaattatacta

SEQ ID NO: 85108 - DNA, 75 bp, Artificial Sequence
  Synthetic
cgattgccacaaaccatcaaatttctccagttgttgcccactcgtttgcggcaaagccattcagtttgtagataa

SEQ ID NO: 85109 - DNA, 75 bp, Artificial Sequence
  Synthetic
tccagttgttgcccactcgtttgcggcaaagccattcagtttgtagataaagcaactcgcaccagatacacagta

SEQ ID NO: 85110 - DNA, 75 bp, Artificial Sequence
  Synthetic
ccgaaccagtaaaggacatcatggtaaaaactgctccagcgctgaactctcccaacatcgaggcatgtggctata

SEQ ID NO: 85111 - DNA, 75 bp, Artificial Sequence
  Synthetic
aaaaactgctccagcgctgaactctcccaacatcgaggcatgtggctatagtgatagggtgctacaattaacatt

SEQ ID NO: 85112 - DNA, 75 bp, Artificial Sequence
  Synthetic
caaggcccactagagtttaaagaacccaaaattgacataaagacagccccaccaccacctgcaatagctgaccta

SEQ ID NO: 85113 - DNA, 75 bp, Artificial Sequence
  Synthetic
tgacaaagaagccaacccagtagacgcacctactgagcctgacgcctctgctaacagattctacacactagaaag

SEQ ID NO: 85114 - DNA, 75 bp, Artificial Sequence
  Synthetic
gcacctactgagcctgacgcctctgctaacagattctacacactagaaagtatcacatgggaaaagtcatcgcgt

SEQ ID NO: 85115 - DNA, 75 bp, Artificial Sequence
  Synthetic
gtcgggccatgacaattgtccaagccgtttcgtcctttgtggttgtttctggcatgctatacgtcatctacaagt

SEQ ID NO: 85116 - DNA, 75 bp, Artificial Sequence
  Synthetic
cgtttcgtcctttgtggttgtttctggcatgctatacgtcatctacaagttgtttgctaattttcagggagcata

SEQ ID NO: 85117 - DNA, 75 bp, Artificial Sequence
  Synthetic
ggtagagctgggtacaccgtgcatgttcagtgcaacgcttccaaatttcaccagggtgctttaatcgtggcagcc

SEQ ID NO: 85118 - DNA, 75 bp, Artificial Sequence
  Synthetic
ttcagtgcaacgcttccaaatttcaccagggtgctttaatcgtggcagccattcctgagtttatgatgggcagta

SEQ ID NO: 85119 - DNA, 75 bp, Artificial Sequence
  Synthetic
cgcggtcgctatggcaaagcgcaatatactgactgcagtgacggagaggggtgaattcaccatgcttggtattca

SEQ ID NO: 85120 - DNA, 75 bp, Artificial Sequence
  Synthetic
atactgactgcagtgacggagaggggtgaattcaccatgcttggtattcacgacagagtggctgttttgcctacc

SEQ ID NO: 85121 - DNA, 75 bp, Artificial Sequence
  Synthetic
aattcataccatccagcgacacagaagccaaaaacaaatttgcaccatgggattggttgcttggttgtggtgtga

SEQ ID NO: 85122 - DNA, 75 bp, Artificial Sequence
  Synthetic
agccaaaaacaaatttgcaccatgggattggttgcttggttgtggtgtgatggcgggtaatatcactgtctatcc

SEQ ID NO: 85123 - DNA, 75 bp, Artificial Sequence
  Synthetic
tcaaatgatgtaaacttagaaataaccatagttgaactagataggaatgaaaagtttagagacatcagggcacac

SEQ ID NO: 85124 - DNA, 75 bp, Artificial Sequence
  Synthetic
ccatagttgaactagataggaatgaaaagtttagagacatcagggcacacataccaacaactatatgtgagacca

SEQ ID NO: 85125 - DNA, 75 bp, Artificial Sequence
  Synthetic
ttgtatggcaaaacataacaattggggtctggttatcatgccctttgtgcaacttgatgctgtcaaagatgccac

SEQ ID NO: 85126 - DNA, 75 bp, Artificial Sequence
  Synthetic
ggtctggttatcatgccctttgtgcaacttgatgctgtcaaagatgccacgcagagtgtacccatcactgtcacc

SEQ ID NO: 85127 - DNA, 75 bp, Artificial Sequence
  Synthetic
ggatgctaaacttgggaggcaggcccaccaatcgaactttgatgtacaactttcccactaaagcaggccagtgtg

SEQ ID NO: 85128 - DNA, 75 bp, Artificial Sequence
  Synthetic
caccaatcgaactttgatgtacaactttcccactaaagcaggccagtgtggtggtgtggtgatgtccacaggtaa

SEQ ID NO: 85129 - DNA, 75 bp, Artificial Sequence
  Synthetic
tccaccccagggtcaaaccagttcttgacttcagacgatttccaatcgccatgtgcgctaccaaactttgatgta

SEQ ID NO: 85130 - DNA, 75 bp, Artificial Sequence
  Synthetic
tgacttcagacgatttccaatcgccatgtgcgctaccaaactttgatgtaactccggctatacacataccaggtg

SEQ ID NO: 85131 - DNA, 75 bp, Artificial Sequence
  Synthetic
tgagcagggtgaaatacagtggatgagacccagcaaggatgctggttatccagtcattaacgcccctagtaaaac

SEQ ID NO: 85132 - DNA, 75 bp, Artificial Sequence
  Synthetic
agacccagcaaggatgctggttatccagtcattaacgcccctagtaaaaccaaactgcagcctagcgtgtttcac

SEQ ID NO: 85133 - DNA, 75 bp, Artificial Sequence
  Synthetic
aaatggaggcgtacccaataccgttacaggcttcaaaaccaaatgcctcagagtccattttctccatctcactta

SEQ ID NO: 85134 - DNA, 75 bp, Artificial Sequence
  Synthetic
acaggcttcaaaaccaaatgcctcagagtccattttctccatctcacttagcccagcagctgatgaaagattggc

SEQ ID NO: 85135 - DNA, 75 bp, Artificial Sequence
  Synthetic
gccattttctccaagtatgtaggcaatgccattactgaagtggacgagtacatgagggaggctgtagatcactac

SEQ ID NO: 85136 - DNA, 75 bp, Artificial Sequence
  Synthetic
atgccattactgaagtggacgagtacatgagggaggctgtagatcactacgctggacagcttatgatactggata

SEQ ID NO: 85137 - DNA, 75 bp, Artificial Sequence
  Synthetic
tggtagtatgatggctactgggaaaattttgatcagttacagcccacctggtgctaaacccccaacaactaggaa

SEQ ID NO: 85138 - DNA, 75 bp, Artificial Sequence
  Synthetic
attttgatcagttacagcccacctggtgctaaacccccaacaactaggaaagaggctatgttaggcactcatgtc

SEQ ID NO: 85139 - DNA, 75 bp, Artificial Sequence
  Synthetic
gtgctggctacccgtacgtgaccatggggaaaagaaagagagagatcttgaacaaagaaacacgtgacaccaagg

SEQ ID NO: 85140 - DNA, 75 bp, Artificial Sequence
  Synthetic
ggggaaaagaaagagagagatcttgaacaaagaaacacgtgacaccaaggagatgcagcgcttgctggacaagta

SEQ ID NO: 85141 - DNA, 75 bp, Artificial Sequence
  Synthetic
gtgagagatgatttcaccgaaggaggttacatttgtgcattttatcaaacagcaatcatagtaccaccaagcacc

SEQ ID NO: 85142 - DNA, 75 bp, Artificial Sequence
  Synthetic
gttacatttgtgcattttatcaaacagcaatcatagtaccaccaagcacccccacagcaatgtacatgttagcgt

SEQ ID NO: 85143 - DNA, 75 bp, Artificial Sequence
  Synthetic
tagattgatagaggccagctcactaaatgattcagttgccatgcggcaagcctttggccacttatatgccaagtt

SEQ ID NO: 85144 - DNA, 75 bp, Artificial Sequence
  Synthetic
aatgattcagttgccatgcggcaagcctttggccacttatatgccaagttccatcaaaaccccggcatagtaacc

SEQ ID NO: 85145 - DNA, 75 bp, Artificial Sequence
  Synthetic
acacacaagggattgaggatacaatcgaaaaagtggttggtgatgctctaagggtctcaatgccacaagttgcca

SEQ ID NO: 85146 - DNA, 75 bp, Artificial Sequence
  Synthetic
cgaaaaagtggttggtgatgctctaagggtctcaatgccacaagttgccaacacccagccatcaggacccgtaaa

SEQ ID NO: 85147 - DNA, 75 bp, Artificial Sequence
  Synthetic
tttgactacactggttatgatgcctctctctcgccagcctggtttgaagccctcaaaatggtgctagagaatcta

SEQ ID NO: 85148 - DNA, 75 bp, Artificial Sequence
  Synthetic
aaccaggcatgttattaacaatagactaagatctgagtgcactgtggaggccttctttggaaggtctgcatgtgt

SEQ ID NO: 85149 - DNA, 75 bp, Artificial Sequence
  Synthetic
ctaagatctgagtgcactgtggaggccttctttggaaggtctgcatgtgttgccatccttggtgtggtaaacaaa

SEQ ID NO: 85150 - DNA, 75 bp, Artificial Sequence
  Synthetic
gtcaaaggagggatgccatccgggtgttccggcacatccattttcaacacaatgatcaacaacataattattaga

SEQ ID NO: 85151 - DNA, 75 bp, Artificial Sequence
  Synthetic
aggaaactcgaactcttcacgtattctagatttgatttggaattaacgtttgtcattacagaaagatacttttca

SEQ ID NO: 85152 - DNA, 75 bp, Artificial Sequence
  Synthetic
ctagatttgatttggaattaacgtttgtcattacagaaagatacttttcagggacagcagccacaaccagagatt

SEQ ID NO: 85153 - DNA, 75 bp, Artificial Sequence
  Synthetic
gccagttacccacaccaaatagacgcaggcctcctagctcagacaggaaaagattatggcctgctaatgacaccg

SEQ ID NO: 85154 - DNA, 75 bp, Artificial Sequence
  Synthetic
ctaccaacccctctgtcttctacaccacaggcaatgccagcccacgcatgtctataccctttgttggtattggtg

SEQ ID NO: 85155 - DNA, 75 bp, Artificial Sequence
  Synthetic
cacaggcaatgccagcccacgcatgtctataccctttgttggtattggtgccgcctatgctcacttttatgacgg

SEQ ID NO: 85156 - DNA, 75 bp, Artificial Sequence
  Synthetic
ccgaagaatacacaagatcacgtgcgatctctatgtctactggcttggcataatggagctgtggaatataacaaa

SEQ ID NO: 85157 - DNA, 75 bp, Artificial Sequence
  Synthetic
tggtacattggcagttagaattgttaatgagtttgatccagtgacaatagaggctaaagtcagagtgtacatgaa

SEQ ID NO: 85158 - DNA, 75 bp, Artificial Sequence
  Synthetic
aatgagtttgatccagtgacaatagaggctaaagtcagagtgtacatgaaacccaaacatgtcagggtgtggtgt

SEQ ID NO: 85159 - DNA, 75 bp, Artificial Sequence
  Synthetic
gtagccacaattaggacgtatgggtttggacatcaaaacaaagcagtctatacagctggatacaaaatttgtaac

SEQ ID NO: 85160 - DNA, 75 bp, Artificial Sequence
  Synthetic
ttggacatcaaaacaaagcagtctatacagctggatacaaaatttgtaactaccacttagccaccccagaagaca

SEQ ID NO: 85161 - DNA, 75 bp, Artificial Sequence
  Synthetic
ttgccaggtgttcatgcaaagcaggagtctattactgtgagtccagaagaaagtattatcccatatcagtgtgtg

SEQ ID NO: 85162 - DNA, 75 bp, Artificial Sequence
  Synthetic
agtctattactgtgagtccagaagaaagtattatcccatatcagtgtgtggaccaacattccaatacatggaggc

SEQ ID NO: 85163 - DNA, 75 bp, Artificial Sequence
  Synthetic
tggaatcctcagatgccaacatggagtaatgggtattatcactgctggtggtgaaggtgttgtggcatttgcaga

SEQ ID NO: 85164 - DNA, 75 bp, Artificial Sequence
  Synthetic
gtaatgggtattatcactgctggtggtgaaggtgttgtggcatttgcagatattagagatctatacatgtatgag

SEQ ID NO: 85165 - DNA, 75 bp, Artificial Sequence
  Synthetic
gaagtggcaaacaaaatttcagagatacagagtacagttcaaagtgttcttacagaaaaactcctcaagaacctt

SEQ ID NO: 85166 - DNA, 75 bp, Artificial Sequence
  Synthetic
tacagagtacagttcaaagtgttcttacagaaaaactcctcaagaaccttataaagattgtttcagctcttgtca

SEQ ID NO: 85167 - DNA, 75 bp, Artificial Sequence
  Synthetic
ggcaatggcttaaggaaaaactctgcaacatgattggtatcccctatgtcatgagacagggtgattcttggctaa

SEQ ID NO: 85168 - DNA, 75 bp, Artificial Sequence
  Synthetic
caacatgattggtatcccctatgtcatgagacagggtgattcttggctaaagaaatttacagaagcttgtaatgc

SEQ ID NO: 85169 - DNA, 75 bp, Artificial Sequence
  Synthetic
ggcaaaagacaagttagagtacctctctaaactaaaacagcttgaaatgatagaaaaccagatggctacactaca

SEQ ID NO: 85170 - DNA, 75 bp, Artificial Sequence
  Synthetic
tctaaactaaaacagcttgaaatgatagaaaaccagatggctacactacatcaatcatgtcccagccaggaagaa

SEQ ID NO: 85171 - DNA, 75 bp, Artificial Sequence
  Synthetic
gcccgcagaattttcaaactggaaacctccatcaataattatgtacagttcaagaccaaacaccgcattgaacca

SEQ ID NO: 85172 - DNA, 75 bp, Artificial Sequence
  Synthetic
cctccatcaataattatgtacagttcaagaccaaacaccgcattgaaccagtatgtcttttgattcatggaacac

SEQ ID NO: 85173 - DNA, 75 bp, Artificial Sequence
  Synthetic
ccctgccaccagatccttcacactttgatggttataaacaacaaggtgttgtaatcatggatgatctgaatcaaa

SEQ ID NO: 85174 - DNA, 75 bp, Artificial Sequence
  Synthetic
tgatggttataaacaacaaggtgttgtaatcatggatgatctgaatcaaaacccagatggtgaggacatgaaatt

SEQ ID NO: 85175 - DNA, 75 bp, Artificial Sequence
  Synthetic
ctcagactatgtattagcttccaccaactccaacataatcacaccacctacagtgtcagcgtctgatgcgctatc

SEQ ID NO: 85176 - DNA, 75 bp, Artificial Sequence
  Synthetic
aactccaacataatcacaccacctacagtgtcagcgtctgatgcgctatccagaaggtttgcttttgatatggac

SEQ ID NO: 85177 - DNA, 75 bp, Artificial Sequence
  Synthetic
cataagccagcaaacttctcaacttgttgccctttggtgtgcggaaaggccattcaactgatggacaaaaacacc

SEQ ID NO: 85178 - DNA, 75 bp, Artificial Sequence
  Synthetic
gttgccctttggtgtgcggaaaggccattcaactgatggacaaaaacaccagaatgagatattcgctagaccaga

SEQ ID NO: 85179 - DNA, 75 bp, Artificial Sequence
  Synthetic
caattgaatttaaagatctcaaaatagatgtagtttccacaccaccaccctcggcaatttcagatctactcaaat

SEQ ID NO: 85180 - DNA, 75 bp, Artificial Sequence
  Synthetic
agatgtagtttccacaccaccaccctcggcaatttcagatctactcaaatcagtggacaaccaagaagtcagaga

SEQ ID NO: 85181 - DNA, 75 bp, Artificial Sequence
  Synthetic
caccagcattctgcaatctctatctacttttgcagtggtggcagggatggtttatgtggtgtacaaactttttgc

SEQ ID NO: 85182 - DNA, 75 bp, Artificial Sequence
  Synthetic
acttttgcagtggtggcagggatggtttatgtggtgtacaaactttttgcagggtttcaaggtgcgtacacaggc

SEQ ID NO: 85183 - DNA, 75 bp, Artificial Sequence
  Synthetic
gcaatggcaaagaaaaacattcttacagccaccacagaaaagggtgagtttacaatgttgggtgtgtatgacaga

SEQ ID NO: 85184 - DNA, 75 bp, Artificial Sequence
  Synthetic
cagccaccacagaaaagggtgagtttacaatgttgggtgtgtatgacagagtagcagtgctccctacccactcaa

SEQ ID NO: 85185 - DNA, 75 bp, Artificial Sequence
  Synthetic
aagtcaatcttgagattactatagtaaccctagacagaaatgagaaatttagagatattagaactcacttaccga

SEQ ID NO: 85186 - DNA, 75 bp, Artificial Sequence
  Synthetic
aaccctagacagaaatgagaaatttagagatattagaactcacttaccgactcagattcatgagaccaatgatgc

SEQ ID NO: 85187 - DNA, 75 bp, Artificial Sequence
  Synthetic
aaatcttggcggtaggcccacaaacaggaccctaatgtataattttccaactaaggcagggcagtgtggtggtgt

SEQ ID NO: 85188 - DNA, 75 bp, Artificial Sequence
  Synthetic
aggaccctaatgtataattttccaactaaggcagggcagtgtggtggtgttttaatggctactggcaaagtgatt

SEQ ID NO: 85189 - DNA, 75 bp, Artificial Sequence
  Synthetic
cgacggtttttccaaagtaccactgaaggaccagtcggcagcactaggtgactccctctatggtgcagcatctct

SEQ ID NO: 85190 - DNA, 75 bp, Artificial Sequence
  Synthetic
ggagaaattcagtggatgaggccaagcaaagatgcaggttatcctatgatcaatgcaccatcaaaaacaaagtta

SEQ ID NO: 85191 - DNA, 75 bp, Artificial Sequence
  Synthetic
gcaaagatgcaggttatcctatgatcaatgcaccatcaaaaacaaagttagagcccagtgtcttctttgatatct

SEQ ID NO: 85192 - DNA, 75 bp, Artificial Sequence
  Synthetic
agagtagtcaatgatcacaacccaaccaaggtcacctccaaaatcagagtgtatctaaaacccaaacacatcaga

SEQ ID NO: 85193 - DNA, 75 bp, Artificial Sequence
  Synthetic
tttccaagtatattggaaacaaaatcactgaagtagatgagtacatgaaggaggcagttgaccactatgctggtc

SEQ ID NO: 85194 - DNA, 75 bp, Artificial Sequence
  Synthetic
cactgaagtagatgagtacatgaaggaggcagttgaccactatgctggtcagttaatgtctcttgatattcccac

SEQ ID NO: 85195 - DNA, 75 bp, Artificial Sequence
  Synthetic
ttatccttatgtagctatagggaaaaagaaaagggatattctcaataaacaaacaagagacaccaaagaaatgca

SEQ ID NO: 85196 - DNA, 75 bp, Artificial Sequence
  Synthetic
aagaaaagggatattctcaataaacaaacaagagacaccaaagaaatgcagaaaatgctagacaaatatgggata

SEQ ID NO: 85197 - DNA, 75 bp, Artificial Sequence
  Synthetic
attgaagcaagttccctaaatgattcagtcgccatgaggcaggcttttggtcacttgtatgctaagttccaccaa

SEQ ID NO: 85198 - DNA, 75 bp, Artificial Sequence
  Synthetic
cagtcgccatgaggcaggcttttggtcacttgtatgctaagttccaccaaaacccaggaataataacaggttcag

SEQ ID NO: 85199 - DNA, 75 bp, Artificial Sequence
  Synthetic
caccacggggtgatagggatcattactgctggtggagaagggttggttgcatttgcagacattagagacttgtat

SEQ ID NO: 85200 - DNA, 75 bp, Artificial Sequence
  Synthetic
acacaggctatgatgcttcactctccccagcctggtttgaggccttgaaaatggtgcttgagaaaattggatttg

SEQ ID NO: 85201 - DNA, 75 bp, Artificial Sequence
  Synthetic
gcggcatgccctcagggtgttccggtacttcaatttttaattcaatgattaataatttaataatcagaacactaa

SEQ ID NO: 85202 - DNA, 75 bp, Artificial Sequence
  Synthetic
tgaagacaccacaacagtgctcgctaccctggcccttcttgggtgtgatgtttcaccatggcagtggcttagaaa

SEQ ID NO: 85203 - DNA, 75 bp, Artificial Sequence
  Synthetic
tgggtgtcaaacaaaatctcaaagtttattgattggctcaaggagaaaattatcccacaagctagagataagttg

SEQ ID NO: 85204 - DNA, 75 bp, Artificial Sequence
  Synthetic
ttgaccagatcactacaatgattatcaatgagagaaacagaagatccaacattggtaattgtatggaggctttgt

SEQ ID NO: 85205 - DNA, 75 bp, Artificial Sequence
  Synthetic
caaaattactgaagtggatgagtatatgaaagaggcagtagaccactatgctggccagctcatgtcactagacat

SEQ ID NO: 85206 - DNA, 75 bp, Artificial Sequence
  Synthetic
tgctggctacccttatgtagcattgggaaagaagaagagagatatcttgaacaaacaaaccagagacactaagga

SEQ ID NO: 85207 - DNA, 75 bp, Artificial Sequence
  Synthetic
caggtgttgattataaagatgggctcaccccactaccagaaaagggattaacgacctatgggtttgggcatcaaa

SEQ ID NO: 85208 - DNA, 75 bp, Artificial Sequence
  Synthetic
tgaatgtcatgtggaacagggatctattggtgtcggagtcaaaagctcagggcactgattcaattgctaggtgta

SEQ ID NO: 85209 - DNA, 75 bp, Artificial Sequence
  Synthetic
attggtgtcggagtcaaaagctcagggcactgattcaattgctaggtgtaattgcaatgcaggggtgtactattg

SEQ ID NO: 85210 - DNA, 75 bp, Artificial Sequence
  Synthetic
cccagcgcgatatcaatcccatatgctgattggccatggttttgcatcaccaggagactgcggtggtattcttag

SEQ ID NO: 85211 - DNA, 75 bp, Artificial Sequence
  Synthetic
ctgattggccatggttttgcatcaccaggagactgcggtggtattcttagatgtcaacatggagtgatcggaatt

SEQ ID NO: 85212 - DNA, 75 bp, Artificial Sequence
  Synthetic
gagcaaggtatttccaactatattgagtcccttggagctgcgtttggaagcggattcactcaacagattggagac

SEQ ID NO: 85213 - DNA, 75 bp, Artificial Sequence
  Synthetic
agtcccttggagctgcgtttggaagcggattcactcaacagattggagacaagataacagagttgactaacatgg

SEQ ID NO: 85214 - DNA, 75 bp, Artificial Sequence
  Synthetic
actacgaggacaccactacagtgctggcaaccctggcactacttgggtgtgacgtgtctccatggcagtggctca

SEQ ID NO: 85215 - DNA, 75 bp, Artificial Sequence
  Synthetic
ggcaaccctggcactacttgggtgtgacgtgtctccatggcagtggctcaaaaagaaagcttgtgatatattgga

SEQ ID NO: 85216 - DNA, 75 bp, Artificial Sequence
  Synthetic
agagtgggtgtcaaacaaaatctctaaattcattgattggttgaagggaaaaatcatccctcaggccagagacaa

SEQ ID NO: 85217 - DNA, 75 bp, Artificial Sequence
  Synthetic
caattagaaatgttggagaatcagatttcgacaattcatcaatcttgccctagtcaagaacaccaggagattttg

SEQ ID NO: 85218 - DNA, 75 bp, Artificial Sequence
  Synthetic
actacatacagttcaagagcaaacaccgtattgaaccagtatgtttgttagtgcacggtagccctggtacaggaa

SEQ ID NO: 85219 - DNA, 75 bp, Artificial Sequence
  Synthetic
gataaaaacagccccaatgctaaactcgccaaacatagaggcttgcgggtatagcgatagagtactgcaattaac

SEQ ID NO: 85220 - DNA, 75 bp, Artificial Sequence
  Synthetic
acccatcccactttgacgggtacaaacaacaaggggtggtgatcatggatgatctaaaccagaacccggacggtg

SEQ ID NO: 85221 - DNA, 75 bp, Artificial Sequence
  Synthetic
acaacaaggggtggtgatcatggatgatctaaaccagaacccggacggtgcagacatgaagctcttttgccaaat

SEQ ID NO: 85222 - DNA, 75 bp, Artificial Sequence
  Synthetic
tttagcttcaaccaactccagccgaattacgccacccacagttgctcacagcgacgctctagccagacgcttcgc

SEQ ID NO: 85223 - DNA, 75 bp, Artificial Sequence
  Synthetic
attacgccacccacagttgctcacagcgacgctctagccagacgcttcgcattcgacatggacatccaggtcatg

SEQ ID NO: 85224 - DNA, 75 bp, Artificial Sequence
  Synthetic
aactttaaaaaatgctgcccactagtgtgtggaaaagccatacaactaatggacaaatcctccagagttaggtac

SEQ ID NO: 85225 - DNA, 75 bp, Artificial Sequence
  Synthetic
tgtgtggaaaagccatacaactaatggacaaatcctccagagttaggtacagtgttgatcaaatcacaacgatga

SEQ ID NO: 85226 - DNA, 75 bp, Artificial Sequence
  Synthetic
aagacctgaaaatagatatcaaaacttcacccccacccgagtgcatcaatgacctgttacaagcggtggactctc

SEQ ID NO: 85227 - DNA, 75 bp, Artificial Sequence
  Synthetic
ttcacccccacccgagtgcatcaatgacctgttacaagcggtggactctcaggaggtgagagactactgtgagaa

SEQ ID NO: 85228 - DNA, 75 bp, Artificial Sequence
  Synthetic
ggcagtcacaacctttgcggcagttgctggagtggtgtatgttatgtacaagctcttcgcaggacatcaaggggc

SEQ ID NO: 85229 - DNA, 75 bp, Artificial Sequence
  Synthetic
gctggagtggtgtatgttatgtacaagctcttcgcaggacatcaaggggcatacactggattacccactaaaagg

SEQ ID NO: 85230 - DNA, 75 bp, Artificial Sequence
  Synthetic
aacatccttacagcgtccactagcaagggagaattcacaatgctcggagttcatgacaatgtagctatcttgcca

SEQ ID NO: 85231 - DNA, 75 bp, Artificial Sequence
  Synthetic
tagtcatcgatggcagagaggttgaagtgcttgacgccaaagccctagaggaccaagctggaaccaatctggaaa

SEQ ID NO: 85232 - DNA, 75 bp, Artificial Sequence
  Synthetic
cactagtaagtaccccaacatgtatgttcctgtcggtgctgtaactgagcagggatatctcaatcttggtggacg

SEQ ID NO: 85233 - DNA, 75 bp, Artificial Sequence
  Synthetic
gggaacggttcacacgggtttgcagcagccctgaagcggtcatactttactcagagtcaaggtgaaatacagtgg

SEQ ID NO: 85234 - DNA, 75 bp, Artificial Sequence
  Synthetic
caccatgtattcgagggtgttaaggaaccagcggtactcaccaaaaacgaccctagattgaaaacagatttcgaa

SEQ ID NO: 85235 - DNA, 75 bp, Artificial Sequence
  Synthetic
aaccagcggtactcaccaaaaacgaccctagattgaaaacagatttcgaagaggccatcttctccaagtacgtgg

SEQ ID NO: 85236 - DNA, 75 bp, Artificial Sequence
  Synthetic
acatcaatacagaacaaatgtgtttggaagatgcaatgtatggcacagacgggcttgaagccttggacctcagta

SEQ ID NO: 85237 - DNA, 75 bp, Artificial Sequence
  Synthetic
ggaagatgcaatgtatggcacagacgggcttgaagccttggacctcagtaccagtgcagggtacccttatgttgc

SEQ ID NO: 85238 - DNA, 75 bp, Artificial Sequence
  Synthetic
ttatggaattaacctacctctagtcacatatgttaaggatgaactcagatccaaaaccaaagtggagcaaggcaa

SEQ ID NO: 85239 - DNA, 75 bp, Artificial Sequence
  Synthetic
atccagattgattgaagcctcaagtttgaatgactccgtagcaatgaggatggcatttggtaacttgtatgcggc

SEQ ID NO: 85240 - DNA, 75 bp, Artificial Sequence
  Synthetic
ccacctttataagaacaaaacatactgtgtcaagggcggcatgccatctggctgctccggcacctcaatttttaa

SEQ ID NO: 85241 - DNA, 75 bp, Artificial Sequence
  Synthetic
gatcctagaaatacacaggaccatgttcgctccttatgcctattggcctggcataatggagaagaagagtataac

SEQ ID NO: 85242 - DNA, 75 bp, Artificial Sequence
  Synthetic
tctcatccttagttatcatcaccaggaattatgaggacactaccacagtgctagctactttggctctccttggat

SEQ ID NO: 85243 - DNA, 75 bp, Artificial Sequence
  Synthetic
ctatcttgggagggctggctacacagtgcacgtgcagtgcaatgcttcaaagtttcatcaaggagctctaggggt

SEQ ID NO: 85244 - DNA, 75 bp, Artificial Sequence
  Synthetic
tgaggcatgtaacgccgccaaagggttggaatgggtatccaacaaaatttccaagttcatcgactggttgaagga

SEQ ID NO: 85245 - DNA, 75 bp, Artificial Sequence
  Synthetic
gatatcaaccattcatcagtcgtgccccagtcaggagcaccaagaaatcctatttaacaatgttcgttggttatc

SEQ ID NO: 85246 - DNA, 75 bp, Artificial Sequence
  Synthetic
cccagtcaggagcaccaagaaatcctatttaacaatgttcgttggttatccattcaatcaaaaaaatttgcacca

SEQ ID NO: 85247 - DNA, 75 bp, Artificial Sequence
  Synthetic
caccgtattgaaccagtatgtttgttagtgcacggtagcccaggcacggggaagtcagttgccaccaatctgatt

SEQ ID NO: 85248 - DNA, 75 bp, Artificial Sequence
  Synthetic
tagtgcacggtagcccaggcacggggaagtcagttgccaccaatctgattgctagagctattgcagagaaagaga

SEQ ID NO: 85249 - DNA, 75 bp, Artificial Sequence
  Synthetic
acgatcttaaccagaaccccgatggggccgatatgaagctcttctgtcaaatggtgtccacagtagagttcattc

SEQ ID NO: 85250 - DNA, 75 bp, Artificial Sequence
  Synthetic
ggccgatatgaagctcttctgtcaaatggtgtccacagtagagttcattccacccatggcttctctggaggaaaa

SEQ ID NO: 85251 - DNA, 75 bp, Artificial Sequence
  Synthetic
cagtgacgcgctggccagaagatttgcttttgatatggacattcaggtgatgggagagttctctagagatggaaa

SEQ ID NO: 85252 - DNA, 75 bp, Artificial Sequence
  Synthetic
gcttttgatatggacattcaggtgatgggagagttctctagagatggaaaactgaatatggcaatggctactgag

SEQ ID NO: 85253 - DNA, 75 bp, Artificial Sequence
  Synthetic
atggataaatcatcaagggttagatacagcattgaccaaatcaccaccatgatcatcaacgagagaaacagaagg

SEQ ID NO: 85254 - DNA, 75 bp, Artificial Sequence
  Synthetic
acagcattgaccaaatcaccaccatgatcatcaacgagagaaacagaaggtccaacattggcaattgcatggaag

SEQ ID NO: 85255 - DNA, 75 bp, Artificial Sequence
  Synthetic
acgatttactccaagctgttgattcacaagaagtcagggactactgtgagaagaaaggatggattgtcaatatta

SEQ ID NO: 85256 - DNA, 75 bp, Artificial Sequence
  Synthetic
acaagaagtcagggactactgtgagaagaaaggatggattgtcaatattacaagtcaagtccagactgaaagaaa

SEQ ID NO: 85257 - DNA, 75 bp, Artificial Sequence
  Synthetic
taaattgttcgctggtcaccagggagcttacaccggactacctactaaaaaacccaacattcccacaatcagaac

SEQ ID NO: 85258 - DNA, 75 bp, Artificial Sequence
  Synthetic
gcttacaccggactacctactaaaaaacccaacattcccacaatcagaactgcaaaagtacaagggcccggattt

SEQ ID NO: 85259 - DNA, 75 bp, Artificial Sequence
  Synthetic
gtacatgacaatgtggcaatacttccaacccacgcttcaccaggagaaaccatcgtgatcgatggaaaagaagtt

SEQ ID NO: 85260 - DNA, 75 bp, Artificial Sequence
  Synthetic
gaagttctggatgctaaagcactcgaggaccaggcaggaaccaatttggagatcactattgtcactttaaaaaga

SEQ ID NO: 85261 - DNA, 75 bp, Artificial Sequence
  Synthetic
ggcaaagtcatcgggatgcatgttggtgggaacggttcacatgggtttgcagcagccctaaaacgatcatacttc

SEQ ID NO: 85262 - DNA, 75 bp, Artificial Sequence
  Synthetic
agcagccctaaaacgatcatacttcactcaaagtcaaggtgaaatacagtggatgagaccatcaaaagaggtcgg

SEQ ID NO: 85263 - DNA, 75 bp, Artificial Sequence
  Synthetic
ggaacctgcagtgctcactaaaaatgatcccagattgaaaacagaatttgaggaagcaatcttctccaagtatgt

SEQ ID NO: 85264 - DNA, 75 bp, Artificial Sequence
  Synthetic
gatcccagattgaaaacagaatttgaggaagcaatcttctccaagtatgtcggcaacaagatcactgaagtggat

SEQ ID NO: 85265 - DNA, 75 bp, Artificial Sequence
  Synthetic
cttgaggatgctatgtatggtacagacgggttagaagccctagacctcagcaccagcgcaggctacccatatgtt

SEQ ID NO: 85266 - DNA, 75 bp, Artificial Sequence
  Synthetic
acgggttagaagccctagacctcagcaccagcgcaggctacccatatgttgcaatgggaaagaagaagagggata

SEQ ID NO: 85267 - DNA, 75 bp, Artificial Sequence
  Synthetic
taacatatgtgaaggatgaactcagatccaagaccaaagtagaacagggcaaatccaggttaattgaagcctcaa

SEQ ID NO: 85268 - DNA, 75 bp, Artificial Sequence
  Synthetic
atccaagaccaaagtagaacagggcaaatccaggttaattgaagcctcaagcctgaatgactccgtagccatgag

SEQ ID NO: 85269 - DNA, 75 bp, Artificial Sequence
  Synthetic
cccagatttattttggagcaagataccagtgttaatggaggaaaaactttttgcttttgattacacgggttacga

SEQ ID NO: 85270 - DNA, 75 bp, Artificial Sequence
  Synthetic
ccagtgttaatggaggaaaaactttttgcttttgattacacgggttacgatgcatcactcagccccgcctggttt

SEQ ID NO: 85271 - DNA, 75 bp, Artificial Sequence
  Synthetic
ttacattggctgcttatggtgacaatcatagattgttatcataaagcgaattggattggccatccggtgaagatt

SEQ ID NO: 85272 - DNA, 75 bp, Artificial Sequence
  Synthetic
tcatagattgttatcataaagcgaattggattggccatccggtgaagattagatcgattgtttatttgtttgttg

SEQ ID NO: 85273 - DNA, 75 bp, Artificial Sequence
  Synthetic
ggtgcacaagtttcatcacagaaagtaggagcacatgagaacaccaatgtggcgactggtggttccacagtcaat

SEQ ID NO: 85274 - DNA, 75 bp, Artificial Sequence
  Synthetic
taggagcacatgagaacaccaatgtggcgactggtggttccacagtcaattacacaacaatcaattattacaaag

SEQ ID NO: 85275 - DNA, 75 bp, Artificial Sequence
  Synthetic
tgctgataaaatcagctccggcattgaactcaccaaacatagaggcatgtgggtatagtgatagactgatgcaat

SEQ ID NO: 85276 - DNA, 75 bp, Artificial Sequence
  Synthetic
acatccagtaatgccaatgaaagaaatccatgaatccattagatggactaaagatcctaggaacacccaggatca

SEQ ID NO: 85277 - DNA, 75 bp, Artificial Sequence
  Synthetic
gaactcaccaaacatagaggcatgtgggtatagtgatagactgatgcaattgacacttgggaattccaccataac

SEQ ID NO: 85278 - DNA, 75 bp, Artificial Sequence
  Synthetic
atccatgaatccattagatggactaaagatcctaggaacacccaggatcatgttcgctcgttatgcttattggct

SEQ ID NO: 85279 - DNA, 75 bp, Artificial Sequence
  Synthetic
agtggatcaaccaactgaaccggatgtttcagcttgcaggttctacacgctagatacagtggaatggcaaaaaga

SEQ ID NO: 85280 - DNA, 75 bp, Artificial Sequence
  Synthetic
gtttcagcttgcaggttctacacgctagatacagtggaatggcaaaaagagtccaagggatggtggtggaagctg

SEQ ID NO: 85281 - DNA, 75 bp, Artificial Sequence
  Synthetic
gtacatgttcagtgcaacgcttcaaagttccaccaaggcacccttggtgtgtttgccgtgcctgaatattgtctg

SEQ ID NO: 85282 - DNA, 75 bp, Artificial Sequence
  Synthetic
agttccaccaaggcacccttggtgtgtttgccgtgcctgaatattgtctggcaggtgactcaaacagcaagacca

SEQ ID NO: 85283 - DNA, 75 bp, Artificial Sequence
  Synthetic
gagcagtgcccaaacgggagttccaaccagtagattacttgtttggatgtggtgttatggcaggcaacgcattcg

SEQ ID NO: 85284 - DNA, 75 bp, Artificial Sequence
  Synthetic
accagtagattacttgtttggatgtggtgttatggcaggcaacgcattcgtgttcccccaccaaatcataaacct

SEQ ID NO: 85285 - DNA, 75 bp, Artificial Sequence
  Synthetic
caactggggtatagtcatactaccactgtccaggctggattacaaccccgatgcaagcacaaagctacccatcac

SEQ ID NO: 85286 - DNA, 75 bp, Artificial Sequence
  Synthetic
ctgtccaggctggattacaaccccgatgcaagcacaaagctacccatcactgtaacaatagcaccaatgtgttgc

SEQ ID NO: 85287 - DNA, 75 bp, Artificial Sequence
  Synthetic
caatatctcacatcagataacttccaatcaccatgtgcactaccagaatttgatgtaactcaacctatttttata

SEQ ID NO: 85288 - DNA, 75 bp, Artificial Sequence
  Synthetic
aatcaccatgtgcactaccagaatttgatgtaactcaacctatttttataccaggggaagtgagaaatttgatgg

SEQ ID NO: 85289 - DNA, 75 bp, Artificial Sequence
  Synthetic
tcaagttatcagacagtggtgatcgcagtagaccaattctatgcctgtctttgtcaccagcgtcagacccacgac

SEQ ID NO: 85290 - DNA, 75 bp, Artificial Sequence
  Synthetic
cagtagaccaattctatgcctgtctttgtcaccagcgtcagacccacgactctcttataccatgctaggagaaat

SEQ ID NO: 85291 - DNA, 75 bp, Artificial Sequence
  Synthetic
taaattattagtggcatactcaccacctggtgcacaaccaccgcaggataggaaaactgcaatgctgggtactca

SEQ ID NO: 85292 - DNA, 75 bp, Artificial Sequence
  Synthetic
cctggtgcacaaccaccgcaggataggaaaactgcaatgctgggtactcatgtaatatgggacataggcttacag

SEQ ID NO: 85293 - DNA, 75 bp, Artificial Sequence
  Synthetic
ggcggatacattagcatgttttatcaaaccagaatagtagtccctgcatccactccaactagcatggacatctta

SEQ ID NO: 85294 - DNA, 75 bp, Artificial Sequence
  Synthetic
aaaccagaatagtagtccctgcatccactccaactagcatggacatcttatgttttgtgtcagcttgcaacgatt

SEQ ID NO: 85295 - DNA, 75 bp, Artificial Sequence
  Synthetic
agcaagtggctacaaatgcattacaattatcacaacccacccgacccgcacttccgccagcagagcaaagtgtgc

SEQ ID NO: 85296 - DNA, 75 bp, Artificial Sequence
  Synthetic
attatcacaacccacccgacccgcacttccgccagcagagcaaagtgtgccaaacaccaatcaatccaccccaga

SEQ ID NO: 85297 - DNA, 75 bp, Artificial Sequence
  Synthetic
gcagactaggcatgtgattcaaactagatctagaagtgagagcacagtggaatccttctttgcgcggggagcgtg

SEQ ID NO: 85298 - DNA, 75 bp, Artificial Sequence
  Synthetic
agatctagaagtgagagcacagtggaatccttctttgcgcggggagcgtgtgtgacaatcatgggggtagacaat

SEQ ID NO: 85299 - DNA, 75 bp, Artificial Sequence
  Synthetic
cagctgagaaggaaattggaaatgttcacatactccagattcgacattgaattcacatttgtggtaactgaacgt

SEQ ID NO: 85300 - DNA, 75 bp, Artificial Sequence
  Synthetic
tcacatactccagattcgacattgaattcacatttgtggtaactgaacgttactacacccagaatagtgggcacg

SEQ ID NO: 85301 - DNA, 75 bp, Artificial Sequence
  Synthetic
ggcagacctcgtcgaacccatcaatcttttacacttatggtacagcaccacccaggatatccatacctttcgtgg

SEQ ID NO: 85302 - DNA, 75 bp, Artificial Sequence
  Synthetic
cttttacacttatggtacagcaccacccaggatatccatacctttcgtgggcattgcaaacgcttactcccattt

SEQ ID NO: 85303 - DNA, 75 bp, Artificial Sequence
  Synthetic
tatcaatgactttggattgttggcagtgcgtgttgttaatgaacacaacccggtgagagtgtcgtcaaaaattag

SEQ ID NO: 85304 - DNA, 75 bp, Artificial Sequence
  Synthetic
gtgcgtgttgttaatgaacacaacccggtgagagtgtcgtcaaaaattagagtgtacatgaaacctaaacatgtc

SEQ ID NO: 85305 - DNA, 75 bp, Artificial Sequence
  Synthetic
accccacttcctaccaagagcctaacaacctacggttttggacatcaactcaaggcagtgtacgtggctggctat

SEQ ID NO: 85306 - DNA, 75 bp, Artificial Sequence
  Synthetic
caacctacggttttggacatcaactcaaggcagtgtacgtggctggctataagatcattaactaccacttagcaa

SEQ ID NO: 85307 - DNA, 75 bp, Artificial Sequence
  Synthetic
gaactgaccagatagccaggtgctcttgtaagatgggtgtttactactgtgagtccaggaacaaacactatccaa

SEQ ID NO: 85308 - DNA, 75 bp, Artificial Sequence
  Synthetic
ttgtaagatgggtgtttactactgtgagtccaggaacaaacactatccaatatctattacatcacccaccttcca

SEQ ID NO: 85309 - DNA, 75 bp, Artificial Sequence
  Synthetic
tggggactgtggtggtatcttgcgatgccagcacggtgtcatgggcctcataactgcaggtggtaacggactggt

SEQ ID NO: 85310 - DNA, 75 bp, Artificial Sequence
  Synthetic
tgccagcacggtgtcatgggcctcataactgcaggtggtaacggactggtagcgtttgcagacatacgtgatctc

SEQ ID NO: 85311 - DNA, 75 bp, Artificial Sequence
  Synthetic
ttcacaagtcaaattggagagaaagtcaacgagatcacctctatgattaactccgtggtgacggaaaagttgctc

SEQ ID NO: 85312 - DNA, 75 bp, Artificial Sequence
  Synthetic
tcaacgagatcacctctatgattaactccgtggtgacggaaaagttgctcaagcatctaatcaaactggtcagca

SEQ ID NO: 85313 - DNA, 75 bp, Artificial Sequence
  Synthetic
tgtctccgtggtcctggctaaagaaaaaggtgtgtgacatcctagaaattccattcgtgttaaaacagggggact

SEQ ID NO: 85314 - DNA, 75 bp, Artificial Sequence
  Synthetic
aaaggtgtgtgacatcctagaaattccattcgtgttaaaacagggggactcttggatgaaaaagttcacagaggc

SEQ ID NO: 85315 - DNA, 75 bp, Artificial Sequence
  Synthetic
catccctgaggctaaagacaaagtagaatttgtgtctaaactcaaacaactgggaatgttggagaaccagataaa

SEQ ID NO: 85316 - DNA, 75 bp, Artificial Sequence
  Synthetic
gaatttgtgtctaaactcaaacaactgggaatgttggagaaccagataaacacaatacaccaatcatgccccagt

SEQ ID NO: 85317 - DNA, 75 bp, Artificial Sequence
  Synthetic
gcattggaagcaaagaggatcagcaaattagagaataccattaataactacatacagttcaagagcaaacaccgt

SEQ ID NO: 85318 - DNA, 75 bp, Artificial Sequence
  Synthetic
aattagagaataccattaataactacatacagttcaagagcaaacaccgtattgaaccagtatgtgtactaatac

SEQ ID NO: 85319 - DNA, 75 bp, Artificial Sequence
  Synthetic
caacatattcactacccccagacccagcccactttgatggatacaaacaacagggcgtggtaattatggatgatc

SEQ ID NO: 85320 - DNA, 75 bp, Artificial Sequence
  Synthetic
agcccactttgatggatacaaacaacagggcgtggtaattatggatgatctcaaccaaaatcctgatgggctgga

SEQ ID NO: 85321 - DNA, 75 bp, Artificial Sequence
  Synthetic
actgttcacatcagactatgttctggcttcgaccaactcaagcacaatcacaccacccacagtggcacacagtga

SEQ ID NO: 85322 - DNA, 75 bp, Artificial Sequence
  Synthetic
gcttcgaccaactcaagcacaatcacaccacccacagtggcacacagtgacgccctgagtcggagattcgccttt

SEQ ID NO: 85323 - DNA, 75 bp, Artificial Sequence
  Synthetic
aaggaatgtcccccacctgccaacttcaagaaatgctgtccattggtttgtggtaaagcaatccagttaatggat

SEQ ID NO: 85324 - DNA, 75 bp, Artificial Sequence
  Synthetic
tcaagaaatgctgtccattggtttgtggtaaagcaatccagttaatggataagtatacaaggcagagatttagcg

SEQ ID NO: 85325 - DNA, 75 bp, Artificial Sequence
  Synthetic
tccagggacccctgcaatataaggatctaaaaattgacataaaaaccaccccaccaccagagtgcattaacgact

SEQ ID NO: 85326 - DNA, 75 bp, Artificial Sequence
  Synthetic
tctaaaaattgacataaaaaccaccccaccaccagagtgcattaacgacttactccagtcagtggactcacagga

SEQ ID NO: 85327 - DNA, 75 bp, Artificial Sequence
  Synthetic
tcgagccatgatcattttgcaagcgttgaccacctttgcagctgtggctggtgttgtgtacgtgatgtacagatt

SEQ ID NO: 85328 - DNA, 75 bp, Artificial Sequence
  Synthetic
ttgaccacctttgcagctgtggctggtgttgtgtacgtgatgtacagattatttgctggtcaacagggggcttat

SEQ ID NO: 85329 - DNA, 75 bp, Artificial Sequence
  Synthetic
gctgtggcaatggcgaagagaaacgtagtcactgcaaccaccacaaagggagaattcaccatgctgggaatccac

SEQ ID NO: 85330 - DNA, 75 bp, Artificial Sequence
  Synthetic
tagtcactgcaaccaccacaaagggagaattcaccatgctgggaatccacgataatgtagccattttaccaaccc

SEQ ID NO: 85331 - DNA, 75 bp, Artificial Sequence
  Synthetic
aggccgggactaacctagagataacaatagtcactctaaaaagaaatgagaagttcagggatatcagaccacaca

SEQ ID NO: 85332 - DNA, 75 bp, Artificial Sequence
  Synthetic
aatagtcactctaaaaagaaatgagaagttcagggatatcagaccacacatcccaacccaaatcaccgagacaaa

SEQ ID NO: 85333 - DNA, 75 bp, Artificial Sequence
  Synthetic
gtatctcaatcttggtggccgccaaactgctcgcacgttgatgtacaactttccaacaagggcaggccagtgcgg

SEQ ID NO: 85334 - DNA, 75 bp, Artificial Sequence
  Synthetic
actgctcgcacgttgatgtacaactttccaacaagggcaggccagtgcggaggagttatcacttgcactggcaag

SEQ ID NO: 85335 - DNA, 75 bp, Artificial Sequence
  Synthetic
agtcaaggtgaaatacagtggatgaagccatcgaaagaagtgggttatcccatcataaatgccccttcaaaaact

SEQ ID NO: 85336 - DNA, 75 bp, Artificial Sequence
  Synthetic
agccatcgaaagaagtgggttatcccatcataaatgccccttcaaaaactaaattagaacccagtgcttttcact

SEQ ID NO: 85337 - DNA, 75 bp, Artificial Sequence
  Synthetic
gcattctgttcacatccaactatgttttagcctccaccaactccagtcgcatcacaccacctacagtagcccaca

SEQ ID NO: 85338 - DNA, 75 bp, Artificial Sequence
  Synthetic
ccatcttctccaagtacgtggggaacaaaatcactgaagtggatgagtacatgaaggaagcagtggaccattatg

SEQ ID NO: 85339 - DNA, 75 bp, Artificial Sequence
  Synthetic
caaaatcactgaagtggatgagtacatgaaggaagcagtggaccattatgcaggacagctcatgtctttagacat

SEQ ID NO: 85340 - DNA, 75 bp, Artificial Sequence
  Synthetic
tgcaggttatccctatgtagcaatgggaaagaaaaagagagacattttgaacaaacaaaccagagacactaaaga

SEQ ID NO: 85341 - DNA, 75 bp, Artificial Sequence
  Synthetic
ggaaagaaaaagagagacattttgaacaaacaaaccagagacactaaagagatgcaaaggcttttggacacctac

SEQ ID NO: 85342 - DNA, 75 bp, Artificial Sequence
  Synthetic
aggcttattgaggcttcaagtttgaatgactcagtggccatgagaatggcatttggcaatttgtatgccgcattt

SEQ ID NO: 85343 - DNA, 75 bp, Artificial Sequence
  Synthetic
ttaatggaagagaaactttttgcctttgattacacaggctacgacgcctcactcagtcccgcttggtttgaagct

SEQ ID NO: 85344 - DNA, 75 bp, Artificial Sequence
  Synthetic
cccagagtactcaacattgtaccgccgttggcttgactcattttagcaaccctacctcagtcgaattggattggg

SEQ ID NO: 85345 - DNA, 75 bp, Artificial Sequence
  Synthetic
ggtgtccgtgtttcctgttatttttatcatggctgcttatggtgacaatcattgattgttatcataaagcgaatt

SEQ ID NO: 85346 - DNA, 75 bp, Artificial Sequence
  Synthetic
atcatggctgcttatggtgacaatcattgattgttatcataaagcgaattggattggccgtccggaaagtgtttt

SEQ ID NO: 85347 - DNA, 75 bp, Artificial Sequence
  Synthetic
agtaaaacatcaccaacgcaatgggtgctcaagtttcatcacaaaaagttggagcccacgaaaactcaaacagag

SEQ ID NO: 85348 - DNA, 75 bp, Artificial Sequence
  Synthetic
ggagcccacgaaaactcaaacagagcttatggcgggtctactattaattacacaacaatcaactactatagagac

SEQ ID NO: 85349 - DNA, 75 bp, Artificial Sequence
  Synthetic
atcagagacactgaggcaaatcctgtagaccagccaaccgaacccgatgtagctgcatgtagattctacacattg

SEQ ID NO: 85350 - DNA, 75 bp, Artificial Sequence
  Synthetic
tttggtcaaaacatgttttatcactaccttggaagagctggttatacagttcacgtgcagtgcaacgcttcaaag

SEQ ID NO: 85351 - DNA, 75 bp, Artificial Sequence
  Synthetic
accttggaagagctggttatacagttcacgtgcagtgcaacgcttcaaagttccatcaaggagccctaggggtgt

SEQ ID NO: 85352 - DNA, 75 bp, Artificial Sequence
  Synthetic
gtgagaaaggaggcacatttaaaggaagcttcacccttgatgacgccaccagccctgcacgaagcttctgtccag

SEQ ID NO: 85353 - DNA, 75 bp, Artificial Sequence
  Synthetic
aagcttcacccttgatgacgccaccagccctgcacgaagcttctgtccagttgattatctctttgggagtggagt

SEQ ID NO: 85354 - DNA, 75 bp, Artificial Sequence
  Synthetic
ccaaggactcaagggttgccggttttaagcacaccaggaagcaaccagtacctaactgcagacaattaccagtcc

SEQ ID NO: 85355 - DNA, 75 bp, Artificial Sequence
  Synthetic
taagcacaccaggaagcaaccagtacctaactgcagacaattaccagtccccgtgtgcgatccccgaattcgatg

SEQ ID NO: 85356 - DNA, 75 bp, Artificial Sequence
  Synthetic
ggagcaaggaattacaaattacatcgagtcacttggcgcagcattcggtagtggattcacccagcaaatagggga

SEQ ID NO: 85357 - DNA, 75 bp, Artificial Sequence
  Synthetic
tcaacctgacaagtcaacgcagaaacacaatggatatgtacagggttgagttgagtgataccgcacgctccgacg

SEQ ID NO: 85358 - DNA, 75 bp, Artificial Sequence
  Synthetic
cacaatggatatgtacagggttgagttgagtgataccgcacgctccgacgagccgatcttgtgcctctcattgtc

SEQ ID NO: 85359 - DNA, 75 bp, Artificial Sequence
  Synthetic
aattaagtttacttttctcttttgcggttcaatgatggctacagggaagttattggtctcttacgcaccacctgg

SEQ ID NO: 85360 - DNA, 75 bp, Artificial Sequence
  Synthetic
agcggaccctccaaagaatcgcaaagaagcaatgcttggaacacacttgatttgggatattggattgcaatcctc

SEQ ID NO: 85361 - DNA, 75 bp, Artificial Sequence
  Synthetic
aaggtagttgtcccattgtccactcccagaaaaatggacatcttgggttttgtgtcggcctgtaatgatttcagt

SEQ ID NO: 85362 - DNA, 75 bp, Artificial Sequence
  Synthetic
gccattgaagggatcaccaaaaatgcactggctcctttgaactccactaacggagtgcctgatatacagccgagc

SEQ ID NO: 85363 - DNA, 75 bp, Artificial Sequence
  Synthetic
cactggctcctttgaactccactaacggagtgcctgatatacagccgagcggtccagcacactccaaggagatac

SEQ ID NO: 85364 - DNA, 75 bp, Artificial Sequence
  Synthetic
ttcagaggcgcacgcgatcagagtccacagttgaatcattttttgcaagaggggcttgcgtggccatcatagagg

SEQ ID NO: 85365 - DNA, 75 bp, Artificial Sequence
  Synthetic
cacagttgaatcattttttgcaagaggggcttgcgtggccatcatagaggtggacaacgatgcaccgacgcagcg

SEQ ID NO: 85366 - DNA, 75 bp, Artificial Sequence
  Synthetic
tggacaaatcatccagggtcaggtacagcattgaccaaatcaccaccatgatcatcaatgaaagaaacagaagat

SEQ ID NO: 85367 - DNA, 75 bp, Artificial Sequence
  Synthetic
cacatattcaagattcgacatggagttcacctttgtggtcacctcaaattacaccgatgcaaacaatgggcacgc

SEQ ID NO: 85368 - DNA, 75 bp, Artificial Sequence
  Synthetic
cagcattgaccaaatcaccaccatgatcatcaatgaaagaaacagaagatccaacattggcaattgcatggaagc

SEQ ID NO: 85369 - DNA, 75 bp, Artificial Sequence
  Synthetic
ttcacctttgtggtcacctcaaattacaccgatgcaaacaatgggcacgcactgaaccaagtttaccaaattatg

SEQ ID NO: 85370 - DNA, 75 bp, Artificial Sequence
  Synthetic
ttctacacctatggggagtcaactgcaagaatatcagtgccctatgtgggaattgccaacgcatactcccatttc

SEQ ID NO: 85371 - DNA, 75 bp, Artificial Sequence
  Synthetic
caagaatatcagtgccctatgtgggaattgccaacgcatactcccatttctacgatggatttgcgaaagtaccgc

SEQ ID NO: 85372 - DNA, 75 bp, Artificial Sequence
  Synthetic
acccaatgtgcccacaattagaacagcaaaagtgcagggaccaggctttgattatgcagtggccatggctaagag

SEQ ID NO: 85373 - DNA, 75 bp, Artificial Sequence
  Synthetic
tccgtgtggtgaatgaccacaaccccacgcgactcacttccaaagttagggtgtatatgaagcccaaacacgtca

SEQ ID NO: 85374 - DNA, 75 bp, Artificial Sequence
  Synthetic
cacgcgactcacttccaaagttagggtgtatatgaagcccaaacacgtcagggtctggtgcccacgaccaccgcg

SEQ ID NO: 85375 - DNA, 75 bp, Artificial Sequence
  Synthetic
acactagtaagtaccccaacatgtatgtcccagttggtgctgtgaccgaacaaggatatctcaatctcggtggcc

SEQ ID NO: 85376 - DNA, 75 bp, Artificial Sequence
  Synthetic
ttatgggcttggtcaccaaaacaaagctgtgtacaccactgggtacaagatctgcaattaccatcttgccactac

SEQ ID NO: 85377 - DNA, 75 bp, Artificial Sequence
  Synthetic
gctgtgtacaccactgggtacaagatctgcaattaccatcttgccactacagaagatctacagaacgctgtgagt

SEQ ID NO: 85378 - DNA, 75 bp, Artificial Sequence
  Synthetic
ccattatgtgtttgagggtgttaaagaaccagcagttctgaccaaaaacgacccgagactcaaaacagagtttga

SEQ ID NO: 85379 - DNA, 75 bp, Artificial Sequence
  Synthetic
agggcaggagtgtactattgtgagtccaggaggaaatattaccctgtatcgtttgtgggacccaccttccagtac

SEQ ID NO: 85380 - DNA, 75 bp, Artificial Sequence
  Synthetic
ccaggaggaaatattaccctgtatcgtttgtgggacccaccttccagtacatggaggccaatgaatactatccag

SEQ ID NO: 85381 - DNA, 75 bp, Artificial Sequence
  Synthetic
aacatggtgtcatcgggattgtgacggccggtggtgaaggattagtcgcgttctctgacataagggacttgcacg

SEQ ID NO: 85382 - DNA, 75 bp, Artificial Sequence
  Synthetic
ggccggtggtgaaggattagtcgcgttctctgacataagggacttgcacgcttacgaggaggaggctatggagca

SEQ ID NO: 85383 - DNA, 75 bp, Artificial Sequence
  Synthetic
atcagaactaaccagcatggtgaccagcacgattacagagaagttgctaaagaatttgataaagataatctcgtc

SEQ ID NO: 85384 - DNA, 75 bp, Artificial Sequence
  Synthetic
agcacgattacagagaagttgctaaagaatttgataaagataatctcgtctctagtgatcatcactagaaactat

SEQ ID NO: 85385 - DNA, 75 bp, Artificial Sequence
  Synthetic
aaggcatgtgacattctggagattccctatgtcatcaaacaaggtgatagttggctgaagaaattcactgaggcg

SEQ ID NO: 85386 - DNA, 75 bp, Artificial Sequence
  Synthetic
cctatgtcatcaaacaaggtgatagttggctgaagaaattcactgaggcgtgtaacgcagccaagggattggagt

SEQ ID NO: 85387 - DNA, 75 bp, Artificial Sequence
  Synthetic
accatctgtacaaaaacaaaacttactgtgtcaagggtggcatgccatctggttgctcgggcacttcaattttca

SEQ ID NO: 85388 - DNA, 75 bp, Artificial Sequence
  Synthetic
agtttgtgaccaaattgaaacagttagagatgctggagaaccaaatatccaccatccaccagtcgtgtccaagcc

SEQ ID NO: 85389 - DNA, 75 bp, Artificial Sequence
  Synthetic
agagatgctggagaaccaaatatccaccatccaccagtcgtgtccaagccaggaacatcaagagattttgttcaa

SEQ ID NO: 85390 - DNA, 75 bp, Artificial Sequence
  Synthetic
attggaacataccatcaacaattacatacagttcaagagcaaacaccgtattgaaccagtatgtctgctagtgca

SEQ ID NO: 85391 - DNA, 75 bp, Artificial Sequence
  Synthetic
atacagttcaagagcaaacaccgtattgaaccagtatgtctgctagtgcatggaagcccaggaacaggaaaatca

SEQ ID NO: 85392 - DNA, 75 bp, Artificial Sequence
  Synthetic
ttgaaccagtatgtctgctagtgcatggaagcccaggaacaggaaaatcagttgccaccaatctaattgccaggg

SEQ ID NO: 85393 - DNA, 75 bp, Artificial Sequence
  Synthetic
aaggtgtggttatcatggatgacctaaatcagaacccggatggggcagatatgaaactcttttgtcagatggtgt

SEQ ID NO: 85394 - DNA, 75 bp, Artificial Sequence
  Synthetic
aaatcagaacccggatggggcagatatgaaactcttttgtcagatggtgtctactgtggaattcattccacccat

SEQ ID NO: 85395 - DNA, 75 bp, Artificial Sequence
  Synthetic
gccaccaacagtggcacacagtgatgctctggcgaggagattcgccttcgacatggacatccaggtaatgagtga

SEQ ID NO: 85396 - DNA, 75 bp, Artificial Sequence
  Synthetic
tgtacttcgggaagcctagtatcaccttcggatcttcgatgcgttgcgctcagcactcaaccccagagtgtagct

SEQ ID NO: 85397 - DNA, 75 bp, Artificial Sequence
  Synthetic
atggcaatggctacagaattgtgcaaaaaactgtcatcagccagcaaaatttttaaacgatgctgccctctagtg

SEQ ID NO: 85398 - DNA, 75 bp, Artificial Sequence
  Synthetic
atcaatgagagaaacagaaggtccaacatcggcaactgcatggaagccttgttccaaggacctctccagtataaa

SEQ ID NO: 85399 - DNA, 75 bp, Artificial Sequence
  Synthetic
ccgactactttgggtgtccgtgtttccttttattctcattatggctgcttatggtgacaatcctagattgttatc

SEQ ID NO: 85400 - DNA, 75 bp, Artificial Sequence
  Synthetic
aacagggcaatgacaatcctacaagcagtcacaactttcgctgctgtggctggagttgtctatgttatgtacaag

SEQ ID NO: 85401 - DNA, 75 bp, Artificial Sequence
  Synthetic
ttgcacgcactcttggcttggttaggattattgtgtggaaaaggcaccatagttacaatgggtgctcaagtttca

SEQ ID NO: 85402 - DNA, 75 bp, Artificial Sequence
  Synthetic
tattacaaggattcagcaagcaatgccgcatccaagcaagactattcccaggatccctccaaattcaccgaacca

SEQ ID NO: 85403 - DNA, 75 bp, Artificial Sequence
  Synthetic
ctgaaggatgtgttaatcaagacagcaccagccctcaactctccaaatgttgaggcatgtggatacagcgatagg

SEQ ID NO: 85404 - DNA, 75 bp, Artificial Sequence
  Synthetic
gtgatcgatggtaaggaaattgagatcttggacgccaaagcactcgaagaccaggcagggaccaaccttgaaaat

SEQ ID NO: 85405 - DNA, 75 bp, Artificial Sequence
  Synthetic
tggcctgagtttatccgagatgacgaagcaaatccagtggaccaaccaacagagccggatgtagcaacttgtagg

SEQ ID NO: 85406 - DNA, 75 bp, Artificial Sequence
  Synthetic
gtggaaactaccagatgctctcagagacatggggctgtttggacaaaatatgtattaccactacttagggaggtc

SEQ ID NO: 85407 - DNA, 75 bp, Artificial Sequence
  Synthetic
aagtcatcgggatgcatgttggtgggaacggttcacacgggtttgcagcagccctgaagcgatcatacttcactc

SEQ ID NO: 85408 - DNA, 75 bp, Artificial Sequence
  Synthetic
gaacggttcacacgggtttgcagcagccctgaagcgatcatacttcactcagagtcaaggtgaaattcagtggat

SEQ ID NO: 85409 - DNA, 75 bp, Artificial Sequence
  Synthetic
aacgcctctaaatttcatcagggctcattgggagtattcgccataccagaattctgtctggctggggacagtgat

SEQ ID NO: 85410 - DNA, 75 bp, Artificial Sequence
  Synthetic
gatactgctgtaacttccccaaaaagggaattttgtccagtagactatttactaggatgtggtgttttgataggg

SEQ ID NO: 85411 - DNA, 75 bp, Artificial Sequence
  Synthetic
actaggatgtggtgttttgatagggaatgcttttgtgttcccccaccagattatcaacttaagaaccaacaacag

SEQ ID NO: 85412 - DNA, 75 bp, Artificial Sequence
  Synthetic
tattctccccctgtcaccattggattttgcacaagactcatcagtggagatacccattacagtcacaatagctcc

SEQ ID NO: 85413 - DNA, 75 bp, Artificial Sequence
  Synthetic
tacccattacagtcacaatagctccgatgtgcagtgagttcaatggcttgcgcaacgttacagccccaaagcttc

SEQ ID NO: 85414 - DNA, 75 bp, Artificial Sequence
  Synthetic
gatgtgcagtgagttcaatggcttgcgcaacgttacagccccaaagcttcaaggactaccagtgctgaacacacc

SEQ ID NO: 85415 - DNA, 75 bp, Artificial Sequence
  Synthetic
acactatgattcctctgaatctagagaataccaagaggaataccatggacatgtacagagtgaggttgagcgaca

SEQ ID NO: 85416 - DNA, 75 bp, Artificial Sequence
  Synthetic
gggcctacaatcctcatgtacgatggttgtaccgtggatcagcaatgtcacatacagacagactacacaggacag

SEQ ID NO: 85417 - DNA, 75 bp, Artificial Sequence
  Synthetic
gttgtaccgtggatcagcaatgtcacatacagacagactacacaggacagttttactgaagggggatacatcagc

SEQ ID NO: 85418 - DNA, 75 bp, Artificial Sequence
  Synthetic
tgcaacgatttcagtgtacggttgctgcgcgacacaacacacatttcgcaggcggccatgccacaaggggtggat

SEQ ID NO: 85419 - DNA, 75 bp, Artificial Sequence
  Synthetic
atgctttagctctctcacttcccaagccacaaagcaatcttcctaatacaaaggccagggggcccgcccactcca

SEQ ID NO: 85420 - DNA, 75 bp, Artificial Sequence
  Synthetic
cgagaccggtgccaccaatccacttgttccatcagacaccgtgcagacgcgacacgtcatacagcagcgtagcag

SEQ ID NO: 85421 - DNA, 75 bp, Artificial Sequence
  Synthetic
cagataatgtacatccccccaggtgcccctacgccaaagtcatgggacgattacacctggcaaacttcttcaaac

SEQ ID NO: 85422 - DNA, 75 bp, Artificial Sequence
  Synthetic
agcgccatggctgtggatgatttcggtgtcctcgccataagagtggtcaatgatcacaaccccactaaagtaaca

SEQ ID NO: 85423 - DNA, 75 bp, Artificial Sequence
  Synthetic
gtgtcctcgccataagagtggtcaatgatcacaaccccactaaagtaacatcaaaggtgcggatatacatgaaac

SEQ ID NO: 85424 - DNA, 75 bp, Artificial Sequence
  Synthetic
acagattgttatcataaagcgaattggattggccatccggtgaaagtgagattcattatctatctgtttgctgga

SEQ ID NO: 85425 - DNA, 75 bp, Artificial Sequence
  Synthetic
acgggttggcacctctatcagagaagggactcacaacgtacgggtttggtcaccaaaataaagctgtttacacag

SEQ ID NO: 85426 - DNA, 75 bp, Artificial Sequence
  Synthetic
gggactcacaacgtacgggtttggtcaccaaaataaagctgtttacacagcgggttataagatctgcaattacca

SEQ ID NO: 85427 - DNA, 75 bp, Artificial Sequence
  Synthetic
actttccaatacatggaagcaaatgattactacccagctcgataccagtcccacatgctaatcggccacggtttc

SEQ ID NO: 85428 - DNA, 75 bp, Artificial Sequence
  Synthetic
ccacatgctaatcggccacggtttcgcatcacctggggattgtggcggtatcctcagatgccagcatggtgtgat

SEQ ID NO: 85429 - DNA, 75 bp, Artificial Sequence
  Synthetic
gagacctttatgcatatgaggaagaagccatggagcagggcatttccagctacattgagtcccttggagcagcat

SEQ ID NO: 85430 - DNA, 75 bp, Artificial Sequence
  Synthetic
agccatggagcagggcatttccagctacattgagtcccttggagcagcatttgggagcgggttcacccagcaaat

SEQ ID NO: 85431 - DNA, 75 bp, Artificial Sequence
  Synthetic
ttgggagcgggttcacccagcaaatcggggacaaaattaccgaactcaccggtatggtcaccagcactataaccg

SEQ ID NO: 85432 - DNA, 75 bp, Artificial Sequence
  Synthetic
accaggaattatgatgacaccaccactgttttagcaaccctagcgctacttgggtgtgatgtgtctccttggcag

SEQ ID NO: 85433 - DNA, 75 bp, Artificial Sequence
  Synthetic
ctgttttagcaaccctagcgctacttgggtgtgatgtgtctccttggcagtggctcaaaaagaaagcttgtgatg

SEQ ID NO: 85434 - DNA, 75 bp, Artificial Sequence
  Synthetic
aaggactggaatgggtgtccaacaaaatctccaaatttattgattggttgagagagaaaatcattcctcaagcta

SEQ ID NO: 85435 - DNA, 75 bp, Artificial Sequence
  Synthetic
aaccaaattgcaaccatccaccagtcatgccccagccaggaacaccaggagattctgttcaacaatgtgaggtgg

SEQ ID NO: 85436 - DNA, 75 bp, Artificial Sequence
  Synthetic
attaacaactacatacagttcaagagcaaacaccgtattgaaccagtatgtttgttagtacatggtagtcccgga

SEQ ID NO: 85437 - DNA, 75 bp, Artificial Sequence
  Synthetic
ccaccagatccatctcatttcgacgggtacaagcaacagggagtagtgatcatggatgatctaaaccagaatcca

SEQ ID NO: 85438 - DNA, 75 bp, Artificial Sequence
  Synthetic
ggtacaagcaacagggagtagtgatcatggatgatctaaaccagaatccagatggagccgatatgaaattattct

SEQ ID NO: 85439 - DNA, 75 bp, Artificial Sequence
  Synthetic
attacgtcctagcctctaccaactctagccgtatcacgccacccactgttgcacacagcgacgctttggctaggc

SEQ ID NO: 85440 - DNA, 75 bp, Artificial Sequence
  Synthetic
aggatccctgaagttcacgtttctgttctgtggatccatgatggcaactggcaaactgttggtgtcatacgcgcc

SEQ ID NO: 85441 - DNA, 75 bp, Artificial Sequence
  Synthetic
gttttgcattcgacgtggacattcaagtcatgagtgagtactccagggatgggaaattaaacatggcaatggcaa

SEQ ID NO: 85442 - DNA, 75 bp, Artificial Sequence
  Synthetic
accagcaaacttcaagaggtgctgtccattgatatgtgggaaggctattcaattaatggacaagtcctctagggt

SEQ ID NO: 85443 - DNA, 75 bp, Artificial Sequence
  Synthetic
aattaatggacaagtcctctagggtcaggtacagcattgatcagatcactaccatgatagttaatgagaaaaaca

SEQ ID NO: 85444 - DNA, 75 bp, Artificial Sequence
  Synthetic
cataaatgacttgctccaggccgttgactctcaagaagtgagggactactgtgagaaaaagggatggattgtcaa

SEQ ID NO: 85445 - DNA, 75 bp, Artificial Sequence
  Synthetic
agcagttgctggagtggtgtatgtgatgtacaagctgtttgcaggacaccaaggggcttatacaggacttccaaa

SEQ ID NO: 85446 - DNA, 75 bp, Artificial Sequence
  Synthetic
agaacagctaaggttcagggtccaggatttgattatgcagtggccatggccaagagaaatattcttacagcaacc

SEQ ID NO: 85447 - DNA, 75 bp, Artificial Sequence
  Synthetic
accagtaaaggagaattcacgatgcttggggtgcacgacaacgtagctattctaccaacccatgcatcgccaggt

SEQ ID NO: 85448 - DNA, 75 bp, Artificial Sequence
  Synthetic
gagacggtagtcattgatggcaaggaaattgaagtgttagatgctaaagctctagaagatcaggccggaactaac

SEQ ID NO: 85449 - DNA, 75 bp, Artificial Sequence
  Synthetic
catgtatgttcctgtaggtgctgtgactgaacagggatatcttaatctcggtggacgccaaactgctcgtacatt

SEQ ID NO: 85450 - DNA, 75 bp, Artificial Sequence
  Synthetic
tgttggtgggaacggttcacacgggtttgcagcagccttaaaacggtcatacttcactcaaagtcaaggagaaat

SEQ ID NO: 85451 - DNA, 75 bp, Artificial Sequence
  Synthetic
tttgcagcagccttaaaacggtcatacttcactcaaagtcaaggagaaattcaatggatgagaccatcaaaagag

SEQ ID NO: 85452 - DNA, 75 bp, Artificial Sequence
  Synthetic
accgagggcagtggcgtactacggccctggagtggattacaaggatggtacacttacacccctctccaccaagga

SEQ ID NO: 85453 - DNA, 75 bp, Artificial Sequence
  Synthetic
gttaaggaaccagccgtgctcacaaaaaatgacccaagactgaaaacgggttttgaggaagccattttttctaaa

SEQ ID NO: 85454 - DNA, 75 bp, Artificial Sequence
  Synthetic
aaaatgacccaagactgaaaacgggttttgaggaagccattttttctaaatatgtgggcaacaagattacagaag

SEQ ID NO: 85455 - DNA, 75 bp, Artificial Sequence
  Synthetic
tgtgccttgaggatgccatgtacggtactgatggtttggaagcactagatctcagcacaagcgcggggtacccat

SEQ ID NO: 85456 - DNA, 75 bp, Artificial Sequence
  Synthetic
tgctcttgcaatacaggcgtatattactgtgagtcaagaagaaaatactaccctgtttcctttgtaggtcccact

SEQ ID NO: 85457 - DNA, 75 bp, Artificial Sequence
  Synthetic
tactgatggtttggaagcactagatctcagcacaagcgcggggtacccatatgttgccatgggaaagaaaaagag

SEQ ID NO: 85458 - DNA, 75 bp, Artificial Sequence
  Synthetic
actgtgagtcaagaagaaaatactaccctgtttcctttgtaggtcccactttccaatatatggaagctaatgatt

SEQ ID NO: 85459 - DNA, 75 bp, Artificial Sequence
  Synthetic
gctagtcacttatgtgaaagatgaactaagatctaagaccaaagtggaacagggaaaatccaggctgattgaagc

SEQ ID NO: 85460 - DNA, 75 bp, Artificial Sequence
  Synthetic
ttagatgtcaacatggagtgataggaattatcacagctggaggggagggtttagttgcattctcagatattagag

SEQ ID NO: 85461 - DNA, 75 bp, Artificial Sequence
  Synthetic
ctaagatctaagaccaaagtggaacagggaaaatccaggctgattgaagcatccagtttaaatgactctgtggca

SEQ ID NO: 85462 - DNA, 75 bp, Artificial Sequence
  Synthetic
aattatcacagctggaggggagggtttagttgcattctcagatattagagacctgtatgcatatgaagaggaggc

SEQ ID NO: 85463 - DNA, 75 bp, Artificial Sequence
  Synthetic
tgtgacccagatttgttttggagtaaaatacccgtcttaatggaagaaaaactctttgcatttgactacacaggg

SEQ ID NO: 85464 - DNA, 75 bp, Artificial Sequence
  Synthetic
agacaagatctcagaactcaccaacatggttaccagtactattacagagaagctccttaaaaatctggttaagat

SEQ ID NO: 85465 - DNA, 75 bp, Artificial Sequence
  Synthetic
actctttgcatttgactacacagggtacgacgcctcgcttagcccggcctggtttgaagcactaaaaatggtgtt

SEQ ID NO: 85466 - DNA, 75 bp, Artificial Sequence
  Synthetic
atggttaccagtactattacagagaagctccttaaaaatctggttaagataatttcttctctagtcattattacc

SEQ ID NO: 85467 - DNA, 75 bp, Artificial Sequence
  Synthetic
cttaagaagaaggcatgtgatattttagagatcccgtatgtgatcaaacagggagacagctggctgaaaaaattt

SEQ ID NO: 85468 - DNA, 75 bp, Artificial Sequence
  Synthetic
tagagatcccgtatgtgatcaaacagggagacagctggctgaaaaaatttacagaagcgtgtaacgctgccaagg

SEQ ID NO: 85469 - DNA, 75 bp, Artificial Sequence
  Synthetic
acaagttagagtttgtgactaagctcaaacaactagagatgttggaaaaccagattgccaccatccaccaatcat

SEQ ID NO: 85470 - DNA, 75 bp, Artificial Sequence
  Synthetic
caaacaactagagatgttggaaaaccagattgccaccatccaccaatcatgcccaagtcaggaacatcaagagat

SEQ ID NO: 85471 - DNA, 75 bp, Artificial Sequence
  Synthetic
gaggttgacgctagtctcctagcccaatcaggaaaagactatggactaaccatgacaccagctgataagtcagcc

SEQ ID NO: 85472 - DNA, 75 bp, Artificial Sequence
  Synthetic
ttgatccacccagtaatgccaatgaaggaaattcatgaatcaattagatggaccaaagatcctagaaacactcag

SEQ ID NO: 85473 - DNA, 75 bp, Artificial Sequence
  Synthetic
aatacaaaaattagagcacacgataaataactacatacagttcaagagcaaacaccgtattgaaccagtatgttt

SEQ ID NO: 85474 - DNA, 75 bp, Artificial Sequence
  Synthetic
aataactacatacagttcaagagcaaacaccgtattgaaccagtatgtttgttagtgcatggcagtcctggtact

SEQ ID NO: 85475 - DNA, 75 bp, Artificial Sequence
  Synthetic
agaagcgtgccaattggaagagctctattgctccctgagtactctacattgtaccgccgttggctcgactctttt

SEQ ID NO: 85476 - DNA, 75 bp, Artificial Sequence
  Synthetic
cctgatcccactcactttgatgggtacaaacagcaaggagtggtcattatggacgacctgaaccaaaatccagat

SEQ ID NO: 85477 - DNA, 75 bp, Artificial Sequence
  Synthetic
acaaacagcaaggagtggtcattatggacgacctgaaccaaaatccagatggtgcagacatgaaactgttttgtc

SEQ ID NO: 85478 - DNA, 75 bp, Artificial Sequence
  Synthetic
atgtcttagcttctaccaattcaagtagaattgctccacctacagtagcccacagtgacgcgctagctaggcgct

SEQ ID NO: 85479 - DNA, 75 bp, Artificial Sequence
  Synthetic
tagaattgctccacctacagtagcccacagtgacgcgctagctaggcgctttgctttcgacatggaaatacaggt

SEQ ID NO: 85480 - DNA, 75 bp, Artificial Sequence
  Synthetic
agcaaacttcaagagatgacgtccgttagtctgtggtaaagccattcaattaatggacaaatcctccagagttag

SEQ ID NO: 85481 - DNA, 75 bp, Artificial Sequence
  Synthetic
ttagtctgtggtaaagccattcaattaatggacaaatcctccagagttagatacagtgttgatcaaattaccaca

SEQ ID NO: 85482 - DNA, 75 bp, Artificial Sequence
  Synthetic
tataaagatttgaaaatagatatcaagactacacctcccccagagtgcatcaatgacctgcttcaagcagttgat

SEQ ID NO: 85483 - DNA, 75 bp, Artificial Sequence
  Synthetic
agactacacctcccccagagtgcatcaatgacctgcttcaagcagttgattctcaagaggtaagagactattgtg

SEQ ID NO: 85484 - DNA, 75 bp, Artificial Sequence
  Synthetic
tgcaagcagtcaccacttttgcagcagttgctggagtagtgtatgtgatgtacaaactcttcgcaggtcaccaag

SEQ ID NO: 85485 - DNA, 75 bp, Artificial Sequence
  Synthetic
agttgctggagtagtgtatgtgatgtacaaactcttcgcaggtcaccaaggggcttacacaggacttcccaataa

SEQ ID NO: 85486 - DNA, 75 bp, Artificial Sequence
  Synthetic
gagaaatgttctcacagcaaccaccagtaaaggagagttcacaatgctcggagtgcatgacaatgtggccatcct

SEQ ID NO: 85487 - DNA, 75 bp, Artificial Sequence
  Synthetic
acaataattattgacggtaaagaggttgatgtgttggatgccagggctctggaagatcaggcgggtaccaacttg

SEQ ID NO: 85488 - DNA, 75 bp, Artificial Sequence
  Synthetic
gtatgttcctgtcggtgctgtgaccgaacagggatatctcaatctcggtggacgccaaactgctcgcaccttaat

SEQ ID NO: 85489 - DNA, 75 bp, Artificial Sequence
  Synthetic
tggtgggaatggttcacatgggttcgcagcagccttaaagcgatcctactttgctcaaagtcaaggtgaaatcca

SEQ ID NO: 85490 - DNA, 75 bp, Artificial Sequence
  Synthetic
gcagcagccttaaagcgatcctactttgctcaaagtcaaggtgaaatccaatggatgagaccatctaaggaggtg

SEQ ID NO: 85491 - DNA, 75 bp, Artificial Sequence
  Synthetic
aaggaaccagcagtgctcaccaagaatgacctacgactgaaaactgacttcgaagaagcaattttctcgaagtat

SEQ ID NO: 85492 - DNA, 75 bp, Artificial Sequence
  Synthetic
atgacctacgactgaaaactgacttcgaagaagcaattttctcgaagtatgtgggcaacaaaattaccgaggtgg

SEQ ID NO: 85493 - DNA, 75 bp, Artificial Sequence
  Synthetic
gtcttgaggacgctatgtacggtacagatggactcgaggcattagacctcagtaccagtgcaggctacccttatg

SEQ ID NO: 85494 - DNA, 75 bp, Artificial Sequence
  Synthetic
agatggactcgaggcattagacctcagtaccagtgcaggctacccttatgtggcaatggggaaaaagaagagaga

SEQ ID NO: 85495 - DNA, 75 bp, Artificial Sequence
  Synthetic
ggtcacctacgtgaaagacgagctcaggtctaaaaccaaagtggaacaaggcaaatccagactgattgaagcttc

SEQ ID NO: 85496 - DNA, 75 bp, Artificial Sequence
  Synthetic
aggtctaaaaccaaagtggaacaaggcaaatccagactgattgaagcttcaagtctcaacgattctgttgcaatg

SEQ ID NO: 85497 - DNA, 75 bp, Artificial Sequence
  Synthetic
ttaaaaaaagttggggggtttttccccccccggggttccctgggaggccagtccccgggcacccgggggcccttt

SEQ ID NO: 85498 - DNA, 75 bp, Artificial Sequence
  Synthetic
gacccagatctgttctggagcaaaataccagttttaatggaagaaaaactcttcgcatttgactacacagggtat

SEQ ID NO: 85499 - DNA, 75 bp, Artificial Sequence
  Synthetic
cttcgcatttgactacacagggtatgacgcatcactcagccccgcttggtttgaggcactcaaaatggtactaga

SEQ ID NO: 85500 - DNA, 75 bp, Artificial Sequence
  Synthetic
ctgtgtgaacggcagaaaggggcaaaatcgttatccgcttgattactgcgggacgcctagtatcaccatggattg

SEQ ID NO: 85501 - DNA, 75 bp, Artificial Sequence
  Synthetic
cccagtgtagcttgggccgatgaggctccgaattccccacgggcgaccgtgtcagagcctgcgttggcggcctac

SEQ ID NO: 85502 - DNA, 75 bp, Artificial Sequence
  Synthetic
atattgtgtcaagggcggcatgccatctggctgctcaggcacttcaatctttaactcaatgatcaacaacttaat

SEQ ID NO: 85503 - DNA, 75 bp, Artificial Sequence
  Synthetic
acaacaatataacacaatgggagctcaagtgtcagcccaacacaacggcactcaccagaattccaacagtgctag

SEQ ID NO: 85504 - DNA, 75 bp, Artificial Sequence
  Synthetic
gtacacccagttatgcctatgaaagaaattcatgaatcaatcagatggaccaaggatcctagaaacactcaggat

SEQ ID NO: 85505 - DNA, 75 bp, Artificial Sequence
  Synthetic
aaattcatgaatcaatcagatggaccaaggatcctagaaacactcaggatcatgttcgttcattgtgcttattgg

SEQ ID NO: 85506 - DNA, 75 bp, Artificial Sequence
  Synthetic
agtgaccgcgtccagcaattgaccttaggaaattcaactattaccactcaggaagcagccaacgcagtggtggca

SEQ ID NO: 85507 - DNA, 75 bp, Artificial Sequence
  Synthetic
cgcaccaacgatgcctgattcctctagtaatcgcttttacactcttgagagtgtggagtgggaagaggggtcccg

SEQ ID NO: 85508 - DNA, 75 bp, Artificial Sequence
  Synthetic
gtgcagtgtaacgcctctaagttccatcagggggccttggtggttgccgccattcccgaatttatgatggctagc

SEQ ID NO: 85509 - DNA, 75 bp, Artificial Sequence
  Synthetic
aactcaagggatagtacaggtggcatcacttacgagaaagcgaaccccggtgagaaaggaggaaaatttcaagca

SEQ ID NO: 85510 - DNA, 75 bp, Artificial Sequence
  Synthetic
atggcaggcaatataaccatttacccccaccagatcatcaatttgcggacaaacaactgtgcgacgctggtgtta

SEQ ID NO: 85511 - DNA, 75 bp, Artificial Sequence
  Synthetic
ccactgaagtttgagagtggtgcgtcaactaagataccaattactgtcaccattgcccccatgtgctgtgaattc

SEQ ID NO: 85512 - DNA, 75 bp, Artificial Sequence
  Synthetic
caactaagataccaattactgtcaccattgcccccatgtgctgtgaattcaacgggctgcgtgctatgaccgccc

SEQ ID NO: 85513 - DNA, 75 bp, Artificial Sequence
  Synthetic
catgtgctataccaaattatgatgtctcaccgcccatacatatacctggtgaagttcgcaatatgatggaaattg

SEQ ID NO: 85514 - DNA, 75 bp, Artificial Sequence
  Synthetic
tgcagcaaggtttggcgaataaggagcagtctatattctccttgagtcttagtccagcttccgaccccagattgt

SEQ ID NO: 85515 - DNA, 75 bp, Artificial Sequence
  Synthetic
cacgtacactgttgggcgagatcttgaattactacacacattgggccggttcagtaaagttcacatttttgtttt

SEQ ID NO: 85516 - DNA, 75 bp, Artificial Sequence
  Synthetic
ggtgctaaacccccaaccacaaggaaagatgccatgcttggaacccatttaatatgggacattggtcttcaatcc

SEQ ID NO: 85517 - DNA, 75 bp, Artificial Sequence
  Synthetic
ggatacatcactgccttctaccaaaccgctatagtggtcccaagtggtgcaccaaaggacatgagtatgctggca

SEQ ID NO: 85518 - DNA, 75 bp, Artificial Sequence
  Synthetic
tttgtcagcgcctgtaatgatttttctgctagattgctaaaggatacaccattcattagacaacttgctacggtg

SEQ ID NO: 85519 - DNA, 75 bp, Artificial Sequence
  Synthetic
aacaccttaccaagtggaccagtgcactcgcaacaagtgccggctcttactgctgttgagacgggcactaccaac

SEQ ID NO: 85520 - DNA, 75 bp, Artificial Sequence
  Synthetic
ccaaaggtcagagtgcacagttgaatccttcctagggagatctgcgtgtgtagctataattggactcaaaaatga

SEQ ID NO: 85521 - DNA, 75 bp, Artificial Sequence
  Synthetic
gaattgttcgccacgtggaacattgggtaccattacgcttaccagttgcgcagaaagcttgaaatgttcacctac

SEQ ID NO: 85522 - DNA, 75 bp, Artificial Sequence
  Synthetic
ggtaccattacgcttaccagttgcgcagaaagcttgaaatgttcacctactctagatttgatgcagagctcacat

SEQ ID NO: 85523 - DNA, 75 bp, Artificial Sequence
  Synthetic
caccaggcgcccccaaaccaaccaaatgggatgactacacatggcaaagttccacaaacccatcagttttccata

SEQ ID NO: 85524 - DNA, 75 bp, Artificial Sequence
  Synthetic
atgggatgactacacatggcaaagttccacaaacccatcagttttccatacaaccgggagtgcgaacccgcgtat

SEQ ID NO: 85525 - DNA, 75 bp, Artificial Sequence
  Synthetic
aattgacgctggcgcgtttaacaagtatggttacaacagcatcaatgacttcggcaccattgccgtgcgcattgt

SEQ ID NO: 85526 - DNA, 75 bp, Artificial Sequence
  Synthetic
tatggttacaacagcatcaatgacttcggcaccattgccgtgcgcattgttaatgagcatgacccagttcccata

SEQ ID NO: 85527 - DNA, 75 bp, Artificial Sequence
  Synthetic
tacaccgggccgtcagtggactataagcaggcaaacaaggtaatgacacatgtagcagacatccgcacatacgga

SEQ ID NO: 85528 - DNA, 75 bp, Artificial Sequence
  Synthetic
agcaggcaaacaaggtaatgacacatgtagcagacatccgcacatacggattcgggcaccaaaacaaagccgtct

SEQ ID NO: 85529 - DNA, 75 bp, Artificial Sequence
  Synthetic
gggaccgcgacctaatggttgtagaaagtagggcccaaggaattgacaccatagctaggtgctcttgtaggtgtg

SEQ ID NO: 85530 - DNA, 75 bp, Artificial Sequence
  Synthetic
aagtagggcccaaggaattgacaccatagctaggtgctcttgtaggtgtggggtgtattactgtgagtccatgag

SEQ ID NO: 85531 - DNA, 75 bp, Artificial Sequence
  Synthetic
tcaatcacacatgctaatagggtccgggtttgcaatgccaggtgactgtgggggaatactgcggtgcacacatgg

SEQ ID NO: 85532 - DNA, 75 bp, Artificial Sequence
  Synthetic
tgtcatgggcctgattacagccggtggcgatggtgttgtagcctttgcagacattagagacttgttcgcctatga

SEQ ID NO: 85533 - DNA, 75 bp, Artificial Sequence
  Synthetic
acagattacatcagtggcctaggggcggcttttggtgcaggctttagtgctgagatttccagtcggatacaagaa

SEQ ID NO: 85534 - DNA, 75 bp, Artificial Sequence
  Synthetic
cggcttttggtgcaggctttagtgctgagatttccagtcggatacaagaactgcaagagacagtacagagcgtca

SEQ ID NO: 85535 - DNA, 75 bp, Artificial Sequence
  Synthetic
caataacagtgttagcaactcttagtctgctggggtgtgattcttcaccgtggcactggttgaaggagaaggttt

SEQ ID NO: 85536 - DNA, 75 bp, Artificial Sequence
  Synthetic
tctgctggggtgtgattcttcaccgtggcactggttgaaggagaaggtttgtcatatattgggaatcccgtatgt

SEQ ID NO: 85537 - DNA, 75 bp, Artificial Sequence
  Synthetic
acagaagataggcaaatttattgattggataaaaaccaagatcttgccagaggcgcaagacaaagtagaatatct

SEQ ID NO: 85538 - DNA, 75 bp, Artificial Sequence
  Synthetic
ctagaaaaccaagttgccacactacaccagtcatgcccaagccaggaagaccaggaagtaatatttaataatata

SEQ ID NO: 85539 - DNA, 75 bp, Artificial Sequence
  Synthetic
tcaagaccaaacaccgcattgaacctgtatgtttattgatacatggcacaccgggtaccggcaagtctattgcca

SEQ ID NO: 85540 - DNA, 75 bp, Artificial Sequence
  Synthetic
tcgacgggtacaaacaacagggtgtagtgattatggatgatcttaatcaaaacccagacggagaagatatgaagc

SEQ ID NO: 85541 - DNA, 75 bp, Artificial Sequence
  Synthetic
ggaatttgtaccaccaatggccagcctagaggaaaagggcattctattcacatcagattatgtacttgcttccac

SEQ ID NO: 85542 - DNA, 75 bp, Artificial Sequence
  Synthetic
cattgaagtgatgtcacaatatagcaacaaaggccacttaaacatggcaactgcaaccaaaccatgcagtgattg

SEQ ID NO: 85543 - DNA, 75 bp, Artificial Sequence
  Synthetic
tgttgcccacttgtttgcggcagggccatccagtttgtggacaaggcaacgcgcaccaggtacacagtagatgag

SEQ ID NO: 85544 - DNA, 75 bp, Artificial Sequence
  Synthetic
gtaatagagaggcacctaaaccgagccatgacaattgttcaagccgtttcgtcctttgtggttgtttctggcatg

SEQ ID NO: 85545 - DNA, 75 bp, Artificial Sequence
  Synthetic
gtcctttgtggttgtttctggcatgttgtatgtcatctacaaactgtttgctaattttcagggggcatatacagg

SEQ ID NO: 85546 - DNA, 75 bp, Artificial Sequence
  Synthetic
tgctatggcaaagcgcaacatactgactgcaacaacagagaagggtgagttcaccatgcttggcatttacgacag

SEQ ID NO: 85547 - DNA, 75 bp, Artificial Sequence
  Synthetic
agtggctgtcttgcccacccactccagacctggagagaccataaccatagcagggaaggaggtgaagattaaaga

SEQ ID NO: 85548 - DNA, 75 bp, Artificial Sequence
  Synthetic
tagagacatcagggcacacatacccacaactatatgtgagaccagtgaagctatactagcagtgaacaccacgcg

SEQ ID NO: 85549 - DNA, 75 bp, Artificial Sequence
  Synthetic
acaactatatgtgagaccagtgaagctatactagcagtgaacaccacgcgtttccctaatatgtacatcccagtg

SEQ ID NO: 85550 - DNA, 75 bp, Artificial Sequence
  Synthetic
actaaagcaggccagtgtggtggtgtggtgatgtctacaggtaaggttattggcattcatgtgggaggtaatggt

SEQ ID NO: 85551 - DNA, 75 bp, Artificial Sequence
  Synthetic
tggtgatgtctacaggtaaggttattggcattcatgtgggaggtaatggttcccatggctttgctgcagcattga

SEQ ID NO: 85552 - DNA, 75 bp, Artificial Sequence
  Synthetic
ttaacgctcctagtaaaaccaaactgcagcctagtgtgtttcacaatgtgttcccaggtgtcaaggaacctgcag

SEQ ID NO: 85553 - DNA, 75 bp, Artificial Sequence
  Synthetic
ttctccaagtacgtgggcaatgccatcacggaagtggatgagtacatgagggaggctgtggaccactacgctgga

SEQ ID NO: 85554 - DNA, 75 bp, Artificial Sequence
  Synthetic
tttgtatggcactgaaggtcttgaggccctggacttgacaaccagtgctggctacccgtatgtgaccatgggaaa

SEQ ID NO: 85555 - DNA, 75 bp, Artificial Sequence
  Synthetic
gagaaagagagagatcttgaacaaggaaacacgtgacaccaaggagatgcagcgtatgctagacaagtacgggat

SEQ ID NO: 85556 - DNA, 75 bp, Artificial Sequence
  Synthetic
gatagaggccagctcgctaaatgactcagttgccatgcggcaagcctttgggcacttatatgccaagttccacca

SEQ ID NO: 85557 - DNA, 75 bp, Artificial Sequence
  Synthetic
tcagttgccatgcggcaagcctttgggcacttatatgccaagttccaccaaaaccctggcatagtgaccggcagt

SEQ ID NO: 85558 - DNA, 75 bp, Artificial Sequence
  Synthetic
tacactggttacgacgcctctctatcgccagcttggtttgaagcccttaagatggtgctagaaaaaattggatat

SEQ ID NO: 85559 - DNA, 75 bp, Artificial Sequence
  Synthetic
ggagggatgccatctgggtgctccggcacgtccattttcaacacaatgattaacaacataattattagaactctc

SEQ ID NO: 85560 - DNA, 75 bp, Artificial Sequence
  Synthetic
ctacggcgatgacgtcctagccagctacccacaccaaatagacgcaggcctcctagctcagacaggaaaagatta

SEQ ID NO: 85561 - DNA, 75 bp, Artificial Sequence
  Synthetic
tacccacaccaaatagacgcaggcctcctagctcagacaggaaaagattatggcctgctaatgacaccggcagac

SEQ ID NO: 85562 - DNA, 75 bp, Artificial Sequence
  Synthetic
ttcccttacttagtacacccagttatgccaatgtcagaaatacatgaatcaatacgctggactaaggatccaaag

SEQ ID NO: 85563 - DNA, 75 bp, Artificial Sequence
  Synthetic
tgccaatgtcagaaatacatgaatcaatacgctggactaaggatccaaagaacacacaagaccacgtgcggtctc

SEQ ID NO: 85564 - DNA, 75 bp, Artificial Sequence
  Synthetic
gccgcgcattactcctaccggagtatacaacgctgcgccgccgctggctggactctttctgatcgaccatacctc

SEQ ID NO: 85565 - DNA, 75 bp, Artificial Sequence
  Synthetic
gactctttctgatcgaccatacctcactcgaattggtctgagagatagtgagttatgggtaaattttcttttaat

SEQ ID NO: 85566 - DNA, 75 bp, Artificial Sequence
  Synthetic
cccaaccaaggtcacctccaaaatcagagtgtatctaaaacccaaacatatcagagtctggtgcccgcgtccacc

SEQ ID NO: 85567 - DNA, 75 bp, Artificial Sequence
  Synthetic
gcagccctgaagcgctcatacttcactcagagtcaaggtgaaattcagtggatgagaccatcaaaagaagtgggt

SEQ ID NO: 85568 - DNA, 75 bp, Artificial Sequence
  Synthetic
gtaccaccacgaacaagcacttctgtttccccggtgatgttgtatagactgctaacgcggttgaaaacagctgat

SEQ ID NO: 85569 - DNA, 75 bp, Artificial Sequence
  Synthetic
attgattgttatcataaagcgaattggattggccatccggtgaaagtgagacttatcatctacttgtttgttgga

SEQ ID NO: 85570 - DNA, 75 bp, Artificial Sequence
  Synthetic
tgcacaagtttcatcacaaaaggttggagcccatgagaacaccaatgttgctactggtgggtcaacagtcaatta

SEQ ID NO: 85571 - DNA, 75 bp, Artificial Sequence
  Synthetic
ggagcccatgagaacaccaatgttgctactggtgggtcaacagtcaattataccactatcaattattacaaggat

SEQ ID NO: 85572 - DNA, 75 bp, Artificial Sequence
  Synthetic
ttaataaagtctgcaccagcgctgaactccccaaacatagaggcatgtggatacagtgatagagttatgcaattg

SEQ ID NO: 85573 - DNA, 75 bp, Artificial Sequence
  Synthetic
actccccaaacatagaggcatgtggatacagtgatagagttatgcaattgacacttggaaactcaaccattacca

SEQ ID NO: 85574 - DNA, 75 bp, Artificial Sequence
  Synthetic
ttgatcaacccaccgagccagatgtatcagcatgtagattctatacattagacacagtagaatgggacaaagaat

SEQ ID NO: 85575 - DNA, 75 bp, Artificial Sequence
  Synthetic
atcagcatgtagattctatacattagacacagtagaatgggacaaagaatccaaaggatggtggtggaaactgcc

SEQ ID NO: 85576 - DNA, 75 bp, Artificial Sequence
  Synthetic
gcatgtgcagtgcaatgcctcaaaattccatcaaggtacccttggtgtatttgctgtgccggagtattgcttagc

SEQ ID NO: 85577 - DNA, 75 bp, Artificial Sequence
  Synthetic
ttccatcaaggtacccttggtgtatttgctgtgccggagtattgcttagcaggtgactccaattcgaaaaccaac

SEQ ID NO: 85578 - DNA, 75 bp, Artificial Sequence
  Synthetic
accagccccaaacgagagtttcagccagtggattacctatttggttgtggtgttatggcaggtaatgcatttgtt

SEQ ID NO: 85579 - DNA, 75 bp, Artificial Sequence
  Synthetic
cagtggattacctatttggttgtggtgttatggcaggtaatgcatttgttttcccacaccagatcattaacctcc

SEQ ID NO: 85580 - DNA, 75 bp, Artificial Sequence
  Synthetic
actggggtattgtcatactaccactatccaagctagattataatcctgatgctagcactaaattacccatcacag

SEQ ID NO: 85581 - DNA, 75 bp, Artificial Sequence
  Synthetic
atccaagctagattataatcctgatgctagcactaaattacccatcacagttaccatcgctccgatgtgttgtga

SEQ ID NO: 85582 - DNA, 75 bp, Artificial Sequence
  Synthetic
gtacctgacttctgacaactttcagtcaccgtgtgcattgccagagtttgatgtgactcagccaattttcatacc

SEQ ID NO: 85583 - DNA, 75 bp, Artificial Sequence
  Synthetic
atgtgactcagccaattttcataccaggagaagtcaaaaatttgatggagttagcagaaatagacacaatgatcc

SEQ ID NO: 85584 - DNA, 75 bp, Artificial Sequence
  Synthetic
ataaaccaatcctgtgtttaacactatcaccagcttcagatccgagactttcctacacaatgctgggtgaaattt

SEQ ID NO: 85585 - DNA, 75 bp, Artificial Sequence
  Synthetic
atcaccagcttcagatccgagactttcctacacaatgctgggtgaaattttgaattattacacccattgggctgg

SEQ ID NO: 85586 - DNA, 75 bp, Artificial Sequence
  Synthetic
atgggtgcccaagtctcatctcaaaaagttggtgcacatgagaacactaatgtagcaactggcggatccacagtt

SEQ ID NO: 85587 - DNA, 75 bp, Artificial Sequence
  Synthetic
gggcgcacagcctcctcaggacaggaaagcagcaatgctagggactcatgtgatctgggacattggtctgcaatc

SEQ ID NO: 85588 - DNA, 75 bp, Artificial Sequence
  Synthetic
aaagcagcaatgctagggactcatgtgatctgggacattggtctgcaatcctcatgcacgatggtggtaccctgg

SEQ ID NO: 85589 - DNA, 75 bp, Artificial Sequence
  Synthetic
aattacactaccattaattactataaagattcagccagtaatgcagcctccaaattggacttttcacaggatcct

SEQ ID NO: 85590 - DNA, 75 bp, Artificial Sequence
  Synthetic
acaagggtagtagtgccagcttctacaccaactagcatggacattttgtgttttatttcagcttgtaacgatttc

SEQ ID NO: 85591 - DNA, 75 bp, Artificial Sequence
  Synthetic
caccaactagcatggacattttgtgttttatttcagcttgtaacgatttcactgttagactgcttagagatacca

SEQ ID NO: 85592 - DNA, 75 bp, Artificial Sequence
  Synthetic
tgtcccagccaacaagaccggcactcccaccagccgagcagagtgtccccaacactaaccaaacaactccagaac

SEQ ID NO: 85593 - DNA, 75 bp, Artificial Sequence
  Synthetic
cccaccagccgagcagagtgtccccaacactaaccaaacaactccagaacactccaaggaagtcccagcgttaac

SEQ ID NO: 85594 - DNA, 75 bp, Artificial Sequence
  Synthetic
aagtagaagtgaaagtacagtggagtctttctttgcgcgaggtgcatgtgtaaccattatgggagtggacaacta

SEQ ID NO: 85595 - DNA, 75 bp, Artificial Sequence
  Synthetic
tctttctttgcgcgaggtgcatgtgtaaccattatgggagtggacaactataatgagacattgaaaggagaccag

SEQ ID NO: 85596 - DNA, 75 bp, Artificial Sequence
  Synthetic
acttactccaggtttgacatcgagtttacttttgtggtgactgaacgctactactcatcaaacagtgggcatgct

SEQ ID NO: 85597 - DNA, 75 bp, Artificial Sequence
  Synthetic
ttacttttgtggtgactgaacgctactactcatcaaacagtgggcatgctctgaaccaagtgtaccaaattatgt

SEQ ID NO: 85598 - DNA, 75 bp, Artificial Sequence
  Synthetic
tctacacttatgggtcagcaccacccaggatatccataccctttgtgggtatagcaaacgcttactcccacttct

SEQ ID NO: 85599 - DNA, 75 bp, Artificial Sequence
  Synthetic
caggatatccataccctttgtgggtatagcaaacgcttactcccacttctatgatgggtatgcgacagtgccctt

SEQ ID NO: 85600 - DNA, 75 bp, Artificial Sequence
  Synthetic
tcgcgtcgtcaatgaacataatccagtcagagtatcatccaaaattagagtgtatatgaaaccaaaacatgtcag

SEQ ID NO: 85601 - DNA, 75 bp, Artificial Sequence
  Synthetic
gtcagagtatcatccaaaattagagtgtatatgaaaccaaaacatgtcagggtatggtgtcccagacctccaagg

SEQ ID NO: 85602 - DNA, 75 bp, Artificial Sequence
  Synthetic
acttatggatttggccaccagttgaaagccgtatacgtggctggatacaaaattgtgaactaccatttagcaacc

SEQ ID NO: 85603 - DNA, 75 bp, Artificial Sequence
  Synthetic
aagccgtatacgtggctggatacaaaattgtgaactaccatttagcaacctcagaagactatagaaactgtgtga

SEQ ID NO: 85604 - DNA, 75 bp, Artificial Sequence
  Synthetic
gcaaaactggagtgtattattgtgagtcaagaaacaaacactacccaatcaccattactgcacccacattccaat

SEQ ID NO: 85605 - DNA, 75 bp, Artificial Sequence
  Synthetic
gtcaagaaacaaacactacccaatcaccattactgcacccacattccaatggatggagaagaatgatttctaccc

SEQ ID NO: 85606 - DNA, 75 bp, Artificial Sequence
  Synthetic
cataatatgggaccttggacttcaatcctcatgcaccatgctagccccttggatatccaacacagtctacagaag

SEQ ID NO: 85607 - DNA, 75 bp, Artificial Sequence
  Synthetic
ccaacacggtgtcatgggccttattactgcgggtgggaatggattggttgcgtttgcagacatccgtgatctcta

SEQ ID NO: 85608 - DNA, 75 bp, Artificial Sequence
  Synthetic
actgcgggtgggaatggattggttgcgtttgcagacatccgtgatctctatgtagaagaagaagccatggaacag

SEQ ID NO: 85609 - DNA, 75 bp, Artificial Sequence
  Synthetic
acagaattgacctccatggtcacttcggtactaacagaaaaactccttaagaacttaattaagttgattagtagt

SEQ ID NO: 85610 - DNA, 75 bp, Artificial Sequence
  Synthetic
cggtactaacagaaaaactccttaagaacttaattaagttgattagtagtctggttataataactaggaattatg

SEQ ID NO: 85611 - DNA, 75 bp, Artificial Sequence
  Synthetic
aggtttgtgacattttagaaattccctttgttttgaaacaaggtgattcttggatgaagaagttcacggaagcat

SEQ ID NO: 85612 - DNA, 75 bp, Artificial Sequence
  Synthetic
ctttgttttgaaacaaggtgattcttggatgaagaagttcacggaagcatgcaacgcagctaaaggacttgaatg

SEQ ID NO: 85613 - DNA, 75 bp, Artificial Sequence
  Synthetic
agaaggaaactggagttttttacctactccagatttgacctagagatgacttttgtcataacggaaaggtactac

SEQ ID NO: 85614 - DNA, 75 bp, Artificial Sequence
  Synthetic
gtatgtgacaaaactcaagcaattgggtatgttagagaatcaaatcaacaccatacaccagtcatgccccagcca

SEQ ID NO: 85615 - DNA, 75 bp, Artificial Sequence
  Synthetic
ggtatgttagagaatcaaatcaacaccatacaccagtcatgccccagccaagagcaacaggaaatcttatttaat

SEQ ID NO: 85616 - DNA, 75 bp, Artificial Sequence
  Synthetic
ttagagaacaccatcaataattacatacagttcaagagcaaacaccgtattgaaccagtatgtgttttgatacac

SEQ ID NO: 85617 - DNA, 75 bp, Artificial Sequence
  Synthetic
tacagttcaagagcaaacaccgtattgaaccagtatgtgttttgatacacggtagcccgggcacaggcaaatctg

SEQ ID NO: 85618 - DNA, 75 bp, Artificial Sequence
  Synthetic
cgcactttgatggttacaagcaacagggagtggtgatcatggatgacctgaatcagaatccagatggtatggaca

SEQ ID NO: 85619 - DNA, 75 bp, Artificial Sequence
  Synthetic
gggagtggtgatcatggatgacctgaatcagaatccagatggtatggacatgaagctcttttgtcagatggtttc

SEQ ID NO: 85620 - DNA, 75 bp, Artificial Sequence
  Synthetic
ttccactaactctagcactatcacaccaccaacagtagctcacagtgatgccttgtcccgccgattcgcctttga

SEQ ID NO: 85621 - DNA, 75 bp, Artificial Sequence
  Synthetic
ccaccaacagtagctcacagtgatgccttgtcccgccgattcgcctttgacatggagatatgtcccttaacccaa

SEQ ID NO: 85622 - DNA, 75 bp, Artificial Sequence
  Synthetic
aagaagtgctgtcccctggtatgtggaaaagcaattcagctcatggacaagtactccaggcagagatttagcgta

SEQ ID NO: 85623 - DNA, 75 bp, Artificial Sequence
  Synthetic
gaaaagcaattcagctcatggacaagtactccaggcagagatttagcgtagatgagatcactaccttggttatta

SEQ ID NO: 85624 - DNA, 75 bp, Artificial Sequence
  Synthetic
taaaaattgacataaaaaccagcccacccccagaatgtatcaatgacctgctgcagtcagtagactcacctgagg

SEQ ID NO: 85625 - DNA, 75 bp, Artificial Sequence
  Synthetic
acccccagaatgtatcaatgacctgctgcagtcagtagactcacctgaggttagagagtattgtgagaagaaagg

SEQ ID NO: 85626 - DNA, 75 bp, Artificial Sequence
  Synthetic
caccacctttgccgcggttgctggtgttgtctatgtcatgtacaggttatttgctggtcaacaaggagcttacac

SEQ ID NO: 85627 - DNA, 75 bp, Artificial Sequence
  Synthetic
gttgtctatgtcatgtacaggttatttgctggtcaacaaggagcttacacaggcttacccaacaaacgcccgaat

SEQ ID NO: 85628 - DNA, 75 bp, Artificial Sequence
  Synthetic
actactgccaccaccagcaagggagagttcactatgttaggggtctatgacaacgtagccatcctacccactcat

SEQ ID NO: 85629 - DNA, 75 bp, Artificial Sequence
  Synthetic
agatgccaaagctcttgaggatcaggcagggaccaatttggagatcaccataatcacactcaaaagaaacgagaa

SEQ ID NO: 85630 - DNA, 75 bp, Artificial Sequence
  Synthetic
ccaacacaaatcactgagactaatgatggagttttgatcgtgaacactagtaagtaccccaacatgtatgtccct

SEQ ID NO: 85631 - DNA, 75 bp, Artificial Sequence
  Synthetic
ggttcacatgggtttgcagcagccctaaagcgatcatacttcactcagagtcaaggtgaaattcaatggatgaaa

SEQ ID NO: 85632 - DNA, 75 bp, Artificial Sequence
  Synthetic
gtatttgagggagtgaaagaaccagcagtcctcactaaaaacgaccccagactcaagacagactttgaagaggca

SEQ ID NO: 85633 - DNA, 75 bp, Artificial Sequence
  Synthetic
cagtcctcactaaaaacgaccccagactcaagacagactttgaagaggcaatcttctccaaatatgtaggcaaca

SEQ ID NO: 85634 - DNA, 75 bp, Artificial Sequence
  Synthetic
acacagagcaaatgtgtctagaagatgccatgtatggaactgatggtctggaagcacttgatttatccaccagtg

SEQ ID NO: 85635 - DNA, 75 bp, Artificial Sequence
  Synthetic
tgccatgtatggaactgatggtctggaagcacttgatttatccaccagtgcaggctatccttatgtagcaatggg

SEQ ID NO: 85636 - DNA, 75 bp, Artificial Sequence
  Synthetic
aatcaatttgccactagtgacatatgtcaaagatgagctaagatccaaaaccaaagtggagcagggaaagtccag

SEQ ID NO: 85637 - DNA, 75 bp, Artificial Sequence
  Synthetic
gtcaaagatgagctaagatccaaaaccaaagtggagcagggaaagtccagattaattgaagcttccagcttaaat

SEQ ID NO: 85638 - DNA, 75 bp, Artificial Sequence
  Synthetic
agtgcagttggttgtgacccagatctgttttggagtaagatcccagtgttaatggaagagaaactttttgctttt

SEQ ID NO: 85639 - DNA, 75 bp, Artificial Sequence
  Synthetic
tgttttggagtaagatcccagtgttaatggaagagaaactttttgcttttgattacacaggttatgatgcatcac

SEQ ID NO: 85640 - DNA, 75 bp, Artificial Sequence
  Synthetic
acgacctagtggtagaaagaaatctgaacagggccatgactgttttgcaagctgtaactacatttgctgctgtgg

SEQ ID NO: 85641 - DNA, 75 bp, Artificial Sequence
  Synthetic
actatcttaatcactctcaccacttgtacaaaaacaaaacttattgtgtcaaaggcggtatgccatctggctgct

SEQ ID NO: 85642 - DNA, 75 bp, Artificial Sequence
  Synthetic
gtctcctagcccaatcaggaaaagactatggactaaccatgactccagcagataaatctaccacatttgaaacgg

SEQ ID NO: 85643 - DNA, 75 bp, Artificial Sequence
  Synthetic
taatgccaatgaaggaaattcatgaatcaattagatggacaaaggatcccagaaacacgcaggatcacgtacgct

SEQ ID NO: 85644 - DNA, 75 bp, Artificial Sequence
  Synthetic
acttcccgacaagagcaggccagtgtggtggtgttgtcacgtgtactggcaaggtgattgggatacatgttggag

SEQ ID NO: 85645 - DNA, 75 bp, Artificial Sequence
  Synthetic
aatgcggctaatcctaaccatggagcaggcagctgcaatccagcagccagcctgtcgtaacgcgcaagtccgtgg

SEQ ID NO: 85646 - DNA, 75 bp, Artificial Sequence
  Synthetic
cggaaccgactactttgggtgtccgtgtttccttttatttttgaatggctgcttatggtgacaatcatagattgt

SEQ ID NO: 85647 - DNA, 75 bp, Artificial Sequence
  Synthetic
gccaattggaagagcattattgcttccagagtactcgacattgtatcgccgttggctcgactctttttagtaacc

SEQ ID NO: 85648 - DNA, 75 bp, Artificial Sequence
  Synthetic
tccgtggcggaaccgactactttgggtgtccgtgtttccttttattttataatggctgcttatggtgacaatcac

SEQ ID NO: 85649 - DNA, 75 bp, Artificial Sequence
  Synthetic
agattgtcgtcataaagcgaattggattggccatccggtgatagtgaaattcattacttaactgtttactggatt

SEQ ID NO: 85650 - DNA, 75 bp, Artificial Sequence
  Synthetic
ccatcagggggcactaggggtattcgctgtaccagagatgtgtttggccggggatagtaacaccactaccatgca

SEQ ID NO: 85651 - DNA, 75 bp, Artificial Sequence
  Synthetic
gctgtaccagagatgtgtttggccggggatagtaacaccactaccatgcacaccagctatcaaaatgccaaccct

SEQ ID NO: 85652 - DNA, 75 bp, Artificial Sequence
  Synthetic
gtttgcagcggccctaaagcgatcatacttcactcagagtcaaggtgaaattcaatggatgaggccttccaaaga

SEQ ID NO: 85653 - DNA, 75 bp, Artificial Sequence
  Synthetic
aattggggaattgcaatattaccactggcccctttaaattttgccaatgaatcctcccccgagattccaatcact

SEQ ID NO: 85654 - DNA, 75 bp, Artificial Sequence
  Synthetic
ccctttaacttaagtgcaacaaaaaagaacactatggacatgtacagggtccagctaaatgacaacccacatacg

SEQ ID NO: 85655 - DNA, 75 bp, Artificial Sequence
  Synthetic
cacaggggttaggtcagatgcttgaaagcatgatcgacaacacagtccgtgaaacggtaggggcggcaccgtcta

SEQ ID NO: 85656 - DNA, 75 bp, Artificial Sequence
  Synthetic
gttatacaacacaggtcaaggtcagagtctagcattgagtcattctttgcacggggtgcatgcgtgaccattata

SEQ ID NO: 85657 - DNA, 75 bp, Artificial Sequence
  Synthetic
attggccatccggtgagtgttgcgtcaggtatacaactgtttgttggaatcactgtgttaactttactttttatc

SEQ ID NO: 85658 - DNA, 75 bp, Artificial Sequence
  Synthetic
ttggagcccacgaaaattcaaatagagcctatggcgggtccaccatcaattacaccacaatcaactactataggg

SEQ ID NO: 85659 - DNA, 75 bp, Artificial Sequence
  Synthetic
agcctatggcgggtccaccatcaattacaccacaatcaactactatagggactctgcaagtaatgctgcaagcaa

SEQ ID NO: 85660 - DNA, 75 bp, Artificial Sequence
  Synthetic
gaataaagcggtgtacactgcaggttacaaaatttgcaattaccacttggccactcaggaagatttgcaaaacgc

SEQ ID NO: 85661 - DNA, 75 bp, Artificial Sequence
  Synthetic
gtgacagttggttgaagaagttcactgaagcatgcaatgcggctaagggattggagtgggtgtcaaacaaaattt

SEQ ID NO: 85662 - DNA, 75 bp, Artificial Sequence
  Synthetic
aaagttactggtttcttacgcaccacccggggcggaggccccaaagagtcgcaaagaagcaatgcttgggacaca

SEQ ID NO: 85663 - DNA, 75 bp, Artificial Sequence
  Synthetic
caactacatacagttcaagagcaaacaccgtattgaaccagtatgtttgctagtgcatggcagccccggaacagg

SEQ ID NO: 85664 - DNA, 75 bp, Artificial Sequence
  Synthetic
ttagtgtgcgcctactgcgcgatacaacacacattagtcaagaggccatgccacaaggaattggtgatgtgattg

SEQ ID NO: 85665 - DNA, 75 bp, Artificial Sequence
  Synthetic
agtgtgtggtaaggcaattcaattaatggacaaatcttccagagttagatacagtgttgaccagatcaccacaat

SEQ ID NO: 85666 - DNA, 75 bp, Artificial Sequence
  Synthetic
cagtgttttacacctatggggcgcccccagcgagaatttcagtgccctatgttggaattgccaatgcatattccc

SEQ ID NO: 85667 - DNA, 75 bp, Artificial Sequence
  Synthetic
acaaagctgtgtacacggctggctataaaatttgcaactatcacctagctacacaagaagacttgcagaatgccg

SEQ ID NO: 85668 - DNA, 75 bp, Artificial Sequence
  Synthetic
gagattttggatgccaaagcgctcgaagaccaggcaggaaccaaccttgaaatcactataattactctacagaga

SEQ ID NO: 85669 - DNA, 75 bp, Artificial Sequence
  Synthetic
atcactgctggaggggagggcttagttgcattttcagacattagagacctgtatgcttatgaggaggaagctatg

SEQ ID NO: 85670 - DNA, 75 bp, Artificial Sequence
  Synthetic
gagcagggaatttctaattatattgagtcgcttggtgccgcatttggtagtgggttcactcaacaaattggtgac

SEQ ID NO: 85671 - DNA, 75 bp, Artificial Sequence
  Synthetic
attatgaggacactaccacagtgcttgccacccttgccctccttgggtgtgacatctcgccttggcagtggctca

SEQ ID NO: 85672 - DNA, 75 bp, Artificial Sequence
  Synthetic
aggcatgtaatgctgcaaaggggttggagtgggtctctaacaaaatttcaaagttcatagattggcttaaggaaa

SEQ ID NO: 85673 - DNA, 75 bp, Artificial Sequence
  Synthetic
tctctacgatccaccagtcatgtcccagtcaagaacaccaggaaatcttgtttaataatgtgaggtggctctcaa

SEQ ID NO: 85674 - DNA, 75 bp, Artificial Sequence
  Synthetic
cagtcaagaacaccaggaaatcttgtttaataatgtgaggtggctctcaattcaatccaagaggtttgctcctct

SEQ ID NO: 85675 - DNA, 75 bp, Artificial Sequence
  Synthetic
ccagtactgatggaagagaagctgttcgcctttgactacacgggttatgacgcatctctcagccctgcttggttc

SEQ ID NO: 85676 - DNA, 75 bp, Artificial Sequence
  Synthetic
ccgtattgaaccagtatgtctattagtacatggtagtccaggaacaggaaaatcagtggcaactaacctgattgc

SEQ ID NO: 85677 - DNA, 75 bp, Artificial Sequence
  Synthetic
acaacaaggagtggtaatcatggatgatctaaatcaaaatccggatggagctgatatgaagttattctgtcagat

SEQ ID NO: 85678 - DNA, 75 bp, Artificial Sequence
  Synthetic
gatctaaatcaaaatccggatggagctgatatgaagttattctgtcagatggtgtccacagtggagttcatccct

SEQ ID NO: 85679 - DNA, 75 bp, Artificial Sequence
  Synthetic
attaccccaccaacagtggcacatagtgacgctctggctagaaggtttgctttcgatatggacatccaagtaatg

SEQ ID NO: 85680 - DNA, 75 bp, Artificial Sequence
  Synthetic
gtgacgctctggctagaaggtttgctttcgatatggacatccaagtaatgagcgagtactccagagatgggaaac

SEQ ID NO: 85681 - DNA, 75 bp, Artificial Sequence
  Synthetic
tatgtggcaaggcaatccagttaatggataagtcttccagagttagatatagcattgatcaaatcactaccatga

SEQ ID NO: 85682 - DNA, 75 bp, Artificial Sequence
  Synthetic
ggataagtcttccagagttagatatagcattgatcaaatcactaccatgatcattaacgaaagaaacaggaggtc

SEQ ID NO: 85683 - DNA, 75 bp, Artificial Sequence
  Synthetic
tagcccccccccagagtgcatcaatgatctgttgcaagcagtagactctcaagaagtaagggattactgtgaaaa

SEQ ID NO: 85684 - DNA, 75 bp, Artificial Sequence
  Synthetic
gatctgttgcaagcagtagactctcaagaagtaagggattactgtgaaaagaagggatggatcgtcaacatcacc

SEQ ID NO: 85685 - DNA, 75 bp, Artificial Sequence
  Synthetic
gctggagttgtttatgtaatgtacaaactatttgctggccaccagggagcttacactggactcccaaacaagaaa

SEQ ID NO: 85686 - DNA, 75 bp, Artificial Sequence
  Synthetic
aactatttgctggccaccagggagcttacactggactcccaaacaagaaaccaaatgtgcctaccattaggactg

SEQ ID NO: 85687 - DNA, 75 bp, Artificial Sequence
  Synthetic
aaggagaattcacaatgctaggggtccacgacaacgtggcaatactacccacacatgcgtcaccaggggaaagta

SEQ ID NO: 85688 - DNA, 75 bp, Artificial Sequence
  Synthetic
acacatgcgtcaccaggggaaagtattgtgattgatggcaaggaagtggagatcttggacgccaaggctttggag

SEQ ID NO: 85689 - DNA, 75 bp, Artificial Sequence
  Synthetic
cacatccccactcaaatcactgaaacaaatgatggagtgttgattgtgaacactagtaagtaccccaacatgtat

SEQ ID NO: 85690 - DNA, 75 bp, Artificial Sequence
  Synthetic
caaggtcatcgggatgcatgttggagggaacggttcacacgggtttgcagcggccctgaaacgatcatacttcac

SEQ ID NO: 85691 - DNA, 75 bp, Artificial Sequence
  Synthetic
cggccctgaaacgatcatacttcactcagagtcaaggtgaaattcagtggatgaagccctcgaaggaagtgggtt

SEQ ID NO: 85692 - DNA, 75 bp, Artificial Sequence
  Synthetic
aacctgctgtactcaccaaaagtgatcccagattaaaaacagacttcgaagaggccattttctctaaatatgtag

SEQ ID NO: 85693 - DNA, 75 bp, Artificial Sequence
  Synthetic
tcccagattaaaaacagacttcgaagaggccattttctctaaatatgtaggaaataaaattactgaagtggatgt

SEQ ID NO: 85694 - DNA, 75 bp, Artificial Sequence
  Synthetic
gtatgcttatgaggaggaagctatggagcagggcatttccaactacattgagtcacttggtgctgcatttggtag

SEQ ID NO: 85695 - DNA, 75 bp, Artificial Sequence
  Synthetic
agaggatgcaatgtatggcacagatgggttagaggcattggacctttccaccagcgcaggatatccttatgttgc

SEQ ID NO: 85696 - DNA, 75 bp, Artificial Sequence
  Synthetic
gggttagaggcattggacctttccaccagcgcaggatatccttatgttgctatgggaaagaagaagagggacatt

SEQ ID NO: 85697 - DNA, 75 bp, Artificial Sequence
  Synthetic
acttatgtgaaagatgaacttaggtctaagataaaggtggaacagggcaagtccaggctaattgaagcttccagc

SEQ ID NO: 85698 - DNA, 75 bp, Artificial Sequence
  Synthetic
ctaagataaaggtggaacagggcaagtccaggctaattgaagcttccagcctcaatgattcagtagcaatgagga

SEQ ID NO: 85699 - DNA, 75 bp, Artificial Sequence
  Synthetic
cagatttattttggagtaagatcccagtgctaatggaagagaagctctttgcttttgactacactggatatgatg

SEQ ID NO: 85700 - DNA, 75 bp, Artificial Sequence
  Synthetic
acatagattacctaaatcactcacatcatctttacaagaacaaaacctactgtgtaaagggcggcatgccatctg

SEQ ID NO: 85701 - DNA, 75 bp, Artificial Sequence
  Synthetic
atccagtaatgccaatgaaggaaattcatgaatcaattagatggacaaaagatcctagaaacacccaggatcatg

SEQ ID NO: 85702 - DNA, 75 bp, Artificial Sequence
  Synthetic
aaactccccaaacattgaggcgtgtggttatagtgacagggtaatgcaactaactctgggcaactcaacgatcac

SEQ ID NO: 85703 - DNA, 75 bp, Artificial Sequence
  Synthetic
tacgctcattgtgcctattggcatggcacaacggtgaagaagaatataacaaatttttagctaaaataagaagcg

SEQ ID NO: 85704 - DNA, 75 bp, Artificial Sequence
  Synthetic
accccagaggcccacgtggcggctagtactccggtattgcggtacccttgtacgcctgttttatactccctcccc

SEQ ID NO: 85705 - DNA, 75 bp, Artificial Sequence
  Synthetic
tgcccgtagattctgcccagtggattacctctttggaaatggcacgttattggggaatgcctttgtattcccgca

SEQ ID NO: 85706 - DNA, 75 bp, Artificial Sequence
  Synthetic
aaggagaattcacaatgcttggcgttcatgacaatgtagctattttgccaacacacgcctcaccaggtgaaacaa

SEQ ID NO: 85707 - DNA, 75 bp, Artificial Sequence
  Synthetic
agtgctagatgctaaagcattagaagatcaggctggaaccaatttggaaattaccatagttacccttaagaggaa

SEQ ID NO: 85708 - DNA, 75 bp, Artificial Sequence
  Synthetic
cactagtaagtaccccaacatgtatgtccctgttggtgctgtgactgagcagggatatctcaatctcggtggacg

SEQ ID NO: 85709 - DNA, 75 bp, Artificial Sequence
  Synthetic
gtccctgttggtgctgtgactgagcagggatatctcaatctcggtggacgccaaaccgctcgtacactgatgtac

SEQ ID NO: 85710 - DNA, 75 bp, Artificial Sequence
  Synthetic
gggaacggttcacacgggtttgcagcggccctgaagcgatcttacttcacccagagtcaaggtgagatccagtgg

SEQ ID NO: 85711 - DNA, 75 bp, Artificial Sequence
  Synthetic
cggccctgaagcgatcttacttcacccagagtcaaggtgagatccagtggatgagaccatccaaagatgttggtt

SEQ ID NO: 85712 - DNA, 75 bp, Artificial Sequence
  Synthetic
aaccagcagtcttaactaaaaacgaccccaggctcaaggtagattttgaagatgcaatcttctctaagtatgtgg

SEQ ID NO: 85713 - DNA, 75 bp, Artificial Sequence
  Synthetic
ccccaggctcaaggtagattttgaagatgcaatcttctctaagtatgtgggcaacaagatcactgaagtggatga

SEQ ID NO: 85714 - DNA, 75 bp, Artificial Sequence
  Synthetic
agaggacgccatgtacggtactgatggtctggaagctcttgacctcacaaccagtgcagggtatccttatgtggc

SEQ ID NO: 85715 - DNA, 75 bp, Artificial Sequence
  Synthetic
ggtctggaagctcttgacctcacaaccagtgcagggtatccttatgtggccttagggaaaaagaaaagagatatc

SEQ ID NO: 85716 - DNA, 75 bp, Artificial Sequence
  Synthetic
acttatgtcaaggacgagctcagatccaaaagtaaagttgagcaaggaaagtccaggctcatcgaagcatctagt

SEQ ID NO: 85717 - DNA, 75 bp, Artificial Sequence
  Synthetic
ccaaaagtaaagttgagcaaggaaagtccaggctcatcgaagcatctagtctcaatgattcagtggcaatgagga

SEQ ID NO: 85718 - DNA, 75 bp, Artificial Sequence
  Synthetic
cagacctgttttggagtaagatcccagttctcatggaagagaagttgtttgcctttgattacaccgggtacgacg

SEQ ID NO: 85719 - DNA, 75 bp, Artificial Sequence
  Synthetic
cataggtcaaggtcagagtctagcatagagtctttcttcgcgcgaggtgcatgcgtagccattataaccgtggat

SEQ ID NO: 85720 - DNA, 75 bp, Artificial Sequence
  Synthetic
acattgactatcttaatcattcacaccacctgtacaaaaataaaacatactgtgtcaagggcggcatgccatctg

SEQ ID NO: 85721 - DNA, 75 bp, Artificial Sequence
  Synthetic
tcatgaatcaatcagatggacaaaggatcctaggaatacccaggatcacgttcgctccctatgcctattggcttg

SEQ ID NO: 85722 - DNA, 75 bp, Artificial Sequence
  Synthetic
aacacatcatttatctatttgttggatttactccaatcacccctaagacacttcagttgatacgtgtagtgttac

SEQ ID NO: 85723 - DNA, 75 bp, Artificial Sequence
  Synthetic
aactctccaaacattgaagcatgcggatatagtgacagagtcatgcaactcacccttggaaactccaccatcacc

SEQ ID NO: 85724 - DNA, 75 bp, Artificial Sequence
  Synthetic
actcaggaagcagccaattcagttgtagcatatggagtttggccctcctatctcaatgccaaggatgctaaccca

SEQ ID NO: 85725 - DNA, 75 bp, Artificial Sequence
  Synthetic
tccacgaactcaagcagaatttccccccccactgtggcgcacagtgatgcattagccaggcgctttgcgtttgac

SEQ ID NO: 85726 - DNA, 75 bp, Artificial Sequence
  Synthetic
gatgttacacaacccatattcattccaggtgaagtcaaaaatatgatggagttagcagaaattgacaccatgata

SEQ ID NO: 85727 - DNA, 75 bp, Artificial Sequence
  Synthetic
cagctatactatgctgggtgaaatcctgaattattacacccactgggcaggttccttaaagttttcgttcctctt

SEQ ID NO: 85728 - DNA, 75 bp, Artificial Sequence
  Synthetic
tgagaagaaaattagagatgttcacgtattccagatttgacattgaattcacctttgttgttacagaaaggtatt

SEQ ID NO: 85729 - DNA, 75 bp, Artificial Sequence
  Synthetic
gtattccagatttgacattgaattcacctttgttgttacagaaaggtattacaatagtaatgcaggttttgcttc

SEQ ID NO: 85730 - DNA, 75 bp, Artificial Sequence
  Synthetic
tcataaactaccacctagccactcccgaagactacaggcactgtgtaaagagcatgtgggagagagatcttatgg

SEQ ID NO: 85731 - DNA, 75 bp, Artificial Sequence
  Synthetic
tcttactgaaaacctacaagggcatagatttagaccacctaaaaatgattgcctatggtgatgatgtaattgctt

SEQ ID NO: 85732 - DNA, 75 bp, Artificial Sequence
  Synthetic
tggcagtggttttgcagcccctggggactgtggtggcatcatcagatgccaacacggtgtcatgggccttgtcac

SEQ ID NO: 85733 - DNA, 75 bp, Artificial Sequence
  Synthetic
gcctatggtgatgatgtaattgcttcctacccccatgaagttgacgctagtctcctagcccaatcaggaaaagac

SEQ ID NO: 85734 - DNA, 75 bp, Artificial Sequence
  Synthetic
atgtcatcaagcagggagactcctggttgaaaaaatttactgaggcttgtaacgcagcaaaaggattggaatggg

SEQ ID NO: 85735 - DNA, 75 bp, Artificial Sequence
  Synthetic
ctcccttccccgagtaactttagaagcaattcaacaagttcaatagagggggtgcaatccagcgccaccacaaca

SEQ ID NO: 85736 - DNA, 75 bp, Artificial Sequence
  Synthetic
gtacttcgagaagcctagtaccaccttggaatctccgacgcgttgcgctcagcactctaccccgagtgtagctta

SEQ ID NO: 85737 - DNA, 75 bp, Artificial Sequence
  Synthetic
gacccctggcacaggcaaatcagtggccacatcacttattgggagagcaattgcagaaaaagaaaacacctcagt

SEQ ID NO: 85738 - DNA, 75 bp, Artificial Sequence
  Synthetic
gtgaagagccgattgagctactcaagagtcctccggcccctgaatgcggctaatcccaaccacggagcaagtgcc

SEQ ID NO: 85739 - DNA, 75 bp, Artificial Sequence
  Synthetic
tttattccattactggctgcttatggtgacaatcatagattgttatcataaagcgacttggattggccatccggt

SEQ ID NO: 85740 - DNA, 75 bp, Artificial Sequence
  Synthetic
gtgacaatcatagattgttatcataaagcgacttggattggccatccggtgaaatataaacacattgtctacttg

SEQ ID NO: 85741 - DNA, 75 bp, Artificial Sequence
  Synthetic
tacaatgggtgcccaagtctcaacccagaaaactggtgcacacgagaatcaaaatatagcggctaatggatccac

SEQ ID NO: 85742 - DNA, 75 bp, Artificial Sequence
  Synthetic
tgtactgcaacccaaatgtgcaaggattgtccacaaccagctaactttaagagatgttgtcccttaatttgtgga

SEQ ID NO: 85743 - DNA, 75 bp, Artificial Sequence
  Synthetic
cagaaaactggtgcacacgagaatcaaaatatagcggctaatggatccactattaattacactaccattaattac

SEQ ID NO: 85744 - DNA, 75 bp, Artificial Sequence
  Synthetic
gaaaagaataggagagcgaatattggtaattgcatggaagctttgttccaaggaccattagtgtacaaagacctc

SEQ ID NO: 85745 - DNA, 75 bp, Artificial Sequence
  Synthetic
aaggatctcatgctgaagagcgcgcccgcgctcaactcgccaaatgtcgaagcctgtgggtacagtgacagagtg

SEQ ID NO: 85746 - DNA, 75 bp, Artificial Sequence
  Synthetic
ccgcgctcaactcgccaaatgtcgaagcctgtgggtacagtgacagagtgagacaaatcacactaggtaactcca

SEQ ID NO: 85747 - DNA, 75 bp, Artificial Sequence
  Synthetic
cgaatccagttgatgcacccactgaaccagacgttagtagtaacagattttacacgctagagtcggtgcaatggg

SEQ ID NO: 85748 - DNA, 75 bp, Artificial Sequence
  Synthetic
accagacgttagtagtaacagattttacacgctagagtcggtgcaatggggcaaggattccaaaggctggtggtg

SEQ ID NO: 85749 - DNA, 75 bp, Artificial Sequence
  Synthetic
gccatgaccattctccaggcactaaccacatttgctgcagtagcaggggtagtatacgtgatgtccaagctgttc

SEQ ID NO: 85750 - DNA, 75 bp, Artificial Sequence
  Synthetic
gtacacaatacacgtccaatgcaacgcttcgaaatttcaccaaggcactctgggcgtctttttgataccagagta

SEQ ID NO: 85751 - DNA, 75 bp, Artificial Sequence
  Synthetic
gcttcgaaatttcaccaaggcactctgggcgtctttttgataccagagtacgtaatggcatgcaacactgaaacc

SEQ ID NO: 85752 - DNA, 75 bp, Artificial Sequence
  Synthetic
accactgacactgcacagggccgcagttttgctgcattagactatttacttgggtgtggagttctagctgggaat

SEQ ID NO: 85753 - DNA, 75 bp, Artificial Sequence
  Synthetic
gatggcaaagaaactgaggtagttgatgccaaagctcttgaagatcaggctggcacaaacctagaaatcactatt

SEQ ID NO: 85754 - DNA, 75 bp, Artificial Sequence
  Synthetic
gttttgctgcattagactatttacttgggtgtggagttctagctgggaatgccttgtttttaccaccatcgcata

SEQ ID NO: 85755 - DNA, 75 bp, Artificial Sequence
  Synthetic
ggagtgttgatcgtgaacactagtaagtaccccaacatgtacgtgcccgtcggtgcagtgaccgagcaagggtac

SEQ ID NO: 85756 - DNA, 75 bp, Artificial Sequence
  Synthetic
gcatggcaaaacacaataattggggtctggtgatcctgcccctagttcccttagattatgccccgactgcctcca

SEQ ID NO: 85757 - DNA, 75 bp, Artificial Sequence
  Synthetic
tctggtgatcctgcccctagttcccttagattatgccccgactgcctccactcaaatcccaataaccgtcacaat

SEQ ID NO: 85758 - DNA, 75 bp, Artificial Sequence
  Synthetic
tacgcccgggtctaatcagttcttaacttctgatgacttccaatccccttgtgcactacccaacttcgacgtaac

SEQ ID NO: 85759 - DNA, 75 bp, Artificial Sequence
  Synthetic
acttctgatgacttccaatccccttgtgcactacccaacttcgacgtaactcccccaattcatattccgggtgag

SEQ ID NO: 85760 - DNA, 75 bp, Artificial Sequence
  Synthetic
atggagatgtaccgcatccccgtcaatgaccagggaggcaccacacccattttctgtatttcactctcccctgcc

SEQ ID NO: 85761 - DNA, 75 bp, Artificial Sequence
  Synthetic
atgaccagggaggcaccacacccattttctgtatttcactctcccctgcctcagaaccacggctttcacacacca

SEQ ID NO: 85762 - DNA, 75 bp, Artificial Sequence
  Synthetic
tgatggccactgggaagctactattaagttactctccccctggtgctgcccccccaaaggatcgtaaagacgcaa

SEQ ID NO: 85763 - DNA, 75 bp, Artificial Sequence
  Synthetic
aagttactctccccctggtgctgcccccccaaaggatcgtaaagacgcaatgcttggcacccacgtcatctggga

SEQ ID NO: 85764 - DNA, 75 bp, Artificial Sequence
  Synthetic
tgacttcacggaagggggttacattacttgtttttaccaaactcgcatcgtggtaccggctgcaacacccaccag

SEQ ID NO: 85765 - DNA, 75 bp, Artificial Sequence
  Synthetic
acttgtttttaccaaactcgcatcgtggtaccggctgcaacacccaccagtatgtcaatactgagtttcgtcagc

SEQ ID NO: 85766 - DNA, 75 bp, Artificial Sequence
  Synthetic
cagggtattgaagacatcattgacaaagttgcagcaaatgccctgtccctgtcactaccaagtgtggctcagtcc

SEQ ID NO: 85767 - DNA, 75 bp, Artificial Sequence
  Synthetic
aagttgcagcaaatgccctgtccctgtcactaccaagtgtggctcagtccacacaagccaccagcggagttaact

SEQ ID NO: 85768 - DNA, 75 bp, Artificial Sequence
  Synthetic
ccagacatgttataaactacaaaactcgatcggagtcgtgcttggaatcgtttttcggacgagcggcatgtgttg

SEQ ID NO: 85769 - DNA, 75 bp, Artificial Sequence
  Synthetic
tcgatcggagtcgtgcttggaatcgtttttcggacgagcggcatgtgttgccatcctagaagtgactaattcagc

SEQ ID NO: 85770 - DNA, 75 bp, Artificial Sequence
  Synthetic
gctggagtttttcacatactctcgatttgacctagaaatgacatttgttttcaccgaaaactatccaagcactag

SEQ ID NO: 85771 - DNA, 75 bp, Artificial Sequence
  Synthetic
tttgacctagaaatgacatttgttttcaccgaaaactatccaagcactagtagtggtgaggttagaaatcaggtt

SEQ ID NO: 85772 - DNA, 75 bp, Artificial Sequence
  Synthetic
aacccatcaatattctacacatatggaaatgccccgcctcgcatgtcaataccctatgtgggcattgccaatgct

SEQ ID NO: 85773 - DNA, 75 bp, Artificial Sequence
  Synthetic
gaaatgccccgcctcgcatgtcaataccctatgtgggcattgccaatgcttactcccacttctacgatggtttcg

SEQ ID NO: 85774 - DNA, 75 bp, Artificial Sequence
  Synthetic
gagtcctggcaataagagcggtgaaccgcagcagcccatccactatacacacgtccattagagtgtacatgaaac

SEQ ID NO: 85775 - DNA, 75 bp, Artificial Sequence
  Synthetic
ccgcagcagcccatccactatacacacgtccattagagtgtacatgaaacccaaacacattaagtgttggtgccc

SEQ ID NO: 85776 - DNA, 75 bp, Artificial Sequence
  Synthetic
agtggcctcaatcaccaccttcggttttggacaccaaaacaaagcagtatacgtagccggttacaagatttgcaa

SEQ ID NO: 85777 - DNA, 75 bp, Artificial Sequence
  Synthetic
tttggacaccaaaacaaagcagtatacgtagccggttacaagatttgcaattatcacctagctacaccagaggac

SEQ ID NO: 85778 - DNA, 75 bp, Artificial Sequence
  Synthetic
attgccaggtgcaactgcagatgtggagtgtattactgtgaatcaaaaaggaagtattatcctgtcacattcact

SEQ ID NO: 85779 - DNA, 75 bp, Artificial Sequence
  Synthetic
gagtgtattactgtgaatcaaaaaggaagtattatcctgtcacattcactgggcccacgtttcagtacatggagg

SEQ ID NO: 85780 - DNA, 75 bp, Artificial Sequence
  Synthetic
gaggtattctgcgatgcaaccacggagttattggtgtgatcaccgcgggcggtgatggagtggttgcgttcgccg

SEQ ID NO: 85781 - DNA, 75 bp, Artificial Sequence
  Synthetic
agttattggtgtgatcaccgcgggcggtgatggagtggttgcgttcgccgacattagagatctgtgggtgtacga

SEQ ID NO: 85782 - DNA, 75 bp, Artificial Sequence
  Synthetic
atcaatcggagaaaaaatctcagaaattacgtcaatgatcaccagtaccataacagaaaagctgttgaagaattt

SEQ ID NO: 85783 - DNA, 75 bp, Artificial Sequence
  Synthetic
attacgtcaatgatcaccagtaccataacagaaaagctgttgaagaatttggtgaaaatagtgtctgcactagtg

SEQ ID NO: 85784 - DNA, 75 bp, Artificial Sequence
  Synthetic
tggcagtggctcaagaagaaaacttgtgatctgctagaaatcccacacatcatgcgccaaggggacagctggatg

SEQ ID NO: 85785 - DNA, 75 bp, Artificial Sequence
  Synthetic
gtgatctgctagaaatcccacacatcatgcgccaaggggacagctggatgaagaaattcacagaagcttgtaatg

SEQ ID NO: 85786 - DNA, 75 bp, Artificial Sequence
  Synthetic
aagccagggataaggtggaatttctttccaagctaaaacaactggacttgttggagaaccaaatttccaccatac

SEQ ID NO: 85787 - DNA, 75 bp, Artificial Sequence
  Synthetic
ttccaagctaaaacaactggacttgttggagaaccaaatttccaccatacatcagtcttgcccgagccaagaaca

SEQ ID NO: 85788 - DNA, 75 bp, Artificial Sequence
  Synthetic
ggcccgggggataaaaaaattggaaaacaccatcaacaattacatacagttcaagagcaaacaccgtattgaacc

SEQ ID NO: 85789 - DNA, 75 bp, Artificial Sequence
  Synthetic
aacaccatcaacaattacatacagttcaagagcaaacaccgtattgaaccagtatgtatgctcattcatggatca

SEQ ID NO: 85790 - DNA, 75 bp, Artificial Sequence
  Synthetic
tcactccctccagatccatcacatttcgatggatacaaacaacagggggttgtaatcatggatgatctcaaccaa

SEQ ID NO: 85791 - DNA, 75 bp, Artificial Sequence
  Synthetic
tcgatggatacaaacaacagggggttgtaatcatggatgatctcaaccaaaaccccgacgggatggacatgaaat

SEQ ID NO: 85792 - DNA, 75 bp, Artificial Sequence
  Synthetic
catctgactacgtgctcgcctccactaactcacattccataacaccccccaccgtcgctcacagtgatgccttgt

SEQ ID NO: 85793 - DNA, 75 bp, Artificial Sequence
  Synthetic
taactcacattccataacaccccccaccgtcgctcacagtgatgccttgtcccgtcgcttcgcttttgatatgga

SEQ ID NO: 85794 - DNA, 75 bp, Artificial Sequence
  Synthetic
tccaactccagcaaacttcaagaaatgctgtcccctaatatgtggcaaagccatacaattaatggataaacacac

SEQ ID NO: 85795 - DNA, 75 bp, Artificial Sequence
  Synthetic
tgctgtcccctaatatgtggcaaagccatacaattaatggataaacacaccagacaaaggttcactttagatgaa

SEQ ID NO: 85796 - DNA, 75 bp, Artificial Sequence
  Synthetic
tattgaatgtttatggtgacaattgtttgattcagttgttaccatttaccacattcattaacctagagtcaaacc

SEQ ID NO: 85797 - DNA, 75 bp, Artificial Sequence
  Synthetic
ccactacagtacagggacctaaaaatagacatcaaaacaacacctccaccagaatgtataagtgacctactgcaa

SEQ ID NO: 85798 - DNA, 75 bp, Artificial Sequence
  Synthetic
tagacatcaaaacaacacctccaccagaatgtataagtgacctactgcaagcagttgattcacaagaagtcagag

SEQ ID NO: 85799 - DNA, 75 bp, Artificial Sequence
  Synthetic
tcacgagaactccaatagtgctagtggaggctcaaccattaactataccaccataaactattacaaggacagtgc

SEQ ID NO: 85800 - DNA, 75 bp, Artificial Sequence
  Synthetic
tgacaattctacaagccatcactacattcgctgcagtggcaggagtagtgtacgtaatatataagctgtttgcag

SEQ ID NO: 85801 - DNA, 75 bp, Artificial Sequence
  Synthetic
attcgctgcagtggcaggagtagtgtacgtaatatataagctgtttgcaggataccagggagcttacactgggct

SEQ ID NO: 85802 - DNA, 75 bp, Artificial Sequence
  Synthetic
gatggctaagagaaatatccttactgcaaccactagtaaaggagaattcacaatgcttggtgtgcacgataatgt

SEQ ID NO: 85803 - DNA, 75 bp, Artificial Sequence
  Synthetic
ccaggggagacaatagtcatcgatggcaaggaagtggaggtcttggacgccaaggcactagaggatctagctggc

SEQ ID NO: 85804 - DNA, 75 bp, Artificial Sequence
  Synthetic
caaatcactgagacaaatgatggagtcttgatcgtgaacactagtaagtaccctaacatgtatgttcctgttggt

SEQ ID NO: 85805 - DNA, 75 bp, Artificial Sequence
  Synthetic
atcccagagtttatgatggccagtaactcagcagataggactggtggtatcacctatgaaaaggccaaccccggt

SEQ ID NO: 85806 - DNA, 75 bp, Artificial Sequence
  Synthetic
ccctaacatgtatgttcctgttggtgctgtgaccgaacagggatacctcaatctcggtgggcgccaaaccgctcg

SEQ ID NO: 85807 - DNA, 75 bp, Artificial Sequence
  Synthetic
gatgcatgttggagggaacggttcgcatgggtttgcagcagccctgaaacggtcatacttcactcaaagtcaagg

SEQ ID NO: 85808 - DNA, 75 bp, Artificial Sequence
  Synthetic
catgggtttgcagcagccctgaaacggtcatacttcactcaaagtcaaggtgaaattcagtggatgagaccatca

SEQ ID NO: 85809 - DNA, 75 bp, Artificial Sequence
  Synthetic
gaaggtgtgaaagaaccagcggtactcaccaagaacgaccccagattgaaaacagacttcgaagaagctatcttc

SEQ ID NO: 85810 - DNA, 75 bp, Artificial Sequence
  Synthetic
tcaccaagaacgaccccagattgaaaacagacttcgaagaagctatcttctctaaatatgtggggaacaagatta

SEQ ID NO: 85811 - DNA, 75 bp, Artificial Sequence
  Synthetic
cgtcttgcagggactaccagtgttgaatacaccgggttctaaccaatttcttaccacagacaactttcagtcccc

SEQ ID NO: 85812 - DNA, 75 bp, Artificial Sequence
  Synthetic
aacagatgtgtctcgaagatgcaatgtatggcactgatggccttgaggctctagatctcagcaccagtgcgggct

SEQ ID NO: 85813 - DNA, 75 bp, Artificial Sequence
  Synthetic
acggctccaatccacatacctggcgaagtgcacaatatgatggaactagcagaaattgatagtgtcatacctatg

SEQ ID NO: 85814 - DNA, 75 bp, Artificial Sequence
  Synthetic
gtatggcactgatggccttgaggctctagatctcagcaccagtgcgggctatccctatgttgccatgggcaagaa

SEQ ID NO: 85815 - DNA, 75 bp, Artificial Sequence
  Synthetic
caagcaatatttgccttaagcctgagcccggcctcagataaaaggctgtcacgcacgcttttgggcgagattctg

SEQ ID NO: 85816 - DNA, 75 bp, Artificial Sequence
  Synthetic
tctaccattggtcacgtatgtgaaagatgaacttaggtccaagactaaagtggagcaaggtaaatccagattgat

SEQ ID NO: 85817 - DNA, 75 bp, Artificial Sequence
  Synthetic
gatgaacttaggtccaagactaaagtggagcaaggtaaatccagattgatcgaagcatcaagccttaatgattct

SEQ ID NO: 85818 - DNA, 75 bp, Artificial Sequence
  Synthetic
gttggatgtgacccagacttattctggagtaagataccagtgttgatggaggagaaactctttgcatttgactac

SEQ ID NO: 85819 - DNA, 75 bp, Artificial Sequence
  Synthetic
ggagtaagataccagtgttgatggaggagaaactctttgcatttgactacacagggtatgatgcctctctcagtc

SEQ ID NO: 85820 - DNA, 75 bp, Artificial Sequence
  Synthetic
ctccaatactgactatcggcgcagcgccaaggatgactttaccgagggaggatacatcactgcgttttaccaaac

SEQ ID NO: 85821 - DNA, 75 bp, Artificial Sequence
  Synthetic
tgaaccactcacaccacctttacaaaaacaaaacttactgtgtcaagggcggcatgccatctggttgctctggca

SEQ ID NO: 85822 - DNA, 75 bp, Artificial Sequence
  Synthetic
aaacaaaacttactgtgtcaagggcggcatgccatctggttgctctggcacttcagtattcaactcaatgattaa

SEQ ID NO: 85823 - DNA, 75 bp, Artificial Sequence
  Synthetic
gacccgacatgtgataaacaaaagacaaagatcagagtgtactgtggagtccttcttgggaagggctgcgttggt

SEQ ID NO: 85824 - DNA, 75 bp, Artificial Sequence
  Synthetic
tagatggaccaaagatcctagaaacacccaggatcacgttcgctcattgtgtctattggcttggcacaatggaga

SEQ ID NO: 85825 - DNA, 75 bp, Artificial Sequence
  Synthetic
gtctccccggtgaagttgcatagactgtaaccacggttaaaagcgattgatccgttatccgctcatgtacttcga

SEQ ID NO: 85826 - DNA, 75 bp, Artificial Sequence
  Synthetic
agcgctggagcaacaaacaagtacggttacaacaccattaatgactttgggaccgtggctgtacgtattgtgaat

SEQ ID NO: 85827 - DNA, 75 bp, Artificial Sequence
  Synthetic
caaacatgtgagagtgtggtgccctaggccaccgagagctgtggagtacactggaccatcggttgactacaaaca

SEQ ID NO: 85828 - DNA, 75 bp, Artificial Sequence
  Synthetic
aacatgcagtagccgtgatgtgggaccgagaccttatggtggtggaaagccgggctcagggaattgacactattg

SEQ ID NO: 85829 - DNA, 75 bp, Artificial Sequence
  Synthetic
tgggtgtccgtgtttcctttatttcttataatggctgcttatggtgacaatcatagattgttatcataaagcgaa

SEQ ID NO: 85830 - DNA, 75 bp, Artificial Sequence
  Synthetic
ttggattggccatccagtgaaagtcagactgattatccttctgtttgttgggtttgttccactcaattcacacac

SEQ ID NO: 85831 - DNA, 75 bp, Artificial Sequence
  Synthetic
tcggtgctcatgaaaataccaacattgccactggtgggtcgactgtgaattatacgacaatcaattactacaagg

SEQ ID NO: 85832 - DNA, 75 bp, Artificial Sequence
  Synthetic
tgccactggtgggtcgactgtgaattatacgacaatcaattactacaaggactcagctagtaatgcagcctctaa

SEQ ID NO: 85833 - DNA, 75 bp, Artificial Sequence
  Synthetic
aaggggttgttgcatttgcggacgtgagagatctgtttgcatatgaagaagaggtcatggaacagggcatcactg

SEQ ID NO: 85834 - DNA, 75 bp, Artificial Sequence
  Synthetic
aaattccccaaacattgaggcgtgtgggtacagtgaccgagtgatgcagctcacattgggaaattccaccataac

SEQ ID NO: 85835 - DNA, 75 bp, Artificial Sequence
  Synthetic
atctgaacgacaaagaagcaaatccagtagaccaacccaccgaaccggatgttgctgcatgtcggttctatacat

SEQ ID NO: 85836 - DNA, 75 bp, Artificial Sequence
  Synthetic
tatttggccagaacatgttttaccattaccttgggcgcagtggatataccgtccatgtccagtgcaacgcctcca

SEQ ID NO: 85837 - DNA, 75 bp, Artificial Sequence
  Synthetic
ttaccttgggcgcagtggatataccgtccatgtccagtgcaacgcctccaagtttcaccaaggaaccttgggggt

SEQ ID NO: 85838 - DNA, 75 bp, Artificial Sequence
  Synthetic
tccaggtgaaagtgggggtgtgtttgtagataagtttacagctagtgccaagacaaaccccacacgtaaattttg

SEQ ID NO: 85839 - DNA, 75 bp, Artificial Sequence
  Synthetic
gtagataagtttacagctagtgccaagacaaaccccacacgtaaattttgcgcagtggattacctactggggtgt

SEQ ID NO: 85840 - DNA, 75 bp, Artificial Sequence
  Synthetic
gtgttgccatatgtgaattcactggccatcgacagcatgaccaaacacaataactggggaattgcaatcttaccg

SEQ ID NO: 85841 - DNA, 75 bp, Artificial Sequence
  Synthetic
caagcaaacactagcacctattctctccccccagacccttctcactttgacggatataaacaacaaggggtcgtg

SEQ ID NO: 85842 - DNA, 75 bp, Artificial Sequence
  Synthetic
ccatcgacagcatgaccaaacacaataactggggaattgcaatcttaccgctctcaaaacttgactttgcctcag

SEQ ID NO: 85843 - DNA, 75 bp, Artificial Sequence
  Synthetic
cggatataaacaacaaggggtcgtgattatggatgacctcaatcaaaacccagacggggaggatatgaaactttt

SEQ ID NO: 85844 - DNA, 75 bp, Artificial Sequence
  Synthetic
ccatacctgcaacccaaggcctgccggtgatgaacacacccggtagtaatcagtacctgacatctgacaatttcc

SEQ ID NO: 85845 - DNA, 75 bp, Artificial Sequence
  Synthetic
aggttgcagagattgacaccatgattccacttgatctctcagcaacaaagagaaacacaatggacatgtacaggg

SEQ ID NO: 85846 - DNA, 75 bp, Artificial Sequence
  Synthetic
gactatctcatactatgctgggggagattttaaactactacacacattgggctgggtccctgaagttctcctttt

SEQ ID NO: 85847 - DNA, 75 bp, Artificial Sequence
  Synthetic
tggtaaaatactggtctcatatgcaccaccgggggcgcaacctccaacaactcgaaaagatgcaatgcttgggac

SEQ ID NO: 85848 - DNA, 75 bp, Artificial Sequence
  Synthetic
cataaagacaacacctccaccgcccgctatagcggatttgcttcgatctgttgatagcgatcaggtgcgagagta

SEQ ID NO: 85849 - DNA, 75 bp, Artificial Sequence
  Synthetic
gcgaactgtgaaggacgactttaccgaaggtggatacataagcatgttctaccagacaaaaatagttgtaccagc

SEQ ID NO: 85850 - DNA, 75 bp, Artificial Sequence
  Synthetic
gacaattgtgcaggccgtttcttcctttgtggttgtctctggcatgttgttcattatttacaagttgtttgccaa

SEQ ID NO: 85851 - DNA, 75 bp, Artificial Sequence
  Synthetic
acagcagtggaaacaggggctacaaaccccttggaaccgtcagacacagtgcaaacgagacatgtcattcaaacc

SEQ ID NO: 85852 - DNA, 75 bp, Artificial Sequence
  Synthetic
gaaggaagtgaaagtcaaagacgccaggcgacttgtggacaccaacgatgtgaacctagaaataaccattgttga

SEQ ID NO: 85853 - DNA, 75 bp, Artificial Sequence
  Synthetic
accccttggaaccgtcagacacagtgcaaacgagacatgtcattcaaaccaggtcgaggtctgaatccacagtgg

SEQ ID NO: 85854 - DNA, 75 bp, Artificial Sequence
  Synthetic
aaaagaaattatttgccacttggaacattacgtacactgacactgtacaactcagacgcaaattagaaatgttta

SEQ ID NO: 85855 - DNA, 75 bp, Artificial Sequence
  Synthetic
ctcagacgcaaattagaaatgtttacttactccaggtttgacattgaattcacttttgtgaccacagaaaggtac

SEQ ID NO: 85856 - DNA, 75 bp, Artificial Sequence
  Synthetic
cagcggtgggatgattacacgtggcaaacttcctccaatccatcagtgttttacacctatggcgatgccccggca

SEQ ID NO: 85857 - DNA, 75 bp, Artificial Sequence
  Synthetic
aaacttcctccaatccatcagtgttttacacctatggcgatgccccggcacgaatctccataccattcgtgggta

SEQ ID NO: 85858 - DNA, 75 bp, Artificial Sequence
  Synthetic
ctgcttattacggagcaacatcaataaatgacttcggtttgcttgctgttagagtggtaaacgaatacaacccag

SEQ ID NO: 85859 - DNA, 75 bp, Artificial Sequence
  Synthetic
ccagaatcacctccaaagtcagagtttatatgaaacccaaacatgtgagagtttggtgtcctaggccaccaagag

SEQ ID NO: 85860 - DNA, 75 bp, Artificial Sequence
  Synthetic
acgggtttggacatcaaaacaaggcagtgtacactgcaggcttcaaaatttgtaattaccatcttgccacacagg

SEQ ID NO: 85861 - DNA, 75 bp, Artificial Sequence
  Synthetic
agtgtacactgcaggcttcaaaatttgtaattaccatcttgccacacaggaggaccttcaaaatgcagtaagtgt

SEQ ID NO: 85862 - DNA, 75 bp, Artificial Sequence
  Synthetic
cactggggtgtactactgtgagtccaaacggaagtattaccccgtctcttttattggcccaactttccagtacat

SEQ ID NO: 85863 - DNA, 75 bp, Artificial Sequence
  Synthetic
cagaactcaccagcatggtcaccagcacaattacagagaaattgctgaagaacttaataaaaattatctcatctc

SEQ ID NO: 85864 - DNA, 75 bp, Artificial Sequence
  Synthetic
ccccatggcagtggctcaagaagaaggcttgtgacattctagaaatcccatacgttatgcggcaaggtgacggct

SEQ ID NO: 85865 - DNA, 75 bp, Artificial Sequence
  Synthetic
cgttggactaaagacccaaagaatacacaagatcacgtgcgatctctatgtttgctggcttggcacaatggggct

SEQ ID NO: 85866 - DNA, 75 bp, Artificial Sequence
  Synthetic
tttgtcaccaagctgaaacaacttgagatgctagagaaccaaattgcgaccattcaccagtcgtgtcctagccaa

SEQ ID NO: 85867 - DNA, 75 bp, Artificial Sequence
  Synthetic
acagttcaagagcaaacaccgtattgaaccagtatgtttattagtgcatggcagtcctggaacaggtaaatcagt

SEQ ID NO: 85868 - DNA, 75 bp, Artificial Sequence
  Synthetic
atcagaatcccgatggagctgacatgaaactcttttgtcagatggtttctacagtagagtttattccaccaatgg

SEQ ID NO: 85869 - DNA, 75 bp, Artificial Sequence
  Synthetic
tggagttttgatcgtgaacactagtaagtaccccaatatgtatgtccccgttggtgctgtgaccgaacagggata

SEQ ID NO: 85870 - DNA, 75 bp, Artificial Sequence
  Synthetic
atcgggatgcatgtcggtgggaacggttcacatgggtttgcagcagccctaaagcgatcatacttcacacagagt

SEQ ID NO: 85871 - DNA, 75 bp, Artificial Sequence
  Synthetic
ttagaacccagtgctttccattatgtatttgaaggagtcaaggagccggctgtgttgaccaggaacgaccctaga

SEQ ID NO: 85872 - DNA, 75 bp, Artificial Sequence
  Synthetic
tatttgaaggagtcaaggagccggctgtgttgaccaggaacgaccctagattgaaaactgactttgaagaggcta

SEQ ID NO: 85873 - DNA, 75 bp, Artificial Sequence
  Synthetic
gacagctcatgtctctggacataaatacagaacaaatgtgtcttgaagacgccatgtatgggactgatggattgg

SEQ ID NO: 85874 - DNA, 75 bp, Artificial Sequence
  Synthetic
tacagaacaaatgtgtcttgaagacgccatgtatgggactgatggattggaagctcttgatcttagcaccagtgc

SEQ ID NO: 85875 - DNA, 75 bp, Artificial Sequence
  Synthetic
gcagagacttttagatacttatggcattaatttacctctagtcacctatgtcaaagatgagcttagatccaaaac

SEQ ID NO: 85876 - DNA, 75 bp, Artificial Sequence
  Synthetic
attaatttacctctagtcacctatgtcaaagatgagcttagatccaaaaccaaagtagagcagggcaaatccagg

SEQ ID NO: 85877 - DNA, 75 bp, Artificial Sequence
  Synthetic
aagaatccaggtgtggtgacaggttcggctgtcggttgtgatccagatctgttctggagcaagataccagtattg

SEQ ID NO: 85878 - DNA, 75 bp, Artificial Sequence
  Synthetic
aagatggtgttggaaaaaattgggtttggagatagagtagactacattgattatctgaatcactcacaccacctt

SEQ ID NO: 85879 - DNA, 75 bp, Artificial Sequence
  Synthetic
ttggagatagagtagactacattgattatctgaatcactcacaccacctttacaaaaacaagacatactgtgtca

SEQ ID NO: 85880 - DNA, 75 bp, Artificial Sequence
  Synthetic
tctcctagcccaatcaggaaaagactatggattaaccatgactccagctgataagtcagcaacttttgaaagagt

SEQ ID NO: 85881 - DNA, 75 bp, Artificial Sequence
  Synthetic
aatgccaatgaaggagattcatgaatcaatcagatggacaaaggatcctagaaacacacaggatcatgttcgttc

SEQ ID NO: 85882 - DNA, 75 bp, Artificial Sequence
  Synthetic
tacgcctgttttatactcccttcccccgtaacttaaaagctacaaatccaagttcaatagaagggggtacaagcc

SEQ ID NO: 85883 - DNA, 75 bp, Artificial Sequence
  Synthetic
tacgcctgttttatactcccttcccccgtaacttataagctacaaatccaagttcaatagaagggggtacaagcc

SEQ ID NO: 85884 - DNA, 75 bp, Artificial Sequence
  Synthetic
tacgcctgttttatactcccttcccccgtaacttacaagctacaaatccaagttcaatagaagggggtacaagcc

SEQ ID NO: 85885 - DNA, 75 bp, Artificial Sequence
  Synthetic
tacgcctgttttatactcccttcccccgtaacttagaagctacaaatccaagttcaatagaagggggtacaagcc

SEQ ID NO: 85886 - DNA, 75 bp, Artificial Sequence
  Synthetic
ttataatggctgcttatggtgacaatcacagattgttatcataaagcgaattggattggccatccggtgaaagtt

SEQ ID NO: 85887 - DNA, 75 bp, Artificial Sequence
  Synthetic
ttataatggctgcttatggtgacaatcacagattgttttcataaagcgaattggattggccatccggtgaaagtt

SEQ ID NO: 85888 - DNA, 75 bp, Artificial Sequence
  Synthetic
ttataatggctgcttatggtgacaatcacagattgttctcataaagcgaattggattggccatccggtgaaagtt

SEQ ID NO: 85889 - DNA, 75 bp, Artificial Sequence
  Synthetic
ttataatggctgcttatggtgacaatcacagattgttgtcataaagcgaattggattggccatccggtgaaagtt

SEQ ID NO: 85890 - DNA, 75 bp, Artificial Sequence
  Synthetic
atcatcacaatgggtgcacaagtttcatcacagaaggtcggtgctcatgaaaataccaacattgctaccggcgga

SEQ ID NO: 85891 - DNA, 75 bp, Artificial Sequence
  Synthetic
catcacagaaggtcggtgctcatgaaaataccaacattgctaccggcggatcaactgtgaattacacgacaatca

SEQ ID NO: 85892 - DNA, 75 bp, Artificial Sequence
  Synthetic
cagttaaagacatcatgttgaagtcagcccccgccctaaactccccaaacattgaggcgtgtggatacagcgatc

SEQ ID NO: 85893 - DNA, 75 bp, Artificial Sequence
  Synthetic
agcccccgccctaaactccccaaacattgaggcgtgtggatacagcgatcgagtgatgcagcttacgctaggaaa

SEQ ID NO: 85894 - DNA, 75 bp, Artificial Sequence
  Synthetic
agaagcaaatccagtggatcaacctaccgaaccggatgttgctgcatgccggttttatacactagactcagttat

SEQ ID NO: 85895 - DNA, 75 bp, Artificial Sequence
  Synthetic
accgaaccggatgttgctgcatgccggttttatacactagactcagttatgtggagtaaagagtccagaggctgg

SEQ ID NO: 85896 - DNA, 75 bp, Artificial Sequence
  Synthetic
agtggttacactgtccatgtccagtgcaatgcctccaagtttcatcaagggactttgggggtgttcgccattcct

SEQ ID NO: 85897 - DNA, 75 bp, Artificial Sequence
  Synthetic
gcaatgcctccaagtttcatcaagggactttgggggtgttcgccattcctgaatactgtttagcaggagataccg

SEQ ID NO: 85898 - DNA, 75 bp, Artificial Sequence
  Synthetic
cggccagtgctcaagcaaaccccacgcgcaaattctgtgcagtggactatctgctggggtgtggggttcttgcag

SEQ ID NO: 85899 - DNA, 75 bp, Artificial Sequence
  Synthetic
gcgcaaattctgtgcagtggactatctgctggggtgtggggttcttgcaggtaatgcatttgtattcccacatca

SEQ ID NO: 85900 - DNA, 75 bp, Artificial Sequence
  Synthetic
gaccaaacacaataactgggggattgtaatcctaccactttcaaaacttgactttgccccagacgcctcagtgga

SEQ ID NO: 85901 - DNA, 75 bp, Artificial Sequence
  Synthetic
gtaatcctaccactttcaaaacttgactttgccccagacgcctcagtggagttgcctatcaccgtgaccattgca

SEQ ID NO: 85902 - DNA, 75 bp, Artificial Sequence
  Synthetic
cctggtagcaaccagtatttaacatctgacaacttccagtcaccatgcgcactgccagagtttgacgtcacacag

SEQ ID NO: 85903 - DNA, 75 bp, Artificial Sequence
  Synthetic
ctgacaacttccagtcaccatgcgcactgccagagtttgacgtcacacagccaatagatattccaggtgaagtca

SEQ ID NO: 85904 - DNA, 75 bp, Artificial Sequence
  Synthetic
aaatgtacagggtacagttgcaggcatcccctagtaatcttgacgctccaattttgtgtctatccttgtctccag

SEQ ID NO: 85905 - DNA, 75 bp, Artificial Sequence
  Synthetic
atcccctagtaatcttgacgctccaattttgtgtctatccttgtctccagctagtgatccaagattggcatttac

SEQ ID NO: 85906 - DNA, 75 bp, Artificial Sequence
  Synthetic
catgatggctaccggcaaaatactggtctcatatgctccaccaggggcacaacccccgaagacccggaaagatgc

SEQ ID NO: 85907 - DNA, 75 bp, Artificial Sequence
  Synthetic
gtctcatatgctccaccaggggcacaacccccgaagacccggaaagatgcgatgctcggtacacatttaatttgg

SEQ ID NO: 85908 - DNA, 75 bp, Artificial Sequence
  Synthetic
gatgattttaccgagggtgggtacataagcatgttttatcaaacaaaaatagttgtaccagcatccacccccact

SEQ ID NO: 85909 - DNA, 75 bp, Artificial Sequence
  Synthetic
taagcatgttttatcaaacaaaaatagttgtaccagcatccacccccactagtatggacatcttgggctttgtgt

SEQ ID NO: 85910 - DNA, 75 bp, Artificial Sequence
  Synthetic
atcaacgatagtttcacagaaggtggctacattagcatgttttatcaaactagggttgttgtcccgttgtccaca

SEQ ID NO: 85911 - DNA, 75 bp, Artificial Sequence
  Synthetic
tcgaggatatcatacaacaagtggccaccaacgcgctccaaatctcacaaccagcgcgcccggcattaccagcac

SEQ ID NO: 85912 - DNA, 75 bp, Artificial Sequence
  Synthetic
caccaacgcgctccaaatctcacaaccagcgcgcccggcattaccagcaccaaattctttaccagatacacaaca

SEQ ID NO: 85913 - DNA, 75 bp, Artificial Sequence
  Synthetic
atcagatacggtacaaacaaggcacgtcattcaaaccaggtcaaggtctgagtccacagtggaatctttctttgc

SEQ ID NO: 85914 - DNA, 75 bp, Artificial Sequence
  Synthetic
gtcattcaaaccaggtcaaggtctgagtccacagtggaatctttctttgcacgcggtgcctgtgtgacgatcatg

SEQ ID NO: 85915 - DNA, 75 bp, Artificial Sequence
  Synthetic
gacactgtgcaattcaggcgcaaattggaaatgttcacttactccaggtttgatattgaattcacctttgtgacc

SEQ ID NO: 85916 - DNA, 75 bp, Artificial Sequence
  Synthetic
tggaaatgttcacttactccaggtttgatattgaattcacctttgtgaccacagaaaggtactacgcctcaaact

SEQ ID NO: 85917 - DNA, 75 bp, Artificial Sequence
  Synthetic
attacacatggcaaacttcctccaatccgtcagtgttttacacatatggtgatgcaccggcacgcgtctctatac

SEQ ID NO: 85918 - DNA, 75 bp, Artificial Sequence
  Synthetic
tccgtcagtgttttacacatatggtgatgcaccggcacgcgtctctataccatttgtggggattgcaaatgctta

SEQ ID NO: 85919 - DNA, 75 bp, Artificial Sequence
  Synthetic
agcaacatcaataaatgatttcggcatgcttgcggttagagtggtgaatgaattcaatccagccagaattacttc

SEQ ID NO: 85920 - DNA, 75 bp, Artificial Sequence
  Synthetic
atgcttgcggttagagtggtgaatgaattcaatccagccagaattacttccaagatcagagtttacatgaaaccc

SEQ ID NO: 85921 - DNA, 75 bp, Artificial Sequence
  Synthetic
gacttgactccgttgtcaactaaaaacttgaccacttatgggtttggacatcaaaacaaagcagtatacaccgca

SEQ ID NO: 85922 - DNA, 75 bp, Artificial Sequence
  Synthetic
acttgaccacttatgggtttggacatcaaaacaaagcagtatacaccgcaggtttcaaaatctgcaattaccatc

SEQ ID NO: 85923 - DNA, 75 bp, Artificial Sequence
  Synthetic
ctcaaggaacagactcaatcgctaggtgtaattgcaacactggggtgtactactgtgagtccaaaagaaaatatt

SEQ ID NO: 85924 - DNA, 75 bp, Artificial Sequence
  Synthetic
gtgtaattgcaacactggggtgtactactgtgagtccaaaagaaaatattacccagttaccttcgttggccccac

SEQ ID NO: 85925 - DNA, 75 bp, Artificial Sequence
  Synthetic
atcaccaggtgattgtggaggcatcctcaggtgtcagcacggagtaatcggcatcatcacagcagggggagaagg

SEQ ID NO: 85926 - DNA, 75 bp, Artificial Sequence
  Synthetic
ctcaggtgtcagcacggagtaatcggcatcatcacagcagggggagaaggtttagttgccttttcagatatcaga

SEQ ID NO: 85927 - DNA, 75 bp, Artificial Sequence
  Synthetic
gggagtggatttacccagcagattggagacaagatttcggagctcaccaatatggttactagcacactcactgag

SEQ ID NO: 85928 - DNA, 75 bp, Artificial Sequence
  Synthetic
gagacaagatttcggagctcaccaatatggttactagcacactcactgagaaactactgaaaaacctgataaaga

SEQ ID NO: 85929 - DNA, 75 bp, Artificial Sequence
  Synthetic
ggtgtgacgtctctccctggcaatggctcaagaaaaaggcttgtgacatactggagatcccttatgtcatgcggc

SEQ ID NO: 85930 - DNA, 75 bp, Artificial Sequence
  Synthetic
gctcaagaaaaaggcttgtgacatactggagatcccttatgtcatgcggcaaggtgacagctggctaaagaagtt

SEQ ID NO: 85931 - DNA, 75 bp, Artificial Sequence
  Synthetic
ggagaaaatcattccccaagctagagacaaattggaatttgtaactaaattgaaacaactggaaatgctggaaaa

SEQ ID NO: 85932 - DNA, 75 bp, Artificial Sequence
  Synthetic
ggagataatcattccccaagctagagacaaattggaatttgtaactaaattgaaacaactggaaatgctggaaaa

SEQ ID NO: 85933 - DNA, 75 bp, Artificial Sequence
  Synthetic
ggagacaatcattccccaagctagagacaaattggaatttgtaactaaattgaaacaactggaaatgctggaaaa

SEQ ID NO: 85934 - DNA, 75 bp, Artificial Sequence
  Synthetic
ggagagaatcattccccaagctagagacaaattggaatttgtaactaaattgaaacaactggaaatgctggaaaa

SEQ ID NO: 85935 - DNA, 75 bp, Artificial Sequence
  Synthetic
gacaacgtggccattctaccaactcatgcctcaccaggagagacaatagttattgatggaaaggaagtggaagtc

SEQ ID NO: 85936 - DNA, 75 bp, Artificial Sequence
  Synthetic
atgcctcaccaggagagacaatagttattgatggaaaggaagtggaagtcctggatgctaaggcgctagaggatc

SEQ ID NO: 85937 - DNA, 75 bp, Artificial Sequence
  Synthetic
tcaaattgccaccattcaccagtcttgtccgagtcaggaacaacaagaaattttgtttaacaatgtgagatggct

SEQ ID NO: 85938 - DNA, 75 bp, Artificial Sequence
  Synthetic
tcaaattgccaccattcaccagtcttgtccgagtcaggaacaacaagaaattttgtttaacattgtgagatggct

SEQ ID NO: 85939 - DNA, 75 bp, Artificial Sequence
  Synthetic
tcaaattgccaccattcaccagtcttgtccgagtcaggaacaacaagaaattttgtttaacactgtgagatggct

SEQ ID NO: 85940 - DNA, 75 bp, Artificial Sequence
  Synthetic
tcaaattgccaccattcaccagtcttgtccgagtcaggaacaacaagaaattttgtttaacagtgtgagatggct

SEQ ID NO: 85941 - DNA, 75 bp, Artificial Sequence
  Synthetic
tcaaattgccaccattcaccagtcttgtccgagtcaggaacatcaagaaattttgtttaacaatgtgagatggct

SEQ ID NO: 85942 - DNA, 75 bp, Artificial Sequence
  Synthetic
tcaaattgccaccattcaccagtcttgtccgagtcaggaacatcaagaaattttgtttaacattgtgagatggct

SEQ ID NO: 85943 - DNA, 75 bp, Artificial Sequence
  Synthetic
tcaaattgccaccattcaccagtcttgtccgagtcaggaacatcaagaaattttgtttaacactgtgagatggct

SEQ ID NO: 85944 - DNA, 75 bp, Artificial Sequence
  Synthetic
tcaaattgccaccattcaccagtcttgtccgagtcaggaacatcaagaaattttgtttaacagtgtgagatggct

SEQ ID NO: 85945 - DNA, 75 bp, Artificial Sequence
  Synthetic
tcaaattgccaccattcaccagtcttgtccgagtcaggaacaccaagaaattttgtttaacaatgtgagatggct

SEQ ID NO: 85946 - DNA, 75 bp, Artificial Sequence
  Synthetic
tcaaattgccaccattcaccagtcttgtccgagtcaggaacaccaagaaattttgtttaacattgtgagatggct

SEQ ID NO: 85947 - DNA, 75 bp, Artificial Sequence
  Synthetic
tcaaattgccaccattcaccagtcttgtccgagtcaggaacaccaagaaattttgtttaacactgtgagatggct

SEQ ID NO: 85948 - DNA, 75 bp, Artificial Sequence
  Synthetic
tcaaattgccaccattcaccagtcttgtccgagtcaggaacaccaagaaattttgtttaacagtgtgagatggct

SEQ ID NO: 85949 - DNA, 75 bp, Artificial Sequence
  Synthetic
tcaaattgccaccattcaccagtcttgtccgagtcaggaacagcaagaaattttgtttaacaatgtgagatggct

SEQ ID NO: 85950 - DNA, 75 bp, Artificial Sequence
  Synthetic
tcaaattgccaccattcaccagtcttgtccgagtcaggaacagcaagaaattttgtttaacattgtgagatggct

SEQ ID NO: 85951 - DNA, 75 bp, Artificial Sequence
  Synthetic
tcaaattgccaccattcaccagtcttgtccgagtcaggaacagcaagaaattttgtttaacactgtgagatggct

SEQ ID NO: 85952 - DNA, 75 bp, Artificial Sequence
  Synthetic
tcaaattgccaccattcaccagtcttgtccgagtcaggaacagcaagaaattttgtttaacagtgtgagatggct

SEQ ID NO: 85953 - DNA, 75 bp, Artificial Sequence
  Synthetic
ctggatgctaaggcgctagaggatcaggccggaaccaatttggagatcactattgtcacccttaaaagaaatgag

SEQ ID NO: 85954 - DNA, 75 bp, Artificial Sequence
  Synthetic
caacaattacatacagttcaagagcaaacaccgtattgaaccagtatgtttgttggtgcatggaagtcctggtac

SEQ ID NO: 85955 - DNA, 75 bp, Artificial Sequence
  Synthetic
accagatccaactcactttgacggctacaaacaacaaggggtagtgattatggatgaattaaaccaaaacccaga

SEQ ID NO: 85956 - DNA, 75 bp, Artificial Sequence
  Synthetic
accagatccaactcactttgacggctacaaacaacaaggggtagtgattatggatgatttaaaccaaaacccaga

SEQ ID NO: 85957 - DNA, 75 bp, Artificial Sequence
  Synthetic
accagatccaactcactttgacggctacaaacaacaaggggtagtgattatggatgacttaaaccaaaacccaga

SEQ ID NO: 85958 - DNA, 75 bp, Artificial Sequence
  Synthetic
accagatccaactcactttgacggctacaaacaacaaggggtagtgattatggatgagttaaaccaaaacccaga

SEQ ID NO: 85959 - DNA, 75 bp, Artificial Sequence
  Synthetic
tccagatccaactcactttgacggctacaaacaacaaggggtagtgattatggatgaattaaaccaaaacccaga

SEQ ID NO: 85960 - DNA, 75 bp, Artificial Sequence
  Synthetic
tccagatccaactcactttgacggctacaaacaacaaggggtagtgattatggatgatttaaaccaaaacccaga

SEQ ID NO: 85961 - DNA, 75 bp, Artificial Sequence
  Synthetic
tccagatccaactcactttgacggctacaaacaacaaggggtagtgattatggatgacttaaaccaaaacccaga

SEQ ID NO: 85962 - DNA, 75 bp, Artificial Sequence
  Synthetic
tccagatccaactcactttgacggctacaaacaacaaggggtagtgattatggatgagttaaaccaaaacccaga

SEQ ID NO: 85963 - DNA, 75 bp, Artificial Sequence
  Synthetic
cccagatccaactcactttgacggctacaaacaacaaggggtagtgattatggatgaattaaaccaaaacccaga

SEQ ID NO: 85964 - DNA, 75 bp, Artificial Sequence
  Synthetic
cccagatccaactcactttgacggctacaaacaacaaggggtagtgattatggatgatttaaaccaaaacccaga

SEQ ID NO: 85965 - DNA, 75 bp, Artificial Sequence
  Synthetic
cccagatccaactcactttgacggctacaaacaacaaggggtagtgattatggatgacttaaaccaaaacccaga

SEQ ID NO: 85966 - DNA, 75 bp, Artificial Sequence
  Synthetic
cccagatccaactcactttgacggctacaaacaacaaggggtagtgattatggatgagttaaaccaaaacccaga

SEQ ID NO: 85967 - DNA, 75 bp, Artificial Sequence
  Synthetic
gccagatccaactcactttgacggctacaaacaacaaggggtagtgattatggatgaattaaaccaaaacccaga

SEQ ID NO: 85968 - DNA, 75 bp, Artificial Sequence
  Synthetic
gccagatccaactcactttgacggctacaaacaacaaggggtagtgattatggatgatttaaaccaaaacccaga

SEQ ID NO: 85969 - DNA, 75 bp, Artificial Sequence
  Synthetic
gccagatccaactcactttgacggctacaaacaacaaggggtagtgattatggatgacttaaaccaaaacccaga

SEQ ID NO: 85970 - DNA, 75 bp, Artificial Sequence
  Synthetic
gccagatccaactcactttgacggctacaaacaacaaggggtagtgattatggatgagttaaaccaaaacccaga

SEQ ID NO: 85971 - DNA, 75 bp, Artificial Sequence
  Synthetic
gtcatcgggatgcatgttggagggaacggttcgcatgggtttgcagcggccctaaagcgatcatacttcactcag

SEQ ID NO: 85972 - DNA, 75 bp, Artificial Sequence
  Synthetic
tacaaacaacaaggggtagtgattatggatgaattaaaccaaaacccagacggagccgacatgaaattgttttgc

SEQ ID NO: 85973 - DNA, 75 bp, Artificial Sequence
  Synthetic
tacaaacaacaaggggtagtgattatggatgatttaaaccaaaacccagacggagccgacatgaaattgttttgc

SEQ ID NO: 85974 - DNA, 75 bp, Artificial Sequence
  Synthetic
tacaaacaacaaggggtagtgattatggatgacttaaaccaaaacccagacggagccgacatgaaattgttttgc

SEQ ID NO: 85975 - DNA, 75 bp, Artificial Sequence
  Synthetic
tacaaacaacaaggggtagtgattatggatgagttaaaccaaaacccagacggagccgacatgaaattgttttgc

SEQ ID NO: 85976 - DNA, 75 bp, Artificial Sequence
  Synthetic
tacgtgttagcttctaccaactccagccgcatcacaccacccacagttgcacacagcgatgcattagccagacgc

SEQ ID NO: 85977 - DNA, 75 bp, Artificial Sequence
  Synthetic
gccgcatcacaccacccacagttgcacacagcgatgcattagccagacgctttgcgtttgacatggacatccaag

SEQ ID NO: 85978 - DNA, 75 bp, Artificial Sequence
  Synthetic
cagccaattttaaaaagtgttgcccgttggtatgtggaaaggccatccagttgatggataagacctccagggtta

SEQ ID NO: 85979 - DNA, 75 bp, Artificial Sequence
  Synthetic
cagccaattttaaaaagtgttgcccgttggtatgtggaaaggccatccagttgatggataagtcctccagggtta

SEQ ID NO: 85980 - DNA, 75 bp, Artificial Sequence
  Synthetic
cagccaattttaaaaagtgttgcccgttggtatgtggaaaggccatccagttgatggataagccctccagggtta

SEQ ID NO: 85981 - DNA, 75 bp, Artificial Sequence
  Synthetic
cagccaattttaaaaagtgttgcccgttggtatgtggaaaggccatccagttgatggataaggcctccagggtta

SEQ ID NO: 85982 - DNA, 75 bp, Artificial Sequence
  Synthetic
cagccaattttaaaatgtgttgcccgttggtatgtggaaaggccatccagttgatggataagacctccagggtta

SEQ ID NO: 85983 - DNA, 75 bp, Artificial Sequence
  Synthetic
cagccaattttaaaatgtgttgcccgttggtatgtggaaaggccatccagttgatggataagtcctccagggtta

SEQ ID NO: 85984 - DNA, 75 bp, Artificial Sequence
  Synthetic
cagccaattttaaaatgtgttgcccgttggtatgtggaaaggccatccagttgatggataagccctccagggtta

SEQ ID NO: 85985 - DNA, 75 bp, Artificial Sequence
  Synthetic
cagccaattttaaaatgtgttgcccgttggtatgtggaaaggccatccagttgatggataaggcctccagggtta

SEQ ID NO: 85986 - DNA, 75 bp, Artificial Sequence
  Synthetic
cagccaattttaaaacgtgttgcccgttggtatgtggaaaggccatccagttgatggataagacctccagggtta

SEQ ID NO: 85987 - DNA, 75 bp, Artificial Sequence
  Synthetic
cagccaattttaaaacgtgttgcccgttggtatgtggaaaggccatccagttgatggataagtcctccagggtta

SEQ ID NO: 85988 - DNA, 75 bp, Artificial Sequence
  Synthetic
cagccaattttaaaacgtgttgcccgttggtatgtggaaaggccatccagttgatggataagccctccagggtta

SEQ ID NO: 85989 - DNA, 75 bp, Artificial Sequence
  Synthetic
cagccaattttaaaacgtgttgcccgttggtatgtggaaaggccatccagttgatggataaggcctccagggtta

SEQ ID NO: 85990 - DNA, 75 bp, Artificial Sequence
  Synthetic
cagccaattttaaaaggtgttgcccgttggtatgtggaaaggccatccagttgatggataagacctccagggtta

SEQ ID NO: 85991 - DNA, 75 bp, Artificial Sequence
  Synthetic
cagccaattttaaaaggtgttgcccgttggtatgtggaaaggccatccagttgatggataagtcctccagggtta

SEQ ID NO: 85992 - DNA, 75 bp, Artificial Sequence
  Synthetic
cagccaattttaaaaggtgttgcccgttggtatgtggaaaggccatccagttgatggataagccctccagggtta

SEQ ID NO: 85993 - DNA, 75 bp, Artificial Sequence
  Synthetic
cagccaattttaaaaggtgttgcccgttggtatgtggaaaggccatccagttgatggataaggcctccagggtta

SEQ ID NO: 85994 - DNA, 75 bp, Artificial Sequence
  Synthetic
gttggtatgtggaaaggccatccagttgatggataagacctccagggttaggtatagtgtggatcagattactac

SEQ ID NO: 85995 - DNA, 75 bp, Artificial Sequence
  Synthetic
gttggtatgtggaaaggccatccagttgatggataagtcctccagggttaggtatagtgtggatcagattactac

SEQ ID NO: 85996 - DNA, 75 bp, Artificial Sequence
  Synthetic
gttggtatgtggaaaggccatccagttgatggataagccctccagggttaggtatagtgtggatcagattactac

SEQ ID NO: 85997 - DNA, 75 bp, Artificial Sequence
  Synthetic
gttggtatgtggaaaggccatccagttgatggataaggcctccagggttaggtatagtgtggatcagattactac

SEQ ID NO: 85998 - DNA, 75 bp, Artificial Sequence
  Synthetic
gtacaaagacctcagaatagacattaagacctcacccccccccgagtgcatcaacgatttactccaggcggtgga

SEQ ID NO: 85999 - DNA, 75 bp, Artificial Sequence
  Synthetic
gtacaaagacctcagtatagacattaagacctcacccccccccgagtgcatcaacgatttactccaggcggtgga

SEQ ID NO: 86000 - DNA, 75 bp, Artificial Sequence
  Synthetic
gtacaaagacctcagcatagacattaagacctcacccccccccgagtgcatcaacgatttactccaggcggtgga

SEQ ID NO: 86001 - DNA, 75 bp, Artificial Sequence
  Synthetic
gtacaaagacctcaggatagacattaagacctcacccccccccgagtgcatcaacgatttactccaggcggtgga

SEQ ID NO: 86002 - DNA, 75 bp, Artificial Sequence
  Synthetic
aagacctcacccccccccgagtgcatcaacgatttactccaggcggtggactctcaggaggtgagagattactgt

SEQ ID NO: 86003 - DNA, 75 bp, Artificial Sequence
  Synthetic
ttacaggctgtcaccactttcgcagctgtcgctggggtagtgtatgtgatgtacaaactgtttgcagggcaacag

SEQ ID NO: 86004 - DNA, 75 bp, Artificial Sequence
  Synthetic
ctgtcgctggggtagtgtatgtgatgtacaaactgtttgcagggcaacagggtgcctacaccgggctcccaaaca

SEQ ID NO: 86005 - DNA, 75 bp, Artificial Sequence
  Synthetic
agaggaacatactcacagcaaccactagcaaaggggagtttacaatgcttggagtgcatgacaatgtggccattt

SEQ ID NO: 86006 - DNA, 75 bp, Artificial Sequence
  Synthetic
gtagaggttctggacgccaaagcattggaagatcaagcagggactaatttggaaataaccattgttactcttaaa

SEQ ID NO: 86007 - DNA, 75 bp, Artificial Sequence
  Synthetic
cactcttactgaaaacctacaagggcatagatttggatcacctaaaaatgattgcctatggtgatgatgtaattg

SEQ ID NO: 86008 - DNA, 75 bp, Artificial Sequence
  Synthetic
gtgaacactagtaagtaccccaatatgtatgtcccggttggtgctgtgaccgaacagggatatctcaacctcggt

SEQ ID NO: 86009 - DNA, 75 bp, Artificial Sequence
  Synthetic
actggtaaagtcatcggaatgcatgtcggagggaacggttcacatgggtttgcagcagccctgaaacgatcatat

SEQ ID NO: 86010 - DNA, 75 bp, Artificial Sequence
  Synthetic
actggtaaagtcatcggaatgcatgtcggtgggaacggttcacatgggtttgcagcagccctgaaacgatcatat

SEQ ID NO: 86011 - DNA, 75 bp, Artificial Sequence
  Synthetic
actggtaaagtcatcggaatgcatgtcggcgggaacggttcacatgggtttgcagcagccctgaaacgatcatat

SEQ ID NO: 86012 - DNA, 75 bp, Artificial Sequence
  Synthetic
actggtaaagtcatcggaatgcatgtcggggggaacggttcacatgggtttgcagcagccctgaaacgatcatat

SEQ ID NO: 86013 - DNA, 75 bp, Artificial Sequence
  Synthetic
gagtactcaacattgtaccgccgttggctcgactctttttagtaaccctacctcagtcgaattggattgggtcat

SEQ ID NO: 86014 - DNA, 75 bp, Artificial Sequence
  Synthetic
gggctaccccattataaatgccccgtctaaaactaagttggaacccagtgcattccactatgtgtttgaaggagt

SEQ ID NO: 86015 - DNA, 75 bp, Artificial Sequence
  Synthetic
tgtaggcaacaagatcacagaggtggatgaatacatgaaagaagcagtggatcattatgcaggacaactaatgtc

SEQ ID NO: 86016 - DNA, 75 bp, Artificial Sequence
  Synthetic
cagcaccagtgctggttatccttatgtggcaatgggaaagaaaaaaagagatatcttgaacaagcagaccagaga

SEQ ID NO: 86017 - DNA, 75 bp, Artificial Sequence
  Synthetic
gtggcaatgggaaagaaaaaaagagatatcttgaacaagcagaccagagacaccaaggagatgcagagacttcta

SEQ ID NO: 86018 - DNA, 75 bp, Artificial Sequence
  Synthetic
ggcaaatccagattgattgaagcctcgagcctgaacgactcagtggctataagaatggcttttggcaacctttat

SEQ ID NO: 86019 - DNA, 75 bp, Artificial Sequence
  Synthetic
ggcaaatccagattgattgaagcctcgagcctgaacgactcagtggctattagaatggcttttggcaacctttat

SEQ ID NO: 86020 - DNA, 75 bp, Artificial Sequence
  Synthetic
ggcaaatccagattgattgaagcctcgagcctgaacgactcagtggctatcagaatggcttttggcaacctttat

SEQ ID NO: 86021 - DNA, 75 bp, Artificial Sequence
  Synthetic
ggcaaatccagattgattgaagcctcgagcctgaacgactcagtggctatgagaatggcttttggcaacctttat

SEQ ID NO: 86022 - DNA, 75 bp, Artificial Sequence
  Synthetic
cgagcctgaacgactcagtggctataagaatggcttttggcaacctttatgcagcattccacaagaacccaggtg

SEQ ID NO: 86023 - DNA, 75 bp, Artificial Sequence
  Synthetic
cgagcctgaacgactcagtggctataagaatggcttttggcaacctttatgcagcattcctcaagaacccaggtg

SEQ ID NO: 86024 - DNA, 75 bp, Artificial Sequence
  Synthetic
cgagcctgaacgactcagtggctataagaatggcttttggcaacctttatgcagcattccccaagaacccaggtg

SEQ ID NO: 86025 - DNA, 75 bp, Artificial Sequence
  Synthetic
cgagcctgaacgactcagtggctataagaatggcttttggcaacctttatgcagcattccgcaagaacccaggtg

SEQ ID NO: 86026 - DNA, 75 bp, Artificial Sequence
  Synthetic
cgagcctgaacgactcagtggctattagaatggcttttggcaacctttatgcagcattccacaagaacccaggtg

SEQ ID NO: 86027 - DNA, 75 bp, Artificial Sequence
  Synthetic
cgagcctgaacgactcagtggctattagaatggcttttggcaacctttatgcagcattcctcaagaacccaggtg

SEQ ID NO: 86028 - DNA, 75 bp, Artificial Sequence
  Synthetic
cgagcctgaacgactcagtggctattagaatggcttttggcaacctttatgcagcattccccaagaacccaggtg

SEQ ID NO: 86029 - DNA, 75 bp, Artificial Sequence
  Synthetic
cgagcctgaacgactcagtggctattagaatggcttttggcaacctttatgcagcattccgcaagaacccaggtg

SEQ ID NO: 86030 - DNA, 75 bp, Artificial Sequence
  Synthetic
cgagcctgaacgactcagtggctatcagaatggcttttggcaacctttatgcagcattccacaagaacccaggtg

SEQ ID NO: 86031 - DNA, 75 bp, Artificial Sequence
  Synthetic
cgagcctgaacgactcagtggctatcagaatggcttttggcaacctttatgcagcattcctcaagaacccaggtg

SEQ ID NO: 86032 - DNA, 75 bp, Artificial Sequence
  Synthetic
cgagcctgaacgactcagtggctatcagaatggcttttggcaacctttatgcagcattccccaagaacccaggtg

SEQ ID NO: 86033 - DNA, 75 bp, Artificial Sequence
  Synthetic
cgagcctgaacgactcagtggctatcagaatggcttttggcaacctttatgcagcattccgcaagaacccaggtg

SEQ ID NO: 86034 - DNA, 75 bp, Artificial Sequence
  Synthetic
cgagcctgaacgactcagtggctatgagaatggcttttggcaacctttatgcagcattccacaagaacccaggtg

SEQ ID NO: 86035 - DNA, 75 bp, Artificial Sequence
  Synthetic
cgagcctgaacgactcagtggctatgagaatggcttttggcaacctttatgcagcattcctcaagaacccaggtg

SEQ ID NO: 86036 - DNA, 75 bp, Artificial Sequence
  Synthetic
cgagcctgaacgactcagtggctatgagaatggcttttggcaacctttatgcagcattccccaagaacccaggtg

SEQ ID NO: 86037 - DNA, 75 bp, Artificial Sequence
  Synthetic
cgagcctgaacgactcagtggctatgagaatggcttttggcaacctttatgcagcattccgcaagaacccaggtg

SEQ ID NO: 86038 - DNA, 75 bp, Artificial Sequence
  Synthetic
tctttgcatttgattacacgggttaagacgcatccctcagtccagcttggttcgaggcactcaaaatggtactgg

SEQ ID NO: 86039 - DNA, 75 bp, Artificial Sequence
  Synthetic
tctttgcatttgattacacgggttatgacgcatccctcagtccagcttggttcgaggcactcaaaatggtactgg

SEQ ID NO: 86040 - DNA, 75 bp, Artificial Sequence
  Synthetic
tctttgcatttgattacacgggttacgacgcatccctcagtccagcttggttcgaggcactcaaaatggtactgg

SEQ ID NO: 86041 - DNA, 75 bp, Artificial Sequence
  Synthetic
tctttgcatttgattacacgggttaggacgcatccctcagtccagcttggttcgaggcactcaaaatggtactgg

SEQ ID NO: 86042 - DNA, 75 bp, Artificial Sequence
  Synthetic
tctttgcatttgattactcgggttaagacgcatccctcagtccagcttggttcgaggcactcaaaatggtactgg

SEQ ID NO: 86043 - DNA, 75 bp, Artificial Sequence
  Synthetic
tctttgcatttgattactcgggttatgacgcatccctcagtccagcttggttcgaggcactcaaaatggtactgg

SEQ ID NO: 86044 - DNA, 75 bp, Artificial Sequence
  Synthetic
tctttgcatttgattactcgggttacgacgcatccctcagtccagcttggttcgaggcactcaaaatggtactgg

SEQ ID NO: 86045 - DNA, 75 bp, Artificial Sequence
  Synthetic
tctttgcatttgattactcgggttaggacgcatccctcagtccagcttggttcgaggcactcaaaatggtactgg

SEQ ID NO: 86046 - DNA, 75 bp, Artificial Sequence
  Synthetic
tctttgcatttgattacccgggttaagacgcatccctcagtccagcttggttcgaggcactcaaaatggtactgg

SEQ ID NO: 86047 - DNA, 75 bp, Artificial Sequence
  Synthetic
tctttgcatttgattacccgggttatgacgcatccctcagtccagcttggttcgaggcactcaaaatggtactgg

SEQ ID NO: 86048 - DNA, 75 bp, Artificial Sequence
  Synthetic
tctttgcatttgattacccgggttacgacgcatccctcagtccagcttggttcgaggcactcaaaatggtactgg

SEQ ID NO: 86049 - DNA, 75 bp, Artificial Sequence
  Synthetic
tctttgcatttgattacccgggttaggacgcatccctcagtccagcttggttcgaggcactcaaaatggtactgg

SEQ ID NO: 86050 - DNA, 75 bp, Artificial Sequence
  Synthetic
tctttgcatttgattacgcgggttaagacgcatccctcagtccagcttggttcgaggcactcaaaatggtactgg

SEQ ID NO: 86051 - DNA, 75 bp, Artificial Sequence
  Synthetic
tctttgcatttgattacgcgggttatgacgcatccctcagtccagcttggttcgaggcactcaaaatggtactgg

SEQ ID NO: 86052 - DNA, 75 bp, Artificial Sequence
  Synthetic
tctttgcatttgattacgcgggttacgacgcatccctcagtccagcttggttcgaggcactcaaaatggtactgg

SEQ ID NO: 86053 - DNA, 75 bp, Artificial Sequence
  Synthetic
tctttgcatttgattacgcgggttaggacgcatccctcagtccagcttggttcgaggcactcaaaatggtactgg

SEQ ID NO: 86054 - DNA, 75 bp, Artificial Sequence
  Synthetic
aaaagattggctttggagacagagtagactatatagattatctaaatcactcccaccatctttacaaaaacaaaa

SEQ ID NO: 86055 - DNA, 75 bp, Artificial Sequence
  Synthetic
ggttgacgctagtctcctagcccaatcaggaaaagactatggactaaccatgactccagctgacaaatcggcaac

SEQ ID NO: 86056 - DNA, 75 bp, Artificial Sequence
  Synthetic
gggcagatgagaagtacccattcttgatacatccagtgatgccaatgaaagaaattcatgaatcaatcagatgga

SEQ ID NO: 86057 - DNA, 75 bp, Artificial Sequence
  Synthetic
gaaattcatgaatcaatcagatggacaaaagatcctagaaatactcaggatcacgttcgctcactgtgcttattg

SEQ ID NO: 86058 - DNA, 75 bp, Artificial Sequence
  Synthetic
tttccccggtgatattgtatagactgtacccacggtcgaaaacgattgatccgttatccgcttctgtacttcgag

SEQ ID NO: 86059 - DNA, 75 bp, Artificial Sequence
  Synthetic
gtacccacggtcgaaaacgattgatccgttatccgcttctgtacttcgagaagcctagtaccactttggaatctt

SEQ ID NO: 86060 - DNA, 75 bp, Artificial Sequence
  Synthetic
gtggtccaggctgcgttggcggcctacctgtggcccaaagccacaggacgctagttgtgaacaaggtgtgaagag

SEQ ID NO: 86061 - DNA, 75 bp, Artificial Sequence
  Synthetic
ccacccggagcagaggcccccaagagccgcaaagaagcaatgcttgggacacatgtgatatgggacattgggttg

SEQ ID NO: 86062 - DNA, 75 bp, Artificial Sequence
  Synthetic
tacgtgggaattgctaatgcgtattcccacttttatgatgggtttgcaaaagtaccactagcgggtcaagcctca

SEQ ID NO: 86063 - DNA, 75 bp, Artificial Sequence
  Synthetic
cacaaccccacgcggctcacctccaagatcagagtgtacatgaagccaaagcatgtcagagtctggtgcccacga

SEQ ID NO: 86064 - DNA, 75 bp, Artificial Sequence
  Synthetic
ttacccagctagatatcaatcacacatgcttattggtcatgggtttgcatcaccgggcgattgtggtggcatact

SEQ ID NO: 86065 - DNA, 75 bp, Artificial Sequence
  Synthetic
tctctacgcatatgaagaggaggctatggaacagggcatttccaactatatcgaatcccttggagctgcgtttgg

SEQ ID NO: 86066 - DNA, 75 bp, Artificial Sequence
  Synthetic
atggaacagggcatttccaactatatcgaatcccttggagctgcgtttggaagtggctttactcaacaaattgga

SEQ ID NO: 86067 - DNA, 75 bp, Artificial Sequence
  Synthetic
atctcttcattagtcatcattaccaggaactatgaagatacaaccacagtgcttgccactctagctcttcttggg

SEQ ID NO: 86068 - DNA, 75 bp, Artificial Sequence
  Synthetic
ggaactatgaagatacaaccacagtgcttgccactctagctcttcttgggtgtgacgtgtccccctggcagtggc

SEQ ID NO: 86069 - DNA, 75 bp, Artificial Sequence
  Synthetic
cagaggcatgcaatgctgccaaaggtctggagtgggtatcaaacaaaatatccaaatttatcgattggctaaagg

SEQ ID NO: 86070 - DNA, 75 bp, Artificial Sequence
  Synthetic
aaacaattagagatgctagagaatcagattgctaccatccaccaatcatgcccaagccaggaacaccaggaaatt

SEQ ID NO: 86071 - DNA, 75 bp, Artificial Sequence
  Synthetic
cacatctcacagagaactttgtttgcgcgcgcgcaaggcattgaggagaccattgacaccgttattaccaatgca

SEQ ID NO: 86072 - DNA, 75 bp, Artificial Sequence
  Synthetic
atccagaagttggaacacacaattaacaattacatacaattcaagagcaaacaccgtattgaaccagtatgtttg

SEQ ID NO: 86073 - DNA, 75 bp, Artificial Sequence
  Synthetic
acaattacatacaattcaagagcaaacaccgtattgaaccagtatgtttgttagtacatggcagtccaggaacag

SEQ ID NO: 86074 - DNA, 75 bp, Artificial Sequence
  Synthetic
cagatccatcgcatttcgatgggtacaagcaacagggagtagtgataatggatgatctaaatcagaacccagatg

SEQ ID NO: 86075 - DNA, 75 bp, Artificial Sequence
  Synthetic
caagcaacagggagtagtgataatggatgatctaaatcagaacccagatggtgctgacatgaaactcttttgtca

SEQ ID NO: 86076 - DNA, 75 bp, Artificial Sequence
  Synthetic
tgtcctggcttccaccaactccagtcgtattacaccacctacggttgcacacagtgatgcactagccaggcgttt

SEQ ID NO: 86077 - DNA, 75 bp, Artificial Sequence
  Synthetic
cgtattacaccacctacggttgcacacagtgatgcactagccaggcgttttgcattcgacatggacattcaggtc

SEQ ID NO: 86078 - DNA, 75 bp, Artificial Sequence
  Synthetic
gcaaactttaaaagatgctgccccttggtttgtggaaaagcaatccagttgatggataagtcttctagggttaga

SEQ ID NO: 86079 - DNA, 75 bp, Artificial Sequence
  Synthetic
tggtttgtggaaaagcaatccagttgatggataagtcttctagggttagatacagtgttgaccaaattacaacaa

SEQ ID NO: 86080 - DNA, 75 bp, Artificial Sequence
  Synthetic
cgcgtactcgcacttctacgacgggttcgcgcgtgttcctttgaaagatgagaccgttgattctggcgacacata

SEQ ID NO: 86081 - DNA, 75 bp, Artificial Sequence
  Synthetic
acaaagacttgaagatagatattaagaccacaccaccacctgagtgtatcaatgatttgctacaagcagtggact

SEQ ID NO: 86082 - DNA, 75 bp, Artificial Sequence
  Synthetic
tacatctaagataagagtgtatatgaagcccaagcatgtaaggtgttggtgtcccagaccgcctcgtgcagttcc

SEQ ID NO: 86083 - DNA, 75 bp, Artificial Sequence
  Synthetic
gaccacaccaccacctgagtgtatcaatgatttgctacaagcagtggactctcaagaagttagagattattgtga

SEQ ID NO: 86084 - DNA, 75 bp, Artificial Sequence
  Synthetic
gtaccgaggtgagggcgtcgatttcaaacaagactcaattaccccactgacagccgttgaaaacattaatacttt

SEQ ID NO: 86085 - DNA, 75 bp, Artificial Sequence
  Synthetic
gcaagcagtcacgactttcgcagcagttgctggagtggtgtatgtgatgtacaagctctttgcaggacagcaagg

SEQ ID NO: 86086 - DNA, 75 bp, Artificial Sequence
  Synthetic
gttgctggagtggtgtatgtgatgtacaagctctttgcaggacagcaagggccatacacagggttacccaataag

SEQ ID NO: 86087 - DNA, 75 bp, Artificial Sequence
  Synthetic
agaaacatcctcacagcaaccaccagtaagggggaatttaccatgcttggagtacacgacaacgtggctatccta

SEQ ID NO: 86088 - DNA, 75 bp, Artificial Sequence
  Synthetic
agtcacagaacccactttccagtttatggaggctaatgagtactacccagccaggtaccagacacacatgctcct

SEQ ID NO: 86089 - DNA, 75 bp, Artificial Sequence
  Synthetic
cgaagtgctggatgctaaagctctagaagatcaggctggtaccaatttagagataacaatagtcactcttaagag

SEQ ID NO: 86090 - DNA, 75 bp, Artificial Sequence
  Synthetic
gaacactagtaagtaccccaacatgtatgttcctgttggtgctgtgaccgaacagggatatctcaatctcggtgg

SEQ ID NO: 86091 - DNA, 75 bp, Artificial Sequence
  Synthetic
tatgttcctgttggtgctgtgaccgaacagggatatctcaatctcggtgggcgccaaactgctcgcactctaatg

SEQ ID NO: 86092 - DNA, 75 bp, Artificial Sequence
  Synthetic
ggagggaacggttcacatgggttcgcggcagccctaaaacggtcttacttcgctcagagtcaaggtgaaatccag

SEQ ID NO: 86093 - DNA, 75 bp, Artificial Sequence
  Synthetic
cggcagccctaaaacggtcttacttcgctcagagtcaaggtgaaatccagtggatgagatcatcaaaagaggtgg

SEQ ID NO: 86094 - DNA, 75 bp, Artificial Sequence
  Synthetic
aggaaccagcagttttaaccaaaaacgaccccagacttaaggtagactttgaagaggccatcttctccaagtatg

SEQ ID NO: 86095 - DNA, 75 bp, Artificial Sequence
  Synthetic
cgaccccagacttaaggtagactttgaagaggccatcttctccaagtatgtgggaaacaagatcactgaagtgga

SEQ ID NO: 86096 - DNA, 75 bp, Artificial Sequence
  Synthetic
actatacatcaatcatgcccaagccaggaacaacaagaaattttgtttaacaatgtgcggtggcttgcgatacag

SEQ ID NO: 86097 - DNA, 75 bp, Artificial Sequence
  Synthetic
cctggaagatgctatgtacggcactgacggtttagaggccttagatctcactaccagcgcaggatatccctatgt

SEQ ID NO: 86098 - DNA, 75 bp, Artificial Sequence
  Synthetic
gacggtttagaggccttagatctcactaccagcgcaggatatccctatgtggcccttgggaaaaagaagagagac

SEQ ID NO: 86099 - DNA, 75 bp, Artificial Sequence
  Synthetic
gttacttatgtgaaagatgaactcagatccaaaagtaaagttgaacagggaaagtccaggcttatcgaagcttct

SEQ ID NO: 86100 - DNA, 75 bp, Artificial Sequence
  Synthetic
gatccaaaagtaaagttgaacagggaaagtccaggcttatcgaagcttctagccttaatgactcagtggcaatga

SEQ ID NO: 86101 - DNA, 75 bp, Artificial Sequence
  Synthetic
accctgatctgttttggagtaaaatcccagttctcatggaggaaaagctgtttgcctttgactacaccggctacg

SEQ ID NO: 86102 - DNA, 75 bp, Artificial Sequence
  Synthetic
attatatagattatttaaaccactcgcaccacctgtacaagaataggacatattgtgtcaagggcggcatgccat

SEQ ID NO: 86103 - DNA, 75 bp, Artificial Sequence
  Synthetic
tggacgctagtctcctagcccaatcaggaaaagactatggactcactatgacaccggccgataaatctgcaacat

SEQ ID NO: 86104 - DNA, 75 bp, Artificial Sequence
  Synthetic
aattcatgaatcaattagatggaccaaagatcccagaaacactcaggatcatgtacgctccttgtgtctattggc

SEQ ID NO: 86105 - DNA, 75 bp, Artificial Sequence
  Synthetic
tgcagccccaggagattcaattgtgattgacggaaaggaggtggaagtcctagatgctgaggcattggaagatca

SEQ ID NO: 86106 - DNA, 75 bp, Artificial Sequence
  Synthetic
attcatggctgcttatggtgacaatcatagattgttatcataaagcgagttggattggccatccggtaaaagtca

SEQ ID NO: 86107 - DNA, 75 bp, Artificial Sequence
  Synthetic
catagattgttatcataaagcgagttggattggccatccggtaaaagtcaagtatatcatttacttgtttgtagg

SEQ ID NO: 86108 - DNA, 75 bp, Artificial Sequence
  Synthetic
gagctcaagtatcatctcagaaagtgggtgcccatgaaaacaccaatgtggccaccggtgggtcaactgtaaact

SEQ ID NO: 86109 - DNA, 75 bp, Artificial Sequence
  Synthetic
gggtgcccatgaaaacaccaatgtggccaccggtgggtcaactgtaaactacactactattaattactacaaaga

SEQ ID NO: 86110 - DNA, 75 bp, Artificial Sequence
  Synthetic
catgctcaagtcagcccctgctctaaactcacccaatattgaggcatgcgggtatagtgatagggtgatgcagtt

SEQ ID NO: 86111 - DNA, 75 bp, Artificial Sequence
  Synthetic
aactcacccaatattgaggcatgcgggtatagtgatagggtgatgcagttgactcttgggaattccaccattact

SEQ ID NO: 86112 - DNA, 75 bp, Artificial Sequence
  Synthetic
gttgaccagccaacggagcccgaagtgtctgcatgcagattctacacgttagatacagtcacgtggagtaagagt

SEQ ID NO: 86113 - DNA, 75 bp, Artificial Sequence
  Synthetic
tgtctgcatgcagattctacacgttagatacagtcacgtggagtaagagttcaaaaggatggtggtggaaactac

SEQ ID NO: 86114 - DNA, 75 bp, Artificial Sequence
  Synthetic
tgcatgtgcaatgtaatgcatccaagttccaccagggcgctttgggcgttttcgccattccagagtactgtatgg

SEQ ID NO: 86115 - DNA, 75 bp, Artificial Sequence
  Synthetic
gttccaccagggcgctttgggcgttttcgccattccagagtactgtatggcctgcaacactgatgctaagaccaa

SEQ ID NO: 86116 - DNA, 75 bp, Artificial Sequence
  Synthetic
aacaactggggcacgaaagtttgcagcggtggattacctgcttggttgtggagtgttggctggtaacgctttcgt

SEQ ID NO: 86117 - DNA, 75 bp, Artificial Sequence
  Synthetic
gcggtggattacctgcttggttgtggagtgttggctggtaacgctttcgtcttcccccaccaaatcatcaatctc

SEQ ID NO: 86118 - DNA, 75 bp, Artificial Sequence
  Synthetic
aattggggaatagcaatactacctcttgctgagctggactttgctgaggcgtcatctcctgaaatccccataacc

SEQ ID NO: 86119 - DNA, 75 bp, Artificial Sequence
  Synthetic
agggagagttcacaatgcttggagtacatgataatgtggccattttaccaacccatgcatcaccaggggaaacga

SEQ ID NO: 86120 - DNA, 75 bp, Artificial Sequence
  Synthetic
acatgataatgtggccattttaccaacccatgcatcaccaggggaaacgattgtcattgatggcaaggaggtgga

SEQ ID NO: 86121 - DNA, 75 bp, Artificial Sequence
  Synthetic
ttgctgagctggactttgctgaggcgtcatctcctgaaatccccataaccatcacaatcgcaccgatgtgttgtg

SEQ ID NO: 86122 - DNA, 75 bp, Artificial Sequence
  Synthetic
agttcttatcatctgacaatttccaatcaccgtgtgccttacctgagtttgacgtaacaccaccgatacacattc

SEQ ID NO: 86123 - DNA, 75 bp, Artificial Sequence
  Synthetic
tgaaaaatttagagacattagaccacacatcccaacccaaatcaccgagacgaatgatggagttttgatcgtgaa

SEQ ID NO: 86124 - DNA, 75 bp, Artificial Sequence
  Synthetic
cacatcccaacccaaatcaccgagacgaatgatggagttttgatcgtgaacactagcaagtaccccaacatgtat

SEQ ID NO: 86125 - DNA, 75 bp, Artificial Sequence
  Synthetic
atcaccgtgtgccttacctgagtttgacgtaacaccaccgatacacattccaggtgaagttaggaacatgatgga

SEQ ID NO: 86126 - DNA, 75 bp, Artificial Sequence
  Synthetic
tgagttagggtctggcaagtcactatctaaacccatactgtgtcttagcttgagtccagctagtgaacaacgttt

SEQ ID NO: 86127 - DNA, 75 bp, Artificial Sequence
  Synthetic
aactttccaacaagagcgggtcagtgcggtggagtcatcacctgcactgggaaagtcatcgggatacacgttgga

SEQ ID NO: 86128 - DNA, 75 bp, Artificial Sequence
  Synthetic
gcggtggagtcatcacctgcactgggaaagtcatcgggatacacgttggagggaacggttcacacgggttcgcag

SEQ ID NO: 86129 - DNA, 75 bp, Artificial Sequence
  Synthetic
tctaaacccatactgtgtcttagcttgagtccagctagtgaacaacgtttagggtacaccatgttgggagagatt

SEQ ID NO: 86130 - DNA, 75 bp, Artificial Sequence
  Synthetic
aagattttaatatcgtatgcaccaccaggtgcgaaaccacctacaaccagaagggaggccatgcttggcacacac

SEQ ID NO: 86131 - DNA, 75 bp, Artificial Sequence
  Synthetic
atcctattatcaacgcccctagtaagactaaattggaaccaagtgcatttcattatgtatttgagggagtgaagg

SEQ ID NO: 86132 - DNA, 75 bp, Artificial Sequence
  Synthetic
gactaaattggaaccaagtgcatttcattatgtatttgagggagtgaaggagccagcagttttaaccaagaatga

SEQ ID NO: 86133 - DNA, 75 bp, Artificial Sequence
  Synthetic
caggtgcgaaaccacctacaaccagaagggaggccatgcttggcacacacgtgatttgggacattggacttcagt

SEQ ID NO: 86134 - DNA, 75 bp, Artificial Sequence
  Synthetic
gtggatatatatcaatgttctaccagactaaaatcgtggtgcctctatcaacacccaccacaatgacactactca

SEQ ID NO: 86135 - DNA, 75 bp, Artificial Sequence
  Synthetic
gtacatgaaggaggcagttgaccattacgctgggcaactaatgtccttagacattaacacagatcagatgtgcct

SEQ ID NO: 86136 - DNA, 75 bp, Artificial Sequence
  Synthetic
tacgctgggcaactaatgtccttagacattaacacagatcagatgtgcctggaggatgccatgtatggcactgat

SEQ ID NO: 86137 - DNA, 75 bp, Artificial Sequence
  Synthetic
gactaaaatcgtggtgcctctatcaacacccaccacaatgacactactcagctttgtgtcagcatgcaacgactt

SEQ ID NO: 86138 - DNA, 75 bp, Artificial Sequence
  Synthetic
aatcatctcaactgttgccagtaacgcgttggcgctcagtcaacccaagccagtggacaactctgtacaaaacac

SEQ ID NO: 86139 - DNA, 75 bp, Artificial Sequence
  Synthetic
ttgaacaagcaaaccagagacaccaaagaaatgcaaaggctacttgacacatacggcatcaacctccctctagtt

SEQ ID NO: 86140 - DNA, 75 bp, Artificial Sequence
  Synthetic
aagaaatgcaaaggctacttgacacatacggcatcaacctccctctagttacttatgtgaaggatgagttaagat

SEQ ID NO: 86141 - DNA, 75 bp, Artificial Sequence
  Synthetic
gcgttggcgctcagtcaacccaagccagtggacaactctgtacaaaacacccaacaaagtgctccagtgcatagc

SEQ ID NO: 86142 - DNA, 75 bp, Artificial Sequence
  Synthetic
agacacgtattgaatgttaaatccaggtctgaatccaccatcgagtcattttttgcaagagctgcatgtgtaacc

SEQ ID NO: 86143 - DNA, 75 bp, Artificial Sequence
  Synthetic
tggcctttggcaatctctatgcagccttccacaaaaatccaggagtggtaactggtagtgcagtaggctgtgacc

SEQ ID NO: 86144 - DNA, 75 bp, Artificial Sequence
  Synthetic
cttccacaaaaatccaggagtggtaactggtagtgcagtaggctgtgacccagacttattttggagcaaaatccc

SEQ ID NO: 86145 - DNA, 75 bp, Artificial Sequence
  Synthetic
ggtctgaatccaccatcgagtcattttttgcaagagctgcatgtgtaaccattatgcaggtggacaatttcaacg

SEQ ID NO: 86146 - DNA, 75 bp, Artificial Sequence
  Synthetic
ggaaattagagtttttcacttattctagatttgacttagagatgacttttgtgctaactgagagatactactccc

SEQ ID NO: 86147 - DNA, 75 bp, Artificial Sequence
  Synthetic
agcccttaaaatggtcctcgagaagatcggctttggtgatagagtagattacatagactatctcaaccactcaca

SEQ ID NO: 86148 - DNA, 75 bp, Artificial Sequence
  Synthetic
tagatttgacttagagatgacttttgtgctaactgagagatactactcccaaagctcagggcatgctagatctca

SEQ ID NO: 86149 - DNA, 75 bp, Artificial Sequence
  Synthetic
atcggctttggtgatagagtagattacatagactatctcaaccactcacatcacctatacaaaaacaaaacatat

SEQ ID NO: 86150 - DNA, 75 bp, Artificial Sequence
  Synthetic
ctccaacccatccattttctttaccaccggcaatgcaccaccgcgcatttcaattccatttgttggaatcgccaa

SEQ ID NO: 86151 - DNA, 75 bp, Artificial Sequence
  Synthetic
accggcaatgcaccaccgcgcatttcaattccatttgttggaatcgccaatgcatactcacacttttatgatggc

SEQ ID NO: 86152 - DNA, 75 bp, Artificial Sequence
  Synthetic
tttggtacacttgcagtcagggtagttaatgactacaacccagccagggtggagacaaggattagagtatacatg

SEQ ID NO: 86153 - DNA, 75 bp, Artificial Sequence
  Synthetic
ttaatgactacaacccagccagggtggagacaaggattagagtatacatgaagcccaaacatgtgagagtctggt

SEQ ID NO: 86154 - DNA, 75 bp, Artificial Sequence
  Synthetic
atccagtgatgccaatgaaagaaattcatgaatcaatcagatggacgaaagatcctagaaacacgcaggatcacg

SEQ ID NO: 86155 - DNA, 75 bp, Artificial Sequence
  Synthetic
ccaaacatgacctagcgacatacgggtttggccaccagaacaaagcagtttacacagcagggtataagatttgca

SEQ ID NO: 86156 - DNA, 75 bp, Artificial Sequence
  Synthetic
gtttggccaccagaacaaagcagtttacacagcagggtataagatttgcaactaccacctagctacccaggaaga

SEQ ID NO: 86157 - DNA, 75 bp, Artificial Sequence
  Synthetic
aatagccaggtgtaattgcaatacaggtgtatattattgtgagtctaggagaaagtactacccaatttcctttgt

SEQ ID NO: 86158 - DNA, 75 bp, Artificial Sequence
  Synthetic
ggtgtatattattgtgagtctaggagaaagtactacccaatttcctttgtggggccaaccttccaatacatggag

SEQ ID NO: 86159 - DNA, 75 bp, Artificial Sequence
  Synthetic
ggtggcattctcagatgtcaacatggagtcataggattgataactgccgggggcgagggcctagttgcattctcg

SEQ ID NO: 86160 - DNA, 75 bp, Artificial Sequence
  Synthetic
gagtcataggattgataactgccgggggcgagggcctagttgcattctcggacatcagagatttatatgcatatg

SEQ ID NO: 86161 - DNA, 75 bp, Artificial Sequence
  Synthetic
aacagattggagataaaatatcagagcttaccagtatggtcaccagcacgatcactgaaaaattacttaaaaact

SEQ ID NO: 86162 - DNA, 75 bp, Artificial Sequence
  Synthetic
gcttaccagtatggtcaccagcacgatcactgaaaaattacttaaaaacttgatcaaaattatctcgtctcttgt

SEQ ID NO: 86163 - DNA, 75 bp, Artificial Sequence
  Synthetic
atggcaatggctgaagaagaaagcatgtgacatcttagaaatcccctatgttgtaaggcaaggtgatagttggct

SEQ ID NO: 86164 - DNA, 75 bp, Artificial Sequence
  Synthetic
tgtgacatcttagaaatcccctatgttgtaaggcaaggtgatagttggctgaagaaattcaccgaggcgtgcaac

SEQ ID NO: 86165 - DNA, 75 bp, Artificial Sequence
  Synthetic
caagctagagataaacttgagttcgtcactaagcttaagcagctggagatgctagagaatcagattgctaccata

SEQ ID NO: 86166 - DNA, 75 bp, Artificial Sequence
  Synthetic
caccaatcttgtcccagccaagagcatcaggagattctgttcaataatgtacgttggttgtcgatccaatccaaa

SEQ ID NO: 86167 - DNA, 75 bp, Artificial Sequence
  Synthetic
ttcaagagcaaacaccgtattgaaccagtatgtttactagtgcatggtagtccaggaacaggcaagtcagttgca

SEQ ID NO: 86168 - DNA, 75 bp, Artificial Sequence
  Synthetic
cagtatgtttactagtgcatggtagtccaggaacaggcaagtcagttgcaacaaatttaatagctagagcaattg

SEQ ID NO: 86169 - DNA, 75 bp, Artificial Sequence
  Synthetic
tggtaatcatggacgacctcaatcagaaccctgatggggctgacatgaaactattctgtcagatggtgtctacag

SEQ ID NO: 86170 - DNA, 75 bp, Artificial Sequence
  Synthetic
gaaccctgatggggctgacatgaaactattctgtcagatggtgtctacagttgaatttatcccaccaatggcatc

SEQ ID NO: 86171 - DNA, 75 bp, Artificial Sequence
  Synthetic
tctagcatccacgaactcaagcagaatttccccccccactgtggcacacagtgatgcattagccaggcgctttgc

SEQ ID NO: 86172 - DNA, 75 bp, Artificial Sequence
  Synthetic
tactgtagcccatagtgatgcactagccaggaggtttgcctttgacatagatattcaggtcatgaatgagtactc

SEQ ID NO: 86173 - DNA, 75 bp, Artificial Sequence
  Synthetic
gccaggaggtttgcctttgacatagatattcaggtcatgaatgagtactccagagatggaaagcttaatatggca

SEQ ID NO: 86174 - DNA, 75 bp, Artificial Sequence
  Synthetic
gcaattcagttaatggataagtcatcaagagtcaggtatagtgtggatcagattactactatgatcatcaatgaa

SEQ ID NO: 86175 - DNA, 75 bp, Artificial Sequence
  Synthetic
caagagtcaggtatagtgtggatcagattactactatgatcatcaatgaaaggaatagaagatcaaatattggca

SEQ ID NO: 86176 - DNA, 75 bp, Artificial Sequence
  Synthetic
cagagtgcatcaatgatttgctccaggcagttgactcccaagaggttagggactattgtgagaagaaagggtgga

SEQ ID NO: 86177 - DNA, 75 bp, Artificial Sequence
  Synthetic
ggcagttgactcccaagaggttagggactattgtgagaagaaagggtggattgtcaatatcaccagtcaagtcca

SEQ ID NO: 86178 - DNA, 75 bp, Artificial Sequence
  Synthetic
tggcttttgggaacctatatgctgcttttcacaaaaacccaggagtgataacaggttcagcagtagggtgtgatc

SEQ ID NO: 86179 - DNA, 75 bp, Artificial Sequence
  Synthetic
gtacgtcatgtacaaacttttcgctggatatcaaggagcttacaccggcctcccgaacaaaagacctagcgtacc

SEQ ID NO: 86180 - DNA, 75 bp, Artificial Sequence
  Synthetic
ggatatcaaggagcttacaccggcctcccgaacaaaagacctagcgtacctaccattagaactgctaaggtgcag

SEQ ID NO: 86181 - DNA, 75 bp, Artificial Sequence
  Synthetic
accatgctaggagttcatgacaatgtggcgattttaccaactcatgcgtcgcctggagagagcattgtgattgat

SEQ ID NO: 86182 - DNA, 75 bp, Artificial Sequence
  Synthetic
tggcgattttaccaactcatgcgtcgcctggagagagcattgtgattgatggaaaagaggtggagattttagatg

SEQ ID NO: 86183 - DNA, 75 bp, Artificial Sequence
  Synthetic
gagacattagaccacacattcccacacagattactgagactaacgatggagtgctgatcgtgaacactagtaagt

SEQ ID NO: 86184 - DNA, 75 bp, Artificial Sequence
  Synthetic
acagattactgagactaacgatggagtgctgatcgtgaacactagtaagtatcccaacatgtatgtgcctgttgg

SEQ ID NO: 86185 - DNA, 75 bp, Artificial Sequence
  Synthetic
tagagcgggccagtgtggtggagttgtcacttgcactggtaaggtcatcgggatgcatgttggtgggaatggttc

SEQ ID NO: 86186 - DNA, 75 bp, Artificial Sequence
  Synthetic
gtcacttgcactggtaaggtcatcgggatgcatgttggtgggaatggttcacatgggttcgcagcggccctaaag

SEQ ID NO: 86187 - DNA, 75 bp, Artificial Sequence
  Synthetic
aatgctccttccaagactaaattagaacctagtgcctttcattatgtgtttgagggagtcaaagagccagcagtc

SEQ ID NO: 86188 - DNA, 75 bp, Artificial Sequence
  Synthetic
aacctagtgcctttcattatgtgtttgagggagtcaaagagccagcagtccttactaagaatgaccctagactaa

SEQ ID NO: 86189 - DNA, 75 bp, Artificial Sequence
  Synthetic
aagcagtagaccactatgcgggacaactactttccctagacatcaacacagaccagatgtgccttgaggatgcca

SEQ ID NO: 86190 - DNA, 75 bp, Artificial Sequence
  Synthetic
actactttccctagacatcaacacagaccagatgtgccttgaggatgccatgtacggcactgatgggcttgaagc

SEQ ID NO: 86191 - DNA, 75 bp, Artificial Sequence
  Synthetic
aaccagggataccaaggagatgcagagattactcgacacctatggaattaatctacctctagttacttatgtaaa

SEQ ID NO: 86192 - DNA, 75 bp, Artificial Sequence
  Synthetic
agattactcgacacctatggaattaatctacctctagttacttatgtaaaagatgaactcaggtctaagacaaaa

SEQ ID NO: 86193 - DNA, 75 bp, Artificial Sequence
  Synthetic
aacttgtatgcagcattccacaaaaacccaggtgtggtgacaggatctgcagttgggtgcgacccagacctgttc

SEQ ID NO: 86194 - DNA, 75 bp, Artificial Sequence
  Synthetic
acccaggtgtggtgacaggatctgcagttgggtgcgacccagacctgttctggagtaagataccagtgctaatgg

SEQ ID NO: 86195 - DNA, 75 bp, Artificial Sequence
  Synthetic
tggttttggagaaaattggttttggagatagggtagattacattgactacttgaatcactcacaccacttataca

SEQ ID NO: 86196 - DNA, 75 bp, Artificial Sequence
  Synthetic
ccaatgaaggaaattcatgaatcaattagatggactaaagatcccagaaacacccaggatcatgtgcgctcatta

SEQ ID NO: 86197 - DNA, 75 bp, Artificial Sequence
  Synthetic
ttagatggactaaagatcccagaaacacccaggatcatgtgcgctcattatgcctattggcttggcataatggcg

SEQ ID NO: 86198 - DNA, 75 bp, Artificial Sequence
  Synthetic
tacgcctgttttacactcccttccccgtaacttagacgcaataaaccaagttcactaggaggggtgcaaaccagc

SEQ ID NO: 86199 - DNA, 75 bp, Artificial Sequence
  Synthetic
tacgtaactttagaagcaatacacagtgttcattaggaggggcacaaaccagtgtccttaagaacaagcacttct

SEQ ID NO: 86200 - DNA, 75 bp, Artificial Sequence
  Synthetic
tattgagctacaagagagtcctccggcccctgaatgcggctaatcctaaccacggagcaagtgctcacgaaccag

SEQ ID NO: 86201 - DNA, 75 bp, Artificial Sequence
  Synthetic
aaatggctgcttatggtgacaatcattgattgttatcataaagcgaattggattggccatccggtgaaaatcaag

SEQ ID NO: 86202 - DNA, 75 bp, Artificial Sequence
  Synthetic
ttgattgttatcataaagcgaattggattggccatccggtgaaaatcaagttgatcatttatttgtttgttggat

SEQ ID NO: 86203 - DNA, 75 bp, Artificial Sequence
  Synthetic
acacaccattcatctatttgttggattcacctcgttgactcagtttacacccaatttggtacatatagtgatagt

SEQ ID NO: 86204 - DNA, 75 bp, Artificial Sequence
  Synthetic
gcacaagtttcttctcagaaggttggagcgcacgaaaacaccaatgtggcaactggcggttccacagttaattat

SEQ ID NO: 86205 - DNA, 75 bp, Artificial Sequence
  Synthetic
gagcgcacgaaaacaccaatgtggcaactggcggttccacagttaattataccaccatcaactattataaagatt

SEQ ID NO: 86206 - DNA, 75 bp, Artificial Sequence
  Synthetic
ttgataaaaacagccccaatgcttaactctccaaatattgaagcttgtgggtacagtgatagagtcttgcagttg

SEQ ID NO: 86207 - DNA, 75 bp, Artificial Sequence
  Synthetic
tgataaaatcagcaccagcattgaactcaccaaacatagaagcatgtggttacagtgacagagtgatgcaactga

SEQ ID NO: 86208 - DNA, 75 bp, Artificial Sequence
  Synthetic
ctcaccaaacatagaagcatgtggttacagtgacagagtgatgcaactgacattgggaaattccacaatcaccac

SEQ ID NO: 86209 - DNA, 75 bp, Artificial Sequence
  Synthetic
tgcagcttgtagattttatacacttgaaacagtctcttggacgaaagagtcaaagggatggtggtggaagttgcc

SEQ ID NO: 86210 - DNA, 75 bp, Artificial Sequence
  Synthetic
agatcaacccaccgaaccagatgtttcagcatgcagattttacacattagaaacggtggaatgggacagagaatc

SEQ ID NO: 86211 - DNA, 75 bp, Artificial Sequence
  Synthetic
tcagcatgcagattttacacattagaaacggtggaatgggacagagaatccaagggatggtggtggaagctacca

SEQ ID NO: 86212 - DNA, 75 bp, Artificial Sequence
  Synthetic
acacgtgcagtgtaatgcatctaaattccaccaaggggcactcggtgtgttcgccgttccggaaatgtgcctggc

SEQ ID NO: 86213 - DNA, 75 bp, Artificial Sequence
  Synthetic
ttccaccaaggggcactcggtgtgttcgccgttccggaaatgtgcctggccggggatagcaacactacacccacg

SEQ ID NO: 86214 - DNA, 75 bp, Artificial Sequence
  Synthetic
catgtacagtgtaatgcatcaaaattccaccagggaactcttggggtgttcgccgtgcctgagtattgtctcgca

SEQ ID NO: 86215 - DNA, 75 bp, Artificial Sequence
  Synthetic
tccaccagggaactcttggggtgttcgccgtgcctgagtattgtctcgcaggtgattcgaactccaaaaccaatt

SEQ ID NO: 86216 - DNA, 75 bp, Artificial Sequence
  Synthetic
caaacatcacctgcccgtagattctgccctgtggattatctctttggcaatggtactctactgggtaatgcattt

SEQ ID NO: 86217 - DNA, 75 bp, Artificial Sequence
  Synthetic
gccctgtggattatctctttggcaatggtactctactgggtaatgcatttgtgttcccgcaccagataatcaacc

SEQ ID NO: 86218 - DNA, 75 bp, Artificial Sequence
  Synthetic
cagtcccgaaacgagaattccaaccagttgattacctcttcggttgtggtgtcatggcgggtaacgcatttgtct

SEQ ID NO: 86219 - DNA, 75 bp, Artificial Sequence
  Synthetic
agttgattacctcttcggttgtggtgtcatggcgggtaacgcatttgtcttcccacaccaaattataaatttgcg

SEQ ID NO: 86220 - DNA, 75 bp, Artificial Sequence
  Synthetic
ataactgggggatcgctataataccgttggcccccttgaactttgctaatgagtcatctccagaaatccccatta

SEQ ID NO: 86221 - DNA, 75 bp, Artificial Sequence
  Synthetic
ctggggtatagtgatactgccactgtccaagttggattacaaccctgacgcaagcacaaaactgccaatcactgt

SEQ ID NO: 86222 - DNA, 75 bp, Artificial Sequence
  Synthetic
tccaagttggattacaaccctgacgcaagcacaaaactgccaatcactgttacaatagcaccaatgtgttgtgaa

SEQ ID NO: 86223 - DNA, 75 bp, Artificial Sequence
  Synthetic
taccttacctcagacaactttcaatcaccatgtgcattgccggaatttgatgtaacccagcccattttcatacca

SEQ ID NO: 86224 - DNA, 75 bp, Artificial Sequence
  Synthetic
caccatgtgcattgccggaatttgatgtaacccagcccattttcataccaggggaggtgaagaacttaatggaat

SEQ ID NO: 86225 - DNA, 75 bp, Artificial Sequence
  Synthetic
aattgtctgatactggtaatcgcgacaaaccaattttgtgtttgtctctctcgccggcatcagacccgcggcttt

SEQ ID NO: 86226 - DNA, 75 bp, Artificial Sequence
  Synthetic
caaaccaattttgtgtttgtctctctcgccggcatcagacccgcggctttcctacaccatgttgggtgaaatact

SEQ ID NO: 86227 - DNA, 75 bp, Artificial Sequence
  Synthetic
ccccggtgctgacccaccaaagaagcgtaaggaagcgatgttagggacacatgtgatttgggacattggattaca

SEQ ID NO: 86228 - DNA, 75 bp, Artificial Sequence
  Synthetic
attactagttgcatactcaccgcctggtgctcagccacctcaagacagaaaagcagcaatgttaggcacacatgt

SEQ ID NO: 86229 - DNA, 75 bp, Artificial Sequence
  Synthetic
ggtgctcagccacctcaagacagaaaagcagcaatgttaggcacacatgtaatctgggatattggcctacagtcc

SEQ ID NO: 86230 - DNA, 75 bp, Artificial Sequence
  Synthetic
gggtggttacatcagtgtgttttaccagactagaatagtagtacccctatccacgcccagggaaatggacatcct

SEQ ID NO: 86231 - DNA, 75 bp, Artificial Sequence
  Synthetic
cagactagaatagtagtacccctatccacgcccagggaaatggacatcctcgggtttgtgtcagcttgcaatgat

SEQ ID NO: 86232 - DNA, 75 bp, Artificial Sequence
  Synthetic
ggttacattagcatgttttatcaaaccaggatagtggtccctgcatccacaccaaccagcatggacattctgtgt

SEQ ID NO: 86233 - DNA, 75 bp, Artificial Sequence
  Synthetic
ccaggatagtggtccctgcatccacaccaaccagcatggacattctgtgttttgtgtcagcttgcaacgatttta

SEQ ID NO: 86234 - DNA, 75 bp, Artificial Sequence
  Synthetic
gagagtatgatagacaacacagtccgtgagacagtaggggcttcaacctctcgggatgctcttccaaacaccgaa

SEQ ID NO: 86235 - DNA, 75 bp, Artificial Sequence
  Synthetic
aagtggccacgaatgcattgagtctgtcgcagcccacaagacccgcacttccaccagcagaacaaagtgtgccaa

SEQ ID NO: 86236 - DNA, 75 bp, Artificial Sequence
  Synthetic
gtcgcagcccacaagacccgcacttccaccagcagaacaaagtgtgccaaacaccagtcagaccaccccagaaca

SEQ ID NO: 86237 - DNA, 75 bp, Artificial Sequence
  Synthetic
ccctcagacactgtacaaactagacatgtcattcaacacaggtcgcggtcggagtccagtgttgaatccttcttc

SEQ ID NO: 86238 - DNA, 75 bp, Artificial Sequence
  Synthetic
aactagacatgttgttcaaacaagatcaaggagcgaaagtacggtggaatctttctttgcaagaggggcgtgtgt

SEQ ID NO: 86239 - DNA, 75 bp, Artificial Sequence
  Synthetic
tcaaggagcgaaagtacggtggaatctttctttgcaagaggggcgtgtgtcacgattatgggagttgacaactac

SEQ ID NO: 86240 - DNA, 75 bp, Artificial Sequence
  Synthetic
gtttttcacttattccaggtttgacatggagttcacttttgtgatcacagcaaactttacggagaccaacaatgg

SEQ ID NO: 86241 - DNA, 75 bp, Artificial Sequence
  Synthetic
ttgaggagaaaattggaaatgttcacctactccagatttgacattgaatttaccttcgtagtaactgaatgttac

SEQ ID NO: 86242 - DNA, 75 bp, Artificial Sequence
  Synthetic
cctactccagatttgacattgaatttaccttcgtagtaactgaatgttactactcgtcaaacagtggccatgcct

SEQ ID NO: 86243 - DNA, 75 bp, Artificial Sequence
  Synthetic
cacttggcaaacatcatcgaacccatcaattttctacacgtatggcacagcaccggcccgcatctccgtgccgta

SEQ ID NO: 86244 - DNA, 75 bp, Artificial Sequence
  Synthetic
tcaattttctacacgtatggcacagcaccggcccgcatctccgtgccgtacgttggcatatcaaatgcctactca

SEQ ID NO: 86245 - DNA, 75 bp, Artificial Sequence
  Synthetic
aaacatcatcaaacccctcaatattctacacctatggaacagcaccacccagaatttcgatcccttttgtgggca

SEQ ID NO: 86246 - DNA, 75 bp, Artificial Sequence
  Synthetic
ctacacctatggaacagcaccacccagaatttcgatcccttttgtgggcattgcaaacgcgtactcacattttta

SEQ ID NO: 86247 - DNA, 75 bp, Artificial Sequence
  Synthetic
gcctccctaaatgactttggcattctggctgtaagggtggttaatgaccataacccaaccaaggtcacctccaag

SEQ ID NO: 86248 - DNA, 75 bp, Artificial Sequence
  Synthetic
tggctgtaagggtggttaatgaccataacccaaccaaggtcacctccaagattagagtgtatctaaaacccaagc

SEQ ID NO: 86249 - DNA, 75 bp, Artificial Sequence
  Synthetic
caatgactttggtttgttggcggtgcgagttgtcaacgagcacaacccggtaagagtgtcttcaaagataagagt

SEQ ID NO: 86250 - DNA, 75 bp, Artificial Sequence
  Synthetic
cgagttgtcaacgagcacaacccggtaagagtgtcttcaaagataagagtgtacatgaagcctaaacatgtcaga

SEQ ID NO: 86251 - DNA, 75 bp, Artificial Sequence
  Synthetic
cgctcgcacccctttctaccaaagacctgaccacttatgggcatgggcatcagaacaaagcagtatatacggctg

SEQ ID NO: 86252 - DNA, 75 bp, Artificial Sequence
  Synthetic
cctgaccacttatgggcatgggcatcagaacaaagcagtatatacggctggttacaaaatttgcaactaccactt

SEQ ID NO: 86253 - DNA, 75 bp, Artificial Sequence
  Synthetic
cctctccctaccaagaacttaactacttatggatttggacatcagaacaaagcggtgtatgtggcaggttataaa

SEQ ID NO: 86254 - DNA, 75 bp, Artificial Sequence
  Synthetic
cttatggatttggacatcagaacaaagcggtgtatgtggcaggttataaaatagtaaattaccacctggcttcag

SEQ ID NO: 86255 - DNA, 75 bp, Artificial Sequence
  Synthetic
tcagggaactgattccattgccagatgtaactgcaacacgggtgtgtactattgtgaatccagaagaaaatacta

SEQ ID NO: 86256 - DNA, 75 bp, Artificial Sequence
  Synthetic
tgtaactgcaacacgggtgtgtactattgtgaatccagaagaaaatactacccagtctcttttgttggccctacc

SEQ ID NO: 86257 - DNA, 75 bp, Artificial Sequence
  Synthetic
ttgatcagatcgctaggtgtacatgcacaactggagtgtactactgtgagtctagaggaaaacactaccccatca

SEQ ID NO: 86258 - DNA, 75 bp, Artificial Sequence
  Synthetic
cacaactggagtgtactactgtgagtctagaggaaaacactaccccatcacggttacccaacccacattccagtg

SEQ ID NO: 86259 - DNA, 75 bp, Artificial Sequence
  Synthetic
tccccaggagactgcgggggaatcctcaggtgtcaacacggggtcataggcatagtcactgcaggaggagaaggt

SEQ ID NO: 86260 - DNA, 75 bp, Artificial Sequence
  Synthetic
tcaggtgtcaacacggggtcataggcatagtcactgcaggaggagaaggtcttgttgcgttttcagacattagag

SEQ ID NO: 86261 - DNA, 75 bp, Artificial Sequence
  Synthetic
ggactgtggtggcattttgcggtgccagcacggtgtcatgggcttgatcacagccggtggaaatggattggttgc

SEQ ID NO: 86262 - DNA, 75 bp, Artificial Sequence
  Synthetic
cagcacggtgtcatgggcttgatcacagccggtggaaatggattggttgcgttcgcagacatcagggatctttat

SEQ ID NO: 86263 - DNA, 75 bp, Artificial Sequence
  Synthetic
gcagcggtttcactcaacaaattggggataagatttcagaattgaccagcatggtcaccagtaccatcacagaga

SEQ ID NO: 86264 - DNA, 75 bp, Artificial Sequence
  Synthetic
ggataagatttcagaattgaccagcatggtcaccagtaccatcacagagaaattactgaagaacctaattaaaat

SEQ ID NO: 86265 - DNA, 75 bp, Artificial Sequence
  Synthetic
actaaccaaattggagagaaaattagtgagatcacgtctatggtcaactcagtggtcactgaaaagctgctaaag

SEQ ID NO: 86266 - DNA, 75 bp, Artificial Sequence
  Synthetic
gtgagatcacgtctatggtcaactcagtggtcactgaaaagctgctaaagaatctaataaaactagttagtggtc

SEQ ID NO: 86267 - DNA, 75 bp, Artificial Sequence
  Synthetic
ttgtgatgtttccccctggcagtggctcaagaaaaaggcctgtgacattttggaaatcccgtacgtaatccgcca

SEQ ID NO: 86268 - DNA, 75 bp, Artificial Sequence
  Synthetic
ctcaagaaaaaggcctgtgacattttggaaatcccgtacgtaatccgccaaggagatagttggctcaagaggttt

SEQ ID NO: 86269 - DNA, 75 bp, Artificial Sequence
  Synthetic
ctccatggacttggctaaagaaaaaggtctgtgacatcttggagattccattcgtcatgaagcaaagtgattcat

SEQ ID NO: 86270 - DNA, 75 bp, Artificial Sequence
  Synthetic
ggtctgtgacatcttggagattccattcgtcatgaagcaaagtgattcatggatgaagaaattcacagaagcgtg

SEQ ID NO: 86271 - DNA, 75 bp, Artificial Sequence
  Synthetic
gaaaggataatcccacaagccagagacaagctcgagtttgtcaccaaacttaaacagttggagatgctagagaat

SEQ ID NO: 86272 - DNA, 75 bp, Artificial Sequence
  Synthetic
acaagctcgagtttgtcaccaaacttaaacagttggagatgctagagaatcagatctccaccattcatcagtcgt

SEQ ID NO: 86273 - DNA, 75 bp, Artificial Sequence
  Synthetic
tcccgaggctagagacaaggttgaattcgtttccaagctcaaacagttgggtatgctagaaaaccagatcaatac

SEQ ID NO: 86274 - DNA, 75 bp, Artificial Sequence
  Synthetic
ttcgtttccaagctcaaacagttgggtatgctagaaaaccagatcaatactatacaccaatcatgccccagccaa

SEQ ID NO: 86275 - DNA, 75 bp, Artificial Sequence
  Synthetic
cactctacgctgttgaggctaagagaattcagaaactggaacacactatcaacaattacatacagttcaagagca

SEQ ID NO: 86276 - DNA, 75 bp, Artificial Sequence
  Synthetic
aattcagaaactggaacacactatcaacaattacatacagttcaagagcaaacaccgaattgaacctgtatgttt

SEQ ID NO: 86277 - DNA, 75 bp, Artificial Sequence
  Synthetic
acagaggcaaagagaataagtaaactagaaaacaccattaataactacatacagttcaagagcaaacaccgtatt

SEQ ID NO: 86278 - DNA, 75 bp, Artificial Sequence
  Synthetic
tagaaaacaccattaataactacatacagttcaagagcaaacaccgtattgaaccagtatgtgttttaatacatg

SEQ ID NO: 86279 - DNA, 75 bp, Artificial Sequence
  Synthetic
aaacacttctacatactcactgcctccagacccctcccatttcgatggttacaaacaacaaggggttgtgataat

SEQ ID NO: 86280 - DNA, 75 bp, Artificial Sequence
  Synthetic
ccagacccctcccatttcgatggttacaaacaacaaggggttgtgataatggatgatttaaaccagaaccctgat

SEQ ID NO: 86281 - DNA, 75 bp, Artificial Sequence
  Synthetic
cttactcgctcccgccagacccagcacactttgatggctacaagcagcagggtgtggtcattatggatgacctca

SEQ ID NO: 86282 - DNA, 75 bp, Artificial Sequence
  Synthetic
acactttgatggctacaagcagcagggtgtggtcattatggatgacctcaatcaaaaccccgatgggcttgacat

SEQ ID NO: 86283 - DNA, 75 bp, Artificial Sequence
  Synthetic
aaaggcatactcttcacatcaaactatgtcttggcatccaccaattccagtagaatcacaccacccacagtggca

SEQ ID NO: 86284 - DNA, 75 bp, Artificial Sequence
  Synthetic
atgtcttggcatccaccaattccagtagaatcacaccacccacagtggcacatagtgatgccctagctagaaggt

SEQ ID NO: 86285 - DNA, 75 bp, Artificial Sequence
  Synthetic
atttacatcagactatgtactggcttcaaccaattccagtactattacaccacctactgtggcacacagtgatgc

SEQ ID NO: 86286 - DNA, 75 bp, Artificial Sequence
  Synthetic
tcaaccaattccagtactattacaccacctactgtggcacacagtgatgccctaagccggagatttgcttttgac

SEQ ID NO: 86287 - DNA, 75 bp, Artificial Sequence
  Synthetic
aaatgtgtaaaaattgccaccaaccagcaaacttcaaaaggtgctgtccactagtgtgtggtaaagctattcaac

SEQ ID NO: 86288 - DNA, 75 bp, Artificial Sequence
  Synthetic
agcaaacttcaaaaggtgctgtccactagtgtgtggtaaagctattcaactaatggacaagtcctccagagtcag

SEQ ID NO: 86289 - DNA, 75 bp, Artificial Sequence
  Synthetic
gaatgccctcaaccagcaaatttcaaaaagtgctgcccactggtgtgtggcaaggccatccaattaatggacaaa

SEQ ID NO: 86290 - DNA, 75 bp, Artificial Sequence
  Synthetic
aaaagtgctgcccactggtgtgtggcaaggccatccaattaatggacaaatacaccagacagaggtttagtgttg

SEQ ID NO: 86291 - DNA, 75 bp, Artificial Sequence
  Synthetic
agctttattccagggaccactccagtacaaagaccttaagatagacataaagacaaccccgccaccagagtgtat

SEQ ID NO: 86292 - DNA, 75 bp, Artificial Sequence
  Synthetic
tacaaagaccttaagatagacataaagacaaccccgccaccagagtgtatcaatgatttactccaggcagttgac

SEQ ID NO: 86293 - DNA, 75 bp, Artificial Sequence
  Synthetic
aaggatcaatcagctacaaggatctcaaaatagatataaaaacaagcccacccccagaatgcatcagtgacctat

SEQ ID NO: 86294 - DNA, 75 bp, Artificial Sequence
  Synthetic
caaaatagatataaaaacaagcccacccccagaatgcatcagtgacctattacaatctgttgattctcaggaagt

SEQ ID NO: 86295 - DNA, 75 bp, Artificial Sequence
  Synthetic
aacatcagcagagcaatgaccatcctccaagcagtgacgacgttcgctgcagtggctggagtcgtgtacgtaatg

SEQ ID NO: 86296 - DNA, 75 bp, Artificial Sequence
  Synthetic
tccaagcagtgacgacgttcgctgcagtggctggagtcgtgtacgtaatgtacaaactctttgctggtcaccaag

SEQ ID NO: 86297 - DNA, 75 bp, Artificial Sequence
  Synthetic
agccatgacaatcttgcaggcgttaacaacctttgcagctgtggctggagttgtttatgtcatgtacaggttgtt

SEQ ID NO: 86298 - DNA, 75 bp, Artificial Sequence
  Synthetic
acaacctttgcagctgtggctggagttgtttatgtcatgtacaggttgtttgctggacaacaaggagcatacacc

SEQ ID NO: 86299 - DNA, 75 bp, Artificial Sequence
  Synthetic
ttgattatgcagtggcaatggcaaagaggaacatagtaacagctaccaccagtaagggagaattcaccatgcttg

SEQ ID NO: 86300 - DNA, 75 bp, Artificial Sequence
  Synthetic
gtagctatggctaaaagaaacattctgactgccaccactagcaaaggagagttcaccatgctaggtgttcatgac

SEQ ID NO: 86301 - DNA, 75 bp, Artificial Sequence
  Synthetic
tgactgccaccactagcaaaggagagttcaccatgctaggtgttcatgacaatgtcgccattctaccaacacatg

SEQ ID NO: 86302 - DNA, 75 bp, Artificial Sequence
  Synthetic
tggagatcttagatgcaaaggctttggaggatcaggctggaactaacctagaaatcaccatcataactcttaaaa

SEQ ID NO: 86303 - DNA, 75 bp, Artificial Sequence
  Synthetic
cagggaccaaccttgaaatcaccatcataactctcaagagaaatgagaaattcagagacattaggcctcacatac

SEQ ID NO: 86304 - DNA, 75 bp, Artificial Sequence
  Synthetic
tgaacactagtaagtaccccaacatgtatgtccctgtcggtgctgtgactgaacagggatatctcaatcttggtg

SEQ ID NO: 86305 - DNA, 75 bp, Artificial Sequence
  Synthetic
gtatgtccctgtcggtgctgtgactgaacagggatatctcaatcttggtggccgccaaaccgctcgtactctaat

SEQ ID NO: 86306 - DNA, 75 bp, Artificial Sequence
  Synthetic
aagtaccccaatatgtatgtacccgtcggtgctgtaaccgaacagggctacctgaatctcggagggcgccagact

SEQ ID NO: 86307 - DNA, 75 bp, Artificial Sequence
  Synthetic
gcagcggccctaaagcgatcatacttcactcagagtcaaggtgaaatccagtggatgagaccatcaaaagaggtg

SEQ ID NO: 86308 - DNA, 75 bp, Artificial Sequence
  Synthetic
gttcacatgggtttgcagcagccctaaaacggtcatacttcactcaaagtcaaggtgaaatacagtggatgagac

SEQ ID NO: 86309 - DNA, 75 bp, Artificial Sequence
  Synthetic
caaggtgaaatacagtggatgagaccatctaaagaagtgggataccccattatcaacgccccttctaaaaccaaa

SEQ ID NO: 86310 - DNA, 75 bp, Artificial Sequence
  Synthetic
aaggaaccagccgttttgacaaagaatgaccctagactaaagacagattttgaagaagctatcttctctaagtat

SEQ ID NO: 86311 - DNA, 75 bp, Artificial Sequence
  Synthetic
atgaccctagactaaagacagattttgaagaagctatcttctctaagtatgtgggcaataagatcactgaagtgg

SEQ ID NO: 86312 - DNA, 75 bp, Artificial Sequence
  Synthetic
tttttgagggcgtgaaagaaccagctgtgcttactaaaaatgaccctagactgaaaacagactttgaagaggcca

SEQ ID NO: 86313 - DNA, 75 bp, Artificial Sequence
  Synthetic
tgtgcttactaaaaatgaccctagactgaaaacagactttgaagaggccatcttctccaagtatgtggggaacaa

SEQ ID NO: 86314 - DNA, 75 bp, Artificial Sequence
  Synthetic
gccttgaagacgctatgtatggcaccgatggactcgaagccctagatcttagcaccagtgctggatatccttatg

SEQ ID NO: 86315 - DNA, 75 bp, Artificial Sequence
  Synthetic
cgatggactcgaagccctagatcttagcaccagtgctggatatccttatgttgcaatgggaaagaagaagagaga

SEQ ID NO: 86316 - DNA, 75 bp, Artificial Sequence
  Synthetic
cacagagcagatgtgtcttgaggacgccatgtatggcactgatggtcttgaggcattggacctcagtactagtgc

SEQ ID NO: 86317 - DNA, 75 bp, Artificial Sequence
  Synthetic
gccatgtatggcactgatggtcttgaggcattggacctcagtactagtgcagggtacccatatgttgctatggga

SEQ ID NO: 86318 - DNA, 75 bp, Artificial Sequence
  Synthetic
agtcacatatgtgaaggatgaactgaggtccaagactaaagttgagcaaggcaaatctagactaatagaagcttc

SEQ ID NO: 86319 - DNA, 75 bp, Artificial Sequence
  Synthetic
aggtccaagactaaagttgagcaaggcaaatctagactaatagaagcttctagtctcaatgactcagtggcaatg

SEQ ID NO: 86320 - DNA, 75 bp, Artificial Sequence
  Synthetic
ataaacttaccattggtcacatatgtgaaggatgagctcagatcaaaaacaaaagtagaacaaggcaaatccagg

SEQ ID NO: 86321 - DNA, 75 bp, Artificial Sequence
  Synthetic
tgaaggatgagctcagatcaaaaacaaaagtagaacaaggcaaatccaggttgattgaagcctcaagtctcaatg

SEQ ID NO: 86322 - DNA, 75 bp, Artificial Sequence
  Synthetic
gacccagatctgttttggagcaagattccagttctaatggaggaaaaactttttgcttttgattacacaggctat

SEQ ID NO: 86323 - DNA, 75 bp, Artificial Sequence
  Synthetic
actatacaggatatgatgcttcactcagtcctgcttggtttgaggctctcaaaatggttcttgagaaaattggat

SEQ ID NO: 86324 - DNA, 75 bp, Artificial Sequence
  Synthetic
gattacatagattacctcaaccattcccaccatctttacaaaaacaaaacatattgtgtcaagggtggcatgcca

SEQ ID NO: 86325 - DNA, 75 bp, Artificial Sequence
  Synthetic
aaattcatgaatcaattagatggaccaaggatcctaggaacacccaggatcatgttcgctcactgtgcctattgg

SEQ ID NO: 86326 - DNA, 75 bp, Artificial Sequence
  Synthetic
agtatccatttctgatacacccagtcatgccaatgaaagaaattcacgaatctattagatggaccaaagatccca

SEQ ID NO: 86327 - DNA, 75 bp, Artificial Sequence
  Synthetic
tagctaaaattaggagtgtgccaatcggaagagcgttattgctccctgagtactctacattgtaccgccgttggc

SEQ ID NO: 86328 - DNA, 75 bp, Artificial Sequence
  Synthetic
agaagcctagtatcaccttggaatctccgatgcgttgcgctcagcaatgtacccccattgtagcttaggccgatg

SEQ ID NO: 86329 - DNA, 75 bp, Artificial Sequence
  Synthetic
gggtgtccgtgtttccttttattcttataatggctgcttatggtgacaatcatagattgttatcataaagcgaat

SEQ ID NO: 86330 - DNA, 75 bp, Artificial Sequence
  Synthetic
tataatggctgcttatggtgacaatcatagattgttatcataaagcgaattggattggccatccggtgagaatca

SEQ ID NO: 86331 - DNA, 75 bp, Artificial Sequence
  Synthetic
catagattgttatcataaagcgaattggattggccatccggtgagaatcagatcgatcatttacctgtttgtcgg

SEQ ID NO: 86332 - DNA, 75 bp, Artificial Sequence
  Synthetic
gagctcaagtctcatcacaaaaggtcggtgcccatgaaaacaccaatgtggctactggaggttcaactgtgaact

SEQ ID NO: 86333 - DNA, 75 bp, Artificial Sequence
  Synthetic
cggtgcccatgaaaacaccaatgtggctactggaggttcaactgtgaactacacaacaatcaactactacaaaga

SEQ ID NO: 86334 - DNA, 75 bp, Artificial Sequence
  Synthetic
aatgttaaagtcagccccagccctaaattcaccgaatgtggaagcgtgtggctatagcgatcgcgtgcggcaaat

SEQ ID NO: 86335 - DNA, 75 bp, Artificial Sequence
  Synthetic
aattcaccgaatgtggaagcgtgtggctatagcgatcgcgtgcggcaaatcacactcggcaattccaccataacc

SEQ ID NO: 86336 - DNA, 75 bp, Artificial Sequence
  Synthetic
gtggatgctcctaccgagccagacgttagttccaacagattttatacattagaatcggtgcagtggacctcgacc

SEQ ID NO: 86337 - DNA, 75 bp, Artificial Sequence
  Synthetic
ttagttccaacagattttatacattagaatcggtgcagtggacctcgaccagcaagggttggtggtggaaattac

SEQ ID NO: 86338 - DNA, 75 bp, Artificial Sequence
  Synthetic
ttcatgtgcagtgtaacgcatcaaaattccaccaaggagcccttggagtttttgctatacctgaatacgtgatgg

SEQ ID NO: 86339 - DNA, 75 bp, Artificial Sequence
  Synthetic
attccaccaaggagcccttggagtttttgctatacctgaatacgtgatggccactaacactgaagcaaaaacatc

SEQ ID NO: 86340 - DNA, 75 bp, Artificial Sequence
  Synthetic
aactgttagtgtcgtacgcgcctcctggagccgacccaccaaagaagcgcaaggaggcgatgttgggaacacatg

SEQ ID NO: 86341 - DNA, 75 bp, Artificial Sequence
  Synthetic
aactaaccaggggaggtcatttgcagctgttgattacctactggggtgtggtgttcttgcaggcaacgcctttgt

SEQ ID NO: 86342 - DNA, 75 bp, Artificial Sequence
  Synthetic
gctgttgattacctactggggtgtggtgttcttgcaggcaacgcctttgtgttccctcatcaaatcatcaacctg

SEQ ID NO: 86343 - DNA, 75 bp, Artificial Sequence
  Synthetic
aactgggggcttgtgattctacctttggaacctttggcttacgcaccacaagcatccacacaaatccccattaca

SEQ ID NO: 86344 - DNA, 75 bp, Artificial Sequence
  Synthetic
tggaacctttggcttacgcaccacaagcatccacacaaatccccattacagtaactattgcaccgatgtacaccg

SEQ ID NO: 86345 - DNA, 75 bp, Artificial Sequence
  Synthetic
aatatcttacctcagatgattttcaatcgccgtgtgcactacccaactttgacgtcactccaccaattgacattc

SEQ ID NO: 86346 - DNA, 75 bp, Artificial Sequence
  Synthetic
atcgccgtgtgcactacccaactttgacgtcactccaccaattgacattccaggagaagtgaaaaatatgatgga

SEQ ID NO: 86347 - DNA, 75 bp, Artificial Sequence
  Synthetic
tccactaaacactgacggtagcaaagatcccatattttgtttaagtctatcccctgcctctgatcaacgtctcca

SEQ ID NO: 86348 - DNA, 75 bp, Artificial Sequence
  Synthetic
gatcccatattttgtttaagtctatcccctgcctctgatcaacgtctccagtacactatgctaggggaaatctta

SEQ ID NO: 86349 - DNA, 75 bp, Artificial Sequence
  Synthetic
ctgatcttgacgtactcgccaccgggtgcgtctcctccaaagagcagaaaagatgccatgcttggtactcacatc

SEQ ID NO: 86350 - DNA, 75 bp, Artificial Sequence
  Synthetic
gtgcgtctcctccaaagagcagaaaagatgccatgcttggtactcacatcatatgggacttgggattacagtcca

SEQ ID NO: 86351 - DNA, 75 bp, Artificial Sequence
  Synthetic
gttacataacatgtttttatcaaacccgcattgtggtcccagcaagtactccatctagcatggccatgctggctt

SEQ ID NO: 86352 - DNA, 75 bp, Artificial Sequence
  Synthetic
ccgcattgtggtcccagcaagtactccatctagcatggccatgctggcttttgtgagtgcgtgcccagattttag

SEQ ID NO: 86353 - DNA, 75 bp, Artificial Sequence
  Synthetic
aaagttcatagattggttgaaggagaaaatcataccacaagccagagataaactagaattcgttactaagctcaa

SEQ ID NO: 86354 - DNA, 75 bp, Artificial Sequence
  Synthetic
catagataaggtgatcaataatgcattacaactatcacaacccactcgacccaccaccgcgtcagacacacccag

SEQ ID NO: 86355 - DNA, 75 bp, Artificial Sequence
  Synthetic
ttacaactatcacaacccactcgacccaccaccgcgtcagacacacccagtacgagtggagtgaacagccaggag

SEQ ID NO: 86356 - DNA, 75 bp, Artificial Sequence
  Synthetic
aaaatcataccacaagccagagataaactagaattcgttactaagctcaaacaactagaaatgttggagaatcag

SEQ ID NO: 86357 - DNA, 75 bp, Artificial Sequence
  Synthetic
attcagtcaaagagatttgcaccactttatgcactagaggctaaaaggatacagaaactagaacatacaataaac

SEQ ID NO: 86358 - DNA, 75 bp, Artificial Sequence
  Synthetic
gtagttaattacaaaacaagatctgaaagcaccttggaatccttctttggtagatcagcatgtgttactatattg

SEQ ID NO: 86359 - DNA, 75 bp, Artificial Sequence
  Synthetic
aaagcaccttggaatccttctttggtagatcagcatgtgttactatattggaagtggaaaatttcaacgcaacag

SEQ ID NO: 86360 - DNA, 75 bp, Artificial Sequence
  Synthetic
tttatgcactagaggctaaaaggatacagaaactagaacatacaataaacaactacatacagttcaagagcaaac

SEQ ID NO: 86361 - DNA, 75 bp, Artificial Sequence
  Synthetic
ctagagcaattgcagagagggagaacacttcaacatattcactacctcccgatccttcccacttcgatggatata

SEQ ID NO: 86362 - DNA, 75 bp, Artificial Sequence
  Synthetic
tggagtttttcacgtactccaggtttgacttggaaatgacttttgttgtgacagagaggtactacaccagcaact

SEQ ID NO: 86363 - DNA, 75 bp, Artificial Sequence
  Synthetic
tgacttggaaatgacttttgttgtgacagagaggtactacaccagcaactcagggcacgctaaaaattcagtgta

SEQ ID NO: 86364 - DNA, 75 bp, Artificial Sequence
  Synthetic
cacttcaacatattcactacctcccgatccttcccacttcgatggatataaacaacaaggggtagtaattatgga

SEQ ID NO: 86365 - DNA, 75 bp, Artificial Sequence
  Synthetic
accaatggcctccttggaggagaaggggatattattcacttcaaattatgtccttgcatctaccaattcaagcag

SEQ ID NO: 86366 - DNA, 75 bp, Artificial Sequence
  Synthetic
tccttcaatcttttacacttatggaagtgctccagcgcgcatctcaatcccgtatgtgggcatagccaatgctta

SEQ ID NO: 86367 - DNA, 75 bp, Artificial Sequence
  Synthetic
agtgctccagcgcgcatctcaatcccgtatgtgggcatagccaatgcttattcacatttttacgatggctttgca

SEQ ID NO: 86368 - DNA, 75 bp, Artificial Sequence
  Synthetic
cgttcgacatggatatccaggtcatgaatgagtactcgagagatggtaagctcaacatggcaatggcaaccgaga

SEQ ID NO: 86369 - DNA, 75 bp, Artificial Sequence
  Synthetic
accctagcaattagagtggtgaatgagttcaaccccgcccgtattacagcaaaagttcgggtatacatgaaaccg

SEQ ID NO: 86370 - DNA, 75 bp, Artificial Sequence
  Synthetic
agttcaaccccgcccgtattacagcaaaagttcgggtatacatgaaaccgaaacacatacgctgctggtgcccta

SEQ ID NO: 86371 - DNA, 75 bp, Artificial Sequence
  Synthetic
cagcattgatcaaatcaccaccatgatcatcaatgaaagaaacaggagatccaatattggtaactgcatggaagc

SEQ ID NO: 86372 - DNA, 75 bp, Artificial Sequence
  Synthetic
tgaccagtataacaacatatggattcggacaccaaaatcaagcagtttatgttgctgggtataaaataatgaact

SEQ ID NO: 86373 - DNA, 75 bp, Artificial Sequence
  Synthetic
cggacaccaaaatcaagcagtttatgttgctgggtataaaataatgaactatcacctggccactgcaaatgattt

SEQ ID NO: 86374 - DNA, 75 bp, Artificial Sequence
  Synthetic
tgatctactccaggcagttgactcccaagaggttagggattattgtgaaaagaaaggatggatagtcaacatcac

SEQ ID NO: 86375 - DNA, 75 bp, Artificial Sequence
  Synthetic
caagaggttagggattattgtgaaaagaaaggatggatagtcaacatcactagtcaggttcaaacagaaaggaac

SEQ ID NO: 86376 - DNA, 75 bp, Artificial Sequence
  Synthetic
tgctaggtgctcatgcgtgactggagtctactactgtttgtcacgcaacaagtattatccagtcaccatcactag

SEQ ID NO: 86377 - DNA, 75 bp, Artificial Sequence
  Synthetic
gtctactactgtttgtcacgcaacaagtattatccagtcaccatcactaggccaacttttcaatggatggaagct

SEQ ID NO: 86378 - DNA, 75 bp, Artificial Sequence
  Synthetic
aagttgtttgctgggcaacaaggagcatacactggtttaccaaataagaagccaaatatacccaccatcagaact

SEQ ID NO: 86379 - DNA, 75 bp, Artificial Sequence
  Synthetic
catacactggtttaccaaataagaagccaaatatacccaccatcagaactgcaaaagtgcagggaccaggatttg

SEQ ID NO: 86380 - DNA, 75 bp, Artificial Sequence
  Synthetic
ggcattctcagatgtcaacatggagtgatgggactcattactgctggcggcaacggaatcgttgcttttgctgac

SEQ ID NO: 86381 - DNA, 75 bp, Artificial Sequence
  Synthetic
tgatgggactcattactgctggcggcaacggaatcgttgcttttgctgacatcagagacttgtatgtggaggagg

SEQ ID NO: 86382 - DNA, 75 bp, Artificial Sequence
  Synthetic
ttcatgacaatgtggccattttaccaacacatgcatcacccggtgaaactattgtgattgatgggaaggaagtgg

SEQ ID NO: 86383 - DNA, 75 bp, Artificial Sequence
  Synthetic
aacacatgcatcacccggtgaaactattgtgattgatgggaaggaagtggaggttctggatgccaaggcactcga

SEQ ID NO: 86384 - DNA, 75 bp, Artificial Sequence
  Synthetic
taagtgagaaagtcactgaaattgcctctatggtcaatagtgtcatcacggagaagttgttgaaaaacttgatca

SEQ ID NO: 86385 - DNA, 75 bp, Artificial Sequence
  Synthetic
ctctatggtcaatagtgtcatcacggagaagttgttgaaaaacttgatcaaactgattagtagcttggtgataat

SEQ ID NO: 86386 - DNA, 75 bp, Artificial Sequence
  Synthetic
acactagtaagtaccccaacatgtatgtccctgttggtgctgtgaccgaacaagggtatctcaatcttggtggcc

SEQ ID NO: 86387 - DNA, 75 bp, Artificial Sequence
  Synthetic
ctggctcagaaagaaggcttgtgatattctggagctaccctatgtgtgcagacaaggagattcctggctgaagaa

SEQ ID NO: 86388 - DNA, 75 bp, Artificial Sequence
  Synthetic
attctggagctaccctatgtgtgcagacaaggagattcctggctgaagaaatttactgaggcttgcaatgcagca

SEQ ID NO: 86389 - DNA, 75 bp, Artificial Sequence
  Synthetic
gtaaagtcatcgggatgcacgttggtgggaacggttcacacgggttcgcagcggccctaaaacggtcatacttca

SEQ ID NO: 86390 - DNA, 75 bp, Artificial Sequence
  Synthetic
tgggaacggttcacacgggttcgcagcggccctaaaacggtcatacttcattcagagtcaaggtgagattcaatg

SEQ ID NO: 86391 - DNA, 75 bp, Artificial Sequence
  Synthetic
agagacaaggtggcgtatgtcactaagctgaagcagttgggaatgcttgagaatcagattaatacaattcaccag

SEQ ID NO: 86392 - DNA, 75 bp, Artificial Sequence
  Synthetic
agctgaagcagttgggaatgcttgagaatcagattaatacaattcaccagtcttgtcctagccaagaacaacaag

SEQ ID NO: 86393 - DNA, 75 bp, Artificial Sequence
  Synthetic
tcactatgtatttgaaggagtcaaggagccagcagtgctaaccaagaatgacccaagactaaaaacagactttga

SEQ ID NO: 86394 - DNA, 75 bp, Artificial Sequence
  Synthetic
gagccagcagtgctaaccaagaatgacccaagactaaaaacagactttgaagaagccatcttttccaagtacgtt

SEQ ID NO: 86395 - DNA, 75 bp, Artificial Sequence
  Synthetic
aacgcatttccaaactagagaatacaatcaacaattatatacagttcaagagcaaacaccgtattgagccagtat

SEQ ID NO: 86396 - DNA, 75 bp, Artificial Sequence
  Synthetic
aatcaacaattatatacagttcaagagcaaacaccgtattgagccagtatgtatgttgatacatggtagtccagg

SEQ ID NO: 86397 - DNA, 75 bp, Artificial Sequence
  Synthetic
gacatcaacactgagcaaatgtgtcttgaagatgcgatgtatggtactgatggtcttgaagccttagatcttagc

SEQ ID NO: 86398 - DNA, 75 bp, Artificial Sequence
  Synthetic
ttgaagatgcgatgtatggtactgatggtcttgaagccttagatcttagcactagtgctggttacccctatgttg

SEQ ID NO: 86399 - DNA, 75 bp, Artificial Sequence
  Synthetic
tcccccagatccagcacacttcgatgggtacaaacagcaaggagtagttataatggatgatttgaaccaaaaccc

SEQ ID NO: 86400 - DNA, 75 bp, Artificial Sequence
  Synthetic
gggtacaaacagcaaggagtagttataatggatgatttgaaccaaaacccggacggagaagacatgaaactcttt

SEQ ID NO: 86401 - DNA, 75 bp, Artificial Sequence
  Synthetic
cctatggaattaacttacccctagtgacttacgtgaaggatgaactcaggtcaaaaacaaaggtggagcaaggca

SEQ ID NO: 86402 - DNA, 75 bp, Artificial Sequence
  Synthetic
gacttacgtgaaggatgaactcaggtcaaaaacaaaggtggagcaaggcaagtccagactgattgaggcctctag

SEQ ID NO: 86403 - DNA, 75 bp, Artificial Sequence
  Synthetic
gactatgtccttgcctccactaattctggtagtatagtacccccaactgtgtctagtgcagatgctctgagcagg

SEQ ID NO: 86404 - DNA, 75 bp, Artificial Sequence
  Synthetic
ctggtagtatagtacccccaactgtgtctagtgcagatgctctgagcaggaggtttgccttcgatatggatgtat

SEQ ID NO: 86405 - DNA, 75 bp, Artificial Sequence
  Synthetic
gacaggctcggcagtcggttgtgatccagatttattttggagtaaaataccagtgcttatggaagaaaaactctt

SEQ ID NO: 86406 - DNA, 75 bp, Artificial Sequence
  Synthetic
agccagcaaatttcaaaaagtgttgccctttgatttgcggtaaagccatacagttgatggataagcacaccagac

SEQ ID NO: 86407 - DNA, 75 bp, Artificial Sequence
  Synthetic
ccctttgatttgcggtaaagccatacagttgatggataagcacaccagacaaaggtttaccgttgatgagatcac

SEQ ID NO: 86408 - DNA, 75 bp, Artificial Sequence
  Synthetic
aatagggtttggagacagggttgattacatcgactatttaaatcactcacatcacttatacaaaaacaagaccta

SEQ ID NO: 86409 - DNA, 75 bp, Artificial Sequence
  Synthetic
acaatacagggatttgaaaatagacatcaaaaccacccctccaccagagtgtatcaatgacttattgcaatcagt

SEQ ID NO: 86410 - DNA, 75 bp, Artificial Sequence
  Synthetic
atcaaaaccacccctccaccagagtgtatcaatgacttattgcaatcagtggatagccaagaagttagggactac

SEQ ID NO: 86411 - DNA, 75 bp, Artificial Sequence
  Synthetic
attctgcaagcaataaccacctttgctgcagttgctggcgttgtttacgtgatgtatcgtctatttgcagggcaa

SEQ ID NO: 86412 - DNA, 75 bp, Artificial Sequence
  Synthetic
ctgcagttgctggcgttgtttacgtgatgtatcgtctatttgcagggcaacagggaccatacacagggctacccg

SEQ ID NO: 86413 - DNA, 75 bp, Artificial Sequence
  Synthetic
caaagagaaacatcttgacagccaccactgataaaggagaattcactatgctaggagtgcatgacaatgtcgcaa

SEQ ID NO: 86414 - DNA, 75 bp, Artificial Sequence
  Synthetic
tgaaaccattgtcattgatgggaaggaagtcaaaattatagatgctcaagcactggtggaccaggcaggaacaaa

SEQ ID NO: 86415 - DNA, 75 bp, Artificial Sequence
  Synthetic
acatgtatgtcccagtcggtgctgtgaccgagcagggatacctcaatctcggtggacgccaaactgcccgcactt

SEQ ID NO: 86416 - DNA, 75 bp, Artificial Sequence
  Synthetic
atgttggagggaacggttcacatgggttcgcagcggccctaaaacggtcatacttcacccagagccaaggtgaga

SEQ ID NO: 86417 - DNA, 75 bp, Artificial Sequence
  Synthetic
gttcgcagcggccctaaaacggtcatacttcacccagagccaaggtgagatacagtggatgagaccatccaagga

SEQ ID NO: 86418 - DNA, 75 bp, Artificial Sequence
  Synthetic
ggttaaggaaccagcagtcttaactaagaacgaccccaggttaaggacagactttgaagaggccattttctcaaa

SEQ ID NO: 86419 - DNA, 75 bp, Artificial Sequence
  Synthetic
aagaacgaccccaggttaaggacagactttgaagaggccattttctcaaaatatgtaggaaacaagattactgaa

SEQ ID NO: 86420 - DNA, 75 bp, Artificial Sequence
  Synthetic
agtaccaccacgaacaagcacttctgtttccccggtgaacttgtatagactgtacccacggtcgaaaacgagtga

SEQ ID NO: 86421 - DNA, 75 bp, Artificial Sequence
  Synthetic
atgtgtcttgaggacgccatgtacgggactgatgggcttgaggctttagatctcagtaccagtgctggttacccc

SEQ ID NO: 86422 - DNA, 75 bp, Artificial Sequence
  Synthetic
ggactgatgggcttgaggctttagatctcagtaccagtgctggttacccctacgtggcaatgggaaaaaagaaga

SEQ ID NO: 86423 - DNA, 75 bp, Artificial Sequence
  Synthetic
cccttgtcacatatgtgaaagacgaacttaggtcgaaaaccaaagtggaacaagggaaatccaggttaattgagg

SEQ ID NO: 86424 - DNA, 75 bp, Artificial Sequence
  Synthetic
acttaggtcgaaaaccaaagtggaacaagggaaatccaggttaattgaggcttcaagtttgaatgattcagtggc

SEQ ID NO: 86425 - DNA, 75 bp, Artificial Sequence
  Synthetic
tgggtgtccgtgtttctctttatttttacaatggctgcttatggtgacaatcttagattgttgtcataaagcgaa

SEQ ID NO: 86426 - DNA, 75 bp, Artificial Sequence
  Synthetic
atgtgacccagacttattttggagcaaaataccagtcttaatggaggagaagctctttgctttcgattacacagg

SEQ ID NO: 86427 - DNA, 75 bp, Artificial Sequence
  Synthetic
agctctttgctttcgattacacaggatatgatgcttctctcagccccgcctggtttgaggcccttaaaatggtcc

SEQ ID NO: 86428 - DNA, 75 bp, Artificial Sequence
  Synthetic
ttatcatttaatacaagtagtgttattgataagaagtgttcaccacaatgggagctcaagtctcatctcagaaag

SEQ ID NO: 86429 - DNA, 75 bp, Artificial Sequence
  Synthetic
ttgataagaagtgttcaccacaatgggagctcaagtctcatctcagaaagtcggggcccatgaaaacactaatat

SEQ ID NO: 86430 - DNA, 75 bp, Artificial Sequence
  Synthetic
acaggatttttctcaagacccatccaaatttaccgaaccagtcaaagacgtgttgatcaagtccgcacccgcact

SEQ ID NO: 86431 - DNA, 75 bp, Artificial Sequence
  Synthetic
aaatttaccgaaccagtcaaagacgtgttgatcaagtccgcacccgcactgaattcaccaaatattgaggcatgt

SEQ ID NO: 86432 - DNA, 75 bp, Artificial Sequence
  Synthetic
tgaggttgacgctagtctcctagcccaatcaggaaaagactatggactaaccatgactccagctgataaatcggc

SEQ ID NO: 86433 - DNA, 75 bp, Artificial Sequence
  Synthetic
gtggcatatggagtttggccatcgtatctcagtgcaaaggatgcaaacccagtagaccaaccaactgaaccagat

SEQ ID NO: 86434 - DNA, 75 bp, Artificial Sequence
  Synthetic
atctcagtgcaaaggatgcaaacccagtagaccaaccaactgaaccagatgtttcagcatgtaggttctacacat

SEQ ID NO: 86435 - DNA, 75 bp, Artificial Sequence
  Synthetic
aaggaaattcatgaatcaatcagatggaccaaagatcctcgaaacacccaggatcatgttcgctcactatgccta

SEQ ID NO: 86436 - DNA, 75 bp, Artificial Sequence
  Synthetic
tgtttggacagaacatgtactatcactatcttggccgttcaggatacactgtacacgtgcagtgcaatgcctcta

SEQ ID NO: 86437 - DNA, 75 bp, Artificial Sequence
  Synthetic
ctatcttggccgttcaggatacactgtacacgtgcagtgcaatgcctctaaatttcaccaggggaccctaggtgt

SEQ ID NO: 86438 - DNA, 75 bp, Artificial Sequence
  Synthetic
cccaggtgaggcaggtggcaagtttgtatcaacatttacaccagataccagtgccgcaccaaagcgcgaattcca

SEQ ID NO: 86439 - DNA, 75 bp, Artificial Sequence
  Synthetic
gtatcaacatttacaccagataccagtgccgcaccaaagcgcgaattccaaccagtggattacttgtttggttgc

SEQ ID NO: 86440 - DNA, 75 bp, Artificial Sequence
  Synthetic
gtgttaccatatgttaattcattggctattgactgtatggccaaacataacaattggggaattgttatactacca

SEQ ID NO: 86441 - DNA, 75 bp, Artificial Sequence
  Synthetic
ctattgactgtatggccaaacataacaattggggaattgttatactaccactttcaaaactcgactacaaccctg

SEQ ID NO: 86442 - DNA, 75 bp, Artificial Sequence
  Synthetic
ccccgagtgtagcttaggctgatgagtctgggcattccccaccggtgacggtggcccaggctgcgttggcggcct

SEQ ID NO: 86443 - DNA, 75 bp, Artificial Sequence
  Synthetic
caatccccgcagcacagggactcccggttatgaacaccccaggtagtaaccaatacttgacttccgacaactttc

SEQ ID NO: 86444 - DNA, 75 bp, Artificial Sequence
  Synthetic
ggttatgaacaccccaggtagtaaccaatacttgacttccgacaactttcagtcaccatgtgccttaccagagtt

SEQ ID NO: 86445 - DNA, 75 bp, Artificial Sequence
  Synthetic
accaatggatttaagcgagggcaagaaaaattcaatggagatgtacagggttaagctatctgattcagctaatag

SEQ ID NO: 86446 - DNA, 75 bp, Artificial Sequence
  Synthetic
attgattgccatcataaagcgagttggattggccatccggtgaaagtcaagaacctcgtccacttatcttttgga

SEQ ID NO: 86447 - DNA, 75 bp, Artificial Sequence
  Synthetic
aaaaattcaatggagatgtacagggttaagctatctgattcagctaatagaagcaatccaatattgtgcttgtca

SEQ ID NO: 86448 - DNA, 75 bp, Artificial Sequence
  Synthetic
ggttcactcaaattctctttcctattctgtggttccatgatggccactggaaaattattggtagcttattcacca

SEQ ID NO: 86449 - DNA, 75 bp, Artificial Sequence
  Synthetic
tctgtggttccatgatggccactggaaaattattggtagcttattcaccacctggagctcaaccacctccagaca

SEQ ID NO: 86450 - DNA, 75 bp, Artificial Sequence
  Synthetic
cgtatggtggttccactatcaactacaccaccattaattattatagagactcagctagcaacgcggcttcgaaac

SEQ ID NO: 86451 - DNA, 75 bp, Artificial Sequence
  Synthetic
ggatcagcaacaccggatatcgtaggactgtcaaggatgacttcacagaaggtggatacatcagcatgttttacc

SEQ ID NO: 86452 - DNA, 75 bp, Artificial Sequence
  Synthetic
gactgtcaaggatgacttcacagaaggtggatacatcagcatgttttaccagacgcgtgtggttgttccagcgtc

SEQ ID NO: 86453 - DNA, 75 bp, Artificial Sequence
  Synthetic
ctcaggaagcggcaaattcagtggtcgcatatgggcggtggccagaatatttgagagacagtgaagccaacccag

SEQ ID NO: 86454 - DNA, 75 bp, Artificial Sequence
  Synthetic
tacacacatcactcaagacgcactaacacaaggaatcgaggatataatacaacaagtggccacaaacgcgctgca

SEQ ID NO: 86455 - DNA, 75 bp, Artificial Sequence
  Synthetic
acacaaggaatcgaggatataatacaacaagtggccacaaacgcgctgcaactgtcacaacccacacgaccggcg

SEQ ID NO: 86456 - DNA, 75 bp, Artificial Sequence
  Synthetic
caaaagggtggtggtggaaactacccgatgcactgagggacatgggattgtttgggcagaatatgtattaccact

SEQ ID NO: 86457 - DNA, 75 bp, Artificial Sequence
  Synthetic
accgctgtcgaaactggagcgacaaacccgttagagcccagtgacactgtgcaaacacggcacgtgatccaaaca

SEQ ID NO: 86458 - DNA, 75 bp, Artificial Sequence
  Synthetic
acccgttagagcccagtgacactgtgcaaacacggcacgtgatccaaacacgttccaggagtgagagcacggtgg

SEQ ID NO: 86459 - DNA, 75 bp, Artificial Sequence
  Synthetic
gggtacttttacaccagataataatcagacaacgcccgcccgtaagttctgccccgtggattacctctttggtaa

SEQ ID NO: 86460 - DNA, 75 bp, Artificial Sequence
  Synthetic
aaaagtcaacactgtttgcaacgtggaatgtcacctacactgacactgtgcagctcagaagaaaactagaaatgt

SEQ ID NO: 86461 - DNA, 75 bp, Artificial Sequence
  Synthetic
gaatgtcacctacactgacactgtgcagctcagaagaaaactagaaatgttcacatactccagatttgatattga

SEQ ID NO: 86462 - DNA, 75 bp, Artificial Sequence
  Synthetic
gtatgttcctcctggagcgccggttccaaagaaatgggatgattacacatggcagacttcgtccaacccatctat

SEQ ID NO: 86463 - DNA, 75 bp, Artificial Sequence
  Synthetic
ccaaagaaatgggatgattacacatggcagacttcgtccaacccatctatcttctacacctatggcactgctcca

SEQ ID NO: 86464 - DNA, 75 bp, Artificial Sequence
  Synthetic
gagtcatccccagagatccccatcacgctaaccatagcaccgatgtgctgtgagtttaatgggttgagaaacatc

SEQ ID NO: 86465 - DNA, 75 bp, Artificial Sequence
  Synthetic
ttgcgaacggacaccaccgaccctggcgcagcttactatggtgcagtatccatcaatgactttggactactagca

SEQ ID NO: 86466 - DNA, 75 bp, Artificial Sequence
  Synthetic
gcgcagcttactatggtgcagtatccatcaatgactttggactactagcagttcgtgtggtcaacgaacacaacc

SEQ ID NO: 86467 - DNA, 75 bp, Artificial Sequence
  Synthetic
gggcagtcaaatattatggacctggagttgactacaaaagtggaacacttgagcccctaccagccaagaacctaa

SEQ ID NO: 86468 - DNA, 75 bp, Artificial Sequence
  Synthetic
agttgactacaaaagtggaacacttgagcccctaccagccaagaacctaaccacttatggttttggacaccaaaa

SEQ ID NO: 86469 - DNA, 75 bp, Artificial Sequence
  Synthetic
tcgcagtttgtggcagagagatcttatggttgtggaatcaaaagcacaaggcatagatcagattgccaggtgttc

SEQ ID NO: 86470 - DNA, 75 bp, Artificial Sequence
  Synthetic
atggttgtggaatcaaaagcacaaggcatagatcagattgccaggtgttcatgcaggtgcggcgtctactattgt

SEQ ID NO: 86471 - DNA, 75 bp, Artificial Sequence
  Synthetic
tggatcagcaacaccacatacagacaaaccattgatgacagttttactgagggtggttatattagtgtgttttac

SEQ ID NO: 86472 - DNA, 75 bp, Artificial Sequence
  Synthetic
ccagcacgatatcaaacacacataaccatcggaagtggatttgccgcccctggcgactgcggtggtgttttgcga

SEQ ID NO: 86473 - DNA, 75 bp, Artificial Sequence
  Synthetic
ccatcggaagtggatttgccgcccctggcgactgcggtggtgttttgcgatgtcaacacggtgtcatgggcctga

SEQ ID NO: 86474 - DNA, 75 bp, Artificial Sequence
  Synthetic
agggggtcacctcatacatagagtcccttggtgcggcatttggtagtgggtttaccaatcaaattagcgagaagg

SEQ ID NO: 86475 - DNA, 75 bp, Artificial Sequence
  Synthetic
gagagcatgatagacaacacagttcgtgaaacgataggagcttcgacctcaagggatgccctcccgaacaccgag

SEQ ID NO: 86476 - DNA, 75 bp, Artificial Sequence
  Synthetic
ccttggtgcggcatttggtagtgggtttaccaatcaaattagcgagaaggtgactgaattaacatctatggtgac

SEQ ID NO: 86477 - DNA, 75 bp, Artificial Sequence
  Synthetic
tgaagataccactactgtgttggcaactttggctcttctaggttgtgatgtgtcaccatgggcatggttgaagaa

SEQ ID NO: 86478 - DNA, 75 bp, Artificial Sequence
  Synthetic
actttggctcttctaggttgtgatgtgtcaccatgggcatggttgaagaagaaagtgtgtgacatattggaaatt

SEQ ID NO: 86479 - DNA, 75 bp, Artificial Sequence
  Synthetic
ctgtgcaactgagaagaaagctggagtttttcacgtattccagatttgacatggaattcacctttgtaatcactg

SEQ ID NO: 86480 - DNA, 75 bp, Artificial Sequence
  Synthetic
tggattagtaacaaaatttccaaattcattgagtggataaagaacaaagtgatccctgaggcaaaagacaaagtt

SEQ ID NO: 86481 - DNA, 75 bp, Artificial Sequence
  Synthetic
tcattgagtggataaagaacaaagtgatccctgaggcaaaagacaaagttgaattcatatccaagctgaaacaac

SEQ ID NO: 86482 - DNA, 75 bp, Artificial Sequence
  Synthetic
acaatgtgaggtggcttgcaattcaatcaaggaggttcgcaccattgtacgcagcggaggctaaaagaattagca

SEQ ID NO: 86483 - DNA, 75 bp, Artificial Sequence
  Synthetic
atcaaggaggttcgcaccattgtacgcagcggaggctaaaagaattagcaaacttgagaacaccatcaacaatta

SEQ ID NO: 86484 - DNA, 75 bp, Artificial Sequence
  Synthetic
agttgccactagcctaatggggagagctattgctgaaaaggagaacacatccacgtactcattacccccagaccc

SEQ ID NO: 86485 - DNA, 75 bp, Artificial Sequence
  Synthetic
gctattgctgaaaaggagaacacatccacgtactcattacccccagaccccacgcactttgatggctacaaacaa

SEQ ID NO: 86486 - DNA, 75 bp, Artificial Sequence
  Synthetic
accgagagcagtggcgtattatggtccaggcgtggactacaaggatggaactctcacccccctctctacaaaaga

SEQ ID NO: 86487 - DNA, 75 bp, Artificial Sequence
  Synthetic
ccaggcgtggactacaaggatggaactctcacccccctctctacaaaagatctgaccacttatgggctcggacac

SEQ ID NO: 86488 - DNA, 75 bp, Artificial Sequence
  Synthetic
tccacagtcgagttcatacccccaatggcatccctggaagaaaagggcattctattcacatccgattacgttctg

SEQ ID NO: 86489 - DNA, 75 bp, Artificial Sequence
  Synthetic
tggcatccctggaagaaaagggcattctattcacatccgattacgttctggcatccactaactccagcaccataa

SEQ ID NO: 86490 - DNA, 75 bp, Artificial Sequence
  Synthetic
gcggtgaacattatgtggaatagagacctgataattgttgaatccaaagcccagggtattgattccatagccaga

SEQ ID NO: 86491 - DNA, 75 bp, Artificial Sequence
  Synthetic
acctgataattgttgaatccaaagcccagggtattgattccatagccagatgcacatgcaataccggtgtttact

SEQ ID NO: 86492 - DNA, 75 bp, Artificial Sequence
  Synthetic
agtacacagtaaaaggtaagcttaacatggctgaggccacaagaatctgcaaggactgccacccaccagccaact

SEQ ID NO: 86493 - DNA, 75 bp, Artificial Sequence
  Synthetic
catggctgaggccacaagaatctgcaaggactgccacccaccagccaacttcaaaaagtgctgcccactggtgtg

SEQ ID NO: 86494 - DNA, 75 bp, Artificial Sequence
  Synthetic
attacccagcaagatatcagtcccacatgctcatcggtcacgggttcgcatcccccggtgactgtgggggcatct

SEQ ID NO: 86495 - DNA, 75 bp, Artificial Sequence
  Synthetic
catgctcatcggtcacgggttcgcatcccccggtgactgtgggggcatcttgaggtgccaacatggggtaatagg

SEQ ID NO: 86496 - DNA, 75 bp, Artificial Sequence
  Synthetic
taatgaaaaagtcaggagatcaaacatcggcaactgtatggaagctctgtttcaaggcccgttgcaatatcgaga

SEQ ID NO: 86497 - DNA, 75 bp, Artificial Sequence
  Synthetic
atcggcaactgtatggaagctctgtttcaaggcccgttgcaatatcgagacctaaaaatagatattaagactagc

SEQ ID NO: 86498 - DNA, 75 bp, Artificial Sequence
  Synthetic
tatggagcagggaatttctaactatattgagtctcttggagctgctttcgggagtggattcactcagcaaattgg

SEQ ID NO: 86499 - DNA, 75 bp, Artificial Sequence
  Synthetic
attgagtctcttggagctgctttcgggagtggattcactcagcaaattggggacaagatctcagagctaactaat

SEQ ID NO: 86500 - DNA, 75 bp, Artificial Sequence
  Synthetic
ggatggatagttaatgtctccagtgacatcacaattgaaagaaacctcaacagggcaatgacaattctccaagca

SEQ ID NO: 86501 - DNA, 75 bp, Artificial Sequence
  Synthetic
acatcacaattgaaagaaacctcaacagggcaatgacaattctccaagcattaacaacatttgctgcagtagcag

SEQ ID NO: 86502 - DNA, 75 bp, Artificial Sequence
  Synthetic
agaaactacgaggacaccaccactgttctcgctaccctagcgctcctgggatgtgacgtctccccatggcaatgg

SEQ ID NO: 86503 - DNA, 75 bp, Artificial Sequence
  Synthetic
ttctcgctaccctagcgctcctgggatgtgacgtctccccatggcaatggttgaagaagaaagcatgcgacatct

SEQ ID NO: 86504 - DNA, 75 bp, Artificial Sequence
  Synthetic
acattcctaccatcagaacagctaaagtccaaggcccaggctttgactacgctgtcgccatggctaagagaaata

SEQ ID NO: 86505 - DNA, 75 bp, Artificial Sequence
  Synthetic
agtccaaggcccaggctttgactacgctgtcgccatggctaagagaaatattgtgacagccaccaccagtaaagg

SEQ ID NO: 86506 - DNA, 75 bp, Artificial Sequence
  Synthetic
ggcttgaatgggtttcaaacaagatctccaaattcattgattggttgaaagaaaagatcataccccaagctagag

SEQ ID NO: 86507 - DNA, 75 bp, Artificial Sequence
  Synthetic
ctccaaattcattgattggttgaaagaaaagatcataccccaagctagagacaaactcgagtttgtgaccaaact

SEQ ID NO: 86508 - DNA, 75 bp, Artificial Sequence
  Synthetic
cattgatggcaaggaagtagaggtattggatgcaaaagcactagaagatcaagctgggactaatttggaaattac

SEQ ID NO: 86509 - DNA, 75 bp, Artificial Sequence
  Synthetic
ttggatgcaaaagcactagaagatcaagctgggactaatttggaaattaccattgttactctcaagagaaatgag

SEQ ID NO: 86510 - DNA, 75 bp, Artificial Sequence
  Synthetic
tctcttcaacaacgtgaggtggttatccatccagtctaagagatttgcccctctttatgctgtagaagcaaagag

SEQ ID NO: 86511 - DNA, 75 bp, Artificial Sequence
  Synthetic
tccatccagtctaagagatttgcccctctttatgctgtagaagcaaagagaattcaaaaattggagcacacaatc

SEQ ID NO: 86512 - DNA, 75 bp, Artificial Sequence
  Synthetic
ctgtcggtgcagtgaccgaacaagggtatctcaatttgggtgggcgccaaacagctcgcactcttatgtataact

SEQ ID NO: 86513 - DNA, 75 bp, Artificial Sequence
  Synthetic
ggcaagtcagttgcaactaacttgattgcaagggcaatagctgagaaagaaaacacatctacctactctctacca

SEQ ID NO: 86514 - DNA, 75 bp, Artificial Sequence
  Synthetic
ttgcaagggcaatagctgagaaagaaaacacatctacctactctctaccaccggaccctagccatttcgacgggt

SEQ ID NO: 86515 - DNA, 75 bp, Artificial Sequence
  Synthetic
acggttcacatgggttcgctgcggccctaaaacggtcatacttcactcagagtcaaggtgaaattcagtggatga

SEQ ID NO: 86516 - DNA, 75 bp, Artificial Sequence
  Synthetic
aaatggtctccacagtggaatttatcccaccaatggcgtccctagaggagaagggcatactattcacctccaatt

SEQ ID NO: 86517 - DNA, 75 bp, Artificial Sequence
  Synthetic
cccaccaatggcgtccctagaggagaagggcatactattcacctccaattatgtgttggcatccacaaactccag

SEQ ID NO: 86518 - DNA, 75 bp, Artificial Sequence
  Synthetic
acatctttgagggggttaaggaaccagcagttctgaccaagaacgaccccagactaaaaacagacttcgaggagg

SEQ ID NO: 86519 - DNA, 75 bp, Artificial Sequence
  Synthetic
agcagttctgaccaagaacgaccccagactaaaaacagacttcgaggaggctatcttttctaaatatgtaggcaa

SEQ ID NO: 86520 - DNA, 75 bp, Artificial Sequence
  Synthetic
tatgggtgagtactccagggacggcaagctcaatatggcaatggccacagaaatgtgcaaaaactgccatcaacc

SEQ ID NO: 86521 - DNA, 75 bp, Artificial Sequence
  Synthetic
aagctcaatatggcaatggccacagaaatgtgcaaaaactgccatcaaccagcaaatttcaagcggtgctgcccc

SEQ ID NO: 86522 - DNA, 75 bp, Artificial Sequence
  Synthetic
aaacactgaccagatgtgtctagaggacgctatgtatggaactgatggtttagaggcccttgaccttactactag

SEQ ID NO: 86523 - DNA, 75 bp, Artificial Sequence
  Synthetic
gacgctatgtatggaactgatggtttagaggcccttgaccttactactagtgcagggtatccgtacgtagccctt

SEQ ID NO: 86524 - DNA, 75 bp, Artificial Sequence
  Synthetic
atgatcattaatgaaagaaacaggagatccaacattggtaattgtatggaagcactctttcaagggccacttcaa

SEQ ID NO: 86525 - DNA, 75 bp, Artificial Sequence
  Synthetic
gatccaacattggtaattgtatggaagcactctttcaagggccacttcaatacaaagatctaaaaatagacatta

SEQ ID NO: 86526 - DNA, 75 bp, Artificial Sequence
  Synthetic
ggaattaatctaccactagtcacctatgtgaaagatgaacttagaagcaagagcaaagtggaacaaggaaaatcc

SEQ ID NO: 86527 - DNA, 75 bp, Artificial Sequence
  Synthetic
atgtgaaagatgaacttagaagcaagagcaaagtggaacaaggaaaatccagattgatagaggcctccagtctaa

SEQ ID NO: 86528 - DNA, 75 bp, Artificial Sequence
  Synthetic
aaaagaaaggatggattgtcaacattactagccaggttcagactgagaggaatatcaatagggccatgacaatac

SEQ ID NO: 86529 - DNA, 75 bp, Artificial Sequence
  Synthetic
tactagccaggttcagactgagaggaatatcaatagggccatgacaatactgcaggcagtcacaacctttgcagc

SEQ ID NO: 86530 - DNA, 75 bp, Artificial Sequence
  Synthetic
gatcagcagtagggtgtgacccagatctattttggagcaagataccagtcttgatggaagaaaagctgtttgcat

SEQ ID NO: 86531 - DNA, 75 bp, Artificial Sequence
  Synthetic
tcgattatacaggctacgacgcttctctcagtcccgcttggttcgaagctctcaagatggtgctagaaaagattg

SEQ ID NO: 86532 - DNA, 75 bp, Artificial Sequence
  Synthetic
gaaacctaatgtcccaactattaggactgcaaaggtgcaaggaccaggtttcgactatgcagttgcgatggccaa

SEQ ID NO: 86533 - DNA, 75 bp, Artificial Sequence
  Synthetic
actgcaaaggtgcaaggaccaggtttcgactatgcagttgcgatggccaagaggaacatcgtcactgctaccacc

SEQ ID NO: 86534 - DNA, 75 bp, Artificial Sequence
  Synthetic
actatcgtaattgatggaaaggaagtggaggttcttgatgccaaagcgctcgaagatcaagctggtaccaacctg

SEQ ID NO: 86535 - DNA, 75 bp, Artificial Sequence
  Synthetic
tggaggttcttgatgccaaagcgctcgaagatcaagctggtaccaacctggaaatcaccatcgtcactcttaaaa

SEQ ID NO: 86536 - DNA, 75 bp, Artificial Sequence
  Synthetic
taaacaccagtaagtaccccaacatgtatgtacccgtcggtgcagtgaccgaacaagggtacctcaatctgggag

SEQ ID NO: 86537 - DNA, 75 bp, Artificial Sequence
  Synthetic
gtatgtacccgtcggtgcagtgaccgaacaagggtacctcaatctgggaggacgccaaacggcacgcaccctgat

SEQ ID NO: 86538 - DNA, 75 bp, Artificial Sequence
  Synthetic
tggaggtaacggttcacatggtttcgctgcagccttaaagcggtcgtacttcactcagagtcaaggtgagattca

SEQ ID NO: 86539 - DNA, 75 bp, Artificial Sequence
  Synthetic
gctgcagccttaaagcggtcgtacttcactcagagtcaaggtgagattcagtggatgagaccatcaaaagaagtt

SEQ ID NO: 86540 - DNA, 75 bp, Artificial Sequence
  Synthetic
aaagagccagctgtgttgaccaaaaatgacccaagattgaaaactgattttgaagaggccatcttctcaaagtat

SEQ ID NO: 86541 - DNA, 75 bp, Artificial Sequence
  Synthetic
atgacccaagattgaaaactgattttgaagaggccatcttctcaaagtatgtaggtaacaaaatcactgaggtag

SEQ ID NO: 86542 - DNA, 75 bp, Artificial Sequence
  Synthetic
gcttagaagatgctatgtatggaactgatggtttagaagccttagatctatcaacaagtgctgggtatccatatg

SEQ ID NO: 86543 - DNA, 75 bp, Artificial Sequence
  Synthetic
tgatggtttagaagccttagatctatcaacaagtgctgggtatccatatgtagcattaggtaagaaaaagagaga

SEQ ID NO: 86544 - DNA, 75 bp, Artificial Sequence
  Synthetic
ggtcacctatgtgaaagatgaactcagatctaaaaccaaagtggaacaaggcaaatccaggttaattgaagcctc

SEQ ID NO: 86545 - DNA, 75 bp, Artificial Sequence
  Synthetic
agatctaaaaccaaagtggaacaaggcaaatccaggttaattgaagcctcgagtttaaatgactctgtggcaatg

SEQ ID NO: 86546 - DNA, 75 bp, Artificial Sequence
  Synthetic
gacccggatttgttttggagtaaaataccagtcctaatggaagagaaactgtttgcttttgattacacgggttat

SEQ ID NO: 86547 - DNA, 75 bp, Artificial Sequence
  Synthetic
aaagattggatttggtgatagggtggattacatcgattatctcaaccactcacaccatctttacaaaaacaaaac

SEQ ID NO: 86548 - DNA, 75 bp, Artificial Sequence
  Synthetic
atacacccagtcatgccaatgaaggaaattcatgaatcaattagatggacaaaggatcccagaaacactcaggat

SEQ ID NO: 86549 - DNA, 75 bp, Artificial Sequence
  Synthetic
aaattcatgaatcaattagatggacaaaggatcccagaaacactcaggatcatgttcgctcgttgtgcctattgg

SEQ ID NO: 86550 - DNA, 75 bp, Artificial Sequence
  Synthetic
tgctccccgagtactcaacattgtaccgccgatggctcgactcattttagtaaccctacttcagtcggattggat

SEQ ID NO: 86551 - DNA, 75 bp, Artificial Sequence
  Synthetic
ccgccgatggctcgactcattttagtaaccctacttcagtcggattggattgggttatattgtcgtaggggtaaa

SEQ ID NO: 86552 - DNA, 75 bp, Artificial Sequence
  Synthetic
ggacttgtttgccaagtggaagattaactacctagacgcgtaccagctgcgccgcaagctagaaatgttcaccta

SEQ ID NO: 86553 - DNA, 75 bp, Artificial Sequence
  Synthetic
acagttcaagagcaaacaccgtattgaaccagtatgtttattggtgcacggtagtcctggaacaggtaaatcagt

SEQ ID NO: 86554 - DNA, 75 bp, Artificial Sequence
  Synthetic
ccatttcgatggatataaacaacagggagtagtaatcatggacgacttgaatcagaatcctgatggggctgacat

SEQ ID NO: 86555 - DNA, 75 bp, Artificial Sequence
  Synthetic
aaaggtgctgcccacttgtgtgcggaaaagctatccaattgatggacaagtcatccagggtcagatacagcattg

SEQ ID NO: 86556 - DNA, 75 bp, Artificial Sequence
  Synthetic
caagtctgtggcggaaccgactactttgggtgtccgtgtttccttttatttatcaatggctgcttatggtgacaa

SEQ ID NO: 86557 - DNA, 75 bp, Artificial Sequence
  Synthetic
tcatagattgttatcataaagcgaattggattggccatccggtgaaagttagattaattatttacctgttcgtcg

SEQ ID NO: 86558 - DNA, 75 bp, Artificial Sequence
  Synthetic
ggtgctcaggtttcatcacagaaagttggagctcatgaaaacactaatgttgccactggtggttccacagttaat

SEQ ID NO: 86559 - DNA, 75 bp, Artificial Sequence
  Synthetic
ggtgctcaggtttcatcacagaaagttggtgctcatgaaaacactaatgttgccactggtggttccacagttaat

SEQ ID NO: 86560 - DNA, 75 bp, Artificial Sequence
  Synthetic
ggtgctcaggtttcatcacagaaagttggcgctcatgaaaacactaatgttgccactggtggttccacagttaat

SEQ ID NO: 86561 - DNA, 75 bp, Artificial Sequence
  Synthetic
ggtgctcaggtttcatcacagaaagttggggctcatgaaaacactaatgttgccactggtggttccacagttaat

SEQ ID NO: 86562 - DNA, 75 bp, Artificial Sequence
  Synthetic
ttggagctcatgaaaacactaatgttgccactggtggttccacagttaattatacgacaattaactactacaagg

SEQ ID NO: 86563 - DNA, 75 bp, Artificial Sequence
  Synthetic
ttggtgctcatgaaaacactaatgttgccactggtggttccacagttaattatacgacaattaactactacaagg

SEQ ID NO: 86564 - DNA, 75 bp, Artificial Sequence
  Synthetic
ttggcgctcatgaaaacactaatgttgccactggtggttccacagttaattatacgacaattaactactacaagg

SEQ ID NO: 86565 - DNA, 75 bp, Artificial Sequence
  Synthetic
ttggggctcatgaaaacactaatgttgccactggtggttccacagttaattatacgacaattaactactacaagg

SEQ ID NO: 86566 - DNA, 75 bp, Artificial Sequence
  Synthetic
tgctcataaaatcagctccagcattaaattctccaaacattgaggcttgtggatatagtgacagggtaatgcaac

SEQ ID NO: 86567 - DNA, 75 bp, Artificial Sequence
  Synthetic
aaattctccaaacattgaggcttgtggatatagtgacagggtaatgcaactaacactcgggaattccacaataac

SEQ ID NO: 86568 - DNA, 75 bp, Artificial Sequence
  Synthetic
agtggaccagcccactgaacctgacgtggcggcatgcagattttatacactagatacagtagaatgggagaggga

SEQ ID NO: 86569 - DNA, 75 bp, Artificial Sequence
  Synthetic
gtggcggcatgcagattttatacactagatacagtagaatgggagagggagtctaaaggatggtggtggaagcta

SEQ ID NO: 86570 - DNA, 75 bp, Artificial Sequence
  Synthetic
gtacacgtgcagtgcaatgcctctaaattccaccagggcactcttggtgtttttgcagttcctgaatgttgctta

SEQ ID NO: 86571 - DNA, 75 bp, Artificial Sequence
  Synthetic
aattccaccagggcactcttggtgtttttgcagttcctgaatgttgcttagctggagattccaacacgaaaacaa

SEQ ID NO: 86572 - DNA, 75 bp, Artificial Sequence
  Synthetic
ggatcaggtaagatcggtcgcggtcggtcgcgcattactcctcccagagtacacaacgctgcgccgtcgttggct

SEQ ID NO: 86573 - DNA, 75 bp, Artificial Sequence
  Synthetic
cagctcaaccagaacgcaaattccaaccagttgattacttattcggcagtggagttctggcgggtaatgctttcg

SEQ ID NO: 86574 - DNA, 75 bp, Artificial Sequence
  Synthetic
accagttgattacttattcggcagtggagttctggcgggtaatgctttcgtatatccacaccagatcattaattt

SEQ ID NO: 86575 - DNA, 75 bp, Artificial Sequence
  Synthetic
accccagaggcccacgtggcggctagtactctggtattacggtacctttgtacgcctgttttatatcccctcccc

SEQ ID NO: 86576 - DNA, 75 bp, Artificial Sequence
  Synthetic
taactggggaatagttatcttaccactgtcaaaattggattattctccagactctagcaccaaactaccaattac

SEQ ID NO: 86577 - DNA, 75 bp, Artificial Sequence
  Synthetic
ctgtcaaaattggattattctccagactctagcaccaaactaccaattacaatcacgattgctcctatgtgctgt

SEQ ID NO: 86578 - DNA, 75 bp, Artificial Sequence
  Synthetic
cagtatttgacctcagataactttcaatcaccgtgtgcactgccagagttcgatgtcacacagcccatttttatc

SEQ ID NO: 86579 - DNA, 75 bp, Artificial Sequence
  Synthetic
aatcaccgtgtgcactgccagagttcgatgtcacacagcccatttttatccctggtgaagttaagaacatgatgg

SEQ ID NO: 86580 - DNA, 75 bp, Artificial Sequence
  Synthetic
tacaattgtccgacactctagacaagaaacccatcctatgcttgtcactctctccagctagtgacccaagactgt

SEQ ID NO: 86581 - DNA, 75 bp, Artificial Sequence
  Synthetic
gaaacccatcctatgcttgtcactctctccagctagtgacccaagactgtcatacactatgttgggagagatcct

SEQ ID NO: 86582 - DNA, 75 bp, Artificial Sequence
  Synthetic
ggtgtccgtgtttccttttatttttactatggctgcttatggtgacaatctaagattgttatcatatagctgttg

SEQ ID NO: 86583 - DNA, 75 bp, Artificial Sequence
  Synthetic
gatactcgttgcgtattcgccacccggtgcccaaccaccgcaggacaggaaacaagcgatgttaggaacccacgt

SEQ ID NO: 86584 - DNA, 75 bp, Artificial Sequence
  Synthetic
ggtgcccaaccaccgcaggacaggaaacaagcgatgttaggaacccacgtcatatgggacattggtcttcaatcg

SEQ ID NO: 86585 - DNA, 75 bp, Artificial Sequence
  Synthetic
catataacaacaatgggagctcaggtatccacacagaagtctggatcacatgagaaccaaaatgttgccgctggc

SEQ ID NO: 86586 - DNA, 75 bp, Artificial Sequence
  Synthetic
tatccacacagaagtctggatcacatgagaaccaaaatgttgccgctggcggttccaccataaactatactacca

SEQ ID NO: 86587 - DNA, 75 bp, Artificial Sequence
  Synthetic
ggatatattagcatgttttaccagactaggatagtagttccagcttccacaccaaccaaaatggacatactaggt

SEQ ID NO: 86588 - DNA, 75 bp, Artificial Sequence
  Synthetic
ctaggatagtagttccagcttccacaccaaccaaaatggacatactaggttttgtttcagcttgcaatgacttta

SEQ ID NO: 86589 - DNA, 75 bp, Artificial Sequence
  Synthetic
aaccagtaaaggatatcatgataaagactgccccagcattaaactctcccaacattgaggcatgtggctacagtg

SEQ ID NO: 86590 - DNA, 75 bp, Artificial Sequence
  Synthetic
gactgccccagcattaaactctcccaacattgaggcatgtggctacagtgatagagtgttacaattgacactggg

SEQ ID NO: 86591 - DNA, 75 bp, Artificial Sequence
  Synthetic
aggtagctagcaatgcattacaactgtcacagccaaccagaccagcactacccccagcggagcaaagcgttccaa

SEQ ID NO: 86592 - DNA, 75 bp, Artificial Sequence
  Synthetic
gtcacagccaaccagaccagcactacccccagcggagcaaagcgttccaaatacactacaaaacaccccggctca

SEQ ID NO: 86593 - DNA, 75 bp, Artificial Sequence
  Synthetic
caaagaggccaacccagttgatgcacccactgaacctgatgcttcagctaatagattctatacactagagagcat

SEQ ID NO: 86594 - DNA, 75 bp, Artificial Sequence
  Synthetic
cccactgaacctgatgcttcagctaatagattctatacactagagagcatcacatgggaaaaatcatcacgtgga

SEQ ID NO: 86595 - DNA, 75 bp, Artificial Sequence
  Synthetic
aaccaggcatgtgatacagagcaggtcgaggtcagagagcaccatagaatcattctttgcaagaggggcgtgtgt

SEQ ID NO: 86596 - DNA, 75 bp, Artificial Sequence
  Synthetic
tcgaggtcagagagcaccatagaatcattctttgcaagaggggcgtgtgttaccatcatgagtgtggataattat

SEQ ID NO: 86597 - DNA, 75 bp, Artificial Sequence
  Synthetic
agagccggatacactgtacacgttcagtgcaatgcctctaaatttcaccaaggtgccttgattgtagcggctatt

SEQ ID NO: 86598 - DNA, 75 bp, Artificial Sequence
  Synthetic
agtgcaatgcctctaaatttcaccaaggtgccttgattgtagcggctattcctgagttcatgatgggtagtaaca

SEQ ID NO: 86599 - DNA, 75 bp, Artificial Sequence
  Synthetic
cttagaagaaagttggagatgttcacatattccagatttgatatagaattcacgttcgtggtaacggaaaggtac

SEQ ID NO: 86600 - DNA, 75 bp, Artificial Sequence
  Synthetic
catattccagatttgatatagaattcacgttcgtggtaacggaaaggtactattcctctaattcagggcatgcgt

SEQ ID NO: 86601 - DNA, 75 bp, Artificial Sequence
  Synthetic
ttataccatccagtgatactgaagccaagaacaagtttgcaccatgggattggttacttggttgtggtgtgatgg

SEQ ID NO: 86602 - DNA, 75 bp, Artificial Sequence
  Synthetic
caagaacaagtttgcaccatgggattggttacttggttgtggtgtgatggcgggtaatatcactgtttacccaca

SEQ ID NO: 86603 - DNA, 75 bp, Artificial Sequence
  Synthetic
aaacagcttcaaacccttcaatattttacacatatggagatgctcccgccagaatttccatcccgtttgtgggaa

SEQ ID NO: 86604 - DNA, 75 bp, Artificial Sequence
  Synthetic
ttacacatatggagatgctcccgccagaatttccatcccgtttgtgggaattgcaaatgcttattcacattttta

SEQ ID NO: 86605 - DNA, 75 bp, Artificial Sequence
  Synthetic
tatggcgaaacacaacaactggggcctagttattatgccatttgtacaacttgatgcagtcaaggatgccacaca

SEQ ID NO: 86606 - DNA, 75 bp, Artificial Sequence
  Synthetic
ctagttattatgccatttgtacaacttgatgcagtcaaggatgccacacaaagtgtgcccattacagttaccata

SEQ ID NO: 86607 - DNA, 75 bp, Artificial Sequence
  Synthetic
aaatgattttgggttactggcggtgagagtggtgaacgaacacaacccagttagagtgagttccaaagtcagagt

SEQ ID NO: 86608 - DNA, 75 bp, Artificial Sequence
  Synthetic
agagtggtgaacgaacacaacccagttagagtgagttccaaagtcagagtgtacatgaaacccaagcatgtcaga

SEQ ID NO: 86609 - DNA, 75 bp, Artificial Sequence
  Synthetic
actcctggatcaaatcagtttttgacttcggatgatttccaatcaccttgtgcattgccaaattttgacgcgacc

SEQ ID NO: 86610 - DNA, 75 bp, Artificial Sequence
  Synthetic
cttcggatgatttccaatcaccttgtgcattgccaaattttgacgcgaccccagcaatacatataccaggtgaag

SEQ ID NO: 86611 - DNA, 75 bp, Artificial Sequence
  Synthetic
ccactaccaaccaaaggattaaccacctatggatttggacaccaaaataaagctgtatatgtagcagggtataaa

SEQ ID NO: 86612 - DNA, 75 bp, Artificial Sequence
  Synthetic
cctatggatttggacaccaaaataaagctgtatatgtagcagggtataaaataatcaactaccacttggccactg

SEQ ID NO: 86613 - DNA, 75 bp, Artificial Sequence
  Synthetic
tggaagcatacccaataccattgcaggcttcaaagccaaacgcttcggagtccatcttctccatttcacttagtc

SEQ ID NO: 86614 - DNA, 75 bp, Artificial Sequence
  Synthetic
ggcttcaaagccaaacgcttcggagtccatcttctccatttcacttagtccagcagcagatgagaggctagcaca

SEQ ID NO: 86615 - DNA, 75 bp, Artificial Sequence
  Synthetic
tagaccgaatagcccggtgtacttgtaagaccggtgtgtactactgtgagtccaaatccaaatattaccccatca

SEQ ID NO: 86616 - DNA, 75 bp, Artificial Sequence
  Synthetic
taagaccggtgtgtactactgtgagtccaaatccaaatattaccccatcacagtgacctctcccaccttccagtg

SEQ ID NO: 86617 - DNA, 75 bp, Artificial Sequence
  Synthetic
cagtatgatggccacaggaaaaattttaatcagttacagcccgcctggtgctaaacctcccacaaccaggaagga

SEQ ID NO: 86618 - DNA, 75 bp, Artificial Sequence
  Synthetic
ttaatcagttacagcccgcctggtgctaaacctcccacaaccaggaaggaggctatgttaggtacccatgtcatc

SEQ ID NO: 86619 - DNA, 75 bp, Artificial Sequence
  Synthetic
ggactgtggtggtattttgaggtgccagcacggtgtcatgggcttgatcaccgccggagggaatggagtggtggc

SEQ ID NO: 86620 - DNA, 75 bp, Artificial Sequence
  Synthetic
cagcacggtgtcatgggcttgatcaccgccggagggaatggagtggtggcatttgcagacattcgtgacctccat

SEQ ID NO: 86621 - DNA, 75 bp, Artificial Sequence
  Synthetic
aaagatgactttacagaagggggctatatctgtgccttctaccaaacagcaataatagtgccacctagcaccccc

SEQ ID NO: 86622 - DNA, 75 bp, Artificial Sequence
  Synthetic
atatctgtgccttctaccaaacagcaataatagtgccacctagcacccccacagcaatgtatatgttggcatttg

SEQ ID NO: 86623 - DNA, 75 bp, Artificial Sequence
  Synthetic
accagccaaattggggagaagatcagtgaaatcacctcaatggtcaattcagtgatcacagaaaagctgctcaaa

SEQ ID NO: 86624 - DNA, 75 bp, Artificial Sequence
  Synthetic
accagccaaattggggtgaagatcagtgaaatcacctcaatggtcaattcagtgatcacagaaaagctgctcaaa

SEQ ID NO: 86625 - DNA, 75 bp, Artificial Sequence
  Synthetic
accagccaaattggggcgaagatcagtgaaatcacctcaatggtcaattcagtgatcacagaaaagctgctcaaa

SEQ ID NO: 86626 - DNA, 75 bp, Artificial Sequence
  Synthetic
accagccaaattggggggaagatcagtgaaatcacctcaatggtcaattcagtgatcacagaaaagctgctcaaa

SEQ ID NO: 86627 - DNA, 75 bp, Artificial Sequence
  Synthetic
gtgaaatcacctcaatggtcaattcagtgatcacagaaaagctgctcaaaaatttaatcaaactagtgagtagtc

SEQ ID NO: 86628 - DNA, 75 bp, Artificial Sequence
  Synthetic
cacaggggattgaagatacaattgaaaaggtggtaggagacgctttgagagtttccatgccacaagttgccaata

SEQ ID NO: 86629 - DNA, 75 bp, Artificial Sequence
  Synthetic
aaaggtggtaggagacgctttgagagtttccatgccacaagttgccaatacccagccatcaggtcctgtaaattc

SEQ ID NO: 86630 - DNA, 75 bp, Artificial Sequence
  Synthetic
caccatgggcctggttgaagaagaaagtctgtgatatcctggaaattccatttgtaatgagacaaggagaatcat

SEQ ID NO: 86631 - DNA, 75 bp, Artificial Sequence
  Synthetic
caccatgggcctggttgaagaagaaagtctgtgatatcctggaaattccatttgtaatgagacaaggagattcat

SEQ ID NO: 86632 - DNA, 75 bp, Artificial Sequence
  Synthetic
caccatgggcctggttgaagaagaaagtctgtgatatcctggaaattccatttgtaatgagacaaggagactcat

SEQ ID NO: 86633 - DNA, 75 bp, Artificial Sequence
  Synthetic
caccatgggcctggttgaagaagaaagtctgtgatatcctggaaattccatttgtaatgagacaaggagagtcat

SEQ ID NO: 86634 - DNA, 75 bp, Artificial Sequence
  Synthetic
agtctgtgatatcctggaaattccatttgtaatgagacaaggagaatcatggatgaagaaattcacagaagcttg

SEQ ID NO: 86635 - DNA, 75 bp, Artificial Sequence
  Synthetic
agtctgtgatatcctggaaattccatttgtaatgagacaaggagattcatggatgaagaaattcacagaagcttg

SEQ ID NO: 86636 - DNA, 75 bp, Artificial Sequence
  Synthetic
agtctgtgatatcctggaaattccatttgtaatgagacaaggagactcatggatgaagaaattcacagaagcttg

SEQ ID NO: 86637 - DNA, 75 bp, Artificial Sequence
  Synthetic
agtctgtgatatcctggaaattccatttgtaatgagacaaggagagtcatggatgaagaaattcacagaagcttg

SEQ ID NO: 86638 - DNA, 75 bp, Artificial Sequence
  Synthetic
taggcatgtcataaataacaggcttagatctgagtgcactgtagaagcctttttcggaaggtctgcatgtgttgc

SEQ ID NO: 86639 - DNA, 75 bp, Artificial Sequence
  Synthetic
agatctgagtgcactgtagaagcctttttcggaaggtctgcatgtgttgccattcttggtgtagcaaacaagaga

SEQ ID NO: 86640 - DNA, 75 bp, Artificial Sequence
  Synthetic
tccagaagcaagggacaaggttgagtatgtgtccaaacttaagcaactgggcatgttagaaaaccaaataaatac

SEQ ID NO: 86641 - DNA, 75 bp, Artificial Sequence
  Synthetic
aaacttgagttgtttacttactcaagatttgacctggagttgacatttgtcatcacagagcggtacttctcaggg

SEQ ID NO: 86642 - DNA, 75 bp, Artificial Sequence
  Synthetic
aatacaccagtcatgtcctagtcaagaacagcaagaaatacttttcaataatgtcagatggttggcaatccagtc

SEQ ID NO: 86643 - DNA, 75 bp, Artificial Sequence
  Synthetic
gatttgacctggagttgacatttgtcatcacagagcggtacttctcagggacagctgcaactaccagagactatg

SEQ ID NO: 86644 - DNA, 75 bp, Artificial Sequence
  Synthetic
ctaatccttctgtcttctacacaacaggtaacgccagcccaagaatgtctataccctttgttggtatcggtgctg

SEQ ID NO: 86645 - DNA, 75 bp, Artificial Sequence
  Synthetic
gaaccagtatgtgtcttgatacatggcagtccaggcaccggaaaatcagttgccactagtttgatgggacgtgcc

SEQ ID NO: 86646 - DNA, 75 bp, Artificial Sequence
  Synthetic
aggtaacgccagcccaagaatgtctataccctttgttggtatcggtgctgcgtactcccacttttatgatggatt

SEQ ID NO: 86647 - DNA, 75 bp, Artificial Sequence
  Synthetic
ggtgtggtgatcatggatgatttgaaccagaatccagatggtcttgacatgaaactcttttgccagatggtgtcc

SEQ ID NO: 86648 - DNA, 75 bp, Artificial Sequence
  Synthetic
cacgttagcagtgagaattgtaaatgaatttgatccagtaacaatagaagctaagatcagggtgtacatgaaacc

SEQ ID NO: 86649 - DNA, 75 bp, Artificial Sequence
  Synthetic
gaatttgatccagtaacaatagaagctaagatcagggtgtacatgaaaccaaagcatgttagggtgtggtgccca

SEQ ID NO: 86650 - DNA, 75 bp, Artificial Sequence
  Synthetic
accagaatccagatggtcttgacatgaaactcttttgccagatggtgtccacagtagaatttataccacctatgg

SEQ ID NO: 86651 - DNA, 75 bp, Artificial Sequence
  Synthetic
caccaactgtggctcatagtgacgccttaagtcgaagatttgcctttgacatggaaatttgtcccatgtcacaat

SEQ ID NO: 86652 - DNA, 75 bp, Artificial Sequence
  Synthetic
gctactattagaacgtatgggtttggacaccaaaacaaagcagtctacacagctgggtataaaatctgtaattac

SEQ ID NO: 86653 - DNA, 75 bp, Artificial Sequence
  Synthetic
gacaccaaaacaaagcagtctacacagctgggtataaaatctgtaattaccatctggccacacctgaagatatgg

SEQ ID NO: 86654 - DNA, 75 bp, Artificial Sequence
  Synthetic
cttaagtcgaagatttgcctttgacatggaaatttgtcccatgtcacaatacacaatcaaaggcaagttgaacat

SEQ ID NO: 86655 - DNA, 75 bp, Artificial Sequence
  Synthetic
aaaagcaatccaactgatggataaatacaccagacagaggtttagtgtggatgagctgacaactctagttattaa

SEQ ID NO: 86656 - DNA, 75 bp, Artificial Sequence
  Synthetic
caaggtgctcatgcaaggcaggaatttactattgtgaatccaagagaaaatactaccctatttcagtatgtggac

SEQ ID NO: 86657 - DNA, 75 bp, Artificial Sequence
  Synthetic
ttactattgtgaatccaagagaaaatactaccctatttcagtatgtggaccaacattccaatacatggaagctaa

SEQ ID NO: 86658 - DNA, 75 bp, Artificial Sequence
  Synthetic
tacaccagacagaggtttagtgtggatgagctgacaactctagttattaatgaaaaggtcaggagagccaacata

SEQ ID NO: 86659 - DNA, 75 bp, Artificial Sequence
  Synthetic
tacaccagacagaggtttagtgtggatgagctgacaactctagttattaatgaaaaggtctggagagccaacata

SEQ ID NO: 86660 - DNA, 75 bp, Artificial Sequence
  Synthetic
tacaccagacagaggtttagtgtggatgagctgacaactctagttattaatgaaaaggtccggagagccaacata

SEQ ID NO: 86661 - DNA, 75 bp, Artificial Sequence
  Synthetic
tacaccagacagaggtttagtgtggatgagctgacaactctagttattaatgaaaaggtcgggagagccaacata

SEQ ID NO: 86662 - DNA, 75 bp, Artificial Sequence
  Synthetic
ccccctgaatgcatcagcgatctgctacaatcggtggactcgcaggaggtcagggattattgtgaaaagaaaggc

SEQ ID NO: 86663 - DNA, 75 bp, Artificial Sequence
  Synthetic
gattctcaggtgtcaacatggagtgatgggtatcatcacagccggtggtgaaggagttgtggcgtttgcggacat

SEQ ID NO: 86664 - DNA, 75 bp, Artificial Sequence
  Synthetic
atgggtatcatcacagccggtggtgaaggagttgtggcgtttgcggacatcagagatctttacatgtatgaagaa

SEQ ID NO: 86665 - DNA, 75 bp, Artificial Sequence
  Synthetic
tacaatcggtggactcgcaggaggtcagggattattgtgaaaagaaaggctggattgtcaacatttcaagtgatg

SEQ ID NO: 86666 - DNA, 75 bp, Artificial Sequence
  Synthetic
tggtttatgtcatgtacagattgtttgccggtcaacagggagcatacactggtctacccaataaaaagcccaata

SEQ ID NO: 86667 - DNA, 75 bp, Artificial Sequence
  Synthetic
gtggcaaacaaaatttcagagatacaaaacacagtccagagcgtcctcacagagaagctcctaaagaacctaata

SEQ ID NO: 86668 - DNA, 75 bp, Artificial Sequence
  Synthetic
aaaacacagtccagagcgtcctcacagagaagctcctaaagaacctaataaaaattgtctcagcccttgttattg

SEQ ID NO: 86669 - DNA, 75 bp, Artificial Sequence
  Synthetic
tgccggtcaacagggagcatacactggtctacccaataaaaagcccaatatccccacaatcagaacagcaaaagt

SEQ ID NO: 86670 - DNA, 75 bp, Artificial Sequence
  Synthetic
attcactatgcttggggtttatgacaatgtggccatcttaccaacacatgcgcatccaggagaaaccataattat

SEQ ID NO: 86671 - DNA, 75 bp, Artificial Sequence
  Synthetic
agtggcttaaggagaaactctgcaatatgattggtgttccctatgtcatgagacaaggagattcctggttgaaaa

SEQ ID NO: 86672 - DNA, 75 bp, Artificial Sequence
  Synthetic
cgcatccaggagaaaccataattattgatggcaaagaaatggaggttgttgatgccaaggcccttgaagatcaag

SEQ ID NO: 86673 - DNA, 75 bp, Artificial Sequence
  Synthetic
cgcatccaggagaaaccataattattgatggcaaagaattggaggttgttgatgccaaggcccttgaagatcaag

SEQ ID NO: 86674 - DNA, 75 bp, Artificial Sequence
  Synthetic
cgcatccaggagaaaccataattattgatggcaaagaactggaggttgttgatgccaaggcccttgaagatcaag

SEQ ID NO: 86675 - DNA, 75 bp, Artificial Sequence
  Synthetic
cgcatccaggagaaaccataattattgatggcaaagaagtggaggttgttgatgccaaggcccttgaagatcaag

SEQ ID NO: 86676 - DNA, 75 bp, Artificial Sequence
  Synthetic
tatgattggtgttccctatgtcatgagacaaggagattcctggttgaaaaagttcacagaagcctgcaatgccgc

SEQ ID NO: 86677 - DNA, 75 bp, Artificial Sequence
  Synthetic
caacccaaatcaccgagacgaacgatggagtcttgatcgtgaacactagtaagtaccccaacatgtatgtcccag

SEQ ID NO: 86678 - DNA, 75 bp, Artificial Sequence
  Synthetic
gaaagataaattagaatacctttctaaattgaaacaacttgaaatgatagagaaccaaatggccacattgcacca

SEQ ID NO: 86679 - DNA, 75 bp, Artificial Sequence
  Synthetic
aagtaccccaacatgtatgtcccagtcggtgctgtaaccgaacaggggtatcttaatctcggtggtcgccaaact

SEQ ID NO: 86680 - DNA, 75 bp, Artificial Sequence
  Synthetic
aaattgaaacaacttgaaatgatagagaaccaaatggccacattgcaccaatcgtgtcctagccaggaagagcaa

SEQ ID NO: 86681 - DNA, 75 bp, Artificial Sequence
  Synthetic
cgcagaatattcaagttagaaacatctatcaacaattatgtacaattcaagaccaaacaccgcattgaaccagta

SEQ ID NO: 86682 - DNA, 75 bp, Artificial Sequence
  Synthetic
gcacaggtaaatcagttgctacaggcctcattggaagagcaattgcaaagcaagcaaacaccagtacctattcct

SEQ ID NO: 86683 - DNA, 75 bp, Artificial Sequence
  Synthetic
tgtttgaaggagtcaaggaaccagccgtgttgaccaagagtgaccccaggttgaagactgacttcgaagaagcta

SEQ ID NO: 86684 - DNA, 75 bp, Artificial Sequence
  Synthetic
cgtgttgaccaagagtgaccccaggttgaagactgacttcgaagaagctattttctcaaaatacgtcggaaacaa

SEQ ID NO: 86685 - DNA, 75 bp, Artificial Sequence
  Synthetic
cagatggggaggacatgaaattgttctgtcaaatggtctccacagtggagttcataccaccaatggccagcttag

SEQ ID NO: 86686 - DNA, 75 bp, Artificial Sequence
  Synthetic
ctgtcaaatggtctccacagtggagttcataccaccaatggccagcttagaggaaaagggaattctgttcacttc

SEQ ID NO: 86687 - DNA, 75 bp, Artificial Sequence
  Synthetic
cacggaacaaatgtgtcttgaggatgccatgtatgggactgatggcttggaggctcttgatcttagcaccagtgc

SEQ ID NO: 86688 - DNA, 75 bp, Artificial Sequence
  Synthetic
gccatgtatgggactgatggcttggaggctcttgatcttagcaccagtgctgggtacccctatatagcaatgggg

SEQ ID NO: 86689 - DNA, 75 bp, Artificial Sequence
  Synthetic
aagatttgctttcgacatggatatatatccaatgtctgaatacacaacaaagggaaaattgaacatggctttagc

SEQ ID NO: 86690 - DNA, 75 bp, Artificial Sequence
  Synthetic
tatccaatgtctgaatacacaacaaagggaaaattgaacatggctttagctacccaattgtgtaaggattgtcat

SEQ ID NO: 86691 - DNA, 75 bp, Artificial Sequence
  Synthetic
attaacctaccactggtcacttatgtaaaagatgaacttagatccaaaacaaaagttgaacagggtaaatccagg

SEQ ID NO: 86692 - DNA, 75 bp, Artificial Sequence
  Synthetic
atgagatactctctggatcagatcaccaccatgatgattaacgagagaaacaggaggtacaacattggaggctgc

SEQ ID NO: 86693 - DNA, 75 bp, Artificial Sequence
  Synthetic
ccaccatgatgattaacgagagaaacaggaggtacaacattggaggctgcctagaggcactattccaaggcccaa

SEQ ID NO: 86694 - DNA, 75 bp, Artificial Sequence
  Synthetic
attcagtggctatgaggatggcttttggcaatctctatgcagcatttcataaaaatccaggtgtggtgactggct

SEQ ID NO: 86695 - DNA, 75 bp, Artificial Sequence
  Synthetic
tagataatcaggaagttagggattattgcaaacaacagggctgggtggtcgagatcccatcaaattctgtcacca

SEQ ID NO: 86696 - DNA, 75 bp, Artificial Sequence
  Synthetic
attatacaggctatgatgcatccctcagtccagcttggtttgaagcactcaagatggtgttagagaaaattggat

SEQ ID NO: 86697 - DNA, 75 bp, Artificial Sequence
  Synthetic
atgtggtttacaaactctttgcaggattccagggtgcgtacacaggactccctaatgcaaaaccaaaagttccca

SEQ ID NO: 86698 - DNA, 75 bp, Artificial Sequence
  Synthetic
attccagggtgcgtacacaggactccctaatgcaaaaccaaaagttcccacaatcagagcagccaaagttcaagg

SEQ ID NO: 86699 - DNA, 75 bp, Artificial Sequence
  Synthetic
aatgctgggtgtctatgatagggtagctgtactccccactcactcaaatccaggagaaaccatagtcatatcagg

SEQ ID NO: 86700 - DNA, 75 bp, Artificial Sequence
  Synthetic
ttaatctcgaaattactattgtaaccctagataggaatgagaagtttagggacattagaacacacttaccaaccc

SEQ ID NO: 86701 - DNA, 75 bp, Artificial Sequence
  Synthetic
actgtgcctattggcctggcacaatggtgaagaagaatacaacaaatttttagctaaaatcagaagcgtgccaat

SEQ ID NO: 86702 - DNA, 75 bp, Artificial Sequence
  Synthetic
cagttgttgaacagggtatgctaaatcttggaggtaggcccaccaacagaaccttgatgtataacttcccaacca

SEQ ID NO: 86703 - DNA, 75 bp, Artificial Sequence
  Synthetic
atggttttgctgccgctctcaagagaagttacttcactgaggaacaaggagagatccaatggatgagatcaagta

SEQ ID NO: 86704 - DNA, 75 bp, Artificial Sequence
  Synthetic
aagttacttcactgaggaacaaggagagatccaatggatgagatcaagtaaagatgcaggctatcccatgatcaa

SEQ ID NO: 86705 - DNA, 75 bp, Artificial Sequence
  Synthetic
aactaagaatgatcccagattgaaagttgattttgaagaagctgtattttctaagtacattggaaacaagatcac

SEQ ID NO: 86706 - DNA, 75 bp, Artificial Sequence
  Synthetic
gttgattttgaagaagctgtattttctaagtacattggaaacaagatcacagaggtagatgaatacatgaaggaa

SEQ ID NO: 86707 - DNA, 75 bp, Artificial Sequence
  Synthetic
tatggtacagatggtcttgaagccttggatttaacaactagtgctgggtatccttatgtggctattgggaagaaa

SEQ ID NO: 86708 - DNA, 75 bp, Artificial Sequence
  Synthetic
ccagagacaccaaagaaatgcagaaaatgctagataagtatggaatcaatctaccattggtaacctatgttaagg

SEQ ID NO: 86709 - DNA, 75 bp, Artificial Sequence
  Synthetic
ttgctatgagacaggcgtttggccacctatatgccaagtttcatcagaatccagggataataacaggttcagcag

SEQ ID NO: 86710 - DNA, 75 bp, Artificial Sequence
  Synthetic
tccagttacggaggaaattggagttcttcacctattctagatttgatatggaattcacctttgtggttactgcaa

SEQ ID NO: 86711 - DNA, 75 bp, Artificial Sequence
  Synthetic
agcatggttcgaagccttaaaaatggtgttggagaagattggttttggtgatcgggttgacttcatagattatct

SEQ ID NO: 86712 - DNA, 75 bp, Artificial Sequence
  Synthetic
cacaggatcatgtccgatcgttgtgcttattggcatggcacaatggagaagaaacttataacaaatttttagctc

SEQ ID NO: 86713 - DNA, 75 bp, Artificial Sequence
  Synthetic
aattacgtacagttcaagagcaagcaccgtattgagccagtatgtttgttagtacatggcagtccagggacagga

SEQ ID NO: 86714 - DNA, 75 bp, Artificial Sequence
  Synthetic
gacacccagagagatggacatccttggttttgtgtcagcgtgtaatgacttcagcgtgcgcttgatgcgagatac

SEQ ID NO: 86715 - DNA, 75 bp, Artificial Sequence
  Synthetic
gttggtatttcgaacgcctattcacacttttacgacggtttttccaaagtaccactgaaggaccagtcggcagca

SEQ ID NO: 86716 - DNA, 75 bp, Artificial Sequence
  Synthetic
tccccggtgatgtcgtatagactgtacccacggttgaaagtgacagatccgttacccgcttttgtacttcgagaa

SEQ ID NO: 86717 - DNA, 75 bp, Artificial Sequence
  Synthetic
ttatggctgcttatggtgacaatcatagattgttgtcataaagcgaattggattggccatccggtgagagtttag

SEQ ID NO: 86718 - DNA, 75 bp, Artificial Sequence
  Synthetic
catgggagctcaagtatcatcacaaaaggttggagcccacgaaaacaccaatgtggcaactggtggctcaactgt

SEQ ID NO: 86719 - DNA, 75 bp, Artificial Sequence
  Synthetic
aaggttggagcccacgaaaacaccaatgtggcaactggtggctcaactgtgaattacaccactatcaactattat

SEQ ID NO: 86720 - DNA, 75 bp, Artificial Sequence
  Synthetic
gacatcatgctgaaatctgccccagcattaaactctccaaatgttgaggcatgtgggtatagtgacagggttaga

SEQ ID NO: 86721 - DNA, 75 bp, Artificial Sequence
  Synthetic
cattaaactctccaaatgttgaggcatgtgggtatagtgacagggttagacaaattacacttggcaattcaacaa

SEQ ID NO: 86722 - DNA, 75 bp, Artificial Sequence
  Synthetic
acccagtagacgcgccaacagagcccgatgtgagcagtaacagattctacacactggaatcagtgcagtggaaaa

SEQ ID NO: 86723 - DNA, 75 bp, Artificial Sequence
  Synthetic
cgatgtgagcagtaacagattctacacactggaatcagtgcagtggaaaaaagagtctaggggttggtggtggaa

SEQ ID NO: 86724 - DNA, 75 bp, Artificial Sequence
  Synthetic
caccgtgcatgtccagtgcaatgcatctaaatttcaccaaggcgctctggctgtgtttgccgtccccgagtgtgt

SEQ ID NO: 86725 - DNA, 75 bp, Artificial Sequence
  Synthetic
tctaaatttcaccaaggcgctctggctgtgtttgccgtccccgagtgtgtgttttcaggtaattcaaaggacaag

SEQ ID NO: 86726 - DNA, 75 bp, Artificial Sequence
  Synthetic
ggaactactgaagatgcgcggatgtttagtcccattgactatttgtttggatcaggtgtcttatttggaaatgca

SEQ ID NO: 86727 - DNA, 75 bp, Artificial Sequence
  Synthetic
ttagtcccattgactatttgtttggatcaggtgtcttatttggaaatgcattcattttcccacaccagatcatta

SEQ ID NO: 86728 - DNA, 75 bp, Artificial Sequence
  Synthetic
ctggtgtcacggtacctttgtacgcctgttttataccccctcccccgtaacttagaagctataaaccaagttcaa

SEQ ID NO: 86729 - DNA, 75 bp, Artificial Sequence
  Synthetic
ctgttttataccccctcccccgtaacttagaagctataaaccaagttcaatagaagggggtacaagccagtacca

SEQ ID NO: 86730 - DNA, 75 bp, Artificial Sequence
  Synthetic
acaacaactggggaatagtcattattccagtggttccgctggactttgctgatgctagtagtccacagataccaa

SEQ ID NO: 86731 - DNA, 75 bp, Artificial Sequence
  Synthetic
tccagtggttccgctggactttgctgatgctagtagtccacagataccaatcacactcacaatcgccccaatgtt

SEQ ID NO: 86732 - DNA, 75 bp, Artificial Sequence
  Synthetic
cccgcttgtgtacttcgagaagtctagtaccaccttggaatcttcgatgcgttgcgctcagcactttaccccaga

SEQ ID NO: 86733 - DNA, 75 bp, Artificial Sequence
  Synthetic
agtaccaccttggaatcttcgatgcgttgcgctcagcactttaccccagagtgtagcttaggctgatgagtctgg

SEQ ID NO: 86734 - DNA, 75 bp, Artificial Sequence
  Synthetic
aaatcagtttttaacatctgataacttccaatcaccgtgcgcacttcccgaatttgatgtaacacctcctataca

SEQ ID NO: 86735 - DNA, 75 bp, Artificial Sequence
  Synthetic
ttccaatcaccgtgcgcacttcccgaatttgatgtaacacctcctatacacatacctggtgaagtcaaaaacatg

SEQ ID NO: 86736 - DNA, 75 bp, Artificial Sequence
  Synthetic
tgaacaaggtgtgaagaacctattgagctacacaagagtcctccggcccctgaatgcggctaatcctaaccatgg

SEQ ID NO: 86737 - DNA, 75 bp, Artificial Sequence
  Synthetic
agaattgaactggatagcaatgcacccaaattaagtgctccaatcttctgtctctcactttcccccgctagcgac

SEQ ID NO: 86738 - DNA, 75 bp, Artificial Sequence
  Synthetic
ccaaattaagtgctccaatcttctgtctctcactttcccccgctagcgaccaaagactacagtacacattgctgg

SEQ ID NO: 86739 - DNA, 75 bp, Artificial Sequence
  Synthetic
ccactggcaagctactactcagctacagtccccctggagcggcccccccaaccacacggaaagaagctatgctgg

SEQ ID NO: 86740 - DNA, 75 bp, Artificial Sequence
  Synthetic
ccatcaaacacattcacttatagtatcatcttgacagtgattagaattagacagtcgtatcacaatgggcgctca

SEQ ID NO: 86741 - DNA, 75 bp, Artificial Sequence
  Synthetic
cagtccccctggagcggcccccccaaccacacggaaagaagctatgctgggtactcatctcatttgggatcttgg

SEQ ID NO: 86742 - DNA, 75 bp, Artificial Sequence
  Synthetic
tcatcttgacagtgattagaattagacagtcgtatcacaatgggcgctcaagtgtcatcccaaaaagtaggcgct

SEQ ID NO: 86743 - DNA, 75 bp, Artificial Sequence
  Synthetic
cactgccggtggctacattacttgcttttatcaaaccaaaattgttgtacccttaagtacaccaactaaaatggt

SEQ ID NO: 86744 - DNA, 75 bp, Artificial Sequence
  Synthetic
agtaatgcggcatccaagcaagactactcacaggatccctcaaagttcaccgagcctctaaaggatgtgctcata

SEQ ID NO: 86745 - DNA, 75 bp, Artificial Sequence
  Synthetic
ttttatcaaaccaaaattgttgtacccttaagtacaccaactaaaatggtaatgttggcattcgtaagtgcatgc

SEQ ID NO: 86746 - DNA, 75 bp, Artificial Sequence
  Synthetic
actcacaggatccctcaaagttcaccgagcctctaaaggatgtgctcataaagacagctccaacactcaactcac

SEQ ID NO: 86747 - DNA, 75 bp, Artificial Sequence
  Synthetic
gaggatatcatcgagtcagtggcccaaaatgcactccaaatttcccaaccaagaccagcccaaagaccagcaatc

SEQ ID NO: 86748 - DNA, 75 bp, Artificial Sequence
  Synthetic
aggcagccaattcagtggtggcctacgggcgttggcctgaattcattagagatgatgaggcaaacccagtggatc

SEQ ID NO: 86749 - DNA, 75 bp, Artificial Sequence
  Synthetic
aaaatgcactccaaatttcccaaccaagaccagcccaaagaccagcaatcaataatacagttgcagacactccag

SEQ ID NO: 86750 - DNA, 75 bp, Artificial Sequence
  Synthetic
cgggcgttggcctgaattcattagagatgatgaggcaaacccagtggatcaaccaaccgaaccagatgtggctac

SEQ ID NO: 86751 - DNA, 75 bp, Artificial Sequence
  Synthetic
ctgcggatgtcatagaaactaggaaagtgatcaactacaaaaccagaagtgaatcaactattgaaagcttctttg

SEQ ID NO: 86752 - DNA, 75 bp, Artificial Sequence
  Synthetic
actgagagacatgggcttgtttgggcaaaacatgtattaccactacctagggagatctggatacactgtgcacgt

SEQ ID NO: 86753 - DNA, 75 bp, Artificial Sequence
  Synthetic
agtgatcaactacaaaaccagaagtgaatcaactattgaaagcttctttggacgatctgcttgtattacaataat

SEQ ID NO: 86754 - DNA, 75 bp, Artificial Sequence
  Synthetic
caaaacatgtattaccactacctagggagatctggatacactgtgcacgtgcagtgtaatgcgtccaagttccat

SEQ ID NO: 86755 - DNA, 75 bp, Artificial Sequence
  Synthetic
agatactgtccagctcaggaggaaattagagatgttcacatactcacgttttgatacagagttcacctttgtatt

SEQ ID NO: 86756 - DNA, 75 bp, Artificial Sequence
  Synthetic
tatgcaaacgcgaatccaggcgaaaaagggggcaaattctactcccaattcaacagggacaccgcagtaacatct

SEQ ID NO: 86757 - DNA, 75 bp, Artificial Sequence
  Synthetic
ttagagatgttcacatactcacgttttgatacagagttcacctttgtattgaccgagaggtattacactcaaaat

SEQ ID NO: 86758 - DNA, 75 bp, Artificial Sequence
  Synthetic
aagggggcaaattctactcccaattcaacagggacaccgcagtaacatctccaaaaagagagttttgtccagtgg

SEQ ID NO: 86759 - DNA, 75 bp, Artificial Sequence
  Synthetic
gattacacatggcaatcctcatcaaacccgtccatcttctacacctatggttgtgcaccaccgagaatgtctgta

SEQ ID NO: 86760 - DNA, 75 bp, Artificial Sequence
  Synthetic
ataacagtgcaaccattgtcctgccatacgtgaatgccttagccattgattcaatggttaaacataataactggg

SEQ ID NO: 86761 - DNA, 75 bp, Artificial Sequence
  Synthetic
atacgtgaatgccttagccattgattcaatggttaaacataataactggggcattgccattctacccttgtcacc

SEQ ID NO: 86762 - DNA, 75 bp, Artificial Sequence
  Synthetic
atagccacttttatgatgggtttgcacgtatacccattaagaatgaaacggcggatgctggagacacatattatg

SEQ ID NO: 86763 - DNA, 75 bp, Artificial Sequence
  Synthetic
cggacttcgcaacgtgactgcacccaagtttcaagggctaccagtgctgaacactcccggtagtaaccaatactt

SEQ ID NO: 86764 - DNA, 75 bp, Artificial Sequence
  Synthetic
aagtttcaagggctaccagtgctgaacactcccggtagtaaccaatacttaacgtcagataaccaccagtcacca

SEQ ID NO: 86765 - DNA, 75 bp, Artificial Sequence
  Synthetic
cacgcatgagagtgtacatgaaacccaaacacatcagggtgtggtgcccaagaccaccacgcgccgtgccatata

SEQ ID NO: 86766 - DNA, 75 bp, Artificial Sequence
  Synthetic
gaaatagacaccatgataccccttaatttggaaaacaccaagaggaatacaatggacatgtacagggtcacactg

SEQ ID NO: 86767 - DNA, 75 bp, Artificial Sequence
  Synthetic
atttggaaaacaccaagaggaatacaatggacatgtacagggtcacactgagcgacagtgcagatctatcacaac

SEQ ID NO: 86768 - DNA, 75 bp, Artificial Sequence
  Synthetic
ttggtcaccagagcaaagctgtctacgtcgctgggtataaaatttgcaattatcaccttgccaccccagaagatc

SEQ ID NO: 86769 - DNA, 75 bp, Artificial Sequence
  Synthetic
cgtcgctgggtataaaatttgcaattatcaccttgccaccccagaagatcacagtagagcagtgaatgttatgtg

SEQ ID NO: 86770 - DNA, 75 bp, Artificial Sequence
  Synthetic
attacactcattgggctggatctttgaagttcactttcctgttttgtggctcaatgatggctacggggaaaattt

SEQ ID NO: 86771 - DNA, 75 bp, Artificial Sequence
  Synthetic
gaagttcactttcctgttttgtggctcaatgatggctacggggaaaattttggtagcctatgcaccaccgggagc

SEQ ID NO: 86772 - DNA, 75 bp, Artificial Sequence
  Synthetic
tgtatattattgtgaatctaaaagaaagtactatccagtgactgtcacagaacccacgtttcagtacatggaggc

SEQ ID NO: 86773 - DNA, 75 bp, Artificial Sequence
  Synthetic
aagtactatccagtgactgtcacagaacccacgtttcagtacatggaggccaatgattactaccctgcgaggtac

SEQ ID NO: 86774 - DNA, 75 bp, Artificial Sequence
  Synthetic
caccatggttgtgccatggattagtaatgtgacatataggcaaaccacacaagacagcttcactgaaggtgggta

SEQ ID NO: 86775 - DNA, 75 bp, Artificial Sequence
  Synthetic
aatgtgacatataggcaaaccacacaagacagcttcactgaaggtgggtacattagcatgttttatcagacaagg

SEQ ID NO: 86776 - DNA, 75 bp, Artificial Sequence
  Synthetic
gtgatgggtatcattacagctggaggggacgggattgttgccttcgctgacattagagacttgtgggtttatgaa

SEQ ID NO: 86777 - DNA, 75 bp, Artificial Sequence
  Synthetic
gggacgggattgttgccttcgctgacattagagacttgtgggtttatgaagaggaagccatggaacaaggtattt

SEQ ID NO: 86778 - DNA, 75 bp, Artificial Sequence
  Synthetic
cgattactacgtgacaccacccacatttcacaatctgcgcttccgcagggcattgaagacttgattaccgaggtc

SEQ ID NO: 86779 - DNA, 75 bp, Artificial Sequence
  Synthetic
tttcacaatctgcgcttccgcagggcattgaagacttgattaccgaggtcgcacaaggcgccctgactttgtcac

SEQ ID NO: 86780 - DNA, 75 bp, Artificial Sequence
  Synthetic
taaccagcatggtcaccagctcgattactgagaagctgttaaaaacacttgtgaagatcatttctacattggtga

SEQ ID NO: 86781 - DNA, 75 bp, Artificial Sequence
  Synthetic
tactgagaagctgttaaaaacacttgtgaagatcatttctacattggtgatcatcagtagaaattatgatgacac

SEQ ID NO: 86782 - DNA, 75 bp, Artificial Sequence
  Synthetic
ctgcagtcgagactggggccaccaatcctttggttccatccgacacagttcagacgcgacatgtaatccaacggc

SEQ ID NO: 86783 - DNA, 75 bp, Artificial Sequence
  Synthetic
tcctttggttccatccgacacagttcagacgcgacatgtaatccaacggcgcagcagatcagaatctacaataga

SEQ ID NO: 86784 - DNA, 75 bp, Artificial Sequence
  Synthetic
cgacattcttgaaatcccctatgtcatgagacagggcgatagttggcttaagaaattcactgaggcgtgtaacgc

SEQ ID NO: 86785 - DNA, 75 bp, Artificial Sequence
  Synthetic
atgagacagggcgatagttggcttaagaaattcactgaggcgtgtaacgcagccaaaggtttggaatggatatcc

SEQ ID NO: 86786 - DNA, 75 bp, Artificial Sequence
  Synthetic
gctttttgccacatggcgtattacatacaaagacacagtgcaattacgccgcaagctggaattctttacatactc

SEQ ID NO: 86787 - DNA, 75 bp, Artificial Sequence
  Synthetic
tacaaagacacagtgcaattacgccgcaagctggaattctttacatactctcgatttgacatggaattcaccttc

SEQ ID NO: 86788 - DNA, 75 bp, Artificial Sequence
  Synthetic
acaaagctgaaacagttgggagtgttagaaaaccaaatcaataccattcaccaatcatgtccgagtcaagaacaa

SEQ ID NO: 86789 - DNA, 75 bp, Artificial Sequence
  Synthetic
tagaaaaccaaatcaataccattcaccaatcatgtccgagtcaagaacaacaagagatactcttcaacaatgtaa

SEQ ID NO: 86790 - DNA, 75 bp, Artificial Sequence
  Synthetic
ccaggagcacctacaccaaagtcatgggacgactacacctggcaaacatcttccaacccgtccatattctacacc

SEQ ID NO: 86791 - DNA, 75 bp, Artificial Sequence
  Synthetic
gggacgactacacctggcaaacatcttccaacccgtccatattctacacctatggggctgctccggcacgaatct

SEQ ID NO: 86792 - DNA, 75 bp, Artificial Sequence
  Synthetic
acaccattaataactacatacagttcaagagcaaacaccgtattgagccagtatgtatgttgatacacggtaccc

SEQ ID NO: 86793 - DNA, 75 bp, Artificial Sequence
  Synthetic
caagagcaaacaccgtattgagccagtatgtatgttgatacacggtaccccagggacaggcaagtccatcgccac

SEQ ID NO: 86794 - DNA, 75 bp, Artificial Sequence
  Synthetic
acgccaatgaccagattggtgactccctatacagcgccatgactgtggatgactttggtgtgctagcaattcgag

SEQ ID NO: 86795 - DNA, 75 bp, Artificial Sequence
  Synthetic
cctatacagcgccatgactgtggatgactttggtgtgctagcaattcgagttgtcaatgatcacaaccctactaa

SEQ ID NO: 86796 - DNA, 75 bp, Artificial Sequence
  Synthetic
tgatggatacaaacagcagggggtagttataatggatgacttaaatcagaatcccgatgggaacgatatgaagtt

SEQ ID NO: 86797 - DNA, 75 bp, Artificial Sequence
  Synthetic
gttataatggatgacttaaatcagaatcccgatgggaacgatatgaagttgttctgccaaatggtgtctacagtc

SEQ ID NO: 86798 - DNA, 75 bp, Artificial Sequence
  Synthetic
accttattatggaccaggggtggattacaaggataatttaaaccctttgtctgagaaaggtttgaccacctacgg

SEQ ID NO: 86799 - DNA, 75 bp, Artificial Sequence
  Synthetic
tacaaggataatttaaaccctttgtctgagaaaggtttgaccacctacggatttggacatcagaataaggcagtg

SEQ ID NO: 86800 - DNA, 75 bp, Artificial Sequence
  Synthetic
aactcaagcaccatagctccacctacggtggcccacagtgatgcactaaccaggagatttgcttttgatatggaa

SEQ ID NO: 86801 - DNA, 75 bp, Artificial Sequence
  Synthetic
cggtggcccacagtgatgcactaaccaggagatttgcttttgatatggaagtgtacacaatgtccgagcactcta

SEQ ID NO: 86802 - DNA, 75 bp, Artificial Sequence
  Synthetic
tggaacagagacctcctggttgctgagtcaagagctcagggtaccgacacaattgctagatgcaactgtaacaca

SEQ ID NO: 86803 - DNA, 75 bp, Artificial Sequence
  Synthetic
agtcaagagctcagggtaccgacacaattgctagatgcaactgtaacacaggtgtgtactattgtgaatctagga

SEQ ID NO: 86804 - DNA, 75 bp, Artificial Sequence
  Synthetic
gctgcccgctagtctgtggaaaggccctgcaactcatggataagaacacgagacaaagattcaccctggatgaaa

SEQ ID NO: 86805 - DNA, 75 bp, Artificial Sequence
  Synthetic
cctgcaactcatggataagaacacgagacaaagattcaccctggatgaaatcactaccctaatcatgaatgagaa

SEQ ID NO: 86806 - DNA, 75 bp, Artificial Sequence
  Synthetic
accaatcgcacatgttaatcgggcatggctttgcctcgccaggtgattgcggcggtatccttaggtgtcagcatg

SEQ ID NO: 86807 - DNA, 75 bp, Artificial Sequence
  Synthetic
tggctttgcctcgccaggtgattgcggcggtatccttaggtgtcagcatggtgtcattggaattataacagctgg

SEQ ID NO: 86808 - DNA, 75 bp, Artificial Sequence
  Synthetic
agacattaaagaaacccccgccccggaatacataaatgatttgctccaggcggttgacagccaagaggtgaggga

SEQ ID NO: 86809 - DNA, 75 bp, Artificial Sequence
  Synthetic
gaatacataaatgatttgctccaggcggttgacagccaagaggtgagggattactgtgagaggaaggggtggatt

SEQ ID NO: 86810 - DNA, 75 bp, Artificial Sequence
  Synthetic
ctataattacattgagtcacttggagctgcctttggtagtggattcacccagcaaataggagataaaatttcaga

SEQ ID NO: 86811 - DNA, 75 bp, Artificial Sequence
  Synthetic
gctgcctttggtagtggattcacccagcaaataggagataaaatttcagagttaactagtatggttaccagcacg

SEQ ID NO: 86812 - DNA, 75 bp, Artificial Sequence
  Synthetic
tttgcagcagttgctggggtggtgtacgtgatgtacaagttgttcgctggacaacagggtgcgtatactgggtta

SEQ ID NO: 86813 - DNA, 75 bp, Artificial Sequence
  Synthetic
acgtgatgtacaagttgttcgctggacaacagggtgcgtatactgggttaccgaacaagaaacccaatgtcccaa

SEQ ID NO: 86814 - DNA, 75 bp, Artificial Sequence
  Synthetic
accaccactgtgcttgccaccctagctcttcttgggtgtgacatctcaccatggcagtggctaaagaagaaagcg

SEQ ID NO: 86815 - DNA, 75 bp, Artificial Sequence
  Synthetic
ctcttcttgggtgtgacatctcaccatggcagtggctaaagaagaaagcgtgtgacatattggagattccctatg

SEQ ID NO: 86816 - DNA, 75 bp, Artificial Sequence
  Synthetic
ccactactagcaaaggtgagtttaccatgttgggggtgcatgacaacgtcgccattctaccaacacacgcctctc

SEQ ID NO: 86817 - DNA, 75 bp, Artificial Sequence
  Synthetic
catgttgggggtgcatgacaacgtcgccattctaccaacacacgcctctcccggggataccattgtcatcgatgg

SEQ ID NO: 86818 - DNA, 75 bp, Artificial Sequence
  Synthetic
ctaacaagatttcaaaattcattgattggttaaaggagaaaattatcccacaagccagagacaaactcgaatttg

SEQ ID NO: 86819 - DNA, 75 bp, Artificial Sequence
  Synthetic
actaaagagaaatgaaaagttcagagacatcagacctcacatacccacccaactcactgagacaaatgatggagt

SEQ ID NO: 86820 - DNA, 75 bp, Artificial Sequence
  Synthetic
tgactaagctaaagcaattggaaatgcttgaaaatcagatatccacgatacaccagtcctgtccaagtcaggaac

SEQ ID NO: 86821 - DNA, 75 bp, Artificial Sequence
  Synthetic
cccaacatgtacgttcctgtcggtgctgtgacagaacagggatatctgaatctcggtggtcgccaaactgctcgc

SEQ ID NO: 86822 - DNA, 75 bp, Artificial Sequence
  Synthetic
aagcaaagagaatacaaaaattggagcataccatcaacaattacatacagttcaagagcaaacaccgtattgagc

SEQ ID NO: 86823 - DNA, 75 bp, Artificial Sequence
  Synthetic
atgcatgttggagggaacggttcacatgggtttgcagcggccctaaagcggtcctacttcactcaaagtcaaggt

SEQ ID NO: 86824 - DNA, 75 bp, Artificial Sequence
  Synthetic
atgggtttgcagcggccctaaagcggtcctacttcactcaaagtcaaggtgaaatacagtggatgagaccttcca

SEQ ID NO: 86825 - DNA, 75 bp, Artificial Sequence
  Synthetic
ctcactgccaccagatccatcccatttcgatggctacaagcaacaaggtgtggtcattatggatgatcttaatca

SEQ ID NO: 86826 - DNA, 75 bp, Artificial Sequence
  Synthetic
ttcgatggctacaagcaacaaggtgtggtcattatggatgatcttaatcagaatcctgatggagctgacatgaaa

SEQ ID NO: 86827 - DNA, 75 bp, Artificial Sequence
  Synthetic
aaggggtcaaagaaccagcagtcctcaccaagaacgatcccaggctcaaaacagactttgaggaggccatctttt

SEQ ID NO: 86828 - DNA, 75 bp, Artificial Sequence
  Synthetic
caccaagaacgatcccaggctcaaaacagactttgaggaggccatcttttcaaagtatgtaggcaacaaaatcac

SEQ ID NO: 86829 - DNA, 75 bp, Artificial Sequence
  Synthetic
acatccaactatgttttggcttccactaattccagccgaatcacaccacctacggtagcccacagtgacgcactg

SEQ ID NO: 86830 - DNA, 75 bp, Artificial Sequence
  Synthetic
ctaattccagccgaatcacaccacctacggtagcccacagtgacgcactggctagaagatttgcctttgatacgg

SEQ ID NO: 86831 - DNA, 75 bp, Artificial Sequence
  Synthetic
gcaaatgtgtctagaagatgcaatgtatggaactgatggtctggaagctttagatctgtctactagtgctggata

SEQ ID NO: 86832 - DNA, 75 bp, Artificial Sequence
  Synthetic
tatggaactgatggtctggaagctttagatctgtctactagtgctggatacccttatgtagcaatgggtaagaaa

SEQ ID NO: 86833 - DNA, 75 bp, Artificial Sequence
  Synthetic
gccatcaaccggcaaatttcaaaaggtgctgtcctttagtgtgtggcaaggcaattcaattaatggacaaatctt

SEQ ID NO: 86834 - DNA, 75 bp, Artificial Sequence
  Synthetic
gtgctgtcctttagtgtgtggcaaggcaattcaattaatggacaaatcttccagagttagatacagtatagacca

SEQ ID NO: 86835 - DNA, 75 bp, Artificial Sequence
  Synthetic
ctaccactagtcacttatgtgaaggatgagctcaggtcaaaaaccaaggtggagcaaggcaagtccaggttgatc

SEQ ID NO: 86836 - DNA, 75 bp, Artificial Sequence
  Synthetic
atgagctcaggtcaaaaaccaaggtggagcaaggcaagtccaggttgatcgaggcatcaagtctcaatgattcag

SEQ ID NO: 86837 - DNA, 75 bp, Artificial Sequence
  Synthetic
accactccagtacaaggacttaagaattgacatcaagacaagccctccacccgaatgcatcaatgacttgcttca

SEQ ID NO: 86838 - DNA, 75 bp, Artificial Sequence
  Synthetic
attgacatcaagacaagccctccacccgaatgcatcaatgacttgcttcaagcagtcgattctcaggaggtaagg

SEQ ID NO: 86839 - DNA, 75 bp, Artificial Sequence
  Synthetic
ttggctgtgatccagatttgttttggagcaaaataccagtattgatggaagaaaagctatttgcatttgattaca

SEQ ID NO: 86840 - DNA, 75 bp, Artificial Sequence
  Synthetic
gagcaaaataccagtattgatggaagaaaagctatttgcatttgattacacaggatatgatgcatcgcttagccc

SEQ ID NO: 86841 - DNA, 75 bp, Artificial Sequence
  Synthetic
atgacgattttacaagcagtaacaacttttgctgcagtggccggtgttgtgtacgttatgtacaaactgtttgcc

SEQ ID NO: 86842 - DNA, 75 bp, Artificial Sequence
  Synthetic
cttttgctgcagtggccggtgttgtgtacgttatgtacaaactgtttgccggacaccagggcgcatacactggtt

SEQ ID NO: 86843 - DNA, 75 bp, Artificial Sequence
  Synthetic
taaccattcacaccatctctacaagaataaaacatactgtgtcaagggcggcatgccatccggctgctcgggcac

SEQ ID NO: 86844 - DNA, 75 bp, Artificial Sequence
  Synthetic
ccatggctaagagaaacattgtcacagcaaccaccagtaaaggggagttcacaatgttgggagtccatgacaacg

SEQ ID NO: 86845 - DNA, 75 bp, Artificial Sequence
  Synthetic
cccatgaggttgacgctagtctcctagcccaatcaggaaaagactatggactaaccatgactccagctgataaat

SEQ ID NO: 86846 - DNA, 75 bp, Artificial Sequence
  Synthetic
gcccggcgagagcattgtgatcgatggtaaggaagtggaaattcttgatgctaaggcccttgaagatcaggcggg

SEQ ID NO: 86847 - DNA, 75 bp, Artificial Sequence
  Synthetic
aatgaaagaaattcatgaatcaattaggtggactaaagatcccaggaacacgcaggatcatgtccgctcattgtg

SEQ ID NO: 86848 - DNA, 75 bp, Artificial Sequence
  Synthetic
ggatgcatgttggtgggaacggttcacatgggttcgcagcagccctgaagcgatcatacttcactcaaagtcaag

SEQ ID NO: 86849 - DNA, 75 bp, Artificial Sequence
  Synthetic
aacccagtgcttttcactatgtgttcgagggagcgaaggaaccagcagtcctcacgaagaatgaccctaggctca

SEQ ID NO: 86850 - DNA, 75 bp, Artificial Sequence
  Synthetic
cgagggagcgaaggaaccagcagtcctcacgaagaatgaccctaggctcaaaacagattttgaagaagcgatttt

SEQ ID NO: 86851 - DNA, 75 bp, Artificial Sequence
  Synthetic
gctcatgtcgctagacatcaacacagaacaaatgtgtctggaggaagccatgtatggcactgacggtctggaggc

SEQ ID NO: 86852 - DNA, 75 bp, Artificial Sequence
  Synthetic
gaacaaatgtgtctggaggaagccatgtatggcactgacggtctggaggcacttgatttgtccaccagtgccggc

SEQ ID NO: 86853 - DNA, 75 bp, Artificial Sequence
  Synthetic
gtactctggtattgcggtacctttgtacgcctgttttatatcccctccccaagtaactttagaagcaattcacaa

SEQ ID NO: 86854 - DNA, 75 bp, Artificial Sequence
  Synthetic
agttcaatagagggggtacaaaccagtaccaccatgaacaagcacttctgtttccccggtgaagctgtatagact

SEQ ID NO: 86855 - DNA, 75 bp, Artificial Sequence
  Synthetic
aggttgttggatacctatggaatcaacttgccactggtgacatatgtcaaagatgagctacggtccaagacaaaa

SEQ ID NO: 86856 - DNA, 75 bp, Artificial Sequence
  Synthetic
acttgccactggtgacatatgtcaaagatgagctacggtccaagacaaaagtggagcagggaaaatccagactga

SEQ ID NO: 86857 - DNA, 75 bp, Artificial Sequence
  Synthetic
atccaggagtcgttactggcagtgcggttggttgtgacccagatctattttggagcaagatcccagtgttaatgg

SEQ ID NO: 86858 - DNA, 75 bp, Artificial Sequence
  Synthetic
ggttggttgtgacccagatctattttggagcaagatcccagtgttaatggaggaaaaactctttgcctttgacta

SEQ ID NO: 86859 - DNA, 75 bp, Artificial Sequence
  Synthetic
tgacaggacagattacatcgattacctcaatcactcacaccatttatacaaaaacaagacatattgtgtcaaagg

SEQ ID NO: 86860 - DNA, 75 bp, Artificial Sequence
  Synthetic
gtgtccgtgtttccttttattcttattatggctgcttatggtgacaacctaagattgttgtcatatagcttttgg

SEQ ID NO: 86861 - DNA, 75 bp, Artificial Sequence
  Synthetic
ctgtagttacaatgggagctcaagtatctactcaaaaatccgggtcacacgagaatcagaatgtggctgccggtg

SEQ ID NO: 86862 - DNA, 75 bp, Artificial Sequence
  Synthetic
atctactcaaaaatccgggtcacacgagaatcagaatgtggctgccggtggttctaccatcaattacaccaccat

SEQ ID NO: 86863 - DNA, 75 bp, Artificial Sequence
  Synthetic
gccagttaaggatatcatgatcaaaacagccccggccttaaactcacccaacattgaagcttgtggatatagtga

SEQ ID NO: 86864 - DNA, 75 bp, Artificial Sequence
  Synthetic
tcctttccttattcatccagtaatgccaatgaaagaaattcatgaatcgattagatggaccaaagatcctagaaa

SEQ ID NO: 86865 - DNA, 75 bp, Artificial Sequence
  Synthetic
acagccccggccttaaactcacccaacattgaagcttgtggatatagtgatagagttcttcaattaacattagga

SEQ ID NO: 86866 - DNA, 75 bp, Artificial Sequence
  Synthetic
aaggaagctaacccagtggatgcccctacggaacccgatgcatctagcaatagattctacactctagatagcaaa

SEQ ID NO: 86867 - DNA, 75 bp, Artificial Sequence
  Synthetic
ctacggaacccgatgcatctagcaatagattctacactctagatagcaaaccatgggcagcagattctagaggat

SEQ ID NO: 86868 - DNA, 75 bp, Artificial Sequence
  Synthetic
tacgcctgttttatatcccctcccccatgcaactttagaagtaattcaaatagttcaatagagggggtacaaacc

SEQ ID NO: 86869 - DNA, 75 bp, Artificial Sequence
  Synthetic
gagctggatataccgtgcacgtacagtgtaatgcttccaagttccaccaaggaacacttcttgttgctgctattc

SEQ ID NO: 86870 - DNA, 75 bp, Artificial Sequence
  Synthetic
gtgtaatgcttccaagttccaccaaggaacacttcttgttgctgctattccagagtttatgatggggtccaacac

SEQ ID NO: 86871 - DNA, 75 bp, Artificial Sequence
  Synthetic
caccttgactaccggggatggtaaaaactctttttgcccactcgactgggtgttgggttgtggggtgatggctgg

SEQ ID NO: 86872 - DNA, 75 bp, Artificial Sequence
  Synthetic
aactctttttgcccactcgactgggtgttgggttgtggggtgatggctggaaatgctacagtgttcccgcaccag

SEQ ID NO: 86873 - DNA, 75 bp, Artificial Sequence
  Synthetic
tagttgtgaacaaggtgtgaagagcctattgagctacttaagagtcctccggcccctgaatgcggctaatcccaa

SEQ ID NO: 86874 - DNA, 75 bp, Artificial Sequence
  Synthetic
gcgaagcataataattggggcctagtggtcatgccagtagtaccactacagtatagcaatggtgcatcaaccctt

SEQ ID NO: 86875 - DNA, 75 bp, Artificial Sequence
  Synthetic
tggtcatgccagtagtaccactacagtatagcaatggtgcatcaacccttgtgcccattactatcacaatagcac

SEQ ID NO: 86876 - DNA, 75 bp, Artificial Sequence
  Synthetic
gtataacaataatgggagctcaagtgtctactcagaagtctggatcacatgaaaatcagaatgtggctgctggtg

SEQ ID NO: 86877 - DNA, 75 bp, Artificial Sequence
  Synthetic
ctggatccaatcagttcttgaccacagacaactttcagtcaccctgtgccctaccagattttgatgtgactccag

SEQ ID NO: 86878 - DNA, 75 bp, Artificial Sequence
  Synthetic
gtctactcagaagtctggatcacatgaaaatcagaatgtggctgctggtggttccactatcaattataccaccat

SEQ ID NO: 86879 - DNA, 75 bp, Artificial Sequence
  Synthetic
agacaactttcagtcaccctgtgccctaccagattttgatgtgactccagaaatacacataccaggggaggttaa

SEQ ID NO: 86880 - DNA, 75 bp, Artificial Sequence
  Synthetic
gccagttaaggatattatgatcaagacagcccctgccttgaactcgcccaacatagaagcctgtgggtatagtga

SEQ ID NO: 86881 - DNA, 75 bp, Artificial Sequence
  Synthetic
agcttaccagataccaatacaagcaaaccagcaagataacaacaagtcaatctttgctatcagtctcagccctgc

SEQ ID NO: 86882 - DNA, 75 bp, Artificial Sequence
  Synthetic
acagcccctgccttgaactcgcccaacatagaagcctgtgggtatagtgatagggttctccaactaacattagga

SEQ ID NO: 86883 - DNA, 75 bp, Artificial Sequence
  Synthetic
aaccagcaagataacaacaagtcaatctttgctatcagtctcagccctgctgctaatcccagattgtcatatacc

SEQ ID NO: 86884 - DNA, 75 bp, Artificial Sequence
  Synthetic
agggaagccaatccggtggatgctccaacagaacctgatgcttcgagtaacagattttacactctagatagtaaa

SEQ ID NO: 86885 - DNA, 75 bp, Artificial Sequence
  Synthetic
gccatggcaaccgggaaattgttgttgagttacagtccaccaggtgctaaaccccctaccaccagaaaagaagcc

SEQ ID NO: 86886 - DNA, 75 bp, Artificial Sequence
  Synthetic
caacagaacctgatgcttcgagtaacagattttacactctagatagtaaaccatgggcagcagggtccagaggat

SEQ ID NO: 86887 - DNA, 75 bp, Artificial Sequence
  Synthetic
tgagttacagtccaccaggtgctaaaccccctaccaccagaaaagaagccatgttgggcactcacataatatggg

SEQ ID NO: 86888 - DNA, 75 bp, Artificial Sequence
  Synthetic
gagctgggtatactgtgcacgtacagtgtaatgcctcaaaatttcatcaagggacgctacttgttgctgctattc

SEQ ID NO: 86889 - DNA, 75 bp, Artificial Sequence
  Synthetic
atgactttacagaaggggggtacatttgctgcttctatcaaacagctattgtagtgcccagtggaaccccagtga

SEQ ID NO: 86890 - DNA, 75 bp, Artificial Sequence
  Synthetic
gtgtaatgcctcaaaatttcatcaagggacgctacttgttgctgctattccagagtttatgatggggtctaacac

SEQ ID NO: 86891 - DNA, 75 bp, Artificial Sequence
  Synthetic
ttgctgcttctatcaaacagctattgtagtgcccagtggaaccccagtgaccatgagcatgctgtgctttgttag

SEQ ID NO: 86892 - DNA, 75 bp, Artificial Sequence
  Synthetic
taccttgaccacaggagatggcaagaattccttctgtccacttgattgggtgttaggttgtggagtgatggctgg

SEQ ID NO: 86893 - DNA, 75 bp, Artificial Sequence
  Synthetic
attgggcgattctattgaggctgccattgacagcatcacacaaaatgcactaaccactgtacaaaatacaacaca

SEQ ID NO: 86894 - DNA, 75 bp, Artificial Sequence
  Synthetic
aattccttctgtccacttgattgggtgttaggttgtggagtgatggctggaaacgctacagtattcccacaccag

SEQ ID NO: 86895 - DNA, 75 bp, Artificial Sequence
  Synthetic
attgacagcatcacacaaaatgcactaaccactgtacaaaatacaacacaatcaggacctactcattcaaaagaa

SEQ ID NO: 86896 - DNA, 75 bp, Artificial Sequence
  Synthetic
gcaaagcataacaattggggtctagttgtcattccagtagtaccactacaatacagtactggtgcatcaaccctt

SEQ ID NO: 86897 - DNA, 75 bp, Artificial Sequence
  Synthetic
gttataaacatgagacaaagatctgaagcatctatcgaatctttctttggccgatccgcatgtgttgcgatactt

SEQ ID NO: 86898 - DNA, 75 bp, Artificial Sequence
  Synthetic
ttgtcattccagtagtaccactacaatacagtactggtgcatcaacccttgtgcctattactataacaatagcac

SEQ ID NO: 86899 - DNA, 75 bp, Artificial Sequence
  Synthetic
aagcatctatcgaatctttctttggccgatccgcatgtgttgcgatacttggtttgtcaaacgccaaaccaactg

SEQ ID NO: 86900 - DNA, 75 bp, Artificial Sequence
  Synthetic
ctgggtctaatcaatttttaaccacagataattttcaatcaccttgtgctttaccggacttcgatgtaacaccag

SEQ ID NO: 86901 - DNA, 75 bp, Artificial Sequence
  Synthetic
agttctttacgtactcaaggtttgatttggaaatgaccatagtaattacagagagggttttcaatgcagtcaatg

SEQ ID NO: 86902 - DNA, 75 bp, Artificial Sequence
  Synthetic
agataattttcaatcaccttgtgctttaccggacttcgatgtaacaccagagatacacataccaggagaagtaaa

SEQ ID NO: 86903 - DNA, 75 bp, Artificial Sequence
  Synthetic
tttggaaatgaccatagtaattacagagagggttttcaatgcagtcaatgtcccattgcgcaattatgtgtacca

SEQ ID NO: 86904 - DNA, 75 bp, Artificial Sequence
  Synthetic
agcttatcagataccaatacaagcaaatcagcaggacaacaacaaatcaatttttgctattagcctcagccctgc

SEQ ID NO: 86905 - DNA, 75 bp, Artificial Sequence
  Synthetic
atcaatattctacaccactggaaatgctcctcccagagtgtcaattccatttgttggaatagggtctgcatattc

SEQ ID NO: 86906 - DNA, 75 bp, Artificial Sequence
  Synthetic
aatcagcaggacaacaacaaatcaatttttgctattagcctcagccctgctgccgaccctaggttgtcatacacc

SEQ ID NO: 86907 - DNA, 75 bp, Artificial Sequence
  Synthetic
gctcctcccagagtgtcaattccatttgttggaatagggtctgcatattcacacttttatgatggtttctcacag

SEQ ID NO: 86908 - DNA, 75 bp, Artificial Sequence
  Synthetic
gctatggcgactggaaaattgttactgagttatagtccaccaggtgcaaaaccccccaccaccaggaaggaagcc

SEQ ID NO: 86909 - DNA, 75 bp, Artificial Sequence
  Synthetic
tgagttatagtccaccaggtgcaaaaccccccaccaccaggaaggaagccatgctgggcacccacataatatggg

SEQ ID NO: 86910 - DNA, 75 bp, Artificial Sequence
  Synthetic
gcaattagaatagtaaatgaatatgacccagtgcaagtggatgcaaaggcccgagtgtatattaaacccaaacat

SEQ ID NO: 86911 - DNA, 75 bp, Artificial Sequence
  Synthetic
acccagtgcaagtggatgcaaaggcccgagtgtatattaaacccaaacatgttcgcatgtggtgccccagaccac

SEQ ID NO: 86912 - DNA, 75 bp, Artificial Sequence
  Synthetic
atgactttactgaaggaggttacatttgctgcttttatcaaacggctattgtggtgcccagtgggactccagtaa

SEQ ID NO: 86913 - DNA, 75 bp, Artificial Sequence
  Synthetic
tcaggacgtatgggtttggacaccaaaacaaggcagtatatacagcgggctacaagatctgcaattatcacctgg

SEQ ID NO: 86914 - DNA, 75 bp, Artificial Sequence
  Synthetic
ttgctgcttttatcaaacggctattgtggtgcccagtgggactccagtaaccatgagcatgttgtgttttgtcag

SEQ ID NO: 86915 - DNA, 75 bp, Artificial Sequence
  Synthetic
aaacaaggcagtatatacagcgggctacaagatctgcaattatcacctggccactccagaagatatggaaaaagc

SEQ ID NO: 86916 - DNA, 75 bp, Artificial Sequence
  Synthetic
attaggtgattcaattgaggccaccattgatagtatcactcaaaatgcactaaccactgttcagaacacagtaca

SEQ ID NO: 86917 - DNA, 75 bp, Artificial Sequence
  Synthetic
ctcatgcaaaacaggaatttactactgtgagtctaaaagaaagtattaccctgtctcagtctgtggaccaacatt

SEQ ID NO: 86918 - DNA, 75 bp, Artificial Sequence
  Synthetic
attgatagtatcactcaaaatgcactaaccactgttcagaacacagtacaatcaggacccactcactcaaaagag

SEQ ID NO: 86919 - DNA, 75 bp, Artificial Sequence
  Synthetic
tgtgagtctaaaagaaagtattaccctgtctcagtctgtggaccaacattccaatacatggaggccaatgatttt

SEQ ID NO: 86920 - DNA, 75 bp, Artificial Sequence
  Synthetic
gtcataaacatgagacagaggtctgaggcatctgttgaatccttctttggtcgatctgcatgtgttgcaatactt

SEQ ID NO: 86921 - DNA, 75 bp, Artificial Sequence
  Synthetic
agatgccaacacggggtgatgggtattatcactgccggtggtgaaggggttgtggcatttgcagacatcagagac

SEQ ID NO: 86922 - DNA, 75 bp, Artificial Sequence
  Synthetic
aggcatctgttgaatccttctttggtcgatctgcatgtgttgcaatacttgggttatcaaatgccaaaccaacca

SEQ ID NO: 86923 - DNA, 75 bp, Artificial Sequence
  Synthetic
ttatcactgccggtggtgaaggggttgtggcatttgcagacatcagagacttgtatatgtatgaagatgaggcca

SEQ ID NO: 86924 - DNA, 75 bp, Artificial Sequence
  Synthetic
agtttttcacatattcaagatttgacttggaaatgactatagtaattacagaaagagtgtttaacgcaatcaatg

SEQ ID NO: 86925 - DNA, 75 bp, Artificial Sequence
  Synthetic
ataaaatttcagagatacaaaatacagtccaaagtgttctcacagaaaagctcctcaaaaatctcataaaaattg

SEQ ID NO: 86926 - DNA, 75 bp, Artificial Sequence
  Synthetic
cttggaaatgactatagtaattacagaaagagtgtttaacgcaatcaatgctccgctgcgcagttatgtgtatca

SEQ ID NO: 86927 - DNA, 75 bp, Artificial Sequence
  Synthetic
agtccaaagtgttctcacagaaaagctcctcaaaaatctcataaaaattgtctcagctcttgttatagttgctag

SEQ ID NO: 86928 - DNA, 75 bp, Artificial Sequence
  Synthetic
atcaattttctacactactggaaatgcccctcccagggtgtcaatcccattcgttggaatagggtctgcatattc

SEQ ID NO: 86929 - DNA, 75 bp, Artificial Sequence
  Synthetic
caaagaaaagctttgtaatatgattggtgttccctatgtcatgaaacaaggagactcttggttaaagaagtttac

SEQ ID NO: 86930 - DNA, 75 bp, Artificial Sequence
  Synthetic
gcccctcccagggtgtcaatcccattcgttggaatagggtctgcatattcacacttttatgatggtttctcacag

SEQ ID NO: 86931 - DNA, 75 bp, Artificial Sequence
  Synthetic
ggtgttccctatgtcatgaaacaaggagactcttggttaaagaagtttacagaagcttgtaatgctgccaaaggg

SEQ ID NO: 86932 - DNA, 75 bp, Artificial Sequence
  Synthetic
gcaattagaatagtaaatgaatatgatccagtgcaagtggatgcaaaggctcgagtttacatcaaacccaagcac

SEQ ID NO: 86933 - DNA, 75 bp, Artificial Sequence
  Synthetic
aaactagagtacctttccaagctaaaacagcttgagatgatagagaatcaaatggctacactacaccaatcatgt

SEQ ID NO: 86934 - DNA, 75 bp, Artificial Sequence
  Synthetic
tcgagtttacatcaaacccaagcacgtacgtgtatggtgtcccagaccaccacgggctatgccctataaaaacaa

SEQ ID NO: 86935 - DNA, 75 bp, Artificial Sequence
  Synthetic
aacagcttgagatgatagagaatcaaatggctacactacaccaatcatgtcccagccaagaagaacaggaagtcc

SEQ ID NO: 86936 - DNA, 75 bp, Artificial Sequence
  Synthetic
tatttaagttggaaacatctatcaataattatgtacaattcaagaccaaacaccgcattgaaccagtatgtttat

SEQ ID NO: 86937 - DNA, 75 bp, Artificial Sequence
  Synthetic
aaataaagcagtctacactgctggatacaaaatctgcaactaccatctagcaactccagaagacatggaaaaagc

SEQ ID NO: 86938 - DNA, 75 bp, Artificial Sequence
  Synthetic
tacaaaatctgcaactaccatctagcaactccagaagacatggaaaaagcagttaacatcatgtgggatagggat

SEQ ID NO: 86939 - DNA, 75 bp, Artificial Sequence
  Synthetic
taattatgtacaattcaagaccaaacaccgcattgaaccagtatgtttattgattcatggaacaccaggcacagg

SEQ ID NO: 86940 - DNA, 75 bp, Artificial Sequence
  Synthetic
agatccctcacatttcgacggctacaagcagcaaggggtcgtaatcatggatgatttaaatcaaaacccagacgg

SEQ ID NO: 86941 - DNA, 75 bp, Artificial Sequence
  Synthetic
tgtgaatccaaaagaaaatactaccctatcacagtttgtggaccaacgttccagtacatggaagccaatgatttc

SEQ ID NO: 86942 - DNA, 75 bp, Artificial Sequence
  Synthetic
ctatcacagtttgtggaccaacgttccagtacatggaagccaatgatttctacccagctagatatcagtctcata

SEQ ID NO: 86943 - DNA, 75 bp, Artificial Sequence
  Synthetic
aagcagcaaggggtcgtaatcatggatgatttaaatcaaaacccagacggggaggatatgaaattgttttgccag

SEQ ID NO: 86944 - DNA, 75 bp, Artificial Sequence
  Synthetic
gtgcttgcttccactaattccaacactataacacctcctacagtatcggcatctgatgcgttatccagaagattt

SEQ ID NO: 86945 - DNA, 75 bp, Artificial Sequence
  Synthetic
ttatcactgctggtggtgaaggagttgtggcatttgccgatattagggatttatacatgtatgaagaggaagtca

SEQ ID NO: 86946 - DNA, 75 bp, Artificial Sequence
  Synthetic
tgtggcatttgccgatattagggatttatacatgtatgaagaggaagtcatggagcagggtgttacagattatgt

SEQ ID NO: 86947 - DNA, 75 bp, Artificial Sequence
  Synthetic
ctataacacctcctacagtatcggcatctgatgcgttatccagaagatttgcttttgatatggatatacatccaa

SEQ ID NO: 86948 - DNA, 75 bp, Artificial Sequence
  Synthetic
caaacttttcaacttgctgtcccttagtgtgtgggaaggctattcaattgatggacaaaaataccagaatgaggt

SEQ ID NO: 86949 - DNA, 75 bp, Artificial Sequence
  Synthetic
agtccaaagtgttctcacagaaaagcttttgaagaatcttataaaaattgtctcagctcttgttatagtggctag

SEQ ID NO: 86950 - DNA, 75 bp, Artificial Sequence
  Synthetic
cttttgaagaatcttataaaaattgtctcagctcttgttatagtggctagaaattatgaagattcaatcacagtg

SEQ ID NO: 86951 - DNA, 75 bp, Artificial Sequence
  Synthetic
agtgtgtgggaaggctattcaattgatggacaaaaataccagaatgaggtactcactagaccaaatcactaccat

SEQ ID NO: 86952 - DNA, 75 bp, Artificial Sequence
  Synthetic
taaagatctcaaaattgatgtggtttccacaccaccaccttctgcaatctcagacctacttaagtcagtggacaa

SEQ ID NO: 86953 - DNA, 75 bp, Artificial Sequence
  Synthetic
ggtattccttatgttatgaaacaaggggattcctggttaaagaaatttacagaagcttgtaatgctgctaaggga

SEQ ID NO: 86954 - DNA, 75 bp, Artificial Sequence
  Synthetic
gggattcctggttaaagaaatttacagaagcttgtaatgctgctaagggattggagtggattgcaaataaaatta

SEQ ID NO: 86955 - DNA, 75 bp, Artificial Sequence
  Synthetic
tccacaccaccaccttctgcaatctcagacctacttaagtcagtggacaatcaggaagttagggattactgtaaa

SEQ ID NO: 86956 - DNA, 75 bp, Artificial Sequence
  Synthetic
ttacaatcactctccacctttgcggtagtagcagggatggtttatgtagtgtacaaactctttgcaggatttcaa

SEQ ID NO: 86957 - DNA, 75 bp, Artificial Sequence
  Synthetic
aacagcttgagatgatagaaaatcagatggctacactacatcagtcatgccctagtcaggaagagcaggaggttc

SEQ ID NO: 86958 - DNA, 75 bp, Artificial Sequence
  Synthetic
gatggctacactacatcagtcatgccctagtcaggaagagcaggaggttctcttcaacaatattagatggctggc

SEQ ID NO: 86959 - DNA, 75 bp, Artificial Sequence
  Synthetic
tagtagcagggatggtttatgtagtgtacaaactctttgcaggatttcaaggtgcatacactggtcttcccaatg

SEQ ID NO: 86960 - DNA, 75 bp, Artificial Sequence
  Synthetic
agaaaaacatcctgacagccaccacagaaaagggtgaattcacaatgttaggagtacatgatagagttgcagtat

SEQ ID NO: 86961 - DNA, 75 bp, Artificial Sequence
  Synthetic
caattacgtacaattcaagaccaaacaccgcattgaaccagtatgcttgttgattcatggaacacccggtactgg

SEQ ID NO: 86962 - DNA, 75 bp, Artificial Sequence
  Synthetic
agaaaagggtgaattcacaatgttaggagtacatgatagagttgcagtattgcctacccattcaaacccaggtga

SEQ ID NO: 86963 - DNA, 75 bp, Artificial Sequence
  Synthetic
caagtcagtcgctacaggcctcattggaagagcaattgcaaagcaagcaaacaccagtacttattctttgccccc

SEQ ID NO: 86964 - DNA, 75 bp, Artificial Sequence
  Synthetic
tgaaattactattgtaaccctagacagaaacgaaaagtttagagacatcagaactcacttaccgacccaaatcca

SEQ ID NO: 86965 - DNA, 75 bp, Artificial Sequence
  Synthetic
agaaacgaaaagtttagagacatcagaactcacttaccgacccaaatccatgagaccaatgatgcggttttggct

SEQ ID NO: 86966 - DNA, 75 bp, Artificial Sequence
  Synthetic
ggaggatatgaaattgttctgtcaaatggtctccacagtggagttcataccaccaatggccagcttagaagaaaa

SEQ ID NO: 86967 - DNA, 75 bp, Artificial Sequence
  Synthetic
ggcagacccacaaatagaaccctaatgtataactttccaactaaagcagggcagtgtggtggtgtcttaatggcc

SEQ ID NO: 86968 - DNA, 75 bp, Artificial Sequence
  Synthetic
tgtataactttccaactaaagcagggcagtgtggtggtgtcttaatggccactggcaaagtgattggcatacatg

SEQ ID NO: 86969 - DNA, 75 bp, Artificial Sequence
  Synthetic
atctgacgcattatctagaagatttgcttttgacatggacatatacccaatgtctgaatatacaacaaaagggaa

SEQ ID NO: 86970 - DNA, 75 bp, Artificial Sequence
  Synthetic
gcttttgacatggacatatacccaatgtctgaatatacaacaaaagggaaattgaacatggcattggctacccaa

SEQ ID NO: 86971 - DNA, 75 bp, Artificial Sequence
  Synthetic
aatggatgagaccaagtaaagatgcaggttaccccatgatcaacgcgccatcaaagacgaaattagagccaagtg

SEQ ID NO: 86972 - DNA, 75 bp, Artificial Sequence
  Synthetic
aggttaccccatgatcaacgcgccatcaaagacgaaattagagccaagtgtcttttttgatgttttcccaggcga

SEQ ID NO: 86973 - DNA, 75 bp, Artificial Sequence
  Synthetic
atggacaaaaacaccaggatgagatattctctggaccagattaccactatgatgatcaatgagagaaacaggagg

SEQ ID NO: 86974 - DNA, 75 bp, Artificial Sequence
  Synthetic
attctctggaccagattaccactatgatgatcaatgagagaaacaggaggtacaacattggaggttgcttagagg

SEQ ID NO: 86975 - DNA, 75 bp, Artificial Sequence
  Synthetic
cattgggaataaaatcacagaagttgacgaatacatgagagaggctgttgaccattacgctggtcaattgatgtc

SEQ ID NO: 86976 - DNA, 75 bp, Artificial Sequence
  Synthetic
gacgaatacatgagagaggctgttgaccattacgctggtcaattgatgtcccttgacatacccacagaacaaatg

SEQ ID NO: 86977 - DNA, 75 bp, Artificial Sequence
  Synthetic
cagacctcctcaaatcagtagataatcaggaagttagggattattgcaaacaacagggctgggtggtggagatcc

SEQ ID NO: 86978 - DNA, 75 bp, Artificial Sequence
  Synthetic
tcaggaagttagggattattgcaaacaacagggctgggtggtggagatcccttcaaactctgtcaccattgaaag

SEQ ID NO: 86979 - DNA, 75 bp, Artificial Sequence
  Synthetic
gtggctattgggaaaaagaaaagagatattcttaacaagcaaacaagagacaccaaggaaatgcaaaaaatgtta

SEQ ID NO: 86980 - DNA, 75 bp, Artificial Sequence
  Synthetic
atattcttaacaagcaaacaagagacaccaaggaaatgcaaaaaatgttagataaatatgggataaatctacctt

SEQ ID NO: 86981 - DNA, 75 bp, Artificial Sequence
  Synthetic
ttacaaactctttgcaggatttcagggcgcatacacaggactccctaatgcaaaaccaaaagtccctacaattag

SEQ ID NO: 86982 - DNA, 75 bp, Artificial Sequence
  Synthetic
ggcgcatacacaggactccctaatgcaaaaccaaaagtccctacaattagagcagccaaagttcaagggcctgta

SEQ ID NO: 86983 - DNA, 75 bp, Artificial Sequence
  Synthetic
gctctttgaatgactcagttgccatgagacaggcttttggccacctgtatgccaaattccaccagaacccaggaa

SEQ ID NO: 86984 - DNA, 75 bp, Artificial Sequence
  Synthetic
gagacaggcttttggccacctgtatgccaaattccaccagaacccaggaataataacaggttcagcagttgggtg

SEQ ID NO: 86985 - DNA, 75 bp, Artificial Sequence
  Synthetic
ggtgtgtatgatagagttgctgtgcttcccactcactcaaacccaggtgagaccatagttatatcaggaaaggag

SEQ ID NO: 86986 - DNA, 75 bp, Artificial Sequence
  Synthetic
tgaaattactattataaccttagacaggaatgaaaagtttagggatattagaactcacttaccaacccaaatcca

SEQ ID NO: 86987 - DNA, 75 bp, Artificial Sequence
  Synthetic
tgatgcttcactttccccagcttggttcgaagctctgaaaatggtgttggaaaagattggatttggtgatcgagt

SEQ ID NO: 86988 - DNA, 75 bp, Artificial Sequence
  Synthetic
ctcagggtgttctggtacttcaatctttaattctatgattaacaatttaataattaggacattaatgctaaaaac

SEQ ID NO: 86989 - DNA, 75 bp, Artificial Sequence
  Synthetic
tgaacagggtatgctaaatcttggaggtaggcccacaaacagaaccttgatgtataacttcccaaccaaggcagg

SEQ ID NO: 86990 - DNA, 75 bp, Artificial Sequence
  Synthetic
cgctgccgctctcaaaagaagttacttcactgaagaacaaggagagattcaatggatgagaccaagcaaagatgc

SEQ ID NO: 86991 - DNA, 75 bp, Artificial Sequence
  Synthetic
ttcactgaagaacaaggagagattcaatggatgagaccaagcaaagatgcaggttaccccatgattaatgcgccc

SEQ ID NO: 86992 - DNA, 75 bp, Artificial Sequence
  Synthetic
gtaacatttctcaaaagattcttcagagcagatgagcagtatcctttccttgttcacccagtgatgcccatgaaa

SEQ ID NO: 86993 - DNA, 75 bp, Artificial Sequence
  Synthetic
tgcttggaagacgccatgtatggtacagatggtctcgaagccttggatttaacaactagtgctgggtatccttat

SEQ ID NO: 86994 - DNA, 75 bp, Artificial Sequence
  Synthetic
ctcctaccggagtattctactcttcgcaggcgctggctcgattctttttagagtaaccctacctcacccgaattg

SEQ ID NO: 86995 - DNA, 75 bp, Artificial Sequence
  Synthetic
taccaaagaaatgcagaaaatgctagataagtatggaattaatctaccattggtaacctatgtcaaggatgaact

SEQ ID NO: 86996 - DNA, 75 bp, Artificial Sequence
  Synthetic
tctttgcctttgattacacaggttatgatgcttcactttctccagcttggttcgaagctttaaaaatggtgttgg

SEQ ID NO: 86997 - DNA, 75 bp, Artificial Sequence
  Synthetic
aggaggcggctaattcagtggtcgcttatgggcgttggcctgaatatctgagggacagcgaagccaatccagtgg

SEQ ID NO: 86998 - DNA, 75 bp, Artificial Sequence
  Synthetic
ctgggaaactccactataaccacacaggaggcggctaattcagtggtcgcttatgggcgttggcctgaatatctg

SEQ ID NO: 86999 - DNA, 75 bp, Artificial Sequence
  Synthetic
ctcagggtgctctggcacctcaattttcaattccatgatcaataatctgataattaggacactaatgttaaaaac

SEQ ID NO: 87000 - DNA, 75 bp, Artificial Sequence
  Synthetic
acaggggttaggtcagatgcttgaaagcatgattgacaacacagtccgtgaaacggtgggggtggcaacgtctag

SEQ ID NO: 87001 - DNA, 75 bp, Artificial Sequence
  Synthetic
agcctagtatcgccttggaatcttcgacgcgttgcgctcagcacccgaccccggggtgtagcttaggctgatgag

SEQ ID NO: 87002 - DNA, 75 bp, Artificial Sequence
  Synthetic
gatgggtgcccaagtctcgtcccaaaaagttggcgcacatgagaacactaatgtggcaactggcggatccacggt

SEQ ID NO: 87003 - DNA, 75 bp, Artificial Sequence
  Synthetic
ttccaaatttactgaaccagtcaaagacattatgataaagactgccccagccctaaactctccaaatgttgaggc

SEQ ID NO: 87004 - DNA, 75 bp, Artificial Sequence
  Synthetic
agtggtcgcctacggagagtggcctagctatctggatgataaggaagccaatcccatagatgccccaaccgagcc

SEQ ID NO: 87005 - DNA, 75 bp, Artificial Sequence
  Synthetic
catggcctgcaacactgaagccaagacttcttatgtgtcctacgtcaatgccaatccgggtgagagagggggagt

SEQ ID NO: 87006 - DNA, 75 bp, Artificial Sequence
  Synthetic
acttcttatgtgtcctacgtcaatgccaatccgggtgagagagggggagtgtttgacaatgcttacaaccccagt

SEQ ID NO: 87007 - DNA, 75 bp, Artificial Sequence
  Synthetic
accattgtgcaagctagactatgcaccaaactcatccacggagattcccataacagtgactattgcaccaatgtt

SEQ ID NO: 87008 - DNA, 75 bp, Artificial Sequence
  Synthetic
caaggctaacacaatggagatgtacccgatcccgctagacgacaaaggtggtgcaacacccatatttagcatttc

SEQ ID NO: 87009 - DNA, 75 bp, Artificial Sequence
  Synthetic
cagacaagaatagtggtgccatctggtacaccaacgtcaatgttcatgttggcctttgtgagtgcttgcccagat

SEQ ID NO: 87010 - DNA, 75 bp, Artificial Sequence
  Synthetic
tttagcgtgcgtctgttgagagacactaatcacatctcacagagaactttgtttgcgcgcgcacaaggcattgag

SEQ ID NO: 87011 - DNA, 75 bp, Artificial Sequence
  Synthetic
tccacaccgctcactagtggagtcaactcacaggaggtgcccgcactaactgcagtagagactggtgcatctggc

SEQ ID NO: 87012 - DNA, 75 bp, Artificial Sequence
  Synthetic
tgcagtagagactggtgcatctggccaggcggtgcccagtgatgtaattgagaccagacatgttgtgaattacaa

SEQ ID NO: 87013 - DNA, 75 bp, Artificial Sequence
  Synthetic
gctgtagagcaggagtgtattactgtaagtcaatgaagaaacactacccagtttcagttacagaacccacttttc

SEQ ID NO: 87014 - DNA, 75 bp, Artificial Sequence
  Synthetic
caggtgattgtggaggtatcctgagatgcaatcatggagtcatgggtattgtaacagcaggtggtaatgggattg

SEQ ID NO: 87015 - DNA, 75 bp, Artificial Sequence
  Synthetic
ggttgagtttgtttccaagctcaaacagctgggaatgttagaaaatcagattaatactatacatcaatcatgccc

SEQ ID NO: 87016 - DNA, 75 bp, Artificial Sequence
  Synthetic
gatcttaaccagaaccctgacggcaacgacatgaagctgttctgccaaatggtttccacagtagagtttatacca

SEQ ID NO: 87017 - DNA, 75 bp, Artificial Sequence
  Synthetic
gctgcagttgtttatgtaatgtacaaactgtttgctgggcaccagggagcctacacaggattaccaaacaagaag

SEQ ID NO: 87018 - DNA, 75 bp, Artificial Sequence
  Synthetic
cacatcccaacccagatcactgagacaaatgatggagtgttgatcgtgaacactagtaagtaccctaacatgtat

SEQ ID NO: 87019 - DNA, 75 bp, Artificial Sequence
  Synthetic
cattatgtgtttgagggtgtgaaagaaccagcagttcttaccaagaatgaccccaggctaaagacagactttgaa

SEQ ID NO: 87020 - DNA, 75 bp, Artificial Sequence
  Synthetic
ggtcttgaagcattagatcttagcaccagtgctggttacccttatgtggcaatgggaaagaaaaagagagacatt

SEQ ID NO: 87021 - DNA, 75 bp, Artificial Sequence
  Synthetic
aggacactcttactgaaaacctacaagggcatagatctagaccatctaaagatgatcgcctatggtgatgatgta

SEQ ID NO: 87022 - DNA, 75 bp, Artificial Sequence
  Synthetic
aatgggtgcccaggtttcatcacagaaggtcggagcccacgaaaattcaaacagagcctacggcggatctaccat

SEQ ID NO: 87023 - DNA, 75 bp, Artificial Sequence
  Synthetic
cagctaaccctaggcaattcaacgatcaccacccaagaagcggccaattctgttgttgcctacggcagatggcct

SEQ ID NO: 87024 - DNA, 75 bp, Artificial Sequence
  Synthetic
acattggatactgtcacctggaataaagaatccagagggtggtggtggaaactaccagatgctttaaaagacatg

SEQ ID NO: 87025 - DNA, 75 bp, Artificial Sequence
  Synthetic
tcaaagttccaccagggagctctaggggtgtttgcagttccagagatgtgtttggctggtgatagcacaattcac

SEQ ID NO: 87026 - DNA, 75 bp, Artificial Sequence
  Synthetic
gggtgtttgcagttccagagatgtgtttggctggtgatagcacaattcacatgttcacaaagtatgagaatgcta

SEQ ID NO: 87027 - DNA, 75 bp, Artificial Sequence
  Synthetic
tctgcccagttgattatctcttcgggagtggagtgctggcagggaatgcttttgtttacccacatcaaataataa

SEQ ID NO: 87028 - DNA, 75 bp, Artificial Sequence
  Synthetic
ccccctagcgccactagactttgccactgaatcctccactgagatacccatcacattgaccatagctccaatgtg

SEQ ID NO: 87029 - DNA, 75 bp, Artificial Sequence
  Synthetic
actgaatcctccactgagatacccatcacattgaccatagctccaatgtgctgtgagttcaacggtttacgcaac

SEQ ID NO: 87030 - DNA, 75 bp, Artificial Sequence
  Synthetic
tgatacccctcaacttgacgaaccaacgcaaaaacacgatggacatgtatagagttgagttgaacgatgcagctc

SEQ ID NO: 87031 - DNA, 75 bp, Artificial Sequence
  Synthetic
gtacatccagtaatgccaatgaaggaaattcatgaatcaatcagatggaccaaagatcctagaaacacacaggat

SEQ ID NO: 87032 - DNA, 75 bp, Artificial Sequence
  Synthetic
agtcgcaaagaggcaatgcttgggacacatgtaatatgggacattgggttgcagtcttcatgtaccatggtagta

SEQ ID NO: 87033 - DNA, 75 bp, Artificial Sequence
  Synthetic
tatcaaactagggtcgttgtcccgttgtccacgcccagaaagatggacattctgggtttcgtgtcagcttgcaat

SEQ ID NO: 87034 - DNA, 75 bp, Artificial Sequence
  Synthetic
tgtccacgcccagaaagatggacattctgggtttcgtgtcagcttgcaatgatttcagtgtgcgcttattgcggg

SEQ ID NO: 87035 - DNA, 75 bp, Artificial Sequence
  Synthetic
agcaccaccacgaacaagcacttctgtttccccggtgaaactgcatagactgtaaccacggttgaaagcggttga

SEQ ID NO: 87036 - DNA, 75 bp, Artificial Sequence
  Synthetic
ctaagaatgcactagtccccctagctaccaccagtagtttgcctgacacaaagccaagtggaccagcccattcca

SEQ ID NO: 87037 - DNA, 75 bp, Artificial Sequence
  Synthetic
agagacaggagctaccaatccgctggtgccatcagatactgtgcaaacgcgccatgtcatccagaggcgaacgcg

SEQ ID NO: 87038 - DNA, 75 bp, Artificial Sequence
  Synthetic
tcagtttggaaaataacttacaaagacactgttcaattgaggcgcaaactggaattcttcacgtattcaagattt

SEQ ID NO: 87039 - DNA, 75 bp, Artificial Sequence
  Synthetic
caaataatgtacataccacccggcgcacccatccctggtaagtgggatgactacacgtggcaaacgtcctccaat

SEQ ID NO: 87040 - DNA, 75 bp, Artificial Sequence
  Synthetic
attataaacttcacaatgggagctcaagtttccacacaaaaatccggttcacatgagaatcaaaatattgctgct

SEQ ID NO: 87041 - DNA, 75 bp, Artificial Sequence
  Synthetic
aagtttccacacaaaaatccggttcacatgagaatcaaaatattgctgctggtggttctactattaactacacca

SEQ ID NO: 87042 - DNA, 75 bp, Artificial Sequence
  Synthetic
ccgtcagtgttttacacctatggggcgccgccagcgagaatatcggtgccctatgtgggaatcgctaatgcgtat

SEQ ID NO: 87043 - DNA, 75 bp, Artificial Sequence
  Synthetic
ccgagccagtgaaagatatcatagtcaaaactgcccccgctttaaattcaccaaacattgaggcatgtgggtaca

SEQ ID NO: 87044 - DNA, 75 bp, Artificial Sequence
  Synthetic
caaaactgcccccgctttaaattcaccaaacattgaggcatgtgggtacagtgatagggtcctacaactgacact

SEQ ID NO: 87045 - DNA, 75 bp, Artificial Sequence
  Synthetic
cgaccaggaagcaaaccctgttgatgccccaactgaacctgatgcatcagcaaacaggttttacaccctagatag

SEQ ID NO: 87046 - DNA, 75 bp, Artificial Sequence
  Synthetic
ggaccaggtgtcgattacaaggatgggcttaccccactaccagaaaaggaattgacaacttatggatttggacac

SEQ ID NO: 87047 - DNA, 75 bp, Artificial Sequence
  Synthetic
gccccaactgaacctgatgcatcagcaaacaggttttacaccctagatagtgtggattggggtgcagactcaaaa

SEQ ID NO: 87048 - DNA, 75 bp, Artificial Sequence
  Synthetic
ggtagggccggttacacagtgcatgtacagtgtaatgcatctaaattccatcagggtacattatttgtagctgcc

SEQ ID NO: 87049 - DNA, 75 bp, Artificial Sequence
  Synthetic
tacagtgtaatgcatctaaattccatcagggtacattatttgtagctgccattccagagtatatgatggcaagta

SEQ ID NO: 87050 - DNA, 75 bp, Artificial Sequence
  Synthetic
cattcactccagacacacaagcaccaggtaaaaacaagtttgcacccctcgattggttgctaggctgtggtgtga

SEQ ID NO: 87051 - DNA, 75 bp, Artificial Sequence
  Synthetic
aggtaaaaacaagtttgcacccctcgattggttgctaggctgtggtgtgatggcaggtaatatcaccgtgttccc

SEQ ID NO: 87052 - DNA, 75 bp, Artificial Sequence
  Synthetic
gataatcaccgctggtggggaaggcttagtcgcattttcagacatcagagacctgcatgcctacgaagaggaagc

SEQ ID NO: 87053 - DNA, 75 bp, Artificial Sequence
  Synthetic
ctcaatggcaaaacacaacaattgggggatagttgtcattccatttgtgaaattggcttaccaaaatggtgcaac

SEQ ID NO: 87054 - DNA, 75 bp, Artificial Sequence
  Synthetic
gggatagttgtcattccatttgtgaaattggcttaccaaaatggtgcaaccacgaaggtgcccattactgtgacc

SEQ ID NO: 87055 - DNA, 75 bp, Artificial Sequence
  Synthetic
agctgcttaagaacttgatcaaaattatttcatcacttgtgattattaccaggaattatgaagacaccaccacag

SEQ ID NO: 87056 - DNA, 75 bp, Artificial Sequence
  Synthetic
gccactcctggctcaaatcagttcttaacatcagacaatttccaatcgccatgtgctttaccagattttgatgtc

SEQ ID NO: 87057 - DNA, 75 bp, Artificial Sequence
  Synthetic
taacatcagacaatttccaatcgccatgtgctttaccagattttgatgtcacaccagagatacacatccctggtg

SEQ ID NO: 87058 - DNA, 75 bp, Artificial Sequence
  Synthetic
tggagattccatatgctatcaaacaaggagatggttggttgaagaaattcaccgaggcatgcaatgctgcaaaag

SEQ ID NO: 87059 - DNA, 75 bp, Artificial Sequence
  Synthetic
gattggagtgggtgtccagcaagatatccaaattcattagttggctacaggataaaattatcccacaagcgagag

SEQ ID NO: 87060 - DNA, 75 bp, Artificial Sequence
  Synthetic
ccatggaggcataccctattcctctacaagccggtgtgcagaataacaatcaatcaatattttcaatcagcttaa

SEQ ID NO: 87061 - DNA, 75 bp, Artificial Sequence
  Synthetic
acaagccggtgtgcagaataacaatcaatcaatattttcaatcagcttaagcccagccgcagatcaaaggttatc

SEQ ID NO: 87062 - DNA, 75 bp, Artificial Sequence
  Synthetic
gtccaagtcaagagcaccaggagattttatttaacaatgtgcggtggctctctattcagtccaagaggtttgcac

SEQ ID NO: 87063 - DNA, 75 bp, Artificial Sequence
  Synthetic
tggtagcatgatggctacaggtaaaatattactaagttatagtccaccaggtgctaagccacccactactagaaa

SEQ ID NO: 87064 - DNA, 75 bp, Artificial Sequence
  Synthetic
atattactaagttatagtccaccaggtgctaagccacccactactagaaaagaagcaatgttaggtacccacttg

SEQ ID NO: 87065 - DNA, 75 bp, Artificial Sequence
  Synthetic
aacaccgtattgaaccagtatgtttgttagtgcatggcagtccggggacagggaagtcagttgcaaccaatctga

SEQ ID NO: 87066 - DNA, 75 bp, Artificial Sequence
  Synthetic
gtcaaagatgatttcacagagggcgggtatatttgttgcttttatcaaactgctatagttgtcccaccaggagcc

SEQ ID NO: 87067 - DNA, 75 bp, Artificial Sequence
  Synthetic
ggtatatttgttgcttttatcaaactgctatagttgtcccaccaggagccccaacagacatgagtatgttggcgt

SEQ ID NO: 87068 - DNA, 75 bp, Artificial Sequence
  Synthetic
acaagcaacagggtgtggtcataatggatgacctgaaccaaaatccagacggagcagacatgaaactcttttgtc

SEQ ID NO: 87069 - DNA, 75 bp, Artificial Sequence
  Synthetic
ggatgacctgaaccaaaatccagacggagcagacatgaaactcttttgtcaaatggtgtccactgtagagttcat

SEQ ID NO: 87070 - DNA, 75 bp, Artificial Sequence
  Synthetic
taacaacacaaggtattgatgatatcatagataatgttgtaaccaatgctttgaaggtgtccatgccacaagttc

SEQ ID NO: 87071 - DNA, 75 bp, Artificial Sequence
  Synthetic
catagataatgttgtaaccaatgctttgaaggtgtccatgccacaagttcaagatacgcaatctagtggaccagt

SEQ ID NO: 87072 - DNA, 75 bp, Artificial Sequence
  Synthetic
ccggatcacaccgcccacggtggctcacagcgatgcgctggccaggagattcgcgttcgacatggacatacaagt

SEQ ID NO: 87073 - DNA, 75 bp, Artificial Sequence
  Synthetic
agaaactagacatgttattaataaccgcctcagatctgagtgcacaatagaatcattctttgggaggtcagcatg

SEQ ID NO: 87074 - DNA, 75 bp, Artificial Sequence
  Synthetic
cgcctcagatctgagtgcacaatagaatcattctttgggaggtcagcatgtgtggccataattgggttatctaac

SEQ ID NO: 87075 - DNA, 75 bp, Artificial Sequence
  Synthetic
agcaaacttcaagagatgctgccccttagtgtgtggcaaggcaattcagttgatggataaatcttccagagtcag

SEQ ID NO: 87076 - DNA, 75 bp, Artificial Sequence
  Synthetic
agaagaaaattggaattcttcacatactccagatttgatcttgagttaacctttgtaatttcagaaagattcttc

SEQ ID NO: 87077 - DNA, 75 bp, Artificial Sequence
  Synthetic
agctctattccagggaccactgcaatacagagatctaaaaatagatgtcaagaccagtccccctccagagtgcat

SEQ ID NO: 87078 - DNA, 75 bp, Artificial Sequence
  Synthetic
actccagatttgatcttgagttaacctttgtaatttcagaaagattcttcacctcaacttcagctgctgcaagag

SEQ ID NO: 87079 - DNA, 75 bp, Artificial Sequence
  Synthetic
catccacaaacccctcaatattctacaccacaggaaatgcatgccctagagtgtccatcccttttgttgggatcg

SEQ ID NO: 87080 - DNA, 75 bp, Artificial Sequence
  Synthetic
caccacaggaaatgcatgccctagagtgtccatcccttttgttgggatcggtgcagcatactctcacttctatga

SEQ ID NO: 87081 - DNA, 75 bp, Artificial Sequence
  Synthetic
tacaagctgttcgctgggcaccaaggtgcatacactggtttgccaaataaacgacctaatgtacccaccatcagg

SEQ ID NO: 87082 - DNA, 75 bp, Artificial Sequence
  Synthetic
ttttgggactatggcaatcaggatagttaatgaatacgacccagtcacaattgatgcaaaagtcagggtttacat

SEQ ID NO: 87083 - DNA, 75 bp, Artificial Sequence
  Synthetic
gttaatgaatacgacccagtcacaattgatgcaaaagtcagggtttacatgaaaccaaagcatattaaggtgtgg

SEQ ID NO: 87084 - DNA, 75 bp, Artificial Sequence
  Synthetic
agcaagggggagttcacaatgctaggggttcatgataatgtagctatcctgccaactcacgccacatccggtgag

SEQ ID NO: 87085 - DNA, 75 bp, Artificial Sequence
  Synthetic
gggttcatgataatgtagctatcctgccaactcacgccacatccggtgagagcatcgtgatcgacggtaaagaag

SEQ ID NO: 87086 - DNA, 75 bp, Artificial Sequence
  Synthetic
gcagttgctgatattagaacttatggatttggacaccagaacaaggccgtttacacggcaggttacaaaatatgc

SEQ ID NO: 87087 - DNA, 75 bp, Artificial Sequence
  Synthetic
gatttggacaccagaacaaggccgtttacacggcaggttacaaaatatgcaattaccatctagcgactccagagg

SEQ ID NO: 87088 - DNA, 75 bp, Artificial Sequence
  Synthetic
ccattgccagatgttcatgtaaagcaggtgtctactactgtgagtccaagaggaaatattaccccatttcagttt

SEQ ID NO: 87089 - DNA, 75 bp, Artificial Sequence
  Synthetic
aggtgtctactactgtgagtccaagaggaaatattaccccatttcagtttgtggacccacattccagtacatgga

SEQ ID NO: 87090 - DNA, 75 bp, Artificial Sequence
  Synthetic
ctggaaaagtcatcgggatgcacgttggcgggaacggttcacatgggtttgcggcggccctgaaacggtcatact

SEQ ID NO: 87091 - DNA, 75 bp, Artificial Sequence
  Synthetic
tggtggcatcctcaggtgccaacacggtgtgatgggcattatcactgctggtggagaaggagtcgtggcttttgc

SEQ ID NO: 87092 - DNA, 75 bp, Artificial Sequence
  Synthetic
ggtgtgatgggcattatcactgctggtggagaaggagtcgtggcttttgcagacattagagacctttacatgtat

SEQ ID NO: 87093 - DNA, 75 bp, Artificial Sequence
  Synthetic
gcagaagtggctaacaaaatctcagagatccagagcactgtacaaagtgtccttacagagaaactccttaagaat

SEQ ID NO: 87094 - DNA, 75 bp, Artificial Sequence
  Synthetic
agatccagagcactgtacaaagtgtccttacagagaaactccttaagaatctaatcaagattgtttccgcacttg

SEQ ID NO: 87095 - DNA, 75 bp, Artificial Sequence
  Synthetic
catggcaatggctcaaagagaaattgtgcaatatgattggtatcccctatgtgatgaggcagggagactcatggt

SEQ ID NO: 87096 - DNA, 75 bp, Artificial Sequence
  Synthetic
gtgcaatatgattggtatcccctatgtgatgaggcagggagactcatggttaaaaaaatttacagaggcttgtaa

SEQ ID NO: 87097 - DNA, 75 bp, Artificial Sequence
  Synthetic
tgtaacgtatgtcaaagatgagctaaggtcaaaaaccaaagtggagcaagggaaatctagactaattgaagcctc

SEQ ID NO: 87098 - DNA, 75 bp, Artificial Sequence
  Synthetic
agaagcaaaagacaaactagagtacctctccaaattgaaacagcttgagatgatagagaaccagatggctacatt

SEQ ID NO: 87099 - DNA, 75 bp, Artificial Sequence
  Synthetic
ctctccaaattgaaacagcttgagatgatagagaaccagatggctacattgcaccagtcatgccccagccaagag

SEQ ID NO: 87100 - DNA, 75 bp, Artificial Sequence
  Synthetic
tcccagtgctgatggaagagaagctcttcgcatttgattacacagggtatgatgcatctcttagccctgcttggt

SEQ ID NO: 87101 - DNA, 75 bp, Artificial Sequence
  Synthetic
gaagcacgcaggatatttaaattggaaacttccattaacaactatgtacagttcaagaccaaacaccgcattgaa

SEQ ID NO: 87102 - DNA, 75 bp, Artificial Sequence
  Synthetic
aaacttccattaacaactatgtacagttcaagaccaaacaccgcattgaaccagtatgtcttttgattcatggaa

SEQ ID NO: 87103 - DNA, 75 bp, Artificial Sequence
  Synthetic
atactgtgtcaagggcggcatgccatctggctgctcaggcacttcaattttcaactcaatgatcaacaacttaat

SEQ ID NO: 87104 - DNA, 75 bp, Artificial Sequence
  Synthetic
attctctaccacctgacccctcacactttgatggttataagcaacaaggtgttgtgatcatggatgacttaaacc

SEQ ID NO: 87105 - DNA, 75 bp, Artificial Sequence
  Synthetic
ctttgatggttataagcaacaaggtgttgtgatcatggatgacttaaaccagaacccagatggagaagacatgaa

SEQ ID NO: 87106 - DNA, 75 bp, Artificial Sequence
  Synthetic
tacttcagattatgtgctagcctcaactaactccaacacaatcatacctcccacagtgtcagcatctgatgcatt

SEQ ID NO: 87107 - DNA, 75 bp, Artificial Sequence
  Synthetic
actaactccaacacaatcatacctcccacagtgtcagcatctgatgcattatctagaagatttgcctttgacatg

SEQ ID NO: 87108 - DNA, 75 bp, Artificial Sequence
  Synthetic
tgtcacaaaccagcaaatttttcaacctgctgccctctagtgtgtggaaaagctattcagttaatggacaagaat

SEQ ID NO: 87109 - DNA, 75 bp, Artificial Sequence
  Synthetic
cctgctgccctctagtgtgtggaaaagctattcagttaatggacaagaataccagaatgagatattcgctagatc

SEQ ID NO: 87110 - DNA, 75 bp, Artificial Sequence
  Synthetic
tgctcccagagtactcaacactgtaccgccgttggctcgactcattttagcaaccctacttcagtcgaattggat

SEQ ID NO: 87111 - DNA, 75 bp, Artificial Sequence
  Synthetic
gacccattgaatttaaagatctcaaaatagatgtagtatccacaccgccaccctcagcaatttcagatttactta

SEQ ID NO: 87112 - DNA, 75 bp, Artificial Sequence
  Synthetic
aatagatgtagtatccacaccgccaccctcagcaatttcagatttacttaagtcagtagataaccaagaagtcag

SEQ ID NO: 87113 - DNA, 75 bp, Artificial Sequence
  Synthetic
aagttcaatagaagggggtacaaaccagtaccaccacgaacaagcacttctgtttccccggtgaagttgcataga

SEQ ID NO: 87114 - DNA, 75 bp, Artificial Sequence
  Synthetic
tgctaccagtgttctacaatctctgtccacctttgcagtagtagcaggaatggtttatgtagtctataagctctt

SEQ ID NO: 87115 - DNA, 75 bp, Artificial Sequence
  Synthetic
tccacctttgcagtagtagcaggaatggtttatgtagtctataagctctttgctgggtttcagggtgcgtacaca

SEQ ID NO: 87116 - DNA, 75 bp, Artificial Sequence
  Synthetic
gttgcaatggccaaaaagaacattcttactgccactacagagaaaggtgaattcacaatgctaggtgtatatgac

SEQ ID NO: 87117 - DNA, 75 bp, Artificial Sequence
  Synthetic
ttactgccactacagagaaaggtgaattcacaatgctaggtgtatatgacagagttgcggtgctccctactcact

SEQ ID NO: 87118 - DNA, 75 bp, Artificial Sequence
  Synthetic
agcctactgagctaattgagagtcctccggcccctgaatgcggataatcctaaccacggagcaggtgatcacaat

SEQ ID NO: 87119 - DNA, 75 bp, Artificial Sequence
  Synthetic
atgagatcaatcttgaaattaccattataaccttagatagaaatgagaaatttagagacattagaacacacttac

SEQ ID NO: 87120 - DNA, 75 bp, Artificial Sequence
  Synthetic
tataaccttagatagaaatgagaaatttagagacattagaacacacttaccaactcaaattcacgaaactaatga

SEQ ID NO: 87121 - DNA, 75 bp, Artificial Sequence
  Synthetic
aatcatagattgttatcataaagcgaattggattggccatccggtgagaattaaatcgctaatatatctatttgt

SEQ ID NO: 87122 - DNA, 75 bp, Artificial Sequence
  Synthetic
gttaaatttagggggtagacccacaaacaggactctaatgtataactttccaactaaggcaggacagtgtggtgg

SEQ ID NO: 87123 - DNA, 75 bp, Artificial Sequence
  Synthetic
tgggagctcaagtttcgtctcaaaaggttggtgcacatgaaaacaccaatgtggccacaggtggatccaccgtca

SEQ ID NO: 87124 - DNA, 75 bp, Artificial Sequence
  Synthetic
ggttggtgcacatgaaaacaccaatgtggccacaggtggatccaccgtcaattacaccacaataaattattacaa

SEQ ID NO: 87125 - DNA, 75 bp, Artificial Sequence
  Synthetic
aacaggactctaatgtataactttccaactaaggcaggacagtgtggtggtgttttaatggccactggtaaagta

SEQ ID NO: 87126 - DNA, 75 bp, Artificial Sequence
  Synthetic
cagggagaaattcagtggatgagaccaagcaaagatgcaggctaccccatgattaatgcaccatcaaaaacaaaa

SEQ ID NO: 87127 - DNA, 75 bp, Artificial Sequence
  Synthetic
tatcatgctaaaatcagcccctgcattgaattcaccaaacgtcgaggcatgtggatatagtgatagggttagaca

SEQ ID NO: 87128 - DNA, 75 bp, Artificial Sequence
  Synthetic
ttgaattcaccaaacgtcgaggcatgtggatatagtgatagggttagacagatcacactaggaaactccaccatt

SEQ ID NO: 87129 - DNA, 75 bp, Artificial Sequence
  Synthetic
caagcaaagatgcaggctaccccatgattaatgcaccatcaaaaacaaaattagaaccaagtgttttctttgatg

SEQ ID NO: 87130 - DNA, 75 bp, Artificial Sequence
  Synthetic
tgttctccaaatatattgggaacaaaatcacagaggtagacgagtacatgaaagaagctgttgatcactatgctg

SEQ ID NO: 87131 - DNA, 75 bp, Artificial Sequence
  Synthetic
cctgttgacgcccctactgaacccgatgtcagttctaatagattttacacccttgaatcggtccaatggtcctca

SEQ ID NO: 87132 - DNA, 75 bp, Artificial Sequence
  Synthetic
atgtcagttctaatagattttacacccttgaatcggtccaatggtcctcaaccagcaaaggatggtggtggaagc

SEQ ID NO: 87133 - DNA, 75 bp, Artificial Sequence
  Synthetic
aatcacagaggtagacgagtacatgaaagaagctgttgatcactatgctggccaattaatgtcccttgatatacc

SEQ ID NO: 87134 - DNA, 75 bp, Artificial Sequence
  Synthetic
tggttacccttatgtggccattgggaaaaagaaaagagacattttaaataaacagacaagagataccaaagaaat

SEQ ID NO: 87135 - DNA, 75 bp, Artificial Sequence
  Synthetic
cggtgcatgtacagtgtaacgcctcaaagtttcatcaaggtgcacttggagtcttcgccattcctgagtacgtta

SEQ ID NO: 87136 - DNA, 75 bp, Artificial Sequence
  Synthetic
aaagtttcatcaaggtgcacttggagtcttcgccattcctgagtacgttatggcaaccaacacagagaccaagac

SEQ ID NO: 87137 - DNA, 75 bp, Artificial Sequence
  Synthetic
aaaaagaaaagagacattttaaataaacagacaagagataccaaagaaatgcaaaaaatgttagataagtatgga

SEQ ID NO: 87138 - DNA, 75 bp, Artificial Sequence
  Synthetic
ttaattgaggcaagctctctgaatgattctgttgctatgagacaagcctttggtcatttgtatgccaaatttcat

SEQ ID NO: 87139 - DNA, 75 bp, Artificial Sequence
  Synthetic
agagacgtcagagggccgcaagtttgcagctgtcgactacttacttggttgtggagtcctagcgggcaatgcgtt

SEQ ID NO: 87140 - DNA, 75 bp, Artificial Sequence
  Synthetic
gcagctgtcgactacttacttggttgtggagtcctagcgggcaatgcgtttgtgttcccgcatcaaatcatcaat

SEQ ID NO: 87141 - DNA, 75 bp, Artificial Sequence
  Synthetic
attctgttgctatgagacaagcctttggtcatttgtatgccaaatttcatcaaaatccaggaataacaacaggtt

SEQ ID NO: 87142 - DNA, 75 bp, Artificial Sequence
  Synthetic
actatacaggttatgatgcctcactctccccagcttggtttgaggcactgaagatggttttagaaaagattggat

SEQ ID NO: 87143 - DNA, 75 bp, Artificial Sequence
  Synthetic
aataactgggggttagtcatcttgccacttgaaccgctagcatatgcaccagaggcctccacaacgatcccaatc

SEQ ID NO: 87144 - DNA, 75 bp, Artificial Sequence
  Synthetic
cacttgaaccgctagcatatgcaccagaggcctccacaacgatcccaatcacagtcacaatagcaccaatgtgca

SEQ ID NO: 87145 - DNA, 75 bp, Artificial Sequence
  Synthetic
aaggtgggatgccctcagggtgctccggcacttcaatctttaattccatgattaacaatttaataattagaacat

SEQ ID NO: 87146 - DNA, 75 bp, Artificial Sequence
  Synthetic
cggcacttcaatctttaattccatgattaacaatttaataattagaacattgatgcttaagacttacaaaggggt

SEQ ID NO: 87147 - DNA, 75 bp, Artificial Sequence
  Synthetic
cacaatacctcacctctgacgacttccagtccccgtgtgcaataccaaactttgatgtaacgccaccaattcaca

SEQ ID NO: 87148 - DNA, 75 bp, Artificial Sequence
  Synthetic
ccagtccccgtgtgcaataccaaactttgatgtaacgccaccaattcacatcccgggagaggtcagaaatatgat

SEQ ID NO: 87149 - DNA, 75 bp, Artificial Sequence
  Synthetic
aattccactaagcacaactggtagcacagatcccatattttgtctaagcctgtcaccagcatctgaccagagatt

SEQ ID NO: 87150 - DNA, 75 bp, Artificial Sequence
  Synthetic
acagatcccatattttgtctaagcctgtcaccagcatctgaccagagattacaatacacaatggtgggtgaaatt

SEQ ID NO: 87151 - DNA, 75 bp, Artificial Sequence
  Synthetic
tcaattaggtggaccaaagatccgcgaaacactcaggatcatgtccgatcattgtgcctattggcttggcacaat

SEQ ID NO: 87152 - DNA, 75 bp, Artificial Sequence
  Synthetic
aagttgatattaacatactccccaccaggtgccagtccacccaaaaccaggaaagatgcaatgttagggactcat

SEQ ID NO: 87153 - DNA, 75 bp, Artificial Sequence
  Synthetic
caggtgccagtccacccaaaaccaggaaagatgcaatgttagggactcatgtaatttgggacttaggtttgcaat

SEQ ID NO: 87154 - DNA, 75 bp, Artificial Sequence
  Synthetic
gtgggtacgttacatgcttttaccaaactagaatcgtggtgccagcaagtacaccaacaaaaatgtcgatgcttg

SEQ ID NO: 87155 - DNA, 75 bp, Artificial Sequence
  Synthetic
aactagaatcgtggtgccagcaagtacaccaacaaaaatgtcgatgcttgccttcgtaagtgcctgtccagactt

SEQ ID NO: 87156 - DNA, 75 bp, Artificial Sequence
  Synthetic
tgtaattgacaaggtcatcagcaatgcactacagttgtcacagcccactagatcagttaacgaagcggcatcaac

SEQ ID NO: 87157 - DNA, 75 bp, Artificial Sequence
  Synthetic
gcactacagttgtcacagcccactagatcagttaacgaagcggcatcaacgccagcaaccagtggagtcaattca

SEQ ID NO: 87158 - DNA, 75 bp, Artificial Sequence
  Synthetic
aggcatgtagtaaactacaagaccagatctgagtcaacactggagtcgttcttcggaaggtctgcatgtgtcacc

SEQ ID NO: 87159 - DNA, 75 bp, Artificial Sequence
  Synthetic
gatctgagtcaacactggagtcgttcttcggaaggtctgcatgtgtcaccattcttgaggttgaaaatttcaacg

SEQ ID NO: 87160 - DNA, 75 bp, Artificial Sequence
  Synthetic
tcataatacacaatgggggctcaggtgtccactcaaaagtctggatcgcacgaaaaccagaatgttgctgctggt

SEQ ID NO: 87161 - DNA, 75 bp, Artificial Sequence
  Synthetic
tgtccactcaaaagtctggatcgcacgaaaaccagaatgttgctgctggtggttctaccatcaactacaccacta

SEQ ID NO: 87162 - DNA, 75 bp, Artificial Sequence
  Synthetic
gaaaattggagttcttcacttactcaaggtttgacattgaaatgacttttgttgtcactgagagatattacacag

SEQ ID NO: 87163 - DNA, 75 bp, Artificial Sequence
  Synthetic
aaggtttgacattgaaatgacttttgttgtcactgagagatattacacaggagcagggtatgccaagaactcagt

SEQ ID NO: 87164 - DNA, 75 bp, Artificial Sequence
  Synthetic
aaccagtaaaagatgtcatgatcaaaacagcacccgcattgaattcacccaacattgaagcctgtgggtacagcg

SEQ ID NO: 87165 - DNA, 75 bp, Artificial Sequence
  Synthetic
aacagcacccgcattgaattcacccaacattgaagcctgtgggtacagcgacagagttctgcaattaaccctcgg

SEQ ID NO: 87166 - DNA, 75 bp, Artificial Sequence
  Synthetic
caacccgtccatcttttacacctatggatgtgcccctgctcgtatttcaatcccctatgttggaattgccaatgc

SEQ ID NO: 87167 - DNA, 75 bp, Artificial Sequence
  Synthetic
ggatgtgcccctgctcgtatttcaatcccctatgttggaattgccaatgcttactcacacttctatgatggtttt

SEQ ID NO: 87168 - DNA, 75 bp, Artificial Sequence
  Synthetic
tagagaagctaacccagtagacgcccctactgaacctgatgcatccgcaaacagattttatactcttgatagtgt

SEQ ID NO: 87169 - DNA, 75 bp, Artificial Sequence
  Synthetic
cctactgaacctgatgcatccgcaaacagattttatactcttgatagtgtcgattggggtaaatcatcacgtggg

SEQ ID NO: 87170 - DNA, 75 bp, Artificial Sequence
  Synthetic
ggcacactagctgttagagtcgtgaatgagtttaatccaacacgagttacagccaaagtgagagtgtacatgaag

SEQ ID NO: 87171 - DNA, 75 bp, Artificial Sequence
  Synthetic
atgagtttaatccaacacgagttacagccaaagtgagagtgtacatgaagccaaaacacatccgttgttggtgtc

SEQ ID NO: 87172 - DNA, 75 bp, Artificial Sequence
  Synthetic
agagctggttacactgtgcacgtgcagtgcaatgcttcaaaattccaccagggtgcacttatggttgcagcaatc

SEQ ID NO: 87173 - DNA, 75 bp, Artificial Sequence
  Synthetic
agtgcaatgcttcaaaattccaccagggtgcacttatggttgcagcaatcccagaatttatgatggcgagtaatt

SEQ ID NO: 87174 - DNA, 75 bp, Artificial Sequence
  Synthetic
cagtcagcaaaatcacaacgtacggattcggacatcagaacaaaggcatattcgtagctgggtacaaaatcatca

SEQ ID NO: 87175 - DNA, 75 bp, Artificial Sequence
  Synthetic
attcggacatcagaacaaaggcatattcgtagctgggtacaaaatcatcaattaccaccttgctactgcagagga

SEQ ID NO: 87176 - DNA, 75 bp, Artificial Sequence
  Synthetic
ttattccagatgcaactgcaccaggtaaaaacaagtttgccccgctggattggcttctgggttgtggggttatgg

SEQ ID NO: 87177 - DNA, 75 bp, Artificial Sequence
  Synthetic
taaaaacaagtttgccccgctggattggcttctgggttgtggggttatggctggcaacatcacagtgttccctca

SEQ ID NO: 87178 - DNA, 75 bp, Artificial Sequence
  Synthetic
aattgccagatgctcatgtaagactggagtatacttttgcgcatctcgccaaaagcattatccagttacgataac

SEQ ID NO: 87179 - DNA, 75 bp, Artificial Sequence
  Synthetic
ggagtatacttttgcgcatctcgccaaaagcattatccagttacgataactagtccaacattccaatggatggag

SEQ ID NO: 87180 - DNA, 75 bp, Artificial Sequence
  Synthetic
tatggccaaacacaacaattggggcctggtggtgatgccatttgttccacttgactatgttaacggagccactac

SEQ ID NO: 87181 - DNA, 75 bp, Artificial Sequence
  Synthetic
ctggtggtgatgccatttgttccacttgactatgttaacggagccactactaaggtgcctattacaatcaccata

SEQ ID NO: 87182 - DNA, 75 bp, Artificial Sequence
  Synthetic
ggaggcatcctcagatgtcagcatggagtcatgggtcttatcactgcaggtggaaatggaattgtcgcgttcgcc

SEQ ID NO: 87183 - DNA, 75 bp, Artificial Sequence
  Synthetic
gagtcatgggtcttatcactgcaggtggaaatggaattgtcgcgttcgccgacgtacgcgatttgtatgtcgagg

SEQ ID NO: 87184 - DNA, 75 bp, Artificial Sequence
  Synthetic
acaccaggatctaatcagtttttgacatccgacaatttccagtcgccatgtgcactcccagattttgatgtcact

SEQ ID NO: 87185 - DNA, 75 bp, Artificial Sequence
  Synthetic
catccgacaatttccagtcgccatgtgcactcccagattttgatgtcactcccgagatacacataccaggggaag

SEQ ID NO: 87186 - DNA, 75 bp, Artificial Sequence
  Synthetic
aaatcggtgacaaaattagtgaaatcacatcgatggtgacatccactttcacagaaaagctactgaagaacctta

SEQ ID NO: 87187 - DNA, 75 bp, Artificial Sequence
  Synthetic
cacatcgatggtgacatccactttcacagaaaagctactgaagaaccttataaaactcattagcagcttggtgat

SEQ ID NO: 87188 - DNA, 75 bp, Artificial Sequence
  Synthetic
tggaagcatacccaatacctctggcagcaggggtacaggataacaacaaatctatattctcaattagtttaagtc

SEQ ID NO: 87189 - DNA, 75 bp, Artificial Sequence
  Synthetic
agcaggggtacaggataacaacaaatctatattctcaattagtttaagtcctgctgctgatcagagattgtccag

SEQ ID NO: 87190 - DNA, 75 bp, Artificial Sequence
  Synthetic
ggtgtggttaaaaaagaaaacctgcgatctactagaaattccatacacttttaaacaaggcgactcatggttgaa

SEQ ID NO: 87191 - DNA, 75 bp, Artificial Sequence
  Synthetic
gatctactagaaattccatacacttttaaacaaggcgactcatggttgaagaaattcacagaagcctgtaatgca

SEQ ID NO: 87192 - DNA, 75 bp, Artificial Sequence
  Synthetic
tagcatgatggcaacaggaaagctgctgttaagttacagccccccaggagccaaacccccaacgaccagaaaaga

SEQ ID NO: 87193 - DNA, 75 bp, Artificial Sequence
  Synthetic
ctgttaagttacagccccccaggagccaaacccccaacgaccagaaaagaggccatgttaggcacacatattgtg

SEQ ID NO: 87194 - DNA, 75 bp, Artificial Sequence
  Synthetic
gccaaagacaagttagactatgtaacaaaattgaagcagttagatctcttggaaaaccagattagtgcaatacac

SEQ ID NO: 87195 - DNA, 75 bp, Artificial Sequence
  Synthetic
caaaattgaagcagttagatctcttggaaaaccagattagtgcaatacaccagtcgtgtcccagccaagaacaac

SEQ ID NO: 87196 - DNA, 75 bp, Artificial Sequence
  Synthetic
aaagatgattttacagaaggtggttacatatgctgcttctatcagactgcaattgtagtgcctccaaacactcca

SEQ ID NO: 87197 - DNA, 75 bp, Artificial Sequence
  Synthetic
acatatgctgcttctatcagactgcaattgtagtgcctccaaacactccaacagacatgtatatgcttgcatttg

SEQ ID NO: 87198 - DNA, 75 bp, Artificial Sequence
  Synthetic
ctaaaagaatatttaaattggaaagtacaataaataattacatacaattcaagagcaaacaccgtattgaaccag

SEQ ID NO: 87199 - DNA, 75 bp, Artificial Sequence
  Synthetic
tacaataaataattacatacaattcaagagcaaacaccgtattgaaccagtatgtttattagtacatggagaacc

SEQ ID NO: 87200 - DNA, 75 bp, Artificial Sequence
  Synthetic
gcactcagggaattgatgatgtcattgacacagtcgtagccaatgcacttaaagtatccatgccacaagtgcaag

SEQ ID NO: 87201 - DNA, 75 bp, Artificial Sequence
  Synthetic
tgacacagtcgtagccaatgcacttaaagtatccatgccacaagtgcaagacacacaatcaagtggaccagtcaa

SEQ ID NO: 87202 - DNA, 75 bp, Artificial Sequence
  Synthetic
acttcccccagacccagcgcattttgatggatacaagcaacaagaagttgtaatcatggatgatttgaatcagaa

SEQ ID NO: 87203 - DNA, 75 bp, Artificial Sequence
  Synthetic
gatggatacaagcaacaagaagttgtaatcatggatgatttgaatcagaacccggatggtgcagacatgaaattg

SEQ ID NO: 87204 - DNA, 75 bp, Artificial Sequence
  Synthetic
gacgcgccatgtcataaaccaaaggttaagatcagaatgcaccgtagaatccttctttgggagatctgcttgtgt

SEQ ID NO: 87205 - DNA, 75 bp, Artificial Sequence
  Synthetic
ttaagatcagaatgcaccgtagaatccttctttgggagatctgcttgtgtggctataataggtttgagcaacaag

SEQ ID NO: 87206 - DNA, 75 bp, Artificial Sequence
  Synthetic
tccaattatgtgttggcgtccactaattcgaacaccattacgcccccaacggtagcacatgcagatgctctatcc

SEQ ID NO: 87207 - DNA, 75 bp, Artificial Sequence
  Synthetic
attcgaacaccattacgcccccaacggtagcacatgcagatgctctatccagaagatttgcatttgacatggatg

SEQ ID NO: 87208 - DNA, 75 bp, Artificial Sequence
  Synthetic
agaaagttggagatgtttacttactctagatttgatattgagatgacttttgtcataacagagagattcttcacc

SEQ ID NO: 87209 - DNA, 75 bp, Artificial Sequence
  Synthetic
ctagatttgatattgagatgacttttgtcataacagagagattcttcacctcaacatctgcagctgctagggact

SEQ ID NO: 87210 - DNA, 75 bp, Artificial Sequence
  Synthetic
ctcagcccgctaacttcaaaaagtgttgccccctagtgtgtggaagagcaatacaactaatggacaaacacacta

SEQ ID NO: 87211 - DNA, 75 bp, Artificial Sequence
  Synthetic
ttgccccctagtgtgtggaagagcaatacaactaatggacaaacacactagacagaggtttaccctggatgagat

SEQ ID NO: 87212 - DNA, 75 bp, Artificial Sequence
  Synthetic
ccactaacccctcaatattctatacaactggaaatgccaacccaaggatttcgatcccattcgtgggcattgcag

SEQ ID NO: 87213 - DNA, 75 bp, Artificial Sequence
  Synthetic
aactggaaatgccaacccaaggatttcgatcccattcgtgggcattgcagcagcctactcacacttttatgatgg

SEQ ID NO: 87214 - DNA, 75 bp, Artificial Sequence
  Synthetic
tctccattacaaggatctaaaaattgacattaaaaattctccagcaccagagtgtatcaatgatttgctgcagtc

SEQ ID NO: 87215 - DNA, 75 bp, Artificial Sequence
  Synthetic
gacattaaaaattctccagcaccagagtgtatcaatgatttgctgcagtctgttgatagccaggaagttagggat

SEQ ID NO: 87216 - DNA, 75 bp, Artificial Sequence
  Synthetic
tggtacactagcagtcaggattgtcaacgaatatgacccggtaactatagatgcaaaagtcagggtgtacctcaa

SEQ ID NO: 87217 - DNA, 75 bp, Artificial Sequence
  Synthetic
aacgaatatgacccggtaactatagatgcaaaagtcagggtgtacctcaaacccaaacatgtaaaagtgtggtgc

SEQ ID NO: 87218 - DNA, 75 bp, Artificial Sequence
  Synthetic
accatattacaagcaataaccacttttgctgccgtggcaggtgtagtttttgtaatgtataagttgtttgcagga

SEQ ID NO: 87219 - DNA, 75 bp, Artificial Sequence
  Synthetic
ttgctgccgtggcaggtgtagtttttgtaatgtataagttgtttgcaggacagcaaggaccatatactggacttc

SEQ ID NO: 87220 - DNA, 75 bp, Artificial Sequence
  Synthetic
gtcgctgatattagaacttatggatttggacaccaaaacaaagcagtctacactgctggatacaaaatttgcaat

SEQ ID NO: 87221 - DNA, 75 bp, Artificial Sequence
  Synthetic
ttggacaccaaaacaaagcagtctacactgctggatacaaaatttgcaattatcacttagctacacctgaagaca

SEQ ID NO: 87222 - DNA, 75 bp, Artificial Sequence
  Synthetic
tggcaaaacgcaacgtagttacagcaaccaccaccaagggggagtttactatgctaggaatccacgataacgtgg

SEQ ID NO: 87223 - DNA, 75 bp, Artificial Sequence
  Synthetic
aaccaccaccaagggggagtttactatgctaggaatccacgataacgtggcagtcctaccaactcacgctacacc

SEQ ID NO: 87224 - DNA, 75 bp, Artificial Sequence
  Synthetic
ttgcaaggtgttcatgtaaagcaggagtctactattgtgaatccaagagaaagtactacccagttacagtatgtg

SEQ ID NO: 87225 - DNA, 75 bp, Artificial Sequence
  Synthetic
agtctactattgtgaatccaagagaaagtactacccagttacagtatgtgggccaacatttcagtacatggaggc

SEQ ID NO: 87226 - DNA, 75 bp, Artificial Sequence
  Synthetic
taacttggagatcactgtaattaagctgcaaagaaatgagaagtttagggacatcagaccacatatacccactca

SEQ ID NO: 87227 - DNA, 75 bp, Artificial Sequence
  Synthetic
tggtatcctcagatgtcaacatggagtaatgggcatcattactgctggtggtgaaggagttgtagcgtttgcaga

SEQ ID NO: 87228 - DNA, 75 bp, Artificial Sequence
  Synthetic
gtaatgggcatcattactgctggtggtgaaggagttgtagcgtttgcagacatcagagatttatacatgtatgag

SEQ ID NO: 87229 - DNA, 75 bp, Artificial Sequence
  Synthetic
tgtaactgaacaggggtacttgaatctcggtggccgtcaaacagctcgaactttaatgtataacttcccaacaag

SEQ ID NO: 87230 - DNA, 75 bp, Artificial Sequence
  Synthetic
gaagtggcaaacaaaatttcagagattcaaaccacagtccaaagtgttctcacagaaaagcttctgaaaaatctc

SEQ ID NO: 87231 - DNA, 75 bp, Artificial Sequence
  Synthetic
ttcaaaccacagtccaaagtgttctcacagaaaagcttctgaaaaatctcataaaaatcgtttcagctcttgtta

SEQ ID NO: 87232 - DNA, 75 bp, Artificial Sequence
  Synthetic
cgggtttgcagcggccctaaagcggtcatacttcactcagagtcaaggtgaaattcagtggatgaggccatcaaa

SEQ ID NO: 87233 - DNA, 75 bp, Artificial Sequence
  Synthetic
ggcaatggctcaaggaaaaactttgtaacatgattggcattccctacgttatgaggcaaggagattcttggttaa

SEQ ID NO: 87234 - DNA, 75 bp, Artificial Sequence
  Synthetic
aggagtcaaagaaccagctgtactcaccaaaaatgatcctagactaagaacagattttgaggaagccatcttctc

SEQ ID NO: 87235 - DNA, 75 bp, Artificial Sequence
  Synthetic
accaaaaatgatcctagactaagaacagattttgaggaagccatcttctctaaatatgtgggaaacaaaatcact

SEQ ID NO: 87236 - DNA, 75 bp, Artificial Sequence
  Synthetic
taacatgattggcattccctacgttatgaggcaaggagattcttggttaaagaagttcacggaagcttgtaatgc

SEQ ID NO: 87237 - DNA, 75 bp, Artificial Sequence
  Synthetic
ggcgaaagacaaattggaatatctctccaaattaaaacagcttgagatgatagagaatcagatggccactttaca

SEQ ID NO: 87238 - DNA, 75 bp, Artificial Sequence
  Synthetic
caaatgtgtctcgaagacgccatgtatggcactgatggtttagaggccttggacttgagtactagtgctgggtac

SEQ ID NO: 87239 - DNA, 75 bp, Artificial Sequence
  Synthetic
atggcactgatggtttagaggccttggacttgagtactagtgctgggtacccctatgtggctttagggaagaaga

SEQ ID NO: 87240 - DNA, 75 bp, Artificial Sequence
  Synthetic
tcaatcatgtcccagtcaagaagaacaggaagttctctttaataacatcagatggctggcaataaaagcaaggaa

SEQ ID NO: 87241 - DNA, 75 bp, Artificial Sequence
  Synthetic
ttcccttggtcacgtatgtgaaagatgagctcagatcaaaaacaaaggtggaacagggtaaatccaggttaattg

SEQ ID NO: 87242 - DNA, 75 bp, Artificial Sequence
  Synthetic
gtatgtttgttgattcatggaacacctggcactggcaaatcagttgccacaggcctcattggaagggcaattgcg

SEQ ID NO: 87243 - DNA, 75 bp, Artificial Sequence
  Synthetic
caggagtggtgacgggatcagccgttgggtgtgacccggacttattttggagcaaaataccagttttaatggaag

SEQ ID NO: 87244 - DNA, 75 bp, Artificial Sequence
  Synthetic
gtgattatggatgacttaaatcagaatccagatggggaggatatgaaattgttctgtcaaatggtttccacggtg

SEQ ID NO: 87245 - DNA, 75 bp, Artificial Sequence
  Synthetic
atccagatggggaggatatgaaattgttctgtcaaatggtttccacggtggaatttataccaccaatggccagct

SEQ ID NO: 87246 - DNA, 75 bp, Artificial Sequence
  Synthetic
tagggtagattacattgactaccttaaccactcacaccatctttacaagaataagacttattgtgtcaagggcgg

SEQ ID NO: 87247 - DNA, 75 bp, Artificial Sequence
  Synthetic
ctgtatctgcatctgatgcattatccagaagatttgcttttgatatggatatatacccaatgtctgaatacacca

SEQ ID NO: 87248 - DNA, 75 bp, Artificial Sequence
  Synthetic
cagaagatttgcttttgatatggatatatacccaatgtctgaatacaccacaaaagggaagttgaacatggcttt

SEQ ID NO: 87249 - DNA, 75 bp, Artificial Sequence
  Synthetic
tattcagctaatggataaaaatactagaatgagatactcactggaccaaatcaccacaatgatgattaacgagag

SEQ ID NO: 87250 - DNA, 75 bp, Artificial Sequence
  Synthetic
agaatgagatactcactggaccaaatcaccacaatgatgattaacgagaggaacaggaggtacaatattgggggt

SEQ ID NO: 87251 - DNA, 75 bp, Artificial Sequence
  Synthetic
tcagcaatctcagatttacttaaatctgtggacaaccaggaagttagagattattgcaaacaacaaggatgggtg

SEQ ID NO: 87252 - DNA, 75 bp, Artificial Sequence
  Synthetic
ctgtggacaaccaggaagttagagattattgcaaacaacaaggatgggtggttgagattccctcaaactctatta

SEQ ID NO: 87253 - DNA, 75 bp, Artificial Sequence
  Synthetic
atgaaagaaattcatgaatcaatcagatggaccaaagatcctagaaacacacaggatcatgtccgctcactgtgc

SEQ ID NO: 87254 - DNA, 75 bp, Artificial Sequence
  Synthetic
gctttactgctccccgagtactctactctgtaccgccgttggctcgactctttctagtgaccttacctcagtcgg

SEQ ID NO: 87255 - DNA, 75 bp, Artificial Sequence
  Synthetic
tttatgtggtgtacaaactctttgcagggtttcaaggtgcatacacagggcttcccaacgcaaaaccaaaagtcc

SEQ ID NO: 87256 - DNA, 75 bp, Artificial Sequence
  Synthetic
agggtttcaaggtgcatacacagggcttcccaacgcaaaaccaaaagtccccacaatcagagcagcaaaggttca

SEQ ID NO: 87257 - DNA, 75 bp, Artificial Sequence
  Synthetic
ctctgtaccgccgttggctcgactctttctagtgaccttacctcagtcggattggattgggttatactgttgtag

SEQ ID NO: 87258 - DNA, 75 bp, Artificial Sequence
  Synthetic
taccatgcttggtgtgtatgacagagttgctgtacttcccactcattcaaatccaggagaaactatagttatatc

SEQ ID NO: 87259 - DNA, 75 bp, Artificial Sequence
  Synthetic
gttgctgtacttcccactcattcaaatccaggagaaactatagttatatcaggaaaggaagtaaaaattttagat

SEQ ID NO: 87260 - DNA, 75 bp, Artificial Sequence
  Synthetic
agagatattagaactcacttaccaacacaaattcatgaaactaatgatgctgttcttgccgtgaatacgtctaaa

SEQ ID NO: 87261 - DNA, 75 bp, Artificial Sequence
  Synthetic
cacaaattcatgaaactaatgatgctgttcttgccgtgaatacgtctaaatttccaaatatgtacattccagttg

SEQ ID NO: 87262 - DNA, 75 bp, Artificial Sequence
  Synthetic
ccaaagcaggacagtgcggtggcgtcttaatggccactggcaaggtgattggcatacacgtcggtggtaatggat

SEQ ID NO: 87263 - DNA, 75 bp, Artificial Sequence
  Synthetic
cttaatggccactggcaaggtgattggcatacacgtcggtggtaatggatcccatggctttgccgctgcacttaa

SEQ ID NO: 87264 - DNA, 75 bp, Artificial Sequence
  Synthetic
caatgcaccttcaaaaacaaaattagaacccagtgtcttctatgatgtctttccaggggagaaggaaccagctgc

SEQ ID NO: 87265 - DNA, 75 bp, Artificial Sequence
  Synthetic
gaacccagtgtcttctatgatgtctttccaggggagaaggaaccagctgccttaaccaaaaatgatcccagatta

SEQ ID NO: 87266 - DNA, 75 bp, Artificial Sequence
  Synthetic
attgattgccatcataaagcgagttggattggccatccggtgaaagttaagtatctcgtccacttatctgttgga

SEQ ID NO: 87267 - DNA, 75 bp, Artificial Sequence
  Synthetic
gaagctgtcgaccactatgctggtcagttaatgtctcttgacatacccacagaacaaatgtgcttagaagacgcc

SEQ ID NO: 87268 - DNA, 75 bp, Artificial Sequence
  Synthetic
agttaatgtctcttgacatacccacagaacaaatgtgcttagaagacgccatgtatggcacagatggtcttgaag

SEQ ID NO: 87269 - DNA, 75 bp, Artificial Sequence
  Synthetic
gtgctcaggtctcatctcagaaagttggagctcacgaaaattcgaacagagcgtatggtggttccactatcaact

SEQ ID NO: 87270 - DNA, 75 bp, Artificial Sequence
  Synthetic
tggagctcacgaaaattcgaacagagcgtatggtggttccactatcaactacaccaccattaattattatagaga

SEQ ID NO: 87271 - DNA, 75 bp, Artificial Sequence
  Synthetic
aaacaagggataccaaagaaatgcagaaaatgctggacaagtacggaataaatctaccattggtgacctacgtta

SEQ ID NO: 87272 - DNA, 75 bp, Artificial Sequence
  Synthetic
gaaaatgctggacaagtacggaataaatctaccattggtgacctacgttaaggatgaactcagatccaagtcaaa

SEQ ID NO: 87273 - DNA, 75 bp, Artificial Sequence
  Synthetic
aattctccaaacattgaagcctgcgggtacagtgacagagtcttgcaattaactctgggaaattccaccattacc

SEQ ID NO: 87274 - DNA, 75 bp, Artificial Sequence
  Synthetic
ccatttgtacgctaaattccatcaaaatccaggagtgataacaggctcagcagttggatgtgacccagatgtctt

SEQ ID NO: 87275 - DNA, 75 bp, Artificial Sequence
  Synthetic
gatggagaactttttgcctttgattatacaggttatgatgcttcactctcaccagcttggtttgaagccttgaaa

SEQ ID NO: 87276 - DNA, 75 bp, Artificial Sequence
  Synthetic
aggaacaaattatattgtgtcaaaggtggaatgccctcagggtgctccggcacctcaatcttcaattccatgatc

SEQ ID NO: 87277 - DNA, 75 bp, Artificial Sequence
  Synthetic
tacggggatgacgtcattgcatcttacccacacaagattgatgctggtctcctagcccaagcaggaaaagactac

SEQ ID NO: 87278 - DNA, 75 bp, Artificial Sequence
  Synthetic
tggtgctcccatacgtaaactctctctctattgacagtatggtgaagcacaacaactgggggatcgcaatactgc

SEQ ID NO: 87279 - DNA, 75 bp, Artificial Sequence
  Synthetic
cgttagcccctctaaactttgctagtgaatcatccccagagatccctatcacgctaaccatagcaccgatgtgtt

SEQ ID NO: 87280 - DNA, 75 bp, Artificial Sequence
  Synthetic
tcaatcaccgtgcgcattgcctgaatttgacgtcaccccacccattgacatacccggggaggttaaaaacatgat

SEQ ID NO: 87281 - DNA, 75 bp, Artificial Sequence
  Synthetic
tacccggggaggttaaaaacatgatggaattggccgaaatcgacaccatgattcccttcgatttgagtgccacaa

SEQ ID NO: 87282 - DNA, 75 bp, Artificial Sequence
  Synthetic
attctgtggttccatgatggcaacaggaaaattgctggtgtcctatgctcctcctggagccgacccaccaaagaa

SEQ ID NO: 87283 - DNA, 75 bp, Artificial Sequence
  Synthetic
ccagaccagaatagtggtgcccctttccacacccagagagatggatatcctcgggtttgtgtcagcatgtaacga

SEQ ID NO: 87284 - DNA, 75 bp, Artificial Sequence
  Synthetic
ccacatctaaagataagctgttttcagtgtggaaaattacatacaaggacactgtgcagctgagaagaaagctgg

SEQ ID NO: 87285 - DNA, 75 bp, Artificial Sequence
  Synthetic
ccggtgccggaaaaatgggacgattacacgtggcaaacttcatcaaatccttcaatattttacacatatggcaca

SEQ ID NO: 87286 - DNA, 75 bp, Artificial Sequence
  Synthetic
agcatccctaaatgactttggtatcttggctgtcagagtggttaatgatcacaacccaaccacggttacttctaa

SEQ ID NO: 87287 - DNA, 75 bp, Artificial Sequence
  Synthetic
tgcccgagccaggaacaccaggaaattctttttaacaacgtgagatggctgtccattcagtcaaaaagatttgcc

SEQ ID NO: 87288 - DNA, 75 bp, Artificial Sequence
  Synthetic
agaacacatccacatactctctaccgccagatcctagtcactttgatgggtacaaacaacaaggagtggtgatca

SEQ ID NO: 87289 - DNA, 75 bp, Artificial Sequence
  Synthetic
tgatgggtgagtattcaagagatggcaagcttaatatggcgatggctacagaaatgtgcaaaaattgtcaccaac

SEQ ID NO: 87290 - DNA, 75 bp, Artificial Sequence
  Synthetic
caagcttaatatggcgatggctacagaaatgtgcaaaaattgtcaccaaccagcaaacttcaaacggtgctgccc

SEQ ID NO: 87291 - DNA, 75 bp, Artificial Sequence
  Synthetic
tatgatcattaatgagagaaacaggagatctaatattggtaattgcatggaagcattgtttcagggaccactgca

SEQ ID NO: 87292 - DNA, 75 bp, Artificial Sequence
  Synthetic
atataaagacttgaaaatagacattaaaacaacaccacctccagaatgcatcaatgatctacttcaagctgtgga

SEQ ID NO: 87293 - DNA, 75 bp, Artificial Sequence
  Synthetic
ctcacaagaggttagggactattgtgagaagaaaggatggatcgttgacatcaccagccaagtccagactgagag

SEQ ID NO: 87294 - DNA, 75 bp, Artificial Sequence
  Synthetic
gtacaagctctttgctggtcatcaaggtgcatacacaggattaccaaacaagaaacccaacattcctaccatcag

SEQ ID NO: 87295 - DNA, 75 bp, Artificial Sequence
  Synthetic
ggtgcatacacaggattaccaaacaagaaacccaacattcctaccatcagaacagctaaagtgcaagggccagga

SEQ ID NO: 87296 - DNA, 75 bp, Artificial Sequence
  Synthetic
ggggtgcacgataacgtggccgtgttaccgacgcacgcgtcgcctggcgacaccatagtgattgatggcaaggaa

SEQ ID NO: 87297 - DNA, 75 bp, Artificial Sequence
  Synthetic
gtggaagtgctagacgccaaagcactcgaagaccaagccggcaccaacctggaaatcaccatcgtcactcttaag

SEQ ID NO: 87298 - DNA, 75 bp, Artificial Sequence
  Synthetic
gggcgccagacagcccgcactctaatgtacaacttcccaacccgagctggtcaatgtggtggtattatcacatgt

SEQ ID NO: 87299 - DNA, 75 bp, Artificial Sequence
  Synthetic
ttggagggaacggttcacatgggtttgctgcagccctaaaacggtcatacttcacccagagtcaaggtgaaatac

SEQ ID NO: 87300 - DNA, 75 bp, Artificial Sequence
  Synthetic
tgctgcagccctaaaacggtcatacttcacccagagtcaaggtgaaatacagtggatgagaccatcaaaagaaat

SEQ ID NO: 87301 - DNA, 75 bp, Artificial Sequence
  Synthetic
gaaagaaccagctgtgttaaccaaaagtgatccaaggttgaaaactgactttgaagaagccatcttttccaagta

SEQ ID NO: 87302 - DNA, 75 bp, Artificial Sequence
  Synthetic
agtgatccaaggttgaaaactgactttgaagaagccatcttttccaagtacgtgggaaacaaaatcacagaagtt

SEQ ID NO: 87303 - DNA, 75 bp, Artificial Sequence
  Synthetic
tgcttggaagatgccatgtatggaacagatgggctggaggcacttgatttgacaactagtgctggatacccctac

SEQ ID NO: 87304 - DNA, 75 bp, Artificial Sequence
  Synthetic
cagatgggctggaggcacttgatttgacaactagtgctggatacccctacgtggctcttgggaaaaagaagaggg

SEQ ID NO: 87305 - DNA, 75 bp, Artificial Sequence
  Synthetic
tagtcacttatgtgaaggatgagcttagaagcaaaagcaaagtggagcaagggaagtctagattaatagaagctt

SEQ ID NO: 87306 - DNA, 75 bp, Artificial Sequence
  Synthetic
tagaagcaaaagcaaagtggagcaagggaagtctagattaatagaagcttccagcttgaatgattcggttgccat

SEQ ID NO: 87307 - DNA, 75 bp, Artificial Sequence
  Synthetic
tgatccagatttgttttggagcaaaataccagtattaatggaagaaaagctcttcgcatttgactacacagggta

SEQ ID NO: 87308 - DNA, 75 bp, Artificial Sequence
  Synthetic
ggactacattgactatctgaaccactcacaccatctctacaaaaacaaaacatactgtgtcaagggcggcatgcc

SEQ ID NO: 87309 - DNA, 75 bp, Artificial Sequence
  Synthetic
ggttgacgctagtctcctagcccaatcaggaaaagactatggactaactatgacaccggctgacaagtcagccac

SEQ ID NO: 87310 - DNA, 75 bp, Artificial Sequence
  Synthetic
ctgtttccccggtgatgttgtatagactgtttccacggttgaaaacgactgatccgttatccgctcttgtacttc

SEQ ID NO: 87311 - DNA, 75 bp, Artificial Sequence
  Synthetic
ggtacacccggtaatgccaatgaaagaaattcatgaatcgatcagatggactaaagatcctagaaacactcagga

SEQ ID NO: 87312 - DNA, 75 bp, Artificial Sequence
  Synthetic
gaaattcatgaatcgatcagatggactaaagatcctagaaacactcaggatcacgttcgctctctgtgcctattg

SEQ ID NO: 87313 - DNA, 75 bp, Artificial Sequence
  Synthetic
ggatttacacctttaacattacacactttgaaactcattgaaattgtactgttgatacggtattactatcacaat

SEQ ID NO: 87314 - DNA, 75 bp, Artificial Sequence
  Synthetic
ctttgaaactcattgaaattgtactgttgatacggtattactatcacaatgggagctcaggtttcatcacagaag

SEQ ID NO: 87315 - DNA, 75 bp, Artificial Sequence
  Synthetic
gattcagctagtaatgcggcctctaaacaggatttctctcaagacccgtccaaattcacagaaccagtcaaagat

SEQ ID NO: 87316 - DNA, 75 bp, Artificial Sequence
  Synthetic
tcacgcggttgaaagcgactgatccgttatccgcttgtgtacttcgagaagcctagtatcaccttggaatcttcg

SEQ ID NO: 87317 - DNA, 75 bp, Artificial Sequence
  Synthetic
aacaggatttctctcaagacccgtccaaattcacagaaccagtcaaagatgtgctgataaagtcggcaccagccc

SEQ ID NO: 87318 - DNA, 75 bp, Artificial Sequence
  Synthetic
caacgcaagaggctgccaattcagtagttggatacggtgtttggccctcttacttgagtgataaagatgcgaacc

SEQ ID NO: 87319 - DNA, 75 bp, Artificial Sequence
  Synthetic
agttggatacggtgtttggccctcttacttgagtgataaagatgcgaaccctgtagaccaacctaccgaaccgga

SEQ ID NO: 87320 - DNA, 75 bp, Artificial Sequence
  Synthetic
acctgatgccctcaaggatatgggcttattcggccagaacatgtattatcactacttggggagatcaggttatac

SEQ ID NO: 87321 - DNA, 75 bp, Artificial Sequence
  Synthetic
ttattcggccagaacatgtattatcactacttggggagatcaggttatacggtacatgttcagtgtaatgcctca

SEQ ID NO: 87322 - DNA, 75 bp, Artificial Sequence
  Synthetic
tagccaactcttccagaataatacgagggtaaaataacaatactataatgggtgctcaagtctcatcacagaaag

SEQ ID NO: 87323 - DNA, 75 bp, Artificial Sequence
  Synthetic
aattacaccagttatgtgaatgccaacccaggtgagtcaggtggaagatttgtttcaacgttcacgccagacacc

SEQ ID NO: 87324 - DNA, 75 bp, Artificial Sequence
  Synthetic
agggtaaaataacaatactataatgggtgctcaagtctcatcacagaaagttggagctcatgagaactcaaacag

SEQ ID NO: 87325 - DNA, 75 bp, Artificial Sequence
  Synthetic
acccaggtgagtcaggtggaagatttgtttcaacgttcacgccagacaccagtaccgcaccaaagagggaatttc

SEQ ID NO: 87326 - DNA, 75 bp, Artificial Sequence
  Synthetic
gcaagatttcgcacaagacccgtccaagttcactgagcccataaaggatgtcctcattaagactgcccccatgtt

SEQ ID NO: 87327 - DNA, 75 bp, Artificial Sequence
  Synthetic
tgcgcacaaacaactgcgcaacactagtgcttccatatgtaaattcattggcaattgactgcatggccaaacata

SEQ ID NO: 87328 - DNA, 75 bp, Artificial Sequence
  Synthetic
aagttcactgagcccataaaggatgtcctcattaagactgcccccatgttgaactccccaaatattgaggcgtgt

SEQ ID NO: 87329 - DNA, 75 bp, Artificial Sequence
  Synthetic
agtgcttccatatgtaaattcattggcaattgactgcatggccaaacataacaactggggaatcgtgatcctgcc

SEQ ID NO: 87330 - DNA, 75 bp, Artificial Sequence
  Synthetic
gttgcctacggtaggtggcctgagtacatcagagatgccgaggcaaacccagtagatcaaccaactgagcccgat

SEQ ID NO: 87331 - DNA, 75 bp, Artificial Sequence
  Synthetic
tgaattcaatggtcttagaaacctaaccattcctgccactcagggactaccagtaatgaatactccaggtagtaa

SEQ ID NO: 87332 - DNA, 75 bp, Artificial Sequence
  Synthetic
acatcagagatgccgaggcaaacccagtagatcaaccaactgagcccgatgtagctgcatgcaggttctacacac

SEQ ID NO: 87333 - DNA, 75 bp, Artificial Sequence
  Synthetic
accattcctgccactcagggactaccagtaatgaatactccaggtagtaaccagtacttgacatcagataacttc

SEQ ID NO: 87334 - DNA, 75 bp, Artificial Sequence
  Synthetic
tattcggtcaaaatatgttctatcactacctagggagggctggctacacggtgcacgtgcagtgcaacgcttcaa

SEQ ID NO: 87335 - DNA, 75 bp, Artificial Sequence
  Synthetic
gaattagctgagatagacacaatgatccccatggacctaggtgaagggaagaaaaactcaatggaaatgtacaga

SEQ ID NO: 87336 - DNA, 75 bp, Artificial Sequence
  Synthetic
ctacctagggagggctggctacacggtgcacgtgcagtgcaacgcttcaaagtttcatcagggtgctctaggggt

SEQ ID NO: 87337 - DNA, 75 bp, Artificial Sequence
  Synthetic
tccccatggacctaggtgaagggaagaaaaactcaatggaaatgtacagagtgaagttaactgacgccagtgacc

SEQ ID NO: 87338 - DNA, 75 bp, Artificial Sequence
  Synthetic
aggtgagaaagggggtgtgtttgaaaggagtttcacccttgataccaatgccaccaaccccgctcgggagttttg

SEQ ID NO: 87339 - DNA, 75 bp, Artificial Sequence
  Synthetic
tcctaaattactacacccactgggcgggttcattgaaattttcattcctattctgcggatccatgatggctactg

SEQ ID NO: 87340 - DNA, 75 bp, Artificial Sequence
  Synthetic
aggagtttcacccttgataccaatgccaccaaccccgctcgggagttttgtccagttgattacctttttggaagt

SEQ ID NO: 87341 - DNA, 75 bp, Artificial Sequence
  Synthetic
gggttcattgaaattttcattcctattctgcggatccatgatggctactggtaaattgttagtggcttactcacc

SEQ ID NO: 87342 - DNA, 75 bp, Artificial Sequence
  Synthetic
gtgttgccatatgtaaactcactctcaatagatagcatgacaaagcacaacaactggggaattgccatcctcccc

SEQ ID NO: 87343 - DNA, 75 bp, Artificial Sequence
  Synthetic
atcatcctgcacaatggtagttccatggattagcaacaccagctaccgccgtaccattaaggatgattttaccga

SEQ ID NO: 87344 - DNA, 75 bp, Artificial Sequence
  Synthetic
caatagatagcatgacaaagcacaacaactggggaattgccatcctccccctagcgccactagatttcgccactg

SEQ ID NO: 87345 - DNA, 75 bp, Artificial Sequence
  Synthetic
tggattagcaacaccagctaccgccgtaccattaaggatgattttaccgaagggggatacatcagcatgttctac

SEQ ID NO: 87346 - DNA, 75 bp, Artificial Sequence
  Synthetic
ctgtaccaagaacccaaggattaccagttttgaacactcctgggagcaaccagtatctaactgctgacaatcacc

SEQ ID NO: 87347 - DNA, 75 bp, Artificial Sequence
  Synthetic
ttcacagtacgattacttagggatactacgcacataaaacaagatgccatgccccagggaattgaggaaatcatt

SEQ ID NO: 87348 - DNA, 75 bp, Artificial Sequence
  Synthetic
agttttgaacactcctgggagcaaccagtatctaactgctgacaatcaccagtccccatgtgcaatacctgagtt

SEQ ID NO: 87349 - DNA, 75 bp, Artificial Sequence
  Synthetic
ctacgcacataaaacaagatgccatgccccagggaattgaggaaatcattcaacaggtcgccagcaatgcactgc

SEQ ID NO: 87350 - DNA, 75 bp, Artificial Sequence
  Synthetic
acccttcaacctgacaagccaacataggaacacaatggacatgtatagggtcgagctgaccgatgcggctcatac

SEQ ID NO: 87351 - DNA, 75 bp, Artificial Sequence
  Synthetic
agcactccaaggaggttccagctcttacagcagtcgaaacaggcgcaacaaatcctttggagcctagtgacaccg

SEQ ID NO: 87352 - DNA, 75 bp, Artificial Sequence
  Synthetic
aggaacacaatggacatgtatagggtcgagctgaccgatgcggctcataccgacgaaccgatcttgtgtttctcg

SEQ ID NO: 87353 - DNA, 75 bp, Artificial Sequence
  Synthetic
tacagcagtcgaaacaggcgcaacaaatcctttggagcctagtgacaccgttcaaactagacatgtcattcaaac

SEQ ID NO: 87354 - DNA, 75 bp, Artificial Sequence
  Synthetic
gggtccttgaaattcactttcctcttttgcggttcaatgatggccaccggaaagttgttggtctcttatgcaccg

SEQ ID NO: 87355 - DNA, 75 bp, Artificial Sequence
  Synthetic
ctacaatgagactttagctggcaaccagaaatccagcttgtttgccacatggaatattacttacacagacaccgt

SEQ ID NO: 87356 - DNA, 75 bp, Artificial Sequence
  Synthetic
tttgcggttcaatgatggccaccggaaagttgttggtctcttatgcaccgcctggagcagaggcccccaagagta

SEQ ID NO: 87357 - DNA, 75 bp, Artificial Sequence
  Synthetic
cagaaatccagcttgtttgccacatggaatattacttacacagacaccgtccaacttagaagaaagttggagatg

SEQ ID NO: 87358 - DNA, 75 bp, Artificial Sequence
  Synthetic
ggattagtaacactacatacagacaaaccatcaatgacagtttcacagagggtggctacattagcatgttctatc

SEQ ID NO: 87359 - DNA, 75 bp, Artificial Sequence
  Synthetic
tctttaaatcaagtctaccaaataatgtatgtgccacctggtgctccagttcctaaaaagtgggatgattacaca

SEQ ID NO: 87360 - DNA, 75 bp, Artificial Sequence
  Synthetic
aaccatcaatgacagtttcacagagggtggctacattagcatgttctatcagaccagggttgttgtcccgttgtc

SEQ ID NO: 87361 - DNA, 75 bp, Artificial Sequence
  Synthetic
tgtatgtgccacctggtgctccagttcctaaaaagtgggatgattacacatggcaaacatcttcaaatccatcca

SEQ ID NO: 87362 - DNA, 75 bp, Artificial Sequence
  Synthetic
aacacacattagccaaaaagctataccacaaggaattgaggacataattgaaggggtcgttgaagggattactaa

SEQ ID NO: 87363 - DNA, 75 bp, Artificial Sequence
  Synthetic
tctatgatgggtatgcaactgtaccgttgaaagataccgaggcagatgcaggagctgcgtactatggtgcagtat

SEQ ID NO: 87364 - DNA, 75 bp, Artificial Sequence
  Synthetic
ccacaaggaattgaggacataattgaaggggtcgttgaagggattactaaaaacgcattgaccccccccacctcc

SEQ ID NO: 87365 - DNA, 75 bp, Artificial Sequence
  Synthetic
gttgaaagataccgaggcagatgcaggagctgcgtactatggtgcagtatccatcaatgattttggtcttcttgc

SEQ ID NO: 87366 - DNA, 75 bp, Artificial Sequence
  Synthetic
acgggagccacaaacccgttggtgccgtcggacaccgtgcaaacgcgccatgtcatccagaggcgaacacggtca

SEQ ID NO: 87367 - DNA, 75 bp, Artificial Sequence
  Synthetic
cagagtgtggtgtccacgcccaccacgtgcagtagagtactatggacctggggtggattacaaggcaaacacatt

SEQ ID NO: 87368 - DNA, 75 bp, Artificial Sequence
  Synthetic
cgtcggacaccgtgcaaacgcgccatgtcatccagaggcgaacacggtcagagaccacaattgagtcattctttg

SEQ ID NO: 87369 - DNA, 75 bp, Artificial Sequence
  Synthetic
cgtgcagtagagtactatggacctggggtggattacaaggcaaacacattagcaccactaccaactaagagatta

SEQ ID NO: 87370 - DNA, 75 bp, Artificial Sequence
  Synthetic
tttggaaaataacttacaaagatactgtccagctgaggtgcaaattggaattcttcacatattcgagatttgaca

SEQ ID NO: 87371 - DNA, 75 bp, Artificial Sequence
  Synthetic
acggcagaagactttaggcactgtgttagaagcatgtgggatcgtgacatcatggtagtggaatccagagcacag

SEQ ID NO: 87372 - DNA, 75 bp, Artificial Sequence
  Synthetic
tgtccagctgaggtgcaaattggaattcttcacatattcgagatttgacatggagttcacctttgtagttacctc

SEQ ID NO: 87373 - DNA, 75 bp, Artificial Sequence
  Synthetic
ttagaagcatgtgggatcgtgacatcatggtagtggaatccagagcacagggaactgaccaaattgcccgctgcg

SEQ ID NO: 87374 - DNA, 75 bp, Artificial Sequence
  Synthetic
tattcctggcaaatgggacgactatacgtggcagacatcctccaacccgtcggtattttacacctatggagcgcc

SEQ ID NO: 87375 - DNA, 75 bp, Artificial Sequence
  Synthetic
agtggatggagaaaaatgacttctatccagcacgctatcagtcacacatgaccattggccatggttacgcagccc

SEQ ID NO: 87376 - DNA, 75 bp, Artificial Sequence
  Synthetic
accattggccatggttacgcagcccctggggactgtggtggcatcttgcggtgtcaacacggtgtcatgggtata

SEQ ID NO: 87377 - DNA, 75 bp, Artificial Sequence
  Synthetic
accattggccatggttacgcagcccctggggactgtggtggcatcttgcggtgtcaacacggtgtcatgggttta

SEQ ID NO: 87378 - DNA, 75 bp, Artificial Sequence
  Synthetic
accattggccatggttacgcagcccctggggactgtggtggcatcttgcggtgtcaacacggtgtcatgggtcta

SEQ ID NO: 87379 - DNA, 75 bp, Artificial Sequence
  Synthetic
accattggccatggttacgcagcccctggggactgtggtggcatcttgcggtgtcaacacggtgtcatgggtgta

SEQ ID NO: 87380 - DNA, 75 bp, Artificial Sequence
  Synthetic
acgtggcagacatcctccaacccgtcggtattttacacctatggagcgcccccagcaagaatatcagtgccatac

SEQ ID NO: 87381 - DNA, 75 bp, Artificial Sequence
  Synthetic
caaggaatcacttcgtacattgagtcccttggtgctgccttcggtagtggtttcaccagccaaattggagagaaa

SEQ ID NO: 87382 - DNA, 75 bp, Artificial Sequence
  Synthetic
cccttggtgctgccttcggtagtggtttcaccagccaaattggagagaaaatcaatgagatcacttcaatggtta

SEQ ID NO: 87383 - DNA, 75 bp, Artificial Sequence
  Synthetic
gatggtgattcgctatacggcgctgcctcactggacgacttcggatcactggctgttcgcgtggtaaatgaccac

SEQ ID NO: 87384 - DNA, 75 bp, Artificial Sequence
  Synthetic
atgaagacactactactgtgatagccacattggctttactgggatgtgatgtatcaccatgggcatggttgaaga

SEQ ID NO: 87385 - DNA, 75 bp, Artificial Sequence
  Synthetic
atgaagacactactactgtgttagccacattggctttactgggatgtgatgtatcaccatgggcatggttgaaga

SEQ ID NO: 87386 - DNA, 75 bp, Artificial Sequence
  Synthetic
atgaagacactactactgtgctagccacattggctttactgggatgtgatgtatcaccatgggcatggttgaaga

SEQ ID NO: 87387 - DNA, 75 bp, Artificial Sequence
  Synthetic
atgaagacactactactgtggtagccacattggctttactgggatgtgatgtatcaccatgggcatggttgaaga

SEQ ID NO: 87388 - DNA, 75 bp, Artificial Sequence
  Synthetic
atgatgacactactactgtgatagccacattggctttactgggatgtgatgtatcaccatgggcatggttgaaga

SEQ ID NO: 87389 - DNA, 75 bp, Artificial Sequence
  Synthetic
atgatgacactactactgtgttagccacattggctttactgggatgtgatgtatcaccatgggcatggttgaaga

SEQ ID NO: 87390 - DNA, 75 bp, Artificial Sequence
  Synthetic
atgatgacactactactgtgctagccacattggctttactgggatgtgatgtatcaccatgggcatggttgaaga

SEQ ID NO: 87391 - DNA, 75 bp, Artificial Sequence
  Synthetic
atgatgacactactactgtggtagccacattggctttactgggatgtgatgtatcaccatgggcatggttgaaga

SEQ ID NO: 87392 - DNA, 75 bp, Artificial Sequence
  Synthetic
atgacgacactactactgtgatagccacattggctttactgggatgtgatgtatcaccatgggcatggttgaaga

SEQ ID NO: 87393 - DNA, 75 bp, Artificial Sequence
  Synthetic
atgacgacactactactgtgttagccacattggctttactgggatgtgatgtatcaccatgggcatggttgaaga

SEQ ID NO: 87394 - DNA, 75 bp, Artificial Sequence
  Synthetic
atgacgacactactactgtgctagccacattggctttactgggatgtgatgtatcaccatgggcatggttgaaga

SEQ ID NO: 87395 - DNA, 75 bp, Artificial Sequence
  Synthetic
atgacgacactactactgtggtagccacattggctttactgggatgtgatgtatcaccatgggcatggttgaaga

SEQ ID NO: 87396 - DNA, 75 bp, Artificial Sequence
  Synthetic
atgaggacactactactgtgatagccacattggctttactgggatgtgatgtatcaccatgggcatggttgaaga

SEQ ID NO: 87397 - DNA, 75 bp, Artificial Sequence
  Synthetic
atgaggacactactactgtgttagccacattggctttactgggatgtgatgtatcaccatgggcatggttgaaga

SEQ ID NO: 87398 - DNA, 75 bp, Artificial Sequence
  Synthetic
atgaggacactactactgtgctagccacattggctttactgggatgtgatgtatcaccatgggcatggttgaaga

SEQ ID NO: 87399 - DNA, 75 bp, Artificial Sequence
  Synthetic
atgaggacactactactgtggtagccacattggctttactgggatgtgatgtatcaccatgggcatggttgaaga

SEQ ID NO: 87400 - DNA, 75 bp, Artificial Sequence
  Synthetic
tgtcagagtctggtgtccgcgacccccgagagcagtcccatactacggacctggtgttgattacaaagatgaact

SEQ ID NO: 87401 - DNA, 75 bp, Artificial Sequence
  Synthetic
cacattggctttactgggatgtgatgtatcaccatgggcatggttgaagaagaaagtttgtgacattttagaaat

SEQ ID NO: 87402 - DNA, 75 bp, Artificial Sequence
  Synthetic
gtggattagcaacaaaatttccaaatttgtggaatggatcaagaacaaaatcattcctgaagcaagggataaggt

SEQ ID NO: 87403 - DNA, 75 bp, Artificial Sequence
  Synthetic
cttggtgactgaatcaagggctagtggcactgactcgatcgcaaggtgcagatgcaacacaggcgtctactactg

SEQ ID NO: 87404 - DNA, 75 bp, Artificial Sequence
  Synthetic
ctaggcatgttggaaaatcaaataaacaccatacatcaatcatgtcctagccaggaacagcaggaagtgctcttc

SEQ ID NO: 87405 - DNA, 75 bp, Artificial Sequence
  Synthetic
aagttagagaataccatcaacaactacatacagttcaagagcaaacaccgtattgaaccagtatgtgttttgata

SEQ ID NO: 87406 - DNA, 75 bp, Artificial Sequence
  Synthetic
tattgaaccagtatgtgttttgatacatggcagtccgggtaccgggaaatcagttgccaccagcttaatgggacg

SEQ ID NO: 87407 - DNA, 75 bp, Artificial Sequence
  Synthetic
gagcaaggcatttccaactacatagagtcacttggtgctgcatttggtagtgggttcactcaacaaatcagtgat

SEQ ID NO: 87408 - DNA, 75 bp, Artificial Sequence
  Synthetic
gcaaggtgtggtgatcatggatgacctgaaccaaaatccagatggtcttgacatgaagctattttgtcaaatggt

SEQ ID NO: 87409 - DNA, 75 bp, Artificial Sequence
  Synthetic
ctgaaccaaaatccagatggtcttgacatgaagctattttgtcaaatggtatccacagtggagttcataccaccc

SEQ ID NO: 87410 - DNA, 75 bp, Artificial Sequence
  Synthetic
tcgtcacttgtgatcattaccaggaactacgaggacaccaccacagtacttgccaccctcgctctccttggatgt

SEQ ID NO: 87411 - DNA, 75 bp, Artificial Sequence
  Synthetic
actacgaggacaccaccacagtacttgccaccctcgctctccttggatgtgacatctcaccatggcagtggctaa

SEQ ID NO: 87412 - DNA, 75 bp, Artificial Sequence
  Synthetic
acgccaccaactgtagctcatagtgatgccttaagtcggagatttgccttcgacatggagatatgcccgatgtca

SEQ ID NO: 87413 - DNA, 75 bp, Artificial Sequence
  Synthetic
atgccttaagtcggagatttgccttcgacatggagatatgcccgatgtcacaatacacaattaaaggcaagttga

SEQ ID NO: 87414 - DNA, 75 bp, Artificial Sequence
  Synthetic
aggcatgtaatgctgcaaagggactggagtgggtatccaataagatatccaagttcattagttggctgcaagata

SEQ ID NO: 87415 - DNA, 75 bp, Artificial Sequence
  Synthetic
gtggtaaagcaatccaactgatggacaagtatactagacaaagattcagtgtggatgaactgacaactttggtca

SEQ ID NO: 87416 - DNA, 75 bp, Artificial Sequence
  Synthetic
caagtatactagacaaagattcagtgtggatgaactgacaactttggtcatcaatgagaagatcaggagagccaa

SEQ ID NO: 87417 - DNA, 75 bp, Artificial Sequence
  Synthetic
tctccactatacatcaatcttgtccaagtcaagaacatcaggaaatcttattcaacaatgtacggtggttatcca

SEQ ID NO: 87418 - DNA, 75 bp, Artificial Sequence
  Synthetic
aagtcaagaacatcaggaaatcttattcaacaatgtacggtggttatccattcagtcaaagaggttcgcaccact

SEQ ID NO: 87419 - DNA, 75 bp, Artificial Sequence
  Synthetic
tccaccccctgagtgtattaatgacttgctccaagcagtggattcgcaagaagtcagagattactgtgagaagaa

SEQ ID NO: 87420 - DNA, 75 bp, Artificial Sequence
  Synthetic
ttgctccaagcagtggattcgcaagaagtcagagattactgtgagaagaaaggatggattgtcaacatctcaagt

SEQ ID NO: 87421 - DNA, 75 bp, Artificial Sequence
  Synthetic
ccgtattgagccagtatgtttattggtgcacggtagtccaggaacaggaaagtcggtagcaaccaacctgattgc

SEQ ID NO: 87422 - DNA, 75 bp, Artificial Sequence
  Synthetic
gtgcacggtagtccaggaacaggaaagtcggtagcaaccaacctgattgctagagcaatagctgagaaagagaac

SEQ ID NO: 87423 - DNA, 75 bp, Artificial Sequence
  Synthetic
ggtgtggtgtacgtcatgtacaggctgttcgccggccaccaaggagcatacactggtttacccaataagaaaccc

SEQ ID NO: 87424 - DNA, 75 bp, Artificial Sequence
  Synthetic
tgttcgccggccaccaaggagcatacactggtttacccaataagaaacccaacatccccactatcagaacggcta

SEQ ID NO: 87425 - DNA, 75 bp, Artificial Sequence
  Synthetic
gacttgaaccaaaatccagacggagcagatatgaaactcttttgtcaaatggtgtctactgtggaattaattcca

SEQ ID NO: 87426 - DNA, 75 bp, Artificial Sequence
  Synthetic
gacttgaaccaaaatccagacggagcagatatgaaactcttttgtcaaatggtgtctactgtggaatttattcca

SEQ ID NO: 87427 - DNA, 75 bp, Artificial Sequence
  Synthetic
gacttgaaccaaaatccagacggagcagatatgaaactcttttgtcaaatggtgtctactgtggaattcattcca

SEQ ID NO: 87428 - DNA, 75 bp, Artificial Sequence
  Synthetic
gacttgaaccaaaatccagacggagcagatatgaaactcttttgtcaaatggtgtctactgtggaattgattcca

SEQ ID NO: 87429 - DNA, 75 bp, Artificial Sequence
  Synthetic
gtattttgttcacatctaactatgtcttagcctcaactaactccagtcgaattacacaacccacagtggctcaca

SEQ ID NO: 87430 - DNA, 75 bp, Artificial Sequence
  Synthetic
gagaattcaccatgcttggagtccatgacaacgtggccatcttaccaacacactcacacccaggagacaccatag

SEQ ID NO: 87431 - DNA, 75 bp, Artificial Sequence
  Synthetic
catagatgccaaagctttagaagatcaagccggcactaacctggaaatcaccatcgtaactttgaaaagaaacga

SEQ ID NO: 87432 - DNA, 75 bp, Artificial Sequence
  Synthetic
gtgcaaaaactgtcatcaaccagcaaacttcaaaaggtgttgtcctttggtctgtggaaaggcaatgcagttaat

SEQ ID NO: 87433 - DNA, 75 bp, Artificial Sequence
  Synthetic
aaacattggtaattgtatggaagctctattccaaggaccattacaatacaaagatttgaaaatagatgtcaagac

SEQ ID NO: 87434 - DNA, 75 bp, Artificial Sequence
  Synthetic
ctattccaaggaccattacaatacaaagatttgaaaatagatgtcaagaccagcccccctccggagtgtatcaac

SEQ ID NO: 87435 - DNA, 75 bp, Artificial Sequence
  Synthetic
agtcatcgggatgcatgtcggtgggaacggttcacatgggtttgcagcagccctgaaacgatcatacttcactca

SEQ ID NO: 87436 - DNA, 75 bp, Artificial Sequence
  Synthetic
ccctgaaacgatcatacttcactcagagtcaaggtgagatccaatggatgagaccatcaaaggaggtgggttatc

SEQ ID NO: 87437 - DNA, 75 bp, Artificial Sequence
  Synthetic
agccaagttcaaacagagaggaacatcaaccgggcgatgactattctacaagcagtgactactttcgctgcggta

SEQ ID NO: 87438 - DNA, 75 bp, Artificial Sequence
  Synthetic
tcaaccgggcgatgactattctacaagcagtgactactttcgctgcggtagctggtgttgtgtatgttatgtaca

SEQ ID NO: 87439 - DNA, 75 bp, Artificial Sequence
  Synthetic
cagctgtgctcactaaaaatgaccccagattgaagacagatttcgaagaggccattttctccaagtatgtaggga

SEQ ID NO: 87440 - DNA, 75 bp, Artificial Sequence
  Synthetic
cagattgaagacagatttcgaagaggccattttctccaagtatgtagggaacaaaatcacagaagtggacgaata

SEQ ID NO: 87441 - DNA, 75 bp, Artificial Sequence
  Synthetic
ccaaagtacaaggccctgggtttgattacgcggtggccatggctaaaagaaatattgttacagcaaccaccagca

SEQ ID NO: 87442 - DNA, 75 bp, Artificial Sequence
  Synthetic
ttacgcggtggccatggctaaaagaaatattgttacagcaaccaccagcaagggggagttcacgatgctaggagt

SEQ ID NO: 87443 - DNA, 75 bp, Artificial Sequence
  Synthetic
agacgccatgtacggcacagatgaccttgaagccctggatctcagtaccagtgctggatacccctatgtggcaat

SEQ ID NO: 87444 - DNA, 75 bp, Artificial Sequence
  Synthetic
cttgaagccctggatctcagtaccagtgctggatacccctatgtggcaatgggaaagaagaaaagggacatcctg

SEQ ID NO: 87445 - DNA, 75 bp, Artificial Sequence
  Synthetic
aattcttgacgccaaatcccttgaagatcaggcaggaaccaaccttgagatcactataatcacactaaggaggaa

SEQ ID NO: 87446 - DNA, 75 bp, Artificial Sequence
  Synthetic
gatcaggcaggaaccaaccttgagatcactataatcacactaaggaggaatgagaaattcagagatatcaggcca

SEQ ID NO: 87447 - DNA, 75 bp, Artificial Sequence
  Synthetic
tatgtcaaagatgagctcagatccaagaccaaagtggaacagggtaagtctagattgattgaagcttcaagcctg

SEQ ID NO: 87448 - DNA, 75 bp, Artificial Sequence
  Synthetic
agaccaaagtggaacagggtaagtctagattgattgaagcttcaagcctgaatgactcggtggccatgagaatgg

SEQ ID NO: 87449 - DNA, 75 bp, Artificial Sequence
  Synthetic
gtacctgttggcgccgtgaccgaacagaggtatcttaatctcggtggacgacaaactgctcgtacgctaatgtac

SEQ ID NO: 87450 - DNA, 75 bp, Artificial Sequence
  Synthetic
agaggtatcttaatctcggtggacgacaaactgctcgtacgctaatgtacaactttccaactagagcgggccagt

SEQ ID NO: 87451 - DNA, 75 bp, Artificial Sequence
  Synthetic
atttgttttggagcaagataccagtgttaatggaggaaaagctctttgcatttgattacacaggctatgacgcat

SEQ ID NO: 87452 - DNA, 75 bp, Artificial Sequence
  Synthetic
gttaatggaggaaaagctctttgcatttgattacacaggctatgacgcatctctcagtccagcttggtttgaagc

SEQ ID NO: 87453 - DNA, 75 bp, Artificial Sequence
  Synthetic
cagccctaaagcggtcatacctcactcagattcaaggtgagatacaatggataaaaccgtcaaaagaggtggggt

SEQ ID NO: 87454 - DNA, 75 bp, Artificial Sequence
  Synthetic
tctctacaaaaacaaaacttactgtgtcaagggcggcatgccatctggctgttcaggcacttcaatctttaattc

SEQ ID NO: 87455 - DNA, 75 bp, Artificial Sequence
  Synthetic
agccagcagttcttactaaaaatgatcccagactcaagacagactttgaggaagcaatattctctaaatacgtgg

SEQ ID NO: 87456 - DNA, 75 bp, Artificial Sequence
  Synthetic
acatcaacacagaacaaatgtgcttggaggatgccatgtacggcaccgatggccttgaagcacttgatttgacta

SEQ ID NO: 87457 - DNA, 75 bp, Artificial Sequence
  Synthetic
cagtaatgccaatgaaagaaattcatgaatcaattagatggacaaaagatcctagaaacacacaagatcatgttc

SEQ ID NO: 87458 - DNA, 75 bp, Artificial Sequence
  Synthetic
aggagatgcagagactcttagacacttatggaatcaacttaccacttgtgacttatgtcaaagatgaattaagat

SEQ ID NO: 87459 - DNA, 75 bp, Artificial Sequence
  Synthetic
ttatggaatcaacttaccacttgtgacttatgtcaaagatgaattaagatcgaaaactaaagtggaacaagggaa

SEQ ID NO: 87460 - DNA, 75 bp, Artificial Sequence
  Synthetic
atttcacaaaaacccaggcgttgtcactggtagcgcagttggctgtgacccagatttattttggagcaagatccc

SEQ ID NO: 87461 - DNA, 75 bp, Artificial Sequence
  Synthetic
actggtagcgcagttggctgtgacccagatttattttggagcaagatcccagtactcatggaagagaagctgttt

SEQ ID NO: 87462 - DNA, 75 bp, Artificial Sequence
  Synthetic
accccagaggcccacgtggcggctagtacactggtattacggtacccttgtacgcctgttttacacccctttccc

SEQ ID NO: 87463 - DNA, 75 bp, Artificial Sequence
  Synthetic
ataggttttggggacagggtggattacattgattatctcaaccactcccatcacctgtacaagaacaaaacctat

SEQ ID NO: 87464 - DNA, 75 bp, Artificial Sequence
  Synthetic
acattgattatctcaaccactcccatcacctgtacaagaacaaaacctattgtgtaaaaggcggcatgccatctg

SEQ ID NO: 87465 - DNA, 75 bp, Artificial Sequence
  Synthetic
tcatgaatcaattagatggacaaaagatcccagaaatacacaggatcatgtacgctctttatgtctattggcctg

SEQ ID NO: 87466 - DNA, 75 bp, Artificial Sequence
  Synthetic
ttaaaacagctctggggttgttcccaccccagaggcccacgtggcggccagtactctggtattacggtacctttg

SEQ ID NO: 87467 - DNA, 75 bp, Artificial Sequence
  Synthetic
caagcaaccttagaagcaattcacaaagttcaatagagggggtacaaaccagtaccaccacgaacaagcacttct

SEQ ID NO: 87468 - DNA, 75 bp, Artificial Sequence
  Synthetic
cgttatccgctcttgtacttcgagaagcctagtatcatcttggaatcttcgatgcgttgcgctcagcactcaacc

SEQ ID NO: 87469 - DNA, 75 bp, Artificial Sequence
  Synthetic
agcctagtatcatcttggaatcttcgatgcgttgcgctcagcactcaaccccagagtgtagcttaggtcgatgag

SEQ ID NO: 87470 - DNA, 75 bp, Artificial Sequence
  Synthetic
atagattgttatcataaagcgacttggattggccatccggtgagagtgaaatacattgtttacttgttcattgga

SEQ ID NO: 87471 - DNA, 75 bp, Artificial Sequence
  Synthetic
tttgctgtgccagaaatgtgcttggccggggatagtaacaccactcccacacacaccagttaccagaatgcaaac

SEQ ID NO: 87472 - DNA, 75 bp, Artificial Sequence
  Synthetic
gtctccgtgtgcgatacctgagtttgatgtcactccacccatagacataccaggggaggtgcgcaacatgatgga

SEQ ID NO: 87473 - DNA, 75 bp, Artificial Sequence
  Synthetic
tccacacccagagagatggatatcctcggatttgtatcagcatgtaacgatttcagtgtgcgcctgttgcgtgat

SEQ ID NO: 87474 - DNA, 75 bp, Artificial Sequence
  Synthetic
gagacaaaatttcagaactaaccagcatggtcaccagtacaattacagagaagttgctaaaaaatttaataaaaa

SEQ ID NO: 87475 - DNA, 75 bp, Artificial Sequence
  Synthetic
caacaattacatacagttcaagagcaaacaccgtattgaaccagtatgtctgttagtgcatggcagcccaggaac

SEQ ID NO: 87476 - DNA, 75 bp, Artificial Sequence
  Synthetic
agaacacatccacgtactccctaccgccagatcctagtcacttcgatgggtacaaacaacaaggagtggtgatta

SEQ ID NO: 87477 - DNA, 75 bp, Artificial Sequence
  Synthetic
agttcatcgattggttaaaggaaaagattattccacaggccagggacaaactagagtttgttacaaaattaaaac

SEQ ID NO: 87478 - DNA, 75 bp, Artificial Sequence
  Synthetic
tgatgggtgagtattcaagagatggcaagcttaacatggcaatggctacggaagtgtgcaaaaattgtcaccaac

SEQ ID NO: 87479 - DNA, 75 bp, Artificial Sequence
  Synthetic
gattattccacaggccagggacaaactagagtttgttacaaaattaaaacaattagagatgttggagaaccaaat

SEQ ID NO: 87480 - DNA, 75 bp, Artificial Sequence
  Synthetic
caagcttaacatggcaatggctacggaagtgtgcaaaaattgtcaccaaccagcaaacttcaagcggtgctgccc

SEQ ID NO: 87481 - DNA, 75 bp, Artificial Sequence
  Synthetic
acagtcaaagagattcgcaccactttatgcagttgaggcaaggagaattcaaaagctggaacacacaatcaacaa

SEQ ID NO: 87482 - DNA, 75 bp, Artificial Sequence
  Synthetic
tatgcagttgaggcaaggagaattcaaaagctggaacacacaatcaacaactacatacagttcaagagcaaacac

SEQ ID NO: 87483 - DNA, 75 bp, Artificial Sequence
  Synthetic
ctcacaagaggttagggactactgcgagaggaagggatggatcgttgacattaccaaccaagtccagactgagag

SEQ ID NO: 87484 - DNA, 75 bp, Artificial Sequence
  Synthetic
agggcgatagctgagaaagaaaacacctccacttactcattgccaccagacccatctcactttgacgggtacaaa

SEQ ID NO: 87485 - DNA, 75 bp, Artificial Sequence
  Synthetic
cctccacttactcattgccaccagacccatctcactttgacgggtacaaacaacagggagtggtaatcatggatg

SEQ ID NO: 87486 - DNA, 75 bp, Artificial Sequence
  Synthetic
ggtgcatacacaggattgccgaacaagaaacccaacattcctaccatcaggacagctaaggtgcaagggccagga

SEQ ID NO: 87487 - DNA, 75 bp, Artificial Sequence
  Synthetic
caatggcttcgctggaggagaagggcatcttgttcacatccaactatgtgttagcttcaaccaactccagccgca

SEQ ID NO: 87488 - DNA, 75 bp, Artificial Sequence
  Synthetic
catcttgttcacatccaactatgtgttagcttcaaccaactccagccgcatcacaccacccacagttgcacacag

SEQ ID NO: 87489 - DNA, 75 bp, Artificial Sequence
  Synthetic
ggggtacacgacaacgtggccgtgttaccaacgcatgcgtcgcctggcgacaccatagtgatcgatggtaaggaa

SEQ ID NO: 87490 - DNA, 75 bp, Artificial Sequence
  Synthetic
gaacatggcaatggcaactgagatgtgtaaaaactgccaccaaccagcaaactttaaaaggtgctgtccactggt

SEQ ID NO: 87491 - DNA, 75 bp, Artificial Sequence
  Synthetic
gtggaagtgctagacgctaaagcactcgaagaccatgccggcaccaacctggaaatcaccatcgtcactctcaag

SEQ ID NO: 87492 - DNA, 75 bp, Artificial Sequence
  Synthetic
tgtaaaaactgccaccaaccagcaaactttaaaaggtgctgtccactggtgtgtggaaaggcgattcagctgatg

SEQ ID NO: 87493 - DNA, 75 bp, Artificial Sequence
  Synthetic
gtgaacactagcaagtaccccaacatgtacgtacctgtcggtgcagtgaccgaacaagggtatcttaatttgggt

SEQ ID NO: 87494 - DNA, 75 bp, Artificial Sequence
  Synthetic
aacattgggaattgcatggaggcacttttccaaggcccactccagtacaaggatttgaaaatagatatcaagacc

SEQ ID NO: 87495 - DNA, 75 bp, Artificial Sequence
  Synthetic
ttttccaaggcccactccagtacaaggatttgaaaatagatatcaagaccacccctcctcctgaatgtatcaatg

SEQ ID NO: 87496 - DNA, 75 bp, Artificial Sequence
  Synthetic
gcgcagtccaaactgagaggaacattagcagagcaatgaccattctgcaagcagtcacaacgtttgctgcagtcg

SEQ ID NO: 87497 - DNA, 75 bp, Artificial Sequence
  Synthetic
tagcagagcaatgaccattctgcaagcagtcacaacgtttgctgcagtcgccggagttgtgtatgtgatgtataa

SEQ ID NO: 87498 - DNA, 75 bp, Artificial Sequence
  Synthetic
caaagttcagggaccaggatttgattatgcagtggccatggccaaaagaaatatccttacagcgaccactagcaa

SEQ ID NO: 87499 - DNA, 75 bp, Artificial Sequence
  Synthetic
agtcatcgatggcagagaggttgaagtattggatgccaaagctctagaggatcaagctgggaccaatctggaaat

SEQ ID NO: 87500 - DNA, 75 bp, Artificial Sequence
  Synthetic
tagtcacttatgtgaaggatgagctcagaagtaaaagcaaagtggagcagggaaaatctagattgattgaagcat

SEQ ID NO: 87501 - DNA, 75 bp, Artificial Sequence
  Synthetic
cagaagtaaaagcaaagtggagcagggaaaatctagattgattgaagcatctagtttgaatgactctgtggcaat

SEQ ID NO: 87502 - DNA, 75 bp, Artificial Sequence
  Synthetic
actagtaagtaccctaacatgtatgttcctgttggtgctgtaacagagcagggatatctcaatctcggtggacga

SEQ ID NO: 87503 - DNA, 75 bp, Artificial Sequence
  Synthetic
tgacccagatctgttttggagcaagataccagtcttgatggaggaaaagctctttgcttttgattacacaggcta

SEQ ID NO: 87504 - DNA, 75 bp, Artificial Sequence
  Synthetic
aaagtcatcgggatgcatgttggtgggaacggttcacatgggtttgcagcggccctgaagcggtcatacttcact

SEQ ID NO: 87505 - DNA, 75 bp, Artificial Sequence
  Synthetic
ggaacggttcacatgggtttgcagcggccctgaagcggtcatacttcactcagaatcaaggtgaaatacagtgga

SEQ ID NO: 87506 - DNA, 75 bp, Artificial Sequence
  Synthetic
agattacatcgattatctgaatcactcacaccatttatacaaaaacaagacttattgtgtcaagggcggcatgcc

SEQ ID NO: 87507 - DNA, 75 bp, Artificial Sequence
  Synthetic
attacgtgttcgaaggtgtcaaggaaccagcagtgctcaccaagaatgaccctagattgaaggcagattttgaag

SEQ ID NO: 87508 - DNA, 75 bp, Artificial Sequence
  Synthetic
accagcagtgctcaccaagaatgaccctagattgaaggcagattttgaagaggccatcttctctaagtatgtagg

SEQ ID NO: 87509 - DNA, 75 bp, Artificial Sequence
  Synthetic
atgtaattgcttcctacccccatgaggttgatgctagtctcctagcccaatcaggaaaagaatatggattgacca

SEQ ID NO: 87510 - DNA, 75 bp, Artificial Sequence
  Synthetic
catcaatacagagcaaatgtgtttggaagatgcgatgtatggcacggatgggcttgaagccctggatctcagtac

SEQ ID NO: 87511 - DNA, 75 bp, Artificial Sequence
  Synthetic
gagcggatgagaagtacccatttctggtgcacccagtaatgccaatgaaggaaattcatgaatcaattagatgga

SEQ ID NO: 87512 - DNA, 75 bp, Artificial Sequence
  Synthetic
gaagatgcgatgtatggcacggatgggcttgaagccctggatctcagtaccagcgcagggtatccttatgttgcc

SEQ ID NO: 87513 - DNA, 75 bp, Artificial Sequence
  Synthetic
gaaattcatgaatcaattagatggaccaaggatcccagaaacacgcaggatcatgttcgctcactgtgcttattg

SEQ ID NO: 87514 - DNA, 75 bp, Artificial Sequence
  Synthetic
tatggtatcaacctacctttggttacatatgtcaaggatgagctcaggtcaaagaccaaggtggagcaaggtaaa

SEQ ID NO: 87515 - DNA, 75 bp, Artificial Sequence
  Synthetic
ctgctcccagagtactcaacattgtaccgccgttggctcgactctttttagtaaccctacctcagtcgaattgga

SEQ ID NO: 87516 - DNA, 75 bp, Artificial Sequence
  Synthetic
tccagactgattgaagcatcgagtttgaatgactccgtggcaatgaggatggcatttggaaatttgtatgcagct

SEQ ID NO: 87517 - DNA, 75 bp, Artificial Sequence
  Synthetic
gtgctaatggaggagaagctctttgcatttgattacacaggctatgatgcttcccttagccccgcctggtttgag

SEQ ID NO: 87518 - DNA, 75 bp, Artificial Sequence
  Synthetic
ttggctttggagacagagtagattacattgactatctaaaccactcacaccacctttacagaaacaaaacatact

SEQ ID NO: 87519 - DNA, 75 bp, Artificial Sequence
  Synthetic
ggacacttttactgaaaacctacaagggcatagatttagaccacctaaagatgattgcctatggtgatgatgtaa

SEQ ID NO: 87520 - DNA, 75 bp, Artificial Sequence
  Synthetic
cgctagtctcctagcccaatcaggaaaagactatggactaaccatgacaccagctgacaaatcagccacttttga

SEQ ID NO: 87521 - DNA, 75 bp, Artificial Sequence
  Synthetic
atgagaagtatccattcttaatacatccagtgatgccaatgaaagaaattcatgaatcaattagatggaccaaag

SEQ ID NO: 87522 - DNA, 75 bp, Artificial Sequence
  Synthetic
tccagtgatgccaatgaaagaaattcatgaatcaattagatggaccaaagatcccagaaacacacaggatcacgt

SEQ ID NO: 87523 - DNA, 75 bp, Artificial Sequence
  Synthetic
aagttcaatagagggggtacaaaccagtaccaccacgaacaagcacttctgtttccccggtgatcttgtataggc

SEQ ID NO: 87524 - DNA, 75 bp, Artificial Sequence
  Synthetic
gtacaagttattcgctggacaccagggagcatacactggtctaccaaacaaaagacccaatgtgcctaccattag

SEQ ID NO: 87525 - DNA, 75 bp, Artificial Sequence
  Synthetic
caagacttctctcaagatccatctaaattcactgaacccatcaaggatgtgttgatcaaaacagctccaatgcta

SEQ ID NO: 87526 - DNA, 75 bp, Artificial Sequence
  Synthetic
tccacacccagagagatggacatcctcgggtttgtgtcagcatgtaacgatttcagcgtgcgcctgttgcgtgat

SEQ ID NO: 87527 - DNA, 75 bp, Artificial Sequence
  Synthetic
aagttgctaaaaaatttgattaagattgtctcatccctagttattattaccaggaactacgaggacaccaccaca

SEQ ID NO: 87528 - DNA, 75 bp, Artificial Sequence
  Synthetic
ttgtctcatccctagttattattaccaggaactacgaggacaccaccacagtcttcgctaccctggcactccttg

SEQ ID NO: 87529 - DNA, 75 bp, Artificial Sequence
  Synthetic
aaggagacagttggcttaagaaattcacagaagcctgcaacgctgctaagggacttgagtgggtttcaaataaaa

SEQ ID NO: 87530 - DNA, 75 bp, Artificial Sequence
  Synthetic
cacagaagcctgcaacgctgctaagggacttgagtgggtttcaaataaaatttcaaaattcattgattggttgaa

SEQ ID NO: 87531 - DNA, 75 bp, Artificial Sequence
  Synthetic
ccagattgccacgatacaccagtcttgtccaagtcaggaacatcaggaaattctattcaacaatgtgaggtggtt

SEQ ID NO: 87532 - DNA, 75 bp, Artificial Sequence
  Synthetic
tgtccaagtcaggaacatcaggaaattctattcaacaatgtgaggtggttgtccattcaatcaaagaggttcgcc

SEQ ID NO: 87533 - DNA, 75 bp, Artificial Sequence
  Synthetic
aaacaccgtattgaaccagtatgtttattagtgcatggtagtccaggaacaggcaaatcagttgcaactaattta

SEQ ID NO: 87534 - DNA, 75 bp, Artificial Sequence
  Synthetic
tacaagcaacaaggagtggtgattatggatgacttgaaccagaatcctgatggtgctgatatgaagctattctgc

SEQ ID NO: 87535 - DNA, 75 bp, Artificial Sequence
  Synthetic
tggatgacttgaaccagaatcctgatggtgctgatatgaagctattctgccagatggtttccacagtagaattca

SEQ ID NO: 87536 - DNA, 75 bp, Artificial Sequence
  Synthetic
gtagaataaccccacccacggttgcgcatagtgatgccctagccagaagattcgcctttgacatggacatccagg

SEQ ID NO: 87537 - DNA, 75 bp, Artificial Sequence
  Synthetic
gcatagtgatgccctagccagaagattcgcctttgacatggacatccaggtgatgggtgagtattccagagacgg

SEQ ID NO: 87538 - DNA, 75 bp, Artificial Sequence
  Synthetic
ccttgtatgtggaaaggccatccaattaatggacaagtcatccagggttaggtatagtgtagatcagattacaac

SEQ ID NO: 87539 - DNA, 75 bp, Artificial Sequence
  Synthetic
ttaatggacaagtcatccagggttaggtatagtgtagatcagattacaacaatgattataaatgagagaaacaga

SEQ ID NO: 87540 - DNA, 75 bp, Artificial Sequence
  Synthetic
aagacaacaccacctccagagtgcatcaatgatttgctacaagcagttgactcacaagaagtcagggattattgt

SEQ ID NO: 87541 - DNA, 75 bp, Artificial Sequence
  Synthetic
tcaatgatttgctacaagcagttgactcacaagaagtcagggattattgtgaaaagaaagggtggttggtaaaca

SEQ ID NO: 87542 - DNA, 75 bp, Artificial Sequence
  Synthetic
cagtggcaggagtagtgtacgttatgtacaaactttttgctggacatcagggtgcgtacacaggcctaccaagca

SEQ ID NO: 87543 - DNA, 75 bp, Artificial Sequence
  Synthetic
gtacaaactttttgctggacatcagggtgcgtacacaggcctaccaagcaagaaacctaacatccccaccattag

SEQ ID NO: 87544 - DNA, 75 bp, Artificial Sequence
  Synthetic
tcaaaagggggaattcaccatgcttggagtacacgacaatgtggccgtgcttccaacacatgcatctcctggtga

SEQ ID NO: 87545 - DNA, 75 bp, Artificial Sequence
  Synthetic
ggagtacacgacaatgtggccgtgcttccaacacatgcatctcctggtgaaactatagtgattgatggcaaggaa

SEQ ID NO: 87546 - DNA, 75 bp, Artificial Sequence
  Synthetic
agaaatgagaaatttagagatatcagacctcacatccccacacagatcactgagacaaatgatggagtactgatc

SEQ ID NO: 87547 - DNA, 75 bp, Artificial Sequence
  Synthetic
gacctcacatccccacacagatcactgagacaaatgatggagtactgatcgtgaacactagcaagtaccccaaca

SEQ ID NO: 87548 - DNA, 75 bp, Artificial Sequence
  Synthetic
tgtacaaatttccaacccgcgctgggcaatgtggtggaataatcacatgcaccggtaaagtgattggaatgcatg

SEQ ID NO: 87549 - DNA, 75 bp, Artificial Sequence
  Synthetic
gcaatgtggtggaataatcacatgcaccggtaaagtgattggaatgcatgtcggagggaacggttcacacgggtt

SEQ ID NO: 87550 - DNA, 75 bp, Artificial Sequence
  Synthetic
tggatatcctatcatcaatgcacccagtaaaaccaagctagaaccgagtgctttccattacatctttgagggtgt

SEQ ID NO: 87551 - DNA, 75 bp, Artificial Sequence
  Synthetic
agtaaaaccaagctagaaccgagtgctttccattacatctttgagggtgtgaaagaaccagcagtgctaaccaag

SEQ ID NO: 87552 - DNA, 75 bp, Artificial Sequence
  Synthetic
gatgaatacatgaaagaggcagtggaccactatgcaggacagttgatatcacttgacatcaacactgaccagatg

SEQ ID NO: 87553 - DNA, 75 bp, Artificial Sequence
  Synthetic
accactatgcaggacagttgatatcacttgacatcaacactgaccagatgtgcttggaagacgccatgtatggaa

SEQ ID NO: 87554 - DNA, 75 bp, Artificial Sequence
  Synthetic
atatactcaataagcaaactagggacaccaaggagatgcagcgtcttcttgacacatatggtatcaatctaccac

SEQ ID NO: 87555 - DNA, 75 bp, Artificial Sequence
  Synthetic
caccaaggagatgcagcgtcttcttgacacatatggtatcaatctaccactagtcacttatgtcaaagatgagct

SEQ ID NO: 87556 - DNA, 75 bp, Artificial Sequence
  Synthetic
gcgaatggcgtttggtaacctgtatgctgctttccacaagaatccaggggtagtgacagggtcagcagtgggatg

SEQ ID NO: 87557 - DNA, 75 bp, Artificial Sequence
  Synthetic
gctgctttccacaagaatccaggggtagtgacagggtcagcagtgggatgtgacccagacttattttggagcaag

SEQ ID NO: 87558 - DNA, 75 bp, Artificial Sequence
  Synthetic
tttgaagctcttaaaatggtcttagagaaaattggctttggtgacagagtagattacattgattacctgaaccat

SEQ ID NO: 87559 - DNA, 75 bp, Artificial Sequence
  Synthetic
agattacattgattacctgaaccattcccaccatctctacaggaacaagacatattgtgtgaagggtggcatgcc

SEQ ID NO: 87560 - DNA, 75 bp, Artificial Sequence
  Synthetic
ttttgagaaagtcacgtgggagaatgtgacatttttaaagaggttctttagagcagatgagaaatacccatttct

SEQ ID NO: 87561 - DNA, 75 bp, Artificial Sequence
  Synthetic
tcatgttcgttcactgtgcttattggcttggcacaatggcgaagaagaatacaacaaattcctagctaaaatcag

SEQ ID NO: 87562 - DNA, 75 bp, Artificial Sequence
  Synthetic
ttacataatggctgcttatggtgacaatcacagattgttgtcataaagcgaattggattggccatccggtgagaa

SEQ ID NO: 87563 - DNA, 75 bp, Artificial Sequence
  Synthetic
cattgtgcaagctagattatgcaccaaactcatccacagagattcccataacagtgactattgcaccaatgttca

SEQ ID NO: 87564 - DNA, 75 bp, Artificial Sequence
  Synthetic
aggctaacacaatggagatgtacccgatcccactagatgacaaaggtggtgcaacacccatatttagtatttccc

SEQ ID NO: 87565 - DNA, 75 bp, Artificial Sequence
  Synthetic
gatcattaggacgcttttactgaaaacctacaagggcatagatttggaccatttaaaaatgattgcctatggtga

SEQ ID NO: 87566 - DNA, 75 bp, Artificial Sequence
  Synthetic
gttcgttgaggttcacgttcctgttttgtggtagtatgatggccacagggaaaattctacttagctactcaccac

SEQ ID NO: 87567 - DNA, 75 bp, Artificial Sequence
  Synthetic
tcattttagtaaccctacctcagtcgaattggattgggtcatactgttgtaggggtaaatttttctttaattcgg

SEQ ID NO: 87568 - DNA, 75 bp, Artificial Sequence
  Synthetic
acgccacgactgatgctgataggaaaaagcagtttactacatgggctatcacgtacacagacacagtccagctaa

SEQ ID NO: 87569 - DNA, 75 bp, Artificial Sequence
  Synthetic
tcaagtctaccagcttatgtacataccacctggtgctccgcgacccacggcctgggacgactatacctggcagag

SEQ ID NO: 87570 - DNA, 75 bp, Artificial Sequence
  Synthetic
tggccgttatgtggaacagagatttgttagtcacagaatcaaaagcccagggcactgatttaattgccaggtgca

SEQ ID NO: 87571 - DNA, 75 bp, Artificial Sequence
  Synthetic
gttagtcacagaatcaaaagcccagggcactgatttaattgccaggtgcaactgcaatacaggggtgtactattg

SEQ ID NO: 87572 - DNA, 75 bp, Artificial Sequence
  Synthetic
tccagctcgttatcaatctcacatgttaattggccacggttttgcatcaccaggagactgcggtggcatcctcag

SEQ ID NO: 87573 - DNA, 75 bp, Artificial Sequence
  Synthetic
ttaattggccacggttttgcatcaccaggagactgcggtggcatcctcagatgccagcacggagtcataggaatc

SEQ ID NO: 87574 - DNA, 75 bp, Artificial Sequence
  Synthetic
tcactgggtgccgcctttgggtccgggttcaccagtcagataggggaaaaggttacggagctaacaagtatggtc

SEQ ID NO: 87575 - DNA, 75 bp, Artificial Sequence
  Synthetic
gagcaaggcatctctaattacattgaatcccttggagctgcgtttgggagtggattcacccagcaaattggtgac

SEQ ID NO: 87576 - DNA, 75 bp, Artificial Sequence
  Synthetic
aatcccttggagctgcgtttgggagtggattcacccagcaaattggtgacaaaatctcggagctcaccagcatgg

SEQ ID NO: 87577 - DNA, 75 bp, Artificial Sequence
  Synthetic
actacgaggacaccaccacggtgttggccactctggcacttcttgggtgtgatgtatccccctggcaatggttaa

SEQ ID NO: 87578 - DNA, 75 bp, Artificial Sequence
  Synthetic
ggccactctggcacttcttgggtgtgatgtatccccctggcaatggttaaagaaaaaggcttgtgatatactgga

SEQ ID NO: 87579 - DNA, 75 bp, Artificial Sequence
  Synthetic
agaatgggtgtcaaacaaaatatctaaattcattgattggttgaaagagaaaatcattccacaaaccagagacaa

SEQ ID NO: 87580 - DNA, 75 bp, Artificial Sequence
  Synthetic
aaattcattgattggttgaaagagaaaatcattccacaaaccagagacaaactagaatttgtcacaaaattaaag

SEQ ID NO: 87581 - DNA, 75 bp, Artificial Sequence
  Synthetic
ttcaacaatgtgagatggctatccatacaatcaaagagatttgcaccactctacgcggtagaagcaaagaggatt

SEQ ID NO: 87582 - DNA, 75 bp, Artificial Sequence
  Synthetic
tacaatcaaagagatttgcaccactctacgcggtagaagcaaagaggattcagaaactagagcacactattaata

SEQ ID NO: 87583 - DNA, 75 bp, Artificial Sequence
  Synthetic
agtcagtggctaccaatctgattgctagagcaatagcagagaaagagaacacctctacttactcactaccaccag

SEQ ID NO: 87584 - DNA, 75 bp, Artificial Sequence
  Synthetic
tagagcaatagcagagaaagagaacacctctacttactcactaccaccagatccatcccatttcgatggttacaa

SEQ ID NO: 87585 - DNA, 75 bp, Artificial Sequence
  Synthetic
ggtctccacagtagagttcataccaccaatggcttcattagaagagaagggcattttgttcacgtcaaactatgt

SEQ ID NO: 87586 - DNA, 75 bp, Artificial Sequence
  Synthetic
ccaatggcttcattagaagagaagggcattttgttcacgtcaaactatgtcctggcctccaccaattccagccga

SEQ ID NO: 87587 - DNA, 75 bp, Artificial Sequence
  Synthetic
ggtgagtactctagagacggtaaactgaacatggcaatggcaacagaaatgtgtaaaaactgtcaccaaccagca

SEQ ID NO: 87588 - DNA, 75 bp, Artificial Sequence
  Synthetic
tgaacatggcaatggcaacagaaatgtgtaaaaactgtcaccaaccagcaaactttaagagatgttgtccgctag

SEQ ID NO: 87589 - DNA, 75 bp, Artificial Sequence
  Synthetic
ttattaatgagaggaacagaaggtcaaacataggaaattgtatggaagcattgtttcaaggcccattacaataca

SEQ ID NO: 87590 - DNA, 75 bp, Artificial Sequence
  Synthetic
aaacataggaaattgtatggaagcattgtttcaaggcccattacaatacaaagacctaaaaattgacatcaagac

SEQ ID NO: 87591 - DNA, 75 bp, Artificial Sequence
  Synthetic
gaaaggttggatagtgaacatcactagtcaagttcaaactgaaagaaacatcaacagagcaatgaccatcttgca

SEQ ID NO: 87592 - DNA, 75 bp, Artificial Sequence
  Synthetic
agtcaagttcaaactgaaagaaacatcaacagagcaatgaccatcttgcaggccgttactacatttgcagcggtt

SEQ ID NO: 87593 - DNA, 75 bp, Artificial Sequence
  Synthetic
cccaacgttcccacaattaggacagccaaagtacaaggcccgggctttgattacgctgtagccatggccaaaaga

SEQ ID NO: 87594 - DNA, 75 bp, Artificial Sequence
  Synthetic
ccaaagtacaaggcccgggctttgattacgctgtagccatggccaaaagaaacattctcacagccaccacctgca

SEQ ID NO: 87595 - DNA, 75 bp, Artificial Sequence
  Synthetic
tagtcattgatggtaaggaagtggaggtgttagacgctaaagcactagaagaccaggctggaactaatctagaaa

SEQ ID NO: 87596 - DNA, 75 bp, Artificial Sequence
  Synthetic
cgaatgatggagtgttgatcgtgaacactagtaagtaccccaatatgtatgtccctgtcggtgctgtgactgaac

SEQ ID NO: 87597 - DNA, 75 bp, Artificial Sequence
  Synthetic
cactagtaagtaccccaatatgtatgtccctgtcggtgctgtgactgaacagggatacctcaatctcggtggtcg

SEQ ID NO: 87598 - DNA, 75 bp, Artificial Sequence
  Synthetic
cttcccaacaagagcaggccagtgtggtggtgttgtcacgtgtactggcaaggtgattgggatacatgttggagg

SEQ ID NO: 87599 - DNA, 75 bp, Artificial Sequence
  Synthetic
cggccctgaagcgatcttacttcacccagactcaaggtgagattcagtggatgagaccatcaaaggaagtcggat

SEQ ID NO: 87600 - DNA, 75 bp, Artificial Sequence
  Synthetic
aaccagcagtcttaaccaaaaacgatcctaggctaaaggtagattttgaagaagcaattttctccaaatatgtgg

SEQ ID NO: 87601 - DNA, 75 bp, Artificial Sequence
  Synthetic
tcctaggctaaaggtagattttgaagaagcaattttctccaaatatgtgggtaacaagattactgaagtggatga

SEQ ID NO: 87602 - DNA, 75 bp, Artificial Sequence
  Synthetic
agaagatgcaatgtacggcactgatggtctagaagcactagacctcacaaccagcgcaggatacccatatgtagc

SEQ ID NO: 87603 - DNA, 75 bp, Artificial Sequence
  Synthetic
ggtctagaagcactagacctcacaaccagcgcaggatacccatatgtagccttagggaaaaagaagagagatgtt

SEQ ID NO: 87604 - DNA, 75 bp, Artificial Sequence
  Synthetic
acctatgtgaaagatgaactaagatctaaatctaaggttgaacaagggaaatcaagacttattgaagcatccagc

SEQ ID NO: 87605 - DNA, 75 bp, Artificial Sequence
  Synthetic
ctaaatctaaggttgaacaagggaaatcaagacttattgaagcatccagccttaatgactcagtggcaatgagaa

SEQ ID NO: 87606 - DNA, 75 bp, Artificial Sequence
  Synthetic
cagacctattttggagcaagattcccgttctaatggaggagaagttgtttgcctttgattatacaggctatgacg

SEQ ID NO: 87607 - DNA, 75 bp, Artificial Sequence
  Synthetic
attggttttggtgatagggtagattatatagattatcttaaccactcacatcacctatacaaaaacaagacatac

SEQ ID NO: 87608 - DNA, 75 bp, Artificial Sequence
  Synthetic
tcatgaatcaatcagatggactaaagatcccaggaacacccaggatcatgtccgctccttgtgcttattggcatg

SEQ ID NO: 87609 - DNA, 75 bp, Artificial Sequence
  Synthetic
tggaaccactgtgttagctttacttctcatttaaccaattaatcaaaaacaatacgaggataaaacaacaatact

SEQ ID NO: 87610 - DNA, 75 bp, Artificial Sequence
  Synthetic
aattactacacacactgggcagggtccttgaaatttacctttctcttttgtggctcaatgatggccaccggaaag

SEQ ID NO: 87611 - DNA, 75 bp, Artificial Sequence
  Synthetic
acaatgggcgcccaagtttcatcacagaaagttggagcccacgaaaattcaaacagagcctatggcgggtccacc

SEQ ID NO: 87612 - DNA, 75 bp, Artificial Sequence
  Synthetic
gtgctgcctcactgaatgactttggatcactggctgttcgcgtggtaaatgatcacaaccccacgcggctcacct

SEQ ID NO: 87613 - DNA, 75 bp, Artificial Sequence
  Synthetic
ctcacagtgatgcgctggccaggagattcgcatttgacatggacatacaagtcatgagcgagtactccagagacg

SEQ ID NO: 87614 - DNA, 75 bp, Artificial Sequence
  Synthetic
aggccacacattcctacgcaaatcactgagacaaatgatggagttctgatcgtgaacactagtaagtaccccaac

SEQ ID NO: 87615 - DNA, 75 bp, Artificial Sequence
  Synthetic
aggagtagtcacaggctcggcagttggttgtgacccagatttgttttggagcaagataccagtgttaatggagga

SEQ ID NO: 87616 - DNA, 75 bp, Artificial Sequence
  Synthetic
ctttttgcatttgattacacaggttatgatgcatctctcagcccagcctggtttgaagcactaaagatggtgttg

SEQ ID NO: 87617 - DNA, 75 bp, Artificial Sequence
  Synthetic
gggtgtccgtgtttccttttatttttatcatggctgcttatggtgacaatcttggattgttatcatatagcgatt

SEQ ID NO: 87618 - DNA, 75 bp, Artificial Sequence
  Synthetic
tttccttaattaaagtggtactattgatcagatcagcataccacaatgggtgcacaagtctcatctcagaaggta

SEQ ID NO: 87619 - DNA, 75 bp, Artificial Sequence
  Synthetic
gatcagatcagcataccacaatgggtgcacaagtctcatctcagaaggtaggggcacacgaaaacaccaacgtgg

SEQ ID NO: 87620 - DNA, 75 bp, Artificial Sequence
  Synthetic
aggatttttcccaggacccctccaagtttactgaacccgttaaagacataatgttaaagtcagccccagctctga

SEQ ID NO: 87621 - DNA, 75 bp, Artificial Sequence
  Synthetic
gtttactgaacccgttaaagacataatgttaaagtcagccccagctctgaattcacctaacgtcgaggcatgtgg

SEQ ID NO: 87622 - DNA, 75 bp, Artificial Sequence
  Synthetic
tgcatacgggaggtggccctcatacctcaaaccaacagaagccaacccagtggatgcacccaccgaaccagatgt

SEQ ID NO: 87623 - DNA, 75 bp, Artificial Sequence
  Synthetic
ctcaaaccaacagaagccaacccagtggatgcacccaccgaaccagatgttagttcaaataggttctacacatta

SEQ ID NO: 87624 - DNA, 75 bp, Artificial Sequence
  Synthetic
tttggacagaacatgttctaccactacctgggtaggagtggatatacaattcacgtgcaatgcaatgcatcgaag

SEQ ID NO: 87625 - DNA, 75 bp, Artificial Sequence
  Synthetic
acctgggtaggagtggatatacaattcacgtgcaatgcaatgcatcgaagtttcaccaaggagctcttggagttt

SEQ ID NO: 87626 - DNA, 75 bp, Artificial Sequence
  Synthetic
cgggagaggcaggcggcaggtttactgaccagtataatcccagcgcagaagccactgagggaagaaaatttgcag

SEQ ID NO: 87627 - DNA, 75 bp, Artificial Sequence
  Synthetic
tgaccagtataatcccagcgcagaagccactgagggaagaaaatttgcagctgttgattacctactaggttgtgg

SEQ ID NO: 87628 - DNA, 75 bp, Artificial Sequence
  Synthetic
tttaccatacgtcaattcactagctatcgactgtatggctaaacataacaattgggggttggtgatactaccact

SEQ ID NO: 87629 - DNA, 75 bp, Artificial Sequence
  Synthetic
atcgactgtatggctaaacataacaattgggggttggtgatactaccactcgaacccctagcatttgcaccagaa

SEQ ID NO: 87630 - DNA, 75 bp, Artificial Sequence
  Synthetic
gtgccagcgacacaaggattgccggtaatggtcacaccagggtctagtcaatatctaacatctgatgatttccag

SEQ ID NO: 87631 - DNA, 75 bp, Artificial Sequence
  Synthetic
taatggtcacaccagggtctagtcaatatctaacatctgatgatttccagtcgccatgtgccttaccaaattttg

SEQ ID NO: 87632 - DNA, 75 bp, Artificial Sequence
  Synthetic
caatgaatagtgtctcagggaaagcaaataccatggatatgtatagaatcccgctgaacaccactggtggaacag

SEQ ID NO: 87633 - DNA, 75 bp, Artificial Sequence
  Synthetic
aaataccatggatatgtatagaatcccgctgaacaccactggtggaacagatcccatcttttgtctgagtctctc

SEQ ID NO: 87634 - DNA, 75 bp, Artificial Sequence
  Synthetic
tattaggttcacattcctgttttgcggtagcatgatggcgactggtaagttgatcttaacatactcgccaccagg

SEQ ID NO: 87635 - DNA, 75 bp, Artificial Sequence
  Synthetic
ggtagcatgatggcgactggtaagttgatcttaacatactcgccaccaggagcttcacctccaaagaataggaaa

SEQ ID NO: 87636 - DNA, 75 bp, Artificial Sequence
  Synthetic
tctaacaccgtctacaggagatgtgttaaggatgactttactgaaggaggctacataacatgcttttaccaaaca

SEQ ID NO: 87637 - DNA, 75 bp, Artificial Sequence
  Synthetic
ttaaggatgactttactgaaggaggctacataacatgcttttaccaaacacgtatagttgttcctgctagtaccc

SEQ ID NO: 87638 - DNA, 75 bp, Artificial Sequence
  Synthetic
acattagccagagtgccataatagccactactcaagggatcgatgaagtcatcgacaaagtgatcaacaatgcac

SEQ ID NO: 87639 - DNA, 75 bp, Artificial Sequence
  Synthetic
cactactcaagggatcgatgaagtcatcgacaaagtgatcaacaatgcactacaactttcacaaccctcccgacc

SEQ ID NO: 87640 - DNA, 75 bp, Artificial Sequence
  Synthetic
cggagcctcgggacaggcagtgccatcggatgtcattgaaactagacatgtggttaattacaaaacaaggtctga

SEQ ID NO: 87641 - DNA, 75 bp, Artificial Sequence
  Synthetic
tcggatgtcattgaaactagacatgtggttaattacaaaacaaggtctgaaagcaccctggagtcgttctttggt

SEQ ID NO: 87642 - DNA, 75 bp, Artificial Sequence
  Synthetic
actgtgtggcctattacatacaccaacactgtccagctcaggagaaagttggagttcttcacatattctaggttt

SEQ ID NO: 87643 - DNA, 75 bp, Artificial Sequence
  Synthetic
acactgtccagctcaggagaaagttggagttcttcacatattctaggtttgatttggagatgacttttgttgtga

SEQ ID NO: 87644 - DNA, 75 bp, Artificial Sequence
  Synthetic
cacccagacccaatgcatgggatgactatacttggcaatcatcctctaacccttccattttctacacttatgggt

SEQ ID NO: 87645 - DNA, 75 bp, Artificial Sequence
  Synthetic
ctatacttggcaatcatcctctaacccttccattttctacacttatgggtgtgcaccggcacgcatttcaatccc

SEQ ID NO: 87646 - DNA, 75 bp, Artificial Sequence
  Synthetic
agattctggagatacatattacggtctggtttccatcaatgactttggatccttagctatcagagtagtgaatga

SEQ ID NO: 87647 - DNA, 75 bp, Artificial Sequence
  Synthetic
ctggtttccatcaatgactttggatccttagctatcagagtagtgaatgaattcaatcccgctcgcattacagca

SEQ ID NO: 87648 - DNA, 75 bp, Artificial Sequence
  Synthetic
ggagagggagtggacctgaggagtggagccattactccgctaactccagtacaaaatatcaccacatacggattt

SEQ ID NO: 87649 - DNA, 75 bp, Artificial Sequence
  Synthetic
gagccattactccgctaactccagtacaaaatatcaccacatacggatttggccatcagaaccaagcagtgtttg

SEQ ID NO: 87650 - DNA, 75 bp, Artificial Sequence
  Synthetic
aaagagacatcatggtagtggactccaaagcacaagggactgaccaaattgccaggtgctcatgcgtgaccggtg

SEQ ID NO: 87651 - DNA, 75 bp, Artificial Sequence
  Synthetic
caaagcacaagggactgaccaaattgccaggtgctcatgcgtgaccggtgtgtactactgtctgtcacgtaataa

SEQ ID NO: 87652 - DNA, 75 bp, Artificial Sequence
  Synthetic
atcacacatgacactaggacatggctttgctgaaccaggagattgtggaggcatccttagatgccagcacggggt

SEQ ID NO: 87653 - DNA, 75 bp, Artificial Sequence
  Synthetic
tttgctgaaccaggagattgtggaggcatccttagatgccagcacggggttatggggttgattaccgcgggtggt

SEQ ID NO: 87654 - DNA, 75 bp, Artificial Sequence
  Synthetic
tacatggagtcacttggagcagcatttgggtgcgggtttaccaatcagataagtgaaaaggttgcagagataaca

SEQ ID NO: 87655 - DNA, 75 bp, Artificial Sequence
  Synthetic
ttgggtgcgggtttaccaatcagataagtgaaaaggttgcagagataacatcaatggtgagtagtgttgtcacag

SEQ ID NO: 87656 - DNA, 75 bp, Artificial Sequence
  Synthetic
ctgtacttgcaacccttgctctgctgggttgtgacatttccccctggtcttggctcaggaaaaaagcatgtgata

SEQ ID NO: 87657 - DNA, 75 bp, Artificial Sequence
  Synthetic
gggttgtgacatttccccctggtcttggctcaggaaaaaagcatgtgatatactggagctaccatatgtgtgcaa

SEQ ID NO: 87658 - DNA, 75 bp, Artificial Sequence
  Synthetic
aatatcaaagttcattgattggctgaaaacaaaaattataccagaagcaagagataaagtggaatatgtaaccaa

SEQ ID NO: 87659 - DNA, 75 bp, Artificial Sequence
  Synthetic
aaaacaaaaattataccagaagcaagagataaagtggaatatgtaaccaagttaaagcaattgagcatgcttgag

SEQ ID NO: 87660 - DNA, 75 bp, Artificial Sequence
  Synthetic
ttggcaattcaatcgcgtcgcttcgcaccactgtatgcagtggaagcaaagcgcattcaaaaactggaaaataca

SEQ ID NO: 87661 - DNA, 75 bp, Artificial Sequence
  Synthetic
caccactgtatgcagtggaagcaaagcgcattcaaaaactggaaaatacaattaacaactacatacagttcaaga

SEQ ID NO: 87662 - DNA, 75 bp, Artificial Sequence
  Synthetic
tagtcggtagggccatagcagagagagaaaacacttctgtatattcccttccaccagatccagcacactttgatg

SEQ ID NO: 87663 - DNA, 75 bp, Artificial Sequence
  Synthetic
agaaaacacttctgtatattcccttccaccagatccagcacactttgatgggtacaagcaacagggagtagtcat

SEQ ID NO: 87664 - DNA, 75 bp, Artificial Sequence
  Synthetic
cattcctccgatggcatcattagaagaaaaaggaattctttttacttcagattatgtcctggcttcaaccaactc

SEQ ID NO: 87665 - DNA, 75 bp, Artificial Sequence
  Synthetic
gaaaaaggaattctttttacttcagattatgtcctggcttcaaccaactctggaagcatagtaccaccgacagta

SEQ ID NO: 87666 - DNA, 75 bp, Artificial Sequence
  Synthetic
ggcaagctgaatatggccactgccacagttttatgcaaagagtgtcccaaaccagctaacttcaaaaagtgttgc

SEQ ID NO: 87667 - DNA, 75 bp, Artificial Sequence
  Synthetic
cagttttatgcaaagagtgtcccaaaccagctaacttcaaaaagtgttgccccctaatttgtggcaaagccatac

SEQ ID NO: 87668 - DNA, 75 bp, Artificial Sequence
  Synthetic
gaagagcaaacattggaaactgtatggaggcgctcttccaaggacctatacagtataaagatttgaaaatagaca

SEQ ID NO: 87669 - DNA, 75 bp, Artificial Sequence
  Synthetic
ggaggcgctcttccaaggacctatacagtataaagatttgaaaatagacatcaagaccaccccaccaccagaatg

SEQ ID NO: 87670 - DNA, 75 bp, Artificial Sequence
  Synthetic
tgtgaacagtgaggttcagatggagcgtaacttgaacagggccatgacaattttgcaggctataaccacttttgc

SEQ ID NO: 87671 - DNA, 75 bp, Artificial Sequence
  Synthetic
cgtaacttgaacagggccatgacaattttgcaggctataaccacttttgctgcagttgcaggagttgtatatgtg

SEQ ID NO: 87672 - DNA, 75 bp, Artificial Sequence
  Synthetic
agaaccgctaaagtgcaaggcccaggttttgattacgcagttgctatggctaaaagaaacatactcactgcaacg

SEQ ID NO: 87673 - DNA, 75 bp, Artificial Sequence
  Synthetic
cttaccaacccatgctgcaccaggtgacactatagtcattgatggcaaagaagtgaaaatactggacgcccaggc

SEQ ID NO: 87674 - DNA, 75 bp, Artificial Sequence
  Synthetic
cagacctcatataccaacacaaatcactgagaccaatgatggagtgttgatcgtgaacactagtaagtaccccaa

SEQ ID NO: 87675 - DNA, 75 bp, Artificial Sequence
  Synthetic
actgagaccaatgatggagtgttgatcgtgaacactagtaagtaccccaacatgtacatccctgtcggggcggtg

SEQ ID NO: 87676 - DNA, 75 bp, Artificial Sequence
  Synthetic
tacgcctgttttatactccctacccctgcaacttagaagctagtaactcaagttcaatagtagggggtacaaacc

SEQ ID NO: 87677 - DNA, 75 bp, Artificial Sequence
  Synthetic
ggacaatgcggtggtgtggtgacctgcacaggaaaagttattggcatccatgttggagggaacggttcacacggg

SEQ ID NO: 87678 - DNA, 75 bp, Artificial Sequence
  Synthetic
gcacaggaaaagttattggcatccatgttggagggaacggttcacacgggtttgccgcagccctaaagcgatcat

SEQ ID NO: 87679 - DNA, 75 bp, Artificial Sequence
  Synthetic
caacaaaaacaaagctagagcctagtgctttccatcatgtgttcgaaggagtaaaggaaccagcagtgttgacca

SEQ ID NO: 87680 - DNA, 75 bp, Artificial Sequence
  Synthetic
tgctttccatcatgtgttcgaaggagtaaaggaaccagcagtgttgaccaaaaacgaccccagactcaaggtgga

SEQ ID NO: 87681 - DNA, 75 bp, Artificial Sequence
  Synthetic
ggatcattatgcaggccaactgatgtccttagatatcaagactgaccagatgtgccttgaggacgcaatgtacgg

SEQ ID NO: 87682 - DNA, 75 bp, Artificial Sequence
  Synthetic
tccttagatatcaagactgaccagatgtgccttgaggacgcaatgtacggcactgatggactggaagctctcgat

SEQ ID NO: 87683 - DNA, 75 bp, Artificial Sequence
  Synthetic
catatatggctgcttatggtgacaattatagattgtcatcatagagcgaattggattggccatccggtgaaagtt

SEQ ID NO: 87684 - DNA, 75 bp, Artificial Sequence
  Synthetic
ttatagattgtcatcatagagcgaattggattggccatccggtgaaagttagacatattgtttacctatttgttg

SEQ ID NO: 87685 - DNA, 75 bp, Artificial Sequence
  Synthetic
gataccaaggaaatgaagagactactggacacttatggaataaacctacctttagttacttatgtgaaagatgag

SEQ ID NO: 87686 - DNA, 75 bp, Artificial Sequence
  Synthetic
tggacacttatggaataaacctacctttagttacttatgtgaaagatgagctcagatcaaaatctaaggttgaac

SEQ ID NO: 87687 - DNA, 75 bp, Artificial Sequence
  Synthetic
ggagctcaagtgtcttcacagaaggtgggagctcatgagaacactaacgtagcaactggaggttctactgttaat

SEQ ID NO: 87688 - DNA, 75 bp, Artificial Sequence
  Synthetic
tgggagctcatgagaacactaacgtagcaactggaggttctactgttaattacaccaccattaactattacaaag

SEQ ID NO: 87689 - DNA, 75 bp, Artificial Sequence
  Synthetic
acgctgcatttcacaagaatccaggagttgttactggtagtgctgttggttgcgacccagatttgttttggagca

SEQ ID NO: 87690 - DNA, 75 bp, Artificial Sequence
  Synthetic
tcatgttaaaatctgcccctgcattgaattcccccaacgtcgaggcatgtggatacagcgacagagtcaggcaaa

SEQ ID NO: 87691 - DNA, 75 bp, Artificial Sequence
  Synthetic
agatcccagtgttgatggaagagaaactatttgcttttgattatacagggtatgatgcatcactcagtccagcct

SEQ ID NO: 87692 - DNA, 75 bp, Artificial Sequence
  Synthetic
gaattcccccaacgtcgaggcatgtggatacagcgacagagtcaggcaaatcacacttggtaactcaacaataac

SEQ ID NO: 87693 - DNA, 75 bp, Artificial Sequence
  Synthetic
actcacaccatctatacaaaaacaaaacatactgtgtcaagggtggcatgccatctggctgctcaggcacttcaa

SEQ ID NO: 87694 - DNA, 75 bp, Artificial Sequence
  Synthetic
agttgatgctccaacagaaccagacgtaagtagtaacaggttctatacactggaatcagtgcagtggagcaaggg

SEQ ID NO: 87695 - DNA, 75 bp, Artificial Sequence
  Synthetic
gtaagtagtaacaggttctatacactggaatcagtgcagtggagcaagggttccaaaggttggtggtggaaacta

SEQ ID NO: 87696 - DNA, 75 bp, Artificial Sequence
  Synthetic
gtgcacgtccagtgcaacgcgtccaagttccatcagggcgctttggctgtgtttgctgtccctgagtgtgtgttc

SEQ ID NO: 87697 - DNA, 75 bp, Artificial Sequence
  Synthetic
agttccatcagggcgctttggctgtgtttgctgtccctgagtgtgtgttctcgggcaatgcaaaagataagacca

SEQ ID NO: 87698 - DNA, 75 bp, Artificial Sequence
  Synthetic
atgcggaagatgccagacaattttgccccattgattatttgtttgggtcaggtgtgatgtttggaaacgcattca

SEQ ID NO: 87699 - DNA, 75 bp, Artificial Sequence
  Synthetic
gactaaagatcctagaaacacacaagatcatgttcgctcgttgtgtctattggcttggcacaatggtgaagaaga

SEQ ID NO: 87700 - DNA, 75 bp, Artificial Sequence
  Synthetic
ccccattgattatttgtttgggtcaggtgtgatgtttggaaacgcattcatttacccacaccaggtcattaattt

SEQ ID NO: 87701 - DNA, 75 bp, Artificial Sequence
  Synthetic
caattggggaattgtcattataccggtagtcccattagactttgctgaagctagtagcacccaaataccaattac

SEQ ID NO: 87702 - DNA, 75 bp, Artificial Sequence
  Synthetic
gtagtcccattagactttgctgaagctagtagcacccaaataccaattactgttacaattgcaccaatgtacacc

SEQ ID NO: 87703 - DNA, 75 bp, Artificial Sequence
  Synthetic
cagtttttgacatctgataactttcagtcgccatgtgcactgcctgagtttgatgtaacgccccctttacatata

SEQ ID NO: 87704 - DNA, 75 bp, Artificial Sequence
  Synthetic
agtcgccatgtgcactgcctgagtttgatgtaacgccccctttacatataccaggtgaagtaaagaacatgatgg

SEQ ID NO: 87705 - DNA, 75 bp, Artificial Sequence
  Synthetic
ttgaactagatagcacatcaaatttgagcagccctatattctgcctatcactctcccccgcaagtgatcagagac

SEQ ID NO: 87706 - DNA, 75 bp, Artificial Sequence
  Synthetic
gagcagccctatattctgcctatcactctcccccgcaagtgatcagagactgcaatacacactcttaggtgaggt

SEQ ID NO: 87707 - DNA, 75 bp, Artificial Sequence
  Synthetic
caagttactactcagttacagtcctcctggtgcggcacccccaacaacccgcaaagaagcaatgttaggcaccca

SEQ ID NO: 87708 - DNA, 75 bp, Artificial Sequence
  Synthetic
cctggtgcggcacccccaacaacccgcaaagaagcaatgttaggcacccacttaatttgggaccttggtttgcaa

SEQ ID NO: 87709 - DNA, 75 bp, Artificial Sequence
  Synthetic
agtaccactacgaacaagcacttctgttaccccggtgaagttgtatagactgtgcccacggtcgaaaatgactga

SEQ ID NO: 87710 - DNA, 75 bp, Artificial Sequence
  Synthetic
ggaggttacatcacttgtttttatcaaaccaaaattgttgtgcccatgaacacaccaataaaaatggatatgcta

SEQ ID NO: 87711 - DNA, 75 bp, Artificial Sequence
  Synthetic
aaaccaaaattgttgtgcccatgaacacaccaataaaaatggatatgctagcgtatgtgagtgcgtgtcctgact

SEQ ID NO: 87712 - DNA, 75 bp, Artificial Sequence
  Synthetic
ccccagagtgtagcttaggtcgatgagtctggacaatcctcactggcgacagtggtccaggctgcgttggcggcc

SEQ ID NO: 87713 - DNA, 75 bp, Artificial Sequence
  Synthetic
tcattgagtcagtggcccagaatgctctgcagatatcacaacctagaccaacccaaagaccagcaattaccaaca

SEQ ID NO: 87714 - DNA, 75 bp, Artificial Sequence
  Synthetic
tctgcagatatcacaacctagaccaacccaaagaccagcaattaccaacactgtcgcagacaccccagcaacatc

SEQ ID NO: 87715 - DNA, 75 bp, Artificial Sequence
  Synthetic
tgggtgtccgtgtttccttttatttttacactggctgcttatggtgacaatcatagattgttatcataaggcgaa

SEQ ID NO: 87716 - DNA, 75 bp, Artificial Sequence
  Synthetic
tgtcattgagaccagaaaggtgatcaactacaagaccaggagtgagtccaccatcgaaagcttctttgggcggtc

SEQ ID NO: 87717 - DNA, 75 bp, Artificial Sequence
  Synthetic
aactacaagaccaggagtgagtccaccatcgaaagcttctttgggcggtccgcttgtgttacaataatgtcagta

SEQ ID NO: 87718 - DNA, 75 bp, Artificial Sequence
  Synthetic
tcttgagcttaacagagttgttctgctggcgagaagttgctatcgcaatgggagcgcaggtttcatcacagaagg

SEQ ID NO: 87719 - DNA, 75 bp, Artificial Sequence
  Synthetic
ctggcgagaagttgctatcgcaatgggagcgcaggtttcatcacagaaggttggtgcacatgaaaactcgaatag

SEQ ID NO: 87720 - DNA, 75 bp, Artificial Sequence
  Synthetic
gttcagctcaggcgcaaaatggagatgttcacatactcacgttttgatacagaattcaccttcgtgttaactgag

SEQ ID NO: 87721 - DNA, 75 bp, Artificial Sequence
  Synthetic
tgttcacatactcacgttttgatacagaattcaccttcgtgttaactgagaggtattacacccagaactcaggac

SEQ ID NO: 87722 - DNA, 75 bp, Artificial Sequence
  Synthetic
acaagactattcccaagacccatctaaattcactgagccaattaaagatgtgttaataaagacggctccaatgtt

SEQ ID NO: 87723 - DNA, 75 bp, Artificial Sequence
  Synthetic
aaattcactgagccaattaaagatgtgttaataaagacggctccaatgttaaattcccctaacattgaagcttgt

SEQ ID NO: 87724 - DNA, 75 bp, Artificial Sequence
  Synthetic
cgtggcaatcgtcatcaaacccgtccatcttttacacatatggatgcgcaccaccaagaatgtccgtgccgtttg

SEQ ID NO: 87725 - DNA, 75 bp, Artificial Sequence
  Synthetic
catcttttacacatatggatgcgcaccaccaagaatgtccgtgccgtttgttggtattgccaacgcatacagtca

SEQ ID NO: 87726 - DNA, 75 bp, Artificial Sequence
  Synthetic
gtggcatatggtcgttggcctgaatacttgagggatagcgaagctaacccagtggatcaaccaacggaaccagac

SEQ ID NO: 87727 - DNA, 75 bp, Artificial Sequence
  Synthetic
acttgagggatagcgaagctaacccagtggatcaaccaacggaaccagacgttgccgcgtgcaggttttataccc

SEQ ID NO: 87728 - DNA, 75 bp, Artificial Sequence
  Synthetic
atcaattaatgattttggggcaattgctcttagagtggtcaatgaacacaatccagctcgcataacatcacgaat

SEQ ID NO: 87729 - DNA, 75 bp, Artificial Sequence
  Synthetic
gctcttagagtggtcaatgaacacaatccagctcgcataacatcacgaatgagagtgtacatgaaacccaagcac

SEQ ID NO: 87730 - DNA, 75 bp, Artificial Sequence
  Synthetic
tgtttgggcaaaacatgtactaccattatttgggcagatccgggtacacagtacacgtgcagtgtaatgcctcca

SEQ ID NO: 87731 - DNA, 75 bp, Artificial Sequence
  Synthetic
ttatttgggcagatccgggtacacagtacacgtgcagtgtaatgcctccaagttccaccagggtgcgctgggtgt

SEQ ID NO: 87732 - DNA, 75 bp, Artificial Sequence
  Synthetic
ctagcgcccatcacgccagttaattccataaccacctatggattcggccatcagagcaaagcggtttacgtcgct

SEQ ID NO: 87733 - DNA, 75 bp, Artificial Sequence
  Synthetic
ccataaccacctatggattcggccatcagagcaaagcggtttacgtcgctgggtacaagatctgcaattatcatc

SEQ ID NO: 87734 - DNA, 75 bp, Artificial Sequence
  Synthetic
cccaggcgaaaaagggggcaccttcacaagtacgtttacaccagacaataaccaaacatcacctgctcgcagatt

SEQ ID NO: 87735 - DNA, 75 bp, Artificial Sequence
  Synthetic
acaagtacgtttacaccagacaataaccaaacatcacctgctcgcagattttgtccagtagattacctctttggt

SEQ ID NO: 87736 - DNA, 75 bp, Artificial Sequence
  Synthetic
cccaaggaactgataccatagccagatgcaattgtagggcaggtgtgtattactgtgaatcaaagagaaagtact

SEQ ID NO: 87737 - DNA, 75 bp, Artificial Sequence
  Synthetic
atgcaattgtagggcaggtgtgtattactgtgaatcaaagagaaagtactacccagtagtggtcacggaacccac

SEQ ID NO: 87738 - DNA, 75 bp, Artificial Sequence
  Synthetic
ctggtgcttccatatgtgaactcactctccatagatagcatggttaagcacaacaactgggggattgccatcatt

SEQ ID NO: 87739 - DNA, 75 bp, Artificial Sequence
  Synthetic
tctccatagatagcatggttaagcacaacaactgggggattgccatcattccactagctccattgaattttgcta

SEQ ID NO: 87740 - DNA, 75 bp, Artificial Sequence
  Synthetic
agaaccaggtgactgtggtggcattttaagatgtaaccacggtgtaatgggcatagtcacagctggggggaatgg

SEQ ID NO: 87741 - DNA, 75 bp, Artificial Sequence
  Synthetic
ttaagatgtaaccacggtgtaatgggcatagtcacagctggggggaatggaattgtcgcctttgctgacattaga

SEQ ID NO: 87742 - DNA, 75 bp, Artificial Sequence
  Synthetic
tcacgttgccgcgtttacagggtttgcctgtgatgaacactccaggcagtaaccagtatctcaccgcagacaact

SEQ ID NO: 87743 - DNA, 75 bp, Artificial Sequence
  Synthetic
gcctgtgatgaacactccaggcagtaaccagtatctcaccgcagacaactttcaatccccgtgtgcgctgcctga

SEQ ID NO: 87744 - DNA, 75 bp, Artificial Sequence
  Synthetic
ggctcaggttttaccaatcaaattggagagaaggttgcagagctaactagtatgattaatagttcaatcactgaa

SEQ ID NO: 87745 - DNA, 75 bp, Artificial Sequence
  Synthetic
gagagaaggttgcagagctaactagtatgattaatagttcaatcactgaaaaattgttgaaaaccctgataaaaa

SEQ ID NO: 87746 - DNA, 75 bp, Artificial Sequence
  Synthetic
gatcccatttgacttgagcgccaccaagaaaaataccatggagatgtatagagtccgcttgagcgacaagcccca

SEQ ID NO: 87747 - DNA, 75 bp, Artificial Sequence
  Synthetic
aagaaaaataccatggagatgtatagagtccgcttgagcgacaagccccacacagacgatccaattctctgttta

SEQ ID NO: 87748 - DNA, 75 bp, Artificial Sequence
  Synthetic
gttgtgattgctccccctggcaatggatcaagaaaaaggcatgtgatattcttgagatcccctatgtaatgagac

SEQ ID NO: 87749 - DNA, 75 bp, Artificial Sequence
  Synthetic
gatcaagaaaaaggcatgtgatattcttgagatcccctatgtaatgagacaaggagattcctggttgaagaagtt

SEQ ID NO: 87750 - DNA, 75 bp, Artificial Sequence
  Synthetic
gcagggtctctgaagttcaccttcctgttctgtggctccatgatggcgactggcaaactactggtgtcttacgcg

SEQ ID NO: 87751 - DNA, 75 bp, Artificial Sequence
  Synthetic
tgttctgtggctccatgatggcgactggcaaactactggtgtcttacgcgccaccgggagctgatccacccaaaa

SEQ ID NO: 87752 - DNA, 75 bp, Artificial Sequence
  Synthetic
agagaaagtaataccggaagccagggataaagtagagtacgttaccaaactgaagcaattaggggttttggagaa

SEQ ID NO: 87753 - DNA, 75 bp, Artificial Sequence
  Synthetic
gataaagtagagtacgttaccaaactgaagcaattaggggttttggagaatcaaatcaacaccatccaccagtcg

SEQ ID NO: 87754 - DNA, 75 bp, Artificial Sequence
  Synthetic
cctggatcagtaataccacttaccgccaaaccattgatgatagtttcacagagggtggttacatcagcgtgttct

SEQ ID NO: 87755 - DNA, 75 bp, Artificial Sequence
  Synthetic
ccaaaccattgatgatagtttcacagagggtggttacatcagcgtgttctatcaaaccagaatagtggtgcccct

SEQ ID NO: 87756 - DNA, 75 bp, Artificial Sequence
  Synthetic
ccgctatatgccacagaggctaaaaggatttccaaactggagaacactatcaacaattacatacagttcaagagc

SEQ ID NO: 87757 - DNA, 75 bp, Artificial Sequence
  Synthetic
ggatttccaaactggagaacactatcaacaattacatacagttcaagagcaaacaccgtattgaaccagtatgta

SEQ ID NO: 87758 - DNA, 75 bp, Artificial Sequence
  Synthetic
caccactcacatagagcaaaaagcattaacacagggtttgggacagatgctggagagtatgatagatggcacagt

SEQ ID NO: 87759 - DNA, 75 bp, Artificial Sequence
  Synthetic
ttaacacagggtttgggacagatgctggagagtatgatagatggcacagttcgggaagcagtaggagtatcatct

SEQ ID NO: 87760 - DNA, 75 bp, Artificial Sequence
  Synthetic
aaaacacttcagtatactcgttgccaccggaccccacacatttcgatggttataaacaacaaggggttgtcataa

SEQ ID NO: 87761 - DNA, 75 bp, Artificial Sequence
  Synthetic
accggaccccacacatttcgatggttataaacaacaaggggttgtcataatggatgacttgaatcagaatccaga

SEQ ID NO: 87762 - DNA, 75 bp, Artificial Sequence
  Synthetic
gaaaccggggccacaaacccattggttccatcagacacagtgcaaaccaggcacgtcatccagcacaggtcaaga

SEQ ID NO: 87763 - DNA, 75 bp, Artificial Sequence
  Synthetic
ttccatcagacacagtgcaaaccaggcacgtcatccagcacaggtcaagatcagaatccagcatagaatccttct

SEQ ID NO: 87764 - DNA, 75 bp, Artificial Sequence
  Synthetic
aaaaggcattttattcacatcagactacgtgctagcgtccactaattccagcaccatatctccccccacagtggc

SEQ ID NO: 87765 - DNA, 75 bp, Artificial Sequence
  Synthetic
tacgtgctagcgtccactaattccagcaccatatctccccccacagtggcccacagtgatgcacttgccagaaga

SEQ ID NO: 87766 - DNA, 75 bp, Artificial Sequence
  Synthetic
cagtgtggaagatcacttacaaagacactgtgcaactaaggagaaaactagagttcttcacctattctagatttg

SEQ ID NO: 87767 - DNA, 75 bp, Artificial Sequence
  Synthetic
cactgtgcaactaaggagaaaactagagttcttcacctattctagatttgacatggaatttacatttgtaatcac

SEQ ID NO: 87768 - DNA, 75 bp, Artificial Sequence
  Synthetic
caattgtgcaaagattgcccgcaaccagcaaatttcaaaaagtgttgtccgttgatttgtggaaaggctttacaa

SEQ ID NO: 87769 - DNA, 75 bp, Artificial Sequence
  Synthetic
cagcaaatttcaaaaagtgttgtccgttgatttgtggaaaggctttacaactcatggacaagcacaccagacaaa

SEQ ID NO: 87770 - DNA, 75 bp, Artificial Sequence
  Synthetic
accagtgcctgaaaaatgggatgactacacatggcaaacctcatcaaatccatcaatcttttatacctatggctc

SEQ ID NO: 87771 - DNA, 75 bp, Artificial Sequence
  Synthetic
tacacatggcaaacctcatcaaatccatcaatcttttatacctatggctcagctccagcgcgaatttcagtgcct

SEQ ID NO: 87772 - DNA, 75 bp, Artificial Sequence
  Synthetic
aagcactattccaagggccactgcagtacaaagatgtcaagatagatatcaaggaaacgcctgctccagagtaca

SEQ ID NO: 87773 - DNA, 75 bp, Artificial Sequence
  Synthetic
gtacaaagatgtcaagatagatatcaaggaaacgcctgctccagagtacattaatgacttgttgcaagcagttga

SEQ ID NO: 87774 - DNA, 75 bp, Artificial Sequence
  Synthetic
gctctgggcgattcactttacggtgctgcatctttgaacgatttcggtatcctggccgttagggtggtcaatgac

SEQ ID NO: 87775 - DNA, 75 bp, Artificial Sequence
  Synthetic
ctgcatctttgaacgatttcggtatcctggccgttagggtggtcaatgaccacaaccccaccaaagtcacttcga

SEQ ID NO: 87776 - DNA, 75 bp, Artificial Sequence
  Synthetic
caatttaaatagagccatgacaattttgcaagcagtaaccacctttgcagcagtcgccggagttgtgtatgtcat

SEQ ID NO: 87777 - DNA, 75 bp, Artificial Sequence
  Synthetic
ttgcaagcagtaaccacctttgcagcagtcgccggagttgtgtatgtcatgtacaaacttttcgcagggcaccaa

SEQ ID NO: 87778 - DNA, 75 bp, Artificial Sequence
  Synthetic
gcccaggggttgattataaagatggaacacttactccgctctcaaccaaagatttgaccacgtacggtttcgggc

SEQ ID NO: 87779 - DNA, 75 bp, Artificial Sequence
  Synthetic
aacacttactccgctctcaaccaaagatttgaccacgtacggtttcgggcatcaaaacaaagcagtatacacagc

SEQ ID NO: 87780 - DNA, 75 bp, Artificial Sequence
  Synthetic
tttgactacgcagtagctatggccaaaagaaacattgtcactgccaccactggtaaaggggagtttactatgctt

SEQ ID NO: 87781 - DNA, 75 bp, Artificial Sequence
  Synthetic
aaagaaacattgtcactgccaccactggtaaaggggagtttactatgcttggggtacacgacaacgtagcagtgc

SEQ ID NO: 87782 - DNA, 75 bp, Artificial Sequence
  Synthetic
agacctcctggttaccgagtcaagggcccagggcacagactcaattgccagatgcaactgtaacacaggagtgta

SEQ ID NO: 87783 - DNA, 75 bp, Artificial Sequence
  Synthetic
gcccagggcacagactcaattgccagatgcaactgtaacacaggagtgtactattgtgaatccaggaggaagtat

SEQ ID NO: 87784 - DNA, 75 bp, Artificial Sequence
  Synthetic
tcgaagatcaagctggtatcaatttggaaattaccattgttactctcaagagaaatgaaaagttcagggacatta

SEQ ID NO: 87785 - DNA, 75 bp, Artificial Sequence
  Synthetic
ggaaattaccattgttactctcaagagaaatgaaaagttcagggacattagacctcacatccccactcaaatcac

SEQ ID NO: 87786 - DNA, 75 bp, Artificial Sequence
  Synthetic
cacatgttgattggacacggttttgcttcacctggcgactgtggcggtattctgaggtgccgacatggagttata

SEQ ID NO: 87787 - DNA, 75 bp, Artificial Sequence
  Synthetic
cttcacctggcgactgtggcggtattctgaggtgccgacatggagttataggaattatcactgctggtggtgagg

SEQ ID NO: 87788 - DNA, 75 bp, Artificial Sequence
  Synthetic
cgaacaaggatatctcaatttgggtgggcgacaaactgctcgcaccctcatgtataacttcccgacacgtgctgg

SEQ ID NO: 87789 - DNA, 75 bp, Artificial Sequence
  Synthetic
gggcgacaaactgctcgcaccctcatgtataacttcccgacacgtgctgggcagtgtggtggtattatcacgtgc

SEQ ID NO: 87790 - DNA, 75 bp, Artificial Sequence
  Synthetic
acattgagtcacttggcgctgcattcggcagtggctttactcaacaaatcggggacaaaatttcagagctcacca

SEQ ID NO: 87791 - DNA, 75 bp, Artificial Sequence
  Synthetic
cggcagtggctttactcaacaaatcggggacaaaatttcagagctcaccagcatgattaccagcaccattacaga

SEQ ID NO: 87792 - DNA, 75 bp, Artificial Sequence
  Synthetic
ttcgctcaaagtcaaggtgaaattcagtggatgagaccatctaaggaggttgggtaccccatcatcaacgcaccc

SEQ ID NO: 87793 - DNA, 75 bp, Artificial Sequence
  Synthetic
agtggatgagaccatctaaggaggttgggtaccccatcatcaacgcacccagcaagaccaagcttgagcccagtg

SEQ ID NO: 87794 - DNA, 75 bp, Artificial Sequence
  Synthetic
tgtgattgcgacattggccctcctcggctgtgatatctcaccttggcaatggctcaagaaaaaggcatgtgacat

SEQ ID NO: 87795 - DNA, 75 bp, Artificial Sequence
  Synthetic
ggctgtgatatctcaccttggcaatggctcaagaaaaaggcatgtgacatacttgaaatcccttacgtgatgaga

SEQ ID NO: 87796 - DNA, 75 bp, Artificial Sequence
  Synthetic
ttgaagaagcaattttctccaaatatgtaggtaacaaaatcacagaggtggatgagtacatgaaagaggcagtgg

SEQ ID NO: 87797 - DNA, 75 bp, Artificial Sequence
  Synthetic
tgtaggtaacaaaatcacagaggtggatgagtacatgaaagaggcagtggaccattatgctggacaactcatgtc

SEQ ID NO: 87798 - DNA, 75 bp, Artificial Sequence
  Synthetic
atttcaaaattcatagattggctcaaggaaaagatcataccacaagctagagataaattagaatttgtaaccaaa

SEQ ID NO: 87799 - DNA, 75 bp, Artificial Sequence
  Synthetic
atcaactagtgcaggatacccctatgttgcaatgggtaagaagaagagagacatcctcaataagcaaactaagga

SEQ ID NO: 87800 - DNA, 75 bp, Artificial Sequence
  Synthetic
ctcaaacaactggaaatgctagaaaatcagatttcaacaattcatcagtcgtgccccagccaggagcatcaagaa

SEQ ID NO: 87801 - DNA, 75 bp, Artificial Sequence
  Synthetic
gttgcaatgggtaagaagaagagagacatcctcaataagcaaactaaggataccaaggaaatgcaaagactccta

SEQ ID NO: 87802 - DNA, 75 bp, Artificial Sequence
  Synthetic
agaatacaaaaattggagcataccattaacaattacatacagttcaagagcaaacaccgtattgagccagtatgt

SEQ ID NO: 87803 - DNA, 75 bp, Artificial Sequence
  Synthetic
ggcaaatccaggttaatcgaagcctccagtcttaatgactctgttgccatgagaatggcatttggaaacctatat

SEQ ID NO: 87804 - DNA, 75 bp, Artificial Sequence
  Synthetic
gaaaacacctccacctattccttaccaccagatccatcccactttgatggatacaaacaacagggggtagtgatt

SEQ ID NO: 87805 - DNA, 75 bp, Artificial Sequence
  Synthetic
atcccagtattgatggaagagaaactctttgcatttgattataccgggtatgatgcatcactaagcccagcctgg

SEQ ID NO: 87806 - DNA, 75 bp, Artificial Sequence
  Synthetic
caccagatccatcccactttgatggatacaaacaacagggggtagtgattatggatgatctcaatcaaaacccag

SEQ ID NO: 87807 - DNA, 75 bp, Artificial Sequence
  Synthetic
tctttgcatttgattataccgggtatgatgcatcactaagcccagcctggtttgaagcactgaaaatggtgctag

SEQ ID NO: 87808 - DNA, 75 bp, Artificial Sequence
  Synthetic
agaagggcatcctattcacatccaattacgtgctagcgtccaccaattccagtcggattacgccacccactgtag

SEQ ID NO: 87809 - DNA, 75 bp, Artificial Sequence
  Synthetic
ttacgtgctagcgtccaccaattccagtcggattacgccacccactgtagcacacagtgatgcgctggctaggag

SEQ ID NO: 87810 - DNA, 75 bp, Artificial Sequence
  Synthetic
tgagatgtgcaaaaactgccaccaaccagcaaacttcaaaaggtgttgcccactagtgtgtggaaaagccattca

SEQ ID NO: 87811 - DNA, 75 bp, Artificial Sequence
  Synthetic
ccagcaaacttcaaaaggtgttgcccactagtgtgtggaaaagccattcaattaatggacaagtcctctagggtc

SEQ ID NO: 87812 - DNA, 75 bp, Artificial Sequence
  Synthetic
tcaggaaaagactatggactaaccatgacaccagctgacaagtcagcgacattcgaaacagtcacatgggagaat

SEQ ID NO: 87813 - DNA, 75 bp, Artificial Sequence
  Synthetic
gaaattcatgaatcaatcagatggaccaaagatccgagaaatacccaggatcatgtccgctcattgtgtctattg

SEQ ID NO: 87814 - DNA, 75 bp, Artificial Sequence
  Synthetic
gaggcactattccaggggccactgcagttcaaagatctgaaaatagacattaaggccagtccacctccagagtgc

SEQ ID NO: 87815 - DNA, 75 bp, Artificial Sequence
  Synthetic
agttcaaagatctgaaaatagacattaaggccagtccacctccagagtgcatcaatgacctgctccaggcagttg

SEQ ID NO: 87816 - DNA, 75 bp, Artificial Sequence
  Synthetic
gaaatatcaatagagccatgaccattctgcaagcagtcaccacctttgctgctgtagctggagttgtttacgtta

SEQ ID NO: 87817 - DNA, 75 bp, Artificial Sequence
  Synthetic
tctgcaagcagtcaccacctttgctgctgtagctggagttgtttacgttatgtacaaattatttgctggtcacca

SEQ ID NO: 87818 - DNA, 75 bp, Artificial Sequence
  Synthetic
ttttgattatgcagtggctatggcaaaaagaaatatcctcacagccaccacatgcaaaggagagtttacgatgtt

SEQ ID NO: 87819 - DNA, 75 bp, Artificial Sequence
  Synthetic
aaaagaaatatcctcacagccaccacatgcaaaggagagtttacgatgttgggtgttcacgataatatagcaatc

SEQ ID NO: 87820 - DNA, 75 bp, Artificial Sequence
  Synthetic
ctagaggatcaagcagggactaatctggagatcaccataatcaccctcaaaagaaacgagaaatttagggacatc

SEQ ID NO: 87821 - DNA, 75 bp, Artificial Sequence
  Synthetic
tggagatcaccataatcaccctcaaaagaaacgagaaatttagggacatcagaccccacattcctacacagatca

SEQ ID NO: 87822 - DNA, 75 bp, Artificial Sequence
  Synthetic
ccgagcaaggatatcttaatctcggtggtcgtcaaactgctcgtactcttatgtacaattttccaactagagcag

SEQ ID NO: 87823 - DNA, 75 bp, Artificial Sequence
  Synthetic
tggtcgtcaaactgctcgtactcttatgtacaattttccaactagagcaggccagtgtggaggagtcattacttg

SEQ ID NO: 87824 - DNA, 75 bp, Artificial Sequence
  Synthetic
cttcattcaagatcaaggtgagattcaatggatgagaccatccaaggaagtgggataccccataatcaatgcacc

SEQ ID NO: 87825 - DNA, 75 bp, Artificial Sequence
  Synthetic
caatggatgagaccatccaaggaagtgggataccccataatcaatgcaccctcaaagaccaaacttgaacctagc

SEQ ID NO: 87826 - DNA, 75 bp, Artificial Sequence
  Synthetic
ttcgaggaagccatcttctctaagtatgttggtaacaagatcactgaggtggatgaatacatgaaagaggctgta

SEQ ID NO: 87827 - DNA, 75 bp, Artificial Sequence
  Synthetic
atgttggtaacaagatcactgaggtggatgaatacatgaaagaggctgtagaccattatgcagggcaactaatgt

SEQ ID NO: 87828 - DNA, 75 bp, Artificial Sequence
  Synthetic
tcagtactagtgccggttatccttacgtggcattgggaaaaaagaagagagacattcttaacaaacaaaccagag

SEQ ID NO: 87829 - DNA, 75 bp, Artificial Sequence
  Synthetic
cgtggcattgggaaaaaagaagagagacattcttaacaaacaaaccagagacaccaaagagatgcaaaggctgtt

SEQ ID NO: 87830 - DNA, 75 bp, Artificial Sequence
  Synthetic
gggcaagtccagattgattgaagcctccagcctcaatgattcagtagccatgagaatggctttcggtaatttgta

SEQ ID NO: 87831 - DNA, 75 bp, Artificial Sequence
  Synthetic
tccagcctcaatgattcagtagccatgagaatggctttcggtaatttgtatgcagctttccacaaaaacccaggt

SEQ ID NO: 87832 - DNA, 75 bp, Artificial Sequence
  Synthetic
ctcttcgcatttgactacacaggatacgatgcctcactcagtcccgcctggtttgaagcccttaagatggtgcta

SEQ ID NO: 87833 - DNA, 75 bp, Artificial Sequence
  Synthetic
acatactgtgtaaagggcggcatgccatctggctgctcgggcacttcaattttcaattcaatgataaataatcta

SEQ ID NO: 87834 - DNA, 75 bp, Artificial Sequence
  Synthetic
taattcacccagtaatgccaatgaaggagattcatgaatcaattagatggactaaagatcccaggaacacccagg

SEQ ID NO: 87835 - DNA, 75 bp, Artificial Sequence
  Synthetic
cagtatgttcatgttaggctttgttagtgcgtgtccagacttcagtgtcagactgcttagggacactccccatat

SEQ ID NO: 87836 - DNA, 75 bp, Artificial Sequence
  Synthetic
ttaaaacagctctggggttgttcccaccccagaggcccacgtggcggctagtactctggtatcacggtacccttg

SEQ ID NO: 87837 - DNA, 75 bp, Artificial Sequence
  Synthetic
ccccggagtgtagcttaggtcgatgagtctggacgatcctcactggcgacagtggtccaggctgcgttggcggcc

SEQ ID NO: 87838 - DNA, 75 bp, Artificial Sequence
  Synthetic
atcgtagattgttatcatagagcgaattggattggccatccggtgaaagtaagacacattatttacctttttgtt

SEQ ID NO: 87839 - DNA, 75 bp, Artificial Sequence
  Synthetic
aacaatgggtgcacaagtctcatcacaaaaagtgggagcacatgagaatactaatgtagcaacgggtggttccac

SEQ ID NO: 87840 - DNA, 75 bp, Artificial Sequence
  Synthetic
caaaaagtgggagcacatgagaatactaatgtagcaacgggtggttccaccgtgaattacaccactataaattac

SEQ ID NO: 87841 - DNA, 75 bp, Artificial Sequence
  Synthetic
aaagatataatgctcaaatcagccccggctttgaactcaccaaacgtagaagcatgtggttacagtgatcgagta

SEQ ID NO: 87842 - DNA, 75 bp, Artificial Sequence
  Synthetic
ccctcctatttaaaacccactgaagccaatccagtggatgcccccactgaaccagatgtcagttcaaataggttt

SEQ ID NO: 87843 - DNA, 75 bp, Artificial Sequence
  Synthetic
ccaatccagtggatgcccccactgaaccagatgtcagttcaaataggttttacacactagaatcagtgcagtggt

SEQ ID NO: 87844 - DNA, 75 bp, Artificial Sequence
  Synthetic
aaaacatcgtacgtttcatatgtgaatgcaaaccccggggaaagtggtggcacatttactgatagctacaaccca

SEQ ID NO: 87845 - DNA, 75 bp, Artificial Sequence
  Synthetic
atgcaaaccccggggaaagtggtggcacatttactgatagctacaacccatctaaggagactgatcaaggaagga

SEQ ID NO: 87846 - DNA, 75 bp, Artificial Sequence
  Synthetic
ttaatttaagaaccaacaacagtgccactcttgtgctaccgtacgtcaattcattagctatcgattgcatggcca

SEQ ID NO: 87847 - DNA, 75 bp, Artificial Sequence
  Synthetic
cactcttgtgctaccgtacgtcaattcattagctatcgattgcatggccaaacacaataactgggggctagtaat

SEQ ID NO: 87848 - DNA, 75 bp, Artificial Sequence
  Synthetic
gtgcactgagttcaacggtctaagaaacatcacaatcccagcgacacaaggtttaccagtaatgatcacgccagg

SEQ ID NO: 87849 - DNA, 75 bp, Artificial Sequence
  Synthetic
tgacatccctggtgaagtaaagaacatgatggaactagcagaaattgacactttaataccaatgaacagcatttc

SEQ ID NO: 87850 - DNA, 75 bp, Artificial Sequence
  Synthetic
atgatggaactagcagaaattgacactttaataccaatgaacagcatttcaggtaaggcaaatactatggaaatg

SEQ ID NO: 87851 - DNA, 75 bp, Artificial Sequence
  Synthetic
cgtcttcaatacaccatgttgggagaaatcctgaactactacactcactggactgggtcacttaggttcacattt

SEQ ID NO: 87852 - DNA, 75 bp, Artificial Sequence
  Synthetic
aaatcctgaactactacactcactggactgggtcacttaggttcacatttttgttttgtggtagcatgatggcga

SEQ ID NO: 87853 - DNA, 75 bp, Artificial Sequence
  Synthetic
ctcacattatatgggatttagggttacagtctagctgcaccatggtggcaccttggatctccaacaccgtttaca

SEQ ID NO: 87854 - DNA, 75 bp, Artificial Sequence
  Synthetic
ctagcacaccaaccaacatggctatgcttgcatttgtgagcgcgtgcccagacttcagtgtgcgattactgaggg

SEQ ID NO: 87855 - DNA, 75 bp, Artificial Sequence
  Synthetic
gcttgcatttgtgagcgcgtgcccagacttcagtgtgcgattactgagggataccactcatatcagccaatcaac

SEQ ID NO: 87856 - DNA, 75 bp, Artificial Sequence
  Synthetic
tacccgtccaatcaccgcatcagatactcctagcacaagcggtgtgaacagccaggaggtaccagcattgacagc

SEQ ID NO: 87857 - DNA, 75 bp, Artificial Sequence
  Synthetic
actcctagcacaagcggtgtgaacagccaggaggtaccagcattgacagctgttgagactggagcctcggggcag

SEQ ID NO: 87858 - DNA, 75 bp, Artificial Sequence
  Synthetic
ttctttggtagatcagcatgcgtcactatattggaagtggaaaacttcaatgcaacagatgcaagtgataaaaag

SEQ ID NO: 87859 - DNA, 75 bp, Artificial Sequence
  Synthetic
aattgcttcctacccccatgaggttgacgctagtctcctagcccaatcaggaaaagactatggactaaccatgac

SEQ ID NO: 87860 - DNA, 75 bp, Artificial Sequence
  Synthetic
catacaccaatacagtccaactaaggagaaaactagagttcttcacctattccaggtttgatttagaaatgactt

SEQ ID NO: 87861 - DNA, 75 bp, Artificial Sequence
  Synthetic
ctccaggagcacctagaccaaatacatgggacgattacacctggcaatcatcatccaacccctcaatcttttaca

SEQ ID NO: 87862 - DNA, 75 bp, Artificial Sequence
  Synthetic
atgggacgattacacctggcaatcatcatccaacccctcaatcttttacacgtatggttgtgcaccagcacgcat

SEQ ID NO: 87863 - DNA, 75 bp, Artificial Sequence
  Synthetic
tgaagccacagattccggcgacacctattacggactagtttcaatcaatgactttggagccttggcaattagagt

SEQ ID NO: 87864 - DNA, 75 bp, Artificial Sequence
  Synthetic
tattacggactagtttcaatcaatgactttggagccttggcaattagagtggtgaatgagttcaaccccgcccgc

SEQ ID NO: 87865 - DNA, 75 bp, Artificial Sequence
  Synthetic
ccttacagaggagaaggagtggatttaaagcagggaactatcacaccactaaccccagtaaatagcatcacaaca

SEQ ID NO: 87866 - DNA, 75 bp, Artificial Sequence
  Synthetic
taaagcagggaactatcacaccactaaccccagtaaatagcatcacaacatatggtcttggacaccaaaaccaag

SEQ ID NO: 87867 - DNA, 75 bp, Artificial Sequence
  Synthetic
ccatgtgggagagggacctattagtggtggaatccagagcacagggtattgatcaaattgccagatgcacatgca

SEQ ID NO: 87868 - DNA, 75 bp, Artificial Sequence
  Synthetic
gatcaaattgccagatgcacatgcacaaccggagtttactattgctcatcacgaggcaagcattatccaatcacc

SEQ ID NO: 87869 - DNA, 75 bp, Artificial Sequence
  Synthetic
ggttgtggttttgctgaaccaggtgattgcggtggtatccttagatgtcaacatggagcaatgggactcatcact

SEQ ID NO: 87870 - DNA, 75 bp, Artificial Sequence
  Synthetic
atcaccagttatatggaatcattgggagcagcatttgggtgcgggttcaccaatcagataagcgaaaaggtcaca

SEQ ID NO: 87871 - DNA, 75 bp, Artificial Sequence
  Synthetic
gagcagcatttgggtgcgggttcaccaatcagataagcgaaaaggtcacagaaatcgcctcaatggtaaacagtg

SEQ ID NO: 87872 - DNA, 75 bp, Artificial Sequence
  Synthetic
acaccacgactgtacttgcaactcttgctctcctggggtgcgatgtgtcaccatggtcctggctcagaaagaaag

SEQ ID NO: 87873 - DNA, 75 bp, Artificial Sequence
  Synthetic
atgcagcaaaaggacttgaatggatcagcaataaattgtccaagtttattgattggctcaaaaacaaaataatac

SEQ ID NO: 87874 - DNA, 75 bp, Artificial Sequence
  Synthetic
cagcaataaattgtccaagtttattgattggctcaaaaacaaaataatacctgaagctagggacaaggtggaata

SEQ ID NO: 87875 - DNA, 75 bp, Artificial Sequence
  Synthetic
acaacaggaggtgttgttcaacaatgttagatggctggcaattcaatcacgacgcttcgcaccactgtacgcagt

SEQ ID NO: 87876 - DNA, 75 bp, Artificial Sequence
  Synthetic
tgcagagagagagaacacatccgtttactctcttcccccagatcctgcacattttgacgggtacaaacagcaggg

SEQ ID NO: 87877 - DNA, 75 bp, Artificial Sequence
  Synthetic
tactctcttcccccagatcctgcacattttgacgggtacaaacagcagggtgtcgttatcatggatgacttgaac

SEQ ID NO: 87878 - DNA, 75 bp, Artificial Sequence
  Synthetic
tcactagaagaaaaaggaatcctgttcacatcagactatgttcttgcttctaccaactcaggtagcatagtgcca

SEQ ID NO: 87879 - DNA, 75 bp, Artificial Sequence
  Synthetic
ggatgtgtataccatgtccgagcactctattaaagggaaactaaacatggcaactgccacggtgctttgtaagga

SEQ ID NO: 87880 - DNA, 75 bp, Artificial Sequence
  Synthetic
caccagacaaagattcacagtcgatgaaattactactctaatcatcaatgagaagattagacgggccaatattgg

SEQ ID NO: 87881 - DNA, 75 bp, Artificial Sequence
  Synthetic
gaaattactactctaatcatcaatgagaagattagacgggccaatattggcaactgcatggaagcactgttccag

SEQ ID NO: 87882 - DNA, 75 bp, Artificial Sequence
  Synthetic
caagccgtagatagtcaggaggttagagattactgtgagaagaaaggatggatagtgaatgtcaacaatgaggtc

SEQ ID NO: 87883 - DNA, 75 bp, Artificial Sequence
  Synthetic
cagttagaacgcaatttgaacagggctatgaccattttgcaggcgataaccacttttgccgcagttgctggagtt

SEQ ID NO: 87884 - DNA, 75 bp, Artificial Sequence
  Synthetic
ccaactatcaggacagctaaagttcaaggcccaggttttgattatgcagtagcaatggcaaaaagaaacatctta

SEQ ID NO: 87885 - DNA, 75 bp, Artificial Sequence
  Synthetic
aaggcccaggttttgattatgcagtagcaatggcaaaaagaaacatcttaacagctaccactgacaagggagagt

SEQ ID NO: 87886 - DNA, 75 bp, Artificial Sequence
  Synthetic
ctaagagtatgagcatgctggggtttgtgtcagcttgcaatgaattcagtgtgcgattgctgcgagacaccactc

SEQ ID NO: 87887 - DNA, 75 bp, Artificial Sequence
  Synthetic
acagctaccactgacaagggagagttcaccatgttgggtgtgcacgacaatgttgctatattgcccacacatgca

SEQ ID NO: 87888 - DNA, 75 bp, Artificial Sequence
  Synthetic
atgggaaggaggtcaagatcattgacgcacaggcgttagtggaccaagcaggtacaaatttagaaataaccatta

SEQ ID NO: 87889 - DNA, 75 bp, Artificial Sequence
  Synthetic
gtaccccaacatgtatgtcccagtcggtgctgtaaccgagcagggatatcttaatcttggtggacgccagactgc

SEQ ID NO: 87890 - DNA, 75 bp, Artificial Sequence
  Synthetic
tcacatgggtttgcagcagccctgaaacggtcatacttcactcagagtcaaggtgagattcaatggatgagacca

SEQ ID NO: 87891 - DNA, 75 bp, Artificial Sequence
  Synthetic
tctaaagaggtgggttaccctatcatcaatgccccctccaagaccaaacttgaacccagtgctttccattacata

SEQ ID NO: 87892 - DNA, 75 bp, Artificial Sequence
  Synthetic
ggagtcttgatcgtgaacactagcaagtaccccaatatgtatgttcctgtcggtgctgtgactgagcagggatat

SEQ ID NO: 87893 - DNA, 75 bp, Artificial Sequence
  Synthetic
ttctcaaaatacgtgggaaacaagataactgaagtggatgagtacatgaaagaagcagttgatcactatgcaggg

SEQ ID NO: 87894 - DNA, 75 bp, Artificial Sequence
  Synthetic
caactcatgtcattggacattagtacagaacaaatgtgtcttgaggatgcaatgtatggcactgatggtctcgag

SEQ ID NO: 87895 - DNA, 75 bp, Artificial Sequence
  Synthetic
caaaccagggacaccaaagagatgcaaaggttattggataagtatggaattaacttgccattagttacctatgtg

SEQ ID NO: 87896 - DNA, 75 bp, Artificial Sequence
  Synthetic
aagtggagcagggcaaatctagattaattgaagcatccagcctaaatgattcagtagcaatgaggatggcttttg

SEQ ID NO: 87897 - DNA, 75 bp, Artificial Sequence
  Synthetic
tttggagcaagatcccagtactaatggaagagaagctttttgcttttgattatactggctatgacgcttcactca

SEQ ID NO: 87898 - DNA, 75 bp, Artificial Sequence
  Synthetic
acctcaaccactcacaccacctttacaaaaacaaaacctattgtgttaagggcggcatgccatctggctgctcag

SEQ ID NO: 87899 - DNA, 75 bp, Artificial Sequence
  Synthetic
tacccatttttagtacatccagtgatgcctatgaaggagattcatgaatcaatcagatggaccaaggatcccaga

SEQ ID NO: 87900 - DNA, 75 bp, Artificial Sequence
  Synthetic
ccaccaaccggcaaacttcaaaagatgctgtcctttagtgtgtggtaaggcaattcagttaatggacaaatcttc

SEQ ID NO: 87901 - DNA, 75 bp, Artificial Sequence
  Synthetic
cctaaactctccaaatgttgaggcttgtggatacagtgatagggttaggcaaattaccctagggaattccacaat

SEQ ID NO: 87902 - DNA, 75 bp, Artificial Sequence
  Synthetic
aaacccaacgtgcccactattaggacagcaaaggtacaagggccagggtttgattacgcagtggctatggctaaa

SEQ ID NO: 87903 - DNA, 75 bp, Artificial Sequence
  Synthetic
cccctgaagaccacagcaatgccgtggatgtgctatggaacagagaccttataattgtcagcagcagagcacagg

SEQ ID NO: 87904 - DNA, 75 bp, Artificial Sequence
  Synthetic
ctatgaggataccaccacagtattggcgacgctggccctattgggatgcgactgttcaccctggcagtggattaa

SEQ ID NO: 87905 - DNA, 75 bp, Artificial Sequence
  Synthetic
gatgttgggaacacatgtgatttgggacataggattgcagtcctcatgtactatggtagtgccatggattagcaa

SEQ ID NO: 87906 - DNA, 75 bp, Artificial Sequence
  Synthetic
agaaggaaatactacccagtgtcctttgttggcccaacgttccagtacatggaggctaatgactattatccagct

SEQ ID NO: 87907 - DNA, 75 bp, Artificial Sequence
  Synthetic
ctcatgcagccccaggggattcaattgtgattgacgggaaggagatagaagtcctagatgctgaggcattggaag

SEQ ID NO: 87908 - DNA, 75 bp, Artificial Sequence
  Synthetic
cagtgctggttacccttatgtggcaatgggaaagaaaaagagagacattttgaacaagcagacccgagatacaaa

SEQ ID NO: 87909 - DNA, 75 bp, Artificial Sequence
  Synthetic
gtactgctacgaacaagcacttctgttaccccggtgagattgcataggctgtccccacggctaaaagcgattgat

SEQ ID NO: 87910 - DNA, 75 bp, Artificial Sequence
  Synthetic
cccagagtgtagcttaggctgatgagtctggacattcctcaccggtgacggtggtccaggctgcgttggcggcct

SEQ ID NO: 87911 - DNA, 75 bp, Artificial Sequence
  Synthetic
caaaaccaaggtggagcaaggaaaatccaggttgatcgaagcttctagtctcaatgactcagtagcaatgcgaat

SEQ ID NO: 87912 - DNA, 75 bp, Artificial Sequence
  Synthetic
tgcccaagtctcgtctcaaaaagttggtgcacatgagaacactaatgtagcaactggcggatccacagttaatta

SEQ ID NO: 87913 - DNA, 75 bp, Artificial Sequence
  Synthetic
tagatgccccaaccgagccagatgtgagtagcaatagattctacaccttggattctgtgcaatggaaaagcacca

SEQ ID NO: 87914 - DNA, 75 bp, Artificial Sequence
  Synthetic
gattctgtgcaatggaaaagcaccagcagaggatggtggtggaagctgccagatgccttaaaagatatgggcatg

SEQ ID NO: 87915 - DNA, 75 bp, Artificial Sequence
  Synthetic
acccctctccaccaaggatttgaccacatatggattcggacaccaaaacaaagcggtgtacactgcaggttacaa

SEQ ID NO: 87916 - DNA, 75 bp, Artificial Sequence
  Synthetic
gcatctgaaggcaggaaattcgcagcccttgactatctattagggtgcggggttctggcagggaatgcgtttgtg

SEQ ID NO: 87917 - DNA, 75 bp, Artificial Sequence
  Synthetic
ggttctggcagggaatgcgtttgtgtaccctcatcagattattaatcttaggacgaataattcggcaacccttgt

SEQ ID NO: 87918 - DNA, 75 bp, Artificial Sequence
  Synthetic
ggacgaataattcggcaacccttgtgctgccctatgtgaactccctagcaatagactgtatggccaaacacaaca

SEQ ID NO: 87919 - DNA, 75 bp, Artificial Sequence
  Synthetic
tcatccacagagattcccataacagtgactatcgcaccaatgttcacagaattcaacgggcttaggaatattacc

SEQ ID NO: 87920 - DNA, 75 bp, Artificial Sequence
  Synthetic
ccactagatgacaaaggtagtgcaacacccatatttagtatttccctcagcccggcctccgataagagattgcag

SEQ ID NO: 87921 - DNA, 75 bp, Artificial Sequence
  Synthetic
attactatacccactggaccggttcgttgaggttcacgttcctgttttgtggcagtatgatggctacagggaaaa

SEQ ID NO: 87922 - DNA, 75 bp, Artificial Sequence
  Synthetic
cattatcacctgcctcagatcctaggctgtctcacacaatgcttggagaaattttgaattattacacacattggg

SEQ ID NO: 87923 - DNA, 75 bp, Artificial Sequence
  Synthetic
gtgcgtctgttgagagacaccaaccacatctcacagagaactttgtttgcgcgcgcgcaaggcattgaggagacc

SEQ ID NO: 87924 - DNA, 75 bp, Artificial Sequence
  Synthetic
tttggaagatctgcttgtgtcaccatactggaagtggagaattttaacgccacgactgacgctgataggaaaaag

SEQ ID NO: 87925 - DNA, 75 bp, Artificial Sequence
  Synthetic
tccaggcgtggactacaaggatggaactctcacccccctctctacaaaagaactgaccacctacgggcttggaca

SEQ ID NO: 87926 - DNA, 75 bp, Artificial Sequence
  Synthetic
tgcggtgaacattatgtggaacagagacctgatagttgttgaatctaaagcccaaggtacagactccatcgccag

SEQ ID NO: 87927 - DNA, 75 bp, Artificial Sequence
  Synthetic
agatttgacctagagatgacttttgtcataacggaaaggtactatgccagtaacacaggacatgccaggaatcaa

SEQ ID NO: 87928 - DNA, 75 bp, Artificial Sequence
  Synthetic
gacctgatagttgttgaatctaaagcccaaggtacagactccatcgccaggtgtagctgcaatgctggagtatat

SEQ ID NO: 87929 - DNA, 75 bp, Artificial Sequence
  Synthetic
tattatccagccagataccaatcacacatgctaatcggctacgggtttgcgtcacccggagattgtggcggaatt

SEQ ID NO: 87930 - DNA, 75 bp, Artificial Sequence
  Synthetic
acatgctaatcggctacgggtttgcgtcacccggagattgtggcggaattctcagatgtcaccacggggtcattg

SEQ ID NO: 87931 - DNA, 75 bp, Artificial Sequence
  Synthetic
gcgtactcacacttctatgacgggttcgcgcgtgttcctttgaaagatgagaccgttgactctggagacacatat

SEQ ID NO: 87932 - DNA, 75 bp, Artificial Sequence
  Synthetic
ccatggagcagggtatttcaaactacattgagtctcttggggctgcttttggaagtggtttcacgcaacaaattg

SEQ ID NO: 87933 - DNA, 75 bp, Artificial Sequence
  Synthetic
cattgagtctcttggggctgcttttggaagtggtttcacgcaacaaattggagataaaatttcagaactaaccag

SEQ ID NO: 87934 - DNA, 75 bp, Artificial Sequence
  Synthetic
cagaaattatgaagacaccaccaccgtgctagctactctagcactcttgggctgtgacgtctccccttggcaatg

SEQ ID NO: 87935 - DNA, 75 bp, Artificial Sequence
  Synthetic
gtgctagctactctagcactcttgggctgtgacgtctccccttggcaatggttgaaaaagaaagcatgtgacgtc

SEQ ID NO: 87936 - DNA, 75 bp, Artificial Sequence
  Synthetic
ggccttgagtgggtctccaacaaaatctctaaattcattgactggttaaaggaaaaaattatcccacaggcaaga

SEQ ID NO: 87937 - DNA, 75 bp, Artificial Sequence
  Synthetic
tctctaaattcattgactggttaaaggaaaaaattatcccacaggcaagagacaaactcgagttcgtgaccaagc

SEQ ID NO: 87938 - DNA, 75 bp, Artificial Sequence
  Synthetic
tactattcaacaatgtcaggtggttatctattcaatcaaagagattcgctcccctctacgccgtggaagcaaaga

SEQ ID NO: 87939 - DNA, 75 bp, Artificial Sequence
  Synthetic
atctattcaatcaaagagattcgctcccctctacgccgtggaagcaaagagaatccaaaaattggagcacacaat

SEQ ID NO: 87940 - DNA, 75 bp, Artificial Sequence
  Synthetic
cggtaaatcagttgcgaccaacttgattgcacgggcaatagccgaaaaagagaacacatccacttattctttgcc

SEQ ID NO: 87941 - DNA, 75 bp, Artificial Sequence
  Synthetic
attgcacgggcaatagccgaaaaagagaacacatccacttattctttgccaccagatcctagccactttgatggg

SEQ ID NO: 87942 - DNA, 75 bp, Artificial Sequence
  Synthetic
caaatggtttcaacagtggagttcatcccaccaatggcatcactggaggaaaaaggcattcttttcacctctaat

SEQ ID NO: 87943 - DNA, 75 bp, Artificial Sequence
  Synthetic
tcccaccaatggcatcactggaggaaaaaggcattcttttcacctctaattacgtgttagcatccactaattcca

SEQ ID NO: 87944 - DNA, 75 bp, Artificial Sequence
  Synthetic
taatgggtgaatattcaaaagatggaaaattaaatatggcgatggccacagagatgtgcaaaaattgtcatcaac

SEQ ID NO: 87945 - DNA, 75 bp, Artificial Sequence
  Synthetic
aaaattaaatatggcgatggccacagagatgtgcaaaaattgtcatcaaccagcaaactttaaacggtgctgtcc

SEQ ID NO: 87946 - DNA, 75 bp, Artificial Sequence
  Synthetic
ctatacatcaatcgtgcccaagtcaggaacaacaagaaatcttgttcaacaatgtgcggtggcttgcgatacagt

SEQ ID NO: 87947 - DNA, 75 bp, Artificial Sequence
  Synthetic
catgatcattaatgaaaggaatagaagatctaatattggcaactgtatggaggcactctttcagggtccactaca

SEQ ID NO: 87948 - DNA, 75 bp, Artificial Sequence
  Synthetic
agatctaatattggcaactgtatggaggcactctttcagggtccactacaatacaaggatttaaaaatagatatc

SEQ ID NO: 87949 - DNA, 75 bp, Artificial Sequence
  Synthetic
gaaaagaaaggatggattgttaatatcactagccaggtccagactgaaaggaacatcaatagagccatgacaata

SEQ ID NO: 87950 - DNA, 75 bp, Artificial Sequence
  Synthetic
aggggttgtcatcatggatgatcttaaccagaatcctgacggcaacgacatgaagctgttctgccaaatggtttc

SEQ ID NO: 87951 - DNA, 75 bp, Artificial Sequence
  Synthetic
tcactagccaggtccagactgaaaggaacatcaatagagccatgacaatattgcaagcagttacaacctttgcag

SEQ ID NO: 87952 - DNA, 75 bp, Artificial Sequence
  Synthetic
gcatccttggaagaaaaggggattctttttacttcagactatgtgttggcctcaacaaactcacatactattaca

SEQ ID NO: 87953 - DNA, 75 bp, Artificial Sequence
  Synthetic
agaaacctaacgtccccacaattagaacagccaaggtgcagggaccaggatttgactatgcagttgctatggcta

SEQ ID NO: 87954 - DNA, 75 bp, Artificial Sequence
  Synthetic
aacagccaaggtgcagggaccaggatttgactatgcagttgctatggctaagaggaacattgtcaccgctactac

SEQ ID NO: 87955 - DNA, 75 bp, Artificial Sequence
  Synthetic
catggaagtttatactatgtctgagcactccattaaaggaaagctaaatatggcaacagcaacgcaattgtgcaa

SEQ ID NO: 87956 - DNA, 75 bp, Artificial Sequence
  Synthetic
aaccatcgtaattgatggtaaggaagtagaggtactcgatgccaaggcattggaagatcaagccggcactaatct

SEQ ID NO: 87957 - DNA, 75 bp, Artificial Sequence
  Synthetic
tgggaattgcatggaggcgttgtttcaaggccctatacagtacagagatttgaagattgatattaaagaaacacc

SEQ ID NO: 87958 - DNA, 75 bp, Artificial Sequence
  Synthetic
gtgaacactagtaagtaccccaacatgtacgtgcccgtcggtgcagtgaccgagcaagggtacctcaatctgggc

SEQ ID NO: 87959 - DNA, 75 bp, Artificial Sequence
  Synthetic
actggtaaagtgattgggatgcatgttggagggaacggttcacatgggtttgctgcagccctgaaacgatcatat

SEQ ID NO: 87960 - DNA, 75 bp, Artificial Sequence
  Synthetic
ttggagggaacggttcacatgggtttgctgcagccctgaaacgatcatatttcactcagagtcaaggtgagattc

SEQ ID NO: 87961 - DNA, 75 bp, Artificial Sequence
  Synthetic
cttttcattacatttttgagggtgtaaaggaaccagcagtgttgaccaagagtgatccaagactaaagacagact

SEQ ID NO: 87962 - DNA, 75 bp, Artificial Sequence
  Synthetic
aaaggaaccagcagtgttgaccaagagtgatccaagactaaagacagactttgaagaggccattttctcaaagta

SEQ ID NO: 87963 - DNA, 75 bp, Artificial Sequence
  Synthetic
acttgatatcaatactgaccagatgtgcttagaagatgccatgtacggaacagatggcctagaggccctcgatct

SEQ ID NO: 87964 - DNA, 75 bp, Artificial Sequence
  Synthetic
tgcttagaagatgccatgtacggaacagatggcctagaggccctcgatctcaccaccagcgcagggtacccgtac

SEQ ID NO: 87965 - DNA, 75 bp, Artificial Sequence
  Synthetic
gacacatatggcattaatctaccactagttacctatgtgaaggatgagcttagaagcaagagcaaagtggaacag

SEQ ID NO: 87966 - DNA, 75 bp, Artificial Sequence
  Synthetic
tagttacctatgtgaaggatgagcttagaagcaagagcaaagtggaacagggaaaatctagattaatagaagctt

SEQ ID NO: 87967 - DNA, 75 bp, Artificial Sequence
  Synthetic
tggtgacgggatctgcagtgggatgtgacccagatctattttggagcaaaataccagtgttgatggaagagaaac

SEQ ID NO: 87968 - DNA, 75 bp, Artificial Sequence
  Synthetic
gtatttgaaggtgtaaaagaaccagcagctctcaccaagaatgaccccaggctaaagacagactttgaagaggcc

SEQ ID NO: 87969 - DNA, 75 bp, Artificial Sequence
  Synthetic
tttgaagcactaaagatggtgttagaaaagattggctttggggacagagtagattatattgattacttaaatcac

SEQ ID NO: 87970 - DNA, 75 bp, Artificial Sequence
  Synthetic
tttaattcaatgatcaacaacttaattatcaggacactcttactgaaaacctacaagggcatagatttagaccac

SEQ ID NO: 87971 - DNA, 75 bp, Artificial Sequence
  Synthetic
ctggttacccttatgtggcaatgggaaagaaaaagagagacattctgaacaagcaaacccgagatacaaaggaaa

SEQ ID NO: 87972 - DNA, 75 bp, Artificial Sequence
  Synthetic
tcaggaaaagactatggactaaccatgaccccagctgacaagtcagccacatttgaaacggtcacgtgggaaaat

SEQ ID NO: 87973 - DNA, 75 bp, Artificial Sequence
  Synthetic
gagattcatgaatcgatcagatggaccaaagatcccaggaacacacaggatcatgtccgctcattgtgcttattg

SEQ ID NO: 87974 - DNA, 75 bp, Artificial Sequence
  Synthetic
tcatgtccgctcattgtgcttattggcttggcacaatggcgaggaagaatacaacaagttcttagctaaaataag

SEQ ID NO: 87975 - DNA, 75 bp, Artificial Sequence
  Synthetic
tgttttggagtaaaataccagttctgatggaggaaaagctgtttgcttttgattacacaggctatgatgcttcac

SEQ ID NO: 87976 - DNA, 75 bp, Artificial Sequence
  Synthetic
tcattttagtaaccctacctcagtcgaattggattgggttatactgttgtaggggtaaatttttctttaattcgg

SEQ ID NO: 87977 - DNA, 75 bp, Artificial Sequence
  Synthetic
accccagaggcccacgtggcggccagtactccggtattacggtacccttgtacgcctgttttatatccccttccc

SEQ ID NO: 87978 - DNA, 75 bp, Artificial Sequence
  Synthetic
ccagcaactagcctgtcgtaacgcgcaagtctgtggcggaaccgactactttgggtgtccgtgtttccttttatt

SEQ ID NO: 87979 - DNA, 75 bp, Artificial Sequence
  Synthetic
gaaagttggagcccatgaaaattcaaacagagcctatggcgggtccaccattaattacactacaatcaattacta

SEQ ID NO: 87980 - DNA, 75 bp, Artificial Sequence
  Synthetic
gattgagggggtcgttgaagggattactaaaaatgcattggttcccccgacttccaccaatagcctgcctgacac

SEQ ID NO: 87981 - DNA, 75 bp, Artificial Sequence
  Synthetic
gattaacgacttatggatttggacaccaaaacaaagctgtgtacacagctggctacaaaatttgcaattaccacc

SEQ ID NO: 87982 - DNA, 75 bp, Artificial Sequence
  Synthetic
tagctacacaagaagacttgcaaaatgccgtgagtgtcatgtggaacagagacctcttagtggctgaatcaaggg

SEQ ID NO: 87983 - DNA, 75 bp, Artificial Sequence
  Synthetic
aaagttgaacatggcgatggctacagagatgtgcaagaattgccaccaaccagcaaatttcaaaaggtgctgccc

SEQ ID NO: 87984 - DNA, 75 bp, Artificial Sequence
  Synthetic
gagaagaaaggatggatcgtcaacattactagccaggttcaaactgaaagaaacattaacagagcaatgaccata

SEQ ID NO: 87985 - DNA, 75 bp, Artificial Sequence
  Synthetic
gtgaacactagtaagtaccccaacatgtatgtcccagttggtgctgtgaccgagcagggatatctcaatctcggt

SEQ ID NO: 87986 - DNA, 75 bp, Artificial Sequence
  Synthetic
tacgcctgttttatactccctccccatgtaactttagaagcaattcaataagttcaatagagggggtacaaacca

SEQ ID NO: 87987 - DNA, 75 bp, Artificial Sequence
  Synthetic
actggctgcttatggtgacaatcatagattgttatcatagagcgaattggattggccatccagtgaaatataaac

SEQ ID NO: 87988 - DNA, 75 bp, Artificial Sequence
  Synthetic
agattgttatcatagagcgaattggattggccatccagtgaaatataaacacgttatctacttgtttgttggatt

SEQ ID NO: 87989 - DNA, 75 bp, Artificial Sequence
  Synthetic
cacaagtttcatctcaaaaagtgggtgctcatgagaacaccaacattgctactggcgggtcaactgtcaattaca

SEQ ID NO: 87990 - DNA, 75 bp, Artificial Sequence
  Synthetic
tgctcatgagaacaccaacattgctactggcgggtcaactgtcaattacactactattaattactacaaagactc

SEQ ID NO: 87991 - DNA, 75 bp, Artificial Sequence
  Synthetic
tggtcacttatgtaaaagatgaacttagatccaaaaccaaggtggaacagggcaagtctagattaattgaagcct

SEQ ID NO: 87992 - DNA, 75 bp, Artificial Sequence
  Synthetic
gttgaagtctgccccagcgctaaactcgccaaacatagaggcgtgcgggtacagtgatagagtgatgcagctcac

SEQ ID NO: 87993 - DNA, 75 bp, Artificial Sequence
  Synthetic
tcgccaaacatagaggcgtgcgggtacagtgatagagtgatgcagctcacattaggtaattctacaataaccacc

SEQ ID NO: 87994 - DNA, 75 bp, Artificial Sequence
  Synthetic
gaccaacccaccgaacctgatgtggccgcgtgtcgtttctacacgttggaatccgttatgtggaacaaggaatct

SEQ ID NO: 87995 - DNA, 75 bp, Artificial Sequence
  Synthetic
ccgcgtgtcgtttctacacgttggaatccgttatgtggaacaaggaatctaaagggtggtggtggaagttgcctg

SEQ ID NO: 87996 - DNA, 75 bp, Artificial Sequence
  Synthetic
atgtccaatgcaacgcttcaaagttccaccaaggtacactgggggtgttcgctattccagagttttgcctcgccg

SEQ ID NO: 87997 - DNA, 75 bp, Artificial Sequence
  Synthetic
ccaccaaggtacactgggggtgttcgctattccagagttttgcctcgccggtgattcagatgtcaaaaactctta

SEQ ID NO: 87998 - DNA, 75 bp, Artificial Sequence
  Synthetic
cagccccacccgtaaattctgtgcggtggattatctgttgggttgcggagtgcttaccgggaatgccttcgtgtt

SEQ ID NO: 87999 - DNA, 75 bp, Artificial Sequence
  Synthetic
gtggattatctgttgggttgcggagtgcttaccgggaatgccttcgtgtttccgcaccaagtcattaacttgcgc

SEQ ID NO: 88000 - DNA, 75 bp, Artificial Sequence
  Synthetic
ttgctcccagagtactcaacattgtaccgccgttggctcgactcattttagtaaccctacctcagtcgaattgga

SEQ ID NO: 88001 - DNA, 75 bp, Artificial Sequence
  Synthetic
tgggggattgcaatcattcctctgtccaagttagactttgcaccagatgcctcagtagagctaccaataacggtc

SEQ ID NO: 88002 - DNA, 75 bp, Artificial Sequence
  Synthetic
ccaagttagactttgcaccagatgcctcagtagagctaccaataacggtcactattgcaccgatgtgttgggagt

SEQ ID NO: 88003 - DNA, 75 bp, Artificial Sequence
  Synthetic
acttgaccgctgacaatttccaatcaccatgtgctcttccagagtttgatgtaacccaaccaattgacatacctg

SEQ ID NO: 88004 - DNA, 75 bp, Artificial Sequence
  Synthetic
accatgtgctcttccagagtttgatgtaacccaaccaattgacatacctggtgaagttaagaatttaatggaggt

SEQ ID NO: 88005 - DNA, 75 bp, Artificial Sequence
  Synthetic
gcttcaagccaaccccagcgtcagagaagcacctatattgtgtttgtcattgtctccagcgagcgatcccagact

SEQ ID NO: 88006 - DNA, 75 bp, Artificial Sequence
  Synthetic
gaagcacctatattgtgtttgtcattgtctccagcgagcgatcccagactatccttcacaatgttaggggagatt

SEQ ID NO: 88007 - DNA, 75 bp, Artificial Sequence
  Synthetic
aagatacttgtgtcctatgcacccccaggtgctcaacctccaaaaacccgaaaggatgcgatgctgggcacacac

SEQ ID NO: 88008 - DNA, 75 bp, Artificial Sequence
  Synthetic
caggtgctcaacctccaaaaacccgaaaggatgcgatgctgggcacacacttgatatgggatattggactgcaat

SEQ ID NO: 88009 - DNA, 75 bp, Artificial Sequence
  Synthetic
gaggttatatcagcatgttctatcaaacaaaaatagttgtccccgcatcgactccgacaacaatggacataatag

SEQ ID NO: 88010 - DNA, 75 bp, Artificial Sequence
  Synthetic
aacaaaaatagttgtccccgcatcgactccgacaacaatggacataataggttttgtgtcagcgtgtaatgactt

SEQ ID NO: 88011 - DNA, 75 bp, Artificial Sequence
  Synthetic
acaggttgcatcaaatgctttgcaaatctcacaaccaacacgaccggcattactctcaagtgagagcctcccaaa

SEQ ID NO: 88012 - DNA, 75 bp, Artificial Sequence
  Synthetic
atctcacaaccaacacgaccggcattactctcaagtgagagcctcccaaatacgcaacaatcagcaccagtacat

SEQ ID NO: 88013 - DNA, 75 bp, Artificial Sequence
  Synthetic
tacccaccccagaggcccacgtggcggctagcactccggtattacggtacccttgtgcgcctgttttatactccc

SEQ ID NO: 88014 - DNA, 75 bp, Artificial Sequence
  Synthetic
accaggcatgtgatacaaaccaggtcacggtctgagtcgacggtggagtccttctttgcacgtggagcatgtgtc

SEQ ID NO: 88015 - DNA, 75 bp, Artificial Sequence
  Synthetic
cacggtctgagtcgacggtggagtccttctttgcacgtggagcatgtgtcacaatcatgacagtagaaaacttca

SEQ ID NO: 88016 - DNA, 75 bp, Artificial Sequence
  Synthetic
ggagaaagctagaaatgttcacatattcaagatttgacattgagttcacgtttgtcactactgagagatactaca

SEQ ID NO: 88017 - DNA, 75 bp, Artificial Sequence
  Synthetic
ttcaagatttgacattgagttcacgtttgtcactactgagagatactacactagtaattcagggcacgccagaaa

SEQ ID NO: 88018 - DNA, 75 bp, Artificial Sequence
  Synthetic
atcctccaatccatcagtcttctatacctatggtgatgcacccgcccgcatttcaatcccttttgtggggattgc

SEQ ID NO: 88019 - DNA, 75 bp, Artificial Sequence
  Synthetic
acctatggtgatgcacccgcccgcatttcaatcccttttgtggggattgccaatgcctactctcatttttatgat

SEQ ID NO: 88020 - DNA, 75 bp, Artificial Sequence
  Synthetic
ttgggtgtccgtgtttcctgttatttttatcatggctgcttatggtgacaatcagagattgttatcataaagcga

SEQ ID NO: 88021 - DNA, 75 bp, Artificial Sequence
  Synthetic
gatttcggaatgcttgctgttagagtagttaatgaatttaacccagctagaattacttcaaaagtgagggtatac

SEQ ID NO: 88022 - DNA, 75 bp, Artificial Sequence
  Synthetic
tagttaatgaatttaacccagctagaattacttcaaaagtgagggtatacatgaaacccaaacacgtgagggtgt

SEQ ID NO: 88023 - DNA, 75 bp, Artificial Sequence
  Synthetic
caaccaagaatctcacaacatatggttttgggcaccaaaacaaagctgtctacacggctggatacaagatctgta

SEQ ID NO: 88024 - DNA, 75 bp, Artificial Sequence
  Synthetic
ttttgggcaccaaaacaaagctgtctacacggctggatacaagatctgtaactaccacttggctactcaagagga

SEQ ID NO: 88025 - DNA, 75 bp, Artificial Sequence
  Synthetic
catcgccaggtgtaactgcagcacaggcgtttattattgtgaatctagaagaaagtattacccagtctcctttgt

SEQ ID NO: 88026 - DNA, 75 bp, Artificial Sequence
  Synthetic
ggcgtttattattgtgaatctagaagaaagtattacccagtctcctttgttggccccacctttcagtacatggag

SEQ ID NO: 88027 - DNA, 75 bp, Artificial Sequence
  Synthetic
ggagggattctcaggtgtcaacatggagttataggcatagtcactgcaggaggagaaggccttgttgctttttca

SEQ ID NO: 88028 - DNA, 75 bp, Artificial Sequence
  Synthetic
gagttataggcatagtcactgcaggaggagaaggccttgttgctttttcagatattagagacctctatgcttatg

SEQ ID NO: 88029 - DNA, 75 bp, Artificial Sequence
  Synthetic
ggagtggagtgctggtagggaatgcatttgtttatccacatcaaataataaacctgcgcactaacaactgtgcta

SEQ ID NO: 88030 - DNA, 75 bp, Artificial Sequence
  Synthetic
aacaaattggtgataaaatttcagagttgactagcatggtcaccagcacaatcactgagaagttgcttaaaaatt

SEQ ID NO: 88031 - DNA, 75 bp, Artificial Sequence
  Synthetic
gttgactagcatggtcaccagcacaatcactgagaagttgcttaaaaatttgattaaaatcatttcatccctggt

SEQ ID NO: 88032 - DNA, 75 bp, Artificial Sequence
  Synthetic
atggcaatggttgaagaagaaagcatgtgacatcttggaagttccatacgtcattcgccagggagacagttggct

SEQ ID NO: 88033 - DNA, 75 bp, Artificial Sequence
  Synthetic
tgtgacatcttggaagttccatacgtcattcgccagggagacagttggctcaaaaaattcacggaagcgtgcaat

SEQ ID NO: 88034 - DNA, 75 bp, Artificial Sequence
  Synthetic
caagcgagagacaaacttgagtttgtgactaaactcaaacaattggaaatgttggagaaccaaatttctacaatt

SEQ ID NO: 88035 - DNA, 75 bp, Artificial Sequence
  Synthetic
caccagtcttgtccaagtcaagagcatcaggaaatactcttcaacaacgtcaggtggttatccatccagtccaag

SEQ ID NO: 88036 - DNA, 75 bp, Artificial Sequence
  Synthetic
ttcaagagcaaacaccgtattgaaccagtatgtctgttagtgcatggtagcccaggaaccggcaaatcagtcgcc

SEQ ID NO: 88037 - DNA, 75 bp, Artificial Sequence
  Synthetic
tttgatggatataaacaacaaggagtggtgatcatggatgatttaaatcagaacccggatggtgctgatatgaag

SEQ ID NO: 88038 - DNA, 75 bp, Artificial Sequence
  Synthetic
tggtgatcatggatgatttaaatcagaacccggatggtgctgatatgaagttgttctgtcaaatggtttctacag

SEQ ID NO: 88039 - DNA, 75 bp, Artificial Sequence
  Synthetic
ctaactccagtagaatcactccacccactgtggcccacagtgatgccctagccagaagatttgcattcgacatgg

SEQ ID NO: 88040 - DNA, 75 bp, Artificial Sequence
  Synthetic
cactgtggcccacagtgatgccctagccagaagatttgcattcgacatggatatacaggtcatgggtgagtactc

SEQ ID NO: 88041 - DNA, 75 bp, Artificial Sequence
  Synthetic
gtgttgcccactagtgtgtggcaaggcgatccagttgatggacaagtcatccagagtaaggtacagtattgacca

SEQ ID NO: 88042 - DNA, 75 bp, Artificial Sequence
  Synthetic
gcgatccagttgatggacaagtcatccagagtaaggtacagtattgaccaaattaccacaatgataatcaatgag

SEQ ID NO: 88043 - DNA, 75 bp, Artificial Sequence
  Synthetic
atagacatcaagaccactccacccccagaatgtataagtgacttgctgcaggctgttgactcccaggaggttagg

SEQ ID NO: 88044 - DNA, 75 bp, Artificial Sequence
  Synthetic
cagaatgtataagtgacttgctgcaggctgttgactcccaggaggttagggactattgtgaaaagaaaggttggt

SEQ ID NO: 88045 - DNA, 75 bp, Artificial Sequence
  Synthetic
cttttgctgcggtagctggggcagtatatgtcatgtataaactcttcgcgggccaccaaggtgcgtacaccgggt

SEQ ID NO: 88046 - DNA, 75 bp, Artificial Sequence
  Synthetic
atatgtcatgtataaactcttcgcgggccaccaaggtgcgtacaccgggttaccaaacaagaagccccacgtacc

SEQ ID NO: 88047 - DNA, 75 bp, Artificial Sequence
  Synthetic
tgccaccaccaccaaaggagaattcacaatgcttggtgtgcatgacaatgtcgctgtgctgcccacacacgcctc

SEQ ID NO: 88048 - DNA, 75 bp, Artificial Sequence
  Synthetic
acaatgcttggtgtgcatgacaatgtcgctgtgctgcccacacacgcctcaccaggggaaacaattgttattgat

SEQ ID NO: 88049 - DNA, 75 bp, Artificial Sequence
  Synthetic
actctcaaaagaaatgagaagttcagagacattagaccccatattcccactcaaatcaccgagacaaatgacggg

SEQ ID NO: 88050 - DNA, 75 bp, Artificial Sequence
  Synthetic
gagacattagaccccatattcccactcaaatcaccgagacaaatgacggggttttgatcgtgaacactagtaagt

SEQ ID NO: 88051 - DNA, 75 bp, Artificial Sequence
  Synthetic
gaaccttaatgtataacttcccgacccgagccggtcaatgtggtggtattatcacatgcactggtaaggtgatcg

SEQ ID NO: 88052 - DNA, 75 bp, Artificial Sequence
  Synthetic
ccgagccggtcaatgtggtggtattatcacatgcactggtaaggtgatcggaatgcatgttggagggaatggttc

SEQ ID NO: 88053 - DNA, 75 bp, Artificial Sequence
  Synthetic
aagggaggttggatacccagtgatcaacgcaccgagcaagacaaaacttgaacccagtgccttccattatatctt

SEQ ID NO: 88054 - DNA, 75 bp, Artificial Sequence
  Synthetic
aacgcaccgagcaagacaaaacttgaacccagtgccttccattatatctttgaaggtgtgaaagaacctgcagta

SEQ ID NO: 88055 - DNA, 75 bp, Artificial Sequence
  Synthetic
actgaggtggacgagtacatgaaggaagcagtggatcattacgctggccagcttatgtccttagatattaacaca

SEQ ID NO: 88056 - DNA, 75 bp, Artificial Sequence
  Synthetic
aagcagtggatcattacgctggccagcttatgtccttagatattaacacagagcaaatgtgcttagaggatgcca

SEQ ID NO: 88057 - DNA, 75 bp, Artificial Sequence
  Synthetic
agaagagggatattctcaataaacaaactagggacaccaaagagatgcaaagactgttagatacatatggaataa

SEQ ID NO: 88058 - DNA, 75 bp, Artificial Sequence
  Synthetic
aactagggacaccaaagagatgcaaagactgttagatacatatggaataaaccttcccctggtcacttatgtcaa

SEQ ID NO: 88059 - DNA, 75 bp, Artificial Sequence
  Synthetic
agtggcaatgagaatggcctttggtaacctgtatgccgccttccataaaaacccaggggttatcactggttcagc

SEQ ID NO: 88060 - DNA, 75 bp, Artificial Sequence
  Synthetic
aacctgtatgccgccttccataaaaacccaggggttatcactggttcagctgtagggtgtgacccagatttattt

SEQ ID NO: 88061 - DNA, 75 bp, Artificial Sequence
  Synthetic
cccgcatggtttgaagcactcaaaatggtcttggagaaaattggatttggagacagagtggattatattgattat

SEQ ID NO: 88062 - DNA, 75 bp, Artificial Sequence
  Synthetic
agaataagacctattgtgtcaagggtggcatgccatctggctgctcaggcacctcaatatttaattctatgatca

SEQ ID NO: 88063 - DNA, 75 bp, Artificial Sequence
  Synthetic
tacccaggatcatgttcgctcactgtgcctattggcttggcacaacggcgaagaggaatataataaatttttagc

SEQ ID NO: 88064 - DNA, 75 bp, Artificial Sequence
  Synthetic
tatttaactaatcaatcaaaaacagtacgaagataaaacaacaatactgcaatgggtgcccaggtttcatcacag

SEQ ID NO: 88065 - DNA, 75 bp, Artificial Sequence
  Synthetic
tctttgcttttgactacacaggttatgatgcatcactcagcccggcctggtttgaggcactcaaaatggtgctag

SEQ ID NO: 88066 - DNA, 75 bp, Artificial Sequence
  Synthetic
ccggattacaccacccacggtggctcacagtgatgcgttggccaggagattcgcatttgacatggacatacaagt

SEQ ID NO: 88067 - DNA, 75 bp, Artificial Sequence
  Synthetic
ggaatgaaaagttcagagacatcagaccacacattcccactcaaatcaccgagacaaatgatggagttttgatcg

SEQ ID NO: 88068 - DNA, 75 bp, Artificial Sequence
  Synthetic
gagtgtgccaattggaagagctttattgctcccagagtactctacattgtaccgccgttggctcgactcttttta

SEQ ID NO: 88069 - DNA, 75 bp, Artificial Sequence
  Synthetic
tttttaaaacagcctgggggttgtttccccctccgaggtcccctggacgcccgtaccccggcatcacggtgccct

SEQ ID NO: 88070 - DNA, 75 bp, Artificial Sequence
  Synthetic
cctttgacttaagtgccacaaaaaagaacaccatggaaatgtatagggttcggttaagtgacaaaccacatacag

SEQ ID NO: 88071 - DNA, 75 bp, Artificial Sequence
  Synthetic
cccccgcaactttagaagaaaacgaactccgagctcagtaggcgtcacgtttccagcgtgactacgagcaagcac

SEQ ID NO: 88072 - DNA, 75 bp, Artificial Sequence
  Synthetic
cgtgtcggagcctgcgttggcggcctacccgcgcctcacggcgtgggacgctcatttcatgacatggtgcgaaga

SEQ ID NO: 88073 - DNA, 75 bp, Artificial Sequence
  Synthetic
cagtgcccagcaggtcgtaatgcgcaagtcggtggcggaaccaactactttgggtgtccgtgtttcctttatttc

SEQ ID NO: 88074 - DNA, 75 bp, Artificial Sequence
  Synthetic
accccagaggcccacgtggcggccagtacaccggtatcacggtacccttgtacgcctgttttatactcccttccc

SEQ ID NO: 88075 - DNA, 75 bp, Artificial Sequence
  Synthetic
agagtgtggagtgggaagaggggtcccgtggatggtggtggaaattacccgatgcatgctttaaagacatgggga

SEQ ID NO: 88076 - DNA, 75 bp, Artificial Sequence
  Synthetic
aagtctgtggcggaaccgactactttgggtgtccgtgtttccttttattttcatattggctgcttatggtgacaa

SEQ ID NO: 88077 - DNA, 75 bp, Artificial Sequence
  Synthetic
ttggattggccatccggtgaaaatcaggtcgattatctaccttttgttggatttacatccttgacatcgcacact

SEQ ID NO: 88078 - DNA, 75 bp, Artificial Sequence
  Synthetic
ggggtcatggcaggcaatataaccatctacccccaccagatcatcaatttgcggacaaacaactgtgcgacgctg

SEQ ID NO: 88079 - DNA, 75 bp, Artificial Sequence
  Synthetic
ccaccaggtgctaaacccccaaccacaaggaaagatgccatgcttggaacccatttaatatgggacatcggcctt

SEQ ID NO: 88080 - DNA, 75 bp, Artificial Sequence
  Synthetic
catcgacagtatgaccaaacacaataactggggaattgcaatcttaccgctttcaaaacttgactttgccccaga

SEQ ID NO: 88081 - DNA, 75 bp, Artificial Sequence
  Synthetic
aattgcagaaattgacaccatgattccactcgatctctcaacagcaaagaagaacacaatggacatgtacagggt

SEQ ID NO: 88082 - DNA, 75 bp, Artificial Sequence
  Synthetic
ggtaaaatattggtttcgtatgcaccgccaggggcgcaacctccaaaaacccgaaaagatgcaatgcttggaaca

SEQ ID NO: 88083 - DNA, 75 bp, Artificial Sequence
  Synthetic
acaacacacatatcacaaacagccatgccgcagggcatcgaagacttgatacaacaagtagctactaacgctctt

SEQ ID NO: 88084 - DNA, 75 bp, Artificial Sequence
  Synthetic
cactcacaagaggtgcctgccctgacagcagtggaaacaggggctacaaaccctttggaaccgtcagacacagtg

SEQ ID NO: 88085 - DNA, 75 bp, Artificial Sequence
  Synthetic
tgcttattacggagcaacatcaataaatgactttggtatgcttgctattagagtggtaaacgaattcaacccagc

SEQ ID NO: 88086 - DNA, 75 bp, Artificial Sequence
  Synthetic
cagaatcacctccaaggtcagagtttacatgaaacccaaacatgtgagagtttggtgccctaggccaccgagagt

SEQ ID NO: 88087 - DNA, 75 bp, Artificial Sequence
  Synthetic
tcatggctttgcttcacctggagattgcggcggcatcctcagatgccagcatggggtaattggaatcattacagc

SEQ ID NO: 88088 - DNA, 75 bp, Artificial Sequence
  Synthetic
catttccaattacatcgagtcccttggagctgcatttgggaatggattcacccagcaaattggagacaaaatatc

SEQ ID NO: 88089 - DNA, 75 bp, Artificial Sequence
  Synthetic
acattatgcggcaaggtgacggctggcttaagaaattcacagaggcatgtaacgctgctaaagggctagagtggg

SEQ ID NO: 88090 - DNA, 75 bp, Artificial Sequence
  Synthetic
tccagttgttgcccacttgtttgcggcaaggccatccagtttgtggacaaggcaacacgcaccaggtacacagta

SEQ ID NO: 88091 - DNA, 75 bp, Artificial Sequence
  Synthetic
ccaaaattgacataaagacagccccaccaccacctgcaatagctgacctattacgatctgtcgacagtgatcagg

SEQ ID NO: 88092 - DNA, 75 bp, Artificial Sequence
  Synthetic
aaagctatccaattgatggacaagtcatccagggtcagatacagcattgaccaaattaccaccatgatcatcaac

SEQ ID NO: 88093 - DNA, 75 bp, Artificial Sequence
  Synthetic
tcaacctaccactggtcacctatgtaaaagatgagcttagatccagaactaaggtggaacagggcaagtccagat

SEQ ID NO: 88094 - DNA, 75 bp, Artificial Sequence
  Synthetic
agaacccaggtgtagtgacaggatcagctgttgggtgtgatccagacttgttttggagcaagataccagtgttaa

SEQ ID NO: 88095 - DNA, 75 bp, Artificial Sequence
  Synthetic
aaatggtactagaaaagattggctttggagacagagtagactacattgactatctaaatcactcccaccatcttt

SEQ ID NO: 88096 - DNA, 75 bp, Artificial Sequence
  Synthetic
tggagacagagtagactacattgactatctaaatcactcccaccatctttacaaaaacaaaacatactgtgttaa

SEQ ID NO: 88097 - DNA, 75 bp, Artificial Sequence
  Synthetic
atgccaatgaaagaaattcatgaatcaatcagatggacaaaagatcctagaaatactcaggatcatgttcgctca

SEQ ID NO: 88098 - DNA, 75 bp, Artificial Sequence
  Synthetic
ggctaaaatcagaagcgtgccaatcggaagagcgttactgctccctgagtactctacattgtaccgccgttggct

SEQ ID NO: 88099 - DNA, 75 bp, Artificial Sequence
  Synthetic
aagcgcgccagcagattgttttcggtttggaaaataacttacaaagacactgttcaactgaggcgcaaactggaa

SEQ ID NO: 88100 - DNA, 75 bp, Artificial Sequence
  Synthetic
tgggtgtccgtgtttccttttaattttattattggctgcttatggtgacaatcatagattgttatcataaagcga

SEQ ID NO: 88101 - DNA, 75 bp, Artificial Sequence
  Synthetic
ctccagatataatttatatagttcttttaatcaggagatcttatcattataacaatgggagcacaggtatcatca

SEQ ID NO: 88102 - DNA, 75 bp, Artificial Sequence
  Synthetic
tttaatcaggagatcttatcattataacaatgggagcacaggtatcatcacagaaagtgggtgcacatgaaaaca

SEQ ID NO: 88103 - DNA, 75 bp, Artificial Sequence
  Synthetic
gtgacctttataggacccacgtttcagtacatggaggctaatgattactacccagctaggtaccaatcccacatg

SEQ ID NO: 88104 - DNA, 75 bp, Artificial Sequence
  Synthetic
agtacatggaggctaatgattactacccagctaggtaccaatcccacatgctcattggccatggttttgcatcac

SEQ ID NO: 88105 - DNA, 75 bp, Artificial Sequence
  Synthetic
cttccaagcaggacttttctcaagacccttctaaattcaccgagccggttaaggacataatgttgaaatcagctc

SEQ ID NO: 88106 - DNA, 75 bp, Artificial Sequence
  Synthetic
cccttctaaattcaccgagccggttaaggacataatgttgaaatcagctccagccttgaattcaccgaacgtgga

SEQ ID NO: 88107 - DNA, 75 bp, Artificial Sequence
  Synthetic
ttgctttttcagacattagggatctatatgcatatgaagaagaagctatggagcaaggcatttccaactacattg

SEQ ID NO: 88108 - DNA, 75 bp, Artificial Sequence
  Synthetic
atatgcatatgaagaagaagctatggagcaaggcatttccaactacattgagtctcttggagtcgcctttggaag

SEQ ID NO: 88109 - DNA, 75 bp, Artificial Sequence
  Synthetic
cgctgtggttgcttatggtaggtggccctcatacttgaaaccaactgaggccaacccagtagatgctcccactga

SEQ ID NO: 88110 - DNA, 75 bp, Artificial Sequence
  Synthetic
ccctcatacttgaaaccaactgaggccaacccagtagatgctcccactgagccagatgttagttcaaacaggttc

SEQ ID NO: 88111 - DNA, 75 bp, Artificial Sequence
  Synthetic
gttgaaaaacctaatcaaaataatctcatcacttgtgatcattactagaaattatgaggacactaccacagtact

SEQ ID NO: 88112 - DNA, 75 bp, Artificial Sequence
  Synthetic
tcatcacttgtgatcattactagaaattatgaggacactaccacagtactagccaccttggcactccttggatgt

SEQ ID NO: 88113 - DNA, 75 bp, Artificial Sequence
  Synthetic
atgggcctgttcgggcaaaacatgttctaccattatttaggtaggagtggatatacaatccacgtgcaatgcaat

SEQ ID NO: 88114 - DNA, 75 bp, Artificial Sequence
  Synthetic
tctaccattatttaggtaggagtggatatacaatccacgtgcaatgcaatgcatcaaaatttcaccaaggggccc

SEQ ID NO: 88115 - DNA, 75 bp, Artificial Sequence
  Synthetic
gatagctggttaaagaagtttacagaagcttgcaacgctgccaagggtctggagtgggtctctaacaaaatatct

SEQ ID NO: 88116 - DNA, 75 bp, Artificial Sequence
  Synthetic
aagcttgcaacgctgccaagggtctggagtgggtctctaacaaaatatctaagtttattgattggttgaaagaga

SEQ ID NO: 88117 - DNA, 75 bp, Artificial Sequence
  Synthetic
acgcaaaccctggagaggccggtggcacattcaccagcagttacaacccgagcaccgatgctgatgcaggaagat

SEQ ID NO: 88118 - DNA, 75 bp, Artificial Sequence
  Synthetic
cacattcaccagcagttacaacccgagcaccgatgctgatgcaggaagatcatttgcagctgttgattatttatt

SEQ ID NO: 88119 - DNA, 75 bp, Artificial Sequence
  Synthetic
ttgccaccatccaccaatcatgtcccagtcaggaacaccaagaaattttgttcaacaatgtcagatggttgtcaa

SEQ ID NO: 88120 - DNA, 75 bp, Artificial Sequence
  Synthetic
cagtcaggaacaccaagaaattttgttcaacaatgtcagatggttgtcaatacaatcaaaaagatttgccccgct

SEQ ID NO: 88121 - DNA, 75 bp, Artificial Sequence
  Synthetic
cactattgtcctaccatatgtcaattcattggccattgattgtatggctaaacacaataactggggcctagtaat

SEQ ID NO: 88122 - DNA, 75 bp, Artificial Sequence
  Synthetic
tcattggccattgattgtatggctaaacacaataactggggcctagtaattttacctttagagccattagcttat

SEQ ID NO: 88123 - DNA, 75 bp, Artificial Sequence
  Synthetic
ccgtattgaaccagtatgtctgttagtccacggcagcccaggaacaggtaaatcagtggccaccaatttgattgc

SEQ ID NO: 88124 - DNA, 75 bp, Artificial Sequence
  Synthetic
gtccacggcagcccaggaacaggtaaatcagtggccaccaatttgattgctagggcgattgcagaaaaggagaac

SEQ ID NO: 88125 - DNA, 75 bp, Artificial Sequence
  Synthetic
aacatcacagttccggcaacacaaggattgccagtattggtcacaccaggttcaagccagtatcttacttccgat

SEQ ID NO: 88126 - DNA, 75 bp, Artificial Sequence
  Synthetic
gattgccagtattggtcacaccaggttcaagccagtatcttacttccgatgatttccagtcaccatgtgcattac

SEQ ID NO: 88127 - DNA, 75 bp, Artificial Sequence
  Synthetic
gatttgaaccagaatccagatggggccgacatgaaattattctgtcagatggtttctacagtggagtttatacca

SEQ ID NO: 88128 - DNA, 75 bp, Artificial Sequence
  Synthetic
ccgacatgaaattattctgtcagatggtttctacagtggagtttataccaccaatggcttcattagaagagaagg

SEQ ID NO: 88129 - DNA, 75 bp, Artificial Sequence
  Synthetic
cattgataccaatgaacagtatttcaggcaaggcaaacaccatggacatgtacagaattccgctgaatactgatg

SEQ ID NO: 88130 - DNA, 75 bp, Artificial Sequence
  Synthetic
aggcaaggcaaacaccatggacatgtacagaattccgctgaatactgatggtgacaaaaaaccaatattctgctt

SEQ ID NO: 88131 - DNA, 75 bp, Artificial Sequence
  Synthetic
gtgacgccctagccaggcgctttgcatttgacatggacattcaggttatgggtgagtattccagggatggtaagt

SEQ ID NO: 88132 - DNA, 75 bp, Artificial Sequence
  Synthetic
atttgacatggacattcaggttatgggtgagtattccagggatggtaagttgaatatggcaatggcaacagaaat

SEQ ID NO: 88133 - DNA, 75 bp, Artificial Sequence
  Synthetic
gaccggatcactcagattcacattcctgttttgtggcagtatgatggcaactggaaagctgatcctgacatactc

SEQ ID NO: 88134 - DNA, 75 bp, Artificial Sequence
  Synthetic
ctggaaagctgatcctgacatactcaccaccaggagcatcccctccaaagaacagaaaagatgcaatgcttggca

SEQ ID NO: 88135 - DNA, 75 bp, Artificial Sequence
  Synthetic
ggataagtcttctagagttaggtacagtatagatcaaatcactacaatgattattaatgagaagaacaggagatc

SEQ ID NO: 88136 - DNA, 75 bp, Artificial Sequence
  Synthetic
agtatagatcaaatcactacaatgattattaatgagaagaacaggagatcaaacataggtaattgcatggaagca

SEQ ID NO: 88137 - DNA, 75 bp, Artificial Sequence
  Synthetic
agaagggggttacataacatgcttttatcaaactcgcattgtagtcccagcaagcacaccaaccagtatggccat

SEQ ID NO: 88138 - DNA, 75 bp, Artificial Sequence
  Synthetic
gacctgttacaatcagtggactcccaagaagtgagagattactgtgagaggaaaggctggattgtgaacattacc

SEQ ID NO: 88139 - DNA, 75 bp, Artificial Sequence
  Synthetic
aagaagtgagagattactgtgagaggaaaggctggattgtgaacattaccagccaggtccagactgaaagaaaca

SEQ ID NO: 88140 - DNA, 75 bp, Artificial Sequence
  Synthetic
tctaatagctcagactcagggcattgaagacataattgacaaggtggttaataatgcactacagctctcacaacc

SEQ ID NO: 88141 - DNA, 75 bp, Artificial Sequence
  Synthetic
gaagacataattgacaaggtggttaataatgcactacagctctcacaacctacacacccacccactgcatcggac

SEQ ID NO: 88142 - DNA, 75 bp, Artificial Sequence
  Synthetic
aactctttgcaggacaccagggtgcctatacaggtctccccaataagagacccaatgtgcctacgattaggaccg

SEQ ID NO: 88143 - DNA, 75 bp, Artificial Sequence
  Synthetic
ctatacaggtctccccaataagagacccaatgtgcctacgattaggaccgctaaggttcaaggcccaggctttga

SEQ ID NO: 88144 - DNA, 75 bp, Artificial Sequence
  Synthetic
gcagtaccatcagatgttatggaaaccagacatgtcgtcaattacaagacaagatctgagagcaccctagaatcc

SEQ ID NO: 88145 - DNA, 75 bp, Artificial Sequence
  Synthetic
ccagacatgtcgtcaattacaagacaagatctgagagcaccctagaatccttctttggtaggtcagcatgtgtca

SEQ ID NO: 88146 - DNA, 75 bp, Artificial Sequence
  Synthetic
gcatgataatgtagccattttaccaacacatgcctcaccaggggagacaatagttattgatggtaaagaagtgga

SEQ ID NO: 88147 - DNA, 75 bp, Artificial Sequence
  Synthetic
tagttattgatggtaaagaagtggaggtactagatgccaaagcactagaagaccaggctggaaccaatttggaga

SEQ ID NO: 88148 - DNA, 75 bp, Artificial Sequence
  Synthetic
cgtacaccaatacggtccagctgaggagaaaactagaatttttcacttattccagatttgatttggagatgactt

SEQ ID NO: 88149 - DNA, 75 bp, Artificial Sequence
  Synthetic
gagaaaactagaatttttcacttattccagatttgatttggagatgacttttgttgtgacggaaagatactacac

SEQ ID NO: 88150 - DNA, 75 bp, Artificial Sequence
  Synthetic
cactagtaagtaccccaacatgtatgtcccagtcggtgctgtgactgaacagggatatctcaatctcggtggccg

SEQ ID NO: 88151 - DNA, 75 bp, Artificial Sequence
  Synthetic
gtcccagtcggtgctgtgactgaacagggatatctcaatctcggtggccgtcaaactgctcgtacactaatgtac

SEQ ID NO: 88152 - DNA, 75 bp, Artificial Sequence
  Synthetic
atgggatgactacacttggcaatcatcgtctaacccctcaatcttctacacatatggaagtgcaccagcacgcat

SEQ ID NO: 88153 - DNA, 75 bp, Artificial Sequence
  Synthetic
tcgtctaacccctcaatcttctacacatatggaagtgcaccagcacgcatttcgattccgtatgtgggcattgcc

SEQ ID NO: 88154 - DNA, 75 bp, Artificial Sequence
  Synthetic
gggaacggttcacatgggttcgcagcggccctgaaacggtcttacttcactcagagtcaaggtgagatccaatgg

SEQ ID NO: 88155 - DNA, 75 bp, Artificial Sequence
  Synthetic
tattacggtttggtttcaatcaatgactttgggaccctggcaattagagtagtgaatgagtttaatcccgctcgc

SEQ ID NO: 88156 - DNA, 75 bp, Artificial Sequence
  Synthetic
actttgggaccctggcaattagagtagtgaatgagtttaatcccgctcgcataacagcgaaagtgcgagtgtaca

SEQ ID NO: 88157 - DNA, 75 bp, Artificial Sequence
  Synthetic
cactacatatttgagggagtgaaggaaccagcagtcctgaccaaaaacgaccctaggctcaaagtggattttgaa

SEQ ID NO: 88158 - DNA, 75 bp, Artificial Sequence
  Synthetic
aaccagcagtcctgaccaaaaacgaccctaggctcaaagtggattttgaagaggcgatcttctccaagtacgtag

SEQ ID NO: 88159 - DNA, 75 bp, Artificial Sequence
  Synthetic
tgaaacaagggactgtggcaccactgaccccagtgaccagtataaccacatatgggtttggacaccaaaatggcg

SEQ ID NO: 88160 - DNA, 75 bp, Artificial Sequence
  Synthetic
gaccccagtgaccagtataaccacatatgggtttggacaccaaaatggcgcagtctatgttgccgggtacaaaat

SEQ ID NO: 88161 - DNA, 75 bp, Artificial Sequence
  Synthetic
acataaacaccgaccagatgtgtctggaggatgccatgtatggcaccgatggcttggaagccttggacctcacaa

SEQ ID NO: 88162 - DNA, 75 bp, Artificial Sequence
  Synthetic
ggaggatgccatgtatggcaccgatggcttggaagccttggacctcacaaccagcgcaggatacccttacgtggc

SEQ ID NO: 88163 - DNA, 75 bp, Artificial Sequence
  Synthetic
ggtggaatccaaagctcaaggagttgaccaaatcgccaggtgtacatgcactactggtatatactactgttcatc

SEQ ID NO: 88164 - DNA, 75 bp, Artificial Sequence
  Synthetic
gaccaaatcgccaggtgtacatgcactactggtatatactactgttcatcgcggaacaagcactaccccatcact

SEQ ID NO: 88165 - DNA, 75 bp, Artificial Sequence
  Synthetic
ctatggtattaacctacccttagtcacttatgtgaaggatgaattaagatccaaaaccaaagtcgaacaaggcaa

SEQ ID NO: 88166 - DNA, 75 bp, Artificial Sequence
  Synthetic
acttatgtgaaggatgaattaagatccaaaaccaaagtcgaacaaggcaaatcaagacttattgaagcatctagt

SEQ ID NO: 88167 - DNA, 75 bp, Artificial Sequence
  Synthetic
ggtcatggttttgctgaaccaggggactgtggtggtgtccttagatgtcaacatggagtaatggggctcatcact

SEQ ID NO: 88168 - DNA, 75 bp, Artificial Sequence
  Synthetic
actgtggtggtgtccttagatgtcaacatggagtaatggggctcatcactgctggtggcaacggaatagtcgcct

SEQ ID NO: 88169 - DNA, 75 bp, Artificial Sequence
  Synthetic
actggtagtgcagtgggttgtgatccagatctgttttggagcaaaattccagttctcatggaggaaaagctgttt

SEQ ID NO: 88170 - DNA, 75 bp, Artificial Sequence
  Synthetic
gagcagcatttgggtgtggattcaccaatcagataagcgagaaggtcacagaaattgcctcaatggtcaatagtg

SEQ ID NO: 88171 - DNA, 75 bp, Artificial Sequence
  Synthetic
caatcagataagcgagaaggtcacagaaattgcctcaatggtcaatagtgttgtcacagagaagttactgaagaa

SEQ ID NO: 88172 - DNA, 75 bp, Artificial Sequence
  Synthetic
attggctttggtgatagagtggactacattgactacctcaaccactctcaccatttatataaaaacaagacatac

SEQ ID NO: 88173 - DNA, 75 bp, Artificial Sequence
  Synthetic
agctcttctggggtgcgatgtgtcaccatggtcttggcttagaaagaaagcatgcgacatcttggagctacccta

SEQ ID NO: 88174 - DNA, 75 bp, Artificial Sequence
  Synthetic
ccatggtcttggcttagaaagaaagcatgcgacatcttggagctaccctacgtgtgtaaacagggagattcctgg

SEQ ID NO: 88175 - DNA, 75 bp, Artificial Sequence
  Synthetic
gattggctcaagaataaaataatacctgaagctagagacaaggtagaatacgtcaccaaattgaaacaattgacc

SEQ ID NO: 88176 - DNA, 75 bp, Artificial Sequence
  Synthetic
gatcccagaaatacacaggatcacgttcgctccttgtgcttattggcttggcataatggagaagaagaatacaac

SEQ ID NO: 88177 - DNA, 75 bp, Artificial Sequence
  Synthetic
cagaacccggacggagaggacatgaagctcttttgccagatggtttccacagtagaattcattcccccaatggca

SEQ ID NO: 88178 - DNA, 75 bp, Artificial Sequence
  Synthetic
agctcttttgccagatggtttccacagtagaattcattcccccaatggcatcactagaggaaaaagggatcttat

SEQ ID NO: 88179 - DNA, 75 bp, Artificial Sequence
  Synthetic
tgagtaggagatttgctttcgatatggatgtgtataccatgtccgagcactctattaaaggaaaactaaacatgg

SEQ ID NO: 88180 - DNA, 75 bp, Artificial Sequence
  Synthetic
ggatgtgtataccatgtccgagcactctattaaaggaaaactaaacatggcaactgccactgtgctgtgcaagga

SEQ ID NO: 88181 - DNA, 75 bp, Artificial Sequence
  Synthetic
taactgcatggaagcactgttccagggaccgatacaatacaaagatttgaagatagatattaaaaccacccctcc

SEQ ID NO: 88182 - DNA, 75 bp, Artificial Sequence
  Synthetic
gatagtgaatgtcaacaatgaggtccagttagaacgcaacttgaacagggccatgacaattttacaggcaataac

SEQ ID NO: 88183 - DNA, 75 bp, Artificial Sequence
  Synthetic
gtttatgtgatgtaccgcttatttgcaggccaacaaggaccatacacagggttgcccaatagaaaaccaaacgtt

SEQ ID NO: 88184 - DNA, 75 bp, Artificial Sequence
  Synthetic
atgggaaggaggtcaagatcattgatgcacaggcgctagtggaccaagcaggtacaaatttggaaataaccatca

SEQ ID NO: 88185 - DNA, 75 bp, Artificial Sequence
  Synthetic
gagttttgatcgtgaacactagtaagtaccccaacatgtatgtcccagtcggtgctgtgaccgagcagggatacc

SEQ ID NO: 88186 - DNA, 75 bp, Artificial Sequence
  Synthetic
gtaccccaacatgtatgtcccagtcggtgctgtgaccgagcagggatacctcaatcttggtggacgccagactgc

SEQ ID NO: 88187 - DNA, 75 bp, Artificial Sequence
  Synthetic
ggtgctgtgaccgagcagggatacctcaatcttggtggacgccagactgcccgtactctaatgtacaactttcca

SEQ ID NO: 88188 - DNA, 75 bp, Artificial Sequence
  Synthetic
aggtgagattcaatggatgagaccatccaaagaggtaggataccccattatcaacgccccctccaagaccaaact

SEQ ID NO: 88189 - DNA, 75 bp, Artificial Sequence
  Synthetic
tccaaagaggtaggataccccattatcaacgccccctccaagaccaaacttgaacccagtgcttttcattacatt

SEQ ID NO: 88190 - DNA, 75 bp, Artificial Sequence
  Synthetic
cagctcatgtcattggacattaatacagaacaaatgtgccttgaagatgcaatgtatggcactgatggtctcgag

SEQ ID NO: 88191 - DNA, 75 bp, Artificial Sequence
  Synthetic
cccggagcagaggcccccaagagtcgcaaagaagcaatgcttgggacacatgtaatatgggacattgggttgcag

SEQ ID NO: 88192 - DNA, 75 bp, Artificial Sequence
  Synthetic
tttggagcaaaattccagtactaatggaagagaagctttttgcttttgattatactggctatgacgcttcactta

SEQ ID NO: 88193 - DNA, 75 bp, Artificial Sequence
  Synthetic
ttactgaaaacctacaagggcatagatttggaccacctaaagatgattgcctatggtgatgatgtaattgcttcc

SEQ ID NO: 88194 - DNA, 75 bp, Artificial Sequence
  Synthetic
aaatcagcaacatttgaaaaagtcacatgggagaatgtaacattcttgaagagattcttcagagcagatgagaag

SEQ ID NO: 88195 - DNA, 75 bp, Artificial Sequence
  Synthetic
tatccatttctggtacatccagtaatgccaatgaaagaaattcacgaatcgatcagatggaccaaggatcccaga

SEQ ID NO: 88196 - DNA, 75 bp, Artificial Sequence
  Synthetic
tgaggaagaatataataactttttggctaaaatcagaagtgtgccaatcggaagagctttactgctcccagagta

SEQ ID NO: 88197 - DNA, 75 bp, Artificial Sequence
  Synthetic
aggacactcttactgaaaacctacaagggcatagatttagatcacctaaagatgattgcctatggtgatgatgta

SEQ ID NO: 88198 - DNA, 75 bp, Artificial Sequence
  Synthetic
acctgtggcccaaagccacaggacgctagatgtgaacaaggtgtgaagagcccactgagctacaagagagtcctc

SEQ ID NO: 88199 - DNA, 75 bp, Artificial Sequence
  Synthetic
agtctgtggcggaaccgactactttgggtgaccgtgtttccttttatcttttcaatggctgcttatggtgacaat

SEQ ID NO: 88200 - DNA, 75 bp, Artificial Sequence
  Synthetic
gggtgaccgtgtttccttttatcttttcaatggctgcttatggtgacaatcattgattgttatcataaagcgact

SEQ ID NO: 88201 - DNA, 75 bp, Artificial Sequence
  Synthetic
cctggccttagtgttgttggtgagacgctaccatcaaaatgggtgctcaggtttcttctcagaaagttggtgcac

SEQ ID NO: 88202 - DNA, 75 bp, Artificial Sequence
  Synthetic
cgctaccatcaaaatgggtgctcaggtttcttctcagaaagttggtgcacacgagaactcaaatagggcatatgg

SEQ ID NO: 88203 - DNA, 75 bp, Artificial Sequence
  Synthetic
ctctcaagacccatccaagttcactgaacctataaaagatgtgttaatcaaaacagccccaatgttgaactctcc

SEQ ID NO: 88204 - DNA, 75 bp, Artificial Sequence
  Synthetic
gaacctataaaagatgtgttaatcaaaacagccccaatgttgaactctccaaatattgaagcgtgtggatatagt

SEQ ID NO: 88205 - DNA, 75 bp, Artificial Sequence
  Synthetic
ggacgatggcctgagtacctgagagacagcgaggccaacccagtggaccaaccaacagagccagacgttgccgcg

SEQ ID NO: 88206 - DNA, 75 bp, Artificial Sequence
  Synthetic
acagcgaggccaacccagtggaccaaccaacagagccagacgttgccgcgtgcaggttttacacgctagacaccg

SEQ ID NO: 88207 - DNA, 75 bp, Artificial Sequence
  Synthetic
aaaacatgtattatcattacctaggcaggtctggctataccgtacatgtacagtgcaatgcctccaaatttcacc

SEQ ID NO: 88208 - DNA, 75 bp, Artificial Sequence
  Synthetic
caggtctggctataccgtacatgtacagtgcaatgcctccaaatttcaccagggggcacttggcgtgtttgccgt

SEQ ID NO: 88209 - DNA, 75 bp, Artificial Sequence
  Synthetic
gaaaggaggtaccttcacaggcacattcacacccgacaacaaccaaacatcacccgcccgtaggttctgccctgt

SEQ ID NO: 88210 - DNA, 75 bp, Artificial Sequence
  Synthetic
ttcacacccgacaacaaccaaacatcacccgcccgtaggttctgccctgtggattacctcttcggaaacggaact

SEQ ID NO: 88211 - DNA, 75 bp, Artificial Sequence
  Synthetic
ccgtatgtgaactccctctccatagacagtatggttaagcacaacaactgggggattgcgattgtacctctagcc

SEQ ID NO: 88212 - DNA, 75 bp, Artificial Sequence
  Synthetic
acagtatggttaagcacaacaactgggggattgcgattgtacctctagccccactaaactttgctaacgaatcat

SEQ ID NO: 88213 - DNA, 75 bp, Artificial Sequence
  Synthetic
cacgactgcaaggattgcctgtcatgaacacccctggtagtaaccaatacctcactgctgataacttccagtcgc

SEQ ID NO: 88214 - DNA, 75 bp, Artificial Sequence
  Synthetic
gaacacccctggtagtaaccaatacctcactgctgataacttccagtcgccgtgtgcattgcctgagtttgacgt

SEQ ID NO: 88215 - DNA, 75 bp, Artificial Sequence
  Synthetic
tgacttgagcgccacaaagaaaaacactatggaaatgtacagagtccagttaagtgataaaccacacacagatga

SEQ ID NO: 88216 - DNA, 75 bp, Artificial Sequence
  Synthetic
actatggaaatgtacagagtccagttaagtgataaaccacacacagatgacccaatactctgtctatcgttgtcc

SEQ ID NO: 88217 - DNA, 75 bp, Artificial Sequence
  Synthetic
ttgaagtttactttcctattctgtggttccatgatggcgactggcaaactgttggtctcatacgcaccccccgga

SEQ ID NO: 88218 - DNA, 75 bp, Artificial Sequence
  Synthetic
gttccatgatggcgactggcaaactgttggtctcatacgcaccccccggagctgatccacccaagaagcgcaaag

SEQ ID NO: 88219 - DNA, 75 bp, Artificial Sequence
  Synthetic
gtaacacaacgtacagacagaccattgacgacagctttactgagggtggttacattagtgttttctaccagacca

SEQ ID NO: 88220 - DNA, 75 bp, Artificial Sequence
  Synthetic
tgacgacagctttactgagggtggttacattagtgttttctaccagaccagaatagtggtccccctttcaacacc

SEQ ID NO: 88221 - DNA, 75 bp, Artificial Sequence
  Synthetic
catagaacagaaagcattgtcacagggactaggccaaatgttggagaacatgatagacaacacagtccgcgagac

SEQ ID NO: 88222 - DNA, 75 bp, Artificial Sequence
  Synthetic
ggactaggccaaatgttggagaacatgatagacaacacagtccgcgagaccatgagagcgtcgacctcaagggat

SEQ ID NO: 88223 - DNA, 75 bp, Artificial Sequence
  Synthetic
gccacgaatccactagttccttcagatacagtacaaactagacatgtcatccaacataggtcaaggtcagagtct

SEQ ID NO: 88224 - DNA, 75 bp, Artificial Sequence
  Synthetic
atacagtacaaactagacatgtcatccaacataggtcaaggtcagagtctagtattgagtccttcttcgcacgtg

SEQ ID NO: 88225 - DNA, 75 bp, Artificial Sequence
  Synthetic
agatcacatataaagatactgtgcagttaaggagaaaattggagtttttcacttactccagatttgacatggaat

SEQ ID NO: 88226 - DNA, 75 bp, Artificial Sequence
  Synthetic
gttaaggagaaaattggagtttttcacttactccagatttgacatggaattcacttttgtgatcaccgccaactt

SEQ ID NO: 88227 - DNA, 75 bp, Artificial Sequence
  Synthetic
tgagaagtgggacgactacacgtggcaaacgtcatcaaacccatcgattttctacacctacggcacagcaccagc

SEQ ID NO: 88228 - DNA, 75 bp, Artificial Sequence
  Synthetic
caaacgtcatcaaacccatcgattttctacacctacggcacagcaccagctcgaatttcagttccatatgttggt

SEQ ID NO: 88229 - DNA, 75 bp, Artificial Sequence
  Synthetic
gactcactctacggtgcagcgtctctgaacgactttggcattttggcagtgagggtggttaacgaccacaaccca

SEQ ID NO: 88230 - DNA, 75 bp, Artificial Sequence
  Synthetic
tgaacgactttggcattttggcagtgagggtggttaacgaccacaacccaaccatagtcacttctaaggttagag

SEQ ID NO: 88231 - DNA, 75 bp, Artificial Sequence
  Synthetic
tagactataaagatggcactcttgcccccttatccacaaaggatttgacaacatacgggtttggacatcaaaaca

SEQ ID NO: 88232 - DNA, 75 bp, Artificial Sequence
  Synthetic
ggggttctggcagggaatgcgtttgtgtaccctcatcagattattaatcttaggacaaacaattcggcaaccctt

SEQ ID NO: 88233 - DNA, 75 bp, Artificial Sequence
  Synthetic
ccccttatccacaaaggatttgacaacatacgggtttggacatcaaaacaaagcagtgtatacggctggatacaa

SEQ ID NO: 88234 - DNA, 75 bp, Artificial Sequence
  Synthetic
tgttgtggagtccaaagcgcagggtattgactcaattgccagatgttcttgcagtgccggcgtgtactattgtga

SEQ ID NO: 88235 - DNA, 75 bp, Artificial Sequence
  Synthetic
attgactcaattgccagatgttcttgcagtgccggcgtgtactattgtgagtccagaagaaagtactacccagtc

SEQ ID NO: 88236 - DNA, 75 bp, Artificial Sequence
  Synthetic
aatccccctgtgccctccccaactttgatgtgaccccaccaatacacataccaggagaggtgtttaacatgatgg

SEQ ID NO: 88237 - DNA, 75 bp, Artificial Sequence
  Synthetic
attggtcatgggtttgcatctcctggagattgtggggggattctcagatgccatcatggagtcataggtataatc

SEQ ID NO: 88238 - DNA, 75 bp, Artificial Sequence
  Synthetic
gagattgtggggggattctcagatgccatcatggagtcataggtataatcacagcaggtggtgagggccttgttg

SEQ ID NO: 88239 - DNA, 75 bp, Artificial Sequence
  Synthetic
ccctaggagccgctttcggcagtggttttacccaacagattggggacaagatctcagaattgactagcatggtga

SEQ ID NO: 88240 - DNA, 75 bp, Artificial Sequence
  Synthetic
ttttacccaacagattggggacaagatctcagaattgactagcatggtgacgagtaccatcacagaaaagttgct

SEQ ID NO: 88241 - DNA, 75 bp, Artificial Sequence
  Synthetic
cactttagcactcttgggttgtgatgtatccccgtggcagtggttaaagaagaaggcttgtgacatactagaaat

SEQ ID NO: 88242 - DNA, 75 bp, Artificial Sequence
  Synthetic
gtatccccgtggcagtggttaaagaagaaggcttgtgacatactagaaatcccgtgtgtcatgcgtcagggtgac

SEQ ID NO: 88243 - DNA, 75 bp, Artificial Sequence
  Synthetic
ttcattgattggctgaaagagaaaatcattcctcaagccagggacaagttggaatttgttaccaaattaaaacaa

SEQ ID NO: 88244 - DNA, 75 bp, Artificial Sequence
  Synthetic
tcattcctcaagccagggacaagttggaatttgttaccaaattaaaacaactggagatgctggaaaatcagattg

SEQ ID NO: 88245 - DNA, 75 bp, Artificial Sequence
  Synthetic
aatcaaaaagatttgctccgctttatgcattagaggcgaagagaatccaaaagttggaacatacaattaacaact

SEQ ID NO: 88246 - DNA, 75 bp, Artificial Sequence
  Synthetic
tgcattagaggcgaagagaatccaaaagttggaacatacaattaacaactacatacagttcaagagcaaacaccg

SEQ ID NO: 88247 - DNA, 75 bp, Artificial Sequence
  Synthetic
ggcaattgcagaaaaagaaaatacttctacttactcattaccgccagacccctcccactttgatggttataagca

SEQ ID NO: 88248 - DNA, 75 bp, Artificial Sequence
  Synthetic
tctacttactcattaccgccagacccctcccactttgatggttataagcagcaaggggtggtaatcatggatgac

SEQ ID NO: 88249 - DNA, 75 bp, Artificial Sequence
  Synthetic
atggcttcattggaggagaaaggcattctgttcacgtcaaattacgtcttggcatccaccaactccagccgcatt

SEQ ID NO: 88250 - DNA, 75 bp, Artificial Sequence
  Synthetic
ttctgttcacgtcaaattacgtcttggcatccaccaactccagccgcattacaccacccaccgttgcacatagtg

SEQ ID NO: 88251 - DNA, 75 bp, Artificial Sequence
  Synthetic
acatggcaatggcaacggaaatgtgtaagaattgtcatcaaccagcgaattttaagaaatgctgccctctagtgt

SEQ ID NO: 88252 - DNA, 75 bp, Artificial Sequence
  Synthetic
taagaattgtcatcaaccagcgaattttaagaaatgctgccctctagtgtgtgggaaagccatccaactgatgga

SEQ ID NO: 88253 - DNA, 75 bp, Artificial Sequence
  Synthetic
tattggcaactgcatggaagcactatttcaaggtccccttcaatacaaggatctcaaaatagacatcaagaccgc

SEQ ID NO: 88254 - DNA, 75 bp, Artificial Sequence
  Synthetic
aagtccgcgattactgcgagaaaaaggggtggattgtcaacatcaccagccaggttcaaactgagagaaacatca

SEQ ID NO: 88255 - DNA, 75 bp, Artificial Sequence
  Synthetic
ctgaagaccacagcaatgccgtggatgtgctatggaacagagacctcataattgtcagcagcagagcacagggaa

SEQ ID NO: 88256 - DNA, 75 bp, Artificial Sequence
  Synthetic
tttttgccgggcaccaaggagcttacactggtctcccaaacaaaaagcccaacgtgcccactattcggactgcta

SEQ ID NO: 88257 - DNA, 75 bp, Artificial Sequence
  Synthetic
cactggtctcccaaacaaaaagcccaacgtgcccactattcggactgctaaagttcagggaccaggctttgatta

SEQ ID NO: 88258 - DNA, 75 bp, Artificial Sequence
  Synthetic
cgacaatgtggcgatcctaccaactcatgcatcaccaggagagtgcgttgtgatcgacggtaaggaagtggagat

SEQ ID NO: 88259 - DNA, 75 bp, Artificial Sequence
  Synthetic
tgatcgacggtaaggaagtggagatcttagatgccaaagctctggaagatcaggctgggactaacttggagatca

SEQ ID NO: 88260 - DNA, 75 bp, Artificial Sequence
  Synthetic
atgatggggtactgatcgtgaacactagtaagtaccctaacatgtacgtccctgttggtgctgtgactgagcagg

SEQ ID NO: 88261 - DNA, 75 bp, Artificial Sequence
  Synthetic
tttccaactagagcaggccagtgtggcggtgtcatcacctgcacaggcaaggtcatcgggatgcatgttggtggg

SEQ ID NO: 88262 - DNA, 75 bp, Artificial Sequence
  Synthetic
caaattagaacctagtgcttttcactatgtttttgagggagttaaggaaccagcagttctaactaagaatgatcc

SEQ ID NO: 88263 - DNA, 75 bp, Artificial Sequence
  Synthetic
gcaggacaattaatgtcacttgacatcaacacagatcaaatgtgtctggaggatgctatgtacggaactgatggt

SEQ ID NO: 88264 - DNA, 75 bp, Artificial Sequence
  Synthetic
gcagttgaggctaaaagaatttctaaattggaaaacaccattaacaactacatccagttcaagagcaaacaccgt

SEQ ID NO: 88265 - DNA, 75 bp, Artificial Sequence
  Synthetic
aacaagcaaaccagggacactaaagaaatgcagaggcttctggatacctatggtatcaacttacccttagtcacc

SEQ ID NO: 88266 - DNA, 75 bp, Artificial Sequence
  Synthetic
aaatgcagaggcttctggatacctatggtatcaacttacccttagtcacctatgtaaaggatgagctcaggtcta

SEQ ID NO: 88267 - DNA, 75 bp, Artificial Sequence
  Synthetic
ccttcgggaacttgtacgcaaccttccacaaaaaccctggtgtggtgacgggatcagctgtcggatgtgatccag

SEQ ID NO: 88268 - DNA, 75 bp, Artificial Sequence
  Synthetic
ccacaaaaaccctggtgtggtgacgggatcagctgtcggatgtgatccagatttgttttggagcaaaataccagt

SEQ ID NO: 88269 - DNA, 75 bp, Artificial Sequence
  Synthetic
tgctttaaacagaaggtttgctttcgacatggaagtttatactatgtctgagcactccgttaaaggaaagttaaa

SEQ ID NO: 88270 - DNA, 75 bp, Artificial Sequence
  Synthetic
tctcaaaatggtgttggagaaaatcggatttggagatagggtagattacattgactacctgaaccactcacacca

SEQ ID NO: 88271 - DNA, 75 bp, Artificial Sequence
  Synthetic
ctagtctcctagcccaatcaggaaaagactatggactaaccatgactccagctgataagtcagctacatttgaaa

SEQ ID NO: 88272 - DNA, 75 bp, Artificial Sequence
  Synthetic
ttcttcaatcagtggacagccaagagctcagggactactgcgagaaaaagggatggatcgtcaagcttaataacg

SEQ ID NO: 88273 - DNA, 75 bp, Artificial Sequence
  Synthetic
atgaaggaagccgtcgatcactatgcaggccaactcatgtctctggatatcaacacagaacaaatgtgtcttgaa

SEQ ID NO: 88274 - DNA, 75 bp, Artificial Sequence
  Synthetic
agtcatgccaatgaaagaaattcatgaatcaattagatggaccaaggatcctaggaacacccaggatcatgttcg

SEQ ID NO: 88275 - DNA, 75 bp, Artificial Sequence
  Synthetic
gagtattcgacattgtatcgccgttggctcgactctttttagtaaccctacctcatcgaattggattgggtcata

SEQ ID NO: 88276 - DNA, 75 bp, Artificial Sequence
  Synthetic
gctcattggccacggattcgcatctccaggggattgtggtggcatactcaggtgtcaccacggggtgatagggat

SEQ ID NO: 88277 - DNA, 75 bp, Artificial Sequence
  Synthetic
atccgttatccgctcttgtacttcgagaagcctagtactaccttggaatcttcgatgcgttgcgctcagcactca

SEQ ID NO: 88278 - DNA, 75 bp, Artificial Sequence
  Synthetic
ttgggtgtccgtgtttccttttattcttacattggctgcttatggtgacaatcatagattgttatcataaagcga

SEQ ID NO: 88279 - DNA, 75 bp, Artificial Sequence
  Synthetic
tcgccaccggtggatcaaccgtaaactacacaacaatcaattattacaaagattcggccagcaacgcggcctcta

SEQ ID NO: 88280 - DNA, 75 bp, Artificial Sequence
  Synthetic
ctacacaacaatcaattattacaaagattcggccagcaacgcggcctctaaacaaaacttctcccaagacccatc

SEQ ID NO: 88281 - DNA, 75 bp, Artificial Sequence
  Synthetic
ccgtagaccagcctactgagccagatgtgtcagcttgtagattttacactcttgaaaccgtggagtggagcaagg

SEQ ID NO: 88282 - DNA, 75 bp, Artificial Sequence
  Synthetic
gtataatttcaatagttatttcaaacagacaattgtaccacaatgggtgctcaggtttcatcacagaaagtgggt

SEQ ID NO: 88283 - DNA, 75 bp, Artificial Sequence
  Synthetic
actacttgggaagatcaggttacacggtgcacgttcagtgcaacgcttcaaaatttcatcagggcacgttggggg

SEQ ID NO: 88284 - DNA, 75 bp, Artificial Sequence
  Synthetic
ggtgcacgttcagtgcaacgcttcaaaatttcatcagggcacgttgggggtgttcgctgtaccagagtactgcct

SEQ ID NO: 88285 - DNA, 75 bp, Artificial Sequence
  Synthetic
tgtctcaacgttcacaccggatactagtgccgcaccaaagagggagttccaaccagtggactacttgttcgggtg

SEQ ID NO: 88286 - DNA, 75 bp, Artificial Sequence
  Synthetic
aaccagtggactacttgttcgggtgtggtgtgctagctggaaacgcctttgtctttccgcatcaaataataaact

SEQ ID NO: 88287 - DNA, 75 bp, Artificial Sequence
  Synthetic
accaggtgaagtgaaaaacatgatggagttggcagagatagacacaatgatccctatggatttgagtgacgggaa

SEQ ID NO: 88288 - DNA, 75 bp, Artificial Sequence
  Synthetic
gagttggcagagatagacacaatgatccctatggatttgagtgacgggaagaagaatacaatggaaatgtataga

SEQ ID NO: 88289 - DNA, 75 bp, Artificial Sequence
  Synthetic
caacacccacctcaatggatattctgtgttttgtgtctgcatgcaatgacttcacagtgagattgctcagggata

SEQ ID NO: 88290 - DNA, 75 bp, Artificial Sequence
  Synthetic
aactgtcccaacctaccagaccagctcttccaccagcagaacaaagtgtaccgaataccacgcaatcctccccag

SEQ ID NO: 88291 - DNA, 75 bp, Artificial Sequence
  Synthetic
tcttccaccagcagaacaaagtgtaccgaataccacgcaatcctccccagaacactccaaggaggtgccagctct

SEQ ID NO: 88292 - DNA, 75 bp, Artificial Sequence
  Synthetic
tttacatactccaggtttgacatcgagtttacttttgttgtgacggagcggtacttttcatctaactctggtcat

SEQ ID NO: 88293 - DNA, 75 bp, Artificial Sequence
  Synthetic
tggcaaacttcctcgaacccatctatcttctatacctatggcacagcaccacctagaatttcaattccttacatc

SEQ ID NO: 88294 - DNA, 75 bp, Artificial Sequence
  Synthetic
tcttctatacctatggcacagcaccacctagaatttcaattccttacatcggtatcgccaatgcttactcccact

SEQ ID NO: 88295 - DNA, 75 bp, Artificial Sequence
  Synthetic
ccatcaatgactttggtcttcttgcagttcgagtggtcaatgaacacaatcctgtcagagtgtcatcgaagatta

SEQ ID NO: 88296 - DNA, 75 bp, Artificial Sequence
  Synthetic
tagggtgtggtgtccacgcccaccacgtgccgtggaatactacggacctggggtggactacaaggcagacacatt

SEQ ID NO: 88297 - DNA, 75 bp, Artificial Sequence
  Synthetic
ctatgtcgaggatgaggcaatggagcaaggaatcacttcgtacatcgagtcccttggcgctgctttcggtagtgg

SEQ ID NO: 88298 - DNA, 75 bp, Artificial Sequence
  Synthetic
caaaaacctcatcaaactagtgagcagtctggtgataattgtcagaaattatgaggacactactaccgtgctagc

SEQ ID NO: 88299 - DNA, 75 bp, Artificial Sequence
  Synthetic
accaccacgaacaagcacttctgtttccccggtgataccatatagactgtacccacggtcaaaaatggtggatcc

SEQ ID NO: 88300 - DNA, 75 bp, Artificial Sequence
  Synthetic
agtctggtgataattgtcagaaattatgaggacactactaccgtgctagccacgctggccttattggggtgtgat

SEQ ID NO: 88301 - DNA, 75 bp, Artificial Sequence
  Synthetic
tcatggatgaagaaattcacagaagcttgcaatgctgccaaagggctagagtggatcagtaataagatttctaaa

SEQ ID NO: 88302 - DNA, 75 bp, Artificial Sequence
  Synthetic
ttgggtatgttagaaaaccaaataaacacaatacaccagtcatgtcccagccaggaacagcaggaaattcttttc

SEQ ID NO: 88303 - DNA, 75 bp, Artificial Sequence
  Synthetic
tccgtggcggaaccgactactttgggtgtccgtgtttccttttattttatgtatggctgcttatggtgacaatca

SEQ ID NO: 88304 - DNA, 75 bp, Artificial Sequence
  Synthetic
ttgtccctttaattcatcacactcttcatctaatttacattgtggttctaattagacagcagtatcacaatggga

SEQ ID NO: 88305 - DNA, 75 bp, Artificial Sequence
  Synthetic
tcatctaatttacattgtggttctaattagacagcagtatcacaatgggagcccaagtttcttcacagaaagtcg

SEQ ID NO: 88306 - DNA, 75 bp, Artificial Sequence
  Synthetic
acatacagttcaagagcaaacaccgtattgaaccagtatgtgttttgatacatggtagtccaggcaccggtaagt

SEQ ID NO: 88307 - DNA, 75 bp, Artificial Sequence
  Synthetic
gtgccagcaatgctgcgtctaagcaggattttagccaagatccttccaaattcacagaaccggtgaaagacatca

SEQ ID NO: 88308 - DNA, 75 bp, Artificial Sequence
  Synthetic
cagcacactttgatgggtacaaacaacaaggtgtggtaatcatggatgacctaaaccaaaacccagacggtcttg

SEQ ID NO: 88309 - DNA, 75 bp, Artificial Sequence
  Synthetic
ggattttagccaagatccttccaaattcacagaaccggtgaaagacatcatgctaaaatctgctccagcattaaa

SEQ ID NO: 88310 - DNA, 75 bp, Artificial Sequence
  Synthetic
acaaggtgtggtaatcatggatgacctaaaccaaaacccagacggtcttgacatgaaactattttgtcagatggt

SEQ ID NO: 88311 - DNA, 75 bp, Artificial Sequence
  Synthetic
ccaggaagccgctaatgctgtagttgcctacggtgagtggccatcatacatctctccacaagaagctaatccagt

SEQ ID NO: 88312 - DNA, 75 bp, Artificial Sequence
  Synthetic
tgcctccaccaactccagtaccatcacaccacccactgtagctcatagtgacgccctaagtcgaagattcgcctt

SEQ ID NO: 88313 - DNA, 75 bp, Artificial Sequence
  Synthetic
gcctacggtgagtggccatcatacatctctccacaagaagctaatccagtagacgcaccaacagagcctgatgtg

SEQ ID NO: 88314 - DNA, 75 bp, Artificial Sequence
  Synthetic
acaccacccactgtagctcatagtgacgccctaagtcgaagattcgccttcgatatggagatatgccccatgtca

SEQ ID NO: 88315 - DNA, 75 bp, Artificial Sequence
  Synthetic
gactgtctcaaagatatgggactgtttggtcagaatatgttctaccattacttgggcaggtcgggttacactgta

SEQ ID NO: 88316 - DNA, 75 bp, Artificial Sequence
  Synthetic
ttcaaaaagtgctgtccactcgtgtgtggtaaagcaattcaactgatggacaagtacactagacagagatttagt

SEQ ID NO: 88317 - DNA, 75 bp, Artificial Sequence
  Synthetic
ttggtcagaatatgttctaccattacttgggcaggtcgggttacactgtacatgtccaatgtaacgcatccaaat

SEQ ID NO: 88318 - DNA, 75 bp, Artificial Sequence
  Synthetic
gtggtaaagcaattcaactgatggacaagtacactagacagagatttagtgtggatgagttgactactctagtta

SEQ ID NO: 88319 - DNA, 75 bp, Artificial Sequence
  Synthetic
acaccagctatgttaatgctaaccccggagaaactggtgggactttcaaagcgcaatacacacccggtactgata

SEQ ID NO: 88320 - DNA, 75 bp, Artificial Sequence
  Synthetic
atttgaaaatagacattaagactagcccaccccctgaatgcatcaatgacttgcttcaatcggtagattcacagg

SEQ ID NO: 88321 - DNA, 75 bp, Artificial Sequence
  Synthetic
cggagaaactggtgggactttcaaagcgcaatacacacccggtactgatattgaggatgcaagacaattcagtcc

SEQ ID NO: 88322 - DNA, 75 bp, Artificial Sequence
  Synthetic
cccaccccctgaatgcatcaatgacttgcttcaatcggtagattcacaggaagtcagggattattgtgaaaagaa

SEQ ID NO: 88323 - DNA, 75 bp, Artificial Sequence
  Synthetic
gacaaacaacagcgccacactggtcttgccttatgtcaactcactgtccatcgattgcatggccaggcacaacaa

SEQ ID NO: 88324 - DNA, 75 bp, Artificial Sequence
  Synthetic
cctgacaacatttgcagctgtagcaggcgtggtatatgtcatgtacagactgtttgctggtcaacaaggagcata

SEQ ID NO: 88325 - DNA, 75 bp, Artificial Sequence
  Synthetic
ttgccttatgtcaactcactgtccatcgattgcatggccaggcacaacaactgggggatagtcatcatcccggtg

SEQ ID NO: 88326 - DNA, 75 bp, Artificial Sequence
  Synthetic
ggcgtggtatatgtcatgtacagactgtttgctggtcaacaaggagcatacactggcttgcccaacaagaaacct

SEQ ID NO: 88327 - DNA, 75 bp, Artificial Sequence
  Synthetic
tttaacggactacggaacataaccataccagctacacaaggcttgccaaccatgttagtgcccggttcaaatcaa

SEQ ID NO: 88328 - DNA, 75 bp, Artificial Sequence
  Synthetic
atcctcacagccaccaccagcaagggagaattcaccatgctcggggtttatgacaatgtggctatcctacccaca

SEQ ID NO: 88329 - DNA, 75 bp, Artificial Sequence
  Synthetic
taccagctacacaaggcttgccaaccatgttagtgcccggttcaaatcaattcttaacctctgacaatttccagt

SEQ ID NO: 88330 - DNA, 75 bp, Artificial Sequence
  Synthetic
gagaattcaccatgctcggggtttatgacaatgtggctatcctacccacacactcacacccaggagacaccatag

SEQ ID NO: 88331 - DNA, 75 bp, Artificial Sequence
  Synthetic
tagcagaagtggattcactaattccaatgaatgcagtgtcaggaaaagcaaacacaatggagatgtacaggatcg

SEQ ID NO: 88332 - DNA, 75 bp, Artificial Sequence
  Synthetic
ccattgtcactctaaagagaaatgaaaagttcagagacatcaggccacatatcccaacacaaatcactgagacga

SEQ ID NO: 88333 - DNA, 75 bp, Artificial Sequence
  Synthetic
aatgaatgcagtgtcaggaaaagcaaacacaatggagatgtacaggatcggattagacagtaacgcatctaatcc

SEQ ID NO: 88334 - DNA, 75 bp, Artificial Sequence
  Synthetic
tagtaagtaccctaacatgtatgtcccagttggtgctgtaactgaacagggatatctcaatcttggtggtcgcca

SEQ ID NO: 88335 - DNA, 75 bp, Artificial Sequence
  Synthetic
gttgaactactacactcattggacaggatctattaggttcacgttcttgttctgtggcagtatgatggccactgg

SEQ ID NO: 88336 - DNA, 75 bp, Artificial Sequence
  Synthetic
ggatctattaggttcacgttcttgttctgtggcagtatgatggccactggtaagctactgctcagctatagcccc

SEQ ID NO: 88337 - DNA, 75 bp, Artificial Sequence
  Synthetic
tcaagtgctacaatggtcgctccatggatgtcaaactgtgtatatcgtaggtgtgttaaagacgactacaccgcc

SEQ ID NO: 88338 - DNA, 75 bp, Artificial Sequence
  Synthetic
ggatgtcaaactgtgtatatcgtaggtgtgttaaagacgactacaccgccggtggttatatcacatgtttctacc

SEQ ID NO: 88339 - DNA, 75 bp, Artificial Sequence
  Synthetic
caagttagagcctagtgcattccactatgtgtttgagggagtgaaagagccagccgtactcaccaaaaatgatcc

SEQ ID NO: 88340 - DNA, 75 bp, Artificial Sequence
  Synthetic
tatgtgtttgagggagtgaaagagccagccgtactcaccaaaaatgatcctaggttgaagacagacttcgagaca

SEQ ID NO: 88341 - DNA, 75 bp, Artificial Sequence
  Synthetic
tctcggtgcgactcctgagagacaccacgcacatcagccagtccactcccatattgccacaaggtttggaggacc

SEQ ID NO: 88342 - DNA, 75 bp, Artificial Sequence
  Synthetic
cacgcacatcagccagtccactcccatattgccacaaggtttggaggacctgattgagtcagtggcccagaatgc

SEQ ID NO: 88343 - DNA, 75 bp, Artificial Sequence
  Synthetic
gctggacaactcatgtccctggatattaacacagagcaaatgtgtttagaggatgcaatgtacggtaccgatggt

SEQ ID NO: 88344 - DNA, 75 bp, Artificial Sequence
  Synthetic
ttaacacagagcaaatgtgtttagaggatgcaatgtacggtaccgatggtctcgaagctctagatctcagcacca

SEQ ID NO: 88345 - DNA, 75 bp, Artificial Sequence
  Synthetic
tggagtgaactcccaggaggtacctgcgctgaccgcagttgaaacaggcgccagtggacaagcagtccctgcaga

SEQ ID NO: 88346 - DNA, 75 bp, Artificial Sequence
  Synthetic
gcgctgaccgcagttgaaacaggcgccagtggacaagcagtccctgcagatgttatagaaactaggaaggtgatc

SEQ ID NO: 88347 - DNA, 75 bp, Artificial Sequence
  Synthetic
aaatgcagagactgttggacatctatggcatcaatctacctttagtcacttatgttaaagatgaacttaggtcca

SEQ ID NO: 88348 - DNA, 75 bp, Artificial Sequence
  Synthetic
tggcatcaatctacctttagtcacttatgttaaagatgaacttaggtccaaaaccaaagtggaacaaggcaaatc

SEQ ID NO: 88349 - DNA, 75 bp, Artificial Sequence
  Synthetic
gagaatttcaacgccactgaaatggcagataagaagaaattgttcagtgtgtgggagattaactacacggacact

SEQ ID NO: 88350 - DNA, 75 bp, Artificial Sequence
  Synthetic
cagataagaagaaattgttcagtgtgtgggagattaactacacggacactgtccaactcaggcggaagctagaaa

SEQ ID NO: 88351 - DNA, 75 bp, Artificial Sequence
  Synthetic
ccacaagaatccaggtgttgtaacaggatcagccgtagggtgtgacccggatttattatggagcaagataccagt

SEQ ID NO: 88352 - DNA, 75 bp, Artificial Sequence
  Synthetic
ccacaagaatccaggtgttgtaacaggatcagccgtagggtgtgacccggatttattttggagcaagataccagt

SEQ ID NO: 88353 - DNA, 75 bp, Artificial Sequence
  Synthetic
ccacaagaatccaggtgttgtaacaggatcagccgtagggtgtgacccggatttattctggagcaagataccagt

SEQ ID NO: 88354 - DNA, 75 bp, Artificial Sequence
  Synthetic
ccacaagaatccaggtgttgtaacaggatcagccgtagggtgtgacccggatttattgtggagcaagataccagt

SEQ ID NO: 88355 - DNA, 75 bp, Artificial Sequence
  Synthetic
ggatcagccgtagggtgtgacccggatttattatggagcaagataccagtgttgatggaagagaaactatttgca

SEQ ID NO: 88356 - DNA, 75 bp, Artificial Sequence
  Synthetic
ggatcagccgtagggtgtgacccggatttattttggagcaagataccagtgttgatggaagagaaactatttgca

SEQ ID NO: 88357 - DNA, 75 bp, Artificial Sequence
  Synthetic
ggatcagccgtagggtgtgacccggatttattctggagcaagataccagtgttgatggaagagaaactatttgca

SEQ ID NO: 88358 - DNA, 75 bp, Artificial Sequence
  Synthetic
ggatcagccgtagggtgtgacccggatttattgtggagcaagataccagtgttgatggaagagaaactatttgca

SEQ ID NO: 88359 - DNA, 75 bp, Artificial Sequence
  Synthetic
acgcccgcaaccaggtttatcaaatcatgtatatacctccaggggcaccaagacccaacgcatgggatgactaca

SEQ ID NO: 88360 - DNA, 75 bp, Artificial Sequence
  Synthetic
ggatttggggatagagtagattacattgactacttaaatcactcacaccatctatacaaaaataagacatactgt

SEQ ID NO: 88361 - DNA, 75 bp, Artificial Sequence
  Synthetic
ttggaatcgctaatgcttatagccatttctacgacgggtttgcacgagtgcccattaaaggtgagacaaccgaca

SEQ ID NO: 88362 - DNA, 75 bp, Artificial Sequence
  Synthetic
acccggcgcgaattacatcacgcatgagagtgtacatgaaacccaaacacatcagagtatggtgcccaagaccac

SEQ ID NO: 88363 - DNA, 75 bp, Artificial Sequence
  Synthetic
gagagtgtacatgaaacccaaacacatcagagtatggtgcccaagaccaccacgcgcagtgccatacaatggtac

SEQ ID NO: 88364 - DNA, 75 bp, Artificial Sequence
  Synthetic
ccaaagtaaagctgtctacgttgctgggtacaaaatctgcaattatcaccttgcaactccagaggaccacaacag

SEQ ID NO: 88365 - DNA, 75 bp, Artificial Sequence
  Synthetic
gggtacaaaatctgcaattatcaccttgcaactccagaggaccacaacagagcagtgaatgtcatgtggaacagg

SEQ ID NO: 88366 - DNA, 75 bp, Artificial Sequence
  Synthetic
tactgtgaatctaaaagaaaatactacccagtaacagtcacagggcccacattccaatacatggaggcaaatcaa

SEQ ID NO: 88367 - DNA, 75 bp, Artificial Sequence
  Synthetic
ttaaaacagctctggggttgctcccaccccagaggcccacgtggcggctagtaatctggtatcaggtacctttgt

SEQ ID NO: 88368 - DNA, 75 bp, Artificial Sequence
  Synthetic
acccagtaacagtcacagggcccacattccaatacatggaggcaaatcaatacttccctgccaggtatcagacac

SEQ ID NO: 88369 - DNA, 75 bp, Artificial Sequence
  Synthetic
gcattgtcacagccggaggggaaggaattgtagccttcgctgatatcagagacctgtgggtctatgaagaagaag

SEQ ID NO: 88370 - DNA, 75 bp, Artificial Sequence
  Synthetic
aattgtagccttcgctgatatcagagacctgtgggtctatgaagaagaagccatggaacaaggcatctcaagcta

SEQ ID NO: 88371 - DNA, 75 bp, Artificial Sequence
  Synthetic
tatggtcactagctcaattactgagaaactattgaagacacttgtgaaaatcatttccactttagtaatcattag

SEQ ID NO: 88372 - DNA, 75 bp, Artificial Sequence
  Synthetic
aaactattgaagacacttgtgaaaatcatttccactttagtaatcattagcaggaattacgaagacaccatcacg

SEQ ID NO: 88373 - DNA, 75 bp, Artificial Sequence
  Synthetic
tgtgaacaaggtgtgaagagcctattgagctactcaagagtcctccggcccctgaatgcggctaatcctaaccac

SEQ ID NO: 88374 - DNA, 75 bp, Artificial Sequence
  Synthetic
ctcgagatcccttacgtcttgaagcaaggtgacagttggttaaagaaatttaccgaagcttgcaatgcagctaag

SEQ ID NO: 88375 - DNA, 75 bp, Artificial Sequence
  Synthetic
aaggtgacagttggttaaagaaatttaccgaagcttgcaatgcagctaagggtttggagtggatctctaacaaga

SEQ ID NO: 88376 - DNA, 75 bp, Artificial Sequence
  Synthetic
tccgtgtttccctttatattcatactggctgcttatggtgacaatttacgaattgttaccatatagctattggat

SEQ ID NO: 88377 - DNA, 75 bp, Artificial Sequence
  Synthetic
taaagcagctagggatgttagaaaatcagatcaatactatacaccaatcgtgcccgagccaagaacagcaggaag

SEQ ID NO: 88378 - DNA, 75 bp, Artificial Sequence
  Synthetic
accaacatcacatttaaaccacaatagtcagtgcaaatgggggctcaagtttcaacccaaaagaccggtgcacac

SEQ ID NO: 88379 - DNA, 75 bp, Artificial Sequence
  Synthetic
tcagatcaatactatacaccaatcgtgcccgagccaagaacagcaggaagtgctcttcaacaatgtgaggtggct

SEQ ID NO: 88380 - DNA, 75 bp, Artificial Sequence
  Synthetic
taataactacatacagttcaagagcaaacatcgtattgagccagtatgtatgttgatacacggcactccagggac

SEQ ID NO: 88381 - DNA, 75 bp, Artificial Sequence
  Synthetic
aaacatcgtattgagccagtatgtatgttgatacacggcactccagggacaggcaaatcaattgccacatcactg

SEQ ID NO: 88382 - DNA, 75 bp, Artificial Sequence
  Synthetic
cagctaatgctattgttgcttatggtgagtggcccacttacataaatgactcagaagctaatccggtagatgcac

SEQ ID NO: 88383 - DNA, 75 bp, Artificial Sequence
  Synthetic
tataaacagcaaggagttgtcataatggatgacttgaaccaaaaccctgatggaaatgatatgaagttgttctgc

SEQ ID NO: 88384 - DNA, 75 bp, Artificial Sequence
  Synthetic
tggatgacttgaaccaaaaccctgatggaaatgatatgaagttgttctgccaaatggtgtccacagtggagttta

SEQ ID NO: 88385 - DNA, 75 bp, Artificial Sequence
  Synthetic
ccgtttttacaccctggaatcggtgtcttggaagaccacttcaaggggatggtggtggaagctaccagattgtct

SEQ ID NO: 88386 - DNA, 75 bp, Artificial Sequence
  Synthetic
gcactatagctccacccacagtggcccacagtgatgcacttaccagaagatttgccttcgatatggaagtgtaca

SEQ ID NO: 88387 - DNA, 75 bp, Artificial Sequence
  Synthetic
ccacagtgatgcacttaccagaagatttgccttcgatatggaagtgtacacgatgtctgagcattcaatcaaagg

SEQ ID NO: 88388 - DNA, 75 bp, Artificial Sequence
  Synthetic
tttggtgtgtggaaaggctttacaactcatggataaaaacactagacagagattcacactggatgagataactac

SEQ ID NO: 88389 - DNA, 75 bp, Artificial Sequence
  Synthetic
caacccatcaaacactgatgtcagtgagggcagacagttcgcagcactggattatctgctgggttctggtgtcct

SEQ ID NO: 88390 - DNA, 75 bp, Artificial Sequence
  Synthetic
ctcatggataaaaacactagacagagattcacactggatgagataactaccttgattgtgaatgaaaggaacaga

SEQ ID NO: 88391 - DNA, 75 bp, Artificial Sequence
  Synthetic
gagggcagacagttcgcagcactggattatctgctgggttctggtgtcctagcaggaaacgctttcgtatacccg

SEQ ID NO: 88392 - DNA, 75 bp, Artificial Sequence
  Synthetic
aaagaaacccctgctccagagtatataaatgatttgcttcaagcagttgacagccaagaagtgagggactattgt

SEQ ID NO: 88393 - DNA, 75 bp, Artificial Sequence
  Synthetic
taaatgatttgcttcaagcagttgacagccaagaagtgagggactattgtgagaagaaagggtggattattaaga

SEQ ID NO: 88394 - DNA, 75 bp, Artificial Sequence
  Synthetic
cagttgctggggtggtatatgtgatgtacaaattgtttgcaggacagcaaggtgcatacaccggattaccaaaca

SEQ ID NO: 88395 - DNA, 75 bp, Artificial Sequence
  Synthetic
gtacaaattgtttgcaggacagcaaggtgcatacaccggattaccaaacaagaaacccaatgtcccaactattag

SEQ ID NO: 88396 - DNA, 75 bp, Artificial Sequence
  Synthetic
cagtaaaggtgagttcaccatgctcggagtacatgataatgtggctgtgctcccaacgcacgcctcacctggtga

SEQ ID NO: 88397 - DNA, 75 bp, Artificial Sequence
  Synthetic
ggagtacatgataatgtggctgtgctcccaacgcacgcctcacctggtgataccatgttgattgatggcaaagaa

SEQ ID NO: 88398 - DNA, 75 bp, Artificial Sequence
  Synthetic
agaaatgaaaaatttagggacattaggcctcacatccctactcaaatcaccgagacaaatgacggagtactgatc

SEQ ID NO: 88399 - DNA, 75 bp, Artificial Sequence
  Synthetic
ggcctcacatccctactcaaatcaccgagacaaatgacggagtactgatcgtgaacactagtaagtaccccaaca

SEQ ID NO: 88400 - DNA, 75 bp, Artificial Sequence
  Synthetic
tgtacaacttcccaacgcgcgccgggcagtgtggtggtatcatcacttgcaccggtaaggtgatcgggatgcacg

SEQ ID NO: 88401 - DNA, 75 bp, Artificial Sequence
  Synthetic
gcagtgtggtggtatcatcacttgcaccggtaaggtgatcgggatgcacgttggagggaacggttcacatgggtt

SEQ ID NO: 88402 - DNA, 75 bp, Artificial Sequence
  Synthetic
ctgcttagggacacttcccatattagtcaatcaaaactaatagcacgcacacaaggcattgaagacctcattgac

SEQ ID NO: 88403 - DNA, 75 bp, Artificial Sequence
  Synthetic
tgggtatcccattattaatgcacccagcaaaactaaattagagcccagtgcatttcattatgtgtttgaaggggt

SEQ ID NO: 88404 - DNA, 75 bp, Artificial Sequence
  Synthetic
agcaaaactaaattagagcccagtgcatttcattatgtgtttgaaggggttaaggaaccggctgtcctcactaag

SEQ ID NO: 88405 - DNA, 75 bp, Artificial Sequence
  Synthetic
gatgagtacatgaaagaggcagtggaccactatgctggtcaactcatgtcgctagacatcaacacagaacaaatg

SEQ ID NO: 88406 - DNA, 75 bp, Artificial Sequence
  Synthetic
accactatgctggtcaactcatgtcgctagacatcaacacagaacaaatgtgcttggaggatgctatgtatggaa

SEQ ID NO: 88407 - DNA, 75 bp, Artificial Sequence
  Synthetic
ccaagagcggggaggagaagaagcatttcaacatatggaacattacatacaccgacactgttcagttacgcagaa

SEQ ID NO: 88408 - DNA, 75 bp, Artificial Sequence
  Synthetic
atatcctcaataaacaaaccagggacaccaaagaaatgcagaggcttttggatacttatggtataaatttacctc

SEQ ID NO: 88409 - DNA, 75 bp, Artificial Sequence
  Synthetic
caccaaagaaatgcagaggcttttggatacttatggtataaatttacctctagtgacatatgtcaaggatgaact

SEQ ID NO: 88410 - DNA, 75 bp, Artificial Sequence
  Synthetic
ttcacagagaattaccctagtacagccagtggggaagtgcgtaaccaatgtgaccagatcatgtacattccacca

SEQ ID NO: 88411 - DNA, 75 bp, Artificial Sequence
  Synthetic
gagaatggcatttgggaatctgtatgcagcatttcataagaatccaggagtagtgaccggatcagcagtgggttg

SEQ ID NO: 88412 - DNA, 75 bp, Artificial Sequence
  Synthetic
attccagtactgatggaggagaagctctttgcatttgattacactggatatgatgcatcactgagtccagcatgg

SEQ ID NO: 88413 - DNA, 75 bp, Artificial Sequence
  Synthetic
ctattcacacttctatgatggctttgcacgggtgccacttgagggtgagaataccgatgctggtgacacgtttta

SEQ ID NO: 88414 - DNA, 75 bp, Artificial Sequence
  Synthetic
tcgcaccatctctacaaaaacaaaacatattgtgtcaagggcggtatgccatctggctgctctggcacttcaatt

SEQ ID NO: 88415 - DNA, 75 bp, Artificial Sequence
  Synthetic
ctaaagatgattgcctatggtgatgatgtaattgcttcctacccccatgaggttgacgctagtctcctagcccaa

SEQ ID NO: 88416 - DNA, 75 bp, Artificial Sequence
  Synthetic
tacgttgccggttacaagatttgtaactaccacctagcaaccccaagtgatcacttgaatgcaattagtgtgtta

SEQ ID NO: 88417 - DNA, 75 bp, Artificial Sequence
  Synthetic
gatacacccagtaatgccaatgaaggaaattcatgaatcaattagatggaccaaagatccgagaaacacccagga

SEQ ID NO: 88418 - DNA, 75 bp, Artificial Sequence
  Synthetic
accagtctcacatgctgatagggtgcggatttgcagaacccggggactgtggtgggatattaaggtgcactcatg

SEQ ID NO: 88419 - DNA, 75 bp, Artificial Sequence
  Synthetic
ttgctcccagagtactcaacattgtaccgtcgttggcttgactcattttagtaaccctacctcagtcgaattgga

SEQ ID NO: 88420 - DNA, 75 bp, Artificial Sequence
  Synthetic
aagaggaagccatggaacagggaataacaagttacatcgaatccctcggtacagcttttggtgcagggttcaccc

SEQ ID NO: 88421 - DNA, 75 bp, Artificial Sequence
  Synthetic
accccagaggcccacgtggcggctagtactctggtatcacggtacctttgtacgcctgttttataccccttcccc

SEQ ID NO: 88422 - DNA, 75 bp, Artificial Sequence
  Synthetic
tagtgaaaatagtatcggctctagtgattgttgtgagaaattatgaggacactaccacgatccttgcaacactag

SEQ ID NO: 88423 - DNA, 75 bp, Artificial Sequence
  Synthetic
cccgagtgtagcttaggctgatgagtctgggcattccccaccggcgacggtggcccaggctgcgttggcggccta

SEQ ID NO: 88424 - DNA, 75 bp, Artificial Sequence
  Synthetic
ctgaggcactaccaccgcaatgggagcacaagtttcatctcagaaagtaggtgctcatgaaaacaccaacgtggc

SEQ ID NO: 88425 - DNA, 75 bp, Artificial Sequence
  Synthetic
accagggacgggtaagggtatagctagctcattgataggtagagcaatagcagagagggaaaccacatcggtcta

SEQ ID NO: 88426 - DNA, 75 bp, Artificial Sequence
  Synthetic
gcacaagtttcatctcagaaagtaggtgctcatgaaaacaccaacgtggccactggcgggtcaacggtgaactac

SEQ ID NO: 88427 - DNA, 75 bp, Artificial Sequence
  Synthetic
ttcaccgaaccagtcaaggacattatgctgaaatcagccccggccctcaattctccaaacattgaggcgtgcggt

SEQ ID NO: 88428 - DNA, 75 bp, Artificial Sequence
  Synthetic
tgctgaaatcagccccggccctcaattctccaaacattgaggcgtgcggttacagtgatagagtaatgcagctta

SEQ ID NO: 88429 - DNA, 75 bp, Artificial Sequence
  Synthetic
tgtcagacaaagaagcaaacccggtagaccaacccactgaaccagatgtatctgcgtgcagattttacaccttag

SEQ ID NO: 88430 - DNA, 75 bp, Artificial Sequence
  Synthetic
agaccaacccactgaaccagatgtatctgcgtgcagattttacaccttagacactgtaacgtggagcaaaagttc

SEQ ID NO: 88431 - DNA, 75 bp, Artificial Sequence
  Synthetic
ttgcaattaatggacaggtacaccagacagaggttcactgtggatgagattaccacattaatcatgaatgagaaa

SEQ ID NO: 88432 - DNA, 75 bp, Artificial Sequence
  Synthetic
cttgggaaggtcagggtacactgttcatgtacagtgcaacgcttccaaatttcaccagggtgctctgggtgtatt

SEQ ID NO: 88433 - DNA, 75 bp, Artificial Sequence
  Synthetic
catgtacagtgcaacgcttccaaatttcaccagggtgctctgggtgtatttgccatccccgaatattgcatggcc

SEQ ID NO: 88434 - DNA, 75 bp, Artificial Sequence
  Synthetic
gatgtgaagacagttcccccccctgagtgcatcagtgatttattacaagcagtggattctcaagaggttagggat

SEQ ID NO: 88435 - DNA, 75 bp, Artificial Sequence
  Synthetic
gacacgtacaaccccagctcaggaaccaccggagcgcgtaaattcgccgcagtggattatttgttggggtgtggg

SEQ ID NO: 88436 - DNA, 75 bp, Artificial Sequence
  Synthetic
ccaccggagcgcgtaaattcgccgcagtggattatttgttggggtgtggggtactagccggtaatgcttttgtgt

SEQ ID NO: 88437 - DNA, 75 bp, Artificial Sequence
  Synthetic
ttgactgcatggctaaacacaacaactgggggattgccgtactccccttggcagaactcgattttactgaagcat

SEQ ID NO: 88438 - DNA, 75 bp, Artificial Sequence
  Synthetic
ctgggggattgccgtactccccttggcagaactcgattttactgaagcatcctcaacggaggtacccatcaccat

SEQ ID NO: 88439 - DNA, 75 bp, Artificial Sequence
  Synthetic
tatgaacgtgccaggcagcaatcaattcttgtcatcagacaacttccaatctccctgtgctctacctgaatttga

SEQ ID NO: 88440 - DNA, 75 bp, Artificial Sequence
  Synthetic
aaagaagtggagatcctagatgccagagccttagaagatcaagcgggaaccaaccttgagattaccattattact

SEQ ID NO: 88441 - DNA, 75 bp, Artificial Sequence
  Synthetic
ttcttgtcatcagacaacttccaatctccctgtgctctacctgaatttgatgtgaccccacctatccatatccca

SEQ ID NO: 88442 - DNA, 75 bp, Artificial Sequence
  Synthetic
ttgatcgtgaacactagtaagtaccccaacatgtatgtcccagttggtgctgtgactgaacagggatatcttaat

SEQ ID NO: 88443 - DNA, 75 bp, Artificial Sequence
  Synthetic
aacaccatgggaatgtacagagtggaattgggttccagcaaatcacagactgacccaatattgtgtttgagcttg

SEQ ID NO: 88444 - DNA, 75 bp, Artificial Sequence
  Synthetic
aattgggttccagcaaatcacagactgacccaatattgtgtttgagcttgagcccagccagtgagcagaggttag

SEQ ID NO: 88445 - DNA, 75 bp, Artificial Sequence
  Synthetic
gtggaagcatgatggcgactggtaaactcttgatatcttacgcaccaccaggggctaaaccacccaaaacccgca

SEQ ID NO: 88446 - DNA, 75 bp, Artificial Sequence
  Synthetic
actcttgatatcttacgcaccaccaggggctaaaccacccaaaacccgcaaggaagctatgctcggcacacacat

SEQ ID NO: 88447 - DNA, 75 bp, Artificial Sequence
  Synthetic
cgtgaaggacgatttcacagaaggagggtacatatccatgttttaccagaccaagatagtcgtccccctgtcaac

SEQ ID NO: 88448 - DNA, 75 bp, Artificial Sequence
  Synthetic
gggtacatatccatgttttaccagaccaagatagtcgtccccctgtcaacccccaccacgatgacaatgctcagc

SEQ ID NO: 88449 - DNA, 75 bp, Artificial Sequence
  Synthetic
aacacacaaggacctattgaggaaataatctccacggtggccagcaacgcactagcactaagtcagcccaaacca

SEQ ID NO: 88450 - DNA, 75 bp, Artificial Sequence
  Synthetic
taatctccacggtggccagcaacgcactagcactaagtcagcccaaaccagtggacaattcagtgcaaaacaccc

SEQ ID NO: 88451 - DNA, 75 bp, Artificial Sequence
  Synthetic
ggatcttagcactagtgctggatacccttatgttgcaatggggaaaaagaaaagagacattctagacaaacagac

SEQ ID NO: 88452 - DNA, 75 bp, Artificial Sequence
  Synthetic
ccttatgttgcaatggggaaaaagaaaagagacattctagacaaacagaccagggatactaaagagatgcagaga

SEQ ID NO: 88453 - DNA, 75 bp, Artificial Sequence
  Synthetic
taccagcggatttagtacaaacaagacacgtgatcaatgtgaaatcgcgatcagaatctacaattgaatctttct

SEQ ID NO: 88454 - DNA, 75 bp, Artificial Sequence
  Synthetic
acacgtgatcaatgtgaaatcgcgatcagaatctacaattgaatctttctttgccagggctgcctgtgttacaat

SEQ ID NO: 88455 - DNA, 75 bp, Artificial Sequence
  Synthetic
cacagatacagtacaattaagaagaaaattagaatttttcacatattccaggtttgatttggagatgactttcgt

SEQ ID NO: 88456 - DNA, 75 bp, Artificial Sequence
  Synthetic
aaattagaatttttcacatattccaggtttgatttggagatgactttcgtgctcacagagagatactacagccag

SEQ ID NO: 88457 - DNA, 75 bp, Artificial Sequence
  Synthetic
gcttggtttgaagctcttaaaatggtgttagaaaagattggattcggcaatagagtagactacatagactacctg

SEQ ID NO: 88458 - DNA, 75 bp, Artificial Sequence
  Synthetic
gacgattacacctggcaaacatcttcaaacccttcaatattcttcaccaccggaaatgcaccaccccggatttcc

SEQ ID NO: 88459 - DNA, 75 bp, Artificial Sequence
  Synthetic
caaacccttcaatattcttcaccaccggaaatgcaccaccccggatttccataccatttgtgggaatcgcaaatg

SEQ ID NO: 88460 - DNA, 75 bp, Artificial Sequence
  Synthetic
acggcctcacctcgatcaatgattttgggactttggctgtgagagtggttaatgattacaatcctgccagagtgg

SEQ ID NO: 88461 - DNA, 75 bp, Artificial Sequence
  Synthetic
tgggactttggctgtgagagtggttaatgattacaatcctgccagagtggagactagaatccgtgtttacatgaa

SEQ ID NO: 88462 - DNA, 75 bp, Artificial Sequence
  Synthetic
atcaacatcagtgactccattatctaagcatgatctcacaacttatggttttggtcaccaaaacaaagcagttta

SEQ ID NO: 88463 - DNA, 75 bp, Artificial Sequence
  Synthetic
aagcatgatctcacaacttatggttttggtcaccaaaacaaagcagtttacacagcaggatataaaatatgcaat

SEQ ID NO: 88464 - DNA, 75 bp, Artificial Sequence
  Synthetic
tcgcgggcacagggtaccgactcgattgctaggtgtacttgcaacactggtgtttactattgtgaatctaggaga

SEQ ID NO: 88465 - DNA, 75 bp, Artificial Sequence
  Synthetic
cattgtaccgccgatggctcgattcattttagtaaccctacctcagtcggattcggattgggttatactgttgta

SEQ ID NO: 88466 - DNA, 75 bp, Artificial Sequence
  Synthetic
ttgctaggtgtacttgcaacactggtgtttactattgtgaatctaggagaaaatactacccagtgtcttttgtgg

SEQ ID NO: 88467 - DNA, 75 bp, Artificial Sequence
  Synthetic
gctttgcatccccaggtgattgtgggggtatattgagatgccagcacggagtcatcggaataattacagctgggg

SEQ ID NO: 88468 - DNA, 75 bp, Artificial Sequence
  Synthetic
gggtatattgagatgccagcacggagtcatcggaataattacagctgggggggaaggtcttgttgcattttctga

SEQ ID NO: 88469 - DNA, 75 bp, Artificial Sequence
  Synthetic
agcttttggcagtggtttcacacagcaaattggagataagatttcagaattaaccaccatgataaccagtaccat

SEQ ID NO: 88470 - DNA, 75 bp, Artificial Sequence
  Synthetic
caaattggagataagatttcagaattaaccaccatgataaccagtaccatcactgagaagctactgaagaatttg

SEQ ID NO: 88471 - DNA, 75 bp, Artificial Sequence
  Synthetic
cttctgggttgcgatgtctctccatggcaatggctgaaaaagaaagcatgtgacatactagagataccttacgtc

SEQ ID NO: 88472 - DNA, 75 bp, Artificial Sequence
  Synthetic
ggcaatggctgaaaaagaaagcatgtgacatactagagataccttacgtcattcgccagggagatagctggctca

SEQ ID NO: 88473 - DNA, 75 bp, Artificial Sequence
  Synthetic
tgggtgaccgtgtttccttttatttttacaatggctgcttatggtgacaatctcagattgttatcataaagcgag

SEQ ID NO: 88474 - DNA, 75 bp, Artificial Sequence
  Synthetic
ggcttaaagaaaggataatcccgcaggcaagagataaattagagtttgttacaaaactgaaacaattggagatgc

SEQ ID NO: 88475 - DNA, 75 bp, Artificial Sequence
  Synthetic
atatcacttgatacaagcggtattactaattaggaacttctatcacaatgggggctcaggtttcatcacaaaaag

SEQ ID NO: 88476 - DNA, 75 bp, Artificial Sequence
  Synthetic
tagagaatcagatttccacgattcatcagtcttgcccaagtcaggaacaccaggaaattctcttcaataatgtta

SEQ ID NO: 88477 - DNA, 75 bp, Artificial Sequence
  Synthetic
ctaattaggaacttctatcacaatgggggctcaggtttcatcacaaaaagttggagctcatgaaaacaccaatgt

SEQ ID NO: 88478 - DNA, 75 bp, Artificial Sequence
  Synthetic
caagagcaaacaccgtattgaaccagtatgtctattagtacatggtagtccagggacaggtaaatcagtggcaac

SEQ ID NO: 88479 - DNA, 75 bp, Artificial Sequence
  Synthetic
gcaagatttttctcaggatccgtctaaattcacagaaccagttaaagatgtcctaatcaaatcagcgcccgctct

SEQ ID NO: 88480 - DNA, 75 bp, Artificial Sequence
  Synthetic
gtatgtctattagtacatggtagtccagggacaggtaaatcagtggcaacaaacctcattgcaagggccatagct

SEQ ID NO: 88481 - DNA, 75 bp, Artificial Sequence
  Synthetic
aaattcacagaaccagttaaagatgtcctaatcaaatcagcgcccgctctcaattcgccaaacattgaggcgtgc

SEQ ID NO: 88482 - DNA, 75 bp, Artificial Sequence
  Synthetic
gtgatcatggacgacctcaaccagaatccagatggagctgacatgaaattgttttgccaaatggtatccaccgtg

SEQ ID NO: 88483 - DNA, 75 bp, Artificial Sequence
  Synthetic
gtagcatatggggtttggccatcgtatcttaatgaccaagatgccaacccagtggaccagccgactgaaccagat

SEQ ID NO: 88484 - DNA, 75 bp, Artificial Sequence
  Synthetic
atccagatggagctgacatgaaattgttttgccaaatggtatccaccgtggaattcattccacctatggcatcat

SEQ ID NO: 88485 - DNA, 75 bp, Artificial Sequence
  Synthetic
atcttaatgaccaagatgccaacccagtggaccagccgactgaaccagatgtttcagcatgcagattctacaccc

SEQ ID NO: 88486 - DNA, 75 bp, Artificial Sequence
  Synthetic
cggtcgcccacagtgacgcattggctagaaggtttgcatttgacatggacatccaagttatgaatgagtactcga

SEQ ID NO: 88487 - DNA, 75 bp, Artificial Sequence
  Synthetic
tatttggccagaacatgtattaccactatttaggaagatcaggatacactgtacatgttcaatgcaacgcctcca

SEQ ID NO: 88488 - DNA, 75 bp, Artificial Sequence
  Synthetic
tagaaggtttgcatttgacatggacatccaagttatgaatgagtactcgagagatggaaaactgaatatggccat

SEQ ID NO: 88489 - DNA, 75 bp, Artificial Sequence
  Synthetic
ctatttaggaagatcaggatacactgtacatgttcaatgcaacgcctccaagttccaccaagggacgttgggcgt

SEQ ID NO: 88490 - DNA, 75 bp, Artificial Sequence
  Synthetic
aattcagttaatggacaaatcgtccagagtcaggtatagcatcgaccaaattactactatgattattaatgaaag

SEQ ID NO: 88491 - DNA, 75 bp, Artificial Sequence
  Synthetic
tcctggtgagaaaggtggtaaatttgttagtgcatttaacccagacacaagtgcagccccaaaacgccagttcca

SEQ ID NO: 88492 - DNA, 75 bp, Artificial Sequence
  Synthetic
agagtcaggtatagcatcgaccaaattactactatgattattaatgaaaggaacagacgatctaacattggcaat

SEQ ID NO: 88493 - DNA, 75 bp, Artificial Sequence
  Synthetic
gttagtgcatttaacccagacacaagtgcagccccaaaacgccagttccaaccagtcgattacctgtttgggtgt

SEQ ID NO: 88494 - DNA, 75 bp, Artificial Sequence
  Synthetic
gaatgtatcaatgatctgctacaagccgtggattcccaagaagttagggactactgtgaaaagaaaggttggttg

SEQ ID NO: 88495 - DNA, 75 bp, Artificial Sequence
  Synthetic
gtgttgccatatgttaactcattggcgatcgactgcatggccaaacacaacaattggggtttggttatattacca

SEQ ID NO: 88496 - DNA, 75 bp, Artificial Sequence
  Synthetic
ccgtggattcccaagaagttagggactactgtgaaaagaaaggttggttggtgaatgtctctagtcaagttcact

SEQ ID NO: 88497 - DNA, 75 bp, Artificial Sequence
  Synthetic
cgatcgactgcatggccaaacacaacaattggggtttggttatattaccattgtctaaactagattttgctcctg

SEQ ID NO: 88498 - DNA, 75 bp, Artificial Sequence
  Synthetic
acgtcatgtataagctttttgcaggacaccagggtgcatacactggactccccaacaagagacctaacgttccca

SEQ ID NO: 88499 - DNA, 75 bp, Artificial Sequence
  Synthetic
cgataccagcagctcagggattaccagttatgaacacaccaggcagcattcagtacctcacatctgataacttcc

SEQ ID NO: 88500 - DNA, 75 bp, Artificial Sequence
  Synthetic
acaccagggtgcatacactggactccccaacaagagacctaacgttcccactatcagaacggctaaggtgcaagg

SEQ ID NO: 88501 - DNA, 75 bp, Artificial Sequence
  Synthetic
agttatgaacacaccaggcagcattcagtacctcacatctgataacttccagtccccatgcgctttgccagagtt

SEQ ID NO: 88502 - DNA, 75 bp, Artificial Sequence
  Synthetic
aatgcttggggtgcacgacaatgtggctgtgttaccaacccatgcttcaccaggggaaacaatagttattgatgg

SEQ ID NO: 88503 - DNA, 75 bp, Artificial Sequence
  Synthetic
tccattaaatttggccacagggaagaaaaacacaatggaaatgtacagggtgcaattgagtgatagtgctaatcg

SEQ ID NO: 88504 - DNA, 75 bp, Artificial Sequence
  Synthetic
aaaaacacaatggaaatgtacagggtgcaattgagtgatagtgctaatcgtaacaagcccatcctttgcctgtca

SEQ ID NO: 88505 - DNA, 75 bp, Artificial Sequence
  Synthetic
aaaagaagttgaggtgttagatgctaaggcgctcgaagaccaagcgggcaccaatttggaaatcacaattgttac

SEQ ID NO: 88506 - DNA, 75 bp, Artificial Sequence
  Synthetic
ggttcactaaaattttcattcctcttttgcggctcgatgatggctactgggaagatactagtggcctattcacca

SEQ ID NO: 88507 - DNA, 75 bp, Artificial Sequence
  Synthetic
tttgcggctcgatgatggctactgggaagatactagtggcctattcaccaccaggggcacaaccgccacagaacc

SEQ ID NO: 88508 - DNA, 75 bp, Artificial Sequence
  Synthetic
ggatcagtaacactagctatagaagaacagtgaaagatgacttcacagagggaggctacatcagtatgttttacc

SEQ ID NO: 88509 - DNA, 75 bp, Artificial Sequence
  Synthetic
cacatgtactggtaaggtaatagggatgcatgttggagggaacggttcacacgggtttgctgcagccctgaagcg

SEQ ID NO: 88510 - DNA, 75 bp, Artificial Sequence
  Synthetic
atgcatgttggagggaacggttcacacgggtttgctgcagccctgaagcgatcttacttcactcagagccaaggt

SEQ ID NO: 88511 - DNA, 75 bp, Artificial Sequence
  Synthetic
aacagtgaaagatgacttcacagagggaggctacatcagtatgttttaccagaccagggtggttgtgcctgcatc

SEQ ID NO: 88512 - DNA, 75 bp, Artificial Sequence
  Synthetic
cacccacattaagcaagatgctatgcctcaagggatcgaagatataatacaacaagtggcatcaaatgcacttca

SEQ ID NO: 88513 - DNA, 75 bp, Artificial Sequence
  Synthetic
cccagcgccttccactatgtatttgagggtgttaaagaaccagccgtgctcaccaagaatgatcctagactgaaa

SEQ ID NO: 88514 - DNA, 75 bp, Artificial Sequence
  Synthetic
agggtgttaaagaaccagccgtgctcaccaagaatgatcctagactgaaaacagactttgaggaggcaatcttct

SEQ ID NO: 88515 - DNA, 75 bp, Artificial Sequence
  Synthetic
cctcaagggatcgaagatataatacaacaagtggcatcaaatgcacttcaactgtcacaaccaactaggcctgca

SEQ ID NO: 88516 - DNA, 75 bp, Artificial Sequence
  Synthetic
acagctgttgaaactggagctaccaacccacttgaaccctcagacacagttcaaactagacatgtgatacaaacc

SEQ ID NO: 88517 - DNA, 75 bp, Artificial Sequence
  Synthetic
tcatgtctctagacattaatacagaacaaatgtgtctggaggatgctatgtatggaactgacggtctagaggctt

SEQ ID NO: 88518 - DNA, 75 bp, Artificial Sequence
  Synthetic
acaaatgtgtctggaggatgctatgtatggaactgacggtctagaggctttagatctgaccaccagtgcaggtta

SEQ ID NO: 88519 - DNA, 75 bp, Artificial Sequence
  Synthetic
acccacttgaaccctcagacacagttcaaactagacatgtgatacaaaccagatcacgaagcgaaagtaccatag

SEQ ID NO: 88520 - DNA, 75 bp, Artificial Sequence
  Synthetic
caagcactctgtttgcaaaatggaacatcacgtacacagacacagtacaactgaggagaaagttggaaatgttca

SEQ ID NO: 88521 - DNA, 75 bp, Artificial Sequence
  Synthetic
actgttggacacgtatggaattaatttgccattggtcacctatgttaaagatgaactaagaagcaagagcaaagt

SEQ ID NO: 88522 - DNA, 75 bp, Artificial Sequence
  Synthetic
ttgccattggtcacctatgttaaagatgaactaagaagcaagagcaaagtggaacagggaaagtccaggttgatt

SEQ ID NO: 88523 - DNA, 75 bp, Artificial Sequence
  Synthetic
catcacgtacacagacacagtacaactgaggagaaagttggaaatgttcacttattcaaggtttgatatagagtt

SEQ ID NO: 88524 - DNA, 75 bp, Artificial Sequence
  Synthetic
tgttccaccaggcgctccaattcctaaaaagtgggatgattacacgtggcagacctcttcaaacccctcaatctt

SEQ ID NO: 88525 - DNA, 75 bp, Artificial Sequence
  Synthetic
ccaggggtgatcactggttcagccgtagggtgtgatccagatttgttttggagtaagatccctgtgttaatggag

SEQ ID NO: 88526 - DNA, 75 bp, Artificial Sequence
  Synthetic
aaaaagtgggatgattacacgtggcagacctcttcaaacccctcaatcttttacacatatggcaccgcaccagcg

SEQ ID NO: 88527 - DNA, 75 bp, Artificial Sequence
  Synthetic
aaggattccacacaggatgctggtgcagcatactatggtgctgtatccataaatgactttggaatgttggcagtc

SEQ ID NO: 88528 - DNA, 75 bp, Artificial Sequence
  Synthetic
gtgttagagaagattggattcggggatagggttgattatatagattaccttaaccattcacaccatctttacaaa

SEQ ID NO: 88529 - DNA, 75 bp, Artificial Sequence
  Synthetic
cagcatactatggtgctgtatccataaatgactttggaatgttggcagtcagagtggttaatgaacacaatccag

SEQ ID NO: 88530 - DNA, 75 bp, Artificial Sequence
  Synthetic
atagggttgattatatagattaccttaaccattcacaccatctttacaaaaacaaaacttactgtgtcaagggtg

SEQ ID NO: 88531 - DNA, 75 bp, Artificial Sequence
  Synthetic
ctgtggagtactttgggagtggggttgattacaaagccgatacactagatattctaccagagaaaaatttaacaa

SEQ ID NO: 88532 - DNA, 75 bp, Artificial Sequence
  Synthetic
tgattacaaagccgatacactagatattctaccagagaaaaatttaacaacatatggttttgggcatcaaaataa

SEQ ID NO: 88533 - DNA, 75 bp, Artificial Sequence
  Synthetic
ggtgatgatgtaattgcttcctacccccatgaggttgacgctagtctcctagcccaatcaggaaaagactatgga

SEQ ID NO: 88534 - DNA, 75 bp, Artificial Sequence
  Synthetic
gagcatgtgggagagggatctgatggttgttgagtcacgtgcacaggggatagataccattgcacggtgtcaatg

SEQ ID NO: 88535 - DNA, 75 bp, Artificial Sequence
  Synthetic
gttgttgagtcacgtgcacaggggatagataccattgcacggtgtcaatgcagaacaggggtgtattactgtgaa

SEQ ID NO: 88536 - DNA, 75 bp, Artificial Sequence
  Synthetic
aatgaaagaaattcatgaatcaatcagatggacaaaagatcctagaaacactcaggaccatgttcgctcattgtg

SEQ ID NO: 88537 - DNA, 75 bp, Artificial Sequence
  Synthetic
agatggacaaaagatcctagaaacactcaggaccatgttcgctcattgtgcctattggcctggcacaatggtgaa

SEQ ID NO: 88538 - DNA, 75 bp, Artificial Sequence
  Synthetic
gccagataccagacacatatgattatcggtagtgggttcgcagcccctggggactgtggtggtattattagatgc

SEQ ID NO: 88539 - DNA, 75 bp, Artificial Sequence
  Synthetic
tcggtagtgggttcgcagcccctggggactgtggtggtattattagatgccaacacggtgtcatgggcttgatta

SEQ ID NO: 88540 - DNA, 75 bp, Artificial Sequence
  Synthetic
gaatcactaactacattgaaaccctcggagctgcttttgggagtgggttcacttcacaaattggggaaaagatta

SEQ ID NO: 88541 - DNA, 75 bp, Artificial Sequence
  Synthetic
cggagctgcttttgggagtgggttcacttcacaaattggggaaaagattagtgagattaccagtatggtaacctc

SEQ ID NO: 88542 - DNA, 75 bp, Artificial Sequence
  Synthetic
agacaccactacagtgttggcaactttggccctgctgggttgtgatgtttcaccgtgggcttggctgaagaagaa

SEQ ID NO: 88543 - DNA, 75 bp, Artificial Sequence
  Synthetic
ttggccctgctgggttgtgatgtttcaccgtgggcttggctgaagaagaaagcttgtgatatcctagaaataccc

SEQ ID NO: 88544 - DNA, 75 bp, Artificial Sequence
  Synthetic
gtgagcaacaaaatttcaaaatttattgattggctgaaagaaaagatcataccagaggcaagagataaggttgag

SEQ ID NO: 88545 - DNA, 75 bp, Artificial Sequence
  Synthetic
ttgattggctgaaagaaaagatcataccagaggcaagagataaggttgagttcattaccaaattaaagcagttgg

SEQ ID NO: 88546 - DNA, 75 bp, Artificial Sequence
  Synthetic
atgttagatggttggctatacaatcgcgcagatttgcaccactgtatgcagttgaagccaagagaattagcaggt

SEQ ID NO: 88547 - DNA, 75 bp, Artificial Sequence
  Synthetic
gcgcagatttgcaccactgtatgcagttgaagccaagagaattagcaggttggaaaacacaataaacaactatat

SEQ ID NO: 88548 - DNA, 75 bp, Artificial Sequence
  Synthetic
agcgacctccctcattgggagggctattgccgaaaaggagagcacatctgtgtactcacttccacccgatcccac

SEQ ID NO: 88549 - DNA, 75 bp, Artificial Sequence
  Synthetic
attgccgaaaaggagagcacatctgtgtactcacttccacccgatcccacacactttgatggctacaaacaacag

SEQ ID NO: 88550 - DNA, 75 bp, Artificial Sequence
  Synthetic
acagtagagtttataccaccaatggcatctttggaagaaaaagggatactgttcacatcagattatgttctggca

SEQ ID NO: 88551 - DNA, 75 bp, Artificial Sequence
  Synthetic
catctttggaagaaaaagggatactgttcacatcagattatgttctggcatccactaattctagcacgattacac

SEQ ID NO: 88552 - DNA, 75 bp, Artificial Sequence
  Synthetic
actcaattagaggaaaactaaacatgagcactgcaacccaaatgtgcaaggaatgtccacaacctgcaaatttca

SEQ ID NO: 88553 - DNA, 75 bp, Artificial Sequence
  Synthetic
gagcactgcaacccaaatgtgcaaggaatgtccacaacctgcaaatttcaagaggtgttgtccgttgatttgtgg

SEQ ID NO: 88554 - DNA, 75 bp, Artificial Sequence
  Synthetic
tgaaaagaataggagggcaaatattggtaactgcatggaagctttgtttcaagggccactagtgtacaaagacct

SEQ ID NO: 88555 - DNA, 75 bp, Artificial Sequence
  Synthetic
ggtaactgcatggaagctttgtttcaagggccactagtgtacaaagacctaaaaattgacatcaaaacaactccc

SEQ ID NO: 88556 - DNA, 75 bp, Artificial Sequence
  Synthetic
tggattgttaatgtaaccagtgaagtgcaaacggagagaaatttaaacagagccatgaccatactgcaagcactg

SEQ ID NO: 88557 - DNA, 75 bp, Artificial Sequence
  Synthetic
tgcaaacggagagaaatttaaacagagccatgaccatactgcaagcactgaccacatttgctgcagtagcaggcg

SEQ ID NO: 88558 - DNA, 75 bp, Artificial Sequence
  Synthetic
ttcccaccattagaactgccaaagtgcaaggaccagggtttgactatgcagttgcgatggccaagagaaacatag

SEQ ID NO: 88559 - DNA, 75 bp, Artificial Sequence
  Synthetic
ccgcaccaggtgacactatagtcattgatggcaaagaagtagaggtgctcgatgctaaggcacttgaggaccaag

SEQ ID NO: 88560 - DNA, 75 bp, Artificial Sequence
  Synthetic
aatcatcacatgcactggcaaggtgattggaatgcatgttggagggaacggttcacacgggtttgctgcagccct

SEQ ID NO: 88561 - DNA, 75 bp, Artificial Sequence
  Synthetic
attggaatgcatgttggagggaacggttcacacgggtttgctgcagccctaaaacggtcatacttcactcaaagt

SEQ ID NO: 88562 - DNA, 75 bp, Artificial Sequence
  Synthetic
ctagagcccagtgcctttcattacatctttgaaggtgtcaaggaaccagcagtgttaacaaaaaccgatcctaga

SEQ ID NO: 88563 - DNA, 75 bp, Artificial Sequence
  Synthetic
tctttgaaggtgtcaaggaaccagcagtgttaacaaaaaccgatcctagattgaaaacagattttgaagaggcca

SEQ ID NO: 88564 - DNA, 75 bp, Artificial Sequence
  Synthetic
ggcagctcatgtccttagacatcaacactgaacaaatgtgcttagaagacgccatgtacggaactgatggactag

SEQ ID NO: 88565 - DNA, 75 bp, Artificial Sequence
  Synthetic
cactgaacaaatgtgcttagaagacgccatgtacggaactgatggactagaggcactcgacctgtcaactagtgc

SEQ ID NO: 88566 - DNA, 75 bp, Artificial Sequence
  Synthetic
gcaacgtctcttggacacctacggaatcaacctaccattagttacatatgtaaaggatgaacttagaagtaaaac

SEQ ID NO: 88567 - DNA, 75 bp, Artificial Sequence
  Synthetic
atcaacctaccattagttacatatgtaaaggatgaacttagaagtaaaaccaaagtggaacaagggaaatccaga

SEQ ID NO: 88568 - DNA, 75 bp, Artificial Sequence
  Synthetic
aaaaacccaggggtagtgacaggttccgcagttggatgtgatccagacctgttttggagcaaaatcccagtatta

SEQ ID NO: 88569 - DNA, 75 bp, Artificial Sequence
  Synthetic
ccgcagttggatgtgatccagacctgttttggagcaaaatcccagtattaatggaggagaaactttttgcctttg

SEQ ID NO: 88570 - DNA, 75 bp, Artificial Sequence
  Synthetic
ttggagacagagttgattacattgactacctcaaccactcacaccatttatacaaaaataaaacatactgtgtca

SEQ ID NO: 88571 - DNA, 75 bp, Artificial Sequence
  Synthetic
agtacccgttcttggtacatccagtgatgccaatgaaggaaattcacgaatcaataagatggacaaaagatccca

SEQ ID NO: 88572 - DNA, 75 bp, Artificial Sequence
  Synthetic
ataccaggggaggtgcgcaacatgatggaattggcggaaatagacaccatgatacccctcaacttgacaagtcaa

SEQ ID NO: 88573 - DNA, 75 bp, Artificial Sequence
  Synthetic
aaaacaaagctgtgtacacagctggctacaaaatttgcaactatcacctagccacgcaggaagatctgcaaagtg

SEQ ID NO: 88574 - DNA, 75 bp, Artificial Sequence
  Synthetic
gcacatgtaaaaccggagtgtattactgtgagtctaagagaagatactatccagtatcttttataggacccactt

SEQ ID NO: 88575 - DNA, 75 bp, Artificial Sequence
  Synthetic
ctgtgagtctaagagaagatactatccagtatcttttataggacccactttccagtacatggaggccaacgaata

SEQ ID NO: 88576 - DNA, 75 bp, Artificial Sequence
  Synthetic
cagatgccagcatggtgtcataggtatcattaccgccggtggagagggcctagtggcgttttcagacatcaggga

SEQ ID NO: 88577 - DNA, 75 bp, Artificial Sequence
  Synthetic
atcattaccgccggtggagagggcctagtggcgttttcagacatcagggatctctacgcatatgaagaggaggct

SEQ ID NO: 88578 - DNA, 75 bp, Artificial Sequence
  Synthetic
gacaagatctcagaactcaccaacatggtcactagcactataactgagaggttattaaaaaacctcattaaaata

SEQ ID NO: 88579 - DNA, 75 bp, Artificial Sequence
  Synthetic
tggtcactagcactataactgagaggttattaaaaaacctcattaaaataatctcttcattggtcattatcacta

SEQ ID NO: 88580 - DNA, 75 bp, Artificial Sequence
  Synthetic
ttaagaagaaggcttgtgacatacttgaaatcccgtacgtcatgcgccaaggtgatagctggttaaaaaaattta

SEQ ID NO: 88581 - DNA, 75 bp, Artificial Sequence
  Synthetic
tgaaatcccgtacgtcatgcgccaaggtgatagctggttaaaaaaatttacagaggcatgcaacgctgccaaggg

SEQ ID NO: 88582 - DNA, 75 bp, Artificial Sequence
  Synthetic
caaattggagtttgtcacaaaattaaaacaactagagatgttggaaaaccagattgctactattcaccaatcatg

SEQ ID NO: 88583 - DNA, 75 bp, Artificial Sequence
  Synthetic
agattgctactattcaccaatcatgtccaagccaggaacaccaggaaattttattcaacaatgtgaggtggttgt

SEQ ID NO: 88584 - DNA, 75 bp, Artificial Sequence
  Synthetic
acaattacatacaattcaagagcaaacaccgtattgaaccagtatgtttgttggtgcatggcagccccgggacag

SEQ ID NO: 88585 - DNA, 75 bp, Artificial Sequence
  Synthetic
acaccgtattgaaccagtatgtttgttggtgcatggcagccccgggacaggtaagtcagtggccaccaacttaat

SEQ ID NO: 88586 - DNA, 75 bp, Artificial Sequence
  Synthetic
caaacaacagggagtagtgataatggatgatttgaatcagaacccagatggtgctgacatgaagctcttttgtca

SEQ ID NO: 88587 - DNA, 75 bp, Artificial Sequence
  Synthetic
gatgatttgaatcagaacccagatggtgctgacatgaagctcttttgtcaaatggtttccactgtggaattcatt

SEQ ID NO: 88588 - DNA, 75 bp, Artificial Sequence
  Synthetic
cgtattacaccacccacggttgcacacagtgacgcactagctaggcgttttgcatttgatatggacattcaggtc

SEQ ID NO: 88589 - DNA, 75 bp, Artificial Sequence
  Synthetic
acagtgacgcactagctaggcgttttgcatttgatatggacattcaggtcatgggtgagtattccagagatggaa

SEQ ID NO: 88590 - DNA, 75 bp, Artificial Sequence
  Synthetic
tggtgtgtggaaaagcaattcagttgatggataagtcttccagagttaggtatagtgttgaccaaattacaacaa

SEQ ID NO: 88591 - DNA, 75 bp, Artificial Sequence
  Synthetic
gatggataagtcttccagagttaggtatagtgttgaccaaattacaacaatgatcattaatgaaaggaacaggag

SEQ ID NO: 88592 - DNA, 75 bp, Artificial Sequence
  Synthetic
gaccacaccaccgcctgaatgcatcaatgacttgctacaagcagttgactctcaagaggtcagagactactgtga

SEQ ID NO: 88593 - DNA, 75 bp, Artificial Sequence
  Synthetic
aatgacttgctacaagcagttgactctcaagaggtcagagactactgtgagaagaaggggtggatagtgaacatc

SEQ ID NO: 88594 - DNA, 75 bp, Artificial Sequence
  Synthetic
gttgccggagtggtgtacgtgatgtacaagctctttgcaggacatcaaggtgcttacacaggactcccaaacaaa

SEQ ID NO: 88595 - DNA, 75 bp, Artificial Sequence
  Synthetic
acaagctctttgcaggacatcaaggtgcttacacaggactcccaaacaaaaagcccaatattcccactatcagga

SEQ ID NO: 88596 - DNA, 75 bp, Artificial Sequence
  Synthetic
gcaaaggggagttcacaatgctcggggtgcatgacaatgtagccatcttgccaacccatgcttcaccaggggagg

SEQ ID NO: 88597 - DNA, 75 bp, Artificial Sequence
  Synthetic
caatagttattgatggtaaggaggtagaggtgttggatgccagagcattggaggatcaagctgggaccaatctgg

SEQ ID NO: 88598 - DNA, 75 bp, Artificial Sequence
  Synthetic
gaacactagtaagtaccccaacatgtatgttcctgttggtgctgtgactgaacagggatatcttaatctcggtgg

SEQ ID NO: 88599 - DNA, 75 bp, Artificial Sequence
  Synthetic
tatgttcctgttggtgctgtgactgaacagggatatcttaatctcggtggacgccaaactgctcgaaccttaatg

SEQ ID NO: 88600 - DNA, 75 bp, Artificial Sequence
  Synthetic
cagcggccctgaagcggtcttacttcactcagagtcaaggtgaaattcagtggatgagaccatcgaaagaggttg

SEQ ID NO: 88601 - DNA, 75 bp, Artificial Sequence
  Synthetic
aagaaccagcagttttgaccaaaaatgaccccagactcaaggtggatttcgaagaggccatattctctaaatatg

SEQ ID NO: 88602 - DNA, 75 bp, Artificial Sequence
  Synthetic
tgaccccagactcaaggtggatttcgaagaggccatattctctaaatatgtgggcaacaaaattactgaagtgga

SEQ ID NO: 88603 - DNA, 75 bp, Artificial Sequence
  Synthetic
cctagaggatgccatgtacggcactgatggtttggaggcactagacctcacaaccagtgcaggatatccctatgt

SEQ ID NO: 88604 - DNA, 75 bp, Artificial Sequence
  Synthetic
gatggtttggaggcactagacctcacaaccagtgcaggatatccctatgtagccctggggaagaagaaaagggac

SEQ ID NO: 88605 - DNA, 75 bp, Artificial Sequence
  Synthetic
gttacttatgtaaaggatgagttgaggtccaagagtaaggttgaacaaggcaagtccagactcattgaagcatcc

SEQ ID NO: 88606 - DNA, 75 bp, Artificial Sequence
  Synthetic
ggtccaagagtaaggttgaacaaggcaagtccagactcattgaagcatccagtctcaatgattcagtagcaatga

SEQ ID NO: 88607 - DNA, 75 bp, Artificial Sequence
  Synthetic
accccgacttgttttggagcaaaattccagttctcatggaagaaaagttatttgcctttgattacactggctatg

SEQ ID NO: 88608 - DNA, 75 bp, Artificial Sequence
  Synthetic
aaaattggttttggtgatagagtagattacattgattatctcaatcattcacaccatctttacaaaaacaaaaca

SEQ ID NO: 88609 - DNA, 75 bp, Artificial Sequence
  Synthetic
aattcatgaatcaatcagatggaccaaagatcccagaaacacgcaggatcatgttcgctccttgtgcctattggc

SEQ ID NO: 88610 - DNA, 75 bp, Artificial Sequence
  Synthetic
gctcccagagtactcaacactgtaccgccgttggctcgattctttttagtaaccctacctcagtcgaattggatt

SEQ ID NO: 88611 - DNA, 75 bp, Artificial Sequence
  Synthetic
cagtgtcaccacgaacaagcacttctgtttccccggtgattttacataagctgtacccacggctgaaagtgaatg

SEQ ID NO: 88612 - DNA, 75 bp, Artificial Sequence
  Synthetic
tgagcatcatgtggaacagagacctcttgattgccgaatcgaaggctcagggcaccgacacaatcgccaggtgca

SEQ ID NO: 88613 - DNA, 75 bp, Artificial Sequence
  Synthetic
cttgattgccgaatcgaaggctcagggcaccgacacaatcgccaggtgcagctgcagaacaggagtttactactg

SEQ ID NO: 88614 - DNA, 75 bp, Artificial Sequence
  Synthetic
tttgtatggctgtttatggtgacaatcatagattgttatcataaagcgaattggattggccatccggtaaaaatt

SEQ ID NO: 88615 - DNA, 75 bp, Artificial Sequence
  Synthetic
tcctgccaggtaccaatctcacatgctgatcggacatggttttgcctcacctggtgattgtggaggcatccttag

SEQ ID NO: 88616 - DNA, 75 bp, Artificial Sequence
  Synthetic
ctgatcggacatggttttgcctcacctggtgattgtggaggcatccttagatgccaacatggagttattggaatt

SEQ ID NO: 88617 - DNA, 75 bp, Artificial Sequence
  Synthetic
ataatcaggctattgtatcacaatgggagctcaagtctcatcgcaaaaggtcggtgcacatgagaataccaacgt

SEQ ID NO: 88618 - DNA, 75 bp, Artificial Sequence
  Synthetic
tcggtgcacatgagaataccaacgttgccactggcgggtcaacagtgaattacaccaccataaattattacaaag

SEQ ID NO: 88619 - DNA, 75 bp, Artificial Sequence
  Synthetic
gaacaaggtatatccaactacatcgaatcactcggcgccgcttttggaagtgggtttactcagcagatcggagac

SEQ ID NO: 88620 - DNA, 75 bp, Artificial Sequence
  Synthetic
aatcactcggcgccgcttttggaagtgggtttactcagcagatcggagacaaaatctcggagctcactagcatgg

SEQ ID NO: 88621 - DNA, 75 bp, Artificial Sequence
  Synthetic
taactctccaaacattgaggcatgtggatatagtgacagagtcatgcaactcacccttggaaactccaccattac

SEQ ID NO: 88622 - DNA, 75 bp, Artificial Sequence
  Synthetic
actacgaggataccaccacagtgctggccacgttggcgctccttggatgtgacgtctcaccatggcagtggttga

SEQ ID NO: 88623 - DNA, 75 bp, Artificial Sequence
  Synthetic
ggccacgttggcgctccttggatgtgacgtctcaccatggcagtggttgaagaagaaagcatgtgacatcctcga

SEQ ID NO: 88624 - DNA, 75 bp, Artificial Sequence
  Synthetic
agtagaccaaccaactgagccggacgtttcagcgtgcagattttacaccttggacacagtagagtggagtaagga

SEQ ID NO: 88625 - DNA, 75 bp, Artificial Sequence
  Synthetic
tgagtgggtgtcaaataagatttccaagttcattgactggctcaaggaaaagatcataccgcaagccagagacaa

SEQ ID NO: 88626 - DNA, 75 bp, Artificial Sequence
  Synthetic
aagttcattgactggctcaaggaaaagatcataccgcaagccagagacaaacttgaattcgtcaccaaacttaag

SEQ ID NO: 88627 - DNA, 75 bp, Artificial Sequence
  Synthetic
tttaacaatgtacgttggttgtcaatccagtctaagagatttgcaccattgtatgcactcgaagctaagagaatc

SEQ ID NO: 88628 - DNA, 75 bp, Artificial Sequence
  Synthetic
tccagtctaagagatttgcaccattgtatgcactcgaagctaagagaatccaaaagttggaacacaccatcaaca

SEQ ID NO: 88629 - DNA, 75 bp, Artificial Sequence
  Synthetic
gttagtgtctttaacccagatacaggtgctgttcccaaacgccagttccaaccagtagactacttgttcgggtgt

SEQ ID NO: 88630 - DNA, 75 bp, Artificial Sequence
  Synthetic
accagtagactacttgttcgggtgtggggttctggccggtaatgcatttgtctttccccatcagattattaactt

SEQ ID NO: 88631 - DNA, 75 bp, Artificial Sequence
  Synthetic
agtcagtggcaaccaatttgatagctagagcaattgcagagaaggaaaacacttccgcgtactcactgccacccg

SEQ ID NO: 88632 - DNA, 75 bp, Artificial Sequence
  Synthetic
tagagcaattgcagagaaggaaaacacttccgcgtactcactgccacccgatccctcccattttgatgggtacaa

SEQ ID NO: 88633 - DNA, 75 bp, Artificial Sequence
  Synthetic
ggtgtctacagttgagttcattcccccgatggcttccttggaagaaaaaggcattttgttcacatccaattacgt

SEQ ID NO: 88634 - DNA, 75 bp, Artificial Sequence
  Synthetic
ccgatggcttccttggaagaaaaaggcattttgttcacatccaattacgtgctggcctctactaattccagccgg

SEQ ID NO: 88635 - DNA, 75 bp, Artificial Sequence
  Synthetic
ggtgagtattccagggatggaaaacttaacatggccatggccacagaaatgtgcaaaaattgccaccaaccagca

SEQ ID NO: 88636 - DNA, 75 bp, Artificial Sequence
  Synthetic
ttaacatggccatggccacagaaatgtgcaaaaattgccaccaaccagcaaatttcaaaagatgttgccctctag

SEQ ID NO: 88637 - DNA, 75 bp, Artificial Sequence
  Synthetic
caacaaaccaattttgtgcttgtcactttcgcctgctagtgacccaaggctcagctatactatgctgggtgaaat

SEQ ID NO: 88638 - DNA, 75 bp, Artificial Sequence
  Synthetic
tcatcaatgagagaaacaggcgctctaacattggtaactgcatggaggcgctgttccagggaccactgcaataca

SEQ ID NO: 88639 - DNA, 75 bp, Artificial Sequence
  Synthetic
aggaggtcagagactattgtgagaagaagggatggattgtcaacatcactagccaggttcaaactgagagaaaca

SEQ ID NO: 88640 - DNA, 75 bp, Artificial Sequence
  Synthetic
aacaccaacgaccatggacatcctcggatttgtatcagcttgcaatgactttactgttagattgctgagggatac

SEQ ID NO: 88641 - DNA, 75 bp, Artificial Sequence
  Synthetic
ccatgacaatgtcgcgattttaccaactcatgcgtcacctggagagagcattgtgatcgacggtaaggaggtgga

SEQ ID NO: 88642 - DNA, 75 bp, Artificial Sequence
  Synthetic
acagcagttgaaacaggtgccactaatccactagagccctcagatactgttcaaaccagacatgtaatccaaacc

SEQ ID NO: 88643 - DNA, 75 bp, Artificial Sequence
  Synthetic
ttgtgatcgacggtaaggaggtggaagtcttggatgccaaagctctggaagatcaggctgggactaacttggaga

SEQ ID NO: 88644 - DNA, 75 bp, Artificial Sequence
  Synthetic
tacaatgagtcgtcaaccgcctcacccagtaccctgtttgcaaaatggaatataacatacacagacaccgtgcaa

SEQ ID NO: 88645 - DNA, 75 bp, Artificial Sequence
  Synthetic
ttcaatggtaatgcaggttatgcctcaaaccaggtgtatcagattatgtatgttcctccaggtgccccaatacct

SEQ ID NO: 88646 - DNA, 75 bp, Artificial Sequence
  Synthetic
cggatttccattccatttgtggggattgccaacgcatattctcacttttacgacgggtatgccacagtgccctta

SEQ ID NO: 88647 - DNA, 75 bp, Artificial Sequence
  Synthetic
aaccaaattggaacccagtgcttttcatcatgtttttgagggagtcaaggaaccagcagttctgactaagaatga

SEQ ID NO: 88648 - DNA, 75 bp, Artificial Sequence
  Synthetic
agagtagtgaatgaatacaacccagttagaatctcatccaaagtgcgagtctacatgaaacccaagcatgtgcgc

SEQ ID NO: 88649 - DNA, 75 bp, Artificial Sequence
  Synthetic
gtacatgaaggaggcggtagatcactatgcaggacaattaatgtcacttgacatcaacacagatcaaatgtgtct

SEQ ID NO: 88650 - DNA, 75 bp, Artificial Sequence
  Synthetic
tatgcaggacaattaatgtcacttgacatcaacacagatcaaatgtgtcttgaggatgccatgtatggaactgat

SEQ ID NO: 88651 - DNA, 75 bp, Artificial Sequence
  Synthetic
ctcaacaaacaaaccagggacaccaaagagatgcagagacttctggatacctacggcataaacctcccattggtg

SEQ ID NO: 88652 - DNA, 75 bp, Artificial Sequence
  Synthetic
aagagatgcagagacttctggatacctacggcataaacctcccattggtgacctatgtcaaggacgagctcagat

SEQ ID NO: 88653 - DNA, 75 bp, Artificial Sequence
  Synthetic
tggcttttggaaacttgtatgcagcctttcacaagaatccaggtgtggtgacggggtcagctgttggttgtgatc

SEQ ID NO: 88654 - DNA, 75 bp, Artificial Sequence
  Synthetic
ctttcacaagaatccaggtgtggtgacggggtcagctgttggttgtgatccagacctgttttggagtaagatacc

SEQ ID NO: 88655 - DNA, 75 bp, Artificial Sequence
  Synthetic
agctctcaagatggtattggagaaaattggatttggagatagggtggattacatcgattacctcaaccattcaca

SEQ ID NO: 88656 - DNA, 75 bp, Artificial Sequence
  Synthetic
acatcgattacctcaaccattcacatcacctttataaaaacaaggcctactgtgtcaaaggcggcatgccatcag

SEQ ID NO: 88657 - DNA, 75 bp, Artificial Sequence
  Synthetic
aaaagactatggactaaccatgactccagctgacaaatcagccacatttgagacagtcacatgggagaatgtaac

SEQ ID NO: 88658 - DNA, 75 bp, Artificial Sequence
  Synthetic
ttgattggttaaaggagaggatcatcccagaggctagggacaaggtggagtacatcaccaagcttaggcaattag

SEQ ID NO: 88659 - DNA, 75 bp, Artificial Sequence
  Synthetic
tcacgaatcaatcagatggacaaaggatcctagaaatacccaggatcacgttcgctcactatgcctattggcttg

SEQ ID NO: 88660 - DNA, 75 bp, Artificial Sequence
  Synthetic
atcaaaatccagatggaatggacatgaaactcttttgtcagatggtctctactgtggagtttataccaccaatgg

SEQ ID NO: 88661 - DNA, 75 bp, Artificial Sequence
  Synthetic
tttgtcaaggcgatttgcctttgacatggaggttttcgtgatgtcagaacactcaatcagaggtaaactaaacat

SEQ ID NO: 88662 - DNA, 75 bp, Artificial Sequence
  Synthetic
atggaggttttcgtgatgtcagaacactcaatcagaggtaaactaaacatgtgcactgcaacccaaatgtgtaga

SEQ ID NO: 88663 - DNA, 75 bp, Artificial Sequence
  Synthetic
aacactagacaaagatacaccattgatgagattaccacgctcataattaatgaaaagaacaggagggcgaatatt

SEQ ID NO: 88664 - DNA, 75 bp, Artificial Sequence
  Synthetic
tgaaaagaacaggagggcgaatattggtaattgcatggaggccctgttccaaggaccattagtgtacaaggacct

SEQ ID NO: 88665 - DNA, 75 bp, Artificial Sequence
  Synthetic
cagagattactgtgaaaagaagggttggatagtcaatgtaaccagtgaagtacaaacagagagaaacctcaatag

SEQ ID NO: 88666 - DNA, 75 bp, Artificial Sequence
  Synthetic
tggatagtcaatgtaaccagtgaagtacaaacagagagaaacctcaatagggccatgacaattcttcaagcacta

SEQ ID NO: 88667 - DNA, 75 bp, Artificial Sequence
  Synthetic
acaagggccaggatttgactatgcagttgctatggccaaaagaaacattgttaccgccactaccagtaagggtga

SEQ ID NO: 88668 - DNA, 75 bp, Artificial Sequence
  Synthetic
tgatggcaaagaagttgaggtagttgatgccaaagctcttgaagatcaggctggcaccaatttagaaatcactat

SEQ ID NO: 88669 - DNA, 75 bp, Artificial Sequence
  Synthetic
taaggtggaacaggggaagtccagattaattgaagcatctagtctgaatgattcggttgcaatgagaatggcctt

SEQ ID NO: 88670 - DNA, 75 bp, Artificial Sequence
  Synthetic
aagaaccctggtgtaatcaccggatcagctgtagggtgtgacccagatctgttctggagtaaaattccagtcttg

SEQ ID NO: 88671 - DNA, 75 bp, Artificial Sequence
  Synthetic
tagtccagcatggtttgaggctctcaagatggtgttagagaaaattggttttggagacagggtagactacattga

SEQ ID NO: 88672 - DNA, 75 bp, Artificial Sequence
  Synthetic
gctgtgcctattggcttggcacaatggcgaagaagaatacaacaaatttttagctaaaattaggagtgtgccaat

SEQ ID NO: 88673 - DNA, 75 bp, Artificial Sequence
  Synthetic
ttgggtgaccgtgtttcctttattacctattgaatgtttatggtgacaattgtttgattcagttgttgccattta

SEQ ID NO: 88674 - DNA, 75 bp, Artificial Sequence
  Synthetic
aacccacgaaaactccaatagtgcaaatggaggctcaaccatcaactataccaccataaactattacaaggatag

SEQ ID NO: 88675 - DNA, 75 bp, Artificial Sequence
  Synthetic
aatggaggctcaaccatcaactataccaccataaactattacaaggatagtgccagcaatgcggccactaaaatg

SEQ ID NO: 88676 - DNA, 75 bp, Artificial Sequence
  Synthetic
tccccgaatattgaggcgtgtggctacagtgaccgagtgatgcagctcacactgggcaattccaccataaccact

SEQ ID NO: 88677 - DNA, 75 bp, Artificial Sequence
  Synthetic
acagtgaccgagtgatgcagctcacactgggcaattccaccataaccactcaggaagcggccaatgctgtgattg

SEQ ID NO: 88678 - DNA, 75 bp, Artificial Sequence
  Synthetic
cgagcaatcgattttacacccttgagagcgttgagtggcaagagtcatctcgtggttggtggtggaagctccctg

SEQ ID NO: 88679 - DNA, 75 bp, Artificial Sequence
  Synthetic
gagcgttgagtggcaagagtcatctcgtggttggtggtggaagctccctgatgctctcaaggacatgggcatgtt

SEQ ID NO: 88680 - DNA, 75 bp, Artificial Sequence
  Synthetic
tcaccaagggaccctgtttgtggctgcaatcccggaatttatgatggccagcaactcggcagataggaccggtgg

SEQ ID NO: 88681 - DNA, 75 bp, Artificial Sequence
  Synthetic
gcaatcccggaatttatgatggccagcaactcggcagataggaccggtggcattacctatgaaaaagctaatccc

SEQ ID NO: 88682 - DNA, 75 bp, Artificial Sequence
  Synthetic
gtggactggttgttggggtgcggtgtgctagctggtaacatcacggtgttcccgcaccaaattataaatttgcgc

SEQ ID NO: 88683 - DNA, 75 bp, Artificial Sequence
  Synthetic
tgctagctggtaacatcacggtgttcccgcaccaaattataaatttgcgcaccaacaattgtgccacgttggtgc

SEQ ID NO: 88684 - DNA, 75 bp, Artificial Sequence
  Synthetic
tgccacttaaatacgaggctggtgcatcaactgcaatccccataactgtaactgtggccccaatgtgctgcgagt

SEQ ID NO: 88685 - DNA, 75 bp, Artificial Sequence
  Synthetic
atcaactgcaatccccataactgtaactgtggccccaatgtgctgcgagtttaacgggcttcggtcgatgacagc

SEQ ID NO: 88686 - DNA, 75 bp, Artificial Sequence
  Synthetic
cccatgcatcgtcccaaattacgatgtgacggctccaatccacatacccggcgaggtgcacaatatgatggaact

SEQ ID NO: 88687 - DNA, 75 bp, Artificial Sequence
  Synthetic
gtgacggctccaatccacatacccggcgaggtgcacaatatgatggaactggcagaaattgatagtgttatacct

SEQ ID NO: 88688 - DNA, 75 bp, Artificial Sequence
  Synthetic
gaccaagcaatatttgcattaagcctaagcccagcctcagacaaaaggttgtcacgcacgcttttgggcgaaatt

SEQ ID NO: 88689 - DNA, 75 bp, Artificial Sequence
  Synthetic
taagcccagcctcagacaaaaggttgtcacgcacgcttttgggcgaaattctgaattattacacacattgggccg

SEQ ID NO: 88690 - DNA, 75 bp, Artificial Sequence
  Synthetic
ctggtgcagcccccccgagaacacgaaaggatgccatgctggggacacatgtaatctgggacattggcttgcaat

SEQ ID NO: 88691 - DNA, 75 bp, Artificial Sequence
  Synthetic
aaaggatgccatgctggggacacatgtaatctgggacattggcttgcaatccagcgccacccttgtggccccgtg

SEQ ID NO: 88692 - DNA, 75 bp, Artificial Sequence
  Synthetic
aacagccatagtagtcccttcaggtgcacccaaaacaatgagtatgttggcctttgttagtgcgtgcaatgactt

SEQ ID NO: 88693 - DNA, 75 bp, Artificial Sequence
  Synthetic
gattgatgccttggtagatgggatggtcaacatgtctctagacacagtccaaaacacaatggccagtggttctgt

SEQ ID NO: 88694 - DNA, 75 bp, Artificial Sequence
  Synthetic
aggcaaagatcagagtgcactgtggagtccttcttggggagggctgcgctggtgacaatcatgagtctgcacaat

SEQ ID NO: 88695 - DNA, 75 bp, Artificial Sequence
  Synthetic
cgcaggaaacttgaaatgttcacctattccagatttgacattgaactcactttcgtcattaccgagcgatttgca

SEQ ID NO: 88696 - DNA, 75 bp, Artificial Sequence
  Synthetic
tgggatgacttcacatggcaaacttccacaaacccgtctgtattttacaccacaggcaacgccccgccaagagtg

SEQ ID NO: 88697 - DNA, 75 bp, Artificial Sequence
  Synthetic
attagcgctggagcaacaaacaagtatggttacaacaccattaatgactttgggaccgtggctgtgcgtattgtg

SEQ ID NO: 88698 - DNA, 75 bp, Artificial Sequence
  Synthetic
cccaggccaccaagagctgtggaatacaccgggccatcggttgactacaaacaggacaacactgtgatggagcag

SEQ ID NO: 88699 - DNA, 75 bp, Artificial Sequence
  Synthetic
aaatattacccagtaactgtggagggtccaacctttaggtacatggatgcaaacgaatactaccccgcacgatac

SEQ ID NO: 88700 - DNA, 75 bp, Artificial Sequence
  Synthetic
gtccaacctttaggtacatggatgcaaacgaatactaccccgcacgataccaatcgcacatgctcataggagccg

SEQ ID NO: 88701 - DNA, 75 bp, Artificial Sequence
  Synthetic
gtgaaggggtcgttgcatttgcagacgtaagagatctgtttgcatatgaggaagaggccatggaacaaggcatca

SEQ ID NO: 88702 - DNA, 75 bp, Artificial Sequence
  Synthetic
gagatatctagcaggatacaggaactacaggaaaccattcagaatgtcattactgaaaagttgcttaaaaatctg

SEQ ID NO: 88703 - DNA, 75 bp, Artificial Sequence
  Synthetic
ttgctggggtgtgatgcctctccatggcattggttgaaagagaaagtttgcaacatactaggtattccatatgca

SEQ ID NO: 88704 - DNA, 75 bp, Artificial Sequence
  Synthetic
ggcattggttgaaagagaaagtttgcaacatactaggtattccatatgcaatgaagcagggcgactcctggatga

SEQ ID NO: 88705 - DNA, 75 bp, Artificial Sequence
  Synthetic
ggataaagactaaaattttgccagaagcacaagacaaagtagaatatttgtccaaattgaagcacctagacacac

SEQ ID NO: 88706 - DNA, 75 bp, Artificial Sequence
  Synthetic
agcacaagacaaagtagaatatttgtccaaattgaagcacctagacacacttgaaaatcaggtaactaccctgca

SEQ ID NO: 88707 - DNA, 75 bp, Artificial Sequence
  Synthetic
gtttgcacccttgtatgctagcgaggcgcgtcgcattttcaagatggagagcaccatcaacaactacatacagtt

SEQ ID NO: 88708 - DNA, 75 bp, Artificial Sequence
  Synthetic
gcgcgtcgcattttcaagatggagagcaccatcaacaactacatacagttcaagaccaaacaccgcattgaacct

SEQ ID NO: 88709 - DNA, 75 bp, Artificial Sequence
  Synthetic
gtgattatggatgatctcaatcaaaatccagacggggaggatatgaaacttttctgtcaaatggtgtcaacggtg

SEQ ID NO: 88710 - DNA, 75 bp, Artificial Sequence
  Synthetic
aactcgtataccatatcaccaccaacgatatcagcttcagacgcactggccaggcgctttgcgtttgatgtggac

SEQ ID NO: 88711 - DNA, 75 bp, Artificial Sequence
  Synthetic
cgatatcagcttcagacgcactggccaggcgctttgcgtttgatgtggacattgaggtgatgtcacagtacaaca

SEQ ID NO: 88712 - DNA, 75 bp, Artificial Sequence
  Synthetic
gttgccctctggtgtgtggaaaagccattcagtttgtggataaaatgacacgcaccagatacactgtagacgagc

SEQ ID NO: 88713 - DNA, 75 bp, Artificial Sequence
  Synthetic
cattcagtttgtggataaaatgacacgcaccagatacactgtagacgagctgaccactttgattgtaaacgagag

SEQ ID NO: 88714 - DNA, 75 bp, Artificial Sequence
  Synthetic
tgacataaaaacaacacctccaccacccgctatagcggatttacttcgatccgtcgatagcgatcaagtccggga

SEQ ID NO: 88715 - DNA, 75 bp, Artificial Sequence
  Synthetic
cccgctatagcggatttacttcgatccgtcgatagcgatcaagtccgggagtattgcaccaaacaaggctgggtt

SEQ ID NO: 88716 - DNA, 75 bp, Artificial Sequence
  Synthetic
tcctttgtggttgtttctggtatgttattcatcatttacaaattgtttgccaactttcaaggggcgtatacaggg

SEQ ID NO: 88717 - DNA, 75 bp, Artificial Sequence
  Synthetic
gggtccagcgtttgattacgcagttgctatggcgaagcgtaatatactgactgcaacaacagacaggggcgaatt

SEQ ID NO: 88718 - DNA, 75 bp, Artificial Sequence
  Synthetic
gccaggcgccttgtggacaccaacgatgtgaacttagaaataaccattgttgaacttgacaggaatgaaaaattt

SEQ ID NO: 88719 - DNA, 75 bp, Artificial Sequence
  Synthetic
gagctgtcactgagcaaggaatgttaaatttggggggtaggcccaccaaccgaaccttgatgtacaactttccca

SEQ ID NO: 88720 - DNA, 75 bp, Artificial Sequence
  Synthetic
cccatgggttcgcggctgcgctgaaaaggtcgtatttcaccagtgaacaaggtgaaatacaatggatgaggccca

SEQ ID NO: 88721 - DNA, 75 bp, Artificial Sequence
  Synthetic
aaggtcgtatttcaccagtgaacaaggtgaaatacaatggatgaggcccagtaaggacgctggctatccggtcat

SEQ ID NO: 88722 - DNA, 75 bp, Artificial Sequence
  Synthetic
tttgactaagtcagatcctagacttgaagtcgattttgaggaagccatcttttccaaatacgtgggcaataccat

SEQ ID NO: 88723 - DNA, 75 bp, Artificial Sequence
  Synthetic
gaagtcgattttgaggaagccatcttttccaaatacgtgggcaataccatcacagaagtcgatgagtacatgaag

SEQ ID NO: 88724 - DNA, 75 bp, Artificial Sequence
  Synthetic
ttgtacgggaccgaaggccttgaggccctggatcttacaaccagtgccggttacccctacgtaaccatggggaaa

SEQ ID NO: 88725 - DNA, 75 bp, Artificial Sequence
  Synthetic
ccctggatcttacaaccagtgccggttacccctacgtaaccatggggaaaaggaagagagaaattctgaataagg

SEQ ID NO: 88726 - DNA, 75 bp, Artificial Sequence
  Synthetic
aggatgagttgcgtaaaccatcaaaaattaagacagggaagtccaggttgatagaggctagctcactaaatgact

SEQ ID NO: 88727 - DNA, 75 bp, Artificial Sequence
  Synthetic
ccgtagggtgcgaccctgacatcttctggagtaagataccagttatgcttgatggccacttgtttgcctttgatt

SEQ ID NO: 88728 - DNA, 75 bp, Artificial Sequence
  Synthetic
accagcttggtttgaagcccttaaaatggtactagagaaaataggatatggtgatcgtgtggactacatagatta

SEQ ID NO: 88729 - DNA, 75 bp, Artificial Sequence
  Synthetic
tatggcgatgatgtcctggccagctacccacaccaaatagacgcaggcctcctagctcagacaggaaaagattac

SEQ ID NO: 88730 - DNA, 75 bp, Artificial Sequence
  Synthetic
tcccttacctaatacacccagttatgccaatgacggagatacaagagtcaattcgctggaccaaagacccaaaga

SEQ ID NO: 88731 - DNA, 75 bp, Artificial Sequence
  Synthetic
atcaggtaagatcggtcgcggtcggccgtgcattactcctgccggagtactcaacactgcgccgacgttggctag

SEQ ID NO: 88732 - DNA, 75 bp, Artificial Sequence
  Synthetic
ccgtgcattactcctgccggagtactcaacactgcgccgacgttggctagactctttctgatcaaccatacctca

SEQ ID NO: 88733 - DNA, 75 bp, Artificial Sequence
  Synthetic
cagtgtaacgcctccaaattccaccagggggcattaggggtattcgccgtaccagagatgtgtctggccggggat

SEQ ID NO: 88734 - DNA, 75 bp, Artificial Sequence
  Synthetic
aactgctcgtactttaatgtacaactttccaaccagagcaggacagtgtggtggagtcatcacatgtactgggaa

SEQ ID NO: 88735 - DNA, 75 bp, Artificial Sequence
  Synthetic
gcaatggctactgagacgtgcaaggactgccaccaaccagcaaacttcaaaagatgctgtcctttagtgtgtggt

SEQ ID NO: 88736 - DNA, 75 bp, Artificial Sequence
  Synthetic
tcgggatgcacgttggtgggaatggttcacatgggtttgcagcggccctgaagcggtcatacttcactcagagcc

SEQ ID NO: 88737 - DNA, 75 bp, Artificial Sequence
  Synthetic
ttaaactggctgcttatggtgacaatcattgattgttatcataaagcgaattggattggccatccggtgagaatc

SEQ ID NO: 88738 - DNA, 75 bp, Artificial Sequence
  Synthetic
tcattgattgttatcataaagcgaattggattggccatccggtgagaatcagatccattatctacttgttcattg

SEQ ID NO: 88739 - DNA, 75 bp, Artificial Sequence
  Synthetic
ggagctcaagtttcctcacaaaaagtcggtgcccatgaaaacaccaatgtggctactggtggatcaactgtaaat

SEQ ID NO: 88740 - DNA, 75 bp, Artificial Sequence
  Synthetic
tcggtgcccatgaaaacaccaatgtggctactggtggatcaactgtaaattacactacaatcaactactataagg

SEQ ID NO: 88741 - DNA, 75 bp, Artificial Sequence
  Synthetic
tcatgttaaagtcggcaccagctctaaattcaccaaacatagaggcgtgtgggtacagtgaccgagtgatgcaac

SEQ ID NO: 88742 - DNA, 75 bp, Artificial Sequence
  Synthetic
aaattcaccaaacatagaggcgtgtgggtacagtgaccgagtgatgcaactcacactgggcaattcaacaattac

SEQ ID NO: 88743 - DNA, 75 bp, Artificial Sequence
  Synthetic
agtggatcaaccaactgagccagatgtggctgcgtgtcgtttttacacactagagtcagtgatgtggagtaagga

SEQ ID NO: 88744 - DNA, 75 bp, Artificial Sequence
  Synthetic
gtggctgcgtgtcgtttttacacactagagtcagtgatgtggagtaaggagagcagagggtggtggtggaagtta

SEQ ID NO: 88745 - DNA, 75 bp, Artificial Sequence
  Synthetic
attcatgtccaatgcaatgcatcaaaattccatcaaggcactctgggagtgttcgctatcccagagtattgttta

SEQ ID NO: 88746 - DNA, 75 bp, Artificial Sequence
  Synthetic
aattccatcaaggcactctgggagtgttcgctatcccagagtattgtttagcaggggactctgatgttaagaatt

SEQ ID NO: 88747 - DNA, 75 bp, Artificial Sequence
  Synthetic
gaaccaaccccacccgcaaattttgtgccgtggattacctcttggggtgtggtgtactagctgggaacgcgtttg

SEQ ID NO: 88748 - DNA, 75 bp, Artificial Sequence
  Synthetic
tgccgtggattacctcttggggtgtggtgtactagctgggaacgcgtttgtgttcccacaccagatcattaactt

SEQ ID NO: 88749 - DNA, 75 bp, Artificial Sequence
  Synthetic
caactggggtatcgcgatcatccccttgtccaagttggattttgcccccgatgcatcagtggaattacccataac

SEQ ID NO: 88750 - DNA, 75 bp, Artificial Sequence
  Synthetic
ttgtccaagttggattttgcccccgatgcatcagtggaattacccataacagttaccattgcgcccatgtgctgt

SEQ ID NO: 88751 - DNA, 75 bp, Artificial Sequence
  Synthetic
cagtatctgaccgccgataactttcagtctccatgcgcacttcctgaattcgatgtgacccagcccattgacatc

SEQ ID NO: 88752 - DNA, 75 bp, Artificial Sequence
  Synthetic
agtctccatgcgcacttcctgaattcgatgtgacccagcccattgacatcccaggggaagtgaaaaacttgatgg

SEQ ID NO: 88753 - DNA, 75 bp, Artificial Sequence
  Synthetic
tacaattgcaagcatctccatctaacagggataccccaatattgtgtttgtcactgtcaccagcaagtgacccca

SEQ ID NO: 88754 - DNA, 75 bp, Artificial Sequence
  Synthetic
cagggataccccaatattgtgtttgtcactgtcaccagcaagtgaccccagattatcatttactatgttgggaga

SEQ ID NO: 88755 - DNA, 75 bp, Artificial Sequence
  Synthetic
gggaaaaatcttagtatcatatgcacctccaggtgcacaaccacccaaaaccagaaaagatgccatgttgggcac

SEQ ID NO: 88756 - DNA, 75 bp, Artificial Sequence
  Synthetic
cctccaggtgcacaaccacccaaaaccagaaaagatgccatgttgggcactcacctgatctgggatattggtctt

SEQ ID NO: 88757 - DNA, 75 bp, Artificial Sequence
  Synthetic
gaaggaggatacatcagcatgttttaccagacaaaaatagtcgttccagcctcaacaccaacaacgatggacatt

SEQ ID NO: 88758 - DNA, 75 bp, Artificial Sequence
  Synthetic
accagacaaaaatagtcgttccagcctcaacaccaacaacgatggacattattgggttcgtgtcagcctgcaatg

SEQ ID NO: 88759 - DNA, 75 bp, Artificial Sequence
  Synthetic
tccaacaggttgcatcgaatgcgctgcaaatctcacagccgacgcgtccggcactgccctctacagaaagtcttc

SEQ ID NO: 88760 - DNA, 75 bp, Artificial Sequence
  Synthetic
gcaaatctcacagccgacgcgtccggcactgccctctacagaaagtcttcccaacacacaacaatcggcaccttc

SEQ ID NO: 88761 - DNA, 75 bp, Artificial Sequence
  Synthetic
acaaacaaggcatgttatccagactagatccaggtcagagtccacaatagagtccttcttcgcgcgtggtgcatg

SEQ ID NO: 88762 - DNA, 75 bp, Artificial Sequence
  Synthetic
agatccaggtcagagtccacaatagagtccttcttcgcgcgtggtgcatgtgtgacaatcatgacagtggaaaat

SEQ ID NO: 88763 - DNA, 75 bp, Artificial Sequence
  Synthetic
ctcagaaggaagttggagatgttcacttactctcgatttgacattgaatttacctttgtcaccacagaaaggtac

SEQ ID NO: 88764 - DNA, 75 bp, Artificial Sequence
  Synthetic
cttactctcgatttgacattgaatttacctttgtcaccacagaaaggtactacgccagtaactcaggccatgcgc

SEQ ID NO: 88765 - DNA, 75 bp, Artificial Sequence
  Synthetic
aaacttcctccaacccatcggtgttttacacatacggtgacgctccagcgcgcatttccataccatttgtaggga

SEQ ID NO: 88766 - DNA, 75 bp, Artificial Sequence
  Synthetic
ttacacatacggtgacgctccagcgcgcatttccataccatttgtagggatagctaatgcctattcccactttta

SEQ ID NO: 88767 - DNA, 75 bp, Artificial Sequence
  Synthetic
taatgattttggaatgttggcggtgagagtagtcaacgaattcaacccagccagaatcacatctaaattgagagt

SEQ ID NO: 88768 - DNA, 75 bp, Artificial Sequence
  Synthetic
agagtagtcaacgaattcaacccagccagaatcacatctaaattgagagtgtacatgaaaccaaagcatgttagg

SEQ ID NO: 88769 - DNA, 75 bp, Artificial Sequence
  Synthetic
ctttctacaaaagcactcaacacttatgggtttggacaccaaaataaggcagtctacacagcaggctacaaaatc

SEQ ID NO: 88770 - DNA, 75 bp, Artificial Sequence
  Synthetic
atgggtttggacaccaaaataaggcagtctacacagcaggctacaaaatctgtaactaccatctggcaacccaag

SEQ ID NO: 88771 - DNA, 75 bp, Artificial Sequence
  Synthetic
attcaatcgcaaggtgcaactgcaatgcaggtgtgtactattgtgaatctaggagaaaatactacccagtatctt

SEQ ID NO: 88772 - DNA, 75 bp, Artificial Sequence
  Synthetic
tgcaggtgtgtactattgtgaatctaggagaaaatactacccagtatcttttgtgggccctaccttccaatatat

SEQ ID NO: 88773 - DNA, 75 bp, Artificial Sequence
  Synthetic
ttgtggtggcatccttagatgtcagcatggagtcatagggatcatcacggccggtggtaatggcttggtcgcgtt

SEQ ID NO: 88774 - DNA, 75 bp, Artificial Sequence
  Synthetic
catggagtcatagggatcatcacggccggtggtaatggcttggtcgcgttctcagacatcagggacttgtatgca

SEQ ID NO: 88775 - DNA, 75 bp, Artificial Sequence
  Synthetic
acacaacaaattggagaaaaagtgtcagaaatcgctaatatggtcaccaatactatcacagagaaattattgaaa

SEQ ID NO: 88776 - DNA, 75 bp, Artificial Sequence
  Synthetic
cagaaatcgctaatatggtcaccaatactatcacagagaaattattgaaaaatctaatcaaaataatctcctcac

SEQ ID NO: 88777 - DNA, 75 bp, Artificial Sequence
  Synthetic
ccccttggcagtggctaaagaagaaagcatgcgacatattagagatcccatatgtgaccaaacagggagacagtt

SEQ ID NO: 88778 - DNA, 75 bp, Artificial Sequence
  Synthetic
agcatgcgacatattagagatcccatatgtgaccaaacagggagacagttggttgaagaagttcacagaagcctg

SEQ ID NO: 88779 - DNA, 75 bp, Artificial Sequence
  Synthetic
accccaagccagggacaaattggagtttgtgaccaaattgaagcaattggagatgttggagaaccaaatatctac

SEQ ID NO: 88780 - DNA, 75 bp, Artificial Sequence
  Synthetic
agatgttggagaaccaaatatctactattcaccagtcatgccccagtcaggaacatcaggagattcttttcaata

SEQ ID NO: 88781 - DNA, 75 bp, Artificial Sequence
  Synthetic
tggaacacactatcaacaattacatacagttcaagagcaaacaccgtattgaaccagtatgtttgttggtacatg

SEQ ID NO: 88782 - DNA, 75 bp, Artificial Sequence
  Synthetic
acagttcaagagcaaacaccgtattgaaccagtatgtttgttggtacatggtagtcctggaacagggaagtcagt

SEQ ID NO: 88783 - DNA, 75 bp, Artificial Sequence
  Synthetic
acactttgatggctacaaacaacagggagtggtcatcatggacgacctcaaccaaaatccggatggtgccgatat

SEQ ID NO: 88784 - DNA, 75 bp, Artificial Sequence
  Synthetic
ggagtggtcatcatggacgacctcaaccaaaatccggatggtgccgatatgaagttgttctgtcagatggtctcc

SEQ ID NO: 88785 - DNA, 75 bp, Artificial Sequence
  Synthetic
tccaccaactccagtaggatcacgccacctacagttgctcatagtgacgcacttgccagaagattcgcctttgat

SEQ ID NO: 88786 - DNA, 75 bp, Artificial Sequence
  Synthetic
cacctacagttgctcatagtgacgcacttgccagaagattcgcctttgatatggatatacaggtgatgggtgagt

SEQ ID NO: 88787 - DNA, 75 bp, Artificial Sequence
  Synthetic
aaaggtgctgccctctggtgtgtgggaaggcgattcaactgatggataagtcctccagagtcaggtacagcattg

SEQ ID NO: 88788 - DNA, 75 bp, Artificial Sequence
  Synthetic
gaaggcgattcaactgatggataagtcctccagagtcaggtacagcattgatcaaatcactacgatgatcattaa

SEQ ID NO: 88789 - DNA, 75 bp, Artificial Sequence
  Synthetic
aaaaatagacatcaaaacaagtccaccaccggagtgtattaatgatctcttacaagctgttgattcacaagaagt

SEQ ID NO: 88790 - DNA, 75 bp, Artificial Sequence
  Synthetic
ccaccggagtgtattaatgatctcttacaagctgttgattcacaagaagtcagggattattgtgagaagaaagga

SEQ ID NO: 88791 - DNA, 75 bp, Artificial Sequence
  Synthetic
actacttttgctgcagttgctggggttgtctacgtaatgtacaagctttttgctggacatcagggggcttacacg

SEQ ID NO: 88792 - DNA, 75 bp, Artificial Sequence
  Synthetic
ttgtctacgtaatgtacaagctttttgctggacatcagggggcttacacgggcttacccaacaagaaacccaatg

SEQ ID NO: 88793 - DNA, 75 bp, Artificial Sequence
  Synthetic
tcacggcaactaccagtaagggagagttcactatgctaggtgttcatgacaatgttgctattttaccaacacatg

SEQ ID NO: 88794 - DNA, 75 bp, Artificial Sequence
  Synthetic
tgatggcaaagaagtggaagtcctagacgccaaggcactcgaagaccaggcaggaaccaaccttgaaatcaccat

SEQ ID NO: 88795 - DNA, 75 bp, Artificial Sequence
  Synthetic
tggagtcttgatcgtgaacactagtaagtaccccaatatgtatgttccagttggtgctgtgaccgaacagggata

SEQ ID NO: 88796 - DNA, 75 bp, Artificial Sequence
  Synthetic
gcccgtacacttatgtacaacttcccaacgagagcaggccagtgtggtggagtcatcacatgtactggcaaggtg

SEQ ID NO: 88797 - DNA, 75 bp, Artificial Sequence
  Synthetic
tatcaacgccccttctaaaaccaaactagaacctagtgctttccattacgtttttgagggagtgaaggaaccagc

SEQ ID NO: 88798 - DNA, 75 bp, Artificial Sequence
  Synthetic
aatcactgaagtggatgagtacatgaaagaggcagtggaccactacgcaggacaactcatgtcgctggacatcaa

SEQ ID NO: 88799 - DNA, 75 bp, Artificial Sequence
  Synthetic
aggatatccttatgttgccatgggaaagaagaaaagagacatcctaaataaacagaccagggacaccaaagaaat

SEQ ID NO: 88800 - DNA, 75 bp, Artificial Sequence
  Synthetic
aagaagaaaagagacatcctaaataaacagaccagggacaccaaagaaatgcagaggctactggacacctatggt

SEQ ID NO: 88801 - DNA, 75 bp, Artificial Sequence
  Synthetic
ttgatagaagcttcgagtttaaatgactcagtggcaatgagaatggcatttggcaacttgtatgcagctttccac

SEQ ID NO: 88802 - DNA, 75 bp, Artificial Sequence
  Synthetic
atggaagagaaactctttgcatttgactacactgggtatgatgcatcgctcagtcccgcttggtttgaggccctt

SEQ ID NO: 88803 - DNA, 75 bp, Artificial Sequence
  Synthetic
tatggactaaccatgacaccggctgataaatcagccatttttgaaacagtcacatgggagaatgtaacattcttg

SEQ ID NO: 88804 - DNA, 75 bp, Artificial Sequence
  Synthetic
cttagaagcacgaaaccaagttcaatagaagggggtacaaaccagtaccaccacgaacaagcacttctgtttccc

SEQ ID NO: 88805 - DNA, 75 bp, Artificial Sequence
  Synthetic
aaaattcaaacagagcctatggcgggtccaccatcaattacactacaatcaattactatagggactctgcaagca

SEQ ID NO: 88806 - DNA, 75 bp, Artificial Sequence
  Synthetic
cccattaaggacgtccttattaagaccgctcccatgctaaactccccaaacattgaggcgtgtggttatagtgac

SEQ ID NO: 88807 - DNA, 75 bp, Artificial Sequence
  Synthetic
aaataataaacctgcgcactaacaactgtgctacgctagtattgccctatgtaaactcactctcaatagatagca

SEQ ID NO: 88808 - DNA, 75 bp, Artificial Sequence
  Synthetic
gcagacaattaccagtctccgtgtgcgatacctgagtttgatgtcactccacccatagacataccaggggaggtg

SEQ ID NO: 88809 - DNA, 75 bp, Artificial Sequence
  Synthetic
cgatacctgagtttgatgtcactccacccatagacataccaggggaggtgcgcaacatgatggaattggcggaaa

SEQ ID NO: 88810 - DNA, 75 bp, Artificial Sequence
  Synthetic
cttgtgtctctcgttgtcccccgcttcagaccccagattggcacacactatgttgggtgagatattaaattacta

SEQ ID NO: 88811 - DNA, 75 bp, Artificial Sequence
  Synthetic
tgcaaataacggacatgcattgaaccaagtttatcagataatgtatataccacccggagcacctatccctggtaa

SEQ ID NO: 88812 - DNA, 75 bp, Artificial Sequence
  Synthetic
acaaattggtgataaagtttccgagctaaccagcatggtaactagcaccattacagagaagttgcttaaaaactt

SEQ ID NO: 88813 - DNA, 75 bp, Artificial Sequence
  Synthetic
cctccttgggtgcgacatctcaccgtggcagtggctaaagaagaaggcatgtgacatcctggaaattccatacgc

SEQ ID NO: 88814 - DNA, 75 bp, Artificial Sequence
  Synthetic
ttaaaacagccttggggttgttcccactccaagggcccacgtggcggctagtactctggtatttcggtacctttg

SEQ ID NO: 88815 - DNA, 75 bp, Artificial Sequence
  Synthetic
gtactctggtatttcggtacctttgtacgcctgttttatctccctccccaatgtaacttagaagttttcaaatca

SEQ ID NO: 88816 - DNA, 75 bp, Artificial Sequence
  Synthetic
gaagaaaaataccgtcattgcaaggactgaaaagggtgagttcaccatgctgggtgtatatgatagggtagcggt

SEQ ID NO: 88817 - DNA, 75 bp, Artificial Sequence
  Synthetic
catccccacacacgcatctgttggagaaaccatttacattaatgatgtagagactaaagttttagatgcgtgtgc

SEQ ID NO: 88818 - DNA, 75 bp, Artificial Sequence
  Synthetic
taatgccacaaaattccatcaaggtgccttattagtggtagcaattccagaacatcagaggggagcgcacaacac

SEQ ID NO: 88819 - DNA, 75 bp, Artificial Sequence
  Synthetic
gtctggacataccccactggtgacagtggtccaggctgcgttggcggcctactcatggtgaaaaccatgagacgc

SEQ ID NO: 88820 - DNA, 75 bp, Artificial Sequence
  Synthetic
actcatggtgaaaaccatgagacgctagacatgaacaaggtgtgaagagtctattgagctactatagagtcctcc

SEQ ID NO: 88821 - DNA, 75 bp, Artificial Sequence
  Synthetic
tagacatgaacaaggtgtgaagagtctattgagctactatagagtcctccggcccctgaatgcggctaatcttaa

SEQ ID NO: 88822 - DNA, 75 bp, Artificial Sequence
  Synthetic
ccatggagcaagtgctcacaaaccagtgagttgcttgtcgtaatgcgcaagtccgtggcggaaccgactactttg

SEQ ID NO: 88823 - DNA, 75 bp, Artificial Sequence
  Synthetic
agaggcagcctaccagatcgagagcatcatcaaaacagcaactgacactgtgaaaagtgagattaacgctgaact

SEQ ID NO: 88824 - DNA, 75 bp, Artificial Sequence
  Synthetic
actagacagcaaaccggaacccatgagaacgccaacattgccacaaatggatctcatatcacatacaatcagata

SEQ ID NO: 88825 - DNA, 75 bp, Artificial Sequence
  Synthetic
tgtattctttaaaatctctgaccccccagccagaatgaccataccttttatgtgcattaactcagcatactcagt

SEQ ID NO: 88826 - DNA, 75 bp, Artificial Sequence
  Synthetic
tgctgaggcatgtggctacagtgatagagtattacaacttaaattaggtaattcggctattgtcactcaggaagc

SEQ ID NO: 88827 - DNA, 75 bp, Artificial Sequence
  Synthetic
aatgggaaactgaaagcacaggatggtggtggaaattacctgatgcactaaacaacataggtatgtttggacaga

SEQ ID NO: 88828 - DNA, 75 bp, Artificial Sequence
  Synthetic
ccatggagcaagtgctcacaagccagtgagttgcttgtcgtaatgcgcaagtccgtggcggaaccgactactttg

SEQ ID NO: 88829 - DNA, 75 bp, Artificial Sequence
  Synthetic
tgtaacgccactaaattccatcaaggcgccctattagtggtagcaatcccagaacaccaaaggggggcgcacaac

SEQ ID NO: 88830 - DNA, 75 bp, Artificial Sequence
  Synthetic
gatgatgggacgtcactagcctgcgcaacaatatttccacaccaatggataaatttaagaaccaataattcagca

SEQ ID NO: 88831 - DNA, 75 bp, Artificial Sequence
  Synthetic
caacaatatttccacaccaatggataaatttaagaaccaataattcagcaacaatagttcttccctggatgaatg

SEQ ID NO: 88832 - DNA, 75 bp, Artificial Sequence
  Synthetic
gacatgtcaagggcagtcgagatgtgcaaaccagacggctgtgcccccaccaattacaaaagatgctgcccattg

SEQ ID NO: 88833 - DNA, 75 bp, Artificial Sequence
  Synthetic
gcacagtgtcaagtatggttccaataacagtttcaattgccccaatgtgttgtgagtttaatggactcagacatg

SEQ ID NO: 88834 - DNA, 75 bp, Artificial Sequence
  Synthetic
ccttctaccaggctcaggacaatttctaactactgatgatcacagctctgcgccagttcttccatgtttcaaccc

SEQ ID NO: 88835 - DNA, 75 bp, Artificial Sequence
  Synthetic
ctaactactgatgatcacagctctgcgccagttcttccatgtttcaacccaactccagaaatgcacattccaggg

SEQ ID NO: 88836 - DNA, 75 bp, Artificial Sequence
  Synthetic
ttcaagtggaatcaatgatggagattaacaacacagaaaatgcagttggcatgcagcgtctcaaagttgatatat

SEQ ID NO: 88837 - DNA, 75 bp, Artificial Sequence
  Synthetic
ttatactcactggtctggatctctagaaatgacatttatgttttgtgggagcttcatggcaacaggaaaattaat

SEQ ID NO: 88838 - DNA, 75 bp, Artificial Sequence
  Synthetic
actccagagatgcacattccagggcaggtccgtaacatgctagaagtggtccaagtggaatcaatgatggagatt

SEQ ID NO: 88839 - DNA, 75 bp, Artificial Sequence
  Synthetic
ctatgttaggtacacatgttgtttgggattttggattacaatccagtgtcaccctggtaataccttggattagtg

SEQ ID NO: 88840 - DNA, 75 bp, Artificial Sequence
  Synthetic
tgatgctaagtcaaccaatgccaacgtcggctatgttacctgttttatgcaaaccaatttgatagtccccaatga

SEQ ID NO: 88841 - DNA, 75 bp, Artificial Sequence
  Synthetic
aattttctcagtagagcagctttggtatcaaagagaagttttgaatacaaagatcatacttcgtctgcagcacaa

SEQ ID NO: 88842 - DNA, 75 bp, Artificial Sequence
  Synthetic
gggttcgtggcagcaaaagatgacttttccctcaggttaatgagagatagccctgacattggacaactagaacat

SEQ ID NO: 88843 - DNA, 75 bp, Artificial Sequence
  Synthetic
tttccctcaggttaatgagagatagccctgacattggacaactagaacatttacatgaggcagaggcagcctacc

SEQ ID NO: 88844 - DNA, 75 bp, Artificial Sequence
  Synthetic
gtttgaatgcagttgaaacaggtgcaagttctaacactgaaccagaggaagccatacaaactcgcacggtgataa

SEQ ID NO: 88845 - DNA, 75 bp, Artificial Sequence
  Synthetic
aagttctaacactgaaccagaggaagccatacaaactcgcacggtgataaatcagcatggtgtatctgagacatt

SEQ ID NO: 88846 - DNA, 75 bp, Artificial Sequence
  Synthetic
ttatcttatgttacacaccaccaggaggctcgtgtccaacagatagagagtcagcaatgcttggtacacatattg

SEQ ID NO: 88847 - DNA, 75 bp, Artificial Sequence
  Synthetic
gccttagtatcaaagagaagtttcgaatacaaaaatcacacctcatctgaagcacgaacagacaagaacttttac

SEQ ID NO: 88848 - DNA, 75 bp, Artificial Sequence
  Synthetic
ttgtccagttgaggagaaaactggaactgttcacgtaccttagatttgatgctgaaattaccatacttacaactg

SEQ ID NO: 88849 - DNA, 75 bp, Artificial Sequence
  Synthetic
ctgaccccccagccagaatgactataccttttatgtgtatcaactcagcatactcggttttctatgatggttttg

SEQ ID NO: 88850 - DNA, 75 bp, Artificial Sequence
  Synthetic
tactcggttttctatgatggttttgctggatttgagaagaatggtctttatgggataaatccagctgataccatc

SEQ ID NO: 88851 - DNA, 75 bp, Artificial Sequence
  Synthetic
cagaagagagacagtcagctatctatgtggattggcaatcagacgtcttggttacccccattgctgctcatggaa

SEQ ID NO: 88852 - DNA, 75 bp, Artificial Sequence
  Synthetic
ttggtacctttgggggcctgttttatatcccttccctcattgtaacttagaagtttcaaaatacagctcaataga

SEQ ID NO: 88853 - DNA, 75 bp, Artificial Sequence
  Synthetic
tatcccttccctcattgtaacttagaagtttcaaaatacagctcaatagacagtagtgcaaaccagtactgctac

SEQ ID NO: 88854 - DNA, 75 bp, Artificial Sequence
  Synthetic
aagggtaaagaaagagcaccaaatgcgctcaatgccataattggtaatagagagagtgtcaaaaccatgcctcat

SEQ ID NO: 88855 - DNA, 75 bp, Artificial Sequence
  Synthetic
gacatccggctagtgaatactggtccaggcttcggaggggtctttgtaggatcttttaaaataattaactaccac

SEQ ID NO: 88856 - DNA, 75 bp, Artificial Sequence
  Synthetic
agattgcggtggtttactagtctgtccacatggggtaatcggtcttcttacagcaggagggggtggaattgtagc

SEQ ID NO: 88857 - DNA, 75 bp, Artificial Sequence
  Synthetic
gaagttgcatagactgtacccacggttgaaagtgactgatccgttatccgctttagtacttcgagaagcctagta

SEQ ID NO: 88858 - DNA, 75 bp, Artificial Sequence
  Synthetic
catactctagtcttagacggaaatggttagattcgttttagacaactctaattgaaacccaagttatagttactt

SEQ ID NO: 88859 - DNA, 75 bp, Artificial Sequence
  Synthetic
cagctatctatgtagactggcagtcagatgttctggttactcccattgctgcccatggaagacaccaaatagcaa

SEQ ID NO: 88860 - DNA, 75 bp, Artificial Sequence
  Synthetic
cgctcagcactcaaccccagagtgtagcttaggtcgatgagtctggacattcctcaccggcgacggtggtccagg

SEQ ID NO: 88861 - DNA, 75 bp, Artificial Sequence
  Synthetic
ctgcgttggcggcctacctgtggcccaaagccacaggacgctagttgtgaacaaggtgtgaagagcctattgagc

SEQ ID NO: 88862 - DNA, 75 bp, Artificial Sequence
  Synthetic
caaagccacaggacgctagttgtgaacaaggtgtgaagagcctattgagctactaaagagtcctccggcccctga

SEQ ID NO: 88863 - DNA, 75 bp, Artificial Sequence
  Synthetic
cctccagaccctaaatattttgatggatacaaacagcaaacagtggtcctcatggatgatttaatgcaaaatcca

SEQ ID NO: 88864 - DNA, 75 bp, Artificial Sequence
  Synthetic
gatgggaatgacatatctatgttctgccaaatggtctctactgtagatttcatacccccaatggctagtttggag

SEQ ID NO: 88865 - DNA, 75 bp, Artificial Sequence
  Synthetic
cagaagcaggagattgtggtggtttactggtctgtccacatggggtaattggtcttctcacagcaggggggggtg

SEQ ID NO: 88866 - DNA, 75 bp, Artificial Sequence
  Synthetic
aagtgctcacaatccagtgagtggcttgtcgtaacgagcaattctgtggcggaaccgactactttgggtgtccgt

SEQ ID NO: 88867 - DNA, 75 bp, Artificial Sequence
  Synthetic
ttgtcgtaacgagcaattctgtggcggaaccgactactttgggtgtccgtgtttccttttatttttatcattggc

SEQ ID NO: 88868 - DNA, 75 bp, Artificial Sequence
  Synthetic
ccatcatatagcttttggattggccatccggtgatatttcgagctatacaacttactgtttacagctcttttaaa

SEQ ID NO: 88869 - DNA, 75 bp, Artificial Sequence
  Synthetic
tggaacaaggcattactgattatattcaaaatcttggtaatgcctttggagcagggtttacagaaacaatctcta

SEQ ID NO: 88870 - DNA, 75 bp, Artificial Sequence
  Synthetic
acattcaaaatctcggtaatgcctttggagcagggtttacagaaacaatctctagtaaagccaaggaagtgcaag

SEQ ID NO: 88871 - DNA, 75 bp, Artificial Sequence
  Synthetic
atccggtgatatttcgagctatacaacttactgtttacagctcttttaaatagcattcaattaccagcactcata

SEQ ID NO: 88872 - DNA, 75 bp, Artificial Sequence
  Synthetic
gtcagaatgggagctcaggtttctagacaacaaactgggactcacgagaacgctaacattgctacaggtggttct

SEQ ID NO: 88873 - DNA, 75 bp, Artificial Sequence
  Synthetic
attagaaaaattattaaaagctctaatcaaaattatctcagcattggtgattgtaattagaaattcagaagattt

SEQ ID NO: 88874 - DNA, 75 bp, Artificial Sequence
  Synthetic
gacaacaaactgggactcacgagaacgctaacattgctacaggtggttctaacataacctacaatcaaataaatt

SEQ ID NO: 88875 - DNA, 75 bp, Artificial Sequence
  Synthetic
ttgctaggatgccatgattcaccatggagctatttgaaacagaaagtgtgctcatatttaggtattccttatgta

SEQ ID NO: 88876 - DNA, 75 bp, Artificial Sequence
  Synthetic
agctagtaaacaagatttctctcaagatccttccaaattcaccgagccagttgcagatgcacttaaggcaggtgc

SEQ ID NO: 88877 - DNA, 75 bp, Artificial Sequence
  Synthetic
gatccttccaaattcaccgagccagttgcagatgcacttaaggcaggtgcccctgttctcaaatccccaagtgca

SEQ ID NO: 88878 - DNA, 75 bp, Artificial Sequence
  Synthetic
ggagctatttgaaacagaaagtgtgctcatatttaggtattccttatgtacctagacagagtgaatcatggctca

SEQ ID NO: 88879 - DNA, 75 bp, Artificial Sequence
  Synthetic
tattgcaactgaaactgggtaattcagcaattgtcactcaagaagcagccaatatgtgctgcgcgtatggggagt

SEQ ID NO: 88880 - DNA, 75 bp, Artificial Sequence
  Synthetic
agcaattgtcactcaagaagcagccaatatgtgctgcgcgtatggggagtggccaaattatctcccagacaatga

SEQ ID NO: 88881 - DNA, 75 bp, Artificial Sequence
  Synthetic
caaccagaaacgtcaactgacagattttacacattaaaatcagtgaaatgggaaggaactagcaagggatggtgg

SEQ ID NO: 88882 - DNA, 75 bp, Artificial Sequence
  Synthetic
tagagaaccaagttagcactattgagcatagctgcccaacaacagaacaacaacaggccttgtttaacaatgttc

SEQ ID NO: 88883 - DNA, 75 bp, Artificial Sequence
  Synthetic
gctgaggcatgtggctacagtgatagagtattacagctcaaattaggaaattcagctattgtcacccaggaagca

SEQ ID NO: 88884 - DNA, 75 bp, Artificial Sequence
  Synthetic
tttacacattaaaatcagtgaaatgggaaggaactagcaagggatggtggtggaaattgccagatgccctcaatc

SEQ ID NO: 88885 - DNA, 75 bp, Artificial Sequence
  Synthetic
ttaattgccagggctatcacagaaaaattgggaggggacatttattccctgcctccagaccctaaatattttgat

SEQ ID NO: 88886 - DNA, 75 bp, Artificial Sequence
  Synthetic
gcagtaccactacttatatagatctggcttcttatgccatgtgcagtgtaatgcaacaaagtttcaccagggcgc

SEQ ID NO: 88887 - DNA, 75 bp, Artificial Sequence
  Synthetic
ggcttcttatgccatgtgcagtgtaatgcaacaaagtttcaccagggcgcactgttggtcgtagccattccagag

SEQ ID NO: 88888 - DNA, 75 bp, Artificial Sequence
  Synthetic
gaacttcggcatctttcgacgatgtcatgaaagggaaaagtgggggggtcttcaatcacccctacgttttagacg

SEQ ID NO: 88889 - DNA, 75 bp, Artificial Sequence
  Synthetic
catgaaagggaaaagtgggggggtcttcaatcacccctacgttttagacgatgggacatcattggcatgttctct

SEQ ID NO: 88890 - DNA, 75 bp, Artificial Sequence
  Synthetic
ccatttttaatagctactactaatgctggctcaatacatgcaccaactgtatcagactcaaaggctttgtcacgc

SEQ ID NO: 88891 - DNA, 75 bp, Artificial Sequence
  Synthetic
gtccttatggatgatttaatgcaaaatccagatggaaatgacatatctatgttttgccaaatggtctctactgtg

SEQ ID NO: 88892 - DNA, 75 bp, Artificial Sequence
  Synthetic
ttgagaacaaacaactcagccaccatcatgttaccctggatgaattgcgcgccaatggactttgcactaagacac

SEQ ID NO: 88893 - DNA, 75 bp, Artificial Sequence
  Synthetic
tcatgttaccctggatgaattgcgcgccaatggactttgcactaagacacaaccagtggactttagctatcatcc

SEQ ID NO: 88894 - DNA, 75 bp, Artificial Sequence
  Synthetic
aagtcacagattcatacaaagactcaaataaattggacatgtcaagggcagtcgagatgtgcaaaccagacggct

SEQ ID NO: 88895 - DNA, 75 bp, Artificial Sequence
  Synthetic
tgggacgactatggtaccaatcacagtctccatagctcccatgtgctgtgagtttaatggtctaagaaatgccat

SEQ ID NO: 88896 - DNA, 75 bp, Artificial Sequence
  Synthetic
gtctccatagctcccatgtgctgtgagtttaatggtctaagaaatgccattacacaaggagtgcctacttatctg

SEQ ID NO: 88897 - DNA, 75 bp, Artificial Sequence
  Synthetic
acgcagatttaaatttgatgtggacattgaagtcacagattcatacaaagactcaaataaattggacatgtcaag

SEQ ID NO: 88898 - DNA, 75 bp, Artificial Sequence
  Synthetic
actcaaataaattggacatgtcaagagcagtagagatgtgtaaaccagatgactgtgctcccactaattataaaa

SEQ ID NO: 88899 - DNA, 75 bp, Artificial Sequence
  Synthetic
ccacggatgatcactcgtcagctcccgcattcccagacttctcaccaactcctgagatccacattccaggtagag

SEQ ID NO: 88900 - DNA, 75 bp, Artificial Sequence
  Synthetic
cgcattcccagacttctcaccaactcctgagatccacattccaggtagagtacacaacatgctagagttagtgca

SEQ ID NO: 88901 - DNA, 75 bp, Artificial Sequence
  Synthetic
agaaaaacacatcagtagagcttttattactctacaagccattgccacctttgtatcaatagctggtgtagttta

SEQ ID NO: 88902 - DNA, 75 bp, Artificial Sequence
  Synthetic
tccacagtttaaagagatcaaaatttcagtcaccccagatacaccagctcctgatgccataaatgaccttcttag

SEQ ID NO: 88903 - DNA, 75 bp, Artificial Sequence
  Synthetic
agctggaagctctgtttcagggacctccacagtttaaagagatcaaaatttcagtcaccccagatacaccagctc

SEQ ID NO: 88904 - DNA, 75 bp, Artificial Sequence
  Synthetic
aatgttgctgatgcaagtggcatggaaagactgagggttgaaatctcggtacagacagacatggacgcacttctc

SEQ ID NO: 88905 - DNA, 75 bp, Artificial Sequence
  Synthetic
gtatagaatcagaaacagtacacaagataaactggaggctctgttccagggacctccacagtttaaagagatcaa

SEQ ID NO: 88906 - DNA, 75 bp, Artificial Sequence
  Synthetic
aaagactgagggttgaaatctcggtacagacagacatggacgcacttctcttcaacattccacttgacattcaat

SEQ ID NO: 88907 - DNA, 75 bp, Artificial Sequence
  Synthetic
gacctccacagtttaaagagatcaaaatttcagttactccagacacaccagctcctgatgccataaacgatcttc

SEQ ID NO: 88908 - DNA, 75 bp, Artificial Sequence
  Synthetic
actagcaaatattgccagatattacactcactggtcaggctctatggaaatgacttttatgttttgtggtagctt

SEQ ID NO: 88909 - DNA, 75 bp, Artificial Sequence
  Synthetic
actcactggtcaggctctatggaaatgacttttatgttttgtggtagctttatggctacgggcaaagtcatcttg

SEQ ID NO: 88910 - DNA, 75 bp, Artificial Sequence
  Synthetic
tagggattattgccaaaagaaagggtggattgtaatacacccatcaaatgaattgttagtggaaaaacacattag

SEQ ID NO: 88911 - DNA, 75 bp, Artificial Sequence
  Synthetic
gtccaacagatcgagagtcagcaatgctgggcacacatattgtgtgggattttgggttacaatctagtataacat

SEQ ID NO: 88912 - DNA, 75 bp, Artificial Sequence
  Synthetic
gctgggcacacatattgtgtgggattttgggttacaatctagtataacattggtcatcccttggataagtgggtc

SEQ ID NO: 88913 - DNA, 75 bp, Artificial Sequence
  Synthetic
gcaaagtctattaatgcaaatgtggggtatgtgacctgttttatgcagacaaacctcatagtgcccaaggaagca

SEQ ID NO: 88914 - DNA, 75 bp, Artificial Sequence
  Synthetic
ggtatgtgacctgttttatgcagacaaacctcatagtgcccaaggaagcagccacctctacgtatataattggat

SEQ ID NO: 88915 - DNA, 75 bp, Artificial Sequence
  Synthetic
gatagagtagcagttatccccacacatgcatctgttggagaaaccatttacatcaacgatgtagagactaaagtt

SEQ ID NO: 88916 - DNA, 75 bp, Artificial Sequence
  Synthetic
gcttcgccttatgagggacagtcccgacattgggcaatcacaacaactagagggggccactgctgccttccaaat

SEQ ID NO: 88917 - DNA, 75 bp, Artificial Sequence
  Synthetic
gacattgggcaatcacaacaactagagggggccactgctgccttccaaatagaagaggtcataaagactgttgcc

SEQ ID NO: 88918 - DNA, 75 bp, Artificial Sequence
  Synthetic
tgaccgacacaaatttagagattaccatagtcaaactggatcgtaaccaaaagtttagagatatcagacattttc

SEQ ID NO: 88919 - DNA, 75 bp, Artificial Sequence
  Synthetic
ctgagcttggtgtgatacccagtttaaatgctgctgagacaggagccacttccaacacctcaccagaggaagcaa

SEQ ID NO: 88920 - DNA, 75 bp, Artificial Sequence
  Synthetic
aaatgctgctgagacaggagccacttccaacacctcaccagaggaagcaattcagaccagagccgtgatcaatca

SEQ ID NO: 88921 - DNA, 75 bp, Artificial Sequence
  Synthetic
tcaaaatttccaaatatgtatatcccagtcgggcaagtcaccaattatggcttcctaaacctaggtggcacacca

SEQ ID NO: 88922 - DNA, 75 bp, Artificial Sequence
  Synthetic
gagaattttcttgggagggcggcattggtaatgatgaaagactttgagtataaaaaccacgttaccagcacaaaa

SEQ ID NO: 88923 - DNA, 75 bp, Artificial Sequence
  Synthetic
tggtaatgatgaaagactttgagtataaaaaccacgttaccagcacaaaaaaagtacaacaaaacttctttaagt

SEQ ID NO: 88924 - DNA, 75 bp, Artificial Sequence
  Synthetic
acagttgaggagaaaatttgaactttttacatacataagatttgatagtgagataaccattgttcctactattag

SEQ ID NO: 88925 - DNA, 75 bp, Artificial Sequence
  Synthetic
tttacatacataagatttgatagtgagataaccattgttcctactattagactcttcacgtccactggtgtatca

SEQ ID NO: 88926 - DNA, 75 bp, Artificial Sequence
  Synthetic
acacaaggtgaaatagttagcaatgagaaaagtggggtgtgtattaacgcaccggcaaagactaaacttcaaccc

SEQ ID NO: 88927 - DNA, 75 bp, Artificial Sequence
  Synthetic
tacaagctatgtttgttccggtaggagctccaaccccaaaatcacaagattcatatgagtggcagtcggcttgca

SEQ ID NO: 88928 - DNA, 75 bp, Artificial Sequence
  Synthetic
agctccaaccccaaaatcacaagattcatatgagtggcagtcggcttgcaaccctagcgtgtttttcaaaattga

SEQ ID NO: 88929 - DNA, 75 bp, Artificial Sequence
  Synthetic
tctttgcttttgattacactggttatgatgctagtttgtcaccagtgtggtttgcctgtttaaagaaagttctaa

SEQ ID NO: 88930 - DNA, 75 bp, Artificial Sequence
  Synthetic
ttcaaaagatcctaggcttaagacagattttgaggaagctatcttctcaaaatatacaggtaacaaaattatgtt

SEQ ID NO: 88931 - DNA, 75 bp, Artificial Sequence
  Synthetic
aatatacaggtaacaaaattatgttgatggatgagtacatggaagaagcagtggatcattatgtaggatgtttag

SEQ ID NO: 88932 - DNA, 75 bp, Artificial Sequence
  Synthetic
ccatttatgtgcataaactccgcttatggcatgttctatgatggattcgctgggttcgaaaagacggccaatggc

SEQ ID NO: 88933 - DNA, 75 bp, Artificial Sequence
  Synthetic
atggcatgttctatgatggattcgctgggttcgaaaagacggccaatggcctttatggcatcaacccggctaata

SEQ ID NO: 88934 - DNA, 75 bp, Artificial Sequence
  Synthetic
ttagagataaccatagtcaaattggaccgtaaccaaaaatttagagatatcagacattttctgcccagatatgag

SEQ ID NO: 88935 - DNA, 75 bp, Artificial Sequence
  Synthetic
agtgaatgcataccagccagttcagtacacaatcacgattagaatctacctgaagcccaaacacattaaagcctg

SEQ ID NO: 88936 - DNA, 75 bp, Artificial Sequence
  Synthetic
tacacaatcacgattagaatctacctgaagcccaaacacattaaagcctgggttcctagaccacctcgcactatg

SEQ ID NO: 88937 - DNA, 75 bp, Artificial Sequence
  Synthetic
agggatatattcaatagacaaaccagggacactactgaaatgacaaggatgttagaaaaatatggagttgatcta

SEQ ID NO: 88938 - DNA, 75 bp, Artificial Sequence
  Synthetic
attacacaggccaaagtagtgctcccaacaatgtcaatgccatagttggcaacaggacaaacatcaccactatgc

SEQ ID NO: 88939 - DNA, 75 bp, Artificial Sequence
  Synthetic
tatggaataaatccagctgacactattggtaacttatgtgttagaatagtgaatgaacaccaaccagttggtttc

SEQ ID NO: 88940 - DNA, 75 bp, Artificial Sequence
  Synthetic
aacttagatcaagagaaaaagttgaaaaaggaaagtcacgcttaattgaagccagttccttgaatgattcagttg

SEQ ID NO: 88941 - DNA, 75 bp, Artificial Sequence
  Synthetic
aaaaggaaagtcacgcttaattgaagccagttccttgaatgattcagttgctatgagggttgcttttggaaatct

SEQ ID NO: 88942 - DNA, 75 bp, Artificial Sequence
  Synthetic
caacaatgtcaatgccatagttggcaacaggacaaacatcaccactatgcccaatgatattgttacagcaggacc

SEQ ID NO: 88943 - DNA, 75 bp, Artificial Sequence
  Synthetic
tcatacaagatcataaattatcatcttgccacagatcaagaaaaacatgatgcagtatatgttgactggcaatca

SEQ ID NO: 88944 - DNA, 75 bp, Artificial Sequence
  Synthetic
ttgccacagatcaagaaaaacatgatgcagtatatgttgactggcaatcagacatcctagtgactacagtagctg

SEQ ID NO: 88945 - DNA, 75 bp, Artificial Sequence
  Synthetic
acaaaggtaaagaaagagcaccaaatgcgctcagtgctataattggcaatagagacagtgtcaaaaccatgcctc

SEQ ID NO: 88946 - DNA, 75 bp, Artificial Sequence
  Synthetic
atgcaagtgcaacactggcgtctactattgtagacatagagataggagttatccagtttgttttgaagggcctgg

SEQ ID NO: 88947 - DNA, 75 bp, Artificial Sequence
  Synthetic
tattgtagacatagagataggagttatccagtttgttttgaagggcctggaatccagtgggttgaagagaatgag

SEQ ID NO: 88948 - DNA, 75 bp, Artificial Sequence
  Synthetic
atggtttgcctgtttaaagaaagttctaattaaattaggttacacccatcagacatctttcatagattatctgtg

SEQ ID NO: 88949 - DNA, 75 bp, Artificial Sequence
  Synthetic
acaccttattagcaaatggtcctgttgaagcaggagattgtggggggttactagtgtgtccacatggagttattg

SEQ ID NO: 88950 - DNA, 75 bp, Artificial Sequence
  Synthetic
agaaaatatatagtcaatggtggaatgccctctggttcttcaggcaccagcatattcaatactatgatcaataat

SEQ ID NO: 88951 - DNA, 75 bp, Artificial Sequence
  Synthetic
tgaagcaggagattgtggggggttactagtgtgtccacatggagttattgggctggtcactgcaggtggcaatgg

SEQ ID NO: 88952 - DNA, 75 bp, Artificial Sequence
  Synthetic
catattcaatactatgatcaataatataatcataaggactttgttgattagggtttataaaggcatagacttaga

SEQ ID NO: 88953 - DNA, 75 bp, Artificial Sequence
  Synthetic
tatctatgtggattggcaatcagacgtcttggttacccccattgctgctcatggaaggcaccaaatagcaagatg

SEQ ID NO: 88954 - DNA, 75 bp, Artificial Sequence
  Synthetic
aacctactctggctagaagatgatgcaatggaacagggtataacagattacatccaaaacctgggtaatgcattt

SEQ ID NO: 88955 - DNA, 75 bp, Artificial Sequence
  Synthetic
actgttcccacggttgaaaacaacctatccgttatccgctatagtacttcgagaaacctagtaccacctttggat

SEQ ID NO: 88956 - DNA, 75 bp, Artificial Sequence
  Synthetic
gatgatgttattgctagttacccacacaagattgatccaggtttactagcagaagcaggcaaacattatggatta

SEQ ID NO: 88957 - DNA, 75 bp, Artificial Sequence
  Synthetic
caatggaacagggtataacagattacatccaaaacctgggtaatgcatttggtgccggtttcaccgagaccatct

SEQ ID NO: 88958 - DNA, 75 bp, Artificial Sequence
  Synthetic
tatgttgttgggtgaggactctctattggaaaagctattgaaagcattgattaagattgtgtcagctatggtcat

SEQ ID NO: 88959 - DNA, 75 bp, Artificial Sequence
  Synthetic
ccaagggcccacgtggcggctagtactctggtacttcggtacctttgtacgcctgttttatctcccttcccaatg

SEQ ID NO: 88960 - DNA, 75 bp, Artificial Sequence
  Synthetic
ccagctttgttgataccaattgggaaaatgtaactttcctgaaaagatattttagagcagatgatcaatatccct

SEQ ID NO: 88961 - DNA, 75 bp, Artificial Sequence
  Synthetic
ttggaaaagctattgaaagcattgattaagattgtgtcagctatggtcatagtgatcagaaattcagatgatttg

SEQ ID NO: 88962 - DNA, 75 bp, Artificial Sequence
  Synthetic
accccagaggcccacgtggcggccagtactctggtatcacggtacctttgtacgcctgttttatatccccttccc

SEQ ID NO: 88963 - DNA, 75 bp, Artificial Sequence
  Synthetic
tgcttggttgtcatgattctccatgggctttcttgaaacaaaaggtgtgctcttatctaggcatcccctatgtga

SEQ ID NO: 88964 - DNA, 75 bp, Artificial Sequence
  Synthetic
ggctttcttgaaacaaaaggtgtgctcttatctaggcatcccctatgtgattagacagggtgactcatggttaaa

SEQ ID NO: 88965 - DNA, 75 bp, Artificial Sequence
  Synthetic
aggaccatgttagatctttgtgttatctcgcatggcataatggggaggaggcttacaatgaattttgtagaaaaa

SEQ ID NO: 88966 - DNA, 75 bp, Artificial Sequence
  Synthetic
gtactctggtatcacggtacctttgtacgcctgttttatatccccttcccccgcaacttagaagaaaacaaatca

SEQ ID NO: 88967 - DNA, 75 bp, Artificial Sequence
  Synthetic
agtaccaccacgaacaagcacttctgtttccccggtgatgtcgtatagactgtaaccacggttgaaaacgattga

SEQ ID NO: 88968 - DNA, 75 bp, Artificial Sequence
  Synthetic
ctcagagggtttgattggctggcacagaaaatcgataagttcattgattggttgaagaccaaaatattgccagaa

SEQ ID NO: 88969 - DNA, 75 bp, Artificial Sequence
  Synthetic
gtttccccggtgatgtcgtatagactgtaaccacggttgaaaacgattgatccgttatccgctcttgtacttcga

SEQ ID NO: 88970 - DNA, 75 bp, Artificial Sequence
  Synthetic
acagtcacagccacactagcattgttgggatgccatgattcaccatggagctacttgaaacagaaggtatgttca

SEQ ID NO: 88971 - DNA, 75 bp, Artificial Sequence
  Synthetic
agaaaatcgataagttcattgattggttgaagaccaaaatattgccagaagccagagagaagtatgaatttgttc

SEQ ID NO: 88972 - DNA, 75 bp, Artificial Sequence
  Synthetic
gttctagataactctaattgaaacccaagttatagttactttcatttagaggtaaattttggttaattggggacc

SEQ ID NO: 88973 - DNA, 75 bp, Artificial Sequence
  Synthetic
tgagagtcagatcaacacgattgaacacagttgccccaattcagagcagcagcaggcactttttaacaatgtcca

SEQ ID NO: 88974 - DNA, 75 bp, Artificial Sequence
  Synthetic
agcaggcactttttaacaatgtccaatactactcacattactgtaaaaaatatgctcctctatacgccttggaag

SEQ ID NO: 88975 - DNA, 75 bp, Artificial Sequence
  Synthetic
aatgctcaataggtggggcgcaaaccagcgctctcatgagcaagcactcctgtctccccggtgaggttgtataaa

SEQ ID NO: 88976 - DNA, 75 bp, Artificial Sequence
  Synthetic
agatagataaattcatcaactggcttaaaaccaaaatattaccagaagctagggagaaatatgaatttgtgcaaa

SEQ ID NO: 88977 - DNA, 75 bp, Artificial Sequence
  Synthetic
gcctattgagctacaagagaatcctccggcccctgaatgcggctaatcctaaccacggagcaagggtacacaaac

SEQ ID NO: 88978 - DNA, 75 bp, Artificial Sequence
  Synthetic
gaaaattaataattacatccagttcaagtccaaatctcgcattgaacctgtatgtcttattattcatggctcacc

SEQ ID NO: 88979 - DNA, 75 bp, Artificial Sequence
  Synthetic
aagtccaaatctcgcattgaacctgtatgtcttattattcatggctcaccgggaaccggaaaatcagttgcctct

SEQ ID NO: 88980 - DNA, 75 bp, Artificial Sequence
  Synthetic
tgggtgtccgtgtttccttttgtttttatcatggctgcttatggtgacaatctaagattgttatcatatagctgt

SEQ ID NO: 88981 - DNA, 75 bp, Artificial Sequence
  Synthetic
aaaaacttggcggggactcttactcactaccaccagatcacaaatatttcgatggttacaagcaacaaacagtag

SEQ ID NO: 88982 - DNA, 75 bp, Artificial Sequence
  Synthetic
actaccaccagatcacaaatatttcgatggttacaagcaacaaacagtagtgctaatggatgatttgatgcaaaa

SEQ ID NO: 88983 - DNA, 75 bp, Artificial Sequence
  Synthetic
gagatttgagcatttgcttgtttcttcaacaatttcacctattcattgcatttcagcagtcaaaatgggcgctca

SEQ ID NO: 88984 - DNA, 75 bp, Artificial Sequence
  Synthetic
tcaacaatttcacctattcattgcatttcagcagtcaaaatgggcgctcaggtctccagacaacaaactggaact

SEQ ID NO: 88985 - DNA, 75 bp, Artificial Sequence
  Synthetic
ttttgccaaatggtttctactgtggactttatcccaccaatggctagtctagaggaaaaaggtactttgtacacc

SEQ ID NO: 88986 - DNA, 75 bp, Artificial Sequence
  Synthetic
cggcccctgaatgcggctaatcctaaccatggagcaagtgctcacaggccagtgagttgcttgtcgtaatgcgca

SEQ ID NO: 88987 - DNA, 75 bp, Artificial Sequence
  Synthetic
actttatcccaccaatggctagtctagaggaaaaaggtactttgtacaccagcccctttttaattgctacaacaa

SEQ ID NO: 88988 - DNA, 75 bp, Artificial Sequence
  Synthetic
gtagctctagcataacttataatcaaatcaatttttacaaagatagttatgctgcgtcagctagcaagcaggact

SEQ ID NO: 88989 - DNA, 75 bp, Artificial Sequence
  Synthetic
aatcaatttttacaaagatagttatgctgcgtcagctagcaagcaggacttttctcaagacccttccaaatttac

SEQ ID NO: 88990 - DNA, 75 bp, Artificial Sequence
  Synthetic
tgtttcagactccaaagcattggccagaaggtttaaatttgatgttgacatagaagttatggaatcattcaaaga

SEQ ID NO: 88991 - DNA, 75 bp, Artificial Sequence
  Synthetic
agaaggtttaaatttgatgttgacatagaagttatggaatcattcaaagatgctactaaattgaatatgttcaaa

SEQ ID NO: 88992 - DNA, 75 bp, Artificial Sequence
  Synthetic
tttatgactgcttatggtgacaatttgatattgttaccatttagcttgtcaaatcaattacaaaagatcctaaat

SEQ ID NO: 88993 - DNA, 75 bp, Artificial Sequence
  Synthetic
gcaggagcccctgttcttaaatctccaagtgcagaggcatgtggttatagtgacagagtattgcaattaaaattg

SEQ ID NO: 88994 - DNA, 75 bp, Artificial Sequence
  Synthetic
caagtgcagaggcatgtggttatagtgacagagtattgcaattaaaattgggcaactcagcaattgtaactcaag

SEQ ID NO: 88995 - DNA, 75 bp, Artificial Sequence
  Synthetic
agtgtgctccaaccaactacaaaaagtgctgtccacttatttgtggtaaagctatccagtttagagacaggagaa

SEQ ID NO: 88996 - DNA, 75 bp, Artificial Sequence
  Synthetic
gtgctgtccacttatttgtggtaaagctatccagtttagagacaggagaactaatgctagatcaacagttgatat

SEQ ID NO: 88997 - DNA, 75 bp, Artificial Sequence
  Synthetic
tggagaatggccaagttatctaccagacaatgaggcaacagcaattgataaacccacccagccagaaacttcaac

SEQ ID NO: 88998 - DNA, 75 bp, Artificial Sequence
  Synthetic
gacaatgaggcaacagcaattgataaacccacccagccagaaacttcaactgatagattctacacactaaaatca

SEQ ID NO: 88999 - DNA, 75 bp, Artificial Sequence
  Synthetic
tacagaattagaaactccactcaggataaattggaagcactgtttcagggacctccccagtttagagaaatcaag

SEQ ID NO: 89000 - DNA, 75 bp, Artificial Sequence
  Synthetic
ataaattggaagcactgtttcagggacctccccagtttagagaaatcaagatttcagtgtcacctgaaactcctg

SEQ ID NO: 89001 - DNA, 75 bp, Artificial Sequence
  Synthetic
gcactatgccatatatgtccattgcaaatacaaattacacaggtcatagcagtgctcccaacaatgttaatgcta

SEQ ID NO: 89002 - DNA, 75 bp, Artificial Sequence
  Synthetic
ggtggtggtggaaattacccgacgccctcaaccaaactgggatgtttggacaaaatgtgcaataccactacctat

SEQ ID NO: 89003 - DNA, 75 bp, Artificial Sequence
  Synthetic
cctcaaccaaactgggatgtttggacaaaatgtgcaataccactacctatacagatctggtttcctatgccatgt

SEQ ID NO: 89004 - DNA, 75 bp, Artificial Sequence
  Synthetic
caggtcagtcgattcgcaggaagtcagggattactgccaaaagaaaggatggatagtcctacatcccccagcaga

SEQ ID NO: 89005 - DNA, 75 bp, Artificial Sequence
  Synthetic
gtcacccaggaagcagcaaactactgctgtgcttatggtgaatggcccaattacttaccagatcatgaagcagta

SEQ ID NO: 89006 - DNA, 75 bp, Artificial Sequence
  Synthetic
gctgtgcttatggtgaatggcccaattacttaccagatcatgaagcagtagccattgataaacctacacaaccag

SEQ ID NO: 89007 - DNA, 75 bp, Artificial Sequence
  Synthetic
cagggagcgttgttagttgtagccattccagaacaccaactgggtaaatataacacagggacgtcagcatctttt

SEQ ID NO: 89008 - DNA, 75 bp, Artificial Sequence
  Synthetic
aaactccaacccagtgttttccatcaagtttttgaaggttcaaaggaaccagcagttctcaatccaaaagatcct

SEQ ID NO: 89009 - DNA, 75 bp, Artificial Sequence
  Synthetic
taaccaccttcgtatcaatagctggtgtagtttatgtaatatacaagctctttgcagggatacagggaccttata

SEQ ID NO: 89010 - DNA, 75 bp, Artificial Sequence
  Synthetic
agggattactgccaaaagaaaggatggatagtcctacatcccccagcagagttagcagtggagaaacatattagc

SEQ ID NO: 89011 - DNA, 75 bp, Artificial Sequence
  Synthetic
tgtagtttatgtaatatacaagctctttgcagggatacagggaccttatacaggattgccaaatgccaaacccaa

SEQ ID NO: 89012 - DNA, 75 bp, Artificial Sequence
  Synthetic
cttagatgatggcacttctctggcgtgttcccttatatttccacaccagtggattaacttgaggacaaacaattc

SEQ ID NO: 89013 - DNA, 75 bp, Artificial Sequence
  Synthetic
ttccagaacaccaactgggtaaatataacacagggacgtcagcatcttttgacgatgtcatgaaagggaaaactg

SEQ ID NO: 89014 - DNA, 75 bp, Artificial Sequence
  Synthetic
gtccagggaccaggatttgactttgcacaggctattatgaagaagaacgcagtcataggtagaacggagaaaggg

SEQ ID NO: 89015 - DNA, 75 bp, Artificial Sequence
  Synthetic
cacaggctattatgaagaagaacgcagtcataggtagaacggagaaaggggaattcaccatgctgggtatatatg

SEQ ID NO: 89016 - DNA, 75 bp, Artificial Sequence
  Synthetic
ggttccaataacagtttcaattgctccaatgtgttgtgagttcaatggactcagacacgccattactcaaggtgt

SEQ ID NO: 89017 - DNA, 75 bp, Artificial Sequence
  Synthetic
ttagacacaaccagtggactttggccataatcccagtcgtccctctcaatactagtggtggaacaactatggtgc

SEQ ID NO: 89018 - DNA, 75 bp, Artificial Sequence
  Synthetic
tgttcccttatatttccacaccagtggattaacttgaggacaaacaattcagctaccatcatgctaccttggatg

SEQ ID NO: 89019 - DNA, 75 bp, Artificial Sequence
  Synthetic
cgcctctattggagagaccatatacattaatgatgtggaaacaaaagtcaaagatgcctatgccttgaaagatat

SEQ ID NO: 89020 - DNA, 75 bp, Artificial Sequence
  Synthetic
attaatgatgtggaaacaaaagtcaaagatgcctatgccttgaaagatatgactgatgtcaatttggaaatcact

SEQ ID NO: 89021 - DNA, 75 bp, Artificial Sequence
  Synthetic
cataatcccagtcgtccctctcaatactagtggtggaacaactatggtgccaatcactgtctctatagcccctat

SEQ ID NO: 89022 - DNA, 75 bp, Artificial Sequence
  Synthetic
aatgccataacgcagggggtccccacatatctactaccaggatcttctcaattcatgaccacggacgatcactct

SEQ ID NO: 89023 - DNA, 75 bp, Artificial Sequence
  Synthetic
catatctactaccaggatcttctcaattcatgaccacggacgatcactcttcagctcctgcttttccagattttt

SEQ ID NO: 89024 - DNA, 75 bp, Artificial Sequence
  Synthetic
aatttagggatattagacattttcttccgatacatgaggatgattataatgatgcagtcttaagtgtgaacactt

SEQ ID NO: 89025 - DNA, 75 bp, Artificial Sequence
  Synthetic
tccgatacatgaggatgattataatgatgcagtcttaagtgtgaacacttccaaatttccaaacatgtacattcc

SEQ ID NO: 89026 - DNA, 75 bp, Artificial Sequence
  Synthetic
aggtagggttcataacatgttagaactagtacaggtggagtcaatgatggagataaacaatgtcgctggttcaag

SEQ ID NO: 89027 - DNA, 75 bp, Artificial Sequence
  Synthetic
ctagtacaggtggagtcaatgatggagataaacaatgtcgctggttcaagcggtatggagagactgagggttgag

SEQ ID NO: 89028 - DNA, 75 bp, Artificial Sequence
  Synthetic
ttcctcaacctcggtggaacccctacccataggatcctgatgtacaactttccaactagggcaggacagtgtgga

SEQ ID NO: 89029 - DNA, 75 bp, Artificial Sequence
  Synthetic
cccataggatcctgatgtacaactttccaactagggcaggacagtgtggaggtgtaattaccaccactggtaaag

SEQ ID NO: 89030 - DNA, 75 bp, Artificial Sequence
  Synthetic
cacttctctttaacatcccgctagacattcaactagatggacccctcaggagtactctgttggcaaacattgcta

SEQ ID NO: 89031 - DNA, 75 bp, Artificial Sequence
  Synthetic
cattcaactagatggacccctcaggagtactctgttggcaaacattgctaggtactacacccattggtcaggatc

SEQ ID NO: 89032 - DNA, 75 bp, Artificial Sequence
  Synthetic
aaaattaattctgtgttatactcctccaggtgggtcgtgcccgacaaccagagagaccgccatgttaggtacaca

SEQ ID NO: 89033 - DNA, 75 bp, Artificial Sequence
  Synthetic
tggggcacaaggatttgctgcaatgttgctcagaaattatttcactgacaaacaaggtgagatagttagtgttga

SEQ ID NO: 89034 - DNA, 75 bp, Artificial Sequence
  Synthetic
gctgtgcttagcgtacatacatcaaaattcccaaatatgtatatcccagttggacaagtcaccaattatggcttc

SEQ ID NO: 89035 - DNA, 75 bp, Artificial Sequence
  Synthetic
ggtagtttcatggctacaggtaaggttatcttatgttacacaccaccaggaggctcgtgtccaacagatagagag

SEQ ID NO: 89036 - DNA, 75 bp, Artificial Sequence
  Synthetic
tgcacatcccagggcaggtccgtaacatgctagaagtggtccaagtggaatcaatgatggagattaacaacacag

SEQ ID NO: 89037 - DNA, 75 bp, Artificial Sequence
  Synthetic
ctactttgggtgtccgtgtttcactttttacttttatgactgcttatggtgacaatttgatattgttaccattta

SEQ ID NO: 89038 - DNA, 75 bp, Artificial Sequence
  Synthetic
ttttacttttatgactgcttatggtgacaatttgatattgttaccatttagcttgtcaaatcaattgcaaaagat

SEQ ID NO: 89039 - DNA, 75 bp, Artificial Sequence
  Synthetic
gtgtctttcatgatgtgtttgaaggtgtgaaggaaccagctgttttacactcgaaggataagagattaaaggtgg

SEQ ID NO: 89040 - DNA, 75 bp, Artificial Sequence
  Synthetic
tataacgttggtcattccttggataagtgggtctcacttccgcatgttcaatagtgatgcaaaatccataaatgc

SEQ ID NO: 89041 - DNA, 75 bp, Artificial Sequence
  Synthetic
tcaatgatggagattaacaacacagaaagtgcagttggcatggagcgtcttaaggttgatatatcagcattgaca

SEQ ID NO: 89042 - DNA, 75 bp, Artificial Sequence
  Synthetic
atggatgaatacatggaagaagcagtggaccactatgttgggtgcttagagcccttagacattagtactgaacca

SEQ ID NO: 89043 - DNA, 75 bp, Artificial Sequence
  Synthetic
tgtgaaggaaccagctgttttacactcgaaggataagagattaaaggtggattttgaagaggccatcttttccaa

SEQ ID NO: 89044 - DNA, 75 bp, Artificial Sequence
  Synthetic
tggaccactatgttgggtgcttagagcccttagacattagtactgaaccaattcctcttgagagtgccatgtatg

SEQ ID NO: 89045 - DNA, 75 bp, Artificial Sequence
  Synthetic
aggaagcggctacttcaacatacataataggctttgcggccgccaagaacgatttctcactccgtcttatgaggg

SEQ ID NO: 89046 - DNA, 75 bp, Artificial Sequence
  Synthetic
agtgggtctcacttccgcatgttcaatagtgatgcaaaatccataaatgcaaatgtgggatatgtaacttgtttt

SEQ ID NO: 89047 - DNA, 75 bp, Artificial Sequence
  Synthetic
cctaaccactagtgccgggtatccatacctactacagggaaagaaaaagagagatatctttaataggcaaactag

SEQ ID NO: 89048 - DNA, 75 bp, Artificial Sequence
  Synthetic
acacatattgtttgggattttggattacaatctagtgtaaccctgataataccttggattagtggatcccactac

SEQ ID NO: 89049 - DNA, 75 bp, Artificial Sequence
  Synthetic
tacctactacagggaaagaaaaagagagatatctttaataggcaaactagggacactacagaaatgaccaagatg

SEQ ID NO: 89050 - DNA, 75 bp, Artificial Sequence
  Synthetic
accttggattagtggatcccactacaggatgtttaacaatgatgctaagtcaactaatgccaacgttggctatgt

SEQ ID NO: 89051 - DNA, 75 bp, Artificial Sequence
  Synthetic
ttccagatagaagaagtcatgaaaactgtggccaacacagtggagagtgagatcagggctgagctcggtgtgata

SEQ ID NO: 89052 - DNA, 75 bp, Artificial Sequence
  Synthetic
catttgtcacctttgttaaggatgaactcagatcaagagagaaagtagaaaaggggaaatctagactaattgaag

SEQ ID NO: 89053 - DNA, 75 bp, Artificial Sequence
  Synthetic
actcagatcaagagagaaagtagaaaaggggaaatctagactaattgaagctagttctctgaatgattcagtcgc

SEQ ID NO: 89054 - DNA, 75 bp, Artificial Sequence
  Synthetic
aataggctttgcggccgccaagaacgatttctcactccgtcttatgagggacagccctgatattgggcaatcaca

SEQ ID NO: 89055 - DNA, 75 bp, Artificial Sequence
  Synthetic
ggaggcaattcagactagggcggtgatcaaccaacacggcaccagtgaaaccttagtggagaacttcttagggag

SEQ ID NO: 89056 - DNA, 75 bp, Artificial Sequence
  Synthetic
ctgtggccaacacagtggagagtgagatcagggctgagctcggtgtgatacctagtctaaatgctgctgagacag

SEQ ID NO: 89057 - DNA, 75 bp, Artificial Sequence
  Synthetic
tatgccgcctttcacaaaaatccaggaatcgctactgggagcgctgttggatgtgatccagatctattttggtct

SEQ ID NO: 89058 - DNA, 75 bp, Artificial Sequence
  Synthetic
gaatcgctactgggagcgctgttggatgtgatccagatctattttggtctaaaatcccagtgatgttagatggaa

SEQ ID NO: 89059 - DNA, 75 bp, Artificial Sequence
  Synthetic
agaggcagcctaccagatcgagagcatcatcaaaacagcaactgacactgtgaaaagtgagattaacgccgaact

SEQ ID NO: 89060 - DNA, 75 bp, Artificial Sequence
  Synthetic
gcacacaaaaagtacaacagaactttttcaagtggaccattaacacccgttcctatgtgcaactcagaagaaagt

SEQ ID NO: 89061 - DNA, 75 bp, Artificial Sequence
  Synthetic
atcaaccaacacggcaccagtgaaaccttagtggagaacttcttagggagggcagcactagtaatgatgaaagat

SEQ ID NO: 89062 - DNA, 75 bp, Artificial Sequence
  Synthetic
ctacgacgccagcttatctccagtttggttcgcttgcctaaagaaagttttaattaaattgggttacacccatca

SEQ ID NO: 89063 - DNA, 75 bp, Artificial Sequence
  Synthetic
tggttcgcttgcctaaagaaagttttaattaaattgggttacacccatcaaactgcatttattgattacttgtgc

SEQ ID NO: 89064 - DNA, 75 bp, Artificial Sequence
  Synthetic
tttcaagtggaccattaacacccgttcctatgtgcaactcagaagaaagtttgagcttttcacttatataaggtt

SEQ ID NO: 89065 - DNA, 75 bp, Artificial Sequence
  Synthetic
acaattaggctatacacgtctactggtgcatcatattcgggtcttcccaatttgacgttgcaagctatgtttgtt

SEQ ID NO: 89066 - DNA, 75 bp, Artificial Sequence
  Synthetic
gtgcatcatattcgggtcttcccaatttgacgttgcaagctatgtttgttccagtaggagctccaaccccaaaat

SEQ ID NO: 89067 - DNA, 75 bp, Artificial Sequence
  Synthetic
ggaaatacatagtgaacggtggtatgccctcaggatcatctggcactagtatcttcaacaccatgatcaacaaca

SEQ ID NO: 89068 - DNA, 75 bp, Artificial Sequence
  Synthetic
gccctcaggatcatctggcactagtatcttcaacaccatgatcaacaacattataattagaaccttacttctcaa

SEQ ID NO: 89069 - DNA, 75 bp, Artificial Sequence
  Synthetic
catacttcgtctgcagcacaagcagacaagaactttttcaaatggacaattaacaccagatcctttgtacagtta

SEQ ID NO: 89070 - DNA, 75 bp, Artificial Sequence
  Synthetic
ggcttgcaacccaagtgtgttcttcaaaattgatgaccctccagctaggatgaccatcccattcatgtgcataaa

SEQ ID NO: 89071 - DNA, 75 bp, Artificial Sequence
  Synthetic
aaaattgatgaccctccagctaggatgaccatcccattcatgtgcataaactcagcctatggtatgttttatgat

SEQ ID NO: 89072 - DNA, 75 bp, Artificial Sequence
  Synthetic
agaagaaagttagaattattcacataccttagatttgatgctgagatcactatactcacaactgtagcagtgaat

SEQ ID NO: 89073 - DNA, 75 bp, Artificial Sequence
  Synthetic
cagtttaaaatgattgcttatggtgatgatgtaattgcaagttacccacatgaaattgaccctggcctattggct

SEQ ID NO: 89074 - DNA, 75 bp, Artificial Sequence
  Synthetic
atgatgtaattgcaagttacccacatgaaattgaccctggcctattggctgaagccgggaaagaatatgggttga

SEQ ID NO: 89075 - DNA, 75 bp, Artificial Sequence
  Synthetic
ccaatggcctttatggtatcaacccggcaaacacaatgggcaacttgtgcatacgagtagtgaatgcataccagc

SEQ ID NO: 89076 - DNA, 75 bp, Artificial Sequence
  Synthetic
ggcaaacacaatgggcaacttgtgcatacgagtagtgaatgcataccagccagttcagtacacaataacaataag

SEQ ID NO: 89077 - DNA, 75 bp, Artificial Sequence
  Synthetic
aagctttactgatacaacttgggaaaatgtaacatttctcaagagatatttcagagcagatgatcagtacccctt

SEQ ID NO: 89078 - DNA, 75 bp, Artificial Sequence
  Synthetic
actggcagtcaggtagtaatgctagtgtattttttaaaatctctgaccccccagccagaatgaccatacctttta

SEQ ID NO: 89079 - DNA, 75 bp, Artificial Sequence
  Synthetic
aattggtaatagagacagtgtcaaaaccatgcctcacaatatagtgaccactggcccaggctttggaggagtttt

SEQ ID NO: 89080 - DNA, 75 bp, Artificial Sequence
  Synthetic
aaggcctgggttcctagaccacctcgcactatgccatatatgtccattgcaaatacaaattacacaggtcatagc

SEQ ID NO: 89081 - DNA, 75 bp, Artificial Sequence
  Synthetic
tttgatccacccagttatgccaatgaaggagattcatgagtccattagatggactaaagatccaagaaacactca

SEQ ID NO: 89082 - DNA, 75 bp, Artificial Sequence
  Synthetic
tgtagggtctttcaaaataattaactatcacttagccaccacagaagagagacagtcagctatttatgtggattg

SEQ ID NO: 89083 - DNA, 75 bp, Artificial Sequence
  Synthetic
ttggcctggcacaatggtgaagaagcttacaatgaattttgcaagaaaattagatcagtccctgtgggcagagct

SEQ ID NO: 89084 - DNA, 75 bp, Artificial Sequence
  Synthetic
aaccatgcccaatgacatcgttacaacaggacctggtttcggtggggcgtttgtgggctcatacaagatcataaa

SEQ ID NO: 89085 - DNA, 75 bp, Artificial Sequence
  Synthetic
tttttatgatggctttgccggatttgagaaaagtggtctgtatggaataaatccagctgacactattggtaactt

SEQ ID NO: 89086 - DNA, 75 bp, Artificial Sequence
  Synthetic
caaccagttggttttacagtgaccgttagggtttacatgaagcctaaacacataaaagcatgggcaccacgacca

SEQ ID NO: 89087 - DNA, 75 bp, Artificial Sequence
  Synthetic
ctagctttaccagtttattctagtttgaggcgcaaatggcttgactcattctagataactctaattaggacccaa

SEQ ID NO: 89088 - DNA, 75 bp, Artificial Sequence
  Synthetic
ctagataactctaattaggacccaaaccccctagggggcacaaatagtttttagaggtaaattttggtcacttgg

SEQ ID NO: 89089 - DNA, 75 bp, Artificial Sequence
  Synthetic
agaagttacccaatttgctttgaaggcccagggattcaatggatcgagcaaagtgaatattatccagcaaggtat

SEQ ID NO: 89090 - DNA, 75 bp, Artificial Sequence
  Synthetic
ggcaatcagacattttggtgaccacagtggctgcccatggaaagcaccagatagccaggtgtaaatgcaacgctg

SEQ ID NO: 89091 - DNA, 75 bp, Artificial Sequence
  Synthetic
acaggacctggtttcggtggggcgtttgtgggctcatacaagatcataaactaccacctagccacagaaaatgaa

SEQ ID NO: 89092 - DNA, 75 bp, Artificial Sequence
  Synthetic
agtggctgcccatggaaagcaccagatagccaggtgtaaatgcaacgctggagtctactattgtaggcataagga

SEQ ID NO: 89093 - DNA, 75 bp, Artificial Sequence
  Synthetic
gggcctggaatccagtggattggggaaaatgagtactatcccgcccgctaccaaaccaacactctactcgcacac

SEQ ID NO: 89094 - DNA, 75 bp, Artificial Sequence
  Synthetic
aaaatgagtactatcccgcccgctaccaaaccaacactctactcgcacacggtccagttgaagcaggagactgtg

SEQ ID NO: 89095 - DNA, 75 bp, Artificial Sequence
  Synthetic
tgtcattggacttgtcactgcgggtggtagcggagtggtggctttcactgacatcagaaacctactttggttaga

SEQ ID NO: 89096 - DNA, 75 bp, Artificial Sequence
  Synthetic
ggtagcggagtggtggctttcactgacatcagaaacctactttggttagaggatgatgcaatggaacagggcata

SEQ ID NO: 89097 - DNA, 75 bp, Artificial Sequence
  Synthetic
atgcttttggcactggcttcactgaaaccatctctgaaaaagctaaagaaatacaaaacatgttagtgggcgagg

SEQ ID NO: 89098 - DNA, 75 bp, Artificial Sequence
  Synthetic
aaccatctctgaaaaagctaaagaaatacaaaacatgttagtgggcgaggattctttactagaaaaattgttaaa

SEQ ID NO: 89099 - DNA, 75 bp, Artificial Sequence
  Synthetic
atggttatagtaatcagaaattcggacgatttggttacagtgactgccacattagcattgcttggttgtaatgac

SEQ ID NO: 89100 - DNA, 75 bp, Artificial Sequence
  Synthetic
acgatttggttacagtgactgccacattagcattgcttggttgtaatgactccccatgggctttcttgaagcaaa

SEQ ID NO: 89101 - DNA, 75 bp, Artificial Sequence
  Synthetic
aaatgcagttgaaacaggtgcaacttctaacactgaaccagaagaagccatacaaactcgcacagtgataaatca

SEQ ID NO: 89102 - DNA, 75 bp, Artificial Sequence
  Synthetic
ctacgtgattaaacagggtgactcttggctgaaaaagtttacagaagcttgtaatgcactcaggggcttggactg

SEQ ID NO: 89103 - DNA, 75 bp, Artificial Sequence
  Synthetic
ggtaatgcctttggagcagggtttacagaaacaatctctaataaagccaaggaagtgcaagatatgctaattgga

SEQ ID NO: 89104 - DNA, 75 bp, Artificial Sequence
  Synthetic
tggctgaaaaagtttacagaagcttgtaatgcactcaggggcttggactggctagcccaaaagatagacaaattc

SEQ ID NO: 89105 - DNA, 75 bp, Artificial Sequence
  Synthetic
aattgaacatagctgcccaacaacagaacaacagcaggccttattcaacaacgtccagtactattcacactactg

SEQ ID NO: 89106 - DNA, 75 bp, Artificial Sequence
  Synthetic
taccagaagccagagagaaatacgaatttgttcagaaattaaagcaacttccagtaattgagagccaaattaata

SEQ ID NO: 89107 - DNA, 75 bp, Artificial Sequence
  Synthetic
catgctagaagtggtccaagtggaatcaatgatggagattaataacacagaaagtgcagttggcatggagcgtct

SEQ ID NO: 89108 - DNA, 75 bp, Artificial Sequence
  Synthetic
agagcaacagcaggcacttttcaataatgtccagtattactcgcactactgtaagaagtatgctcctttgtatgc

SEQ ID NO: 89109 - DNA, 75 bp, Artificial Sequence
  Synthetic
tccagttcaagtccaaatctcgcattgaacctgtatgtcttattattcatggctcaccaggaactggaaagtcag

SEQ ID NO: 89110 - DNA, 75 bp, Artificial Sequence
  Synthetic
aatcacagagaaactcggtggggatacctactcactaccaccagaccccaagtactttgatggttacaaacagca

SEQ ID NO: 89111 - DNA, 75 bp, Artificial Sequence
  Synthetic
acctactcactaccaccagaccccaagtactttgatggttacaaacagcaaacagtagtgttaatggatgacttg

SEQ ID NO: 89112 - DNA, 75 bp, Artificial Sequence
  Synthetic
actgtggacttcatacctccaatggctagtttggaggaaaaaggaactctgtacaccagtccatttttaatagct

SEQ ID NO: 89113 - DNA, 75 bp, Artificial Sequence
  Synthetic
agctcttgaaaagaaaataaacaactacatccagttcaagtccaaatctcgcattgaaccggtttgtttaataat

SEQ ID NO: 89114 - DNA, 75 bp, Artificial Sequence
  Synthetic
ttgccatgttttgccaaatggtttccacggtagatttcatcccaccaatggccagcttggaggagaaaggtactc

SEQ ID NO: 89115 - DNA, 75 bp, Artificial Sequence
  Synthetic
cacggtagatttcatcccaccaatggccagcttggaggagaaaggtactctatataccagtccctttttaattgc

SEQ ID NO: 89116 - DNA, 75 bp, Artificial Sequence
  Synthetic
gcccccactgtttcagattctaaagccctagctaggagattcaagtttgatgtggacattgaggttatggaatca

SEQ ID NO: 89117 - DNA, 75 bp, Artificial Sequence
  Synthetic
ccctagctaggagattcaagtttgatgtggacattgaggttatggaatcatttaaggaggccaacaaattgaata

SEQ ID NO: 89118 - DNA, 75 bp, Artificial Sequence
  Synthetic
gcccagtgaatgtgccccagctaattacaagaaatgttgtccactcatatgtggtagggccatccaatttagaga

SEQ ID NO: 89119 - DNA, 75 bp, Artificial Sequence
  Synthetic
tacaagaaatgttgtccactcatatgtggtagggccatccaatttagagataggagaactaatgccagatcaaca

SEQ ID NO: 89120 - DNA, 75 bp, Artificial Sequence
  Synthetic
tgaaggaatatagagtcagaaacactacccaagataagttggaagcactgttccaggggccaccccagtttaaag

SEQ ID NO: 89121 - DNA, 75 bp, Artificial Sequence
  Synthetic
tacccaagataagttggaagcactgttccaggggccaccccagtttaaagaaatcaaaatttctgtatcccctga

SEQ ID NO: 89122 - DNA, 75 bp, Artificial Sequence
  Synthetic
tttgctttgaaggcccagggattcaatggattgaacaaaatgaatattacccagcaaggtaccagaccaatgtac

SEQ ID NO: 89123 - DNA, 75 bp, Artificial Sequence
  Synthetic
gtgcagttggttgtgatccagatatattttggtcaaaaatccctattttgctagatggagaaatctttgcttttg

SEQ ID NO: 89124 - DNA, 75 bp, Artificial Sequence
  Synthetic
gatcttctcaggtcagttgattcacaggaagtcagagattactgtcaaaagaaaggttggatagttctacacccc

SEQ ID NO: 89125 - DNA, 75 bp, Artificial Sequence
  Synthetic
aggaagtcagagattactgtcaaaagaaaggttggatagttctacaccccccaactgagcttgcagtggaaaagc

SEQ ID NO: 89126 - DNA, 75 bp, Artificial Sequence
  Synthetic
ctatggttagatactgatgctatggaacaaggcattactgattatattcaaaatcttggtaatgcctttggagca

SEQ ID NO: 89127 - DNA, 75 bp, Artificial Sequence
  Synthetic
tcaagccataaccacttttgtatcgatagctggagtggtatatgtaatatacaaactatttgctggaatgcaggg

SEQ ID NO: 89128 - DNA, 75 bp, Artificial Sequence
  Synthetic
atagctggagtggtatatgtaatatacaaactatttgctggaatgcaggggccctatacagggttgccaaatgcc

SEQ ID NO: 89129 - DNA, 75 bp, Artificial Sequence
  Synthetic
ccgcaaaggttcaggggcccgggtttgattttgcacaggctattatgaaaaagaacacagttattggcaggacag

SEQ ID NO: 89130 - DNA, 75 bp, Artificial Sequence
  Synthetic
tgattttgcacaggctattatgaaaaagaacacagttattggcaggacagagaaaggagaatttaccatgctggg

SEQ ID NO: 89131 - DNA, 75 bp, Artificial Sequence
  Synthetic
atacttcgtctgcagcacaagcagacaagaactttttcaaatggacaattaacaccaggtcctttgtacagctaa

SEQ ID NO: 89132 - DNA, 75 bp, Artificial Sequence
  Synthetic
gatgccatgattcaccatggagctacttgaaacagaaggtatgttcatacttaggtattccttatgtacctagac

SEQ ID NO: 89133 - DNA, 75 bp, Artificial Sequence
  Synthetic
cccactcatgcttccattggagaaaccatttatattaatgatgtggaaacaaaagtcaaagatgcctatgctttg

SEQ ID NO: 89134 - DNA, 75 bp, Artificial Sequence
  Synthetic
taatggtggaatgccctctggttcttcaggtaccagcatattcaacactatgatcaacaatataatcataagaac

SEQ ID NO: 89135 - DNA, 75 bp, Artificial Sequence
  Synthetic
atcaatagctggtgtagtttatgttatatacaaactttttgctggcattcagggtccatacacaggaatccccaa

SEQ ID NO: 89136 - DNA, 75 bp, Artificial Sequence
  Synthetic
ccatttatattaatgatgtggaaacaaaagtcaaagatgcctatgctttgaaagacatgactgatgtcaatctgg

SEQ ID NO: 89137 - DNA, 75 bp, Artificial Sequence
  Synthetic
aaatgagaagttcagggatattagacactttctcccaacatatgaagatgactataacgatgcagtattaagtgt

SEQ ID NO: 89138 - DNA, 75 bp, Artificial Sequence
  Synthetic
cactttctcccaacatatgaagatgactataacgatgcagtattaagtgtaaatacttccaaattcccaaacatg

SEQ ID NO: 89139 - DNA, 75 bp, Artificial Sequence
  Synthetic
attatggtttcctcaaccttggtggcactcccacgcatagaatacttatgtacaatttcccaactagggcaggac

SEQ ID NO: 89140 - DNA, 75 bp, Artificial Sequence
  Synthetic
ccacatcaatggataaatctgagaaccaacaattcagcaacaattgttcttccctggatgaatgctgctccaatg

SEQ ID NO: 89141 - DNA, 75 bp, Artificial Sequence
  Synthetic
tgatattgttaccatttagcttgtcaaatcaattgcgaaagatcccaagtcttatttatcaacttgcattttgat

SEQ ID NO: 89142 - DNA, 75 bp, Artificial Sequence
  Synthetic
ttcacactactgtagaaagtacgcaccactttacgcagtggaagcaaagagggtagtagctcttgaaaagaaaat

SEQ ID NO: 89143 - DNA, 75 bp, Artificial Sequence
  Synthetic
cactcccacgcatagaatacttatgtacaatttcccaactagggcaggacagtgtgggggtgtcgtcactaccac

SEQ ID NO: 89144 - DNA, 75 bp, Artificial Sequence
  Synthetic
ggtggtaatggggctcaagggttcgccgcaatgctactcagaaactactttactgacaagcaaggtgagatagtc

SEQ ID NO: 89145 - DNA, 75 bp, Artificial Sequence
  Synthetic
caacccagtgtcttccatcaagtttttgaaggttcaaaggaaccagcagttctcaatccaaaagatcctaggctt

SEQ ID NO: 89146 - DNA, 75 bp, Artificial Sequence
  Synthetic
ccgcaatgctactcagaaactactttactgacaagcaaggtgagatagtcagtgtcgagaagagtggggtttttg

SEQ ID NO: 89147 - DNA, 75 bp, Artificial Sequence
  Synthetic
gatagttatgcggcttcagctagcaagcaggatttctcacaggacccatcaaaattcactgaaccagtagtggaa

SEQ ID NO: 89148 - DNA, 75 bp, Artificial Sequence
  Synthetic
tctcaatccaaaagatcctaggcttaaaacaaatttcgaggaagccattttctcgaaatatacaggcaacaaaat

SEQ ID NO: 89149 - DNA, 75 bp, Artificial Sequence
  Synthetic
ggaacccagtgtctttcatgatgtgttcgaaggtgtaaaggagccagctgtcttacactcaaaagataaaagact

SEQ ID NO: 89150 - DNA, 75 bp, Artificial Sequence
  Synthetic
ttcgaaggtgtaaaggagccagctgtcttacactcaaaagataaaagactcaaggttgattttgaagaagccatc

SEQ ID NO: 89151 - DNA, 75 bp, Artificial Sequence
  Synthetic
tgaaatctcctagtgctgaggcgtgtggctacagtgatagagtgttacagcttaaattaggtaactcagctattg

SEQ ID NO: 89152 - DNA, 75 bp, Artificial Sequence
  Synthetic
tacaaacagcaaacagtggtcctcatggatgatttaatgcaaaatccagatgggaatgacatatctatgttctgc

SEQ ID NO: 89153 - DNA, 75 bp, Artificial Sequence
  Synthetic
ccccattgctgctcatggaaggcaccaaatagcaagatgcaagtgcaatacaggggtttactattgtagacacaa

SEQ ID NO: 89154 - DNA, 75 bp, Artificial Sequence
  Synthetic
ctatgctaatggatgagtatatggaggaagctgtggatcattatgtggggtgtttggaaccactggatatcagca

SEQ ID NO: 89155 - DNA, 75 bp, Artificial Sequence
  Synthetic
ggaagctgtggatcattatgtggggtgtttggaaccactggatatcagcacagagccaatcccccttgagagtgc

SEQ ID NO: 89156 - DNA, 75 bp, Artificial Sequence
  Synthetic
tacttgccagatcatgaagcagtagccattgataaacctacacaaccagaaactgctacagatagattttatact

SEQ ID NO: 89157 - DNA, 75 bp, Artificial Sequence
  Synthetic
aagaaaagggacatatttaacagacataccaaagacaccactgaaatgacaaagatgctagaaaaatatggagtt

SEQ ID NO: 89158 - DNA, 75 bp, Artificial Sequence
  Synthetic
gctcttgacctaactaccagtgctggctacccatacatactacaaggaaagaaaaagagagacattttcaatagg

SEQ ID NO: 89159 - DNA, 75 bp, Artificial Sequence
  Synthetic
gctacccatacatactacaaggaaagaaaaagagagacattttcaataggcaaaccagagacactacagagatga

SEQ ID NO: 89160 - DNA, 75 bp, Artificial Sequence
  Synthetic
ggcttaaaacagatttcgaggaagccattttctcaaaatacacaggtaacaaaattatgttaatggatgaataca

SEQ ID NO: 89161 - DNA, 75 bp, Artificial Sequence
  Synthetic
tgatttaccattcgtcacctttgttaaagatgaacttagatcaagggagaaagttgaaaaaggcaaatctagatt

SEQ ID NO: 89162 - DNA, 75 bp, Artificial Sequence
  Synthetic
ggggtgtttagaaccattagatatcagtgtggatcccatacccctggaaagtgccatgtatggaatggatggcct

SEQ ID NO: 89163 - DNA, 75 bp, Artificial Sequence
  Synthetic
aaattccatcaaggcgccttattagtagtagcaattccagagcatcagaggggagcacataacaccaacactagc

SEQ ID NO: 89164 - DNA, 75 bp, Artificial Sequence
  Synthetic
aaagatgaacttagatcaagggagaaagttgaaaaaggcaaatctagattgattgaggctagttccttaaatgac

SEQ ID NO: 89165 - DNA, 75 bp, Artificial Sequence
  Synthetic
ggaatctctatgccacctttcacaagaatccaggggttgctactgggagcgccgttggatgcgatccggacatat

SEQ ID NO: 89166 - DNA, 75 bp, Artificial Sequence
  Synthetic
gaatccaggggttgctactgggagcgccgttggatgcgatccggacatattttggtctaaaatcccagtaatgtt

SEQ ID NO: 89167 - DNA, 75 bp, Artificial Sequence
  Synthetic
tggaagctctgtttcaggggcctccacagtttaaagagatcaaaatttcagtcaccccagatacaccagctcctg

SEQ ID NO: 89168 - DNA, 75 bp, Artificial Sequence
  Synthetic
accagtgtggtttgcctgtttaaagaaagttctaattaaattaggttacacacaccaaacatcttttatagatta

SEQ ID NO: 89169 - DNA, 75 bp, Artificial Sequence
  Synthetic
atgacaaagatgttagagaaatatggggttgacctaccttttgtaacctttgtaaaagatgagcttagatcaaga

SEQ ID NO: 89170 - DNA, 75 bp, Artificial Sequence
  Synthetic
tatacaggctacgatgccagtttgtctccagtctggtttgcttgcctaaagaaagttttaattaaattgggttat

SEQ ID NO: 89171 - DNA, 75 bp, Artificial Sequence
  Synthetic
ctccagtctggtttgcttgcctaaagaaagttttaattaaattgggttatactcatcaaactgcatttatcgatt

SEQ ID NO: 89172 - DNA, 75 bp, Artificial Sequence
  Synthetic
ttaccggtgatagaaaaccaagttagcacaatcgagcatagctgcccaacaacagaacaacagcaggccttattc

SEQ ID NO: 89173 - DNA, 75 bp, Artificial Sequence
  Synthetic
caaagatagaaagtacatagtgagcggtggtatgccctcaggatcatctggcaccagtatcttcaacaccatgat

SEQ ID NO: 89174 - DNA, 75 bp, Artificial Sequence
  Synthetic
ggtggtatgccctcaggatcatctggcaccagtatcttcaacaccatgatcaacaatattataattagaacctta

SEQ ID NO: 89175 - DNA, 75 bp, Artificial Sequence
  Synthetic
ctcggggcaattcctaacaactgacgaccatagctctgcaccagttctcccatgtttcaacccaactccagagat

SEQ ID NO: 89176 - DNA, 75 bp, Artificial Sequence
  Synthetic
accttgatcagtttaaaatgattgcttatggtgatgatgtgattgcaagttacccacatgagattgaccctggcc

SEQ ID NO: 89177 - DNA, 75 bp, Artificial Sequence
  Synthetic
ttatggtgatgatgtgattgcaagttacccacatgagattgaccctggcctattggccaaagctgggaaagaata

SEQ ID NO: 89178 - DNA, 75 bp, Artificial Sequence
  Synthetic
aaaagcgcaagctttactgacacaacttgggaaaatgtaacattcctaaaaagatattttagagcagatgatcag

SEQ ID NO: 89179 - DNA, 75 bp, Artificial Sequence
  Synthetic
tatccctttttgatccacccagttatgccaatgaaggaaatccatgagtccatcagatggaccaaagacccaaga

SEQ ID NO: 89180 - DNA, 75 bp, Artificial Sequence
  Synthetic
atagacctggaccagttcaaaatgattgcctatggggatgatgttattgctagctacccacataagattgatcca

SEQ ID NO: 89181 - DNA, 75 bp, Artificial Sequence
  Synthetic
ttgcctatggggatgatgttattgctagctacccacataagattgatccaggtttgctggcagaagcaggtaaac

SEQ ID NO: 89182 - DNA, 75 bp, Artificial Sequence
  Synthetic
tagctacccacataagattgatccaggtttgctggcagaagcaggtaaacagtatggattagtaatgacaccagc

SEQ ID NO: 89183 - DNA, 75 bp, Artificial Sequence
  Synthetic
tctagtcttagacgaaaatggttagattcgttttagataactctaattgaaacccaagttgattactttcattta

SEQ ID NO: 89184 - DNA, 75 bp, Artificial Sequence
  Synthetic
gcattttaatgtataacttcccaacaagagctggccagtgtggtggtgtggtgacaactacaggtaaggtgatag

SEQ ID NO: 89185 - DNA, 75 bp, Artificial Sequence
  Synthetic
gactcattctagataactctaattaggacccaaacccttagaggggaacaaacaattttttagaggtaaattttg

SEQ ID NO: 89186 - DNA, 75 bp, Artificial Sequence
  Synthetic
atgtaacttagaagttctcaaatcaaagctcaataggtggagcgcaaaccagcgctctcatgagcaagcactcct

SEQ ID NO: 89187 - DNA, 75 bp, Artificial Sequence
  Synthetic
ttatttatcaatttgtatttggatagcttcatttgaaaattctaaactcattcataaagatgggagctcaagtta

SEQ ID NO: 89188 - DNA, 75 bp, Artificial Sequence
  Synthetic
attttctcaaaatatacaggtaacaaaattatgttaatggatgagtacatggaagaggcagtggatcattatgtg

SEQ ID NO: 89189 - DNA, 75 bp, Artificial Sequence
  Synthetic
acttttacaaggatagttatgcagcttcagctagtaaacaagatttttcacaggatccatcaaaatttaccgaac

SEQ ID NO: 89190 - DNA, 75 bp, Artificial Sequence
  Synthetic
atcaagagaaaaagttgaaaaagggaaatcacgcctgattgaggccagttccttgaatgactcagttgctatgag

SEQ ID NO: 89191 - DNA, 75 bp, Artificial Sequence
  Synthetic
tcttcctgacttaacacttcaagcaatgtttgtacccactggtgctcttaccccagaaaagcaagattcattcca

SEQ ID NO: 89192 - DNA, 75 bp, Artificial Sequence
  Synthetic
agtgcagttggttgtgatccagatatattctggtcaaaaatccctattttgttagatggagaaatctttgctttt

SEQ ID NO: 89193 - DNA, 75 bp, Artificial Sequence
  Synthetic
cttcaatcagaaaatttcaataatgggagctcaagttaccagacagcaaactggtacccacgagaatgccaacat

SEQ ID NO: 89194 - DNA, 75 bp, Artificial Sequence
  Synthetic
ataaaagcatgggcaccacgaccaccacgaactctcccatacatgagcattgcaaatgcaaattataaaggtaaa

SEQ ID NO: 89195 - DNA, 75 bp, Artificial Sequence
  Synthetic
caaaaccatgcctcacaatatagtgaccactggcccaggttttggaggagtttttgtagggtctttcaaaataat

SEQ ID NO: 89196 - DNA, 75 bp, Artificial Sequence
  Synthetic
gaacatcagaggggagcgtataacactaatactagtccagagtttactgacatcatgaaaggtgaagaaggagga

SEQ ID NO: 89197 - DNA, 75 bp, Artificial Sequence
  Synthetic
cactcaggaagcagcaaactactgttgtgcttacggtgaatggcctaattacttaccagatcatgaagcagtggc

SEQ ID NO: 89198 - DNA, 75 bp, Artificial Sequence
  Synthetic
tgatccaggtttgctggcagaagcaggtaaacagtatggattagtaatgacaccagcagacaaaggaaccagttt

SEQ ID NO: 89199 - DNA, 75 bp, Artificial Sequence
  Synthetic
aagcacaggatggtggtggaaattacccgatgcgctaaataatataggcatgtttggacagaatgtgcaacacca

SEQ ID NO: 89200 - DNA, 75 bp, Artificial Sequence
  Synthetic
ttagattcgttctagacaactctaatgaaaccccaagttatagttactttcatttagaggtaaattttggtcact

SEQ ID NO: 89201 - DNA, 75 bp, Artificial Sequence
  Synthetic
gttggccctgcggaagcaggagattgcggtggtttattggtctgtccacatggggtaattggtcttcttacagca

SEQ ID NO: 89202 - DNA, 75 bp, Artificial Sequence
  Synthetic
tgggagctcaggttactagacaacaaactggcactcatgaaaatgccaacattgccacaaatggatctcatatta

SEQ ID NO: 89203 - DNA, 75 bp, Artificial Sequence
  Synthetic
ggtttaaaagcaggagcgccagttttgaaatctcctagtgctgaggcgtgtggttacagtgatagagtgctacag

SEQ ID NO: 89204 - DNA, 75 bp, Artificial Sequence
  Synthetic
tgaagaaggagggactttcaatcacccatatgtccttgatgatgggacatcattggcttgtgcaacaatatttcc

SEQ ID NO: 89205 - DNA, 75 bp, Artificial Sequence
  Synthetic
tacgcctgttttatctccctccccaatgtaacttagaagttttcaaatcaaagctcaataggtggagcgcaaacc

SEQ ID NO: 89206 - DNA, 75 bp, Artificial Sequence
  Synthetic
atgtaacttagaagttttcaaatcaaagctcaataggtggagcgcaaaccagcgttttcatgagcaagcactcct

SEQ ID NO: 89207 - DNA, 75 bp, Artificial Sequence
  Synthetic
gattcaccatggagctacttaaagcagaaggtatgttcatatttaggtattccttatgtacctagacagagtgaa

SEQ ID NO: 89208 - DNA, 75 bp, Artificial Sequence
  Synthetic
tatggttccaataacagtttcaattgctccaatgtgttgtgagttcaatggactcagacacgccatcactcaagg

SEQ ID NO: 89209 - DNA, 75 bp, Artificial Sequence
  Synthetic
tccttatgtacctagacagagtgaatcgtggcttaagaaatttacagaagcatgtaatgctctcagaggtctaga

SEQ ID NO: 89210 - DNA, 75 bp, Artificial Sequence
  Synthetic
ttatctatcaatttgcatttggatagcttcattttgaagattctaaacctgttcacaaagatgggggctcaagtt

SEQ ID NO: 89211 - DNA, 75 bp, Artificial Sequence
  Synthetic
tcgggacaatttctaactactgatgatcatagctcagcaccggttctcccgtgtttcaacccaactccagagatg

SEQ ID NO: 89212 - DNA, 75 bp, Artificial Sequence
  Synthetic
gtgtttcaacccaactccagagatgcacattccagggcaggtccgcaacatgctagaagtggttcaagtggaatc

SEQ ID NO: 89213 - DNA, 75 bp, Artificial Sequence
  Synthetic
cacattccagggcaggtccgcaacatgctagaagtggttcaagtggaatcaatgatggagatcaacaacacagaa

SEQ ID NO: 89214 - DNA, 75 bp, Artificial Sequence
  Synthetic
tttatcaactggcttaaaaacaaaatattaccagaagctagggagaaatatgaatttgtgcaaagactcaaacag

SEQ ID NO: 89215 - DNA, 75 bp, Artificial Sequence
  Synthetic
gcacaattgaacatagttgcccaacaacagaacaacagcaggccttattcaataacgtccagtactattcacact

SEQ ID NO: 89216 - DNA, 75 bp, Artificial Sequence
  Synthetic
tcctctaacacatgttccttaatagggttcgtagcagcaaaagatgacttttcccttaggttaatgagagatagc

SEQ ID NO: 89217 - DNA, 75 bp, Artificial Sequence
  Synthetic
catatctaggtattatacccattggtctggatctctagaaatgacatttatgttttgtggcagcttcatggcaac

SEQ ID NO: 89218 - DNA, 75 bp, Artificial Sequence
  Synthetic
attcagctattgtcactcaggaagcagcaaactattgttgcgcttatggtgaatggcccaattatttaccagatc

SEQ ID NO: 89219 - DNA, 75 bp, Artificial Sequence
  Synthetic
cttggattagtggatctcactacaggatgttcaacaatgatgctaagtcaactaatgccaacgttggctacgtta

SEQ ID NO: 89220 - DNA, 75 bp, Artificial Sequence
  Synthetic
ccatacaaactcgcacagtgataaatcagcatggcgtgtctgagacattagtggagaattttcttagtagggcag

SEQ ID NO: 89221 - DNA, 75 bp, Artificial Sequence
  Synthetic
gatgttcaacaatgatgctaagtcaactaatgccaacgttggctacgttacctgttttatgcagaccaatctgat

SEQ ID NO: 89222 - DNA, 75 bp, Artificial Sequence
  Synthetic
atctggtttcttaattcatgtgcagtgtaacgccacaaaattccatcaaggcgccctattagtggtagcaatccc

SEQ ID NO: 89223 - DNA, 75 bp, Artificial Sequence
  Synthetic
gtggagaattttcttagtagggcagccttagtatcaaagagaagtttcgagtacaaaaatcacgcctcatctgaa

SEQ ID NO: 89224 - DNA, 75 bp, Artificial Sequence
  Synthetic
tgttccttaatagggttcatagcagcaaaagatgacttctctctcaggctaatgagagacagtcctgacattgga

SEQ ID NO: 89225 - DNA, 75 bp, Artificial Sequence
  Synthetic
caaaagatgacttctctctcaggctaatgagagacagtcctgacattggacaattggaccatttagatgcggcag

SEQ ID NO: 89226 - DNA, 75 bp, Artificial Sequence
  Synthetic
tgtaacgccacaaaattccatcaaggcgccctattagtggtagcaatcccagaacatcagaggggagcgtataac

SEQ ID NO: 89227 - DNA, 75 bp, Artificial Sequence
  Synthetic
acatcatgaaaggtgaagaaggaggaacattcagtcacccatatgtccttgacgatgggacatcactagcctgtg

SEQ ID NO: 89228 - DNA, 75 bp, Artificial Sequence
  Synthetic
actttgatttgaaaattttaataatgggagctcaggttactagacaacaaactggcactcacgaaaatgccaatg

SEQ ID NO: 89229 - DNA, 75 bp, Artificial Sequence
  Synthetic
aggcagcctatcaaattgagagcatcatcagaacagcaactgatactgtaaaaagcgagattaacgccgaacttg

SEQ ID NO: 89230 - DNA, 75 bp, Artificial Sequence
  Synthetic
gaaccagaagaagccatacaaactcgcacagtgataaatcagcatggtgtgtctgaaactttagtggagaacttt

SEQ ID NO: 89231 - DNA, 75 bp, Artificial Sequence
  Synthetic
agatcgtagaactaatgcaagatccaccattgatatgctagtaactgatatcatcaaggaatatagaaccagaaa

SEQ ID NO: 89232 - DNA, 75 bp, Artificial Sequence
  Synthetic
atgctagcgtgttcttcaaaatttctgaccctccagccagaatgactataccttttatgtgtattaactcagcat

SEQ ID NO: 89233 - DNA, 75 bp, Artificial Sequence
  Synthetic
agagaagtttcgaatacaagaatcatacctcgtctgaagcgcagacggacaagaactttttcaagtggacaatta

SEQ ID NO: 89234 - DNA, 75 bp, Artificial Sequence
  Synthetic
ccatcactcaaggcgttccaacgtaccttctaccaggctcaggacaatttctaactactgatgatcatagctctg

SEQ ID NO: 89235 - DNA, 75 bp, Artificial Sequence
  Synthetic
aagaaagttagaattgtttacatatctcagatttgatgctgaaatcaccatactcacaactgtggcagtgaatgg

SEQ ID NO: 89236 - DNA, 75 bp, Artificial Sequence
  Synthetic
aactccagaaatgcacattccagggcaagtccgcaacatgctagaagtggttcaagtggagtcaatgatggagat

SEQ ID NO: 89237 - DNA, 75 bp, Artificial Sequence
  Synthetic
cttcctgacttgacgcttcaagcaatgtttgtacccactggtgcccttaccccaaaacagcaggattcattccac

SEQ ID NO: 89238 - DNA, 75 bp, Artificial Sequence
  Synthetic
gaaaagtggtctgtatggaataaatccagccgacactatcggtaacttatgtgtcagaatagtgaatgaacacca

SEQ ID NO: 89239 - DNA, 75 bp, Artificial Sequence
  Synthetic
ttatgtagactggcaatcagatgttctagttactcccatcgctgctcatggaagacatcaaatagcaagatgcaa

SEQ ID NO: 89240 - DNA, 75 bp, Artificial Sequence
  Synthetic
agggtttacatgaagcctaaacacataaaagcatgggcaccgcgaccaccccgaaccctaccatacatgagcatt

SEQ ID NO: 89241 - DNA, 75 bp, Artificial Sequence
  Synthetic
gactaaagttttagatgcatgtgcacttagagacttaactgatacaaacttagagattaccatagtcaaattaga

SEQ ID NO: 89242 - DNA, 75 bp, Artificial Sequence
  Synthetic
gatcccactacaggatgttcaacaatgatgctaagtcaaccaatgccaacgttggctatgttacctgttttatgc

SEQ ID NO: 89243 - DNA, 75 bp, Artificial Sequence
  Synthetic
gcaaacgcaaattacagaggtaaagaaagagcaccaaatgcgctcaatgccataattggtaatagagacagtgtc

SEQ ID NO: 89244 - DNA, 75 bp, Artificial Sequence
  Synthetic
agagacagtcagctatctatgtggattggcaatcagatgttctagtaactcccattgctgctcatggaagacacc

SEQ ID NO: 89245 - DNA, 75 bp, Artificial Sequence
  Synthetic
ctatggttagacactgatgctatggaacaaggcattactgattatattcaaaatctcggcaatgcctttggagca

SEQ ID NO: 89246 - DNA, 75 bp, Artificial Sequence
  Synthetic
ttagatgcagcagaggcagcctaccagattgagagtattatcaaaacagcaactgacaccgtgaagagtgaaatt

SEQ ID NO: 89247 - DNA, 75 bp, Artificial Sequence
  Synthetic
ttggcaatcagatgttctagtaactcccattgctgctcatggaagacaccaaatagcaagatgcaagtgtaatac

SEQ ID NO: 89248 - DNA, 75 bp, Artificial Sequence
  Synthetic
aagctaaggaggtgcaagatatgctaattggagagagctcactattagaaaaattgttaaaagctctaatcaaaa

SEQ ID NO: 89249 - DNA, 75 bp, Artificial Sequence
  Synthetic
ggagtaatcggtcttcttacagcaggagggggtggaattgtagctttcactgatatcagaaatttactatggtta

SEQ ID NO: 89250 - DNA, 75 bp, Artificial Sequence
  Synthetic
gcttaaaacagatttcgaggaggccattttctcgaaatatacaggcaacaaaattatgttaatggatgagtacat

SEQ ID NO: 89251 - DNA, 75 bp, Artificial Sequence
  Synthetic
ttgtccagttgaggagaaagctggaattgttcacatacctcagatttgatgctgaaattaccatactcacgactg

SEQ ID NO: 89252 - DNA, 75 bp, Artificial Sequence
  Synthetic
gggtgtttagaaccattagatattagtgtagatcccatacccctcgaaagtgccatgtatgggatggatggcctt

SEQ ID NO: 89253 - DNA, 75 bp, Artificial Sequence
  Synthetic
taatgcctttggagcaggtttcacagaaacgatctctaacaaagctagggaagtacaagatatgctaattggaga

SEQ ID NO: 89254 - DNA, 75 bp, Artificial Sequence
  Synthetic
gaagcattagacctgactaccagtgcaggattcccctacttactacaagggaagaagaaaagggacatatttaac

SEQ ID NO: 89255 - DNA, 75 bp, Artificial Sequence
  Synthetic
aaagctctgatcaaaatcatatcagcattggtgattgtaatcagaaattcagaagacttggttacagttactgcc

SEQ ID NO: 89256 - DNA, 75 bp, Artificial Sequence
  Synthetic
gaaagagcgccaaatgcactcaatgctataattggcaatagagacagtgttaagaccatgcctcataatatagta

SEQ ID NO: 89257 - DNA, 75 bp, Artificial Sequence
  Synthetic
ctgaccctccagccagaatgactataccttttatgtgtattaactcagcatactcagttttttatgatggttttg

SEQ ID NO: 89258 - DNA, 75 bp, Artificial Sequence
  Synthetic
agaagacttggttacagttactgccacactagcattgctaggatgccatgattcaccatggagctacttgaaaca

SEQ ID NO: 89259 - DNA, 75 bp, Artificial Sequence
  Synthetic
tactcagttttttatgatggttttgctggatttgagaaaaatggtctctatggaataaatccagctgataccatc

SEQ ID NO: 89260 - DNA, 75 bp, Artificial Sequence
  Synthetic
aaaaagttgaaaaaggaaaatcacgcctaattgaggctagttccttgaatgactcagttgctatgagggtcgcct

SEQ ID NO: 89261 - DNA, 75 bp, Artificial Sequence
  Synthetic
agtgcagttggttgtgatccagatatattttggtcaaaaatccctattttattagatggagaaatctttgctttt

SEQ ID NO: 89262 - DNA, 75 bp, Artificial Sequence
  Synthetic
acagaacaacagcaagccttgttcaacaatgtccaatattactcacactactgcagaaagtacgcaccactttac

SEQ ID NO: 89263 - DNA, 75 bp, Artificial Sequence
  Synthetic
cgggcttcggaggggtctttgtagggtctttcaaaataattaactaccacttagctaccacagaagagagacagt

SEQ ID NO: 89264 - DNA, 75 bp, Artificial Sequence
  Synthetic
gcccatggaagacaccaaatagcaagatgcaagtgtaatacaggggtttattattgcagacacagagatagaagt

SEQ ID NO: 89265 - DNA, 75 bp, Artificial Sequence
  Synthetic
tcacagattcatacaaagactcaaataaattggacatgtccagagcagtagagatgtgtaaaccagatgactgtg

SEQ ID NO: 89266 - DNA, 75 bp, Artificial Sequence
  Synthetic
gctatcacagaaaaattaggaggggatatttactccttgcctccagaccctaagtattttgatggatacaaacaa

SEQ ID NO: 89267 - DNA, 75 bp, Artificial Sequence
  Synthetic
ctattaattagggtttacaaaggcatagatctggaccagttcaaaatgattgcctatggggatgatgttatcgct

SEQ ID NO: 89268 - DNA, 75 bp, Artificial Sequence
  Synthetic
tccgctgatttgtggaaaggccattcaattcagagatcgtagaactaatgcaagatccactatagatatgttagt

SEQ ID NO: 89269 - DNA, 75 bp, Artificial Sequence
  Synthetic
caattcagagatcgtagaactaatgcaagatccactatagatatgttagtaactgatatcataaaggagtataga

SEQ ID NO: 89270 - DNA, 75 bp, Artificial Sequence
  Synthetic
taatgcaaaatccagatgggaatgacatatctatgttctgtcagatggtctctactgtggacttcatacccccaa

SEQ ID NO: 89271 - DNA, 75 bp, Artificial Sequence
  Synthetic
ctcgggacaattcctaacaactgatgatcatagctctgcaccggctctcccgtgtttcaacccaactccagaaat

SEQ ID NO: 89272 - DNA, 75 bp, Artificial Sequence
  Synthetic
agtatggtcccaataacagtttcaatcgctccaatgtgttgtgagtttaatgggcttagacacgccattactcaa

SEQ ID NO: 89273 - DNA, 75 bp, Artificial Sequence
  Synthetic
actagtctgtccacatggggtaattggtcttctcacagcagggggggatggaattgtagctttcactgatatcag

SEQ ID NO: 89274 - DNA, 75 bp, Artificial Sequence
  Synthetic
tgatgccaatgaaggagatacatgaatccattagatggactaaagatcccagaaacacacaggaccatgttaggt

SEQ ID NO: 89275 - DNA, 75 bp, Artificial Sequence
  Synthetic
caaattgggaaaatgtaactttcttgaaaagatacttcagagcagatgatcaatacccctttcttatacatccag

SEQ ID NO: 89276 - DNA, 75 bp, Artificial Sequence
  Synthetic
tattgccaaaagaaagggtggattgtaatacacccgtcaaatgaactacttgtagaaaaacatattagtagggct

SEQ ID NO: 89277 - DNA, 75 bp, Artificial Sequence
  Synthetic
cgggaaaattaatcctgtgctatactcctccaggtgggtcatgcccgacaaccagagagaccgccatgttaggta

SEQ ID NO: 89278 - DNA, 75 bp, Artificial Sequence
  Synthetic
ttagattcgttctagataactctaattgaaacccaagttgattactttcaattagaggtaaattttcctttaatt

SEQ ID NO: 89279 - DNA, 75 bp, Artificial Sequence
  Synthetic
agtacacaagacaagctggaagctctgttccagggacctccacagtttaaggaaattaaaatttcagtcactcca

SEQ ID NO: 89280 - DNA, 75 bp, Artificial Sequence
  Synthetic
ttcatatttaggtatcccttacgtacctagacagagtgaatcatggcttaagaagttcactgaagcatgcaatgc

SEQ ID NO: 89281 - DNA, 75 bp, Artificial Sequence
  Synthetic
tcaagaagttagggattattgccaaaagaaaggatggattgtaatacacccatcaaatgaactacttgtagaaaa

SEQ ID NO: 89282 - DNA, 75 bp, Artificial Sequence
  Synthetic
caaagactcaaacagttaccggtgatagaaaaccaagttagcactattgagcatagctgcccaacaacagaacaa

SEQ ID NO: 89283 - DNA, 75 bp, Artificial Sequence
  Synthetic
ctacaagccattgccacctttgtgtcaatagctggtgtggtttatgttatctacaagctttttgctggcattcag

SEQ ID NO: 89284 - DNA, 75 bp, Artificial Sequence
  Synthetic
gcatagctgcccaacaacagaacaacaacaggccttgtttaataatgtccaatattactcacattactgtagaaa

SEQ ID NO: 89285 - DNA, 75 bp, Artificial Sequence
  Synthetic
gagatatcaggcactttctgcccagatatgaggatgattacaatgacgctgtgcttagcgtacatacatcaaaat

SEQ ID NO: 89286 - DNA, 75 bp, Artificial Sequence
  Synthetic
ggtccatacacaggaattcccaaccccaaacccaaggtaccctctcttagaacagctaaagtgcaaggaccaggg

SEQ ID NO: 89287 - DNA, 75 bp, Artificial Sequence
  Synthetic
agaaaaacaccgtcgttgcaaggactgagaaaggtgagttcaccatgctaggtgtgtatgacagagtggcagtca

SEQ ID NO: 89288 - DNA, 75 bp, Artificial Sequence
  Synthetic
tccccacacacgcatctgttggagaaactatttacatcaatgatgtagaaactaaagtcttggatgcgtgtgcac

SEQ ID NO: 89289 - DNA, 75 bp, Artificial Sequence
  Synthetic
gtccttatggatgatttaatgcaaaatccagatgggaatgatatatctatgttctgccaaatggtctctactgtg

SEQ ID NO: 89290 - DNA, 75 bp, Artificial Sequence
  Synthetic
attcatgtgcagtgtaacgccacaaaatttcatcaaggtgctctattagtggtagcaattccagaacatcagagg

SEQ ID NO: 89291 - DNA, 75 bp, Artificial Sequence
  Synthetic
cctatctaacaattcacatttggatagcttcattttgaggactttaaacctatttacaaagatgggggctcaagt

SEQ ID NO: 89292 - DNA, 75 bp, Artificial Sequence
  Synthetic
aagactaaactccaacccagtgttttccatcaagtttttgaaggttcaaaggagccagcagttctcaattcaaaa

SEQ ID NO: 89293 - DNA, 75 bp, Artificial Sequence
  Synthetic
cgcaatcaaaagtttagagacatcagacattttttgcccaagtatgaggatgattacaatgacgctgtgcttagc

SEQ ID NO: 89294 - DNA, 75 bp, Artificial Sequence
  Synthetic
tgtacatcccagttggacaagtcaccaattatggtttcttgaacctaggtggtacaccaacgcaccgcattttaa

SEQ ID NO: 89295 - DNA, 75 bp, Artificial Sequence
  Synthetic
caattatggtttcttgaacctaggtggtacaccaacgcaccgcattttaatgtacaattttccaacaagagctgg

SEQ ID NO: 89296 - DNA, 75 bp, Artificial Sequence
  Synthetic
attgaagtcacagattcatacaaagactcaaataaattagacatgtcaaaagcagtagaaatgtgtaaaccagat

SEQ ID NO: 89297 - DNA, 75 bp, Artificial Sequence
  Synthetic
gcttcagctagtaaacaagatttttcacaggacccatcaaaatttactgaaccagtggtagaaggcttaaaagca

SEQ ID NO: 89298 - DNA, 75 bp, Artificial Sequence
  Synthetic
gatgctgtccgttgatttgtggaaaggccattcaatttagagatcgtagaactaatgcaaggtccaatatagata

SEQ ID NO: 89299 - DNA, 75 bp, Artificial Sequence
  Synthetic
tgggtggaaatggagcccaaggatttgcagcaatgctactacactcttactttactgatacacaaggtgagatag

SEQ ID NO: 89300 - DNA, 75 bp, Artificial Sequence
  Synthetic
aatggtgggatgccctctggttcttcaggtaccagcatattcaacactatgatcaataatataatcataagaact

SEQ ID NO: 89301 - DNA, 75 bp, Artificial Sequence
  Synthetic
gtttactggcagaagcaggtaaacattatggattagtaatgacaccagcagacaaaggaaccagttttgttgaca

SEQ ID NO: 89302 - DNA, 75 bp, Artificial Sequence
  Synthetic
aaaagctctaatcaaaatcatatcagcattagtaattgtaatcagaaattcggaagacttagtcacagtcacagc

SEQ ID NO: 89303 - DNA, 75 bp, Artificial Sequence
  Synthetic
tatcaacgcaccggtgaagactaaactccaacccagtgtcttccaccaagtttttgaaggttcgaaggaaccagc

SEQ ID NO: 89304 - DNA, 75 bp, Artificial Sequence
  Synthetic
tgaatggcccaattatttaccagatcatgaggcagtagctattgacaaacccacacaaccagaaactgctacgga

SEQ ID NO: 89305 - DNA, 75 bp, Artificial Sequence
  Synthetic
atcgctacctttgtatcaatagctggtgtggtttatgttatatataaactttttgctggtatccaaggcccttat

SEQ ID NO: 89306 - DNA, 75 bp, Artificial Sequence
  Synthetic
gtgtggtttatgttatatataaactttttgctggtatccaaggcccttatacaggaattcccaatcctaaaccca

SEQ ID NO: 89307 - DNA, 75 bp, Artificial Sequence
  Synthetic
aagaagaaaagagatatatttaatagacacaccagagacactactgaaatgacaaaaatgctagaaaaatatgga

SEQ ID NO: 89308 - DNA, 75 bp, Artificial Sequence
  Synthetic
ggtgcaagggccagggtttgattttgcacaagccataatgaagaaaaacaccgtcattgccaggactgaaaaggg

SEQ ID NO: 89309 - DNA, 75 bp, Artificial Sequence
  Synthetic
gacatcatgaaaggtgaagaaggaggaacatttaaccacccatatgtccttgatgatgggacgtcactagcctgc

SEQ ID NO: 89310 - DNA, 75 bp, Artificial Sequence
  Synthetic
tgtttccccggtgcggttgtatagactgtttccacggttgaaaacaacttatccgttatccgctatagtacttcg

SEQ ID NO: 89311 - DNA, 75 bp, Artificial Sequence
  Synthetic
gttgacctaccttttgtaacttttgtaaaagatgaacttagatcaaaagaaaaagttgaaaaagggaagtcacgc

SEQ ID NO: 89312 - DNA, 75 bp, Artificial Sequence
  Synthetic
ggcacaatcagtggacactagcaataataccagtagtaccactaggtacgcgcacagtgtcaagtatggttccaa

SEQ ID NO: 89313 - DNA, 75 bp, Artificial Sequence
  Synthetic
taaaggcatagacttagaccagttcaagatgatagcatatggagatgatgttattgctagctacccacacaagat

SEQ ID NO: 89314 - DNA, 75 bp, Artificial Sequence
  Synthetic
attttggtcaaaaatccctattctattagatggagaaatctttgcttttgattacactggttatgatgccagttt

SEQ ID NO: 89315 - DNA, 75 bp, Artificial Sequence
  Synthetic
tgatccaggtttactagcagaagcaggcaaacattacggattaataatgacaccagcagacaaaggaaccagctt

SEQ ID NO: 89316 - DNA, 75 bp, Artificial Sequence
  Synthetic
tcaaaattcccaaatatgtatatcccagttgggcaagtcaccaattatggcttcctaaacctaggcggtacacca

SEQ ID NO: 89317 - DNA, 75 bp, Artificial Sequence
  Synthetic
aagaaagtcctaattaaattaggttacacacaccaaacatcttttatagattatttgtgtcactcggtacactta

SEQ ID NO: 89318 - DNA, 75 bp, Artificial Sequence
  Synthetic
cagatgatcaatatccctttcttatacatccagtaatgccaatgaaggagatacatgagtctattagatggacta

SEQ ID NO: 89319 - DNA, 75 bp, Artificial Sequence
  Synthetic
caactccagaaatgcacattccagggcaagtccgcaacatgctagaagtgattcaagtggaatcaatgatggaga

SEQ ID NO: 89320 - DNA, 75 bp, Artificial Sequence
  Synthetic
catgcagcgtctcaaagttgatatatcagtactaacagacgttgatcaattgttattcaacattccactagacat

SEQ ID NO: 89321 - DNA, 75 bp, Artificial Sequence
  Synthetic
gctactccactcttactttactgatacacaaggtgaaatagttagcaatgagaaaagtggagtgtgtattaacgc

SEQ ID NO: 89322 - DNA, 75 bp, Artificial Sequence
  Synthetic
gcctatggagatgatgttattgctagttacccacataagattgatccgggtctactggcagaagcaggcaaacat

SEQ ID NO: 89323 - DNA, 75 bp, Artificial Sequence
  Synthetic
tagtagtagcaacacatacatgggtcttcctgacttgacacttcaagcaatgtttgtacccactggtgccctcac

SEQ ID NO: 89324 - DNA, 75 bp, Artificial Sequence
  Synthetic
tgacctggatcagttcaaaatgatagcctatggagatgatgttattgctagttacccacataagattgatccggg

SEQ ID NO: 89325 - DNA, 75 bp, Artificial Sequence
  Synthetic
aaaagatacttcagagcagatgatcaatacccctttcttatacatccagtaatgccaatgaaggagatacatgaa

SEQ ID NO: 89326 - DNA, 75 bp, Artificial Sequence
  Synthetic
gtcatgcccaacaaccagagaaactgctatgttaggtacacatgttgtttgggattttggattacaatccagtgt

SEQ ID NO: 89327 - DNA, 75 bp, Artificial Sequence
  Synthetic
tccattagatggactaaggatcccagaaacacacaggaccatgttaggtctttgtgctaccttgcatggcacaac

SEQ ID NO: 89328 - DNA, 75 bp, Artificial Sequence
  Synthetic
tataccccttgaaagtgccatgtatgggatggatggtctcgaagcattagacctaaccaccagtgcaggattccc

SEQ ID NO: 89329 - DNA, 75 bp, Artificial Sequence
  Synthetic
aaaaccatgcctcataatatagtaaccactggcccaggctttggaggagtttttgtagggtctttcaaaatcatt

SEQ ID NO: 89330 - DNA, 75 bp, Artificial Sequence
  Synthetic
tagattcgttctagataactctaattgaaacccaagttgtagttactttcatttagaggtaaattttggtcactt

SEQ ID NO: 89331 - DNA, 75 bp, Artificial Sequence
  Synthetic
ctactgacaccgtgaaaagtgaaattaacgctgaacttggcgtggtccctagtttgaatgcagttgaaacaggtg

SEQ ID NO: 89332 - DNA, 75 bp, Artificial Sequence
  Synthetic
gttgtgatccagatatattttggtcaaaaatccctgttttattggatggagaaatctttgcttttgattacactg

SEQ ID NO: 89333 - DNA, 75 bp, Artificial Sequence
  Synthetic
gctacagtgatagagtattacaacttaaattaggtaattcagctattgtcactcaggaagcagcaaactactgtt

SEQ ID NO: 89334 - DNA, 75 bp, Artificial Sequence
  Synthetic
tacgcctgttttatctcccttcccaatgtaacttagaagctcttaaatcaaggctcaataggtggggcgcaaacc

SEQ ID NO: 89335 - DNA, 75 bp, Artificial Sequence
  Synthetic
agaagcaggcaaacattatggattagtaatgacaccagcagacaaaggaaccagctttgttgacactaattggga

SEQ ID NO: 89336 - DNA, 75 bp, Artificial Sequence
  Synthetic
attcaccatggagctacttgaaacaaaaggtatgttcgtatctaggcattccctatgtacctagacagagtgaat

SEQ ID NO: 89337 - DNA, 75 bp, Artificial Sequence
  Synthetic
gggcgtacaacaccaatactagcccagggttcgatgatatcatgaagggtgaagaaggagggactttcaatcacc

SEQ ID NO: 89338 - DNA, 75 bp, Artificial Sequence
  Synthetic
ccctatgtacctagacagagtgaatcatggcttaagaaattcacggaagcatgcaatgctctcagaggtctagat

SEQ ID NO: 89339 - DNA, 75 bp, Artificial Sequence
  Synthetic
accttgatttgtaaattttaataatgggagctcaggttactagacaacaaacaggcactcacgaaaatgccaacg

SEQ ID NO: 89340 - DNA, 75 bp, Artificial Sequence
  Synthetic
gggagctcaggttactagacaacaaacaggcactcacgaaaatgccaacgttgccacaaatggatctcatatcac

SEQ ID NO: 89341 - DNA, 75 bp, Artificial Sequence
  Synthetic
atagacaagttcattaattggctcaaaactaaaatattaccagaggctagggagaaatatgaattcgtgcaaaga

SEQ ID NO: 89342 - DNA, 75 bp, Artificial Sequence
  Synthetic
atacaatcagataaacttttataaggatagttatgcggcttcagccagcaagcaagatttttcacaggacccatc

SEQ ID NO: 89343 - DNA, 75 bp, Artificial Sequence
  Synthetic
attgacactacctgcatactctagtcttagacgaaaatggttagattcgttctagacaactctaattgaaaccca

SEQ ID NO: 89344 - DNA, 75 bp, Artificial Sequence
  Synthetic
aatgagcaccagccaattggtttcacagtaaccgtcagggtttacatgaagcctaaacacataaaagcgtgggca

SEQ ID NO: 89345 - DNA, 75 bp, Artificial Sequence
  Synthetic
cgctagcaataataccagtagtgccattgggtacgcgcacaatgtcaagtatggttccaataacagtttcaattg

SEQ ID NO: 89346 - DNA, 75 bp, Artificial Sequence
  Synthetic
ttaaaacagccttggggttgttcccacctcaagggcccacgtggcggctagtactctggtatttcggtacccttg

SEQ ID NO: 89347 - DNA, 75 bp, Artificial Sequence
  Synthetic
tcatgtccaacaaccagagagactgccatgttaggtacacatattgtttgggattttggattgcaatctagtgtc

SEQ ID NO: 89348 - DNA, 75 bp, Artificial Sequence
  Synthetic
tgcccatggaagacaccaaatagcaagatgtaagtgcaatacaggggtttattattgcagacacagagatagaag

SEQ ID NO: 89349 - DNA, 75 bp, Artificial Sequence
  Synthetic
gaaacaggtgcaacttccaacactgaaccagaagaagccatacaaactcgcacagtgataaatcagcatggtgtg

SEQ ID NO: 89350 - DNA, 75 bp, Artificial Sequence
  Synthetic
ctctcaggggtttagattggttatcacagaagatagataaattcatcagctggcttaaaaacaagatattaccag

SEQ ID NO: 89351 - DNA, 75 bp, Artificial Sequence
  Synthetic
caccaggtcctttgtacagttaagaagaaagttagaattgtttacatatctcagatttgatgctgaaatcaccat

SEQ ID NO: 89352 - DNA, 75 bp, Artificial Sequence
  Synthetic
atgttttgtggcagctttatggcaacgggaaaattaatcctgtgctatactcctccaggtgggtcgtgtccgaca

SEQ ID NO: 89353 - DNA, 75 bp, Artificial Sequence
  Synthetic
accagagagaccgccatgttaggtacacatattgtttgggattttggactacaatctagtgtaaccctgataata

SEQ ID NO: 89354 - DNA, 75 bp, Artificial Sequence
  Synthetic
ccttggattagtggatcccactacaggatgttcaataatgatgctaagtcaactaatgctaatgttggctatgtc

SEQ ID NO: 89355 - DNA, 75 bp, Artificial Sequence
  Synthetic
tatgagcattgcaaatgcaaactacaagggtaaagaaagagcaccaaatgcgctcaatgccataattggcaatag

SEQ ID NO: 89356 - DNA, 75 bp, Artificial Sequence
  Synthetic
gaggcagcctaccagatcgagagcatcatcaaaacagcaactgacaccgtgaaaagtgaaattaacgctgaactt

SEQ ID NO: 89357 - DNA, 75 bp, Artificial Sequence
  Synthetic
cgcacagtgataaatcaacacggtgtatccgaaactctagtggagaattttctcagtagagcagctttggtatca

SEQ ID NO: 89358 - DNA, 75 bp, Artificial Sequence
  Synthetic
tttgtagggtcttttaaaataattaactaccacctagccactacagaagagagacagtcagctatctatgtggat

SEQ ID NO: 89359 - DNA, 75 bp, Artificial Sequence
  Synthetic
actatggttagacactgatgctatggaacagggtattactgattatattcaaaatcttggcaatgcctttggagc

SEQ ID NO: 89360 - DNA, 75 bp, Artificial Sequence
  Synthetic
tcttcctgacttgacactgcaggcaatgtttgtacccactggtgcccttaccccagaaaagcaagactcattcca

SEQ ID NO: 89361 - DNA, 75 bp, Artificial Sequence
  Synthetic
caaaatgaatattacccagcaaggtaccagaccaatgtactcctggcagctggccctgcggaagcgggagattgc

SEQ ID NO: 89362 - DNA, 75 bp, Artificial Sequence
  Synthetic
aaatttgattgccagggctatcacagaaaagttaggaggagatgtttattctctacccccagacccaaaatattt

SEQ ID NO: 89363 - DNA, 75 bp, Artificial Sequence
  Synthetic
aggtgcaggggccagggtttgattttgcacaagctataatgaagaaaaacaccgtcattgccaggactgaaaagg

SEQ ID NO: 89364 - DNA, 75 bp, Artificial Sequence
  Synthetic
tgcaaatgcaaattacaaaggtaaagaaagagcaccaaatgcactcaatgctataattggcaatagagacagtgt

SEQ ID NO: 89365 - DNA, 75 bp, Artificial Sequence
  Synthetic
gaaagagcaccaaatgcactcaatgctataattggcaatagagacagtgttaaaaccatgcctcataatatagtg

SEQ ID NO: 89366 - DNA, 75 bp, Artificial Sequence
  Synthetic
ccatagtcaaactggatcgtaaccaaaagtttagagatatcagacattttctgcccagatacgaggatgattata

SEQ ID NO: 89367 - DNA, 75 bp, Artificial Sequence
  Synthetic
gattgccagggctatcacagaaaagttaggaggggatgtttattccctacccccagacccaaaatattttgatgg

SEQ ID NO: 89368 - DNA, 75 bp, Artificial Sequence
  Synthetic
actattgaacatagctgcccaacaacagaacaacagcaagccttattcaacaatgtccaatattactcacactac

SEQ ID NO: 89369 - DNA, 75 bp, Artificial Sequence
  Synthetic
tttccaacaagagctggtcagtgtggtggtgtggtgacaaccacaggtaaggtgatagggatacatgtaggtgga

SEQ ID NO: 89370 - DNA, 75 bp, Artificial Sequence
  Synthetic
aaaagggaactctgtacaccagtccctttttgatagccactactaatgctggttcaatacatgcaccaaccgtct

SEQ ID NO: 89371 - DNA, 75 bp, Artificial Sequence
  Synthetic
tgggatggatggtctcgaggcattagacttaaccaccagtgcagggttcccttacttgctgcaagggaagaagaa

SEQ ID NO: 89372 - DNA, 75 bp, Artificial Sequence
  Synthetic
gctttgtcacgcagattcaaatttgatgtggacattgaagtcacagattcatacaaagactcaaacaaattagac

SEQ ID NO: 89373 - DNA, 75 bp, Artificial Sequence
  Synthetic
aacagaacaacagcaggccttatttaacaatgtccagtatttttcacactactgcagaaagtacgcaccacttta

SEQ ID NO: 89374 - DNA, 75 bp, Artificial Sequence
  Synthetic
ttcctgacttgacacttcaagcaatgtttgtacccactggtgctcttaccccagaaaagcaggactcattccact

SEQ ID NO: 89375 - DNA, 75 bp, Artificial Sequence
  Synthetic
cattgaaccggtttgtttaataatacatggctctccaggaactggcaagtcagtggcctcaaatttaattgccag

SEQ ID NO: 89376 - DNA, 75 bp, Artificial Sequence
  Synthetic
aaaatgtaactttcctgaaaagatactttagagcagatgatcaatatccctttcttatacatccagtaatgccaa

SEQ ID NO: 89377 - DNA, 75 bp, Artificial Sequence
  Synthetic
tcatacaaagactcaaacaaattggacatgtcaagagcagtcgagatgtgcaaaccagacgactgtgcccccacc

SEQ ID NO: 89378 - DNA, 75 bp, Artificial Sequence
  Synthetic
gagataactatagtcaaattggaccgcaatcaaaagtttagagacatcagacattttctgcccaagtatgaggat

SEQ ID NO: 89379 - DNA, 75 bp, Artificial Sequence
  Synthetic
tctgtggaaaggctattcaattcagagatcgtagaactaatgcaagatccactattgatatgctagtaactgata

SEQ ID NO: 89380 - DNA, 75 bp, Artificial Sequence
  Synthetic
atctcgcatggcataatggggaggaggcttacaatgaattttgtagaaaaattagaagtgtgcccgtgggaaggg

SEQ ID NO: 89381 - DNA, 75 bp, Artificial Sequence
  Synthetic
ggcttacaatgaattttgtagaaaaattagaagtgtgcccgtgggaagggcattgacactacctgcatactctag

SEQ ID NO: 89382 - DNA, 75 bp, Artificial Sequence
  Synthetic
gaggaagccatcttctcaaaatatacaggtaacaaaattatgttgatggatgagtacatggaagaagcagtagat

SEQ ID NO: 89383 - DNA, 75 bp, Artificial Sequence
  Synthetic
tggcaatcagacgtcttggttacccccattgctgctcatggaaggcaccaaatagcaagatgcaagtgcaacaca

SEQ ID NO: 89384 - DNA, 75 bp, Artificial Sequence
  Synthetic
ctgtttcagggacctccacagtttaaagagatcaaaatttcagtcactccagatacaccagctcctgatgccata

SEQ ID NO: 89385 - DNA, 75 bp, Artificial Sequence
  Synthetic
ttaaaacagctctggggttgttcccaccccagaggcccacgtggcggctagtactccggtaccccggtacccttg

SEQ ID NO: 89386 - DNA, 75 bp, Artificial Sequence
  Synthetic
accccagaggcccacgtggcggctagtactccggtaccccggtacccttgtacgcctgttttatactccctttcc

SEQ ID NO: 89387 - DNA, 75 bp, Artificial Sequence
  Synthetic
gtactccggtaccccggtacccttgtacgcctgttttatactccctttcccaagtaactttagaagaaataaact

SEQ ID NO: 89388 - DNA, 75 bp, Artificial Sequence
  Synthetic
ccagtaccaccacgaacacacacttctgtttccccggtgaagttgcatagactgtacccacggttgaaagcgatg

SEQ ID NO: 89389 - DNA, 75 bp, Artificial Sequence
  Synthetic
ctgtttccccggtgaagttgcatagactgtacccacggttgaaagcgatgaatccgttacccgcttaggtacttc

SEQ ID NO: 89390 - DNA, 75 bp, Artificial Sequence
  Synthetic
gatcaagagaaaaagttgaaaaaggaaaatcacgcttaattgaggccagttccttgaatgactcagttgctatga

SEQ ID NO: 89391 - DNA, 75 bp, Artificial Sequence
  Synthetic
cttcgatgcgttgcgatcagcactctaccccgagtgtagcttgggtcgatgagtctggacaccccacaccggcga

SEQ ID NO: 89392 - DNA, 75 bp, Artificial Sequence
  Synthetic
ttttgaaggttcaaaggaaccagcagttctcaattcgaaagatcctaggcttaagacagattttgaagaagctat

SEQ ID NO: 89393 - DNA, 75 bp, Artificial Sequence
  Synthetic
cgtggtccaggctgcgttggcggcctacccatggctagcaccatgggacgctagttgtgaacaaggtgcgaagag

SEQ ID NO: 89394 - DNA, 75 bp, Artificial Sequence
  Synthetic
ctagttgtgaacaaggtgcgaagagcctattgagctacctgagagtcctccggcccctgaatgcggctaatccca

SEQ ID NO: 89395 - DNA, 75 bp, Artificial Sequence
  Synthetic
cctattgagctacctgagagtcctccggcccctgaatgcggctaatcccaaccacggagcaaatgctcacaatcc

SEQ ID NO: 89396 - DNA, 75 bp, Artificial Sequence
  Synthetic
ctatgtatgggatggatggccttgaagcattagacctaaccaccagtgcaggattcccttacttgctacaaggga

SEQ ID NO: 89397 - DNA, 75 bp, Artificial Sequence
  Synthetic
agtctgtggcggaaccgactactttgggtgtccgtgtttccttttatttttattatggctgcttatggtgacaat

SEQ ID NO: 89398 - DNA, 75 bp, Artificial Sequence
  Synthetic
agacattttctgcccagatatgaggatgattacaatgacgctgtgcttagcgtacacacatcaaaattcccaaat

SEQ ID NO: 89399 - DNA, 75 bp, Artificial Sequence
  Synthetic
gggtgtccgtgtttccttttatttttattatggctgcttatggtgacaatctgagattgttatcatatagctatt

SEQ ID NO: 89400 - DNA, 75 bp, Artificial Sequence
  Synthetic
aaattttgccataactttttcacaaatcctacaacattacactacactttctcttgaataattgagacaactcat

SEQ ID NO: 89401 - DNA, 75 bp, Artificial Sequence
  Synthetic
aatttgtgcaaaggctcaaacagttaccggtgatagaaaaccaagttagtacaatcgagcatagctgcccaacaa

SEQ ID NO: 89402 - DNA, 75 bp, Artificial Sequence
  Synthetic
atcctacaacattacactacactttctcttgaataattgagacaactcataatgggagcacaagtttctagacaa

SEQ ID NO: 89403 - DNA, 75 bp, Artificial Sequence
  Synthetic
acgttgccactggaggctcaagcataacttacaatcaaataaatttctacaaagatagttatgcagcctcagcta

SEQ ID NO: 89404 - DNA, 75 bp, Artificial Sequence
  Synthetic
aacttacaatcaaataaatttctacaaagatagttatgcagcctcagctagtaaacaagatttcagccaagaccc

SEQ ID NO: 89405 - DNA, 75 bp, Artificial Sequence
  Synthetic
gaagccctaaaagctggagccccagtcctaaaatcaccatcagcagaggcttgtggttatagtgacagggtctta

SEQ ID NO: 89406 - DNA, 75 bp, Artificial Sequence
  Synthetic
tggctctccaggaactggcaagtcagtggcttcaaatttaattgccagggctatcacagagaaattgggagggga

SEQ ID NO: 89407 - DNA, 75 bp, Artificial Sequence
  Synthetic
tcctaaaatcaccatcagcagaggcttgtggttatagtgacagggtcttacagctcaaattaggaaattccagta

SEQ ID NO: 89408 - DNA, 75 bp, Artificial Sequence
  Synthetic
ttgttgtgcctatggagagtggcccacctatctacctgataatgaggcagtggctattgataaacctacccagcc

SEQ ID NO: 89409 - DNA, 75 bp, Artificial Sequence
  Synthetic
acctatctacctgataatgaggcagtggctattgataaacctacccagccagaaacatccacagatagattttac

SEQ ID NO: 89410 - DNA, 75 bp, Artificial Sequence
  Synthetic
gcaacagtactgggtggtggtggaagctccctgatgctttgaatcaaattggtatgtttggtcaaaacgtccaat

SEQ ID NO: 89411 - DNA, 75 bp, Artificial Sequence
  Synthetic
caaaccagcgctctcatgagcaagcactcctgtctccccggtgaggttgtataaactgttcccacggttgaaaac

SEQ ID NO: 89412 - DNA, 75 bp, Artificial Sequence
  Synthetic
gctccctgatgctttgaatcaaattggtatgtttggtcaaaacgtccaataccactacctgtataggagtgggtt

SEQ ID NO: 89413 - DNA, 75 bp, Artificial Sequence
  Synthetic
acaaaatttcaccaaggtactcttctaatagtggctatcccagaacaccaaattggaaagaaaggaacaggtacg

SEQ ID NO: 89414 - DNA, 75 bp, Artificial Sequence
  Synthetic
taatagtggctatcccagaacaccaaattggaaagaaaggaacaggtacgtcagcaagctttgctgaagtcatga

SEQ ID NO: 89415 - DNA, 75 bp, Artificial Sequence
  Synthetic
acaaccctaccttttagatgatggtactagtttggcctgtgctcttgtataccctcaccagtggataaatcttag

SEQ ID NO: 89416 - DNA, 75 bp, Artificial Sequence
  Synthetic
actagtttggcctgtgctcttgtataccctcaccagtggataaatcttagaaccaacaactcagcaacaattgtg

SEQ ID NO: 89417 - DNA, 75 bp, Artificial Sequence
  Synthetic
tggattttgctcttagacataacaactggacattagccgttattccggtatgtccattggcaggaggtactggca

SEQ ID NO: 89418 - DNA, 75 bp, Artificial Sequence
  Synthetic
ctggacattagccgttattccggtatgtccattggcaggaggtactggcaacacaaacacctatgtgccaattac

SEQ ID NO: 89419 - DNA, 75 bp, Artificial Sequence
  Synthetic
attatttgtgtcattcggtacatttatataaggacagaaaatatatagttaatggtgggatgccctctggttctt

SEQ ID NO: 89420 - DNA, 75 bp, Artificial Sequence
  Synthetic
gaatacaatgggcttagaaatgccattacacaaggagtgcccacttgcctgttgccaggctccaaccaatttttg

SEQ ID NO: 89421 - DNA, 75 bp, Artificial Sequence
  Synthetic
ttacacaaggagtgcccacttgcctgttgccaggctccaaccaatttttgactactgatgaccactcatcggcac

SEQ ID NO: 89422 - DNA, 75 bp, Artificial Sequence
  Synthetic
ccaacattgccacaaatggatctcatatcacatacaatcagataaacttttacaaggatagttatgcggcttcag

SEQ ID NO: 89423 - DNA, 75 bp, Artificial Sequence
  Synthetic
ccctgaaatgcacataccaggacaagtgcacagcatgttagaaatagtgcaaattgaatctatgatggaaattaa

SEQ ID NO: 89424 - DNA, 75 bp, Artificial Sequence
  Synthetic
gtgcacagcatgttagaaatagtgcaaattgaatctatgatggaaattaacaatgtgaatgacgctagtggagtg

SEQ ID NO: 89425 - DNA, 75 bp, Artificial Sequence
  Synthetic
gtggaaggtttaaaagcaggggcgccagttttgaaatctcctagtgctgaggcatgtggctacagtgatagagta

SEQ ID NO: 89426 - DNA, 75 bp, Artificial Sequence
  Synthetic
cacaatcagacatggaccaattgcttttcaacatcccattggacatacagttggaaggcccattaagaaacacac

SEQ ID NO: 89427 - DNA, 75 bp, Artificial Sequence
  Synthetic
gtgtatatgatagggtagcggtcatccccacacacgcatctgttggagaaaccatttacattaatgatgtagaga

SEQ ID NO: 89428 - DNA, 75 bp, Artificial Sequence
  Synthetic
caatacccctttctcatacatccagtgatgccaatgaaggagatacatgaatctattagatggactaaagatccc

SEQ ID NO: 89429 - DNA, 75 bp, Artificial Sequence
  Synthetic
ccccacacacgcatctgttggagaaaccatttacattaatgatgtagagactaaagttttagatgcgtgtgcact

SEQ ID NO: 89430 - DNA, 75 bp, Artificial Sequence
  Synthetic
tggacgctagcaataataccagtggtgccattaggtacgcgtacaacatcaagtatggtcccaataacagtttca

SEQ ID NO: 89431 - DNA, 75 bp, Artificial Sequence
  Synthetic
tagagacttgactgatacaaacttagagataaccatagtcaaattagaccgtaatcaaaaatttagagatatcag

SEQ ID NO: 89432 - DNA, 75 bp, Artificial Sequence
  Synthetic
atgactttcatgttttgtgggagctttatgaccacaggtaaattgatcatttgctacacaccacctggtggatct

SEQ ID NO: 89433 - DNA, 75 bp, Artificial Sequence
  Synthetic
tttcaacatcccattggacatacagttggaaggcccattaagaaacacactgctaggcaacatcagcaggtatta

SEQ ID NO: 89434 - DNA, 75 bp, Artificial Sequence
  Synthetic
ttatgaccacaggtaaattgatcatttgctacacaccacctggtggatctagcccaacagataggatgcaagcca

SEQ ID NO: 89435 - DNA, 75 bp, Artificial Sequence
  Synthetic
ctttgggctgcaatctagtatcaccattataattccttggatctcagggtctcattacaggatgtttaacacaga

SEQ ID NO: 89436 - DNA, 75 bp, Artificial Sequence
  Synthetic
attataattccttggatctcagggtctcattacaggatgtttaacacagatgccaaagcaataaatgctaatgtt

SEQ ID NO: 89437 - DNA, 75 bp, Artificial Sequence
  Synthetic
ccaaccttgtagcaccagtgggtgctgcagatcaatgttacattgttggaatggttgcggcaaagaaagatttta

SEQ ID NO: 89438 - DNA, 75 bp, Artificial Sequence
  Synthetic
tgcagatcaatgttacattgttggaatggttgcggcaaagaaagattttaatcttagattgatgagggattcacc

SEQ ID NO: 89439 - DNA, 75 bp, Artificial Sequence
  Synthetic
cctgaacaagctgcaacaacacaaattggagaaatagtgaaaactgtggctaatacagtagagagtgagattaag

SEQ ID NO: 89440 - DNA, 75 bp, Artificial Sequence
  Synthetic
ttggagaaatagtgaaaactgtggctaatacagtagagagtgagattaaggctgaattaggagtgataccttcac

SEQ ID NO: 89441 - DNA, 75 bp, Artificial Sequence
  Synthetic
ccgactactttgggtgtccgtgtttcactttttacttttatgactgcttatggtgacaatttgatattgttacca

SEQ ID NO: 89442 - DNA, 75 bp, Artificial Sequence
  Synthetic
tggtgacaatttgatattgttaccatttagcttgtcaaatcaattgcaaaagatcctaaatcttatttatcaact

SEQ ID NO: 89443 - DNA, 75 bp, Artificial Sequence
  Synthetic
atccaacacagaaccagaggaagctattcaaactcgtactgtgatcaatatgcatggtactgcagagtgcctggt

SEQ ID NO: 89444 - DNA, 75 bp, Artificial Sequence
  Synthetic
attcaaactcgtactgtgatcaatatgcatggtactgcagagtgcctggtggaaaatttcttaggcagatctgca

SEQ ID NO: 89445 - DNA, 75 bp, Artificial Sequence
  Synthetic
aattttaacaatgggagctcaggttactagacaacaaactggcactcatgaaaatgccaacattgccacaaatgg

SEQ ID NO: 89446 - DNA, 75 bp, Artificial Sequence
  Synthetic
acaagaatcactcaacaagtacctcatccattcaaaagaatttcttcatctggactttgaacaccagagaacttg

SEQ ID NO: 89447 - DNA, 75 bp, Artificial Sequence
  Synthetic
atccattcaaaagaatttcttcatctggactttgaacaccagagaacttgtccaaattaggaggaagatggaatt

SEQ ID NO: 89448 - DNA, 75 bp, Artificial Sequence
  Synthetic
acaggacccatcaaaattcactgaaccagtagtggaaggtttaaaagcaggggcgccagttttgaaatctcctag

SEQ ID NO: 89449 - DNA, 75 bp, Artificial Sequence
  Synthetic
ggattcccttacttactacaagggaagaagaaaagggatatatttaatagacatactagagacaccagtgaaatg

SEQ ID NO: 89450 - DNA, 75 bp, Artificial Sequence
  Synthetic
gaaataactattgtacccacccttagactattctcaagcagcaatgtctccttttctggattgcccaatctaact

SEQ ID NO: 89451 - DNA, 75 bp, Artificial Sequence
  Synthetic
gactattctcaagcagcaatgtctccttttctggattgcccaatctaactctacaagcgatgtatgtaccaactg

SEQ ID NO: 89452 - DNA, 75 bp, Artificial Sequence
  Synthetic
gaatggcccaattacttaccagaccatgaagcagtagccattgataaacctacacaaccagaaactgctacagat

SEQ ID NO: 89453 - DNA, 75 bp, Artificial Sequence
  Synthetic
ctcatttgagtggcaatcagcatgcaatcctagtgtctttttcaagatcaatgacccaccagcgcgtctaacaat

SEQ ID NO: 89454 - DNA, 75 bp, Artificial Sequence
  Synthetic
aatcctagtgtctttttcaagatcaatgacccaccagcgcgtctaacaattccattcatgagcattaactcagct

SEQ ID NO: 89455 - DNA, 75 bp, Artificial Sequence
  Synthetic
agattctacactttgaaatcagtcaaatgggaaactggaagcacaggatggtggtggaaactacccgatgcacta

SEQ ID NO: 89456 - DNA, 75 bp, Artificial Sequence
  Synthetic
ctggttttgagaaaaaggccactgtcctttacggcataaatccagcaaacactatgggaaacttgtgcttgagag

SEQ ID NO: 89457 - DNA, 75 bp, Artificial Sequence
  Synthetic
cctttacggcataaatccagcaaacactatgggaaacttgtgcttgagagtggttaattcttaccaaccagtcca

SEQ ID NO: 89458 - DNA, 75 bp, Artificial Sequence
  Synthetic
atgaagcctaagcatattaaggcctgggcacctagggcgcctcgcaccatgccctataccaacatcctcaacaac

SEQ ID NO: 89459 - DNA, 75 bp, Artificial Sequence
  Synthetic
gggcacctagggcgcctcgcaccatgccctataccaacatcctcaacaacaattatgcaggtcggtcagctgcac

SEQ ID NO: 89460 - DNA, 75 bp, Artificial Sequence
  Synthetic
gaccttcaatcatccatatgtccttgatgatggaacatcattggcttgtgcgacgatatttccacatcagtggat

SEQ ID NO: 89461 - DNA, 75 bp, Artificial Sequence
  Synthetic
ccataggagtaccataaagacaatgcccaacgatatcaatttgacaacagccggtcccggttatggaggagcttt

SEQ ID NO: 89462 - DNA, 75 bp, Artificial Sequence
  Synthetic
cccaacgatatcaatttgacaacagccggtcccggttatggaggagcttttgtggggtcttacaaaatcattaat

SEQ ID NO: 89463 - DNA, 75 bp, Artificial Sequence
  Synthetic
aagaaaggtcagtttatgtagactggcaatcagatgtcctagtgacaacagtagctgcccatgggaaacatcaaa

SEQ ID NO: 89464 - DNA, 75 bp, Artificial Sequence
  Synthetic
gcaatcagatgtcctagtgacaacagtagctgcccatgggaaacatcaaattgcgcgatgtaggtgcaatactgg

SEQ ID NO: 89465 - DNA, 75 bp, Artificial Sequence
  Synthetic
ccattactcaaggtgtcccaacataccttttaccaggctcgggacaattcctaacaactgatgatcatagctctg

SEQ ID NO: 89466 - DNA, 75 bp, Artificial Sequence
  Synthetic
agaagttacccagtatgctttgagggccctggtattcagtggatcaatgaaagtgattactatccagctagatat

SEQ ID NO: 89467 - DNA, 75 bp, Artificial Sequence
  Synthetic
aaatggttagattcgttctagacaactctaattgaaacccaagttatagttactttcatttagaggtaaattttg

SEQ ID NO: 89468 - DNA, 75 bp, Artificial Sequence
  Synthetic
gccctggtattcagtggatcaatgaaagtgattactatccagctagatatcaaacaaacactctcttagcaatgg

SEQ ID NO: 89469 - DNA, 75 bp, Artificial Sequence
  Synthetic
actctacaagccattgccacctttgtatcaatagctggtgtagtttatgttatatacaaactttttgctggcatt

SEQ ID NO: 89470 - DNA, 75 bp, Artificial Sequence
  Synthetic
ttgtgctacctcgcatggcataatggagaggaggcttataatgaattttgcagaaaaatcagaagtgtgcctgtg

SEQ ID NO: 89471 - DNA, 75 bp, Artificial Sequence
  Synthetic
gggcctcttagtctgctcacatggagtgataggactcgtcaccgcaggcggtgagggaatagttgctttcacaga

SEQ ID NO: 89472 - DNA, 75 bp, Artificial Sequence
  Synthetic
gtatcaaagagaagttttgaatacaaagatcatacttcgtctgcagcacaagcagacaagaactttttcaaatgg

SEQ ID NO: 89473 - DNA, 75 bp, Artificial Sequence
  Synthetic
gtgataggactcgtcaccgcaggcggtgagggaatagttgctttcacagacattagaaatctcctgtggttagag

SEQ ID NO: 89474 - DNA, 75 bp, Artificial Sequence
  Synthetic
cagattacatccagaaccttggtagcgcctttgggactggatttactgagaccatcagtgaaaaggctaaagaga

SEQ ID NO: 89475 - DNA, 75 bp, Artificial Sequence
  Synthetic
cagttggatgggccacttagaaacactttagtaggaaacatatctagatattacactcattggtctggatcccta

SEQ ID NO: 89476 - DNA, 75 bp, Artificial Sequence
  Synthetic
ttaaaacagctctggggttgttcccactcaagggcccacgtggcggctagtactctggtatctcggtacctttgt

SEQ ID NO: 89477 - DNA, 75 bp, Artificial Sequence
  Synthetic
cgcctttgggactggatttactgagaccatcagtgaaaaggctaaagagattcagaacatgctagttggagagga

SEQ ID NO: 89478 - DNA, 75 bp, Artificial Sequence
  Synthetic
actcaagggcccacgtggcggctagtactctggtatctcggtacctttgtacgcctgttttaattccctccccaa

SEQ ID NO: 89479 - DNA, 75 bp, Artificial Sequence
  Synthetic
gcattaatcaaaatagtatctgcaatggtgattgtgattaggaattcagaagatctagttacagtcactgcaaca

SEQ ID NO: 89480 - DNA, 75 bp, Artificial Sequence
  Synthetic
tggtgattgtgattaggaattcagaagatctagttacagtcactgcaacacttgccctcctagggtgcaatgact

SEQ ID NO: 89481 - DNA, 75 bp, Artificial Sequence
  Synthetic
agctcaataggtggagcgcaaaccagcgctcttatgagcaagcacttctgtctccccggtgtggttgtatagact

SEQ ID NO: 89482 - DNA, 75 bp, Artificial Sequence
  Synthetic
agtttgctcatatcttggcatcccatacacaataagacagagtgattcttggctcaagaagttcacagaggcatg

SEQ ID NO: 89483 - DNA, 75 bp, Artificial Sequence
  Synthetic
gtccccacggttgaaaacaacttatccgttaaccgctatagtacttcgagaaacctagtattgccttcggagtgt

SEQ ID NO: 89484 - DNA, 75 bp, Artificial Sequence
  Synthetic
tgatgctaagtcaactaatgccaacgttggctatgtcacttgttttatgcagaccaatctgatagtccccagtga

SEQ ID NO: 89485 - DNA, 75 bp, Artificial Sequence
  Synthetic
tacacaataagacagagtgattcttggctcaagaagttcacagaggcatgcaatgcattgagaggcctggattgg

SEQ ID NO: 89486 - DNA, 75 bp, Artificial Sequence
  Synthetic
tcaactggcttaaaacaaagattctcccagaagccagagaaaagcatgaatttgtacaaaagctcaagcaactgc

SEQ ID NO: 89487 - DNA, 75 bp, Artificial Sequence
  Synthetic
cccagaagccagagaaaagcatgaatttgtacaaaagctcaagcaactgcccgtcattgaaagtcagattaatac

SEQ ID NO: 89488 - DNA, 75 bp, Artificial Sequence
  Synthetic
gagcaacaacaggccctgtttaataatgtgcaatactattcacactactgcaaaaaatacgctcctttgtatgca

SEQ ID NO: 89489 - DNA, 75 bp, Artificial Sequence
  Synthetic
gagctacaacaggccctgtttaataatgtgcaatactattcacactactgcaaaaaatacgctcctttgtatgca

SEQ ID NO: 89490 - DNA, 75 bp, Artificial Sequence
  Synthetic
gagccacaacaggccctgtttaataatgtgcaatactattcacactactgcaaaaaatacgctcctttgtatgca

SEQ ID NO: 89491 - DNA, 75 bp, Artificial Sequence
  Synthetic
gagcgacaacaggccctgtttaataatgtgcaatactattcacactactgcaaaaaatacgctcctttgtatgca

SEQ ID NO: 89492 - DNA, 75 bp, Artificial Sequence
  Synthetic
atgtgcaatactattcacactactgcaaaaaatacgctcctttgtatgcactagaagctaagagggtttctgcct

SEQ ID NO: 89493 - DNA, 75 bp, Artificial Sequence
  Synthetic
acagttcaagtccaaatctcgcattgaaccagtatgtttgataatacatggatctccaggcactgggaagtcagt

SEQ ID NO: 89494 - DNA, 75 bp, Artificial Sequence
  Synthetic
gaaccagtatgtttgataatacatggatctccaggcactgggaagtcagtggcatctaacctcattgccagagct

SEQ ID NO: 89495 - DNA, 75 bp, Artificial Sequence
  Synthetic
tgttcactgatttgctttgaaataatctcacctcaaaacctccagtacataacatttaaagagtttaaacttatt

SEQ ID NO: 89496 - DNA, 75 bp, Artificial Sequence
  Synthetic
tctcacctcaaaacctccagtacataacatttaaagagtttaaacttatttataacaatgggagctcaagttact

SEQ ID NO: 89497 - DNA, 75 bp, Artificial Sequence
  Synthetic
cttactcactcccacctgatccaaaatattttgatgggtataaacaacagacagtggtcctgatggatgacttaa

SEQ ID NO: 89498 - DNA, 75 bp, Artificial Sequence
  Synthetic
atattttgatgggtataaacaacagacagtggtcctgatggatgacttaatgcaaaatccagatggtaatgatat

SEQ ID NO: 89499 - DNA, 75 bp, Artificial Sequence
  Synthetic
tcttagacgaaaatggttagattcgttctagacaactctaattgaaacccaagttatagttactttcatttagag

SEQ ID NO: 89500 - DNA, 75 bp, Artificial Sequence
  Synthetic
atgctaacattgctacaaatggatcccatattacatacaatcagataaatttttacaaggatagttatgcagctt

SEQ ID NO: 89501 - DNA, 75 bp, Artificial Sequence
  Synthetic
ccatattacatacaatcagataaatttttacaaggatagttatgcagcttcagccagcaagcaagacttttcaca

SEQ ID NO: 89502 - DNA, 75 bp, Artificial Sequence
  Synthetic
actgtagactttataccaccaatggccagtcttgaggaaaagggaaccctgtacactagcccatttctgattgcg

SEQ ID NO: 89503 - DNA, 75 bp, Artificial Sequence
  Synthetic
ccagtcttgaggaaaagggaaccctgtacactagcccatttctgattgcgaccaccaatgctggctcaattcacg

SEQ ID NO: 89504 - DNA, 75 bp, Artificial Sequence
  Synthetic
gtggtggaaggcttaaaagcaggggcaccagttttgaaatctcctagcgctgaggcttgtggctacagtgataga

SEQ ID NO: 89505 - DNA, 75 bp, Artificial Sequence
  Synthetic
caccagttttgaaatctcctagcgctgaggcttgtggctacagtgatagagtactacaactcaaattgggcaact

SEQ ID NO: 89506 - DNA, 75 bp, Artificial Sequence
  Synthetic
tttggcccgcagatttaaatttgacatggagattgagtcaatggaatcgtataaggatggtgttagattagatat

SEQ ID NO: 89507 - DNA, 75 bp, Artificial Sequence
  Synthetic
tctctgaccccccagccagaataaccataccttttatgtgcattaactcagcatactcagttttttatgatggct

SEQ ID NO: 89508 - DNA, 75 bp, Artificial Sequence
  Synthetic
atggagattgagtcaatggaatcgtataaggatggtgttagattagatatgtttaaagcagtggagttgtgcaac

SEQ ID NO: 89509 - DNA, 75 bp, Artificial Sequence
  Synthetic
aaactactgttgcgcttatggtgaatggcctaattatttaccagatcatgaagcagtagctattgataaacctac

SEQ ID NO: 89510 - DNA, 75 bp, Artificial Sequence
  Synthetic
tggcctaattatttaccagatcatgaagcagtagctattgataaacctacacaaccagaaacttctacagacaga

SEQ ID NO: 89511 - DNA, 75 bp, Artificial Sequence
  Synthetic
ataaaaagtgttgtccactgatttgtggaaaggccattcagtttagagacaagagaacgaacgtcaggtactcag

SEQ ID NO: 89512 - DNA, 75 bp, Artificial Sequence
  Synthetic
tggaaaggccattcagtttagagacaagagaacgaacgtcaggtactcagtagatatgttagtaactgaaatgat

SEQ ID NO: 89513 - DNA, 75 bp, Artificial Sequence
  Synthetic
tgaatgaacaccaaccagttggtttcacagtgaccgttagggtttacatgaagcctaaacacataaaagcatggg

SEQ ID NO: 89514 - DNA, 75 bp, Artificial Sequence
  Synthetic
gggagagtaatagcacaggatggtggtggaaactacctgatgcattaaacaacataggcatgtttggacaaaatg

SEQ ID NO: 89515 - DNA, 75 bp, Artificial Sequence
  Synthetic
gtggaaactacctgatgcattaaacaacataggcatgtttggacaaaatgtacaatatcactacctatacagatc

SEQ ID NO: 89516 - DNA, 75 bp, Artificial Sequence
  Synthetic
acacaagataaattggaggctctgtttcagggaccaccaactttcaaggaaattaaaatatctgtgacacctgag

SEQ ID NO: 89517 - DNA, 75 bp, Artificial Sequence
  Synthetic
tctcatatcacatacaatcagataaacttttacaaggatagttatgcagcttcagctagcaaacaagatttttca

SEQ ID NO: 89518 - DNA, 75 bp, Artificial Sequence
  Synthetic
ttcagggaccaccaactttcaaggaaattaaaatatctgtgacacctgagaccccagcacccgatgcaataaacg

SEQ ID NO: 89519 - DNA, 75 bp, Artificial Sequence
  Synthetic
agattatttgtgtcattcagtacatttatataaggacaaaaagtacatagttaatggtggaatgccctctggttc

SEQ ID NO: 89520 - DNA, 75 bp, Artificial Sequence
  Synthetic
aacgctacaaagttccatcaaggcgcgctgttggtggtagcaataccagagcatcagagaggggcacacgacacc

SEQ ID NO: 89521 - DNA, 75 bp, Artificial Sequence
  Synthetic
agaggttagagattactgccagaagaagggatggatagtcatgcacccacccactgaactggtggtggacaagca

SEQ ID NO: 89522 - DNA, 75 bp, Artificial Sequence
  Synthetic
aagggatggatagtcatgcacccacccactgaactggtggtggacaagcacattagtagagcctttatagcgcta

SEQ ID NO: 89523 - DNA, 75 bp, Artificial Sequence
  Synthetic
cgctgttggtggtagcaataccagagcatcagagaggggcacacgacaccaccactagtccagggtttaatgata

SEQ ID NO: 89524 - DNA, 75 bp, Artificial Sequence
  Synthetic
gtttaaccacccatatgttcttgatgatggaacatcaatagcttgtgcgacaatatttccacatcaatggataaa

SEQ ID NO: 89525 - DNA, 75 bp, Artificial Sequence
  Synthetic
ctatctatgtggattggcaatcagacgtcttggttacccccattgctgctcatggaaggcaccaaatagcaagat

SEQ ID NO: 89526 - DNA, 75 bp, Artificial Sequence
  Synthetic
ttgctggggtggtttatgtaatctacaagctttttgctggaatccaaggtccatacactggtttacccaatcaaa

SEQ ID NO: 89527 - DNA, 75 bp, Artificial Sequence
  Synthetic
caagctttttgctggaatccaaggtccatacactggtttacccaatcaaaaacccaaggtccctaccttgcgcac

SEQ ID NO: 89528 - DNA, 75 bp, Artificial Sequence
  Synthetic
gatggaacatcaatagcttgtgcgacaatatttccacatcaatggataaatctaagaaccaacaattcagcaacg

SEQ ID NO: 89529 - DNA, 75 bp, Artificial Sequence
  Synthetic
caccaatggactttccacttagacacaatcagtggacactagcagtaataccagtggttccattgggtacacgca

SEQ ID NO: 89530 - DNA, 75 bp, Artificial Sequence
  Synthetic
caatcagtggacactagcagtaataccagtggttccattgggtacacgcacaatgtcaagtgttgtcccaataac

SEQ ID NO: 89531 - DNA, 75 bp, Artificial Sequence
  Synthetic
cacaaattgggaaaatgtaactttcttaaaaagatatttcagagcagatgatcaatacccctttctcatacatcc

SEQ ID NO: 89532 - DNA, 75 bp, Artificial Sequence
  Synthetic
gatttcgcacaagccataatgagaaagaatacagtaatagctaggactagcaaaggggagtttaccatgttgggc

SEQ ID NO: 89533 - DNA, 75 bp, Artificial Sequence
  Synthetic
tgtgcagtatcactatctatacagatctggtttcttaattcatgtgcagtgtaacgccacaaaattccaccaggg

SEQ ID NO: 89534 - DNA, 75 bp, Artificial Sequence
  Synthetic
gagtttaacggactcaggcacgccatcacccagggtgttccaacatatcttctaccaggttcaggacaatttctg

SEQ ID NO: 89535 - DNA, 75 bp, Artificial Sequence
  Synthetic
aagcaggagattgcggtggtttactagtttgtccgcatggggtaatcggtcttcttacagcaggagggggtggaa

SEQ ID NO: 89536 - DNA, 75 bp, Artificial Sequence
  Synthetic
aatttacattaatgatgttccagtaaaagttaaggatgcttatgcccttagagatataaatgatgtgaacctgga

SEQ ID NO: 89537 - DNA, 75 bp, Artificial Sequence
  Synthetic
agaatacagtaatagctaggactagcaaaggggagtttaccatgttgggcatctatgatagaattgcagttgtac

SEQ ID NO: 89538 - DNA, 75 bp, Artificial Sequence
  Synthetic
aaagttaaggatgcttatgcccttagagatataaatgatgtgaacctggaaattactgttgtagaactagacaga

SEQ ID NO: 89539 - DNA, 75 bp, Artificial Sequence
  Synthetic
tccagaaatgcacattccagggcaaatccgcaacatgttggaaatgattcaagtggaatcaatgatggagattaa

SEQ ID NO: 89540 - DNA, 75 bp, Artificial Sequence
  Synthetic
tcacccagggtgttccaacatatcttctaccaggttcaggacaatttctgactactgatgaccatagctcagcac

SEQ ID NO: 89541 - DNA, 75 bp, Artificial Sequence
  Synthetic
gattcctgccaaagtatgaagatgattacaatgatgcaatcctcagcgtaaacactagcaagttcccaaacatgt

SEQ ID NO: 89542 - DNA, 75 bp, Artificial Sequence
  Synthetic
aaggaactctatacaccagtccatttttgatagctactaccaatgctggctcaatacatgcaccaactgtatcag

SEQ ID NO: 89543 - DNA, 75 bp, Artificial Sequence
  Synthetic
ttacaatgatgcaatcctcagcgtaaacactagcaagttcccaaacatgtatataccagtaggacaaacactaaa

SEQ ID NO: 89544 - DNA, 75 bp, Artificial Sequence
  Synthetic
tacaagcagatcttgatcagttattatttaacattccactagatatacaactggatggaccacttagaaacactt

SEQ ID NO: 89545 - DNA, 75 bp, Artificial Sequence
  Synthetic
atccgcaacatgttggaaatgattcaagtggaatcaatgatggagattaacaatacagacggcgcaaatggcatg

SEQ ID NO: 89546 - DNA, 75 bp, Artificial Sequence
  Synthetic
acccccacccacagaatattaatgtataacttccccacaagagcaggacaatgtggaggggtggtgaccaccact

SEQ ID NO: 89547 - DNA, 75 bp, Artificial Sequence
  Synthetic
atttaacattccactagatatacaactggatggaccacttagaaacactttagtagggaacatatccagatatta

SEQ ID NO: 89548 - DNA, 75 bp, Artificial Sequence
  Synthetic
atgacattcatgttttgcggtagttttatggcaacagggaaattgatcctatgttacacacctccaggtggatca

SEQ ID NO: 89549 - DNA, 75 bp, Artificial Sequence
  Synthetic
gtggcaatggtgcgcaaggctttgctgccatgctattgcaaaattactttactgagaagcagggtgagatagtat

SEQ ID NO: 89550 - DNA, 75 bp, Artificial Sequence
  Synthetic
ttatggcaacagggaaattgatcctatgttacacacctccaggtggatcatgcccaacaactagagaaactgcca

SEQ ID NO: 89551 - DNA, 75 bp, Artificial Sequence
  Synthetic
atagttcccagtgaatcctctgacacatgttccttgatagggttcatagcagcaaaagatgatttctccctcaga

SEQ ID NO: 89552 - DNA, 75 bp, Artificial Sequence
  Synthetic
aaatgcgccagctaaaaccaaattagaacctagtgtcttccatgaagtatttgagggagttaaggaacctgcagt

SEQ ID NO: 89553 - DNA, 75 bp, Artificial Sequence
  Synthetic
ctttggattacaatctagtatcaccttaataataccttggattagtggatcccactacaggatgttcaatagcga

SEQ ID NO: 89554 - DNA, 75 bp, Artificial Sequence
  Synthetic
gaacctagtgtcttccatgaagtatttgagggagttaaggaacctgcagttttacatagcaaggacaagagactg

SEQ ID NO: 89555 - DNA, 75 bp, Artificial Sequence
  Synthetic
ttaataataccttggattagtggatcccactacaggatgttcaatagcgacgctaagtcaaccaatgctaatgtt

SEQ ID NO: 89556 - DNA, 75 bp, Artificial Sequence
  Synthetic
tttccaaatacgttggtaacaaaaccatgctaatggatgagtacatggaggaggcagtggaccactatgtaggtt

SEQ ID NO: 89557 - DNA, 75 bp, Artificial Sequence
  Synthetic
ccaacctgatagtccccagtgagtcctctgatacttgttctttaataggattcatagcagcaaaagatgactttt

SEQ ID NO: 89558 - DNA, 75 bp, Artificial Sequence
  Synthetic
catgctaatggatgagtacatggaggaggcagtggaccactatgtaggttgtttagagccccttgatattagcac

SEQ ID NO: 89559 - DNA, 75 bp, Artificial Sequence
  Synthetic
ctctgatacttgttctttaataggattcatagcagcaaaagatgacttttccctcaggttaatgagagatagtcc

SEQ ID NO: 89560 - DNA, 75 bp, Artificial Sequence
  Synthetic
aagagggtagtagctcttgaaaagaaaataaacaactacatccagttcaagtccaaatctcgcattgaaccggtt

SEQ ID NO: 89561 - DNA, 75 bp, Artificial Sequence
  Synthetic
atacaatcagataaacttttacaaggatagttatgcggcttcagccagcaagcaggatttttcacaggacccatc

SEQ ID NO: 89562 - DNA, 75 bp, Artificial Sequence
  Synthetic
atgtatggtatggatggccttgaagccttggacctcactaccagtgctggctacccatacttgttgcaggggaag

SEQ ID NO: 89563 - DNA, 75 bp, Artificial Sequence
  Synthetic
catggagcagaggcagcctatcaggtggagagtatcatcaaaacagcaactgatactgtgaagagtgagattaac

SEQ ID NO: 89564 - DNA, 75 bp, Artificial Sequence
  Synthetic
aaataaacaactacatccagttcaagtccaaatctcgcattgaaccggtttgtttaataatacatggctctccag

SEQ ID NO: 89565 - DNA, 75 bp, Artificial Sequence
  Synthetic
ccttggacctcactaccagtgctggctacccatacttgttgcaggggaagaagaaaagagacatcttcaacagac

SEQ ID NO: 89566 - DNA, 75 bp, Artificial Sequence
  Synthetic
caaaatgttggacaaatatggtgtggatttgccctttgtcacatttgtcaaagatgaactcagaagcagagagaa

SEQ ID NO: 89567 - DNA, 75 bp, Artificial Sequence
  Synthetic
atacaaactcgcacagtaataaatcagcatggtgtgtcggagacgttagtggagaattttcttggtagggcagcc

SEQ ID NO: 89568 - DNA, 75 bp, Artificial Sequence
  Synthetic
gatttgccctttgtcacatttgtcaaagatgaactcagaagcagagagaaagtagagaagggcaagtctagattg

SEQ ID NO: 89569 - DNA, 75 bp, Artificial Sequence
  Synthetic
cagttgccatgcgagtggcatttggaaacctttatgcaacattccacaaaaatccaggagtcgccactgggagcg

SEQ ID NO: 89570 - DNA, 75 bp, Artificial Sequence
  Synthetic
acaagaatcatgcctcatccagcgcagggacacacaaaaacttttttaaatggacaattaatactaagtcttttg

SEQ ID NO: 89571 - DNA, 75 bp, Artificial Sequence
  Synthetic
aaacctttatgcaacattccacaaaaatccaggagtcgccactgggagcgctgttggatgtgatccagatttgtt

SEQ ID NO: 89572 - DNA, 75 bp, Artificial Sequence
  Synthetic
agggacacacaaaaacttttttaaatggacaattaatactaagtcttttgtccagttaagaagaaagctggaatt

SEQ ID NO: 89573 - DNA, 75 bp, Artificial Sequence
  Synthetic
agcaaacagtggtccttatggatgatttaatgcaaaatccagatgggaatgacatatctatgttctgccaaatgg

SEQ ID NO: 89574 - DNA, 75 bp, Artificial Sequence
  Synthetic
gatggaaaaatttttgcatttgactacacaggttatgatgccagtctctcaccagtctggtttgcatgcctaaag

SEQ ID NO: 89575 - DNA, 75 bp, Artificial Sequence
  Synthetic
gaaatcaccatactcacaactgtggcagtaaatggtaataatgacagcacatacatgggtctccctgacttgaca

SEQ ID NO: 89576 - DNA, 75 bp, Artificial Sequence
  Synthetic
acacaggttatgatgccagtctctcaccagtctggtttgcatgcctaaagaaaactctggtaaaattaggttata

SEQ ID NO: 89577 - DNA, 75 bp, Artificial Sequence
  Synthetic
cagtaaatggtaataatgacagcacatacatgggtctccctgacttgacactccaagcaatgtttgtaccaactg

SEQ ID NO: 89578 - DNA, 75 bp, Artificial Sequence
  Synthetic
cttgtgtcactcggttcacttgtacaaagacagaaaatacatagtgaacggtggaatgccatcaggctcatctgg

SEQ ID NO: 89579 - DNA, 75 bp, Artificial Sequence
  Synthetic
ttcatttcattggcaatcaggcagtaatgctagtgtgttctttaaaatttctgatcccccagctagaatgactat

SEQ ID NO: 89580 - DNA, 75 bp, Artificial Sequence
  Synthetic
aaagacagaaaatacatagtgaacggtggaatgccatcaggctcatctggcaccagtatcttcaacactatgatc

SEQ ID NO: 89581 - DNA, 75 bp, Artificial Sequence
  Synthetic
tatccaattcagagatcgcagaactaatgcaagatccactattgatatgctggtaactgatattataaaggaata

SEQ ID NO: 89582 - DNA, 75 bp, Artificial Sequence
  Synthetic
tattcagttttttatgatggctttgctggatttgagaaaaatggtctatatggaataaacccagctgacactatt

SEQ ID NO: 89583 - DNA, 75 bp, Artificial Sequence
  Synthetic
tacttaaagtttacaaaggtattgatttagatcagttcaaaatgatagcatatggtgatgatgtaattgctagtt

SEQ ID NO: 89584 - DNA, 75 bp, Artificial Sequence
  Synthetic
tttagatcagttcaaaatgatagcatatggtgatgatgtaattgctagttacccacatgagatagaccctggcct

SEQ ID NO: 89585 - DNA, 75 bp, Artificial Sequence
  Synthetic
agtgaccgttagggtttacatgaagcctaaacatataaaagcatgggctccacgaccaccgcgaaccatgccata

SEQ ID NO: 89586 - DNA, 75 bp, Artificial Sequence
  Synthetic
ggattaataatgaccccagcagacaagagtagtggttttactgagactacttgggagaatgttacctttttgaag

SEQ ID NO: 89587 - DNA, 75 bp, Artificial Sequence
  Synthetic
agagtagtggttttactgagactacttgggagaatgttacctttttgaagaggtatttcagagcagatgaacagt

SEQ ID NO: 89588 - DNA, 75 bp, Artificial Sequence
  Synthetic
aaaggtagagatacagcaccaaacacacttaatgccataattggtaatagagcgagtgtcacaactatgcctcac

SEQ ID NO: 89589 - DNA, 75 bp, Artificial Sequence
  Synthetic
cacttaatgccataattggtaatagagcgagtgtcacaactatgcctcacaacatagtaaccaccggtccaggtt

SEQ ID NO: 89590 - DNA, 75 bp, Artificial Sequence
  Synthetic
gtaacaaaattatgttaatggatgagtacatggaagaggcagtggatcattatgtggggtgtttagaaccattag

SEQ ID NO: 89591 - DNA, 75 bp, Artificial Sequence
  Synthetic
gcgaccaccacgaactctgccgtacatgagcattgcaaatgcaaactacaggggtaaagaaagagcaccaaatgc

SEQ ID NO: 89592 - DNA, 75 bp, Artificial Sequence
  Synthetic
gccaatgaaggaaatccatgagtcaattagatggacaaaagatccgagaaacacacaagatcatgtgagatcctt

SEQ ID NO: 89593 - DNA, 75 bp, Artificial Sequence
  Synthetic
taagataattaactatcacttagccacaatagaagagagacaatcagccatctatgtggactggcaatcagatgt

SEQ ID NO: 89594 - DNA, 75 bp, Artificial Sequence
  Synthetic
taccctctctcagaacagctaaagtgcaaggaccagggttcgattttgcacaagccataatgaagaaaaataccg

SEQ ID NO: 89595 - DNA, 75 bp, Artificial Sequence
  Synthetic
ggaaaatcagaactgtacctgtaggaagagctttagctttaccagtatattctagtttgaggcgcaagtggttag

SEQ ID NO: 89596 - DNA, 75 bp, Artificial Sequence
  Synthetic
attagatggacaaaagatccgagaaacacacaagatcatgtgagatccttgtgcctactagcctggcacaatggt

SEQ ID NO: 89597 - DNA, 75 bp, Artificial Sequence
  Synthetic
attagatggacaaaagatccgagaaacacacaagatcatgtgagatccttgtgcctacttgcctggcacaatggt

SEQ ID NO: 89598 - DNA, 75 bp, Artificial Sequence
  Synthetic
attagatggacaaaagatccgagaaacacacaagatcatgtgagatccttgtgcctactcgcctggcacaatggt

SEQ ID NO: 89599 - DNA, 75 bp, Artificial Sequence
  Synthetic
attagatggacaaaagatccgagaaacacacaagatcatgtgagatccttgtgcctactggcctggcacaatggt

SEQ ID NO: 89600 - DNA, 75 bp, Artificial Sequence
  Synthetic
acaatagaagagagacaatcagccatctatgtggactggcaatcagatgttctagtcacccccattgccgctcat

SEQ ID NO: 89601 - DNA, 75 bp, Artificial Sequence
  Synthetic
actcattctagataactctacttaggaacccaagaacccctccctggggcattagattttgtagaggtaaatttt

SEQ ID NO: 89602 - DNA, 75 bp, Artificial Sequence
  Synthetic
agtgtaatacaggggtttactattgccggcacagagatagaagctacccaatttgctttgaaggtccaggaattc

SEQ ID NO: 89603 - DNA, 75 bp, Artificial Sequence
  Synthetic
ccggcacagagatagaagctacccaatttgctttgaaggtccaggaattcaatggattgaacaaaatgaatacta

SEQ ID NO: 89604 - DNA, 75 bp, Artificial Sequence
  Synthetic
taatgatgtagagactaaagttttagatgcgtgtgcacttagagacttgactgatacaaacttagagataaccat

SEQ ID NO: 89605 - DNA, 75 bp, Artificial Sequence
  Synthetic
ctttgtacgcctgttttatctcccttcccaatgtaacttagaagttttcaaatcgaagctcagtaggtggggcgc

SEQ ID NO: 89606 - DNA, 75 bp, Artificial Sequence
  Synthetic
cttctagcagctggccctgcagaagcaggagattgtggtggtctattagtctgcccacacggggtgattggcctc

SEQ ID NO: 89607 - DNA, 75 bp, Artificial Sequence
  Synthetic
tgactcagttgctatgagggttgcttttggaaacctttacgccacatttcacaacaatccaggtacagcaactgg

SEQ ID NO: 89608 - DNA, 75 bp, Artificial Sequence
  Synthetic
caggagattgtggtggtctattagtctgcccacacggggtgattggcctccttacagcaggagggggtgggattg

SEQ ID NO: 89609 - DNA, 75 bp, Artificial Sequence
  Synthetic
tgtccacatggggtaattggtcttcttacagcaggagggggtggaattgtagctttcactgacatcaggaattta

SEQ ID NO: 89610 - DNA, 75 bp, Artificial Sequence
  Synthetic
actgtggttagatactgatgttatggaacaaggtattactgattacatacaaaatcttggtaatgcttttggagc

SEQ ID NO: 89611 - DNA, 75 bp, Artificial Sequence
  Synthetic
gaacaaggtattactgattacatacaaaatcttggtaatgcttttggagcaggattcacagaaacaatctccaat

SEQ ID NO: 89612 - DNA, 75 bp, Artificial Sequence
  Synthetic
taattggagagagttcattattggaaaaattactaaaagctctaatcaaaattatatcagcactggtgattgtca

SEQ ID NO: 89613 - DNA, 75 bp, Artificial Sequence
  Synthetic
aaaattactaaaagctctaatcaaaattatatcagcactggtgattgtcattagaaattcagaagatttgataac

SEQ ID NO: 89614 - DNA, 75 bp, Artificial Sequence
  Synthetic
atagttaatggtggaatgccctctggttcttcaggcaccagcatattcaacactatgatcaacaatataatcata

SEQ ID NO: 89615 - DNA, 75 bp, Artificial Sequence
  Synthetic
agagtggggtgtgcattaacgcaccggcaaagactaaactccaacccagtgttttccatcaagtttttgaaggtt

SEQ ID NO: 89616 - DNA, 75 bp, Artificial Sequence
  Synthetic
gggtgtcatgactcaccatggagctacttgaagcaaaaagtatgctcatacttgggtattccctatgtgcctaga

SEQ ID NO: 89617 - DNA, 75 bp, Artificial Sequence
  Synthetic
cgcaagtccgtggcggaaccgactactttgggtgtccgtgtttcactttttacctttatgactgcttatggtgac

SEQ ID NO: 89618 - DNA, 75 bp, Artificial Sequence
  Synthetic
acttgaagcaaaaagtatgctcatacttgggtattccctatgtgcctagacaaagtgaatcatggcttaagaagt

SEQ ID NO: 89619 - DNA, 75 bp, Artificial Sequence
  Synthetic
ttaggtattccttatgtacctagacagagtgaatcatggcttaagaagttcacagaagcatgcaatgctctcaga

SEQ ID NO: 89620 - DNA, 75 bp, Artificial Sequence
  Synthetic
aacccgtgtgtagcttgggtcgatgagtctggacataccccactggcgacagtggtccaggctgcgttggcggcc

SEQ ID NO: 89621 - DNA, 75 bp, Artificial Sequence
  Synthetic
gggtttagattggctatcacaaaagatagacaagttcattaattggctcaaaactaaaatattaccagaggctag

SEQ ID NO: 89622 - DNA, 75 bp, Artificial Sequence
  Synthetic
tacctttatgactgcttatggtgacaatttaatattgttaccatttagcttgtcagattaatcgcgtgaaatcct

SEQ ID NO: 89623 - DNA, 75 bp, Artificial Sequence
  Synthetic
ggatagcttcatttgaaaattctaaactcattcataaagatgggagctcaagttactaggcagcaaactggaacc

SEQ ID NO: 89624 - DNA, 75 bp, Artificial Sequence
  Synthetic
tagataaattcatcaactggcttaaaaacaaaatattaccagaagctagggagaaatatgaatttgtgcaaagac

SEQ ID NO: 89625 - DNA, 75 bp, Artificial Sequence
  Synthetic
aacaagttagcactattgagcatagttgcccaacaacagaacgacaacaggccttattcaacaatgttcagtatt

SEQ ID NO: 89626 - DNA, 75 bp, Artificial Sequence
  Synthetic
atggatggccttgaggcattagacttaactaccagtgcaggattcccttacttactacaagggaagaagaaaagg

SEQ ID NO: 89627 - DNA, 75 bp, Artificial Sequence
  Synthetic
atccagtgatgccaatgaaagagatacatgaatctattagatggactaaagatcccagaaacacacaggatcatg

SEQ ID NO: 89628 - DNA, 75 bp, Artificial Sequence
  Synthetic
ttcacactactgtagaaagtatgcaccactttacgcagtggaggcaaagagagtgacagctcttgaaaagaaaat

SEQ ID NO: 89629 - DNA, 75 bp, Artificial Sequence
  Synthetic
ttgcccaacaacagaacgacaacaggccttattcaacaatgttcagtattactcacattactgtaggaagtacgc

SEQ ID NO: 89630 - DNA, 75 bp, Artificial Sequence
  Synthetic
gataaacttttacaaggatagttatgcagcttcagctagcaaacaagatttttcacaggacccgtcaaaatttac

SEQ ID NO: 89631 - DNA, 75 bp, Artificial Sequence
  Synthetic
agagaaatatggagttgacctaccttttgtaacctttgtaaaagatgagcttagatcaagagaaaaagttgaaaa

SEQ ID NO: 89632 - DNA, 75 bp, Artificial Sequence
  Synthetic
aattgctagagctatcacagaaaaattaggcggggacatttactccctacccccagaccctaaatactttgatgg

SEQ ID NO: 89633 - DNA, 75 bp, Artificial Sequence
  Synthetic
ttaggcggggacatttactccctacccccagaccctaaatactttgatggatataaacagcaaacagtagtcctt

SEQ ID NO: 89634 - DNA, 75 bp, Artificial Sequence
  Synthetic
tggtgaatggcccaattatttaccagatcatgaggcagtagccattgataaacccacacaaccagaaaccgctac

SEQ ID NO: 89635 - DNA, 75 bp, Artificial Sequence
  Synthetic
acagcaactggtagtgcagttggttgtgatccagatatattttggtcaaaaatccctattttgttagatggagaa

SEQ ID NO: 89636 - DNA, 75 bp, Artificial Sequence
  Synthetic
gatcatgaggcagtagccattgataaacccacacaaccagaaaccgctacagacagattttataccttgaaatca

SEQ ID NO: 89637 - DNA, 75 bp, Artificial Sequence
  Synthetic
atgggaatgatatatctatgttttgccaaatggtttcaactgtggattttattcctccaatggctagtttggaag

SEQ ID NO: 89638 - DNA, 75 bp, Artificial Sequence
  Synthetic
ccaaatggtttcaactgtggattttattcctccaatggctagtttggaagagaaaggaactctatataccagtcc

SEQ ID NO: 89639 - DNA, 75 bp, Artificial Sequence
  Synthetic
ggtggtggtggaaactacccgatgcactaaataacataggcatgtttggacagaatgtgcagtatcactatctat

SEQ ID NO: 89640 - DNA, 75 bp, Artificial Sequence
  Synthetic
gcagtgtaacgccacaaagttccatcaaggcgctctattagtagtagcaattccagaacatcagaggggggcgta

SEQ ID NO: 89641 - DNA, 75 bp, Artificial Sequence
  Synthetic
gttacagattcatacaaagactcaaacaaactagacatgtccagagcagtggaaatgtgcaaaccagataactgt

SEQ ID NO: 89642 - DNA, 75 bp, Artificial Sequence
  Synthetic
atcataagaactttattaattagggtttacaaaggcatagacctggaccagttcaaaatgattgcctatggggat

SEQ ID NO: 89643 - DNA, 75 bp, Artificial Sequence
  Synthetic
gcccactgatttgcggaaaagctattcaatttagagatcgtagaaccaatgcaagatccacggttgatatgctag

SEQ ID NO: 89644 - DNA, 75 bp, Artificial Sequence
  Synthetic
tcaatttagagatcgtagaaccaatgcaagatccacggttgatatgctagtgactgacattattaaggaatacag

SEQ ID NO: 89645 - DNA, 75 bp, Artificial Sequence
  Synthetic
agcaacaatagttcttccctggatgaatgctgctccaatggacttcccactcaggcacaatcagtggacgctagc

SEQ ID NO: 89646 - DNA, 75 bp, Artificial Sequence
  Synthetic
ttagaagccctatttcaaggacctccacaattcaaggagattaaaatctcagtcgctccagacacaccagcccct

SEQ ID NO: 89647 - DNA, 75 bp, Artificial Sequence
  Synthetic
taatacacccatcaaatgaactacttgtagaaaaacatattagtagggcttttatcactctacaagctattgcta

SEQ ID NO: 89648 - DNA, 75 bp, Artificial Sequence
  Synthetic
acgcgcacagtgtcaagtatggttccaataacagtttcaattgctccaatgtgttgtgagttcaatggactcagg

SEQ ID NO: 89649 - DNA, 75 bp, Artificial Sequence
  Synthetic
caataacagtttcaattgctccaatgtgttgtgagttcaatggactcaggcatgccatcacgcaaggtgttccaa

SEQ ID NO: 89650 - DNA, 75 bp, Artificial Sequence
  Synthetic
cacaattcaaggagattaaaatctcagtcgctccagacacaccagcccctgatgccataaatgaccttcttaggt

SEQ ID NO: 89651 - DNA, 75 bp, Artificial Sequence
  Synthetic
ttatgttatatataaactttttgctggcattcaaggtccatatacaggaattcccaatcctaaacccaaagtacc

SEQ ID NO: 89652 - DNA, 75 bp, Artificial Sequence
  Synthetic
ttattgtcaaaagaaggggtggattgtaatacacccgtcaaatgagctagttgtagaaaaacatattagtagagc

SEQ ID NO: 89653 - DNA, 75 bp, Artificial Sequence
  Synthetic
atttctaactactgatgaccatagctctgcgccggttcttccgtgttttaacccgactccagaaatgcacattcc

SEQ ID NO: 89654 - DNA, 75 bp, Artificial Sequence
  Synthetic
gtaatacacccgtcaaatgagctagttgtagaaaaacatattagtagagctttcatcactctgcaagctattgcc

SEQ ID NO: 89655 - DNA, 75 bp, Artificial Sequence
  Synthetic
tctatgttatatacaaactttttgctggtattcagggcccatatacaggaattcctaatcctaaacccaaagtgc

SEQ ID NO: 89656 - DNA, 75 bp, Artificial Sequence
  Synthetic
tggtattcagggcccatatacaggaattcctaatcctaaacccaaagtgccctctcttagaacagccaaagtgca

SEQ ID NO: 89657 - DNA, 75 bp, Artificial Sequence
  Synthetic
agattaacaacacagaaaatgcagttggcatgcagcgtctcaaagttgacatatcagtattaacagacgttgatc

SEQ ID NO: 89658 - DNA, 75 bp, Artificial Sequence
  Synthetic
tggcatgcagcgtctcaaagttgacatatcagtattaacagacgttgatcaactgttattcaacattccactgga

SEQ ID NO: 89659 - DNA, 75 bp, Artificial Sequence
  Synthetic
tactctggtacttcggtacctttgtacgcctgttttatctcccttcccaatgtaacttagaagttcttaaatcaa

SEQ ID NO: 89660 - DNA, 75 bp, Artificial Sequence
  Synthetic
gccataatgaagaaaaatactgttattgctagaactgaaaaaggcgagttcacaatgcttggtgtgtatgataga

SEQ ID NO: 89661 - DNA, 75 bp, Artificial Sequence
  Synthetic
ttgctagaactgaaaaaggcgagttcacaatgcttggtgtgtatgatagagtggcagtcattccaacacatgcat

SEQ ID NO: 89662 - DNA, 75 bp, Artificial Sequence
  Synthetic
cgatgtagaaaccagagttctagatgcatgtgcacttagagacttgacagacacaaacctagaaataactatagt

SEQ ID NO: 89663 - DNA, 75 bp, Artificial Sequence
  Synthetic
taattctatgttacactcctccaggcgggtcatgtccaacaaccagagagactgccatgctaggtacacatattg

SEQ ID NO: 89664 - DNA, 75 bp, Artificial Sequence
  Synthetic
gcatgtgcacttagagacttgacagacacaaacctagaaataactatagtcaaattggatcgcaatcaaaaattt

SEQ ID NO: 89665 - DNA, 75 bp, Artificial Sequence
  Synthetic
ggatacatgtaggtggaaatggagctcaagggtttgcagcaatgctactccactcttactttactgatacacaag

SEQ ID NO: 89666 - DNA, 75 bp, Artificial Sequence
  Synthetic
gatgtgaggatgattacaatgatgctgtgcttagtgtacatacatcaaaattccctaacatgtacattccagttg

SEQ ID NO: 89667 - DNA, 75 bp, Artificial Sequence
  Synthetic
tgtgcttagtgtacatacatcaaaattccctaacatgtacattccagttggacaagtcactaactacggcttctt

SEQ ID NO: 89668 - DNA, 75 bp, Artificial Sequence
  Synthetic
cggattttaatgtataattttccaacaagagctggtcagtgtggtggtgtggtgacaaccacaggtaaagtgata

SEQ ID NO: 89669 - DNA, 75 bp, Artificial Sequence
  Synthetic
ctcagggattcgcagcaatgttgctccactcttactttactgatacacaaggtgagatagttagcaatgagaaga

SEQ ID NO: 89670 - DNA, 75 bp, Artificial Sequence
  Synthetic
tactgaaatgacaaggatgttagaaaaatatggagttgatttaccttttgtaacttttgtaaaagatgaacttag

SEQ ID NO: 89671 - DNA, 75 bp, Artificial Sequence
  Synthetic
tgagtacatggaagaagcagtggatcattatgtgggatgtttagaaccactggatattagtgtagatcccatacc

SEQ ID NO: 89672 - DNA, 75 bp, Artificial Sequence
  Synthetic
tttcaaatggacgattaataccaagtcctttgttcagttaaggagaaagctggaattgttcacataccttagatt

SEQ ID NO: 89673 - DNA, 75 bp, Artificial Sequence
  Synthetic
gagggtcttgaagcattggacttaaccaccagtgcgggcttcccttatttgttacaagggaaaaagaaaagggac

SEQ ID NO: 89674 - DNA, 75 bp, Artificial Sequence
  Synthetic
tggaattgttcacataccttagatttgatgctgaagtcaccatactcacaactgtggcagtaagtagcagtaaca

SEQ ID NO: 89675 - DNA, 75 bp, Artificial Sequence
  Synthetic
actgtggcagtaagtagcagtaacagtacatacacgggccttcctgacttgacacttcaagcaatgttcgtaccc

SEQ ID NO: 89676 - DNA, 75 bp, Artificial Sequence
  Synthetic
ccaccagtgcgggcttcccttatttgttacaagggaaaaagaaaagggacatattcaacagacaaaccagagata

SEQ ID NO: 89677 - DNA, 75 bp, Artificial Sequence
  Synthetic
gacacttcaagcaatgttcgtacccactggtgctcttactccagaaaaacaggattcattccattggcagtcagc

SEQ ID NO: 89678 - DNA, 75 bp, Artificial Sequence
  Synthetic
aaaatacggagttgacctacctttcgtgactttcgtgaaagacgagcttagatcaagagagaaagtcgaaaaggg

SEQ ID NO: 89679 - DNA, 75 bp, Artificial Sequence
  Synthetic
gaagtcacgcctgattgaagccagttccttgaacgactcagttgccatgagggttgcctttggaaatctctacgc

SEQ ID NO: 89680 - DNA, 75 bp, Artificial Sequence
  Synthetic
tttgctggatttgagaaaagtggtctgtatggaataaatccagctgacaccatcggcaacttatgcgtcagaata

SEQ ID NO: 89681 - DNA, 75 bp, Artificial Sequence
  Synthetic
tgtatggaataaatccagctgacaccatcggcaacttatgcgtcagaatagtgaatgagcaccagccaattggtt

SEQ ID NO: 89682 - DNA, 75 bp, Artificial Sequence
  Synthetic
atccagatatattctggtcaaaaatccctattttgttagatggagagatttttgcttttgattacactggttatg

SEQ ID NO: 89683 - DNA, 75 bp, Artificial Sequence
  Synthetic
gaagcctaaacacataaaagcatgggcaccgcgaccaccacgaactctgccgtacatgagcattgcaaatgcaaa

SEQ ID NO: 89684 - DNA, 75 bp, Artificial Sequence
  Synthetic
tgcctgtttgaaaaaggttctgattaaattaggttacacccaccaaacatcttttatagattatctatgccactc

SEQ ID NO: 89685 - DNA, 75 bp, Artificial Sequence
  Synthetic
cgtacatgagcattgcaaatgcaaactacaggggtaaagaaagagcaccaaatgcactcaatgccataattggta

SEQ ID NO: 89686 - DNA, 75 bp, Artificial Sequence
  Synthetic
aaattaggttacacccaccaaacatcttttatagattatctatgccactcagtgcatttgtacaaggatagaaaa

SEQ ID NO: 89687 - DNA, 75 bp, Artificial Sequence
  Synthetic
tcacaatatagtgaccactggcccaggttttggaggggtctttgtagggtctttcaaaataattaactatcactt

SEQ ID NO: 89688 - DNA, 75 bp, Artificial Sequence
  Synthetic
ctggttcttcaggtactagtatatttaacactatgattaataacataattataagaactttattaattaaggttt

SEQ ID NO: 89689 - DNA, 75 bp, Artificial Sequence
  Synthetic
ggttttggaggggtctttgtagggtctttcaaaataattaactatcacttagctaccacagaagagaggcagtct

SEQ ID NO: 89690 - DNA, 75 bp, Artificial Sequence
  Synthetic
taacactatgattaataacataattataagaactttattaattaaggtttacaaaggcatagatctggaccagtt

SEQ ID NO: 89691 - DNA, 75 bp, Artificial Sequence
  Synthetic
atgttctggttactcccattgctgctcatggaagacaccagatagcaagatgcaagtgtaatacaggggtttatt

SEQ ID NO: 89692 - DNA, 75 bp, Artificial Sequence
  Synthetic
gttattgctagttacccacacaaaattgatccaggtttattagcagaagcaggcaagcactatggattggtaatg

SEQ ID NO: 89693 - DNA, 75 bp, Artificial Sequence
  Synthetic
tgcaagtgtaatacaggggtttattattgtagacacaaggatagaagttacccagtttgttttgaaggcccaggg

SEQ ID NO: 89694 - DNA, 75 bp, Artificial Sequence
  Synthetic
tgtacttctggcagctggtcctgcagaagcaggggactgtggcggtttactagtctgtccacatggggtaattgg

SEQ ID NO: 89695 - DNA, 75 bp, Artificial Sequence
  Synthetic
aaagaaagttctaattaagttaggttacacacatcaaacgtcttttatagattatttgtgtcattcggtacattt

SEQ ID NO: 89696 - DNA, 75 bp, Artificial Sequence
  Synthetic
cggaaatggttagattcgttttagataactctaattgaaacccaagttacagttactttcacttagaggtaaatt

SEQ ID NO: 89697 - DNA, 75 bp, Artificial Sequence
  Synthetic
catatctagatattacactcattggtctggatccctagaaatgacgtttatgttttgtggcagcttcatggcaac

SEQ ID NO: 89698 - DNA, 75 bp, Artificial Sequence
  Synthetic
gccttggggttgttcccactccaagggcccacgtggcggctagtactctggtacttcggtacctttgtacgcctg

SEQ ID NO: 89699 - DNA, 75 bp, Artificial Sequence
  Synthetic
gtaattagaaattcagaggacttagttacagtcacagccacattagcattgctgggatgccatgattcaccatgg

SEQ ID NO: 89700 - DNA, 75 bp, Artificial Sequence
  Synthetic
caaaagatgatttctccctcagattaatgagagacagccctgacattggacaactagaccatttacatgcagcag

SEQ ID NO: 89701 - DNA, 75 bp, Artificial Sequence
  Synthetic
atagctgcccaacaacagaacaacaacaagccttattcaataatgtccaatattattcacactactgtagaaagt

SEQ ID NO: 89702 - DNA, 75 bp, Artificial Sequence
  Synthetic
gcttatggtgacaatttgatattgttaccatttagcttgtcaaatcaattgcaaaagatcctaaatcttatttat

SEQ ID NO: 89703 - DNA, 75 bp, Artificial Sequence
  Synthetic
atcatcaaaacagcaactgacactgtaaaaagtgagattaacgccgaacttggtgtggtccctagcttaaatgca

SEQ ID NO: 89704 - DNA, 75 bp, Artificial Sequence
  Synthetic
gtccctttttgatagccactacaaatgctggttcaatacatgcaccaaccgtctcagactccaaggctttatcac

SEQ ID NO: 89705 - DNA, 75 bp, Artificial Sequence
  Synthetic
ccattcaattcagagatcgtagaactaatgcaagatccactatagatatgctagtaactgatatcataaaagagt

SEQ ID NO: 89706 - DNA, 75 bp, Artificial Sequence
  Synthetic
acagaatgtacagcatcactacctatatagatctggtttcttgattcatgtgcagtgtaatgccacaaaattcca

SEQ ID NO: 89707 - DNA, 75 bp, Artificial Sequence
  Synthetic
caagctggaggctctgttccagggacctccacagtttaaagaggttaaaatttcagtcactccagacacgccagc

SEQ ID NO: 89708 - DNA, 75 bp, Artificial Sequence
  Synthetic
acaacaccaacactagcccagggtttgatgatataatgaaaggtgaagaaggagggaccttcaatcatccatatg

SEQ ID NO: 89709 - DNA, 75 bp, Artificial Sequence
  Synthetic
tgcaagggccagggtttgatttcgcacaagccataatgaagaaaaatactgtcattgccaggactgaaaagggtg

SEQ ID NO: 89710 - DNA, 75 bp, Artificial Sequence
  Synthetic
ttatttatcaacttgcattttgataacttcattttgaaaattctaataatgggggctcaagttactagacagcaa

SEQ ID NO: 89711 - DNA, 75 bp, Artificial Sequence
  Synthetic
accgatacaaacttggagattaccatagtcaaaatggaccgcaaccaaaagtttagagatatcaggcactttctg

SEQ ID NO: 89712 - DNA, 75 bp, Artificial Sequence
  Synthetic
gagttcactattagaaaaattgttaaaagctctaatcaaaatcatatcagcattagtaattgtaatcagaaactc

SEQ ID NO: 89713 - DNA, 75 bp, Artificial Sequence
  Synthetic
tgaaatcccctagtgctgaggcatgtggctacagtgatagagtattacaactcaaattaggtaattcagctattg

SEQ ID NO: 89714 - DNA, 75 bp, Artificial Sequence
  Synthetic
tcttgaacctaggcggtacaccaacacaccgcattttaatgtacaactttccaacaagagctggtcagtgtggtg

SEQ ID NO: 89715 - DNA, 75 bp, Artificial Sequence
  Synthetic
ccctagaaatgacgtttatgttttgtggcagcttcatggcaacgggaaaattaatcctgtgctatactcctccag

SEQ ID NO: 89716 - DNA, 75 bp, Artificial Sequence
  Synthetic
tacaatcgagcatagctgcccaacaacagaacaacaacaggccttattcaacaacgtccaatactattcacacta

SEQ ID NO: 89717 - DNA, 75 bp, Artificial Sequence
  Synthetic
taaaagctctaatcaaaatcatatcagcattagtaattgtaatcagaaactcggaagacttggttacagttacag

SEQ ID NO: 89718 - DNA, 75 bp, Artificial Sequence
  Synthetic
ccagagtttaatgacatcatgaaaggtgaagaaggaggaacattcaatcacccatatgtccttgatgatgggaca

SEQ ID NO: 89719 - DNA, 75 bp, Artificial Sequence
  Synthetic
tgatagggttcatagcagcaaaagatgatttctccctcagattaatgagagacagccctgacattggacaactag

SEQ ID NO: 89720 - DNA, 75 bp, Artificial Sequence
  Synthetic
tatacaggcaacaaaattatgttgatggatgagtacatggaagaagcagtagatcattatgtagggtgtctagaa

SEQ ID NO: 89721 - DNA, 75 bp, Artificial Sequence
  Synthetic
ctcttgaaaagaagataaacaactacatccagttcaagtccaaatctcgcattgaaccggtttgtttaataatac

SEQ ID NO: 89722 - DNA, 75 bp, Artificial Sequence
  Synthetic
accatttacatgcagcagaggcagcctaccagatcgagagcatcatcaaaacagcaaccgacactgtgaaaagtg

SEQ ID NO: 89723 - DNA, 75 bp, Artificial Sequence
  Synthetic
cacatcaatggataaatctgagaactaacaattcagcaacaattgttcttccctggatgaatgctgctccaatgg

SEQ ID NO: 89724 - DNA, 75 bp, Artificial Sequence
  Synthetic
taccccttgaaagtgccatgtatggaatggatggtcttgaagcattagacctgaccaccagtgcaggattccctt

SEQ ID NO: 89725 - DNA, 75 bp, Artificial Sequence
  Synthetic
aatggatggtcttgaagcattagacctgaccaccagtgcaggattcccttacttactgcaggggaagaagaaaag

SEQ ID NO: 89726 - DNA, 75 bp, Artificial Sequence
  Synthetic
gatactactgaaatgacaaggatgttggagaaatatggagttgatttgccttttgtaacttttgtaaaagatgaa

SEQ ID NO: 89727 - DNA, 75 bp, Artificial Sequence
  Synthetic
gagcagctttggtatcaaagagaagttttgaatacaaagatcatacttcgtctgcagcacaagcagacaagaact

SEQ ID NO: 89728 - DNA, 75 bp, Artificial Sequence
  Synthetic
acgccacatttcataacaatccaggtacagcaactggtagtgcagttggttgtgatccagatgtattttggtcaa

SEQ ID NO: 89729 - DNA, 75 bp, Artificial Sequence
  Synthetic
aatctttgcttttgattacactggttatgatgctagtttgtcaccagtatggtttgcctgtttaaagaaagttct

SEQ ID NO: 89730 - DNA, 75 bp, Artificial Sequence
  Synthetic
aaatgcggttggcatggagcgtctcaaagttgacatatcagcattaacagacgttgatcaattgttattcaacat

SEQ ID NO: 89731 - DNA, 75 bp, Artificial Sequence
  Synthetic
ccacttagaaacactctagtaggaaacatatctagatattatactcattggtctggatctctagaaatgacattt

SEQ ID NO: 89732 - DNA, 75 bp, Artificial Sequence
  Synthetic
acatatctagatattatactcattggtctggatctctagaaatgacatttatgttttgtggcagcttcatggcaa

SEQ ID NO: 89733 - DNA, 75 bp, Artificial Sequence
  Synthetic
acatctttcatagattatctgtgtcattcggtacatttgtataaggacagaaaatatatagtcaatggtggaatg

SEQ ID NO: 89734 - DNA, 75 bp, Artificial Sequence
  Synthetic
tcctccaggtgggtcatgcccaacaaccagagagactgccatgttaggtacacatattgtctgggattttgggtt

SEQ ID NO: 89735 - DNA, 75 bp, Artificial Sequence
  Synthetic
acatgcaccaactgtatcagactcaaaggctttgtcacgcagattcaaatttgatgtggacattgaagttacaga

SEQ ID NO: 89736 - DNA, 75 bp, Artificial Sequence
  Synthetic
gacatgtcaagagcagtcgagatgtgtaaaccagacgactgtgcccccaccaattataaaagatgctgcccgttg

SEQ ID NO: 89737 - DNA, 75 bp, Artificial Sequence
  Synthetic
tagtccccagtgagtcctctgacacatgttccttaatagggttcatagcagcaaaagatgatttttccctcaggt

SEQ ID NO: 89738 - DNA, 75 bp, Artificial Sequence
  Synthetic
tgcctcataatatagtgaacactggtccaggcttcggaggagtttttgtagggtctttcaaaataatcaactatc

SEQ ID NO: 89739 - DNA, 75 bp, Artificial Sequence
  Synthetic
taatgagagatagccctgacattgcacaattagaccatttagatgcagcagaggcagcctaccagatcgagagca

SEQ ID NO: 89740 - DNA, 75 bp, Artificial Sequence
  Synthetic
gaccatgttaggtctttgtgttatctcgcatggcacaatggagaggaggcttacaatgaattttgtagaaaaatt

SEQ ID NO: 89741 - DNA, 75 bp, Artificial Sequence
  Synthetic
tcatcaaaacagcaactgacactgtgaagagtgagattagcgctgaacttggtgtggttcctagcttaaacgcag

SEQ ID NO: 89742 - DNA, 75 bp, Artificial Sequence
  Synthetic
cgcacagtgataaatcagcacggcgtgtccgagactttagtggagaattttctcagtagggcagctttagtgtca

SEQ ID NO: 89743 - DNA, 75 bp, Artificial Sequence
  Synthetic
atacctcgtctaaagctcggacagacaagaactttttcaaatggacaattaataccaagtcctttgtacagttaa

SEQ ID NO: 89744 - DNA, 75 bp, Artificial Sequence
  Synthetic
caagaactttttcaaatggacaattaataccaagtcctttgtacagttaagaagaaagctagaattgtttacata

SEQ ID NO: 89745 - DNA, 75 bp, Artificial Sequence
  Synthetic
atactcacaactgtggcagtgaatggtagtagtaacagcacatacatgggtcttcctgacttgacacttcaagca

SEQ ID NO: 89746 - DNA, 75 bp, Artificial Sequence
  Synthetic
tcttcctgacttgacacttcaagcaatgttcgtaccaactggtgctcttactccagaaaagcaggattcattcca

SEQ ID NO: 89747 - DNA, 75 bp, Artificial Sequence
  Synthetic
acaggtaaggtgataggaatacatgtaggtggaaatggagctcaaggatttgcagcaatgctactacactcttac

SEQ ID NO: 89748 - DNA, 75 bp, Artificial Sequence
  Synthetic
agatatgctaattggagagagttcactattagaaaaattgttaaaagctctaatcaaaatcatatcagcattagt

SEQ ID NO: 89749 - DNA, 75 bp, Artificial Sequence
  Synthetic
gtgcattaactcagcatactcagttttttatgatggctttgctggatttgagaaaagtggtctgtatggaataaa

SEQ ID NO: 89750 - DNA, 75 bp, Artificial Sequence
  Synthetic
gatagagcaccaaatgccctcaatgccataattggcaatagagagagtgtcaaaaccatgccccacaatatagtg

SEQ ID NO: 89751 - DNA, 75 bp, Artificial Sequence
  Synthetic
aacaaaatgaatactacccagcaagataccagaccaatgtgcttctggcagctggccctgcagaagcaggagatt

SEQ ID NO: 89752 - DNA, 75 bp, Artificial Sequence
  Synthetic
ggagggggtggaattgtagctttcactgatatcagaaatttactatggttagatactgatgctatggaacaaggc

SEQ ID NO: 89753 - DNA, 75 bp, Artificial Sequence
  Synthetic
gtaatgcctttggagcagggttcacagaaacaatctctaacaaagctaaggaagtgcaagacatgctaattggag

SEQ ID NO: 89754 - DNA, 75 bp, Artificial Sequence
  Synthetic
acattgaagtcacagattcatacaaggactcaaataaattggatatgtcaagggcagtcgagatgtgcaaaccag

SEQ ID NO: 89755 - DNA, 75 bp, Artificial Sequence
  Synthetic
aaaagctctaatcaaaattatatcagcattagtgattgtaatcagaaattcagaagacttagttacagtcacagc

SEQ ID NO: 89756 - DNA, 75 bp, Artificial Sequence
  Synthetic
cagaagacttagttacagtcacagccacgttggcattgttaggatgccatgattcaccatggagctacttgaaac

SEQ ID NO: 89757 - DNA, 75 bp, Artificial Sequence
  Synthetic
tcttaggtcagtggattctcaagaagttagggattattgccaaaagaaaggatggattgtagtacacccatcaaa

SEQ ID NO: 89758 - DNA, 75 bp, Artificial Sequence
  Synthetic
tccgttatccgctatagtacttcgagaaacctagtatcacctttggattgttgacgcgttgcgctcagcacacta

SEQ ID NO: 89759 - DNA, 75 bp, Artificial Sequence
  Synthetic
tacattaatgatgtagagactaaagttttagatgcgtgtgcacttagagacttgactgatacaaacttagagata

SEQ ID NO: 89760 - DNA, 75 bp, Artificial Sequence
  Synthetic
gttagattcgttctagataactctaattgaaacccaagttagagttactttcaattagaggtaaattttccttta

SEQ ID NO: 89761 - DNA, 75 bp, Artificial Sequence
  Synthetic
ttaaaacagcctgtgggttgttcccaccccagaggcccacgtggcggccagtactctggtatcacggtacctttg

SEQ ID NO: 89762 - DNA, 75 bp, Artificial Sequence
  Synthetic
acatatctatgttctgccagatggtctctactgtggactttatacctccaatggctagtttggaagaaaaaggaa

SEQ ID NO: 89763 - DNA, 75 bp, Artificial Sequence
  Synthetic
aatgacgctgtgcttagcgtacatacatcaaaattcccaaatatgtatatcccagttggacaagtcaccaattat

SEQ ID NO: 89764 - DNA, 75 bp, Artificial Sequence
  Synthetic
tgatgtggacattgaagtcacagattcatacaaagactcaaacaaattggacatgtcaagagcagtagagatgtg

SEQ ID NO: 89765 - DNA, 75 bp, Artificial Sequence
  Synthetic
aattataaaagatgctgcccgttgatttgtggaaaggctattcaatttagagatcgtagaactaatgcaagatcc

SEQ ID NO: 89766 - DNA, 75 bp, Artificial Sequence
  Synthetic
actgctacggacagattttatactttgaaatcagtcaaatgggaggctggaagcacaggatggtggtggaaatta

SEQ ID NO: 89767 - DNA, 75 bp, Artificial Sequence
  Synthetic
aaatggagctcaaggatttgcagcaatgctactacactcttactttaccgatacacaaggtgagatagttagtag

SEQ ID NO: 89768 - DNA, 75 bp, Artificial Sequence
  Synthetic
cagtacacaggacaagctagaagctctgtttcagggacctccacagtttaaagagattaaaatttcagtcactcc

SEQ ID NO: 89769 - DNA, 75 bp, Artificial Sequence
  Synthetic
tgaaatctcctagtgctgaggcgtgtggctacagtgatagagtgctacagcttaaattaggtaattcagctattg

SEQ ID NO: 89770 - DNA, 75 bp, Artificial Sequence
  Synthetic
ccctggatgaatgctgctccaatggacttcccacttagacataatcagtggacgctagcaataataccagtggtg

SEQ ID NO: 89771 - DNA, 75 bp, Artificial Sequence
  Synthetic
aggttgacatatcagcattgacagacgttgatcaattgttattcaacatcccactggacatacagttagacgggc

SEQ ID NO: 89772 - DNA, 75 bp, Artificial Sequence
  Synthetic
ccagggtttgatgatatcatgaaaggtgaagcaggagggacctttaatcatccatatgtccttgatgatggaacg

SEQ ID NO: 89773 - DNA, 75 bp, Artificial Sequence
  Synthetic
ctttacgccacatttcacaacaatccaggtacagcaactggtagtgcagttggttgtgatccagatatattttgg

SEQ ID NO: 89774 - DNA, 75 bp, Artificial Sequence
  Synthetic
gagaaatctttgcttttgactacactggttatgatgctagtttgtcaccagtgtggtttgcctgtttaaagaaag

SEQ ID NO: 89775 - DNA, 75 bp, Artificial Sequence
  Synthetic
ccaattatggcttcttgaacctaggcggtacaccaacacaccgcattttaatgtataactttccaacaagagctg

SEQ ID NO: 89776 - DNA, 75 bp, Artificial Sequence
  Synthetic
caatgatggagattaacaacacagaaagtgcggttggcatggagcgtctcaaggttgacatatcagcattgacag

SEQ ID NO: 89777 - DNA, 75 bp, Artificial Sequence
  Synthetic
ttgcagcaatgctacttcactcttactttactgatacacaaggtgagatagttagtaatgagaagagtggggtgt

SEQ ID NO: 89778 - DNA, 75 bp, Artificial Sequence
  Synthetic
aaatagcaagatgcaagtgtaatacagggatttactattgcagacacaaagacagaagttacccaatttgcttcg

SEQ ID NO: 89779 - DNA, 75 bp, Artificial Sequence
  Synthetic
actccaacccagtgtcttccatcaagtttttgaaggttcaaaggaaccagcagttctcaattcaaaagatcccag

SEQ ID NO: 89780 - DNA, 75 bp, Artificial Sequence
  Synthetic
aaattatgttaatggatgagtacatggaagaagcagtggatcattatgtgggatgtttagaaccattagatatta

SEQ ID NO: 89781 - DNA, 75 bp, Artificial Sequence
  Synthetic
agacaaaccaaggacactactgaaatgacaaggatgttagaaaaatatggagttgatttaccttttgtaactttt

SEQ ID NO: 89782 - DNA, 75 bp, Artificial Sequence
  Synthetic
taacttagaagctcttaaatcaaggctcaataggtggagcgcaaaccagcgctcttatgagcaagtacttctgtt

SEQ ID NO: 89783 - DNA, 75 bp, Artificial Sequence
  Synthetic
aaaaagttgaaaaagggaaatcacgcttaattgaggccagttccttgaacgactcagttgctatgagggttgcct

SEQ ID NO: 89784 - DNA, 75 bp, Artificial Sequence
  Synthetic
tgtcaccagtatggtttgcctgtttaaagaaagttctaattaaattaggttacacacaccaaacatcttttatag

SEQ ID NO: 89785 - DNA, 75 bp, Artificial Sequence
  Synthetic
aaagaaagttctaattaaattaggttacacacaccaaacatcttttatagattatctgtgtcactcggtgcattt

SEQ ID NO: 89786 - DNA, 75 bp, Artificial Sequence
  Synthetic
cttttgtaggatctttcaaaataattaactatcacttagccactacagaggagagacagtcagctatctatgtgg

SEQ ID NO: 89787 - DNA, 75 bp, Artificial Sequence
  Synthetic
agacagaagttacccaatttgctttgaaggcccagggattcaatggattgaacaaaatgaatattacccagcaag

SEQ ID NO: 89788 - DNA, 75 bp, Artificial Sequence
  Synthetic
gggctccagttttgaaatcccctagtgctgaggcatgtggctacagtgatagagtattacaactcaaattaggta

SEQ ID NO: 89789 - DNA, 75 bp, Artificial Sequence
  Synthetic
ttatggattagtaatgacaccagcagacaagggaaccagttttgttgataccaattgggaaaacgtaactttctt

SEQ ID NO: 89790 - DNA, 75 bp, Artificial Sequence
  Synthetic
ctaaatattttgatgggtacaaacagcaaacggtggtcctcatggatgatttaatgcaaaatccagatgggaatg

SEQ ID NO: 89791 - DNA, 75 bp, Artificial Sequence
  Synthetic
tgtagaaaaatcagaagtgtgcctgtgggaagggcattgacactacctgcatattctagtcttagacgaaaatgg

SEQ ID NO: 89792 - DNA, 75 bp, Artificial Sequence
  Synthetic
actcagttgctatgagggttgcttttggaaatctttacgccacatttcataacaatccaggtacagcaactggta

SEQ ID NO: 89793 - DNA, 75 bp, Artificial Sequence
  Synthetic
aattacaaaagatgctgcccattgatctgtggaaaggctattcaattcagagatcgcagaactaatgcaagatcc

SEQ ID NO: 89794 - DNA, 75 bp, Artificial Sequence
  Synthetic
aatgaccttcttaggtcagtggattctcaagaagttagggattattgccaaaagaaaggatggattgtaatacac

SEQ ID NO: 89795 - DNA, 75 bp, Artificial Sequence
  Synthetic
gtcttctaacacatgttccttaatagggttcgtagcagcaaaagatgacttttccctcaggctaatgagagatag

SEQ ID NO: 89796 - DNA, 75 bp, Artificial Sequence
  Synthetic
atacatgggccttcctgacttgacacttcaagcaatgtttgtacctactggtgcccttactccagaaaaacagga

SEQ ID NO: 89797 - DNA, 75 bp, Artificial Sequence
  Synthetic
caattgttattcaacattccactggacatacagttggatgggccacttagaaacactttagtaggaaacatatct

SEQ ID NO: 89798 - DNA, 75 bp, Artificial Sequence
  Synthetic
gtgcccttactccagaaaaacaggattcattccattggcagtccggtagtaatgctagtgtattcttcaaagttt

SEQ ID NO: 89799 - DNA, 75 bp, Artificial Sequence
  Synthetic
gaaccagaagaagccatacaaactcgcacagtgataaatcagcacggtgtgtccgagactttagtggagaatttt

SEQ ID NO: 89800 - DNA, 75 bp, Artificial Sequence
  Synthetic
cagctatctatgtagactggcaatcagatgttctggttactcccattgctgcccatggaagacaccaaatagcaa

SEQ ID NO: 89801 - DNA, 75 bp, Artificial Sequence
  Synthetic
tacccagtttgttttgaaggcccagggattcaatggattgaacaaaatgaatattacccagcaaggtaccagact

SEQ ID NO: 89802 - DNA, 75 bp, Artificial Sequence
  Synthetic
aatggctagtttggaagaaaaaggaactctatacaccagtccatttttaatagctactaccaatgctggctcaat

SEQ ID NO: 89803 - DNA, 75 bp, Artificial Sequence
  Synthetic
tccctggatgaatgctgctccaatggatttcccactcagacataatcagtggacgctagcaataataccagtggt

SEQ ID NO: 89804 - DNA, 75 bp, Artificial Sequence
  Synthetic
gatactgatgctatggaacaaggcattactgattacattcaaaatcttggtaatgcctttggagcagggtttaca

SEQ ID NO: 89805 - DNA, 75 bp, Artificial Sequence
  Synthetic
gtccttatggatgatttaatgcaaaatccagatggaaacgacatatctatgttttgccaaatggtttccaccgtg

SEQ ID NO: 89806 - DNA, 75 bp, Artificial Sequence
  Synthetic
atgcaatgctcttagaggtctggattggctatcacaaaagatagataaattcatcaactggcttaaaaccaaaat

SEQ ID NO: 89807 - DNA, 75 bp, Artificial Sequence
  Synthetic
tagaagaaaagggaactctatacaccagtccatttttgatagccactactaatgctggctcaatacatgcaccaa

SEQ ID NO: 89808 - DNA, 75 bp, Artificial Sequence
  Synthetic
tcaggtcagtggattctcaagaagttagggactattgccaaaagaaagggtggattgtaatacacccatcaaatg

SEQ ID NO: 89809 - DNA, 75 bp, Artificial Sequence
  Synthetic
gttgctacctttgtatcaatagcaggtgtagtttatgttatatataaactttttgctggtatccaaggcccttac

SEQ ID NO: 89810 - DNA, 75 bp, Artificial Sequence
  Synthetic
ctgtggaaaggctattcaattcagagatcgcagaactaatgcaagatccactattgatatgctagtaactgatat

SEQ ID NO: 89811 - DNA, 75 bp, Artificial Sequence
  Synthetic
aggtaccctctcttagaacagctaaagtgcaggggccagggtttgattttgcacaagctataatgaagaaaaaca

SEQ ID NO: 89812 - DNA, 75 bp, Artificial Sequence
  Synthetic
ttgctcagaaattatttcactgacaaacaaggtgagatagttagtgttgaaaagagcggtgtcttcatcaatgcc

SEQ ID NO: 89813 - DNA, 75 bp, Artificial Sequence
  Synthetic
gtggatcattatgtaggatgtttagaaccattagatattagtatagatcctataccccttgaaagtgccatgtat

SEQ ID NO: 89814 - DNA, 75 bp, Artificial Sequence
  Synthetic
atcctaactcttatttatcaacttgcatcttgataactttaatttgaaaattttaacaatgggagctcaggttac

SEQ ID NO: 89815 - DNA, 75 bp, Artificial Sequence
  Synthetic
ggagaggaggcttataatgaattttgtagaaaaatcagaagtgtgcctgtgggaagggcattgacactacctgca

SEQ ID NO: 89816 - DNA, 75 bp, Artificial Sequence
  Synthetic
ggaagcacaggatggtggtggaaactacccgatgcactaaataatataggcatgtttggacagaatgtacagcat

SEQ ID NO: 89817 - DNA, 75 bp, Artificial Sequence
  Synthetic
gacaatttgtcctgaagactgagactgtgtctaacttctcgttgataatcaaccagctaactctcaacatgttca

SEQ ID NO: 89818 - DNA, 75 bp, Artificial Sequence
  Synthetic
ccaacaaagctatccttgctgtttatcaactccctgaagagtgcacactcgaattggtcgttcgtgacgcgtccg

SEQ ID NO: 89819 - DNA, 75 bp, Artificial Sequence
  Synthetic
gaaacattgtcgactcttgctacgctgagcttttccaactacgtgggaacgtcaaacatggggatagacaagccc

SEQ ID NO: 89820 - DNA, 75 bp, Artificial Sequence
  Synthetic
agatgatcaatcatttcaatcaggtgctcgacttactgcgtacgtcggttggtgaaagtattgacagcatgatca

SEQ ID NO: 89821 - DNA, 75 bp, Artificial Sequence
  Synthetic
ggtatgttggagagcagggaacagatgacactcgtgcgttggtgattcgagccatgaatgacttcttcccggcca

SEQ ID NO: 89822 - DNA, 75 bp, Artificial Sequence
  Synthetic
aggttggagaagcagtgttccaagcagtgcaggctgccatgcaaggacccggaatgttgactgcgttgttgacaa

SEQ ID NO: 89823 - DNA, 75 bp, Artificial Sequence
  Synthetic
aacagttggagtttcttggcaatgcaacgctatacaatacaaggatgcttgaggcactggttagcattcttgatc

SEQ ID NO: 89824 - DNA, 75 bp, Artificial Sequence
  Synthetic
caaagaagtcaacaacgcaggatgttgcgcccatcgactacattaacggacctgtgaaaacgccgctctgggacc

SEQ ID NO: 89825 - DNA, 75 bp, Artificial Sequence
  Synthetic
cctttatcatgcagcacccagatttggcaccaacggagaaagtggatattccgcagatgtctgcccctataccag

SEQ ID NO: 89826 - DNA, 75 bp, Artificial Sequence
  Synthetic
gccgaccacaagtttctggatggtatccccccctggcaaaggttggcactatcatgccagacggatcggtgcttt

SEQ ID NO: 89827 - DNA, 75 bp, Artificial Sequence
  Synthetic
ataattctgggtgtgatgacgtcgcctcctcagtagtgagtgagcctcctcacgagtgtaaccccgatgatggtg

SEQ ID NO: 89828 - DNA, 75 bp, Artificial Sequence
  Synthetic
ggtctgtcaaggacagtaagctggagttagtatcagcaagtgaggttcctgaaaacgatgacgcattgaggctac

SEQ ID NO: 89829 - DNA, 75 bp, Artificial Sequence
  Synthetic
ttgaggaacttgcccgaagtcaattgccatcacgacagcaagttcacagcatgatcgtacctcagaggggtgctg

SEQ ID NO: 89830 - DNA, 75 bp, Artificial Sequence
  Synthetic
ctggaaaggtggtggttactccagattatatgaaagaggggtctaagattgatatgcaaccgtaccattcctacg

SEQ ID NO: 89831 - DNA, 75 bp, Artificial Sequence
  Synthetic
gtggacctggtgaggatcactatgtaccgatgggaaccatgttgaactacatcaaacatgactgtggattcgtta

SEQ ID NO: 89832 - DNA, 75 bp, Artificial Sequence
  Synthetic
tcccgttagaggacccacgtcatagtgaatgtgctctctggactgaaatggactcgctgcgtgatgaagcgcccc

SEQ ID NO: 89833 - DNA, 75 bp, Artificial Sequence
  Synthetic
ggacgggaccttactatcgatatgacttgaatctggatcactttcgggagtgtctggctcgtcattctcacatct

SEQ ID NO: 89834 - DNA, 75 bp, Artificial Sequence
  Synthetic
atgctgatggaacacgtttaattggagcgtatgtctttgagtttgtggatggcgagcgatggactcttgaaattt

SEQ ID NO: 89835 - DNA, 75 bp, Artificial Sequence
  Synthetic
gttcatatcgagatcgagcctttcggtcggcgttgttggctcgtgcgaaccccagattgatgcacgcccttggtt

SEQ ID NO: 89836 - DNA, 75 bp, Artificial Sequence
  Synthetic
atacaacgaacttcggtcggtttgtcgtcgctatggacccgcgaatgaatctatcagacttcccagtggatgtga

SEQ ID NO: 89837 - DNA, 75 bp, Artificial Sequence
  Synthetic
tgcgtcctgcagaaggtcgtccattatgtgttgagatggaatctcgaggcgctggacctttgatggacgagcttg

SEQ ID NO: 89838 - DNA, 75 bp, Artificial Sequence
  Synthetic
acttctactttgagcgtgagtggaggaacatacaggggagagcattccaaggtaaagtgccgaaatcgctgactc

SEQ ID NO: 89839 - DNA, 75 bp, Artificial Sequence
  Synthetic
gtcctgatgatcttctcgaggccttgacagctttagggaaggggaccgccttttcgcttactcctcagaggggct

SEQ ID NO: 89840 - DNA, 75 bp, Artificial Sequence
  Synthetic
cgagcgttcccacgactatggctagaatgttacgtgatcggggagcacatgattgggcacaaattttggagaaga

SEQ ID NO: 89841 - DNA, 75 bp, Artificial Sequence
  Synthetic
tggcaggtgtgcttgcccgggccgctgcagaagatgggaacccagccgaggccttctatcgtgaagtatcgacgt

SEQ ID NO: 89842 - DNA, 75 bp, Artificial Sequence
  Synthetic
ggcaacctgatgaaaaagcgaaagtgatgcagcttgttacatggaagagacttgcaacgaactttggggtaaagg

SEQ ID NO: 89843 - DNA, 75 bp, Artificial Sequence
  Synthetic
ttgcaatgcgcgcgctcggtgttcgtaatgggtatcgtgtatcccgagcagcgatccctaaaggagtgatggctt

SEQ ID NO: 89844 - DNA, 75 bp, Artificial Sequence
  Synthetic
tgaataattgtgatctgtttggcggtggtcatgtgtgtccagaatgtcactctgtcttccagacggctggtgaaa

SEQ ID NO: 89845 - DNA, 75 bp, Artificial Sequence
  Synthetic
gaaagatgtgcacgactctggatctgatgttccatcagttgtttctcctttccaccggcgaagtgtggctgggcg

SEQ ID NO: 89846 - DNA, 75 bp, Artificial Sequence
  Synthetic
ctttaatgattcatgatcccaagacgcgacagttcaagaagttgaaggacgttgcgcgtggccagaatgggggcg

SEQ ID NO: 89847 - DNA, 75 bp, Artificial Sequence
  Synthetic
ttagttatgaggaagtcaagaaagtgcggcagttcatggtgcgatttccgttcggtaggatgtgtcctcactaac

SEQ ID NO: 89848 - DNA, 75 bp, Artificial Sequence
  Synthetic
acattgtgtggagactgcatatacaattggggttgaatgacacaggggccggtctgtgttcggatgcatgcagtc

SEQ ID NO: 89849 - DNA, 75 bp, Artificial Sequence
  Synthetic
gacatttgttcctgtccgctatagtcaagatcgcgaccgtagctatgtccacgcgtaccaaagagaaaaccaaag

SEQ ID NO: 89850 - DNA, 75 bp, Artificial Sequence
  Synthetic
aaaagaaaaatgaagaacttacaagcataaacgaaccaactcaagctcaagataccaaagtttcatctagtttag

SEQ ID NO: 89851 - DNA, 75 bp, Artificial Sequence
  Synthetic
acctcgtaagctcgcgtgatcgcccgaagcaagagaatgataagacggaagatcagcaagagggtacagataaac

SEQ ID NO: 89852 - DNA, 75 bp, Artificial Sequence
  Synthetic
ccgggagtaagaggtcgatagacgctttagctgcgataattgaaaagaaagttcagatgtcaggtactgctggtt

SEQ ID NO: 89853 - DNA, 75 bp, Artificial Sequence
  Synthetic
tgggtgacttctttggccgaatgcgtcctgaaataacagatgcgtttttttctgcgttagaaaaggaagctgatg

SEQ ID NO: 89854 - DNA, 75 bp, Artificial Sequence
  Synthetic
tatccaaggttgttccaagttcattgtcaaagttggacgatggtcaagtggttgatttgttggctgttggcgagg

SEQ ID NO: 89855 - DNA, 75 bp, Artificial Sequence
  Synthetic
aaaaggcgctcagtcagtctctttttcaattagaaatcgttgcatctataccccatttttatcaactaacggcga

SEQ ID NO: 89856 - DNA, 75 bp, Artificial Sequence
  Synthetic
agcagattggcgcgttgggggcacaaggaggttatttgaaagcttttcatggtgagcaggtatacccttttattg

SEQ ID NO: 89857 - DNA, 75 bp, Artificial Sequence
  Synthetic
atccagtcgctaatgagtttgggagaggatttgatctcgcttatgttcgtgttaacacttcgggtcaaggtattg

SEQ ID NO: 89858 - DNA, 75 bp, Artificial Sequence
  Synthetic
agctgtttatagatccatttgactttgacaaagtctcttgtaaggtaggagggcagtccttaacgggaattgggt

SEQ ID NO: 89859 - DNA, 75 bp, Artificial Sequence
  Synthetic
tgtcaaatgttgtgggtatggatgaaataacctatgatgatgttaaaacacctgaacagatgatggagtttgtgg

SEQ ID NO: 89860 - DNA, 75 bp, Artificial Sequence
  Synthetic
ttcttctaattgccggtgctgctaaaatgggacgctttgttttggtcgcatcaacgcccgaagggggaggtctac

SEQ ID NO: 89861 - DNA, 75 bp, Artificial Sequence
  Synthetic
tgttcaaaaaatgggtgcgtcgccctgtggcggagaattttcgtaatatcaatggatggctccttgaagatgact

SEQ ID NO: 89862 - DNA, 75 bp, Artificial Sequence
  Synthetic
acgagaactacccgcatgttcctgaaacattgacggtatttagcgagtatcaatggttcgctcgagaggtggctg

SEQ ID NO: 89863 - DNA, 75 bp, Artificial Sequence
  Synthetic
acaacatgacggataacgggctcggtacttcggttgagatggatgagggtcctaatatcgaggcgttttttaatc

SEQ ID NO: 89864 - DNA, 75 bp, Artificial Sequence
  Synthetic
gaaagtatcgtgaggccgccatttgtaatttagatttcattacgtctgaggctcatgctaatgtcatggaagagt

SEQ ID NO: 89865 - DNA, 75 bp, Artificial Sequence
  Synthetic
tgcaaaacgagaagatgaacgtgagtgcgtatgtggagttactacaatcatgccagatggggatttatgacattg

SEQ ID NO: 89866 - DNA, 75 bp, Artificial Sequence
  Synthetic
aaggcgacacagagattattaagttgaaggtgtatatgcgcgaggttgaagactatgaggctgagttaacgagga

SEQ ID NO: 89867 - DNA, 75 bp, Artificial Sequence
  Synthetic
tgatgttatttccaggtgatcaactttatgtggattgtctgcgtacggcggcgttagtgtccccaaatatccgtc

SEQ ID NO: 89868 - DNA, 75 bp, Artificial Sequence
  Synthetic
aattcattctgagtattcttgttcagcaggcgacctcgcgagttggcttgatagaattgttgcccatcgcagaaa

SEQ ID NO: 89869 - DNA, 75 bp, Artificial Sequence
  Synthetic
tgactgcctcattgaatgcgcgagataacatttctgtatctcataatatggcattaactttggcaattggggagt

SEQ ID NO: 89870 - DNA, 75 bp, Artificial Sequence
  Synthetic
ggaaggagttgttacgactaacgaatccacagcaggtctgtcagaagattgtgtgcgatattatggctccatttg

SEQ ID NO: 89871 - DNA, 75 bp, Artificial Sequence
  Synthetic
ttgacggactgaaggttgaagattcactcggagtcccgacgcctagcaagctagtgtttgcactactaggagcga

SEQ ID NO: 89872 - DNA, 75 bp, Artificial Sequence
  Synthetic
aggttgctcttattcttactcctaatttgtatgactataatcttcacctcaaggcgcagcttgtgaccatgatct

SEQ ID NO: 89873 - DNA, 75 bp, Artificial Sequence
  Synthetic
catcatgcttctttcccgatcagtacggcgcactcattgctgctcgtggatatggccgcgacgttgtggggaatc

SEQ ID NO: 89874 - DNA, 75 bp, Artificial Sequence
  Synthetic
gtattgacagtgtaagggacggtgaaaggacaaaaaagaattgtcgcttcgctacttacactgttttggagccaa

SEQ ID NO: 89875 - DNA, 75 bp, Artificial Sequence
  Synthetic
tccctaatgggccaccagatcgttctcgtaggaagtggcttttaatgaagagggtgcaagaatggctgctccgga

SEQ ID NO: 89876 - DNA, 75 bp, Artificial Sequence
  Synthetic
acgaccttgttagacgtcgtgagattcgagacatcatgtaccgtccatatgcgaacgtgcttcgactgcctggtc

SEQ ID NO: 89877 - DNA, 75 bp, Artificial Sequence
  Synthetic
aaacatatttgccgagaagacaggcagcgggagctcctctaccatgcgaggttttgcttaatgatgcgattgcca

SEQ ID NO: 89878 - DNA, 75 bp, Artificial Sequence
  Synthetic
ttctggatgagtacagagttgtctttcatcatccgaatgaccgcaatcagggtcctcaagatcgtcatgctctta

SEQ ID NO: 89879 - DNA, 75 bp, Artificial Sequence
  Synthetic
ccaccttatcgaacttgttaagatggtatactcgtgggtttgctgagtggtttcactgggtctattgtccactgt

SEQ ID NO: 89880 - DNA, 75 bp, Artificial Sequence
  Synthetic
atctccaaatagctttgcatcctgtaattttttggtctcataggctagggcagggagtgtggcgtcaatttccag

SEQ ID NO: 89881 - DNA, 75 bp, Artificial Sequence
  Synthetic
ctgtacgtgaggatcgtgagcggagattcgataatcatctcgagggcgtacctttcgattctccggtgatcgctg

SEQ ID NO: 89882 - DNA, 75 bp, Artificial Sequence
  Synthetic
cgtttgaaccggatgcggcaatgaacccttttaccttacgacagggtgctgatttgtttggccgagtacatgcac

SEQ ID NO: 89883 - DNA, 75 bp, Artificial Sequence
  Synthetic
aaggatcaacatttaagggtggggcatatgacagtaatgctgtaattttgttatctgaatacgaagctctgtacc

SEQ ID NO: 89884 - DNA, 75 bp, Artificial Sequence
  Synthetic
ggatgactgactcagagggaatggtggatgagtacatcaagactttaatgtcttctcgccagctcttagagggtt

SEQ ID NO: 89885 - DNA, 75 bp, Artificial Sequence
  Synthetic
tacgtctagtggctgagttgtcgactggagaactgttacgtgacactcctatccttgattatattagaactgcat

SEQ ID NO: 89886 - DNA, 75 bp, Artificial Sequence
  Synthetic
tttgcgagggtcgttttccgtctcatattttcttcaaggtgttgagtctcttcggagtgaaaattaatcatggag

SEQ ID NO: 89887 - DNA, 75 bp, Artificial Sequence
  Synthetic
ttctggctcaggttggtgaacgttcgattgagcatcgacttcggggagactatcgagtttattatcctcgtcctg

SEQ ID NO: 89888 - DNA, 75 bp, Artificial Sequence
  Synthetic
gttttttagacccagcgctggagtttattcctgatagaattgtagtcaatgatccggttagaccatcggtgcgca

SEQ ID NO: 89889 - DNA, 75 bp, Artificial Sequence
  Synthetic
ggaatgtgaaacttgtcatggatgctgtgtttgatccagattttggaatgattaagatgcgcaagggggtgactt

SEQ ID NO: 89890 - DNA, 75 bp, Artificial Sequence
  Synthetic
tctctttgagaccaactaacgatttaacgttctcctcatttcacgagatccccccgattcaggttgagatgacag

SEQ ID NO: 89891 - DNA, 75 bp, Artificial Sequence
  Synthetic
ggaacgtcaactatgtgtatgattctgagacggctaggacgagagcagagtatgatgtgcaagttcgatgggagg

SEQ ID NO: 89892 - DNA, 75 bp, Artificial Sequence
  Synthetic
tagctggccgcgtagtgattatgaatctgctcgttaccagcagttatgaaattattgctaacatggaggacattc

SEQ ID NO: 89893 - DNA, 75 bp, Artificial Sequence
  Synthetic
tgggtagggaggtacgagctttctcatttgttgtccatgatgtatccaagtttagcgggatttattatgagttta

SEQ ID NO: 89894 - DNA, 75 bp, Artificial Sequence
  Synthetic
tgttatcggcagtgagaaaggaacacgcgattgtgtggtttccgaatctgcgagggattctacaccatcacgcga

SEQ ID NO: 89895 - DNA, 75 bp, Artificial Sequence
  Synthetic
tatctattgaaaaggtagagtcttgttttcatgctgcggagatcgcccaattttcatcctttctcagtctccggc

SEQ ID NO: 89896 - DNA, 75 bp, Artificial Sequence
  Synthetic
caacagctctgattaagcttaatgttgtccagacaaccaatgttcgagggggaatgttgccaccatctgtgtcaa

SEQ ID NO: 89897 - DNA, 75 bp, Artificial Sequence
  Synthetic
aaccgattctgccgtgtgagggggttcatccatcttttattttctgttcggacgttaatgtagcgactcatcgta

SEQ ID NO: 89898 - DNA, 75 bp, Artificial Sequence
  Synthetic
ttagagggacaccaattcaaataaaaaagttttttccgccgttggtgaaggatgcgagcggtcgaccccgaatca

SEQ ID NO: 89899 - DNA, 75 bp, Artificial Sequence
  Synthetic
tggatgagaatggtgctgtgcaaaatggcttagagcagcatccttatggcttgagatctcttgttttcgtatatc

SEQ ID NO: 89900 - DNA, 75 bp, Artificial Sequence
  Synthetic
attttgatccaacgtttcggccaaaggtgtgctctgtactgcgctgactggttgctactggaggcggtctatgac

SEQ ID NO: 89901 - DNA, 75 bp, Artificial Sequence
  Synthetic
tgtactgcgctgactggttgctactggaggcggtctatgactatccggtgaggctcgggagctgggattgcagtc

SEQ ID NO: 89902 - DNA, 75 bp, Artificial Sequence
  Synthetic
gacatttgcgagatggcacgccgtccttcgaaagagtggagagagagattcaataccttatccctgaaatgcaag

SEQ ID NO: 89903 - DNA, 75 bp, Artificial Sequence
  Synthetic
caactgacacatacgaatacaagtactgatctgtcttcatccaactcagcgaaaccaacaaccttttattcgtct

SEQ ID NO: 89904 - DNA, 75 bp, Artificial Sequence
  Synthetic
tctggagtcatggatgttcgtaagagattatcgatctctgaaagtcttgacgtatttggagacctcattgacaat

SEQ ID NO: 89905 - DNA, 75 bp, Artificial Sequence
  Synthetic
tgggacttagttcagctgattggagttcgatcggagccctttgtgatagaaaatcctgcatcttatttgttgatt

SEQ ID NO: 89906 - DNA, 75 bp, Artificial Sequence
  Synthetic
aatcagcttttagcattagctggtcaagcgcattctgcagcgtccatggtttttcttaagtctttagagtatgat

SEQ ID NO: 89907 - DNA, 75 bp, Artificial Sequence
  Synthetic
gatacgctggatacagtatcgttgtggccgtatgaaacgacgcctccttctccggttgttccgaaagagttgctg

SEQ ID NO: 89908 - DNA, 75 bp, Artificial Sequence
  Synthetic
tttccgcctcctttcaacgtaaattcatattatcttcataaagatattgacataattaaggcaaagacaaaagca

SEQ ID NO: 89909 - DNA, 75 bp, Artificial Sequence
  Synthetic
gcagtgtacatcgaaaattatcgtgctggagatgtgtttgcaaagaagcgtagtatcagcgagggtgcaacgttt

SEQ ID NO: 89910 - DNA, 75 bp, Artificial Sequence
  Synthetic
gaagagcgggtgtatcatggtgccgttactatgttgcaaagaatggtaaaactgagaggatcaaccattcaagag

SEQ ID NO: 89911 - DNA, 75 bp, Artificial Sequence
  Synthetic
tcgtttgtaattgccgttgcttcatacaggtgctcagaatgtgttcgaagaatgatggtgtctgattcaggaacg

SEQ ID NO: 89912 - DNA, 75 bp, Artificial Sequence
  Synthetic
ggctcaattcatgatattaaccatatttgcattatgaggtcgaatgcgcttcgctggcttaagatgttgtttttt

SEQ ID NO: 89913 - DNA, 75 bp, Artificial Sequence
  Synthetic
gagtttccagagtttccctttctgatgacacgcgatggcataaaatttgcttccaattgtggggcgatcagtacc

SEQ ID NO: 89914 - DNA, 75 bp, Artificial Sequence
  Synthetic
caattgcctttgttgttctttcagacactcgaactgatgatactaacgatggatggtactttatcttctacttgg

SEQ ID NO: 89915 - DNA, 75 bp, Artificial Sequence
  Synthetic
gaaggttgggcgtgttatgaatggtatgatcgtgccagggtaggattattttcagagatgtttgagaggagagga

SEQ ID NO: 89916 - DNA, 75 bp, Artificial Sequence
  Synthetic
gttgtcgctcatctgcgagaggcgatttttcggcagagtgacttattacgatatcagagtcgagggttgcagctc

SEQ ID NO: 89917 - DNA, 75 bp, Artificial Sequence
  Synthetic
gcatcaatatcgcaattccctaggcgcagcgtacaggttgatgatcttgacaaacgtatcacggagggtttggac

SEQ ID NO: 89918 - DNA, 75 bp, Artificial Sequence
  Synthetic
aaacttaatccaaaggttgcagacttcattaaatcgtggatattcggtgttaatttgtcagatgagaaagcgcgt

SEQ ID NO: 89919 - DNA, 75 bp, Artificial Sequence
  Synthetic
tggttagctgtagctatgaagacgtttgcgagtgccttgttgtatgttatgggagcgacttctctttctcttgaa

SEQ ID NO: 89920 - DNA, 75 bp, Artificial Sequence
  Synthetic
cagtctgctcagggtacgcttggcattggggacccaatttcgtttcctcggcaagagattcttttggatggtgag

SEQ ID NO: 89921 - DNA, 75 bp, Artificial Sequence
  Synthetic
tggattgctgtggactggtattatgcagaccctgatttagcggacatgcgagagattgggatggcgttagtttca

SEQ ID NO: 89922 - DNA, 75 bp, Artificial Sequence
  Synthetic
gatgcagatccagagtatgcggattgggagtacggtttttttaacgttcaaacaacaaacagcgccgggaatgtg

SEQ ID NO: 89923 - DNA, 75 bp, Artificial Sequence
  Synthetic
aaagaagtcattgaagagcgacgaaagcaattggtggctgagtttggggatcagggaaagttacttgctaaagtt

SEQ ID NO: 89924 - DNA, 75 bp, Artificial Sequence
  Synthetic
gagaatactagaatcctcgatgctgtgcaaaagatcacatctacgtttcaaaacccgcaggatttttgcgattca

SEQ ID NO: 89925 - DNA, 75 bp, Artificial Sequence
  Synthetic
gctgataatgtaaggaaagctggggaaaggcatcaagtaggtcgtcgacctagggttattcaaatggtgggaacc

SEQ ID NO: 89926 - DNA, 75 bp, Artificial Sequence
  Synthetic
gaagggcaattatcagctttcgtacttcacaatgttttgaggcctgcttacaagaagactagatttacgacttct

SEQ ID NO: 89927 - DNA, 75 bp, Artificial Sequence
  Synthetic
gggaagaattctggtgacattcgcgatatgaatatcgtgcttgaaatttccggagaactagggtataagtcatca

SEQ ID NO: 89928 - DNA, 75 bp, Artificial Sequence
  Synthetic
ttagatgtgaaaggtatggactcatcgacaaaaccattccagacgaatttatcattgagttgtgtcttccatcgt

SEQ ID NO: 89929 - DNA, 75 bp, Artificial Sequence
  Synthetic
ttgcgaggtgaagtgttagggtatccgccctttttcctggggtcaatgtcgtcgtctaaagaaaattatgtgtta

SEQ ID NO: 89930 - DNA, 75 bp, Artificial Sequence
  Synthetic
accagaacgaggtataggaatgagcatggcgttattgtggctgaagaagagtataagctaacgtacccacagtat

SEQ ID NO: 89931 - DNA, 75 bp, Artificial Sequence
  Synthetic
gtgttgcttttgggtgctgttcactggacgagtcccaccagatttactgacggctactttcaagagtttgttatg

SEQ ID NO: 89932 - DNA, 75 bp, Artificial Sequence
  Synthetic
acttcgagaactgtgtttcgatctggtctgttgaataccgctgaccagcatacttttctcggcgttatcatgtat

SEQ ID NO: 89933 - DNA, 75 bp, Artificial Sequence
  Synthetic
acgcttttggaaaagagattaaaacagaggtggtatggacagcatggtcgcgagatccgtagtcagaatggtcat

SEQ ID NO: 89934 - DNA, 75 bp, Artificial Sequence
  Synthetic
cgcagggaagctcttgaagtttatgaggagcatgttcgattattaggttccgttcttggagatgatcaggtagca

SEQ ID NO: 89935 - DNA, 75 bp, Artificial Sequence
  Synthetic
ggggcgttctgtcgcgggatcgtagatgaagatgtcattttaagaattacgcgagatttatgcgatgagacgaag

SEQ ID NO: 89936 - DNA, 75 bp, Artificial Sequence
  Synthetic
tttttaatggagcggttggggtatgagtgtgagcctgagatttctgaatattctgccgaattcctaaaacagaag

SEQ ID NO: 89937 - DNA, 75 bp, Artificial Sequence
  Synthetic
ggtgttcttggcgcaccggagttatttcctgagaggcttttgttattttcttccgaaaggggtgacatggctggc

SEQ ID NO: 89938 - DNA, 75 bp, Artificial Sequence
  Synthetic
tccttgccattggatagggttaaaattatgttaagtatgattgatgaaaaaattggtagggcgagatgtccattg

SEQ ID NO: 89939 - DNA, 75 bp, Artificial Sequence
  Synthetic
ccatatgcttcattaatgctttttacctcgtggatttccggaacagcgtcattttcgattggtgaaggtgggaag

SEQ ID NO: 89940 - DNA, 75 bp, Artificial Sequence
  Synthetic
ttgttatataggactggccgcaattggaagaaggtgtacgcctcaaaaaagacggcctcgacaatttggaagcaa

SEQ ID NO: 89941 - DNA, 75 bp, Artificial Sequence
  Synthetic
gagttcgtgtctgacggtgttcttgaagtcaagtggaataaactagggttgttttataaagagtggtctactgcg

SEQ ID NO: 89942 - DNA, 75 bp, Artificial Sequence
  Synthetic
caaactggaactatccttatcggatgtggattattgtgggcatgcagtgacgcgctcggcgttcccttccctccc

SEQ ID NO: 89943 - DNA, 75 bp, Artificial Sequence
  Synthetic
ttggtacgtactggtgagattttatgcccaggtacttctgtatacactattccttctaatgcgatgacgcattac

SEQ ID NO: 89944 - DNA, 75 bp, Artificial Sequence
  Synthetic
ttgctctgggctactcaaagagaccgagccacagctgaacaaatgtggtgtgaggtacgggagcaattagtacgt

SEQ ID NO: 89945 - DNA, 75 bp, Artificial Sequence
  Synthetic
ggtgaggacgatcctctggggaagtacatcgactatgtcaacgacatgtttgaggatgttggcgtctccgatctg

SEQ ID NO: 89946 - DNA, 75 bp, Artificial Sequence
  Synthetic
ccgtatgccgcgctgcacatttatggagttggaatgggtttcgtggctggagttatgcctgtgccgatggaggtg

SEQ ID NO: 89947 - DNA, 75 bp, Artificial Sequence
  Synthetic
tggtacgattttgatctgtttggtcgagttgggggttttggaacgtggattgcggaaatagtatttaaagatatt

SEQ ID NO: 89948 - DNA, 75 bp, Artificial Sequence
  Synthetic
aggattgagcgtgagaagtatgatttaccacggctatccatgtggaagaacgctgccaatcatttattgccgagt

SEQ ID NO: 89949 - DNA, 75 bp, Artificial Sequence
  Synthetic
gaggtccgccgatcgagtttgtatgccagggatacgttgcatcaaaaatatggtatgctagtcccgtcgactgtt

SEQ ID NO: 89950 - DNA, 75 bp, Artificial Sequence
  Synthetic
cttattgctgagagacctgggtgcaaaatcgaccaagcattatttgaagttcggcgtgttggaatggaggatgtg

SEQ ID NO: 89951 - DNA, 75 bp, Artificial Sequence
  Synthetic
caagaactagagaaggtactcgatgaattaacgaggttaaaaaatcctgagagaaaatttatgaagaggttggca

SEQ ID NO: 89952 - DNA, 75 bp, Artificial Sequence
  Synthetic
atgggcctttttacagtggagaaacttgccgagcgaagaactggatacggacctgctgttgcagagaaagggtgg

SEQ ID NO: 89953 - DNA, 75 bp, Artificial Sequence
  Synthetic
ggtcacattgtgccacctgcgagttttcagtcacgtgtagtcgaatgtctatcttttccaatgtataatgggttt

SEQ ID NO: 89954 - DNA, 75 bp, Artificial Sequence
  Synthetic
aattatgaagcggtacgagagagggtttttgtagacggtaagctcccaggggatccgaaactgtaccttaaagta

SEQ ID NO: 89955 - DNA, 75 bp, Artificial Sequence
  Synthetic
ggacgtcaagctttatcttatagtgaggaagcttatagtttagttgctgcatcattgggattgtcaagtagacag

SEQ ID NO: 89956 - DNA, 75 bp, Artificial Sequence
  Synthetic
gcggctgatatgcgggacatgatcatcgaaggaattaatggacttgaagaggcccgttttgcgctaaatccgcga

SEQ ID NO: 89957 - DNA, 75 bp, Artificial Sequence
  Synthetic
aaaacttttctgtttgacgtgtctcggcgaaagggtgctggattttttcgaacacctcatcgtcgtaaaactaac

SEQ ID NO: 89958 - DNA, 75 bp, Artificial Sequence
  Synthetic
caagcctattgtgagatgatgggtatggctttactgctaatggagccatggcgctttagtagtggagactggagg

SEQ ID NO: 89959 - DNA, 75 bp, Artificial Sequence
  Synthetic
gatgtccttctcccaccgtttgcgcgcagttcttgggaggaggtaggaatctgggctctctgtcgcattgcagtc

SEQ ID NO: 89960 - DNA, 75 bp, Artificial Sequence
  Synthetic
gacattttaataatggcaaccccgggatgggagacagtggtaccgagaacctcaagctttgattataatattgtg

SEQ ID NO: 89961 - DNA, 75 bp, Artificial Sequence
  Synthetic
aaattacaaaatacaaatgaatcaaataaaaagagcttgattattcagttccagcctgcatcttatttcttcggc

SEQ ID NO: 89962 - DNA, 75 bp, Artificial Sequence
  Synthetic
gtagcttggactttaaatgatcttattattgtgaggattcccaggaatacacagccttggacgtcatttgataag

SEQ ID NO: 89963 - DNA, 75 bp, Artificial Sequence
  Synthetic
ttaactactatccaccagttaccttggaaactcattgatgatgacattcgggtagatattaccggtccatttgtt

SEQ ID NO: 89964 - DNA, 75 bp, Artificial Sequence
  Synthetic
gatcgaattttgatgacatgtaatattgggacaatgtattatactgcaacgtttttgttaagcgctattcctgag

SEQ ID NO: 89965 - DNA, 75 bp, Artificial Sequence
  Synthetic
aatggtttaacagtgtatgggatgtttaattatgtttcattatcaaacataactgttacagttaatggtttggat

SEQ ID NO: 89966 - DNA, 75 bp, Artificial Sequence
  Synthetic
actggttatgttgaagctctaattgcaatcgaaggaagtgcaatacgtcacagggctggtaaacttgttctatgg

SEQ ID NO: 89967 - DNA, 75 bp, Artificial Sequence
  Synthetic
tctttatataatgttgggacacatctaaaattcgggagactaattgacaaagttggcagagatcctgagacagga

SEQ ID NO: 89968 - DNA, 75 bp, Artificial Sequence
  Synthetic
tattttaaaggagtggtgaagaagaaagatgagattaaagctttaaatattccacaaggtgaggcatggtattac

SEQ ID NO: 89969 - DNA, 75 bp, Artificial Sequence
  Synthetic
gcagagttatgggctaatactcccctagatacgagtggaactgggttgagctttttcatacgtgttagaggtgta

SEQ ID NO: 89970 - DNA, 75 bp, Artificial Sequence
  Synthetic
ggtttaagaacggagggtccatttcaaggttggaaagcgcgggatgtttttcgccctcctgaagtacgtctagaa

SEQ ID NO: 89971 - DNA, 75 bp, Artificial Sequence
  Synthetic
tctgatttttcttatgctgtacatcctgaagctcaggaggatgatagtttggccattcataaagcacatctcctt

SEQ ID NO: 89972 - DNA, 75 bp, Artificial Sequence
  Synthetic
gcgcaaagtattattcgtgatcttggctatattgatgtaccggatatagattcggctgacgaaactcatctgcca

SEQ ID NO: 89973 - DNA, 75 bp, Artificial Sequence
  Synthetic
attgggtctgttgatagtattgcagctcttttggatctactatatcgaagatcggaagaggtgactcgagcgctg

SEQ ID NO: 89974 - DNA, 75 bp, Artificial Sequence
  Synthetic
aacggggattacaggcccagaaggcggagagctgctgttgctccccaaattattgacccagctgttccttcaatt

SEQ ID NO: 89975 - DNA, 75 bp, Artificial Sequence
  Synthetic
caaacgtatcagaatatagttcgcggcatgttacaagaattatccgcgtcaaggaagagtgctgcggatgtccaa

SEQ ID NO: 89976 - DNA, 75 bp, Artificial Sequence
  Synthetic
gaaaaattgatctcgttagaaaataagattatgacttacgtttcgccttcggtgtcggcgcgatttcggactatt

SEQ ID NO: 89977 - DNA, 75 bp, Artificial Sequence
  Synthetic
gaggataggttgggcgagttagaaaaacagaggggaacagtgtctttgctagaggctgaatttgctgcgcttaag

SEQ ID NO: 89978 - DNA, 75 bp, Artificial Sequence
  Synthetic
aaaacgcaccaagtattggaccagactgtcagggatcaagtgcaacaaggatcaaattttacagctgatttggcg

SEQ ID NO: 89979 - DNA, 75 bp, Artificial Sequence
  Synthetic
aacgttcgctcacaattgcagggtgctgcatcagaggtgaaaagtcgtttgggggcggatatagtaacaatattc

SEQ ID NO: 89980 - DNA, 75 bp, Artificial Sequence
  Synthetic
aaaccaattattaagttgatgtatcaagacatcggtcgttgtatgaagcttggagacattgatcaagtgcggaat

SEQ ID NO: 89981 - DNA, 75 bp, Artificial Sequence
  Synthetic
gatatgaatcagacgacggcgaagcttggtgactttggtcgacgagttacttcattagagaatcgagatttgcct

SEQ ID NO: 89982 - DNA, 75 bp, Artificial Sequence
  Synthetic
agattgttttacctcgctgataagagcgaaattaaggccgctgcaggatcactcgatgtgattgcttcacatgta

SEQ ID NO: 89983 - DNA, 75 bp, Artificial Sequence
  Synthetic
tatttggggtggatcggtcagaaatttttatgtccggctgtattaggtcccccatttcatcatgaccgattcatt

SEQ ID NO: 89984 - DNA, 75 bp, Artificial Sequence
  Synthetic
caaggggtttattataagttagtagcgtgtactattcagacggtgcatttagatagaggcacaatgatactgttg

SEQ ID NO: 89985 - DNA, 75 bp, Artificial Sequence
  Synthetic
gtgagggatgctgtgccgccagacaatctgcatcatgatgtagagtcagacataattttggaccaatgtgatcat

SEQ ID NO: 89986 - DNA, 75 bp, Artificial Sequence
  Synthetic
gttccaggaatggttgtgttatcgagagatcgggtgtcacctgtcgactatatcgaagtttatgaggtagcgagt

SEQ ID NO: 89987 - DNA, 75 bp, Artificial Sequence
  Synthetic
tctggtgtttttacgatttccttttcacatttaatcgcaatttatattcctaggtgtcccgggctgaggttgttg

SEQ ID NO: 89988 - DNA, 75 bp, Artificial Sequence
  Synthetic
atttatattcctaggtgtcccgggctgaggttgttgccgtgatggtggtgcaccacgccatacactattgcagtc

SEQ ID NO: 89989 - DNA, 75 bp, Artificial Sequence
  Synthetic
gacaattgagatgctcaagcgtccggcttactataacattttcctgcttccaactgggcgacgtcttgcaaaaac

SEQ ID NO: 89990 - DNA, 75 bp, Artificial Sequence
  Synthetic
ttacaatatacttgaaaacttaacacttctcccaaaagcagactggaaattgtatgaagccattgaacaaaagtt

SEQ ID NO: 89991 - DNA, 75 bp, Artificial Sequence
  Synthetic
gaaatggatgattcaagaataccgaagcgactggcgagacagactttcccaccatgagagatatggcgtgaagtt

SEQ ID NO: 89992 - DNA, 75 bp, Artificial Sequence
  Synthetic
aagattaacctatcgttctgagagtgaacgtagtttactagaaacgagggttatagactttgttgtttcttcagg

SEQ ID NO: 89993 - DNA, 75 bp, Artificial Sequence
  Synthetic
taagaaggcttcaaccgttcagttttgcactcgtgattcttataaaggtagagtccgtgccaatcagatattaat

SEQ ID NO: 89994 - DNA, 75 bp, Artificial Sequence
  Synthetic
tttgttggaaccggaagggcttggcgaagttgagggcttaacggtaaaatatggtggtaattggatgtctcttat

SEQ ID NO: 89995 - DNA, 75 bp, Artificial Sequence
  Synthetic
gactcattgtctttttgtgctaggctcgaccctcacatgttttggtttcgttgacccttctcacgggtgcaaatt

SEQ ID NO: 89996 - DNA, 75 bp, Artificial Sequence
  Synthetic
taacttaattccatatttgaagaatttgaatccagctgacaagtggttgcttgatctgcaagcgggatggagaat

SEQ ID NO: 89997 - DNA, 75 bp, Artificial Sequence
  Synthetic
ggagtatggtgttactcgctcattggaagatggagctctttacgatttttttgctgaatcatttaccacttatgc

SEQ ID NO: 89998 - DNA, 75 bp, Artificial Sequence
  Synthetic
ggttcggacttggcctggatatgagaaatatgttggaagcgttgatggtttttctggaaaattagccgttcttcc

SEQ ID NO: 89999 - DNA, 75 bp, Artificial Sequence
  Synthetic
agctcagtgtcttactccaaaggagtatgcatttcagtctcagttgacggttaaggcgaagcgaacaggtcttca

SEQ ID NO: 90000 - DNA, 75 bp, Artificial Sequence
  Synthetic
ttatttgtattatttgatttcctttactatgaagactaatttgcttgataaaatcattagagagtctctatcgat

SEQ ID NO: 90001 - DNA, 75 bp, Artificial Sequence
  Synthetic
ggtacgtgtttttagcttcttaattgggcgagaccatcttccccacatagggtttcattcaggtgaggactttag

SEQ ID NO: 90002 - DNA, 75 bp, Artificial Sequence
  Synthetic
taaaaagtacttgtcaatggccttaggaactatggatactcctagtaggtatgctataactattgtttcgggcat

SEQ ID NO: 90003 - DNA, 75 bp, Artificial Sequence
  Synthetic
gcaggtggacgttgaagtaaaaagcgtaatggggatttccagttttaaggatgggactcaatataccattgtaga

SEQ ID NO: 90004 - DNA, 75 bp, Artificial Sequence
  Synthetic
tgaaattctccttcagcctgcgagactaatcctgctaggtcgaaagggaggtggcaagtctcggctgtcgaagac

SEQ ID NO: 90005 - DNA, 75 bp, Artificial Sequence
  Synthetic
tttctctgagctagggtataacgtgctcgattctgatacttatggaaaggtcttgactttacttggaaatgaagg

SEQ ID NO: 90006 - DNA, 75 bp, Artificial Sequence
  Synthetic
tgcggatggtttagatagtgttttgagacgttttgttcggttgactcctgatgaaaggaaagtgatcccttcaat

SEQ ID NO: 90007 - DNA, 75 bp, Artificial Sequence
  Synthetic
ttttgagaccgagatggatcggctttgtactgtattcacagctcggggaatgaagccttatacattggactgtca

SEQ ID NO: 90008 - DNA, 75 bp, Artificial Sequence
  Synthetic
gttacaggctggaagacttcattgggaattatacatatcttttcaagagttctatgaccgtacaattcggattgt

SEQ ID NO: 90009 - DNA, 75 bp, Artificial Sequence
  Synthetic
tactcctgatagttttaggtatgcatattttagcgagttagcgaaggggggatttgacgataatggagtgacttt

SEQ ID NO: 90010 - DNA, 75 bp, Artificial Sequence
  Synthetic
ttcgcctgacttaaagtctgttgtctttgttcattctatgcctgagctgttcgaggccatgggtggatgtgttgc

SEQ ID NO: 90011 - DNA, 75 bp, Artificial Sequence
  Synthetic
ggagattgtgcctactcacagtacgcggctggcgatactcttgcgtggccaaggtttgtcggtgaacgctgaact

SEQ ID NO: 90012 - DNA, 75 bp, Artificial Sequence
  Synthetic
tcatttacatgatttttatgttgcaattaatcagaatggtgctaggaaagtatctctcggatggttagttcatgc

SEQ ID NO: 90013 - DNA, 75 bp, Artificial Sequence
  Synthetic
cctaaatgatttgttgaaaatgaggtagtgagccggtgggattggtgaccggtgcaggatgctgatctcctttgt

SEQ ID NO: 90014 - DNA, 75 bp, Artificial Sequence
  Synthetic
aatgatttgttgaaaatgaggtagtgagccggtgggattggtgaccggtgcaggatgctgatctcctttgtagtc

SEQ ID NO: 90015 - DNA, 75 bp, Artificial Sequence
  Synthetic
gacatttgtcatggcacaactgttgttcaggaaaacgacccaagactttagagattgctttggactcaaacacga

SEQ ID NO: 90016 - DNA, 75 bp, Artificial Sequence
  Synthetic
aatactttccgcaatttacaatgataaaagcactttctctagcgaaaatggactcgttcaaattctggaagaagc

SEQ ID NO: 90017 - DNA, 75 bp, Artificial Sequence
  Synthetic
agaggttaacgctttaggagaattaattcgcgacggtacagttgcaatatcatttggtcctgggatttactctcg

SEQ ID NO: 90018 - DNA, 75 bp, Artificial Sequence
  Synthetic
catgtttcctcatttacgtgatgattcagactatcgatctgcattaattgactgtgtggctcatgggtggaaaaa

SEQ ID NO: 90019 - DNA, 75 bp, Artificial Sequence
  Synthetic
gtcaagagacgcgagggacattagagaatggcagcgatctgcagctattatgtgcgcagagagatatatgtataa

SEQ ID NO: 90020 - DNA, 75 bp, Artificial Sequence
  Synthetic
ggtacggcaggcgtacaagagggtcgttgaaaatctcgacttgtcgtatacttggcactgtttgactgaggggcc

SEQ ID NO: 90021 - DNA, 75 bp, Artificial Sequence
  Synthetic
agctgaggatgttttcattctacccgcaatgtatgagtctgtgcgacatgagacaccttcagaggctcatggaat

SEQ ID NO: 90022 - DNA, 75 bp, Artificial Sequence
  Synthetic
gcaatgtggtggcgtgataggtggtaatgtttctcttcttttaccacgtgacgagcagtatgctacgttgttccg

SEQ ID NO: 90023 - DNA, 75 bp, Artificial Sequence
  Synthetic
tgtttggttgatgtcactagcgaagatgcgtctcgatgacctacgagaaccgcattggaatagtgtacgagttca

SEQ ID NO: 90024 - DNA, 75 bp, Artificial Sequence
  Synthetic
gctgctccgtgactaccgcatcttgtattttggagatttattgcctgatgatggagatattacgtatttagttaa

SEQ ID NO: 90025 - DNA, 75 bp, Artificial Sequence
  Synthetic
taagcttgattatcatacaatttggtttcctgagggtgagtttgagacgatgcttcaagcgatgctaagagattc

SEQ ID NO: 90026 - DNA, 75 bp, Artificial Sequence
  Synthetic
gtttcccgctgggtgtcatgcgcacctgaatatcccaattcctcactattttgtatttgatacggaggatgattt

SEQ ID NO: 90027 - DNA, 75 bp, Artificial Sequence
  Synthetic
acgtcttagatgctggaaaggtgtgagggatacctggataaagttgcggttgggatatgaagatgggggggttaa

SEQ ID NO: 90028 - DNA, 75 bp, Artificial Sequence
  Synthetic
cgactctcgtatgagtgaggctctgatcgtaaatcgtgaattacctgcggagttaagtgagtcattattctgttg

SEQ ID NO: 90029 - DNA, 75 bp, Artificial Sequence
  Synthetic
ttgtttggctagaggagtgtcgcgagaacaagtccgtacattaaaggaagtgaagaatgtcgcccaggcacaaat

SEQ ID NO: 90030 - DNA, 75 bp, Artificial Sequence
  Synthetic
tcgacatgttgtgtcaggacaaggcgtgtggtggcggagcgtcgagcggaatcgtcaattggcttgttcgattca

SEQ ID NO: 90031 - DNA, 75 bp, Artificial Sequence
  Synthetic
tcctggtaaaattgtattggtggttgattacgaggaaggtccgattagggttgcgatacgtgttcggttactgaa

SEQ ID NO: 90032 - DNA, 75 bp, Artificial Sequence
  Synthetic
tgttcattacgcgagagaacttgggatgaaagcgaatgatgtaattgtaaggattcccacctctgaccgtgctag

SEQ ID NO: 90033 - DNA, 75 bp, Artificial Sequence
  Synthetic
atgggtccagacgagggaatatgaacgatctctacggttctatgagtttcggcccggcgctgttgagacagagtt

SEQ ID NO: 90034 - DNA, 75 bp, Artificial Sequence
  Synthetic
tcatcacctgttcgcttttttcttttattgggggtgcggaaaggttgagaaacgtcaacatttatatcagacgcg

SEQ ID NO: 90035 - DNA, 75 bp, Artificial Sequence
  Synthetic
tgaggtgcgacgcgggcatttatatagccagtctcgtttcttacgtaaaatttccgaggaaggacgaaagatcaa

SEQ ID NO: 90036 - DNA, 75 bp, Artificial Sequence
  Synthetic
aattcagggtaagtattatcctactcccacccgagcggtgcaacatgaaagttgtaatgctgttgatgctgtttt

SEQ ID NO: 90037 - DNA, 75 bp, Artificial Sequence
  Synthetic
atactctaaggaattcacgcgtgagttagttgctgcaggccgcgctaaagaggctggagctctcggtgtagtgta

SEQ ID NO: 90038 - DNA, 75 bp, Artificial Sequence
  Synthetic
cacttgtttgcaaaccattggagcagacctggatcctccagttggatggttaagagatgtaagacttgatgtgcc

SEQ ID NO: 90039 - DNA, 75 bp, Artificial Sequence
  Synthetic
tgtgagtgggttgtgtcacttggttttacgaatccttacttctttttttgaacatcgtggggggcctccagattt

SEQ ID NO: 90040 - DNA, 75 bp, Artificial Sequence
  Synthetic
attgtgcagcgttatggtggttttaatttcaatatttttgcattatctcagattgaggcaagcagttcgggagta

SEQ ID NO: 90041 - DNA, 75 bp, Artificial Sequence
  Synthetic
ccgatatgatgagttaacgattatttggtatggagagactggtgctgatttacagcgaattttaagatcgtcagg

SEQ ID NO: 90042 - DNA, 75 bp, Artificial Sequence
  Synthetic
gttaacaagatttgtcgctgttcttggtgatccagctactccggagtatctggctcaagcgaaattgtgggcgaa

SEQ ID NO: 90043 - DNA, 75 bp, Artificial Sequence
  Synthetic
taagaaaagcaacattgtgatttttaattatgctaggccatacgagcggggggcgcaatttcttaatttgctgaa

SEQ ID NO: 90044 - DNA, 75 bp, Artificial Sequence
  Synthetic
tgaaacgatggcgttgcgacaagctgctgaggtgtttttgctcagaacggatgactcgttagtgcaagcgggtga

SEQ ID NO: 90045 - DNA, 75 bp, Artificial Sequence
  Synthetic
cgctctgttaatgtcggtcgacgagggcgagttttgcgacctcgtgcattttggtgcgtcgtgcgatcctatgga

SEQ ID NO: 90046 - DNA, 75 bp, Artificial Sequence
  Synthetic
gcattatttggttgtcgttactcggccccctggtgacgatcctgaatatgaacctcttgaagatcgagatccatt

SEQ ID NO: 90047 - DNA, 75 bp, Artificial Sequence
  Synthetic
tgaggaatggttatatgagactcaaggcatggagagagtaatacctagtacgtgggagtctgaggtggttgatgc

SEQ ID NO: 90048 - DNA, 75 bp, Artificial Sequence
  Synthetic
acgaggaatgttaatgtcgatacttacttatcattttcgtttggctgggtggtttgaacttgatgttccgggaga

SEQ ID NO: 90049 - DNA, 75 bp, Artificial Sequence
  Synthetic
tgatgttggtagagggctccaattaatgggtagcattaataaggtagtgcatgtgagttgtttcttacagaatgg

SEQ ID NO: 90050 - DNA, 75 bp, Artificial Sequence
  Synthetic
tagacgatattttcgtttgtcggctgacttagatgtagatagagttttacgtaatatgcgacatgacggtgaggt

SEQ ID NO: 90051 - DNA, 75 bp, Artificial Sequence
  Synthetic
tttaatggctgctgagttgtttgttgctgacgcggttttgatttgtgaggggttagtagttggtgagatgtaccg

SEQ ID NO: 90052 - DNA, 75 bp, Artificial Sequence
  Synthetic
acttcagcggtcatacaggtctgttaatgcgatgatttatcatcagggtatgacgaatttcattatttttgagtg

SEQ ID NO: 90053 - DNA, 75 bp, Artificial Sequence
  Synthetic
gatgcggcgagtgctgttaactaaccgacatgatgaagtgctggtgtctgatattggtggacgtaatggcgagct

SEQ ID NO: 90054 - DNA, 75 bp, Artificial Sequence
  Synthetic
ttcggggtgggtcgtacaagatgcggcagttcgttatttttgcgttgatccggcgggtgatgagtcaatacctaa

SEQ ID NO: 90055 - DNA, 75 bp, Artificial Sequence
  Synthetic
aggagagagggtgtcgattggaaacggtcgtgcggtttgggatgttacgcaaacagtagagcggaacgttgctag

SEQ ID NO: 90056 - DNA, 75 bp, Artificial Sequence
  Synthetic
ctatttacaacgcattggacggcagaacgctcctgatgattcaattgtactgattttatctaacagtattgtggc

SEQ ID NO: 90057 - DNA, 75 bp, Artificial Sequence
  Synthetic
ggcttacgaacgtcttgggcgtgataataatgctcatgtaactgcagtttatgcagagtttcaagcatgggctgg

SEQ ID NO: 90058 - DNA, 75 bp, Artificial Sequence
  Synthetic
gaaagtgtttattcgggatcggcttctgccaatcaggcagaatcccggtgagtcatggatgcgtttacagttccc

SEQ ID NO: 90059 - DNA, 75 bp, Artificial Sequence
  Synthetic
taacaacgtgtatccttctgtcctatgtgaagattttaatgttgacccacgtgctggtatactgtctatgcgata

SEQ ID NO: 90060 - DNA, 75 bp, Artificial Sequence
  Synthetic
tcctgacacaggtcgtggcgcaacggacgtggtgctggcaaacggaagattgggccatttgctcccgtcttggtt

SEQ ID NO: 90061 - DNA, 75 bp, Artificial Sequence
  Synthetic
tcaagcattatattgtggggcggctagaggtttcattttaaacggatttggcagattaatctggcctatctattg

SEQ ID NO: 90062 - DNA, 75 bp, Artificial Sequence
  Synthetic
ctggcctatctattgtcgacacgtcgtagttcttgcaacagcgccgtgatcgcgtagcctccgcgaattgcagtc

SEQ ID NO: 90063 - DNA, 75 bp, Artificial Sequence
  Synthetic
gacatttgtcaaccatcagaatgggaaatcgagtttccacgtatagtcctcaatacatcacaatcaaaggaaata

SEQ ID NO: 90064 - DNA, 75 bp, Artificial Sequence
  Synthetic
acaatgcacttgacacgaagactatggagcgatttgatcagaccaactctgttgatgcagctgttaaacttccag

SEQ ID NO: 90065 - DNA, 75 bp, Artificial Sequence
  Synthetic
atggaataaaccctacaatagcggagttcaattctatttatgacatgagaagctttatcgggttgcgggatgatt

SEQ ID NO: 90066 - DNA, 75 bp, Artificial Sequence
  Synthetic
tattaaatgaaaatgatgacatttttgatggcatgtttgaccaaatggttggatcagagggcaaaattaaaggtg

SEQ ID NO: 90067 - DNA, 75 bp, Artificial Sequence
  Synthetic
tagtttcaggtacattagatggatatgaaaagataagaaaggctgctaactggttgggtggaacttatagtcgtc

SEQ ID NO: 90068 - DNA, 75 bp, Artificial Sequence
  Synthetic
cgtggaaagttgaaactcgtgaaatgtcggaaatacagcaacgtattgacaacgcgattccggcgatgacttcga

SEQ ID NO: 90069 - DNA, 75 bp, Artificial Sequence
  Synthetic
ttattgggggtacattcggccctgctggtgctcgatcaggcggtgatcacatgctggtaaggccagagcaatggg

SEQ ID NO: 90070 - DNA, 75 bp, Artificial Sequence
  Synthetic
tgagcgttagagaagatactttttttggccatgatgatgggttcacagagcgtcatgttgccattgggtcagatg

SEQ ID NO: 90071 - DNA, 75 bp, Artificial Sequence
  Synthetic
tgttcgagacagttaaactgggatcgtttatggcggggtttcgtgatgcgactaatgcgagtgggtggaatcagg

SEQ ID NO: 90072 - DNA, 75 bp, Artificial Sequence
  Synthetic
gagtgtcatatttgatgagccatgatgtgtttcggatcgggtatgccagtatcgttcctgattctgatcgacctc

SEQ ID NO: 90073 - DNA, 75 bp, Artificial Sequence
  Synthetic
cacaagtattatggcaatctgcgcttaggtcgggggcaatagcagatggtgatgtgttaacagcagatgccctaa

SEQ ID NO: 90074 - DNA, 75 bp, Artificial Sequence
  Synthetic
ggattcttggacaggctacgaggagcacattttcgtggatggttgacattaatggaaccgagtacatttctgagg

SEQ ID NO: 90075 - DNA, 75 bp, Artificial Sequence
  Synthetic
caactgtggaggcaccactgacaccaataaaggatcgagggatcggcgattttgagttgcttcaacgtctgtttg

SEQ ID NO: 90076 - DNA, 75 bp, Artificial Sequence
  Synthetic
tgatgtggctgcggggtgacgttacgtcacaaacatttttggatgtcgtagccaatttggagtcttttatatcag

SEQ ID NO: 90077 - DNA, 75 bp, Artificial Sequence
  Synthetic
gggtgacatttcttaatcgtgtgcgcttgtctttacaggtgtttgtggctaagttgagtgaggataccgccgatc

SEQ ID NO: 90078 - DNA, 75 bp, Artificial Sequence
  Synthetic
ggcatggttattggtgtgacatcctgaataaacttttggaagtgcactcttgtccccttctgtatacagcttttc

SEQ ID NO: 90079 - DNA, 75 bp, Artificial Sequence
  Synthetic
tcattagtgatgggtggtctacggtccctaaactagattgcaatccaatcgaggctacagtcatagatcgattgg

SEQ ID NO: 90080 - DNA, 75 bp, Artificial Sequence
  Synthetic
ctttctcgggaaggtatctctgggcatcgtggcggaattcagctgtatacactgactatgtaggaggagctttca

SEQ ID NO: 90081 - DNA, 75 bp, Artificial Sequence
  Synthetic
tgggggataacagcgaagaagacgtcctcgggctgttaaagcgtggtgcagcaaaaatgaaggggatggtggctg

SEQ ID NO: 90082 - DNA, 75 bp, Artificial Sequence
  Synthetic
ggcatttaaggccgatgcttggagaggcagcgggggcagccgagcgagttatggcaagatgggcgaagcaaaaag

SEQ ID NO: 90083 - DNA, 75 bp, Artificial Sequence
  Synthetic
ctggaactttgaagcaagcggtgactaatgcaatggcgggagtacttctggatactaagcgagaggcccaagcag

SEQ ID NO: 90084 - DNA, 75 bp, Artificial Sequence
  Synthetic
aggctaacgtttatggtagtatggtggggggtcgtcatgtgttagcccttcctccaacagagcatctacaaaaat

SEQ ID NO: 90085 - DNA, 75 bp, Artificial Sequence
  Synthetic
tagcaccattgataccaccgggggcagcagatacagttatggatgacgttaaacgagttggacatcatgtaggtc

SEQ ID NO: 90086 - DNA, 75 bp, Artificial Sequence
  Synthetic
tcgagcttgtggagcgaggtgagcctgtgaaggagtctgttgttgaaaaccacgtggttcatgagatggttaatc

SEQ ID NO: 90087 - DNA, 75 bp, Artificial Sequence
  Synthetic
gaacgaagacaggggttggccagattggagaggtgcgacgtgagctggctaagtgttcagaggttatgaaagatg

SEQ ID NO: 90088 - DNA, 75 bp, Artificial Sequence
  Synthetic
tctcgattgagaagatggtggctagacctgatgaagtgcgtggaacgtcctttcccattcatactcgaggttatc

SEQ ID NO: 90089 - DNA, 75 bp, Artificial Sequence
  Synthetic
acgtatctctagtagatggatgtgataagcatgctatgcaggatccgacgaacaagttagatgctaaagcgacat

SEQ ID NO: 90090 - DNA, 75 bp, Artificial Sequence
  Synthetic
tttcttgccaaggacttgtcacagggaaattaaaaaagggtcttaaagtgacactagcgaaggcgcatcatggtc

SEQ ID NO: 90091 - DNA, 75 bp, Artificial Sequence
  Synthetic
gagatacatctcctcaaacagtctgtataatttctggaagcttcttttcttatgatcctgctgctgtgcatattg

SEQ ID NO: 90092 - DNA, 75 bp, Artificial Sequence
  Synthetic
gaggggagggggaggtagcaccggatcatgacatgaatattaatgtggttttaacggcggccattaagaagagct

SEQ ID NO: 90093 - DNA, 75 bp, Artificial Sequence
  Synthetic
cgtctggtacgtcgtgtaaggtatatgtgggggcgtttgctaaatcgccggacaaaagtcatcataatacgaact

SEQ ID NO: 90094 - DNA, 75 bp, Artificial Sequence
  Synthetic
gtggtttaggacttgttcctgcaattgatgacaaaggccagacgtatctgactgcatccggagtattcgtaggaa

SEQ ID NO: 90095 - DNA, 75 bp, Artificial Sequence
  Synthetic
gactctcttttaatatttcagcgctgctgaggggtggtttgacaggagttgcggattgtccatggaatgggacct

SEQ ID NO: 90096 - DNA, 75 bp, Artificial Sequence
  Synthetic
tcgcctttggagtcgcctgtgacgatggtaattgtggttcaagcgagtgttcgcatgttgagttagtccagttag

SEQ ID NO: 90097 - DNA, 75 bp, Artificial Sequence
  Synthetic
gagttgagttcggcgagtgtattatagtgcctagaggattagataggtatttcatttttaacagagttaggtatt

SEQ ID NO: 90098 - DNA, 75 bp, Artificial Sequence
  Synthetic
atgataagactatattcgattttattggtaaggtggatgcaactgtagctgtgtctgaggcccctctggatgtgg

SEQ ID NO: 90099 - DNA, 75 bp, Artificial Sequence
  Synthetic
tgagtgcatggtctgaattgattagtccgttgactgtgtatttgcctctgatggttaatgagttacgagctcaaa

SEQ ID NO: 90100 - DNA, 75 bp, Artificial Sequence
  Synthetic
atactttagcacttgtgaaaacgaggtatcgaacgtggctaaagaagattggattaaagatgggggacaaaaacc

SEQ ID NO: 90101 - DNA, 75 bp, Artificial Sequence
  Synthetic
cttttaaaaccgacgacgcatgtgatgagtgggtgtctactgcaatattagcgatgcctatgtggatgcgttaca

SEQ ID NO: 90102 - DNA, 75 bp, Artificial Sequence
  Synthetic
catctggtaatcctttggtttatctaacacaggaagaccgaaagtcagcagccattatgctcttatccaccgcta

SEQ ID NO: 90103 - DNA, 75 bp, Artificial Sequence
  Synthetic
aagctatgttgcctttaagtgcttttcaactggtggatgggtcattaaacagggctgcggcgaagggactaaaat

SEQ ID NO: 90104 - DNA, 75 bp, Artificial Sequence
  Synthetic
gggctgcggatcgtgagattatggggtagatatgtggaccttgattccagggtgcattcttgatgtggagacatt

SEQ ID NO: 90105 - DNA, 75 bp, Artificial Sequence
  Synthetic
cggatcgtgagattatggggtagatatgtggaccttgattccagggtgcattcttgatgtggagacattgcagtc

SEQ ID NO: 90106 - DNA, 75 bp, Artificial Sequence
  Synthetic
gacattttgtttctgtgatccccgcacagacgttccactatgccggctcttgctataatcggtgactcactacta

SEQ ID NO: 90107 - DNA, 75 bp, Artificial Sequence
  Synthetic
actgcttctctcattgacaaatacgtaccaccaagtagcaatgctcaggtttttggattcgttgcgcacacacat

SEQ ID NO: 90108 - DNA, 75 bp, Artificial Sequence
  Synthetic
tctgtcaaaccattgattccgcagataattggtattccagaggactctctcatgcagtggccgttgtttacggaa

SEQ ID NO: 90109 - DNA, 75 bp, Artificial Sequence
  Synthetic
tgggctcgaaagaatgagatagatttgaccacgggtgaaacttttaaagaaatcttagacattggaaaacgactg

SEQ ID NO: 90110 - DNA, 75 bp, Artificial Sequence
  Synthetic
gtttcgggagatgtgatgacgtttgttttccgtcagtttcgtggccgaacggaagtcggttaccatgggaagaca

SEQ ID NO: 90111 - DNA, 75 bp, Artificial Sequence
  Synthetic
gagaatccaagagatcgtccgtcgtttttccctttgttaagtgcctgtgcagttgacagcgtcaaggacctgctc

SEQ ID NO: 90112 - DNA, 75 bp, Artificial Sequence
  Synthetic
tataagcattttgagaaatgggtgtattttgcgccaaaaccagtagttgagtgggtcattgagcaggagattgat

SEQ ID NO: 90113 - DNA, 75 bp, Artificial Sequence
  Synthetic
ttatcgacagttgagttcgatgtaaggaacatgctcaaaatgttgtctaacaatccaattaaatgggaaaggctg

SEQ ID NO: 90114 - DNA, 75 bp, Artificial Sequence
  Synthetic
ttagactcagttcgagatgtagccgaaagtcgacttaacgcaggtggacaggaggtgggcgagtggagagcatgg

SEQ ID NO: 90115 - DNA, 75 bp, Artificial Sequence
  Synthetic
attattggtttattgatggttttcggtcagtcactgaaggttggaggattgatggcagtttttctggaagtagaa

SEQ ID NO: 90116 - DNA, 75 bp, Artificial Sequence
  Synthetic
gcgcttggagctagactgctacttgaattgttggcgcgcgttaagactgatccaggtgctgttcctcatcttcag

SEQ ID NO: 90117 - DNA, 75 bp, Artificial Sequence
  Synthetic
tctgtgaatagagagttaaaggtagggtggagagtggcgccaatgaaacgagaggggcggaattatgcaatccgt

SEQ ID NO: 90118 - DNA, 75 bp, Artificial Sequence
  Synthetic
ttgaacgcgcgtcctccacaaatgggcgggaattttacgattgggagcggagcctttaaggcatagtgtgaacgg

SEQ ID NO: 90119 - DNA, 75 bp, Artificial Sequence
  Synthetic
gggaattttacgattgggagcggagcctttaaggcatagtgtgaacggggtcaaggcctggatacaaatgcagtc

SEQ ID NO: 90120 - DNA, 75 bp, Artificial Sequence
  Synthetic
gacatttgttgcactaggatgagggccgaaagacagagcactgtgaaactacgtccatcccttcaagctgttata

SEQ ID NO: 90121 - DNA, 75 bp, Artificial Sequence
  Synthetic
cgtacaaataatataaatgcattcaacttacatattgagggaattgactgtccaacacctgctgacttaagccgt

SEQ ID NO: 90122 - DNA, 75 bp, Artificial Sequence
  Synthetic
tattgtgttccaaatggttggttttttaaggttaaaaatcagaatgtcattcccgtaccccgcaatttccccgct

SEQ ID NO: 90123 - DNA, 75 bp, Artificial Sequence
  Synthetic
tttaattatgatgtggatattggtcagtatactgtgctaccatttgaaactcttgaagatgtcgcgcagttatac

SEQ ID NO: 90124 - DNA, 75 bp, Artificial Sequence
  Synthetic
gagtcagcggatggtgacttgatacctcattttgcgatttttgagaatggcatgccagtcgttgcagcaatttct

SEQ ID NO: 90125 - DNA, 75 bp, Artificial Sequence
  Synthetic
gatcgacagaataatgtgttaacactcagattccgggcggggggagaacactttttaacaattgatgatttgtta

SEQ ID NO: 90126 - DNA, 75 bp, Artificial Sequence
  Synthetic
gcagcagaacctagagatttagacatttatcagggtgtagatcaaatggctgatgaggcgggtatccgtttagat

SEQ ID NO: 90127 - DNA, 75 bp, Artificial Sequence
  Synthetic
gacgttgatcaagctgctttggctgctcaggctgttgctgatgctggtggtggagttcaacaacagcaggatgct

SEQ ID NO: 90128 - DNA, 75 bp, Artificial Sequence
  Synthetic
atggcaggtgtggttgctcaagctgtaagagatttgccagtagcacatgaagacgggattagattgggagatgtt

SEQ ID NO: 90129 - DNA, 75 bp, Artificial Sequence
  Synthetic
gctgttgttcaagttcaggtcgctcctgctgctcctattcaagttccccctgcgccaaacgtgattgcacagcgt

SEQ ID NO: 90130 - DNA, 75 bp, Artificial Sequence
  Synthetic
cagagggaacaggcgttggcacgacaggtaccaaatttacatgttttaccacgaccgagacaagagttaatagag

SEQ ID NO: 90131 - DNA, 75 bp, Artificial Sequence
  Synthetic
aggcttgaacaaattcgagaggctgaacgtttattcattaacgagattgttcaagaggttggggcaattgatcag

SEQ ID NO: 90132 - DNA, 75 bp, Artificial Sequence
  Synthetic
cagcgagatgtagcggcagcagggatgcgtttagatctatgtagagcggtgcatcgagtagatggcattttgcga

SEQ ID NO: 90133 - DNA, 75 bp, Artificial Sequence
  Synthetic
gcatatcaagagagagttgatccctttagacttggattgaattatcgccctccaatcttggcgcaagaggagatt

SEQ ID NO: 90134 - DNA, 75 bp, Artificial Sequence
  Synthetic
cgggttgaggaaaatgtcagacgacttggtggtgaggttggtttagaggattttgaaattttagcgaggcctgaa

SEQ ID NO: 90135 - DNA, 75 bp, Artificial Sequence
  Synthetic
cgtgctctgctgcatgaggagtacttgggagatctcatcatccgggagactgaaaagcttattgagacaggacag

SEQ ID NO: 90136 - DNA, 75 bp, Artificial Sequence
  Synthetic
tcttttattgctcatattcaaagggttgggtattgcaaccacgaagggtggtgttgtcttcaagatgttggtgta

SEQ ID NO: 90137 - DNA, 75 bp, Artificial Sequence
  Synthetic
caggtgcaaggtgtagatcctgagagtcatttgcctgctcttattgtaaggacaaattgtcgtggttttgtatta

SEQ ID NO: 90138 - DNA, 75 bp, Artificial Sequence
  Synthetic
cgcgctccaattcctattattcgagtgttaaaccaaataatacacaatccgtctggattagataggttggaggcg

SEQ ID NO: 90139 - DNA, 75 bp, Artificial Sequence
  Synthetic
agcttaaatgttctgatgactgatgtacgagagcgtgtgtcgactctccaaactgctgataataatcgacgagtg

SEQ ID NO: 90140 - DNA, 75 bp, Artificial Sequence
  Synthetic
agagtgaacgatccacacgatttaacatctatgaatggtatgatcacccatgtctatgctatgctgtcgagatgg

SEQ ID NO: 90141 - DNA, 75 bp, Artificial Sequence
  Synthetic
agggataatattgccagattgcgtgctagcgcccagcatcaattaatcgctcaagagttagctcgacgatatgct

SEQ ID NO: 90142 - DNA, 75 bp, Artificial Sequence
  Synthetic
gagtggagacctggacaacattatgatattcccggcagagtattgaacctattagtgaatcgacagctcagatat

SEQ ID NO: 90143 - DNA, 75 bp, Artificial Sequence
  Synthetic
cagactcagttagaatggatctatcctcatatgtgggtagcggacagggaattagagggtgtttggatacttggt

SEQ ID NO: 90144 - DNA, 75 bp, Artificial Sequence
  Synthetic
ggagtgactcctacttacaggaacttacacgagtggcaggaaaatattgcgtatattgggttagttcagtttatt

SEQ ID NO: 90145 - DNA, 75 bp, Artificial Sequence
  Synthetic
gagttttgggaggaatttgtaacttggtttccccactatggtgttggacctattaatcatggtgtgccggtcttt

SEQ ID NO: 90146 - DNA, 75 bp, Artificial Sequence
  Synthetic
ccaacggtcttttctcctcggatgctctcggtcgcggtgcggcttctgtaggccttcgtgcacggggatattgca

SEQ ID NO: 90147 - DNA, 75 bp, Artificial Sequence
  Synthetic
acggtcttttctcctcggatgctctcggtcgcggtgcggcttctgtaggccttcgtgcacggggatattgcagtc

SEQ ID NO: 90148 - DNA, 75 bp, Artificial Sequence
  Synthetic
gacaatttgtccacaccacaaacatggcagcccgacttccaatcgacgcctttggcatttcagtgattcagcaaa

SEQ ID NO: 90149 - DNA, 75 bp, Artificial Sequence
  Synthetic
acggtctcaaagtatacacaattctacctacaagcatgctaatcacactgactgaacaaacggcatctagcaagt

SEQ ID NO: 90150 - DNA, 75 bp, Artificial Sequence
  Synthetic
tgtatgctatacctgagaaacatctagactcattaaatgagcgtgatcgaggaaagataaaaaaagtcaaattta

SEQ ID NO: 90151 - DNA, 75 bp, Artificial Sequence
  Synthetic
tgattacaagtaagtctgtggattatacgaactggttcacctcagagactgatgtggaaattcaggagtatttgg

SEQ ID NO: 90152 - DNA, 75 bp, Artificial Sequence
  Synthetic
aagacaccggattataccttgcgttgcaaaaagcatatgaaaagaaccgagagaagccctcagttgttgcaagtc

SEQ ID NO: 90153 - DNA, 75 bp, Artificial Sequence
  Synthetic
ctgcaaacccggctccaatgacggctagacagaaagatgtgttaggaacgtggtcaatggggtctatacctaatt

SEQ ID NO: 90154 - DNA, 75 bp, Artificial Sequence
  Synthetic
tttgtgaatcagttggtttggatagacaacctgaaggcccttggagacaacttgtgagaagcgcgggttttttac

SEQ ID NO: 90155 - DNA, 75 bp, Artificial Sequence
  Synthetic
tcctgtctagtcctggtgcattagcctcgacccatattggctcagtggatgctgatttaagttattttgaggtgc

SEQ ID NO: 90156 - DNA, 75 bp, Artificial Sequence
  Synthetic
gagaccagagatggatgaagctgttggattacaaagagattttgtcgagaggtggtgatcaccccaaacgttatc

SEQ ID NO: 90157 - DNA, 75 bp, Artificial Sequence
  Synthetic
agctattccctttaaccggacccccttccgatgacacttctgaggagatggtggcgcttgacggatcttgggtcc

SEQ ID NO: 90158 - DNA, 75 bp, Artificial Sequence
  Synthetic
gaagtgaggagcacgataaagggttattcgctcttcctagtcgtgtgactatcattaatgtgcgacaggtaatgg

SEQ ID NO: 90159 - DNA, 75 bp, Artificial Sequence
  Synthetic
aatcaaggcccgatagtgacatggaagacgaggaggttacagagccatggaagtgtcagcgcattgtcgaagaag

SEQ ID NO: 90160 - DNA, 75 bp, Artificial Sequence
  Synthetic
tgactcagcaggcagaatcacttagtcttgagtctagtggaaagtttgagttttctcagcctaccctgacgatgc

SEQ ID NO: 90161 - DNA, 75 bp, Artificial Sequence
  Synthetic
caaaatttgttgcaaagtcgggtgaggcaacgcacctcggggttgaggaatcaccgtctcgtgaaggacaacgtg

SEQ ID NO: 90162 - DNA, 75 bp, Artificial Sequence
  Synthetic
caagtcacaagcctgaggagcgttcgttggagcagcccgtcgatgatgcgttgctggttgatgatgtctttaatg

SEQ ID NO: 90163 - DNA, 75 bp, Artificial Sequence
  Synthetic
ctagttgggttacagcatctacattctcgcctcataaggcttcccaacataagtcagccattggaatgtctgcta

SEQ ID NO: 90164 - DNA, 75 bp, Artificial Sequence
  Synthetic
ccatgacagatatcgacgaggaggattgtgagtcgatcatgtctgaattttcaaacactccatatgaagtgcgaa

SEQ ID NO: 90165 - DNA, 75 bp, Artificial Sequence
  Synthetic
cgcctccaccctcccctccacctccttctgttccagagccgacactttatcctccatctgacattcccgcatcaa

SEQ ID NO: 90166 - DNA, 75 bp, Artificial Sequence
  Synthetic
ctcctctaccccagcgcaagccgagggttaaactcacggaagctcagattcaggcacagcgtcgatcaaggaaac

SEQ ID NO: 90167 - DNA, 75 bp, Artificial Sequence
  Synthetic
tgaaaccttactatcgggcgctaggggattgtttcgtccctgcgtgtgatgttgaatcataccgagctagtgtta

SEQ ID NO: 90168 - DNA, 75 bp, Artificial Sequence
  Synthetic
ttgtgcagccaactcctcgaaatgtgctcccctttcctggaacgcagctgactcgtgagaccgttcttcgaacgg

SEQ ID NO: 90169 - DNA, 75 bp, Artificial Sequence
  Synthetic
ctttagttcgggaatgtgagcttgtggcccctcataaacctcccgagccggaaaagttacttgatgaggagacat

SEQ ID NO: 90170 - DNA, 75 bp, Artificial Sequence
  Synthetic
ttgagatgtgtcgtaaaagggcgcgaattatgtatgagtcagttccttctcatcttcgtgatgtcgaagtggtaa

SEQ ID NO: 90171 - DNA, 75 bp, Artificial Sequence
  Synthetic
aaaatggagatcaggctgtccgaccatcagtgatatgtccacgccctcagatttcaatgcctgataactattctc

SEQ ID NO: 90172 - DNA, 75 bp, Artificial Sequence
  Synthetic
ttgggaatgaggaggaacgaattaagacttatgtgcggaaaagaaccattatggagagagagtctggtgattatg

SEQ ID NO: 90173 - DNA, 75 bp, Artificial Sequence
  Synthetic
ccgtattacgtcctggatatggagctgaggcgttggagcatgcacgatatgtgtcagccgctggtgtccccgttc

SEQ ID NO: 90174 - DNA, 75 bp, Artificial Sequence
  Synthetic
caggattagatgggcaggttcttcggtccagagcgtctcgggagatgatgagtaagatagatttgaggttgcttg

SEQ ID NO: 90175 - DNA, 75 bp, Artificial Sequence
  Synthetic
agctaatgatgcctgtagtaacgaagccggatgagcaaatggatccggagcttgtgagtttgtacaaagcgacgg

SEQ ID NO: 90176 - DNA, 75 bp, Artificial Sequence
  Synthetic
ttatagatattttaacaggctaggcggagatgaggaggactgcgcagtcggtggcgagtggggagaccagttgca

SEQ ID NO: 90177 - DNA, 75 bp, Artificial Sequence
  Synthetic
tagatattttaacaggctaggcggagatgaggaggactgcgcagtcggtggcgagtggggagaccagttgcagtc

SEQ ID NO: 90178 - DNA, 75 bp, Artificial Sequence
  Synthetic
gacattttgtgtcacgagcgttcaccctacgttcagcatcatgtttggctatatgcaactcatcaaccccacttc

SEQ ID NO: 90179 - DNA, 75 bp, Artificial Sequence
  Synthetic
tgacatttatattaaagactatggaaacttttctgggattgttgcacatcaagcctatgatccgattcgcaggga

SEQ ID NO: 90180 - DNA, 75 bp, Artificial Sequence
  Synthetic
ccacatgctccttcgttcgatgaaactccatttcggacctaattccaagctcctatggttgggagattttcatgc

SEQ ID NO: 90181 - DNA, 75 bp, Artificial Sequence
  Synthetic
catcacattatctcatgctaacatgatatttggtgcagattcggtcggatttaaaggtgtaaatgtatcaacatt

SEQ ID NO: 90182 - DNA, 75 bp, Artificial Sequence
  Synthetic
gcccccggacactttaactaccggaatcagaccgagaccaacagtgaccatggaccttgctcagcttaaagcttt

SEQ ID NO: 90183 - DNA, 75 bp, Artificial Sequence
  Synthetic
ctaccaggacttgacagacaaggagttgtacatcttatattttcatgatgttcttaggttcgtaagtcaaacggg

SEQ ID NO: 90184 - DNA, 75 bp, Artificial Sequence
  Synthetic
aggacctgttcttgagttgcaggatgtgtttcgatggataagcgagacagtttcagggcctgtcgtgatacgaac

SEQ ID NO: 90185 - DNA, 75 bp, Artificial Sequence
  Synthetic
ggattgtacaacaggagttggcaacctctggcccaatggtagtggacatttctactatccttatgaaaggaaaac

SEQ ID NO: 90186 - DNA, 75 bp, Artificial Sequence
  Synthetic
gaagtttcggtatggtacatttattgattgtggaaagaacttgatttgggcggagggaccccagtgggatgtgaa

SEQ ID NO: 90187 - DNA, 75 bp, Artificial Sequence
  Synthetic
aagttatgtagcgggttttaacttcgttacgagggctaactccttgttgggtggaggatttgatgaggtctgtta

SEQ ID NO: 90188 - DNA, 75 bp, Artificial Sequence
  Synthetic
tagattgatgatgcaagcagagattcccaatcaggtgattgagcaggggctgacgctggaacaggcggttaggaa

SEQ ID NO: 90189 - DNA, 75 bp, Artificial Sequence
  Synthetic
gatggcagcagagcatcatctagctcgacctcaactgacctcgagaaggctgcctggagtatctgaacccgcgaa

SEQ ID NO: 90190 - DNA, 75 bp, Artificial Sequence
  Synthetic
gtatgaggcgtacgtagtgtgcggacctttcagaacggggcaggtcattgctgatgtcctgcgaacggccgagga

SEQ ID NO: 90191 - DNA, 75 bp, Artificial Sequence
  Synthetic
tttggcttggagggaaatgcttggtgtgctgaagacactaatccatgatgatgctcggattactaagggttgttg

SEQ ID NO: 90192 - DNA, 75 bp, Artificial Sequence
  Synthetic
ttgacggtgttggcctggtgagctctacctcatcaacatcgagagtgtgggctttagagagggagcttcagcagc

SEQ ID NO: 90193 - DNA, 75 bp, Artificial Sequence
  Synthetic
agcggcttaccaggcgggtttcttgcgggcgttttacggttttttaaacacttctgtatgctcgctttcttcttt

SEQ ID NO: 90194 - DNA, 75 bp, Artificial Sequence
  Synthetic
agatgatggcttacggtggttgtgcactcgtctttgctctaagtcgactaatgtaggggggagaacgattgtgtt

SEQ ID NO: 90195 - DNA, 75 bp, Artificial Sequence
  Synthetic
gttcgggtgtcattcagaaggagaggttcttgctgatggatctggtaaaacgtatccagctgcagaagctagaga

SEQ ID NO: 90196 - DNA, 75 bp, Artificial Sequence
  Synthetic
gcagattgcagcagcaggaaggcttgggggcagctcgcaagtcgtagtagtttggcagaggtgtagagagtcaaa

SEQ ID NO: 90197 - DNA, 75 bp, Artificial Sequence
  Synthetic
gctacagcgaattttgcctgagttatccatggtgtcctacgtccccgaagatgtaattctgggctttaagagagc

SEQ ID NO: 90198 - DNA, 75 bp, Artificial Sequence
  Synthetic
tcgcgagaaggaggatttttctcagtggtgtggatggttatatagaagtgttttagaggcgatgcgaatgattga

SEQ ID NO: 90199 - DNA, 75 bp, Artificial Sequence
  Synthetic
ccatggtgtacgtgatttttcacccttgacagagcgtggagttgtgtatcaagtagaggctgctcattacggtat

SEQ ID NO: 90200 - DNA, 75 bp, Artificial Sequence
  Synthetic
gcgtaccactcgtgtcaagcgtgcggatgggactatcgattatcagggattatcatggatttcaatgttaatgtt

SEQ ID NO: 90201 - DNA, 75 bp, Artificial Sequence
  Synthetic
tctacttggtcactatggggatgatcaaacttacgaggccttgagagtaagcgccttatttattcgagctcgaga

SEQ ID NO: 90202 - DNA, 75 bp, Artificial Sequence
  Synthetic
gataggatggagaaagtggggtactttcacttgcatcgtgtcaacatgatgtgacacaccctcatatagggatcc

SEQ ID NO: 90203 - DNA, 75 bp, Artificial Sequence
  Synthetic
gagaaagtggggtactttcacttgcatcgtgtcaacatgatgtgacacaccctcatatagggatcccttgcagtc

SEQ ID NO: 90204 - DNA, 75 bp, Artificial Sequence
  Synthetic
gacaatttgtcctagtaagatgccctgcaaccgcgctgtgtttggtgctttcatactagcagttctcattggtct

SEQ ID NO: 90205 - DNA, 75 bp, Artificial Sequence
  Synthetic
tcaatcagcatatttcaaactttatgaattctacagaaataatgataatgctcagaacactactgcctctgcttt

SEQ ID NO: 90206 - DNA, 75 bp, Artificial Sequence
  Synthetic
tttgaaacaacacgaagtcgctgttaacgttgtagttgaatttctttttgacattttgttctttttgtgcggatt

SEQ ID NO: 90207 - DNA, 75 bp, Artificial Sequence
  Synthetic
actcgggtttgaactcaccccggctgcgcgtcggcttacattcaggaagagctctagtgcagtgaaagcagactt

SEQ ID NO: 90208 - DNA, 75 bp, Artificial Sequence
  Synthetic
ggtagaacttcaagatgcgtcgtcgaaaaaacggaatgaccccgcagatggtgagggaatacgcaatgtttcgaa

SEQ ID NO: 90209 - DNA, 75 bp, Artificial Sequence
  Synthetic
gacatcgcttcttaacgctgagtgtcccagtgatgcagttgatagagatacaggaaccctcgtacctccagctta

SEQ ID NO: 90210 - DNA, 75 bp, Artificial Sequence
  Synthetic
ctcttcctcagagttctttcctccgccgcccgctcctcacctgtatgagacgcccaaggcgcctcgtcttgttcc

SEQ ID NO: 90211 - DNA, 75 bp, Artificial Sequence
  Synthetic
atctgctcctagctttaatttatttactgctggtggcttggctagttagattcacgacacgagcgtaagggttgc

SEQ ID NO: 90212 - DNA, 75 bp, Artificial Sequence
  Synthetic
ggtggatcctagggacctcgccggcattctgaatgatgtcatcctagcatcattcttccgggacgggtaattgca

SEQ ID NO: 90213 - DNA, 75 bp, Artificial Sequence
  Synthetic
ggatcctagggacctcgccggcattctgaatgatgtcatcctagcatcattcttccgggacgggtaattgcagtc

SEQ ID NO: 90214 - DNA, 75 bp, Artificial Sequence
  Synthetic
tattctaacgacaagactattactaaatatttaggaataacgattccattagtggggtgaggggaaggaatcagg

SEQ ID NO: 90215 - DNA, 75 bp, Artificial Sequence
  Synthetic
tgaattatgtgtcatcaattaatagcttaatagcactgttttacatacttatgttgatagatagatgtgtcatat

SEQ ID NO: 90216 - DNA, 75 bp, Artificial Sequence
  Synthetic
agtggggtgaggggaaggaatcaggtatttcagaatgtcgagtctactgaaatcacttgccgcatttaaaagaca

SEQ ID NO: 90217 - DNA, 75 bp, Artificial Sequence
  Synthetic
tgtaatcaaggatttagtatctagaagaagaaagagttcaattggttgttaattggttattgtgtattcaattag

SEQ ID NO: 90218 - DNA, 75 bp, Artificial Sequence
  Synthetic
tagagagcaaccaactacaccgtcaggttcaggtggtacaattaaaggattgaaaaacacaattattgttccagt

SEQ ID NO: 90219 - DNA, 75 bp, Artificial Sequence
  Synthetic
aaaaaacttaggaatccatgttaataaaaactcattatcatggagtccaacaatatcaaatattacaaggattct

SEQ ID NO: 90220 - DNA, 75 bp, Artificial Sequence
  Synthetic
ggttcaggtggtacaattaaaggattgaaaaacacaattattgttccagttccaggggatacagtaattaccacg

SEQ ID NO: 90221 - DNA, 75 bp, Artificial Sequence
  Synthetic
aggtctaacttgttgtttagattagtttatataataggcaatccagatacgcctctaagcacctcgacgggagca

SEQ ID NO: 90222 - DNA, 75 bp, Artificial Sequence
  Synthetic
attgtacagcttaagtattaaaataattaccattattgctataattgtaagcctgattgcaacaataatgactat

SEQ ID NO: 90223 - DNA, 75 bp, Artificial Sequence
  Synthetic
ataatatcattgttgaccctatttgtcgaatccccaggtcaattaattcaaagaattgctgatgaccctgatgca

SEQ ID NO: 90224 - DNA, 75 bp, Artificial Sequence
  Synthetic
cattaatgccacaagtgggagaactgccctaaacagtaatacagacatactgcttagccaaagagatgagattca

SEQ ID NO: 90225 - DNA, 75 bp, Artificial Sequence
  Synthetic
gtttttaaattagtagaggtcattcctgaagctggtaatcctggagaattgacttttgcatctcgagggattaat

SEQ ID NO: 90226 - DNA, 75 bp, Artificial Sequence
  Synthetic
ttagataagcaagcccaacaatactttaaactggctgagaaaaatgatcaggggtattatgttagcttaggattt

SEQ ID NO: 90227 - DNA, 75 bp, Artificial Sequence
  Synthetic
tcctaccttattggatgaacttactaaagcgattgaccaaaagattaaaataatgaatccccctattgacactgt

SEQ ID NO: 90228 - DNA, 75 bp, Artificial Sequence
  Synthetic
gagaacccaccaaatgatgatgatataacatctagtcctgagatatttaattatattttggcatctgtacttgcg

SEQ ID NO: 90229 - DNA, 75 bp, Artificial Sequence
  Synthetic
gacgtctgatcttaattggtgcatcaaaccccccaatggaattattatagatccgaaaggttattgtgagagtat

SEQ ID NO: 90230 - DNA, 75 bp, Artificial Sequence
  Synthetic
caagtttggattcttttggcaaaagctgtgactgctccagatacagctgctgaagctgaaaaccgtagatggatt

SEQ ID NO: 90231 - DNA, 75 bp, Artificial Sequence
  Synthetic
atccgaaaggttattgtgagagtatggaattgtccaaaacttataaattactacttgaccaattagatgtcttaa

SEQ ID NO: 90232 - DNA, 75 bp, Artificial Sequence
  Synthetic
aaattgatgcaacaacgtcgggtggatggtgaattaagattgagtaaaggatggctagatttggtgagaaacaaa

SEQ ID NO: 90233 - DNA, 75 bp, Artificial Sequence
  Synthetic
attgcgtcagatattacaataagacgattcatggtggcattagttcttgatatcaaacgttctcctgggacaaga

SEQ ID NO: 90234 - DNA, 75 bp, Artificial Sequence
  Synthetic
gttgatgattcaaagatcatttttgctactgtcaacatacaatctacaccgaggtttttgaactttggtcacaca

SEQ ID NO: 90235 - DNA, 75 bp, Artificial Sequence
  Synthetic
cccagaatagctgaaatgatttgtgatattgataattatattgtggaggcagggcttgcaagtttcttgttaact

SEQ ID NO: 90236 - DNA, 75 bp, Artificial Sequence
  Synthetic
attaaatttggcatagagacacgttacccagcattggcattgcatgagttctctggagaattagctactattgag

SEQ ID NO: 90237 - DNA, 75 bp, Artificial Sequence
  Synthetic
ataactgatgttcaatatcgagtttttgaaatcgggtatatctctgatcagtttggtgttttcccctccttaata

SEQ ID NO: 90238 - DNA, 75 bp, Artificial Sequence
  Synthetic
ggacttatgaaattgtaccaatctatgggagaaatggcaccatatatggtaattctggagaattcaattcaaacc

SEQ ID NO: 90239 - DNA, 75 bp, Artificial Sequence
  Synthetic
tgctattaggaatggaatcctgtaccttgacaagtgacagactaggtgggtatttcttgtgtatgaatatactga

SEQ ID NO: 90240 - DNA, 75 bp, Artificial Sequence
  Synthetic
aggtttagtgccgggtcttatcctttgctatggagttatgccatgggcgttggtgtggagcttgaaagatcgatg

SEQ ID NO: 90241 - DNA, 75 bp, Artificial Sequence
  Synthetic
cacgatctatatatgattatgttagcataagggatttgaaatcattatatataacactcccacattatggtaagg

SEQ ID NO: 90242 - DNA, 75 bp, Artificial Sequence
  Synthetic
tgctatggagttatgccatgggcgttggtgtggagcttgaaagatcgatgggtggacttaattttactaggagct

SEQ ID NO: 90243 - DNA, 75 bp, Artificial Sequence
  Synthetic
tctttgaccctacgtacttcagacttggtcaagagatggtgagaagatcttcagggatggttaatagttcatttg

SEQ ID NO: 90244 - DNA, 75 bp, Artificial Sequence
  Synthetic
ttaattatacttactttaattttggtaagatcagaagcccacatgaaatagataaaatttggttaacatctgaga

SEQ ID NO: 90245 - DNA, 75 bp, Artificial Sequence
  Synthetic
taagatcagaagcccacatgaaatagataaaatttggttaacatctgagaggggccaaattatttctggttattt

SEQ ID NO: 90246 - DNA, 75 bp, Artificial Sequence
  Synthetic
cgcgagaacttgggctatctgaacatgagacacaacttgtcagccaaattgttaattcgggaggtgaatctggga

SEQ ID NO: 90247 - DNA, 75 bp, Artificial Sequence
  Synthetic
tacctaaatttgatggattcagagcaaatccaacaacctttctaggaaccaaagataatattaatgatagaggtg

SEQ ID NO: 90248 - DNA, 75 bp, Artificial Sequence
  Synthetic
aggatcagtcaagttcaatatcagggttacctggtccattattacccagtcgtgacctaactcatccaggtgatt

SEQ ID NO: 90249 - DNA, 75 bp, Artificial Sequence
  Synthetic
acgatgttccgatattagcatacttattagttgaaatgtatgatgaagaaggacctttaattacacttgtagcaa

SEQ ID NO: 90250 - DNA, 75 bp, Artificial Sequence
  Synthetic
catatggaacagataatggtgtgaaagatgtcagtaataaattaaatgaaggaataagtccagatcatgatgtgt

SEQ ID NO: 90251 - DNA, 75 bp, Artificial Sequence
  Synthetic
ctagctctgccatggaagaattgaggaggttagttgagtctaccaacagaattgacaccaaaaagccggaagctc

SEQ ID NO: 90252 - DNA, 75 bp, Artificial Sequence
  Synthetic
gaggttagttgagtctaccaacagaattgacaccaaaaagccggaagctccaggtgtctctaaccattataatga

SEQ ID NO: 90253 - DNA, 75 bp, Artificial Sequence
  Synthetic
tactgaccttttaagataatatgagtatatcctatttgatcatcatacaattcaaattaagaaaaacttaggacc

SEQ ID NO: 90254 - DNA, 75 bp, Artificial Sequence
  Synthetic
attacatcttgagtgctttagctgggacaaatcttggtggtgcgccttgatacctcagttttcattaagttggaa

SEQ ID NO: 90255 - DNA, 75 bp, Artificial Sequence
  Synthetic
tatatcctatttgatcatcatacaattcaaattaagaaaaacttaggacctcaaggttcacaactgttggcacat

SEQ ID NO: 90256 - DNA, 75 bp, Artificial Sequence
  Synthetic
ccaccacatgtcctctcaccaaatccaacaagtcaaacatggcctcgaatctttacaagagatcaaaaacaaccc

SEQ ID NO: 90257 - DNA, 75 bp, Artificial Sequence
  Synthetic
tccgtcttccaaagatgtcaatcttgccagggagatttacgaatccattagacaaacaggaacatcttcagtgca

SEQ ID NO: 90258 - DNA, 75 bp, Artificial Sequence
  Synthetic
gccagggagatttacgaatccattagacaaacaggaacatcttcagtgcaaggaggagccattgcgggagataat

SEQ ID NO: 90259 - DNA, 75 bp, Artificial Sequence
  Synthetic
aggaggagccattgcgggagataatattacgtcagggggtaacaatcactcaatgcatagccaaggaccaagttc

SEQ ID NO: 90260 - DNA, 75 bp, Artificial Sequence
  Synthetic
tcctatttcaagtgttaacaagaatatcgaaggatctactggattcgatcattcaggactatgggatccagaggg

SEQ ID NO: 90261 - DNA, 75 bp, Artificial Sequence
  Synthetic
gttcttcccgtttttattttggttttcgattaaaactgagactagaagctgtatccgacaaaatcaaaaaactcg

SEQ ID NO: 90262 - DNA, 75 bp, Artificial Sequence
  Synthetic
taacctctgcatgttattcgaaagcgatgatgatgaaaaccattattcagagattaatggccggtctcccgctat

SEQ ID NO: 90263 - DNA, 75 bp, Artificial Sequence
  Synthetic
cgaaggattggatgaacaggatactgagaactcaattattaaacaaccaggaaatcagtgtactgagggagtgtc

SEQ ID NO: 90264 - DNA, 75 bp, Artificial Sequence
  Synthetic
gagaactcaattattaaacaaccaggaaatcagtgtactgagggagtgtctaagactgattcaccttctagttcc

SEQ ID NO: 90265 - DNA, 75 bp, Artificial Sequence
  Synthetic
caggaaactacactatctgttgggggatctaatatacctgggacaggaatatcaacctgtgcctctttggatata

SEQ ID NO: 90266 - DNA, 75 bp, Artificial Sequence
  Synthetic
actgtaaatgaacttgaggatgcaactataaggaacagcgacaatatgaagggaaactggccaattccgaaatta

SEQ ID NO: 90267 - DNA, 75 bp, Artificial Sequence
  Synthetic
gggaaactggccaattccgaaattacttgttaagccgccacctagggcaagatcaagcatggatcatagcaatcc

SEQ ID NO: 90268 - DNA, 75 bp, Artificial Sequence
  Synthetic
gccatgggggaacatggcctcctgtagagttaccaaatcatgcatctgctgtaattagaaatgcccagctatctg

SEQ ID NO: 90269 - DNA, 75 bp, Artificial Sequence
  Synthetic
attaaaaggggccacaggagggaaattagtctcacctgggatggagattacattattcgagaagagtggtgcaac

SEQ ID NO: 90270 - DNA, 75 bp, Artificial Sequence
  Synthetic
cccatctgtacacccatctactcaacctgcaagcgacttcaatgcaaatgcaagcaatgtccatcaacctgcccc

SEQ ID NO: 90271 - DNA, 75 bp, Artificial Sequence
  Synthetic
aagtgtgaataatgattacagagacagtgaggtaacagtgcttaactcacataaagatattgaggataagtctga

SEQ ID NO: 90272 - DNA, 75 bp, Artificial Sequence
  Synthetic
agtgaggtaacagtgcttaactcacataaagatattgaggataagtctgaaatatctatacaggatatatataac

SEQ ID NO: 90273 - DNA, 75 bp, Artificial Sequence
  Synthetic
attcacaatcgaagagggcaattgaatcaaagtcttctagatcacatcgaaataatagggatatcttaaggggta

SEQ ID NO: 90274 - DNA, 75 bp, Artificial Sequence
  Synthetic
atcaaagtcttctagatcacatcgaaataatagggatatcttaaggggtaggagagatttaaataaacagataaa

SEQ ID NO: 90275 - DNA, 75 bp, Artificial Sequence
  Synthetic
ttgattcttggatttaaggatgattataggaaattatcaaacaaattagatatggtattagagatgaaacaagac

SEQ ID NO: 90276 - DNA, 75 bp, Artificial Sequence
  Synthetic
ataggaaattatcaaacaaattagatatggtattagagatgaaacaagacattgacaatctaaaaaagagtagtg

SEQ ID NO: 90277 - DNA, 75 bp, Artificial Sequence
  Synthetic
attgacaatctaaaaaagagtagtgctaaggtacaattggcattgtcaactattgagggacatctatctagtgtt

SEQ ID NO: 90278 - DNA, 75 bp, Artificial Sequence
  Synthetic
atgattgccatccctggttcaggtattgattccactggggaagagaaaaaggatcagatgaattctgacttaaaa

SEQ ID NO: 90279 - DNA, 75 bp, Artificial Sequence
  Synthetic
ccattgttagggagggatcattgtagagcatttcgagaagttactaatcctctagatgagtcgttactggccaat

SEQ ID NO: 90280 - DNA, 75 bp, Artificial Sequence
  Synthetic
tctagatgagtcgttactggccaattctccaacaaaacatgttgctaaaatagacaagagttgcactcttcagaa

SEQ ID NO: 90281 - DNA, 75 bp, Artificial Sequence
  Synthetic
tagtgatccttactcaataaaccttccttatagccagagtatgaccaaggttttaaaaaatgtaacggcaagata

SEQ ID NO: 90282 - DNA, 75 bp, Artificial Sequence
  Synthetic
aatcaacaagaatgaaacatctgcaatcaagtttgttcccaatgatagtcatgcaagcacatcaaccatcagatc

SEQ ID NO: 90283 - DNA, 75 bp, Artificial Sequence
  Synthetic
atcaagtttgttcccaatgatagtcatgcaagcacatcaaccatcagatcaattatcaggtcatctaatctcgat

SEQ ID NO: 90284 - DNA, 75 bp, Artificial Sequence
  Synthetic
atgcaagcacatcaaccatcagatcaattatcaggtcatctaatctcgatcaggatttgaagacaaaattgctca

SEQ ID NO: 90285 - DNA, 75 bp, Artificial Sequence
  Synthetic
caattctatcccaaattagagggacagagaatgttaaagaattttatgagaaggtcatgatattgataaagaaca

SEQ ID NO: 90286 - DNA, 75 bp, Artificial Sequence
  Synthetic
agagaatgttaaagaattttatgagaaggtcatgatattgataaagaacaagcactagacatcaccaatccacat

SEQ ID NO: 90287 - DNA, 75 bp, Artificial Sequence
  Synthetic
gcactatgggttgtaattgtcttcagtagaatttagttgatttaatacatactgttgttgatttataataattat

SEQ ID NO: 90288 - DNA, 75 bp, Artificial Sequence
  Synthetic
aaaaaacttaggagctaaaggctactcagtcatatacaacatgactgagatattcactcttgatgagagctcatg

SEQ ID NO: 90289 - DNA, 75 bp, Artificial Sequence
  Synthetic
tcagtcatatacaacatgactgagatattcactcttgatgagagctcatggtcaatcaaaggaacacttgatccg

SEQ ID NO: 90290 - DNA, 75 bp, Artificial Sequence
  Synthetic
ctaacacctgatatctatcctgatgggagactcgtgcccaaagttcgggttatcgatccgggcctaggcgatcgc

SEQ ID NO: 90291 - DNA, 75 bp, Artificial Sequence
  Synthetic
actggacaatcaaacactgtaattcacttacatgcagatgttaattgttgtatagtgcagatgactgatcagcct

SEQ ID NO: 90292 - DNA, 75 bp, Artificial Sequence
  Synthetic
aagagtgggggatatatgtatctacttctccatggtgtcatagaagacagcgagaacatgattagtccaaagggg

SEQ ID NO: 90293 - DNA, 75 bp, Artificial Sequence
  Synthetic
agagcatttggggcattcccattaggagtgggtcaatcaactgaaaacccggaagatttgtttaaggaaatatta

SEQ ID NO: 90294 - DNA, 75 bp, Artificial Sequence
  Synthetic
actctcaatatcgtgactcgtagaactgctggatttaatgagaagttagtttattataataccacacctatacat

SEQ ID NO: 90295 - DNA, 75 bp, Artificial Sequence
  Synthetic
tgtattctcaaaaatatctgtcacatctaatagatttcccaagttggtcaactactcagcttaacacagtgttgg

SEQ ID NO: 90296 - DNA, 75 bp, Artificial Sequence
  Synthetic
ctgctggatttaatgagaagttagtttattataataccacacctatacatttactgaccccctggaaaaaggtgt

SEQ ID NO: 90297 - DNA, 75 bp, Artificial Sequence
  Synthetic
tggcatatggaagcatctttaatgctaatcaggtctgcagtgatacaagctctataccaatagatattccacaaa

SEQ ID NO: 90298 - DNA, 75 bp, Artificial Sequence
  Synthetic
agtttaggcctgtatatttgactgttacaaaattatctgatgatggctattatcagataccaaagatgattcaag

SEQ ID NO: 90299 - DNA, 75 bp, Artificial Sequence
  Synthetic
tacaaaattatctgatgatggctattatcagataccaaagatgattcaagatttcaaatcgtcaaattctgttgc

SEQ ID NO: 90300 - DNA, 75 bp, Artificial Sequence
  Synthetic
atttcaaatcgtcaaattctgttgcattcaacatccttgtgcatctatcaatgggtacaaatttacttgaccaat

SEQ ID NO: 90301 - DNA, 75 bp, Artificial Sequence
  Synthetic
ccaaagactctcgattaagaaatgctggggaaactgtgattacatttatgattcatattgggaacttcaaaagga

SEQ ID NO: 90302 - DNA, 75 bp, Artificial Sequence
  Synthetic
attcatattgggaacttcaaaaggaagagtaataaatcttattcaccggaatactgcaagaggaaaataatgagg

SEQ ID NO: 90303 - DNA, 75 bp, Artificial Sequence
  Synthetic
cgactacaggcctacttaggattcaaaaggactttatgttaccctctgatgtatgtaaatgaagggcttaataaa

SEQ ID NO: 90304 - DNA, 75 bp, Artificial Sequence
  Synthetic
acactgtggagaaatgaatgtagaatagagaaggttcaagcagtcttacagccatctgttccaaatgaatttaag

SEQ ID NO: 90305 - DNA, 75 bp, Artificial Sequence
  Synthetic
gtatatgatgatgtcattattgacaataccaatggtctcttcaagattaaataggttataaccgtaataaacagc

SEQ ID NO: 90306 - DNA, 75 bp, Artificial Sequence
  Synthetic
taataaatggtattatgtatttaggtgtacactgataattgtgaataaaatacattggattaataacggtataga

SEQ ID NO: 90307 - DNA, 75 bp, Artificial Sequence
  Synthetic
tttagaatctaattgatatgtaggttaatgcttaagcacttattagctctattgatcatctatattttgagttat

SEQ ID NO: 90308 - DNA, 75 bp, Artificial Sequence
  Synthetic
tcagtttaaacttgttggattaacgttcaattattataaccagaatacacaaattgttaaacttataattccgtt

SEQ ID NO: 90309 - DNA, 75 bp, Artificial Sequence
  Synthetic
aaattgttaaacttataattccgttagattcattcaagttgaacttctgtaatgctaaccgattatcattcgagc

SEQ ID NO: 90310 - DNA, 75 bp, Artificial Sequence
  Synthetic
aattataaaaaactaaggacctaatgtagtaggaacccaaattctatccagtgagcttgaaatcgccatactcaa

SEQ ID NO: 90311 - DNA, 75 bp, Artificial Sequence
  Synthetic
atatcagtttgtctagggcctgtctaactcaaaacaaagctcataaccagaatccagacgagtgggttaaatcta

SEQ ID NO: 90312 - DNA, 75 bp, Artificial Sequence
  Synthetic
aatgactattaagaattgagattttaaattgattctttcttaactctaaagttttagtagtatagcatcaattca

SEQ ID NO: 90313 - DNA, 75 bp, Artificial Sequence
  Synthetic
aaattgattctttcttaactctaaagttttagtagtatagcatcaattcagcaccatgaacagaattaaagctat

SEQ ID NO: 90314 - DNA, 75 bp, Artificial Sequence
  Synthetic
aataattagttctttgttattatcagatattacgattgcacaaataggctgggataatttaacttcgatcggggt

SEQ ID NO: 90315 - DNA, 75 bp, Artificial Sequence
  Synthetic
taggtagttattactaaatatttaggataacgattccattagtggggtgaggggaaggaatcaggtatttcagaa

SEQ ID NO: 90316 - DNA, 75 bp, Artificial Sequence
  Synthetic
caatatatcgtcaatcattaattgcactaaacttgaattgataaaatatagagagttagtctcagggatcattag

SEQ ID NO: 90317 - DNA, 75 bp, Artificial Sequence
  Synthetic
gagagttagtctcagggatcattagaccaataaatgagtcattagaattaatgaactcatacattaatatgagag

SEQ ID NO: 90318 - DNA, 75 bp, Artificial Sequence
  Synthetic
taggttcagagagatttataggggctgtaatagctggagtagcattaggagtggcaactgcagcacaaataacat

SEQ ID NO: 90319 - DNA, 75 bp, Artificial Sequence
  Synthetic
tgtaatagctggagtagcattaggagtggcaactgcagcacaaataacatcagggattgccctacataattcaat

SEQ ID NO: 90320 - DNA, 75 bp, Artificial Sequence
  Synthetic
cagggattgccctacataattcaattatgaacaaaaaacagatacaagagttgaggaaggctcttagtactacca

SEQ ID NO: 90321 - DNA, 75 bp, Artificial Sequence
  Synthetic
tatgaacaaaaaacagatacaagagttgaggaaggctcttagtactaccaacaaagcaattgatgaaataaggat

SEQ ID NO: 90322 - DNA, 75 bp, Artificial Sequence
  Synthetic
tgcaggtgaacgaacattaatggcagtacaaggtgtacaggattatatcaataatataattgtccctatgcagga

SEQ ID NO: 90323 - DNA, 75 bp, Artificial Sequence
  Synthetic
gtacaaggtgtacaggattatatcaataatataattgtccctatgcaggacaaactccaatgtgatattttatca

SEQ ID NO: 90324 - DNA, 75 bp, Artificial Sequence
  Synthetic
caaactccaatgtgatattttatcatcacagctttctgttgcattactcagatattatacaaatatattaacagt

SEQ ID NO: 90325 - DNA, 75 bp, Artificial Sequence
  Synthetic
ctttggaccaagtatacgagatcctatcactagcacgatttcgatacaagcacttagtcaagcattcaatggtaa

SEQ ID NO: 90326 - DNA, 75 bp, Artificial Sequence
  Synthetic
tcttcaggcattgcttgaaggactgggatatactgggagagacttacgtgatcttctagagagtaaatctatcac

SEQ ID NO: 90327 - DNA, 75 bp, Artificial Sequence
  Synthetic
tggtcagataattcatgcagatatgactgatttgttccttgttctgagaataaattatccttctataactgagat

SEQ ID NO: 90328 - DNA, 75 bp, Artificial Sequence
  Synthetic
gcagggagtaacaatatatgggctcaattcaattacatatcatattgggcctgaagagtggtataccattatgcc

SEQ ID NO: 90329 - DNA, 75 bp, Artificial Sequence
  Synthetic
cgattttattgctgttcagggttttttaatatctaattttgatgagagaaagtgttcaataactaaatcaagtat

SEQ ID NO: 90330 - DNA, 75 bp, Artificial Sequence
  Synthetic
attgtgccaacaaaattcaatttacccaatgtcaacagagatgcaaagatgtattaagggcgagataagattctg

SEQ ID NO: 90331 - DNA, 75 bp, Artificial Sequence
  Synthetic
tccaagatccaaggcaattgggacattagttaatcggtttatactgaccaaaggtaatttaatggctaattgttt

SEQ ID NO: 90332 - DNA, 75 bp, Artificial Sequence
  Synthetic
aggggttatatgcagatgttatacttcaggccaagttataacacaagaccctagtaaattgattacgataatatc

SEQ ID NO: 90333 - DNA, 75 bp, Artificial Sequence
  Synthetic
gcaagaagagtgcaaggaagttggtgttgatggtatccgtattatggtaggacctagaaaattaccagatattac

SEQ ID NO: 90334 - DNA, 75 bp, Artificial Sequence
  Synthetic
gacctagaaaattaccagatattacctttaacgctaagttggaaattggtgtaccgatatcattaagcaaattag

SEQ ID NO: 90335 - DNA, 75 bp, Artificial Sequence
  Synthetic
atgtcgggactgatttagcgattgcttcagctaaacttaataattctaaggcattgttagagcaatcagataaga

SEQ ID NO: 90336 - DNA, 75 bp, Artificial Sequence
  Synthetic
ttttggattcaatgtccaaattggattctatgaattcaagaataataggattaatcttagcaattatgataatct

SEQ ID NO: 90337 - DNA, 75 bp, Artificial Sequence
  Synthetic
ttataatcattatgactattatctggatcatatataagaaatgtaggaataaagataataaattcagtacttcaa

SEQ ID NO: 90338 - DNA, 75 bp, Artificial Sequence
  Synthetic
ttgaaccgctctacatacctccttcttataactcacctcatagtgtggttaagtctatttgagtactgactatat

SEQ ID NO: 90339 - DNA, 75 bp, Artificial Sequence
  Synthetic
gatccactgtaataagtccaatgaaagtatcaattaataatattggtagtgcaatgagtattgattgtataatat

SEQ ID NO: 90340 - DNA, 75 bp, Artificial Sequence
  Synthetic
actcctttaaactcgatagtgataaagggttataaatgatttcagtcattttaatataatcatatattgatttta

SEQ ID NO: 90341 - DNA, 75 bp, Artificial Sequence
  Synthetic
caactgttggcacatcactgagatatagtcaactctttacccaccacatgtcctctcaccaaatccaacaagtca

SEQ ID NO: 90342 - DNA, 75 bp, Artificial Sequence
  Synthetic
ttatctagcataactattatgtaattgaatgatgtgtcatcaattaatagcttgataatatgttttaatatactt

SEQ ID NO: 90343 - DNA, 75 bp, Artificial Sequence
  Synthetic
atattgatggatagatgtattatattgtaatcaaggatttagtatttagaagaggaaagagtttaatttgttgtt

SEQ ID NO: 90344 - DNA, 75 bp, Artificial Sequence
  Synthetic
aattagttattgtgtattcaattagaaaaaacttaggaatccatgttaatagaaatttattatcatggagtccaa

SEQ ID NO: 90345 - DNA, 75 bp, Artificial Sequence
  Synthetic
caatattaagtactacaaagattctagccggtactttggtaaaatattagatgaacacaaaacaattaatagtca

SEQ ID NO: 90346 - DNA, 75 bp, Artificial Sequence
  Synthetic
attgtacagtttgagtatcaaggtaattaccattattgctattattgtaagcctgattgcaacaataataactat

SEQ ID NO: 90347 - DNA, 75 bp, Artificial Sequence
  Synthetic
tatcaatgccactagtgggagaactaccctaaatagtaatacagacatactactcagccaacgagatgagattca

SEQ ID NO: 90348 - DNA, 75 bp, Artificial Sequence
  Synthetic
taacatccaagaaatgatatttgatcgtatttatcctttgataaatgctatgagtacagagctaggacttcatat

SEQ ID NO: 90349 - DNA, 75 bp, Artificial Sequence
  Synthetic
cgtatttatcctttgataaatgctatgagtacagagctaggacttcatattcctaccctattggatgaacttact

SEQ ID NO: 90350 - DNA, 75 bp, Artificial Sequence
  Synthetic
aaagcgattgaccagaaaattaaaataatgcatcctcctgtggacactatgacctctgaccttaattggtgcatc

SEQ ID NO: 90351 - DNA, 75 bp, Artificial Sequence
  Synthetic
aaaccccctaatggaattatcatagacccaaaaagttattgtgagagtatggaattgtctaaaacttatgaattg

SEQ ID NO: 90352 - DNA, 75 bp, Artificial Sequence
  Synthetic
ttacttgaccagttagatgtctcaagaaagaaatcacttattataaatagaaagaatattaaccagtgccaatta

SEQ ID NO: 90353 - DNA, 75 bp, Artificial Sequence
  Synthetic
gttgataattcaaagatcatttttgctactgtcaacatacaatctacaccgaggtttttaaactttggtcacacg

SEQ ID NO: 90354 - DNA, 75 bp, Artificial Sequence
  Synthetic
gtcagcaatcaacgtataacatttggtcaaggaacatatagtagtacttatgttataactatccaagaagatgga

SEQ ID NO: 90355 - DNA, 75 bp, Artificial Sequence
  Synthetic
gtaactgatgttcaatatcgagtgtttgagatcggatatatttctgatcagtttggtgtattcccctccttaata

SEQ ID NO: 90356 - DNA, 75 bp, Artificial Sequence
  Synthetic
gtatcgagagtgttgccgatacgcatgctattaggaatggaatcctgtaccttgacaagtgatagactaggcggg

SEQ ID NO: 90357 - DNA, 75 bp, Artificial Sequence
  Synthetic
tattttttatgtatgaatacactgacacgatctatatatgattatgttagcataagggatttgaaatcactttat

SEQ ID NO: 90358 - DNA, 75 bp, Artificial Sequence
  Synthetic
ataacaatccctcattatggtaaagttaattatacttactttaattttggtaagatcaggagcccacatgagatt

SEQ ID NO: 90359 - DNA, 75 bp, Artificial Sequence
  Synthetic
taagatcaggagcccacatgagattgataaaatttggttaacatctgatagaggccaaattatttctggttattt

SEQ ID NO: 90360 - DNA, 75 bp, Artificial Sequence
  Synthetic
caactctgagaattactgtagagggtggtataaaaacataacaggtaatgacgatgttccgatattagcatactt

SEQ ID NO: 90361 - DNA, 75 bp, Artificial Sequence
  Synthetic
atcaaccatcagatcaattatcaggtcatccaatctcgatcaagatttgaagacaaagttgctcacaattctatc

SEQ ID NO: 90362 - DNA, 75 bp, Artificial Sequence
  Synthetic
ggacctttaattacacttgtagcaatcccgccttacaattatacagctccatctcataattctctttactatgat

SEQ ID NO: 90363 - DNA, 75 bp, Artificial Sequence
  Synthetic
gataaaatcaataaattgataatgactacatctcatataggtcatattcaaattaatgaggtgcatgaggtgatt

SEQ ID NO: 90364 - DNA, 75 bp, Artificial Sequence
  Synthetic
aattaatgaggtgcatgaggtgattgttggcgataatttagaagctatcctcctaaacagattgtctgatgaaca

SEQ ID NO: 90365 - DNA, 75 bp, Artificial Sequence
  Synthetic
tcctaatcttaccgcctgtagactcaatcagggcatcaaggagcagtacaggtctgacggaacaataatttcaaa

SEQ ID NO: 90366 - DNA, 75 bp, Artificial Sequence
  Synthetic
ttctgcacttattgatatacaagaacggatgtatattacaattaaagctgttccaccagtgggtaactataactt

SEQ ID NO: 90367 - DNA, 75 bp, Artificial Sequence
  Synthetic
ggcctaggcgatcgcaagagtgggggatatatgtatctacttctccatggtgtcatagaagacagtgagaacatg

SEQ ID NO: 90368 - DNA, 75 bp, Artificial Sequence
  Synthetic
gatatatgtatctacttctccatggtgtcatagaagacagtgagaacatgagtagtccaaaggggagagcatttg

SEQ ID NO: 90369 - DNA, 75 bp, Artificial Sequence
  Synthetic
tacagttgaattgcattctagatcaaacacatcctatctattgttaccaaaacagtttaatgctaaatacgacaa

SEQ ID NO: 90370 - DNA, 75 bp, Artificial Sequence
  Synthetic
tgaatccctttctgttgatactgctatttttaatttaataagttgcaaatgaatatgtcaactgatagttgatag

SEQ ID NO: 90371 - DNA, 75 bp, Artificial Sequence
  Synthetic
gaatatgtcaactgatagttgatagttgtcaaaacatcagctaattgagattaaagaaataaaaaaatgaaatta

SEQ ID NO: 90372 - DNA, 75 bp, Artificial Sequence
  Synthetic
ttaaagaaataaaaaaatgaaattatcaagatttgactaaatgtatactcaagctaaattacaaaaaacttagga

SEQ ID NO: 90373 - DNA, 75 bp, Artificial Sequence
  Synthetic
aagctaaattacaaaaaacttaggagtcagagacttcgttgcaatggagcagtcagactaccaagatattctata

SEQ ID NO: 90374 - DNA, 75 bp, Artificial Sequence
  Synthetic
tcctgaagtacatcttaacagtcctatagtaatctctaaattagtaggtattttagaatatgcccaaattgatca

SEQ ID NO: 90375 - DNA, 75 bp, Artificial Sequence
  Synthetic
caatcaacaactatcagactatacaattatcaagaatattcaatttagattaagaaatggctttaatagtccaag

SEQ ID NO: 90376 - DNA, 75 bp, Artificial Sequence
  Synthetic
gatacaaacactatcaactatgggtgaaatcatcaacaaaattaaaaacaaacaccctaattatttacacatacc

SEQ ID NO: 90377 - DNA, 75 bp, Artificial Sequence
  Synthetic
ttaccccgaatgtaaccaaaagctatttcgaatagtagatccagaactgacatcaaaattggaatctcttctaaa

SEQ ID NO: 90378 - DNA, 75 bp, Artificial Sequence
  Synthetic
caaaggtgatacactgtatctcaaaattcggtcagatatcataaaatgctttgatagattgaaaatgaagatgaa

SEQ ID NO: 90379 - DNA, 75 bp, Artificial Sequence
  Synthetic
attcggtcagatatcataaaatgctttgatagattgaaaatgaagatgaatataaggaatgatcttcttaatgac

SEQ ID NO: 90380 - DNA, 75 bp, Artificial Sequence
  Synthetic
ttgatagattgaaaatgaagatgaatataaggaatgatcttcttaatgacaatagtcaattaattctagatcttc

SEQ ID NO: 90381 - DNA, 75 bp, Artificial Sequence
  Synthetic
ctttaattatcaaaggatctcagtggttcttcccgtttttattttggttttcgattaaaactgagactagaagct

SEQ ID NO: 90382 - DNA, 75 bp, Artificial Sequence
  Synthetic
gttcttcccgtttttattttggttttcgattaaaactgagactagaagctgtatccgacaaaataaaaaaaatcg

SEQ ID NO: 90383 - DNA, 75 bp, Artificial Sequence
  Synthetic
tgttagatcacaatatcggcctcacttatcagagactaagagaattacattggttgttacatctgatctgataac

SEQ ID NO: 90384 - DNA, 75 bp, Artificial Sequence
  Synthetic
taataacggtatagagttagaatctaattgatatgtaggttaatgattaagcacttattagctctattgattatc

SEQ ID NO: 90385 - DNA, 75 bp, Artificial Sequence
  Synthetic
aatatttgatcatattaataaatgtatattttatctgacttttgagatgttgttaatgtattgcgatgtggtaga

SEQ ID NO: 90386 - DNA, 75 bp, Artificial Sequence
  Synthetic
tatatttttagttatctaatatcagagtatcaatatgtaatcagtttaaacttgttggattaacgttcaattatt

SEQ ID NO: 90387 - DNA, 75 bp, Artificial Sequence
  Synthetic
aggtagattaatgactgaaacagctatgagcttggattgtcgatttatcaatctattgccaagagtgcaatatat

SEQ ID NO: 90388 - DNA, 75 bp, Artificial Sequence
  Synthetic
ataaccagaatacacaaattgttaaacttataattccgttagattcattcaagttgaacttctgtaatgctaacc

SEQ ID NO: 90389 - DNA, 75 bp, Artificial Sequence
  Synthetic
gtgggatttgctagatggaatgtttgagagtttaggtaatcaattatattcagttattgcattgttagagcctct

SEQ ID NO: 90390 - DNA, 75 bp, Artificial Sequence
  Synthetic
cagttattgcattgttagagcctctttctcttgcttatttgcaattaatagatgcagatccacagattcggggaa

SEQ ID NO: 90391 - DNA, 75 bp, Artificial Sequence
  Synthetic
cgttcttgcatcactgtttttcagagttagaagaaattatatttgacaagtctccttttgatccttttgtgtatg

SEQ ID NO: 90392 - DNA, 75 bp, Artificial Sequence
  Synthetic
tctccttttgatccttttgtgtatgaaaatttaattaatggactagattatatttacttgacagatgatattcat

SEQ ID NO: 90393 - DNA, 75 bp, Artificial Sequence
  Synthetic
aagaattgagattttaaattgattctttcttaactctaaagttttagtagtatagcatcaattcagcacgatgaa

SEQ ID NO: 90394 - DNA, 75 bp, Artificial Sequence
  Synthetic
ctaactgcagaagttttttctttttttaggagctttggtcatccttttttagaagcacaaaatgctgccaataat

SEQ ID NO: 90395 - DNA, 75 bp, Artificial Sequence
  Synthetic
cagaattaaagttataataattagttctttgttattatcagatattacaattgcacagataggctgggataattt

SEQ ID NO: 90396 - DNA, 75 bp, Artificial Sequence
  Synthetic
gtgaggaagtatatgaataggcctaaagtgatctcataccagactctaatgcaaggacatgcgattttttgtggt

SEQ ID NO: 90397 - DNA, 75 bp, Artificial Sequence
  Synthetic
aagtgatctcataccagactctaatgcaaggacatgcgattttttgtggtattataataaacggatttagagatc

SEQ ID NO: 90398 - DNA, 75 bp, Artificial Sequence
  Synthetic
agagttaccaaatcatgcatctgctgtaattagaaatgcccagctatctggagaagggttgacatctgaacaatg

SEQ ID NO: 90399 - DNA, 75 bp, Artificial Sequence
  Synthetic
tgctcaacattggagatccttttgtggatttaaatttaaatgttttatgccactgagtctagatagtgaccttac

SEQ ID NO: 90400 - DNA, 75 bp, Artificial Sequence
  Synthetic
aatgtaccttcgggacaaggcgttgtcacctgtcagaagtgagtgggattccgtttatgcgaaagagtatttaag

SEQ ID NO: 90401 - DNA, 75 bp, Artificial Sequence
  Synthetic
atacaatccaggattacctacaagctctagaagattagtgaatgtattcttagaagatgataagtttgatccata

SEQ ID NO: 90402 - DNA, 75 bp, Artificial Sequence
  Synthetic
tctagaagattagtgaatgtattcttagaagatgataagtttgatccatatgaaatgatcatgtacgtgataaat

SEQ ID NO: 90403 - DNA, 75 bp, Artificial Sequence
  Synthetic
ggtgattacttaagagacaaagagtttaatctttcatacagtcttaaagagaaagagatcaaagaggtaggtcga

SEQ ID NO: 90404 - DNA, 75 bp, Artificial Sequence
  Synthetic
ttgttcgccaaaatgacttataaaatgagggcttgccaggtaatagctgaaaacctgattgccaatggagtaggg

SEQ ID NO: 90405 - DNA, 75 bp, Artificial Sequence
  Synthetic
tgagggcttgccaggtaatagctgaaaacctgattgccaatggagtagggaagtttttcaaagataatggaatgg

SEQ ID NO: 90406 - DNA, 75 bp, Artificial Sequence
  Synthetic
caaaagatgaacataaactaactaaaacgttacacaaattagccatttcaggtgtacctaaagataattctcaac

SEQ ID NO: 90407 - DNA, 75 bp, Artificial Sequence
  Synthetic
tttatttagatgaatgctgggagcaagtagttcgacaatgttcaagtagtacacagataggagaacagactatga

SEQ ID NO: 90408 - DNA, 75 bp, Artificial Sequence
  Synthetic
attcacaattgaagagggcaattggaccaaagtcttctagatcacatcgaaataatagggatatcttaaggggta

SEQ ID NO: 90409 - DNA, 75 bp, Artificial Sequence
  Synthetic
accaaagtcttctagatcacatcgaaataatagggatatcttaaggggtaggggagatttaaataaacagataaa

SEQ ID NO: 90410 - DNA, 75 bp, Artificial Sequence
  Synthetic
gtacccttccaacaccgagtattacgagactattagtagtttcataactactgaccttaaaaagtactgtcttaa

SEQ ID NO: 90411 - DNA, 75 bp, Artificial Sequence
  Synthetic
ttggcgatatgaatcaagtagtgtgtttgcagagagacttaatgaaatttatggattgcctgggttttttcagtg

SEQ ID NO: 90412 - DNA, 75 bp, Artificial Sequence
  Synthetic
tttgcagagagacttaatgaaatttatggattgcctgggttttttcagtggcttcacaaaattttggagaaatct

SEQ ID NO: 90413 - DNA, 75 bp, Artificial Sequence
  Synthetic
gcttcacaaaattttggagaaatctgttttatacgttagcgatccgtctagtccacctgattttgatcaacatat

SEQ ID NO: 90414 - DNA, 75 bp, Artificial Sequence
  Synthetic
gttttatacgttagcgatccgtctagtccacctgattttgatcaacatatcgatatagaatcagttccgaatgac

SEQ ID NO: 90415 - DNA, 75 bp, Artificial Sequence
  Synthetic
catatctttatcaagtacccgatgggtggaatagaggggttctgtcaaaaattatggactattagtacgattcca

SEQ ID NO: 90416 - DNA, 75 bp, Artificial Sequence
  Synthetic
gtggaatagaggggttctgtcaaaaattatggactattagtacgattccattcctatatttagcagcttttgata

SEQ ID NO: 90417 - DNA, 75 bp, Artificial Sequence
  Synthetic
ttcctatatttagcagcttttgatacaggagtcagaatctcatcattggttcagggcgataatcaagcaattgca

SEQ ID NO: 90418 - DNA, 75 bp, Artificial Sequence
  Synthetic
caggagtcagaatctcatcattggttcagggcgataatcaagcaattgcagtgaccaaaagagttccatcatctt

SEQ ID NO: 90419 - DNA, 75 bp, Artificial Sequence
  Synthetic
ttctttgtttactctaaaggtatttattacgatggaatacttctctcccaagcacttaaaagtattgcaagatgt

SEQ ID NO: 90420 - DNA, 75 bp, Artificial Sequence
  Synthetic
attacgatggaatacttctctcccaagcacttaaaagtattgcaagatgtgttttttggtctgaaacaattgttg

SEQ ID NO: 90421 - DNA, 75 bp, Artificial Sequence
  Synthetic
atgagactagatcagcttgcagtaatatatctacgacacttgcaaaggcaattgaaaggggttatgataaatttg

SEQ ID NO: 90422 - DNA, 75 bp, Artificial Sequence
  Synthetic
attgaaaggggttatgataaatttgtggcatatgctattaatatttataaaacaatacatcaagttttgattgca

SEQ ID NO: 90423 - DNA, 75 bp, Artificial Sequence
  Synthetic
ttatcctttacgattaatcctactatgacaccagacattacagaacctttctacaaaagtttggatctacttaaa

SEQ ID NO: 90424 - DNA, 75 bp, Artificial Sequence
  Synthetic
attagatagtgataaagagttatagatgattgcaatcattttaatataattatatattgatttgattacctggta

SEQ ID NO: 90425 - DNA, 75 bp, Artificial Sequence
  Synthetic
aatctagttctaattcctgcaccattggggggcatgaattatatgaacatgagcaggttatttgttaggaacata

SEQ ID NO: 90426 - DNA, 75 bp, Artificial Sequence
  Synthetic
tggggggcatgaattatatgaacatgagcaggttatttgttaggaacataggtgaccccattactgcttcatttg

SEQ ID NO: 90427 - DNA, 75 bp, Artificial Sequence
  Synthetic
taattcttatgcaattgaattatgtgtcatcaattaatagcttaatagcactgttttacatacttatgttgacag

SEQ ID NO: 90428 - DNA, 75 bp, Artificial Sequence
  Synthetic
ctgatataaagcgcatgatcgaatgtgggttattaggatgtagcattctgtcacaaataatgtaccaaaaatgtg

SEQ ID NO: 90429 - DNA, 75 bp, Artificial Sequence
  Synthetic
atagatgtgttatattgtaatcaaggatttagtatctagaagaagaaagagttcaattggttgttaattggttat

SEQ ID NO: 90430 - DNA, 75 bp, Artificial Sequence
  Synthetic
tcacaaataatgtaccaaaaatgtggttcctctaaatacttagactgggctagtgatccttactcaataaacctt

SEQ ID NO: 90431 - DNA, 75 bp, Artificial Sequence
  Synthetic
ttttgaaaaatgtaacggcaagatatgtacttatgcatagccccaatcctatgcttaaagatttgttccatgaaa

SEQ ID NO: 90432 - DNA, 75 bp, Artificial Sequence
  Synthetic
tattacaaggattctaaccgatactttggtagaatattagatgaacacaaaacaattaatagtcaattgtacagc

SEQ ID NO: 90433 - DNA, 75 bp, Artificial Sequence
  Synthetic
agtcacaagaagaagatgaaatccttgctgaatttctgttagaccgacacttaataatccctagagcagcacacg

SEQ ID NO: 90434 - DNA, 75 bp, Artificial Sequence
  Synthetic
ttaataatccctagagcagcacacgagattttatcaaattcagtgacaggtgctagggaatctatagcaggtatg

SEQ ID NO: 90435 - DNA, 75 bp, Artificial Sequence
  Synthetic
tgctagggaatctatagcaggtatgcttgacactactaagggtttaatccgtgctagtatgtcaagaggtgggct

SEQ ID NO: 90436 - DNA, 75 bp, Artificial Sequence
  Synthetic
cttgacactactaagggtttaatccgtgctagtatgtcaagaggtgggctgacatcatcactagttttaaaatta

SEQ ID NO: 90437 - DNA, 75 bp, Artificial Sequence
  Synthetic
gacatcatcactagttttaaaattatcaacatatgattaccaacagtttagaacgtgtcttgaatggctttatgc

SEQ ID NO: 90438 - DNA, 75 bp, Artificial Sequence
  Synthetic
gctaggacttcatattcctaccttattggatgaacttactaaagcgattgaccaaaagattaaaataatgaatcc

SEQ ID NO: 90439 - DNA, 75 bp, Artificial Sequence
  Synthetic
tcaacatatgattaccaacagtttagaacgtgtcttgaatggctttatgctcctatcacgggaattgctgtaagc

SEQ ID NO: 90440 - DNA, 75 bp, Artificial Sequence
  Synthetic
gaacgtgtcttgaatggctttatgctcctatcacgggaattgctgtaagcgttgattcttgttctgtattcttag

SEQ ID NO: 90441 - DNA, 75 bp, Artificial Sequence
  Synthetic
ctaagaccatccgaaagagaatgtgggttcatctgactaagggaagagagatttacgggttggaagtacctgaca

SEQ ID NO: 90442 - DNA, 75 bp, Artificial Sequence
  Synthetic
ttttggaatgcatgcaaaacaatataattattgatcatgaagattgttactcatgtattcaaggatcaaaatatt

SEQ ID NO: 90443 - DNA, 75 bp, Artificial Sequence
  Synthetic
atacatggttttttgtaccttcaagttgtcagctcgaccagataaataagtcaacgaattctctccgagtacctt

SEQ ID NO: 90444 - DNA, 75 bp, Artificial Sequence
  Synthetic
atgttggatcaacaactgaagaaaggagtgatatgaagttgtcatatgtaaggtcaccgagtagaccacttaaag

SEQ ID NO: 90445 - DNA, 75 bp, Artificial Sequence
  Synthetic
cagcagtccgaattgcagcagtatatacatgggcttatggtgatgatgatttatcttggcatgaggcttggtatt

SEQ ID NO: 90446 - DNA, 75 bp, Artificial Sequence
  Synthetic
tggcaaggactagggcaaacattacatttgatgaactcaaattaataacacctatagctacatctactaatttgg

SEQ ID NO: 90447 - DNA, 75 bp, Artificial Sequence
  Synthetic
cacatagattgagagatagaagtactcaagttaaatattcagggacttccttagtaagagtggcacgctatacaa

SEQ ID NO: 90448 - DNA, 75 bp, Artificial Sequence
  Synthetic
caatatctaatgataacatgtcgttcattattaacaacaggaaagtcgatactaattttgtctaccagcaaggga

SEQ ID NO: 90449 - DNA, 75 bp, Artificial Sequence
  Synthetic
cattattaacaacaggaaagtcgatactaattttgtctaccagcaagggatgttattaggcttgagtatactaga

SEQ ID NO: 90450 - DNA, 75 bp, Artificial Sequence
  Synthetic
atacatattcagatactgtacaagtactggacaatcaaacactgtaattcacttacatgcagatgttaattgttg

SEQ ID NO: 90451 - DNA, 75 bp, Artificial Sequence
  Synthetic
tatttctggttattttgcagcatttgttaccattacaattcggaattataataattatccctacaaatgtttaaa

SEQ ID NO: 90452 - DNA, 75 bp, Artificial Sequence
  Synthetic
gttaccattacaattcggaattataataattatccctacaaatgtttaaataatccatgctttgacaactctgag

SEQ ID NO: 90453 - DNA, 75 bp, Artificial Sequence
  Synthetic
tatacgccaagcttaactaagaagctacctgatatcaaacccatcaacaataaattgatatatgatccggctcct

SEQ ID NO: 90454 - DNA, 75 bp, Artificial Sequence
  Synthetic
taaattgatatatgatccggctcctataattgatactgatgcagctaggttgtattctcaaaaatatctgtcaca

SEQ ID NO: 90455 - DNA, 75 bp, Artificial Sequence
  Synthetic
caaaagtggtagcagtatccatagtagaattaatcacaaaagcgagtaaagaccatctcaatgagataatagcgg

SEQ ID NO: 90456 - DNA, 75 bp, Artificial Sequence
  Synthetic
ttgttggtgatgatgatatcaatagctttattacagaatttctacttgttgatccacgtctgtttacactatact

SEQ ID NO: 90457 - DNA, 75 bp, Artificial Sequence
  Synthetic
taggccaatacacgtcattacaatgggcatatgaaatccattatcatagaccagtgggcaagtaccagatggccg

SEQ ID NO: 90458 - DNA, 75 bp, Artificial Sequence
  Synthetic
aagtattgcataatttgttgtcaagagctagtagaggcatatttagcatattgaccaatgcctttagccacccca

SEQ ID NO: 90459 - DNA, 75 bp, Artificial Sequence
  Synthetic
gggtctataaaagattctgggaatgtggtttattggagcctatttatgggccttatataggaagtcaaaatctac

SEQ ID NO: 90460 - DNA, 75 bp, Artificial Sequence
  Synthetic
atagtgcagtgattgattatatctataatgcatatcttacttatttggatgcttatttatctgatcaagtagatg

SEQ ID NO: 90461 - DNA, 75 bp, Artificial Sequence
  Synthetic
atactgatattataatctgtgaaacagaggagacatgtttagcaaatagaattgacaattaccaaagtagacacc

SEQ ID NO: 90462 - DNA, 75 bp, Artificial Sequence
  Synthetic
tagctgtactcatagacttgtactgcgattccactagatgccccaatataaaagggtcagatacaattgtgagaa

SEQ ID NO: 90463 - DNA, 75 bp, Artificial Sequence
  Synthetic
atcagctaattgagattaaagaaataaaaaaatgaaattatcaagatctgactaaatgtatattcaagctaaatt

SEQ ID NO: 90464 - DNA, 75 bp, Artificial Sequence
  Synthetic
attcaatccttagatccttcattgataatgagaggagaacaaacccactcggtttgacatggaatcttgatccat

SEQ ID NO: 90465 - DNA, 75 bp, Artificial Sequence
  Synthetic
tacttgtggatcactttagctgttctattacgtatctaaggagaggtattattaaacagatgagattaagatttg

SEQ ID NO: 90466 - DNA, 75 bp, Artificial Sequence
  Synthetic
acctaagcgtatctcttgaactatctagaatgattaaacctgatgtgatttatcaagcacctaaagttccgtcct

SEQ ID NO: 90467 - DNA, 75 bp, Artificial Sequence
  Synthetic
catgggctcttatagatatcaaccctgaagtaaatgaccttaatacaatttttggagagctgaatagcaagtgga

SEQ ID NO: 90468 - DNA, 75 bp, Artificial Sequence
  Synthetic
aagacatccctataggacaaatcagaattcaaaattatgaaatacatgcatataggaggattggagttaattcaa

SEQ ID NO: 90469 - DNA, 75 bp, Artificial Sequence
  Synthetic
aattcaaaattatgaaatacatgcatataggaggattggagttaattcaactgcatgttataaagctttagagct

SEQ ID NO: 90470 - DNA, 75 bp, Artificial Sequence
  Synthetic
attatctgtgctaaaccggttcatgtctaacccatcaggtgcattgtttttaggtgaaggggcaggatcgatgct

SEQ ID NO: 90471 - DNA, 75 bp, Artificial Sequence
  Synthetic
ggtcacatatcgtgcctttgttccattcaagacaatttattataatagtggtatttcagttcaaaatgttcaggg

SEQ ID NO: 90472 - DNA, 75 bp, Artificial Sequence
  Synthetic
tcagagagaattaagtctatatccatctgaagtggcactagttgataacaaaaatcgcatggctaatgaccctaa

SEQ ID NO: 90473 - DNA, 75 bp, Artificial Sequence
  Synthetic
tctgaagtggcactagttgataacaaaaatcgcatggctaatgaccctaatatcaaagtcttgtttaatggtaag

SEQ ID NO: 90474 - DNA, 75 bp, Artificial Sequence
  Synthetic
ccagagtctacgtgggttggaaatattgactgttttgcttatattcttagccatattgagacttcaagcttgaca

SEQ ID NO: 90475 - DNA, 75 bp, Artificial Sequence
  Synthetic
ttgactgttttgcttatattcttagccatattgagacttcaagcttgacattgatacatagtgatattgagtcca

SEQ ID NO: 90476 - DNA, 75 bp, Artificial Sequence
  Synthetic
ttgatacatagtgatattgagtccagcttgagcaaaacaaagaataaaattcttgaggagctgtgccatattctg

SEQ ID NO: 90477 - DNA, 75 bp, Artificial Sequence
  Synthetic
tcaatggcactcatcttgggaaagatcggatctttattagttgttaagttgctaccaagggtcggtgattatacg

SEQ ID NO: 90478 - DNA, 75 bp, Artificial Sequence
  Synthetic
tattcattttgcaaatatgcatcagagttctatcaacaaaactttcttgttctgcctagatttagtaacatgtca

SEQ ID NO: 90479 - DNA, 75 bp, Artificial Sequence
  Synthetic
tcatctgaggtttactacataggaattcaccttaatacaaatcgattgattgaccctgatagaatagtacaatac

SEQ ID NO: 90480 - DNA, 75 bp, Artificial Sequence
  Synthetic
tgaccctgatagaatagtacaatacataattagaaatttacaacctactccagttacatttttatcctacatttt

SEQ ID NO: 90481 - DNA, 75 bp, Artificial Sequence
  Synthetic
acagatgatattcatctaactgcagaagttttttctttttttaggagctttggtcatccttttttagaagcacaa

SEQ ID NO: 90482 - DNA, 75 bp, Artificial Sequence
  Synthetic
tgaaactaagtatcgaaataatatggttacaaattatggactatgcttgtcagacggacacaaaagtgattactt

SEQ ID NO: 90483 - DNA, 75 bp, Artificial Sequence
  Synthetic
gtcatcaattacaaaaatagagagtgttcttctgtcatgtgggttagaattgaacggacctaagattatacagca

SEQ ID NO: 90484 - DNA, 75 bp, Artificial Sequence
  Synthetic
attatcaggacatgactatgccagtggagagactagtctggaatcaagtataatgatattagttagagaatatct

SEQ ID NO: 90485 - DNA, 75 bp, Artificial Sequence
  Synthetic
taatgcaactatacaaggccgggaaacattaggcttgttttcaccttacccggtccttcatgagagtcagttaag

SEQ ID NO: 90486 - DNA, 75 bp, Artificial Sequence
  Synthetic
agaaatcaataagtgtattgtattgaagtatattgtatatctgctcttttattcaaactctacattatctagtaa

SEQ ID NO: 90487 - DNA, 75 bp, Artificial Sequence
  Synthetic
acaaataatgagtaatcttagaaaaggaatattgatgtatgatttgagagatgagtttttcatatcaagattgtc

SEQ ID NO: 90488 - DNA, 75 bp, Artificial Sequence
  Synthetic
agcaaattacaagaaaaaagtaatgtcacaggaagttaagaccacctggatatttaatattgatactccgacacg

SEQ ID NO: 90489 - DNA, 75 bp, Artificial Sequence
  Synthetic
tatttaatattgatactccgacacgaaaggcgttatataagttagtaggttactcattaataattaatcacatat

SEQ ID NO: 90490 - DNA, 75 bp, Artificial Sequence
  Synthetic
tttaaggggtaagataagacttgatatatgataactgattaaacattacctctgaattgaaggattgctcaatta

SEQ ID NO: 90491 - DNA, 75 bp, Artificial Sequence
  Synthetic
tatggtttttgagtaattgagattttattccaattagtacaattagaaaaaacttcaacagttgattgagcctta

SEQ ID NO: 90492 - DNA, 75 bp, Artificial Sequence
  Synthetic
atttactccatactagctatatttataagctcggataaaactttggattaagattataacagtcataccaattta

SEQ ID NO: 90493 - DNA, 75 bp, Artificial Sequence
  Synthetic
tcaaggaaatacaattgatatctagtatgaagttcatatttatatgttttaaatcttatacccactctaattagt

SEQ ID NO: 90494 - DNA, 75 bp, Artificial Sequence
  Synthetic
tataggcattgtattagataatgtttatttcttacaaatgtgcaatctcatacatcggacccctcagcctccccc

SEQ ID NO: 90495 - DNA, 75 bp, Artificial Sequence
  Synthetic
tcggacccctcagcctcccccttatagttgcgtaatttgaaaaaacataaaaaataatcctgaatgattgtacgg

SEQ ID NO: 90496 - DNA, 75 bp, Artificial Sequence
  Synthetic
tcgactgttactaaatatttaggataacgattccattggtggggtgaggggaaggaatcaggtattccacaatgt

SEQ ID NO: 90497 - DNA, 75 bp, Artificial Sequence
  Synthetic
cgagtctattgaggtcacttgctgcatttaaaaggcatagggagcaaccaactacaccgtcagggtcaggtggta

SEQ ID NO: 90498 - DNA, 75 bp, Artificial Sequence
  Synthetic
caattaaaggattgaaaaatacagtcattgttccagttccaggggatacagtaattaccacgaggtctaacttgt

SEQ ID NO: 90499 - DNA, 75 bp, Artificial Sequence
  Synthetic
tatttagattagtttatataataggtaatccagatacacctctaagcacctcgacgggggcaataatatcattgt

SEQ ID NO: 90500 - DNA, 75 bp, Artificial Sequence
  Synthetic
gagttccatcatcttggagttactcaaagaaaaaggaagaatcaaccaaaataacaacacagtatttccttaatt

SEQ ID NO: 90501 - DNA, 75 bp, Artificial Sequence
  Synthetic
tgaccctatttgtcgaatccccaggtcaattaattcaaagaattgccgatgatcctgatgcagtttttaaattag

SEQ ID NO: 90502 - DNA, 75 bp, Artificial Sequence
  Synthetic
taagacaacgcttacacgacataggtcatgaattaaaagcaaatgaaactattatatcctctcatttctttgttt

SEQ ID NO: 90503 - DNA, 75 bp, Artificial Sequence
  Synthetic
tcgaggttattcctgaagccggtaatcctggagaattgacttttgcatctcgagggattaatttagataagcaag

SEQ ID NO: 90504 - DNA, 75 bp, Artificial Sequence
  Synthetic
ctcagcaatactttaaactggctgagagaaatgatcaagggtattatgttagcttaggatttgagaacccaccaa

SEQ ID NO: 90505 - DNA, 75 bp, Artificial Sequence
  Synthetic
gtgatgatgatataacatccagtcctgaaatatttaattatattctggcatctgtacttgcacaagtttggattc

SEQ ID NO: 90506 - DNA, 75 bp, Artificial Sequence
  Synthetic
ttctggcaaaagctgtgactgctccagacacagctgctgaagctgaaaaccgtagatgggttaaattgatgcaac

SEQ ID NO: 90507 - DNA, 75 bp, Artificial Sequence
  Synthetic
aacgtagggtggatggtgaattaagattaagtaaaggatggctagatttggtgagaaacaaaattgcgtcagaca

SEQ ID NO: 90508 - DNA, 75 bp, Artificial Sequence
  Synthetic
ttacaataagacgatttatggtggcattggtccttgacatcaaacgttctccggggacaagacccagaatagctg

SEQ ID NO: 90509 - DNA, 75 bp, Artificial Sequence
  Synthetic
aaatgatttgtgatattgataattatattgtagaggcagggcttgcaagtttcttgttaactattaaattcggta

SEQ ID NO: 90510 - DNA, 75 bp, Artificial Sequence
  Synthetic
tagagacacgttacccagcattggcattacatgagttttctggagaattagctactattgagggacttatgaaat

SEQ ID NO: 90511 - DNA, 75 bp, Artificial Sequence
  Synthetic
tgtaccaatctatgggagaaatggcaccatacatggtaattctggaaaattcaattcaaaccaggtttagtgccg

SEQ ID NO: 90512 - DNA, 75 bp, Artificial Sequence
  Synthetic
ggtcttaccctttgctatggagttatgccatgggtgttggtgtggagcttgaaagatcgatgagtggactcaatt

SEQ ID NO: 90513 - DNA, 75 bp, Artificial Sequence
  Synthetic
tgccatgggtgttggtgtggagcttgaaagatcgatgagtggactcaattttactaggagcttctttgaccctac

SEQ ID NO: 90514 - DNA, 75 bp, Artificial Sequence
  Synthetic
gtacttcagacttggtcaagagatggtgagaagatcctcagggatggttaatagttcatttgcaagagaacttgg

SEQ ID NO: 90515 - DNA, 75 bp, Artificial Sequence
  Synthetic
gctatctgaacatgagacacaacttgtcagccaaattgttaactcaggaggtgaatctgggatacctaaatttga

SEQ ID NO: 90516 - DNA, 75 bp, Artificial Sequence
  Synthetic
ggaattgctgtaagcgttgattcttgttctgtattcttagctaagaccatccgaaagagaatgtgggttcatcta

SEQ ID NO: 90517 - DNA, 75 bp, Artificial Sequence
  Synthetic
cggattcagagcaaatccaacaacctttctaggaactaaagataacataaacgataggagtgaggatcagtcaaa

SEQ ID NO: 90518 - DNA, 75 bp, Artificial Sequence
  Synthetic
ttcaatattagggttacctggtccattattacccagtcgtgatctgaatcctccaggtgattcatatggaatgga

SEQ ID NO: 90519 - DNA, 75 bp, Artificial Sequence
  Synthetic
cagtggtgtgaaaaatgccagtgataaactaaatgaaggaataggtccagatcatgatgtgtctagttctgccat

SEQ ID NO: 90520 - DNA, 75 bp, Artificial Sequence
  Synthetic
ggaagaattgaggagattagttgagtcgaccaacagaatcgacaccaaaaagccagaagctccaggtgtcactaa

SEQ ID NO: 90521 - DNA, 75 bp, Artificial Sequence
  Synthetic
ccattataatgatactgaccttttaagataatatgagtataccctatttgatcattatataattcgagttaagaa

SEQ ID NO: 90522 - DNA, 75 bp, Artificial Sequence
  Synthetic
aaacttaggacctcaaggttcacaactgttggcatatcactgagacacaggcaactctttacccaccacatgtcc

SEQ ID NO: 90523 - DNA, 75 bp, Artificial Sequence
  Synthetic
gcgggaaataatattacgtcagggagtaacaatcactcaatgcatagccaaggaccaagtcctcttatttcaagt

SEQ ID NO: 90524 - DNA, 75 bp, Artificial Sequence
  Synthetic
gcgggaaataatattacgtcagggagtaacaatcactcaatgcatagcctaggaccaagtcctcttatttcaagt

SEQ ID NO: 90525 - DNA, 75 bp, Artificial Sequence
  Synthetic
gcgggaaataatattacgtcagggagtaacaatcactcaatgcatagcccaggaccaagtcctcttatttcaagt

SEQ ID NO: 90526 - DNA, 75 bp, Artificial Sequence
  Synthetic
gcgggaaataatattacgtcagggagtaacaatcactcaatgcatagccgaggaccaagtcctcttatttcaagt

SEQ ID NO: 90527 - DNA, 75 bp, Artificial Sequence
  Synthetic
aggaccaagtcctcttatttcaagtgttaacgggaatatcgaaggacctactggattcgatcattcaggactatg

SEQ ID NO: 90528 - DNA, 75 bp, Artificial Sequence
  Synthetic
ggatccagagggtaacctctgcatgttattcgaaagcgatgatgatgaaaaccattattcagagattaatggccg

SEQ ID NO: 90529 - DNA, 75 bp, Artificial Sequence
  Synthetic
gtcttccgctatcgaaagattggatgaacaggataatgagaactcaattgttaaacaatcaggaaatcagtgtac

SEQ ID NO: 90530 - DNA, 75 bp, Artificial Sequence
  Synthetic
ttaaacaatcaggaaatcagtgtactgagggagtgtctgaggctgattcaccttctagttcccaggaaactacac

SEQ ID NO: 90531 - DNA, 75 bp, Artificial Sequence
  Synthetic
tatctgttgggggatctaatatatctgggacaggaatatcaacctgtgcctctttggatataactgtgaatgaac

SEQ ID NO: 90532 - DNA, 75 bp, Artificial Sequence
  Synthetic
tcgaggatgcgactgtaagaaacagcgacaatatgaagggaaactggccaattccgaaattacttgttaagccgc

SEQ ID NO: 90533 - DNA, 75 bp, Artificial Sequence
  Synthetic
attccgaaattacttgttaagccgccacctagagcaaaatctagccttgatcacagcaatccattaaaaggggcc

SEQ ID NO: 90534 - DNA, 75 bp, Artificial Sequence
  Synthetic
acaggagggaaattagtctcacctgggatggagactacattattcgagaagagtggtgcaaccctatctgtacac

SEQ ID NO: 90535 - DNA, 75 bp, Artificial Sequence
  Synthetic
ccatctactcaacctgcaagcgacttcaatgtagatgcaagcaatgtccatcaacctgtccaaagtgtgaataat

SEQ ID NO: 90536 - DNA, 75 bp, Artificial Sequence
  Synthetic
gattacagaaacagtgaggtaatagggctcaactcacataaagatattgaggataagtctgggatatccattcag

SEQ ID NO: 90537 - DNA, 75 bp, Artificial Sequence
  Synthetic
ggctcaactcacataaagatattgaggataagtctgggatatccattcaggatgtatataacttgattcttggat

SEQ ID NO: 90538 - DNA, 75 bp, Artificial Sequence
  Synthetic
aaaagagtagtgctaaagtacaattggcgttatcaactattgagggacatctatctagtgttatgattgctatcc

SEQ ID NO: 90539 - DNA, 75 bp, Artificial Sequence
  Synthetic
ctggttcaggtattgattctactggggatgagaaaaaggatcagatgaattccgacttaaaaccattattaggga

SEQ ID NO: 90540 - DNA, 75 bp, Artificial Sequence
  Synthetic
gggatcattgtagagcatttcgagaagttactaatcctctagatgagtcattactagccaattctccaacaaaac

SEQ ID NO: 90541 - DNA, 75 bp, Artificial Sequence
  Synthetic
ttactagccaattctccaacaaaacatgttgccaaagtagacaagaactgcactctccagaaaatcaacaagaat

SEQ ID NO: 90542 - DNA, 75 bp, Artificial Sequence
  Synthetic
ccaatgatagtcatgcaagcacatcaaccatcagatcaattatcaggtcatctaatctcgatcaagatttgaaaa

SEQ ID NO: 90543 - DNA, 75 bp, Artificial Sequence
  Synthetic
caaaattgctcacaattctatcccaaattaaagggacagagaatgttaaagaattctatgagaaggtcatgatat

SEQ ID NO: 90544 - DNA, 75 bp, Artificial Sequence
  Synthetic
tgataaagaataagaactaaatattactaatctacatgcactatgagttgtaattgtcttcagaagaatttaggc

SEQ ID NO: 90545 - DNA, 75 bp, Artificial Sequence
  Synthetic
gatttcatgtatactgttattgatttatgataattataaaaaacttaggagctaaaggttactcagtcatataca

SEQ ID NO: 90546 - DNA, 75 bp, Artificial Sequence
  Synthetic
atatgactgagatcttcaatcttgatgagagctcatggtcaattaaaggaacacttgagccgctgacacctgata

SEQ ID NO: 90547 - DNA, 75 bp, Artificial Sequence
  Synthetic
cctatcctgatgggagacttgtgcccaaagttcgggttatcgacccgggtttaggagatcgtaagagtggaggat

SEQ ID NO: 90548 - DNA, 75 bp, Artificial Sequence
  Synthetic
atatgtatctacttctccatggtgtcatagaagatagtgagactatgattagtccaaaggggagagcatttgggg

SEQ ID NO: 90549 - DNA, 75 bp, Artificial Sequence
  Synthetic
cattcccattaggggtgggacaatcaactgaaaacccggaagatttgtttaaggaaatattaactctcaatattg

SEQ ID NO: 90550 - DNA, 75 bp, Artificial Sequence
  Synthetic
tgactcgtagaactgctggatttaatgagaaattagtttattataacaccacacctctacatttattgaccccct

SEQ ID NO: 90551 - DNA, 75 bp, Artificial Sequence
  Synthetic
tgagaaattagtttattataacaccacacctctacatttattgaccccctggaaaaaggtgttggcatatggaag

SEQ ID NO: 90552 - DNA, 75 bp, Artificial Sequence
  Synthetic
gaattctgttgcattcaacatccttgtacatctatcaatgggcacaaatttacttgaccaatccaaagaccatcg

SEQ ID NO: 90553 - DNA, 75 bp, Artificial Sequence
  Synthetic
attaggaaatactgcagaaactttgattacatttatgattcacattggaaacttcaaacggaagagtaacaaatc

SEQ ID NO: 90554 - DNA, 75 bp, Artificial Sequence
  Synthetic
ttattcacctgaatactgcaagaggaaaataataaggcttggtttgatattttcattaggggcaattggtggtac

SEQ ID NO: 90555 - DNA, 75 bp, Artificial Sequence
  Synthetic
aagcctacatattagatgcacaggtaagatgagcaaacggctacaggcctacttaggattcaaaaggaccttatg

SEQ ID NO: 90556 - DNA, 75 bp, Artificial Sequence
  Synthetic
tgagagtcagttaagagaaatcaataagtgtattgtattgaagtatattgtatatctgctcttttattcaaactc

SEQ ID NO: 90557 - DNA, 75 bp, Artificial Sequence
  Synthetic
ttatcctctgatgtatgtgaatgaagggctgaataaaaccctgtggagaaatgaatgtagaatagagaaggttca

SEQ ID NO: 90558 - DNA, 75 bp, Artificial Sequence
  Synthetic
agcagtcttacagccatcagtcccaaatgaatttaagatatatgatgatgtcattattgacaataccaatggtct

SEQ ID NO: 90559 - DNA, 75 bp, Artificial Sequence
  Synthetic
tttcaagattaaataggttataaccgtaataaatagctactaaatgatattatatatttaagtgtacactgataa

SEQ ID NO: 90560 - DNA, 75 bp, Artificial Sequence
  Synthetic
ttgtgaataaaatacactggattaataacaatatagaattgaaatccaattgatacgcgggttagtacttaagca

SEQ ID NO: 90561 - DNA, 75 bp, Artificial Sequence
  Synthetic
taattaatcacatatgaaggttgggtacggttattcattttttaaggggtaagataagacttgatatatgataac

SEQ ID NO: 90562 - DNA, 75 bp, Artificial Sequence
  Synthetic
tctatttgctctattgattatctatactttgagttatttaatatcagagtatcaagatataatcagtttaaagtt

SEQ ID NO: 90563 - DNA, 75 bp, Artificial Sequence
  Synthetic
gttggattaacgcttaattcttagaactaaaatacacagattgttgaacttataatcttgttagattcattcaag

SEQ ID NO: 90564 - DNA, 75 bp, Artificial Sequence
  Synthetic
ttgaatttctgtaatgtttaccaattatcattcgagcaattataaaaaactaaggacctaatgtaacaggaatcc

SEQ ID NO: 90565 - DNA, 75 bp, Artificial Sequence
  Synthetic
aaattccatccagtgggccaaaaatcgctatacttaaatatcggtttaactagggcctgtctaactcaaaacaaa

SEQ ID NO: 90566 - DNA, 75 bp, Artificial Sequence
  Synthetic
cccactctaattagttcttatttaagagttaaattatagatgtttacacgttatataatggaaaccatcaatgct

SEQ ID NO: 90567 - DNA, 75 bp, Artificial Sequence
  Synthetic
gctcacaaccagaatccagacgagtgggttaaatctgaataactattaagaattgagatttaaaattgattcttt

SEQ ID NO: 90568 - DNA, 75 bp, Artificial Sequence
  Synthetic
cttaactttagagtttaagtaatatatcatcaattcagtactatgaacagaattaaggttataataattagttct

SEQ ID NO: 90569 - DNA, 75 bp, Artificial Sequence
  Synthetic
gctattgttggtaactataggcattgtattagataatgtttatttcttacaaatgtgcaatctcatacatcggac

SEQ ID NO: 90570 - DNA, 75 bp, Artificial Sequence
  Synthetic
ttatttttatcagatattacgattgcgcatataggctgggataatttaacttcgattggggttataagtactaag

SEQ ID NO: 90571 - DNA, 75 bp, Artificial Sequence
  Synthetic
ctcatacatcggacccctcagcctcccccttatagttgcgtaattgaaaaaacacaaaaaataatcagaaagttg

SEQ ID NO: 90572 - DNA, 75 bp, Artificial Sequence
  Synthetic
cagtacaactataaaatcactactctaaatgctaatcagttgatggtcataaagatggttcccaatatatcatca

SEQ ID NO: 90573 - DNA, 75 bp, Artificial Sequence
  Synthetic
agggatcattagaccaataaatgagtcattaaaattaatgaactcatacattaacatgaaagtaggttcagaaag

SEQ ID NO: 90574 - DNA, 75 bp, Artificial Sequence
  Synthetic
acataattcaattatgaacaaaaagcagatactagaattaaagaaagctcttattactaccaataaggcaattga

SEQ ID NO: 90575 - DNA, 75 bp, Artificial Sequence
  Synthetic
cagatactagaattaaagaaagctcttattactaccaataaggcaattgatgaaataaggattgcaggtgaacga

SEQ ID NO: 90576 - DNA, 75 bp, Artificial Sequence
  Synthetic
gatattttatcatcacagctttccattgccttactcagatattatacaaatatattaactatttttggaccaagt

SEQ ID NO: 90577 - DNA, 75 bp, Artificial Sequence
  Synthetic
atacgtgaccctatcactagcacaatttcggtacaagcactcagtcaagcattcaatggtaatcttcaggcacta

SEQ ID NO: 90578 - DNA, 75 bp, Artificial Sequence
  Synthetic
cttgacggactaggatatactgggagagacctacatgaccttctagagagtaaatctatcactggccagataatt

SEQ ID NO: 90579 - DNA, 75 bp, Artificial Sequence
  Synthetic
catgcagatatgactgatttgttccttgttctgaggattaattatccttccataactgagatgcagggagtaaca

SEQ ID NO: 90580 - DNA, 75 bp, Artificial Sequence
  Synthetic
atatatgagctaaattcaattacatatcatattgggccagaagagtggtataccattatgcctgattttatagct

SEQ ID NO: 90581 - DNA, 75 bp, Artificial Sequence
  Synthetic
gttcagggttttttagtatctaattttgatgaaagaaagtgctcaataactaaatcaagtatattatgccaacaa

SEQ ID NO: 90582 - DNA, 75 bp, Artificial Sequence
  Synthetic
aattcaatttacccgatgtcaacagagatgcaaagatgtatcaagggtgagataaaattttgtccaagatctaag

SEQ ID NO: 90583 - DNA, 75 bp, Artificial Sequence
  Synthetic
gcaattggaactttagttaatcggtttatattgaccaaaggtaatttaatggctaattgtttggggattatatgc

SEQ ID NO: 90584 - DNA, 75 bp, Artificial Sequence
  Synthetic
ggctaattgtttggggattatatgcagatgttatacttcaggccaagttataacacaagaccctagtaaattaat

SEQ ID NO: 90585 - DNA, 75 bp, Artificial Sequence
  Synthetic
tacaataatatcacaagaggagtgcaaagaagtcggtgttgatggtattcgtattatggtaggacctagaaaatt

SEQ ID NO: 90586 - DNA, 75 bp, Artificial Sequence
  Synthetic
tttagcaattgcttcagctaaacttaataattctaaggcattgttagagcaatcagataagattctggattcaat

SEQ ID NO: 90587 - DNA, 75 bp, Artificial Sequence
  Synthetic
gtctaagttggattctattaattcaaaaattataggattaatcttagcaattatgataatctttataattatcat

SEQ ID NO: 90588 - DNA, 75 bp, Artificial Sequence
  Synthetic
tactattatctggatcatatataaaaaatgcagaaataaatacaataaattcagtacttcaattgaaccgctcta

SEQ ID NO: 90589 - DNA, 75 bp, Artificial Sequence
  Synthetic
catacccccttcttataattcacctcatagtgtggttaagtctatttgagtactgaccatatgatttactgtaat

SEQ ID NO: 90590 - DNA, 75 bp, Artificial Sequence
  Synthetic
aagtccaatgaaagtatcaactgataatactggtagtataatgaatcttgattatataacatattctcttaaact

SEQ ID NO: 90591 - DNA, 75 bp, Artificial Sequence
  Synthetic
agataatgataatgagctatagatgattgcaatcattttaatgtaattatgtattgatttgattacctggtataa

SEQ ID NO: 90592 - DNA, 75 bp, Artificial Sequence
  Synthetic
ttctttatacagttgaataatgtgtcatcaattaagagcttaatagtgttatttttatatacttatactggtgga

SEQ ID NO: 90593 - DNA, 75 bp, Artificial Sequence
  Synthetic
taggtgtgttatatttgtaatcaaaggttttagtatttagaagaggaaagagtttaattcaactgtttaattggt

SEQ ID NO: 90594 - DNA, 75 bp, Artificial Sequence
  Synthetic
cattgtgtattcaattagaaaaaaccttaggaacccatgttaataaaacttcattatcatggagtccaacaatat

SEQ ID NO: 90595 - DNA, 75 bp, Artificial Sequence
  Synthetic
taaatattacaaggattctaaccggtaccttggtaaaatattagatgaacacaaaacaattaatagtcaattgta

SEQ ID NO: 90596 - DNA, 75 bp, Artificial Sequence
  Synthetic
cagtttgagtattaaagtaattaccattattgctataattgtaagtctgattgcaacaataataactattattaa

SEQ ID NO: 90597 - DNA, 75 bp, Artificial Sequence
  Synthetic
tgccacaagtggaagaactaccctaaacagtaatacagatatactgcttagccaaagagatgagattcataatat

SEQ ID NO: 90598 - DNA, 75 bp, Artificial Sequence
  Synthetic
ccaagaaatgatatttgatcgtatctatcctttgataaatgctatgagtacagagctaggacttcatattcctac

SEQ ID NO: 90599 - DNA, 75 bp, Artificial Sequence
  Synthetic
cttattggatgaacttactaaagcgattgaccaaaagatcaaaataatgaatcctcctttggacgctgtgacgtc

SEQ ID NO: 90600 - DNA, 75 bp, Artificial Sequence
  Synthetic
tgatcttagttggtgcatcaaaccccctgatggaattattatagacccaaaaggttactgtgagggtatggaatt

SEQ ID NO: 90601 - DNA, 75 bp, Artificial Sequence
  Synthetic
cctgatggaattattatagacccaaaaggttactgtgagggtatggaattgtctaaaacttatgaattattactt

SEQ ID NO: 90602 - DNA, 75 bp, Artificial Sequence
  Synthetic
gaccaattagatgtcttaaggaagaaatcactcattataaatagaaagaatattaaccagtgtcaattagttgat

SEQ ID NO: 90603 - DNA, 75 bp, Artificial Sequence
  Synthetic
gattcaaaggtcatttttgctactatcaacatacaatctacaccaaggtttttaaattttggtcatacagttagc

SEQ ID NO: 90604 - DNA, 75 bp, Artificial Sequence
  Synthetic
aatcaacgtataacatttggtcaaggaacatatagtagcacttatgttataactatccaagaagatggaataact

SEQ ID NO: 90605 - DNA, 75 bp, Artificial Sequence
  Synthetic
tcgggtatatctctgatcagtttggtgttttcccctccttaatagtatctagagtgttgcctatacgcatgctat

SEQ ID NO: 90606 - DNA, 75 bp, Artificial Sequence
  Synthetic
agagtgttgcctatacgcatgctattaggaatggaatcctgtaccttgacaagtgacagactaggtggatatttc

SEQ ID NO: 90607 - DNA, 75 bp, Artificial Sequence
  Synthetic
ttatgtatgaatacactgacacgatctatatatgattatgttagcataagggatttgaagtcactatatataaca

SEQ ID NO: 90608 - DNA, 75 bp, Artificial Sequence
  Synthetic
ctccctcattatggtaaagttaattatacttactttaattttggaaagatcaggagcccacatgaaatagataaa

SEQ ID NO: 90609 - DNA, 75 bp, Artificial Sequence
  Synthetic
caggagcccacatgaaatagataaaatttggttaacatctgagaggggccagattatttctggttactttgcagc

SEQ ID NO: 90610 - DNA, 75 bp, Artificial Sequence
  Synthetic
tgagaattactgtagaggatggtataaaaacataacaggtactgatgatgttccgatattagcatacttattagt

SEQ ID NO: 90611 - DNA, 75 bp, Artificial Sequence
  Synthetic
cgaaatgtatgacgaagaaggacctttaattacacttgtagcgataccaccttacaattatacagctccatctca

SEQ ID NO: 90612 - DNA, 75 bp, Artificial Sequence
  Synthetic
taattctctctactatgatgataaaattaataaattgataatgactacatctcacataggtcatattcaaatcaa

SEQ ID NO: 90613 - DNA, 75 bp, Artificial Sequence
  Synthetic
tgaggtgcatgaggtgattgttggtgataatttaaaggctatcctcctaaacagattatctgatgaacatcctaa

SEQ ID NO: 90614 - DNA, 75 bp, Artificial Sequence
  Synthetic
gataatttaaaggctatcctcctaaacagattatctgatgaacatcctaatcttaccgcctgtagactcaatcag

SEQ ID NO: 90615 - DNA, 75 bp, Artificial Sequence
  Synthetic
acagattatctgatgaacatcctaatcttaccgcctgtagactcaatcagggcatcaaggagcagtacaagtctg

SEQ ID NO: 90616 - DNA, 75 bp, Artificial Sequence
  Synthetic
atggaacaataatttcaaattctgcacttattgatatacaagaacggatgtatattacaattaaagctgttccac

SEQ ID NO: 90617 - DNA, 75 bp, Artificial Sequence
  Synthetic
cagtgggtaactacaattttacagttgaattgcattctggatcaaatacatcctatgtgttgttgccaaaacagt

SEQ ID NO: 90618 - DNA, 75 bp, Artificial Sequence
  Synthetic
ttaatgccaaatacgacaaattacatcttgagtgctttagctgggacaagtcttggtggtgtgccttgatacctc

SEQ ID NO: 90619 - DNA, 75 bp, Artificial Sequence
  Synthetic
agttttcattaagttggaatgaatcccttcctgttgatactgctatttttaaattgataagttgtaagtgaatct

SEQ ID NO: 90620 - DNA, 75 bp, Artificial Sequence
  Synthetic
atcaactgatagttgacagttgtcaaaacatcagttaattgaggtttaggagataaaaaaatgaaattattaaga

SEQ ID NO: 90621 - DNA, 75 bp, Artificial Sequence
  Synthetic
tttaattagatatatattcaaaccaaattacaaaaaacttaggagtcagagacttcgttgtaatggagcagtcag

SEQ ID NO: 90622 - DNA, 75 bp, Artificial Sequence
  Synthetic
actaccaagatattctatatccggaagtacatcttaacagtcctatagtaatttccaaattagtaggtattttag

SEQ ID NO: 90623 - DNA, 75 bp, Artificial Sequence
  Synthetic
aatatgcccaaattgctcacaatcaacaattgtcagaccatacaattatcaagaatattcaatttagattaagaa

SEQ ID NO: 90624 - DNA, 75 bp, Artificial Sequence
  Synthetic
atggatttaatagtccaaggatacagacactttcaactatgggtgaaatcatcaacaaaattaaaagcaaacatc

SEQ ID NO: 90625 - DNA, 75 bp, Artificial Sequence
  Synthetic
ctaattatttacacataccttaccccgaatgcaaccaaaaactatttcgaatagtggatccagaactgacatcaa

SEQ ID NO: 90626 - DNA, 75 bp, Artificial Sequence
  Synthetic
cgaatgcaaccaaaaactatttcgaatagtggatccagaactgacatcaaaattagaatcacttctaaacaaagg

SEQ ID NO: 90627 - DNA, 75 bp, Artificial Sequence
  Synthetic
gaatgatcttcttaatgacaatagtcaattgatcctggatcttcctttgattatcaaaggatctcagtggttctt

SEQ ID NO: 90628 - DNA, 75 bp, Artificial Sequence
  Synthetic
cccgtttttattctggttttcgattaaaactgagactagaagctgtattcgccaaaatcaaaagactcgtgttag

SEQ ID NO: 90629 - DNA, 75 bp, Artificial Sequence
  Synthetic
gttacaatatcggcctcacttatcagagactaagagaattacattggttgtgacatctgatctcattacaatatt

SEQ ID NO: 90630 - DNA, 75 bp, Artificial Sequence
  Synthetic
tgatcatattaataaatgtatattctacctgacttttgagatgttgttaatgtattgcgatgtgatagaaggtag

SEQ ID NO: 90631 - DNA, 75 bp, Artificial Sequence
  Synthetic
attaatgactgaaacagctatgagtttggactgtcgatttatcaatctattgccaagagtgcaatatatgtggga

SEQ ID NO: 90632 - DNA, 75 bp, Artificial Sequence
  Synthetic
tctgctagatggaatgtttgaaagtttaggcaatcaattatattcagttattgcattgttagagcctctttctct

SEQ ID NO: 90633 - DNA, 75 bp, Artificial Sequence
  Synthetic
ttgcattgttagagcctctttctcttgcttatttgcaattgatagatgcagatccacagattcgaggaacgttct

SEQ ID NO: 90634 - DNA, 75 bp, Artificial Sequence
  Synthetic
tttgatccttttgtgtatgaaaatttaattaatggactcgattatatttatttgacagatgatattcatttaact

SEQ ID NO: 90635 - DNA, 75 bp, Artificial Sequence
  Synthetic
gcagaagttttttctttttttaggagctttggtcatccttttttagaagcacaaaatgctgctaacaatgttagg

SEQ ID NO: 90636 - DNA, 75 bp, Artificial Sequence
  Synthetic
aagtatatgaataagcctaaggtgatctcataccggactttaatgcaaggacatgcgattttttgtggtattata

SEQ ID NO: 90637 - DNA, 75 bp, Artificial Sequence
  Synthetic
tctcataccggactttaatgcaaggacatgcgattttttgtggtattataataaatggatttagagatcgtcatg

SEQ ID NO: 90638 - DNA, 75 bp, Artificial Sequence
  Synthetic
accaaatcatgcatctgctgtaattagaaatgcccagctatctggggaagggttaacatctgaacaatgtgctca

SEQ ID NO: 90639 - DNA, 75 bp, Artificial Sequence
  Synthetic
acattggagatccttttgtggatttaaatttaaatgttttatgccactaagtctagatagtgaccttacaatgta

SEQ ID NO: 90640 - DNA, 75 bp, Artificial Sequence
  Synthetic
tcttcgggacaaggcgttatcacctgtcagaaatgagtgggattccgtttatgctaaggaatatttaagatataa

SEQ ID NO: 90641 - DNA, 75 bp, Artificial Sequence
  Synthetic
tccaggattgcctacaagctctagaagattagtgaatgtattcttggaagatgataagtttgatccatatgagat

SEQ ID NO: 90642 - DNA, 75 bp, Artificial Sequence
  Synthetic
agattagtgaatgtattcttggaagatgataagtttgatccatatgagatgatcatgtatgtgattaatggtgat

SEQ ID NO: 90643 - DNA, 75 bp, Artificial Sequence
  Synthetic
tacttaagagacaaagagtttaacctttcatacagtcttaaagagaaagagatcaaagaggtaggtcgattgttc

SEQ ID NO: 90644 - DNA, 75 bp, Artificial Sequence
  Synthetic
gctaaaatgacttacaaaatgagggcttgccaagtgatagctgaaaacctgattgccaatggagtagggaagttt

SEQ ID NO: 90645 - DNA, 75 bp, Artificial Sequence
  Synthetic
ttcagggataatggtatggcaaaagatgaacataaattaactaaaacattacacaaattagccatttcaggtgta

SEQ ID NO: 90646 - DNA, 75 bp, Artificial Sequence
  Synthetic
cctaaggataattctcaactttacttagatgaatgctgggaacaaatagttcgacaatgttcaagcagcacacag

SEQ ID NO: 90647 - DNA, 75 bp, Artificial Sequence
  Synthetic
ataggagaacagaccatgaatccacaatcgaagaagaaaattgaatcaaagtcttttaggtcacatctaaataat

SEQ ID NO: 90648 - DNA, 75 bp, Artificial Sequence
  Synthetic
agggatattttaaggggcaagagagatttggacaaacaaataaagtacccttcaaacaccgagtattatgagact

SEQ ID NO: 90649 - DNA, 75 bp, Artificial Sequence
  Synthetic
ttcaaacaccgagtattatgagactattagtagtttcataactactgacctcaaaaagtattgtcttaattggcg

SEQ ID NO: 90650 - DNA, 75 bp, Artificial Sequence
  Synthetic
caaaattttggagaaatctgttttatacgttagtgacccgtctagtccacctgacttcgatcaacatatcgatat

SEQ ID NO: 90651 - DNA, 75 bp, Artificial Sequence
  Synthetic
tacgttagtgacccgtctagtccacctgacttcgatcaacatatcgatatagaatcagttccaaatgaccatatt

SEQ ID NO: 90652 - DNA, 75 bp, Artificial Sequence
  Synthetic
tatttagcagcttttgatacaggggttagaatctcatcattagttcagggcgataatcaggcaattgcagtgacc

SEQ ID NO: 90653 - DNA, 75 bp, Artificial Sequence
  Synthetic
aaaagagtcccgtcatcttggagttactcaaagaaaaaggaagaatcaactaaaataacaacacaatatttcctt

SEQ ID NO: 90654 - DNA, 75 bp, Artificial Sequence
  Synthetic
aacttaagacaacgcttacacgacataggtcatgaattaaaagcaaatgagaccattatatcctctcatttcttt

SEQ ID NO: 90655 - DNA, 75 bp, Artificial Sequence
  Synthetic
gtttactctaaaggtatttattacgatggaatacttctctcccaagcacttaaaagtattgcgagatgtgtcttc

SEQ ID NO: 90656 - DNA, 75 bp, Artificial Sequence
  Synthetic
tggtctgaaacaattgttgatgagactagatcagcttgcagtaatatatctacgacactcgcaaaggcaattgaa

SEQ ID NO: 90657 - DNA, 75 bp, Artificial Sequence
  Synthetic
tacgacactcgcaaaggcaattgaaaggggttatgataaatttgtggcgtatgccatcaatatttataagacaat

SEQ ID NO: 90658 - DNA, 75 bp, Artificial Sequence
  Synthetic
acatcaagttttgattgcattatcctttacgattaatcctactatgacaccagacatcacagaacctttctacaa

SEQ ID NO: 90659 - DNA, 75 bp, Artificial Sequence
  Synthetic
gagtctggacctgcttaaaaatctagttctaattcctgcaccattgggaggtatgaattacatgaacatgagcag

SEQ ID NO: 90660 - DNA, 75 bp, Artificial Sequence
  Synthetic
gttctaattcctgcaccattgggaggtatgaattacatgaacatgagcagattatttgttagaaatatcggagac

SEQ ID NO: 90661 - DNA, 75 bp, Artificial Sequence
  Synthetic
cccattactgcttcatttgctgatataaagcgcatgatcgaatgtgggttattaggaggtagcattctgtcacaa

SEQ ID NO: 90662 - DNA, 75 bp, Artificial Sequence
  Synthetic
aaaatgtaacggcaagatatgtacttatgcatagccccaaccctatgcttaaagatttgtttcatgaaaagtcac

SEQ ID NO: 90663 - DNA, 75 bp, Artificial Sequence
  Synthetic
atcacttgttttaaaattatcaacatatgattaccaacagtttagaacatgtcttgaatggctttatgctcctat

SEQ ID NO: 90664 - DNA, 75 bp, Artificial Sequence
  Synthetic
cacaggaattgctgtaagtgttgattcttgctctgtatttttagctaagaccatccgaaagagaatgtgggttca

SEQ ID NO: 90665 - DNA, 75 bp, Artificial Sequence
  Synthetic
tctaactaaaggaagggagatttacgggttggaagtacctgacattttggaatgcatgcaaaacaatataattgt

SEQ ID NO: 90666 - DNA, 75 bp, Artificial Sequence
  Synthetic
cgatcacgaggattgttactcatgtattcaaggatcaagatattatacatggttttttgtaccttcaaattgtca

SEQ ID NO: 90667 - DNA, 75 bp, Artificial Sequence
  Synthetic
acttgatcagataaataagtcaacaaattccctcagagtaccctatgttggatcaacaactgaagaaaggagtga

SEQ ID NO: 90668 - DNA, 75 bp, Artificial Sequence
  Synthetic
tatgaagttgtcatatgtaaggtcaccaagtcgaccacttaaagcagcggtccgaattgcagcagtatatacgtg

SEQ ID NO: 90669 - DNA, 75 bp, Artificial Sequence
  Synthetic
ggcttatggtgatgatgatttatcttggcaggaggcctggtatttggcaaggactagggcaaatattacatttga

SEQ ID NO: 90670 - DNA, 75 bp, Artificial Sequence
  Synthetic
tgaactcaaattaataacacctatagccacatctactaatttggcacatagattgagagatagaagcactcaagt

SEQ ID NO: 90671 - DNA, 75 bp, Artificial Sequence
  Synthetic
taaatattcgggaacttccttagtaagagtggcacgctatacaacaatatccaatgataacatgtcgttcattat

SEQ ID NO: 90672 - DNA, 75 bp, Artificial Sequence
  Synthetic
taacaacaagaaagtcgatactaattttgtttaccagcaaggaatgttattaggcctgagtatactagaatacat

SEQ ID NO: 90673 - DNA, 75 bp, Artificial Sequence
  Synthetic
caatcaaacactgtaattcacttacatgcagatgttaattgttgtatagtacagatgactgatcagccttataca

SEQ ID NO: 90674 - DNA, 75 bp, Artificial Sequence
  Synthetic
ccaagtctaactaagaagctacctgatattaaacccattaataataaattgatctacgatccggcccctgtaatt

SEQ ID NO: 90675 - DNA, 75 bp, Artificial Sequence
  Synthetic
atattaaacccattaataataaattgatctacgatccggcccctgtaattgatactgatgcagctaggttgtatt

SEQ ID NO: 90676 - DNA, 75 bp, Artificial Sequence
  Synthetic
cccaaaaatatctgtcacatctaatagatttcccaagttggtcaactactcagcttaacacagtgttggcaaaag

SEQ ID NO: 90677 - DNA, 75 bp, Artificial Sequence
  Synthetic
tggtggcagtatccattgtagaattaataacaaaagcgagtaaagaccatcttaatgagatcatagcagtcgttg

SEQ ID NO: 90678 - DNA, 75 bp, Artificial Sequence
  Synthetic
gtgatgatgatatcaatagctttattacggagtttctacttgttgatccacgtctgtttacactatacttaggtc

SEQ ID NO: 90679 - DNA, 75 bp, Artificial Sequence
  Synthetic
aatatacatcattacagtgggcatacgaagtccattatcatagaccagtgggtaagtaccagatggccgaagtgc

SEQ ID NO: 90680 - DNA, 75 bp, Artificial Sequence
  Synthetic
tacataatctgctgtcacgagctagtagaggtatatttagcatattgaccaatgcctttagccaccccagagtct

SEQ ID NO: 90681 - DNA, 75 bp, Artificial Sequence
  Synthetic
ataaaagattctgggaatgtggtttattagagcctatttatggaccttatataggaagtcaaaatctacataatg

SEQ ID NO: 90682 - DNA, 75 bp, Artificial Sequence
  Synthetic
cagtgattgattatatatataatgcatatattacttatttggatgcttatttatctgatcaagtagatgatactg

SEQ ID NO: 90683 - DNA, 75 bp, Artificial Sequence
  Synthetic
atattataatatgtgaaacagaagagacatgtttagcaaatagaattgacaattatcaaagcagacacctagccg

SEQ ID NO: 90684 - DNA, 75 bp, Artificial Sequence
  Synthetic
tactcatagacttgtactgtgattccactagatgccccaatataaaggggtcagatacgattatgagaaattcta

SEQ ID NO: 90685 - DNA, 75 bp, Artificial Sequence
  Synthetic
ttcttagatcttttattgataatgagagaaaaacaaatccacttggtttgacatggagcctcgatcctttacttg

SEQ ID NO: 90686 - DNA, 75 bp, Artificial Sequence
  Synthetic
tggatcactttagctgttctatcacatatctaaggagaggtattattaaacagatgaggttaagatttgatccaa

SEQ ID NO: 90687 - DNA, 75 bp, Artificial Sequence
  Synthetic
gcgtatcccttgaactatctagaatgattaaacctgatgtgatttatcaagcacctaaagttccgtcttcatggg

SEQ ID NO: 90688 - DNA, 75 bp, Artificial Sequence
  Synthetic
ctcttatagatatcaatcccgaagtaaatgaccttaatacaatttttggagaactgaatagcaagtggaaagaca

SEQ ID NO: 90689 - DNA, 75 bp, Artificial Sequence
  Synthetic
tccctattggacaaatcagaattcagaattatgaaatacatgcatatagaaggattggggttaattcaactgcat

SEQ ID NO: 90690 - DNA, 75 bp, Artificial Sequence
  Synthetic
gttataaggctttagaactattatctgttttaaatcggtttatgtctaacccatcaggtgcattgtttttaggtg

SEQ ID NO: 90691 - DNA, 75 bp, Artificial Sequence
  Synthetic
agggggcaggatcaatgttggtcacatatcgtgcttttgttccatttaagacaatttattataatagtggtattt

SEQ ID NO: 90692 - DNA, 75 bp, Artificial Sequence
  Synthetic
cagttcaaaatgttcagggccagagagaattaagtctatatccatccgaagtggcactagttgataacaaacatc

SEQ ID NO: 90693 - DNA, 75 bp, Artificial Sequence
  Synthetic
gtggcactagttgataacaaacatcgcttgggtaatgaccctaatatcaaggtcttgtttaatggtaaaccagag

SEQ ID NO: 90694 - DNA, 75 bp, Artificial Sequence
  Synthetic
catagtgatattgagtccagcttgagcaagacaaaaaataaaattcttgaggagctgtgccacattttatcaatg

SEQ ID NO: 90695 - DNA, 75 bp, Artificial Sequence
  Synthetic
gcactcattttgggaaaagtcggatctttatttgttgtgaagttgctaccaagggtcggtgattatacgtattca

SEQ ID NO: 90696 - DNA, 75 bp, Artificial Sequence
  Synthetic
ttttgcagatatgcatcagaattctatcaacaaaactttcttgttttacctagatttagtaacatgtcatcatct

SEQ ID NO: 90697 - DNA, 75 bp, Artificial Sequence
  Synthetic
gaggtttactatataggaattcaccttaatacaaatcgactgattgatcctgatagaatagtacaatacataatt

SEQ ID NO: 90698 - DNA, 75 bp, Artificial Sequence
  Synthetic
tgatagaatagtacaatacataattagaaatttacaacctactccagttacatttttatcctatatatttgaaac

SEQ ID NO: 90699 - DNA, 75 bp, Artificial Sequence
  Synthetic
aattacaaaaatagagagtgttcttctgtcatgtgggttagaattgaatggacctaagattatacagcaattatc

SEQ ID NO: 90700 - DNA, 75 bp, Artificial Sequence
  Synthetic
aggacatgattatgccaatggggagactagtctggaatcaagtataatgatattagttagagaatatcttaatgc

SEQ ID NO: 90701 - DNA, 75 bp, Artificial Sequence
  Synthetic
agctatacaaggacgggaaacattaggcttgttttcaccttacccggtcctacatgagagtcagttaagagaaat

SEQ ID NO: 90702 - DNA, 75 bp, Artificial Sequence
  Synthetic
caataagtgtattgcattgaagtatattgtatatctgctcttttattcaaactctacatcaccgagtaaacaaat

SEQ ID NO: 90703 - DNA, 75 bp, Artificial Sequence
  Synthetic
aatgagtaatcttagaaaaggaatattgatgtatgatttgagagatgaattttttatatcaagattgtcagcaaa

SEQ ID NO: 90704 - DNA, 75 bp, Artificial Sequence
  Synthetic
ttacaagaaaaaggtaatgtcacaggaagttaaaaccacctggatatttaatattgatactccaacacgaaaagc

SEQ ID NO: 90705 - DNA, 75 bp, Artificial Sequence
  Synthetic
gttatataagttagtaggttattcattgataattaatcacatatgatgatcgggtatggttattcatctttttaa

SEQ ID NO: 90706 - DNA, 75 bp, Artificial Sequence
  Synthetic
gaataagataagactcgatacatgataattgattaaacattacctctgaattgaaagattgctcaattacatgtt

SEQ ID NO: 90707 - DNA, 75 bp, Artificial Sequence
  Synthetic
ttttgagtagttaagattttattccaattagtacagttagaaaaaacttcaacagttgattgagccttaattcac

SEQ ID NO: 90708 - DNA, 75 bp, Artificial Sequence
  Synthetic
tccatacaagttatacttataatttttaataaaaccttggtttaaaattacaacagtaatactaatttattaagg

SEQ ID NO: 90709 - DNA, 75 bp, Artificial Sequence
  Synthetic
gaatgcaattgatgtccagtgtgaagtttatatttatatgtttttaatcttatacccactataactagttcttat

SEQ ID NO: 90710 - DNA, 75 bp, Artificial Sequence
  Synthetic
ttaagaattaaattatagatgttcacatgttatataatgggaaccatcaatgctgccattgttcgtaactataag

SEQ ID NO: 90711 - DNA, 75 bp, Artificial Sequence
  Synthetic
tattgtatgagataatatttattccttacaaatgtgcaatctcatatgtcggacccctcaccctcccccttatag

SEQ ID NO: 90712 - DNA, 75 bp, Artificial Sequence
  Synthetic
tatgtcggacccctcaccctcccccttatagttgagtaatttaggaaagcacgaaaaataatctaagattaaact

SEQ ID NO: 90713 - DNA, 75 bp, Artificial Sequence
  Synthetic
tattctaacgacaagactattactaaatatttaggaataacgattccattagtgaggcgaggaggaggaatcaga

SEQ ID NO: 90714 - DNA, 75 bp, Artificial Sequence
  Synthetic
cattccacaatgtcgagtctactgaggtcacttgctgcatttaaaagacatagggagcaaccaactgcaccgtca

SEQ ID NO: 90715 - DNA, 75 bp, Artificial Sequence
  Synthetic
ggttcaggtggtacaattaaaggattgaagaatacaattattgttccggttccaggtgatacagtaatcactacg

SEQ ID NO: 90716 - DNA, 75 bp, Artificial Sequence
  Synthetic
aggtctaacttgttatttagattagtttatataataggcaatccagatacacctttaagtacctcaacgggagca

SEQ ID NO: 90717 - DNA, 75 bp, Artificial Sequence
  Synthetic
ataatatcattgttgaccctatttgttgaatctccaggtcaattaatacaaagaattgctgatgaccctgatgca

SEQ ID NO: 90718 - DNA, 75 bp, Artificial Sequence
  Synthetic
gtcttcaaattagtagaagtcattcctgaagttggtaatcctggagaactgacttttgcatctcgaggaattaat

SEQ ID NO: 90719 - DNA, 75 bp, Artificial Sequence
  Synthetic
ttggataagcaagctcaacaatattttaaactggctgagaaaaatgatcaggggtattacgttagcttaggattt

SEQ ID NO: 90720 - DNA, 75 bp, Artificial Sequence
  Synthetic
gaaaacccaccaaatgatgatgatataacatccagtcctgagatatttaattatattctggcatctgtacttgca

SEQ ID NO: 90721 - DNA, 75 bp, Artificial Sequence
  Synthetic
caggtttggatccttctggcaaaagctgtgactgctccagacacagccgccgaagcagaaaaccgcagatggatt

SEQ ID NO: 90722 - DNA, 75 bp, Artificial Sequence
  Synthetic
aagctaatgcagcaacgtagggtggatggtgaactaagattgagcaaaggatggctggatctggtgaggaataaa

SEQ ID NO: 90723 - DNA, 75 bp, Artificial Sequence
  Synthetic
attgcatcggacattacaataagacgattcatggtggcattagttcttgatattaaacgttctcctggaacaaga

SEQ ID NO: 90724 - DNA, 75 bp, Artificial Sequence
  Synthetic
ccaagaatagctgagatgatttgtgatattgataattatattgtagaagcagggcttgcaagctttttattgact

SEQ ID NO: 90725 - DNA, 75 bp, Artificial Sequence
  Synthetic
atcaaatttggtatagaaacacgttacccagcattggcattgcatgaattttctggagaattggctactattgaa

SEQ ID NO: 90726 - DNA, 75 bp, Artificial Sequence
  Synthetic
gggctaatgaaattgtaccaatctatgggggaaatggcaccttacatggtaattctagaaaattcaatccaaacc

SEQ ID NO: 90727 - DNA, 75 bp, Artificial Sequence
  Synthetic
aggtttagtgctgggtcttatcctttgttatggagttacgctatgggtgttggtgtagagcttgaaagatcaatg

SEQ ID NO: 90728 - DNA, 75 bp, Artificial Sequence
  Synthetic
ggtggactcaattttactaggagtttctttgaccctacatatttcagacttggtcaagagatggtgagaagatct

SEQ ID NO: 90729 - DNA, 75 bp, Artificial Sequence
  Synthetic
tcagggatggttaatagttcatttgcaagagaacttggattatctgaacatgagacacaacttgtcagccaaatt

SEQ ID NO: 90730 - DNA, 75 bp, Artificial Sequence
  Synthetic
gttaattcaggaggtgaatctggtatacctaagtttgatggattcagagcaaatccaacaacttttctaggagcc

SEQ ID NO: 90731 - DNA, 75 bp, Artificial Sequence
  Synthetic
aaagacaatataaatgatggaggtgaggaccagtcaaatgcagtatcaggattgtctggaccactgttaccaagt

SEQ ID NO: 90732 - DNA, 75 bp, Artificial Sequence
  Synthetic
aatgacgtgaatctttcaggtgattcgtatggaattgatagtggtatgaaaaatgtcggcgataaacttaatgaa

SEQ ID NO: 90733 - DNA, 75 bp, Artificial Sequence
  Synthetic
agagtaagtccaaaccatgatgtttctagctctgccatggaagaattaaggagattggttgagtctactaataga

SEQ ID NO: 90734 - DNA, 75 bp, Artificial Sequence
  Synthetic
attgacaccaaacagccagagactccaggcgttaccaaccattacaatgatactgaccttctgaaataatatgag

SEQ ID NO: 90735 - DNA, 75 bp, Artificial Sequence
  Synthetic
tatgctctattggattattgtataactcaaattaagaaaaacttaggacctcaaggttcacaactgtcgacagct

SEQ ID NO: 90736 - DNA, 75 bp, Artificial Sequence
  Synthetic
caccaggaaataatcaactcctcacccgccacatgtcctctcaccaaatccaacaagtcagacatggcctcgaat

SEQ ID NO: 90737 - DNA, 75 bp, Artificial Sequence
  Synthetic
ctttacaagagatcaaaaacaaccctccatcttcccaagatatcaatcttgccagggagatttacgaatccatta

SEQ ID NO: 90738 - DNA, 75 bp, Artificial Sequence
  Synthetic
aacaaacaggaacaccttcagtgcaaggaggagccattacgggagataatattacgtcagggggtaacaattaca

SEQ ID NO: 90739 - DNA, 75 bp, Artificial Sequence
  Synthetic
caatgcatagccaaggaccaagtccttctattccaagtgttaacaagaatatcgaaggacttactggattcgatc

SEQ ID NO: 90740 - DNA, 75 bp, Artificial Sequence
  Synthetic
ttctattccaagtgttaacaagaatatcgaaggacttactggattcgatcatccaggattatgggatccagaggg

SEQ ID NO: 90741 - DNA, 75 bp, Artificial Sequence
  Synthetic
taacctctgcatgttattcgaaagcgatgatgatgaaaaccattattcagagattaatggccggccttccactat

SEQ ID NO: 90742 - DNA, 75 bp, Artificial Sequence
  Synthetic
cgaaggattggatgaacaggataataagaacccaagtattgaacaaccaggaaatcaatatactgaaggagtgtc

SEQ ID NO: 90743 - DNA, 75 bp, Artificial Sequence
  Synthetic
taagactgattcatcttctagttcccaagaaattacactacctgttgggggatctgatctacctgggacaggaat

SEQ ID NO: 90744 - DNA, 75 bp, Artificial Sequence
  Synthetic
atcaacctgtgcctctttggatataactgttaatgaactcgaggatgcaactgtgaggaatagcgccaatatgaa

SEQ ID NO: 90745 - DNA, 75 bp, Artificial Sequence
  Synthetic
gggaaactggccaataccaaagttacttgttaagccaccacctaggacaaaattaagcattgattacagtaatcc

SEQ ID NO: 90746 - DNA, 75 bp, Artificial Sequence
  Synthetic
attaaaaggggccacaggagggaaattagtcttacctgggatggagactacattatccgagaagagtggtgcaac

SEQ ID NO: 90747 - DNA, 75 bp, Artificial Sequence
  Synthetic
cccatctgtgcaccagtctactcaacctgtaaacgacttcaatgtaaatgtaagcaatgcccgtcaacctgcccc

SEQ ID NO: 90748 - DNA, 75 bp, Artificial Sequence
  Synthetic
aaatgtgaatgatgattacagtaacagtggggtaacaatgcctaacttacataaagacatggcagataagtctga

SEQ ID NO: 90749 - DNA, 75 bp, Artificial Sequence
  Synthetic
agtatccattcaggatttatacaacttaatacttggatttaaggatgattatagaaaattatcgaataaattggg

SEQ ID NO: 90750 - DNA, 75 bp, Artificial Sequence
  Synthetic
tatggtattagagatgaaacaagatattgacaatcttaaaaagagtagtgctaaagtacaattggcattatcaac

SEQ ID NO: 90751 - DNA, 75 bp, Artificial Sequence
  Synthetic
tattgagggacatctatctagtgtcatgatcgctattccagggtcgggtattgattccactggggatgataaaaa

SEQ ID NO: 90752 - DNA, 75 bp, Artificial Sequence
  Synthetic
ggatcagatgaactctgatttgaaaccattattggggagggatcattgcagagcatttcgagaagtgaccaatcc

SEQ ID NO: 90753 - DNA, 75 bp, Artificial Sequence
  Synthetic
tttagatgagatgtcattggccaattctcccacaaaacatgttgccaaaataaacaaaaactgcacccttcagaa

SEQ ID NO: 90754 - DNA, 75 bp, Artificial Sequence
  Synthetic
aatcaataagaatgaaacatctgcaatcaaatttgttcccaatgatggtcatgcaagcacatcaactatcagatc

SEQ ID NO: 90755 - DNA, 75 bp, Artificial Sequence
  Synthetic
aatcatcagatcatccaatcttgatcaggatttgaaaacaaagctactcacaattctatctcaaattcgagggat

SEQ ID NO: 90756 - DNA, 75 bp, Artificial Sequence
  Synthetic
agataatattaaggaattttatgaaaaggtcatgatactaataaagaatagaaactaaacatcaccattctacat

SEQ ID NO: 90757 - DNA, 75 bp, Artificial Sequence
  Synthetic
gcactattggttgtgattattctcagtagaatttggtccaattcatttatatgtttattgttttaaaccaattat

SEQ ID NO: 90758 - DNA, 75 bp, Artificial Sequence
  Synthetic
aaaaaacttaggagctcaaggttattcagttagatacaacatgactgagatatttaatcttgatgagagttcatg

SEQ ID NO: 90759 - DNA, 75 bp, Artificial Sequence
  Synthetic
gtcagtcaaaggaacacttgatccactaacccctgatacctatccagatgggcgactcgtacccaaagtccgggt

SEQ ID NO: 90760 - DNA, 75 bp, Artificial Sequence
  Synthetic
aatcgatccaggcttaggagatcgcaagagtggagggtacatgtatctacttcttcatggtgtcatagaagatac

SEQ ID NO: 90761 - DNA, 75 bp, Artificial Sequence
  Synthetic
tgaaactacaattagtccgaaaggaagagcattcggggcattcccattaggagtaggtcagtcaactgaaaaccc

SEQ ID NO: 90762 - DNA, 75 bp, Artificial Sequence
  Synthetic
agaagatctgtttaaagaagtattaactctcaacattgtaactcgtaggactgctggatttaatgaaaaattggt

SEQ ID NO: 90763 - DNA, 75 bp, Artificial Sequence
  Synthetic
ttattataataccacgcctctacatttattgaccccctggaagaaagtgttggcatatgggagtatttttaatgc

SEQ ID NO: 90764 - DNA, 75 bp, Artificial Sequence
  Synthetic
taaccaggtctgcagtgatactagttctataccgatagatattccacaaaaatttagacctgtatacttgactat

SEQ ID NO: 90765 - DNA, 75 bp, Artificial Sequence
  Synthetic
cacaaaattatctgatgatggctattatcagataccgaagatgattcaagatttcaaatcatcaaattctgttgc

SEQ ID NO: 90766 - DNA, 75 bp, Artificial Sequence
  Synthetic
atttaatatccttgtgcatttatcaatgggcacaactttaattgatcaatccaaagaccctcgattaagaggtac

SEQ ID NO: 90767 - DNA, 75 bp, Artificial Sequence
  Synthetic
tccagaaactatgatcacattcatgattcatatcggaaacttcaaacggaagagtaacaaatcttattctcctga

SEQ ID NO: 90768 - DNA, 75 bp, Artificial Sequence
  Synthetic
attcatatcggaaacttcaaacggaagagtaacaaatcttattctcctgaatattgcaagaggaaaataataagg

SEQ ID NO: 90769 - DNA, 75 bp, Artificial Sequence
  Synthetic
cgactacaggcttatctaggattcaaaagaaccttatgttaccctctgatgtatgtaaatgaagggctgaataaa

SEQ ID NO: 90770 - DNA, 75 bp, Artificial Sequence
  Synthetic
accctgtggagaaatgaatgtaagatagaaaaggttcaagcggtcctacagccatcagttccaaatgaattcaag

SEQ ID NO: 90771 - DNA, 75 bp, Artificial Sequence
  Synthetic
atatacgatgatgtcattattgacaataccaatggtctcttcaagattaaatagggtataataataataaacagt

SEQ ID NO: 90772 - DNA, 75 bp, Artificial Sequence
  Synthetic
tacaaaatgatatcatgtttaaaagtgtatactgatgattatgaattaaatatactgggttaattacaatatagg

SEQ ID NO: 90773 - DNA, 75 bp, Artificial Sequence
  Synthetic
gttagaatctcgtggatatgtgggttgataattaatcatctattagttttattaatcattcctattttgagttgc

SEQ ID NO: 90774 - DNA, 75 bp, Artificial Sequence
  Synthetic
ttaatttaaagatatcaatatgtaataaatttagcattactaaattaacatttaattcttaaaattggaatacat

SEQ ID NO: 90775 - DNA, 75 bp, Artificial Sequence
  Synthetic
acgttgtcagacttacagttatattaaattcacttcaactgaatctctgtaacattaatcaattattatacaagc

SEQ ID NO: 90776 - DNA, 75 bp, Artificial Sequence
  Synthetic
aattataaaaaactgaggatctaatgtaatggggattcaaatttcatctagtaggtttaagatcaccgtgctcaa

SEQ ID NO: 90777 - DNA, 75 bp, Artificial Sequence
  Synthetic
acaccaaactgcctagtgtctgcccaactcaaaacaaagatcataactaaactcttgacaagtgggctaaacctg

SEQ ID NO: 90778 - DNA, 75 bp, Artificial Sequence
  Synthetic
aataactattaagaattaagaccttaaactgagtcctcctgcaattcagggtttctgtaatacattatcaatcta

SEQ ID NO: 90779 - DNA, 75 bp, Artificial Sequence
  Synthetic
agatcatgggtaaaattagggttataataattagctctttactactatcaaatattacgactgcacaagtaggtt

SEQ ID NO: 90780 - DNA, 75 bp, Artificial Sequence
  Synthetic
gggacaatttaacttcgatcggagttataagtactaagcaatacgattataaaataactactttgaatactaacc

SEQ ID NO: 90781 - DNA, 75 bp, Artificial Sequence
  Synthetic
agttgatggttataaaaatggttcccaatatatcgtcaatcatcaattgcaccaagcctgagttaatgaaatatc

SEQ ID NO: 90782 - DNA, 75 bp, Artificial Sequence
  Synthetic
gagagttggtcttaggggttattagaccaatcaatgaatcattagaattaatgaattcatacattaatatgaggg

SEQ ID NO: 90783 - DNA, 75 bp, Artificial Sequence
  Synthetic
caggttcagagagatttataggggctgtaatagctggagttgccttaggagtagcaactgcagcacaaataacat

SEQ ID NO: 90784 - DNA, 75 bp, Artificial Sequence
  Synthetic
caggaattgccttacataattcaattatgaacaaaaggcaaatacaagaattgaggaaggccctcagtaccacca

SEQ ID NO: 90785 - DNA, 75 bp, Artificial Sequence
  Synthetic
ataaagcaattgatgaaataaggattgcaggtgagagaacactaatagcagtccaaggtgtgcaagattatatta

SEQ ID NO: 90786 - DNA, 75 bp, Artificial Sequence
  Synthetic
ataatataattattcctatgcaggacaaacttcaatgtgacattttatcgtcacagcttgctattgccttactca

SEQ ID NO: 90787 - DNA, 75 bp, Artificial Sequence
  Synthetic
gatattatacaaatatattgacagtcttcggaccaagcatacgggatcctgttactagtataatctcaatacaag

SEQ ID NO: 90788 - DNA, 75 bp, Artificial Sequence
  Synthetic
cacttagtcaagcgtttaatggtaatcttcaggcactgcttgatggattaggatatactgggagagacttacgtg

SEQ ID NO: 90789 - DNA, 75 bp, Artificial Sequence
  Synthetic
atcttttagagagtagatctatcaccggtcagataattcatgcagatatgactgatttgttccttgtcctaagaa

SEQ ID NO: 90790 - DNA, 75 bp, Artificial Sequence
  Synthetic
ttaattatccttccataactgaaatgcagggagtaacgatatatgaacttaattcaatcacatatcatattggac

SEQ ID NO: 90791 - DNA, 75 bp, Artificial Sequence
  Synthetic
ctgaagaatggtatactattatgcctaattttatagctgttcagggttttttaacatccaattttgatgaaagga

SEQ ID NO: 90792 - DNA, 75 bp, Artificial Sequence
  Synthetic
agtgttcaataactaaatcaagtatactgtgccaacaaaattcaatttacccgatgtccacagagatgcaaagat

SEQ ID NO: 90793 - DNA, 75 bp, Artificial Sequence
  Synthetic
gtatcaagggtgagataagattctgtccaagatccaaggcagttgggacattagttaatagatttatattgacta

SEQ ID NO: 90794 - DNA, 75 bp, Artificial Sequence
  Synthetic
aaggtaatttaatggctaattgccttggtgttatatgcaggtgttatagctcaggccaaattataacacaagacc

SEQ ID NO: 90795 - DNA, 75 bp, Artificial Sequence
  Synthetic
ctagtaagttaattacaataatatcacaagaggaatgcaaggaagtcggagttgatggcatccgtattatggtag

SEQ ID NO: 90796 - DNA, 75 bp, Artificial Sequence
  Synthetic
gacctaggaagttaccagacattatcttcaatgctaggttggaggttggtgtgccgatatcgttaagtaaattag

SEQ ID NO: 90797 - DNA, 75 bp, Artificial Sequence
  Synthetic
atgtgggaactgatttggcgattgcttcagctaaactcaataattctaaggcactgttagagcaatcagataaga

SEQ ID NO: 90798 - DNA, 75 bp, Artificial Sequence
  Synthetic
ttctggactcaatgtctaaattggattctatcaattcacgaattacaggattgatcttggcaatcatggcaatct

SEQ ID NO: 90799 - DNA, 75 bp, Artificial Sequence
  Synthetic
ttataatcaccgttattattatctggatcatatataaaagatgcaggaataaagacaataaattcagtacttcaa

SEQ ID NO: 90800 - DNA, 75 bp, Artificial Sequence
  Synthetic
ttgaaccgctttacatacctccctcttacaactcaccttacagtgtagttaagtctatttgagtactaactgtat

SEQ ID NO: 90801 - DNA, 75 bp, Artificial Sequence
  Synthetic
catttactgtggtaaattcaatgaagttaacaattgatgatattagtaccttaataagtattgattatattacat

SEQ ID NO: 90802 - DNA, 75 bp, Artificial Sequence
  Synthetic
actctgtttaactaagtgctgataacgagttatagatgattacaattatttcaataaaattatatattaatttta

SEQ ID NO: 90803 - DNA, 75 bp, Artificial Sequence
  Synthetic
ttatcttgcataatcttcatacaattgaattatatgttattaattaatagcttaatggtgttgccttatatattt

SEQ ID NO: 90804 - DNA, 75 bp, Artificial Sequence
  Synthetic
agatcgatagatagacatgctatattgtaatcaagaatctaatacttaaaggacagaataatttaacgtgttgct

SEQ ID NO: 90805 - DNA, 75 bp, Artificial Sequence
  Synthetic
gattgatgattgtgtattcaattagaaaaaacttaggaatccatgttaatctaagtttattatcatggagtccaa

SEQ ID NO: 90806 - DNA, 75 bp, Artificial Sequence
  Synthetic
caacattaaatattacaaagattctaaccgatatcttggtaaaatattagatgaacacaagatagttaatagtca

SEQ ID NO: 90807 - DNA, 75 bp, Artificial Sequence
  Synthetic
attgtacagtttaagtattaaagtaattaccattattgctattatcgtaagcctaattgcaacaataatgactat

SEQ ID NO: 90808 - DNA, 75 bp, Artificial Sequence
  Synthetic
tattaatgccacaagtgggaggactaccctaaacagtaacacagatatactgcttaaccaaagaggtgagattca

SEQ ID NO: 90809 - DNA, 75 bp, Artificial Sequence
  Synthetic
tagtattcatgagatgatatttgatcgggtttatcctttgataactgccatgagtacagaactaggacttcatat

SEQ ID NO: 90810 - DNA, 75 bp, Artificial Sequence
  Synthetic
tcctactttattagatgaacttactaaggcaattgatcaaaagattaaaataatgaatcctcctgttaacactgt

SEQ ID NO: 90811 - DNA, 75 bp, Artificial Sequence
  Synthetic
cacatccgatcttagctggtgtattaaaccccccaatgggattattatagatccaaaaggttattgtgaaagtat

SEQ ID NO: 90812 - DNA, 75 bp, Artificial Sequence
  Synthetic
ggaattatctaaaacttacaaattattgcttgaccagttagatgtctcaagaaagaaatcactcactataaatag

SEQ ID NO: 90813 - DNA, 75 bp, Artificial Sequence
  Synthetic
aaagaatatcaaccagtgtcaattagttgatgactcaaagatcatttttgctactgttaatatacaatcgacacc

SEQ ID NO: 90814 - DNA, 75 bp, Artificial Sequence
  Synthetic
gaggtttttaaactttggtcatacagtcagcaatcaacgtataacatttggtcaaggaacttatagtagtactta

SEQ ID NO: 90815 - DNA, 75 bp, Artificial Sequence
  Synthetic
tattctaactatccaagaagatggaataactgatgttcaatatcgagtgtttgaaataggatatatttctgatca

SEQ ID NO: 90816 - DNA, 75 bp, Artificial Sequence
  Synthetic
gtttggtgttttcccctccctaatagtatccagagtattgcctatacgcatggtattaggaatggaatcctgtac

SEQ ID NO: 90817 - DNA, 75 bp, Artificial Sequence
  Synthetic
cttgacaagtgatcggcaaggtgggtatttcttatgtatgaatacattaacacgatctatatatgattatgttaa

SEQ ID NO: 90818 - DNA, 75 bp, Artificial Sequence
  Synthetic
cataagagatttgaaatcactatacataacacttcctcattatggtaaggttaattatacttactttaattttgg

SEQ ID NO: 90819 - DNA, 75 bp, Artificial Sequence
  Synthetic
gaaaattaggagcccacatgagattgataaactttggctaacatctgatagaggtcaaattatttctggttattt

SEQ ID NO: 90820 - DNA, 75 bp, Artificial Sequence
  Synthetic
tgcagcatttgttacaattacaattcggaattataataattatccctacaaatgtttgaataacccatgttttga

SEQ ID NO: 90821 - DNA, 75 bp, Artificial Sequence
  Synthetic
caactctgagaattactgtaggggatggtataaaaacataacaggtaccgatgatgttccaatattagcatacct

SEQ ID NO: 90822 - DNA, 75 bp, Artificial Sequence
  Synthetic
gctagttgaaatgtatgatgaagaaggacctttaattacacttgtggcaataccaccctataattatacagctcc

SEQ ID NO: 90823 - DNA, 75 bp, Artificial Sequence
  Synthetic
atctcataattctctttactatgatgacaaaattaataaattgataatgacgacatctcacataggttatattca

SEQ ID NO: 90824 - DNA, 75 bp, Artificial Sequence
  Synthetic
gatcaatgaggtgcatgaggtgattgttggtgataatttaaaggctattctcctgaacagattatctgatgagca

SEQ ID NO: 90825 - DNA, 75 bp, Artificial Sequence
  Synthetic
tcccaatcttacagcctgtagactcaatcaaggtatcaaggagcagtacaagtctgatggaatgataatttcaaa

SEQ ID NO: 90826 - DNA, 75 bp, Artificial Sequence
  Synthetic
ttctgcacttattgatatacaagaacgaatgtatattacagttaaggctattccaccagtaggtaactataactt

SEQ ID NO: 90827 - DNA, 75 bp, Artificial Sequence
  Synthetic
tacaattgagttacactctagatcaaacacatcttatatattgttaccgaaacagtttaatgccaagtatgataa

SEQ ID NO: 90828 - DNA, 75 bp, Artificial Sequence
  Synthetic
attacatcttgagtgctttaattgggataagtcttggtggtgtgctttgatccctcaattttcattaagttggaa

SEQ ID NO: 90829 - DNA, 75 bp, Artificial Sequence
  Synthetic
tgaatccctttctgttgatactgctatttttaatttaataaattgtaaatgagtctatcagctaatagttaatag

SEQ ID NO: 90830 - DNA, 75 bp, Artificial Sequence
  Synthetic
ttgttcaaatgatagctaattgaggtaaaatgaatagaggagttaaattattaacatttgattaaatgtatagcc

SEQ ID NO: 90831 - DNA, 75 bp, Artificial Sequence
  Synthetic
aaactagattacaaaaaacttaggagtcagaagcttcttcgcaatggagcagtcagactaccaagacattttata

SEQ ID NO: 90832 - DNA, 75 bp, Artificial Sequence
  Synthetic
cccagaagtacatcttaatagccctatagtaatttctaaattagtaggtattttagaatatgctcaagttattca

SEQ ID NO: 90833 - DNA, 75 bp, Artificial Sequence
  Synthetic
taatcaacaattaacagatcacacaattattaagaatatccaattcagattgagaaatgggtttaatagcccaag

SEQ ID NO: 90834 - DNA, 75 bp, Artificial Sequence
  Synthetic
gatacagacactgtcaactatgggcgaaatcatcaacaagattaaaaacaagtattctaattatttccacatacc

SEQ ID NO: 90835 - DNA, 75 bp, Artificial Sequence
  Synthetic
ttatcccgaatgcaaccaaaagttatttcggatagtagatccagaactaacatcaaaattggaatctcttctaaa

SEQ ID NO: 90836 - DNA, 75 bp, Artificial Sequence
  Synthetic
caaaggagatacactatatctcaaaattcggtcagatatcataaaatgtttcgataaactgaagatgaagatgaa

SEQ ID NO: 90837 - DNA, 75 bp, Artificial Sequence
  Synthetic
tataagtaatgatctccttaatgacaacagtcaattaattttggatcttcctttaattatcaaaggatctcagtg

SEQ ID NO: 90838 - DNA, 75 bp, Artificial Sequence
  Synthetic
gttcttcccgtttttgttttggttttctattaaaactgaaactaggaactgtattcgccaaaatcaaaaagcgcg

SEQ ID NO: 90839 - DNA, 75 bp, Artificial Sequence
  Synthetic
tgttagatcacaatatcgacctcacttatcagagaccaagagaattacattggttgttacatctgacctgattac

SEQ ID NO: 90840 - DNA, 75 bp, Artificial Sequence
  Synthetic
aatatttgatcatattaataagtgtatattttacctgacttttgaaatgttattgatgtattgcgatgtgataga

SEQ ID NO: 90841 - DNA, 75 bp, Artificial Sequence
  Synthetic
aggtaggttaatgaccgaaacagctatgagcctggattgtcgatttaccaatctattaccaagagtacaatatat

SEQ ID NO: 90842 - DNA, 75 bp, Artificial Sequence
  Synthetic
gtgggatttactagatggaatgtttgaaagtctaggtaatcagatatattcagttattgcattattagaacctct

SEQ ID NO: 90843 - DNA, 75 bp, Artificial Sequence
  Synthetic
ttctcttgcctatttgcaattgatagatgctgatccacagattcggggaacattcctgcatcactgtttttcaga

SEQ ID NO: 90844 - DNA, 75 bp, Artificial Sequence
  Synthetic
gttggaagagattatatttgacaaatctccttttgacccttttgtgtatgaaaatcttattaatggacttgatta

SEQ ID NO: 90845 - DNA, 75 bp, Artificial Sequence
  Synthetic
tatttatcttacagatgacattcatctaactgcagaagtcttttctttttttagaagttttggtcatccttacct

SEQ ID NO: 90846 - DNA, 75 bp, Artificial Sequence
  Synthetic
agaagcacaaaatgctgccaataatgtgaggaaatatatgaatcagccaaaagtgatctcataccagaccttaat

SEQ ID NO: 90847 - DNA, 75 bp, Artificial Sequence
  Synthetic
gcaaggacatgcaattttctgtggaattataataaatggatttagagatcgtcatgggggaacgtggcctcctgt

SEQ ID NO: 90848 - DNA, 75 bp, Artificial Sequence
  Synthetic
ggaattaccaagtcatgcatctgctgtaattagaaatgctcagctatctggagaagggttaacatctgaacaatg

SEQ ID NO: 90849 - DNA, 75 bp, Artificial Sequence
  Synthetic
tgctcaacactggagatctttttgtggttttaaattcaagtgtttcatgccattgagtctagatagcgatcttac

SEQ ID NO: 90850 - DNA, 75 bp, Artificial Sequence
  Synthetic
aatgtatcttcgagacaaggcattgtcacctgttagaagtgagtgggattctgtctatgctaaagaatatttgag

SEQ ID NO: 90851 - DNA, 75 bp, Artificial Sequence
  Synthetic
atataatccaggattacctacaagttccagaagattagtgaatgtatttttggaagatgataagtttgacccata

SEQ ID NO: 90852 - DNA, 75 bp, Artificial Sequence
  Synthetic
tgagatgattatgtatgtgataaatggtgattacctaatagacaatgagtttaacctttcatatagtcttaaaga

SEQ ID NO: 90853 - DNA, 75 bp, Artificial Sequence
  Synthetic
gaaagaaattaaagaggttggtcgcttgttcgccaaaatgacttataaaatgagggcttgtcaggtaatagctga

SEQ ID NO: 90854 - DNA, 75 bp, Artificial Sequence
  Synthetic
tgagggcttgtcaggtaatagctgaaaacttgattgctaatggagtagggaagttttttaaagacaatggaatgg

SEQ ID NO: 90855 - DNA, 75 bp, Artificial Sequence
  Synthetic
tatatttagatgaatgctgggagcaggcagttcgacattgttccagtgacacacataccaaaaaacagactatgg

SEQ ID NO: 90856 - DNA, 75 bp, Artificial Sequence
  Synthetic
gttcgcaatcaaacaggataattgaatcaaagtcttctagatcacctcttaataatagggatactttaaaaggta

SEQ ID NO: 90857 - DNA, 75 bp, Artificial Sequence
  Synthetic
aaagagatccgaatacacagttaaagtacccttcaaacaccgaatattatgagactatcagcagttttataacta

SEQ ID NO: 90858 - DNA, 75 bp, Artificial Sequence
  Synthetic
ctgacctcaaaaagtattgtcttaattggcgatatgagtcaagtagtgtatttgcggagagactcaatgaaattt

SEQ ID NO: 90859 - DNA, 75 bp, Artificial Sequence
  Synthetic
acggattgcctggatttttccagtggcttcacaaaattttggaaaaatctgttttgtatgtcagtgatccatcta

SEQ ID NO: 90860 - DNA, 75 bp, Artificial Sequence
  Synthetic
gcccacctgattttgatcaacatactgatatagaatcggttccaaatgaccacatctttattaagtatccgatgg

SEQ ID NO: 90861 - DNA, 75 bp, Artificial Sequence
  Synthetic
gtggaatagaggggttctgtcaaaagttatggactattagtacaatcccatttctatacttagcagcttttgata

SEQ ID NO: 90862 - DNA, 75 bp, Artificial Sequence
  Synthetic
caggtgttaggatcgcatcattggttcagggcgataatcaggcgattgcagtgacaaaaagagttccgtcatctt

SEQ ID NO: 90863 - DNA, 75 bp, Artificial Sequence
  Synthetic
ggagttactcgaagaaaaaggaagaatcaactaaaataacaacacaatatttccttaacttaaggcaacgtctac

SEQ ID NO: 90864 - DNA, 75 bp, Artificial Sequence
  Synthetic
atgatataggtcatgaattgaaagcaaatgaaactatcatatcctctcatttctttgtttactctaaaggtattt

SEQ ID NO: 90865 - DNA, 75 bp, Artificial Sequence
  Synthetic
attacgatggaatacttctttctcaggcacttaaaagtatggcaagatgtgtcttttggtctgaaacaattgttg

SEQ ID NO: 90866 - DNA, 75 bp, Artificial Sequence
  Synthetic
atgaaactagatcagcttgcagtaatatatccaccacacttgcaaaggcaattgaaaggggttatgataaatttg

SEQ ID NO: 90867 - DNA, 75 bp, Artificial Sequence
  Synthetic
tggcgtatgctatcaatatttataaaaccatacatcaagttttgattgcattatcttttacgatcaaccctacta

SEQ ID NO: 90868 - DNA, 75 bp, Artificial Sequence
  Synthetic
tgacaccagatatcacagaacctttctacaagagcttagatctacttaaaaatctagttctaattcctgcaccat

SEQ ID NO: 90869 - DNA, 75 bp, Artificial Sequence
  Synthetic
tggggggtatgaactatatgaacatgagcaggttatttgttaggaatataggagatcccattactgcttcatttg

SEQ ID NO: 90870 - DNA, 75 bp, Artificial Sequence
  Synthetic
ctgatataaagcgcatgatcgagtgtgggttgctgggatgtagtatcctgtcacagataatgtaccaaaaatgtg

SEQ ID NO: 90871 - DNA, 75 bp, Artificial Sequence
  Synthetic
gttcctccaaatatttggactgggctagtgatccttactcaataaaccttccatatagtcaaagtatgaccaagg

SEQ ID NO: 90872 - DNA, 75 bp, Artificial Sequence
  Synthetic
tattgaagaatgtaacagcaagatatgtgctcatgcatagccccaaccctatgcttaaggatttattccatgaga

SEQ ID NO: 90873 - DNA, 75 bp, Artificial Sequence
  Synthetic
agtcgcaagaagaggatgaaattcttgctgagtttttattagatcgacatttaataatccctagggcagcacatg

SEQ ID NO: 90874 - DNA, 75 bp, Artificial Sequence
  Synthetic
aaattttatcaaattcagtaacaggtgctagagaatctattgcaggtatgcttgacactactaaggggttgattc

SEQ ID NO: 90875 - DNA, 75 bp, Artificial Sequence
  Synthetic
gtgctagtatgtcaagaggtggtctgacatcgtcacttgttttgaaattatcaacatatgattaccagcagttta

SEQ ID NO: 90876 - DNA, 75 bp, Artificial Sequence
  Synthetic
gaacgtgtcttgaatggctttatgctcctaccacgggaattgctgtgagtgtggattcttgttccgttttcttag

SEQ ID NO: 90877 - DNA, 75 bp, Artificial Sequence
  Synthetic
ctaagactatccgaaaaagaatgtgggttcacctgactaaaggaagggagatttacgggttggaagtacctgaca

SEQ ID NO: 90878 - DNA, 75 bp, Artificial Sequence
  Synthetic
ttttggaatgcatgcaaaacaacataattatcgatcatgaagattgttactcctgcattcagggatcaagatatt

SEQ ID NO: 90879 - DNA, 75 bp, Artificial Sequence
  Synthetic
acacatggttttttgtgccttcaaattgtcaactagatcaaataaataagtcaacaaattctctccgagttcctt

SEQ ID NO: 90880 - DNA, 75 bp, Artificial Sequence
  Synthetic
acgttgggtcaacaacagaagaaaggagtgatatgaggttgtcatatgtcaggtcgccaagtcgaccacttaaag

SEQ ID NO: 90881 - DNA, 75 bp, Artificial Sequence
  Synthetic
cagcagttagaattgcagctgtatatacatgggcttatggtgatgatgatttatcttggcatgaagcttggtatt

SEQ ID NO: 90882 - DNA, 75 bp, Artificial Sequence
  Synthetic
tggcaaggactagagcaaatatcacctttgatgaactcaaattgataacacctatagctacatctacgaatttag

SEQ ID NO: 90883 - DNA, 75 bp, Artificial Sequence
  Synthetic
cacatagattaagagataggagcactcaggttaaatattcaggaacttctttagtaagagtagcacgctatacaa

SEQ ID NO: 90884 - DNA, 75 bp, Artificial Sequence
  Synthetic
caatttccaatgataatatgtcgttcattattaacaacaagaaggtagatactaactttgtctatcagcaaggca

SEQ ID NO: 90885 - DNA, 75 bp, Artificial Sequence
  Synthetic
tgttgttgggcctgagtatactagagtacatatttagatattgtacaagtactggacaatcaaacactgtaattc

SEQ ID NO: 90886 - DNA, 75 bp, Artificial Sequence
  Synthetic
acttacatgcagacattaattgttgtatagtacagatgactgatcagccctatacaccaagtttgacaaagaagc

SEQ ID NO: 90887 - DNA, 75 bp, Artificial Sequence
  Synthetic
tacctgatattaaacctattaataataaattgatatatgatccggcccctataattgatactgatgcagctagat

SEQ ID NO: 90888 - DNA, 75 bp, Artificial Sequence
  Synthetic
tatattctcaaaagtacctatcacatttaatagattttccaagttggtcaactactcagcttaacacagtattgg

SEQ ID NO: 90889 - DNA, 75 bp, Artificial Sequence
  Synthetic
caaaagtggtagcagtatcgattgtggaattaataacaaaggcaagtaaagaccatcttaatgagataatagcgg

SEQ ID NO: 90890 - DNA, 75 bp, Artificial Sequence
  Synthetic
tcgttggtgatgatgatattaatagttttattacggagtttctacttgttgatccacgtctgtttacattatatt

SEQ ID NO: 90891 - DNA, 75 bp, Artificial Sequence
  Synthetic
taggccaatatacatcattacaatgggcatatgaagttcattaccatagaccagtaggtaagtatcagatggccg

SEQ ID NO: 90892 - DNA, 75 bp, Artificial Sequence
  Synthetic
aagtgttacataatctactgtcaagagctagtcgaggtatatttagcgtgttgactaatgcttttagccatccca

SEQ ID NO: 90893 - DNA, 75 bp, Artificial Sequence
  Synthetic
gggtatatagaagattctgggaatgtgggttactggagcctatctatgggccctatatagggagtcaaaatctac

SEQ ID NO: 90894 - DNA, 75 bp, Artificial Sequence
  Synthetic
atactgcagtgattgattatatttataatgcatatattacctatctggatgcttatttatctgatcaagtagatg

SEQ ID NO: 90895 - DNA, 75 bp, Artificial Sequence
  Synthetic
atactgatatcataatatgtgaaacagaggagacatgtctagcaaataggatcgacaattatcaaagcaggcatc

SEQ ID NO: 90896 - DNA, 75 bp, Artificial Sequence
  Synthetic
tagctgtacttatcgatatgtattgtgattccactagatgccctaatataaaagggtcagatacaattatgcgga

SEQ ID NO: 90897 - DNA, 75 bp, Artificial Sequence
  Synthetic
attcgatccttagatcttttattgacaatgagagaagaacaaatccactcggtttgacatggaatcttgatccgt

SEQ ID NO: 90898 - DNA, 75 bp, Artificial Sequence
  Synthetic
tacttgtggatcactttagctgttctattacgtatctaagaagaggcattattaaacagatgaggttaagatttg

SEQ ID NO: 90899 - DNA, 75 bp, Artificial Sequence
  Synthetic
atccaaacatatctcttgagttagtcaagatgatcaaacctgatgttatttatcaagcacctaaagttccgtctt

SEQ ID NO: 90900 - DNA, 75 bp, Artificial Sequence
  Synthetic
cgtgggctcttatagatatcaatcctgaagtcaatgatcttaacacaattttcggagagctgaacagcaaatgga

SEQ ID NO: 90901 - DNA, 75 bp, Artificial Sequence
  Synthetic
aagatattcctatcgggcaaatcaagatccaaaattatgagatacatgcatataggagagttggagttaattcaa

SEQ ID NO: 90902 - DNA, 75 bp, Artificial Sequence
  Synthetic
ctgcatgttataaggctctagagatattatctgttttaaatcgatttatgtctaatccattaggtgcattgtttt

SEQ ID NO: 90903 - DNA, 75 bp, Artificial Sequence
  Synthetic
taggtgaaggagcaggatcgatgctggtgacataccgtgcttttattccatttaagacaatttattataatagtg

SEQ ID NO: 90904 - DNA, 75 bp, Artificial Sequence
  Synthetic
gcatttctgtccaacatgtgcaaggtcagagagaattaagtctatatccatctgaagtggcactagttgacaaca

SEQ ID NO: 90905 - DNA, 75 bp, Artificial Sequence
  Synthetic
agaatcgtttggctaatgaccctaatattaaagtcttgtttaacggtaagccggagtctacgtgggttgggaata

SEQ ID NO: 90906 - DNA, 75 bp, Artificial Sequence
  Synthetic
ttgattgttttgcttatattcttagccatattgagacctcaagcttgacactgatacacagtgatatcgagtcca

SEQ ID NO: 90907 - DNA, 75 bp, Artificial Sequence
  Synthetic
gtttgagcaagacaaaaaataaaattcttgaagagttgtgtcatatcctatcaatggcacttatcttagggaaac

SEQ ID NO: 90908 - DNA, 75 bp, Artificial Sequence
  Synthetic
ttggatcagtgttagttattaaactactaccaagggtcggtgattatacctattcattttgcaagtatgcgtcag

SEQ ID NO: 90909 - DNA, 75 bp, Artificial Sequence
  Synthetic
agttctatcagcaaaactttctaatattacctagatttagtaacatgtcgtcatctgaaatctactacataggag

SEQ ID NO: 90910 - DNA, 75 bp, Artificial Sequence
  Synthetic
ttcaccttaatacaaatagattgatcgatcccgacagaatagtacaatacataattagaaatttgcaacctaccc

SEQ ID NO: 90911 - DNA, 75 bp, Artificial Sequence
  Synthetic
cagttacatttttatcctatatctttgaaactaaatatagaaataatatggttacaaattacggattatgcttgt

SEQ ID NO: 90912 - DNA, 75 bp, Artificial Sequence
  Synthetic
cagatggacataaaagtgattacttatcatcaattacaaagatagagaacgttcttctgtcatgtggattagaat

SEQ ID NO: 90913 - DNA, 75 bp, Artificial Sequence
  Synthetic
tgaatggacctaagattatacagcaattatcaggacatgactatgcaaatggggagactagtctggaatcaagta

SEQ ID NO: 90914 - DNA, 75 bp, Artificial Sequence
  Synthetic
taatgatattggttagagaatatcttaatgcaactattcaaggccgggaaacattaggcttgttttcaccttacc

SEQ ID NO: 90915 - DNA, 75 bp, Artificial Sequence
  Synthetic
cagtattacatgagagtcagttaagagaaatcaataagtgtattgcattgaagtatgttgtgtacttactctttt

SEQ ID NO: 90916 - DNA, 75 bp, Artificial Sequence
  Synthetic
acttgaactctatatcgtctagtaaacagataatgagtaatcttagaaaggggatactaatgtatgatttgagag

SEQ ID NO: 90917 - DNA, 75 bp, Artificial Sequence
  Synthetic
acgaatttttcatatcgaggttatcagcaaattataagaaaaaagtaatgctacaggaagttaaaactacatgga

SEQ ID NO: 90918 - DNA, 75 bp, Artificial Sequence
  Synthetic
tatttaacattgatactccgacacgaaaagcattatacaagttggtgggttattctttgataattaatcacatat

SEQ ID NO: 90919 - DNA, 75 bp, Artificial Sequence
  Synthetic
gatgatcaactgtggttattcatatttaaaaaagtaagataagacctagtatattatagctaacaaaacatcacc

SEQ ID NO: 90920 - DNA, 75 bp, Artificial Sequence
  Synthetic
tttgaattgaaggattgctcagttacctaactgatgagtaattaagattaaatttcaatcaaaaaaattagaaaa

SEQ ID NO: 90921 - DNA, 75 bp, Artificial Sequence
  Synthetic
aacttactctattaacaaagctctaattcattctatccaagttatatttacaatcctgaattaaacttgaattta

SEQ ID NO: 90922 - DNA, 75 bp, Artificial Sequence
  Synthetic
aaactatcacagtagtactaatttatcaagggaaaacaattagtacttagtattgagtttctatttgtgtacctt

SEQ ID NO: 90923 - DNA, 75 bp, Artificial Sequence
  Synthetic
caatcttatgcttatcattatcaatttttattaaagtatttaattatggatgttaatgtgttatatgatgagaat

SEQ ID NO: 90924 - DNA, 75 bp, Artificial Sequence
  Synthetic
tacttacactgatattgctagtaattataagtactgtatgagacaatgtctaatttttaccaatgcacaatctca

SEQ ID NO: 90925 - DNA, 75 bp, Artificial Sequence
  Synthetic
catgccggacccctcagcctcctcctaatagacaagtgatttgaaaaaaaacaaaaaacaatcttgaggaattgt

SEQ ID NO: 90926 - DNA, 75 bp, Artificial Sequence
  Synthetic
ccggacccctcagcctcctcctaatagacaagtgatttgaaaaaaaacaaaaaacaatcttgaggaattgtacgg

SEQ ID NO: 90927 - DNA, 75 bp, Artificial Sequence
  Synthetic
gaggttagttgagtctaccaacagaattgacaccaaaaagccggaagctccaggtgtcaccaaccattataatga

SEQ ID NO: 90928 - DNA, 75 bp, Artificial Sequence
  Synthetic
ttcaaattaagaaaaacttaggacctcaaggttcacaactgttggcacgtcactgagatatagtcaactctttat

SEQ ID NO: 90929 - DNA, 75 bp, Artificial Sequence
  Synthetic
gggaaactggccaattccgaaattacttgtcaagccgccacccagggcaagatcaagcatggatcatagcaatcc

SEQ ID NO: 90930 - DNA, 75 bp, Artificial Sequence
  Synthetic
agagaatgttaaagaattttatgagaaggtcatgatattgataaagaataagaactagatatcaccaatctacat

SEQ ID NO: 90931 - DNA, 75 bp, Artificial Sequence
  Synthetic
tcagtcatatacaacatgactgagatattcactcttgatgagagctcatggtcaatcaaaggaacacttgattca

SEQ ID NO: 90932 - DNA, 75 bp, Artificial Sequence
  Synthetic
cttggtttgatattctcattaggtgcaattggtggcacaagcttacatattagatgtacaggtaagatgagcaaa

SEQ ID NO: 90933 - DNA, 75 bp, Artificial Sequence
  Synthetic
tacattggattaataacggtatagagttagaatctaattgatatgtaggttaatgcttaagcacttattagctct

SEQ ID NO: 90934 - DNA, 75 bp, Artificial Sequence
  Synthetic
taatgcttaagcacttattagctctattgattatctatattttgagttatttaatatcagagtatcaatatgtaa

SEQ ID NO: 90935 - DNA, 75 bp, Artificial Sequence
  Synthetic
aaattgttaaacttataattccgttagattcattcaagttgaactcctgtaatgctaaccaattatcactcgagc

SEQ ID NO: 90936 - DNA, 75 bp, Artificial Sequence
  Synthetic
aaattgattctttcttaactctaaagttttggtagtatagcatcaattcagtaccatgaacagaattaaagttat

SEQ ID NO: 90937 - DNA, 75 bp, Artificial Sequence
  Synthetic
gggataatttaacttcgattggggttataagtactaagcagtacaactataaaataactactctaaatactaatc

SEQ ID NO: 90938 - DNA, 75 bp, Artificial Sequence
  Synthetic
tataagtactaagcagtacaactataaaataactactctaaatactaatcagttgatggttataaagatggttcc

SEQ ID NO: 90939 - DNA, 75 bp, Artificial Sequence
  Synthetic
tcttcaggcactgcttgacggactaggatatactgggagagacttacgtgaccttctagaaagtaaatctatcac

SEQ ID NO: 90940 - DNA, 75 bp, Artificial Sequence
  Synthetic
tggtcagataattcatgcagatatgactgatttgttccttgttctgagaattaattacccttccataactgagat

SEQ ID NO: 90941 - DNA, 75 bp, Artificial Sequence
  Synthetic
gcagggagtaacaatatatgaactaaattcaattacatatcatattgggcctgaagagtggtatactattatgcc

SEQ ID NO: 90942 - DNA, 75 bp, Artificial Sequence
  Synthetic
tgattttatagctgttcagggttttttaatatctaattttgatgaaagaaagtgttcaataactaaatcgagtgt

SEQ ID NO: 90943 - DNA, 75 bp, Artificial Sequence
  Synthetic
attatgccaacaaaattcaatttacccgatgtcaacagagatgcaaagatgtattaagggcgaaataagattctg

SEQ ID NO: 90944 - DNA, 75 bp, Artificial Sequence
  Synthetic
tccaagatccaaggcaattgggacgttagttaatcggttcatattgaccaaaggtaatttaatggctaattgtct

SEQ ID NO: 90945 - DNA, 75 bp, Artificial Sequence
  Synthetic
gggaattatatgcagatgttatacctcaggccaagttataacacaggaccccagtaagttaattacaataatatc

SEQ ID NO: 90946 - DNA, 75 bp, Artificial Sequence
  Synthetic
gacctagaaaattaccagatattacctttaatgctaggttagaaattggtgtaccgatatcattaagcaaattag

SEQ ID NO: 90947 - DNA, 75 bp, Artificial Sequence
  Synthetic
atgtcggaaatgatttagcaattgcttcagctaaacttaataattccaaagcattgttagagcaatcagataaga

SEQ ID NO: 90948 - DNA, 75 bp, Artificial Sequence
  Synthetic
ttctggattctatgtctaagttggattctattaattcaagaattataggattaatcttagcaatcatgataatct

SEQ ID NO: 90949 - DNA, 75 bp, Artificial Sequence
  Synthetic
ttataattattattaccattatctggctcatatataaaaattgtagaaataaagatactaaattcagtacttcaa

SEQ ID NO: 90950 - DNA, 75 bp, Artificial Sequence
  Synthetic
ttgaaccgctctacatacccccttcttataactcacctcatagtgtggtcaagtctatttgagtactgaccatat

SEQ ID NO: 90951 - DNA, 75 bp, Artificial Sequence
  Synthetic
gatttactgtaataagtccaatggaagtatcaattgacaatactggtagtataatgaatattgaatatataatat

SEQ ID NO: 90952 - DNA, 75 bp, Artificial Sequence
  Synthetic
agtatcaattgacaatactggtagtataatgaatattgaatatataatatactctcttaaattagatagtgataa

SEQ ID NO: 90953 - DNA, 75 bp, Artificial Sequence
  Synthetic
actctcttaaattagatagtgataaagagttatagatgactgcaatcgttttaatataattatatatggatttga

SEQ ID NO: 90954 - DNA, 75 bp, Artificial Sequence
  Synthetic
ttacctggtataatccttatgcaattgaattatgtgtcatcaattaatagcttaatagcactgttttacatactt

SEQ ID NO: 90955 - DNA, 75 bp, Artificial Sequence
  Synthetic
acccaacaaggggaaataagtcaacaagagaattaaaatctattaagttgaaattaggatcaaagactccaatct

SEQ ID NO: 90956 - DNA, 75 bp, Artificial Sequence
  Synthetic
actgggattgtctttgatcaattgtcataacaattatggagttgtttgacatcgcagacgggttcgctgatcatc

SEQ ID NO: 90957 - DNA, 75 bp, Artificial Sequence
  Synthetic
agatcaacctaagatcttctaagcaggcaactggaagtctcagtgcaatcaaggatcaaatccttgtattgatcc

SEQ ID NO: 90958 - DNA, 75 bp, Artificial Sequence
  Synthetic
ctggaacacaagattctgacattttaagcaacctcctaattgccctattatccttgatcttcaatgcaggctgtc

SEQ ID NO: 90959 - DNA, 75 bp, Artificial Sequence
  Synthetic
cagagcctatctgcgctggggctttcctcagccttttagtcctcttcacgaataatccaactgcagccttaggaa

SEQ ID NO: 90960 - DNA, 75 bp, Artificial Sequence
  Synthetic
ctcatgcaaaggactcggatacagtcatcagtacctacaccatcactgagttttcaggaatgggtccagtattaa

SEQ ID NO: 90961 - DNA, 75 bp, Artificial Sequence
  Synthetic
tgaacagagaccaagtagaagaattcatgactaataaacttaacgatttaatccgagttatcaagtttcccgact

SEQ ID NO: 90962 - DNA, 75 bp, Artificial Sequence
  Synthetic
tattcgtaaggtcaaacaaggctgatgcactctttaatggcccggtagagttcaaagttgccctcaactcgatac

SEQ ID NO: 90963 - DNA, 75 bp, Artificial Sequence
  Synthetic
taattcaagtttggaatttgctagctaaaagcatcacagcaagtaatactgcagaaggctctgaagacagaagaa

SEQ ID NO: 90964 - DNA, 75 bp, Artificial Sequence
  Synthetic
ccgagagatttgagcaagaagggaggattgcgtccatctatgaactgagcaaaaacatgaaaaagcgactcaggg

SEQ ID NO: 90965 - DNA, 75 bp, Artificial Sequence
  Synthetic
aaacactaaggaaacacatgatcatcaagaagacgatggtgagcattatgcaggaatctgtagcaatgggctcaa

SEQ ID NO: 90966 - DNA, 75 bp, Artificial Sequence
  Synthetic
atgggggagagttggttaagaccattgcggtaatctcccactatgtcgtcaatgcagggctcaccggtttctttc

SEQ ID NO: 90967 - DNA, 75 bp, Artificial Sequence
  Synthetic
agaccattaagtatggtataaacacacgctctgctgcattggctgtcagtgatatccaagccgagcttggcaaga

SEQ ID NO: 90968 - DNA, 75 bp, Artificial Sequence
  Synthetic
ttaaggctctcatgcaactatacaagaagaaaggtgagaatgcaccgtacatggtcatactagacgactcagatg

SEQ ID NO: 90969 - DNA, 75 bp, Artificial Sequence
  Synthetic
catcttatttcgcacctgcggcatacccgatgatatggagttttgcaatgggctacgggacagcagttgatacag

SEQ ID NO: 90970 - DNA, 75 bp, Artificial Sequence
  Synthetic
cgctggctggagtaaactacaataggagtttcctagatagcaagtggtttgcgataggccagaaaatggcagttg

SEQ ID NO: 90971 - DNA, 75 bp, Artificial Sequence
  Synthetic
agtcagggtccaaggttaacgttgggatgcttaagacacttggtttaacagaacagcaaggtcagactttggcaa

SEQ ID NO: 90972 - DNA, 75 bp, Artificial Sequence
  Synthetic
caatattggaggaaagcaaggatgctagagctgccatgatatcaggcatcagtggatcaagcaatattaaagatg

SEQ ID NO: 90973 - DNA, 75 bp, Artificial Sequence
  Synthetic
gcgaaagtttcgaattggagccaaacatgtcacccagcatatacagcgagtcaaccacaaccaagctagacagaa

SEQ ID NO: 90974 - DNA, 75 bp, Artificial Sequence
  Synthetic
tcaagaagctggccaaagaggtcagagaaacagcaataacggcagaggacaacatcgggtctttggatgatgaga

SEQ ID NO: 90975 - DNA, 75 bp, Artificial Sequence
  Synthetic
gcaaggtcatagctggcatgtcataaccatattgctgagagatcaactttgtatacctaacaacgagcataccaa

SEQ ID NO: 90976 - DNA, 75 bp, Artificial Sequence
  Synthetic
ctataggcatgtgaagatgattaaagaaaacctaggatcaaagatccatgatcagaacacgcatctacaaaccga

SEQ ID NO: 90977 - DNA, 75 bp, Artificial Sequence
  Synthetic
cctacacaacaaccacaccacccacatgtcacacccccatcaagatggaagaagacccgagagagaagatgcatc

SEQ ID NO: 90978 - DNA, 75 bp, Artificial Sequence
  Synthetic
cccaatcaatgtggagactggtgagactgagagcacagagacttctatcatacagcgaatcaacagatctttcga

SEQ ID NO: 90979 - DNA, 75 bp, Artificial Sequence
  Synthetic
ccagggagttcctggaagacgtcagcaagtcggtggtcgtccttttcaacagagatgggatgagttctatatcac

SEQ ID NO: 90980 - DNA, 75 bp, Artificial Sequence
  Synthetic
agtggcgtacagaagactgtgctgcgaggagactggggaatttatctaaatttgcatgggatgcggtaaccaaag

SEQ ID NO: 90981 - DNA, 75 bp, Artificial Sequence
  Synthetic
gtaggatggatccatgcagactagccttcaagatggtcactgaattgggaaatgatgtagccatacgagctgaga

SEQ ID NO: 90982 - DNA, 75 bp, Artificial Sequence
  Synthetic
tcctgacggttgtatggttgataacagggtggtcaacaatcccccgaactctacacaaagatctatggtctagtg

SEQ ID NO: 90983 - DNA, 75 bp, Artificial Sequence
  Synthetic
ctatatataggagattgtcgttgtgatcacaatcaggttcattgcaatatcccactcttttggtgggctgtgtcg

SEQ ID NO: 90984 - DNA, 75 bp, Artificial Sequence
  Synthetic
tagtcagtcatgattcatttaagcaaattaagaaaaacttaggatcaaaggtatctgagatccagtaagaatggc

SEQ ID NO: 90985 - DNA, 75 bp, Artificial Sequence
  Synthetic
taacttcaatggtttcgaagcaagcagccttattgatcaaggcttagacgacatagaggcaatcggacagatgac

SEQ ID NO: 90986 - DNA, 75 bp, Artificial Sequence
  Synthetic
ctgcattagaccctctgaggagtcaccatacgtagagataccagacactggtatcgtacctgggatagtaggcaa

SEQ ID NO: 90987 - DNA, 75 bp, Artificial Sequence
  Synthetic
agccattggtgaaattgagtccaaaaccaatggtgatggccatacctcagcacctacaccgcacaacaccatcaa

SEQ ID NO: 90988 - DNA, 75 bp, Artificial Sequence
  Synthetic
gggcaatgctgataaagtcaagaaatctggcgaaacgatcccggacaaagcggaggaacctcaaccggtgcaaca

SEQ ID NO: 90989 - DNA, 75 bp, Artificial Sequence
  Synthetic
gcaggataggagcaaagtcaaagaaagcaacattacaatgaatccagacagctcaggtttcaagcaactcttcaa

SEQ ID NO: 90990 - DNA, 75 bp, Artificial Sequence
  Synthetic
tagagacacggaactcaagacaaattcatggaaaaacaccatagctggttccatgatgaaccataaagatgagaa

SEQ ID NO: 90991 - DNA, 75 bp, Artificial Sequence
  Synthetic
caagttaggaataaggggggcttctagcgaagggagaagacccagccgaggtcatagaagggaaatcagtacctc

SEQ ID NO: 90992 - DNA, 75 bp, Artificial Sequence
  Synthetic
taccattgacgggatatttgaggtctgggaattttgcaatcccatgtgttcccgtattacccccgatttcaagcc

SEQ ID NO: 90993 - DNA, 75 bp, Artificial Sequence
  Synthetic
caaaatctgcgtctgcggagagtgtccgagatactgcccaagatgcaaggaacagggcggtatcagagtgcctga

SEQ ID NO: 90994 - DNA, 75 bp, Artificial Sequence
  Synthetic
gtgagcaggttggcgagatatccatggcagtttcggatctaggtgtcattgttagaaaagtcataatgggcaatt

SEQ ID NO: 90995 - DNA, 75 bp, Artificial Sequence
  Synthetic
ccgagagggacgaaaacttaacagcactaatgatgaagatgcaaaaacagcttgcaatccaggagggaaagctgg

SEQ ID NO: 90996 - DNA, 75 bp, Artificial Sequence
  Synthetic
aaactctgcaatccactgttgggaaaatctatgctaaagttgacctgatcaaggatcatgtctcgaagtacatga

SEQ ID NO: 90997 - DNA, 75 bp, Artificial Sequence
  Synthetic
tattaacaagagaaggaggtaaagacagtcaagaacatgaacctaggagattgatacagtcttacacaggcccag

SEQ ID NO: 90998 - DNA, 75 bp, Artificial Sequence
  Synthetic
ggaaacccgaagccgtgatcaatgagcatggccaaatcaggctcaaaggaacgaccaggagtggcaccagttgga

SEQ ID NO: 90999 - DNA, 75 bp, Artificial Sequence
  Synthetic
acacgaccccacatgatttggtggatcccacaagactgacgatgtccagagatgaatcaaatgctacaaggttta

SEQ ID NO: 91000 - DNA, 75 bp, Artificial Sequence
  Synthetic
tacccaagcttgatgatgcttctagggcaactctcctcagcctcctaaccatgtccggcctggacaatgacactc

SEQ ID NO: 91001 - DNA, 75 bp, Artificial Sequence
  Synthetic
aaagcacacttgaaggaataattatgagtgccacaagagtagatcagctaattgaggttcatgagatactcttgg

SEQ ID NO: 91002 - DNA, 75 bp, Artificial Sequence
  Synthetic
aaccataacaaccccatatatgatagacccagtatatctgtgcaatgtcgactctccaacctgacatctgagcca

SEQ ID NO: 91003 - DNA, 75 bp, Artificial Sequence
  Synthetic
caccgccatagaacaaattccatccagtcatcaccttattaagaaaaacctaggaacaaagttccactggttcca

SEQ ID NO: 91004 - DNA, 75 bp, Artificial Sequence
  Synthetic
gaatggggactatcgcagaattcaaccctgtgacatgggccgagcatggctcacttagccctatgttactcgagc

SEQ ID NO: 91005 - DNA, 75 bp, Artificial Sequence
  Synthetic
aaggaccggataaaaagattatcccgcagtacagattcatagcacctaaacctgaagctggaaggacaaagatgg

SEQ ID NO: 91006 - DNA, 75 bp, Artificial Sequence
  Synthetic
attggtacctaactctcagtggtattatagaatgtaaatcacaatcaggagctggaagtgatacggcaccaacga

SEQ ID NO: 91007 - DNA, 75 bp, Artificial Sequence
  Synthetic
cctccggcaaaaagattgtatccatgggaatgataccactaggtgtgggtcacactagggagacgccagatgcac

SEQ ID NO: 91008 - DNA, 75 bp, Artificial Sequence
  Synthetic
ttctggatgctgtggtgaagttgaaaataaccgtgcgtaggactgcccgaagctcagaaacactgatattcacat

SEQ ID NO: 91009 - DNA, 75 bp, Artificial Sequence
  Synthetic
tcgcagaagttgacccgaggcttgctccttggaactacaatctcaagagtgggatgggatttccatcgatgaaag

SEQ ID NO: 91010 - DNA, 75 bp, Artificial Sequence
  Synthetic
tatcatcacaggctcatttgattcccgtcgatcaaagatgtactatgagaggtgtctttctgatcatcactgcac

SEQ ID NO: 91011 - DNA, 75 bp, Artificial Sequence
  Synthetic
taggttcaggaagttactacaagatcccgagacctattcagaacttgacaatcgcggacacaatctctgtcaatt

SEQ ID NO: 91012 - DNA, 75 bp, Artificial Sequence
  Synthetic
ttttggttgggttgacaactgacggggatttatcaaaagccggtttgatgaccacaagagactcggaaggccatc

SEQ ID NO: 91013 - DNA, 75 bp, Artificial Sequence
  Synthetic
acacagttgaaacaatgatacatttgggtatattcaagaggaccaaaggcaagagttacacagtggaatattgcc

SEQ ID NO: 91014 - DNA, 75 bp, Artificial Sequence
  Synthetic
aggctaaagtactggctatggatctgacttttgcattggcaggtgtcggcggtgtttccctgcatgtgatcgtta

SEQ ID NO: 91015 - DNA, 75 bp, Artificial Sequence
  Synthetic
atgggaaaattagcaaacagttattaacacaattagccgggcaccgatccatatgctactcactgatggatatca

SEQ ID NO: 91016 - DNA, 75 bp, Artificial Sequence
  Synthetic
atcctaagatcaacagtgtgttatggagacctatggtagagatatcctacatcaaagctgtgttccagcctagta

SEQ ID NO: 91017 - DNA, 75 bp, Artificial Sequence
  Synthetic
tccccaaagagttcaagatctactcagatgtcatcgtcaagaaagcgggaagagtacagcagctgataaagaaag

SEQ ID NO: 91018 - DNA, 75 bp, Artificial Sequence
  Synthetic
gattttaatcaaaggatcccggtgtacggacatatgagagaaacactacatagttttaaactaattatacttcag

SEQ ID NO: 91019 - DNA, 75 bp, Artificial Sequence
  Synthetic
caacctagctggagaataaatgtacctcaatcaacttaattacaacttggcttgatgattctctttaagcttacc

SEQ ID NO: 91020 - DNA, 75 bp, Artificial Sequence
  Synthetic
acggcctgaattaattcctcactgtaactattaagatttataatggcatgatctatgttaggttaacgtaattgt

SEQ ID NO: 91021 - DNA, 75 bp, Artificial Sequence
  Synthetic
aaaataaaaaacttaggagcaaagctctttaagacctctccgagcgtttttgaaaggagatataatacgtgacta

SEQ ID NO: 91022 - DNA, 75 bp, Artificial Sequence
  Synthetic
agatgactaggataactatccttcagattatcctgacactaacacttccggtcatgtgtcaagtctcatttgata

SEQ ID NO: 91023 - DNA, 75 bp, Artificial Sequence
  Synthetic
accttgaacaagtaggggtcatgtttgataagcccaagttcctgaagatcacgggtccggctagtactgcgacaa

SEQ ID NO: 91024 - DNA, 75 bp, Artificial Sequence
  Synthetic
tgataatcaaattaataccaacactaggaactatggagagctgtggaacttctgctgttaatgaatataagaaga

SEQ ID NO: 91025 - DNA, 75 bp, Artificial Sequence
  Synthetic
ctcttgacaccatcttagtacctctgagggacaccataaacaaattaagtactgatatcactgtagtagaaggga

SEQ ID NO: 91026 - DNA, 75 bp, Artificial Sequence
  Synthetic
cctcaaacatatcaaacaagagagagaagagatttgtcggaatagcgattgcagttggagctgttgccctagcta

SEQ ID NO: 91027 - DNA, 75 bp, Artificial Sequence
  Synthetic
cgtctgcacagataacagcggggattgctctctctaatactattaagaatgcagaggcgatcgaaagtatcaaat

SEQ ID NO: 91028 - DNA, 75 bp, Artificial Sequence
  Synthetic
catctatccaagcgtcaaaccaggcaatacagaaagtcatagatgctcaaggaagaactgtcacagtcataaatg

SEQ ID NO: 91029 - DNA, 75 bp, Artificial Sequence
  Synthetic
gtattcaagatcacataaactccgtaattaatccggctttgaaccaactggggtgtgatgtcgccaaaaacacac

SEQ ID NO: 91030 - DNA, 75 bp, Artificial Sequence
  Synthetic
ttgctatatccctgactcagtacttctctaaactttcattgctatttggacctaatcttaggaaccctgtcgaac

SEQ ID NO: 91031 - DNA, 75 bp, Artificial Sequence
  Synthetic
aacccttgtcagttcaggcgatagccggcttaatggatggtgatattaatgcggtagtatcacaattagggtata

SEQ ID NO: 91032 - DNA, 75 bp, Artificial Sequence
  Synthetic
ctcaatccgacctgcttgacttattgtccacagagtcgatagtggggacagtcacggccattgatatggttaact

SEQ ID NO: 91033 - DNA, 75 bp, Artificial Sequence
  Synthetic
acatgatccagattgagatgtccttcccccaatatattacaattcctgacacgaaagtactagaagggcacaaaa

SEQ ID NO: 91034 - DNA, 75 bp, Artificial Sequence
  Synthetic
tcaccttcaatgataagggttctgaatggcaaactcaagtccctagcaccatcgcagttagagatatactaattg

SEQ ID NO: 91035 - DNA, 75 bp, Artificial Sequence
  Synthetic
ccggggttgaccctgatggatgttcgatcacaagtacttcttacatatgtaagaatgatccaacatacgccatgt

SEQ ID NO: 91036 - DNA, 75 bp, Artificial Sequence
  Synthetic
cagaggtccttactaattgtttcagaggcaatacacaagagtgtccgagagccaggataacatctacattcgcta

SEQ ID NO: 91037 - DNA, 75 bp, Artificial Sequence
  Synthetic
ctagattcgcaattgcaagatctacagtcatagccaattgtgtcgctgcagtatgtttatgcggtgaccccggga

SEQ ID NO: 91038 - DNA, 75 bp, Artificial Sequence
  Synthetic
tccctgtagtacagaaagccgaagtgactctgactgcgatgacccttgatcaatgtagcttgataactgtggacg

SEQ ID NO: 91039 - DNA, 75 bp, Artificial Sequence
  Synthetic
ggctacaaatcaaacccagcaaaagcattgcgaacgtaactgccaattttggaaacataacgttagggccagtgg

SEQ ID NO: 91040 - DNA, 75 bp, Artificial Sequence
  Synthetic
tatcagttggggacctagacttatcagcagaactaactaaggtccaatcagatctaaaggaggctcaggataagc

SEQ ID NO: 91041 - DNA, 75 bp, Artificial Sequence
  Synthetic
tcgatgaatcaaatgcaatcctacaaggaattaacaataagatcctgactgctccaacctctatcgcattaattg

SEQ ID NO: 91042 - DNA, 75 bp, Artificial Sequence
  Synthetic
tagtctctgttgtggttattttgttaatcatagggatgatcagctggttggtctggttgaccaaggcagtcagga

SEQ ID NO: 91043 - DNA, 75 bp, Artificial Sequence
  Synthetic
ggtccaacactaggtcagaaagggtgacaccaagtgcttacaacaatctaggctttataaaataaaaagttgact

SEQ ID NO: 91044 - DNA, 75 bp, Artificial Sequence
  Synthetic
atgtgatcatttgtcagacctgttaaagtatcaaggcgggagcatggagtcataatactgtccttatgtacgatt

SEQ ID NO: 91045 - DNA, 75 bp, Artificial Sequence
  Synthetic
aagaaaaacctaggatcaaagattattgatcttaagtacaatggatcccaaaagctactactgcaatgaggacct

SEQ ID NO: 91046 - DNA, 75 bp, Artificial Sequence
  Synthetic
gaggagcgatggtggagaaaaatcaccaggaggagacctctacaagggaatcatcctggtgtcgactgtgatatc

SEQ ID NO: 91047 - DNA, 75 bp, Artificial Sequence
  Synthetic
ccttatcattgctataatctctctcgcattcattatagataacaagattaatatacaatcactcgaccctttgag

SEQ ID NO: 91048 - DNA, 75 bp, Artificial Sequence
  Synthetic
aggtctggaggatagttacttagtcccaattaaagataagtctgaatctatcagtcaagatatacaggaaggaat

SEQ ID NO: 91049 - DNA, 75 bp, Artificial Sequence
  Synthetic
attccctcgtctgaacttgatcacagccgcaacaacgactaccattccccggagcatagccatacagacaaagga

SEQ ID NO: 91050 - DNA, 75 bp, Artificial Sequence
  Synthetic
tctgagtgacttgattatgaataggtgttacccctctgttgtgaataatgacacctcttgtgatgtactagctgg

SEQ ID NO: 91051 - DNA, 75 bp, Artificial Sequence
  Synthetic
agcaatacacagtaatttattctcgcaactggacccgtcgacatactggacatgctcttctgggaccccgaccat

SEQ ID NO: 91052 - DNA, 75 bp, Artificial Sequence
  Synthetic
gaatcaaacagtgaaattactacctgataactcccagatcccaggttccacgtactcaaccggttgtgttagaat

SEQ ID NO: 91053 - DNA, 75 bp, Artificial Sequence
  Synthetic
accaacattctcactaggcagtatgatctattcttatagtcacaacgtcatatatgaaggttgcaatgatcattc

SEQ ID NO: 91054 - DNA, 75 bp, Artificial Sequence
  Synthetic
taaatcctcacagtattggcaattaggctacattagtacaagtaaaactggtgaaccacttcagcaagtcagcag

SEQ ID NO: 91055 - DNA, 75 bp, Artificial Sequence
  Synthetic
gacactgactctgaataatgggctaaaccgcaaatcctgcagtaccgtggcacaagggagaggcgcatacctgtt

SEQ ID NO: 91056 - DNA, 75 bp, Artificial Sequence
  Synthetic
atgtaccaatgttgtggaagatgagaggaccgattacagtacagagggtattcaagatctgactttggactacat

SEQ ID NO: 91057 - DNA, 75 bp, Artificial Sequence
  Synthetic
agatatctttggcgcggagaggagctatagatatactaataatgaggttgacctggaccgtccttacgcggcact

SEQ ID NO: 91058 - DNA, 75 bp, Artificial Sequence
  Synthetic
ctaccccagtgttggatcagggacagtttataatgataggatcttattcctggggtatggaggattgatgacacc

SEQ ID NO: 91059 - DNA, 75 bp, Artificial Sequence
  Synthetic
ttacggagatcaagctatgtgccaagctccagaatgtacatctgctacacaagaggggtgtaacagtaaccagct

SEQ ID NO: 91060 - DNA, 75 bp, Artificial Sequence
  Synthetic
aatagggtatttttcagggaggcagatagtgaactgtattattgagattattacagttgggacagagaaaccaat

SEQ ID NO: 91061 - DNA, 75 bp, Artificial Sequence
  Synthetic
cattcgtgttaggaccatcccaaattcccaggtgtggctcggtgcagagggtcgtatacagacattaggtggagt

SEQ ID NO: 91062 - DNA, 75 bp, Artificial Sequence
  Synthetic
actttacctctacattagatcatcagggtggcatgctctggctcagacaggtatcatcttgacgcttgaccctat

SEQ ID NO: 91063 - DNA, 75 bp, Artificial Sequence
  Synthetic
aagaataagttggatagtaaatacaggatattcgagacctgggaacggtccctgctcagcatcgtcacgatgtcc

SEQ ID NO: 91064 - DNA, 75 bp, Artificial Sequence
  Synthetic
agcgcagtgtatcacaggagtttacacagatatctttccgttgtcgcaaaattatggttatttggctacagtcac

SEQ ID NO: 91065 - DNA, 75 bp, Artificial Sequence
  Synthetic
attgctatccggagtagatcgggtcaacccggtgatatcatatggtacttccactggacgggttgcagatagtca

SEQ ID NO: 91066 - DNA, 75 bp, Artificial Sequence
  Synthetic
actaacgagctcaagtcaggtggccgcatacacgacaaccacttgtttcacattcaatcaaaaggggtattgcta

SEQ ID NO: 91067 - DNA, 75 bp, Artificial Sequence
  Synthetic
tcatatcatagagttaagtcctgctactctaggcatattccaaccggtcctagtcgtgaccgagatccccaaaat

SEQ ID NO: 91068 - DNA, 75 bp, Artificial Sequence
  Synthetic
ctgttcataatattgttagtgcacagagggctgtcaagcaagttagacgcagccgggcacgaacgagacacacca

SEQ ID NO: 91069 - DNA, 75 bp, Artificial Sequence
  Synthetic
gccgaacggagctgacacacaggacaatgatgatgacctgggggacttaaatttcggtcacatcagcagcatcaa

SEQ ID NO: 91070 - DNA, 75 bp, Artificial Sequence
  Synthetic
ggagaatgaacaaaccggaacccagaaagccaaccacagcaatcaaccaggattgattatccaattaagaaaaac

SEQ ID NO: 91071 - DNA, 75 bp, Artificial Sequence
  Synthetic
ctaggatcaaagatcctgcatgcacaatggatcccaaggatatcctttaccctgaatgtcatcttgattcaccaa

SEQ ID NO: 91072 - DNA, 75 bp, Artificial Sequence
  Synthetic
ttgtgcttggaaaggtcataagactgcattatctccttgaccttacagttgagtatgatattaaagactcatcaa

SEQ ID NO: 91073 - DNA, 75 bp, Artificial Sequence
  Synthetic
tcttgagaaacctagattataatgctaagtccgggagattatctaacagggatagggagctagtaaagcacaaag

SEQ ID NO: 91074 - DNA, 75 bp, Artificial Sequence
  Synthetic
atatcttaagaaaagaagggtttgtcagatcaggatacagagggattgattacccaagagggaataaggaacttt

SEQ ID NO: 91075 - DNA, 75 bp, Artificial Sequence
  Synthetic
tcagattagtgatcccaaatctgacaaagcccctggagtgtctgttaaaacagagcaataaggtatttgatagga

SEQ ID NO: 91076 - DNA, 75 bp, Artificial Sequence
  Synthetic
ttgagtctggattgagggacacgttcctggcatcagccaataagatttcggggaaaggcaaggaagtattcactg

SEQ ID NO: 91077 - DNA, 75 bp, Artificial Sequence
  Synthetic
agcagaacctaacagagagcgggatggccggtgtgtccagatctattcataacaatggatggaaccaaccattca

SEQ ID NO: 91078 - DNA, 75 bp, Artificial Sequence
  Synthetic
tgacttggttcacaatcaagaaagagatgcggaagttaaagaaggattatagaaagaacgccaagagcacaggga

SEQ ID NO: 91079 - DNA, 75 bp, Artificial Sequence
  Synthetic
tgaccagattggcatctcatcatgagaggtattccctatacattcactctgacttcgtgctgatttctgatcatg

SEQ ID NO: 91080 - DNA, 75 bp, Artificial Sequence
  Synthetic
tgttggaagtatatcacttgctgactgacgatatggttttgggattctgtgatgtagtagaagggagattgatgg

SEQ ID NO: 91081 - DNA, 75 bp, Artificial Sequence
  Synthetic
tctcagcagttgcttcaatggaccctaattatgtgaacataggcattagaggggaacaattgtggagcttgattg

SEQ ID NO: 91082 - DNA, 75 bp, Artificial Sequence
  Synthetic
actcgctcttcattctacttggtaataaagtctatgatgtggttggtatgctagagcccttggcattatcctata

SEQ ID NO: 91083 - DNA, 75 bp, Artificial Sequence
  Synthetic
tccaactaagagatcctattaaagaaataagaggtgcattcctgtattataacctaagcgagttagaccagctct

SEQ ID NO: 91084 - DNA, 75 bp, Artificial Sequence
  Synthetic
taaaagaagacactatactttcaacaggtgaagttaaagactttatcgagctaataagtgagataatcaatatgg

SEQ ID NO: 91085 - DNA, 75 bp, Artificial Sequence
  Synthetic
gcagtgtatctgaaatatcagagattttctctttcttcagatcctttggtcatcccgtcctagaggctgttactg

SEQ ID NO: 91086 - DNA, 75 bp, Artificial Sequence
  Synthetic
ctgctgataaagtgagagatcatatgtgtaagcctaaagtcttagactatgagacactgcagaaaggacatgcag

SEQ ID NO: 91087 - DNA, 75 bp, Artificial Sequence
  Synthetic
tattctgttctatgataatcaacggattcagagagagacacggaggatcttggccaccatgcttcctcccagact

SEQ ID NO: 91088 - DNA, 75 bp, Artificial Sequence
  Synthetic
atgcatcatctgagctcaaagcggttatggcaaatcatgccgcaattccttatgagttaagtgtaaataactggg

SEQ ID NO: 91089 - DNA, 75 bp, Artificial Sequence
  Synthetic
aatcttttataggcttcaaatttgacaaattcgaagaggtcaacctggatgaagatctgactatatttatgaaag

SEQ ID NO: 91090 - DNA, 75 bp, Artificial Sequence
  Synthetic
ataaggcactgtctcctattagggcagaatgggatactgtttacccgcaagagaacatgcaatactcacctggca

SEQ ID NO: 91091 - DNA, 75 bp, Artificial Sequence
  Synthetic
gaagctctaccagtaggagattggtagatgtgttccttgaagacatggaattcaacccacaggacataatagatt

SEQ ID NO: 91092 - DNA, 75 bp, Artificial Sequence
  Synthetic
atgttgtatctggtagttacctgattgatcaggacttcaatatctcctatagcctcaaagagaaagagattaagc

SEQ ID NO: 91093 - DNA, 75 bp, Artificial Sequence
  Synthetic
aagcgggcagattatttgccaagatgacatacaaaatgagagctgcacaagtcctagcagaatctctggttgcgc

SEQ ID NO: 91094 - DNA, 75 bp, Artificial Sequence
  Synthetic
atggtgtggggaagtatttccaggaaaatgggatggttaaggatgagcatgaactccttaaatcactaacaacct

SEQ ID NO: 91095 - DNA, 75 bp, Artificial Sequence
  Synthetic
tgtcactagctggggtacctagatcaaggcctggtgaggacccatctgcaacagaggagagcaagtttgtgaaga

SEQ ID NO: 91096 - DNA, 75 bp, Artificial Sequence
  Synthetic
tagctcagaagggaaaggagattctcaggaacaaccaaacaagaaggagtacacaagagagccgggatcaggatg

SEQ ID NO: 91097 - DNA, 75 bp, Artificial Sequence
  Synthetic
ggttagccaatgagaaacatgagactgttgcgtcattcataaccactgatctgcaaaaattttgtttaaattgga

SEQ ID NO: 91098 - DNA, 75 bp, Artificial Sequence
  Synthetic
ggtacgagagtgttatactcttcgcccagagattggatgagatctatgggttgccaggattcttcgagtggttgc

SEQ ID NO: 91099 - DNA, 75 bp, Artificial Sequence
  Synthetic
acaaaagacttgagaagtctgtactgtatgttgcagatccaaattgtccacctgacttcaggaccaaaatgagtc

SEQ ID NO: 91100 - DNA, 75 bp, Artificial Sequence
  Synthetic
tggaggacaccccggacactgggatatttatccacaatccaatgggagggattgagggatactcacaaaaaatgt

SEQ ID NO: 91101 - DNA, 75 bp, Artificial Sequence
  Synthetic
ggactattatatctattagcatgatccacctagctgcagtccagacaggggtgagagtctccgcagttatccaag

SEQ ID NO: 91102 - DNA, 75 bp, Artificial Sequence
  Synthetic
gagacaatcaatctatcgcagttactacaagagttccggtgagaatgaattataatcagaaaaagactgagtgtt

SEQ ID NO: 91103 - DNA, 75 bp, Artificial Sequence
  Synthetic
acaaaagcacgataagatactttgagactttgaggaaagtgatgggagggttgggacataacttgaaactgaacg

SEQ ID NO: 91104 - DNA, 75 bp, Artificial Sequence
  Synthetic
agactatcatatccaatcagttctttatctactcgaagcgaatatactttgatggttctatcttaccccaaggtc

SEQ ID NO: 91105 - DNA, 75 bp, Artificial Sequence
  Synthetic
ttaaaactatttctcggtgtgttttctggtcagaaactttagtggatgaaactagggcagcttgctctaacattt

SEQ ID NO: 91106 - DNA, 75 bp, Artificial Sequence
  Synthetic
cgacatctctcgctaaggcggtcgagaacgggatatcccctctattgtgttacctacttaatgcctggaaaacac

SEQ ID NO: 91107 - DNA, 75 bp, Artificial Sequence
  Synthetic
tgcaacaactacacatatccttagctttttcaattaacccgacaataacgaaagatctgtatgggccgattttga

SEQ ID NO: 91108 - DNA, 75 bp, Artificial Sequence
  Synthetic
gctctcaagactggatgataatagctgtcatagtcccatcacaattaggcgggttcaattacatgagtctctcta

SEQ ID NO: 91109 - DNA, 75 bp, Artificial Sequence
  Synthetic
ggttgttcgtgcgtaatatcggggatcctttagtagcggcattggcagatgttaagagatatattgagattgggt

SEQ ID NO: 91110 - DNA, 75 bp, Artificial Sequence
  Synthetic
tactcacgacagctgccctcacgaagtttaccactcaagtcccaggggattccacagagttagactgggcatcag

SEQ ID NO: 91111 - DNA, 75 bp, Artificial Sequence
  Synthetic
atccctactctgcaaatttaccccactcacaaagtgtgaccactgtaatcaaacatgtgacagccaggtctgtat

SEQ ID NO: 91112 - DNA, 75 bp, Artificial Sequence
  Synthetic
tatccaaatcaccaaaccccatgctggaagggttattccatgagaatactgatgaggaggatcatgatctggcca

SEQ ID NO: 91113 - DNA, 75 bp, Artificial Sequence
  Synthetic
gattcttaatagaccgagaaataatactgccaagagttgcaaatgttatactagatcaatccgtgacaggtgcca

SEQ ID NO: 91114 - DNA, 75 bp, Artificial Sequence
  Synthetic
ggtctgcaattgcagggctcttagacacgacaaagaccctaatcaagaatacggcaaacaaaggaggactttcaa

SEQ ID NO: 91115 - DNA, 75 bp, Artificial Sequence
  Synthetic
atcgaactgtatcaaaacttttgtaccacgattatcaacaatttattgtctttaacaagatactaaggtcccaag

SEQ ID NO: 91116 - DNA, 75 bp, Artificial Sequence
  Synthetic
tcgatgataccacagatttcagtctagtttgttcagtcacacttgctaagataatgagatctaggatgtgggtca

SEQ ID NO: 91117 - DNA, 75 bp, Artificial Sequence
  Synthetic
aggttgcaaaaggaagaaggatagagggattggaggttcctgatcccttggagtgtttgaggggtgaattaatag

SEQ ID NO: 91118 - DNA, 75 bp, Artificial Sequence
  Synthetic
ttgggtcgggttcatgcaccatatgcgaaagagggatggaccaatacagttggttctacattccacccgggatgg

SEQ ID NO: 91119 - DNA, 75 bp, Artificial Sequence
  Synthetic
atctagagggacagcatcgggagaatggatcactgagagtcccgtatttcggttcatcaacgtctgagaggtcgg

SEQ ID NO: 91120 - DNA, 75 bp, Artificial Sequence
  Synthetic
aggcatccgtgaatactactagaggattgtcgagagccgcaaaagcagccattaggatagcgtccgtatacacct

SEQ ID NO: 91121 - DNA, 75 bp, Artificial Sequence
  Synthetic
gggcctacggagaatctcagcttagctggtatgaggcgtatgctttggcatcccaaagagcaaatctcacactag

SEQ ID NO: 91122 - DNA, 75 bp, Artificial Sequence
  Synthetic
agcaattgaaagtgataaccccgaagtccacctcaactagcttgtctcacaggcttaatgactcttcgacgcaaa

SEQ ID NO: 91123 - DNA, 75 bp, Artificial Sequence
  Synthetic
tgaaatttgcctctacaaacttacaacgtgttagcaggtttgttactatctcaaatgatcatatcaagttgaaag

SEQ ID NO: 91124 - DNA, 75 bp, Artificial Sequence
  Synthetic
ggaacggggatgcaggggataccaatttgatctaccagcaagtgatgttagtaggcttgagtattatcgagttga

SEQ ID NO: 91125 - DNA, 75 bp, Artificial Sequence
  Synthetic
cccacaggaggcaagagaataccggcgaggacagcaaggtcctacaccttcacatcagagaagactgctgtgtcg

SEQ ID NO: 91126 - DNA, 75 bp, Artificial Sequence
  Synthetic
aattcacacaagaccagggggatatcccttccttaaacaatctacctgaatttgaagaccacccaacgaacagac

SEQ ID NO: 91127 - DNA, 75 bp, Artificial Sequence
  Synthetic
tgatttatgatcctaatccgctagataatatatatataaccaggatcaaagaaacaagcgtttacttacatgaac

SEQ ID NO: 91128 - DNA, 75 bp, Artificial Sequence
  Synthetic
tggacttcctggcttggcatgatgaagatataaagacggtgcttgggaattcagtaggacagatgattgaagaag

SEQ ID NO: 91129 - DNA, 75 bp, Artificial Sequence
  Synthetic
ttatagcgaccactgagagagataatcttaaggacattaatgcactttcaaatgaagataatatcaactcaatca

SEQ ID NO: 91130 - DNA, 75 bp, Artificial Sequence
  Synthetic
taacggagatgatgctttctaatcctgatgatgtgttatcgtcactgggttgcatgttggtattaagatttgcgt

SEQ ID NO: 91131 - DNA, 75 bp, Artificial Sequence
  Synthetic
atgaatgttatgcacggcatatagagggcaaagaacagtatatatcatatgtaagcgataagatcgaaacaatgt

SEQ ID NO: 91132 - DNA, 75 bp, Artificial Sequence
  Synthetic
cacgttcaaatctgtcaatcttaatcaatagtctgactcatcctagagtgtttaggaagtactgtgatgaaggag

SEQ ID NO: 91133 - DNA, 75 bp, Artificial Sequence
  Synthetic
tactggtcccggataggggacagacattatctactcaggacttccgggcacacagtgtagaatactgtatcgcaa

SEQ ID NO: 91134 - DNA, 75 bp, Artificial Sequence
  Synthetic
gtctacagagattttttgaaaaatggacaatttccggcaatataactatattactgtgtgaccaagatgaagtca

SEQ ID NO: 91135 - DNA, 75 bp, Artificial Sequence
  Synthetic
tcataggtgagagagaactaactctcaaaggaaggatcaaggcaatgataatctgtatctactgtttgactgaaa

SEQ ID NO: 91136 - DNA, 75 bp, Artificial Sequence
  Synthetic
attccccgagccttgttggtctcaatacaaaggaaagagatgaagtgctgactgaatacttggaagaggtcggtc

SEQ ID NO: 91137 - DNA, 75 bp, Artificial Sequence
  Synthetic
aaagtaatatagagagtagatattgggtacttggatcaatagggattaagaagtacaatacatcccttacgtata

SEQ ID NO: 91138 - DNA, 75 bp, Artificial Sequence
  Synthetic
ttaggaggagcttagtcaaacagtacagattgagggatcttgatgttcagttactcattgatgagatggcagaac

SEQ ID NO: 91139 - DNA, 75 bp, Artificial Sequence
  Synthetic
aagacatggaatcattatccatggctgacccaatatttgaccaagtgaataagacagagaccatggggtctgtgt

SEQ ID NO: 91140 - DNA, 75 bp, Artificial Sequence
  Synthetic
cactatggcaatctataaaagtcaaggacctaacactagacaggaacccaagagcagaatctgccgaatatcgta

SEQ ID NO: 91141 - DNA, 75 bp, Artificial Sequence
  Synthetic
tacccacaacatgtgagatacctagtcaaattttacggattgtgggagtaaattctacatcttgctcgaaagctc

SEQ ID NO: 91142 - DNA, 75 bp, Artificial Sequence
  Synthetic
acgagttgaactcagtcatctgcaccctcccattagaagggaaatcctgtttgtttttggccgagggatcaggat

SEQ ID NO: 91143 - DNA, 75 bp, Artificial Sequence
  Synthetic
caatgatgacctattatatgttaagacacagattgaacaatgtttatttcaacacgggagtcggatcagaggata

SEQ ID NO: 91144 - DNA, 75 bp, Artificial Sequence
  Synthetic
tcaatagtcaacgagaaaccgacccatccccgtcagagcctgtcctagtcgaggggaatctccgaatcaagcatt

SEQ ID NO: 91145 - DNA, 75 bp, Artificial Sequence
  Synthetic
gtctaagtgaaaaagtcactgtgttatttaatgggagacctgagacgacctgggtagggaatgaagattgtgaat

SEQ ID NO: 91146 - DNA, 75 bp, Artificial Sequence
  Synthetic
cttatgtgactacacagataggtgaggacaaagtatcacttgttcactcagacatggaaagcgggatagagaaaa

SEQ ID NO: 91147 - DNA, 75 bp, Artificial Sequence
  Synthetic
gcaatcaggcggttcttgttgaacatgtatcactaatcaagatcttccaaggtgtgccaacgcctggagctacac

SEQ ID NO: 91148 - DNA, 75 bp, Artificial Sequence
  Synthetic
tagttagcaagatagcaccgagactagggactaactggactcagataatatcgttgtatttagaaacctttacca

SEQ ID NO: 91149 - DNA, 75 bp, Artificial Sequence
  Synthetic
atgtgacaatcttgtgtttaaagaacagtaaccctgcaagtagcgagctgtatgtcatatgtgatggtgtcaaga

SEQ ID NO: 91150 - DNA, 75 bp, Artificial Sequence
  Synthetic
cacgtattagggttaaatcaatcgtgtatgcgcagtgtgtccattatttaacagaggagagtcagtccagattag

SEQ ID NO: 91151 - DNA, 75 bp, Artificial Sequence
  Synthetic
aacagcggattatcgatgccaaactcaaagctggtgagcatctaatgagtgttataaatgatctcaagagtgggg

SEQ ID NO: 91152 - DNA, 75 bp, Artificial Sequence
  Synthetic
agaagataaaccagattgaaagtttattgaagatcggcttttctgcaaacatgaccacagtagccagacaattcc

SEQ ID NO: 91153 - DNA, 75 bp, Artificial Sequence
  Synthetic
tgagggtgactgatctgacagatacaactaccatattcacaaagctcaggctggcactagttgacttactaagag

SEQ ID NO: 91154 - DNA, 75 bp, Artificial Sequence
  Synthetic
tgacctcagaagagtcaacaactttatccttgtaccaaccttacccgctctcccagtcaggaaagtgtagggttg

SEQ ID NO: 91155 - DNA, 75 bp, Artificial Sequence
  Synthetic
taaaagagagagcaatgaagggttggattagtatcaatcttaacaccatcttcaccaagaggaactatctaaaac

SEQ ID NO: 91156 - DNA, 75 bp, Artificial Sequence
  Synthetic
atgacttcgagtaccttgcagtacgaaacaaagtgataatagatatgaagtgcctgttggcttgtggagttgtga

SEQ ID NO: 91157 - DNA, 75 bp, Artificial Sequence
  Synthetic
acaagaaaaccggtgatagacttaatcggatgtcacatttactatactcagagattactaatcgtgacaagaaga

SEQ ID NO: 91158 - DNA, 75 bp, Artificial Sequence
  Synthetic
aactgttcaaactcatcggatcggccttttatttctcaggacgttgaggggtaagtgagatccaatcccaaccgc

SEQ ID NO: 91159 - DNA, 75 bp, Artificial Sequence
  Synthetic
aatcttttggagagaatgatacgatcggtcgagtaagaaaaactttttctttcttgttcatatttccccttgttg

SEQ ID NO: 91160 - DNA, 75 bp, Artificial Sequence
  Synthetic
cttttggagagaatgatacgatcggtcgagtaagaaaaactttttctttcttgttcatatttccccttgttgggt

SEQ ID NO: 91161 - DNA, 75 bp, Artificial Sequence
  Synthetic
acccaacaaggggaaatatatcaacaatagaattaaaatctattaagttgaaattaggatcaaagactccaattt

SEQ ID NO: 91162 - DNA, 75 bp, Artificial Sequence
  Synthetic
attgggattgtctttgatcaattgtaagaacaattatggaattatttgatatcgcggacgggtttgctgatcatc

SEQ ID NO: 91163 - DNA, 75 bp, Artificial Sequence
  Synthetic
agatcaatctgaggtcttccaaacaagcaactgggagtcttagtgcaatcaaagatcagatccttgtgttgatcc

SEQ ID NO: 91164 - DNA, 75 bp, Artificial Sequence
  Synthetic
ctggaacccaagattctgacatcttgagcaatctcctaattgccctcttatctctgatcttcaacgctggctgcc

SEQ ID NO: 91165 - DNA, 75 bp, Artificial Sequence
  Synthetic
ctgagcctatctgtgctggtgcctttctcagcctcttggttcttttcacgaacaacccaacagcagctctcggaa

SEQ ID NO: 91166 - DNA, 75 bp, Artificial Sequence
  Synthetic
cacacgcgaaagactcagacacagtcatcaacacatacacgatcaccgagttctcaggagtaggtccagtgctga

SEQ ID NO: 91167 - DNA, 75 bp, Artificial Sequence
  Synthetic
tgaacagagatcaggtggaggaattcatgaccaataaactcaatgatttaatccgggcaatcaagtttcccgact

SEQ ID NO: 91168 - DNA, 75 bp, Artificial Sequence
  Synthetic
tgttcgtaagaccaaacaaggctgatgcactctttaacggcccagtagaattcaaaatcgctctcaactcaatac

SEQ ID NO: 91169 - DNA, 75 bp, Artificial Sequence
  Synthetic
taattcagatctggaatctgttggccaaaagcattacagcaagtaatactgcagaaggttctgaagacagaagaa

SEQ ID NO: 91170 - DNA, 75 bp, Artificial Sequence
  Synthetic
ctgagagatttgagcaagaagggagaatagcatctatctatgaattgagcaaaaacatgaagaagcggttaagag

SEQ ID NO: 91171 - DNA, 75 bp, Artificial Sequence
  Synthetic
agacactgagaaaacacatgatcatcaagaaaacaatggtgagcattatgcaggagtctgtggcgatgggctcaa

SEQ ID NO: 91172 - DNA, 75 bp, Artificial Sequence
  Synthetic
atggaggagagttggtcaagaccattgctgtgatctcccattatgtggtcaatgcagggcttacaggtttcttcc

SEQ ID NO: 91173 - DNA, 75 bp, Artificial Sequence
  Synthetic
agaccattaagtatggtataaacacacgctctgctgcattagctgtcagtgatattcaggctgagctcggaaaga

SEQ ID NO: 91174 - DNA, 75 bp, Artificial Sequence
  Synthetic
tcaaggctcttatgcagctatacaagaagaaaggcgaaaatgcaccgtacatggttatactagacgattcggatg

SEQ ID NO: 91175 - DNA, 75 bp, Artificial Sequence
  Synthetic
catcttattttgctcctgcggcatacccaatgatatggagctttgcaatgggctacggaacagcagttgatacag

SEQ ID NO: 91176 - DNA, 75 bp, Artificial Sequence
  Synthetic
cgctggctggagtaaactacaataggagtttcctagatagcaagtggtttgcaataggccagaaaatggcagttg

SEQ ID NO: 91177 - DNA, 75 bp, Artificial Sequence
  Synthetic
agtcagggtccaaggtcaacgtcgggatgctcaagacacttggtctgacagaacagcaaggtcaaaccttggcta

SEQ ID NO: 91178 - DNA, 75 bp, Artificial Sequence
  Synthetic
caatactagaggagagcaaggacgctagagctgctatgatatcgggcattagcggatcaagcaatatcaaggatg

SEQ ID NO: 91179 - DNA, 75 bp, Artificial Sequence
  Synthetic
gcgagagcttcgaactagagccaaacatgtcacccagcatatacagcgaatcaagtacaaataagatggatagaa

SEQ ID NO: 91180 - DNA, 75 bp, Artificial Sequence
  Synthetic
tcaagaagctagccaaggagattagagagacaacactgacagcagaggacaacattgggtccttggacgacgaga

SEQ ID NO: 91181 - DNA, 75 bp, Artificial Sequence
  Synthetic
gcaaggtcgtagctgggatgtcatgaccacgcagccgagagatcgacccccaaaagtcaacaacgagtgcaccaa

SEQ ID NO: 91182 - DNA, 75 bp, Artificial Sequence
  Synthetic
tcataagcctgccaaaatgattaaagaaaacctaggatcaaagatccacagatagtacatacacctacaaatcag

SEQ ID NO: 91183 - DNA, 75 bp, Artificial Sequence
  Synthetic
ttcacatcacagccacatcatccacatgtcacacctccatcagaatggaagtggacccgagggagagaatgcatc

SEQ ID NO: 91184 - DNA, 75 bp, Artificial Sequence
  Synthetic
cacaatcaatgtggagactggtgaggctgagggcacagaggcttctatcgtacaacgactcgacggatctatcaa

SEQ ID NO: 91185 - DNA, 75 bp, Artificial Sequence
  Synthetic
ccagagagttcctagaagccatcagcaggtcggtggtcgtccttttcaacagagatgggatgagttctacaccac

SEQ ID NO: 91186 - DNA, 75 bp, Artificial Sequence
  Synthetic
agtggcatacagaggactgtgctgcgcggagactggagaatttatctaaattcgcgtgggatgtcataaccagag

SEQ ID NO: 91187 - DNA, 75 bp, Artificial Sequence
  Synthetic
gtaggatggacccgtgcaggttagctttcaagatggtcactgaactaggaaatgatgtgatcatacgagctgaga

SEQ ID NO: 91188 - DNA, 75 bp, Artificial Sequence
  Synthetic
tcctgacagttgtatggctaataacaggatggtcctcaatcccccaaaccctacacaaagacctatggtccagtg

SEQ ID NO: 91189 - DNA, 75 bp, Artificial Sequence
  Synthetic
ctatatataggagattatcattgtgatcgcagttaggcccatcgtagtacttcattcataatgcaggctgtactg

SEQ ID NO: 91190 - DNA, 75 bp, Artificial Sequence
  Synthetic
caatcaatcatgattcatttgatcacattaagaaaaacttaggatcaaaggtatctgagatccagtaataatggc

SEQ ID NO: 91191 - DNA, 75 bp, Artificial Sequence
  Synthetic
aaacttcaatggtttcgaagcaagcagtcttattgaccaaggcttggatgacatagaggcaatcgggcagatgac

SEQ ID NO: 91192 - DNA, 75 bp, Artificial Sequence
  Synthetic
ctgcattaggccatcagaggaatcaccatatgtggagatacctaacaccggtatagtacctgggatagtgggcaa

SEQ ID NO: 91193 - DNA, 75 bp, Artificial Sequence
  Synthetic
ggctatcggcgagattgagtccaaaactggtgatgatggttgtacttccgcacccaccccatacaacaccatcaa

SEQ ID NO: 91194 - DNA, 75 bp, Artificial Sequence
  Synthetic
gaataagactgagaaagtcaagggacccagtgacatagttctaaacaaaatggaagaaccccaaccagtgcacca

SEQ ID NO: 91195 - DNA, 75 bp, Artificial Sequence
  Synthetic
acaggacaagggcaaaaccaaggagagcaacatcacaataaacccagacagcaaaggtctcaagcagctattcaa

SEQ ID NO: 91196 - DNA, 75 bp, Artificial Sequence
  Synthetic
tagagacgcagactccaagacaaactcctggaaagacaccatatctggttccatgatgaatcacaaagatgagag

SEQ ID NO: 91197 - DNA, 75 bp, Artificial Sequence
  Synthetic
caagctcggagtaaggggggctcctagcgaagggaggagatccaaccgaggtcatagaagagaaattagtacctc

SEQ ID NO: 91198 - DNA, 75 bp, Artificial Sequence
  Synthetic
taccatcgacggaatatttgaggtctgggaattttgcaatcccatgtgttcccgtattacccccgatttcaagcc

SEQ ID NO: 91199 - DNA, 75 bp, Artificial Sequence
  Synthetic
caaagtctgcatctgtggagagtgtccgagatactgcccaagatgcaaggagcagggcggtatcagagtgcctga

SEQ ID NO: 91200 - DNA, 75 bp, Artificial Sequence
  Synthetic
gtgaacaagtaggtgagatatccatggcggtttcagatctaggtgtcattgttagaaaagccatgatgagcaatt

SEQ ID NO: 91201 - DNA, 75 bp, Artificial Sequence
  Synthetic
ctgagagggacgagaacttgacagcactgatgttgaagatgcaaaaacaacttgcaatccaagaagggaagttag

SEQ ID NO: 91202 - DNA, 75 bp, Artificial Sequence
  Synthetic
agactctgcaatccactgttgggaaaatttatgccaaagttgatctgatcaaggaccatgtttcgaagtatatga

SEQ ID NO: 91203 - DNA, 75 bp, Artificial Sequence
  Synthetic
tactaacaagagaaggaggtaaagataatcaagaacatgaaccgaggaggctaatacaatcttatacaggtccag

SEQ ID NO: 91204 - DNA, 75 bp, Artificial Sequence
  Synthetic
gaaaacccgaagctacaatcaatgagcacggccaaatcaggctcaaaggaacaaccagaagcggcaccagctgga

SEQ ID NO: 91205 - DNA, 75 bp, Artificial Sequence
  Synthetic
atacaacaccacatgacctgatggaccctgcaagactgatgatgtcgaaggatgaatcaaatgccacaaggtttg

SEQ ID NO: 91206 - DNA, 75 bp, Artificial Sequence
  Synthetic
tacccaaacttgatgatgcctccagagcaaccctactaagtctactgaccgtatctggcttagataatgacaccc

SEQ ID NO: 91207 - DNA, 75 bp, Artificial Sequence
  Synthetic
aaggtatgcttgagagaataattatgagtgctacaagggtagaccagctaattgaggttcacgaaatactcttgg

SEQ ID NO: 91208 - DNA, 75 bp, Artificial Sequence
  Synthetic
aaccataacaacttcatatataatcagctccgtacacttgtctgatgttgactttcttacctgacatctgagcca

SEQ ID NO: 91209 - DNA, 75 bp, Artificial Sequence
  Synthetic
tgccgccacggaacaaatcccactcagtcattgccttattaagaaaaacttaggaacaaagttccattggttccg

SEQ ID NO: 91210 - DNA, 75 bp, Artificial Sequence
  Synthetic
aaatggggaccattgcagaattcaatccgctaacatgggccgaacatggatccctcagtcctatgctgctcgagc

SEQ ID NO: 91211 - DNA, 75 bp, Artificial Sequence
  Synthetic
aagggccagacaaaaagatcatcccgcagtacaggttcatagcacccaaacctgaagctggaagaacgaagatgg

SEQ ID NO: 91212 - DNA, 75 bp, Artificial Sequence
  Synthetic
actggtacctgaccctcagtggcatcattgaatgcaaatctcagtctggagcagggaatgatgcatcaccgacaa

SEQ ID NO: 91213 - DNA, 75 bp, Artificial Sequence
  Synthetic
cttccagtaaaaagattgtctccatgggaatgatccccctgggtgtgggacatacaagagaaacaccagatgcac

SEQ ID NO: 91214 - DNA, 75 bp, Artificial Sequence
  Synthetic
tcttggatgcagtagtcaggttgaaaataactgtgcgcagaaccgcccggagttcagagacattaatattcactt

SEQ ID NO: 91215 - DNA, 75 bp, Artificial Sequence
  Synthetic
tcgcagatgttgacccgagacttgccccttggaattacaatctcaagagtggaatgggcttcccttcgatgaaag

SEQ ID NO: 91216 - DNA, 75 bp, Artificial Sequence
  Synthetic
tatcatcacaggctcatctgattcctgtcgatcaaagatgcaccatgagaggtgtatttttgatcatcactgcat

SEQ ID NO: 91217 - DNA, 75 bp, Artificial Sequence
  Synthetic
tgggttctggaagttactataagatcccaaggcctattcagaacttgacaatcgcggacacgatctctgttaact

SEQ ID NO: 91218 - DNA, 75 bp, Artificial Sequence
  Synthetic
ttttggttggattgacaactgacggggacttgtcaaaggctggtttgatgtccacaagagattcagagggccatc

SEQ ID NO: 91219 - DNA, 75 bp, Artificial Sequence
  Synthetic
acacagttgagacgatgatacatctgggtatattcaagaggaccaaaggcaagagctacacagtggaatactgcc

SEQ ID NO: 91220 - DNA, 75 bp, Artificial Sequence
  Synthetic
aggctaaagtactggccatggacctgacatttgcactggcgggtgttggtggtgtctccttgcatgtgatagtta

SEQ ID NO: 91221 - DNA, 75 bp, Artificial Sequence
  Synthetic
atgggaaaattagcaaacagttattaacacagttggccgggcaccgatctatatgttactcgcttatggatatca

SEQ ID NO: 91222 - DNA, 75 bp, Artificial Sequence
  Synthetic
atcctaagattaacagtgtgttgtggagacctatggtggagatatcttacattaaagctgtgttccagcccagta

SEQ ID NO: 91223 - DNA, 75 bp, Artificial Sequence
  Synthetic
ttcctaaagaattcaagatctactcagatgtaattgtcaagaaggcagggagagtacagcaactgatgaaaaagg

SEQ ID NO: 91224 - DNA, 75 bp, Artificial Sequence
  Synthetic
gattttagtcaaagaatcctggtgtgcgaatatgcaaaataaacactacatagccttgagctaattatacctcaa

SEQ ID NO: 91225 - DNA, 75 bp, Artificial Sequence
  Synthetic
caatctagatggaaaataaatataccttgatcggcttggccataacttgacttgatgattctttctaacctaatc

SEQ ID NO: 91226 - DNA, 75 bp, Artificial Sequence
  Synthetic
aagacctggtttaattccccactgcaactctttaaatttataatgatatgattgatactgagttattgtaatcgt

SEQ ID NO: 91227 - DNA, 75 bp, Artificial Sequence
  Synthetic
aaaataaaaaacttaggagcaaagctctttcaatccctcctgaaagcattgagaaggagacacgacacattaccg

SEQ ID NO: 91228 - DNA, 75 bp, Artificial Sequence
  Synthetic
ggatgatgaagacaaccatctttcagatcatcttcacactaacaattccagctatgtgccaaatatcatttgaca

SEQ ID NO: 91229 - DNA, 75 bp, Artificial Sequence
  Synthetic
atctcgagcaggtaggggtcatgtttgataaacctaaattccttaaaattacaggtccagctagtactgcgacaa

SEQ ID NO: 91230 - DNA, 75 bp, Artificial Sequence
  Synthetic
tgataattaaattaataccaacactggggactatggaaagctgtggaacttctgctgtcaatgaatataagaaga

SEQ ID NO: 91231 - DNA, 75 bp, Artificial Sequence
  Synthetic
ctcttgatacaattctgatacctctgagagacaccataaacaagttaagtactgatatcactgtggtggaaggaa

SEQ ID NO: 91232 - DNA, 75 bp, Artificial Sequence
  Synthetic
cctcaaaggtgtcaaacaagagagagaagcggtttgttgggatagcaattgcagttggggctgtggcactagcca

SEQ ID NO: 91233 - DNA, 75 bp, Artificial Sequence
  Synthetic
cgtccgcacagataacagcagggattgctctctccaataccataaagaacgcagaggcaatcgagagcatcaagt

SEQ ID NO: 91234 - DNA, 75 bp, Artificial Sequence
  Synthetic
catccatccaagcatccaaccaagcaatacaaaaagtgatagatgctcaggggaggaccgtcacagttataaatg

SEQ ID NO: 91235 - DNA, 75 bp, Artificial Sequence
  Synthetic
gcattcaagatcatataaattccgtgattaacccagctttaaaccagctagggtgtgatgttgccaagaacacac

SEQ ID NO: 91236 - DNA, 75 bp, Artificial Sequence
  Synthetic
tcgccatatccttgactcaatatttctccaagttatcattactattcggacccaatcttagaaaccccgtcgaac

SEQ ID NO: 91237 - DNA, 75 bp, Artificial Sequence
  Synthetic
aacctctatcagttcaagcaatagccgggctaatggatggtgatataaattcggtagtatcgcaattagggtata

SEQ ID NO: 91238 - DNA, 75 bp, Artificial Sequence
  Synthetic
cccaatctgacctgctcgacttgttatccactgagtcaatagttgggacagttacagccattgacatggttaact

SEQ ID NO: 91239 - DNA, 75 bp, Artificial Sequence
  Synthetic
atatgatccaaattgagatgtccttccctcagtatatcacaattcctgacacgaaggtgctcgaggggcataaaa

SEQ ID NO: 91240 - DNA, 75 bp, Artificial Sequence
  Synthetic
tcactttcaatgataagggttctgagtggcaaacacaagtacctagtactatcgcagtcagagatatactaatcg

SEQ ID NO: 91241 - DNA, 75 bp, Artificial Sequence
  Synthetic
ctggtgtcgatcctgaaggatgctcgattactagcacgtcctacatatgtaagaatgacccgacgtacgccatgt

SEQ ID NO: 91242 - DNA, 75 bp, Artificial Sequence
  Synthetic
cagaggttctcactaactgtttcagaggtaaaacacaagagtgcccaagagctaggataacgtctacatttgcca

SEQ ID NO: 91243 - DNA, 75 bp, Artificial Sequence
  Synthetic
ccagatttgcaattgcaaggtccaccgttattgccaactgcgttgcggcggtgtgtctgtgtggtgacccaggaa

SEQ ID NO: 91244 - DNA, 75 bp, Artificial Sequence
  Synthetic
cccctgtagtccaaaaggctgaagttactctaactgccatgactctcgatcagtgcagcttgattactgtcgatg

SEQ ID NO: 91245 - DNA, 75 bp, Artificial Sequence
  Synthetic
ggctgcaaataaagcccagtaagagcatcgcaaatgtgacagccaatttcggaaatataacattggggccggtgg

SEQ ID NO: 91246 - DNA, 75 bp, Artificial Sequence
  Synthetic
tatcagtaggagatctggatttgtcagcggaactgactaaagtccaatcagatctaaaagaggctcaggataaac

SEQ ID NO: 91247 - DNA, 75 bp, Artificial Sequence
  Synthetic
ttgacgaatcgaacgcgatcttacaaggaatcaacaacaagatcctaactgctccgacatctattgcgttgatag

SEQ ID NO: 91248 - DNA, 75 bp, Artificial Sequence
  Synthetic
tgatttccgttgtgatcattctattaatcatcgggataattagctggttagtcttgttaactagagcagtcaaaa

SEQ ID NO: 91249 - DNA, 75 bp, Artificial Sequence
  Synthetic
aatccagcactagatcagaaagagtaacaccaagcacctataacaatctaggctttataaaataagttgccgact

SEQ ID NO: 91250 - DNA, 75 bp, Artificial Sequence
  Synthetic
aaataatcatttacttagccttttaaaataccagggtgatgtaatgaagtcataatactgtgtccatgcacgatt

SEQ ID NO: 91251 - DNA, 75 bp, Artificial Sequence
  Synthetic
aagaaaaacttaggatcaaagattattgatcttaatagcaatggatcctaaaagctattacagcagtgaggacct

SEQ ID NO: 91252 - DNA, 75 bp, Artificial Sequence
  Synthetic
gaggaaagatgatggagatagatcatccggaggaaatctctataagggaataatcctggtgtcaacggtaatatc

SEQ ID NO: 91253 - DNA, 75 bp, Artificial Sequence
  Synthetic
ccttattatcgctatagtctctcttggattcattatagacaacaggatcaacatacagtcacttgaccctctgag

SEQ ID NO: 91254 - DNA, 75 bp, Artificial Sequence
  Synthetic
aagcttggaagacagttacttagtcccgattaaggagaaatctgagaccatcaatcaagatatacaagaaggaat

SEQ ID NO: 91255 - DNA, 75 bp, Artificial Sequence
  Synthetic
attccctcgcttgaacttgatcacagcctcaacaacaaccaccattcctaggagtatagctatacagacgaagga

SEQ ID NO: 91256 - DNA, 75 bp, Artificial Sequence
  Synthetic
tctgagcgatttaatcaagaacagatgttacccttctgttgcgaataatgacacctcttgtgatgtactggcggg

SEQ ID NO: 91257 - DNA, 75 bp, Artificial Sequence
  Synthetic
agcaatacacagtaattcgttttcacagttggacccatcaacatattggacatgctcctccggatccccgactat

SEQ ID NO: 91258 - DNA, 75 bp, Artificial Sequence
  Synthetic
gaaccagacagtaaagttactcccagacaactcacagatcccaggttctacatactcaactggttgcgttaggat

SEQ ID NO: 91259 - DNA, 75 bp, Artificial Sequence
  Synthetic
accaacattctcactgggcagtatgatctattcttatagtcacaatattatctatgacggttgcaacgaccactc

SEQ ID NO: 91260 - DNA, 75 bp, Artificial Sequence
  Synthetic
taaatcctcacaatattggcagctaggttacatcagcactggtaagaacggtgaaccactccagcaagtcagtag

SEQ ID NO: 91261 - DNA, 75 bp, Artificial Sequence
  Synthetic
aacactaaccttgaataatggactgaaccgtaaatcctgtagcactgtggcacagggaagaggtgcatatctact

SEQ ID NO: 91262 - DNA, 75 bp, Artificial Sequence
  Synthetic
atgtaccaatgtcatagaggatgagagaaccgattacagtacagaaggtatccaggacctgattctggactatat

SEQ ID NO: 91263 - DNA, 75 bp, Artificial Sequence
  Synthetic
agatatcttcggtgcggagaggagttatagatatactaatagtgaggttgacctagatcgcccttatgcagcact

SEQ ID NO: 91264 - DNA, 75 bp, Artificial Sequence
  Synthetic
ttacccaagtgttgggtcagggacagtctacaatgatcgaattttatttctggggtatggagggctgatgacacc

SEQ ID NO: 91265 - DNA, 75 bp, Artificial Sequence
  Synthetic
ttatggggaccaagctatgtgtcaagctccggagtgcacgtctgccacacaagatgactgcaacagtaatcagct

SEQ ID NO: 91266 - DNA, 75 bp, Artificial Sequence
  Synthetic
gatagggtatttttcaggtagacagatagtgaattgtatcattgagatcatcacagttggaacagaaaaaccaat

SEQ ID NO: 91267 - DNA, 75 bp, Artificial Sequence
  Synthetic
tattcgtgttaggaccatcccaaattcacaggtgtggctcggtgcagagggtcgtatacagacattaggcggggt

SEQ ID NO: 91268 - DNA, 75 bp, Artificial Sequence
  Synthetic
gctttatctttacatcagatcagcaggatggcatgctttggcccaaacaggcatcatcctgacgcttgaccccat

SEQ ID NO: 91269 - DNA, 75 bp, Artificial Sequence
  Synthetic
aagaataagttggatagagaatacgggatattcgagaccagggaacacgccttgtccggcatcatcacgctgtcc

SEQ ID NO: 91270 - DNA, 75 bp, Artificial Sequence
  Synthetic
agcacagtgtatcacaggagtttatacagacatctttccattgtcgcaaaattacggttatttggctacagttac

SEQ ID NO: 91271 - DNA, 75 bp, Artificial Sequence
  Synthetic
actactgtctgggatcaaccgagtaaacccggtaatatcatacggcacctccaccggacgagttgcagatagtca

SEQ ID NO: 91272 - DNA, 75 bp, Artificial Sequence
  Synthetic
gttgacagattccagtcaagttgctgcttatacaactacaacctgtttcacattcaatcaaaaggggtactgcta

SEQ ID NO: 91273 - DNA, 75 bp, Artificial Sequence
  Synthetic
ccatatcattgagctaagccctgctactctgggtatattccaaccagtcctagttgttactgagattccaaaaac

SEQ ID NO: 91274 - DNA, 75 bp, Artificial Sequence
  Synthetic
ctgctcataacgtaatcgacacacaagagaacatcaaacaagtcaggtttagcagagtatgagccagacacacca

SEQ ID NO: 91275 - DNA, 75 bp, Artificial Sequence
  Synthetic
actggacaaggctggtacacagaacagcagtagtgattttagaaaatttatgtacatcacgccggcagccataga

SEQ ID NO: 91276 - DNA, 75 bp, Artificial Sequence
  Synthetic
gaccacaaatcaatcagagctaggtgtaccaagcataacaagcaagtgaaatcagttaccttattaagaaaaaac

SEQ ID NO: 91277 - DNA, 75 bp, Artificial Sequence
  Synthetic
ctaggatcaaagatcctgctcacatgatggatcctagagacattctttatcctgaatgccaccttgattcaccta

SEQ ID NO: 91278 - DNA, 75 bp, Artificial Sequence
  Synthetic
ttgtacttggaaaggttataagattacattaccttcttgaccttactgtcgagtacgatattaaagactcatcga

SEQ ID NO: 91279 - DNA, 75 bp, Artificial Sequence
  Synthetic
tcttgagaaacttagactacaatgctaaatctgggagattatccaacagggacagagagctgaccaagcacaaag

SEQ ID NO: 91280 - DNA, 75 bp, Artificial Sequence
  Synthetic
atatcttaaggagggagggatttgtcagatcaggatatcgagggattgattaccctagagggaataaagaactct

SEQ ID NO: 91281 - DNA, 75 bp, Artificial Sequence
  Synthetic
ttaggctggtgatcccgaacttgacaaagccattagaatgtctgttgaagcagagcaacagggtgtttgacagga

SEQ ID NO: 91282 - DNA, 75 bp, Artificial Sequence
  Synthetic
tcgagtctgggttaagggacacattcttagcatcagctaataagatttcggggaggggtaaagaagtattcaccg

SEQ ID NO: 91283 - DNA, 75 bp, Artificial Sequence
  Synthetic
agcagaacctcacggaaggtggaatggcaggtgtgtctagatccgttcacaacaatgggtggaatcaaccgttta

SEQ ID NO: 91284 - DNA, 75 bp, Artificial Sequence
  Synthetic
tgacctggttcacaatcaagaaggagatgcgaaggttgaagaaagattatagaaagaatgccaagagtgcagata

SEQ ID NO: 91285 - DNA, 75 bp, Artificial Sequence
  Synthetic
tgaccaagttagcatctcatcatgaaagatactctctctacattcactccgatttcgtgctgatttctgaccata

SEQ ID NO: 91286 - DNA, 75 bp, Artificial Sequence
  Synthetic
tctcagaagtatatcacttgctaaccgacgatatggttctaggattctgtgatgtagtagaagggagattgatgg

SEQ ID NO: 91287 - DNA, 75 bp, Artificial Sequence
  Synthetic
tttcagcggttgcttcaatggaccctaattatgttaacatcggcattaaaggggaacagctgtggagtttgatcg

SEQ ID NO: 91288 - DNA, 75 bp, Artificial Sequence
  Synthetic
actcactcttcatactacttggtaataaagtctatgatgtggttggcatgctggagcccctggccctatcctata

SEQ ID NO: 91289 - DNA, 75 bp, Artificial Sequence
  Synthetic
ttcaactgagagaccccattaaggaaattaggggtgcatttttgtattacaatctaagtgagttagatcaattgt

SEQ ID NO: 91290 - DNA, 75 bp, Artificial Sequence
  Synthetic
taaaagaggatacgatactttccacaagtgaagtcaaggactttattgaattgataagtgagataatcaatatgg

SEQ ID NO: 91291 - DNA, 75 bp, Artificial Sequence
  Synthetic
gcagtgtatctgagatatcagaaattttctcttttttcagatcctttggtcaccctgttttagaggctgtcactg

SEQ ID NO: 91292 - DNA, 75 bp, Artificial Sequence
  Synthetic
ccgccgataaagtgagagatcacatgtgtaaaccgaaaatcttagattatgagatactacagaaaggacatgcgg

SEQ ID NO: 91293 - DNA, 75 bp, Artificial Sequence
  Synthetic
tgttctgctctatgataatcaacggattcagagagagacatggggggtcctggccaccatgctccctcccagact

SEQ ID NO: 91294 - DNA, 75 bp, Artificial Sequence
  Synthetic
atgcatcgtccgagatcaaagcagttatggcgaatcatgctgcaattccttatgaattaagtgttaacaactggg

SEQ ID NO: 91295 - DNA, 75 bp, Artificial Sequence
  Synthetic
aatcctttatagggttcaaatttgacaaattcgaggaagttaatctggatgaggatctgactatattcatgaagg

SEQ ID NO: 91296 - DNA, 75 bp, Artificial Sequence
  Synthetic
acaaggcattatcccctattaaagcagaatgggatactgtgtacccacaagagaacatgcaatattcaccaggta

SEQ ID NO: 91297 - DNA, 75 bp, Artificial Sequence
  Synthetic
ggagctctaccagtaggaggttggtcgacgtgttccttgaggatatggaattcaatcctcaggatataatagact

SEQ ID NO: 91298 - DNA, 75 bp, Artificial Sequence
  Synthetic
atgttgtatccggagactacttgactgaccaagacttcaatatctcttatagtctcaaggaaaaagaaatcaaac

SEQ ID NO: 91299 - DNA, 75 bp, Artificial Sequence
  Synthetic
aggcgggtaggttatttgctaagatgacgtataagatgagagctgcacaagtcttagcagaatcgctagttgctc

SEQ ID NO: 91300 - DNA, 75 bp, Artificial Sequence
  Synthetic
atggagtagggaagtatttccaagaaaatggaatggttaaggatgagcatgaacttctcaaatcattgacaacct

SEQ ID NO: 91301 - DNA, 75 bp, Artificial Sequence
  Synthetic
tgtcactagccggggtaccgaggtcacgacccggtgaggacccatctgcgaccgaggaaaataagtatgtgagga

SEQ ID NO: 91302 - DNA, 75 bp, Artificial Sequence
  Synthetic
tagctcagaaagggaaagagatcctgagaaacaaccagacaaggaggagtacacaagagagccgagatcaggatg

SEQ ID NO: 91303 - DNA, 75 bp, Artificial Sequence
  Synthetic
ggttagctaacgagaagcatgagactgtcgcatcattcataaccactgacctacagaaattctgtctgaattgga

SEQ ID NO: 91304 - DNA, 75 bp, Artificial Sequence
  Synthetic
gatacgagagtgtcatactattcgcccaaagactagatgagatttacgggttaccaggtttctttgaatggttac

SEQ ID NO: 91305 - DNA, 75 bp, Artificial Sequence
  Synthetic
ataaacgacttgagaggtctgtattatatgttgcagacccaaattgtccacctgactttcgaaccaaaatgagtt

SEQ ID NO: 91306 - DNA, 75 bp, Artificial Sequence
  Synthetic
tagaagatactcctgacaccgggatttttattcataatccaatgggcggaattgaagggtactcacaaaaaatgt

SEQ ID NO: 91307 - DNA, 75 bp, Artificial Sequence
  Synthetic
ggactattatttccatcagcatgatacacctagctgcagtccagacaggggtgagagtctctgcagtcatacagg

SEQ ID NO: 91308 - DNA, 75 bp, Artificial Sequence
  Synthetic
gagacaatcaatctattgcggttaccacaagagtcccagtaaggatgaattacaatcagaagaagactgagtgtt

SEQ ID NO: 91309 - DNA, 75 bp, Artificial Sequence
  Synthetic
atagaaacacaataagatactttgaaactttaaggaaagtgatgggagggttaggacacaacctgaaattgaacg

SEQ ID NO: 91310 - DNA, 75 bp, Artificial Sequence
  Synthetic
agacaatcatctcaaatcagttctttatatactcaaaacggatatactttgatggctcaatcttgccccagggtc

SEQ ID NO: 91311 - DNA, 75 bp, Artificial Sequence
  Synthetic
ttaagactatttccagatgtgttttttggtcagagactttagtggatgaaactagagcggcatgttctaacatct

SEQ ID NO: 91312 - DNA, 75 bp, Artificial Sequence
  Synthetic
caacatccctcgccaaggcggttgagaacgggatatcccctctattatgttacctcctcaatgcctggaaaacat

SEQ ID NO: 91313 - DNA, 75 bp, Artificial Sequence
  Synthetic
tacaacaactccacatatccttagcgttttcaatcaacccgacaataacgaaagacctctacggacctatcttga

SEQ ID NO: 91314 - DNA, 75 bp, Artificial Sequence
  Synthetic
gctcccaagactggatgataatagctgtcatagtcccttcacagttaggcggattcaactatatgagtctgtcta

SEQ ID NO: 91315 - DNA, 75 bp, Artificial Sequence
  Synthetic
ggttgttcgtgcgtaatatcggggatcctttagttgcggcactagcagatgtcaagaggtacattgagatcggtt

SEQ ID NO: 91316 - DNA, 75 bp, Artificial Sequence
  Synthetic
tactcacaactgctgccctcacaaagtttacaactcagatcccaggggactccacagaactagactgggcatcag

SEQ ID NO: 91317 - DNA, 75 bp, Artificial Sequence
  Synthetic
atccttactctgcaaatctgcctcactcacagagtgtgactactgtgatcaagcatgtaacagccagatctgtat

SEQ ID NO: 91318 - DNA, 75 bp, Artificial Sequence
  Synthetic
tatctaaatcaccaaatcctatgctggaagggttgtttcatgagaacaccgatgaagaagatcatgatctagcca

SEQ ID NO: 91319 - DNA, 75 bp, Artificial Sequence
  Synthetic
gattcttgattgatcgggaaatcatactgccgagggttgcaaatgttatactagatcaatctgtgacaggtgcca

SEQ ID NO: 91320 - DNA, 75 bp, Artificial Sequence
  Synthetic
gatctgcaattgcagggctcctagacacgacgaagacgttgatcaagaatacagcaaacaaaggaggactatcga

SEQ ID NO: 91321 - DNA, 75 bp, Artificial Sequence
  Synthetic
accgaactgtgtcaaaactcttgtatcacgactaccaacagttcattgtcttcaacaagatattgagatctcaag

SEQ ID NO: 91322 - DNA, 75 bp, Artificial Sequence
  Synthetic
tcgatgataccacagatttcagtctagtttgttcagttacacttgctaagataatgagatccaggatgtgggtca

SEQ ID NO: 91323 - DNA, 75 bp, Artificial Sequence
  Synthetic
aagttgctaaagggagaaggatagaggggttagaagtccctgatcctctagagtgtctgagaggtgagttaataa

SEQ ID NO: 91324 - DNA, 75 bp, Artificial Sequence
  Synthetic
ttggatcaaggtcgtgcaccatatgtgagagaggcatggaccaatacagctggttttacatcccacccgggatgg

SEQ ID NO: 91325 - DNA, 75 bp, Artificial Sequence
  Synthetic
atctagaaggacagcgtagggagaacggttcattgagagtcccatattttggttcatcaacgtctgagagatcgg

SEQ ID NO: 91326 - DNA, 75 bp, Artificial Sequence
  Synthetic
aggcgtctgtgaataccactaggggattgtcgagggctgcgaaggcagccatcaggatagcatctgtctacacct

SEQ ID NO: 91327 - DNA, 75 bp, Artificial Sequence
  Synthetic
gggcctacggagagtctcaacttagttggtatgaagcgtatgcattggcatcacagagggcaaacctcacattgg

SEQ ID NO: 91328 - DNA, 75 bp, Artificial Sequence
  Synthetic
agcaattgaaagtaataactccaaaatccacttccactagtctgtcccataggctcaatgactcttctacacaaa

SEQ ID NO: 91329 - DNA, 75 bp, Artificial Sequence
  Synthetic
tgaagttcgcctctacaaacctacagcgtgtcagcaggtttgttaccatctcaaatgaccatatcaagttaaaag

SEQ ID NO: 91330 - DNA, 75 bp, Artificial Sequence
  Synthetic
ggaacggagatgcaggagacactaacctgatttaccaacaggtaatgttagttggcttgagtattatcgagttaa

SEQ ID NO: 91331 - DNA, 75 bp, Artificial Sequence
  Synthetic
ctcataggaggcaagagaacactggtgaagatagcaaagttctacaccttcatatcagagaggactgttgtgtag

SEQ ID NO: 91332 - DNA, 75 bp, Artificial Sequence
  Synthetic
agttcactcaagaccaaggagacatcccttccctgaccaacctaccagaattcgaagatcatcctacgaatagac

SEQ ID NO: 91333 - DNA, 75 bp, Artificial Sequence
  Synthetic
taatttatgatcctaacccattggacaatgtgtatataaccaggatcaaagaaacaagcgtttacttacatgaat

SEQ ID NO: 91334 - DNA, 75 bp, Artificial Sequence
  Synthetic
tagacttcttggcttggcatgatgaggatataaagacagtactcgggaactcagtgggccaaatgattgaggagg

SEQ ID NO: 91335 - DNA, 75 bp, Artificial Sequence
  Synthetic
tcatcgcaactactgagagggataatttaaaggatattaatgcactctcaaatgaggacaacatcaactcaatta

SEQ ID NO: 91336 - DNA, 75 bp, Artificial Sequence
  Synthetic
taacagagatgatgctttctgaccctgacgatgtgttgtcatcactaggttgtatgttggtacttagatttgcgt

SEQ ID NO: 91337 - DNA, 75 bp, Artificial Sequence
  Synthetic
atgaatgctatgcacgacatatagaagggaaagaacaatatatatcatacgtcagtgacaagatcgagaccatgt

SEQ ID NO: 91338 - DNA, 75 bp, Artificial Sequence
  Synthetic
cacgctcaaacctatcgatcttggtcaatagtctgacccatcccagagtgtttaggaaatattgtgatgaaggag

SEQ ID NO: 91339 - DNA, 75 bp, Artificial Sequence
  Synthetic
tactggtcccagatcgggggcaaacattatctactcaggacttcaaggcacacagtgtagagtattgtatcgcaa

SEQ ID NO: 91340 - DNA, 75 bp, Artificial Sequence
  Synthetic
gtctacagagatttttcgaaaaatggacaatttccggcaatataaccatattgttgtgtgatcaagacgaaatca

SEQ ID NO: 91341 - DNA, 75 bp, Artificial Sequence
  Synthetic
ttattggtgagagggaattaaccatcaagggaaggataaaggcgatgatcatttgtatctattgtttaactgaca

SEQ ID NO: 91342 - DNA, 75 bp, Artificial Sequence
  Synthetic
attcccctagccttgtcggactaaatacaaaggaaagggatgaggtattgacagaatacttagaagaagtaggcc

SEQ ID NO: 91343 - DNA, 75 bp, Artificial Sequence
  Synthetic
agagtaatatagagagtagatattgggtgctcggatcgattgggattaagaggtacaacacttccctcacgtata

SEQ ID NO: 91344 - DNA, 75 bp, Artificial Sequence
  Synthetic
ttcgaaggagtctggtcaagcagtacagattgagggaccttgatgtccagttgctcattgatgagatggcagaac

SEQ ID NO: 91345 - DNA, 75 bp, Artificial Sequence
  Synthetic
aagatctagaatctctatccataactgaccaaatccccgatcaagtagataaagcggggactatgggggctgtat

SEQ ID NO: 91346 - DNA, 75 bp, Artificial Sequence
  Synthetic
cactatggcagtccataaaagtcaaagacctgacattagatagaaacccaagggcagaatctgcagagtaccgca

SEQ ID NO: 91347 - DNA, 75 bp, Artificial Sequence
  Synthetic
tacccacaacatgtgagatacccagtcaaatcctacgaattgcaggggtaaattctacatcctgttccaaggctc

SEQ ID NO: 91348 - DNA, 75 bp, Artificial Sequence
  Synthetic
atgaattaaactcagttatctgcaccctaccattagaggggaaatcctgtctgttcctagccgaagggtcagggt

SEQ ID NO: 91349 - DNA, 75 bp, Artificial Sequence
  Synthetic
caatgatgacttactatatgttgagacacaggttgaataatgtctatttcaacacaggagtagggtcagaagata

SEQ ID NO: 91350 - DNA, 75 bp, Artificial Sequence
  Synthetic
ttaatagccaaagggaaactgatccatccccttcagaacctgtcttagttgaaggtaaccttaggatcaaacact

SEQ ID NO: 91351 - DNA, 75 bp, Artificial Sequence
  Synthetic
gtctgagtgagaagatcaccgtgttgttcaatggaagacctgaaacaacttgggtaggaaatgaagattgcgagt

SEQ ID NO: 91352 - DNA, 75 bp, Artificial Sequence
  Synthetic
cttatgtgatagcacagataggcgaggacaaagtctcacttgttcactcagatatggagagcgggattgagaaga

SEQ ID NO: 91353 - DNA, 75 bp, Artificial Sequence
  Synthetic
gcaatcaagcggtgcttgttgagcatgtatcgttgatcaggattttccaaaatgtgacaacacccggtgccacac

SEQ ID NO: 91354 - DNA, 75 bp, Artificial Sequence
  Synthetic
tggtcagtaaaatcgcaccgagactagggaccaactggacccagataatagcgctatacttagagacctttgtca

SEQ ID NO: 91355 - DNA, 75 bp, Artificial Sequence
  Synthetic
atgtgacaatcctatgtctgaaaaatagcaaccccgcaagtagcgaattatatgtcatatgtgatggtgtcaaga

SEQ ID NO: 91356 - DNA, 75 bp, Artificial Sequence
  Synthetic
cacgtatcggtgtcaaatcaatcgtatatgcacaatgtgtccattacttaacagaggagagccagtctagattgg

SEQ ID NO: 91357 - DNA, 75 bp, Artificial Sequence
  Synthetic
agcagcggattatcgatgccaaactcaaagccggtgagcatttgatcagtgtaataaatgatcttaagagtggga

SEQ ID NO: 91358 - DNA, 75 bp, Artificial Sequence
  Synthetic
gaaagataaaccaaattgagagtttgttgaagattggtttttctacaaacatgaccacagtagctagacagttct

SEQ ID NO: 91359 - DNA, 75 bp, Artificial Sequence
  Synthetic
tgagagtgactgacttgacggacacaactactatcttcactaagcttaggctggcgttagttgacctactgagag

SEQ ID NO: 91360 - DNA, 75 bp, Artificial Sequence
  Synthetic
tgacctcggacgagtcgactacattatcgctgtaccaaccttacccactctcccagtcgggaaagtgtagagttg

SEQ ID NO: 91361 - DNA, 75 bp, Artificial Sequence
  Synthetic
tgaaagaacgagcaatgaaaggctggattagtatcaatctcaacaccatccttaccaaaaggagctaccttaaac

SEQ ID NO: 91362 - DNA, 75 bp, Artificial Sequence
  Synthetic
atgacttcgaataccttgcagtaagaaataaggtgataatagacataaggtgcctgttagcctgtggggtcgtaa

SEQ ID NO: 91363 - DNA, 75 bp, Artificial Sequence
  Synthetic
ataagaagactggtgatcggctcaaccgaatgtcccacctgttatactcagagatcactaatcgtgacaagaaga

SEQ ID NO: 91364 - DNA, 75 bp, Artificial Sequence
  Synthetic
aattgttcaaactcatcgggtcggctttttatttctcaaaacgttgattaatgggtaggatccaatcccaatctc

SEQ ID NO: 91365 - DNA, 75 bp, Artificial Sequence
  Synthetic
agttttctggggaggatagcatggttagctgagtaagaaaaactttttctttcttattcatatttccccttgttg

SEQ ID NO: 91366 - DNA, 75 bp, Artificial Sequence
  Synthetic
tttctggggaggatagcatggttagctgagtaagaaaaactttttctttcttattcatatttccccttgttgggt

SEQ ID NO: 91367 - DNA, 75 bp, Artificial Sequence
  Synthetic
gtgaacaagtaggtgagatatccatggcggtttcagatctaggtgtcattgttagaaaagccatgatgagtaatt

SEQ ID NO: 91368 - DNA, 75 bp, Artificial Sequence
  Synthetic
gctttatctttacatcagatcagcaggatggcatgctttggcccaaacaggcgtcatcctgacgcttgaccccat

SEQ ID NO: 91369 - DNA, 75 bp, Artificial Sequence
  Synthetic
taattcagatctggaatctgttggccaaaagcattacagcaagtaatactgcagagggttctgaagacagaagaa

SEQ ID NO: 91370 - DNA, 75 bp, Artificial Sequence
  Synthetic
agtatattctgcgtgctaatcgttcaacgttagtccgtggagtgagcatctgaaaagttgttaacacgtttgaat

SEQ ID NO: 91371 - DNA, 75 bp, Artificial Sequence
  Synthetic
aatttctactgaaaggagtagaataaaggagatttgcttctcatggcaacacgaggagcaagtatgtctcgggtc

SEQ ID NO: 91372 - DNA, 75 bp, Artificial Sequence
  Synthetic
aaaacccgaggcgtcaatatggtaacggccaaggttaaaagcttggctgttaaagttaaaaacaaaaccaaacaa

SEQ ID NO: 91373 - DNA, 75 bp, Artificial Sequence
  Synthetic
agtgcaagaggcttgcgggggttcctcttgttcttggtagctcagattttctgggctcgaaaactcaccccgcaa

SEQ ID NO: 91374 - DNA, 75 bp, Artificial Sequence
  Synthetic
gtcaaaagattgtggaagatggttgacaaagtgcagggcctcaaaatcctaaagaggatacgtaacatagtgaca

SEQ ID NO: 91375 - DNA, 75 bp, Artificial Sequence
  Synthetic
aatctcatgaaaggactttcaggacggaaaaagagaagaagcatgaccggttccactatcatggttctgctgccg

SEQ ID NO: 91376 - DNA, 75 bp, Artificial Sequence
  Synthetic
ttggtggtgtattctgcaagtgtttcaaggatgcatggaggtggtctgctgctgaatgtcacttttgcggatgtt

SEQ ID NO: 91377 - DNA, 75 bp, Artificial Sequence
  Synthetic
ggcaagacatttgaagtccaaggcggcaattgctcagtcaacacactggaagctggaaaatggtgtgatgattac

SEQ ID NO: 91378 - DNA, 75 bp, Artificial Sequence
  Synthetic
gttgagtactcctgcgtcaccctggttgaaggagaagaaccagatgaccttgactgctggtgttatggagtcgac

SEQ ID NO: 91379 - DNA, 75 bp, Artificial Sequence
  Synthetic
aatgtgagagtgacttatgggagatgcaagggtggagggtcacgtaggtcaagacgctctgctctgataacacct

SEQ ID NO: 91380 - DNA, 75 bp, Artificial Sequence
  Synthetic
catgtggacaagggactcaccaccagacaagagaagtggctgccttcaaagataggtgagcaacaattgcaaaaa

SEQ ID NO: 91381 - DNA, 75 bp, Artificial Sequence
  Synthetic
gtggaaaaatggataattcggaatccactgtatgccataggttccattgctctggcttactttattggaacctct

SEQ ID NO: 91382 - DNA, 75 bp, Artificial Sequence
  Synthetic
gtggtccaaaaagttgtcatttccatacttcttttgggtattggaccagcttactcaacacactgcttgggtatc

SEQ ID NO: 91383 - DNA, 75 bp, Artificial Sequence
  Synthetic
cccaaaagggacttcatcagaggtctcgatggcaatacttgggtttctgttgttcttgagcaaggaggatgcgta

SEQ ID NO: 91384 - DNA, 75 bp, Artificial Sequence
  Synthetic
accttaattgccgacaacaagccgtcagtggacatctggctcagctcaattgtagtcgacaccccaaccctggtc

SEQ ID NO: 91385 - DNA, 75 bp, Artificial Sequence
  Synthetic
agaaaggtttgctatgagagctcagtcactggctctaaggctgaaggcgcatgccctacaatgggtgacgcccac

SEQ ID NO: 91386 - DNA, 75 bp, Artificial Sequence
  Synthetic
ctaacagaggaaggaaatgaggaatgggaatgcaagagatccttttcagaccgaggatggggtaacagttgtgga

SEQ ID NO: 91387 - DNA, 75 bp, Artificial Sequence
  Synthetic
ctctttggaaaaggtagcattgtggcttgtgccaaatttgcctgcaccaaagaaatggaagtgtaccagattgac

SEQ ID NO: 91388 - DNA, 75 bp, Artificial Sequence
  Synthetic
tccaccaagatagaatataccatcagcacacaggtccattccggagccaagaaggaagattgggtcaaccataca

SEQ ID NO: 91389 - DNA, 75 bp, Artificial Sequence
  Synthetic
aagttgatcaagtttgtccccacgacgggaacctcaacagtggcgtttactggatatgggaattttggtcttgaa

SEQ ID NO: 91390 - DNA, 75 bp, Artificial Sequence
  Synthetic
tgccatgtgcaaatgatggtggacctcagcaattcatacttggtcaaagttggaactgacgcttggctggttaac

SEQ ID NO: 91391 - DNA, 75 bp, Artificial Sequence
  Synthetic
aaacaatgggtccatgatatcacccttccctggcagagtggcactggaggacattggcgtgacaagcatttcatg

SEQ ID NO: 91392 - DNA, 75 bp, Artificial Sequence
  Synthetic
gtagactttgaacaaccccatgccgtcacaatgaaggcccttgtactaggaagccaagaaggagcattgaggaca

SEQ ID NO: 91393 - DNA, 75 bp, Artificial Sequence
  Synthetic
gctttgtctggagccatggtggtggaggtcagctcaaaaagatataccctgaaaggtggacatgttacttgcaag

SEQ ID NO: 91394 - DNA, 75 bp, Artificial Sequence
  Synthetic
gcatacatgaatgacttgacattaaaaggatcaacctactctatgtgcaaaagaggcatgtcttttgtcaaacag

SEQ ID NO: 91395 - DNA, 75 bp, Artificial Sequence
  Synthetic
cctgtggagacagatcatggaacagcagtcatgcaggtaaaagtcacaaccggggctccatgcagaattccggtc

SEQ ID NO: 91396 - DNA, 75 bp, Artificial Sequence
  Synthetic
atagccgcagactctatggcaggcactgagaatagaggaagtgtcataaccaccaatcccatcgccgcatcaaac

SEQ ID NO: 91397 - DNA, 75 bp, Artificial Sequence
  Synthetic
aatgatgaagttctggtcgaaattagccctccatttggagagagttatatcatagtgggcagtggggatgacaaa

SEQ ID NO: 91398 - DNA, 75 bp, Artificial Sequence
  Synthetic
ctcacatatcactggcaaagatcaggaagcaccattggaaaccttttcacagaaacaatgaaaggagctcagagg

SEQ ID NO: 91399 - DNA, 75 bp, Artificial Sequence
  Synthetic
atgataataactggcgaacactcatgggactttggctcaacaggaggattctttgcctcagtcgggaaggctatt

SEQ ID NO: 91400 - DNA, 75 bp, Artificial Sequence
  Synthetic
cacactgtttttggggctgcgtttcatgccatctttggaggtctgagctggatgaccaagatcttgataggaggc

SEQ ID NO: 91401 - DNA, 75 bp, Artificial Sequence
  Synthetic
ctgatggtgtggttgggtctgaattcaagaagcagcgccctctcaatggtgttcatctgtataggagcactgctt

SEQ ID NO: 91402 - DNA, 75 bp, Artificial Sequence
  Synthetic
ttggtccttgccacaggggttggagctgaggtcggttgttcactcaattggaaacagcgtgaagtcaaatgtgga

SEQ ID NO: 91403 - DNA, 75 bp, Artificial Sequence
  Synthetic
gatggaatgttcgttttcaaagacacagatgattggttttcaaagtatcagtacattccagaagacccaaagaca

SEQ ID NO: 91404 - DNA, 75 bp, Artificial Sequence
  Synthetic
atggctggcttgatagcacaagctcataaagaaggcttgtgtgggctaagttcagtcagcgatctggagcaccgc

SEQ ID NO: 91405 - DNA, 75 bp, Artificial Sequence
  Synthetic
atgtggctgtcaagatccgatgagatcaatgctattctagaagagaatgagatcgacctcacagttgtggtgcaa

SEQ ID NO: 91406 - DNA, 75 bp, Artificial Sequence
  Synthetic
gattctgcctcagtgtatcaacgtggatcacacgcttttccacggcccaaaggagaactcaaatacggttggaaa

SEQ ID NO: 91407 - DNA, 75 bp, Artificial Sequence
  Synthetic
acatggggaaagaacatagttttcaacccttcaaggaaaaatggcactttcatcatagatgggaaaagcaagtct

SEQ ID NO: 91408 - DNA, 75 bp, Artificial Sequence
  Synthetic
gagtgcccttttaacaagagagtgtggaactccatcaaagtggaggagttcgggacagggatttatcagactaga

SEQ ID NO: 91409 - DNA, 75 bp, Artificial Sequence
  Synthetic
gtgttcatgcgccccgaatatgattacaccaagttatgtgatacaggcatgttgggcgctgcagccaaaggaagt

SEQ ID NO: 91410 - DNA, 75 bp, Artificial Sequence
  Synthetic
gcctcagtacatggagaccctttgttttggatggaatcacaggaaatcaatggaacatggacaataacatcattg

SEQ ID NO: 91411 - DNA, 75 bp, Artificial Sequence
  Synthetic
gaagccctcaactaccgtgaatgtgaatggcccagttcacacacactggatgggtcaaaggtaatagagtcagac

SEQ ID NO: 91412 - DNA, 75 bp, Artificial Sequence
  Synthetic
atgttcatgccacgaagcctggccggaccggttagtcgtcacaaccacatccctggatacaaagtacagtccagt

SEQ ID NO: 91413 - DNA, 75 bp, Artificial Sequence
  Synthetic
ggtccatggcacaacacccccctggagatcagaagggaagagtgtcctggaacaaaagtctcagtggaagaatca

SEQ ID NO: 91414 - DNA, 75 bp, Artificial Sequence
  Synthetic
tgtgatgatagagggaaagctacccgatccactacagacagcggcaagattataccagaatggtgctgtaggagt

SEQ ID NO: 91415 - DNA, 75 bp, Artificial Sequence
  Synthetic
tgcaccatgccccctgtcagcttttggggtccagatgggtgttggtactcaatggaaatcagacccaagcacact

SEQ ID NO: 91416 - DNA, 75 bp, Artificial Sequence
  Synthetic
aatgaagggcatttggtgaaatcctgggtggttgcttccaaaggagacgtagaccctttttccttggggcttctc

SEQ ID NO: 91417 - DNA, 75 bp, Artificial Sequence
  Synthetic
atgctttttctctgcagcgacatgtttctaatgaagagattttcaatgagagctctcatcgttggaagcgtcgtg

SEQ ID NO: 91418 - DNA, 75 bp, Artificial Sequence
  Synthetic
atgctgggagccatgacattgggaagcctaacctatcttgatctttttaggtacataatcacagttggcatgtac

SEQ ID NO: 91419 - DNA, 75 bp, Artificial Sequence
  Synthetic
atggctgaggtcaacagtgggggagacgtcacacaccttgctctgatcgcggtttttcgggcacgggctggcttt

SEQ ID NO: 91420 - DNA, 75 bp, Artificial Sequence
  Synthetic
gttagtgtgctggccctaaaacagatgtggagccctagggaaagattcgtggcagcctgtggaataatcatggtc

SEQ ID NO: 91421 - DNA, 75 bp, Artificial Sequence
  Synthetic
cagattgcgctaggagacatcataaacacttccatcatggagtggttgaatgcagcaggaatgtcaattttaatc

SEQ ID NO: 91422 - DNA, 75 bp, Artificial Sequence
  Synthetic
atcaaatcaatagttgaacccaaaagatgcaatgcagtcctccctctgttgtgtttcttgacacctctcacactg

SEQ ID NO: 91423 - DNA, 75 bp, Artificial Sequence
  Synthetic
gtggagctccagagagctgcaatgctcacttgttctatggtcatattagtgactgtatggcagacagacagtgtg

SEQ ID NO: 91424 - DNA, 75 bp, Artificial Sequence
  Synthetic
tctacgagaaaatccattccactggtggcactgaccatatgttcattttttaaatggactagcccttttctgggt

SEQ ID NO: 91425 - DNA, 75 bp, Artificial Sequence
  Synthetic
ttagtttgttacttggcatttacacgcatgccacagaggtcatggcctttaggcgagacaatggcggcagtaggc

SEQ ID NO: 91426 - DNA, 75 bp, Artificial Sequence
  Synthetic
cttgttggagtattagctggaatgggactgaaagacatgaatggaatgctcggtccagtggcagtaggtggagtt

SEQ ID NO: 91427 - DNA, 75 bp, Artificial Sequence
  Synthetic
ctcctcattatcatgagtctgtctgggaaagtagatggtctggtgatcaggaaaatctcagagatcagctgggat

SEQ ID NO: 91428 - DNA, 75 bp, Artificial Sequence
  Synthetic
gaagaagctgaaattagtggagcgtctcacaggtatgacgtggaacagacagacacaggagaattcaaactacgg

SEQ ID NO: 91429 - DNA, 75 bp, Artificial Sequence
  Synthetic
aatgaggaaccggctccctggatccaagtgtttgtgctaactgtggccatagtgagtgcagcaatccatcctgcc

SEQ ID NO: 91430 - DNA, 75 bp, Artificial Sequence
  Synthetic
tgcctagctgtcgtcacactggcatggtttctctggcaaaaaacttccacgcgcagtggtgtgctttgggacatt

SEQ ID NO: 91431 - DNA, 75 bp, Artificial Sequence
  Synthetic
ccaaccgttgttccaccagaagaagtggggtacctagaagatggtgtgtacaccatcaatcaaaatagtatcttg

SEQ ID NO: 91432 - DNA, 75 bp, Artificial Sequence
  Synthetic
ggactggcacagaaaggcgtgggggtcgtcaaagatggagtttttcacaccatgtggcatgttaccagaggggct

SEQ ID NO: 91433 - DNA, 75 bp, Artificial Sequence
  Synthetic
ttcctcctatttgagggaaaaaggttaacaccagcatgggcgaatgtaaaagaggacttaatctcatacggtggg

SEQ ID NO: 91434 - DNA, 75 bp, Artificial Sequence
  Synthetic
agctggaaattggatgccaaatgggatgggtctgaagaagtgcagttgattgccgtagctccagggaagaaccct

SEQ ID NO: 91435 - DNA, 75 bp, Artificial Sequence
  Synthetic
atgaatgtccagacaactccaagcatcttccagttgactgggggaaaggaaataggcgctgtgaacctggatttc

SEQ ID NO: 91436 - DNA, 75 bp, Artificial Sequence
  Synthetic
cctagcggaacttctggatcccccattgtcaacaagaatggtgaagtcatcggcctgtatggaaatggaatattg

SEQ ID NO: 91437 - DNA, 75 bp, Artificial Sequence
  Synthetic
atcggcaacaacacttatgtgtcggccattacccagagtgatacagcatcagaacaaggaaatgaccagttgcag

SEQ ID NO: 91438 - DNA, 75 bp, Artificial Sequence
  Synthetic
gacataccaaccatgcttaaaaaaggaatgttgacagtgttggacttccacccaggggcgggaaaaacacgcatt

SEQ ID NO: 91439 - DNA, 75 bp, Artificial Sequence
  Synthetic
tacctgccgcaaattttgaaagaatgtgagcgcctcaaactgaaaaccctggtgttggcacctacaagagtagtt

SEQ ID NO: 91440 - DNA, 75 bp, Artificial Sequence
  Synthetic
ttgagtgagatgaaggaggccatgccaaaaatgagcatcaagttccacacgcaagctttttcgaactcttctact

SEQ ID NO: 91441 - DNA, 75 bp, Artificial Sequence
  Synthetic
ggaaaagaaataattgatgccatgtgccatgccaccttaacccacaggatgctggaacctactagagtcacaaac

SEQ ID NO: 91442 - DNA, 75 bp, Artificial Sequence
  Synthetic
tgggaagttgtcatcatggacgaagcacatttcatggacccagccagcatagcagcacgaggctgggcagctcac

SEQ ID NO: 91443 - DNA, 75 bp, Artificial Sequence
  Synthetic
agatcacgagctagagagtgtgccaccatttttatgtccgcaacaccaccaggaacaagtaatgagtttccagag

SEQ ID NO: 91444 - DNA, 75 bp, Artificial Sequence
  Synthetic
tcaaatggagctattgaggacataaaaaaggacgtgcccacggaaccatggacaaaaggacatgaatggatcctt

SEQ ID NO: 91445 - DNA, 75 bp, Artificial Sequence
  Synthetic
gaagacaaaagacccacagcgtggttcttaccatccattcgaattgccaactcaatagccaattgtctacgaaag

SEQ ID NO: 91446 - DNA, 75 bp, Artificial Sequence
  Synthetic
gctgatagaaccgttgtggttctcaacagaaagacctttgagaaagagtatccaacaataaaaacaaaacggcct

SEQ ID NO: 91447 - DNA, 75 bp, Artificial Sequence
  Synthetic
gacttcatattagctactgacattgcagaaatgggagccaatctaaaagtggagcgggtcattgattgcagaacg

SEQ ID NO: 91448 - DNA, 75 bp, Artificial Sequence
  Synthetic
gcatacaaaccagtgctagttgatgatggcactaaagtaatggtcaaaggacctctcagaatatcagcatcctct

SEQ ID NO: 91449 - DNA, 75 bp, Artificial Sequence
  Synthetic
gcagctcaaagaagaggaagagttggtagggaccccagtcgtgacacagacacgtatgtctatggagactcaaca

SEQ ID NO: 91450 - DNA, 75 bp, Artificial Sequence
  Synthetic
acagaagacaatggacactatgtctgttggacagagggctcaatgttgctggacaacatggagataaaaaatggg

SEQ ID NO: 91451 - DNA, 75 bp, Artificial Sequence
  Synthetic
atgattgccccgctctatggaattgaaggaactaaaacaacaacagtgcctggggagacgaggctgagagaagac

SEQ ID NO: 91452 - DNA, 75 bp, Artificial Sequence
  Synthetic
cagagaaaagttttcagagagatggtcaaacgactggacataccggtatggctctcttggcatgtggctaaagca

SEQ ID NO: 91453 - DNA, 75 bp, Artificial Sequence
  Synthetic
ggtttgagagtgcaggacaggtcttggtgctttgatggagaggatgacaacacactgttaaatgacaacggggaa

SEQ ID NO: 91454 - DNA, 75 bp, Artificial Sequence
  Synthetic
cctatttttgcccgcagtccaggtggttcaaaaagacctctaaagcccaggtgggtggacactagagtctgcagc

SEQ ID NO: 91455 - DNA, 75 bp, Artificial Sequence
  Synthetic
gataacgcatctttgattgagttcatcaagtttgcagaaggaagaaggtccctcagtgggctccttgtgggactg

SEQ ID NO: 91456 - DNA, 75 bp, Artificial Sequence
  Synthetic
caaggattcccagatttcttatcagggaagatgagagaagccatagatacagtgacagtcttatacaacagtgat

SEQ ID NO: 91457 - DNA, 75 bp, Artificial Sequence
  Synthetic
gcaggcagccgagcttaccgacatgcccttgccatgatgcctgaggcagccacaatctttttgttggtgatgttg

SEQ ID NO: 91458 - DNA, 75 bp, Artificial Sequence
  Synthetic
gccatcatctgcacatcaggaatcatcatgtttttcctggctccaaaggggttgagccgcatgtccatggctatg

SEQ ID NO: 91459 - DNA, 75 bp, Artificial Sequence
  Synthetic
atgactatgctggtgtctgcttatttgatgtccttgggaggcatgaatccagtgcaaatctcatgcatcatgctt

SEQ ID NO: 91460 - DNA, 75 bp, Artificial Sequence
  Synthetic
gttttcttcattttcatggttgtgctgattccagaaccaggaacccaacgatcctcatatgacaaccaaatcatt

SEQ ID NO: 91461 - DNA, 75 bp, Artificial Sequence
  Synthetic
tacctgctggtgggaattttgagcctgatcctgcttgtggcagcaaatgagatgggcatgcttgaaaagacaaag

SEQ ID NO: 91462 - DNA, 75 bp, Artificial Sequence
  Synthetic
agagacatctttggtgacacaatggttactgaaagcaagaaatggtccttccctgaacttgacctgcatccaggt

SEQ ID NO: 91463 - DNA, 75 bp, Artificial Sequence
  Synthetic
gcagcttggacggtatacgtcggtttggtgacacttgtcacgccgatgttgcaccattggataaaagtggactat

SEQ ID NO: 91464 - DNA, 75 bp, Artificial Sequence
  Synthetic
ggcaacatatcactgtcaggcattactcaaaacgcccaggtgcttggcttgatggacaaaggcatacctttcatc

SEQ ID NO: 91465 - DNA, 75 bp, Artificial Sequence
  Synthetic
aagatgaacatgtccgtggtgatcttactactgagcgcttggaatggaataacattgctacccctcttttctgga

SEQ ID NO: 91466 - DNA, 75 bp, Artificial Sequence
  Synthetic
atgggagctgctgccctgcattggggtttcatactaccaggcctgcgagctcaagccgccaaagctgcccaaaaa

SEQ ID NO: 91467 - DNA, 75 bp, Artificial Sequence
  Synthetic
agagtgtaccacggtgtggcaaagaacccagtggtggatggaaaccctacagttgacattgatgatgccccagga

SEQ ID NO: 91468 - DNA, 75 bp, Artificial Sequence
  Synthetic
atgcctgctatgtatgaaaagaagctggccttgattatccttctaacattggctattgtaaatttgattcttacc

SEQ ID NO: 91469 - DNA, 75 bp, Artificial Sequence
  Synthetic
agaaccccatttgccactgctgagttggtcgtcctaggctcagctgcagttggtccactgatcgaaggcaacaca

SEQ ID NO: 91470 - DNA, 75 bp, Artificial Sequence
  Synthetic
aatgcctattggaatgggcccattgctgtggcattttcaggactgatgagaggcaactattatgccaccataggc

SEQ ID NO: 91471 - DNA, 75 bp, Artificial Sequence
  Synthetic
ctaatgtacaatggatggttggccaaacaggcaagaagaggaaaggcagcaggagtgacccttggcgaagtgtgg

SEQ ID NO: 91472 - DNA, 75 bp, Artificial Sequence
  Synthetic
aaacgacagctgaacatgttgggtaagcaagagtttgaaaggtacaaagtctctgacatcttagaggtagataga

SEQ ID NO: 91473 - DNA, 75 bp, Artificial Sequence
  Synthetic
acggctgcccagaggtacctgaaagaaggtaggaatgatgtaggtatcagtgtgtcaagaggggctgccaaaatc

SEQ ID NO: 91474 - DNA, 75 bp, Artificial Sequence
  Synthetic
cgctggctccatgagagagggtatgtgaaactatctggaagggtagttgatctgggatgcggacgtggcggatgg

SEQ ID NO: 91475 - DNA, 75 bp, Artificial Sequence
  Synthetic
agctactatgctgcagcccagaaagaggtgatgagcgtcaaaggttacactttgggggttgaaggccacgagaaa

SEQ ID NO: 91476 - DNA, 75 bp, Artificial Sequence
  Synthetic
cctgttcccatgcaaacattgggctggaacatcatcaagtttaaagataaatcaaatgtgttcaccatgccaact

SEQ ID NO: 91477 - DNA, 75 bp, Artificial Sequence
  Synthetic
gaatcaagtgataccctgctgtgtgacataggggagtcctcatcaaacccactcatagagagggacagaacgtta

SEQ ID NO: 91478 - DNA, 75 bp, Artificial Sequence
  Synthetic
aaggtcctagagaactttgaaagatggaaacatgtcaacactgagcacttttgtgtgaaagtgctatgtccatat

SEQ ID NO: 91479 - DNA, 75 bp, Artificial Sequence
  Synthetic
cacccagatgtcatagaaaagctagagcgactgcagctcaagtttggtggagggcttgtgagaataccattttcc

SEQ ID NO: 91480 - DNA, 75 bp, Artificial Sequence
  Synthetic
cgaaactccactcatgaaatgtattacatatcaggagccaggaataacattacacacatggtcaatgtcacgtcc

SEQ ID NO: 91481 - DNA, 75 bp, Artificial Sequence
  Synthetic
agaagcttattaagaaggatgaatagaccaacagggaagcccattattgagggagatgtcttcctccctactggc

SEQ ID NO: 91482 - DNA, 75 bp, Artificial Sequence
  Synthetic
accagaaatgtggccagtgaggctggtcctattgaccatgatgcattgcagttacgggttagccaactcaggaac

SEQ ID NO: 91483 - DNA, 75 bp, Artificial Sequence
  Synthetic
gaatacatcaaaacctggacaactgacgccaaccacccctatagaacttggcattatcttggaagttatctatgc

SEQ ID NO: 91484 - DNA, 75 bp, Artificial Sequence
  Synthetic
aaagctactggaagttcctcctccatgcttaacggtatagtgaaaatgttgtctatgccatgggataaattcgaa

SEQ ID NO: 91485 - DNA, 75 bp, Artificial Sequence
  Synthetic
tcagtcacccttctagccatgacagacacaacgccttttggtcagcaaagggtttttaaagagaaagttgacaca

SEQ ID NO: 91486 - DNA, 75 bp, Artificial Sequence
  Synthetic
agggcacctccaccacctccaggaacaagggctgttatgagagtagtcaatgcatggctgttcaagcacttggcc

SEQ ID NO: 91487 - DNA, 75 bp, Artificial Sequence
  Synthetic
aggaaattaaaacccaggatttgcacacgagaggaattcatttccaaagtaaggagcaatgcagctattggtgct

SEQ ID NO: 91488 - DNA, 75 bp, Artificial Sequence
  Synthetic
taccttgaagaacatgacaaatggaaaagtgctagtgaggccgtgcaggaccccaagttctggaagctcgttgaa

SEQ ID NO: 91489 - DNA, 75 bp, Artificial Sequence
  Synthetic
gacgaacgcaaactccacctccaaggaaagtgccgcacttgtgtgtacaacatgatgggaaagagagagaaaaaa

SEQ ID NO: 91490 - DNA, 75 bp, Artificial Sequence
  Synthetic
ccttctgaattcggcaaagcaaaaggcagcagagcgatctggtacatgtggcttggtgcccgtttccttgagttt

SEQ ID NO: 91491 - DNA, 75 bp, Artificial Sequence
  Synthetic
gaggcactgggattcttgaatgaggatcattgggtgtcaagaaagaactctgggggaggagttgaagggacagga

SEQ ID NO: 91492 - DNA, 75 bp, Artificial Sequence
  Synthetic
ctgcaatacctaggatacatcctcaaggaacttgggcagaaaccaggtggttcaatgtatgcagatgacacggct

SEQ ID NO: 91493 - DNA, 75 bp, Artificial Sequence
  Synthetic
ggatgggacacccgcatcacagaagaagacctggaggatgaacaggaaattctgaaatacatgactggagatcac

SEQ ID NO: 91494 - DNA, 75 bp, Artificial Sequence
  Synthetic
caaaaactggcctgggcagtcactgagttagcctataaaaacaaagtggtcaaggttatgagaccagggcctgga

SEQ ID NO: 91495 - DNA, 75 bp, Artificial Sequence
  Synthetic
gggttaacgtttatggacatcatttcccgcagagaccagagagggtcaggacaagttgtgacctatgctttgaac

SEQ ID NO: 91496 - DNA, 75 bp, Artificial Sequence
  Synthetic
acagtaaccaatctcaaagtgcaactcatccgcatggcagaggccgaacatgtgataactagacatgatgtggaa

SEQ ID NO: 91497 - DNA, 75 bp, Artificial Sequence
  Synthetic
tcagtcagccaaaacacactgaaggatgtgagagactggcttgaaaagtttggagcagacagactatctagaatg

SEQ ID NO: 91498 - DNA, 75 bp, Artificial Sequence
  Synthetic
gccgtcagtggggatgactgtgtggtcaagccaattgatgaccagtttgcagatgcgctctcacatttaaacgcc

SEQ ID NO: 91499 - DNA, 75 bp, Artificial Sequence
  Synthetic
atgtcaaagattagaaaagacattgatgattggaagccgtcaacaggatgggattcatgggaagctgtgccattc

SEQ ID NO: 91500 - DNA, 75 bp, Artificial Sequence
  Synthetic
tgctcgcatcatttccatgagattgtgttaaaagatggtagatccatcgtggccccatgccgtgaccaggatgaa

SEQ ID NO: 91501 - DNA, 75 bp, Artificial Sequence
  Synthetic
ttgattgggagagcccgtgtttcaccaggaaatgggtggatgatcagagagactgcatgcctcagcaaagcctac

SEQ ID NO: 91502 - DNA, 75 bp, Artificial Sequence
  Synthetic
gcccaaatgtggttgctgatgtacttccacaggagagatctccgagtcatggggaacgctatatgttcagcagtc

SEQ ID NO: 91503 - DNA, 75 bp, Artificial Sequence
  Synthetic
cctgtaaactgggtccccacaggaagaaccacttggtcaatacacggcaaaggagaatggatgaccacagaagac

SEQ ID NO: 91504 - DNA, 75 bp, Artificial Sequence
  Synthetic
atgttagaagtgtggaatagggtctggatagaagaaaatccacatcagcctgacaagacacccatcactgagtgg

SEQ ID NO: 91505 - DNA, 75 bp, Artificial Sequence
  Synthetic
agagacataccatacctgcccaaatctgtggacaagacatgcaattccttagtcgggacaactcaacgtgcaaca

SEQ ID NO: 91506 - DNA, 75 bp, Artificial Sequence
  Synthetic
tgggcgcgtgacatcaaacacactgtccacaaagtcagaggcctggtaggaaatgaaagataccaagactatctg

SEQ ID NO: 91507 - DNA, 75 bp, Artificial Sequence
  Synthetic
tcatccatggacagatttaaagagttggatgaagaaggcccaggggaaatcctctggtaagatgaaaatcatttt

SEQ ID NO: 91508 - DNA, 75 bp, Artificial Sequence
  Synthetic
acatggaaaccgggatacaaactacggagatagaaccggactatctcaccactgtaaaaccgggatacaaaccac

SEQ ID NO: 91509 - DNA, 75 bp, Artificial Sequence
  Synthetic
ggggaggaccggacctcccacatagcaaaaccgggatacaaactagaaaacaggaccggacctgtattggagtca

SEQ ID NO: 91510 - DNA, 75 bp, Artificial Sequence
  Synthetic
gcccatcaactgatgccatggctaagctgtgaggccatgctggctgggacagccgcgaccacccgcgtaaagggg

SEQ ID NO: 91511 - DNA, 75 bp, Artificial Sequence
  Synthetic
ttcctggatcgctcaatctggggtaaaaacttattgggagcctccacccgttgcctccgcgcacaacgggaaaga

SEQ ID NO: 91512 - DNA, 75 bp, Artificial Sequence
  Synthetic
aggggtctagaggttagaggagaccctcccgagcatttaagcggaccatattgacgcctgggaaagaccggagac

SEQ ID NO: 91513 - DNA, 75 bp, Artificial Sequence
  Synthetic
actccttgattctcacctttctcacccttaagcacagattgcttgaatgcagggtggggaagttgggaaccaacc

SEQ ID NO: 91514 - DNA, 75 bp, Artificial Sequence
  Synthetic
gattctcacctttctcacccttaagcacagattgcttgaatgcagggtggggaagttgggaaccaaccagtgtct

SEQ ID NO: 91515 - DNA, 75 bp, Artificial Sequence
  Synthetic
cgcacagtggatcctaggcattttcctgaatctgcgcaacattctgactccttgaaagatgggtcaggtggtgac

SEQ ID NO: 91516 - DNA, 75 bp, Artificial Sequence
  Synthetic
tttctttcaatcaattcctgagatcatacaagaggccatcaacattgctctaattgctgttagcgtcatctgcat

SEQ ID NO: 91517 - DNA, 75 bp, Artificial Sequence
  Synthetic
catcaaaggctgtgtaaacctctggaaatgtggtctaattcaactgatggtctttctcttgcttgcggggaaaag

SEQ ID NO: 91518 - DNA, 75 bp, Artificial Sequence
  Synthetic
gtgtgatgctcttaacattgatagaagacatgtgctgtcatctgtggaactcaacctaacgaggatgtttgacaa

SEQ ID NO: 91519 - DNA, 75 bp, Artificial Sequence
  Synthetic
ttttcctcagtcctgttccaagaataacacacaccactattataaaggccctgaaggaacaaactggggaattga

SEQ ID NO: 91520 - DNA, 75 bp, Artificial Sequence
  Synthetic
gctcactttgaccaatacgtcggttgccaactacacatcgatgaataggatcagaagtcttgcttttggcaatat

SEQ ID NO: 91521 - DNA, 75 bp, Artificial Sequence
  Synthetic
tcagaagtcttgcttttggcaatatcaccaattgtgacaagactggtgaggcaggtcacactctcaaatggcttt

SEQ ID NO: 91522 - DNA, 75 bp, Artificial Sequence
  Synthetic
caccaattgtgacaagactggtgaggcaggtcacactctcaaatggcttttgaatgagctacacttcaatgtttt

SEQ ID NO: 91523 - DNA, 75 bp, Artificial Sequence
  Synthetic
acatgtgacgagacatgtgggtgcaagatgcatgacaacagagggtgcaggacttctgattcaatacaacctgac

SEQ ID NO: 91524 - DNA, 75 bp, Artificial Sequence
  Synthetic
agatgcatgacaacagagggtgcaggacttctgattcaatacaacctgacaattggagaccatgggggtgaggta

SEQ ID NO: 91525 - DNA, 75 bp, Artificial Sequence
  Synthetic
gggagacatctgatagcatcacttgctcagatcatcggtgacaataaagcagcttgggtggggaaatgtgactcc

SEQ ID NO: 91526 - DNA, 75 bp, Artificial Sequence
  Synthetic
agatgttccaacgatggtaagtgcaactacactaactgtgaaggctacacacactataattatctcattatccag

SEQ ID NO: 91527 - DNA, 75 bp, Artificial Sequence
  Synthetic
acactataattatctcattatccagaacaccacatgggctcaacattgcacatacagtcctctaccctccatcag

SEQ ID NO: 91528 - DNA, 75 bp, Artificial Sequence
  Synthetic
aacaccacatgggctcaacattgcacatacagtcctctaccctccatcaggatggcattgaacaaagtggcctac

SEQ ID NO: 91529 - DNA, 75 bp, Artificial Sequence
  Synthetic
agttctgtcagtagatcactccttggattcttcacctgggatatttcagactcatcaggaaaccatgtccctggt

SEQ ID NO: 91530 - DNA, 75 bp, Artificial Sequence
  Synthetic
gggtactgtttggagcagtgggccgttgtttgggctgggatcaagtgttttgacaacgcggtgatggccaagtgc

SEQ ID NO: 91531 - DNA, 75 bp, Artificial Sequence
  Synthetic
aacaaagagcatgatgttgagttttgtgacacaatgagactttttgattacaaccaaaatgctataaagactctc

SEQ ID NO: 91532 - DNA, 75 bp, Artificial Sequence
  Synthetic
caacttaatacagagaatgcagttaacttactcaagagatcaataaatggattgatttcagactcattagtcatt

SEQ ID NO: 91533 - DNA, 75 bp, Artificial Sequence
  Synthetic
agaaacagtctgaagcaactagccaggattccctactgcaactacaccaaattttggtacattaatgacacagtc

SEQ ID NO: 91534 - DNA, 75 bp, Artificial Sequence
  Synthetic
agtgggaaacattctctcccacagtgttggaaggttcacaatggaagctacttaaatgagtcacagttcaagaat

SEQ ID NO: 91535 - DNA, 75 bp, Artificial Sequence
  Synthetic
gagtggctcttagagagtgaccacctgtatagtgagatgttgctgaaagagtacgaagagagacaggggaggacc

SEQ ID NO: 91536 - DNA, 75 bp, Artificial Sequence
  Synthetic
cctctagcactaactgacatctgcttttggtcactagtgtttttcactagtacagttttcctccacctggtgggc

SEQ ID NO: 91537 - DNA, 75 bp, Artificial Sequence
  Synthetic
atcccctcacacaggcacattgttggcgatgcgtgccctaaaccacacagaataactaagaatgctctatgctct

SEQ ID NO: 91538 - DNA, 75 bp, Artificial Sequence
  Synthetic
tgtggttattacaacctaccaggcaaacaagtcaggtgggtcaggaaagggaagtaaacaccatccccccccact

SEQ ID NO: 91539 - DNA, 75 bp, Artificial Sequence
  Synthetic
ccgccccgacaggggcggagtggggggcgcccggatctccacccccttgggggtggagatccggggagcagatgc

SEQ ID NO: 91540 - DNA, 75 bp, Artificial Sequence
  Synthetic
agctcacaggtgtatcaggttttcagttcggtatagtaaatcaattgggagcaactgctgaggttttgcatcagc

SEQ ID NO: 91541 - DNA, 75 bp, Artificial Sequence
  Synthetic
tatgtagccagtaattgtggcgtcaaacatgatgcagtccagcagggcacagtgtgcattggtcgatgttggggc

SEQ ID NO: 91542 - DNA, 75 bp, Artificial Sequence
  Synthetic
agcacccttctttttcttcttgatgacaaggcctttgtgtttcttgcacaaggggttgaatctctcccagacagt

SEQ ID NO: 91543 - DNA, 75 bp, Artificial Sequence
  Synthetic
gtcctcatacactctggcttgttcactagtgagagcaacgtccactaccttcaggtctctcctgccatgcatcag

SEQ ID NO: 91544 - DNA, 75 bp, Artificial Sequence
  Synthetic
gaacaacttttcaatgtcgtctgagccttgtgctgtcaacaccattccttcaggtagggccctgatgattgcaga

SEQ ID NO: 91545 - DNA, 75 bp, Artificial Sequence
  Synthetic
caccaaccctggttgtgcagactcaaggtccttaagcagaaggccgtgtgagaatttactttggtccttgaatga

SEQ ID NO: 91546 - DNA, 75 bp, Artificial Sequence
  Synthetic
aggtccttaagcagaaggccgtgtgagaatttactttggtccttgaatgattgctcattatgagggcgcctgtaa

SEQ ID NO: 91547 - DNA, 75 bp, Artificial Sequence
  Synthetic
cagtggaggtatttgccactgtttggctgaaagattgcaaactccactaagtccccagggggcccctcaatgtca

SEQ ID NO: 91548 - DNA, 75 bp, Artificial Sequence
  Synthetic
acccaggttgttactttagggtccaacagcctcacagctcctttcacttgatcttcctggtctctgcttagtggg

SEQ ID NO: 91549 - DNA, 75 bp, Artificial Sequence
  Synthetic
ttaatttgtggagttccaccatttctcactggagggtggttgggtgagggtttcccctcgatgtcgatagatgtg

SEQ ID NO: 91550 - DNA, 75 bp, Artificial Sequence
  Synthetic
ttgtcccatgctctcccagaaacttgtgatctggagccaatgtatggccacccttcaccactcaggcagatcttg

SEQ ID NO: 91551 - DNA, 75 bp, Artificial Sequence
  Synthetic
taaagcagattctcataaggatttctttgaggtccagcattgccaatgaacattccctctctgtttttcacttga

SEQ ID NO: 91552 - DNA, 75 bp, Artificial Sequence
  Synthetic
agaactgtctttataagtgtactaaacatgcttggggaaaccttaatggtctctaacatgttccctccgtcaatc

SEQ ID NO: 91553 - DNA, 75 bp, Artificial Sequence
  Synthetic
atacaagcacctgctttgacagctgcagaaagactcagattatagcctgaaatgttgatctgtgattgttcttgg

SEQ ID NO: 91554 - DNA, 75 bp, Artificial Sequence
  Synthetic
gtgatgagcttcaagcagggatgttgttcggtcagcttttccaagtcatccaagtttgggaacttcacagtgtac

SEQ ID NO: 91555 - DNA, 75 bp, Artificial Sequence
  Synthetic
acaagccctaatgctgtcaaaccttgcacaacatcattcatttgttctccgccctgctctgtcatacaggcaatg

SEQ ID NO: 91556 - DNA, 75 bp, Artificial Sequence
  Synthetic
gttaatgctggcatggagccaaactgattgatcataagagaagaatctttgacatcccatactttaactacccca

SEQ ID NO: 91557 - DNA, 75 bp, Artificial Sequence
  Synthetic
cctcttgattgttgcagaggcttcatgccaaccagcttaagcagatccgctctctgctggagctgtgatgttgtt

SEQ ID NO: 91558 - DNA, 75 bp, Artificial Sequence
  Synthetic
aagttgccttgatagacacctggtgtacttgatccctctgctctcatcactttctttctcaacttctcaaggtct

SEQ ID NO: 91559 - DNA, 75 bp, Artificial Sequence
  Synthetic
gatgataactccagcaactcatccttagatagccctcctatcttcaacaccacatctctctgaactgatctcatt

SEQ ID NO: 91560 - DNA, 75 bp, Artificial Sequence
  Synthetic
gtcatgagagcatcaacctccttgttcatgtctctcaatctagtgagatcagcttcagatcgtttgtccttcctc

SEQ ID NO: 91561 - DNA, 75 bp, Artificial Sequence
  Synthetic
atcattctctgaacttgtgccacctgattgaagtcaagggcactcataatagcctttgcatctttgatgacatcg

SEQ ID NO: 91562 - DNA, 75 bp, Artificial Sequence
  Synthetic
gctttgacagtctgtgtccagttggataggcctcttctgagagcttgagtccaacgaaacgcaggaatatttgag

SEQ ID NO: 91563 - DNA, 75 bp, Artificial Sequence
  Synthetic
acgcaggaatatttgagtcactcatggtgattcaatgcgcaatgagttcctaaaatgcctaggatccactgtgcg

SEQ ID NO: 91564 - DNA, 75 bp, Artificial Sequence
  Synthetic
cgcaccggggatcctaggcttttattggatctgcgcactgtgtgatagccatggggttgagatactcaaaggctg

SEQ ID NO: 91565 - DNA, 75 bp, Artificial Sequence
  Synthetic
tcagagacagatatggagagagggaaactgtcggcagagtgcccatgacactcaaccttccccaaggtctctatg

SEQ ID NO: 91566 - DNA, 75 bp, Artificial Sequence
  Synthetic
ggagatttaattgtaagtcctgttggtttgctaacaaaggtctgattgcatgcagtgatcattatctgtgtctga

SEQ ID NO: 91567 - DNA, 75 bp, Artificial Sequence
  Synthetic
attgcctaacaaggatgctcagcaggtcagagttttgcgagatctgcaataggcctcttccaaccaagatcatct

SEQ ID NO: 91568 - DNA, 75 bp, Artificial Sequence
  Synthetic
ttgaagaaagtccatcagcaccaccctacgaaccctaggtccacgggtgggccccgccgcgggccctggggcccg

SEQ ID NO: 91569 - DNA, 75 bp, Artificial Sequence
  Synthetic
ctgtgcttagtctatttccaccctctcatcgtgagacttcaacagtttctcacacgaaagacctttcaaacggta

SEQ ID NO: 91570 - DNA, 75 bp, Artificial Sequence
  Synthetic
tggccctctttcatcttggatcattattgctgacaaactgttgctgtatgccaatttaaatgcaccaaatgaaac

SEQ ID NO: 91571 - DNA, 75 bp, Artificial Sequence
  Synthetic
ccaatcggactccctttttagaatttgcttgaagtcctcattgtaattgtcaacaagattctgcagatctgatgt

SEQ ID NO: 91572 - DNA, 75 bp, Artificial Sequence
  Synthetic
tgtcatgcttagtaaagcaccagtctttcctgaagatttcaaataataaaatagcgattcaaggaactcggaaac

SEQ ID NO: 91573 - DNA, 75 bp, Artificial Sequence
  Synthetic
tttatcattggatagcaaaccaagtgccataaacaaggacttactggtgacattgacatttaactttgaaacaat

SEQ ID NO: 91574 - DNA, 75 bp, Artificial Sequence
  Synthetic
cctatctccttctttgataatgcccttatctaaatgtagtggagtaaaacccatctcaggcccgatgatcttgta

SEQ ID NO: 91575 - DNA, 75 bp, Artificial Sequence
  Synthetic
agaaaatttattctttaattcttttatatgtgctgagaagtctaacctaactttggatagatgtggagaagtgcc

SEQ ID NO: 91576 - DNA, 75 bp, Artificial Sequence
  Synthetic
actgaaactcacgtcctgatcttttaatagcaagtcaaaattgagaacttcctttccagatactacaggaactag

SEQ ID NO: 91577 - DNA, 75 bp, Artificial Sequence
  Synthetic
aggaatcaatcccgccccgtccagctgtagatggttcccaggtgagttggacacaaaacattcaacatcctttac

SEQ ID NO: 91578 - DNA, 75 bp, Artificial Sequence
  Synthetic
tgggatgactaaaacatcctgatcatcttgatcagaaaataaggacgtctcaaggacaaaagatgccttaactgt

SEQ ID NO: 91579 - DNA, 75 bp, Artificial Sequence
  Synthetic
gtaggtggttgtatgttcatatttatgcttgtagctctttctgatatgactaaaaactaagacaagctccatact

SEQ ID NO: 91580 - DNA, 75 bp, Artificial Sequence
  Synthetic
gaactcagagtctggggattcaatgaacattgactcaaaagtctcgtaaagatatctattagcccagtcaacctt

SEQ ID NO: 91581 - DNA, 75 bp, Artificial Sequence
  Synthetic
ggttaaaaatgtagagagattcaaattcacatctgtcattttcattgtcgactgaacaaacccaagatcaagatc

SEQ ID NO: 91582 - DNA, 75 bp, Artificial Sequence
  Synthetic
atcaatggtcattgccttgctaatattaagcattttacagtccatcacaaattgtgtcaactgttgaagttcatg

SEQ ID NO: 91583 - DNA, 75 bp, Artificial Sequence
  Synthetic
aggttctgtgttaggcagtagctcaacttctccgtaccaaaagtatttcttcaactgactggttgtcaataagac

SEQ ID NO: 91584 - DNA, 75 bp, Artificial Sequence
  Synthetic
gggtgttaacatagattcaaaaaggatttgcaacaagaaattgtaacagatttcatatgagtttaactgcaaacc

SEQ ID NO: 91585 - DNA, 75 bp, Artificial Sequence
  Synthetic
ttcctcgaaagttgatgcttctcttaaatgtgacattgactgctcattctgcttgacgacatacagctcctctct

SEQ ID NO: 91586 - DNA, 75 bp, Artificial Sequence
  Synthetic
tttccttttaatcatgtgggagataatgccaaggctctcacttgtcatgtcaaccgctacacaaatgtccagaaa

SEQ ID NO: 91587 - DNA, 75 bp, Artificial Sequence
  Synthetic
ttttatcctctgaacccatgatatctttaaagtgttaagatcagataaatatggcgctacatgctcctcaaacag

SEQ ID NO: 91588 - DNA, 75 bp, Artificial Sequence
  Synthetic
agaagggaaattcctttttattgaaaaaagcacatggttaaggtttaccttatcttcaagctctgtatgtgatga

SEQ ID NO: 91589 - DNA, 75 bp, Artificial Sequence
  Synthetic
tggcttacacaaccaaaattgacttgggttgtctaacttataaactgacttaggcaaaactgcctttgaaaaaac

SEQ ID NO: 91590 - DNA, 75 bp, Artificial Sequence
  Synthetic
ccagtttcccaactcacaagcattagttaaaaccagtgcaaaataatcccagaataatggtctggagtactcact

SEQ ID NO: 91591 - DNA, 75 bp, Artificial Sequence
  Synthetic
cacttcttttaaagcctccctacaatagatgttgcaataatttctacaagagtggcagtttacatgtttaattat

SEQ ID NO: 91592 - DNA, 75 bp, Artificial Sequence
  Synthetic
gtctttcaaaacatcctttatatagaggaaactccctttcccgtctctaacacacttactacccatgcttttgca

SEQ ID NO: 91593 - DNA, 75 bp, Artificial Sequence
  Synthetic
aacaccaacaaatccagatgctatgcaactctgaaatgcagacttgttgactgcatctgtgattatcttctttgc

SEQ ID NO: 91594 - DNA, 75 bp, Artificial Sequence
  Synthetic
acctctcacaaaattcttcgacaattttgattgaacagatttaattaatgagggtatttcttccctttcaataat

SEQ ID NO: 91595 - DNA, 75 bp, Artificial Sequence
  Synthetic
ccgtgcagaattcatcaatttcgtcctcaataccattctatagtcaccatgtgctcttaaattcaaccatctgaa

SEQ ID NO: 91596 - DNA, 75 bp, Artificial Sequence
  Synthetic
gtctaagattctttctatctgttcattagtaacatcagcaatttcaagtatacgccttaaacagtcatcagggtc

SEQ ID NO: 91597 - DNA, 75 bp, Artificial Sequence
  Synthetic
agtctgtatagtactcaccaggtattcttcctctattgttcctgatctaattaaatggaacacttttctcgctgc

SEQ ID NO: 91598 - DNA, 75 bp, Artificial Sequence
  Synthetic
agctctcactatcccagggacttcatcatctggaaatacattttcaactgatctctgcaatcggtagcctctaga

SEQ ID NO: 91599 - DNA, 75 bp, Artificial Sequence
  Synthetic
accatcaacccagtctttaacgtcagtctcttccaaacataagaataagttgtaaggatgtcctgaataacgcaa

SEQ ID NO: 91600 - DNA, 75 bp, Artificial Sequence
  Synthetic
aagagcattagtcctcttagcaatcctaccaacaacttcaattgaaacaccattggccacacactgatccaaaat

SEQ ID NO: 91601 - DNA, 75 bp, Artificial Sequence
  Synthetic
tgtgtcaattgtctcagcaagttgatttggtgccttggccttaacattatgcagtgcagcggcaacaaattttgt

SEQ ID NO: 91602 - DNA, 75 bp, Artificial Sequence
  Synthetic
caagagtgggacctcttgtgaccaaataaaaaagcgagacttaaactcacatgcaaatgtcccagccactgtctt

SEQ ID NO: 91603 - DNA, 75 bp, Artificial Sequence
  Synthetic
aggactcacaaacttgtttagtcctcttgaaagaaagtcatgaaagtctagaatgtcctttgccaattcaacatc

SEQ ID NO: 91604 - DNA, 75 bp, Artificial Sequence
  Synthetic
caattcaccgtcattcttctttaatatgaaggatgaactcattaaaatctcatcatcactggaggtgtaagataa

SEQ ID NO: 91605 - DNA, 75 bp, Artificial Sequence
  Synthetic
acatggggtgtcatagcaaagctttatgcagtaatttataaactgttctgtgaccaaaccatagaagtcagacac

SEQ ID NO: 91606 - DNA, 75 bp, Artificial Sequence
  Synthetic
attatgcaaaattccttgccccatatcaatcacagaacttatgtgtgagggcacaaccccagtctcaaactgctt

SEQ ID NO: 91607 - DNA, 75 bp, Artificial Sequence
  Synthetic
gtgcatgaagtcctcaaccatagtcattgagttcttctccataactccagtgcaccttttgatgtaccccttcat

SEQ ID NO: 91608 - DNA, 75 bp, Artificial Sequence
  Synthetic
gtaggcacgaactacattaaaaggcacctccaccattttgtgaatgtgccaatttaacaactcaagaattggtct

SEQ ID NO: 91609 - DNA, 75 bp, Artificial Sequence
  Synthetic
attgtctattactgaaccatccaacaatgatagtttcaacagtctcaaaaattgggaaaatatgacaggagacat

SEQ ID NO: 91610 - DNA, 75 bp, Artificial Sequence
  Synthetic
gtgaggaccccactttgagtgatccatactaacaacaaaaccggactgccttataatggccttcatgtctaaaag

SEQ ID NO: 91611 - DNA, 75 bp, Artificial Sequence
  Synthetic
tgccttttcaaactctttctcattgttcagacaagaatacctcatgtcacccacaattgactcaaagtaatcctc

SEQ ID NO: 91612 - DNA, 75 bp, Artificial Sequence
  Synthetic
aatgagtctagttgtaagcttggtgttgaggtctccaacatacagttctctatttccacctacttgctctttgta

SEQ ID NO: 91613 - DNA, 75 bp, Artificial Sequence
  Synthetic
tgacaatccaaacttcaatctccctatgtttgtgccaacacaagacctttcagttgctgattcatctgaataaaa

SEQ ID NO: 91614 - DNA, 75 bp, Artificial Sequence
  Synthetic
acaaagatttcttaaggaagaatttgtgaagaaacttttatctaatcttttcagaattgactcagaattgctttc

SEQ ID NO: 91615 - DNA, 75 bp, Artificial Sequence
  Synthetic
cctcgtgctaattctaaccacttctgaaatattgagcgcaggttccttaaaccctaagcgattaatcttcttgtg

SEQ ID NO: 91616 - DNA, 75 bp, Artificial Sequence
  Synthetic
atcatacctcccaactctgttgtcataacctgtagaaaccaagatgtatttgaaacattcaaagaagtcctgttc

SEQ ID NO: 91617 - DNA, 75 bp, Artificial Sequence
  Synthetic
ttcatagtacttccgtgttaaatttcgcaacaacatctcaagggggcaaggactaaacactctttcagtaaaata

SEQ ID NO: 91618 - DNA, 75 bp, Artificial Sequence
  Synthetic
taattctttgaatctgctctcaaaaacaatctgaaccaattcttcataagtctcaggtggaaaggtgttgaagtc

SEQ ID NO: 91619 - DNA, 75 bp, Artificial Sequence
  Synthetic
aaagtctttaacttcatggtgactggtttcaatgttcacccgcatcctcacttcctcagaccagagggaatcaag

SEQ ID NO: 91620 - DNA, 75 bp, Artificial Sequence
  Synthetic
gggattgtggtcagctttacctgtcccaaccttcttttcacatccatgattacatttggaagattccatccttga

SEQ ID NO: 91621 - DNA, 75 bp, Artificial Sequence
  Synthetic
aagacaggaagttacatcagattctattttcaagattacatctttcacctcatctgagacagagtctaaaatatc

SEQ ID NO: 91622 - DNA, 75 bp, Artificial Sequence
  Synthetic
atcctcagagtcgaagggctcatctattggatgtttgactttgtttgaaacgagccccatcagtctatcataaat

SEQ ID NO: 91623 - DNA, 75 bp, Artificial Sequence
  Synthetic
cttgtagacaagtgattttctatctagcttatattgcagtttatttttaaatgattctgacaactcaacaacaac

SEQ ID NO: 91624 - DNA, 75 bp, Artificial Sequence
  Synthetic
tgatgagactaatgtttgatagtcataggttgtaattggctctcctaactcattgagctttggaactacaacact

SEQ ID NO: 91625 - DNA, 75 bp, Artificial Sequence
  Synthetic
cttattgctgcttaagtctagagccgtgcttgtaaatgagggtgactgtgggtctctactcaatttatttgggag

SEQ ID NO: 91626 - DNA, 75 bp, Artificial Sequence
  Synthetic
cccaagctcaccatgattaaaaagcgacgaacaaatgctcattaacaatgggtcagtcccagggtctgaaccctg

SEQ ID NO: 91627 - DNA, 75 bp, Artificial Sequence
  Synthetic
tgctcccttcacatccttagataacaatcttgtcatgtcgtttaggaacttatcctcctgcttaggttcaagatg

SEQ ID NO: 91628 - DNA, 75 bp, Artificial Sequence
  Synthetic
gagggacatacttgggttaattaagactgagtcaaagtttagcttaggctccatgaacttctcaaaacacttgat

SEQ ID NO: 91629 - DNA, 75 bp, Artificial Sequence
  Synthetic
ctgatcagtgagcctgtctggtgtttccttggtgattaagtgacataggtaggaaacatttagtatgaatttgaa

SEQ ID NO: 91630 - DNA, 75 bp, Artificial Sequence
  Synthetic
agccttagtcatgttgacctcatcagatgatgtcaaaacagaaagtatcaaatcatcagttaagcacatagtgtg

SEQ ID NO: 91631 - DNA, 75 bp, Artificial Sequence
  Synthetic
aaactctgccttggattttgctacaattttcagtttatttaggagctgcacgtggtgcaattcattcacgtaagc

SEQ ID NO: 91632 - DNA, 75 bp, Artificial Sequence
  Synthetic
cataatgaagtatctcatcccttggaggtatgtttgcaaccttttagtaggagtacacatgacacaaagcagaag

SEQ ID NO: 91633 - DNA, 75 bp, Artificial Sequence
  Synthetic
tttcctcagattgcaggaaacctttcttttgtcggaatcactcataaaatcaagccatgatagcatttcacatgc

SEQ ID NO: 91634 - DNA, 75 bp, Artificial Sequence
  Synthetic
catactgtggatcacatcagaactcattatgggtaagaaaaacctttttggatcacaatagaaggatgccaaatg

SEQ ID NO: 91635 - DNA, 75 bp, Artificial Sequence
  Synthetic
ctcttcactatcacctcctccaacagtcttgaatatggagtagcacctattcttttcacctgttttctgatacaa

SEQ ID NO: 91636 - DNA, 75 bp, Artificial Sequence
  Synthetic
taatactgacctatatgcctcctgaaactcttggtaatagcactcattgcaatgtacaaacccgtagtaattgtc

SEQ ID NO: 91637 - DNA, 75 bp, Artificial Sequence
  Synthetic
tggctgattaacagtcagttttgttgtactagctgtcttcatagaattgaccaaccccaatgataatgtggacaa

SEQ ID NO: 91638 - DNA, 75 bp, Artificial Sequence
  Synthetic
ggcctctagatactgaaggaaagactcatcagagaggttcacatagtcaagtctatcattctcctcacaattaca

SEQ ID NO: 91639 - DNA, 75 bp, Artificial Sequence
  Synthetic
aggtgtagctatagcattataatttattgatggtttgttaccccagttctccctgtaactgtcatagtactcagc

SEQ ID NO: 91640 - DNA, 75 bp, Artificial Sequence
  Synthetic
ccatgtttccaggtccaactctgttaaaaggggttgtacttgaagttcataattttgtcttagtggttcaggtag

SEQ ID NO: 91641 - DNA, 75 bp, Artificial Sequence
  Synthetic
tccatgaaccagtttctgatcaactttagtgagccatttgggagaactgatcatttttctctcatatgctttaac

SEQ ID NO: 91642 - DNA, 75 bp, Artificial Sequence
  Synthetic
aattagatccggacacaccagtctatcattaaccgaacgcagacatccaccaacaaggaaatgaacatcctgtgt

SEQ ID NO: 91643 - DNA, 75 bp, Artificial Sequence
  Synthetic
acagtctttctttatgatttgtaaaaacttgttgaacataatgacatctagactgaggaaagtcagtctccttgt

SEQ ID NO: 91644 - DNA, 75 bp, Artificial Sequence
  Synthetic
gttcaaaattttctgtcccttgatcttattacatactgatagcaatgaaaagtactcagagacctcctgactcac

SEQ ID NO: 91645 - DNA, 75 bp, Artificial Sequence
  Synthetic
tagctttgtgtttgaggatgacttggagcccttcaatttagtcaggacctcaatcatatgattctgacatagttc

SEQ ID NO: 91646 - DNA, 75 bp, Artificial Sequence
  Synthetic
acaatgaggtgaagcaccaaggttaccatgctctattaaggagtgagatctcaatgcctcttgcagttctagtct

SEQ ID NO: 91647 - DNA, 75 bp, Artificial Sequence
  Synthetic
atccgtagatttgaagctctctgcaaggtacccttgctccttcaatgtctgatattcagtaaatagttttagaat

SEQ ID NO: 91648 - DNA, 75 bp, Artificial Sequence
  Synthetic
agctgtcttacaatcactaacagacagttgaccatttacacccaaggacaggactgattccaacctttgtttgta

SEQ ID NO: 91649 - DNA, 75 bp, Artificial Sequence
  Synthetic
tgatgcaccacattccctcatttgtgtcaggctttcaaggcccaacccctgattctccattgtggataaactaca

SEQ ID NO: 91650 - DNA, 75 bp, Artificial Sequence
  Synthetic
caccaacctctcatactctacctcctcaatgtcttcaccatcatccttaagctgcttcattattgtaatgatgag

SEQ ID NO: 91651 - DNA, 75 bp, Artificial Sequence
  Synthetic
ccatctcaacctctctatcacccaatctgggatataatcaacgtagtaattggatctaccatcaaccacaggtac

SEQ ID NO: 91652 - DNA, 75 bp, Artificial Sequence
  Synthetic
tagtgtaatacccacttttgacagatcttgactcaacatcatcaatttcccaaagtcatgattatacttaacctc

SEQ ID NO: 91653 - DNA, 75 bp, Artificial Sequence
  Synthetic
aaagcttgattggtttactctaacaaacgcctctaagagtaccacgatgtcccctgtgacaagataaccatccgg

SEQ ID NO: 91654 - DNA, 75 bp, Artificial Sequence
  Synthetic
cactaggtcgggtagtgtcggtgcaaccatcttgtactcccttaatatggcgttaactgtcttagatctgttgtg

SEQ ID NO: 91655 - DNA, 75 bp, Artificial Sequence
  Synthetic
gatgcacctatttttcttgcaagaatctacttctacaagtaaagatagcaattttagaccttcaatcaccacagc

SEQ ID NO: 91656 - DNA, 75 bp, Artificial Sequence
  Synthetic
tcttaggtgcacctgagatagtgaactagccttctgttctatgaattcaggctcatcagggacccattttctgat

SEQ ID NO: 91657 - DNA, 75 bp, Artificial Sequence
  Synthetic
ccattttctgatgaggtccctcatttcgttcaaggtttcatccatgatctagaaaagcctaggatccccggtgcg

SEQ ID NO: 91658 - DNA, 75 bp, Artificial Sequence
  Synthetic
caccaattgtgacaagactggtgaggcaggtcacactctcaaatggcttttaaatgagctacacttcaatgtttt

SEQ ID NO: 91659 - DNA, 75 bp, Artificial Sequence
  Synthetic
agatgcatgacaacagagggtgcaggacttctgattcaatacaacctgacaattggagatcatgggggtgaggta

SEQ ID NO: 91660 - DNA, 75 bp, Artificial Sequence
  Synthetic
aacaccacatgggctcaacattgcacatacagtcctctaccctccatcaggatggcattgaacaaagtggcctat

SEQ ID NO: 91661 - DNA, 75 bp, Artificial Sequence
  Synthetic
ccgccccgacaggggcggagtggggggcgccccgggatctccacccccttgggagtggagatccggggagcagat

SEQ ID NO: 91662 - DNA, 75 bp, Artificial Sequence
  Synthetic
ggcgccccgggatctccacccccttgggagtggagatccggggagcagatgcagctcacaggtgtatcaggtttt

SEQ ID NO: 91663 - DNA, 75 bp, Artificial Sequence
  Synthetic
tgagaatttactttggtccttgaatgattgctcattgtgagggcgcctgtaacagtggaggtatttgccactgtt

SEQ ID NO: 91664 - DNA, 75 bp, Artificial Sequence
  Synthetic
ggatcctaggcgtattgttagccaattctggtgtgctatctccttgacccactccacctcatcaaacaaagcgac

SEQ ID NO: 91665 - DNA, 75 bp, Artificial Sequence
  Synthetic
ggatcctaggcgtattgttagccaattctggtgtgctatctccttgtcccactccacctcatcaaacaaagcgac

SEQ ID NO: 91666 - DNA, 75 bp, Artificial Sequence
  Synthetic
ggatcctaggcgtattgttagccaattctggtgtgctatctccttgccccactccacctcatcaaacaaagcgac

SEQ ID NO: 91667 - DNA, 75 bp, Artificial Sequence
  Synthetic
ggatcctaggcgtattgttagccaattctggtgtgctatctccttggcccactccacctcatcaaacaaagcgac

SEQ ID NO: 91668 - DNA, 75 bp, Artificial Sequence
  Synthetic
caaagaaatccacaccgacaatcacacaccccagcaacctcagcccaacatcccagcatggggcaaaactccacc

SEQ ID NO: 91669 - DNA, 75 bp, Artificial Sequence
  Synthetic
agatcagccaagtccaccaccgggactcaacccaaacaaaactcctctactctaatagctgatgcaatcggccca

SEQ ID NO: 91670 - DNA, 75 bp, Artificial Sequence
  Synthetic
gagttttgcaaaagctgctggtttgagaggagagggttagtcaagtgccatgatcattatctgtgcatgtcttgc

SEQ ID NO: 91671 - DNA, 75 bp, Artificial Sequence
  Synthetic
ctaacgctactcctaagtgtctcagacagatgtccagtgtgcaaattccctctaccaagaaggctcaagctggaa

SEQ ID NO: 91672 - DNA, 75 bp, Artificial Sequence
  Synthetic
aagccaccctccgcaccacccgccccagaaaatcctccgccatacagaccctaaacaaaacccaccagtacaacc

SEQ ID NO: 91673 - DNA, 75 bp, Artificial Sequence
  Synthetic
aaccctcaccactctcccacccctccccccgggggggacccccgccgggggcccccccggggggcaacgacagga

SEQ ID NO: 91674 - DNA, 75 bp, Artificial Sequence
  Synthetic
cacagcactgactccacacctagtcaatctcctcaatctctctagctgagctgaataactctctacacagcttac

SEQ ID NO: 91675 - DNA, 75 bp, Artificial Sequence
  Synthetic
ccttcaatctaagatttccctcagaagaatgtatcatcacagtactttttgacttactataacacaaactatacc

SEQ ID NO: 91676 - DNA, 75 bp, Artificial Sequence
  Synthetic
ccttgaaatcaatccagaaatcaaggtcaacaaacaccgacttcaggaaggattgagaatcagacggcaagcaca

SEQ ID NO: 91677 - DNA, 75 bp, Artificial Sequence
  Synthetic
atgtcactacctttatgatatccagacaatgccactgaagtccttgagaattccttgacaacaacatctcatgta

SEQ ID NO: 91678 - DNA, 75 bp, Artificial Sequence
  Synthetic
acattctttgtaataaatctctattatcatcatagagttcccttatcagcacctccaaatcctgatcatgaatac

SEQ ID NO: 91679 - DNA, 75 bp, Artificial Sequence
  Synthetic
taggattgaatggcagcaatttcctctgaccctcacaaatataacccttttcaatggtaagtggaaccacattag

SEQ ID NO: 91680 - DNA, 75 bp, Artificial Sequence
  Synthetic
tttcagggcccactctttcaaaattgaggttttcaaccctcaagacatctcgattgatcaccacttcaatcggaa

SEQ ID NO: 91681 - DNA, 75 bp, Artificial Sequence
  Synthetic
tcacttccccaaccattgaactgtctctcaagtaatcacagacattagatgacgtgacatgccatacagaattgc

SEQ ID NO: 91682 - DNA, 75 bp, Artificial Sequence
  Synthetic
tttttgagaagtgtgcatttgacataacaagattccaacaatctacaattgcagctctgttcacagaaccgccaa

SEQ ID NO: 91683 - DNA, 75 bp, Artificial Sequence
  Synthetic
acatgacttctgcatcattgagatggtatttatggtcagcatcaaagactcctttgaatctacaatacagcgaga

SEQ ID NO: 91684 - DNA, 75 bp, Artificial Sequence
  Synthetic
acctttctctcagggactcaccttggctttttatttgaaaattgattgtcattgaaagctggactgtttctacat

SEQ ID NO: 91685 - DNA, 75 bp, Artificial Sequence
  Synthetic
ctactaattctgacaggaactcattgatactcgtgaaaacatttgtctcacaataacccatgcggatgaactggt

SEQ ID NO: 91686 - DNA, 75 bp, Artificial Sequence
  Synthetic
tagtgtcaaagtaaatttcttgtatatcaaaatctaaccaagagtatccactaaaaaggtcatgtctgtacatcg

SEQ ID NO: 91687 - DNA, 75 bp, Artificial Sequence
  Synthetic
gcctttccgttcctttataaatcaccttctctacgaaagtaccaaaaggaccaagtgagctcaaaccctctgatc

SEQ ID NO: 91688 - DNA, 75 bp, Artificial Sequence
  Synthetic
caggcaaagagctcttatgagggaaccaggtgaaagatcccaatgttcttgacgttgcaacaaagggcctgacaa

SEQ ID NO: 91689 - DNA, 75 bp, Artificial Sequence
  Synthetic
aagattcaaagtaaatctgcctcaggaagttttgtgcagcatcttctgtagaaaccactctctcatcggccatag

SEQ ID NO: 91690 - DNA, 75 bp, Artificial Sequence
  Synthetic
attcatgtgatctagagtgtgcaacagatagatctgctgagagaacaacatagtgttcttccctcttccacttca

SEQ ID NO: 91691 - DNA, 75 bp, Artificial Sequence
  Synthetic
ctatgtgtgagactaatgacatcgcttcacagttaacgtctagcatgacacaaaagtctaaaaactttattcttg

SEQ ID NO: 91692 - DNA, 75 bp, Artificial Sequence
  Synthetic
ctatgtgtgagactaatgacatcgcttcacagttaacgtctagcatgacacataagtctaaaaactttattcttg

SEQ ID NO: 91693 - DNA, 75 bp, Artificial Sequence
  Synthetic
ctatgtgtgagactaatgacatcgcttcacagttaacgtctagcatgacacacaagtctaaaaactttattcttg

SEQ ID NO: 91694 - DNA, 75 bp, Artificial Sequence
  Synthetic
ctatgtgtgagactaatgacatcgcttcacagttaacgtctagcatgacacagaagtctaaaaactttattcttg

SEQ ID NO: 91695 - DNA, 75 bp, Artificial Sequence
  Synthetic
gtgaccacttcatcttcactgatgccaaatcactcataaagggtaggaggtgcttctcgaaaatttcaggataaa

SEQ ID NO: 91696 - DNA, 75 bp, Artificial Sequence
  Synthetic
gccttctgaaagaatgtattatatggttaaaacccactttatcctccaacaatttagtgatagaaggttttattg

SEQ ID NO: 91697 - DNA, 75 bp, Artificial Sequence
  Synthetic
ggaaatagtcgcaaggtctgaagttcactggtgacaagacagattttatgacgggttctcccagcacccaggatc

SEQ ID NO: 91698 - DNA, 75 bp, Artificial Sequence
  Synthetic
ctatctctaaagcagttgacagtgctatgcacaggtaatcccaaaggactggcctaaaataacccatcaaagagc

SEQ ID NO: 91699 - DNA, 75 bp, Artificial Sequence
  Synthetic
acccattacagtgttgtgttcgaaatgggggtgaaatattccacacctccattccgttcctcactgtcctctcta

SEQ ID NO: 91700 - DNA, 75 bp, Artificial Sequence
  Synthetic
tgttagaaagttctaaagcacctgcagtcactgattttatatacaaattctctctctctgggcctctcacacatt

SEQ ID NO: 91701 - DNA, 75 bp, Artificial Sequence
  Synthetic
tactccccaaggttttacacagccctacaaagcctgaagcaatgctactttggaaagcactcttatttattgctt

SEQ ID NO: 91702 - DNA, 75 bp, Artificial Sequence
  Synthetic
cagaaaggagcttttgtgcccctctagtgaaactagatgacaatttgttttgaagtgtttttacaattgttggta

SEQ ID NO: 91703 - DNA, 75 bp, Artificial Sequence
  Synthetic
gtttctcttcttcaacattgacagcccctgtatacacaaccttctgcctaagcaccattctcaatgggaagtaag

SEQ ID NO: 91704 - DNA, 75 bp, Artificial Sequence
  Synthetic
aggcaaggtttagccaagataagcccaattcctcatccttcaagggctcagaatcaaaaaatgtggtaagcttct

SEQ ID NO: 91705 - DNA, 75 bp, Artificial Sequence
  Synthetic
gaagtgactcatatgggtcgcctgataaatatgcagtagtaaactcttcatggagttcccctgtcttcaatttgt

SEQ ID NO: 91706 - DNA, 75 bp, Artificial Sequence
  Synthetic
tatatagtcttcgaagaagggatctaatcttttttgtgccagaagggtcaatcatttctatattcctcattattc

SEQ ID NO: 91707 - DNA, 75 bp, Artificial Sequence
  Synthetic
tgtaccctctgtttccatccacccagtccttaacatcagagttgcaattcattaaaaatggatcaattggatact

SEQ ID NO: 91708 - DNA, 75 bp, Artificial Sequence
  Synthetic
gtgcatatcttagaaggtttaatgtccttacttgtattttgttgcagagagagattggcacaccattggcaactg

SEQ ID NO: 91709 - DNA, 75 bp, Artificial Sequence
  Synthetic
cctggtcaataatagtgtcaatagtctcagctagctgatgaggctctttacactttatgttatggagtgatgcag

SEQ ID NO: 91710 - DNA, 75 bp, Artificial Sequence
  Synthetic
cgacaaactttgtcagcagtggtacctcatcaccccaaacgtaaaatctcgatttgaactctgccacaaacctgc

SEQ ID NO: 91711 - DNA, 75 bp, Artificial Sequence
  Synthetic
caatgacactcttagggctaatgaatttgtttaattgatcactaaggtaattgtggaattctaaaatatactcaa

SEQ ID NO: 91712 - DNA, 75 bp, Artificial Sequence
  Synthetic
attccgttgggtctttttcagacaattcagacagcatcttgtcaaataggcttatctgatcatcactagaggtgt

SEQ ID NO: 91713 - DNA, 75 bp, Artificial Sequence
  Synthetic
aagcatcaatgcggccatcgtataaacaacttaaacaataattaatgaatctttcagtgataagtccatagaagt

SEQ ID NO: 91714 - DNA, 75 bp, Artificial Sequence
  Synthetic
cagaagcattgtgcagtataccttgacccatgtcaaggattgaacttatgtgtgatgggacttgccctagctgga

SEQ ID NO: 91715 - DNA, 75 bp, Artificial Sequence
  Synthetic
agtgctcaaagaaaaacctttctgtatcagtcattgtcagttgctttttcaacccaagtttcattttcaagaatg

SEQ ID NO: 91716 - DNA, 75 bp, Artificial Sequence
  Synthetic
acttcatcatggctgtcacaacattaaatgggacttcaacaattttatggatatgccatgacaacattgttgaca

SEQ ID NO: 91717 - DNA, 75 bp, Artificial Sequence
  Synthetic
cataatctttactcttcatatctgatagggtatctatggatgcccaattgatgttctgcaacattgctaaaaaca

SEQ ID NO: 91718 - DNA, 75 bp, Artificial Sequence
  Synthetic
aaaatggagacatcatgggcccccatttactatggtcaagactgtatgacatgagtcctaatgacacattgattt

SEQ ID NO: 91719 - DNA, 75 bp, Artificial Sequence
  Synthetic
tcatagacaaaattgcattttcaaactcatgttcatcattcaaacagctccctttgaactgggatgtcaatgctt

SEQ ID NO: 91720 - DNA, 75 bp, Artificial Sequence
  Synthetic
caaagtaatcctcaataagtctagtaaacatctttgtccttaaatcccctatatacagctctctgttgccaccaa

SEQ ID NO: 91721 - DNA, 75 bp, Artificial Sequence
  Synthetic
cttgttccttatatgataaggaaaatttgagtctacctgtatcaggtcctctagaggtgtaggactgaggggatt

SEQ ID NO: 91722 - DNA, 75 bp, Artificial Sequence
  Synthetic
cttggctataaaaacataagtttttcaatgccgcagttgcacagtctgtaaagttgagtgctttactaagcgctt

SEQ ID NO: 91723 - DNA, 75 bp, Artificial Sequence
  Synthetic
cagagttgctctccctttcactaattcttgtttcatcaaatagtcggtctctatccaacttaaaatttagacact

SEQ ID NO: 91724 - DNA, 75 bp, Artificial Sequence
  Synthetic
tgcttctataatggttgaatttacctgacaatttgttagcattcatctgtagtaatattgatttaaaacattgaa

SEQ ID NO: 91725 - DNA, 75 bp, Artificial Sequence
  Synthetic
agtattctccgtcatcataagtccttttgcagatagcctgagctattttagttattgggcatgactgcagtgaat

SEQ ID NO: 91726 - DNA, 75 bp, Artificial Sequence
  Synthetic
ccaaataaaaatattttaccctaagatcatggttgttgtaaatcttctcacagatatcttgataaacattaagag

SEQ ID NO: 91727 - DNA, 75 bp, Artificial Sequence
  Synthetic
gcaatgtcgacatgtcaaaatcctccaccatgtgagtggacagttcactctgaatcagtctgaaatggattttat

SEQ ID NO: 91728 - DNA, 75 bp, Artificial Sequence
  Synthetic
ccgaaatgacatctttcaaatcacccaaatcacaactagtctctctactctccttttcatttgagacagaccagt

SEQ ID NO: 91729 - DNA, 75 bp, Artificial Sequence
  Synthetic
taaatttattcatgactgaatcaatggactgctttattctttcaaagtactctgaagctccaccttctagtaaga

SEQ ID NO: 91730 - DNA, 75 bp, Artificial Sequence
  Synthetic
tctcatcaatcccatcgctagcctcaagggtagtgtctccctcccttttcttgtttctgcctatgacaaggtcac

SEQ ID NO: 91731 - DNA, 75 bp, Artificial Sequence
  Synthetic
ttacaacttgttgaattctgtagtcatattcttccctttgtaaaacatatttccctttcctcataaaaacttctg

SEQ ID NO: 91732 - DNA, 75 bp, Artificial Sequence
  Synthetic
acaattgacacacagccgttgcaactaacttatcataatcatactctatgactctttcaccatctttatatttgt

SEQ ID NO: 91733 - DNA, 75 bp, Artificial Sequence
  Synthetic
tcacaaccacactcttattgcttgccagatctaaggctgttgcacacccactagttattaaagggtctttaatcc

SEQ ID NO: 91734 - DNA, 75 bp, Artificial Sequence
  Synthetic
catcttttagttcactttgcctgaagagagatccattattgaatgaagaaaccatcaaagaaaataatttcttag

SEQ ID NO: 91735 - DNA, 75 bp, Artificial Sequence
  Synthetic
agacaccaggtattttcatgaccacatcacccccaccaaaacaacttggtttgttcataaatgacgttgctgatg

SEQ ID NO: 91736 - DNA, 75 bp, Artificial Sequence
  Synthetic
aaatcagagatgagagctctgctttattagcagtttcttcaggattgacattcacacttccaaagtgcaacttag

SEQ ID NO: 91737 - DNA, 75 bp, Artificial Sequence
  Synthetic
gttcaatgaatttttcaaaacattttatttgatcggttaatctgtctggtgtctcttttgtgataaaatgacaca

SEQ ID NO: 91738 - DNA, 75 bp, Artificial Sequence
  Synthetic
aatatgacatgtttaaaacaaacttgaatctattggtcatcatggatttgacctcattatttaaaacaatattaa

SEQ ID NO: 91739 - DNA, 75 bp, Artificial Sequence
  Synthetic
gcaccctccttatgatcctatataagagaaattcacattcagttatcaaatcctctctcaacttcttcatgaggt

SEQ ID NO: 91740 - DNA, 75 bp, Artificial Sequence
  Synthetic
ctttatgatagtattcagaaacgaaagccatgatgaagtacctcaaattttgcaataacttttgagccctcttag

SEQ ID NO: 91741 - DNA, 75 bp, Artificial Sequence
  Synthetic
tagggtttgttaaaatcaagatgatcatcatcttcgtcaataatttcagttcctttaatgaatcttttatctctg

SEQ ID NO: 91742 - DNA, 75 bp, Artificial Sequence
  Synthetic
aacattctgacaaccaactaatcatacaatccactacatcctgtaacacatcttgagaaaagattgcaggaaaat

SEQ ID NO: 91743 - DNA, 75 bp, Artificial Sequence
  Synthetic
atcttttcggatcagcataaaatgaacagatttctcccttaactgagtcgtttattgcataacatttagaacatt

SEQ ID NO: 91744 - DNA, 75 bp, Artificial Sequence
  Synthetic
caccagttttctgatagattaatttcaatttgtgacccccaatacaaaagtcctgaaaatatgcctctctgcatc

SEQ ID NO: 91745 - DNA, 75 bp, Artificial Sequence
  Synthetic
taacaatcttgaatcttgatttcccatgctcgttctgcctaatctttgcagttgaagatgttttcatggaattga

SEQ ID NO: 91746 - DNA, 75 bp, Artificial Sequence
  Synthetic
caagtgcaagagatacacttgatagtctcttccagtcgtcattgtcatcacaattgacctctttaatgtcatacg

SEQ ID NO: 91747 - DNA, 75 bp, Artificial Sequence
  Synthetic
ggtatctgtccagttcattcttttcataattcatggtaggttcaacaccatcaacttctaattgcagcattttat

SEQ ID NO: 91748 - DNA, 75 bp, Artificial Sequence
  Synthetic
ggaacaactcttctgaaaggtctaactccttcacagagtaattcgaaaaattcaaccctacatgacttagtgctt

SEQ ID NO: 91749 - DNA, 75 bp, Artificial Sequence
  Synthetic
cagatgcctttttcacaacacaattgatgaccttaagaaacatgccatacaggttcatgttatcctgattcctat

SEQ ID NO: 91750 - DNA, 75 bp, Artificial Sequence
  Synthetic
gatgtgctgaattgcagactcttctgtacaaccacgctttcaattccttttgagtggaatatagtgatactaacc

SEQ ID NO: 91751 - DNA, 75 bp, Artificial Sequence
  Synthetic
tatcattgacactcaaaaaggatgaacccagccattcagtttcacacaacttacctttggacctcaagtccatga

SEQ ID NO: 91752 - DNA, 75 bp, Artificial Sequence
  Synthetic
catttacaagtaatatgatgctatcaaatgttagcattaattttcttctggtgtttaataattttagactcttaa

SEQ ID NO: 91753 - DNA, 75 bp, Artificial Sequence
  Synthetic
ctttattcagcaaagctctccagttcggaacatagctatctttcatggatgatgtgttcacctcgggcagttcac

SEQ ID NO: 91754 - DNA, 75 bp, Artificial Sequence
  Synthetic
tgtaaatgaaggatataattgggtttgcatgtttataagcctccatgatttcttgagtttcaccttgtccctctc

SEQ ID NO: 91755 - DNA, 75 bp, Artificial Sequence
  Synthetic
ttaattcaagaccatacatgttgttaaatgcactcaataattcctcttgatcaactttcctaaactgccgctcaa

SEQ ID NO: 91756 - DNA, 75 bp, Artificial Sequence
  Synthetic
ggacaccatctcgtaacttatttctaaaagcttggaattcttgtattacttcccgtttcacatccactggactca

SEQ ID NO: 91757 - DNA, 75 bp, Artificial Sequence
  Synthetic
tgctgttgttgatgcctgtatggcacagtctgagaagctcatcataatgcccagctctatgatcctgcaaagtgt

SEQ ID NO: 91758 - DNA, 75 bp, Artificial Sequence
  Synthetic
tgatgttttctatacctgacctcttgtttcctgaaatactcaaggattcacacaatcttgcatactctgcttctt

SEQ ID NO: 91759 - DNA, 75 bp, Artificial Sequence
  Synthetic
caaacaatttcattgattcttgtgaataggacaaaaggctgaataataaaaacctcaacctgtcgtttacccact

SEQ ID NO: 91760 - DNA, 75 bp, Artificial Sequence
  Synthetic
ctggtaagtgctcagtgtagaagctagtcctcccatcaataagtggcagcattgtcaccccaattctgcttaggt

SEQ ID NO: 91761 - DNA, 75 bp, Artificial Sequence
  Synthetic
cattcttaagagagtccagtttaattgagtcctccctgtacttttgttcaaaattggctggtgaacttctaacaa

SEQ ID NO: 91762 - DNA, 75 bp, Artificial Sequence
  Synthetic
agcattccaaaataatcaacacatttccagtcattttgaacccgtcagggacaaccaagggtagacctgggcaaa

SEQ ID NO: 91763 - DNA, 75 bp, Artificial Sequence
  Synthetic
gaatacgattttgacacaaaaagttctctacagacaactcatctgtattgtgatcacagccatttgcttgacaac

SEQ ID NO: 91764 - DNA, 75 bp, Artificial Sequence
  Synthetic
tatctaactcaatacataatgataacagtttcaatccttctatcagtaacaatcttggttcagattgaactaaaa

SEQ ID NO: 91765 - DNA, 75 bp, Artificial Sequence
  Synthetic
aagcaagcttttgttttgatagtctttcatcatctgagaggtacttgctcacaagctctttggcctctgagattt

SEQ ID NO: 91766 - DNA, 75 bp, Artificial Sequence
  Synthetic
ctctgagatttgttcctccattttccaataactaagtctaaagaagaaaaacactatagtatagaataagtcaat

SEQ ID NO: 91767 - DNA, 75 bp, Artificial Sequence
  Synthetic
cagtggatcctaggcatttttggttgcgctaatagaaagtcttgcatagtgagacttacaactatggggcaaatt

SEQ ID NO: 91768 - DNA, 75 bp, Artificial Sequence
  Synthetic
ataacattctttcaggaagtgccacacatcattgaagaggtgatgaacattgtgatgatcaccttgtccatactg

SEQ ID NO: 91769 - DNA, 75 bp, Artificial Sequence
  Synthetic
ataacattctttcaggaagtgccacacatcattgaagaggtgatgaacattgtgttgatcaccttgtccatactg

SEQ ID NO: 91770 - DNA, 75 bp, Artificial Sequence
  Synthetic
ataacattctttcaggaagtgccacacatcattgaagaggtgatgaacattgtgctgatcaccttgtccatactg

SEQ ID NO: 91771 - DNA, 75 bp, Artificial Sequence
  Synthetic
ataacattctttcaggaagtgccacacatcattgaagaggtgatgaacattgtggtgatcaccttgtccatactg

SEQ ID NO: 91772 - DNA, 75 bp, Artificial Sequence
  Synthetic
gctctcctgaagggcatctacaatgttgccagctgcggaataatagggcttctcaccttcttgttcctctgtggg

SEQ ID NO: 91773 - DNA, 75 bp, Artificial Sequence
  Synthetic
agatcctgctctctcatgttcaaaggcaattatgaactgaaacatttagaactggatatgagtatgttgaactcg

SEQ ID NO: 91774 - DNA, 75 bp, Artificial Sequence
  Synthetic
acaatgcccctctcttgttcaaaaaacaactctcaccattacattcaggtgtccaatgtgactgggttagagtta

SEQ ID NO: 91775 - DNA, 75 bp, Artificial Sequence
  Synthetic
acaatgcccctctcttgttcaaaaaactactctcaccattacattcaggtgtccaatgtgactgggttagagtta

SEQ ID NO: 91776 - DNA, 75 bp, Artificial Sequence
  Synthetic
acaatgcccctctcttgttcaaaaaaccactctcaccattacattcaggtgtccaatgtgactgggttagagtta

SEQ ID NO: 91777 - DNA, 75 bp, Artificial Sequence
  Synthetic
acaatgcccctctcttgttcaaaaaacgactctcaccattacattcaggtgtccaatgtgactgggttagagtta

SEQ ID NO: 91778 - DNA, 75 bp, Artificial Sequence
  Synthetic
acaatgcccctctcttgttctaaaaacaactctcaccattacattcaggtgtccaatgtgactgggttagagtta

SEQ ID NO: 91779 - DNA, 75 bp, Artificial Sequence
  Synthetic
acaatgcccctctcttgttctaaaaactactctcaccattacattcaggtgtccaatgtgactgggttagagtta

SEQ ID NO: 91780 - DNA, 75 bp, Artificial Sequence
  Synthetic
acaatgcccctctcttgttctaaaaaccactctcaccattacattcaggtgtccaatgtgactgggttagagtta

SEQ ID NO: 91781 - DNA, 75 bp, Artificial Sequence
  Synthetic
acaatgcccctctcttgttctaaaaacgactctcaccattacattcaggtgtccaatgtgactgggttagagtta

SEQ ID NO: 91782 - DNA, 75 bp, Artificial Sequence
  Synthetic
acaatgcccctctcttgttccaaaaacaactctcaccattacattcaggtgtccaatgtgactgggttagagtta

SEQ ID NO: 91783 - DNA, 75 bp, Artificial Sequence
  Synthetic
acaatgcccctctcttgttccaaaaactactctcaccattacattcaggtgtccaatgtgactgggttagagtta

SEQ ID NO: 91784 - DNA, 75 bp, Artificial Sequence
  Synthetic
acaatgcccctctcttgttccaaaaaccactctcaccattacattcaggtgtccaatgtgactgggttagagtta

SEQ ID NO: 91785 - DNA, 75 bp, Artificial Sequence
  Synthetic
acaatgcccctctcttgttccaaaaacgactctcaccattacattcaggtgtccaatgtgactgggttagagtta

SEQ ID NO: 91786 - DNA, 75 bp, Artificial Sequence
  Synthetic
acaatgcccctctcttgttcgaaaaacaactctcaccattacattcaggtgtccaatgtgactgggttagagtta

SEQ ID NO: 91787 - DNA, 75 bp, Artificial Sequence
  Synthetic
acaatgcccctctcttgttcgaaaaactactctcaccattacattcaggtgtccaatgtgactgggttagagtta

SEQ ID NO: 91788 - DNA, 75 bp, Artificial Sequence
  Synthetic
acaatgcccctctcttgttcgaaaaaccactctcaccattacattcaggtgtccaatgtgactgggttagagtta

SEQ ID NO: 91789 - DNA, 75 bp, Artificial Sequence
  Synthetic
acaatgcccctctcttgttcgaaaaacgactctcaccattacattcaggtgtccaatgtgactgggttagagtta

SEQ ID NO: 91790 - DNA, 75 bp, Artificial Sequence
  Synthetic
actcttacaaacaccagcataattggtcataagttttgtaacttgtcagatgcacacaagaagaacttatatgac

SEQ ID NO: 91791 - DNA, 75 bp, Artificial Sequence
  Synthetic
cactccatgatggcaataatctcaacattccatttgagtattcctaacttcaaccaatacgaagcaatgagttgt

SEQ ID NO: 91792 - DNA, 75 bp, Artificial Sequence
  Synthetic
gacttcaatggcgggaaaataagtgtgcagtacaacctcagtcatggaacagacaatgctgcaagggaccattgt

SEQ ID NO: 91793 - DNA, 75 bp, Artificial Sequence
  Synthetic
ggctcagttgcaaatggtatacttgacacctttcaaaggatgcactggtgttcagcatgtgaatacaacgtgtac

SEQ ID NO: 91794 - DNA, 75 bp, Artificial Sequence
  Synthetic
atgcccggagccaggtgtataacaaccccgtatcaatacctccttattcaaaacacaacctgggaggaccattgt

SEQ ID NO: 91795 - DNA, 75 bp, Artificial Sequence
  Synthetic
cagatgtcaaggccatcgccaattggttacctctctctcttggctcaaagaacaaggcaaatatatatttcaaga

SEQ ID NO: 91796 - DNA, 75 bp, Artificial Sequence
  Synthetic
agattacttggaaccttcacttggaccctatctgactcaacaggtaatgacctcccaggggggtattgtctccaa

SEQ ID NO: 91797 - DNA, 75 bp, Artificial Sequence
  Synthetic
cgatggatgctaattgaagctgaattaaaatgctttgggaatactgctgtagcaaaatgcaatcaacagcatgat

SEQ ID NO: 91798 - DNA, 75 bp, Artificial Sequence
  Synthetic
gaggaattctgtgatatgttaaggctttttgattttaacaatgaagcaatcaaaagattgaaagcagatgctgaa

SEQ ID NO: 91799 - DNA, 75 bp, Artificial Sequence
  Synthetic
gtggaattctgtgatatgttaaggctttttgattttaacaatgaagcaatcaaaagattgaaagcagatgctgaa

SEQ ID NO: 91800 - DNA, 75 bp, Artificial Sequence
  Synthetic
gcggaattctgtgatatgttaaggctttttgattttaacaatgaagcaatcaaaagattgaaagcagatgctgaa

SEQ ID NO: 91801 - DNA, 75 bp, Artificial Sequence
  Synthetic
ggggaattctgtgatatgttaaggctttttgattttaacaatgaagcaatcaaaagattgaaagcagatgctgaa

SEQ ID NO: 91802 - DNA, 75 bp, Artificial Sequence
  Synthetic
aagagcatcaatctgataaccaaggctgttaattctttaatcaatgaccagctcaaaatgaaaaatcatcttaga

SEQ ID NO: 91803 - DNA, 75 bp, Artificial Sequence
  Synthetic
aagagcatcaatctgataaccaaggctgttaattctttaatcaatgaccagctcataatgaaaaatcatcttaga

SEQ ID NO: 91804 - DNA, 75 bp, Artificial Sequence
  Synthetic
aagagcatcaatctgataaccaaggctgttaattctttaatcaatgaccagctcacaatgaaaaatcatcttaga

SEQ ID NO: 91805 - DNA, 75 bp, Artificial Sequence
  Synthetic
aagagcatcaatctgataaccaaggctgttaattctttaatcaatgaccagctcagaatgaaaaatcatcttaga

SEQ ID NO: 91806 - DNA, 75 bp, Artificial Sequence
  Synthetic
gacatcatggggattccttactgtaattattccaagttttggtatctgaatgacacaagaactggcaaaacatcg

SEQ ID NO: 91807 - DNA, 75 bp, Artificial Sequence
  Synthetic
ctgccgaaatgttggatggtcacaaatggcagctacctgaatgagtcacacttctcatcagagattgaacaagaa

SEQ ID NO: 91808 - DNA, 75 bp, Artificial Sequence
  Synthetic
gctgacaacatgatcacagaaatgttgaggaaggaatatgaaaaaagacaaggcacaacaccacttgggctagtg

SEQ ID NO: 91809 - DNA, 75 bp, Artificial Sequence
  Synthetic
gatatatttgtcttttcaacatccttttatctgataagtgtgttcttacatctgattaagatacccactcataga

SEQ ID NO: 91810 - DNA, 75 bp, Artificial Sequence
  Synthetic
cacatagtcggaaaaccatgcccaaaaccccacagactgaaccacatgggtgtatgcagttgcgggttatacaag

SEQ ID NO: 91811 - DNA, 75 bp, Artificial Sequence
  Synthetic
cagcccggagttcctaccaagtggaagagatagacccacgaggcccccgtgacccaccacctcatgtgaggtggt

SEQ ID NO: 91812 - DNA, 75 bp, Artificial Sequence
  Synthetic
gggtcacgggggcattccgtctacagaatgactcttggtgcagatgttctaaacacaagatctctacttaggaca

SEQ ID NO: 91813 - DNA, 75 bp, Artificial Sequence
  Synthetic
ggtcttggggtgttgatgtccacgctgttcttaatggcagattcgaacattaggcagtctagcagtgcacagtgt

SEQ ID NO: 91814 - DNA, 75 bp, Artificial Sequence
  Synthetic
ggagtaatctcttccttgccccctcgtttcttcttctcaaccactatgccagtgtgcattgaacaaagacctttg

SEQ ID NO: 91815 - DNA, 75 bp, Artificial Sequence
  Synthetic
tattcatcccaaatctggtgctcaaattttctagagtcagccttctgcattgaaacatcaattagtttgatgtct

SEQ ID NO: 91816 - DNA, 75 bp, Artificial Sequence
  Synthetic
cttcttccttgtgaatccaaaagcttcttgatgtcatcggctccctgacacgtgaggaccatgtttctagggagg

SEQ ID NO: 91817 - DNA, 75 bp, Artificial Sequence
  Synthetic
ttttccaaaacagcactagtcagtcctggttgagtggaaaaaagatcctgaatgtctatcccatgtgagtatttt

SEQ ID NO: 91818 - DNA, 75 bp, Artificial Sequence
  Synthetic
gcatcttgcctaaactgtttgatgtcggttggctctctgtaaaagtgaacgtaactaccactcaatggctgataa

SEQ ID NO: 91819 - DNA, 75 bp, Artificial Sequence
  Synthetic
atggctatttccactgggtcttctggccttccctcaatatcaatccaagtctttgcatttgggtcaagttgcatc

SEQ ID NO: 91820 - DNA, 75 bp, Artificial Sequence
  Synthetic
attgaatccttcagctccatcatctgagagtaggtcagccctgcactcaagcccaatgccccggcagccttgttg

SEQ ID NO: 91821 - DNA, 75 bp, Artificial Sequence
  Synthetic
gaggggggaggagggagggtcttgctgtctgcgattggagcattaccactcagatcaacttgagtgttgtcccag

SEQ ID NO: 91822 - DNA, 75 bp, Artificial Sequence
  Synthetic
gccctgcccatgatcgaggtcctggatgcaatgtatggccaaccctcacctgagagacaaaccttatataggata

SEQ ID NO: 91823 - DNA, 75 bp, Artificial Sequence
  Synthetic
ttctcgtaggggtttctgtcacccggggtgtctgaaataaacatcccaatggatctctttactttcaggatggat

SEQ ID NO: 91824 - DNA, 75 bp, Artificial Sequence
  Synthetic
ttgaggatgttatccatgttttttggagttaccctgatggtttctaacatgttcccaccatccaaaaggcttgca

SEQ ID NO: 91825 - DNA, 75 bp, Artificial Sequence
  Synthetic
cctgctttcactgcagcatttagactgaagttgtatcctgaaatgttgatggcactcttcttgccatcaatgaga

SEQ ID NO: 91826 - DNA, 75 bp, Artificial Sequence
  Synthetic
cccaagacaggatgagtttgagtcagtttgtccaggtcagagaggttggggtactttgctgtgtagaccaaccct

SEQ ID NO: 91827 - DNA, 75 bp, Artificial Sequence
  Synthetic
aagtccgtcaatgctttgaccacatcattaagatcttcctggccttgtttgcatagacaggcaagtgttaggctt

SEQ ID NO: 91828 - DNA, 75 bp, Artificial Sequence
  Synthetic
ggtattgttccaaactgattgttgagaagatcggggttctttacatcccaaactctaacaatcccatctccgttc

SEQ ID NO: 91829 - DNA, 75 bp, Artificial Sequence
  Synthetic
ccaatggaggttctgccaccattcattccgaccaattgtaacagggccttcctttggtctaactgttgttgtgtc

SEQ ID NO: 91830 - DNA, 75 bp, Artificial Sequence
  Synthetic
aaatttcccagatagacacccccagtgaggggcctctcagttctcctcactttggctttcagcctgtctaagtct

SEQ ID NO: 91831 - DNA, 75 bp, Artificial Sequence
  Synthetic
gctgcaagaaccagcaagtcatctgaggtcagggaaccaactttaagaatgctcttttgctgcacagatttcaat

SEQ ID NO: 91832 - DNA, 75 bp, Artificial Sequence
  Synthetic
tccacaagattgttgacagcctgattcagatctctgagccttttcaggtctgaatcatctcttttctccttcctc

SEQ ID NO: 91833 - DNA, 75 bp, Artificial Sequence
  Synthetic
atcagcctttgaatgttgttgacttcggagaagtctaggccatgtaggagtgactgagcatcctttatcacctga

SEQ ID NO: 91834 - DNA, 75 bp, Artificial Sequence
  Synthetic
acacgcgtgttggtgcaatacccagacagttctcttctcagggactgtgtccataagaaggacttgacctctttt

SEQ ID NO: 91835 - DNA, 75 bp, Artificial Sequence
  Synthetic
tgtgtccataagaaggacttgacctcttttgaattgctcatggttgtgtttcccaataagcgcagccaatttcgc

SEQ ID NO: 91836 - DNA, 75 bp, Artificial Sequence
  Synthetic
cagatgccaacacagtgacagatgcggtggcagccatccaggtggactgcgattggtctatcatgaccctgtcga

SEQ ID NO: 91837 - DNA, 75 bp, Artificial Sequence
  Synthetic
gcactaccacttggttgaaccgtctgctgacaactctgccccggtcctcatgcatcccggacagctatttccaac

SEQ ID NO: 91838 - DNA, 75 bp, Artificial Sequence
  Synthetic
gctgacaactctgccccggtcctcatgcatcccggacagctatttccaacaggctgactactgcgacaaagtctc

SEQ ID NO: 91839 - DNA, 75 bp, Artificial Sequence
  Synthetic
tacccacctgggcaaacgacgcccacgtacggtccacgtcgcccttcaatgtctctcttgaccaataggcttagc

SEQ ID NO: 91840 - DNA, 75 bp, Artificial Sequence
  Synthetic
acagggaacccaaggtggatgaggtccaggtggggtatgtctgggacctgtgggagtgggtcatgcgccagattc

SEQ ID NO: 91841 - DNA, 75 bp, Artificial Sequence
  Synthetic
ggaaatgcatggggccacccagctccgcggcggcctgcagccggggtagcccaagaatccttcgggtgagggcgg

SEQ ID NO: 91842 - DNA, 75 bp, Artificial Sequence
  Synthetic
gcatggtcatggccaggctccgggccctctgccccgtagtgtcgctaccactgtggcactgtggggaggggtggt

SEQ ID NO: 91843 - DNA, 75 bp, Artificial Sequence
  Synthetic
tcgacttcatggctgggaaactatcgtcagaagatctgtggtacgccatcccagtgctcaccagcccgggggcgg

SEQ ID NO: 91844 - DNA, 75 bp, Artificial Sequence
  Synthetic
tggatgggaactgtgccagtcaacatgctgggctacggggaaacctcgcccctcctagcctccgacaccccaaag

SEQ ID NO: 91845 - DNA, 75 bp, Artificial Sequence
  Synthetic
ggtgctgtactcagctaacaactctggcactaccacttggttgaaccgtctgctaaccacacttccccggtcttc

SEQ ID NO: 91846 - DNA, 75 bp, Artificial Sequence
  Synthetic
gtccgcggcccagttggttggggagcttgggagcctttacgggcccctgtcggtgtcggcttacgtggccggcat

SEQ ID NO: 91847 - DNA, 75 bp, Artificial Sequence
  Synthetic
ccacgtggtgattaggcgcacctcgtgctacaagttgctgcgccaacaaatactttctgctgctgtggctgagcc

SEQ ID NO: 91848 - DNA, 75 bp, Artificial Sequence
  Synthetic
ttgcatcccggatagctatttccaacaggccgactactgtgacaaagtctcagccatgttgcgccgcttgagcct

SEQ ID NO: 91849 - DNA, 75 bp, Artificial Sequence
  Synthetic
tccaggtggggtacgtctgggacctgtgggaatggatcatgcgccaggtgcgcatggtcatagccagagtacggg

SEQ ID NO: 91850 - DNA, 75 bp, Artificial Sequence
  Synthetic
caattactggattctggaatatctctggaaggtgccctctgacttctggcgtggagtgatgagcctaacacccct

SEQ ID NO: 91851 - DNA, 75 bp, Artificial Sequence
  Synthetic
ccctctgccccgtggtgtcactgcctttgtggcactgcggggaggggtggtccggagaatggttgttagacggcc

SEQ ID NO: 91852 - DNA, 75 bp, Artificial Sequence
  Synthetic
tctttctgttggttaccatggcgggaatgtcacaaggcgctcccgcctcggtactggggtcacgcccctttgagc

SEQ ID NO: 91853 - DNA, 75 bp, Artificial Sequence
  Synthetic
actctaccaagctgtgccggcactattggatggggactgttccggtcaacatgctggggtatggggagacatcgc

SEQ ID NO: 91854 - DNA, 75 bp, Artificial Sequence
  Synthetic
ctggattgacatggcagtcgtgttcctgcagggcgaacggatcgtccgcacccacgggggaacgggtttgggatc

SEQ ID NO: 91855 - DNA, 75 bp, Artificial Sequence
  Synthetic
ttggatggggactgttccggtcaacatgctggggtatggggagacatcgcccctcctagcctctgacacgccgaa

SEQ ID NO: 91856 - DNA, 75 bp, Artificial Sequence
  Synthetic
cccacgtggtgatccgacggacttcatgctacaagttgttgcgcccacaaatactctctgcagctgtagctgagc

SEQ ID NO: 91857 - DNA, 75 bp, Artificial Sequence
  Synthetic
gctggggcgaccctatcacttactggagccacggacaaaatcagtggcccctctcatgtccccagtatgtctacg

SEQ ID NO: 91858 - DNA, 75 bp, Artificial Sequence
  Synthetic
acaaagggccgcgattcgagaatcgatgtgtggagtttggtgccagttggctcagccagctgtaccatagccgca

SEQ ID NO: 91859 - DNA, 75 bp, Artificial Sequence
  Synthetic
aaagcgtcaccattgacggggaacgctacacccttccgcaccaactgcggatgaggaacgtggcgccctctgagg

SEQ ID NO: 91860 - DNA, 75 bp, Artificial Sequence
  Synthetic
atgaggaacgtggcgccctctgaggtttcgtctgaggtcagcatcgagattgggacggagactgaagactcagaa

SEQ ID NO: 91861 - DNA, 75 bp, Artificial Sequence
  Synthetic
ttgggtgcttggtgggcaatgaacttacctttgaatgtgataagtgtgaggcacgccaagagacgttggcctcct

SEQ ID NO: 91862 - DNA, 75 bp, Artificial Sequence
  Synthetic
cgtcggcctgcctcctgcggcacctgtgtgcgggactgctggcccgagaccgggtcggtgcggttcccattccat

SEQ ID NO: 91863 - DNA, 75 bp, Artificial Sequence
  Synthetic
cgggtcggtgcggttcccattccatcggtgcggcgcgggaccgcggctgacaagggatttggaagctgtgccctt

SEQ ID NO: 91864 - DNA, 75 bp, Artificial Sequence
  Synthetic
caagggatttggaagctgtgcccttcgtcaacaggacaactcccttcaccataaggggccccctgggagaccagg

SEQ ID NO: 91865 - DNA, 75 bp, Artificial Sequence
  Synthetic
ccaccagtggtgcggccggttggttctctgttggtggcagacacgaccaaagtgtatgtcactaacccagataac

SEQ ID NO: 91866 - DNA, 75 bp, Artificial Sequence
  Synthetic
agtgtatgtcactaacccagataacgtggggaggcgggttgacaaggtcaccttctggcgggctccgagggttca

SEQ ID NO: 91867 - DNA, 75 bp, Artificial Sequence
  Synthetic
ataaggggccccctgggagaccaggggagaggcaacccgctgcggacgcccctggattttggatcctacgccatg

SEQ ID NO: 91868 - DNA, 75 bp, Artificial Sequence
  Synthetic
ccaagagtccgagacagccgaaacggaggaaagcgtcttcaacgtggctctttccgtactagaagccttctttcc

SEQ ID NO: 91869 - DNA, 75 bp, Artificial Sequence
  Synthetic
tgaggaggcaataaggactgttaggccacatgctgccatgggctggggatctaaggtgtcggtcaaggacttggc

SEQ ID NO: 91870 - DNA, 75 bp, Artificial Sequence
  Synthetic
agctaggaagcgaaatccggtttgtccggggttcgcgtggctatcctcgggcaggcctgatgggttcatacatgt

SEQ ID NO: 91871 - DNA, 75 bp, Artificial Sequence
  Synthetic
gactgtgaaaaaggaggtgttcttcaaagaccggaaggaggagaaggccccccgcctcattgtgttcccccccct

SEQ ID NO: 91872 - DNA, 75 bp, Artificial Sequence
  Synthetic
ttcttctcctgctgtggtggtgggtgaaccagctggcggtccttggactgccggcggcgcacgctgccgtggcgg

SEQ ID NO: 91873 - DNA, 75 bp, Artificial Sequence
  Synthetic
tccctattagtggcggacaccaccaaggtgtatgtgaccaacccggacaatgtgggtagaagggttgacaaggtg

SEQ ID NO: 91874 - DNA, 75 bp, Artificial Sequence
  Synthetic
gaaccagctggcggtccttggactgccggcggcgcacgctgccgtggcgggggaggtcttcgcaggcccggcctt

SEQ ID NO: 91875 - DNA, 75 bp, Artificial Sequence
  Synthetic
gtaagtatgatcctggggttggcaaacctggtgttgtacttccgttgggtgggccctcagcgcctgatgttcctt

SEQ ID NO: 91876 - DNA, 75 bp, Artificial Sequence
  Synthetic
acctggtgttgtacttccgttgggtgggccctcagcgcctgatgttccttgtgctgtggaagctcgctcggggag

SEQ ID NO: 91877 - DNA, 75 bp, Artificial Sequence
  Synthetic
cctctggcactatggtcaccccggaaggggtgcccgtgggggagaggtactgtaggtcctcaggagtcttgacca

SEQ ID NO: 91878 - DNA, 75 bp, Artificial Sequence
  Synthetic
cagagagtgggacttaagaacgtctcgcttctcattgcaggtgatgactgtctgatcatatgtgagcggcccatg

SEQ ID NO: 91879 - DNA, 75 bp, Artificial Sequence
  Synthetic
agcgtggtagcctgggccatagcgctcctgagctctatgagcgcgggaggctggaggcacaaagctgtgatctac

SEQ ID NO: 91880 - DNA, 75 bp, Artificial Sequence
  Synthetic
tggactttcggatagctgaaaagctaatcctgggagacccggggcgagtggccaaagccggtgttggggggcgtt

SEQ ID NO: 91881 - DNA, 75 bp, Artificial Sequence
  Synthetic
ccccctcggggaggggcggcccactaagccgttgaccatcgcttggtgcttggcttcctacatctggccagacgc

SEQ ID NO: 91882 - DNA, 75 bp, Artificial Sequence
  Synthetic
aagccgttgaccatcgcttggtgcttggcttcctacatctggccagacgctgtgatgttggtggtggtaggcatt

SEQ ID NO: 91883 - DNA, 75 bp, Artificial Sequence
  Synthetic
tgggagtcaaagaagaccccgtgcgccatctgtgtggacgccacctgcttcgacagtagcataactgaagaggac

SEQ ID NO: 91884 - DNA, 75 bp, Artificial Sequence
  Synthetic
gcatgtcgagtgagtacagtgacccgatggcttcggccattggttacatcctcctttatccctggcatcccatca

SEQ ID NO: 91885 - DNA, 75 bp, Artificial Sequence
  Synthetic
actggtctcccggccttctttacggcgtttggcacgggtggtggaatgttgtgtgatggcgggtgagaaggccac

SEQ ID NO: 91886 - DNA, 75 bp, Artificial Sequence
  Synthetic
cgtttggcacgggtggtggaatgttgtgtgatggcgggtgagaaggccacaaccatcaggctggtgtccaagatg

SEQ ID NO: 91887 - DNA, 75 bp, Artificial Sequence
  Synthetic
ggtgcgggcacttgggaaatactatgcctcaggcaccatggtcacgccggaaggggtgcccgtgggagagaggta

SEQ ID NO: 91888 - DNA, 75 bp, Artificial Sequence
  Synthetic
gcctcaggcaccatggtcacgccggaaggggtgcccgtgggagagaggtactgtagatcctcaggtgtactcacc

SEQ ID NO: 91889 - DNA, 75 bp, Artificial Sequence
  Synthetic
atcatcgtggccctccacggtccagcagcgttgagggttaccgcagacacaaccaaaacaaaaatggaggccggc

SEQ ID NO: 91890 - DNA, 75 bp, Artificial Sequence
  Synthetic
cagcgttgagggttaccgcagacacaaccaaaacaaaaatggaggccggcaaggtgctgagcgacctcaagctcc

SEQ ID NO: 91891 - DNA, 75 bp, Artificial Sequence
  Synthetic
tgagcgggtgggactcaaaaacgtttccctcctaatcgcaggcgatgactgtcagatcatatgtgagcggcctat

SEQ ID NO: 91892 - DNA, 75 bp, Artificial Sequence
  Synthetic
tagagacgctgctcggaccctgtcgtgcggccagtgtgtcatgggcttgcccgtggtagctcgccgtggtgatga

SEQ ID NO: 91893 - DNA, 75 bp, Artificial Sequence
  Synthetic
ggctggggcattgcgaacacgcatgctccggtcgcgcggttgggcggagttggctcggggcctgttgtggcatcc

SEQ ID NO: 91894 - DNA, 75 bp, Artificial Sequence
  Synthetic
ggtgctgattggtgtttttaaggatgtgaaccacttgcctccagggtttgtccctaccgcgccagttttcatccg

SEQ ID NO: 91895 - DNA, 75 bp, Artificial Sequence
  Synthetic
tccctaccgcgccagttttcatccgtaggtgcgggaaaggcttccttggtgtcacaaaggctgccttgactggtc

SEQ ID NO: 91896 - DNA, 75 bp, Artificial Sequence
  Synthetic
acggcctgctgttcacaactttccatggggcttcttcccgaaccattgccacgcccggggagccccttaatccaa

SEQ ID NO: 91897 - DNA, 75 bp, Artificial Sequence
  Synthetic
gccaactcgttgacgccctgcacttgccaggctgagtcttgttgggtcattagatccgatggggctttatgccat

SEQ ID NO: 91898 - DNA, 75 bp, Artificial Sequence
  Synthetic
accgacgcccacggaatagtgggactaaggcccaatcaaagccaggaattccggccgaaagggtgtggatggtgg

SEQ ID NO: 91899 - DNA, 75 bp, Artificial Sequence
  Synthetic
gcagcgttgagggttaccgcagacacaaccaaaacaaaaatggaagctggtaaggttctgagcgacctcaagctc

SEQ ID NO: 91900 - DNA, 75 bp, Artificial Sequence
  Synthetic
ccggccgaaagggtgtggatggtggtgacagggttggcaggtcgtaaatcccggccattctggtagcacctatag

SEQ ID NO: 91901 - DNA, 75 bp, Artificial Sequence
  Synthetic
tagatccgatggggctttatgccatggcttgtgtaagggggacagggtggagctcgacgtggccgtggaggtctc

SEQ ID NO: 91902 - DNA, 75 bp, Artificial Sequence
  Synthetic
tgacagggttggcaggtcgtaaatcccggccattctggtagcacctataggtgggttgaactggcggcgagaagt

SEQ ID NO: 91903 - DNA, 75 bp, Artificial Sequence
  Synthetic
cagtaggaatgctcgtgtcagtgctccattctgggggtcgggtgacagcggcacgattcactcggccgtggaccc

SEQ ID NO: 91904 - DNA, 75 bp, Artificial Sequence
  Synthetic
ttggctgggggcatgttgtggcatccaggactacggctacctccccctgagattgctgctatcccggggggtttc

SEQ ID NO: 91905 - DNA, 75 bp, Artificial Sequence
  Synthetic
cggtgtgaatagagacccgacgccagtcacgtcgttaaacagagtgcctttccccatcgcaacgccggccctcgt

SEQ ID NO: 91906 - DNA, 75 bp, Artificial Sequence
  Synthetic
gtcacgtcgttaaacagagtgcctttccccatcgcaacgccggccctcgtacgggaacgtcgcccttttaatacc

SEQ ID NO: 91907 - DNA, 75 bp, Artificial Sequence
  Synthetic
caggactacggctacctccccctgagattgctgctatcccggggggtttccctctctcccccccgtacatggggg

SEQ ID NO: 91908 - DNA, 75 bp, Artificial Sequence
  Synthetic
tgtttatgcctacgggagccgggaagagcacccgggttccgttggagtacggcaacatgggccataaagtcttaa

SEQ ID NO: 91909 - DNA, 75 bp, Artificial Sequence
  Synthetic
gggtttgctcgacctgctacatcaaggtgaaagtgtctgataagaaagctagtctggacatcggaaaactggaga

SEQ ID NO: 91910 - DNA, 75 bp, Artificial Sequence
  Synthetic
gggcgtacacggtaggaccgtgccgcctgcgttgtcggggtctggtattaatgcatggggccacccagctccgcg

SEQ ID NO: 91911 - DNA, 75 bp, Artificial Sequence
  Synthetic
cctgcgttgtcggggtctggtattaatgcatggggccacccagctccgcggcggactgcagccggggtagaccaa

SEQ ID NO: 91912 - DNA, 75 bp, Artificial Sequence
  Synthetic
aggggttggtggatgctgttgagaagggtacattagccaaggttacgaacgatacgctcaaagattaccccaagc

SEQ ID NO: 91913 - DNA, 75 bp, Artificial Sequence
  Synthetic
cgcctggcaggcaagcatcctagcatttactgtgggcacgatacaacagctttcactagggttactgactctccc

SEQ ID NO: 91914 - DNA, 75 bp, Artificial Sequence
  Synthetic
tttactgtgggcacgatacaacagctttcactagggttactgactctcccctgacgtattcaacctacggtaggt

SEQ ID NO: 91915 - DNA, 75 bp, Artificial Sequence
  Synthetic
gatcgccctgctgtttctaatcatcaatggggccgggggtctgttgaccccggcctcacatgcttgcagggttgg

SEQ ID NO: 91916 - DNA, 75 bp, Artificial Sequence
  Synthetic
aatggggccgggggtctgttgaccccggcctcacatgcttgcagggttgggtcttcttatttcctcacaaactgt

SEQ ID NO: 91917 - DNA, 75 bp, Artificial Sequence
  Synthetic
gatgagtgccacagtcatgactcaacggtgttgctgggcattggtcgggtcagggagttggcccgtggctgtggg

SEQ ID NO: 91918 - DNA, 75 bp, Artificial Sequence
  Synthetic
cggtgttgctgggcattggtcgggtcagggagttggcccgtggctgtggggtccaactggtcctctacgccactg

SEQ ID NO: 91919 - DNA, 75 bp, Artificial Sequence
  Synthetic
ccttggctgtacagtttgtacggatgtttgctggcctatcctacgcccaggtatatccatcaggcctggggtgga

SEQ ID NO: 91920 - DNA, 75 bp, Artificial Sequence
  Synthetic
gtttgctggcctatcctacgcccaggtatatccatcaggcctggggtggactcttcagcgctagtgggccaacta

SEQ ID NO: 91921 - DNA, 75 bp, Artificial Sequence
  Synthetic
aaattggatgtgggagaaatccccttctatggacatggtattcccctggagcggatgcgaaccggtaggcacctc

SEQ ID NO: 91922 - DNA, 75 bp, Artificial Sequence
  Synthetic
ggggttaggggaggtctatagtggagcactggcgttaggcgtgctggtcacccggcacgcctatcccctccccaa

SEQ ID NO: 91923 - DNA, 75 bp, Artificial Sequence
  Synthetic
gcactggcgttaggcgtgctggtcacccggcacgcctatcccctccccaacctgacatgtgctgttgagtgtgag

SEQ ID NO: 91924 - DNA, 75 bp, Artificial Sequence
  Synthetic
ctctaggggggtaaatgccatcgcctattataggggaaaagacagttcaatcattaaagatggggatctcgtggt

SEQ ID NO: 91925 - DNA, 75 bp, Artificial Sequence
  Synthetic
gtactggatactggagtatctttggcgccttccctttgacttttggaagggggtgatggccctagacgtcctgtt

SEQ ID NO: 91926 - DNA, 75 bp, Artificial Sequence
  Synthetic
tgaccgttgctggccactgtatcaggcggggttagccgtgcggcccggcaagtccgccgcccagttggttgggga

SEQ ID NO: 91927 - DNA, 75 bp, Artificial Sequence
  Synthetic
cgccttccctttgacttttggaagggggtgatggccctagacgtcctgttggcctttgtggcggccttactcctc

SEQ ID NO: 91928 - DNA, 75 bp, Artificial Sequence
  Synthetic
agtccgccgcccagttggttggggagctcggaagcttctacgggcccctatcggtgtctgcctacgtggcgggca

SEQ ID NO: 91929 - DNA, 75 bp, Artificial Sequence
  Synthetic
cagtgcctgcgtcggcagaattgtcgatgcaacggcgaggtcgcacgggcagaggtcggtccggccgatactact

SEQ ID NO: 91930 - DNA, 75 bp, Artificial Sequence
  Synthetic
ggctgcctctcgacccactggggacctcggggctcgcccctttgttcctggtccgggttggggttgcacatgcta

SEQ ID NO: 91931 - DNA, 75 bp, Artificial Sequence
  Synthetic
ctcggggctcgcccctttgttcctggtccgggttggggttgcacatgctatgaggatgggtcgcgggtgccaacg

SEQ ID NO: 91932 - DNA, 75 bp, Artificial Sequence
  Synthetic
caacgggccgtgggtgtggctccctagcatttgcggtggtgttgcttggggtagtggcgtggtcaagacttggtc

SEQ ID NO: 91933 - DNA, 75 bp, Artificial Sequence
  Synthetic
agcatttgcggtggtgttgcttggggtagtggcgtggtcaagacttggtcacatggccaaaaccagtggccgctg

SEQ ID NO: 91934 - DNA, 75 bp, Artificial Sequence
  Synthetic
gtcgcgctcttggttctcttccacaaggggggatggcactatcgacctctggtccctggtgtcaacggggtcagc

SEQ ID NO: 91935 - DNA, 75 bp, Artificial Sequence
  Synthetic
aggggggatggcactatcgacctctggtccctggtgtcaacggggtcagccttatgcaccatagcggtcctagga

SEQ ID NO: 91936 - DNA, 75 bp, Artificial Sequence
  Synthetic
cttgtaagtcgaacgggtcgcacatacccacgggggaacgggtttgggacagagggaatgtcacactgttgtgtg

SEQ ID NO: 91937 - DNA, 75 bp, Artificial Sequence
  Synthetic
atgatttaccatcaaaagtggccggccaccacattgtagacgacctggtcagacgactcggtgtcgcggagggtt

SEQ ID NO: 91938 - DNA, 75 bp, Artificial Sequence
  Synthetic
tgtgtcttgtgttgtggatcgtcgaccaccgagttgtggcggctgcgtgagagactgctggccggagaccggtga

SEQ ID NO: 91939 - DNA, 75 bp, Artificial Sequence
  Synthetic
ccaccgagttgtggcggctgcgtgagagactgctggccggagaccggtgagtttgggaccccattcgctaaatgc

SEQ ID NO: 91940 - DNA, 75 bp, Artificial Sequence
  Synthetic
ggagccacggacaaaatcagtggcccctgtcttgtccccagtatgtctatggtgctgtttcagtgacctgcgtgt

SEQ ID NO: 91941 - DNA, 75 bp, Artificial Sequence
  Synthetic
tcgctctgtccccttccagatcagggggcccctcggttttcagggttctggtaacccgctccgcaacccgttgcg

SEQ ID NO: 91942 - DNA, 75 bp, Artificial Sequence
  Synthetic
ggggttccgtgtcttggtttgcctccaccggggggcgcgactcgagaatcgacgtgtggagtttggttccagttg

SEQ ID NO: 91943 - DNA, 75 bp, Artificial Sequence
  Synthetic
gggcccctcggttttcagggttctggtaacccgctccgcaacccgttgcggggtggaacctttaccatgactttg

SEQ ID NO: 91944 - DNA, 75 bp, Artificial Sequence
  Synthetic
tcctgaaggcacatatggtttcttcccaggagcgcctccagttaacaactgcttcttgctgggcactgaggtcag

SEQ ID NO: 91945 - DNA, 75 bp, Artificial Sequence
  Synthetic
ccaggagcgcctccagttaacaactgcttcttgctgggcactgaggtcagtgaggagttagggggcgccggcatg

SEQ ID NO: 91946 - DNA, 75 bp, Artificial Sequence
  Synthetic
ggacgcgggccgtccccacagtctcaattgtggacaagctcttcgccggagggtgggctgcagtcgtgggccact

SEQ ID NO: 91947 - DNA, 75 bp, Artificial Sequence
  Synthetic
aattgtggacaagctcttcgccggagggtgggctgcagtcgtgggccactgccacagtgtcatagctgcggcggt

SEQ ID NO: 91948 - DNA, 75 bp, Artificial Sequence
  Synthetic
taagcggcacacggtctgccccggctttgcctgggtcagttcatcacgcccggatggatttatccatgtgaaggg

SEQ ID NO: 91949 - DNA, 75 bp, Artificial Sequence
  Synthetic
tttgcctgggtcagttcatcacgcccggatggatttatccatgtgaagggcggtgttcaggaggtcgatgaccat

SEQ ID NO: 91950 - DNA, 75 bp, Artificial Sequence
  Synthetic
ggcagcctacggggcttctaggagtcccccgttggccgcggctgcttcctaccttatggggttgggcgtcggagg

SEQ ID NO: 91951 - DNA, 75 bp, Artificial Sequence
  Synthetic
cccccgttggccgcggctgcttcctaccttatggggttgggcgtcggaggcaacgcacaggcgcgcttggcttct

SEQ ID NO: 91952 - DNA, 75 bp, Artificial Sequence
  Synthetic
tctttacctgatgaaactggccgaggctcgcctggtaccattgatcctgcttttgttgtggtggtggctaaatca

SEQ ID NO: 91953 - DNA, 75 bp, Artificial Sequence
  Synthetic
gctcgcctggtaccattgatcctgcttttgttgtggtggtggctaaatcaactggctgccctcggagcagttgtg

SEQ ID NO: 91954 - DNA, 75 bp, Artificial Sequence
  Synthetic
ggtggcgatgatcctgggtttagtcaatttggtgttgtatctcaggtggctagggacaaccagactagtcctcct

SEQ ID NO: 91955 - DNA, 75 bp, Artificial Sequence
  Synthetic
tggcagggaaattgtcaacggaagacctgtggtatgccatcccggtgctgactagccctggggcgggccttgcgg

SEQ ID NO: 91956 - DNA, 75 bp, Artificial Sequence
  Synthetic
cctgtggtatgccatcccggtgctgactagccctggggcgggccttgcggggatcgccctggggttggttttgta

SEQ ID NO: 91957 - DNA, 75 bp, Artificial Sequence
  Synthetic
tctggggttcgcgtggctatcctcgggcaggcctgacgggtttatacatgtccagggtcaccttcaggaggtgga

SEQ ID NO: 91958 - DNA, 75 bp, Artificial Sequence
  Synthetic
aatttggtgttgtatctcaggtggctagggacaaccagactagtcctcctcctggcttggaaactcgctaggggg

SEQ ID NO: 91959 - DNA, 75 bp, Artificial Sequence
  Synthetic
ggatcgccctggggttggttttgtactcacccaacaactctggcactaccacatggttgaaccgactgttgacca

SEQ ID NO: 91960 - DNA, 75 bp, Artificial Sequence
  Synthetic
ttctgtcctaggagcccagttttgcttagatgtggccgttgatatggagccgaccatcctgggttgggtattggc

SEQ ID NO: 91961 - DNA, 75 bp, Artificial Sequence
  Synthetic
ttagatgtggccgttgatatggagccgaccatcctgggttgggtattggcctcgctgatagcctggtcgattgcc

SEQ ID NO: 91962 - DNA, 75 bp, Artificial Sequence
  Synthetic
tactgtgataaggtctcagccatgctcagacgcctgagcctcactcgaaccgtggtagccctggttaacagggag

SEQ ID NO: 91963 - DNA, 75 bp, Artificial Sequence
  Synthetic
cgtggtagccctggttaacagggagcctaaggtggatgaggttcaggtcgggtatgtctgggatctgtgggagtg

SEQ ID NO: 91964 - DNA, 75 bp, Artificial Sequence
  Synthetic
tcggctatggtgtaagggacaccaatggctgagacgcaggattgtcgactcccctattggggaggggagaccgac

SEQ ID NO: 91965 - DNA, 75 bp, Artificial Sequence
  Synthetic
tggctgagacgcaggattgtcgactcccctattggggaggggagaccgaccacacccgccgtcgcagcttggtgc

SEQ ID NO: 91966 - DNA, 75 bp, Artificial Sequence
  Synthetic
ggtggttgtcctcggcctagttgacgccctcgactgggccttggaagagctacttgtgtcacggccctcattgaa

SEQ ID NO: 91967 - DNA, 75 bp, Artificial Sequence
  Synthetic
gccctcgactgggccttggaagagctacttgtgtcacggccctcattgaagcgccttgccagggtactagaggca

SEQ ID NO: 91968 - DNA, 75 bp, Artificial Sequence
  Synthetic
aacctcccgcaatctgttcctgtatgagcatatgggggctttttgcgggcgagtggctcagcaactgcgcgcatg

SEQ ID NO: 91969 - DNA, 75 bp, Artificial Sequence
  Synthetic
cctcggacacgccgaaggtggtacccttcggcacatccgggtgggcggaggttgtggtgacgccaacccacgtgg

SEQ ID NO: 91970 - DNA, 75 bp, Artificial Sequence
  Synthetic
gagcatatgggggctttttgcgggcgagtggctcagcaactgcgcgcatgggacgctgctttggaacctctgtct

SEQ ID NO: 91971 - DNA, 75 bp, Artificial Sequence
  Synthetic
ttgtggtcagtgcgtcatgggcttgcctgtggtagcgcgccgcggagatgaggttttgatcggcgttttcggatc

SEQ ID NO: 91972 - DNA, 75 bp, Artificial Sequence
  Synthetic
tggatggcatacctgtctcatgggaggccgacgcgcgagcgccggcgatggtctatggtcccggccaaagtgtta

SEQ ID NO: 91973 - DNA, 75 bp, Artificial Sequence
  Synthetic
cctgtggtagcgcgccgcggagatgaggttttgatcggcgttttcggatctgtcaatgatttgcctcccgggttc

SEQ ID NO: 91974 - DNA, 75 bp, Artificial Sequence
  Synthetic
gcgattggctcgggttgtggaatgctgtgtgatggcgggtgagaaggccactactgtgaggctggtgtccaagat

SEQ ID NO: 91975 - DNA, 75 bp, Artificial Sequence
  Synthetic
tgttaccaaaagtgccttaactgggagggatccagaccaacatcctggcaacgtgatggtcctgggaaccactac

SEQ ID NO: 91976 - DNA, 75 bp, Artificial Sequence
  Synthetic
agggatccagaccaacatcctggcaacgtgatggtcctgggaaccactacctcacggagtatggggacttgtctc

SEQ ID NO: 91977 - DNA, 75 bp, Artificial Sequence
  Synthetic
ctgtcaaggaacgcttgctagagtgggacgcggcgcttgaacccctgtcattcaccaggacggactgtcgcatca

SEQ ID NO: 91978 - DNA, 75 bp, Artificial Sequence
  Synthetic
ggacgcggcgcttgaacccctgtcattcaccaggacggactgtcgcatcatcagagatgccgcccggaccttgtc

SEQ ID NO: 91979 - DNA, 75 bp, Artificial Sequence
  Synthetic
cactcctgttggggctttaaacccaagatggtggtcccctagtgatgatgtgacggtctaccctctcccggatgg

SEQ ID NO: 91980 - DNA, 75 bp, Artificial Sequence
  Synthetic
agatggtggtcccctagtgatgatgtgacggtctaccctctcccggatggggctacgtcattagcaccctgcaca

SEQ ID NO: 91981 - DNA, 75 bp, Artificial Sequence
  Synthetic
aggttttgatcggcgttctccaagatgtgaaccacttgcctccgggattcgtccccaccgcgccagttgtcatcc

SEQ ID NO: 91982 - DNA, 75 bp, Artificial Sequence
  Synthetic
gtccccaccgcgccagttgtcatccgtatgtgcggccagggctctctcggagtcacaagggctgccttgaccggt

SEQ ID NO: 91983 - DNA, 75 bp, Artificial Sequence
  Synthetic
tggctcctgtcatggggataaggtggaactggatgtagccatggaggtcgctgacttccgtggctcttctggttc

SEQ ID NO: 91984 - DNA, 75 bp, Artificial Sequence
  Synthetic
gaactggatgtagccatggaggtcgctgacttccgtggctcttctggttccccggttctctgtgatgagggtcat

SEQ ID NO: 91985 - DNA, 75 bp, Artificial Sequence
  Synthetic
atggggcttcttcccgaaccatcgccacacctgtgggagcccttaatccaaggtggtggtctgccagtgatgatg

SEQ ID NO: 91986 - DNA, 75 bp, Artificial Sequence
  Synthetic
tgcaagattcactagaccttggaaccaagttccttcggacgccaagactaccaccgagccccctcctgtccctgc

SEQ ID NO: 91987 - DNA, 75 bp, Artificial Sequence
  Synthetic
caagttccttcggacgccaagactaccaccgagccccctcctgtccctgcgaagggccagttcaaggaggctcct

SEQ ID NO: 91988 - DNA, 75 bp, Artificial Sequence
  Synthetic
cacacctgtgggagcccttaatccaaggtggtggtctgccagtgatgatgtcactgtgtacccgctcccggatgg

SEQ ID NO: 91989 - DNA, 75 bp, Artificial Sequence
  Synthetic
cagcctattgtgacaaggtgcgcactccgcttgaattgcaagttgggtgcttggtgggcaatgaacttacctttg

SEQ ID NO: 91990 - DNA, 75 bp, Artificial Sequence
  Synthetic
ttccaacatggggcacaaggttttgattctcaatccctcagtggccactgtacggaagatgggaccctacatgga

SEQ ID NO: 91991 - DNA, 75 bp, Artificial Sequence
  Synthetic
tcagatcagatggagccttatgccatggtttgagcaagggggataaggtggaactagacgtggccatggaggtct

SEQ ID NO: 91992 - DNA, 75 bp, Artificial Sequence
  Synthetic
gaactagacgtggccatggaggtctcagacttccgcggctcgtccggatcgcctgtcctgtgcgacgagggacac

SEQ ID NO: 91993 - DNA, 75 bp, Artificial Sequence
  Synthetic
attctcaatccctcagtggccactgtacggaagatgggaccctacatggagaagatgtccggcaaacatccatcg

SEQ ID NO: 91994 - DNA, 75 bp, Artificial Sequence
  Synthetic
gtggcggacaccactaaggtgtacgtaaccaatccagataatgtgggtaggagggtagacaaggtaaccttttgg

SEQ ID NO: 91995 - DNA, 75 bp, Artificial Sequence
  Synthetic
ggcacggttcactcggccgtggacccaagtcccaacagacgccaagactaccactgagcccccgccggttccggc

SEQ ID NO: 91996 - DNA, 75 bp, Artificial Sequence
  Synthetic
cttgacgtactgtacctacgggaggtttcttgccaatcctaggtccttcctgcgaggcgtgagcgtggttatctg

SEQ ID NO: 91997 - DNA, 75 bp, Artificial Sequence
  Synthetic
tttcttgccaatcctaggtccttcctgcgaggcgtgagcgtggttatctgtgatgagtgccactcccacgatccc

SEQ ID NO: 91998 - DNA, 75 bp, Artificial Sequence
  Synthetic
ttgtttatgcctacgggggccgggaagagcacccgggtcccgttggagtatggctacatgggccacaaggtcctg

SEQ ID NO: 91999 - DNA, 75 bp, Artificial Sequence
  Synthetic
agcatgggttacacttatgaggaggcaataaggactgttaggccacatgctgccatgggctggggatctaaggtg

SEQ ID NO: 92000 - DNA, 75 bp, Artificial Sequence
  Synthetic
ggtcactttggtcctctacgccacagctacgccccctggcgctccgatgacaccccatccaagcatcatcgagca

SEQ ID NO: 92001 - DNA, 75 bp, Artificial Sequence
  Synthetic
gctacgccccctggcgctccgatgacaccccatccaagcatcatcgagcaaaaactagatgtgggcgagatcccc

SEQ ID NO: 92002 - DNA, 75 bp, Artificial Sequence
  Synthetic
gcggctggccggcaaacatcccagcatttactgtgggcacgatacaacagccttcactaggatcactgattcgcc

SEQ ID NO: 92003 - DNA, 75 bp, Artificial Sequence
  Synthetic
atttactgtgggcacgatacaacagccttcactaggatcactgattcgcccttgacgtattctacctacggtagg

SEQ ID NO: 92004 - DNA, 75 bp, Artificial Sequence
  Synthetic
agtgttctgccattcaaaggcggaatgcgatcggctggctggtcagttttcctcacggggggttaactctgtgtc

SEQ ID NO: 92005 - DNA, 75 bp, Artificial Sequence
  Synthetic
tgcgatcggctggctggtcagttttcctcacggggggttaactctgtgtcctattatcgggggaaagactcgtcc

SEQ ID NO: 92006 - DNA, 75 bp, Artificial Sequence
  Synthetic
taaggaggagaaggccccccgcctcattgtgttcccccccctggacttccggatagctgaaaagctcattctggg

SEQ ID NO: 92007 - DNA, 75 bp, Artificial Sequence
  Synthetic
tgatgagtgccacagccatgactcgacggtgctgcttggcatcggacgagtcagggagttggcgcgtggatgtgg

SEQ ID NO: 92008 - DNA, 75 bp, Artificial Sequence
  Synthetic
acggtgctgcttggcatcggacgagtcagggagttggcgcgtggatgtggggtccaactggtcttctacgccacc

SEQ ID NO: 92009 - DNA, 75 bp, Artificial Sequence
  Synthetic
tggttattctggcaacttcgattcggtgactgactgtggattggtggtggaggaacgcgttgaagtgacgcttga

SEQ ID NO: 92010 - DNA, 75 bp, Artificial Sequence
  Synthetic
gtgactgactgtggattggtggtggaggaacgcgttgaagtgacgcttgatcccaccatcaccctgtcgctgcac

SEQ ID NO: 92011 - DNA, 75 bp, Artificial Sequence
  Synthetic
agtacaccccaaaccagcgggttagggagatgctgaagctgtgggagtcaaagaagaccccgtgcgccatctgcg

SEQ ID NO: 92012 - DNA, 75 bp, Artificial Sequence
  Synthetic
caagctggatgtgggtgagatccccttctatgggcatggtatccccttggagaggatgcgaaccggcaggcatct

SEQ ID NO: 92013 - DNA, 75 bp, Artificial Sequence
  Synthetic
tggatgccacgtgcttcgacagtagcataactgaagaggacgtggccctcgagacagagctatatgctctggcct

SEQ ID NO: 92014 - DNA, 75 bp, Artificial Sequence
  Synthetic
gagacagagctatatgctctggcctctgaccacccagaatgggtgcgcgccctggggaaatactatgcctctggc

SEQ ID NO: 92015 - DNA, 75 bp, Artificial Sequence
  Synthetic
gagaggaagatcaggtcgttactactatgcaggggttgggaaagctcctgctggtgtggtgcgaaccggacccgt

SEQ ID NO: 92016 - DNA, 75 bp, Artificial Sequence
  Synthetic
tatgcaggggttgggaaagctcctgctggtgtggtgcgaaccggacccgtctgggccgcaatagagactggcatt

SEQ ID NO: 92017 - DNA, 75 bp, Artificial Sequence
  Synthetic
cttccaggggggtaaatgccattgcctattatcggggaaaagacagttctatcatcaaggacggagatctcgtgg

SEQ ID NO: 92018 - DNA, 75 bp, Artificial Sequence
  Synthetic
ctgaccacccagaatgggtgcgcgccctggggaaatactatgcctctggcaccatggttacccccgagggggtgc

SEQ ID NO: 92019 - DNA, 75 bp, Artificial Sequence
  Synthetic
cgacgactgcccatacaccgcagccgttgcagctgacattggtgaagccgcggtgtttttctcaggtctcacccc

SEQ ID NO: 92020 - DNA, 75 bp, Artificial Sequence
  Synthetic
gttgcagctgacattggtgaagccgcggtgtttttctcaggtctcacccctctgagaatgcatcctgatgtcagc

SEQ ID NO: 92021 - DNA, 75 bp, Artificial Sequence
  Synthetic
acagtgcccgcgtcggctgaactgtcgatgcagcggcgaggtcgcacagggagaggccgatccggccggtactac

SEQ ID NO: 92022 - DNA, 75 bp, Artificial Sequence
  Synthetic
gactatgtgccgggaagcactgtcgcccggcccatccgatgacccccaatgggctggccttaagggcccaaaccc

SEQ ID NO: 92023 - DNA, 75 bp, Artificial Sequence
  Synthetic
cctcatatcatgcatcattggacacagctcccttctgctccacttggcttgctgagtgcaatgctgatgggaagc

SEQ ID NO: 92024 - DNA, 75 bp, Artificial Sequence
  Synthetic
agctcccttctgctccacttggcttgctgagtgcaatgctgatgggaagcgtcatttctttcttactacggactt

SEQ ID NO: 92025 - DNA, 75 bp, Artificial Sequence
  Synthetic
gcttcatatgggtacgcgtgtgagccctcatatcatgcatcattggacacagctcccttctgctccacttggctt

SEQ ID NO: 92026 - DNA, 75 bp, Artificial Sequence
  Synthetic
ctggtcggcggtggaagccggagtgacctggtacggaatggaacctgacttgacagcaaaccttctgagacttta

SEQ ID NO: 92027 - DNA, 75 bp, Artificial Sequence
  Synthetic
tcggaggccgctggcacgcatgtcaagtgagtacagcgacccgatggcttcagctattgggtacatcctcctata

SEQ ID NO: 92028 - DNA, 75 bp, Artificial Sequence
  Synthetic
tgacagcaaaccttctgagactttacgatgactgcccttacaccgcagccatcgcagctgacatcggtgaagccg

SEQ ID NO: 92029 - DNA, 75 bp, Artificial Sequence
  Synthetic
tcgtcgtctgggcgtcgctgagggatatgcccactgcgatgcagggccgatcttaatggtcggccttgctattgc

SEQ ID NO: 92030 - DNA, 75 bp, Artificial Sequence
  Synthetic
cccggcccatccgatgacccccaatgggctggccttaagggcccaaaccctgtgcccctccttctccggtggggc

SEQ ID NO: 92031 - DNA, 75 bp, Artificial Sequence
  Synthetic
tatgcccactgcgatgcagggccgatcttaatggtcggccttgctattgcaggtgggatgatctatgcgtcgtac

SEQ ID NO: 92032 - DNA, 75 bp, Artificial Sequence
  Synthetic
ccccctcatgcgccatggtgaccaggcaactccattaccagtcgtgcaggttcccccggaagaacaccgccccgg

SEQ ID NO: 92033 - DNA, 75 bp, Artificial Sequence
  Synthetic
catggcaattactacaagtttcccttggacaaactgcccaacatcatcgtggctctccacggaccagcagcgttg

SEQ ID NO: 92034 - DNA, 75 bp, Artificial Sequence
  Synthetic
gcaactccattaccagtcgtgcaggttcccccggaagaacaccgccccggggcagagagtgctcctgccgacgca

SEQ ID NO: 92035 - DNA, 75 bp, Artificial Sequence
  Synthetic
aatgatttaccatctaaagtggccggacaccacattgttgacgacctggtcaggagactcggtgtggcggaaggt

SEQ ID NO: 92036 - DNA, 75 bp, Artificial Sequence
  Synthetic
tatattgaccctctccatcggggatgtgttggctgcagtgcaagctaaggccacgacagcgcacgcttggctggc

SEQ ID NO: 92037 - DNA, 75 bp, Artificial Sequence
  Synthetic
gtgttggctgcagtgcaagctaaggccacgacagcgcacgcttggctggctgggtgttacaccggaacccgtgcc

SEQ ID NO: 92038 - DNA, 75 bp, Artificial Sequence
  Synthetic
cccccctatatgggggtggttcatcaattggatttcacagcccagcggagtcgctggcggtggttggggttctta

SEQ ID NO: 92039 - DNA, 75 bp, Artificial Sequence
  Synthetic
catcgtgggccactgtcatagtgtcatagcagcggccgtggccgcttatggcgctaacaggagcccgcctttggc

SEQ ID NO: 92040 - DNA, 75 bp, Artificial Sequence
  Synthetic
atagcagcggccgtggccgcttatggcgctaacaggagcccgcctttggctgctgctgcttcctacctaatgggg

SEQ ID NO: 92041 - DNA, 75 bp, Artificial Sequence
  Synthetic
aattggatttcacagcccagcggagtcgctggcggtggttggggttcttagccctgctcatcgtggcgctctttg

SEQ ID NO: 92042 - DNA, 75 bp, Artificial Sequence
  Synthetic
gggggctgccggcactgcccttggaacaccggtcgtgggtctaaccatggccggtgctttcatgggcggttcgtc

SEQ ID NO: 92043 - DNA, 75 bp, Artificial Sequence
  Synthetic
acaccggtcgtgggtctaaccatggccggtgctttcatgggcggttcgtcggtgtccccctccttggtcacaatg

SEQ ID NO: 92044 - DNA, 75 bp, Artificial Sequence
  Synthetic
gggacgcgggccgtccccactgtatcaattgtggacaagctcttcgccggagggtgggcagctgtcgtaggccac

SEQ ID NO: 92045 - DNA, 75 bp, Artificial Sequence
  Synthetic
cgttttcgacttcatggcgggaaagttaacaccagaggacctatggtatggcatcccgatactaacgagtcccgg

SEQ ID NO: 92046 - DNA, 75 bp, Artificial Sequence
  Synthetic
ttaacaccagaggacctatggtatggcatcccgatactaacgagtcccggggctggcctagccggctttgccttg

SEQ ID NO: 92047 - DNA, 75 bp, Artificial Sequence
  Synthetic
tcctccattggctgcggctgcttcctacctgatggggttgggcgtcggaggcaacgctcaggcgcggctggcctc

SEQ ID NO: 92048 - DNA, 75 bp, Artificial Sequence
  Synthetic
agggttggtaggtcgtaaatcccggtcatcttggtagccactataggtgggtcttaagggttggttaaggtccct

SEQ ID NO: 92049 - DNA, 75 bp, Artificial Sequence
  Synthetic
tcgactgttgactaccctcccgagatccaatgtcatcccagacacgtacttccaggaggctgactattgtgacag

SEQ ID NO: 92050 - DNA, 75 bp, Artificial Sequence
  Synthetic
cgctctcctgtggggggccgctggcactgcccttgggactcccgtcgtgggtttaaccatggcgggggccttcat

SEQ ID NO: 92051 - DNA, 75 bp, Artificial Sequence
  Synthetic
tccaatgtcatcccagacacgtacttccaggaggctgactattgtgacagagtatctgccctactgcgacgcctc

SEQ ID NO: 92052 - DNA, 75 bp, Artificial Sequence
  Synthetic
cgaaatccaggtgggctatgtatgggatctctgggaatgggtgatgcgcctcctgcgtcgatgcgtgaataggct

SEQ ID NO: 92053 - DNA, 75 bp, Artificial Sequence
  Synthetic
gatctctgggaatgggtgatgcgcctcctgcgtcgatgcgtgaataggctgcgggccctctgccccgtcgtgtca

SEQ ID NO: 92054 - DNA, 75 bp, Artificial Sequence
  Synthetic
tgggcggcaggggaaggacccttgtcgctgcccttcccggtggggtgggaaatgcatggggccacccagctccgc

SEQ ID NO: 92055 - DNA, 75 bp, Artificial Sequence
  Synthetic
cgctgcccttcccggtggggtgggaaatgcatggggccacccagctccgcggcggcctgcagccggggtagccca

SEQ ID NO: 92056 - DNA, 75 bp, Artificial Sequence
  Synthetic
aatgcatggggccacccagctccgcggcggcctgcagccggggtagcccaaaaaccttcgggtgagggcgggtgg

SEQ ID NO: 92057 - DNA, 75 bp, Artificial Sequence
  Synthetic
aatgcatggggccacccagctccgcggcggcctgcagccggggtagcccaaaatccttcgggtgagggcgggtgg

SEQ ID NO: 92058 - DNA, 75 bp, Artificial Sequence
  Synthetic
aatgcatggggccacccagctccgcggcggcctgcagccggggtagcccaaaacccttcgggtgagggcgggtgg

SEQ ID NO: 92059 - DNA, 75 bp, Artificial Sequence
  Synthetic
aatgcatggggccacccagctccgcggcggcctgcagccggggtagcccaaaagccttcgggtgagggcgggtgg

SEQ ID NO: 92060 - DNA, 75 bp, Artificial Sequence
  Synthetic
aatgcatggggccacccagctccgcggcggcctgcagccggggtagcccaataaccttcgggtgagggcgggtgg

SEQ ID NO: 92061 - DNA, 75 bp, Artificial Sequence
  Synthetic
aatgcatggggccacccagctccgcggcggcctgcagccggggtagcccaatatccttcgggtgagggcgggtgg

SEQ ID NO: 92062 - DNA, 75 bp, Artificial Sequence
  Synthetic
aatgcatggggccacccagctccgcggcggcctgcagccggggtagcccaatacccttcgggtgagggcgggtgg

SEQ ID NO: 92063 - DNA, 75 bp, Artificial Sequence
  Synthetic
aatgcatggggccacccagctccgcggcggcctgcagccggggtagcccaatagccttcgggtgagggcgggtgg

SEQ ID NO: 92064 - DNA, 75 bp, Artificial Sequence
  Synthetic
aatgcatggggccacccagctccgcggcggcctgcagccggggtagcccaacaaccttcgggtgagggcgggtgg

SEQ ID NO: 92065 - DNA, 75 bp, Artificial Sequence
  Synthetic
aatgcatggggccacccagctccgcggcggcctgcagccggggtagcccaacatccttcgggtgagggcgggtgg

SEQ ID NO: 92066 - DNA, 75 bp, Artificial Sequence
  Synthetic
aatgcatggggccacccagctccgcggcggcctgcagccggggtagcccaacacccttcgggtgagggcgggtgg

SEQ ID NO: 92067 - DNA, 75 bp, Artificial Sequence
  Synthetic
aatgcatggggccacccagctccgcggcggcctgcagccggggtagcccaacagccttcgggtgagggcgggtgg

SEQ ID NO: 92068 - DNA, 75 bp, Artificial Sequence
  Synthetic
aatgcatggggccacccagctccgcggcggcctgcagccggggtagcccaagaaccttcgggtgagggcgggtgg

SEQ ID NO: 92069 - DNA, 75 bp, Artificial Sequence
  Synthetic
aatgcatggggccacccagctccgcggcggcctgcagccggggtagcccaagatccttcgggtgagggcgggtgg

SEQ ID NO: 92070 - DNA, 75 bp, Artificial Sequence
  Synthetic
aatgcatggggccacccagctccgcggcggcctgcagccggggtagcccaagacccttcgggtgagggcgggtgg

SEQ ID NO: 92071 - DNA, 75 bp, Artificial Sequence
  Synthetic
aatgcatggggccacccagctccgcggcggcctgcagccggggtagcccaagagccttcgggtgagggcgggtgg

SEQ ID NO: 92072 - DNA, 75 bp, Artificial Sequence
  Synthetic
actcagccaacaactctggcactaccacatggttgaaccgactgctgaccacacttcctcggtcctcttgcatcc

SEQ ID NO: 92073 - DNA, 75 bp, Artificial Sequence
  Synthetic
gggccatattgaggcacgatgtctctgtggctgtgtgatcactggagaggttctcaatgggaaattgcaggacgt

SEQ ID NO: 92074 - DNA, 75 bp, Artificial Sequence
  Synthetic
tgtggctgtgtgatcactggagaggttctcaatgggaaattgcaggacgtcatttactctacaaaaatgtgccgt

SEQ ID NO: 92075 - DNA, 75 bp, Artificial Sequence
  Synthetic
ccgtggtagccctggtcaacagggagcctaaggtggatgaggtgcaggtagggtatgtctgggacttgtgggagt

SEQ ID NO: 92076 - DNA, 75 bp, Artificial Sequence
  Synthetic
tagtcccctgctgtgtaccgacgcccctaaggttgtccctattgggacctccggatgggtagaggttgtggtgac

SEQ ID NO: 92077 - DNA, 75 bp, Artificial Sequence
  Synthetic
cctaaggttgtccctattgggacctccggatgggtagaggttgtggtgacccccactcatgtgatcgtgcgtcgc

SEQ ID NO: 92078 - DNA, 75 bp, Artificial Sequence
  Synthetic
cctgtggtgtcacttcctctgtggcactgcggggaggggtggtccggtgagtggttgctggacggccatgtggag

SEQ ID NO: 92079 - DNA, 75 bp, Artificial Sequence
  Synthetic
agaaccctactttgtggatggcattcctgtctcatgggaggctgatgctaaggctccggccttggtgtatggccc

SEQ ID NO: 92080 - DNA, 75 bp, Artificial Sequence
  Synthetic
ggagcctttacgggcctttgtctgtgtcggcctatgtggccggcatactagggcttggggaggtctactcggggg

SEQ ID NO: 92081 - DNA, 75 bp, Artificial Sequence
  Synthetic
cctgtctcatgggaggctgatgctaaggctccggccttggtgtatggcccaggacaaggtgtgaccatagacggt

SEQ ID NO: 92082 - DNA, 75 bp, Artificial Sequence
  Synthetic
tgaggtaagttcggtttcgatcgatgtcagctgtgaggagtctgaggacactgaactgactgagacggatttgcc

SEQ ID NO: 92083 - DNA, 75 bp, Artificial Sequence
  Synthetic
gcctctgacacgccaaaggtggtacctttcggcacgtctggatgggcggaggtggtggtgactccaacccacgtg

SEQ ID NO: 92084 - DNA, 75 bp, Artificial Sequence
  Synthetic
gtcagctgtgaggagtctgaggacactgaactgactgagacggatttgccacctgcagcggcggccctccaggct

SEQ ID NO: 92085 - DNA, 75 bp, Artificial Sequence
  Synthetic
tgaagtgggaaagtgagttttggagatggactgagcagttggcctccaattactggatactggaatatctctgga

SEQ ID NO: 92086 - DNA, 75 bp, Artificial Sequence
  Synthetic
gtgtgtgttgcggcccttctcctgcttgagcaaaggattgtcatggtctttctgctggtgaccatggcggggatg

SEQ ID NO: 92087 - DNA, 75 bp, Artificial Sequence
  Synthetic
ttgagcaaaggattgtcatggtctttctgctggtgaccatggcggggatgtcgcaaggcgcccccgcctcggtac

SEQ ID NO: 92088 - DNA, 75 bp, Artificial Sequence
  Synthetic
ggactgttcaacaccctctctctgtggtagcagtcgagagatgcctgtatggggtgacgacattccccgtacgcc

SEQ ID NO: 92089 - DNA, 75 bp, Artificial Sequence
  Synthetic
ggtagcagtcgagagatgcctgtatggggtgacgacattccccgtacgccatcgcctgcgcgaatttctgtaaca

SEQ ID NO: 92090 - DNA, 75 bp, Artificial Sequence
  Synthetic
tctgctggtgaccatggcggggatgtcgcaaggcgcccccgcctcggtactggggtcacgcccctttgaacccgg

SEQ ID NO: 92091 - DNA, 75 bp, Artificial Sequence
  Synthetic
ctgtccatcatcagactcgtttgaagtgataccctcaacatcatctgtaactgaggaggaaggggagaatgtctt

SEQ ID NO: 92092 - DNA, 75 bp, Artificial Sequence
  Synthetic
gtgataccctcaacatcatctgtaactgaggaggaaggggagaatgtctttaatgtcgctctgtcaatactgaag

SEQ ID NO: 92093 - DNA, 75 bp, Artificial Sequence
  Synthetic
atgcgaggataaatcggtcacccggttcttctcgcttggcctcaccgttgctgatgtggcgagcttgtgtgagat

SEQ ID NO: 92094 - DNA, 75 bp, Artificial Sequence
  Synthetic
ttcttctcgcttggcctcaccgttgctgatgtggcgagcttgtgtgagatgcagattaccaaccacacagcctat

SEQ ID NO: 92095 - DNA, 75 bp, Artificial Sequence
  Synthetic
gcgggcgtgattcgaagatcgatgtgtggagtttggttccggttggctctgccagctgcaccatagccgctctcg

SEQ ID NO: 92096 - DNA, 75 bp, Artificial Sequence
  Synthetic
taatgagcttatttttgtatgtgatgaagatgacaagcgctgtgaaacgctgacctccttctcatattgttggtc

SEQ ID NO: 92097 - DNA, 75 bp, Artificial Sequence
  Synthetic
gaagatgacaagcgctgtgaaacgctgacctccttctcatattgttggtcgggagtgcccttaacacgggcgttg

SEQ ID NO: 92098 - DNA, 75 bp, Artificial Sequence
  Synthetic
tgcgctacctgcatcctggaccgtcggcccgcctcgtgcggcacctgtgtgcgggactgctggcccgagaccggg

SEQ ID NO: 92099 - DNA, 75 bp, Artificial Sequence
  Synthetic
taccaccaaggtgtacgttaccaatccggacaatgtggggagaagggttgacagtgtgaccttttggcgtggacc

SEQ ID NO: 92100 - DNA, 75 bp, Artificial Sequence
  Synthetic
ccggacaatgtggggagaagggttgacagtgtgaccttttggcgtggaccccgggttcacgacaagttcttggtc

SEQ ID NO: 92101 - DNA, 75 bp, Artificial Sequence
  Synthetic
ggttttgggtcctacaccatgaccaagatccgagactccttacatctggtgaaatgtcccacccctgccattgag

SEQ ID NO: 92102 - DNA, 75 bp, Artificial Sequence
  Synthetic
ttacacatatgaggaagcaatcaagacggtgaggccgcatgcagccatgggctggggatctaagacttcagttaa

SEQ ID NO: 92103 - DNA, 75 bp, Artificial Sequence
  Synthetic
ggtggcagataccaccaaggtgtacgtcactaatccggacaatgtgggtaggagggttgacaaggtaaccttttg

SEQ ID NO: 92104 - DNA, 75 bp, Artificial Sequence
  Synthetic
gtcactaatccggacaatgtgggtaggagggttgacaaggtaaccttttggcgcgcccctcgggtccatgacaag

SEQ ID NO: 92105 - DNA, 75 bp, Artificial Sequence
  Synthetic
acggtgaggccgcatgcagccatgggctggggatctaagacttcagttaaaggccttgaaacacctgaagggaaa

SEQ ID NO: 92106 - DNA, 75 bp, Artificial Sequence
  Synthetic
tcacgggggggttctatgaacccctggtgcggcggtgttcagagttagctgggaagcgaaatccggtttgtccgg

SEQ ID NO: 92107 - DNA, 75 bp, Artificial Sequence
  Synthetic
cttcactctaactgtgaaaaaggaggtcttctaccgagatcggaaggaggagaaagctccaaggctcattgtctt

SEQ ID NO: 92108 - DNA, 75 bp, Artificial Sequence
  Synthetic
gtcttctaccgagatcggaaggaggagaaagctccaaggctcattgtcttcccccccctggacttccgggtcgct

SEQ ID NO: 92109 - DNA, 75 bp, Artificial Sequence
  Synthetic
ggacgcctatgctttccagtacactccgaaccagcgggtgaaaaagatggtggagatgtgggggagcaagaagac

SEQ ID NO: 92110 - DNA, 75 bp, Artificial Sequence
  Synthetic
ccgaaccagcgggtgaaaaagatggtggagatgtgggggagcaagaagacaccctgtgccatatgtgtagacgcc

SEQ ID NO: 92111 - DNA, 75 bp, Artificial Sequence
  Synthetic
gtaaggaggagaaggccccccgcctcattgtgttcccccccctggacttccggatagctgaaaagctcatcctgg

SEQ ID NO: 92112 - DNA, 75 bp, Artificial Sequence
  Synthetic
gctctatgctttggcatcagataatcctgaacaagtcagagcccttggtcggtattacgcggaaggtcctatggt

SEQ ID NO: 92113 - DNA, 75 bp, Artificial Sequence
  Synthetic
cggcgcacgctgctgtggcgggggaggtcttcgcgggcccggccttgtcctggtgtcttgggctgcccttcgtga

SEQ ID NO: 92114 - DNA, 75 bp, Artificial Sequence
  Synthetic
cctgaacaagtcagagcccttggtcggtattacgcggaaggtcctatggtttcccctgagggggttcccttgggc

SEQ ID NO: 92115 - DNA, 75 bp, Artificial Sequence
  Synthetic
catcacatgctacattaaggtcagtgctgcttgtgcacgcattggcctgaagggcgtgtcgctgcttattgctgg

SEQ ID NO: 92116 - DNA, 75 bp, Artificial Sequence
  Synthetic
gctgcttgtgcacgcattggcctgaagggcgtgtcgctgcttattgctggtgatgactgtcttatcatttgtgaa

SEQ ID NO: 92117 - DNA, 75 bp, Artificial Sequence
  Synthetic
caccatggtcacccctgagggggtgcccgtgggcgagaggtattgtaggtcctccggagtacttaccactagtgc

SEQ ID NO: 92118 - DNA, 75 bp, Artificial Sequence
  Synthetic
cgggtacaattgtgaaccatcctatcatgcctcccttgacactgctccgttttgctcgacctggctggcagagtg

SEQ ID NO: 92119 - DNA, 75 bp, Artificial Sequence
  Synthetic
catgcctcccttgacactgctccgttttgctcgacctggctggcagagtgtaatgccaatggtagtaggcacttt

SEQ ID NO: 92120 - DNA, 75 bp, Artificial Sequence
  Synthetic
tggggctgaaaaatgtctctctcttgattgcgggcgatgactgtctgatcatatgtgagcggccaatgtgtgacc

SEQ ID NO: 92121 - DNA, 75 bp, Artificial Sequence
  Synthetic
gcgccagcgggtagtgcggagccccctcggggaggggcggcccacgaagccgttgaccatcgcttggtgcttggc

SEQ ID NO: 92122 - DNA, 75 bp, Artificial Sequence
  Synthetic
ttcagacccaatggcttcggcaattgggtattgtttgctctacccttggcacccgatagtcaggtgggttgccat

SEQ ID NO: 92123 - DNA, 75 bp, Artificial Sequence
  Synthetic
gggtattgtttgctctacccttggcacccgatagtcaggtgggttgccataccccatgttttgcaagtcgctttc

SEQ ID NO: 92124 - DNA, 75 bp, Artificial Sequence
  Synthetic
atgttggtggtggtggggctggtgctcctctttggcctgttcgatgcgttggactgggccctggaggagttactg

SEQ ID NO: 92125 - DNA, 75 bp, Artificial Sequence
  Synthetic
ttactatctgttccctttgaacaagttgcctaacatcatagtggccctgcacggtccagcagcgttaagggtcac

SEQ ID NO: 92126 - DNA, 75 bp, Artificial Sequence
  Synthetic
ttgcctaacatcatagtggccctgcacggtccagcagcgttaagggtcactgcagacacaaccaaaaccaaaatg

SEQ ID NO: 92127 - DNA, 75 bp, Artificial Sequence
  Synthetic
tatgggctctttttcgcgtgccgttaaggaacgcttgcttgagtgggacgcggcgctggaacccctgtcattcac

SEQ ID NO: 92128 - DNA, 75 bp, Artificial Sequence
  Synthetic
aaggaacgcttgcttgagtgggacgcggcgctggaacccctgtcattcactaggacggactgtcgcatcattaga

SEQ ID NO: 92129 - DNA, 75 bp, Artificial Sequence
  Synthetic
ccggaaaaaggctggtgcgcttcgaacgcgcatgctcaaatcctccggttgggcggagttggctcggggcctgtt

SEQ ID NO: 92130 - DNA, 75 bp, Artificial Sequence
  Synthetic
acgcgcatgctcaaatcctccggttgggcggagttggctcggggcctgttgtggcaccctggtcttcgactaagg

SEQ ID NO: 92131 - DNA, 75 bp, Artificial Sequence
  Synthetic
gtcagtgcgtcatgggcttgcccgtggtggcgcgccgcggcgatgaggtcttgatcggtgtctttcaggatgtga

SEQ ID NO: 92132 - DNA, 75 bp, Artificial Sequence
  Synthetic
tatgggggtagtccacacattggatttcactcagccaaggagtcggtggcgactgttatttgggctattagccct

SEQ ID NO: 92133 - DNA, 75 bp, Artificial Sequence
  Synthetic
gcactgcgtacacgcatgctccggtcgcgcggttgggcggagctggctcggggcctgttgtggcatccaggcctc

SEQ ID NO: 92134 - DNA, 75 bp, Artificial Sequence
  Synthetic
tgcggcaaggggtttctcggggtcacaaaggctgccttgactggtcgggatcctgacctacatccaggaaacgtc

SEQ ID NO: 92135 - DNA, 75 bp, Artificial Sequence
  Synthetic
ttcactcagccaaggagtcggtggcgactgttatttgggctattagcccttgtagtggttgccatctttggttga

SEQ ID NO: 92136 - DNA, 75 bp, Artificial Sequence
  Synthetic
cccccccaggacgattccccgcttggtaaaaagggccaggccatgggatcgacgattgtggaatcgtaaaatcca

SEQ ID NO: 92137 - DNA, 75 bp, Artificial Sequence
  Synthetic
gtggtaatccaccgctgccgcaggccggtcgctacgttatagcgtaatccgtgactacgggctgctcgcagagcc

SEQ ID NO: 92138 - DNA, 75 bp, Artificial Sequence
  Synthetic
ggccgagtcttgttgggtcatcagatccgacggggctctgtgtcatggtttgagcaagggggacaaggtggagct

SEQ ID NO: 92139 - DNA, 75 bp, Artificial Sequence
  Synthetic
gagttttcaaggaggccccgttgtttatgcctacgggagccgggaagagcacccgggtcccgttggaatacggca

SEQ ID NO: 92140 - DNA, 75 bp, Artificial Sequence
  Synthetic
tatgcctacgggagccgggaagagcacccgggtcccgttggaatacggcaacatgggccataaagttcttatctt

SEQ ID NO: 92141 - DNA, 75 bp, Artificial Sequence
  Synthetic
aggcggggttggccgtgcggcctggcaagtccgctgcccagttggtgggggaacttgggagcctctacggacccc

SEQ ID NO: 92142 - DNA, 75 bp, Artificial Sequence
  Synthetic
gttgaggccggggccattctggccccggccacccacgcttgccgagctgatgggcaatatttcctcacaaactgt

SEQ ID NO: 92143 - DNA, 75 bp, Artificial Sequence
  Synthetic
cggccacccacgcttgccgagctgatgggcaatatttcctcacaaactgttgcgccccggaggacattgggttct

SEQ ID NO: 92144 - DNA, 75 bp, Artificial Sequence
  Synthetic
gagctggcgcgaggctgcggggtccaactggtcctctacgctacggccacccctcctggttcccccatggtccag

SEQ ID NO: 92145 - DNA, 75 bp, Artificial Sequence
  Synthetic
cgatgctggccactgtatcaggcgggtttggctgtgcggcctggcaagtccgcggcccagctggtgggggaactg

SEQ ID NO: 92146 - DNA, 75 bp, Artificial Sequence
  Synthetic
tgggcacggcatacctctggagaggatgcggaccggtaggcacctcgtattctgccattcaaaggcggagtgcga

SEQ ID NO: 92147 - DNA, 75 bp, Artificial Sequence
  Synthetic
tggtggttctcctggtgactatggcgggtatgtctcagggcgtacccgtcactgtactggggtccaggccttttg

SEQ ID NO: 92148 - DNA, 75 bp, Artificial Sequence
  Synthetic
tctcagcatacgtggcggggatcttgggcctaggagaggtttactccggtgtcctcacggttggggtcgcgttga

SEQ ID NO: 92149 - DNA, 75 bp, Artificial Sequence
  Synthetic
tctcagcttacgtggcggggatcttgggcctaggagaggtttactccggtgtcctcacggttggggtcgcgttga

SEQ ID NO: 92150 - DNA, 75 bp, Artificial Sequence
  Synthetic
tctcagcctacgtggcggggatcttgggcctaggagaggtttactccggtgtcctcacggttggggtcgcgttga

SEQ ID NO: 92151 - DNA, 75 bp, Artificial Sequence
  Synthetic
tctcagcgtacgtggcggggatcttgggcctaggagaggtttactccggtgtcctcacggttggggtcgcgttga

SEQ ID NO: 92152 - DNA, 75 bp, Artificial Sequence
  Synthetic
tctctgcatacgtggcggggatcttgggcctaggagaggtttactccggtgtcctcacggttggggtcgcgttga

SEQ ID NO: 92153 - DNA, 75 bp, Artificial Sequence
  Synthetic
tctctgcttacgtggcggggatcttgggcctaggagaggtttactccggtgtcctcacggttggggtcgcgttga

SEQ ID NO: 92154 - DNA, 75 bp, Artificial Sequence
  Synthetic
tctctgcctacgtggcggggatcttgggcctaggagaggtttactccggtgtcctcacggttggggtcgcgttga

SEQ ID NO: 92155 - DNA, 75 bp, Artificial Sequence
  Synthetic
tctctgcgtacgtggcggggatcttgggcctaggagaggtttactccggtgtcctcacggttggggtcgcgttga

SEQ ID NO: 92156 - DNA, 75 bp, Artificial Sequence
  Synthetic
tctccgcatacgtggcggggatcttgggcctaggagaggtttactccggtgtcctcacggttggggtcgcgttga

SEQ ID NO: 92157 - DNA, 75 bp, Artificial Sequence
  Synthetic
tctccgcttacgtggcggggatcttgggcctaggagaggtttactccggtgtcctcacggttggggtcgcgttga

SEQ ID NO: 92158 - DNA, 75 bp, Artificial Sequence
  Synthetic
tctccgcctacgtggcggggatcttgggcctaggagaggtttactccggtgtcctcacggttggggtcgcgttga

SEQ ID NO: 92159 - DNA, 75 bp, Artificial Sequence
  Synthetic
tctccgcgtacgtggcggggatcttgggcctaggagaggtttactccggtgtcctcacggttggggtcgcgttga

SEQ ID NO: 92160 - DNA, 75 bp, Artificial Sequence
  Synthetic
tctcggcatacgtggcggggatcttgggcctaggagaggtttactccggtgtcctcacggttggggtcgcgttga

SEQ ID NO: 92161 - DNA, 75 bp, Artificial Sequence
  Synthetic
tctcggcttacgtggcggggatcttgggcctaggagaggtttactccggtgtcctcacggttggggtcgcgttga

SEQ ID NO: 92162 - DNA, 75 bp, Artificial Sequence
  Synthetic
tctcggcctacgtggcggggatcttgggcctaggagaggtttactccggtgtcctcacggttggggtcgcgttga

SEQ ID NO: 92163 - DNA, 75 bp, Artificial Sequence
  Synthetic
tctcggcgtacgtggcggggatcttgggcctaggagaggtttactccggtgtcctcacggttggggtcgcgttga

SEQ ID NO: 92164 - DNA, 75 bp, Artificial Sequence
  Synthetic
actgtactggggtccaggccttttgagcctgggatcacgtggcagtcatgttcctgtaggtcgaatgggtcccgc

SEQ ID NO: 92165 - DNA, 75 bp, Artificial Sequence
  Synthetic
ttaaagtgggaaagtgagttttggagatggactgaacagctggcctccaactactggattctggaatatctctgg

SEQ ID NO: 92166 - DNA, 75 bp, Artificial Sequence
  Synthetic
tgactgccccaacggtccctgggtgtggcaaccggccttttgccaagcaattggctggggcgaccctatcactca

SEQ ID NO: 92167 - DNA, 75 bp, Artificial Sequence
  Synthetic
ctactggattctggaatatctctggaaagtgccttttgacttctggcggggagtgatgagcttgacccccttgtt

SEQ ID NO: 92168 - DNA, 75 bp, Artificial Sequence
  Synthetic
ccattaccatttccttgcgcacagtgccggcgtcggcagaactgtcgatgcagcggcgaggtcgcacgggaagag

SEQ ID NO: 92169 - DNA, 75 bp, Artificial Sequence
  Synthetic
tcgatgtgtggagtttggtaccagttggctcagccagttgtaccatagccgcactcgggtcatcggatcgcgacg

SEQ ID NO: 92170 - DNA, 75 bp, Artificial Sequence
  Synthetic
ttggggtcacgcccctttgaccgcgggttgacatggcagtcttgttcttgtagggcgaatggctcacgcattcct

SEQ ID NO: 92171 - DNA, 75 bp, Artificial Sequence
  Synthetic
ggtcccctgtgccacgtgcattctggacaggcggcctgcttcgtgcggctcctgtgtgcgggactgctggcccga

SEQ ID NO: 92172 - DNA, 75 bp, Artificial Sequence
  Synthetic
tcatgcccccagtacgtctacggtgctgtttcagtgacatgcgtttggggttccgtgtcttggtttgcaaccaca

SEQ ID NO: 92173 - DNA, 75 bp, Artificial Sequence
  Synthetic
tgccagctgcaccatagccgctctcgggtcatcggatcgtgacaccgtggtggagctctccgagtgggggatccc

SEQ ID NO: 92174 - DNA, 75 bp, Artificial Sequence
  Synthetic
cgctactgctgaggtggggcaacgacttgccatccaaagtggccggccaccacattgtggacgacctggtcagac

SEQ ID NO: 92175 - DNA, 75 bp, Artificial Sequence
  Synthetic
gggttcttcccgggagtccctccgcttaacaactgcatgcttctcttcctggggggttccgaggcattggggggt

SEQ ID NO: 92176 - DNA, 75 bp, Artificial Sequence
  Synthetic
cttgccatccaaagtggccggccaccacattgtggacgacctggtcagacgactcggtgtcgcagagggctacgt

SEQ ID NO: 92177 - DNA, 75 bp, Artificial Sequence
  Synthetic
aggggccccctgggcaaccaggggagaggcaacccggtgcggtcgcccctgggttttgggtcctacaccatgacc

SEQ ID NO: 92178 - DNA, 75 bp, Artificial Sequence
  Synthetic
caggtgaactgtgattggtcagtgatgaccctgtcgatcggggaagtgctggcattggcacaggctaagacagcc

SEQ ID NO: 92179 - DNA, 75 bp, Artificial Sequence
  Synthetic
ctgcctgctgccaacgccgctgtagctggggaggtgtttgcgggcccagccttgtcctggtgtctgggtctgccc

SEQ ID NO: 92180 - DNA, 75 bp, Artificial Sequence
  Synthetic
tgaaatgtcccacaccagccattgagcctcccaccgggacgtttgggttcttccctggagtgccgccccttaaca

SEQ ID NO: 92181 - DNA, 75 bp, Artificial Sequence
  Synthetic
ctcacgggggggttctatgaacccctggtgcgcaggtgttcggagctgatggggcgccgaaatccggtttgcccg

SEQ ID NO: 92182 - DNA, 75 bp, Artificial Sequence
  Synthetic
tggtgcgcaggtgttcggagctgatggggcgccgaaatccggtttgcccggggtacgcatggctgtcctcgggta

SEQ ID NO: 92183 - DNA, 75 bp, Artificial Sequence
  Synthetic
gtggacaagctcttcgccggagggtgggctgcggttgtaggccattgccacagcgtcatagctgcggcggtggcg

SEQ ID NO: 92184 - DNA, 75 bp, Artificial Sequence
  Synthetic
accatggcgggggctttcatgggtggtgctagcgtgtccccctcgctggtcacggtcctcttgggggccgtgggc

SEQ ID NO: 92185 - DNA, 75 bp, Artificial Sequence
  Synthetic
ccagctggcggtcttaggattgccggctgctcacgccgccgtggcgggggaggtgtttgcgggtccagccctgtc

SEQ ID NO: 92186 - DNA, 75 bp, Artificial Sequence
  Synthetic
cacggtcctcttgggggccgtgggcggttgggagggcgttgtcaacgccgccagcttggtcttcgacttcatggc

SEQ ID NO: 92187 - DNA, 75 bp, Artificial Sequence
  Synthetic
aggcggtgcgccagcgggtggtgcggagccccctcggggaggggcggccgaccaaaccgttgaccatagcctggt

SEQ ID NO: 92188 - DNA, 75 bp, Artificial Sequence
  Synthetic
atggtggtggtgttcggtgtgttggtggtggtggattgggtgttggtggtggtggtggtgtggtggtgttggtgg

SEQ ID NO: 92189 - DNA, 75 bp, Artificial Sequence
  Synthetic
gcctcaacgtctcatgttccttgtgttgtggaagctcgctcggggggctttcccgctggctctcttgatggggat

SEQ ID NO: 92190 - DNA, 75 bp, Artificial Sequence
  Synthetic
ggttgaaccggctgctaaccacacttcctcggtcttcatgcattccggacagctacttccaacaggccgactact

SEQ ID NO: 92191 - DNA, 75 bp, Artificial Sequence
  Synthetic
acatgacattcgaggttgacacgtcggtcttgggatgggtggttgctagtgtggttgcttgggccatagcgctcc

SEQ ID NO: 92192 - DNA, 75 bp, Artificial Sequence
  Synthetic
cacgacggtccggctggtctccaagatgtgcgcgcggggagcttacctattcgaccacatgggttcgttctcgcg

SEQ ID NO: 92193 - DNA, 75 bp, Artificial Sequence
  Synthetic
ggtcttgggatgggtggttgctagtgtggttgcttgggccatagcgctcctgagctcgatgagcgcaggggggtg

SEQ ID NO: 92194 - DNA, 75 bp, Artificial Sequence
  Synthetic
aggtggacgaggttcaggttgggtatgtctgggacctgtgggagtggatcatgcgccaagtgcgcatggttatct

SEQ ID NO: 92195 - DNA, 75 bp, Artificial Sequence
  Synthetic
tacgccagagggttgtgcggagccccctcggggaggggcgtcccacaaagcctttgaccattgcttggtgcttgg

SEQ ID NO: 92196 - DNA, 75 bp, Artificial Sequence
  Synthetic
cctcggggaggggcgtcccacaaagcctttgaccattgcttggtgcttggcctcatacatctggccggacgctgt

SEQ ID NO: 92197 - DNA, 75 bp, Artificial Sequence
  Synthetic
ggggaggggtggtccggagaatggctgttggacggtcatgtggaaagtcgctgtttgtgtgggtgtgtgattacc

SEQ ID NO: 92198 - DNA, 75 bp, Artificial Sequence
  Synthetic
tggactgggctttggaggagctcctggtggctaggccctcgctgcggcgccttgcccgggtggttgagtgttgtg

SEQ ID NO: 92199 - DNA, 75 bp, Artificial Sequence
  Synthetic
ggagatgtgctaaatgggcaactcaaagatccagtttattcaaccaagctgtgccggcattactggatggggact

SEQ ID NO: 92200 - DNA, 75 bp, Artificial Sequence
  Synthetic
ggtggctaggccctcgctgcggcgccttgcccgggtggttgagtgttgtgtgatggctggcgaaagggcgaccac

SEQ ID NO: 92201 - DNA, 75 bp, Artificial Sequence
  Synthetic
acatgggctctttttcgcgcgctgtcaaggaacgcttgctagaatgggatgccgctctcgagcctctttcattca

SEQ ID NO: 92202 - DNA, 75 bp, Artificial Sequence
  Synthetic
ggagctaactcattgactccctgcacctgccaggccgagtcctgttgggtcatacgatctgacggggctctgtgc

SEQ ID NO: 92203 - DNA, 75 bp, Artificial Sequence
  Synthetic
gggcagtgcgttatgggtttacctgtagtcgcgcgccgtggtgatgaagttttgatcggcgttttccaagatgtg

SEQ ID NO: 92204 - DNA, 75 bp, Artificial Sequence
  Synthetic
tcgcctgtcctgtgcgatgaggggcacgcagtaggaatgctggtgtccgtgcttcattctggggggcgggttact

SEQ ID NO: 92205 - DNA, 75 bp, Artificial Sequence
  Synthetic
gcttgttgttcacaacattccatggggcttcttcccgaaccatcgccacacccgtgggggccctaaatccaagat

SEQ ID NO: 92206 - DNA, 75 bp, Artificial Sequence
  Synthetic
cacttttcatgcctaccggggccggcaagagcacgcgggtcccgttagagtacgggaatatggggcacaaagttc

SEQ ID NO: 92207 - DNA, 75 bp, Artificial Sequence
  Synthetic
acctcgctgaccccttgcacatgccaggcggagtcctgctgggtcatcagatccgacggggctttgtgccatggc

SEQ ID NO: 92208 - DNA, 75 bp, Artificial Sequence
  Synthetic
aggcggagtcctgctgggtcatcagatccgacggggctttgtgccatggcttgtccaagggagacaaggttgagc

SEQ ID NO: 92209 - DNA, 75 bp, Artificial Sequence
  Synthetic
gagaagctggcgggaaaacatccaagtgtattctgtgggcatgacacaacagcttttacgcgcatcacggactcc

SEQ ID NO: 92210 - DNA, 75 bp, Artificial Sequence
  Synthetic
gtgtattctgtgggcatgacacaacagcttttacgcgcatcacggactccccattgacgtattctacctatggta

SEQ ID NO: 92211 - DNA, 75 bp, Artificial Sequence
  Synthetic
tcaacacggctctttcgattctaaaagccttattcccacagagcgatgccacccggaagctgacagtcaggatgt

SEQ ID NO: 92212 - DNA, 75 bp, Artificial Sequence
  Synthetic
gtcttgtgcgacgagggacacgcagtgggaatgctggtgtcagtgctccattcaggtggtagggtgacggcggcc

SEQ ID NO: 92213 - DNA, 75 bp, Artificial Sequence
  Synthetic
tgggaatgctggtgtcagtgctccattcaggtggtagggtgacggcggcccgattcacacggccttggacccaag

SEQ ID NO: 92214 - DNA, 75 bp, Artificial Sequence
  Synthetic
tgcgatgaatgccacagccatgacccgacggtgttgttggggatagggcgagtgagggagctggcgcgtggttgt

SEQ ID NO: 92215 - DNA, 75 bp, Artificial Sequence
  Synthetic
acgcttcttttccctggggctgactgtagctgacgtggctagcctgtgtgagatggaaatccagaaccatacagc

SEQ ID NO: 92216 - DNA, 75 bp, Artificial Sequence
  Synthetic
tgggcaatgaacttacctttgaatgtgacaagtgtgaggcacggcaagagactttggcttccttctcctacatct

SEQ ID NO: 92217 - DNA, 75 bp, Artificial Sequence
  Synthetic
actgtggacacgatacaacagctttcacgaggatcactgactcgcccctcacgtactcaacctacggaaggtttt

SEQ ID NO: 92218 - DNA, 75 bp, Artificial Sequence
  Synthetic
cacgaggatcactgactcgcccctcacgtactcaacctacggaaggtttttggccaaccctaggcagatgctgcg

SEQ ID NO: 92219 - DNA, 75 bp, Artificial Sequence
  Synthetic
cgtggactcgatcgagcgcgctaggaggagtgctcaagcctgccaaagcatgggttacacttatgaggaggcaat

SEQ ID NO: 92220 - DNA, 75 bp, Artificial Sequence
  Synthetic
tgttgctgggtattgggcgggtccgggagctggcgcgggggtgtggagttcaactggttctctacgccaccgcca

SEQ ID NO: 92221 - DNA, 75 bp, Artificial Sequence
  Synthetic
ggagctggcgcgggggtgtggagttcaactggttctctacgccaccgccacgcctccgggctcgcccatgaccca

SEQ ID NO: 92222 - DNA, 75 bp, Artificial Sequence
  Synthetic
gtcgatgcagaggcgaggacgcacggggaggggcaggtcgggccggtactactacgcgggggttggcaaagctcc

SEQ ID NO: 92223 - DNA, 75 bp, Artificial Sequence
  Synthetic
atgggcatggcatccccctggagcggatgaggaccggtaggcacctggtattctgccactcaaaggcggagtgtg

SEQ ID NO: 92224 - DNA, 75 bp, Artificial Sequence
  Synthetic
acggggggttaatgctgttgcctattataggggtaaggacagttcaatcatcaaggatggtgacctggtggtgtg

SEQ ID NO: 92225 - DNA, 75 bp, Artificial Sequence
  Synthetic
ggccggtctgggcgttactactacgcgggggtgggcaaagcccctgctggtgtggtgaggtccgggccggtctgg

SEQ ID NO: 92226 - DNA, 75 bp, Artificial Sequence
  Synthetic
cggccaccacatagttgatgatctggttcgtcggctcggtgtggcggagggttacgtccgctgtgacgctgggcc

SEQ ID NO: 92227 - DNA, 75 bp, Artificial Sequence
  Synthetic
ggtacggaatggaacctgacctgacagcaaaccttctgagactgtacgacgactgcccttacaccgcagccgtcg

SEQ ID NO: 92228 - DNA, 75 bp, Artificial Sequence
  Synthetic
atttaccatcgaaagtggccggccatcacatagtggacgacttggtccgtcgcctgggtgtggccgagggttatg

SEQ ID NO: 92229 - DNA, 75 bp, Artificial Sequence
  Synthetic
cggggacgcgggccgtccccacagtttcaattgtggacaagctcttcgccgggggttgggcggctgtggtcggcc

SEQ ID NO: 92230 - DNA, 75 bp, Artificial Sequence
  Synthetic
tggcaccccatcacacggtgggtcatcatcccgcatgtgctaacttgcgcatttaggggtggaggcacaccgtct

SEQ ID NO: 92231 - DNA, 75 bp, Artificial Sequence
  Synthetic
gggatgatctacgcgtcatacaccgggtcacttgtggtggttacagactgggatgtgaaggggggtggcaacccc

SEQ ID NO: 92232 - DNA, 75 bp, Artificial Sequence
  Synthetic
agccccccgctggctgcggccgcctcttacctcatggggttgggcgttggaggcaacgcgcaggcgcgcttggcg

SEQ ID NO: 92233 - DNA, 75 bp, Artificial Sequence
  Synthetic
tccggtagaccatcggccggggggggaatctgcgccatcggatgccaagacagtgacagatgcggtggcagccat

SEQ ID NO: 92234 - DNA, 75 bp, Artificial Sequence
  Synthetic
gcacggccttgggcacccccgtggtgggtttaaccatggcgggggcgttcatgggtggtgctagcgtgtccccat

SEQ ID NO: 92235 - DNA, 75 bp, Artificial Sequence
  Synthetic
gacctcaaactcccgggcttggccgtccaccgcaagaaggccggagcactgcgcacgcgcatgcttcggtcgcgc

SEQ ID NO: 92236 - DNA, 75 bp, Artificial Sequence
  Synthetic
tcatggcagggaaactttcaacggaggacctgtggtatgccatcccagtgctcaccagtcccggggcgggccttg

SEQ ID NO: 92237 - DNA, 75 bp, Artificial Sequence
  Synthetic
tgtggacaagctcttcgccggcgggtgggcggccgtggtgggtcactgccacagcgtcatagctgcggcggtggc

SEQ ID NO: 92238 - DNA, 75 bp, Artificial Sequence
  Synthetic
accacgtggttaaaccgtctgctgaccacactccctcgttcatcatgcatcccagacagctatttccaacaagcc

SEQ ID NO: 92239 - DNA, 75 bp, Artificial Sequence
  Synthetic
acagcgtcatagctgcggcggtggctgcttacggggcttctaggagtcccccgttggctgccgcggcttcctacc

SEQ ID NO: 92240 - DNA, 75 bp, Artificial Sequence
  Synthetic
cccggcactgggtgcaagccccagaaaccgacgcctatttaaacagacgttaagaaccggcgccgacccggcgac

SEQ ID NO: 92241 - DNA, 75 bp, Artificial Sequence
  Synthetic
tgcttacggggcttctaggagtcccccgttggctgccgcggcttcctacctaatggggttgggcgtcggaggcaa

SEQ ID NO: 92242 - DNA, 75 bp, Artificial Sequence
  Synthetic
ccacactccctcgttcatcatgcatcccagacagctatttccaacaagccgactactatgacaaagtttccgcca

SEQ ID NO: 92243 - DNA, 75 bp, Artificial Sequence
  Synthetic
ccctgggcaccccggtcgttggtttgaccatggccggggcgttcatggggggggccagcgtctccccgtccttgg

SEQ ID NO: 92244 - DNA, 75 bp, Artificial Sequence
  Synthetic
gaccatggccggggcgttcatggggggggccagcgtctccccgtccttggtcaccattttactgggggccgtggg

SEQ ID NO: 92245 - DNA, 75 bp, Artificial Sequence
  Synthetic
tggggtatgtgtgggacctgtgggaatggatcatgcgccaagtgcggatggtggtgtccaggctccgggccctct

SEQ ID NO: 92246 - DNA, 75 bp, Artificial Sequence
  Synthetic
cagggaaattatcatcagaagacctgtggtatgccatcccggtactcactagcccgggcgcgggcctcgcgggga

SEQ ID NO: 92247 - DNA, 75 bp, Artificial Sequence
  Synthetic
gaatggctcctagacggacatgtggagagtcggtgcctctgtgggtgcgtcataacaggtgatgtgttgaatggg

SEQ ID NO: 92248 - DNA, 75 bp, Artificial Sequence
  Synthetic
acgtacggcccacgtcgcccttcaatgtctctcttgaccaataggcttagccggcgagttgacaagggccagtgg

SEQ ID NO: 92249 - DNA, 75 bp, Artificial Sequence
  Synthetic
gtggtatgccatcccggtactcactagcccgggcgcgggcctcgcggggatcgcgctcgggttggtgttgtattc

SEQ ID NO: 92250 - DNA, 75 bp, Artificial Sequence
  Synthetic
ggggactgtaccggtcaacatgctggggtatggggagacatcccccctgctcgcgtcggacactccgaaggtggt

SEQ ID NO: 92251 - DNA, 75 bp, Artificial Sequence
  Synthetic
tgccaccttcatcgtgcatccctgacagttacttccagcaagccgattactgtaacaaggtctcggccgtgctcc

SEQ ID NO: 92252 - DNA, 75 bp, Artificial Sequence
  Synthetic
cagttacttccagcaagccgattactgtaacaaggtctcggccgtgctccggcgcctgagcctcacccgaacagt

SEQ ID NO: 92253 - DNA, 75 bp, Artificial Sequence
  Synthetic
tggtgatccggcgcacttcctgttacaagctgctgcgccagcaaattctttcagctgctgttgctgagccctatt

SEQ ID NO: 92254 - DNA, 75 bp, Artificial Sequence
  Synthetic
acgtctgggacttgtgggagtggatcatgcgtcaagtgcgcatggtcatggccagactccgagccctctgtcccg

SEQ ID NO: 92255 - DNA, 75 bp, Artificial Sequence
  Synthetic
acgtctgggacttgtgggagtggatcatgcgtcaagtgcgcatggtcatggccagactccgtgccctctgtcccg

SEQ ID NO: 92256 - DNA, 75 bp, Artificial Sequence
  Synthetic
acgtctgggacttgtgggagtggatcatgcgtcaagtgcgcatggtcatggccagactccgcgccctctgtcccg

SEQ ID NO: 92257 - DNA, 75 bp, Artificial Sequence
  Synthetic
acgtctgggacttgtgggagtggatcatgcgtcaagtgcgcatggtcatggccagactccgggccctctgtcccg

SEQ ID NO: 92258 - DNA, 75 bp, Artificial Sequence
  Synthetic
catgcgtcaagtgcgcatggtcatggccagactccgagccctctgtcccgtggtgtcactacccttgtggcactg

SEQ ID NO: 92259 - DNA, 75 bp, Artificial Sequence
  Synthetic
catgcgtcaagtgcgcatggtcatggccagactccgtgccctctgtcccgtggtgtcactacccttgtggcactg

SEQ ID NO: 92260 - DNA, 75 bp, Artificial Sequence
  Synthetic
catgcgtcaagtgcgcatggtcatggccagactccgcgccctctgtcccgtggtgtcactacccttgtggcactg

SEQ ID NO: 92261 - DNA, 75 bp, Artificial Sequence
  Synthetic
catgcgtcaagtgcgcatggtcatggccagactccgggccctctgtcccgtggtgtcactacccttgtggcactg

SEQ ID NO: 92262 - DNA, 75 bp, Artificial Sequence
  Synthetic
tctgcctggaaggcggatgccttgtggccttgggttgcacagtttgtactgaccgctgctggccactgtatcagg

SEQ ID NO: 92263 - DNA, 75 bp, Artificial Sequence
  Synthetic
gctgtctttgtgggtgcgtgataactggtgacgtactgaatggacaactcaaggagccagtttactctacaaagc

SEQ ID NO: 92264 - DNA, 75 bp, Artificial Sequence
  Synthetic
gtccgcggcccaactggttggggaactcgggagcctttacgggcccttgtcggtgtctgcctacgtggcgggcat

SEQ ID NO: 92265 - DNA, 75 bp, Artificial Sequence
  Synthetic
ggtgaaacctcacctctcttggcctcagacaccccgaaggtggtaccttttgggacgtcgggctgggctgaggtg

SEQ ID NO: 92266 - DNA, 75 bp, Artificial Sequence
  Synthetic
tgacgcgacgggtctacccggtcccgaacttgacgtgtgcagtagaatgtgagctgaagtgggaaagtgagtttt

SEQ ID NO: 92267 - DNA, 75 bp, Artificial Sequence
  Synthetic
gcaccaactgcggcttaggaacgtagcgccctctgaggtttcatccgaggtgtccatagacattgggacggagac

SEQ ID NO: 92268 - DNA, 75 bp, Artificial Sequence
  Synthetic
tttttctcttggtgaccatggcggggatgtcgcaaggcgctcccgcctcggtgatggggtctcgccccttcgaac

SEQ ID NO: 92269 - DNA, 75 bp, Artificial Sequence
  Synthetic
tgtggtgagaccggtggggtccttgttggtagccgacacaaccaaggtgtacgtcaccaacccagacaatgttgg

SEQ ID NO: 92270 - DNA, 75 bp, Artificial Sequence
  Synthetic
gcctgtgtggggagaagacatcccccgcactccatcgcctgcacttatctcggttacggagagcagctcagatga

SEQ ID NO: 92271 - DNA, 75 bp, Artificial Sequence
  Synthetic
gagccacggacaacatcagtggcccctttcttgtccccagtatgtctacggtgccgtttcagtgacctgcgtgtg

SEQ ID NO: 92272 - DNA, 75 bp, Artificial Sequence
  Synthetic
cggttacggagagcagctcagatgagaagaccccgtcggtgtcctcctcgcaggaggataccccgtcctcagact

SEQ ID NO: 92273 - DNA, 75 bp, Artificial Sequence
  Synthetic
ctttcttgtccccagtatgtctacggtgccgtttcagtgacctgcgtgtggggttccgtgtcttggtttgcttcc

SEQ ID NO: 92274 - DNA, 75 bp, Artificial Sequence
  Synthetic
acgtcaccaacccagacaatgttgggaggagagtggacaaagtgaccttctggcgcgcccctcgggttcatgata

SEQ ID NO: 92275 - DNA, 75 bp, Artificial Sequence
  Synthetic
gacagctgagggggaggacagtgtcttcaacgtggctctttctgtactaaaagccttgtttccacagagcgatgc

SEQ ID NO: 92276 - DNA, 75 bp, Artificial Sequence
  Synthetic
tccggatagctgaaaagctcatcctgggagacccggggcgggttgccaaggcggtgttggggggggcttacgcct

SEQ ID NO: 92277 - DNA, 75 bp, Artificial Sequence
  Synthetic
gcttgaattgcaggttgggtgcttggtgggcaatgaacttacctttgaatgtgacaagtgtgaggcaaggcaaga

SEQ ID NO: 92278 - DNA, 75 bp, Artificial Sequence
  Synthetic
tagggagatgctcaagctgtgggagtctaaaaagaccccttgtgccatctgtgtggacgccacatgcttcgacag

SEQ ID NO: 92279 - DNA, 75 bp, Artificial Sequence
  Synthetic
gaggccggttggttcgctgttggtggccgacaccaccaaggtgtatgtgaccaacccggacaacgtggggagaag

SEQ ID NO: 92280 - DNA, 75 bp, Artificial Sequence
  Synthetic
gccgacaccaccaaggtgtatgtgaccaacccggacaacgtggggagaagagtggacaaggtgaccttctggcgt

SEQ ID NO: 92281 - DNA, 75 bp, Artificial Sequence
  Synthetic
acaactgcatgctcttgggcactgaggtgtccgaggtgctgggcggcgcggggctcacgggggggttctatgaac

SEQ ID NO: 92282 - DNA, 75 bp, Artificial Sequence
  Synthetic
ccctggtgcgacggtgttcagagttagctgggcggcgaaatccggtctgtccggggttcgcgtggctttcctcgg

SEQ ID NO: 92283 - DNA, 75 bp, Artificial Sequence
  Synthetic
gcgagtaactgcctgacttgttacatcaaggtccgagccgcgtgtgagcgtgtggggctgaaaaatgtctcactc

SEQ ID NO: 92284 - DNA, 75 bp, Artificial Sequence
  Synthetic
tgtcctactctatctgatgaagctggctgaggctaggctggtaccgctgattcttctcctgctgtggtggtgggt

SEQ ID NO: 92285 - DNA, 75 bp, Artificial Sequence
  Synthetic
gggaggtcttcgcgggtccagccttgtcctggtgtcttgggctccccttcgtgagtatgatactgggtttggcaa

SEQ ID NO: 92286 - DNA, 75 bp, Artificial Sequence
  Synthetic
gtgttgtggaagctcgctcggggagcattcccactggctttactgatggggatttcagccacccgcggccgcacc

SEQ ID NO: 92287 - DNA, 75 bp, Artificial Sequence
  Synthetic
gtcgcgcggttgggcggagttggctcggggcctgttgtggcatccaggcctccggctccctccccctgagattgc

SEQ ID NO: 92288 - DNA, 75 bp, Artificial Sequence
  Synthetic
tgtcagctgcctgtcagcgggtggggctgaaaaatgtctcgctactgatagcaggtgacgactgtctgatcatat

SEQ ID NO: 92289 - DNA, 75 bp, Artificial Sequence
  Synthetic
actggtctcccggccttcgttgcggcgcttggctcgggtggtggaatgctgtgtgatggcgggtgagaaggccac

SEQ ID NO: 92290 - DNA, 75 bp, Artificial Sequence
  Synthetic
atttcttcctgacaacggactttcggaggccgctcgctcgcatgtcgagtgagtacagtgacccgatggcttcgg

SEQ ID NO: 92291 - DNA, 75 bp, Artificial Sequence
  Synthetic
gtgtgatggcgggtgagaaggccacaaccgtccggctggtgtccaagatgtgctcgcggggggcctatttgttcg

SEQ ID NO: 92292 - DNA, 75 bp, Artificial Sequence
  Synthetic
gagtacagtgacccgatggcttcggccatcggttacatcctcctttacccctggcatcccatcacacggtgggtc

SEQ ID NO: 92293 - DNA, 75 bp, Artificial Sequence
  Synthetic
cgtttaggggtggtggtacaccgtctgatccggtctggtgccaggttcatggaaattactacaagtttcccctgg

SEQ ID NO: 92294 - DNA, 75 bp, Artificial Sequence
  Synthetic
gtgaatcatttgcctccagggtttgtccccactgcaccagtagtcatccgtcggtgcggtaagggcttccttgga

SEQ ID NO: 92295 - DNA, 75 bp, Artificial Sequence
  Synthetic
gtcacgaaggccgctttgactggtcgggaccctgacctacatccagggaatgtcatggtattggggacggcaacg

SEQ ID NO: 92296 - DNA, 75 bp, Artificial Sequence
  Synthetic
ttctgccttgagggtggatgccttgtggccttgggctgcacaatttgtaatgaccgctgctggccactgtatcag

SEQ ID NO: 92297 - DNA, 75 bp, Artificial Sequence
  Synthetic
gcggggttagccgtgagacctggcaagtccgctgcccagttggtgggggagctcggaggcctttacgggcccttg

SEQ ID NO: 92298 - DNA, 75 bp, Artificial Sequence
  Synthetic
gctcggaggcctttacgggcccttgtccgtgtccgcatacgttgcgggcattcttgggctcggggaggtgtactc

SEQ ID NO: 92299 - DNA, 75 bp, Artificial Sequence
  Synthetic
gccaggccgagtcctgttgggtcattagatccgatggagctttgtgccatggcttgagcaagggagacaaggtgg

SEQ ID NO: 92300 - DNA, 75 bp, Artificial Sequence
  Synthetic
cctgtcctgtgcgacgaagggcacgcagtaggaatgctcgtgtcagtgctccactctgggggtcgggtgaccgcg

SEQ ID NO: 92301 - DNA, 75 bp, Artificial Sequence
  Synthetic
cgaggagtgatgagcctgacgcccctgttggtgtgcgtcgcggccctgctcctgcttgagcaaaggattgtcatg

SEQ ID NO: 92302 - DNA, 75 bp, Artificial Sequence
  Synthetic
cagtaggaatgctcgtgtcagtgctccactctgggggtcgggtgaccgcggcacgcttcactcggccgtggaccc

SEQ ID NO: 92303 - DNA, 75 bp, Artificial Sequence
  Synthetic
tgttggtgtgcgtcgcggccctgctcctgcttgagcaaaggattgtcatggttttcctgctcgtaaccatggcgg

SEQ ID NO: 92304 - DNA, 75 bp, Artificial Sequence
  Synthetic
cctggactgacatggcagtcctgctcttgcagggctaacgggtcgcacgtatcgaccggggaacgggtttgggat

SEQ ID NO: 92305 - DNA, 75 bp, Artificial Sequence
  Synthetic
tgtttatgccgacgggggccgggaagagcacccgggtcccgttggagtacggcaacatgggccacaaagtcctaa

SEQ ID NO: 92306 - DNA, 75 bp, Artificial Sequence
  Synthetic
cggttggcggggaaacatcccagcatttactgtgggcacgacacaacagcattcacaaggatcactgattcccca

SEQ ID NO: 92307 - DNA, 75 bp, Artificial Sequence
  Synthetic
tttactgtgggcacgacacaacagcattcacaaggatcactgattccccattgacgtattctacctatggaaggt

SEQ ID NO: 92308 - DNA, 75 bp, Artificial Sequence
  Synthetic
gacgagtgccatagtcatgaccctacggtgttgctggggattgggagagtcagggagttggcgcgtggctgcggg

SEQ ID NO: 92309 - DNA, 75 bp, Artificial Sequence
  Synthetic
gttctgccagctgcaccatagctgcgctcggtaggtcggatcgcgacaccgtggctgagctctccgagtggggga

SEQ ID NO: 92310 - DNA, 75 bp, Artificial Sequence
  Synthetic
cagggagttggcgcgtggctgcggggtccagttggtcctctacgccaccgccacccctcctggctcccctatgac

SEQ ID NO: 92311 - DNA, 75 bp, Artificial Sequence
  Synthetic
tttatgggcacggcataccccttgagcggatgcggaccggtaggcacctcgtgttctgtcattcaaaggcagagt

SEQ ID NO: 92312 - DNA, 75 bp, Artificial Sequence
  Synthetic
catcttggccccggccacccacgcttgtcgagcgaatgggcaatatttcctcacaaattgttgcgccccggagga

SEQ ID NO: 92313 - DNA, 75 bp, Artificial Sequence
  Synthetic
tattatcggggaaaggacagttcaatcatcaaagatggggacctcgtggtgtgtgctacagacgcgctctccacg

SEQ ID NO: 92314 - DNA, 75 bp, Artificial Sequence
  Synthetic
tttgcactgaccgatgctggccactgtatcaggcgggtttggctgtgcggcctggcaagtccgcggcccaactgg

SEQ ID NO: 92315 - DNA, 75 bp, Artificial Sequence
  Synthetic
gggtacactgggaacttcgattctgttaccgactgtgggttggtggtggaggaggtcgttgaggtgacccttgat

SEQ ID NO: 92316 - DNA, 75 bp, Artificial Sequence
  Synthetic
ggaggtcgttgaggtgacccttgatcccaccattaccatctccttgcgcacagtgcccgcgtcggcagaactgtc

SEQ ID NO: 92317 - DNA, 75 bp, Artificial Sequence
  Synthetic
cagtgcccgcgtcggcagaactgtcgatgcagcggcgaggtcgcacaggtagaggtcggtccgggcggtactact

SEQ ID NO: 92318 - DNA, 75 bp, Artificial Sequence
  Synthetic
gggcaaaagtgcgcggcgtcaattggcccctcctggtgggtgttcagcggacgatgtgtcgggaaacactgtcgc

SEQ ID NO: 92319 - DNA, 75 bp, Artificial Sequence
  Synthetic
gccggtcgctcacgctgccgtggcgggagaggtattcgcgggtccagccttgtcctggtgtcttgggcttccctt

SEQ ID NO: 92320 - DNA, 75 bp, Artificial Sequence
  Synthetic
ggagaggtattcgcgggtccagccttgtcctggtgtcttgggcttcccttcgtgagtatgatcctaggcttggca

SEQ ID NO: 92321 - DNA, 75 bp, Artificial Sequence
  Synthetic
atgatttaccatcgagagtggccggccaccacatcgtggacgacctggtcagaaggctcggtgtggcggagggtt

SEQ ID NO: 92322 - DNA, 75 bp, Artificial Sequence
  Synthetic
acccattggagccacggacaaaatcagtggcccctctcatgcccccagtttgtctacgggtctgtctcagtcact

SEQ ID NO: 92323 - DNA, 75 bp, Artificial Sequence
  Synthetic
ggggggatgatctacgcgtcctacaccgggtccctagtggtggtgacagactgggatgtgaaggggggtggcaac

SEQ ID NO: 92324 - DNA, 75 bp, Artificial Sequence
  Synthetic
tttgatgtcaccttcgaagtggacacgtcagttctgggatgggtggtggccagcgtggtagcctgggccatagcg

SEQ ID NO: 92325 - DNA, 75 bp, Artificial Sequence
  Synthetic
cagcgtggtagcctgggccatagcgctcctgagctccatgagcgcgggaggctggaggcacaaggctgtgatcta

SEQ ID NO: 92326 - DNA, 75 bp, Artificial Sequence
  Synthetic
gcgctcggctcgggtggtggaatgctgtgtgatggcgggagagaaggccactaccgtcagactggtgtccaagat

SEQ ID NO: 92327 - DNA, 75 bp, Artificial Sequence
  Synthetic
accttatggggttgggcgtcggaggcaacgcacaggcacggttggcctctgctctcctactgggggctgcgggta

SEQ ID NO: 92328 - DNA, 75 bp, Artificial Sequence
  Synthetic
gctctcctactgggggctgcgggtactgctctggggacccccgtggttggtctaaccatggcgggggccttcatg

SEQ ID NO: 92329 - DNA, 75 bp, Artificial Sequence
  Synthetic
gggcggctgggagggcgtggtcaacgctgctagccttgtcttcgacttcatggcagggaagttgtctacggacga

SEQ ID NO: 92330 - DNA, 75 bp, Artificial Sequence
  Synthetic
gctgctagccttgtcttcgacttcatggcagggaagttgtctacggacgacctgtggtatgccatcccggtgctg

SEQ ID NO: 92331 - DNA, 75 bp, Artificial Sequence
  Synthetic
cccgtggtcgctcgccgcggtgatgaggttctgatcggtgtctttcaggatgtgaaccatttgcctccggggttt

SEQ ID NO: 92332 - DNA, 75 bp, Artificial Sequence
  Synthetic
actagccctggggcgggccttgcggggatcgccctggggttggtgctgtactcagctaacaactctggcactact

SEQ ID NO: 92333 - DNA, 75 bp, Artificial Sequence
  Synthetic
tgacagttacttccaacaggccgactattgtgacaaagtctcagccatgctcaggcgcttgagcctcactcgcac

SEQ ID NO: 92334 - DNA, 75 bp, Artificial Sequence
  Synthetic
tattgtgacaaagtctcagccatgctcaggcgcttgagcctcactcgcaccgtggtggccctggtcaacagggaa

SEQ ID NO: 92335 - DNA, 75 bp, Artificial Sequence
  Synthetic
tgtagctggtgaggtttttgcgggccctgccctgtcctggtgtctggggctcccggtcgtcagtatgatactagg

SEQ ID NO: 92336 - DNA, 75 bp, Artificial Sequence
  Synthetic
cacccctgtgggagcccttaatcctaggtggtggtctgccagtgatgatgtcactgtgtacccactcccagatgg

SEQ ID NO: 92337 - DNA, 75 bp, Artificial Sequence
  Synthetic
gatcatgcgtcaagtgcgtatggtcatttcaagggtccgggcactctgtcccgtggtgtcgctacctctgtggca

SEQ ID NO: 92338 - DNA, 75 bp, Artificial Sequence
  Synthetic
tgttccttgtgttgtggaagctcgctcggggagctttcccgctggctcttctgatggggatttcggcgacccgcg

SEQ ID NO: 92339 - DNA, 75 bp, Artificial Sequence
  Synthetic
tcagatctgacggggctttgtgccatggcttgagcaagggagacaaggtagagctggatgtggccatggaggtgt

SEQ ID NO: 92340 - DNA, 75 bp, Artificial Sequence
  Synthetic
ccgtggtgtcgctacctctgtggcactgcggggaggggtggtccggagaatggttgttggacggtcatgtggaaa

SEQ ID NO: 92341 - DNA, 75 bp, Artificial Sequence
  Synthetic
tggcttgagcaagggagacaaggtagagctggatgtggccatggaggtgtccgacttccgtggctcttccgggtc

SEQ ID NO: 92342 - DNA, 75 bp, Artificial Sequence
  Synthetic
ttcactctgggggtcgggtgacagcggcgcgattcactcggccgtggacccaagtccctacagacgccaaaacca

SEQ ID NO: 92343 - DNA, 75 bp, Artificial Sequence
  Synthetic
ggcgcgattcactcggccgtggacccaagtccctacagacgccaaaaccaccaccgagcccccaccggtaccggc

SEQ ID NO: 92344 - DNA, 75 bp, Artificial Sequence
  Synthetic
tacggggaaacctcgcccctgctcgcctctgacacgcccaaggtggtgccctttggcacgtctgggtgggcggag

SEQ ID NO: 92345 - DNA, 75 bp, Artificial Sequence
  Synthetic
agagcacccggttcccgttggagtacggcaacatgggtcacaaagtccttatcctaaacccgtcagtcgccacag

SEQ ID NO: 92346 - DNA, 75 bp, Artificial Sequence
  Synthetic
ggcccaccaaacccctgacgttcgcttggtgcttggcctcgtacatctggccggatgctgtgatgatggtggtgg

SEQ ID NO: 92347 - DNA, 75 bp, Artificial Sequence
  Synthetic
cggcaacatgggtcacaaagtccttatcctaaacccgtcagtcgccacagtgcgggccatgggtccgtacatgga

SEQ ID NO: 92348 - DNA, 75 bp, Artificial Sequence
  Synthetic
ctttcactagggttacagattctcccctgacgtattccacctacggtaggttcctagccaaccctaggcagatgc

SEQ ID NO: 92349 - DNA, 75 bp, Artificial Sequence
  Synthetic
ccattgacggggagcgctacaccttaccgcaccagttgcggatgaggaacgtggcgccctctgaggtttcatcag

SEQ ID NO: 92350 - DNA, 75 bp, Artificial Sequence
  Synthetic
cctgacgtattccacctacggtaggttcctagccaaccctaggcagatgctacggggggtgtctgtggtcatatg

SEQ ID NO: 92351 - DNA, 75 bp, Artificial Sequence
  Synthetic
tcagggagctggcgcgtggctgtggggtccaactggtcctctatgccaccgctacgcctcctggttctccaatgg

SEQ ID NO: 92352 - DNA, 75 bp, Artificial Sequence
  Synthetic
aaagctggatgtgggtgaaatccccttctatgggcatggcatccccctggagcggatgcgcactggcaggcatct

SEQ ID NO: 92353 - DNA, 75 bp, Artificial Sequence
  Synthetic
cctctaggggggtgaatgccattgcctattataggggcaaggacagttctatcatcaaagatggagacctcgtgg

SEQ ID NO: 92354 - DNA, 75 bp, Artificial Sequence
  Synthetic
gtcttcaacgtggctctttccgtactaaaagccttattcccacagagcgatgccacgcgtaagctaacggtcaag

SEQ ID NO: 92355 - DNA, 75 bp, Artificial Sequence
  Synthetic
atcatcaaagatggagacctcgtggtatgcgccactgacgcattatcgacggggtacactggcaacttcgattcc

SEQ ID NO: 92356 - DNA, 75 bp, Artificial Sequence
  Synthetic
tccgcttgaattgcaggttgggtgcttggtgggcaatgaacttacctttgaatgtgacaagtgtgaagcacggca

SEQ ID NO: 92357 - DNA, 75 bp, Artificial Sequence
  Synthetic
aatgtgacaagtgtgaagcacggcaagagaccttggcttccttctcctacatctggtcaggtgttccactgactc

SEQ ID NO: 92358 - DNA, 75 bp, Artificial Sequence
  Synthetic
cgggggtggtgcggtctgggccggtctggtcggcagtggaagccggagtgacctggtacggaatggaacctgact

SEQ ID NO: 92359 - DNA, 75 bp, Artificial Sequence
  Synthetic
gtggcggacaccaccaaggtgtacgtaaccaacccagacaatgtgggtaggagggtagacaaggtaaccttctgg

SEQ ID NO: 92360 - DNA, 75 bp, Artificial Sequence
  Synthetic
taaccaacccagacaatgtgggtaggagggtagacaaggtaaccttctggcgcgctcctagggttcatgacaagt

SEQ ID NO: 92361 - DNA, 75 bp, Artificial Sequence
  Synthetic
ggcccctcctggtgggtgttcagcggacaatgtgccgggaaacactgtcacctggcccgtccgatgacccccaat

SEQ ID NO: 92362 - DNA, 75 bp, Artificial Sequence
  Synthetic
tgccatgggctggggatctaaggtgtcggttaaggacttggccacccctgcggggaagatggctgtccatgaccg

SEQ ID NO: 92363 - DNA, 75 bp, Artificial Sequence
  Synthetic
aatgatttgccatcaaaattggccggccaccacattgtggacgacctggtcaggaggctcggtgtggcggaaggt

SEQ ID NO: 92364 - DNA, 75 bp, Artificial Sequence
  Synthetic
gtgttggggggggcttatgccttccagtacacccctaatcagcgggttaaggagatgctgaaactgtgggagtca

SEQ ID NO: 92365 - DNA, 75 bp, Artificial Sequence
  Synthetic
agtacacccctaatcagcgggttaaggagatgctgaaactgtgggagtcaaaaaagaccccgtgcgccatctgcg

SEQ ID NO: 92366 - DNA, 75 bp, Artificial Sequence
  Synthetic
ggagatgctgaaactgtgggagtcaaaaaagaccccgtgcgccatctgcgtggacgccacatgcttcgacagtag

SEQ ID NO: 92367 - DNA, 75 bp, Artificial Sequence
  Synthetic
cctggggaaatactatgcctctggcaccatggtcaccccggaaggggtgcccgtgggcgagaggtattgtaggtc

SEQ ID NO: 92368 - DNA, 75 bp, Artificial Sequence
  Synthetic
gggacgcgggccgtccccactgtatcaattgtggacaacctcttcgccggagggtgggctgcggttgtgggtcac

SEQ ID NO: 92369 - DNA, 75 bp, Artificial Sequence
  Synthetic
ccgtgggcgagaggtattgtaggtcctcaggtgtactcaccactagtgccagcaactgcttgacctgttacatta

SEQ ID NO: 92370 - DNA, 75 bp, Artificial Sequence
  Synthetic
cccaccgttggctgcagccgcttcctatctaatggggttgggcgtcgcaggcaatgcgcaggcgcgcttggcctc

SEQ ID NO: 92371 - DNA, 75 bp, Artificial Sequence
  Synthetic
tatctaatggggttgggcgtcgcaggcaatgcgcaggcgcgcttggcctctgctctccttttgggggctgcgggg

SEQ ID NO: 92372 - DNA, 75 bp, Artificial Sequence
  Synthetic
gggtggtgccagcgtgtccccctcgctggtcaccgtcctcttgggggcggtgggcggttgggagggcttggtcaa

SEQ ID NO: 92373 - DNA, 75 bp, Artificial Sequence
  Synthetic
agcgagtacagtgacccaatggcttcggccattggttacatcctcctttacccctggcaccccatcacacggtgg

SEQ ID NO: 92374 - DNA, 75 bp, Artificial Sequence
  Synthetic
acacttccccggtcttcttgcatcccagacagctatttccaacaggccgactattgtgacaaggtgtcagccatg

SEQ ID NO: 92375 - DNA, 75 bp, Artificial Sequence
  Synthetic
gctgtccaccgcaagaaggccggagcactacggacacgtatgctccggtcgcgcggttgggcagagctggctcgg

SEQ ID NO: 92376 - DNA, 75 bp, Artificial Sequence
  Synthetic
cccgtagtgtcactacccttgtggcactgcggggaggggtggtccggtgagtggttgctggacggtcatgtggag

SEQ ID NO: 92377 - DNA, 75 bp, Artificial Sequence
  Synthetic
ccaggggtctccccgctgggtaaaaagggcccggccttgggaggcatggtggttactaaccccctggcagggtca

SEQ ID NO: 92378 - DNA, 75 bp, Artificial Sequence
  Synthetic
ttatggggaaacttcacccctgctcgcctctgacacgcctaaggtggtaccctttggcacgtctggctgggcgga

SEQ ID NO: 92379 - DNA, 75 bp, Artificial Sequence
  Synthetic
agggcccggccttgggaggcatggtggttactaaccccctggcagggtcaaagcctgatggtgctaatgcactgc

SEQ ID NO: 92380 - DNA, 75 bp, Artificial Sequence
  Synthetic
gttggtaggtcgtaaatcccggtcatcttggtagccactataggtgggtcttaagggtgggtcaaggttcctctt

SEQ ID NO: 92381 - DNA, 75 bp, Artificial Sequence
  Synthetic
gaggccggggccatcttggccccggccacccatgcttgcggagctaaggggcaatatttcctcacaaattgctgc

SEQ ID NO: 92382 - DNA, 75 bp, Artificial Sequence
  Synthetic
ccttgcggggatcgctctcgggttggttttgtactcagctaacaactctggcactaccacttggttgaaccgtct

SEQ ID NO: 92383 - DNA, 75 bp, Artificial Sequence
  Synthetic
tgctggccactgtatcaggcgggattggctgtgcgtcccggcaagtccgccgctcaactcgtgggggagctgggg

SEQ ID NO: 92384 - DNA, 75 bp, Artificial Sequence
  Synthetic
cctggtgggcaatgaacttacctttgaatgtgacaagtgtgaggcacggcaggaaaccctggcgtccttctccta

SEQ ID NO: 92385 - DNA, 75 bp, Artificial Sequence
  Synthetic
gctaggggaggtttactctggcgtcctcacggtgggcgttgcgttgacgcgtcgggtctacccggtcccgaactt

SEQ ID NO: 92386 - DNA, 75 bp, Artificial Sequence
  Synthetic
gcatggtcatggctagactcagggccctctgccccgtggtgtcactacctttgtggcactgtggggaggggtggt

SEQ ID NO: 92387 - DNA, 75 bp, Artificial Sequence
  Synthetic
tggtgaggccggtggggtctttgttggtggcagacactactaaggtgtatgttaccaacccggacaatgttggga

SEQ ID NO: 92388 - DNA, 75 bp, Artificial Sequence
  Synthetic
ggtggcagacactactaaggtgtatgttaccaacccggacaatgttgggaggagggttgacaaggtgaccttttg

SEQ ID NO: 92389 - DNA, 75 bp, Artificial Sequence
  Synthetic
tgtgtgatcaccggtgatgttctaaatgggcaactcaaagaaccagtttactctaccaagctgtgccggcactat

SEQ ID NO: 92390 - DNA, 75 bp, Artificial Sequence
  Synthetic
tgatgagcctgacacccctgttggtgtgcgtggcggccctcctcctgctggagcagcgtgtgatcatggtctttc

SEQ ID NO: 92391 - DNA, 75 bp, Artificial Sequence
  Synthetic
ggttcccggccctttgaggtgggactgacctgggacacctgctcctgtagggcgaacggctcacgtgtgcctact

SEQ ID NO: 92392 - DNA, 75 bp, Artificial Sequence
  Synthetic
ggcgaacggctcacgtgtgcctactggggaaaaggtttgggatcgtgggaatgtctcactgttgtgtgattgccc

SEQ ID NO: 92393 - DNA, 75 bp, Artificial Sequence
  Synthetic
gggagatgctgaagctgtgggagtcaaagaagaccccgtgcgccatctgtgtggacgccacgtgcttcgacagta

SEQ ID NO: 92394 - DNA, 75 bp, Artificial Sequence
  Synthetic
ttcatccgaggtgtccattgacattgggacggagactgaagactcagaactgactgaggccgacttgccgccggc

SEQ ID NO: 92395 - DNA, 75 bp, Artificial Sequence
  Synthetic
gtggacgccacgtgcttcgacagtagcattactgaagaggacgtggccttggagacggagctttatgctctggcc

SEQ ID NO: 92396 - DNA, 75 bp, Artificial Sequence
  Synthetic
gggcgcgactccaagctcgatgtgtggagtttggtgcctactggctcagctagttgcaccatagccgcactcggg

SEQ ID NO: 92397 - DNA, 75 bp, Artificial Sequence
  Synthetic
atattgatgtcatcatggaggactgcagtacaccctctctttgtggtagtagccgagagatgcctgtgtggggag

SEQ ID NO: 92398 - DNA, 75 bp, Artificial Sequence
  Synthetic
ccagcctcgtgcggcacctgtgtgcgggactgctggcccgagaccgggtcagtgagattcccattccatcggtgc

SEQ ID NO: 92399 - DNA, 75 bp, Artificial Sequence
  Synthetic
aaggtgaaagccgcctgcgatcgggtgggcctcaaaaacgtgtccctcctgattgctggtgatgactgtctgatc

SEQ ID NO: 92400 - DNA, 75 bp, Artificial Sequence
  Synthetic
agtgtcccactcctgccattgagcctcctaccgggacgttcgggttcttccccggagtgcccccgcttaacaact

SEQ ID NO: 92401 - DNA, 75 bp, Artificial Sequence
  Synthetic
acgggggggttctacgagcccctggttcggcggtgttcagagttgatgggtcggcggaatccggtttgtccgggg

SEQ ID NO: 92402 - DNA, 75 bp, Artificial Sequence
  Synthetic
ggtgtatgttaccaacccagacaatgtgggaaggagggtggacaaggtgaccttctggcgtgctccgagggttca

SEQ ID NO: 92403 - DNA, 75 bp, Artificial Sequence
  Synthetic
gttggccgtcttgggcgtgccatcggttcaagccgccgtggctggggaggtgtttgcggggccggccttgtcatg

SEQ ID NO: 92404 - DNA, 75 bp, Artificial Sequence
  Synthetic
gttcaagccgccgtggctggggaggtgtttgcggggccggccttgtcatggtgcctgggccttcccttcgtgagt

SEQ ID NO: 92405 - DNA, 75 bp, Artificial Sequence
  Synthetic
atcatggcagtccttctgctcttactcgtggtggaggccggggccattctggccccggccacacatgcttgtagt

SEQ ID NO: 92406 - DNA, 75 bp, Artificial Sequence
  Synthetic
cccgcctcattgtgttcccccccctggacttccggatagctgaaaagctcatcctgggagacccgggtcgggtag

SEQ ID NO: 92407 - DNA, 75 bp, Artificial Sequence
  Synthetic
gctaaagggcaatatttcctcacaaattgctgtgccatggaggacatcgggttctgcctggagggtggatgcctg

SEQ ID NO: 92408 - DNA, 75 bp, Artificial Sequence
  Synthetic
gcacaaagctgtgatttacagaacgtggtgtaaggggtaccaggcgctgcgtcaacgggtggtgcggagccccct

SEQ ID NO: 92409 - DNA, 75 bp, Artificial Sequence
  Synthetic
tggtgtaaggggtaccaggcgctgcgtcaacgggtggtgcggagccccctcggggaggggcgtcccaccaagcct

SEQ ID NO: 92410 - DNA, 75 bp, Artificial Sequence
  Synthetic
aagtccgccgctcaactggtgggggaactcgggagcctttacgggcctctctctgtctcagcttacgtggctggg

SEQ ID NO: 92411 - DNA, 75 bp, Artificial Sequence
  Synthetic
actgggctttggaggagttgctggtctcacggccttcgttgcggcgtttggctcgggtggttgagtgttgtgtga

SEQ ID NO: 92412 - DNA, 75 bp, Artificial Sequence
  Synthetic
ctacattaaggtgaaagccgcctgtgagagggtggggctgaaaaatgtctcactcctcatagctggcgatgactg

SEQ ID NO: 92413 - DNA, 75 bp, Artificial Sequence
  Synthetic
aggggggcttatttgttcgaccatatgggctctttttcgcgcgccgtcaaggaacgcttggttgagtgggacgcg

SEQ ID NO: 92414 - DNA, 75 bp, Artificial Sequence
  Synthetic
tctggaaagtgccgtttgacttctggcggggagtgatgagcttgacccccctgttggtgtgcgtggcggcccttc

SEQ ID NO: 92415 - DNA, 75 bp, Artificial Sequence
  Synthetic
gcggggagtgatgagcttgacccccctgttggtgtgcgtggcggcccttctcttgttggagcaaaggattgtcat

SEQ ID NO: 92416 - DNA, 75 bp, Artificial Sequence
  Synthetic
gagccctagcaagctatgggtacgcgtgcgagccttcatatcatgcatcattggacacggcccccttctgctcca

SEQ ID NO: 92417 - DNA, 75 bp, Artificial Sequence
  Synthetic
tgctgccaggaccttgagctgcgggcagtgcgtcatggggttacccgtggtggcgcgccgcggcgacgaggtttt

SEQ ID NO: 92418 - DNA, 75 bp, Artificial Sequence
  Synthetic
gtgtactggggtccaggcctttcgagcctgggatcacctggcagtcctgcacctgcaggtcgaacgggtcccgcg

SEQ ID NO: 92419 - DNA, 75 bp, Artificial Sequence
  Synthetic
acctgcaggtcgaacgggtcccgcgtgatcacgggggagcgagtttgggatcgagggaacgtctcactgttgtgt

SEQ ID NO: 92420 - DNA, 75 bp, Artificial Sequence
  Synthetic
ccgcgcccgttgttatccggcggtgcggaaagggcttcctcggagtcacaaaggctgccttgacaggtcgggatc

SEQ ID NO: 92421 - DNA, 75 bp, Artificial Sequence
  Synthetic
cggaaagggcttcctcggagtcacaaaggctgccttgacaggtcgggatcctgacttacatccaggaaacgtcat

SEQ ID NO: 92422 - DNA, 75 bp, Artificial Sequence
  Synthetic
tggggttccgtgtcttggtttgcctccactggcggccgcgattccaagatcgatgtgtggagtttggtgccggtt

SEQ ID NO: 92423 - DNA, 75 bp, Artificial Sequence
  Synthetic
ccactggcggccgcgattccaagatcgatgtgtggagtttggtgccggttggctctgctagctgcaccatagccg

SEQ ID NO: 92424 - DNA, 75 bp, Artificial Sequence
  Synthetic
gtaccccctgcctgatggagccacctcgctgacgccttgtacatgccaggccgagtcctgttgggtcatcagatc

SEQ ID NO: 92425 - DNA, 75 bp, Artificial Sequence
  Synthetic
atgccctgcgccacatgtattctggacaggcggcctgcttcgtgcggttcctgtgtgcgggactgctggcccgaa

SEQ ID NO: 92426 - DNA, 75 bp, Artificial Sequence
  Synthetic
acgtggccatggaggtctctgatttccgtgggtcgtctggatcgccagtcctgtgcgacgagggacacgcagtag

SEQ ID NO: 92427 - DNA, 75 bp, Artificial Sequence
  Synthetic
gggcggcagagtcaccgctgctcgctttacgcggccgtggacccaggtaccaactgatgccaagaccactaccga

SEQ ID NO: 92428 - DNA, 75 bp, Artificial Sequence
  Synthetic
tgcctacgggggccgggaagagcacccgggtcccgctggagtacggcaacatgggccacaaggttctgattctca

SEQ ID NO: 92429 - DNA, 75 bp, Artificial Sequence
  Synthetic
gaggtgtccgaggcattgggtggggcgggcctcactgggggattctatgaaccactggtgcggcggtgttcagag

SEQ ID NO: 92430 - DNA, 75 bp, Artificial Sequence
  Synthetic
ccgggtcccgctggagtacggcaacatgggccacaaggttctgattctcaacccgtcggtcgccactgtgagggc

SEQ ID NO: 92431 - DNA, 75 bp, Artificial Sequence
  Synthetic
catgggcccttatatggagaaactggcgggcaagcatcccagcatttactgtgggcacgatacaacagctttcac

SEQ ID NO: 92432 - DNA, 75 bp, Artificial Sequence
  Synthetic
gcccggggtttgcatggctttcctctggtaggcctgatgggtttatacatgttcagggtcacttgcaggaggtgg

SEQ ID NO: 92433 - DNA, 75 bp, Artificial Sequence
  Synthetic
tgctgggcattgggcgggtccgggagctggcgcgtgggtgtggggtgcaactcgtgctctacgctaccgccacgc

SEQ ID NO: 92434 - DNA, 75 bp, Artificial Sequence
  Synthetic
gttaaccagctcgcagtcttaggactgcctgctgctcacgccgctgtggctggggaggtcttcgctggaccagcc

SEQ ID NO: 92435 - DNA, 75 bp, Artificial Sequence
  Synthetic
gatgtgggtgagatccccttctatgggcatggtatcccccttgagcgaatgcggactggcaggcatctcgtattc

SEQ ID NO: 92436 - DNA, 75 bp, Artificial Sequence
  Synthetic
ggcatggtatcccccttgagcgaatgcggactggcaggcatctcgtattctgccactcaaaggctgagtgcgaac

SEQ ID NO: 92437 - DNA, 75 bp, Artificial Sequence
  Synthetic
atgggcccacaacgcctgatgttccttgtgttgtggaagctcgctcggggagcttttccgctggccttactgatg

SEQ ID NO: 92438 - DNA, 75 bp, Artificial Sequence
  Synthetic
cgggggaaggacagttccatcattaaagacggagacttagtggtgtgcgctacagacgcgctatccactgggtac

SEQ ID NO: 92439 - DNA, 75 bp, Artificial Sequence
  Synthetic
gctcctgagctctatgagcgcgggggggtggaggcacaaggccgtgatctataggacgtggtgtaaagggtacca

SEQ ID NO: 92440 - DNA, 75 bp, Artificial Sequence
  Synthetic
gtggttgaggccggggccattctggccccggccacccacgcttgtcgagcgaatgggcaatatttcctcacaaat

SEQ ID NO: 92441 - DNA, 75 bp, Artificial Sequence
  Synthetic
ccccggccacccacgcttgtcgagcgaatgggcaatatttcctcacaaattgttgtgccccggaggacatcgggt

SEQ ID NO: 92442 - DNA, 75 bp, Artificial Sequence
  Synthetic
gcggcgaggtcgcacagggagaggacggtctgggcggtactactacgcgggggtgggcaaagcccccgccgggag

SEQ ID NO: 92443 - DNA, 75 bp, Artificial Sequence
  Synthetic
ggcgttgcggcagcgggtggtgcggagccccctcggggaggggcggcccactaagccgctgacctttgcctggtg

SEQ ID NO: 92444 - DNA, 75 bp, Artificial Sequence
  Synthetic
tggtgctactcttcggcctgttcgacgctttggactgggccttggaggagttgctggtgtcgcggccttcgttgc

SEQ ID NO: 92445 - DNA, 75 bp, Artificial Sequence
  Synthetic
cttctcgggcctcgcgcccttgaggatgcatcctgatgtcagctgggcaaaagttcgcggcgtgaactggcccct

SEQ ID NO: 92446 - DNA, 75 bp, Artificial Sequence
  Synthetic
actaccattcggctggtctccaagatgtgcgcgaggggagcctatttgtttgaccacatgggttctttttcgcgc

SEQ ID NO: 92447 - DNA, 75 bp, Artificial Sequence
  Synthetic
cggtctcggcctatgtggctgggatcctgggcctgggtgaggtgtactcgggtgtcctaacggtgggagtcgcgt

SEQ ID NO: 92448 - DNA, 75 bp, Artificial Sequence
  Synthetic
atgcatcctgatgtcagctgggcaaaagttcgcggcgtgaactggcccctacttgtgggtgttcagcggacgatg

SEQ ID NO: 92449 - DNA, 75 bp, Artificial Sequence
  Synthetic
gagctaaagtgggaaagtgagttttggagatggactgaacagctggcctccaactactggattctggaatacctc

SEQ ID NO: 92450 - DNA, 75 bp, Artificial Sequence
  Synthetic
ccttaaaggcccaaatcctgttccactcctgctgaggtggggcaatgatttaccaacaaaggtggccggccacca

SEQ ID NO: 92451 - DNA, 75 bp, Artificial Sequence
  Synthetic
cattgtggacgacctggtccggaggctcggtgtggcggagggttatgtacgctgcgatgcgggccccatcttgat

SEQ ID NO: 92452 - DNA, 75 bp, Artificial Sequence
  Synthetic
atgtgaaccatttgccgcccgggtttgtccctaccgcgcccgttgtcatccggcggtgcgggaagggcttcctcg

SEQ ID NO: 92453 - DNA, 75 bp, Artificial Sequence
  Synthetic
ctgcttgagcaacggattgtcatggtcttcctgttggtgacgatggccgggatgtcgcaaggcgcccctgcctcc

SEQ ID NO: 92454 - DNA, 75 bp, Artificial Sequence
  Synthetic
tcttcctgttggtgacgatggccgggatgtcgcaaggcgcccctgcctccgttttggggtcacgcccctttgact

SEQ ID NO: 92455 - DNA, 75 bp, Artificial Sequence
  Synthetic
gatgtcgcaaggcgcccctgcctccgttttggggtcacgcccctttgactacgggttgacttggcagacctgctc

SEQ ID NO: 92456 - DNA, 75 bp, Artificial Sequence
  Synthetic
gttttggggtcacgcccctttgactacgggttgacttggcagacctgctcttgcagggccaacggttcgcgtttt

SEQ ID NO: 92457 - DNA, 75 bp, Artificial Sequence
  Synthetic
catggggcttcttcccgaaccattgctacccccgtgggggcccttaacccaaggtggtggtcggccagtgatgac

SEQ ID NO: 92458 - DNA, 75 bp, Artificial Sequence
  Synthetic
ctgccctaacggcccctgggtgtggttgccagccttttgccaagcaatcggctggggtgaccccatcacttattg

SEQ ID NO: 92459 - DNA, 75 bp, Artificial Sequence
  Synthetic
ttgccagccttttgccaagcaatcggctggggtgaccccatcacttattggagccacgggcaaaatcagtggccc

SEQ ID NO: 92460 - DNA, 75 bp, Artificial Sequence
  Synthetic
gagctaactcattgacgccatgtacttgccaggctgagtcttgttgggtcatcaggtccgacggggcattatgcc

SEQ ID NO: 92461 - DNA, 75 bp, Artificial Sequence
  Synthetic
gggttccgcttcttggtttgcctccaccagtggtcgcgactcgaagatagatgtgtggagtttagtgccagttgg

SEQ ID NO: 92462 - DNA, 75 bp, Artificial Sequence
  Synthetic
gggccgttcctactgtttcaattgtggacaagctcttcgcagggggttgggcggcggtcgtcggtcattgtcaca

SEQ ID NO: 92463 - DNA, 75 bp, Artificial Sequence
  Synthetic
tccgacttccgtgggtcgtctgggtcgcctgtcttgtgcgatgaggggcacgcagtaggaatgctggtgtccgtg

SEQ ID NO: 92464 - DNA, 75 bp, Artificial Sequence
  Synthetic
atgtgtggagtttagtgccagttggctctgccacctgcaccatagccgcacttggatcatcggatcgcgacacgg

SEQ ID NO: 92465 - DNA, 75 bp, Artificial Sequence
  Synthetic
cgcagtaggaatgctggtgtccgtgcttcattcgggtggtcgggtcactgccgcacgatttactcggccttggac

SEQ ID NO: 92466 - DNA, 75 bp, Artificial Sequence
  Synthetic
ttggcggcggccgcctcctacctcatgggactgggcgtcggaggcaatacgcaggtgcgcttggcttccgctctc

SEQ ID NO: 92467 - DNA, 75 bp, Artificial Sequence
  Synthetic
cgtcggcctgcctcctgcggcacctgtgtgagggactgctggcccgagaccgggtcggttaggttcccattccat

SEQ ID NO: 92468 - DNA, 75 bp, Artificial Sequence
  Synthetic
tgggactgggcgtcggaggcaatacgcaggtgcgcttggcttccgctctcctgttgggggccgctggtaccgccc

SEQ ID NO: 92469 - DNA, 75 bp, Artificial Sequence
  Synthetic
caaaaggggtattcaaggaagctccacttttcatgcccactggggccggcaagagcacgcgggttcctctggaat

SEQ ID NO: 92470 - DNA, 75 bp, Artificial Sequence
  Synthetic
acttttcatgcccactggggccggcaagagcacgcgggttcctctggaatatggaaacatggggcacaaggtcct

SEQ ID NO: 92471 - DNA, 75 bp, Artificial Sequence
  Synthetic
gctagcgtgtccccctctctagtcacgatcctcttgggggccgtgggtggttgggagggcgtggtcaatgcggcc

SEQ ID NO: 92472 - DNA, 75 bp, Artificial Sequence
  Synthetic
cgatcctcttgggggccgtgggtggttgggagggcgtggtcaatgcggccagccttgtcttcgatttcatgtcag

SEQ ID NO: 92473 - DNA, 75 bp, Artificial Sequence
  Synthetic
agaagctggcgggtaaacatccaagcattttctgtggacatgatactacggccttcaccaggatcaccgactctc

SEQ ID NO: 92474 - DNA, 75 bp, Artificial Sequence
  Synthetic
cattttctgtggacatgatactacggccttcaccaggatcaccgactctccattgacgtattcaacctatggtag

SEQ ID NO: 92475 - DNA, 75 bp, Artificial Sequence
  Synthetic
ccgggggcgggccttgcggggatcgccttgggacttgttctgtactcagccaacaactctgggactaccacttgg

SEQ ID NO: 92476 - DNA, 75 bp, Artificial Sequence
  Synthetic
ccttgggacttgttctgtactcagccaacaactctgggactaccacttggttgaaccgtctgttgaccacactgc

SEQ ID NO: 92477 - DNA, 75 bp, Artificial Sequence
  Synthetic
gtgatgagtgccatagtcatgactccactgtgttgctgggaattggtcgggtcagggagctggcgcgtggctgcg

SEQ ID NO: 92478 - DNA, 75 bp, Artificial Sequence
  Synthetic
cactgtgttgctgggaattggtcgggtcagggagctggcgcgtggctgcggggtccaactggtcctctatgctac

SEQ ID NO: 92479 - DNA, 75 bp, Artificial Sequence
  Synthetic
gacagggtctcagccatgctcaggcgcctgagcctcactcgtaccgtggttgctctcgtcaacagggagcccaag

SEQ ID NO: 92480 - DNA, 75 bp, Artificial Sequence
  Synthetic
tgctctcgtcaacagggagcccaaggtagatgaggtccaggttgggtatgtgtgggacctgtatgagtggatcat

SEQ ID NO: 92481 - DNA, 75 bp, Artificial Sequence
  Synthetic
ccagggtcacttgcaggaggtggatgcaggcaacttcatcccgcccccgcgctggttgctcttggactttgtatt

SEQ ID NO: 92482 - DNA, 75 bp, Artificial Sequence
  Synthetic
gctggttgctcttggactttgtatttgtcctgttatacctgatgaagctggctgaggcacggttggtcccgctga

SEQ ID NO: 92483 - DNA, 75 bp, Artificial Sequence
  Synthetic
tcgtcccggggggtgaacgccatcgcctattacaggggaaaggacagttctatcatcaaagatggggacctagtg

SEQ ID NO: 92484 - DNA, 75 bp, Artificial Sequence
  Synthetic
gtctgtgcgggtgcgtgatcactggggacgtgctgaatgggcaactcaaagaaccagtttactctaccaagctgt

SEQ ID NO: 92485 - DNA, 75 bp, Artificial Sequence
  Synthetic
gtgaggtcttcgcgggccctgccctgtcctggtgtctgggactcccggtcgtcagtatgatattgggtttggcaa

SEQ ID NO: 92486 - DNA, 75 bp, Artificial Sequence
  Synthetic
ctgggtacactggaaacttcgattctgtaactgactgtgggcttgtggtggaggaggtcgtcgaggtgacccttg

SEQ ID NO: 92487 - DNA, 75 bp, Artificial Sequence
  Synthetic
tgtaactgactgtgggcttgtggtggaggaggtcgtcgaggtgacccttgatcccaccataaccatctccttgcg

SEQ ID NO: 92488 - DNA, 75 bp, Artificial Sequence
  Synthetic
gcaggcattactggatggggactgtgccggtgaacatgcttggttacggggagacgtcgcctctgctggcctcgg

SEQ ID NO: 92489 - DNA, 75 bp, Artificial Sequence
  Synthetic
acctggtgctgtactttagatggttgggaccccaacgcctgatgttcctcgtgttgtggaagcttgctcggggag

SEQ ID NO: 92490 - DNA, 75 bp, Artificial Sequence
  Synthetic
caccgtgcctgcgtcggcagaattgtcgatgcaacggcgaggacgcacgggtaggggcaggtcaggccgatacta

SEQ ID NO: 92491 - DNA, 75 bp, Artificial Sequence
  Synthetic
gtgacccctacccatgttgtgatccggcgcacttcctgttacaagttgctgcgccagcaaatactttcagctgct

SEQ ID NO: 92492 - DNA, 75 bp, Artificial Sequence
  Synthetic
gcatcccggtctcatgggaggcggacgcccgtgcgcccgctatggtctatgggcctggccaaagcgtcaccattg

SEQ ID NO: 92493 - DNA, 75 bp, Artificial Sequence
  Synthetic
aaacccctgacctttgcctggtgcttggcctcgtacatctggccagatgctgtgatgatggtggtggttgccttg

SEQ ID NO: 92494 - DNA, 75 bp, Artificial Sequence
  Synthetic
tgggcaggtctgaaaggcccaaatcctgtcccgctactgctgaggtggggcaatgacttgccatcgaaagtggcc

SEQ ID NO: 92495 - DNA, 75 bp, Artificial Sequence
  Synthetic
cgtttggctcgggtggttgagtgctgtgtgatggcgggtgagaaggccacaaccgtccggctggtctccaagatg

SEQ ID NO: 92496 - DNA, 75 bp, Artificial Sequence
  Synthetic
ttatgtccgctgcgatgcggggcccatcctcatggtgggcctcgctattgcgggggggatgatctacgcctcata

SEQ ID NO: 92497 - DNA, 75 bp, Artificial Sequence
  Synthetic
tgtcaaggagcgcctgttggaatgggacgcagctcttgaacctctgtcattcactaggacggactgtcgcatcat

SEQ ID NO: 92498 - DNA, 75 bp, Artificial Sequence
  Synthetic
gactgggatgtgaaggggggtggcaaccccctttataggaatggagaccaggccactcctcaacctgtggtgcag

SEQ ID NO: 92499 - DNA, 75 bp, Artificial Sequence
  Synthetic
agctgagagtgaggaaagcgtcttcaacgtggctctttccgtactaaaagccttatttccacagagcgacgccac

SEQ ID NO: 92500 - DNA, 75 bp, Artificial Sequence
  Synthetic
ccgtggttgcgcgccgtggtgatgaggttctcatcggcgtcttccaggatgtgaatcatttgcctcccgggtttg

SEQ ID NO: 92501 - DNA, 75 bp, Artificial Sequence
  Synthetic
ggctgacgtggctagcctgtgtgagatggaaatccagaaccatacagcctattgtgacaaggtgcgcactccgct

SEQ ID NO: 92502 - DNA, 75 bp, Artificial Sequence
  Synthetic
tcaattgtggacaagctctttgccggaggttgggccgccgtggtgggtcactgccacagcgtaatagctgcggcg

SEQ ID NO: 92503 - DNA, 75 bp, Artificial Sequence
  Synthetic
gccggtggggtccttgttggtggccgacactaccaaagtgtacgtgaccaatccggataacgtgggaaggagggt

SEQ ID NO: 92504 - DNA, 75 bp, Artificial Sequence
  Synthetic
gacactaccaaagtgtacgtgaccaatccggataacgtgggaaggagggttgacaaggtgaccttctggcgtgct

SEQ ID NO: 92505 - DNA, 75 bp, Artificial Sequence
  Synthetic
atacctcatgggattgggcgtcggaggcaacgcgcaggctcgcttggcttctgccctcctattgggggctgctgg

SEQ ID NO: 92506 - DNA, 75 bp, Artificial Sequence
  Synthetic
ggcttgagcaagggggacaaggtggagctggatgtggccatggaggtctctgacttccgtggctcgtctggctca

SEQ ID NO: 92507 - DNA, 75 bp, Artificial Sequence
  Synthetic
gaccgctcttggtactcctgtcgtggggctaaccatggcaggggctttcatgggcggcgctagcgtgtccccctc

SEQ ID NO: 92508 - DNA, 75 bp, Artificial Sequence
  Synthetic
ggactgttaggccacatgctgccatgggctggggatctaaggtgtcggtcaaggacttagccacccctgcgggga

SEQ ID NO: 92509 - DNA, 75 bp, Artificial Sequence
  Synthetic
cagtaggaatgctcgtgtctgtgcttcactccggtggtagggtcaccgcggcacggttcactaggccgtggaccc

SEQ ID NO: 92510 - DNA, 75 bp, Artificial Sequence
  Synthetic
atgcggccagcctcgtcttcgacttcatggcagggaaactttctacggaggacctgtggtacgccatcccagtgc

SEQ ID NO: 92511 - DNA, 75 bp, Artificial Sequence
  Synthetic
catggcagggaaactttctacggaggacctgtggtacgccatcccagtgctcaccagcccgggggcgggcctagc

SEQ ID NO: 92512 - DNA, 75 bp, Artificial Sequence
  Synthetic
aaaggagttttcaaagaggccccgttgtttatgcctacgggagcgggaaagagcactcgcgtcccgttggagtac

SEQ ID NO: 92513 - DNA, 75 bp, Artificial Sequence
  Synthetic
ccacttggttgaaccggctgctgacgacgctgccacgttcgtcgtgcatcccagacagctacttccaacaagccg

SEQ ID NO: 92514 - DNA, 75 bp, Artificial Sequence
  Synthetic
ccagacagctacttccaacaagccgactactgtgacaaggtttccgcaatgctgcgccgcctgagccttactcga

SEQ ID NO: 92515 - DNA, 75 bp, Artificial Sequence
  Synthetic
gggggggcctatgccttccagtacaccccaaatcagcgggtacgggagatgctcaaactgtgggagtcaaagaaa

SEQ ID NO: 92516 - DNA, 75 bp, Artificial Sequence
  Synthetic
gcgggccatgggcccgtacatggagcggctggcgggtaaacatccaagtatatactgtgggcatgatacaactgc

SEQ ID NO: 92517 - DNA, 75 bp, Artificial Sequence
  Synthetic
ccccaaatcagcgggtacgggagatgctcaaactgtgggagtcaaagaaaaccccgtgcgcaatctgtgtggatg

SEQ ID NO: 92518 - DNA, 75 bp, Artificial Sequence
  Synthetic
ttttggccaaccctaggcagatgctacggggcgtttcggtggtcatttgtgatgagtgccacagtcatgactcaa

SEQ ID NO: 92519 - DNA, 75 bp, Artificial Sequence
  Synthetic
gagctatatgccctggcttctgaccgcccagagtgggtgcgggccctggggaaatactatgcctctggtacgatg

SEQ ID NO: 92520 - DNA, 75 bp, Artificial Sequence
  Synthetic
acggggcgtttcggtggtcatttgtgatgagtgccacagtcatgactcaaccgtgctgttaggcattgggagagt

SEQ ID NO: 92521 - DNA, 75 bp, Artificial Sequence
  Synthetic
cactgcggtgaggggtggtccggagaatggctcctagacggtcatgtggagagtcggtgcctctgtgggtgcgtg

SEQ ID NO: 92522 - DNA, 75 bp, Artificial Sequence
  Synthetic
aatggctcctagacggtcatgtggagagtcggtgcctctgtgggtgcgtgataactggcgacgttctgaatgggc

SEQ ID NO: 92523 - DNA, 75 bp, Artificial Sequence
  Synthetic
ctacacctcccggatcccctatgacgcagcacccttccataattgagacaaaattggacgtgggcgagattccct

SEQ ID NO: 92524 - DNA, 75 bp, Artificial Sequence
  Synthetic
ggtcttgaccaccagtgcgagcaactgcttaacctgctacattaaggtgaaagccgcgtgcgagagggttggcct

SEQ ID NO: 92525 - DNA, 75 bp, Artificial Sequence
  Synthetic
gcagcacccttccataattgagacaaaattggacgtgggcgagattcccttttatgggcatggaatacccctcga

SEQ ID NO: 92526 - DNA, 75 bp, Artificial Sequence
  Synthetic
gggactgttccggttaacatgctgggttacggggaaacctcacctcttctcgcctcggacactccgaaggtggtt

SEQ ID NO: 92527 - DNA, 75 bp, Artificial Sequence
  Synthetic
tgcttaacctgctacattaaggtgaaagccgcgtgcgagagggttggccttaaaaacgtctcccttctcatcgct

SEQ ID NO: 92528 - DNA, 75 bp, Artificial Sequence
  Synthetic
gcgagcgccttgctggccagttctccgctaggggggtcaatgccattgcctattataggggtaaagacagttcta

SEQ ID NO: 92529 - DNA, 75 bp, Artificial Sequence
  Synthetic
aggtggtggtgactcccacccacgtgatagtccggcgcacttcctgttacaaattgctgcgccaacagattcttt

SEQ ID NO: 92530 - DNA, 75 bp, Artificial Sequence
  Synthetic
gggtacactggaaatttcgactccgtcaccgactgtggattagtggtggaggaggtcgttgaggtgacccttgat

SEQ ID NO: 92531 - DNA, 75 bp, Artificial Sequence
  Synthetic
tcaccgactgtggattagtggtggaggaggtcgttgaggtgacccttgatcccaccattaccatctccctgcgga

SEQ ID NO: 92532 - DNA, 75 bp, Artificial Sequence
  Synthetic
atgtggccccctctgaggtttcgtcagaggtcagcatcgagattgggacggagactgaggattcagaactgactg

SEQ ID NO: 92533 - DNA, 75 bp, Artificial Sequence
  Synthetic
tccggtttggtgccaggtgcatggcaattactacaagtttccactggacaaactgcctaacatcatcgtggccct

SEQ ID NO: 92534 - DNA, 75 bp, Artificial Sequence
  Synthetic
ccacggaccagcagcgttgagggttaccgcagacacaactaagacaaaaatggaagccggcaaggtgctgagcga

SEQ ID NO: 92535 - DNA, 75 bp, Artificial Sequence
  Synthetic
caccgtaagaaggctggagcattgcgcacgcgcatgcttcggtcgcgcggttgggcggagctggctaggggcttg

SEQ ID NO: 92536 - DNA, 75 bp, Artificial Sequence
  Synthetic
tctgatacagctgaatcagaggaaagcgtcttcaacgtggctctttccgtactaaaagccttgtttccacagagc

SEQ ID NO: 92537 - DNA, 75 bp, Artificial Sequence
  Synthetic
gtcccactcctgctgaggtggggcaatgatttaccatctaaagtggccggccaccacatagtggacgacctggtc

SEQ ID NO: 92538 - DNA, 75 bp, Artificial Sequence
  Synthetic
gatgccacacgcaagctaacggttaagatgtcatgctgtgtcgagaagagcgtcacacgcttcttttcgttggga

SEQ ID NO: 92539 - DNA, 75 bp, Artificial Sequence
  Synthetic
ccaccacatagtggacgacctggtccggagactcggtgtggcggagggttacgtccgctgcgacgctgggccgat

SEQ ID NO: 92540 - DNA, 75 bp, Artificial Sequence
  Synthetic
ccgggtcgctagtggtggtgacagactgggatgtgaaggggggtggcgcccccctttatcggcatggagaccagg

SEQ ID NO: 92541 - DNA, 75 bp, Artificial Sequence
  Synthetic
gtggttaggccggtggggtccctgttggtggccgacaccaccaaggtgtacgtcaccaacccagacaatgttggg

SEQ ID NO: 92542 - DNA, 75 bp, Artificial Sequence
  Synthetic
atttctcgtggactcgattgagagggcccggagggctgctcaaggctgcctaagcatgggttacacatatgagga

SEQ ID NO: 92543 - DNA, 75 bp, Artificial Sequence
  Synthetic
ggacgcgggccgttcccactgtatccattgttgacaagctcttcgccggagggtgggcggctgtggtgggccatt

SEQ ID NO: 92544 - DNA, 75 bp, Artificial Sequence
  Synthetic
ggcggcctacggggcttcaaggagcccgccgttggcagccgcggcttcctacctgatggggttgggcgttggagg

SEQ ID NO: 92545 - DNA, 75 bp, Artificial Sequence
  Synthetic
tcccgggggagtgggaaatgcatggggccacccagctccgcggcggcctgcagccggggtagcccaagagccttc

SEQ ID NO: 92546 - DNA, 75 bp, Artificial Sequence
  Synthetic
ggccacccagctccgcggcggcctgcagccggggtagcccaagagccttcgggtgagggcgggtggcatttttct

SEQ ID NO: 92547 - DNA, 75 bp, Artificial Sequence
  Synthetic
gccctcctattgggggctgctggaaccgccttgggcactcctgtcgtgggcttgaccatggcaggtgcgttcatg

SEQ ID NO: 92548 - DNA, 75 bp, Artificial Sequence
  Synthetic
gaaaaaggaggtgttcttcaaagaccgaaaggaggagaaggccccccgcctcattgtatttcctcccttggactt

SEQ ID NO: 92549 - DNA, 75 bp, Artificial Sequence
  Synthetic
cttgaccatggcaggtgcgttcatggggggggccagtgtctccccctccttggtcaccattttattgggggccgt

SEQ ID NO: 92550 - DNA, 75 bp, Artificial Sequence
  Synthetic
ctgcttctcttcgtggtggaggccggggccattctggccccggccacacacgcttgcggagctaacgggcaatat

SEQ ID NO: 92551 - DNA, 75 bp, Artificial Sequence
  Synthetic
caaagaagaccccctgcgccatctgcgtggatgccacttgcttcgacagtagcattactgaagaggacgtggccc

SEQ ID NO: 92552 - DNA, 75 bp, Artificial Sequence
  Synthetic
cggatgccttgtagccttggggtgcacggtttgtactgaccaatgctggccactgtatcaggcgggtttggccgt

SEQ ID NO: 92553 - DNA, 75 bp, Artificial Sequence
  Synthetic
acttggttgaaccgtctgctgactacgttaccaaggtcttcatgtatcccggacagttactttcagcaagttgac

SEQ ID NO: 92554 - DNA, 75 bp, Artificial Sequence
  Synthetic
acgggcccctttcggtttcggcttacgtggccgggatcttggggctcggggaggtgtactccggggtgctcacca

SEQ ID NO: 92555 - DNA, 75 bp, Artificial Sequence
  Synthetic
cgtggccgggatcttggggctcggggaggtgtactccggggtgctcaccattggggtcgcgttgacgcgtcgggt

SEQ ID NO: 92556 - DNA, 75 bp, Artificial Sequence
  Synthetic
caaagttcgagccgcgtgtgagagggtgggactgaaaaatgtctcactcctcatcgctggcgacgactgtctgat

SEQ ID NO: 92557 - DNA, 75 bp, Artificial Sequence
  Synthetic
agtggttgccctggtcaacagggagcctaaggtggatgaggtacaggtggggtatgtctgggacctgtgggagtg

SEQ ID NO: 92558 - DNA, 75 bp, Artificial Sequence
  Synthetic
aaagtgagttttggagatggactgaacagctggcctccaactactggatcttggaatacctctggaaggtcccat

SEQ ID NO: 92559 - DNA, 75 bp, Artificial Sequence
  Synthetic
acagctggcctccaactactggatcttggaatacctctggaaggtcccatttgatttttggagaggcgtgatgag

SEQ ID NO: 92560 - DNA, 75 bp, Artificial Sequence
  Synthetic
tagcttcgtacgggtacgcgtgtgagccctcatatcatgcatcactggacacggcccccttctgctccacttggc

SEQ ID NO: 92561 - DNA, 75 bp, Artificial Sequence
  Synthetic
ccgtggtgtcactacccttgtggcattgcggggaggggtggtccggggaatggttgcttgacggtcatgttgaga

SEQ ID NO: 92562 - DNA, 75 bp, Artificial Sequence
  Synthetic
ggatagtcatggtcttcctgttggtgacgatggccgggatgtcgcaaggcgccccggcctctgtcatgggctcac

SEQ ID NO: 92563 - DNA, 75 bp, Artificial Sequence
  Synthetic
ggttccagagttcctactggggagaaagtgtgggaccgtgggaatgtcacacttttgtgtgactgccccaacggg

SEQ ID NO: 92564 - DNA, 75 bp, Artificial Sequence
  Synthetic
tacggtgaaacgtcgcctctcctggcctccgacaccccgaaggttgtgcccttcgggacgtctggctgggctgag

SEQ ID NO: 92565 - DNA, 75 bp, Artificial Sequence
  Synthetic
aagtgtgggaccgtgggaatgtcacacttttgtgtgactgccccaacgggccctgggtctggctcccggcctttt

SEQ ID NO: 92566 - DNA, 75 bp, Artificial Sequence
  Synthetic
gctgctgtagctgagccctactacgtcgacggcattccggtctcatgggacgcggacgctcgtgcgcccgccatg

SEQ ID NO: 92567 - DNA, 75 bp, Artificial Sequence
  Synthetic
ggtgccggttggctctgccagctgtaccatagccgcactcggttcatcagatcgcgatacagtggtggagctctc

SEQ ID NO: 92568 - DNA, 75 bp, Artificial Sequence
  Synthetic
atcgcgatacagtggtggagctctccgagtggggggtcccttgcgtgacgtgtattctggaccgtcggccggcct

SEQ ID NO: 92569 - DNA, 75 bp, Artificial Sequence
  Synthetic
tttcctttccatcggtgcggcgcggggcctcggctgacaaaggacttggaagctgtgcccttcgtcaataggaca

SEQ ID NO: 92570 - DNA, 75 bp, Artificial Sequence
  Synthetic
cgagacagccgaaggggaggaaagtgtcttcaacgtggctctttccgtattaaaagccttatttccacagagcga

SEQ ID NO: 92571 - DNA, 75 bp, Artificial Sequence
  Synthetic
tcacgcgctttttctcattggggttgacggtggctgatgttgctagcctgtgtgagatggaaatccagaaccata

SEQ ID NO: 92572 - DNA, 75 bp, Artificial Sequence
  Synthetic
ggttctatgaacccctggtgcgcaggtgttcggagctgatggggcgccgaaatccggtctgcccggggtatgcat

SEQ ID NO: 92573 - DNA, 75 bp, Artificial Sequence
  Synthetic
gttcatacatgtccagggccacttgcaggaggtggatgcaggcaacttcattccgccccctcgctggttgctttt

SEQ ID NO: 92574 - DNA, 75 bp, Artificial Sequence
  Synthetic
ttccgccccctcgctggttgcttttggactttgtatttgtcctgttatacctgatgaagctggcagaggcacggc

SEQ ID NO: 92575 - DNA, 75 bp, Artificial Sequence
  Synthetic
agaaaccttggcctccttctcttacatttggtctggagtgccgctgactagggccacgccggccaagcctcccgt

SEQ ID NO: 92576 - DNA, 75 bp, Artificial Sequence
  Synthetic
gtccttggactgccggctgtggacgccgctgtggctggagaggtgttcgcggggccggctttgtcgtggtgtctg

SEQ ID NO: 92577 - DNA, 75 bp, Artificial Sequence
  Synthetic
aacttgggagcctctacgggcctctgtctgtctcggcctacgtggccgggatactggggctcggggaggtttact

SEQ ID NO: 92578 - DNA, 75 bp, Artificial Sequence
  Synthetic
ccgctgtggctggagaggtgttcgcggggccggctttgtcgtggtgtctgggcctccccaccgtcagtatgatac

SEQ ID NO: 92579 - DNA, 75 bp, Artificial Sequence
  Synthetic
tgggtggtggccagcgtggtggcttgggccattgcgatcctgagatcgatgagcgcagggggctggaggcacaag

SEQ ID NO: 92580 - DNA, 75 bp, Artificial Sequence
  Synthetic
gaaggaggagaaggccccccgcctcattgtgttcccccccctggacttccggatagctgaaaagctcatcttggg

SEQ ID NO: 92581 - DNA, 75 bp, Artificial Sequence
  Synthetic
ggtgttcctcctggttaccatggcggggatgtctcagggcgttcccgtcacggtgctggggtccaggccttttga

SEQ ID NO: 92582 - DNA, 75 bp, Artificial Sequence
  Synthetic
ggtggttcggagccccctcggggaggggcgacctaccaaacccctgactttcgcttggtgcttggcctcatacat

SEQ ID NO: 92583 - DNA, 75 bp, Artificial Sequence
  Synthetic
tacccactggggagcgggtttgggaccgagggaatgtctcactgttgtgtgactgccccaatggcccctgggtct

SEQ ID NO: 92584 - DNA, 75 bp, Artificial Sequence
  Synthetic
tggttgagtgctgtgtgatggcgggtgagcgagccaccaccgttcggctggtctccaagatgtgcgcgagggggg

SEQ ID NO: 92585 - DNA, 75 bp, Artificial Sequence
  Synthetic
tttttcgcgggcagtcaaggagcgcttgcttgagtgggacgcggctctggaacctctatcattcaccaggacgga

SEQ ID NO: 92586 - DNA, 75 bp, Artificial Sequence
  Synthetic
aggtgaaagctgcctgtgagagagtggggctgaaaaatgtctctcttctcatagccggcgatgactgcttgatca

SEQ ID NO: 92587 - DNA, 75 bp, Artificial Sequence
  Synthetic
aacctctatcattcaccaggacggactgtcgcatcattagagatgctgccaggactttgtcgtgcggccagtgcg

SEQ ID NO: 92588 - DNA, 75 bp, Artificial Sequence
  Synthetic
gtctttcaggatgtgaaccatttgcctcccgggtttgtccccactgcgccagttgtcatccgacggtgcggtaag

SEQ ID NO: 92589 - DNA, 75 bp, Artificial Sequence
  Synthetic
gcgagctatgggtacgcgtgcgagccctcatatcatgcatcattggacacggcccccttctgctccacttggctt

SEQ ID NO: 92590 - DNA, 75 bp, Artificial Sequence
  Synthetic
cctggtgaaatgtcccaccccagccattgagcctcccaccggcacgtttgggttcttcccgggagtcccccccct

SEQ ID NO: 92591 - DNA, 75 bp, Artificial Sequence
  Synthetic
cgaaccatcgccacacccgtgggggccctaaatcccagatggtggtcagccagtgatgatgtcacggtgtacccc

SEQ ID NO: 92592 - DNA, 75 bp, Artificial Sequence
  Synthetic
cttgttggtcattcgatctgatgggcccctgtgccatggcttgggcaagggggacaaggtggagttggacgttgc

SEQ ID NO: 92593 - DNA, 75 bp, Artificial Sequence
  Synthetic
acgctggttgctcttggactttgtatttgtcctgttatacctgatgaagctggcggaggcacggttggtcccgct

SEQ ID NO: 92594 - DNA, 75 bp, Artificial Sequence
  Synthetic
tttgtcctgttatacctgatgaagctggcggaggcacggttggtcccgcttatacttctcttgctatggtggtgg

SEQ ID NO: 92595 - DNA, 75 bp, Artificial Sequence
  Synthetic
tcttccggttcgcccgtcctttgtgacgaggggcacgcagtaggaatgctcgtgtcagtgcttcattcggggggt

SEQ ID NO: 92596 - DNA, 75 bp, Artificial Sequence
  Synthetic
gtgaatcagctcgcagttttaggactgcctgctgctcacgccgctgtggctggggaggtgttcgccggaccggcc

SEQ ID NO: 92597 - DNA, 75 bp, Artificial Sequence
  Synthetic
tgccaaaaccaccactgaacccccgccggtgccggcaaaaggagttttcaaggaggccccgttgttcatgcccac

SEQ ID NO: 92598 - DNA, 75 bp, Artificial Sequence
  Synthetic
ccggtgccggcaaaaggagttttcaaggaggccccgttgttcatgcccacgggggccgggaagagcacccgggtc

SEQ ID NO: 92599 - DNA, 75 bp, Artificial Sequence
  Synthetic
ggtcgctaccgtgcgggccatgggcccctacatggagcggttggcgggaaaacatccaagcatatactgtggcca

SEQ ID NO: 92600 - DNA, 75 bp, Artificial Sequence
  Synthetic
ccctacatggagcggttggcgggaaaacatccaagcatatactgtggccatgatacaacagccttcactaggata

SEQ ID NO: 92601 - DNA, 75 bp, Artificial Sequence
  Synthetic
taggcagatgctacgaggtgttcccgtggtcatttgtgatgagtgccacagtcatgattctactgtgttgttggg

SEQ ID NO: 92602 - DNA, 75 bp, Artificial Sequence
  Synthetic
gtggtcatttgtgatgagtgccacagtcatgattctactgtgttgttggggatcggacgagtcagggagctggcg

SEQ ID NO: 92603 - DNA, 75 bp, Artificial Sequence
  Synthetic
gggtggaggcacaaggccgtgatttataggacgtggtgtaaaggataccaggccttgcgccagcgggtggttcgg

SEQ ID NO: 92604 - DNA, 75 bp, Artificial Sequence
  Synthetic
tttggcctcctacttctggcctgacgctgtgatgttggtggtggtggctctagtgctcctttttggcctgttcga

SEQ ID NO: 92605 - DNA, 75 bp, Artificial Sequence
  Synthetic
ctctccgatgacccagcacccttccatcattgagacaaacttgacgttgggagagatccccttttatgggcatgg

SEQ ID NO: 92606 - DNA, 75 bp, Artificial Sequence
  Synthetic
catacccctcgaacggatgcgcacgggtcgccacctcgtattctgccattcaaaggcggagtgcgagcgtctggc

SEQ ID NO: 92607 - DNA, 75 bp, Artificial Sequence
  Synthetic
ggcgcttggcacgggtggtggagtgttgtgtgatggctggcgagaaggccactaccgtccggctggtctccaaga

SEQ ID NO: 92608 - DNA, 75 bp, Artificial Sequence
  Synthetic
aggacagttcaatcatcaaagatggggacctcgtggtgtgtgcgacagacgcgctatccactgggtacaccggga

SEQ ID NO: 92609 - DNA, 75 bp, Artificial Sequence
  Synthetic
attcactaggacggactgtcgcatcataagagatgccgctaggactctgagctgtggtcagtgcgtcatgggctt

SEQ ID NO: 92610 - DNA, 75 bp, Artificial Sequence
  Synthetic
gttggtggtggaggaggtcgtcgaggtgacccttgatcccaccattaccatctccttgcggacggtgcccgcgtc

SEQ ID NO: 92611 - DNA, 75 bp, Artificial Sequence
  Synthetic
acttcgattctgtgaccgattgtgggttggtggtggaggaggtcgtcgaggtgacccttgatcccaccattacca

SEQ ID NO: 92612 - DNA, 75 bp, Artificial Sequence
  Synthetic
tctccttgcggacggtgcccgcgtcggctgagctgtcgatgcagaggcgaggacgcacagggagaggccggtctg

SEQ ID NO: 92613 - DNA, 75 bp, Artificial Sequence
  Synthetic
gtgacccttgatcccaccattaccatctccttgcggacggtgcccgcgtcggctgagctgtcgatgcagaggcga

SEQ ID NO: 92614 - DNA, 75 bp, Artificial Sequence
  Synthetic
ccccggccacccatgcttgtgaagctgaggggcaatatttcctcacaaattgctgcgccatggaggacatagggt

SEQ ID NO: 92615 - DNA, 75 bp, Artificial Sequence
  Synthetic
ctgagactttacgacgactgcccttacaccgcagccgtcgcggctgacatcggggaagccgcggtgttctttgcg

SEQ ID NO: 92616 - DNA, 75 bp, Artificial Sequence
  Synthetic
gacaaatgctggccactgtatcaggcggggctggccgtgcggcctggcaagtccgcggcccaactggtcggggaa

SEQ ID NO: 92617 - DNA, 75 bp, Artificial Sequence
  Synthetic
cggtgtcggcgtacgtcgccggcatcctagggctgggggaggtttactcgggagtccttaccattggcgtcgcgt

SEQ ID NO: 92618 - DNA, 75 bp, Artificial Sequence
  Synthetic
gtgacggtgtacccgttgcccgatggagccaactcattaacgccatgcacttgccaggccgagtcctgttgggtc

SEQ ID NO: 92619 - DNA, 75 bp, Artificial Sequence
  Synthetic
ggtgttcagcggaccatgtgccgggaaacactgtctcccggcccatcggatgacccccaatgggcaggtctgaag

SEQ ID NO: 92620 - DNA, 75 bp, Artificial Sequence
  Synthetic
agaactggacgtggccatggaggtctctgacttccgtgggtcgtctgggtcacctgtcttgtgtgatgaggggca

SEQ ID NO: 92621 - DNA, 75 bp, Artificial Sequence
  Synthetic
gacgacttggtccgtcgtctcggtgtggcggagggttatgtccgctgcgacgcggggccgatcttgatggtcggt

SEQ ID NO: 92622 - DNA, 75 bp, Artificial Sequence
  Synthetic
cgcagtaggaatgctggtgtccgtgcttcattcgggcggacgggttaccgctgctcgattcactcggccttggac

SEQ ID NO: 92623 - DNA, 75 bp, Artificial Sequence
  Synthetic
ttgctggagcagcgaattgtcatggtcttcctcctggttaccatggcgggcatgtctcagggcgcgcctgcttcg

SEQ ID NO: 92624 - DNA, 75 bp, Artificial Sequence
  Synthetic
tcttcctcctggttaccatggcgggcatgtctcagggcgcgcctgcttcggtactagggtcccggccattcgagc

SEQ ID NO: 92625 - DNA, 75 bp, Artificial Sequence
  Synthetic
acttttcatgcccactggggccggcaagagcacgcgggtccctctggaatatgggaatatggggcacaaagtcct

SEQ ID NO: 92626 - DNA, 75 bp, Artificial Sequence
  Synthetic
cccacgggggagcgggtttgggaccgagggaacgtcacactcctgtgtgactgccccaacggcccctgggtctgg

SEQ ID NO: 92627 - DNA, 75 bp, Artificial Sequence
  Synthetic
cagcggatgccaagacagtgacagatgcggtggcagccattcaggtggattgcgattggtcagtgatgaccctgt

SEQ ID NO: 92628 - DNA, 75 bp, Artificial Sequence
  Synthetic
ctgccggccttttgccaagcaatcggctggggcgaccctatcactcattggagccacggacaaaatcagtggccc

SEQ ID NO: 92629 - DNA, 75 bp, Artificial Sequence
  Synthetic
aaaagctggcgggcaaacatccaagcatctattgtggacacgacactacggccttcactagaatcactgactccc

SEQ ID NO: 92630 - DNA, 75 bp, Artificial Sequence
  Synthetic
gctggggcgaccctatcactcattggagccacggacaaaatcagtggcccctctcgtgcccccagttcgtctatg

SEQ ID NO: 92631 - DNA, 75 bp, Artificial Sequence
  Synthetic
acagcaaccgccaagtggctcgctggctgctacacggggacgcgggccgttcccactgtttcaattgttgacaag

SEQ ID NO: 92632 - DNA, 75 bp, Artificial Sequence
  Synthetic
gctgctacacggggacgcgggccgttcccactgtttcaattgttgacaagctctttgccggagggtgggcggccg

SEQ ID NO: 92633 - DNA, 75 bp, Artificial Sequence
  Synthetic
catctattgtggacacgacactacggccttcactagaatcactgactccccattgacgtattcaacctacggtag

SEQ ID NO: 92634 - DNA, 75 bp, Artificial Sequence
  Synthetic
acgggaggccgcgattctaagatcgatgtgtggagtttggtgcctgttggctctgccagctgcaccatagccgca

SEQ ID NO: 92635 - DNA, 75 bp, Artificial Sequence
  Synthetic
gtgatgagtgccatagccatgattccactgtgttgttggggattggacgggtcagagagttggcgcgtggttgtg

SEQ ID NO: 92636 - DNA, 75 bp, Artificial Sequence
  Synthetic
cactgtgttgttggggattggacgggtcagagagttggcgcgtggttgtggggtccaactggtcctctatgccac

SEQ ID NO: 92637 - DNA, 75 bp, Artificial Sequence
  Synthetic
gcctctcggagtcccccgttggcggcggcagcctcctaccttatggggttgggcgtcggaggcaatgctcaagcg

SEQ ID NO: 92638 - DNA, 75 bp, Artificial Sequence
  Synthetic
cggcagcctcctaccttatggggttgggcgtcggaggcaatgctcaagcgcgcttggcttccgctctccttttgg

SEQ ID NO: 92639 - DNA, 75 bp, Artificial Sequence
  Synthetic
cccttgtgccacgtgtatcctggatcgtcgacctgcctcgtgcggtacctgtgtgcgggactgctggcccgaaac

SEQ ID NO: 92640 - DNA, 75 bp, Artificial Sequence
  Synthetic
ctaaactggatgtgggtgaaatccccttctatgggcatggaatccccctcgagcggatgcggacgggtcggcacc

SEQ ID NO: 92641 - DNA, 75 bp, Artificial Sequence
  Synthetic
cttctatgggcatggaatccccctcgagcggatgcggacgggtcggcacctcgtattctgccactcaaaggctga

SEQ ID NO: 92642 - DNA, 75 bp, Artificial Sequence
  Synthetic
cgtcgacctgcctcgtgcggtacctgtgtgcgggactgctggcccgaaaccgggtcggtcagattcccattccac

SEQ ID NO: 92643 - DNA, 75 bp, Artificial Sequence
  Synthetic
ggggcgttcatgggtggtgctagtgtgtccccttcactcgtcactgtgctcctgggcgcagtggggggttgggag

SEQ ID NO: 92644 - DNA, 75 bp, Artificial Sequence
  Synthetic
tgtccccttcactcgtcactgtgctcctgggcgcagtggggggttgggagggcgttgtcaacgccgccagcttag

SEQ ID NO: 92645 - DNA, 75 bp, Artificial Sequence
  Synthetic
atcccagtcttgaccagtccaggggcgggcctcgcggggatcgctctagggttggttttgtactcagctaacaac

SEQ ID NO: 92646 - DNA, 75 bp, Artificial Sequence
  Synthetic
tggtgaagtgtcccactcccgccattaagcctcccactgggacgtttgggttcttccccggcgtaccgcccctta

SEQ ID NO: 92647 - DNA, 75 bp, Artificial Sequence
  Synthetic
gtctgctaacgacactaccccggtcttcttgcattcctgacagctatttccaacaggccgactactgtgacaagg

SEQ ID NO: 92648 - DNA, 75 bp, Artificial Sequence
  Synthetic
tcgatgcaacggcgaggacgcacgggtagaggcaggtcaggccggtactactacgctggggtgggcaaagccccg

SEQ ID NO: 92649 - DNA, 75 bp, Artificial Sequence
  Synthetic
gcctttgtggcactgtggggaagggtggtccggagagtggttgttggacggtcatgtggagagtcgctgtctttg

SEQ ID NO: 92650 - DNA, 75 bp, Artificial Sequence
  Synthetic
gcggaggctaggttggttccactcatacttctcctcctgtggtggtgggtgaatcagttggcggtccttggactt

SEQ ID NO: 92651 - DNA, 75 bp, Artificial Sequence
  Synthetic
gaatcagttggcggtccttggacttccttctgctcacgccgccgtagctggtgaggtgtttgctggtcccgccct

SEQ ID NO: 92652 - DNA, 75 bp, Artificial Sequence
  Synthetic
tttactcaaccaagctgtgcaggcactattggatggggaccgtcccggtcaacatgctgggttacggggaaacct

SEQ ID NO: 92653 - DNA, 75 bp, Artificial Sequence
  Synthetic
acctggtgttgtactttcggtggatgggcccccaacgcctaatgttccttgtgttgtggaagcttgctcggggag

SEQ ID NO: 92654 - DNA, 75 bp, Artificial Sequence
  Synthetic
gggtgggcggaggtggtggtgacccccacccatgtggtggtcaggaggacctcttcctacaagttgcttcgccag

SEQ ID NO: 92655 - DNA, 75 bp, Artificial Sequence
  Synthetic
gatttcggctacacgtggccgcacctctgtgctcggagctgagttctgctttgatgtcaccttcgaagtcgatac

SEQ ID NO: 92656 - DNA, 75 bp, Artificial Sequence
  Synthetic
gatttcggctactcgtggccgcacctctgtgctcggagctgagttctgctttgatgtcaccttcgaagtcgatac

SEQ ID NO: 92657 - DNA, 75 bp, Artificial Sequence
  Synthetic
gatttcggctacccgtggccgcacctctgtgctcggagctgagttctgctttgatgtcaccttcgaagtcgatac

SEQ ID NO: 92658 - DNA, 75 bp, Artificial Sequence
  Synthetic
gatttcggctacgcgtggccgcacctctgtgctcggagctgagttctgctttgatgtcaccttcgaagtcgatac

SEQ ID NO: 92659 - DNA, 75 bp, Artificial Sequence
  Synthetic
agccctattacgtagatggcattcctgtctcttgggaggccgatgcgagagcaccggcaatggtttacggtgctg

SEQ ID NO: 92660 - DNA, 75 bp, Artificial Sequence
  Synthetic
ctggaggcacaaagctgtgatctataggacgtggtgtaaagggtaccaggcgattcgccagcgggtgattcggag

SEQ ID NO: 92661 - DNA, 75 bp, Artificial Sequence
  Synthetic
aggtttcgtcagaggtcagtatcgagatcgggacggagactgaggattcagagctgactgaggcagatctgccac

SEQ ID NO: 92662 - DNA, 75 bp, Artificial Sequence
  Synthetic
tggcctcttacatctggccggacgctgtgatgttggtggtagtggctctagtacttctctttggcctcttcgatg

SEQ ID NO: 92663 - DNA, 75 bp, Artificial Sequence
  Synthetic
ggggacgcgggccgtccctacagtgtcaattgtggacaagctcttcgccggaggttgggccgctgtggtgggcca

SEQ ID NO: 92664 - DNA, 75 bp, Artificial Sequence
  Synthetic
cgagaatgctgcgagaattctcgagcctcacattgatgtcatcatggaggactgcagtacaccctctctctgtgg

SEQ ID NO: 92665 - DNA, 75 bp, Artificial Sequence
  Synthetic
tgtgatgttggtggtagtggctctagtacttctctttggcctcttcgatgcactcgactgggctttggaggagct

SEQ ID NO: 92666 - DNA, 75 bp, Artificial Sequence
  Synthetic
tcaattgtggacaagctcttcgccggaggttgggccgctgtggtgggccattgtcacagtgtcatagctgcggcg

SEQ ID NO: 92667 - DNA, 75 bp, Artificial Sequence
  Synthetic
ggagaagacataccccgcactccatcgcctgcacttatctcggttacggagagcggctcaggagagtttaccccg

SEQ ID NO: 92668 - DNA, 75 bp, Artificial Sequence
  Synthetic
gtgtgatggctggtgaaagggctacaaccattcggctcgtgtccaagatgtgcgctcgtggggcctatttgttcg

SEQ ID NO: 92669 - DNA, 75 bp, Artificial Sequence
  Synthetic
aaccattcggctcgtgtccaagatgtgcgctcgtggggcctatttgttcgaccatatgggctctttttcccgcgc

SEQ ID NO: 92670 - DNA, 75 bp, Artificial Sequence
  Synthetic
catccaggagtctgatacagctgaaagtgaggaaaacgtcttcaacgtggctctttctgttttaaaagccttgtt

SEQ ID NO: 92671 - DNA, 75 bp, Artificial Sequence
  Synthetic
gactgcccttggcacccctgtcgtgggattaaccatggcgggggcgttcatgggcggagccagcgtgtccccttc

SEQ ID NO: 92672 - DNA, 75 bp, Artificial Sequence
  Synthetic
tcactaggacggactgtcgcatcattcgagacgctgccaggaccttgagctgcggccagtgcgtcatgggcttgc

SEQ ID NO: 92673 - DNA, 75 bp, Artificial Sequence
  Synthetic
tcgagacgctgccaggaccttgagctgcggccagtgcgtcatgggcttgcccgtggtggctcggcgcggtgacga

SEQ ID NO: 92674 - DNA, 75 bp, Artificial Sequence
  Synthetic
atgcggccagccttgtcttcgacttcatggcagggaaactttcaactgaggacctgtggtatgccatcccagtgc

SEQ ID NO: 92675 - DNA, 75 bp, Artificial Sequence
  Synthetic
tcccaaccgcgcccgttgtcatccggcggtgcggaaagggctttcttggagtcacgaaggctgccttgactggaa

SEQ ID NO: 92676 - DNA, 75 bp, Artificial Sequence
  Synthetic
ccacttggttgaaccgtctgctgacaacgttgccacgttcatcatgtatcccagacagctatttccaacaggccg

SEQ ID NO: 92677 - DNA, 75 bp, Artificial Sequence
  Synthetic
aacgttgccacgttcatcatgtatcccagacagctatttccaacaggccgactactgtgacagggtctccgccat

SEQ ID NO: 92678 - DNA, 75 bp, Artificial Sequence
  Synthetic
tcgcgcagcatgggaacgtgcttgaacgggttgcttttcactacattccatggggcttcttcccgaaccattgcg

SEQ ID NO: 92679 - DNA, 75 bp, Artificial Sequence
  Synthetic
aacttacctttgaatgtgacaagtgtgaggctaggcaagagaccttggcgtccttctcttacatttggtcgggcg

SEQ ID NO: 92680 - DNA, 75 bp, Artificial Sequence
  Synthetic
acacctgtgggggccctcaacccaaggtggtggtctgccagtgatgacgtgacggtgtaccccctccctgacggg

SEQ ID NO: 92681 - DNA, 75 bp, Artificial Sequence
  Synthetic
ggttcgttgttggtggcggacaccaccaaggtgtacgttacaaacccggacaatgttgggaggagggtagacaag

SEQ ID NO: 92682 - DNA, 75 bp, Artificial Sequence
  Synthetic
ggtggtggtctgccagtgatgacgtgacggtgtaccccctccctgacggggcaacctcattggcgccttgcacat

SEQ ID NO: 92683 - DNA, 75 bp, Artificial Sequence
  Synthetic
aactagacgtggccatggaggtcgcagacttccgtgggtcgtccggatcccctgtcttgtgcgatgaggggcacg

SEQ ID NO: 92684 - DNA, 75 bp, Artificial Sequence
  Synthetic
ttgccacccccgcggggaagatggctgtccatgacaggctccaggaaatacttgaagggacaccggtcccattta

SEQ ID NO: 92685 - DNA, 75 bp, Artificial Sequence
  Synthetic
taagctgtgccggcattattggatggggactgttccggtcaacatgctgggttacggggaaacctcaccccttct

SEQ ID NO: 92686 - DNA, 75 bp, Artificial Sequence
  Synthetic
gcgagattcacgcggccgtggacccaagtcccaactgatgccaaaaccaccactgaacccccgccagtgccagct

SEQ ID NO: 92687 - DNA, 75 bp, Artificial Sequence
  Synthetic
gggactgttccggtcaacatgctgggttacggggaaacctcaccccttctcgcctcagataccccgaaggtcgta

SEQ ID NO: 92688 - DNA, 75 bp, Artificial Sequence
  Synthetic
aagggtgtctttaaggaggctcctcttttcatgccaactggggccggtaagagcacacgggtccctttggaatat

SEQ ID NO: 92689 - DNA, 75 bp, Artificial Sequence
  Synthetic
ccctggacttccggatagctgaaaagctcattttgggagacccagggaaggtagccaaggcggtgttaggggggg

SEQ ID NO: 92690 - DNA, 75 bp, Artificial Sequence
  Synthetic
ctgtgggagtcgaaaaagaccccttgcgccatctgcgtggatgctacgtgcttcgacagtagtattactgaagag

SEQ ID NO: 92691 - DNA, 75 bp, Artificial Sequence
  Synthetic
cgcttggccgggaaacatcctagcatctactgcggacatgacaccacggcattcacacgcattacggattcccct

SEQ ID NO: 92692 - DNA, 75 bp, Artificial Sequence
  Synthetic
atgggtgcgagccctggggaaatactatgcctcgggtaccatggttaccccggaaggggttcccgtgggagagag

SEQ ID NO: 92693 - DNA, 75 bp, Artificial Sequence
  Synthetic
gaggggcgtctctgtggtgatttgtgatgagtgccacagccatgactcgactgtgctgctggggattgggagggt

SEQ ID NO: 92694 - DNA, 75 bp, Artificial Sequence
  Synthetic
gatgagtgccacagccatgactcgactgtgctgctggggattgggagggtccgggaattggcgcgcggatgcgga

SEQ ID NO: 92695 - DNA, 75 bp, Artificial Sequence
  Synthetic
cttgctatattaaggtgaaagccgcttgcgatcgggttggactcaaaaacgtttccctcctgatcgctggcgatg

SEQ ID NO: 92696 - DNA, 75 bp, Artificial Sequence
  Synthetic
ccagcacccttctatcatcgagaccaaactggatgtgggagagatccccttctatgggcatggcatacccctgga

SEQ ID NO: 92697 - DNA, 75 bp, Artificial Sequence
  Synthetic
aaactggatgtgggagagatccccttctatgggcatggcatacccctggagaggatgcgcaccggacggcacctc

SEQ ID NO: 92698 - DNA, 75 bp, Artificial Sequence
  Synthetic
tgctaggggggtcaatgctattgcctattacagggggaaggacagttcgatcatcaaggatggggacctcgtggt

SEQ ID NO: 92699 - DNA, 75 bp, Artificial Sequence
  Synthetic
acccaatggcttcggccattggttacatcctcctttacccctggcatcccatcacacggtgggtcatcatccctc

SEQ ID NO: 92700 - DNA, 75 bp, Artificial Sequence
  Synthetic
cagtccctgcgtcggctgaactgtcgatgcagcggagaggacgcacaggcagaggccggtctgggcggtactatt

SEQ ID NO: 92701 - DNA, 75 bp, Artificial Sequence
  Synthetic
gcccggagggctgctcaaggctgcctaagcatgggttacacttatgaggaggcaataaggactgttaggccgcat

SEQ ID NO: 92702 - DNA, 75 bp, Artificial Sequence
  Synthetic
cggtgttggggggggcttacgccttccagtacaccccaaatcagcgagttaaggagatgctcaagctgtgggagt

SEQ ID NO: 92703 - DNA, 75 bp, Artificial Sequence
  Synthetic
actacgggctgctcgcagagccctccccggatggggcacagtgcactgtgatctgaaggggtgcaccccggtaag

SEQ ID NO: 92704 - DNA, 75 bp, Artificial Sequence
  Synthetic
gacgcaatgactcggcgccgactcggcgaccggccaaaaggtggtggatgggtgatgacagggttggtaggtcgt

SEQ ID NO: 92705 - DNA, 75 bp, Artificial Sequence
  Synthetic
aaatcccggtcaccttggtagccactataggtgggtcttaagagaaggttaagattcctcttgtgcctgcggcga

SEQ ID NO: 92706 - DNA, 75 bp, Artificial Sequence
  Synthetic
gggtgggcggctgttgttggccactgtcacagtgtcatagctgcggcggtggctgcctacggggcttctcgaagc

SEQ ID NO: 92707 - DNA, 75 bp, Artificial Sequence
  Synthetic
caacgcgcaggctcgcttggcgtctgccctcctgctgggggccgcagggactgcccttggaacacccgtcgttgg

SEQ ID NO: 92708 - DNA, 75 bp, Artificial Sequence
  Synthetic
gccctcctgctgggggccgcagggactgcccttggaacacccgtcgttggtttgaccatggcgggtgctttcatg

SEQ ID NO: 92709 - DNA, 75 bp, Artificial Sequence
  Synthetic
gggcggttgggagggcgtcgtcaatgcggccagccttgtcttcgatttcatggcagggaaattatcaactgaaga

SEQ ID NO: 92710 - DNA, 75 bp, Artificial Sequence
  Synthetic
gcggccagccttgtcttcgatttcatggcagggaaattatcaactgaagacttgtggtatgccatcccggtgctc

SEQ ID NO: 92711 - DNA, 75 bp, Artificial Sequence
  Synthetic
ctcagcaaacaactctggcactaccacttggttgaatcgtctgcttacgacgcttccccggtcttcttgcattcc

SEQ ID NO: 92712 - DNA, 75 bp, Artificial Sequence
  Synthetic
tgtggttgccctggtcaacagggagcctaaggtggatgaggtccaggtggggtatgtctgggacctgtgggagtg

SEQ ID NO: 92713 - DNA, 75 bp, Artificial Sequence
  Synthetic
ggggagctggggagcctttacgggcccttgtcggtctcggcctacgtggctgggatcttgggtctgggagaggtg

SEQ ID NO: 92714 - DNA, 75 bp, Artificial Sequence
  Synthetic
aactgtgccggcactattggatggggactgtgcctgtcaacatgttgggttacggggaaacttcaccccttctgg

SEQ ID NO: 92715 - DNA, 75 bp, Artificial Sequence
  Synthetic
ttgctgctgcttgagcaacggattgtcatggtcttcctgttggtgacaatggcggggatgtcgcaaggcgctccc

SEQ ID NO: 92716 - DNA, 75 bp, Artificial Sequence
  Synthetic
ttgctcttgtagggctaacggttcgcgtattccgaccggggagaaggtgtgggatcgagggaatgccacgctctt

SEQ ID NO: 92717 - DNA, 75 bp, Artificial Sequence
  Synthetic
cgtattccgaccggggagaaggtgtgggatcgagggaatgccacgctcttgtgtgattgccccaacggtccctgg

SEQ ID NO: 92718 - DNA, 75 bp, Artificial Sequence
  Synthetic
aggtcagcatcgagattgggacggagactgaggattcagaactgacagaggccgatttgccgccggcagctgcag

SEQ ID NO: 92719 - DNA, 75 bp, Artificial Sequence
  Synthetic
tgtggccctcgggtgcacagtttgcactgaccattgctggccgctgtatcaggcggggttggccgtgcgacccgg

SEQ ID NO: 92720 - DNA, 75 bp, Artificial Sequence
  Synthetic
tctcggttacggagagcagctcagaagagaagaccccgtcggtgtccccctcgcaggaggacactccgtcgtccg

SEQ ID NO: 92721 - DNA, 75 bp, Artificial Sequence
  Synthetic
gaactcggtagcctctacggacccttgtcggtttcggcatatgttgccggaatcctggggcttggggaggtctat

SEQ ID NO: 92722 - DNA, 75 bp, Artificial Sequence
  Synthetic
gcccttcgtcaataggacaactcccctcaccattagggggcccctgggcaaccagggtcgaggcaacccggtgcg

SEQ ID NO: 92723 - DNA, 75 bp, Artificial Sequence
  Synthetic
ctctggaaagtgccttttgacttctggcgtggagtgatgagcctgacacccctgttggtgtgcgtggcggccctg

SEQ ID NO: 92724 - DNA, 75 bp, Artificial Sequence
  Synthetic
tccgctcgaattgcaagttgggtgcttggtgggcaatgaacttacctttgaatgtgacaagtgtgaggcacggca

SEQ ID NO: 92725 - DNA, 75 bp, Artificial Sequence
  Synthetic
ggggctggcctcacgggggggttctatgaacccctggtgcgcaggtgttcggagctgatgggacgccgaaatcca

SEQ ID NO: 92726 - DNA, 75 bp, Artificial Sequence
  Synthetic
tggtatgtcgcaaggcgtgccggtcgtggagctgggttcacggccctttgaggccgggctgacgtggcagtcctg

SEQ ID NO: 92727 - DNA, 75 bp, Artificial Sequence
  Synthetic
gggccacaccggccaaacctccagtggtgaggccggtggggtccttgttggtggccgacaccactaaggtgtacg

SEQ ID NO: 92728 - DNA, 75 bp, Artificial Sequence
  Synthetic
gtggagctgggttcacggccctttgaggccgggctgacgtggcagtcctgttcctgcaggtccaatgggtcccgc

SEQ ID NO: 92729 - DNA, 75 bp, Artificial Sequence
  Synthetic
taaccaacccggataatgtggggaggagggtcgacaaggttactttctggcgggccccaagagttcatgacaaat

SEQ ID NO: 92730 - DNA, 75 bp, Artificial Sequence
  Synthetic
tgtatttgtcctgttatacctgatgaagctggctgaggcacggttggtcccgctgatcttgctattgctatggtg

SEQ ID NO: 92731 - DNA, 75 bp, Artificial Sequence
  Synthetic
tcggaaggccgctcaagcctgtctaagcatgggttacacttatgaggaggcaataaggactgtaaggccgcatgc

SEQ ID NO: 92732 - DNA, 75 bp, Artificial Sequence
  Synthetic
tggctccgctagctgcaccatagccgcactgggatcatcggatcgcgacgtggtggttgagctctccgagtgggg

SEQ ID NO: 92733 - DNA, 75 bp, Artificial Sequence
  Synthetic
cctggggaaatactatgcctcgggtaccatggtcaccccggagggggtgcccgtgggagagaggtactgtagatc

SEQ ID NO: 92734 - DNA, 75 bp, Artificial Sequence
  Synthetic
ggatgctgtgatgatggtgatggttgccttggtcttgctctttggtctgttcgacgcgttggactgggctttgga

SEQ ID NO: 92735 - DNA, 75 bp, Artificial Sequence
  Synthetic
aggtgaaagccgcctgccagagagtggggctgaaaaatgtctcacttctcatcgcgggcgatgactgcttgatca

SEQ ID NO: 92736 - DNA, 75 bp, Artificial Sequence
  Synthetic
agtgctgtgtgatggcgggtgagaaggccacaacggtccggttggtctccaagatgtgtgcgaggggagcctatt

SEQ ID NO: 92737 - DNA, 75 bp, Artificial Sequence
  Synthetic
tgcccggggtttgcatggctctcctcgggtagacctgatgggttcatacatgttcagggacacctacaggaggtg

SEQ ID NO: 92738 - DNA, 75 bp, Artificial Sequence
  Synthetic
tagtgaggccttgggcagagccctggcctcctacggttacgcgtgtgagccctcatatcatgcatcactagacac

SEQ ID NO: 92739 - DNA, 75 bp, Artificial Sequence
  Synthetic
ggccacaacggtccggttggtctccaagatgtgtgcgaggggagcctatttgttcgatcatatgggttccttctc

SEQ ID NO: 92740 - DNA, 75 bp, Artificial Sequence
  Synthetic
cctcatatcatgcatcactagacacagctcccttctgctccacttggttagccgagtgcaatgcagatgggaagc

SEQ ID NO: 92741 - DNA, 75 bp, Artificial Sequence
  Synthetic
ggtcaatcagcttgcagtcctcggactgccagcggtccatgccgccgtagctggggaggtgtttgcgggtccagc

SEQ ID NO: 92742 - DNA, 75 bp, Artificial Sequence
  Synthetic
caagatgtgaaccatttgcctcccgggttcgtcccgactgcgccagttgtcatccggcggtgcggaaagggcttc

SEQ ID NO: 92743 - DNA, 75 bp, Artificial Sequence
  Synthetic
cccctggcatcccatcacacggtgggtcatcatccctcacgtactaacttgtgcgtttaggggtggtggcacacc

SEQ ID NO: 92744 - DNA, 75 bp, Artificial Sequence
  Synthetic
gatgggccctcagcgtctaatgttccttgtgttgtggaagctcgctcggggggctttcccgctggctttgttgat

SEQ ID NO: 92745 - DNA, 75 bp, Artificial Sequence
  Synthetic
gctacgtcgcgaagcatgggaacatgcttgaacggcttgctgttcacgactttccatggggcttcatcccgaacc

SEQ ID NO: 92746 - DNA, 75 bp, Artificial Sequence
  Synthetic
atcctaggtggtggtcagccagtgacgacgtcacggtgtacccgcttccagatggggcaacttcgttgacgcctt

SEQ ID NO: 92747 - DNA, 75 bp, Artificial Sequence
  Synthetic
tacaggacgtggtgtaaaggataccaggcgattcgccagcgggtggttcggagccccctcggggaggggcgacct

SEQ ID NO: 92748 - DNA, 75 bp, Artificial Sequence
  Synthetic
aggtggagctggatgtggccatggaggtctctgacttccgtggctcgtctggctcaccggtcttgtgcgacgaag

SEQ ID NO: 92749 - DNA, 75 bp, Artificial Sequence
  Synthetic
ggctcaccggtcttgtgcgacgaagggcacgcggtaggaatgctcgtgtccgtgctccactctggtggtagggtt

SEQ ID NO: 92750 - DNA, 75 bp, Artificial Sequence
  Synthetic
atggttctcctgttcggtcttttcgacgcgctcgattgggccttagaggagctccttgtgtcgcggccttcgttg

SEQ ID NO: 92751 - DNA, 75 bp, Artificial Sequence
  Synthetic
cactaccattcgactggtctctaagatgtgcgcgcgaggtgcctatttgttcgaccacatgggttccttctcgcg

SEQ ID NO: 92752 - DNA, 75 bp, Artificial Sequence
  Synthetic
ccggcaaaaggagttttcaaagaggccccgttgtttatgcctacgggagcgggaaagagcacccgcgtcccgttg

SEQ ID NO: 92753 - DNA, 75 bp, Artificial Sequence
  Synthetic
tcgaccacatgggttccttctcgcgcgccgtcaaggagcgcctgctcgagtgggacgcggctctcgagcccctat

SEQ ID NO: 92754 - DNA, 75 bp, Artificial Sequence
  Synthetic
agaaaccgacgcctatcaaaatagacgtgatggccccgcgccaaactggcgaccggccaaaaggtggtggatggg

SEQ ID NO: 92755 - DNA, 75 bp, Artificial Sequence
  Synthetic
atggagcgccttgcggggaaacatccaagcatatactgtggccatgacaccactgctttcacgaggatcactgac

SEQ ID NO: 92756 - DNA, 75 bp, Artificial Sequence
  Synthetic
agttgcggccaatgcgtcatgggcttgcccgtggtggctaggcgcggcgacgaggttctgattggcgtctttcag

SEQ ID NO: 92757 - DNA, 75 bp, Artificial Sequence
  Synthetic
ggtccctctcgcgcttacggagagaaagcgcacggtccacaggtgttggccctaccggtgtaataagggcccggc

SEQ ID NO: 92758 - DNA, 75 bp, Artificial Sequence
  Synthetic
gatgttgaggggggtctcggtggtcatttgtgatgaatgccacagtcatgactcaactgtgctgttgggcattgg

SEQ ID NO: 92759 - DNA, 75 bp, Artificial Sequence
  Synthetic
atttgtgatgaatgccacagtcatgactcaactgtgctgttgggcattgggagggtccgggagctggcacgtggg

SEQ ID NO: 92760 - DNA, 75 bp, Artificial Sequence
  Synthetic
ggtgtcacaaaggctgccttgactggtcgggatcctgacttacatccaggaaacgtcatggtcttggggacggcg

SEQ ID NO: 92761 - DNA, 75 bp, Artificial Sequence
  Synthetic
catgacacagcacccatctatcattgagactaagctggatgtgggagagatccccttttatgggcatggcatacc

SEQ ID NO: 92762 - DNA, 75 bp, Artificial Sequence
  Synthetic
tgtgacggtttaccctctcccagatggggccaactcgttgacaccttgcacgtgccaggcggagtcctgttgggt

SEQ ID NO: 92763 - DNA, 75 bp, Artificial Sequence
  Synthetic
ctgagtgcgagcgtctggccggccagttttctgctagaggggtgaacgccattgcctattataggggcaaagaca

SEQ ID NO: 92764 - DNA, 75 bp, Artificial Sequence
  Synthetic
tcgtggtggaggccggggccattctggccccggccacacatgcttgtagcgctaaggggcaatatttcctcacaa

SEQ ID NO: 92765 - DNA, 75 bp, Artificial Sequence
  Synthetic
attgttgcgccatggaggacatcgggttctgcctggaaggtggatgcctggtggccctggggtgcacgatttgta

SEQ ID NO: 92766 - DNA, 75 bp, Artificial Sequence
  Synthetic
acgcagtaggaatgctggtgtcagtgctccactcaggggggcgggtcaccgccgctcgattcactcggccgtgga

SEQ ID NO: 92767 - DNA, 75 bp, Artificial Sequence
  Synthetic
cttgatcccaccattaccatctccctgcggacagtgcctgcttcggctgaattgtcgatgcagagacgaggacgc

SEQ ID NO: 92768 - DNA, 75 bp, Artificial Sequence
  Synthetic
gtctgtctcagcctatgtggctgggatactggggctcggggaggtttactcgggggtcctcactgtgggggtagc

SEQ ID NO: 92769 - DNA, 75 bp, Artificial Sequence
  Synthetic
actactacgcgggggtgggcaaagctcccgctggtgtggttcgctcgggtcctgtctggtcggcggtggaagccg

SEQ ID NO: 92770 - DNA, 75 bp, Artificial Sequence
  Synthetic
agtgaaggccatgggcccttacatggaacggctggcggggaaacatcctagcattttctgtgggcacgatacaac

SEQ ID NO: 92771 - DNA, 75 bp, Artificial Sequence
  Synthetic
ttggagatggactgaacagctggcctccaactactggattctggaatatctctggaaggtgccttttgacttctg

SEQ ID NO: 92772 - DNA, 75 bp, Artificial Sequence
  Synthetic
gaacggctggcggggaaacatcctagcattttctgtgggcacgatacaacagctttcactcggatcactgactcc

SEQ ID NO: 92773 - DNA, 75 bp, Artificial Sequence
  Synthetic
caactggcccctcttggtgggtgttcagcggaccatgtgccgggaaacactgtctcccggtccatcggatgaccc

SEQ ID NO: 92774 - DNA, 75 bp, Artificial Sequence
  Synthetic
ggtgtttctcctggtcactatggcgggcatgtctcagggcgcgcctgcctcggtgctggggtccaggccctttga

SEQ ID NO: 92775 - DNA, 75 bp, Artificial Sequence
  Synthetic
tgtgatgagtgccacagtcatgactcaactgtgttgctggggattggtcgggtcagagagttggcgcgggggtgt

SEQ ID NO: 92776 - DNA, 75 bp, Artificial Sequence
  Synthetic
ggccggccatcacatagtggacgacctggtccggaggctcggtgtggcggagggttatgtccgctgcgatgctgg

SEQ ID NO: 92777 - DNA, 75 bp, Artificial Sequence
  Synthetic
gacacagcatccatccatcattgagacaaagctggatgtaggggagatccccttctatgggcatggtatacccct

SEQ ID NO: 92778 - DNA, 75 bp, Artificial Sequence
  Synthetic
tgcccacgggggagcgggtttgggatcgagggaacgtctcactcctgtgtgactgccccaacggtccctgggtct

SEQ ID NO: 92779 - DNA, 75 bp, Artificial Sequence
  Synthetic
acaaagctggatgtaggggagatccccttctatgggcatggtataccccttgagaggatgcggacgggccggcac

SEQ ID NO: 92780 - DNA, 75 bp, Artificial Sequence
  Synthetic
tggagccacggacaaaatcagtggcccctctcgtgcccccagtatgtgtacggcgccgtttcagtgacctgcgta

SEQ ID NO: 92781 - DNA, 75 bp, Artificial Sequence
  Synthetic
ctcctcgcgaggggtcaatgccatcgcctattacaggggaaaggacagttctatcatcaaagatggggacctcgt

SEQ ID NO: 92782 - DNA, 75 bp, Artificial Sequence
  Synthetic
cgatgtgtggagtttggtgccaactggctcagccagctgcaccatagccgcactcgggacctcggatcgcgacgt

SEQ ID NO: 92783 - DNA, 75 bp, Artificial Sequence
  Synthetic
gatcccaccattaccatctccttgcggactgtgcctgcgtcggctgaattgtctatgcagcgccgaggacgcaca

SEQ ID NO: 92784 - DNA, 75 bp, Artificial Sequence
  Synthetic
gagaagtgctgtccttggctcaggctaagacggccgaggcctacacagcgaccgccaagtggcttgctggctgct

SEQ ID NO: 92785 - DNA, 75 bp, Artificial Sequence
  Synthetic
ttcccctgcgccacatgcattctggacaggcggcctgcctcgtgcggctcctgtgtgagggactgctggcccgaa

SEQ ID NO: 92786 - DNA, 75 bp, Artificial Sequence
  Synthetic
aggagccctccgttggcagctgcggcctcctacctgatggggttgggcgtcgggggcaacgctcaaacgcgtctg

SEQ ID NO: 92787 - DNA, 75 bp, Artificial Sequence
  Synthetic
ctgggaccgccctgggcactcctgtcgtgggtttaaccatggcgggggcgtttatgggaggtgctagcgtctctc

SEQ ID NO: 92788 - DNA, 75 bp, Artificial Sequence
  Synthetic
ggttcttcccgggagtcccccccctgaacaactgcatgctgctgggcactgaggtgtccgaggcattgggcgggg

SEQ ID NO: 92789 - DNA, 75 bp, Artificial Sequence
  Synthetic
acttcatggcggggaaactttcatcagaagatctgtggtatgctatcccagtgctgactagtccgggggcgggcc

SEQ ID NO: 92790 - DNA, 75 bp, Artificial Sequence
  Synthetic
ctgatgggtcggcggaatccggtctgcccggggtttgcatggctctcctcgggccggcctgatgggtttatacat

SEQ ID NO: 92791 - DNA, 75 bp, Artificial Sequence
  Synthetic
gccactggtgcggcggtgttcggagctgatgggtcggcggaatccggtctgcccggggtttgcatggctctcctc

SEQ ID NO: 92792 - DNA, 75 bp, Artificial Sequence
  Synthetic
gggccggcctgatgggtttatacatgttcagggtcacttgcaggaggtggatgcgggcaacttcattccgccccc

SEQ ID NO: 92793 - DNA, 75 bp, Artificial Sequence
  Synthetic
atgcgggcaacttcattccgcccccgcgctggttgctcttggactttgtatttgtcctgttatacctgatgaagc

SEQ ID NO: 92794 - DNA, 75 bp, Artificial Sequence
  Synthetic
actaccacttggttgaaccgtctgctgactacattacctaggtcttcatgcatcccagacagttacttccagcag

SEQ ID NO: 92795 - DNA, 75 bp, Artificial Sequence
  Synthetic
ccaagacagtgacagatgcggtggcggccatccaggtgaactgcgattggtcagtgatgaccctgtcgatcgggg

SEQ ID NO: 92796 - DNA, 75 bp, Artificial Sequence
  Synthetic
gctgactactgtgacaaagtctcagccgtgctccgccgattgagccttacccgcactgtggttgccctggtcaac

SEQ ID NO: 92797 - DNA, 75 bp, Artificial Sequence
  Synthetic
ccgcactgtggttgccctggtcaacagggagcctaaggtggacgaggttcaggtggggtacgtctgggacctgtg

SEQ ID NO: 92798 - DNA, 75 bp, Artificial Sequence
  Synthetic
tatacttctcttgctatggtggtgggtgaaccagctagcggtccttggactgccggctgccaacgccgccgtggc

SEQ ID NO: 92799 - DNA, 75 bp, Artificial Sequence
  Synthetic
tcgtgagtatgatactgggattagcaaacctagtgctgtacttccgatggatgggcccacagcgcctgatgttcc

SEQ ID NO: 92800 - DNA, 75 bp, Artificial Sequence
  Synthetic
agccccccgcttgccgctgcggcctcatacctcatggggttgggcgttgggggcaacgcgcaggcccgactggcc

SEQ ID NO: 92801 - DNA, 75 bp, Artificial Sequence
  Synthetic
gggcaactcaaagaaccagtttactctaccaagctgtgccggcactattggatggggacagtccctgtgaacatg

SEQ ID NO: 92802 - DNA, 75 bp, Artificial Sequence
  Synthetic
catacctcatggggttgggcgttgggggcaacgcgcaggcccgactggcctctgccctccttttgggagccgctg

SEQ ID NO: 92803 - DNA, 75 bp, Artificial Sequence
  Synthetic
gatggggacagtccctgtgaacatgctgggttacggtgaaacatcgcccctcctggcccctgacaccccgaaggt

SEQ ID NO: 92804 - DNA, 75 bp, Artificial Sequence
  Synthetic
ctgggttacggtgaaacatcgcccctcctggcccctgacaccccgaaggttgtacccttcgggacgtctggctgg

SEQ ID NO: 92805 - DNA, 75 bp, Artificial Sequence
  Synthetic
atgggcggtgctagcgtgtctccctcgctggtgaccgtccttttgggggcggttggcggctgggagggtgtggtc

SEQ ID NO: 92806 - DNA, 75 bp, Artificial Sequence
  Synthetic
ctacaagttgctgcgccagcaaatcctatcggctgctgtagctgagccctactacgtcgacggcattccggtctc

SEQ ID NO: 92807 - DNA, 75 bp, Artificial Sequence
  Synthetic
actacgtcgacggcattccggtctcgtgggacgcggacgctcgcgcgcccgccatggtctatggccctgggcaaa

SEQ ID NO: 92808 - DNA, 75 bp, Artificial Sequence
  Synthetic
tggtgctcctctttggcctgttcgacgcgttggactgggctttggaggagttgctggtgtcacggccttcattgc

SEQ ID NO: 92809 - DNA, 75 bp, Artificial Sequence
  Synthetic
cgcgttggactgggctttggaggagttgctggtgtcacggccttcattgcggcgattggctcgagtggtggagtg

SEQ ID NO: 92810 - DNA, 75 bp, Artificial Sequence
  Synthetic
aggaatgtggcgccctctgaggtttcatccgaggtgtccattgacattgggacggagactgaagactcagaactg

SEQ ID NO: 92811 - DNA, 75 bp, Artificial Sequence
  Synthetic
tccagacagctatttccaacaggctgactactgtgacagggtttcctccatgttgcgccgcctgagcctcactcg

SEQ ID NO: 92812 - DNA, 75 bp, Artificial Sequence
  Synthetic
tgtgcgcgaggggggcctatttgttcgaccatatgggctctttttcgcgcgccgtcagggagcgcctgcttgagt

SEQ ID NO: 92813 - DNA, 75 bp, Artificial Sequence
  Synthetic
cgaccatatgggctctttttcgcgcgccgtcagggagcgcctgcttgagtgggatgctgccttggagccgctttc

SEQ ID NO: 92814 - DNA, 75 bp, Artificial Sequence
  Synthetic
gctgcggccagtgcgtcatgggcttgcccgtggtggccaggcgcggcgacgaggtcctaatcggagtcttccagg

SEQ ID NO: 92815 - DNA, 75 bp, Artificial Sequence
  Synthetic
gccccgtagtgtcactaccgctgtggcattgtggggaggggtggtccggggagtggctcctagatggtcatgtgg

SEQ ID NO: 92816 - DNA, 75 bp, Artificial Sequence
  Synthetic
gacatcccccgcactccatcgccagcacttatctcggttactgagagcagctcagatgagaagaccccgtcggtg

SEQ ID NO: 92817 - DNA, 75 bp, Artificial Sequence
  Synthetic
caactcaaagaaccagtttactctaccaagctgtgccggcactactggatggggactgtgcctgttaacatgctg

SEQ ID NO: 92818 - DNA, 75 bp, Artificial Sequence
  Synthetic
ccaagctgtgccggcactactggatggggactgtgcctgttaacatgctgggctacggtgagacttccccccttc

SEQ ID NO: 92819 - DNA, 75 bp, Artificial Sequence
  Synthetic
gggtcacaaaggctgccttgacaggtcgggaccctgacctacatccagggaacgtcatggtattggggacggcta

SEQ ID NO: 92820 - DNA, 75 bp, Artificial Sequence
  Synthetic
gaggtggtggtcacacctacccacgtgatcatcaggcgcacttcctgttacaagctgctgcgccagcaaatcctg

SEQ ID NO: 92821 - DNA, 75 bp, Artificial Sequence
  Synthetic
ctacccccgtgggggcccttaacccaaggtggtggtcggccagtgatgacgtgacggtgtatccgctgccggatg

SEQ ID NO: 92822 - DNA, 75 bp, Artificial Sequence
  Synthetic
atggtctacggtcctggccaaagcgttaccattgacggggagcgttacacccttccgcaccagttgcggatgcgg

SEQ ID NO: 92823 - DNA, 75 bp, Artificial Sequence
  Synthetic
attcgatctgacggggccctctgccatggcttgtgcaagggggacaaggttgaactggacgtggccatggaggtc

SEQ ID NO: 92824 - DNA, 75 bp, Artificial Sequence
  Synthetic
caggcaagaaaccttggcctccttctcctacatttggtctggcgtgccactgactagggctactccggccaagcc

SEQ ID NO: 92825 - DNA, 75 bp, Artificial Sequence
  Synthetic
atggcttgtgcaagggggacaaggttgaactggacgtggccatggaggtctctgatttccgtgggtcgtctgggt

SEQ ID NO: 92826 - DNA, 75 bp, Artificial Sequence
  Synthetic
ctccattcgggaggcagggtcaccgctgctagattcactaggccctggacccaagtcccgacagacgccaagact

SEQ ID NO: 92827 - DNA, 75 bp, Artificial Sequence
  Synthetic
ctgctagattcactaggccctggacccaagtcccgacagacgccaagactaccactgaacccccaccagttccag

SEQ ID NO: 92828 - DNA, 75 bp, Artificial Sequence
  Synthetic
aagagcacgcgggtcccgttggaatatgggaatatggggcacaaggtacttatcctcaacccgtcggtcgctact

SEQ ID NO: 92829 - DNA, 75 bp, Artificial Sequence
  Synthetic
acatgctgccatgggctggggatctaaggtgtcagtcaaggatcttgccacccctgcggggaagatggctgtcca

SEQ ID NO: 92830 - DNA, 75 bp, Artificial Sequence
  Synthetic
agcgcctggcgggtaaacatcccagcatttactgtgggcacgacacaacagctttcacgaggatcaccgactccc

SEQ ID NO: 92831 - DNA, 75 bp, Artificial Sequence
  Synthetic
gtgatgagtgccacagtcatgactctactgtgttgttgggaattgggcgagttagggaactggcgcgtggttgcg

SEQ ID NO: 92832 - DNA, 75 bp, Artificial Sequence
  Synthetic
ccttccagtacaccccaaaccagcgagttagggagatgctcaagctatgggagtcaaagaaaacaccttgcgcca

SEQ ID NO: 92833 - DNA, 75 bp, Artificial Sequence
  Synthetic
agttagggagatgctcaagctatgggagtcaaagaaaacaccttgcgccatctgcgtggatgcgacgtgcttcga

SEQ ID NO: 92834 - DNA, 75 bp, Artificial Sequence
  Synthetic
actcagcatccttcaatcatagagaccaaactggatgttggtgagatccccttttatgggcatggtatccccctg

SEQ ID NO: 92835 - DNA, 75 bp, Artificial Sequence
  Synthetic
tcaagagaccttggcgtctttctcctacatttggtctggggtgccgctgaccagggctactcccgccaaacctcc

SEQ ID NO: 92836 - DNA, 75 bp, Artificial Sequence
  Synthetic
tggcctctgaccacccagaatgggtgcgagccctggggaaatactatgcttcaggcaccatggtcaccccggaag

SEQ ID NO: 92837 - DNA, 75 bp, Artificial Sequence
  Synthetic
gcgagccctggggaaatactatgcttcaggcaccatggtcaccccggaaggggttcccgttggtgagaggtattg

SEQ ID NO: 92838 - DNA, 75 bp, Artificial Sequence
  Synthetic
gtgcgagcgcttggctgggcagttttcgtctaggggtgtgaacgccattgcctattataggggtaaggactgttc

SEQ ID NO: 92839 - DNA, 75 bp, Artificial Sequence
  Synthetic
acgtgaccaacccggacaatgtggggaggagagtcgacaaggtgaccttctggcgcgcccctcgggtccatgaca

SEQ ID NO: 92840 - DNA, 75 bp, Artificial Sequence
  Synthetic
tcgtctaggggtgtgaacgccattgcctattataggggtaaggactgttctatcatcaaagatggagacctagtg

SEQ ID NO: 92841 - DNA, 75 bp, Artificial Sequence
  Synthetic
gaggaggtcgtcgaggtgacccttgatcccaccataaccatctccttgcgaactgtgccggcttcggctgaactg

SEQ ID NO: 92842 - DNA, 75 bp, Artificial Sequence
  Synthetic
tcgatgcagcggcgaggacgcacgggtagaggcaggtccgggcggtactactacgcgggggtcggcaaggcccct

SEQ ID NO: 92843 - DNA, 75 bp, Artificial Sequence
  Synthetic
caggtgcatggtaattactacaagtttccactggacaaactgcctaacatcatcgtggccctccacggaccagca

SEQ ID NO: 92844 - DNA, 75 bp, Artificial Sequence
  Synthetic
ctgggcaaaagtgcgcggcgtcaactggcccctcttggtgggtgttcagcggacgatgtgccgggaaacactgtc

SEQ ID NO: 92845 - DNA, 75 bp, Artificial Sequence
  Synthetic
ccaaaacaaaaatggaggctggcaaggtcctgagcgacctcaagctccctggcttagcggtccaccgcaagaagg

SEQ ID NO: 92846 - DNA, 75 bp, Artificial Sequence
  Synthetic
caacgatttgccatccaaagtggccggccaccacatagttgacgacctggtccgtcggctcggtgtggcggaggg

SEQ ID NO: 92847 - DNA, 75 bp, Artificial Sequence
  Synthetic
tgcccgtgggcgagaggtattgtaggtcctcgggggtcctgaccaccagcgccagcaattgcttgacttgctaca

SEQ ID NO: 92848 - DNA, 75 bp, Artificial Sequence
  Synthetic
tccgtcggctcggtgtggcggagggttacgtccgctgcgacgctgggcccatcttgatggtgggcttagctatcg

SEQ ID NO: 92849 - DNA, 75 bp, Artificial Sequence
  Synthetic
ggttggactgaaaaatgtctcactcctaatcgcgggcgatgactgcttgatcatatgtgagaggcctatatgcga

SEQ ID NO: 92850 - DNA, 75 bp, Artificial Sequence
  Synthetic
gtaaaaagggcccggccttgggaggcatggtggttactaaccccctggcagggtcaaagcctgatggtgctaatg

SEQ ID NO: 92851 - DNA, 75 bp, Artificial Sequence
  Synthetic
gagggtgggccgccgtggtcggtcactgccacagcgtcatagctgcggcggtggctgcgtatggggcttctcgga

SEQ ID NO: 92852 - DNA, 75 bp, Artificial Sequence
  Synthetic
ctataggtgggtcttaagggctggtcaaggtccctctggcgcttgtggcgagaaagcgcacggtccacaggtgtt

SEQ ID NO: 92853 - DNA, 75 bp, Artificial Sequence
  Synthetic
ggcaacgcgcaggcgcgcctggcttccgctctcctgttgggggccgccggcactgcccttggcactcccgtcgtg

SEQ ID NO: 92854 - DNA, 75 bp, Artificial Sequence
  Synthetic
gtgggcggttgggagggcgtggtcaacgccgccagccttgtcttcgacttcatggctgggaaactgtcaacagag

SEQ ID NO: 92855 - DNA, 75 bp, Artificial Sequence
  Synthetic
ggggatcgcgctagggctggtgttgtattcagccaacaactcagggactaccacttggttaaaccgtctgctaac

SEQ ID NO: 92856 - DNA, 75 bp, Artificial Sequence
  Synthetic
tattcagccaacaactcagggactaccacttggttaaaccgtctgctaaccacgttgcctcgttcatcttgcatc

SEQ ID NO: 92857 - DNA, 75 bp, Artificial Sequence
  Synthetic
ttctggccccggccacacacgtttgcagagcgagtgggcaatatttcctcacaaactgttgcgccctggagaaca

SEQ ID NO: 92858 - DNA, 75 bp, Artificial Sequence
  Synthetic
gctccgccggctgagcctcactcgtacggtggtgtccctggtcaacagggagcccaaggtcgatgaggttcaggt

SEQ ID NO: 92859 - DNA, 75 bp, Artificial Sequence
  Synthetic
tcatggccaggctccgggctctctgccccgtggtgtcactaccattgtggcattgcggggaggggtggtctggag

SEQ ID NO: 92860 - DNA, 75 bp, Artificial Sequence
  Synthetic
ccctgtcggtgtccgcatacgtggcgggcatcttggggctcggggaggtctattcaggggtcctcaccgtcgggg

SEQ ID NO: 92861 - DNA, 75 bp, Artificial Sequence
  Synthetic
ataacaggcgacgtcctgaatgggcaactcaaagaaccagtttactctaccaagttgtgccggcattattggatg

SEQ ID NO: 92862 - DNA, 75 bp, Artificial Sequence
  Synthetic
agttttggagatggactgagcagttggcctccaattactggattctggaatatctctggaaggtgccttttgact

SEQ ID NO: 92863 - DNA, 75 bp, Artificial Sequence
  Synthetic
gggactgtaccggtgaacatgctgggttacggagaaacttctccgcttctggcctccgacaccccaaaggtggta

SEQ ID NO: 92864 - DNA, 75 bp, Artificial Sequence
  Synthetic
accgttgctggccactgtatcaggcgggattggccgtgcgacctggcaagtccgccgcccagctggtgggggaac

SEQ ID NO: 92865 - DNA, 75 bp, Artificial Sequence
  Synthetic
ttatggttttcctgctggtgaccatggcggggatgtcgcaaggcgcccccgcttcggtcttggggtctcggccct

SEQ ID NO: 92866 - DNA, 75 bp, Artificial Sequence
  Synthetic
ctggggctcggcgaggtttactcgggggtcctcactgttggtgtggcgttgacgcgccgggtctacccggtccca

SEQ ID NO: 92867 - DNA, 75 bp, Artificial Sequence
  Synthetic
gcttcggtcttggggtctcggccctttgaagcgggtttgacatggcagtcctgttcttgcgaggcgaacgggtcg

SEQ ID NO: 92868 - DNA, 75 bp, Artificial Sequence
  Synthetic
tggtctacggtcctggccaaagtgttaccattgacggggagcgctacaccctaccgcaccagctgcggatgagga

SEQ ID NO: 92869 - DNA, 75 bp, Artificial Sequence
  Synthetic
gtgtgactgccccaacggcccctgggtctggctgccggccgtttgccaagcgatcggctggggcgaccctatcac

SEQ ID NO: 92870 - DNA, 75 bp, Artificial Sequence
  Synthetic
aattactggatcttggagtatctctggaaagtgccttttgacttctggcggggagtgatgagcctaacacccctg

SEQ ID NO: 92871 - DNA, 75 bp, Artificial Sequence
  Synthetic
tggcccctctcttgtccccagtttgtttacggcgccgtttcagtgacctgcgtctggggttccgtgtcttggttt

SEQ ID NO: 92872 - DNA, 75 bp, Artificial Sequence
  Synthetic
atgtcatcatggaggactgcagtacaccctctctctgtggtagtagccgagagatgcctgtgtggggagaagaca

SEQ ID NO: 92873 - DNA, 75 bp, Artificial Sequence
  Synthetic
agggaatgttacactattgtgtgactgccccaacggcccctgggtttggattccagccgtttgccaagcaattgg

SEQ ID NO: 92874 - DNA, 75 bp, Artificial Sequence
  Synthetic
tgccccaacggcccctgggtttggattccagccgtttgccaagcaattggctggggtgaccctatcactcattgg

SEQ ID NO: 92875 - DNA, 75 bp, Artificial Sequence
  Synthetic
ctggatcgtcggcctgcctcgtgtggcacctgtgtgcgggactgctggcccgaaaccgggtcggttagattccct

SEQ ID NO: 92876 - DNA, 75 bp, Artificial Sequence
  Synthetic
gcacctgtgtgcgggactgctggcccgaaaccgggtcggttagattccctttccatcggtgcggcgcgggcccaa

SEQ ID NO: 92877 - DNA, 75 bp, Artificial Sequence
  Synthetic
tgctgtttcagtgacctgcgtttggggttccgtgtcttggtttgcctctacgaagggacgcgattcgaagatcga

SEQ ID NO: 92878 - DNA, 75 bp, Artificial Sequence
  Synthetic
tgctgtttcagtgacctgcgtttggggttccgtgtcttggtttgcctctacgaagggacgcgattcgatgatcga

SEQ ID NO: 92879 - DNA, 75 bp, Artificial Sequence
  Synthetic
tgctgtttcagtgacctgcgtttggggttccgtgtcttggtttgcctctacgaagggacgcgattcgacgatcga

SEQ ID NO: 92880 - DNA, 75 bp, Artificial Sequence
  Synthetic
tgctgtttcagtgacctgcgtttggggttccgtgtcttggtttgcctctacgaagggacgcgattcgaggatcga

SEQ ID NO: 92881 - DNA, 75 bp, Artificial Sequence
  Synthetic
tgtgtggagtttggtgccagttggatctgccagctgcaccatagccgcgctcggtacgtcggaccgcgacaccgt

SEQ ID NO: 92882 - DNA, 75 bp, Artificial Sequence
  Synthetic
accatgaccaagatccgagactccttacatctggtgaaatgtcccaccccagccattgagcctcccaccgggacg

SEQ ID NO: 92883 - DNA, 75 bp, Artificial Sequence
  Synthetic
ggcgcggggctcacgggggggttctatgaacccctggtgcggcggtgttcagagctagctgggaggcgaaatccg

SEQ ID NO: 92884 - DNA, 75 bp, Artificial Sequence
  Synthetic
tcgtggcagacaccaccaaggtgtatgtgaccaatccagacaatgttgggaggagagtggacaaggttaccttct

SEQ ID NO: 92885 - DNA, 75 bp, Artificial Sequence
  Synthetic
gtttgtccggggtttgcatggctctcctcgggcaggcctgatgggttcatacatgttcagggccacctgcaggag

SEQ ID NO: 92886 - DNA, 75 bp, Artificial Sequence
  Synthetic
tgtgaccaatccagacaatgttgggaggagagtggacaaggttaccttctggcgttctccgagggtccacgacaa

SEQ ID NO: 92887 - DNA, 75 bp, Artificial Sequence
  Synthetic
aagctggctgaggctaggctggtccccttgattctgctcctgctgtggtggtgggtgaaccagttggcggtctta

SEQ ID NO: 92888 - DNA, 75 bp, Artificial Sequence
  Synthetic
ggccctgtcctggtgtcttggcctacccttcgtaagtatgatcctaggcctcgcaaacctggtgttgtacttccg

SEQ ID NO: 92889 - DNA, 75 bp, Artificial Sequence
  Synthetic
cgcacctctgtgctcggagccgagttctgctttgacgtcacctttgaagtggacacatcagttttgggatgggtg

SEQ ID NO: 92890 - DNA, 75 bp, Artificial Sequence
  Synthetic
ggaggttttcgcgggtccggccttgtcctggtgtctgggtctgcccttcgtgagtatgatcctgggtttggcgaa

SEQ ID NO: 92891 - DNA, 75 bp, Artificial Sequence
  Synthetic
tagcgctcctgagctctatgagcgcgggaggctggaggcataaagctgtgatctacagaacgtggtgtaaggggt

SEQ ID NO: 92892 - DNA, 75 bp, Artificial Sequence
  Synthetic
agtatcactgaagaggacgtggctttggagaccgagctctacgctctggcctccgaccgcccagaatgggtgcga

SEQ ID NO: 92893 - DNA, 75 bp, Artificial Sequence
  Synthetic
cccacgaagccgttgacctttgcctggtgcttggcttcctacatttggcccgatgccgtaatgttggtggtggtg

SEQ ID NO: 92894 - DNA, 75 bp, Artificial Sequence
  Synthetic
gcccgttggcgagaggtattgtaggtcctcaggagtactcaccaccagcgccagcaattgcttgacctgctacat

SEQ ID NO: 92895 - DNA, 75 bp, Artificial Sequence
  Synthetic
gggctggtgctcctctttggcctgttcgatgcgttggactgggctctcgaggaactactagtctcgcggccttcg

SEQ ID NO: 92896 - DNA, 75 bp, Artificial Sequence
  Synthetic
gtgggactgaaaaatgtctcactcctcatcgccggcgatgactgtttgatcatatgcgaacggcctatatgcgac

SEQ ID NO: 92897 - DNA, 75 bp, Artificial Sequence
  Synthetic
cctgcgccagcgggtggtgcggagccccctcggggaggggcggcccaccaagccgctgaccatagcctggtgctt

SEQ ID NO: 92898 - DNA, 75 bp, Artificial Sequence
  Synthetic
aagatgtgcgcgcgtggggcctatttgttcgaccatatgggctctctctcgcgtgccgtcaaggagcgcttgccc

SEQ ID NO: 92899 - DNA, 75 bp, Artificial Sequence
  Synthetic
catcataagggatgccgctcggactttgtcctgcggccagtgtgtcatgggcttgcccgtggtcgctcgccgcgg

SEQ ID NO: 92900 - DNA, 75 bp, Artificial Sequence
  Synthetic
gttggactgggccttggaggagctactggtctcccggccttcgttacggcgattggcccgggtggtagagtgctg

SEQ ID NO: 92901 - DNA, 75 bp, Artificial Sequence
  Synthetic
ttgtcctgcggccagtgtgtcatgggcttgcccgtggtcgctcgccgcggtgacgaggtcttgattggtgtcttt

SEQ ID NO: 92902 - DNA, 75 bp, Artificial Sequence
  Synthetic
catccgtcggtgcggcaagggctttctcggtgtcactaaggctgccttgacaggtcgggatcctgacttacatcc

SEQ ID NO: 92903 - DNA, 75 bp, Artificial Sequence
  Synthetic
tttccatggggcttcatcccgaaccatcgccacacccgtgggagccctaaatccaaggtggtggtccgccagtga

SEQ ID NO: 92904 - DNA, 75 bp, Artificial Sequence
  Synthetic
agcactgcgaacacgcatgcttcggtcgcgcggttgggcggagttggctcggggcctgttgtggcatccaggcct

SEQ ID NO: 92905 - DNA, 75 bp, Artificial Sequence
  Synthetic
gatggagctaactcgttgactccgtgcacatgccaggctgagtcttgttgggtcatcagatccgacggggcattg

SEQ ID NO: 92906 - DNA, 75 bp, Artificial Sequence
  Synthetic
ggatcctgacttacatccagggaacgtcatggttttggggacggctacgtcacgcagcatggggacatgtctgaa

SEQ ID NO: 92907 - DNA, 75 bp, Artificial Sequence
  Synthetic
gtcatggttttggggacggctacgtcacgcagcatggggacatgtctgaatggcctgctgttcactacattccat

SEQ ID NO: 92908 - DNA, 75 bp, Artificial Sequence
  Synthetic
agtcgctggcggtggttggggttcttagccctgctcatcgtagccctctttgggtgaactaaattcatctgttgc

SEQ ID NO: 92909 - DNA, 75 bp, Artificial Sequence
  Synthetic
ggttcgcctgtcctgtgcgacgaggggcacgcagtaggaatgctcgtgtccgtgcttcactctgggggtcgggtc

SEQ ID NO: 92910 - DNA, 75 bp, Artificial Sequence
  Synthetic
gtggtggtccgccagtgatgacgtcaccgtgtatccgctcccggatggggctaactcgttgacgccctgcacttg

SEQ ID NO: 92911 - DNA, 75 bp, Artificial Sequence
  Synthetic
accgtgtatccgctcccggatggggctaactcgttgacgccctgcacttgccaagctgagtcctgttgggtcatc

SEQ ID NO: 92912 - DNA, 75 bp, Artificial Sequence
  Synthetic
gaccaccactgagcccccaccggttccggcgaaaggagtgttcaaagaggccccgttgtttatgccgacgggagc

SEQ ID NO: 92913 - DNA, 75 bp, Artificial Sequence
  Synthetic
ccggcgaaaggagtgttcaaagaggccccgttgtttatgccgacgggagccggtaagagcacacgggtcccgctg

SEQ ID NO: 92914 - DNA, 75 bp, Artificial Sequence
  Synthetic
gctagacgtggctatggaggtctcggacttccgtggctcgtctggttcgcctgtcctatgcgacgagggacacgc

SEQ ID NO: 92915 - DNA, 75 bp, Artificial Sequence
  Synthetic
cactgtgcgggccatgggcccctacatggaacgcttggcggggagacatccaagcatctactgtggccatgatac

SEQ ID NO: 92916 - DNA, 75 bp, Artificial Sequence
  Synthetic
ctgtcctatgcgacgagggacacgcagtaggaatgctggtgtccgtgctccattctgggggtcgggttacggcgg

SEQ ID NO: 92917 - DNA, 75 bp, Artificial Sequence
  Synthetic
atggaacgcttggcggggagacatccaagcatctactgtggccatgatacaactgcattcactaggatcacagat

SEQ ID NO: 92918 - DNA, 75 bp, Artificial Sequence
  Synthetic
gatgctgaggggagtctcagtggtcatttgtgatgagtgccacagtcatgactcaaccgtgttgctgggaatagg

SEQ ID NO: 92919 - DNA, 75 bp, Artificial Sequence
  Synthetic
atttgtgatgagtgccacagtcatgactcaaccgtgttgctgggaataggacgggtcagggagttggcgcgtggc

SEQ ID NO: 92920 - DNA, 75 bp, Artificial Sequence
  Synthetic
tctgaacccctcagtcgcgacagtgcgggccatgggcccgtatatggagcggcttgcggggaaacatcctagtat

SEQ ID NO: 92921 - DNA, 75 bp, Artificial Sequence
  Synthetic
cgggccatgggcccgtatatggagcggcttgcggggaaacatcctagtatctactgtgggcacgatacaacagca

SEQ ID NO: 92922 - DNA, 75 bp, Artificial Sequence
  Synthetic
aatggtccagcatccctcgatcattgagacaaagttggacgtgggtgagatccccttttatgggcatggcatttc

SEQ ID NO: 92923 - DNA, 75 bp, Artificial Sequence
  Synthetic
ggcagtccttctgctccttctcgtggttgaggccggggccattctggccccggccacccacgcttgtcgagcgaa

SEQ ID NO: 92924 - DNA, 75 bp, Artificial Sequence
  Synthetic
tctggagcggatgcgtaccggcaggcatctcgtattctgtcactcaaaggcagagtgtgaacgtctggcggggca

SEQ ID NO: 92925 - DNA, 75 bp, Artificial Sequence
  Synthetic
tttagccaaccccaggcagatgttgaggggggtgtcggtggtcatatgtgatgagtgccacagtcatgactcaac

SEQ ID NO: 92926 - DNA, 75 bp, Artificial Sequence
  Synthetic
gttctatcatcaaagatggagacctcgtggtgtgcgctacagacgcgctctccacggggtacactggaaacttcg

SEQ ID NO: 92927 - DNA, 75 bp, Artificial Sequence
  Synthetic
ccttgggtgcaccgtttgtactgaccgatgctggccactgtatcaggcgggtttggctgtgcggcctggcaagtc

SEQ ID NO: 92928 - DNA, 75 bp, Artificial Sequence
  Synthetic
aaagagctcgcgcgtgggtgtggggtccagctggtcctctacgctaccgcaacgcctcctggctcccctatgact

SEQ ID NO: 92929 - DNA, 75 bp, Artificial Sequence
  Synthetic
attccgttaccgactgtgggcttgtggtggaggaggttgtcgaggtgacccttgatcccaccattaccatctcct

SEQ ID NO: 92930 - DNA, 75 bp, Artificial Sequence
  Synthetic
ggtggaggaggttgtcgaggtgacccttgatcccaccattaccatctccttgcgcacggtgcccgcttcggctga

SEQ ID NO: 92931 - DNA, 75 bp, Artificial Sequence
  Synthetic
actgtcgatgcagcggcgaagtcgcacaggtaggggccggtcgggccgatactactacgctggggtgggcaaagc

SEQ ID NO: 92932 - DNA, 75 bp, Artificial Sequence
  Synthetic
cctgacgtgtgcagttgaatgtgagcttaagtgggaaagtgagttttggagatggactgagcagctggcctccaa

SEQ ID NO: 92933 - DNA, 75 bp, Artificial Sequence
  Synthetic
tcgcggggggtcaatgccatagcctattatcgggggaaggacagttcaatcataaaggatggggatctcgtggtg

SEQ ID NO: 92934 - DNA, 75 bp, Artificial Sequence
  Synthetic
ggtttgcgtggccgcgttgctgctgctcgagcaacggattgtcatggtcttcctgttggtgacaatggctgggat

SEQ ID NO: 92935 - DNA, 75 bp, Artificial Sequence
  Synthetic
ccaccataaccatctccttgcggacagtgcccgcttcggctgaattgtcgatgcagcggcgaggacgcacaggta

SEQ ID NO: 92936 - DNA, 75 bp, Artificial Sequence
  Synthetic
cagggctaacggttcgcgtgttccgactggggaaaaggtctgggaccgtgggaacgtcacgcttttgtgtgattg

SEQ ID NO: 92937 - DNA, 75 bp, Artificial Sequence
  Synthetic
actggggaaaaggtctgggaccgtgggaacgtcacgcttttgtgtgattgccccaacggcccctgggtttggcta

SEQ ID NO: 92938 - DNA, 75 bp, Artificial Sequence
  Synthetic
ccacggacaaaatcggtggcccctctcatgcccccaatatgtctatgggtctgtttcagtcacttgcgtgtgggg

SEQ ID NO: 92939 - DNA, 75 bp, Artificial Sequence
  Synthetic
tgtggagtttggtgccagttggttctgccacctgtaccgtagccgcactcggttcatcggaccgcgacacagtgg

SEQ ID NO: 92940 - DNA, 75 bp, Artificial Sequence
  Synthetic
tgatttgccatcaaaagtggccggccaccacatagtggacgacctggtcagaagactcggtgtggcggagggtta

SEQ ID NO: 92941 - DNA, 75 bp, Artificial Sequence
  Synthetic
ggcagccatccaggtgaactgtgattggtcagtcatgaccctgtcgatcggggaagtgctggccttggctcaggc

SEQ ID NO: 92942 - DNA, 75 bp, Artificial Sequence
  Synthetic
tggtcagtcatgaccctgtcgatcggggaagtgctggccttggctcaggctaagacagccgaggcctacacagct

SEQ ID NO: 92943 - DNA, 75 bp, Artificial Sequence
  Synthetic
tgtttcaattgtggacaaactcttcgccggagggtgggccgcagtcgtaggtcattgccacagcgttatagctgc

SEQ ID NO: 92944 - DNA, 75 bp, Artificial Sequence
  Synthetic
tgaaatgtcccacaccagccattgagcctcccaccgggacgtttgggttcttccccgggacgccgcccctcaaca

SEQ ID NO: 92945 - DNA, 75 bp, Artificial Sequence
  Synthetic
cttcctatctgatggggttgggtgatggaggcaatgctcaggcgcgcttggcctctgccctcctgctgggggcag

SEQ ID NO: 92946 - DNA, 75 bp, Artificial Sequence
  Synthetic
tggaggcaatgctcaggcgcgcttggcctctgccctcctgctgggggcagctggcactgccttggggacccctgt

SEQ ID NO: 92947 - DNA, 75 bp, Artificial Sequence
  Synthetic
gggacgccgaaatccggtctgcccggggtatgcatggctttcctcgggtcggcctgatgggtttatacatgttca

SEQ ID NO: 92948 - DNA, 75 bp, Artificial Sequence
  Synthetic
cttcgctggtcacggtccttttgggggccgtgggtggctgggagggcgtggtcaacgccgccagtcttgtcttcg

SEQ ID NO: 92949 - DNA, 75 bp, Artificial Sequence
  Synthetic
gtcaacgccgccagtcttgtcttcgacttcatggcagggaagttgtcaacggacgacctgtggtatgctatccca

SEQ ID NO: 92950 - DNA, 75 bp, Artificial Sequence
  Synthetic
cctaatgggattgggcgttggaggcaacgcgcaggcacgcttggcttctgccctccttttgggggccgcgggcac

SEQ ID NO: 92951 - DNA, 75 bp, Artificial Sequence
  Synthetic
aacgcgcaggcacgcttggcttctgccctccttttgggggccgcgggcacggccctggggactcccgtcgtgggg

SEQ ID NO: 92952 - DNA, 75 bp, Artificial Sequence
  Synthetic
gttgtactcagctaacaactctggcactaccacttggttgaaccgtctgctgaccacacttccccggtcctcatg

SEQ ID NO: 92953 - DNA, 75 bp, Artificial Sequence
  Synthetic
ggtcactgttcttttgggagcagtgggcggttgggagggcgtggtcaacgctgccagccttgtcttcgacttcat

SEQ ID NO: 92954 - DNA, 75 bp, Artificial Sequence
  Synthetic
catcccggacagttatttccaacaggccgactactgtgacaaggtttcagccatgctccgacgcctgagcctcac

SEQ ID NO: 92955 - DNA, 75 bp, Artificial Sequence
  Synthetic
gttgtggacgccgccgtggcaggtgaggtctttgcgggccctgccctgtcgtggtgtctgggccttccggtcgtc

SEQ ID NO: 92956 - DNA, 75 bp, Artificial Sequence
  Synthetic
ctgccagccttgtcttcgacttcatggcggggaaactgtcaacagaagatctatggtatgccatcccagtgctta

SEQ ID NO: 92957 - DNA, 75 bp, Artificial Sequence
  Synthetic
aggtctttgcgggccctgccctgtcgtggtgtctgggccttccggtcgtcagtatgatactgggtttagctaatc

SEQ ID NO: 92958 - DNA, 75 bp, Artificial Sequence
  Synthetic
gtggcattgcggggaggggtggtccggagaatggttgttagacggccatgtggagagtcgctgcctgtgtgggtg

SEQ ID NO: 92959 - DNA, 75 bp, Artificial Sequence
  Synthetic
cagacgcctgagcctcactagaacagtggtagctctggtcaacagggagccaaaggtggatgaggttcaggtagg

SEQ ID NO: 92960 - DNA, 75 bp, Artificial Sequence
  Synthetic
gggcaactcaaagatccagtttactcaaccaagctgtgccgacactattggatggggaccgtcccggtcaacatg

SEQ ID NO: 92961 - DNA, 75 bp, Artificial Sequence
  Synthetic
gatggggaccgtcccggtcaacatgctgggttacggggaaacatcgcttctcctagcttctgacacgccaaaggt

SEQ ID NO: 92962 - DNA, 75 bp, Artificial Sequence
  Synthetic
cgtagtgtcgctacctttgtggcattgcggggaggggtggtccggagagtggttgctggacggccacgtggaaag

SEQ ID NO: 92963 - DNA, 75 bp, Artificial Sequence
  Synthetic
cctcatacatctggccggatgttgtgatgatggtggtggtcgccttggtactcctctttggtctgttcgatgcgt

SEQ ID NO: 92964 - DNA, 75 bp, Artificial Sequence
  Synthetic
acgtggtgattcgacggacctcatgctacaagttgttgcgccagcaaatactctctgcagctgtagctgagccct

SEQ ID NO: 92965 - DNA, 75 bp, Artificial Sequence
  Synthetic
attacgtggatggcattcctgtctcgtgggaggccgacgcgcgagcgccggctatggtctacggtcctggtcaaa

SEQ ID NO: 92966 - DNA, 75 bp, Artificial Sequence
  Synthetic
gtccgacacgcctaaggtggtaccttttggcacgtcgggctgggctgaggtggtggttacccctactcacgtggt

SEQ ID NO: 92967 - DNA, 75 bp, Artificial Sequence
  Synthetic
tggtagcacgccgcggtgacgaggttcttatcggcgtcttccaggatgtgaaccatttgcctcccgggtttgtcc

SEQ ID NO: 92968 - DNA, 75 bp, Artificial Sequence
  Synthetic
acaaaggctgccttgacgggtcgggatcctgacttacatccagggaacgtcatggtgttggggacggcaacgtcg

SEQ ID NO: 92969 - DNA, 75 bp, Artificial Sequence
  Synthetic
ccgtacccaaagccttattcccgcagagcgacgccacacggaagctaacagttaggatgtcatgctgtgtggaaa

SEQ ID NO: 92970 - DNA, 75 bp, Artificial Sequence
  Synthetic
acctcgttgacgccctgcacttgccaggccgagtcctgttgggttatcagatccgacggggctttatgccatggc

SEQ ID NO: 92971 - DNA, 75 bp, Artificial Sequence
  Synthetic
gatactgctgagagtgaggaaagcgtcttcaacgtggctctttccgtactaaaagccttatttccacagagcgat

SEQ ID NO: 92972 - DNA, 75 bp, Artificial Sequence
  Synthetic
cctttgaatgtgacaagtgtgaggcacggcaagagaccttggcttccttctcctacatctggtctggggtgccgc

SEQ ID NO: 92973 - DNA, 75 bp, Artificial Sequence
  Synthetic
cttccgtggctcatctggctcgccagtcctgtgcgacgagggacacgcagtaggaatgctcgtgtcggtgctcca

SEQ ID NO: 92974 - DNA, 75 bp, Artificial Sequence
  Synthetic
taggaatgctcgtgtcggtgctccattctgggggtagggtcaccgcggcccgcttcactcggccgtggacccaag

SEQ ID NO: 92975 - DNA, 75 bp, Artificial Sequence
  Synthetic
ctgttagtggcagacaccaccaaagtctacgtgacaaacccacacaatgtggggaggagggttgacaatgtgacc

SEQ ID NO: 92976 - DNA, 75 bp, Artificial Sequence
  Synthetic
ggccatgggcccatacatggagcggctggcgggcaaacatccaagcatatactgtggacatgacactactgcttt

SEQ ID NO: 92977 - DNA, 75 bp, Artificial Sequence
  Synthetic
gtgaggccggtggggtccctgttggtggcagacaccaccaaggtgtacgtaaccaacccagataacgttgggaga

SEQ ID NO: 92978 - DNA, 75 bp, Artificial Sequence
  Synthetic
ctggcgggcaaacatccaagcatatactgtggacatgacactactgctttcacgaggattacggattcgcctcta

SEQ ID NO: 92979 - DNA, 75 bp, Artificial Sequence
  Synthetic
tggcagacaccaccaaggtgtacgtaaccaacccagataacgttgggagaagggttgacaaggtgactttctggc

SEQ ID NO: 92980 - DNA, 75 bp, Artificial Sequence
  Synthetic
aggcgtctcagtggtcatttgtgatgagtgccacagtcatgactcaacggtgctgttggggattggccgggtccg

SEQ ID NO: 92981 - DNA, 75 bp, Artificial Sequence
  Synthetic
gagtgccacagtcatgactcaacggtgctgttggggattggccgggtccgggagttggcgcgtgggtgtggggtg

SEQ ID NO: 92982 - DNA, 75 bp, Artificial Sequence
  Synthetic
acttccggatagctgcaaagctcattctgggagacccggctcgggtgcccaaggcggtgttgggaggggcctatg

SEQ ID NO: 92983 - DNA, 75 bp, Artificial Sequence
  Synthetic
acatccctctataattgagactaaactggatgtgggtgaaatccccttctatgggcatggcatacccctcgagcg

SEQ ID NO: 92984 - DNA, 75 bp, Artificial Sequence
  Synthetic
gagtcgaaaaagaccccgtgcgccatctgtgtggacgctacgtgcttcgacagtagcattactgaagaggacgtg

SEQ ID NO: 92985 - DNA, 75 bp, Artificial Sequence
  Synthetic
agcgacttgccggtcagttttctgccaggggggtgaacgccatcgcctattacagggggaaggacagttcaatca

SEQ ID NO: 92986 - DNA, 75 bp, Artificial Sequence
  Synthetic
gcgcgccctggggaaatactatgcctctggcaccatggttacccctgagggggtgcccgtgggcgagaggtattg

SEQ ID NO: 92987 - DNA, 75 bp, Artificial Sequence
  Synthetic
agcgccagcaattgcttgacctgctacatcaaggtgaaagccgcctgcgatcgggtgggactcaaaaacgtgtct

SEQ ID NO: 92988 - DNA, 75 bp, Artificial Sequence
  Synthetic
cgaccgaccagagtgggtgcgcgcccttgggaagtactatgcctctggcactatggtcacccctgagggggtgcc

SEQ ID NO: 92989 - DNA, 75 bp, Artificial Sequence
  Synthetic
tgtggggcgctcgggtcctgtctggtcggcggtggaagccggagtgacctggtacggaatggaacctgacttgac

SEQ ID NO: 92990 - DNA, 75 bp, Artificial Sequence
  Synthetic
tggcttgctgagtgcaatgcagatgggaagcgccatttcttcctgaccacggactttcggaggccactggctcgc

SEQ ID NO: 92991 - DNA, 75 bp, Artificial Sequence
  Synthetic
ggtacggaatggaacctgacttgacagcaaacctactgagactttacgacgactgcccttacaccgcagccgtcg

SEQ ID NO: 92992 - DNA, 75 bp, Artificial Sequence
  Synthetic
tggcttcggccattgggtacatcctcctatacccctggcatcccatcacacggtgggtcatcatccctcacgtgc

SEQ ID NO: 92993 - DNA, 75 bp, Artificial Sequence
  Synthetic
ctggggcgttgcgcacgcgcatgctccggtcgcacgattgggcagagctggctcggggcctgttgtggcatccag

SEQ ID NO: 92994 - DNA, 75 bp, Artificial Sequence
  Synthetic
tagccactataggtgggtcttaagggtgggtcaaggcacctcttactcctgcggcgggacagcgcacggtccaca

SEQ ID NO: 92995 - DNA, 75 bp, Artificial Sequence
  Synthetic
ctccctacatgggagtggtccatcaattggatttcacagcccagagaagtcgctggcggtggttggggttctttg

SEQ ID NO: 92996 - DNA, 75 bp, Artificial Sequence
  Synthetic
tggcttgctggctgctacacggggacgcgggccgtccccactgtttccattgttgacaagctcttcgccggaggg

SEQ ID NO: 92997 - DNA, 75 bp, Artificial Sequence
  Synthetic
tgttgacaagctcttcgccggagggtgggcggctgtggtgggccactgtcacagcgtcatagctgcggcggtggc

SEQ ID NO: 92998 - DNA, 75 bp, Artificial Sequence
  Synthetic
cgctcagacgcgcttggcgtctgccctcctactgggagcggctggaaccgccctgggcactcccgtcgtgggttt

SEQ ID NO: 92999 - DNA, 75 bp, Artificial Sequence
  Synthetic
tttcctgactaatcatggcagtccttctgcttcttttcgtggttgaggccggggccattctggccccggccaccc

SEQ ID NO: 93000 - DNA, 75 bp, Artificial Sequence
  Synthetic
ccctgggcactcccgtcgtgggtttaaccatggcgggggcgttcatgggtggcgccagcgtctcaccttccttgg

SEQ ID NO: 93001 - DNA, 75 bp, Artificial Sequence
  Synthetic
cccaaaccctgcccttcccggtgggccgggaaatgcatggggccacccagctccgcggcggcctgcagccggggt

SEQ ID NO: 93002 - DNA, 75 bp, Artificial Sequence
  Synthetic
agcaaacaactctggcactaccacttggttgaaccgtctgctgaccacgttaccgcggtcttcgtgcatccctga

SEQ ID NO: 93003 - DNA, 75 bp, Artificial Sequence
  Synthetic
acgtggctgggatcttaggacttggggaggtgtactccggcgtcctcacggtgggcgttgcgttgacgcgtcggg

SEQ ID NO: 93004 - DNA, 75 bp, Artificial Sequence
  Synthetic
gtcgcctgagccttacccgcactgtggttgccctggtcaacagggagcctaaggtggacgaggtgcaggtggggt

SEQ ID NO: 93005 - DNA, 75 bp, Artificial Sequence
  Synthetic
aggcgggtttggctgtgcggcctggcaagtccgcggcccagctcgttggggaactggggagcctgtacgggccct

SEQ ID NO: 93006 - DNA, 75 bp, Artificial Sequence
  Synthetic
agcagttggcctctaattactggatcctggaatatctctggaaggtgcctttcgacttctggcggggagtgatga

SEQ ID NO: 93007 - DNA, 75 bp, Artificial Sequence
  Synthetic
tccggggtcctgacagttggtgttgcgttgaggcgccgggtctacctgatgcccaacctgaagtgtgcagtagaa

SEQ ID NO: 93008 - DNA, 75 bp, Artificial Sequence
  Synthetic
cgagtggtcatggtcttcctgctcgtcactatggctgggatgtcgcaaggcgccccagcttcagtgatgggatca

SEQ ID NO: 93009 - DNA, 75 bp, Artificial Sequence
  Synthetic
cgttgaggcgccgggtctacctgatgcccaacctgaagtgtgcagtagaatgtgacgttaagtggggaagtgagt

SEQ ID NO: 93010 - DNA, 75 bp, Artificial Sequence
  Synthetic
gggactcgtgttcttgcagagcgaacggctcgcgcgtgccgacaggggagaaggtttgggatcgtggtaacgtca

SEQ ID NO: 93011 - DNA, 75 bp, Artificial Sequence
  Synthetic
ctttggaaagtcccatttgaattttggagaggagtgatgagcctgacccctctgttggtttgggtggccgcattg

SEQ ID NO: 93012 - DNA, 75 bp, Artificial Sequence
  Synthetic
ggagaggagtgatgagcctgacccctctgttggtttgggtggccgcattgcttttgctggagcaacggattgtca

SEQ ID NO: 93013 - DNA, 75 bp, Artificial Sequence
  Synthetic
ccgacaccccgaaggtggtaccttttgggacgtctggctgggctgaggtggtggtgacccctacccacgtggtga

SEQ ID NO: 93014 - DNA, 75 bp, Artificial Sequence
  Synthetic
ctatcactcattggagccacggacaaaatcagtggcccctatcatgcccccagtatgtctacggcgccgtttcag

SEQ ID NO: 93015 - DNA, 75 bp, Artificial Sequence
  Synthetic
tccgttttggggtcccgcccctttgactacgggttgaagtggcagtcatgctcctgcagggctaacgggtcgcgt

SEQ ID NO: 93016 - DNA, 75 bp, Artificial Sequence
  Synthetic
aaatcagtggcccctatcatgcccccagtatgtctacggcgccgtttcagtgacctgcgtgtggggttccgtgtc

SEQ ID NO: 93017 - DNA, 75 bp, Artificial Sequence
  Synthetic
actacgggttgaagtggcagtcatgctcctgcagggctaacgggtcgcgtattcccactggggagagggtgtggg

SEQ ID NO: 93018 - DNA, 75 bp, Artificial Sequence
  Synthetic
tggtgccaactggttcaaccagctgtaccataccccctcttgggacctcggatcgcaacacattgccggagctct

SEQ ID NO: 93019 - DNA, 75 bp, Artificial Sequence
  Synthetic
tgggtcccggccttttgccaggcggttgggtggggcgaccccatcacccattggagccacggacaaaaccagtgg

SEQ ID NO: 93020 - DNA, 75 bp, Artificial Sequence
  Synthetic
taccataccccctcttgggacctcggatcgcaacacattgccggagctctccaagtgggggatcccccgcgccac

SEQ ID NO: 93021 - DNA, 75 bp, Artificial Sequence
  Synthetic
ttgggtggggcgaccccatcacccattggagccacggacaaaaccagtggcccctatcatgcccccaatatgtct

SEQ ID NO: 93022 - DNA, 75 bp, Artificial Sequence
  Synthetic
gcaccagctgcggcttaggaatgtggcgccctctgaggtttcatccgaggtgtccattgacattgggacggagac

SEQ ID NO: 93023 - DNA, 75 bp, Artificial Sequence
  Synthetic
gctggcccgaaaccgggtccatgcggattccaatccataggtgcggtgcggtccctcggttgacacgtgacttgg

SEQ ID NO: 93024 - DNA, 75 bp, Artificial Sequence
  Synthetic
tcgaccggcggtcgtgattcgaagatcgatgtgtggagtttggtgccggttggatctgccagctgcaccatagcc

SEQ ID NO: 93025 - DNA, 75 bp, Artificial Sequence
  Synthetic
tcgatgtgtggagtttggtgccggttggatctgccagctgcaccatagccgctctagggtcatcggatcgcgaca

SEQ ID NO: 93026 - DNA, 75 bp, Artificial Sequence
  Synthetic
aggctgtgcccttcgccaataggacgactcccttcaccattcgggggcccctgggcaaccagggccggggcaatc

SEQ ID NO: 93027 - DNA, 75 bp, Artificial Sequence
  Synthetic
ccactcctgccattgagcctccgactgggacgttcgggttcttccctggagtgcccccgctaaacaactgcatgc

SEQ ID NO: 93028 - DNA, 75 bp, Artificial Sequence
  Synthetic
aagccttgtttccacagagcgacgcgaccagaaagcttaccgtcaaaatgtcatgctgtgtggagaagagcgtca

SEQ ID NO: 93029 - DNA, 75 bp, Artificial Sequence
  Synthetic
gcccctgggttttgggtcctacaccatgaccaagatccgggattccctgcatttggtgaaatgtcccacaccagc

SEQ ID NO: 93030 - DNA, 75 bp, Artificial Sequence
  Synthetic
catagagcctccgactggaacgttcgggttcttccccggagtcccgcccattaacaactgcatgccgctaggcac

SEQ ID NO: 93031 - DNA, 75 bp, Artificial Sequence
  Synthetic
atcccacctccgcgatggctgctcttggactttgtatttgtcctgttatacctgatgaagctggctgaggctcgg

SEQ ID NO: 93032 - DNA, 75 bp, Artificial Sequence
  Synthetic
ggtcctaggactgcctgctgtggacgccgccgtggcgggtgaggtgttcgcgggcccagccttgtcgtggtgcct

SEQ ID NO: 93033 - DNA, 75 bp, Artificial Sequence
  Synthetic
gcggacaccaccaaggtgtatgtcaccaatccagacaacgtgggacgaagggtggacaaggttaccttctggcgc

SEQ ID NO: 93034 - DNA, 75 bp, Artificial Sequence
  Synthetic
cgtccaggggcacctgcaggaggtggatgcgggcaacttcatccctcctccacgctggttgctcttggattttgt

SEQ ID NO: 93035 - DNA, 75 bp, Artificial Sequence
  Synthetic
gccgccgtggcgggtgaggtgttcgcgggcccagccttgtcgtggtgcctgggccttcccgtcgtcagtatgatc

SEQ ID NO: 93036 - DNA, 75 bp, Artificial Sequence
  Synthetic
tcgtggactctatcgagcgagccaagagggctgctcaagcctgcctaagcatgggttacacttatgaggaggcaa

SEQ ID NO: 93037 - DNA, 75 bp, Artificial Sequence
  Synthetic
cctcatgttcctcgtgctgtggaagctcgctcggggggcattcccgctggctctcttgatggggatttcggcgac

SEQ ID NO: 93038 - DNA, 75 bp, Artificial Sequence
  Synthetic
ggtgaaccagttggcggttctaggactgccggctgtggacgctgccgtggcgggtgaagtttttgcgggccctgc

SEQ ID NO: 93039 - DNA, 75 bp, Artificial Sequence
  Synthetic
acctctgtgctcggggccgagttctgcttcgatgtcacattcgaggtggacacttcggtgttgggctgggtggtg

SEQ ID NO: 93040 - DNA, 75 bp, Artificial Sequence
  Synthetic
gggacgtcctaccaaacccttgacgttcgcttggtgcttagcctcatacatctggcctgatgcggtgatgatggt

SEQ ID NO: 93041 - DNA, 75 bp, Artificial Sequence
  Synthetic
ggggtggaagcacaaggccgtgatctataggacgtggtgtaaagggtaccaggctgtgcgccagagggtggtgcg

SEQ ID NO: 93042 - DNA, 75 bp, Artificial Sequence
  Synthetic
gccctcgttgcggcgtttggctcgggtggttgagtgctgtgtgatggctggcgagaaggccactaccattcggct

SEQ ID NO: 93043 - DNA, 75 bp, Artificial Sequence
  Synthetic
gcttggcctcatacatctggccggatgctgtgatgatggtggtggtggccttggtcctcctcttcggcctgttcg

SEQ ID NO: 93044 - DNA, 75 bp, Artificial Sequence
  Synthetic
cgggaaatactatgcctcaggcaccatggtcactccggaaggggtgcccgttggtgagaggtattgtaggtcctc

SEQ ID NO: 93045 - DNA, 75 bp, Artificial Sequence
  Synthetic
ctttttcgcgcgctgtcaaggagcgcttgctcgagtgggacgcggctcttgaacccctgtctttcactaggacgg

SEQ ID NO: 93046 - DNA, 75 bp, Artificial Sequence
  Synthetic
aactgcctgacctgctacatcaaggtgaaagccgcctgtgagagggtggggctgaaaaacgtctcgctcctcata

SEQ ID NO: 93047 - DNA, 75 bp, Artificial Sequence
  Synthetic
cggcgactggcacgggtggttgagtgctgtgtgatggcgggcgagaaggccaccaccatccgactggtctccaag

SEQ ID NO: 93048 - DNA, 75 bp, Artificial Sequence
  Synthetic
gaacccctgtctttcactaggacggactgtcgcatcataagggatgctgccaggactctgagttgcgggcagtgc

SEQ ID NO: 93049 - DNA, 75 bp, Artificial Sequence
  Synthetic
tgaaagccgcctgtgagagggtggggctgaaaaacgtctcgctcctcatagccggtgatgactgtctgatcatat

SEQ ID NO: 93050 - DNA, 75 bp, Artificial Sequence
  Synthetic
cgtctttcaggatgtgaaccacttgcctccggggtttgtcccgaccgcgccagttgtcatccgacggtgtgggaa

SEQ ID NO: 93051 - DNA, 75 bp, Artificial Sequence
  Synthetic
cgctgtcaaggagcgcttgttggaatgggacgcggctttggagcccttgtcattcactaggacggactgtcgcat

SEQ ID NO: 93052 - DNA, 75 bp, Artificial Sequence
  Synthetic
gggcttccttggtgtcacaaaagctgccttgacaggtcgggatcctgacatacatccaggtaacgtcatggttct

SEQ ID NO: 93053 - DNA, 75 bp, Artificial Sequence
  Synthetic
tgaggttctcatcggcgtctttcaggatgtgaatcatttgcctcccgggtttgtcccgactgcaccagttgtcat

SEQ ID NO: 93054 - DNA, 75 bp, Artificial Sequence
  Synthetic
gaggccgctcgctcgcatgtcgagtgagtacagtgacccgatggcttcggccattggttacatcctcctatatcc

SEQ ID NO: 93055 - DNA, 75 bp, Artificial Sequence
  Synthetic
ccgaaccatagccacacccgtgggagccctaaatccaaggtggtggtcagccagtgatgacgtgacggtgtaccc

SEQ ID NO: 93056 - DNA, 75 bp, Artificial Sequence
  Synthetic
acaaactgcctaacatcatcgtggccctccacggaccagcagcgttgagggttaccgcagacacaactaaaacaa

SEQ ID NO: 93057 - DNA, 75 bp, Artificial Sequence
  Synthetic
ccatggggcttcatcccgaaccatcgccacgcccgtgggggcccttaatcccaggtggtggtcagccagtgatga

SEQ ID NO: 93058 - DNA, 75 bp, Artificial Sequence
  Synthetic
cctgttgggtcattagatccgacggggctctatgccatggcttgatcaaaggggacaaggtcgaactggaggagg

SEQ ID NO: 93059 - DNA, 75 bp, Artificial Sequence
  Synthetic
ggctctatgccatggcttgatcaaaggggacaaggtcgaactggaggaggccatggaggtttcagaattccgtgg

SEQ ID NO: 93060 - DNA, 75 bp, Artificial Sequence
  Synthetic
cgacctcaagctccctggcttggcggtccaccgcaagaaggccggggcactgcgaactcgcatgctccgttcgcg

SEQ ID NO: 93061 - DNA, 75 bp, Artificial Sequence
  Synthetic
cctccacggaccagcagcgttgagggttaccgcagacacaactaaaacaaaaatggaggctggaaaggtcttaag

SEQ ID NO: 93062 - DNA, 75 bp, Artificial Sequence
  Synthetic
tcgtgtccgtgcttcactcgggcggtagagtcaccgctgcgaggttcactcggccgtggacccaagtaccaactg

SEQ ID NO: 93063 - DNA, 75 bp, Artificial Sequence
  Synthetic
accccaaaaccaccacggagcccccaccggttccagctaaaggtttctttaaagaagcccttctgttcatcccca

SEQ ID NO: 93064 - DNA, 75 bp, Artificial Sequence
  Synthetic
tcaccggtcctttgcgacaaagggcacgcagtaagaatgctcgtgtcagtgctccactctggcggcagggttact

SEQ ID NO: 93065 - DNA, 75 bp, Artificial Sequence
  Synthetic
cacaaggtcctgatcttgaacccgtcagtggctaccgtgcgggccatgggcccttacatggagaagctggcgggc

SEQ ID NO: 93066 - DNA, 75 bp, Artificial Sequence
  Synthetic
cagtggctaccgtgcgggccatgggcccttacatggagaagctggcgggcaaacatcccagcgtctactgtgggc

SEQ ID NO: 93067 - DNA, 75 bp, Artificial Sequence
  Synthetic
taccacagaaccccctccggtgccggcaaaaggagttttcaaggaggccccgttgtttatgcctacgggggcggg

SEQ ID NO: 93068 - DNA, 75 bp, Artificial Sequence
  Synthetic
cgttgtttatgcctacgggggcgggaaagagcacccgcgtaccgttggagtacggcaacatgggccacaaggtct

SEQ ID NO: 93069 - DNA, 75 bp, Artificial Sequence
  Synthetic
acctacggtcggtttcttgccaaccctaggcagatgctacggggcgtttctgtggttatttgtgatgagtgccac

SEQ ID NO: 93070 - DNA, 75 bp, Artificial Sequence
  Synthetic
ctaggcagatgctacggggcgtttctgtggttatttgtgatgagtgccacagtcatgattccacggtgcttttgg

SEQ ID NO: 93071 - DNA, 75 bp, Artificial Sequence
  Synthetic
cgtgagggccatgggcccatacatggagcggctggcggggaaacaccccagtatttactgtggccatgacaccac

SEQ ID NO: 93072 - DNA, 75 bp, Artificial Sequence
  Synthetic
ctctacgccactgctacgccacccgggtctcctatgacccagcacccttccatcatagagactaaactggatgtg

SEQ ID NO: 93073 - DNA, 75 bp, Artificial Sequence
  Synthetic
catcatagagactaaactggatgtgggagagatccccttttatgggcatggtatacctcttgagcggatgcgcac

SEQ ID NO: 93074 - DNA, 75 bp, Artificial Sequence
  Synthetic
gctgaggggtgtgtcggtggtcatttgtgacgagtgccacagtcatgactcaactgtgttgttgggcattgggcg

SEQ ID NO: 93075 - DNA, 75 bp, Artificial Sequence
  Synthetic
cggggcaattctcagctaggggggtcaatgccatagcctattataggggtaaagacagttccatcattaaagacg

SEQ ID NO: 93076 - DNA, 75 bp, Artificial Sequence
  Synthetic
ctgccacccctcccggatccccgatgacccagcacccatcaatcattgagacaaaactggacgtgggagagatcc

SEQ ID NO: 93077 - DNA, 75 bp, Artificial Sequence
  Synthetic
aaagacagttccatcattaaagacggagacctggtcgtttgcgccacagacgcgctttccactgggtataccgga

SEQ ID NO: 93078 - DNA, 75 bp, Artificial Sequence
  Synthetic
ccttctatgggcatggcatacctcttgagcggatgcggaccggaaggcatctcgtattctgccactccaaggctg

SEQ ID NO: 93079 - DNA, 75 bp, Artificial Sequence
  Synthetic
ggtaacccttgatcccaccataaccatctccttgaggacagtgcccgcttcggcagaattgtcgatgcagcggcg

SEQ ID NO: 93080 - DNA, 75 bp, Artificial Sequence
  Synthetic
gcctattacagggggaaagacagttctatcatcaaagatggagacctggtggtgtgtgctacagacgcactatcc

SEQ ID NO: 93081 - DNA, 75 bp, Artificial Sequence
  Synthetic
actgggtacactgggaacttcgattctgtcaccgattgtgggttagtggtggaggaggtcgtcgaggtgaccctt

SEQ ID NO: 93082 - DNA, 75 bp, Artificial Sequence
  Synthetic
gcaaagcccctgccggtgtggtgcggtccgggccggtctggtcggctgtggaggctggagtgacctggtacggaa

SEQ ID NO: 93083 - DNA, 75 bp, Artificial Sequence
  Synthetic
gctggtggtggtggggctggttctgctctttggcctgttcgacgcgttggactgggccttggaggagttactagt

SEQ ID NO: 93084 - DNA, 75 bp, Artificial Sequence
  Synthetic
gtggcagaaggttatgtccgctgcgatgcggggcccatcttgatggtgggtctcgctattgcgggggggatgatc

SEQ ID NO: 93085 - DNA, 75 bp, Artificial Sequence
  Synthetic
ctgcgattggtcggtcatgaccctgtcgatcggggaagtgctgaccttggcacaggctaagacagccgaggccta

SEQ ID NO: 93086 - DNA, 75 bp, Artificial Sequence
  Synthetic
actgggaacttcgattccgtgaccgattgcgggctggtggtggaggaggtcgtcgaggtgacccttgatcccacc

SEQ ID NO: 93087 - DNA, 75 bp, Artificial Sequence
  Synthetic
cggggacgcgggccgtccccactgtttcaattgttgacaagctcttcgccgggggctgggcggcggtggtaggcc

SEQ ID NO: 93088 - DNA, 75 bp, Artificial Sequence
  Synthetic
ggcttccagaagcccgccgttggcggccgctgcttcctacctcatgggattgggcgtcggaggcaacgcgcaggc

SEQ ID NO: 93089 - DNA, 75 bp, Artificial Sequence
  Synthetic
agccctccattggctgctgccgcttcctacctcatggggttgggcgtcggaggcaacgcgcaaacccgcttagcc

SEQ ID NO: 93090 - DNA, 75 bp, Artificial Sequence
  Synthetic
ctccggtcgtggggttaactatggccggggcattcatgggtggtgctagcgtgtccccatccctcgtcacggtcc

SEQ ID NO: 93091 - DNA, 75 bp, Artificial Sequence
  Synthetic
ggaccgctctgggcacgcctgtcgtggggttaaccatggcgggcgcgttcatgggaagtgctagcgtctccccct

SEQ ID NO: 93092 - DNA, 75 bp, Artificial Sequence
  Synthetic
ttttgggggccgtgggaggatgggagggcgtggtcaacgccgctagcctggtcttcgacttcatgtctgggaaac

SEQ ID NO: 93093 - DNA, 75 bp, Artificial Sequence
  Synthetic
aatgcggctagccttgtcttcgactttatggcggggaaactatcatcagaagatctgtggtatgccatcccagtg

SEQ ID NO: 93094 - DNA, 75 bp, Artificial Sequence
  Synthetic
cggggatcgccctcgggttggtgttgtactcagctaacaactctggcactaccacttggttgaaccgtctgctga

SEQ ID NO: 93095 - DNA, 75 bp, Artificial Sequence
  Synthetic
gtactcagctaacaactctggcactaccacttggttgaaccgtctgctgactacattgccaaggtcctcatgcat

SEQ ID NO: 93096 - DNA, 75 bp, Artificial Sequence
  Synthetic
gtgtcagccatgctcaggcgcctgagcctcactcggacggtggtggccctagtcaatagggagcccaaggtcgat

SEQ ID NO: 93097 - DNA, 75 bp, Artificial Sequence
  Synthetic
tgctccgacgcttgagcctcactcgcaccgtggttgccctggtcaacagggagcctaaggtggatgaggttcagg

SEQ ID NO: 93098 - DNA, 75 bp, Artificial Sequence
  Synthetic
aatacgcatggtcatggccaggctccgggccctctgccccgtggtgtcactacctttgtggcactgtggggaggg

SEQ ID NO: 93099 - DNA, 75 bp, Artificial Sequence
  Synthetic
cgggccctctgccccgtggtgtcactacctttgtggcactgtggggaggggtggtccggagagtggttgttggac

SEQ ID NO: 93100 - DNA, 75 bp, Artificial Sequence
  Synthetic
gagcctaaggtggatgaggttcaggtggggtacgtctgggacttgtgggagtggatcatgcgtcaagtgcgcatg

SEQ ID NO: 93101 - DNA, 75 bp, Artificial Sequence
  Synthetic
tacctttgtggcactgtggggaggggtggtccggagagtggttgttggacggtcatgtggaaagtcgctgccttt

SEQ ID NO: 93102 - DNA, 75 bp, Artificial Sequence
  Synthetic
gccccgtggtgtcattacccttatggcactgcggggaggggtggtccggagaatggttgttggacggccatgttg

SEQ ID NO: 93103 - DNA, 75 bp, Artificial Sequence
  Synthetic
ttttactctaccaagctgtgccggcactattggatggggaccgtgccggtgaacatgcttgggtacggcgaaacc

SEQ ID NO: 93104 - DNA, 75 bp, Artificial Sequence
  Synthetic
actattggatggggaccgtgccggtgaacatgcttgggtacggcgaaacctcacctgtgcttgcctccgacaccc

SEQ ID NO: 93105 - DNA, 75 bp, Artificial Sequence
  Synthetic
ccgacccaagttgtgatccgtcgcacctcgtgctacaagctgcttcgccagcaaatactatctgctgctgtggct

SEQ ID NO: 93106 - DNA, 75 bp, Artificial Sequence
  Synthetic
tcgcctcagacaccccgaaggtggtaccattcgggacgtctgggtgggctgaggtggtggtgacccctacccacg

SEQ ID NO: 93107 - DNA, 75 bp, Artificial Sequence
  Synthetic
cggtatcatgggaggcggacgctcgcgcgcccgcgatggtatatggtcctggccaaagcgttaccattgacgggg

SEQ ID NO: 93108 - DNA, 75 bp, Artificial Sequence
  Synthetic
tcggctgctgttgctgagccctattacgtcgacggcataccggtctcatgggacgcggacgcgcgagcgcctgcc

SEQ ID NO: 93109 - DNA, 75 bp, Artificial Sequence
  Synthetic
gaggtttcgtcagaggtcagtatcgagatcgggacggagtcggaggacaccgaactgacagaggccgatttgccg

SEQ ID NO: 93110 - DNA, 75 bp, Artificial Sequence
  Synthetic
ggcgcacttcctgttacaagttgcttcgccagcaaatactctctgctgctgtggctgagccctactacgtcgatg

SEQ ID NO: 93111 - DNA, 75 bp, Artificial Sequence
  Synthetic
gagtgaggaaagcgtcttcaacgtggctctttccgtactaaaagccttatttccacagagcgacgccacccggaa

SEQ ID NO: 93112 - DNA, 75 bp, Artificial Sequence
  Synthetic
tttccttggggttgacggtggctgacgtggctagcctgtgtgagatggaaatccagaaccatacagcctattgtg

SEQ ID NO: 93113 - DNA, 75 bp, Artificial Sequence
  Synthetic
gaacttacctttgaatgtgacaagtgtgaggctaggcaagagaccttggcatccttttcctacatttggtctggg

SEQ ID NO: 93114 - DNA, 75 bp, Artificial Sequence
  Synthetic
tgggtccttgttagtggcggacaccactaaggtgtatgtcaccaacccagacaatgttgggaggagagtggacaa

SEQ ID NO: 93115 - DNA, 75 bp, Artificial Sequence
  Synthetic
gggtggcttccctttgtcccctccctacatgggagtggtacaccaattggatttcacagcccagcggagtcgctg

SEQ ID NO: 93116 - DNA, 75 bp, Artificial Sequence
  Synthetic
ctggtggccgacaccaccaaggtgtatgtcaccaacccggacaatgttgggagaagagttgacaaggttaccttc

SEQ ID NO: 93117 - DNA, 75 bp, Artificial Sequence
  Synthetic
actcttactgtgaaaaaggaggtgttcttcaaagaccgtaaggaggagaaggccccccgcctcattgtgttcccc

SEQ ID NO: 93118 - DNA, 75 bp, Artificial Sequence
  Synthetic
ccggtcatcctggtagccactataggtgggtcttaaagggaggctacggtccctcttgcgcttatggcgagaaag

SEQ ID NO: 93119 - DNA, 75 bp, Artificial Sequence
  Synthetic
gcctacgccttccagtacaccccaaaccagcgagttaaggagatgctcaagctctgggaatcaaagaagacaccg

SEQ ID NO: 93120 - DNA, 75 bp, Artificial Sequence
  Synthetic
tagggagatgctcaaactgtgggaatcaaagaagacaccatgcgccatctgtgtggacgccacatgcttcgacag

SEQ ID NO: 93121 - DNA, 75 bp, Artificial Sequence
  Synthetic
tcaaagaagacaccatgcgccatctgtgtggacgccacatgcttcgacagtagcataactgaagaggacgtggcg

SEQ ID NO: 93122 - DNA, 75 bp, Artificial Sequence
  Synthetic
ggatctggcattagaggccgagcgatatgctatggcctctgaccatccagaatggatgcgcgccgtaggcaagta

SEQ ID NO: 93123 - DNA, 75 bp, Artificial Sequence
  Synthetic
tatgctatggcctctgaccatccagaatggatgcgcgccgtaggcaagtactatgcctcaggtaccatggtcact

SEQ ID NO: 93124 - DNA, 75 bp, Artificial Sequence
  Synthetic
tgccctggggaaatactatgcctctggcacaatggtaacccccgagggggtgccagtgggtgagaggtattgtag

SEQ ID NO: 93125 - DNA, 75 bp, Artificial Sequence
  Synthetic
tcaaggtgaaagccgcctgtgagagggtggggctgaaaaatgtctcgctcctcatcgctggcgatgactgtttga

SEQ ID NO: 93126 - DNA, 75 bp, Artificial Sequence
  Synthetic
ggttctgcctcgagggtggatgcctggtggccctagggtgcacgatttgtactgacagatgctggccactgtatc

SEQ ID NO: 93127 - DNA, 75 bp, Artificial Sequence
  Synthetic
gggcagagccctagctagctatgggtacgcgtgcgagccctcgtatcatgcatcattggacacggcccccttctg

SEQ ID NO: 93128 - DNA, 75 bp, Artificial Sequence
  Synthetic
gaactgggtagtctctacgggcccctttcggtgtcggcctacgtggccggcatcttggggctcggggaggtctat

SEQ ID NO: 93129 - DNA, 75 bp, Artificial Sequence
  Synthetic
gcagatgggaagcgccatttcttcctgaccacggactttcggaggccgctcgctcgcatgtcgagcgagtacagt

SEQ ID NO: 93130 - DNA, 75 bp, Artificial Sequence
  Synthetic
tacaagtttcccttggacaaactgcccaacatcatcgtggccctccacggaccagcagcgttgagggttaccgca

SEQ ID NO: 93131 - DNA, 75 bp, Artificial Sequence
  Synthetic
tggtcttcctcctggtcaccatggcgggcatgtcgcaaggcgcgcctgcctcggtgctagggtcccggccttttg

SEQ ID NO: 93132 - DNA, 75 bp, Artificial Sequence
  Synthetic
gggcattgcgaacgcgtatgctccggtcgcgcggttgggctgagttggctagggggctgttgtggcgtccaggcc

SEQ ID NO: 93133 - DNA, 75 bp, Artificial Sequence
  Synthetic
aggccgggttgacatggcagtcctgttcgtgtaggtcgaatggctcgcgcgtgccgacgggggagaaggtttggg

SEQ ID NO: 93134 - DNA, 75 bp, Artificial Sequence
  Synthetic
ttggctggggcgaccctatcactcattggagccacggacaaaatcagtggcccctgtcatgtccccagtatgtct

SEQ ID NO: 93135 - DNA, 75 bp, Artificial Sequence
  Synthetic
tcgatgtgtggagtttggtaccggttggttcagccagctgtaccatagccggcgctgggtcatcggatcgcgacg

SEQ ID NO: 93136 - DNA, 75 bp, Artificial Sequence
  Synthetic
aattccctgcgccacatgtattctggataggcggcctgcctcgtgtggcacttgtgtgcgggactgctggcccga

SEQ ID NO: 93137 - DNA, 75 bp, Artificial Sequence
  Synthetic
gactacggggtgctcgcatagacctccccggatgggggacactgcactgtgatctgaaagggtgtaccccggtaa

SEQ ID NO: 93138 - DNA, 75 bp, Artificial Sequence
  Synthetic
aggggagaggcaacccggtgcggtcgcccttgggttttgggtcctacaccatgaccaagatccgagactccttac

SEQ ID NO: 93139 - DNA, 75 bp, Artificial Sequence
  Synthetic
cgaggtgtccgaagcacttgggggtgcagggctcaccggggggttctacgagccactggtgaggcggtgttcgga

SEQ ID NO: 93140 - DNA, 75 bp, Artificial Sequence
  Synthetic
ggacgcggccttggaacctttgtcattcactaggacggactgtcgcatcatcagggatgccgctcggaccttgtc

SEQ ID NO: 93141 - DNA, 75 bp, Artificial Sequence
  Synthetic
ggtggcatttttctttccttaccgatcatggcagtccttctgcttctcttcgttgtggaggccggggccattctg

SEQ ID NO: 93142 - DNA, 75 bp, Artificial Sequence
  Synthetic
gccccggccacgcacgcttgtggaacgaatgggcaatatttcctcacaaactgttgcgccttggaggatataggg

SEQ ID NO: 93143 - DNA, 75 bp, Artificial Sequence
  Synthetic
ggtgaaccagttggcagtcctcggactgcctccggtgaacgccgctgtggcgggggaggtgttcgcgggtccggc

SEQ ID NO: 93144 - DNA, 75 bp, Artificial Sequence
  Synthetic
tgaccgctgctggccactgtatcaggcggggttagccgtgcgtcccggcaagtccgccgcccaattggtggggga

SEQ ID NO: 93145 - DNA, 75 bp, Artificial Sequence
  Synthetic
ctaacctggtgttgtacttccgatggatgggccctcaacgcctgatgtttctcgtgctgtggaagctcgctcggg

SEQ ID NO: 93146 - DNA, 75 bp, Artificial Sequence
  Synthetic
agtccgccgcccaattggtgggggagctcgggagcctctacgggcccctatcggtgtccgcctacgtggcgggca

SEQ ID NO: 93147 - DNA, 75 bp, Artificial Sequence
  Synthetic
ggggatttcagccacccggggccgcacctccgtgctcggagccgaattctgcttcgacgtcacgttcgaagtgga

SEQ ID NO: 93148 - DNA, 75 bp, Artificial Sequence
  Synthetic
cactcctgagctctatgagcgcgggggggtggaggcacaaagccgtgatttacaggacgtggtgcaaggggtacc

SEQ ID NO: 93149 - DNA, 75 bp, Artificial Sequence
  Synthetic
ggggtggaggcacaaagccgtgatttacaggacgtggtgcaaggggtaccaggcgatacgtcagcgggtggtgcg

SEQ ID NO: 93150 - DNA, 75 bp, Artificial Sequence
  Synthetic
gcttggcctcctacatctggccggacgctgtgatgttggtggtggtggcattggtgctcctcttcggcctgttcg

SEQ ID NO: 93151 - DNA, 75 bp, Artificial Sequence
  Synthetic
cgctgtgatgttggtggtggtggcattggtgctcctcttcggcctgttcgacgcgttggactgggcccttgagga

SEQ ID NO: 93152 - DNA, 75 bp, Artificial Sequence
  Synthetic
gttgtgtgatggcgggtgagaaagccactaccatccggctggtgtccaagatgtgcgcgcggggggcctatttgt

SEQ ID NO: 93153 - DNA, 75 bp, Artificial Sequence
  Synthetic
gctgccggccgtttgccaagcaattggctggggcgacccaatcacacactggggccacgggcaaaatcagtggcc

SEQ ID NO: 93154 - DNA, 75 bp, Artificial Sequence
  Synthetic
cactaccatccggctggtgtccaagatgtgcgcgcggggggcctatttgttcgaccatatgggctccttctcgcg

SEQ ID NO: 93155 - DNA, 75 bp, Artificial Sequence
  Synthetic
cattcactaggacggactgtcgcatcattagagatgctgccagaaccttgagctgtggccagtgcgtcatgggct

SEQ ID NO: 93156 - DNA, 75 bp, Artificial Sequence
  Synthetic
ggggttccgtgtcttggtttgcttccactggggggcgcgattcgaagatcgatgtgtggagtttggtaccagttg

SEQ ID NO: 93157 - DNA, 75 bp, Artificial Sequence
  Synthetic
cactggggggcgcgattcgaagatcgatgtgtggagtttggtaccagttgggtcagccagctgtaccatagccgc

SEQ ID NO: 93158 - DNA, 75 bp, Artificial Sequence
  Synthetic
gatgtgaaccatttgcctcctgggtttgtcccgaccgcgcccgttgtcatccggcggtgcgggaagggttttctc

SEQ ID NO: 93159 - DNA, 75 bp, Artificial Sequence
  Synthetic
tgtggcgccctctgaggtttcgtctgaggtcagcatcgagattgggacggagactgaagattcagaactgactga

SEQ ID NO: 93160 - DNA, 75 bp, Artificial Sequence
  Synthetic
ccgtcggcccgcctcgtgcggcacctgtgtgcgggactgctggcccgagaccgggtcggtgcgtttcccattcca

SEQ ID NO: 93161 - DNA, 75 bp, Artificial Sequence
  Synthetic
ccggcggtgcgggaagggttttctcggagtgacgaaggctgccttgacgggccgggatcctgacttacatccagg

SEQ ID NO: 93162 - DNA, 75 bp, Artificial Sequence
  Synthetic
ggagtgacgaaggctgccttgacgggccgggatcctgacttacatccagggaacgtcatggttctggggaccgca

SEQ ID NO: 93163 - DNA, 75 bp, Artificial Sequence
  Synthetic
ccatggggcttcatcccgaaccattgccacgcccgtgggggccctcaacccaaggtggtggtcggccagtgatga

SEQ ID NO: 93164 - DNA, 75 bp, Artificial Sequence
  Synthetic
gccacgcccgtgggggccctcaacccaaggtggtggtcggccagtgatgatgtcaccgtgtaccctctcccggat

SEQ ID NO: 93165 - DNA, 75 bp, Artificial Sequence
  Synthetic
ttggtgaaatgtcccacccctgccattgagcctcccactgggacgtttgggttcttccccgggactcccccgctt

SEQ ID NO: 93166 - DNA, 75 bp, Artificial Sequence
  Synthetic
ttgagcctcccactgggacgtttgggttcttccccgggactcccccgcttaacaactgcatgctcttgggcactg

SEQ ID NO: 93167 - DNA, 75 bp, Artificial Sequence
  Synthetic
catcagatctgacggtgctctctgccatggcttgtgcaagggagacaaggtagaactggacgtggccatggaggt

SEQ ID NO: 93168 - DNA, 75 bp, Artificial Sequence
  Synthetic
catggcttgtgcaagggagacaaggtagaactggacgtggccatggaggtcgctgactttcgtgggtcttctggg

SEQ ID NO: 93169 - DNA, 75 bp, Artificial Sequence
  Synthetic
cggcggcctgcagccggggtagcccaagagccttcgggtgagggcgggtggcatttttcctttctgtactaatca

SEQ ID NO: 93170 - DNA, 75 bp, Artificial Sequence
  Synthetic
tccggggttcgcgtggctatcctcgggcaggcctgatgggtttatacatgtccagggtcacttgcaggaggtgga

SEQ ID NO: 93171 - DNA, 75 bp, Artificial Sequence
  Synthetic
gctccattcgggtggacgggttacggcggcacgattcactaggccgtggacccaagttccaaccgatgccaagac

SEQ ID NO: 93172 - DNA, 75 bp, Artificial Sequence
  Synthetic
gcggcacgattcactaggccgtggacccaagttccaaccgatgccaagaccaccactgaacccccaccggttccg

SEQ ID NO: 93173 - DNA, 75 bp, Artificial Sequence
  Synthetic
tgcgggcaacttcataccgcctcctcgctggttgctcttggactttgtatttgtcctactctatctgatgaagct

SEQ ID NO: 93174 - DNA, 75 bp, Artificial Sequence
  Synthetic
ccggccacccacgcttgcagagccaaggagcaatatttcctcacaaattgttgcgcccctgaggacatagggttc

SEQ ID NO: 93175 - DNA, 75 bp, Artificial Sequence
  Synthetic
cgctggttgctcttggactttgtatttgtcctactctatctgatgaagctggctgaggctcggttggtcccgttg

SEQ ID NO: 93176 - DNA, 75 bp, Artificial Sequence
  Synthetic
aaagagcacgcgggttccactggagtatggaaacatggggcacaaggtgctgattctcaacccgtcggtggccac

SEQ ID NO: 93177 - DNA, 75 bp, Artificial Sequence
  Synthetic
aggagcaatatttcctcacaaattgttgcgcccctgaggacatagggttctgccttgagggcggatgccttgtgg

SEQ ID NO: 93178 - DNA, 75 bp, Artificial Sequence
  Synthetic
tgaaccagctggcggtccttgggctgccggcggtgaaccctgccgtggcgggagaggtttttgcgggcccagcct

SEQ ID NO: 93179 - DNA, 75 bp, Artificial Sequence
  Synthetic
tgtgcgggccatgggcccctacatggagaagctggcgggtaaacatcctagcatttactgtggacacgacacaac

SEQ ID NO: 93180 - DNA, 75 bp, Artificial Sequence
  Synthetic
ggtttggctgtgcggcctggcaagtccgcggcccagctcgtgggtgaactggggagcctctacgggcccctgtcg

SEQ ID NO: 93181 - DNA, 75 bp, Artificial Sequence
  Synthetic
aacctggtgttgtacttccgttggatgggccctcagcgcctgatgttccttgtgttgtggaagctcgctcgggga

SEQ ID NO: 93182 - DNA, 75 bp, Artificial Sequence
  Synthetic
tgggacttggggaggtttactctggggtgctcacgattggtgttgcgttgacgcgtcgggcctacccgatcccga

SEQ ID NO: 93183 - DNA, 75 bp, Artificial Sequence
  Synthetic
gctgaggggtgtgtctgtggtaatatgtgatgagtgccacagtcatgactcgactgtgttgctgggaattgggcg

SEQ ID NO: 93184 - DNA, 75 bp, Artificial Sequence
  Synthetic
cggccacgccacctggatcccccatgacccagcatccatcgatcattgagacaaaattggatgtgggagagatcc

SEQ ID NO: 93185 - DNA, 75 bp, Artificial Sequence
  Synthetic
actattggattctggaatatctttggaaggtgccgtttgacttctggcgtggagtggtgagcctgacacccttgt

SEQ ID NO: 93186 - DNA, 75 bp, Artificial Sequence
  Synthetic
gacccagcatccatcgatcattgagacaaaattggatgtgggagagatccccttttatgggcatggcatacccct

SEQ ID NO: 93187 - DNA, 75 bp, Artificial Sequence
  Synthetic
gctggaggcacaaagctgtgatctataggacgtggtgtaaagggtaccaggctttgcgtcagcgggtagtgcgga

SEQ ID NO: 93188 - DNA, 75 bp, Artificial Sequence
  Synthetic
ttcctcctggtgaccatggctggcatgtcgcaaggcgcgccggcctcggtgctcggatcacgcccattcgatcgt

SEQ ID NO: 93189 - DNA, 75 bp, Artificial Sequence
  Synthetic
agtgtgagcgtttggctggccagttttcttcaaggggggttaatgccatagcttattacagggggaaggacagtt

SEQ ID NO: 93190 - DNA, 75 bp, Artificial Sequence
  Synthetic
gggctgacatggcaggcctgttcgtgcagggcgaacggctcgcgcataccgactggggaaaaggtttgggaccga

SEQ ID NO: 93191 - DNA, 75 bp, Artificial Sequence
  Synthetic
gcttattacagggggaaggacagttcaatcatcaaagatggagatctggtggtgtgcgcgacagacgcgctatcc

SEQ ID NO: 93192 - DNA, 75 bp, Artificial Sequence
  Synthetic
ggtactccttttcggcctgttcgatgcgttggactgggcccttgaggagttactggtctcccggccctcgttgcg

SEQ ID NO: 93193 - DNA, 75 bp, Artificial Sequence
  Synthetic
gccacgggcaaaatcagtggcccctctcatgtccccagtatgtctacggtgctgtttcagtgacttgcgtgtggg

SEQ ID NO: 93194 - DNA, 75 bp, Artificial Sequence
  Synthetic
gtcgatgcaaaggcgaggacgcacgggtagaggtcggtctgggcgctattactacgcgggggtcgggaaggcccc

SEQ ID NO: 93195 - DNA, 75 bp, Artificial Sequence
  Synthetic
gtgcgcgcgtggggcctatttgttcgaccatatgggctctttttcgcgtgcggtcaaggaacgccttcttgagtg

SEQ ID NO: 93196 - DNA, 75 bp, Artificial Sequence
  Synthetic
ctcatgtccccagtatgtctacggtgctgtttcagtgacttgcgtgtggggctctgtctcttggtttgcttccac

SEQ ID NO: 93197 - DNA, 75 bp, Artificial Sequence
  Synthetic
ttagagacgctgctcggactttgtcctgcggccagtgtgtcatgggcttgcctgtggtagctcgccgtggtgatg

SEQ ID NO: 93198 - DNA, 75 bp, Artificial Sequence
  Synthetic
ctgccagttgtaccatagccgcactggggtcttcggaccgcgacaccgtggtggagctctccgagtggggagtgc

SEQ ID NO: 93199 - DNA, 75 bp, Artificial Sequence
  Synthetic
cctgtggtagctcgccgtggtgatgaggtcctgattggcgtctaccaaaatgtgaaccatttgcctcccgggttt

SEQ ID NO: 93200 - DNA, 75 bp, Artificial Sequence
  Synthetic
ggggtcttcggaccgcgacaccgtggtggagctctccgagtggggagtgccctgtgctacatgcattctggatcg

SEQ ID NO: 93201 - DNA, 75 bp, Artificial Sequence
  Synthetic
gctgggcaaaagttcgcggcgtcaactggcccctcctggtgggtgttcagcggacgatgtgccgggaaacactgt

SEQ ID NO: 93202 - DNA, 75 bp, Artificial Sequence
  Synthetic
agtcacaaaggctgccttgactggtcgggaccctgacttacatccagggaacgtcatggtgttggggacggctac

SEQ ID NO: 93203 - DNA, 75 bp, Artificial Sequence
  Synthetic
ggtcggtacgattcccattccatcggtgcggcgcgggaccccggctgacaaaggacttggaagccgtgcccttcg

SEQ ID NO: 93204 - DNA, 75 bp, Artificial Sequence
  Synthetic
gtcgcggagcatgggaacatgtctcaacggcctgctgttcaccactttccatggggcttcttcccgaaccatcgc

SEQ ID NO: 93205 - DNA, 75 bp, Artificial Sequence
  Synthetic
cctgtcccactactgctgaggtggggcaatgatttgccgtcaaaagtggccggccatcacatagtggacgatctg

SEQ ID NO: 93206 - DNA, 75 bp, Artificial Sequence
  Synthetic
aggtggtggtccgccagtgatgatgtcactgtgtacccgctcccggatggggccaactcgttaacaccatgcact

SEQ ID NO: 93207 - DNA, 75 bp, Artificial Sequence
  Synthetic
aactgtatgcttcttggcaccgaggtgtctgaggcattaggaggggctggccttacgggggggttctacgagccc

SEQ ID NO: 93208 - DNA, 75 bp, Artificial Sequence
  Synthetic
gcggggggcatgatctatgcgtcttacaccgggtcactagtggtggtaacagactgggatgtgaaggggggtggc

SEQ ID NO: 93209 - DNA, 75 bp, Artificial Sequence
  Synthetic
tggcttgagcaagggggacaaggtggagctcgatgtggccatggaggtctctgacttccgtggttcgtcgggctc

SEQ ID NO: 93210 - DNA, 75 bp, Artificial Sequence
  Synthetic
gagctcgatgtggccatggaggtctctgacttccgtggttcgtcgggctcgcctgtcctatgtgacgagggacac

SEQ ID NO: 93211 - DNA, 75 bp, Artificial Sequence
  Synthetic
tgtctgaggcattaggaggggctggccttacgggggggttctacgagcccctggtgcgcaggtgttcggagctga

SEQ ID NO: 93212 - DNA, 75 bp, Artificial Sequence
  Synthetic
ggcacgattcactcggccgtggacccaagtcccaactgatgctaaaaccaccactgaacccccaccggtaccggc

SEQ ID NO: 93213 - DNA, 75 bp, Artificial Sequence
  Synthetic
caagtcccaactgatgctaaaaccaccactgaacccccaccggtaccggccaaaggagttttcaaagaggcccct

SEQ ID NO: 93214 - DNA, 75 bp, Artificial Sequence
  Synthetic
tgaggctaggttggtcccgttgatccttctcctgctgtggtggtgggtgaaccagttggtagttcttggactgcc

SEQ ID NO: 93215 - DNA, 75 bp, Artificial Sequence
  Synthetic
cggggacgcgggccgtccccacagtttcaattgtggacaagctctttgccggagggtgggcagctgtggtggggc

SEQ ID NO: 93216 - DNA, 75 bp, Artificial Sequence
  Synthetic
cggctatatgggccacaaagtccttatcctcaatccatcggtcgcaacagtgcgggccatgggcccgtatatgga

SEQ ID NO: 93217 - DNA, 75 bp, Artificial Sequence
  Synthetic
gaggtgtttgcggggccagccttgtcatggtgcttgggactccccttcgtaagtatgatactgggattggctaac

SEQ ID NO: 93218 - DNA, 75 bp, Artificial Sequence
  Synthetic
agcccaccgttggctgccgccgcgtcctacctgatgggattgggcgttggaggcaatgcgcaggcgcgcctcgcc

SEQ ID NO: 93219 - DNA, 75 bp, Artificial Sequence
  Synthetic
atttactgtgggcacgacacaactgcattcactaggattacggattcccccctgacgtactctacctatgggagg

SEQ ID NO: 93220 - DNA, 75 bp, Artificial Sequence
  Synthetic
ttcccgctggcacttctgatggggatctcggcgacccgcggccgcacctcagtgctcggagccgaattctgcttc

SEQ ID NO: 93221 - DNA, 75 bp, Artificial Sequence
  Synthetic
ggaccgccctgggcacacccgtcgtgggattaaccatggcgggcgcgttcatgggcggtgctagcgtgtccccct

SEQ ID NO: 93222 - DNA, 75 bp, Artificial Sequence
  Synthetic
tgatgagtgccacagtcatgactcaacggtgttgctggggattgggcgggtcagggagctggcgcgtggctgcgg

SEQ ID NO: 93223 - DNA, 75 bp, Artificial Sequence
  Synthetic
acggtgttgctggggattgggcgggtcagggagctggcgcgtggctgcggggtccaactggtcctttacgccact

SEQ ID NO: 93224 - DNA, 75 bp, Artificial Sequence
  Synthetic
cgtggtggcttgggccatagcactcctgggctcgatgagcgcaggggggtggaagcacaaagctgtgatttacag

SEQ ID NO: 93225 - DNA, 75 bp, Artificial Sequence
  Synthetic
aaaactggatgttggtgagattcccttttatgggcatggcatacccctggagcggatgcggaccggccggcactt

SEQ ID NO: 93226 - DNA, 75 bp, Artificial Sequence
  Synthetic
ccctcggggaggggcgacctaccaagcccttgaccttcgcctggtgtctggcctcatacatctggcctgacgcag

SEQ ID NO: 93227 - DNA, 75 bp, Artificial Sequence
  Synthetic
gcccttgaccttcgcctggtgtctggcctcatacatctggcctgacgcagtgatgatggtggtggtcgccatggt

SEQ ID NO: 93228 - DNA, 75 bp, Artificial Sequence
  Synthetic
ccaccttgcctcggtcatcatgcattccagacagctatttccaacaggctgactactgtgataaagtctcggcca

SEQ ID NO: 93229 - DNA, 75 bp, Artificial Sequence
  Synthetic
cctctaggggggtgaatgccattgcttattaccgagggaaggacagttcaatcatcaaggacggagacctcgtgg

SEQ ID NO: 93230 - DNA, 75 bp, Artificial Sequence
  Synthetic
tggtctcccggccctcgttgcgccgactggcgcgggtggttgagtgctgtgtgatggcgggtgagagggccacta

SEQ ID NO: 93231 - DNA, 75 bp, Artificial Sequence
  Synthetic
tgctccgtcggttgagcctcacgaggacagtggttgccctggtcaacagggagcctaaggttgatgaggttcagg

SEQ ID NO: 93232 - DNA, 75 bp, Artificial Sequence
  Synthetic
actggcgcgggtggttgagtgctgtgtgatggcgggtgagagggccactactgtaaggttggtctccaagatgtg

SEQ ID NO: 93233 - DNA, 75 bp, Artificial Sequence
  Synthetic
tcccaccattaccatctccttgcggacagtgcccgcgtcggcagaactgtcgatgcagcggcgaggacgcacagg

SEQ ID NO: 93234 - DNA, 75 bp, Artificial Sequence
  Synthetic
tcaaggagcgcctactggaatgggatgcggcccttgaacccctatcatttaccaggacggactgtcgcatcataa

SEQ ID NO: 93235 - DNA, 75 bp, Artificial Sequence
  Synthetic
accaggacggactgtcgcatcataagggacgccgccaggaccctctcctgcggccagtgtgtcatgggcttgcct

SEQ ID NO: 93236 - DNA, 75 bp, Artificial Sequence
  Synthetic
cgggggtggttcgatccgggccggtctggtcggcggtggaagccggagtgacctggtatggaatggaacctgact

SEQ ID NO: 93237 - DNA, 75 bp, Artificial Sequence
  Synthetic
catcactggcgacgtgctcaatgggcaactcagagatcctgtttattctaccaaactgtgccggcactattggat

SEQ ID NO: 93238 - DNA, 75 bp, Artificial Sequence
  Synthetic
caactcagagatcctgtttattctaccaaactgtgccggcactattggatggggaccgtgcctgtgaacatgctg

SEQ ID NO: 93239 - DNA, 75 bp, Artificial Sequence
  Synthetic
acctttcgggactgcgggctgggctgaggtggtcgtgaccccgacccatgtggtgatcaggcgcacctcgtgcta

SEQ ID NO: 93240 - DNA, 75 bp, Artificial Sequence
  Synthetic
gaggtggtcgtgaccccgacccatgtggtgatcaggcgcacctcgtgctataagctgctgcgccagcaattacta

SEQ ID NO: 93241 - DNA, 75 bp, Artificial Sequence
  Synthetic
ggcccctcttggtgggtgttcagcggaccatgtgccgggagacactgtcgcctggcccatcggatgacccccaat

SEQ ID NO: 93242 - DNA, 75 bp, Artificial Sequence
  Synthetic
ggacgcggacgcgagagcgcccgccttggtctacggtcctggccaaagcgttaccattgacggggagaggtacac

SEQ ID NO: 93243 - DNA, 75 bp, Artificial Sequence
  Synthetic
gcccgtgggggcccttaatcccaggtggtggtcagccagtgatgatgtaaccgtgtacccccttccagatggggc

SEQ ID NO: 93244 - DNA, 75 bp, Artificial Sequence
  Synthetic
ttaccattgacggggagaggtacaccttaccgcatcagctgcggatgaggaatgttgccccctctgaggtttcgt

SEQ ID NO: 93245 - DNA, 75 bp, Artificial Sequence
  Synthetic
ggtccgacggggctctttgccatggcttgtccaagggggataaggtcgaactggacgtggccatggaagtgtctg

SEQ ID NO: 93246 - DNA, 75 bp, Artificial Sequence
  Synthetic
accgggtccctagtggtggtgacagactgggatgtgaaggggggtggcaaccccctttataggaatggagaccag

SEQ ID NO: 93247 - DNA, 75 bp, Artificial Sequence
  Synthetic
tgtcctgtgcgacgaggggcacgcagtaggcatgcttgtgtcagtgctacattctgggggaagggtcacggcagc

SEQ ID NO: 93248 - DNA, 75 bp, Artificial Sequence
  Synthetic
aacacagtgactgatgcggtggcagccctccgggtgaactgtgattggtcctttgtaaccctgtcgaccggggaa

SEQ ID NO: 93249 - DNA, 75 bp, Artificial Sequence
  Synthetic
ctgaacccccgccggtgccggcaaaaggagttttcaaggaggccccgctgttcatgcctacgggggctgggaaga

SEQ ID NO: 93250 - DNA, 75 bp, Artificial Sequence
  Synthetic
atcccccgcactccatcgcctgcacttatctcggttacggagagcagctcagatgagaaaccatcgtcagtgtcc

SEQ ID NO: 93251 - DNA, 75 bp, Artificial Sequence
  Synthetic
cattccatcgtctgactcctttgacatcatccaagagtcggatgcagcagaaggggaggataatgtcttcaacgt

SEQ ID NO: 93252 - DNA, 75 bp, Artificial Sequence
  Synthetic
ctgaacccctcggtggctactgtgagggccatgggcccttacatggagcggctggcgggtaaacatcccagtatc

SEQ ID NO: 93253 - DNA, 75 bp, Artificial Sequence
  Synthetic
gggccatgggcccttacatggagcggctggcgggtaaacatcccagtatctactgtggacacgatacgacagcct

SEQ ID NO: 93254 - DNA, 75 bp, Artificial Sequence
  Synthetic
ggccctctccgtactaaaagccttgtttccacagaacgacgccaccagaaagctaacagtcaagatgtcatgctg

SEQ ID NO: 93255 - DNA, 75 bp, Artificial Sequence
  Synthetic
tcctccattggcagcggctgcttcatacctgatggggttgggcgtcggaggtaacgcgcaggcgcgcctggcttc

SEQ ID NO: 93256 - DNA, 75 bp, Artificial Sequence
  Synthetic
ttagccaaccctaggcagatgttgcgaggtgtctcggtggtaatctgtgatgagtgccacagtcatgactctaca

SEQ ID NO: 93257 - DNA, 75 bp, Artificial Sequence
  Synthetic
gaggtgtctcggtggtaatctgtgatgagtgccacagtcatgactctacagtgttgctggggattgggcgcgtca

SEQ ID NO: 93258 - DNA, 75 bp, Artificial Sequence
  Synthetic
tgcaagttgggtgcttggtgggcaatgaacttacctttgaatgtgacaagcatgaagcacggcaagagactctag

SEQ ID NO: 93259 - DNA, 75 bp, Artificial Sequence
  Synthetic
acgcctcctggatcgcctatgacccagcacccttcaatcattgagacaaagctggatgtgggagagatccccttt

SEQ ID NO: 93260 - DNA, 75 bp, Artificial Sequence
  Synthetic
agcacccttcaatcattgagacaaagctggatgtgggagagatccccttttatgggcacggcattcccctggagc

SEQ ID NO: 93261 - DNA, 75 bp, Artificial Sequence
  Synthetic
cgccgccagccttgtcttcgactttatggcagggaaattgtctacggaggacctgtggtatgccatcccggtact

SEQ ID NO: 93262 - DNA, 75 bp, Artificial Sequence
  Synthetic
gctaaacctccagtggtaaggccggttggctcgttgttagtggctgacaccaccaaggtgtacgtcacgaaccca

SEQ ID NO: 93263 - DNA, 75 bp, Artificial Sequence
  Synthetic
caccaaggtgtacgtcacgaacccagataacgtggggaggagggtggacaaggtcaccttttggcggtctccgcg

SEQ ID NO: 93264 - DNA, 75 bp, Artificial Sequence
  Synthetic
gagcggcttgccggtcagttttcctccaggggggttaatgccatagcctactataggggcaaagacagttccatc

SEQ ID NO: 93265 - DNA, 75 bp, Artificial Sequence
  Synthetic
ctcaagcctgcttaagcatgggttacacttatgaggaggcaataaggactgttaggccgcatgctgccatgggct

SEQ ID NO: 93266 - DNA, 75 bp, Artificial Sequence
  Synthetic
gggtatgtctgggatctgtgggagtggatcatgcgccaagtgcgtatggtcatttccagggtccgggctctctgc

SEQ ID NO: 93267 - DNA, 75 bp, Artificial Sequence
  Synthetic
actcaaagatccagtttactcaaccaagctgtgccggcactattggatggggaccgtccctgtcaacatgctggg

SEQ ID NO: 93268 - DNA, 75 bp, Artificial Sequence
  Synthetic
ctgcgccatctgtgtggatgccacgtgcttcgacagtagcatcactgaagaggacgtggccttggagacagagct

SEQ ID NO: 93269 - DNA, 75 bp, Artificial Sequence
  Synthetic
gcctctgacacgccgaaggttgttcccttcggtacgtctgggtgggcggaggtggtcgtgactcctacccacgtg

SEQ ID NO: 93270 - DNA, 75 bp, Artificial Sequence
  Synthetic
actacgcctcgggtactatggtgaccccggaaggggttcccgtaggagagaggtactgtagatcctcaggagtac

SEQ ID NO: 93271 - DNA, 75 bp, Artificial Sequence
  Synthetic
tgcagctgtagctgagccctattatgtggatggcatacctgtctcatgggaagccgacgcgcgagcgccggcgat

SEQ ID NO: 93272 - DNA, 75 bp, Artificial Sequence
  Synthetic
gtggatggcatacctgtctcatgggaagccgacgcgcgagcgccggcgatggtctacggtcctggccaaagcgtc

SEQ ID NO: 93273 - DNA, 75 bp, Artificial Sequence
  Synthetic
cccactactgctgaggtggggcaatgatttgccatccaaagtggccggccatcacattgtagacgacctggtccg

SEQ ID NO: 93274 - DNA, 75 bp, Artificial Sequence
  Synthetic
cccggaaggggttcccgtaggagagaggtactgtagatcctcaggagtactcaccacaagtgcgagcaattgctt

SEQ ID NO: 93275 - DNA, 75 bp, Artificial Sequence
  Synthetic
atgtctccctcttaattgcgggcgatgactgtctgatcatatgcgagaggcccatatgcgatccaagtgaggccc

SEQ ID NO: 93276 - DNA, 75 bp, Artificial Sequence
  Synthetic
tgatggtggggcttgctattgcgggcggcatgatctacgcgtcatatacaggatcactcgtggtggttacagact

SEQ ID NO: 93277 - DNA, 75 bp, Artificial Sequence
  Synthetic
cggcatgatctacgcgtcatatacaggatcactcgtggtggttacagactgggatgtgaaggggggtggcaatcc

SEQ ID NO: 93278 - DNA, 75 bp, Artificial Sequence
  Synthetic
gcatcattggatacggcccccttctgctccacttggctcgccgagtgcaatgctgacgggaaacgccatttcttc

SEQ ID NO: 93279 - DNA, 75 bp, Artificial Sequence
  Synthetic
cgagaattctcgaaccgcacattgatgtcatcatggaggactgcagtacaccctctctctgtggaagtagccgag

SEQ ID NO: 93280 - DNA, 75 bp, Artificial Sequence
  Synthetic
ggtggcggcacaccgtctgatccggtctggtgtcaggttcatggcaattactacaagtttcctctggacaaactg

SEQ ID NO: 93281 - DNA, 75 bp, Artificial Sequence
  Synthetic
acgcgggccgtccccactgtttcaattgtggacaagctctttgccggtggatgggcggccgtggtaggccactgt

SEQ ID NO: 93282 - DNA, 75 bp, Artificial Sequence
  Synthetic
cccgttggcggctgcggcctcctatctcatgggcttgggcgtcggaggcaacgctcagacgcgtctggcttcggc

SEQ ID NO: 93283 - DNA, 75 bp, Artificial Sequence
  Synthetic
ctcatgggcttgggcgtcggaggcaacgctcagacgcgtctggcttcggctctcctcttgggggctgctggaact

SEQ ID NO: 93284 - DNA, 75 bp, Artificial Sequence
  Synthetic
cgcatgctccggtcgcgcggttgggcggagctggctaggggcctgttgtggcatccaggcctacggctccctccc

SEQ ID NO: 93285 - DNA, 75 bp, Artificial Sequence
  Synthetic
cggggccagtgtttccccatccttggtcaccatcttattgggggccgtgggtggttgggagggcgtggtcaatgc

SEQ ID NO: 93286 - DNA, 75 bp, Artificial Sequence
  Synthetic
gtcaccatcttattgggggccgtgggtggttgggagggcgtggtcaatgcggctagccttgtctttgacttcatg

SEQ ID NO: 93287 - DNA, 75 bp, Artificial Sequence
  Synthetic
cagcccgggggcgggccttgcggggatcgccctagggctggtgttgtactcagcaaacaactctggcactactac

SEQ ID NO: 93288 - DNA, 75 bp, Artificial Sequence
  Synthetic
gtaaccaatccagataacgtgggtcggagggttgacaaggtgacctcttggcgcgcgcctcgggtccatgacaaa

SEQ ID NO: 93289 - DNA, 75 bp, Artificial Sequence
  Synthetic
atcgccctagggctggtgttgtactcagcaaacaactctggcactactacatggttgaaccgtctgctgaccacg

SEQ ID NO: 93290 - DNA, 75 bp, Artificial Sequence
  Synthetic
ttgtgacaaggtatcagccgtgctccgacgcctgagcctcacgcgaactgtggtggccctggtcaacagggaacc

SEQ ID NO: 93291 - DNA, 75 bp, Artificial Sequence
  Synthetic
cgacgcctgagcctcacgcgaactgtggtggccctggtcaacagggaacctaaggttgacgaggtacaggttgga

SEQ ID NO: 93292 - DNA, 75 bp, Artificial Sequence
  Synthetic
ggccagactccgggctctctgccccgtggtgtcactacccctgtggcactgcggggaggggtggtccggagaatg

SEQ ID NO: 93293 - DNA, 75 bp, Artificial Sequence
  Synthetic
cctgctcgagcaaaggattgttatggtctttctgttggtgaccatggcggggatgtcgcaaggcgctcccgcctc

SEQ ID NO: 93294 - DNA, 75 bp, Artificial Sequence
  Synthetic
caggcgacgtgctaaacgggcaactcaaagaaccagtttattccacaaagctgtgccgacactattggatgggga

SEQ ID NO: 93295 - DNA, 75 bp, Artificial Sequence
  Synthetic
gagacccgggtcgggttgccaaggcggtgttggggggggcttacgccttccagtacactcctaatcagcgagtta

SEQ ID NO: 93296 - DNA, 75 bp, Artificial Sequence
  Synthetic
gtggacgccacgtgcttccacagtagcattactgaggaggacttggctttggagacagagctttatgccctggct

SEQ ID NO: 93297 - DNA, 75 bp, Artificial Sequence
  Synthetic
gttcttccctgggactcccccgcttaacaactgcatgctcttgggcactgaggtgtccgaggtgctgggcggcgc

SEQ ID NO: 93298 - DNA, 75 bp, Artificial Sequence
  Synthetic
ccttggggaaatactatgcttctggcaccatggtcactcctgaaggggtgcccgtgggcgagaggtattgtagtt

SEQ ID NO: 93299 - DNA, 75 bp, Artificial Sequence
  Synthetic
tgttgcgccagcaaattttatcggccgctgtagctgaaccctactatgttgacggcattccggtctcgtggggtg

SEQ ID NO: 93300 - DNA, 75 bp, Artificial Sequence
  Synthetic
ctatggccctgggcaaagtgttaccattgacggggagcgctacaccctgccgcaccaactgcggcttaggaatgt

SEQ ID NO: 93301 - DNA, 75 bp, Artificial Sequence
  Synthetic
attgacggggagcgctacaccctgccgcaccaactgcggcttaggaatgtggcgccctctgaggtttcatccgag

SEQ ID NO: 93302 - DNA, 75 bp, Artificial Sequence
  Synthetic
ctcctgagctccatgagcgcggggggctggaggcacaaggctgtgatctacaggacgtggtgcaaggggtatcag

SEQ ID NO: 93303 - DNA, 75 bp, Artificial Sequence
  Synthetic
aaagtgaaagccgcctgcgatcgggtgggactcaaaaacgtgtctctcctgatcgctggcgatgactgcttgatc

SEQ ID NO: 93304 - DNA, 75 bp, Artificial Sequence
  Synthetic
cgagcgaggccttgggcagagccctggcttcgtacgggtacgcgtgtgagccctcatatcatgcatcattggaca

SEQ ID NO: 93305 - DNA, 75 bp, Artificial Sequence
  Synthetic
ggcttcgtacgggtacgcgtgtgagccctcatatcatgcatcattggacacggcccccttctgctccacttggct

SEQ ID NO: 93306 - DNA, 75 bp, Artificial Sequence
  Synthetic
tctctctgcggtagtagccgagagatgcctgtgtgggatgaagacattccccgcactccatcgccagcattgata

SEQ ID NO: 93307 - DNA, 75 bp, Artificial Sequence
  Synthetic
gcaggaggataccccgtcctctcatttattcgaagtcatcccaaagacggagccgttcgagggggaggaaagcgt

SEQ ID NO: 93308 - DNA, 75 bp, Artificial Sequence
  Synthetic
aaagccttgttttcacagagcgatgccacacgtaagctaacggtgaagatgtcttgctgcgtggagaagagcgtc

SEQ ID NO: 93309 - DNA, 75 bp, Artificial Sequence
  Synthetic
gaaggttaccgcagacactacaaagacaaaaatggaagcgggcaaggtcctgagcgacctcaagctcccgggctt

SEQ ID NO: 93310 - DNA, 75 bp, Artificial Sequence
  Synthetic
acaaaaatggaagcgggcaaggtcctgagcgacctcaagctcccgggcttggccgtccaccgtaagaaggccggg

SEQ ID NO: 93311 - DNA, 75 bp, Artificial Sequence
  Synthetic
tgaggccggtgggctcattgttagtggccgacaccaccaaggtgtatgtcaccaatccagacaatgtgggtagga

SEQ ID NO: 93312 - DNA, 75 bp, Artificial Sequence
  Synthetic
ggccgacaccaccaaggtgtatgtcaccaatccagacaatgtgggtaggagagtcgacaaggtaaccttctggcg

SEQ ID NO: 93313 - DNA, 75 bp, Artificial Sequence
  Synthetic
agatgctcaagctatgggagtcaaagaaaacgccatgcgccatctgtgtggatgcgacgtgcttcgacagtagta

SEQ ID NO: 93314 - DNA, 75 bp, Artificial Sequence
  Synthetic
gaaaacgccatgcgccatctgtgtggatgcgacgtgcttcgacagtagtattactgaggaggacgttgccctgga

SEQ ID NO: 93315 - DNA, 75 bp, Artificial Sequence
  Synthetic
tggggaaatactatgcctctggcactatggtcactccggaaggggtgcccgtgggcgagaggtactgtaggtcct

SEQ ID NO: 93316 - DNA, 75 bp, Artificial Sequence
  Synthetic
tatggtcactccggaaggggtgcccgtgggcgagaggtactgtaggtcctcaggtgttttgaccaccagcgcaag

SEQ ID NO: 93317 - DNA, 75 bp, Artificial Sequence
  Synthetic
tggccccggccacccacgcttgtcgagcgaatgggcaatatttcctcacaaactgttgtgctccagaggacattg

SEQ ID NO: 93318 - DNA, 75 bp, Artificial Sequence
  Synthetic
gactgaaaaatgtctcgctcctcattgcaggtgatgactgtctgatcatatgcgaaaggccagtgtgtgatccta

SEQ ID NO: 93319 - DNA, 75 bp, Artificial Sequence
  Synthetic
actgaccgatgctggccgctgtatcaggcgggcttggctgtgcggcctggcaagtccgcagcccagctggtgggg

SEQ ID NO: 93320 - DNA, 75 bp, Artificial Sequence
  Synthetic
caactgggtggcctctacgggcccttgtcggtgtcggcctacgtggccggcatcctgggcctgggtgaggtgtac

SEQ ID NO: 93321 - DNA, 75 bp, Artificial Sequence
  Synthetic
cgttgacgcgccgggtctacccgatgcccaacctgacgtgtgcagtagagtgtgagcttaagtgggaaagtgagt

SEQ ID NO: 93322 - DNA, 75 bp, Artificial Sequence
  Synthetic
ggttctgccttgaaggtggatgcctagtggcgttggggtgcacagtttgtactgaccgatgctggccactgtatc

SEQ ID NO: 93323 - DNA, 75 bp, Artificial Sequence
  Synthetic
tgtgagcttaagtgggaaagtgagttttggagatggactgagcagctggcctccaattactggattctggaatac

SEQ ID NO: 93324 - DNA, 75 bp, Artificial Sequence
  Synthetic
tggtcttcctgttggtgacgatggccgggatgtcgcaaggcgctccggcctccgttttggggtctcgcccctttg

SEQ ID NO: 93325 - DNA, 75 bp, Artificial Sequence
  Synthetic
tatactactggggagaaggtgtgggaccgtgggaacgtcacgctcctgtgtgactgccccaacggcccctgggtg

SEQ ID NO: 93326 - DNA, 75 bp, Artificial Sequence
  Synthetic
ctccaattactggattctggaatatctctggaaggtcccgtttgacttctggaggggtgtgatgagcttgacccc

SEQ ID NO: 93327 - DNA, 75 bp, Artificial Sequence
  Synthetic
cgggatgtcgcaaggcgccccggcctccgttttggggtcccgcccctttgactacgggttgacatggcagtcctg

SEQ ID NO: 93328 - DNA, 75 bp, Artificial Sequence
  Synthetic
tccgttttggggtcccgcccctttgactacgggttgacatggcagtcctgttcctgcagggcgaatgggtcgcgt

SEQ ID NO: 93329 - DNA, 75 bp, Artificial Sequence
  Synthetic
cccctctcatgcccccagtatgtctatgggtctgtttcagtcacttgcgtgtggggttccgtctcttggtttgcc

SEQ ID NO: 93330 - DNA, 75 bp, Artificial Sequence
  Synthetic
tggttccgccagctgcaccatagccgctcttggatcgtcggatcgggacacggtagttgagctctccgagtgggg

SEQ ID NO: 93331 - DNA, 75 bp, Artificial Sequence
  Synthetic
tgactgccccaacggcccgtgggtgtggctgccggccttttgccaggcaataggctggggcgacccaatcaccca

SEQ ID NO: 93332 - DNA, 75 bp, Artificial Sequence
  Synthetic
cggtagttgagctctccgagtggggagtcccgtgcgcaacgtgcattctggatcgtcggccggcctcgtgcggca

SEQ ID NO: 93333 - DNA, 75 bp, Artificial Sequence
  Synthetic
tggctgccggccttttgccaggcaataggctggggcgacccaatcacccactggagccacggacaaaatcagtgg

SEQ ID NO: 93334 - DNA, 75 bp, Artificial Sequence
  Synthetic
gtggggctccgtgtcttggtttgcctcgacaggcggacgcgattcgaaaatcgacgtgtggagtttggttccagt

SEQ ID NO: 93335 - DNA, 75 bp, Artificial Sequence
  Synthetic
tgacaaaggacttggaagctgtgcccttcgtcaataggacaactcccttcaccataaggggccccctgggcaacc

SEQ ID NO: 93336 - DNA, 75 bp, Artificial Sequence
  Synthetic
tcgacgtgtggagtttggttccagttggttctgccagctgcaccatagctgcactcggttcttcggaccgcgata

SEQ ID NO: 93337 - DNA, 75 bp, Artificial Sequence
  Synthetic
tagccactataggtgggtcttaaggggaggttatggtccctctcgcgcttatagagagaaagcgcacggtccaca

SEQ ID NO: 93338 - DNA, 75 bp, Artificial Sequence
  Synthetic
gccacccagctccgcggcggcctacagccggggtagcccaagagccttcgggtgagggcgggtggcatttttctt

SEQ ID NO: 93339 - DNA, 75 bp, Artificial Sequence
  Synthetic
atttggtgaaatgtcccacaccagccattgagcctcccactgggacgttcgggtttttccccggagtgccgcccc

SEQ ID NO: 93340 - DNA, 75 bp, Artificial Sequence
  Synthetic
gggtttttccccggagtgccgcccctcaacaactgcatgctgctgggcacggaagtgtccgaagcattaggtggg

SEQ ID NO: 93341 - DNA, 75 bp, Artificial Sequence
  Synthetic
ctggctgaggcacggctggtcccgttgatcttgcttctgctgtggtggtgggtgaaccagttggcagtccttgga

SEQ ID NO: 93342 - DNA, 75 bp, Artificial Sequence
  Synthetic
cctgtcgtggtgtctgggcctccccaccgttagtatgatcctgggcttagcaaacctggtgttgtatttccggtg

SEQ ID NO: 93343 - DNA, 75 bp, Artificial Sequence
  Synthetic
tggtgggggaacttgggagcctctacggacccctttcggtctcggcctacgtggccgggatcttggggctcgggg

SEQ ID NO: 93344 - DNA, 75 bp, Artificial Sequence
  Synthetic
tacccggtacctaacctcacgtgtgctgtagaatgtgagctgaagtgggaaagtgagttttggagatggactgag

SEQ ID NO: 93345 - DNA, 75 bp, Artificial Sequence
  Synthetic
ggggatctcggcaacccgcgggcgcacctcggtgctcggggccgagttctgcttcgatgtcacattcgaggtgga

SEQ ID NO: 93346 - DNA, 75 bp, Artificial Sequence
  Synthetic
ggtcaaccagttggcggtccttgggctgccagctgtgcacgccgccgtggctggcgaggtttttgtgggcccggc

SEQ ID NO: 93347 - DNA, 75 bp, Artificial Sequence
  Synthetic
cgctcctgagctcgatgagcgcgggagggtggaggcacaaggccgtgatctataggacgtggtgtaaggggtacc

SEQ ID NO: 93348 - DNA, 75 bp, Artificial Sequence
  Synthetic
ccgcccttctcctgctggagcaaagaatcgtcatggtctttctcctggtgaccatggcgggcatgtctcagggcg

SEQ ID NO: 93349 - DNA, 75 bp, Artificial Sequence
  Synthetic
caaaccttgtgttgtactttcggtggatggggccgcagcgcctcatgttcctcgtgttgtggaagctcgctcggg

SEQ ID NO: 93350 - DNA, 75 bp, Artificial Sequence
  Synthetic
ctcgtgttgtggaagctcgctcggggggctttcccgctggctcttctgatggggatctcggcgacccgcgggcgc

SEQ ID NO: 93351 - DNA, 75 bp, Artificial Sequence
  Synthetic
tgcccgtctcggttctaggttccaggccctttgagcctgggctcacctggcagtcttgctcctgtaggtcgaacg

SEQ ID NO: 93352 - DNA, 75 bp, Artificial Sequence
  Synthetic
accaaacccctgacgtttgcctggtgcttggcctcatacatctggccagatgctgtgatgttggtggtggttgcc

SEQ ID NO: 93353 - DNA, 75 bp, Artificial Sequence
  Synthetic
cgctgtcaaggagcgcctgctggagtgggacgcggctttggaacccctgtcattcactaggacggactgtcgcat

SEQ ID NO: 93354 - DNA, 75 bp, Artificial Sequence
  Synthetic
ttccaagatcgatgtgtggagtttggtgccagttggctctgccagctgcaccatagccgctctcggtacttcgga

SEQ ID NO: 93355 - DNA, 75 bp, Artificial Sequence
  Synthetic
cattagagatgctgcgaggaccttggcctgcgggcagtgcgtcatgggcttgcctgtggtagcgcgccgtggtga

SEQ ID NO: 93356 - DNA, 75 bp, Artificial Sequence
  Synthetic
gagtggggggtcccctgtgccacgtgtattctggacaggcggcctgcctcgtgcggctcctgtgtgcgggactgc

SEQ ID NO: 93357 - DNA, 75 bp, Artificial Sequence
  Synthetic
cacaactgtccgactggtttccaagatgtgcgcgagaggggcctacttgttcgaccatatgggctctttctcgcg

SEQ ID NO: 93358 - DNA, 75 bp, Artificial Sequence
  Synthetic
gtcgggatcctgacttacatccagggaacgtcatggtgttggggacggctacgtcgcgaagcatggggacatgcc

SEQ ID NO: 93359 - DNA, 75 bp, Artificial Sequence
  Synthetic
cataagagatgccgcgagaaccctgtcctgcggacagtgcgtcatggggctacccgtggtagcgcgccgcggtga

SEQ ID NO: 93360 - DNA, 75 bp, Artificial Sequence
  Synthetic
tgaacggcctgctgttcacgactttccatggggcttcatcccgaaccatcgccacgcccgtgggggcccttaatc

SEQ ID NO: 93361 - DNA, 75 bp, Artificial Sequence
  Synthetic
ctccttacatctggtggaatgtcccatcccagccattgagcctccaaccggcacgtttgggttcttcccgggagt

SEQ ID NO: 93362 - DNA, 75 bp, Artificial Sequence
  Synthetic
tcgtcccgaccgcgcccgttgtcatccggcggtgcgggaaggggttcctgggggtcactaaggctgccttgacag

SEQ ID NO: 93363 - DNA, 75 bp, Artificial Sequence
  Synthetic
cgtcacggtgtacccgctcccggatggggcaacctcgttgacgccctgcacttgccaggctgagtcctgttgggt

SEQ ID NO: 93364 - DNA, 75 bp, Artificial Sequence
  Synthetic
ggggtcactaaggctgccttgacaggtcgggatcctgacttgcatccagggaacgtcatggtgttggggactgcg

SEQ ID NO: 93365 - DNA, 75 bp, Artificial Sequence
  Synthetic
ggggcaacctcgttgacgccctgcacttgccaggctgagtcctgttgggtcatacggtccgacggggctttgtgc

SEQ ID NO: 93366 - DNA, 75 bp, Artificial Sequence
  Synthetic
ccatggggcttcatcccgaaccatcgctacacctgtgggggccctaaatcccaggtggtggtcggcaagtgatga

SEQ ID NO: 93367 - DNA, 75 bp, Artificial Sequence
  Synthetic
acgcagtaggaatgctcgtgtcggtgctccactcgggtggtcgggtcaccgcggctcgattcaccaggccgtgga

SEQ ID NO: 93368 - DNA, 75 bp, Artificial Sequence
  Synthetic
gctccactcgggtggtcgggtcaccgcggctcgattcaccaggccgtggacccaggtcccaacagatgctaagac

SEQ ID NO: 93369 - DNA, 75 bp, Artificial Sequence
  Synthetic
cttgccaggctgagtcctgttgggtcatccgatcagacggggctttatgccatggcttgagcaagggggacaagg

SEQ ID NO: 93370 - DNA, 75 bp, Artificial Sequence
  Synthetic
ggtcccgcttattcttctcctgctatggtggtgggtgaaccagctcgtagttctcggactgcctgctgctaacgc

SEQ ID NO: 93371 - DNA, 75 bp, Artificial Sequence
  Synthetic
cactgtttatgcccacgggcgcaggaaagagcacgcgcgtcccgttggagtatggcaacatggggcacaaggtcc

SEQ ID NO: 93372 - DNA, 75 bp, Artificial Sequence
  Synthetic
aaagagcacgcgcgtcccgttggagtatggcaacatggggcacaaggtcctgattttgaacccctcggtggcgac

SEQ ID NO: 93373 - DNA, 75 bp, Artificial Sequence
  Synthetic
gtatctactgtggccatgacaccactgccttcacaaggatcactgattcccccttaacgtactctacctatggga

SEQ ID NO: 93374 - DNA, 75 bp, Artificial Sequence
  Synthetic
tgccttcacaaggatcactgattcccccttaacgtactctacctatgggaggtttctggccaaccctaggcagat

SEQ ID NO: 93375 - DNA, 75 bp, Artificial Sequence
  Synthetic
ccactgtgttgttggggattggacgggtccgggagctggcacgagagtgtggggtgcagcttgtgctctacgcca

SEQ ID NO: 93376 - DNA, 75 bp, Artificial Sequence
  Synthetic
tgtgagagccatgggcccttacatggagcgactggcgggcaaacatccaagcatatactgtggccatgacaccac

SEQ ID NO: 93377 - DNA, 75 bp, Artificial Sequence
  Synthetic
ggtccgggagctggcacgagagtgtggggtgcagcttgtgctctacgccactgccacgcctcctgggtcccccat

SEQ ID NO: 93378 - DNA, 75 bp, Artificial Sequence
  Synthetic
gagcgactggcgggcaaacatccaagcatatactgtggccatgacaccactgctttcacgaggattactgactcc

SEQ ID NO: 93379 - DNA, 75 bp, Artificial Sequence
  Synthetic
ggggtatcaggctgtgcgtcagcgggtggtgcggagtcctctgggagaaggacgtcccactaagccgctgaccat

SEQ ID NO: 93380 - DNA, 75 bp, Artificial Sequence
  Synthetic
ccttctatgggcatggcatacccctcgagcggatgcggaccggtaggcacctcgtattctgctactctaaggcag

SEQ ID NO: 93381 - DNA, 75 bp, Artificial Sequence
  Synthetic
gctccggggggtttcggtggtcatctgtgacgagtgccacagccatgactcaactgtgttactgggcatcgggcg

SEQ ID NO: 93382 - DNA, 75 bp, Artificial Sequence
  Synthetic
tgtgacgagtgccacagccatgactcaactgtgttactgggcatcgggcgagtacgggagctggcgcgcggctgt

SEQ ID NO: 93383 - DNA, 75 bp, Artificial Sequence
  Synthetic
agtgtgagcggctagccggtcagttttctgctaggggagttaacgccatagcctattacaggggaaaagacagtt

SEQ ID NO: 93384 - DNA, 75 bp, Artificial Sequence
  Synthetic
gacccagcacccatcaattattgagaccaaactggatgtgggagagatccccttctatgggcatggcatacccct

SEQ ID NO: 93385 - DNA, 75 bp, Artificial Sequence
  Synthetic
accaaactggatgtgggagagatccccttctatgggcatggcatacccctcgagcgaatgcgaaccggtaggcat

SEQ ID NO: 93386 - DNA, 75 bp, Artificial Sequence
  Synthetic
gagaaagccactactatccggctggtatccaagatgtgtgcgcggggagcttacctgttcgaccatatgggttcg

SEQ ID NO: 93387 - DNA, 75 bp, Artificial Sequence
  Synthetic
ctgtcaccgactgtgggttagtggtggaggaggtcgtcgaggtgacccttgatcccaccattaccatctccctgc

SEQ ID NO: 93388 - DNA, 75 bp, Artificial Sequence
  Synthetic
gatcccaccattaccatctccctgcggacagtgcccgcgtcggcagaactgtcgatgcagagacgaggacgcacg

SEQ ID NO: 93389 - DNA, 75 bp, Artificial Sequence
  Synthetic
ttccgcgaggggggtcaacgccatcgcctattataggggaaaggacagttctatcatcaaggacggtgacctggt

SEQ ID NO: 93390 - DNA, 75 bp, Artificial Sequence
  Synthetic
ggaggaggtcgttgaggtgacccttgatcccaccattaccatctccctgcggacagtgcctgcgtcggcagaatt

SEQ ID NO: 93391 - DNA, 75 bp, Artificial Sequence
  Synthetic
gatcccaccattaccatctccctgcggacagtgcctgcgtcggcagaattgtcgatgcaacggcgaggacgcacg

SEQ ID NO: 93392 - DNA, 75 bp, Artificial Sequence
  Synthetic
ccgttgaggatgcatcccgatgttagctgggcaaaagtgcgcggcgtcaactggcccctcttggtgggtgttcag

SEQ ID NO: 93393 - DNA, 75 bp, Artificial Sequence
  Synthetic
gcaatgatttaccatcaaaagtggccggccaccacattgttgacgacctggttcgtaggcttggtgtggcggagg

SEQ ID NO: 93394 - DNA, 75 bp, Artificial Sequence
  Synthetic
cggccaccacattgttgacgacctggttcgtaggcttggtgtggcggagggttatgtccgctgcgatgcggggcc

SEQ ID NO: 93395 - DNA, 75 bp, Artificial Sequence
  Synthetic
gttcgtaggcttggtgtggcggagggttatgtccgctgcgatgcggggccgatcttaatggtcggcctcgctatc

SEQ ID NO: 93396 - DNA, 75 bp, Artificial Sequence
  Synthetic
tgctgggtcatccgatccgacggggctttgtgccatggcttgtgcaagggggacaaggtagaactggacgtggcc

SEQ ID NO: 93397 - DNA, 75 bp, Artificial Sequence
  Synthetic
tgaagggcacgcagtaggaatgctcgtgtccgtgcttcattcggggggtcgggtcaccgctgcgcgcttcactcg

SEQ ID NO: 93398 - DNA, 75 bp, Artificial Sequence
  Synthetic
cagtaccagcaaaaggggtattcaaggaagctccattgttcatgcccaccggggccggcaagagcacgcgggtcc

SEQ ID NO: 93399 - DNA, 75 bp, Artificial Sequence
  Synthetic
acaccgggtcattggtggtggtgacagactgggatgtgaaggggggtggcagccccctttatcggcatggagacc

SEQ ID NO: 93400 - DNA, 75 bp, Artificial Sequence
  Synthetic
gtcgctaccgtgcgggccatgggcccttacatggaaaagttggcgggcaaacatccaagcatcttctgtgggcac

SEQ ID NO: 93401 - DNA, 75 bp, Artificial Sequence
  Synthetic
ggagggtgggcggctgtggttggccactgtcacagcgtcatagctgcggcggtggctgcctacggggcttccagg

SEQ ID NO: 93402 - DNA, 75 bp, Artificial Sequence
  Synthetic
aggcagatgctgaggggagtgtcggtggtgatatgtgatgagtgccacagtcatgactctactgtgttgttggga

SEQ ID NO: 93403 - DNA, 75 bp, Artificial Sequence
  Synthetic
aggcaacgctcagacgcgtttggcgtctgccctcctgttgggggccgctggcaccgccctgggcactcccgtcgt

SEQ ID NO: 93404 - DNA, 75 bp, Artificial Sequence
  Synthetic
tcatgactctactgtgttgttgggaatcgggcgagtgagggagctggcacgtgggtgtggagtccagttggttct

SEQ ID NO: 93405 - DNA, 75 bp, Artificial Sequence
  Synthetic
gggtttaaccatggcgggggcgttcatggggggtgctagcgtctctccctccttggtcaccatcttgttgggggc

SEQ ID NO: 93406 - DNA, 75 bp, Artificial Sequence
  Synthetic
tcattgagaccaagctggatgtgggagaaatccccttttatgggcatggaatccccctcgagcggatgcggacgg

SEQ ID NO: 93407 - DNA, 75 bp, Artificial Sequence
  Synthetic
ggtggcggcctacggggcttccagaagcccgccgttggcggccgcggcttcctacctgatgggattgggcgtcgg

SEQ ID NO: 93408 - DNA, 75 bp, Artificial Sequence
  Synthetic
ggccagtttttcgtcccgggggggttgaacgccattgcctattataggggtaaggacagttctatcatcaaagat

SEQ ID NO: 93409 - DNA, 75 bp, Artificial Sequence
  Synthetic
gtaccgccctgggcacgcctgtcgtgggactaaccatggcaggtgcgttcatggggggtgccagcgtctccccct

SEQ ID NO: 93410 - DNA, 75 bp, Artificial Sequence
  Synthetic
cactgtggtggccctagtcaatagggaacccaaggtggacgaggtacaggtggggtacgtctgggatctctggga

SEQ ID NO: 93411 - DNA, 75 bp, Artificial Sequence
  Synthetic
cggggatcgctcttggtctggttttgtactcagctaacaactctggcactaccacttggctgaaccgtctgctga

SEQ ID NO: 93412 - DNA, 75 bp, Artificial Sequence
  Synthetic
gtactcagctaacaactctggcactaccacttggctgaaccgtctgctgactacgttgccgaggtcctcgtgcat

SEQ ID NO: 93413 - DNA, 75 bp, Artificial Sequence
  Synthetic
gtcatggccaggctccgggctctctgccccgtggtgtcactgcctttgtggcactgcggggaggggtggtccgga

SEQ ID NO: 93414 - DNA, 75 bp, Artificial Sequence
  Synthetic
gccccgtggtgtcactgcctttgtggcactgcggggaggggtggtccggagagtggttgttggacggccatgtgg

SEQ ID NO: 93415 - DNA, 75 bp, Artificial Sequence
  Synthetic
tgctccgccgattgagcctgacccgcacagtggtggccctggtcaacagggaacccaaggtggatgaggtgcagg

SEQ ID NO: 93416 - DNA, 75 bp, Artificial Sequence
  Synthetic
gatcaccggcgatgttttcaatgggcaactcaaagagccagtttactctacaaagttgtgccggcactattggat

SEQ ID NO: 93417 - DNA, 75 bp, Artificial Sequence
  Synthetic
atggaacctgacttgacagcaaacctactgagactatacgacgactgcccttacaccgcagccgtcgcagctgac

SEQ ID NO: 93418 - DNA, 75 bp, Artificial Sequence
  Synthetic
gtcatggccaggctccgggccctctgccccgtggtgtcactcccgttgtggcattgcggggagggttggtccggg

SEQ ID NO: 93419 - DNA, 75 bp, Artificial Sequence
  Synthetic
gccccgtggtgtcactcccgttgtggcattgcggggagggttggtccggggaatggctgttggacggtcatgtgg

SEQ ID NO: 93420 - DNA, 75 bp, Artificial Sequence
  Synthetic
gccttttgggacgtcgggctgggctgaggtggtggtgacccctacccacgtggtgatcaggagaacctctcccta

SEQ ID NO: 93421 - DNA, 75 bp, Artificial Sequence
  Synthetic
gctgaggtggggcaacgacttgccatcgaaagtggccggccaccacatagttgatgacttggtccgtcgactcgg

SEQ ID NO: 93422 - DNA, 75 bp, Artificial Sequence
  Synthetic
ttgatgacttggtccgtcgactcggtgtggcggagggttatatccgctgcgacgcgggacccatcttaatggtgg

SEQ ID NO: 93423 - DNA, 75 bp, Artificial Sequence
  Synthetic
gctcaggctaagacagccgaggcctacgcagctaccaccaagtggctcgctggctgctacacggggacgcgggcc

SEQ ID NO: 93424 - DNA, 75 bp, Artificial Sequence
  Synthetic
tggctgctacacggggacgcgggccgtccccactgtttcaattgtggacaagctcttcgccggaggttgggccgc

SEQ ID NO: 93425 - DNA, 75 bp, Artificial Sequence
  Synthetic
gtccccactgtttcaattgtggacaagctcttcgccggaggttgggccgccgtggtgggccactgccacagtgta

SEQ ID NO: 93426 - DNA, 75 bp, Artificial Sequence
  Synthetic
gatgtcatcatggaggactgcagtacaccctctctttgtgggagtagccgagagatgcctgtgtggggagaagac

SEQ ID NO: 93427 - DNA, 75 bp, Artificial Sequence
  Synthetic
tactagaagccttgtttccacagagtgatgccactagaaagcttaccgtcaggatgaattgctgcgttgagaaga

SEQ ID NO: 93428 - DNA, 75 bp, Artificial Sequence
  Synthetic
tgcggcggcgtcgtacctcatggggttgggcgtcggaggcaacgcgcaggcgcggctggcatccgccctcctttt

SEQ ID NO: 93429 - DNA, 75 bp, Artificial Sequence
  Synthetic
acccccgtcgtgggtctaaccatggcgggggcgttcatgggtggggctagcgtgtcaccatccctcgtcacggtc

SEQ ID NO: 93430 - DNA, 75 bp, Artificial Sequence
  Synthetic
ttgaatgtgataagtgtgaggctaggcaagagactttggcctccttctcctatatttggtctggggtgccattga

SEQ ID NO: 93431 - DNA, 75 bp, Artificial Sequence
  Synthetic
cgtcttcgacttcatggcagggaagctttctacggaggacctgtggtatgccatcccagtgctcactagcccggg

SEQ ID NO: 93432 - DNA, 75 bp, Artificial Sequence
  Synthetic
ttggtggctgacaccacgaaagtgtatgtcacaaacccggacaatgttgggagaagagtggacaaggtgaccttc

SEQ ID NO: 93433 - DNA, 75 bp, Artificial Sequence
  Synthetic
actccgggaccaccacatggttgaaccgtctgctgaccacgctgcctcgttcatcatgcatcccagatagctact

SEQ ID NO: 93434 - DNA, 75 bp, Artificial Sequence
  Synthetic
ccgtctgctgaccacgctgcctcgttcatcatgcatcccagatagctacttccaacaggccgactactgtgacaa

SEQ ID NO: 93435 - DNA, 75 bp, Artificial Sequence
  Synthetic
tgccaggagggcggctcaagcctgccaaagcatgggttacacttatgaggaagcaataaggactgttaggccaca

SEQ ID NO: 93436 - DNA, 75 bp, Artificial Sequence
  Synthetic
tggtcaacagggaacccaaggtggatgaagtgcaggttggctacgtgtgggacctttgggaatggatcatgcccc

SEQ ID NO: 93437 - DNA, 75 bp, Artificial Sequence
  Synthetic
ttagtggctgacactactaaagtgtatgttaccaacccagacaatgtggggaggagggtagacaaggtgaccttc

SEQ ID NO: 93438 - DNA, 75 bp, Artificial Sequence
  Synthetic
tgaagtgcaggttggctacgtgtgggacctttgggaatggatcatgccccaggtgcgtatggtggtgtccagact

SEQ ID NO: 93439 - DNA, 75 bp, Artificial Sequence
  Synthetic
gatggtctggggaatggttcctggacggacatgtggagagtcggtgtctctgtggctgcgtcataacaggtgacg

SEQ ID NO: 93440 - DNA, 75 bp, Artificial Sequence
  Synthetic
gcggtgttggggggggcttacgccttccagtacaccccaaatcagcgagttaaggagatgctcaaactgtgggag

SEQ ID NO: 93441 - DNA, 75 bp, Artificial Sequence
  Synthetic
agtttactttaccaaattgtgccggcactattggatggggactgttccggtcaacatgctgggttacggggaaac

SEQ ID NO: 93442 - DNA, 75 bp, Artificial Sequence
  Synthetic
taaggagatgctcaaactgtgggagtcaaagaaaacaccttgcgccatctgtgtggacgccacttgcttcgacag

SEQ ID NO: 93443 - DNA, 75 bp, Artificial Sequence
  Synthetic
ctggctgggctgaggtggtagtgacccccacccacgtggtggtccggcgcacttcctgttacaagctgctgcgcc

SEQ ID NO: 93444 - DNA, 75 bp, Artificial Sequence
  Synthetic
cctctgaccatccagagtgggtgcgagctttggggaagtactatgcctcaggaaccatggtcacccctgaggggg

SEQ ID NO: 93445 - DNA, 75 bp, Artificial Sequence
  Synthetic
gcggtgttggggggggcttatgccttccagtacaccccaaaccagcgggttagggagatgctcaaactgtgggaa

SEQ ID NO: 93446 - DNA, 75 bp, Artificial Sequence
  Synthetic
ccggtctcgtgggaagccgacgctcgcgcgccggcgatggtctacggtcctggccaaagcgttaccattgacggg

SEQ ID NO: 93447 - DNA, 75 bp, Artificial Sequence
  Synthetic
tcaaagaaaacaccttgcgccatctgtgtggatgccacgtgcttcgacagtagtattactgaagaggacgtggca

SEQ ID NO: 93448 - DNA, 75 bp, Artificial Sequence
  Synthetic
gcgagtaactgcctgacctgctacatcaaggtgaaagccgcttgtgagagagtggggctgaaaaatgtctcgctt

SEQ ID NO: 93449 - DNA, 75 bp, Artificial Sequence
  Synthetic
tcaaggtgaaagccgcttgtgagagagtggggctgaaaaatgtctcgcttctcatagccggcgatgactgtttga

SEQ ID NO: 93450 - DNA, 75 bp, Artificial Sequence
  Synthetic
tgaggtttcgtcagaggtcagcatcgagattgggacggagactgaagactcagaattgactgaggccgacttgcc

SEQ ID NO: 93451 - DNA, 75 bp, Artificial Sequence
  Synthetic
cttccgaccatccagattgggtgcgagcgttggggaaatactatgcctcaggcaccatggtcacccccgaggggg

SEQ ID NO: 93452 - DNA, 75 bp, Artificial Sequence
  Synthetic
ctggcgagctatgggtatgcttgcgagccttcgtatcatgcatcactggacacggcccccttctgctccacttgg

SEQ ID NO: 93453 - DNA, 75 bp, Artificial Sequence
  Synthetic
gcgagcaactgcttgacttgctacatcaaggtgaaagccgcttgtgagagggtggggctgaagaacgtctcactc

SEQ ID NO: 93454 - DNA, 75 bp, Artificial Sequence
  Synthetic
tcaaggtgaaagccgcttgtgagagggtggggctgaagaacgtctcactcctcatagccggcgatgactgtttga

SEQ ID NO: 93455 - DNA, 75 bp, Artificial Sequence
  Synthetic
cacggcccccttctgctccacttggcttgccgagtgcaatgcagatgggaagcgccatttcttcctgaccacgga

SEQ ID NO: 93456 - DNA, 75 bp, Artificial Sequence
  Synthetic
ctttcggaggccgctcgctcgcatgtcgagcgagtacagtgaccctatggcttcggccattggttacatcctcct

SEQ ID NO: 93457 - DNA, 75 bp, Artificial Sequence
  Synthetic
cgtggccctccacggaccagcagcgttgagggttaccgcagacacaactaagacaaaaatggaagctgggaaggt

SEQ ID NO: 93458 - DNA, 75 bp, Artificial Sequence
  Synthetic
tgtggagaagagcgtcacacgcttcttttccttggggttgaccgtggctgacgtggctagcctgtgtgaaatgga

SEQ ID NO: 93459 - DNA, 75 bp, Artificial Sequence
  Synthetic
gctgagcgacctcaagctccctggcctggcggtccaccgtaagaaggctggagcattgcgaacacgcatgctccg

SEQ ID NO: 93460 - DNA, 75 bp, Artificial Sequence
  Synthetic
tggggtctttgttggtggctgacaccacgaaagtgtatgtcactaacccggacaatgttgggaggagggtagaca

SEQ ID NO: 93461 - DNA, 75 bp, Artificial Sequence
  Synthetic
tcgggtgaactaaattcatctgttgcggcaaggtccagtgactgatcatcactggaggaggttcccgccctcccc

SEQ ID NO: 93462 - DNA, 75 bp, Artificial Sequence
  Synthetic
tcgatcgagagggccagaaaagctgctcaaagctgcctaagcatgggttacacttatgaggaggcaataaggact

SEQ ID NO: 93463 - DNA, 75 bp, Artificial Sequence
  Synthetic
tacttgaagggactccggtcccctttacattgactgtgaaaaaggaggtgttcttcaaagaccgaaaggaggaga

SEQ ID NO: 93464 - DNA, 75 bp, Artificial Sequence
  Synthetic
tggccttgggttgcacgatttgtactgaccgctgctggccactgtatcaggcggggttagccgtgcggcctggca

SEQ ID NO: 93465 - DNA, 75 bp, Artificial Sequence
  Synthetic
gctcggaagcctttacgggcccttatcagtgtccgcctacgtggcgggcatcttagggcttggggaagtgtattc

SEQ ID NO: 93466 - DNA, 75 bp, Artificial Sequence
  Synthetic
tcaccactagcgcgagcaactgcttgacctgctacatcaaggtccgagccgcgtgtgagcgggtgggtctgaaaa

SEQ ID NO: 93467 - DNA, 75 bp, Artificial Sequence
  Synthetic
caaacctgacttgtgctgtagaatgtgagctgaagtgggaaagtgagttttggagatggactgagcagttggcct

SEQ ID NO: 93468 - DNA, 75 bp, Artificial Sequence
  Synthetic
tgagctgaagtgggaaagtgagttttggagatggactgagcagttggcctccaattactggattctggaatacct

SEQ ID NO: 93469 - DNA, 75 bp, Artificial Sequence
  Synthetic
gtatgcgtgtgaaccctcatatcatgcatcactggacacggcccccttctgctccacttggcttgccgagtgcaa

SEQ ID NO: 93470 - DNA, 75 bp, Artificial Sequence
  Synthetic
ggtggtggcacaccgtctgatccggtgtggtgccaggttcatggcaattactacaagtttccactggacaaactg

SEQ ID NO: 93471 - DNA, 75 bp, Artificial Sequence
  Synthetic
ggggagcctctacgggcccttgtcggtctcggcctacgtggccgggatcttgggcctgggtgaggtttactccgg

SEQ ID NO: 93472 - DNA, 75 bp, Artificial Sequence
  Synthetic
cctctcgtgtccccagtatgtctatggtgctgtttcagtgacttgtgtgtggggttccgtgtcttggtttgcctc

SEQ ID NO: 93473 - DNA, 75 bp, Artificial Sequence
  Synthetic
cgcatgctccggtcgcgcggatgggcagagttggctcggggcctgttgtggcatccaggcctccggctccctccc

SEQ ID NO: 93474 - DNA, 75 bp, Artificial Sequence
  Synthetic
gctctgccagttgtaccatagccgcgctagggtcatcggatcgcgataccgtggtggagctctccgagtggggga

SEQ ID NO: 93475 - DNA, 75 bp, Artificial Sequence
  Synthetic
gaaggtcccgttcgatttttggaggggcgtgatgagcctgacccccctattggtctgcctggcggccttgctact

SEQ ID NO: 93476 - DNA, 75 bp, Artificial Sequence
  Synthetic
tcccgtgcgcgacctgcattctggatcgtcggcctgcctcgtgcggcacctgtgtgcgggattgctggcccgaaa

SEQ ID NO: 93477 - DNA, 75 bp, Artificial Sequence
  Synthetic
tttggggtcgcgcccctttgactacgggttaacatggcagtcctgctcctgcagggctaacggctcacgcgttcc

SEQ ID NO: 93478 - DNA, 75 bp, Artificial Sequence
  Synthetic
gccccaatggaccctgggtatggctcccagccttttgccaggcgataggctggggtgaccccatcacccattgga

SEQ ID NO: 93479 - DNA, 75 bp, Artificial Sequence
  Synthetic
cccagccttttgccaggcgataggctggggtgaccccatcacccattggagccacggacaaaatcagtggcccct

SEQ ID NO: 93480 - DNA, 75 bp, Artificial Sequence
  Synthetic
gctccgtgtcttggtttgcctcgactggtggtcgcgactcgaagatcgatgtgtggagtttggtaccagttggct

SEQ ID NO: 93481 - DNA, 75 bp, Artificial Sequence
  Synthetic
gtcgagctctccgagtggggagttccgtgcgtgacgtgcattctggatcgtcggccgagctcgtgtggcacctgt

SEQ ID NO: 93482 - DNA, 75 bp, Artificial Sequence
  Synthetic
tgaaccacctggcagtccttggattgccggcggcacatgctgctgtggcgggggaagtgttcccgggtccagcct

SEQ ID NO: 93483 - DNA, 75 bp, Artificial Sequence
  Synthetic
ctggtgcgcaggtgttcggagctgatgggccgccgaaatccagtttgcccggggtatgcatggctttcctcgggc

SEQ ID NO: 93484 - DNA, 75 bp, Artificial Sequence
  Synthetic
taggacgtggtgtaaggggtaccaggcgttgcgccagcgggtggtgcggagccccctcggggaggggcggcccac

SEQ ID NO: 93485 - DNA, 75 bp, Artificial Sequence
  Synthetic
gcgttgcgccagcgggtggtgcggagccccctcggggaggggcggcccaccaagccgttgaccattgcctggtgc

SEQ ID NO: 93486 - DNA, 75 bp, Artificial Sequence
  Synthetic
tggttgcttttggactttgtatttgtcctattatacctgatgaagctggctgaggcacggttggtcccgttgatc

SEQ ID NO: 93487 - DNA, 75 bp, Artificial Sequence
  Synthetic
ggtgctccttttcggcctgttcgatgcgttggactgggccttagaggagctactggtctcccggccttctttgcg

SEQ ID NO: 93488 - DNA, 75 bp, Artificial Sequence
  Synthetic
gcgttggactgggccttagaggagctactggtctcccggccttctttgcggcgtttggctcgggtggtggaatgc

SEQ ID NO: 93489 - DNA, 75 bp, Artificial Sequence
  Synthetic
ggttgtggacgccgccgtagctggggaggtttttgcggggccggccttgtcgtggtgcctgggcttgccgactgt

SEQ ID NO: 93490 - DNA, 75 bp, Artificial Sequence
  Synthetic
gaggtttttgcggggccggccttgtcgtggtgcctgggcttgccgactgttagcatgatattaggtctagcaaac

SEQ ID NO: 93491 - DNA, 75 bp, Artificial Sequence
  Synthetic
gtgtgcacgaggagcctatctgttcgaccacatgggctctttctcgcgcgccgtcaaggaacgcttgcttgaatg

SEQ ID NO: 93492 - DNA, 75 bp, Artificial Sequence
  Synthetic
gaccacatgggctctttctcgcgcgccgtcaaggaacgcttgcttgaatgggacgcggccctggaacctctgtca

SEQ ID NO: 93493 - DNA, 75 bp, Artificial Sequence
  Synthetic
gtgcggccagtgcgtcatgggcttgcctgtggtagctcgccgcggcgatgaggtcctgatcggcgtctttcaaga

SEQ ID NO: 93494 - DNA, 75 bp, Artificial Sequence
  Synthetic
cctgtggtagctcgccgcggcgatgaggtcctgatcggcgtctttcaagatgtgaaccatttgcctcccgggttt

SEQ ID NO: 93495 - DNA, 75 bp, Artificial Sequence
  Synthetic
tgtggtggcctgggccattgcgctcctgagctcgatgagcgcgggaaggtggaggcacaaagccgtggtctacag

SEQ ID NO: 93496 - DNA, 75 bp, Artificial Sequence
  Synthetic
ctgagctcgatgagcgcgggaaggtggaggcacaaagccgtggtctacagaacgtggtgcaaggggtatcaggcg

SEQ ID NO: 93497 - DNA, 75 bp, Artificial Sequence
  Synthetic
aacggcttgctgttcacgactttccatggggcttcttcccgaaccatcgccacacctgtgggagccctaaatcca

SEQ ID NO: 93498 - DNA, 75 bp, Artificial Sequence
  Synthetic
gcctcgtacatctggccggatgccgtgatgatggtggtggttgccttggtgcttcttttcggcttgttcgacgcg

SEQ ID NO: 93499 - DNA, 75 bp, Artificial Sequence
  Synthetic
cttggcgcgggtgttcgagtgttgtgtgatggcgggcgagaaggccacaactgtccggttggtcaccaagatgtg

SEQ ID NO: 93500 - DNA, 75 bp, Artificial Sequence
  Synthetic
gaactagatgtggcgatggaggtctcagacttccgcggctcgtcggggtctccagtcctgtgcgacgagggacac

SEQ ID NO: 93501 - DNA, 75 bp, Artificial Sequence
  Synthetic
gagacgccgcgaggactttgtcctgcgggcagtgcgtcatgggtttacccgtggtggcacgccgtggtgacgagg

SEQ ID NO: 93502 - DNA, 75 bp, Artificial Sequence
  Synthetic
caaaggagttttcaaggaggccccgttgttcatgcctacgggggccgggaagagcacccgggtcccgttggaata

SEQ ID NO: 93503 - DNA, 75 bp, Artificial Sequence
  Synthetic
ttgttcatgcctacgggggccgggaagagcacccgggtcccgttggaatacgggaacatgggccacaaagtcctc

SEQ ID NO: 93504 - DNA, 75 bp, Artificial Sequence
  Synthetic
cactaaggctgccttgacaggacgggatcctgacttacatccagggaacgtcatggtgttggggacggcgacctc

SEQ ID NO: 93505 - DNA, 75 bp, Artificial Sequence
  Synthetic
gcgactggcggggaaacatcctagcatttactgtggacatgatacaacagcgttcactaggatcactgactctcc

SEQ ID NO: 93506 - DNA, 75 bp, Artificial Sequence
  Synthetic
atttactgtggacatgatacaacagcgttcactaggatcactgactctccattgacgtattttacctacgggagg

SEQ ID NO: 93507 - DNA, 75 bp, Artificial Sequence
  Synthetic
acccgtgggggccctaaatcccaggtggtggtcggccagtgatgacgttacggtgtaccccctcccggatggagc

SEQ ID NO: 93508 - DNA, 75 bp, Artificial Sequence
  Synthetic
tgacgaatgccacagtcatgactcgacggtactgctggggattgggagggtcagggagttggcacgtggttgtgg

SEQ ID NO: 93509 - DNA, 75 bp, Artificial Sequence
  Synthetic
acggtactgctggggattgggagggtcagggagttggcacgtggttgtggggtccaattggtcctctatgccact

SEQ ID NO: 93510 - DNA, 75 bp, Artificial Sequence
  Synthetic
gatccgatggggctctatgccatggcttgagcaagggggataaggtggagctggacctggccatggaggtctctg

SEQ ID NO: 93511 - DNA, 75 bp, Artificial Sequence
  Synthetic
cttgagcaagggggataaggtggagctggacctggccatggaggtctctgacttccgcggctcgtccggttcgcc

SEQ ID NO: 93512 - DNA, 75 bp, Artificial Sequence
  Synthetic
aaaattggacgtgggagagatccccttttatgggcatggcataccccttgaaaggatgcggactggtaggcacct

SEQ ID NO: 93513 - DNA, 75 bp, Artificial Sequence
  Synthetic
ttttatgggcatggcataccccttgaaaggatgcggactggtaggcacctcgtattctgccactcaaaggcggag

SEQ ID NO: 93514 - DNA, 75 bp, Artificial Sequence
  Synthetic
attcgggtggtagggtcaccgccgctcgattcaccaggccgtggacccaagtaccaacagacgccaaagctacca

SEQ ID NO: 93515 - DNA, 75 bp, Artificial Sequence
  Synthetic
tcgattcaccaggccgtggacccaagtaccaacagacgccaaagctaccactgaacccccggcggtgccagcaaa

SEQ ID NO: 93516 - DNA, 75 bp, Artificial Sequence
  Synthetic
gcacacgcgtcccgttggagtatggtaacatggggcacaaggtcctgattctgaacccctcagtcgctactgtga

SEQ ID NO: 93517 - DNA, 75 bp, Artificial Sequence
  Synthetic
ggggtacactgggaacttcgactccgtaaccgactgtgggctggtggtggaggaggtcgttgaggtgacccttga

SEQ ID NO: 93518 - DNA, 75 bp, Artificial Sequence
  Synthetic
taacatggggcacaaggtcctgattctgaacccctcagtcgctactgtgaaggctatgggcccttacatggagcg

SEQ ID NO: 93519 - DNA, 75 bp, Artificial Sequence
  Synthetic
acagtgcccgcgtcggcagaattgtcgatgcagcggcgaggtcgcacgggcagaggccggtctggccggtactac

SEQ ID NO: 93520 - DNA, 75 bp, Artificial Sequence
  Synthetic
tcactaggattactgactcccccttaacgtattccacctacgggaggtttttggccaaccctaggcagatgctac

SEQ ID NO: 93521 - DNA, 75 bp, Artificial Sequence
  Synthetic
aacgtattccacctacgggaggtttttggccaaccctaggcagatgctacggggggtgtcggtggtcatttgtga

SEQ ID NO: 93522 - DNA, 75 bp, Artificial Sequence
  Synthetic
gggagttggcgcgcgggtgtggggtgcagcttgtactctacgccacagctacaccacccggttctcctatgaccc

SEQ ID NO: 93523 - DNA, 75 bp, Artificial Sequence
  Synthetic
gcagcttgtactctacgccacagctacaccacccggttctcctatgacccagcatccatcaatcattgagacaaa

SEQ ID NO: 93524 - DNA, 75 bp, Artificial Sequence
  Synthetic
ggatgcgaaccggcaggcacctcgttttctgccattccaaggcggagtgcgagcgtcttgctggtcagttttctg

SEQ ID NO: 93525 - DNA, 75 bp, Artificial Sequence
  Synthetic
ttatagagggaaggacagttctatcatcaaagatggagacctggtggtgtgcgcgacggacgcactgtccaccgg

SEQ ID NO: 93526 - DNA, 75 bp, Artificial Sequence
  Synthetic
gccaccacattgtagacgacctggtcaggaggctcggtgtggcggaaggttacgtccgctgtgatgctggtccca

SEQ ID NO: 93527 - DNA, 75 bp, Artificial Sequence
  Synthetic
gccactcctcaacctgtggtgcaggtccccccggtagaccatcggccggggggggaatctgctccatcaaatgcc

SEQ ID NO: 93528 - DNA, 75 bp, Artificial Sequence
  Synthetic
caagtggcttgctggctgctacacggggacgcgggccgtccccacagtttcaattgtggacaagctctttgccgg

SEQ ID NO: 93529 - DNA, 75 bp, Artificial Sequence
  Synthetic
ccctccgttggcagcagccgcttcctacctgatgggactgggcgtcgcgggcaatgcgcaggcgcgcttggcttc

SEQ ID NO: 93530 - DNA, 75 bp, Artificial Sequence
  Synthetic
gggtggtgctagcgtgtccccctcgctggtcacggtcctcttgggggccgtgggcggttgggaaggcttcctcaa

SEQ ID NO: 93531 - DNA, 75 bp, Artificial Sequence
  Synthetic
acttgtggtatgccatcccggtactgaccagcccaggagcgggccttgcggggatcgcccttgggttggttttgt

SEQ ID NO: 93532 - DNA, 75 bp, Artificial Sequence
  Synthetic
cacttggctaaaccgactgctgaccacacttcctcggtcttcctgcatcccggacagctatttccaacaggccga

SEQ ID NO: 93533 - DNA, 75 bp, Artificial Sequence
  Synthetic
ctcagacgcctgagcctcactcgaactgtggttgccctggtcaacagggagcctaaggtagatgaggtccaggtt

SEQ ID NO: 93534 - DNA, 75 bp, Artificial Sequence
  Synthetic
cggcctacggggcttctaggagtcccccgttggcagctgcggcttcctatctgatgggactgggcgtcggaggca

SEQ ID NO: 93535 - DNA, 75 bp, Artificial Sequence
  Synthetic
cccgttggcagctgcggcttcctatctgatgggactgggcgtcggaggcaacgcacagacgcgcttggcatcagc

SEQ ID NO: 93536 - DNA, 75 bp, Artificial Sequence
  Synthetic
cccgttggcagctgcggcttcctatctgatgggactgggcgtcggaggcaacgctcagacgcgcttggcatcagc

SEQ ID NO: 93537 - DNA, 75 bp, Artificial Sequence
  Synthetic
cccgttggcagctgcggcttcctatctgatgggactgggcgtcggaggcaacgcccagacgcgcttggcatcagc

SEQ ID NO: 93538 - DNA, 75 bp, Artificial Sequence
  Synthetic
cccgttggcagctgcggcttcctatctgatgggactgggcgtcggaggcaacgcgcagacgcgcttggcatcagc

SEQ ID NO: 93539 - DNA, 75 bp, Artificial Sequence
  Synthetic
taacgatggcgggcgcattcatggggggtgctagcgtctccccctccctggtcaccattttactgggggccgtcg

SEQ ID NO: 93540 - DNA, 75 bp, Artificial Sequence
  Synthetic
ttacggtgaaacctcacccctgctagcctcagacacgcctaaggtggtaccctttggcacgtcggggtgggcgga

SEQ ID NO: 93541 - DNA, 75 bp, Artificial Sequence
  Synthetic
gtggtgtcactccctttgtggcactgcggggaggggtggtccggagaatggctgttggacggtcatgtggagagt

SEQ ID NO: 93542 - DNA, 75 bp, Artificial Sequence
  Synthetic
ctgtgccggcattactggatggggacagtccctgtgaacatgctgggctacgggggaacatcacccctcctagcc

SEQ ID NO: 93543 - DNA, 75 bp, Artificial Sequence
  Synthetic
cgggggaacatcacccctcctagcctctgatactccgaaggtggtacccttcgggacatcaggctgggctgaggt

SEQ ID NO: 93544 - DNA, 75 bp, Artificial Sequence
  Synthetic
cgtcttcaacgtggctctttccgtactaaaagccttattcccacagagcgacgctacgcgtaagctaacggtcag

SEQ ID NO: 93545 - DNA, 75 bp, Artificial Sequence
  Synthetic
tgctgcgccagcaaatcctatcagctgctgttgctgagccctattatgtcgacggcataccggtctcgtgggacg

SEQ ID NO: 93546 - DNA, 75 bp, Artificial Sequence
  Synthetic
tgaccgtggctgatgtggctagcctgtgtgagatggaaatccagaaccatacagcctattgtgacaaggtgcgca

SEQ ID NO: 93547 - DNA, 75 bp, Artificial Sequence
  Synthetic
gaatgtgacaagtgtgaggcacggcaagagaccttggcttccttctcctacatttggtttggagtgccattgact

SEQ ID NO: 93548 - DNA, 75 bp, Artificial Sequence
  Synthetic
ggtggcagacactactaaagtgtatgtgaccaatccagacaatgtgggtaggagggtggacaaggtaaccttctg

SEQ ID NO: 93549 - DNA, 75 bp, Artificial Sequence
  Synthetic
ctaggaggagtgctcaagcctgcctaagcatgggttacacttatgaggaggcaataaggactgttaggccacatg

SEQ ID NO: 93550 - DNA, 75 bp, Artificial Sequence
  Synthetic
cttcaacgtggctctttccgtattaaaagccttgtttccacagagcgatgccaccaggaagcttaccgttaagat

SEQ ID NO: 93551 - DNA, 75 bp, Artificial Sequence
  Synthetic
ggtgggcaatgaacttacctttgaatgtgacaagtgtgaagccaggcaggagactttggcctccttttcctacat

SEQ ID NO: 93552 - DNA, 75 bp, Artificial Sequence
  Synthetic
tgaggccggttgggtccttgttagtggccgacaccactaaagtgtatgtcaccaatccggacaatgttgggagga

SEQ ID NO: 93553 - DNA, 75 bp, Artificial Sequence
  Synthetic
cccgtgggcgagaggtattgtaggtcctcaggtgtacttaccactagcgccagcaactgcctgacttgctacatc

SEQ ID NO: 93554 - DNA, 75 bp, Artificial Sequence
  Synthetic
gatcgctggtgatgactgtctgatcatatgtgagaggcctatgtgcgaccctagtgaggccttgggcagggccct

SEQ ID NO: 93555 - DNA, 75 bp, Artificial Sequence
  Synthetic
tggctctccacggaccagcagcgttgagagttaccgcagacacaactaagacaaaaatggaggccggcaaggtgc

SEQ ID NO: 93556 - DNA, 75 bp, Artificial Sequence
  Synthetic
gaccatccagaatgggtgcgagccctggggaaatactatgcctcgggcaccatggtcacccctgagggggtgccc

SEQ ID NO: 93557 - DNA, 75 bp, Artificial Sequence
  Synthetic
gggcctgttgtggcatccaggcctacggctccccccccccgagattgctggtatcccggggggtttccccctgtc

SEQ ID NO: 93558 - DNA, 75 bp, Artificial Sequence
  Synthetic
caattgcttgacctgctatatcaaggtgaaagccgcctgtgagagagtaggcctgaaaaacgtctcgctcctcat

SEQ ID NO: 93559 - DNA, 75 bp, Artificial Sequence
  Synthetic
ctgaggaggttcccgccctccccgccccaggggtctccccgctgggtaaaaagggcccggccttgggaggcatgg

SEQ ID NO: 93560 - DNA, 75 bp, Artificial Sequence
  Synthetic
gcggttgggcagagttggctaggggcctgttgtggcatccaggcctacggcttcctccccctgagattgctggta

SEQ ID NO: 93561 - DNA, 75 bp, Artificial Sequence
  Synthetic
ggccattttggccccggccacccacgcgtgtagagcgaatgggcaatatttcctcacaaactgttgcgctccgga

SEQ ID NO: 93562 - DNA, 75 bp, Artificial Sequence
  Synthetic
ggtcatcttggtagccactataggtgggtcttaagagtgggttaaggtccctctttcgcctgcggcgggaacgcg

SEQ ID NO: 93563 - DNA, 75 bp, Artificial Sequence
  Synthetic
cagtttgtactgaccgatgctggccactgtatcaggcgggattggctgtgcgacccggcaagtccgccgcccagc

SEQ ID NO: 93564 - DNA, 75 bp, Artificial Sequence
  Synthetic
gtcgctggaatattggggctaggggaggtgtactccggcgtcctcacagtgggtgttgcgttgacgcgccgagtg

SEQ ID NO: 93565 - DNA, 75 bp, Artificial Sequence
  Synthetic
gagtgagttttggagatggactgagcagttggcctccaattactggatcctggagtacctctggaaagtgccttt

SEQ ID NO: 93566 - DNA, 75 bp, Artificial Sequence
  Synthetic
cagttggcctccaattactggatcctggagtacctctggaaagtgcctttcgacttttggcggggagtgatgagc

SEQ ID NO: 93567 - DNA, 75 bp, Artificial Sequence
  Synthetic
tggttgaggccggggccattctggccccggccacccacgcttgtaaaacgaatgggcaatatttcctcacaaact

SEQ ID NO: 93568 - DNA, 75 bp, Artificial Sequence
  Synthetic
tggttgaggccggggccattctggccccggccacccacgcttgtataacgaatgggcaatatttcctcacaaact

SEQ ID NO: 93569 - DNA, 75 bp, Artificial Sequence
  Synthetic
tggttgaggccggggccattctggccccggccacccacgcttgtacaacgaatgggcaatatttcctcacaaact

SEQ ID NO: 93570 - DNA, 75 bp, Artificial Sequence
  Synthetic
tggttgaggccggggccattctggccccggccacccacgcttgtagaacgaatgggcaatatttcctcacaaact

SEQ ID NO: 93571 - DNA, 75 bp, Artificial Sequence
  Synthetic
agtggtcatggtcttcctgctggttaccatggctgggatgtctcagggcgccccggcctcggtaatggggtctcg

SEQ ID NO: 93572 - DNA, 75 bp, Artificial Sequence
  Synthetic
accatggctgggatgtctcagggcgccccggcctcggtaatggggtctcgtccctttgaggcgggattgacctgg

SEQ ID NO: 93573 - DNA, 75 bp, Artificial Sequence
  Synthetic
ggttcgggatcctgggaacgtctcaccattgtgtgactgccccaacggcccctgggtatggctgccggccttttg

SEQ ID NO: 93574 - DNA, 75 bp, Artificial Sequence
  Synthetic
ccattgtgtgactgccccaacggcccctgggtatggctgccggccttttgcctcgcgatccgctggggcgaccct

SEQ ID NO: 93575 - DNA, 75 bp, Artificial Sequence
  Synthetic
ggtttcggcttacgtggccggaatcttggggctcggggaggtttattctggcgtcctcactgtgggtgttgcgtt

SEQ ID NO: 93576 - DNA, 75 bp, Artificial Sequence
  Synthetic
atttgtctacggtgctgtttcagtgacctgcgtgtggggttccgtgtcttggttcgcttccacaggtggtcgtga

SEQ ID NO: 93577 - DNA, 75 bp, Artificial Sequence
  Synthetic
acctgcgtgtggggttccgtgtcttggttcgcttccacaggtggtcgtgattctaagctcgatgtgtggagtttg

SEQ ID NO: 93578 - DNA, 75 bp, Artificial Sequence
  Synthetic
tcgcgacactgtgccggagctggccgagtggggagtcccttgcgccacctgtattctggaccgtcgaccaacctc

SEQ ID NO: 93579 - DNA, 75 bp, Artificial Sequence
  Synthetic
cttcctgttagtcaccatggccgggatgtcgcaaggtgccccggcctcggtgcttgggtctcggccctttgagcc

SEQ ID NO: 93580 - DNA, 75 bp, Artificial Sequence
  Synthetic
ttccattccatcggtgcggcgcggggccacggctgacacttgacttggatgctgttcccttcgtcaacaggacaa

SEQ ID NO: 93581 - DNA, 75 bp, Artificial Sequence
  Synthetic
gggattgacatgggattcttgctcctgcagggcgaacggttcgcgcgtgcctactggggagaaggtttgggagcg

SEQ ID NO: 93582 - DNA, 75 bp, Artificial Sequence
  Synthetic
ctcgttacatctggtgaagtgtcccactcctgccattgagcctccaactgggacgttcgggttcttccctggagt

SEQ ID NO: 93583 - DNA, 75 bp, Artificial Sequence
  Synthetic
cgtgtggagtctggtgccgcatggctctgccagttgcaccatagccgcactcgggtcgtcggatcgcgacgtcgt

SEQ ID NO: 93584 - DNA, 75 bp, Artificial Sequence
  Synthetic
gctctcctcgggcaggcctgatgggtttatacatgttcaggggcacttgcaggaggtggatgcgggcaacttcat

SEQ ID NO: 93585 - DNA, 75 bp, Artificial Sequence
  Synthetic
gtcggccagcctcgtgcggcacctgtgtgcgggactgttggcccgagaccgggtcattacggtacccattccatc

SEQ ID NO: 93586 - DNA, 75 bp, Artificial Sequence
  Synthetic
gattttgtatttgtcctgttatacctgatgaagctggcggaggcacggttggttccgctcatacttctcctgctg

SEQ ID NO: 93587 - DNA, 75 bp, Artificial Sequence
  Synthetic
gtcaacaggacaactcccttcgccatacgaggacccctgggcaaccagggccggggcaatccggtgcggtccccc

SEQ ID NO: 93588 - DNA, 75 bp, Artificial Sequence
  Synthetic
cgcggtggcgggggaggtgtttgcgggcccggccctgtcctggtgccttggcctacccttcgtgagtatgatact

SEQ ID NO: 93589 - DNA, 75 bp, Artificial Sequence
  Synthetic
aagcctccgactgggacgttcgggttcttccctggagtgcccccgctgaacaactgcatgctattggggacggaa

SEQ ID NO: 93590 - DNA, 75 bp, Artificial Sequence
  Synthetic
ttccggtggatggggccacaacgtctgatgttccttgtgttgtggaagctcgctcggggagctttcccgctggct

SEQ ID NO: 93591 - DNA, 75 bp, Artificial Sequence
  Synthetic
tcttccctggagtgcccccgctgaacaactgcatgctattggggacggaagtctctgaagcattgggcggagcgg

SEQ ID NO: 93592 - DNA, 75 bp, Artificial Sequence
  Synthetic
cgagttctgctttgatgtcacctttgaagtggacacgtccgttttgggatgggtggtggccagtgtcattgcttg

SEQ ID NO: 93593 - DNA, 75 bp, Artificial Sequence
  Synthetic
atgggtcggcgaaatccagtctgccccgggtttgcatggctatcctcgggcagacctgacgggtttatacatgtt

SEQ ID NO: 93594 - DNA, 75 bp, Artificial Sequence
  Synthetic
ccgggtttgcatggctatcctcgggcagacctgacgggtttatacatgttcaggggcacttgcaggaggtggatg

SEQ ID NO: 93595 - DNA, 75 bp, Artificial Sequence
  Synthetic
ggccatagcgctcctgagctctatgagcgcggggggctggaggcacaaagctgtgatctacaggatgtggtgtaa

SEQ ID NO: 93596 - DNA, 75 bp, Artificial Sequence
  Synthetic
agcgcggggggctggaggcacaaagctgtgatctacaggatgtggtgtaagggataccaggctttgcgccagcgg

SEQ ID NO: 93597 - DNA, 75 bp, Artificial Sequence
  Synthetic
gtcctgttatacctgatgaagctggcggaggcgaggttggtcccgctcatacttctcctgctctggtggtgggtg

SEQ ID NO: 93598 - DNA, 75 bp, Artificial Sequence
  Synthetic
agcttggtgcttggccccatacgtctggccagacgccgtgatgctggtggtagtggggatagtgctccttttcgg

SEQ ID NO: 93599 - DNA, 75 bp, Artificial Sequence
  Synthetic
cggctgttcacgccgctgtggctggggaggtgttcgcgggccctgctttgtcctggtgcctcggcctacccttcg

SEQ ID NO: 93600 - DNA, 75 bp, Artificial Sequence
  Synthetic
tctgttagatgcgttggactgggccttggaggagttgctggtttcgcggccctcgttgcggcgcttagcacgggt

SEQ ID NO: 93601 - DNA, 75 bp, Artificial Sequence
  Synthetic
ggcccacagcgcctaatgttccttgtgttgtggaagcttgctcggggagctttcccgctggccttactgatgggg

SEQ ID NO: 93602 - DNA, 75 bp, Artificial Sequence
  Synthetic
tctccaagatgtgcgctagaggggcctatttgtttgaccatatgggccctttttcgcgcgcggtcaaggagcgcc

SEQ ID NO: 93603 - DNA, 75 bp, Artificial Sequence
  Synthetic
tgtcgcatcatacgagacgccgccaggactctgagctgcggccagtgcgtcatggggttgcctgtggtagcgcgc

SEQ ID NO: 93604 - DNA, 75 bp, Artificial Sequence
  Synthetic
ggactctgagctgcggccagtgcgtcatggggttgcctgtggtagcgcgccgcggtgatgaagttctgattggcg

SEQ ID NO: 93605 - DNA, 75 bp, Artificial Sequence
  Synthetic
tggaggcacaaggctgtgatttacaggacgtggtgtaaagggtatcaggccctgcgtcaacgggtggtgcgcagc

SEQ ID NO: 93606 - DNA, 75 bp, Artificial Sequence
  Synthetic
ggcctcatacatctggcccgacgcggttatgctggtggtggtggggctggtgcttctctttggcctgttcgacgc

SEQ ID NO: 93607 - DNA, 75 bp, Artificial Sequence
  Synthetic
gcttccttggagtcacaaaggctgccttgacaggtcgggatcctgatctacatccaggtaacgtcatggttcttg

SEQ ID NO: 93608 - DNA, 75 bp, Artificial Sequence
  Synthetic
gttatgctggtggtggtggggctggtgcttctctttggcctgttcgacgcgttggactgggctttggaggagctg

SEQ ID NO: 93609 - DNA, 75 bp, Artificial Sequence
  Synthetic
accacgttccatggggcctcatcccgaaccatagcgacacctgtgggagcccttaatccaaggtggtggtcagcc

SEQ ID NO: 93610 - DNA, 75 bp, Artificial Sequence
  Synthetic
tgtgatggctggtgagcgggccactacagttcggctggtgtccaagatgtgcgctaggggagcctatttgtttga

SEQ ID NO: 93611 - DNA, 75 bp, Artificial Sequence
  Synthetic
acagttcggctggtgtccaagatgtgcgctaggggagcctatttgtttgaccatatgggttctttctcgcgcgca

SEQ ID NO: 93612 - DNA, 75 bp, Artificial Sequence
  Synthetic
tccccgatggagccaactcgttgacaccttgtacatgcccggccgagtcctgttgggtcattcgatccgacgggg

SEQ ID NO: 93613 - DNA, 75 bp, Artificial Sequence
  Synthetic
cacccggacggactgtcgcatcattagggatgccgccaggaccttgagctgcggccagtgcgtcatgggcttgcc

SEQ ID NO: 93614 - DNA, 75 bp, Artificial Sequence
  Synthetic
atggaggtttctgatttccgtgggtcatctgggtcgcctgtcctgtgcgacgaggggcacgcagtaggaatgctc

SEQ ID NO: 93615 - DNA, 75 bp, Artificial Sequence
  Synthetic
cgtggtagcgcgccgtggcgatgaggttctgatcggggtctttcaagatgtgcaccatttgcccccaggattcgt

SEQ ID NO: 93616 - DNA, 75 bp, Artificial Sequence
  Synthetic
gccgtggacccaagtaccaactgatgccaaaaccaccactgagcccccgccagttccagctaaaggtgtctttaa

SEQ ID NO: 93617 - DNA, 75 bp, Artificial Sequence
  Synthetic
gccaaaaccaccactgagcccccgccagttccagctaaaggtgtctttaaggaggctccattgttcatgcctacg

SEQ ID NO: 93618 - DNA, 75 bp, Artificial Sequence
  Synthetic
ggggcttcatcccgaaccatcgccacacccgtgggggcccttaatccgagatggtggtcggccagtgatgatgtc

SEQ ID NO: 93619 - DNA, 75 bp, Artificial Sequence
  Synthetic
gtcgctaccgtgcgggccatgggcccttacatggagaagctggctggcaaacatccaagtatctactgtgggcac

SEQ ID NO: 93620 - DNA, 75 bp, Artificial Sequence
  Synthetic
acagtgtaccccctgcccgatggagctaactcgttgaccccgtgcacatgccaggcggagtcctgttgggtcatc

SEQ ID NO: 93621 - DNA, 75 bp, Artificial Sequence
  Synthetic
ctacggtcggtttcttgccaaccctaggcagatgctgcggggcgtgtctgtggtcatctgtgatgagtgccacag

SEQ ID NO: 93622 - DNA, 75 bp, Artificial Sequence
  Synthetic
tggtcatctgtgatgagtgccacagtcatgactcaactgtgttgttggggatagggagggtccgggagctggctc

SEQ ID NO: 93623 - DNA, 75 bp, Artificial Sequence
  Synthetic
gacttccgtgggtcttctgggtcacctgtcttgtgtgacgaggggcacgcagtaggaatgctcgtgtccgttctc

SEQ ID NO: 93624 - DNA, 75 bp, Artificial Sequence
  Synthetic
tcgcccatgacccagcatccttccatcattgagaccaaattggacgtgggtgagatacccttttatgggcatggt

SEQ ID NO: 93625 - DNA, 75 bp, Artificial Sequence
  Synthetic
agtaccaactgatgccaagaccaccaccgagccacccccagttccagctaaaggtgtctttaaggaggccccact

SEQ ID NO: 93626 - DNA, 75 bp, Artificial Sequence
  Synthetic
accgagccacccccagttccagctaaaggtgtctttaaggaggccccactgttcatgcctacgggagcagggaag

SEQ ID NO: 93627 - DNA, 75 bp, Artificial Sequence
  Synthetic
tcattgagaccaaattggacgtgggtgagatacccttttatgggcatggtataccccttgagcggatgaggaccg

SEQ ID NO: 93628 - DNA, 75 bp, Artificial Sequence
  Synthetic
tttaaacccgtcagtcgctacagtacgggccatgggcccttacatggagcgattggcgggtaaacatccaagcat

SEQ ID NO: 93629 - DNA, 75 bp, Artificial Sequence
  Synthetic
cgggccatgggcccttacatggagcgattggcgggtaaacatccaagcatctactgtggacatgacaccacggcg

SEQ ID NO: 93630 - DNA, 75 bp, Artificial Sequence
  Synthetic
tctcgccaaccctaggcagatgttgcggggggtttctgtggtcatctgcgatgaatgccatagccatgactctac

SEQ ID NO: 93631 - DNA, 75 bp, Artificial Sequence
  Synthetic
cggggggtttctgtggtcatctgcgatgaatgccatagccatgactctactgtgttgctggggataggaagggta

SEQ ID NO: 93632 - DNA, 75 bp, Artificial Sequence
  Synthetic
gtcgcacggggaggggccggtccgggcggtactactatgcgggggtcggcaaggctcctgcaggggtggtgaggt

SEQ ID NO: 93633 - DNA, 75 bp, Artificial Sequence
  Synthetic
tactcctcccggatcccctatgacgcaacacccctcaatcattgagactaagttggatgtgggtgaaatcccctt

SEQ ID NO: 93634 - DNA, 75 bp, Artificial Sequence
  Synthetic
tattctgccactcaaaggcggagtgcgagcgcttggccggccaattctcggcgaggggggtcaatgccatcgcct

SEQ ID NO: 93635 - DNA, 75 bp, Artificial Sequence
  Synthetic
cgagcgcttggccggccaattctcggcgaggggggtcaatgccatcgcctattataggggtaaggacagttcaat

SEQ ID NO: 93636 - DNA, 75 bp, Artificial Sequence
  Synthetic
ggtacaccggtaactttgactctgtgactgactgtgggttggtggtggaggaggtcgtcgaggtgacccttgatc

SEQ ID NO: 93637 - DNA, 75 bp, Artificial Sequence
  Synthetic
gacccacaatgggcaggccttaagggcccaaatcctgtcccgttactgctgagatggggcaatgatttgccatca

SEQ ID NO: 93638 - DNA, 75 bp, Artificial Sequence
  Synthetic
agtgcccgcgtcggcagaattgtcgatgcagcggcgaggtcgcacggggagaggtcggtccgggcggtactacta

SEQ ID NO: 93639 - DNA, 75 bp, Artificial Sequence
  Synthetic
ggcagaaggttatgtccgctgcgatgcgggtcccatcctaatggtggggctcgctatcgcggggggcatgatcta

SEQ ID NO: 93640 - DNA, 75 bp, Artificial Sequence
  Synthetic
tcgctatcgcggggggcatgatctacgcgtcatacaccggctccatagtggtggtgacagattgggatgcgaagg

SEQ ID NO: 93641 - DNA, 75 bp, Artificial Sequence
  Synthetic
ttaggatgcatcccgatgttagctgggcaaaagttcgcggcgtcaactggcccctgctagtgggtgttcagcgga

SEQ ID NO: 93642 - DNA, 75 bp, Artificial Sequence
  Synthetic
cggcccatcggatgacccacaatgggcaggccttaagggcccaaatcctgtcccgctactgctgaggtggggcaa

SEQ ID NO: 93643 - DNA, 75 bp, Artificial Sequence
  Synthetic
cagccaccaccaagtggcttgctggctgctacacagggacgcgggccgttcctactgtatcaattgtggacaagc

SEQ ID NO: 93644 - DNA, 75 bp, Artificial Sequence
  Synthetic
catcacatagtggacgatctggtacgtcgactcggtgtggcagagggttacgtccgctgcgatgcggggcccatc

SEQ ID NO: 93645 - DNA, 75 bp, Artificial Sequence
  Synthetic
gctgcggcggtggcagcctacggggcttctcggagcccgccgttggcggctgctgcttcctacctcatgggattg

SEQ ID NO: 93646 - DNA, 75 bp, Artificial Sequence
  Synthetic
cttctcggagcccgccgttggcggctgctgcttcctacctcatgggattgggcgtcggaggcaacgcgcaggcgc

SEQ ID NO: 93647 - DNA, 75 bp, Artificial Sequence
  Synthetic
ccggtcgtgggtctaaccatggccggggcgttcatgggtggtgcgagcgtgtctccttccctcgtcaccgtcctt

SEQ ID NO: 93648 - DNA, 75 bp, Artificial Sequence
  Synthetic
gggcgttcatgggtggtgcgagcgtgtctccttccctcgtcaccgtccttttgggggcggttgggggctgggagg

SEQ ID NO: 93649 - DNA, 75 bp, Artificial Sequence
  Synthetic
tcaacaaaagacctgtggtatgccatcccggtactcactagtcctggggcgggccttgcggggatcgccctcggg

SEQ ID NO: 93650 - DNA, 75 bp, Artificial Sequence
  Synthetic
agtggctcgctggctgctacacggggacgcgggccgtccccactgtttcaattgtggacaagctcttcgcagggg

SEQ ID NO: 93651 - DNA, 75 bp, Artificial Sequence
  Synthetic
gacgcgggccgtccccactgtttcaattgtggacaagctcttcgcagggggttgggcggccgtggtgggccattg

SEQ ID NO: 93652 - DNA, 75 bp, Artificial Sequence
  Synthetic
tctgcttaccacactaccccggtcctcttgtatcccggacagctacttccaacaggccgactactgtgacaaggt

SEQ ID NO: 93653 - DNA, 75 bp, Artificial Sequence
  Synthetic
tcttgtatcccggacagctacttccaacaggccgactactgtgacaaggtctcagccatgctccgacgcttgagc

SEQ ID NO: 93654 - DNA, 75 bp, Artificial Sequence
  Synthetic
cgccgttggctgcggctgcctcatacctcatgggattgggcgtcggaggcaatgcacaagcacgcttggcttccg

SEQ ID NO: 93655 - DNA, 75 bp, Artificial Sequence
  Synthetic
ttcgcatggtcatggctagactccgggccctctgccctgtggtgtcgctacctttgtggcattgcggggaggggt

SEQ ID NO: 93656 - DNA, 75 bp, Artificial Sequence
  Synthetic
ctcactatggcgggggccttcatgggtggcgccagcgtgtccccttcgctggtcacggtccttcttggggccgtg

SEQ ID NO: 93657 - DNA, 75 bp, Artificial Sequence
  Synthetic
ggccctctgccctgtggtgtcgctacctttgtggcattgcggggaggggtggtctggagaatggttgttggacgg

SEQ ID NO: 93658 - DNA, 75 bp, Artificial Sequence
  Synthetic
gtggcgccagcgtgtccccttcgctggtcacggtccttcttggggccgtgggcggatgggagggcgtggttaacg

SEQ ID NO: 93659 - DNA, 75 bp, Artificial Sequence
  Synthetic
tgaatgggcaactcaaagaaccagtttactcaaccaagttgtgcaggcactattggatggggactgtgcccgtga

SEQ ID NO: 93660 - DNA, 75 bp, Artificial Sequence
  Synthetic
ctgtggtacgccatcccagtgctcactagtccaggggcgggccttgcggggatcgcccttgggctggtgttgtac

SEQ ID NO: 93661 - DNA, 75 bp, Artificial Sequence
  Synthetic
aaggtggtaccctttgggacgtcgggctgggcagaggtggtggtgacccctactcatgtcgtgatccggcgcacc

SEQ ID NO: 93662 - DNA, 75 bp, Artificial Sequence
  Synthetic
cagacgcctgagcctcacacgaaccgtggtagccctggtcaacagggagcctaaggtcgatgaggtccaggttgg

SEQ ID NO: 93663 - DNA, 75 bp, Artificial Sequence
  Synthetic
gccctattacgtcgacggcatcccggtatcgtgggaggcggacgcccgtgcgcccgccatggtttacggtcctgg

SEQ ID NO: 93664 - DNA, 75 bp, Artificial Sequence
  Synthetic
gtatcgtgggaggcggacgcccgtgcgcccgccatggtttacggtcctggccagagtgttaccattgacggggaa

SEQ ID NO: 93665 - DNA, 75 bp, Artificial Sequence
  Synthetic
cgtggtgtcacttcctttgtggcattgcggggaggggtggtcaggagaatggttgttggacggtcatgtggagag

SEQ ID NO: 93666 - DNA, 75 bp, Artificial Sequence
  Synthetic
tgcggggaggggtggtcaggagaatggttgttggacggtcatgtggagagccgctgtctgtgtgggtgtgtcatc

SEQ ID NO: 93667 - DNA, 75 bp, Artificial Sequence
  Synthetic
gctgtgccggcactactggatggggactgtcccggtcaacatgctgggttacggggaaacgtcccctctcctggc

SEQ ID NO: 93668 - DNA, 75 bp, Artificial Sequence
  Synthetic
actgtcccggtcaacatgctgggttacggggaaacgtcccctctcctggcctcagatactcccaaggtagtaccc

SEQ ID NO: 93669 - DNA, 75 bp, Artificial Sequence
  Synthetic
gcctgcacttatctcggttacggagagcagctcagatgagaagaccccgtcggtgtcttcctcgcaggaggatac

SEQ ID NO: 93670 - DNA, 75 bp, Artificial Sequence
  Synthetic
gatcaggcggacttcatgctataagttgttgcgccagcaaattctttcagctgctgttgctgagccctattatgt

SEQ ID NO: 93671 - DNA, 75 bp, Artificial Sequence
  Synthetic
cgacggcattccggtctcgtgggaggcagatgcgcgtgcacctgctatggtctacgggcctggccaaagcgtcac

SEQ ID NO: 93672 - DNA, 75 bp, Artificial Sequence
  Synthetic
tctttccgtactaaaagccttatttccacaaagtgatgccacccggaagctgactgttaaaatgtcgtgctgtgt

SEQ ID NO: 93673 - DNA, 75 bp, Artificial Sequence
  Synthetic
acttacctttgaatgtgacaagtgtgaggctaggcaagagaccttggcttccttctcctacatctggtctggcgt

SEQ ID NO: 93674 - DNA, 75 bp, Artificial Sequence
  Synthetic
caaggtgtacgtgaccaatccagacaatgtgggtcggagggtggacaaggtgactttctggcgagcccctcgggt

SEQ ID NO: 93675 - DNA, 75 bp, Artificial Sequence
  Synthetic
tcttcaacgtggctctttctgtactaaaagccttatttccacaaagtgatgccacacggaagctaaccgttaaga

SEQ ID NO: 93676 - DNA, 75 bp, Artificial Sequence
  Synthetic
cttgactgtgaaaaaggaggtgttcttcaaagaccgtaaggaggagaagcccccccgtctcattgtcttcccgcc

SEQ ID NO: 93677 - DNA, 75 bp, Artificial Sequence
  Synthetic
tggtgggcaatgaacttacctttgaatgtgacaagtgtgaggctaggcaagagaccctggcttccttctcctaca

SEQ ID NO: 93678 - DNA, 75 bp, Artificial Sequence
  Synthetic
atgtgacaagtgtgaggctaggcaagagaccctggcttccttctcctacatttggtctggggtaccattgacccg

SEQ ID NO: 93679 - DNA, 75 bp, Artificial Sequence
  Synthetic
tggcggacactaccaaggtgtacgtcaccaacccagacaatgtgggtaggagggttgacaaggtgaccttctggc

SEQ ID NO: 93680 - DNA, 75 bp, Artificial Sequence
  Synthetic
ttacgccttccagtacaccccaaatcagcgagatagggagatgctaaaactgtgggagtcaaagaagacaccatg

SEQ ID NO: 93681 - DNA, 75 bp, Artificial Sequence
  Synthetic
aggagggcagctcaagcctgcctaagcatgggttacacttatgaggaggcaataaggactgttaggccacatgct

SEQ ID NO: 93682 - DNA, 75 bp, Artificial Sequence
  Synthetic
acgtggcgttggagacagagctatacgttctggcttcggaccatcatggatgggtgcgagccatagataggaaat

SEQ ID NO: 93683 - DNA, 75 bp, Artificial Sequence
  Synthetic
cgttctggcttcggaccatcatggatgggtgcgagccatagataggaaatatgcctgtggaaccatggtcactcc

SEQ ID NO: 93684 - DNA, 75 bp, Artificial Sequence
  Synthetic
ccaccagcgcaagcagttgcctgacatgctacattaaggtgaaagccgcgtgtgagagggtgggcctcaagaacg

SEQ ID NO: 93685 - DNA, 75 bp, Artificial Sequence
  Synthetic
cggtcccctttactttgactgtgaaaaaggaggtgttcttcaaagaccgtaaggaggagaaggccccccgcctca

SEQ ID NO: 93686 - DNA, 75 bp, Artificial Sequence
  Synthetic
atgctacattaaggtgaaagccgcgtgtgagagggtgggcctcaagaacgtctcactcctcatcgccggcgatga

SEQ ID NO: 93687 - DNA, 75 bp, Artificial Sequence
  Synthetic
gagatgctcaaactgtgggaatcaaagaagaccccctgcgccatctgtgtggatgccacttgcttcgacagtagc

SEQ ID NO: 93688 - DNA, 75 bp, Artificial Sequence
  Synthetic
ggatgccacttgcttcgacagtagcattactgaagaggacgtggctttagagacagagctttacgctctagcctc

SEQ ID NO: 93689 - DNA, 75 bp, Artificial Sequence
  Synthetic
cccaatggcttcggccatcggttacattctcccttatccctggcatcccatcacacggtgggtcatcatcccgca

SEQ ID NO: 93690 - DNA, 75 bp, Artificial Sequence
  Synthetic
caatggtgactccggaaggggtgccagtgggcgagaggtattgtaggtcgtctggggttttgaccactagtgcga

SEQ ID NO: 93691 - DNA, 75 bp, Artificial Sequence
  Synthetic
gtaactgccttacttgctacattaaggtgaaagcagcgtgtgagcgagtgggacttaagaacgtctcgcttctca

SEQ ID NO: 93692 - DNA, 75 bp, Artificial Sequence
  Synthetic
aacatcatcgtggccctccacggaccagcagcgttgagggttaccgcagacacaactaaaaccaaaatggaagcc

SEQ ID NO: 93693 - DNA, 75 bp, Artificial Sequence
  Synthetic
gaaggccggagcattgcgaacgcgtatgctccggtcgcgcggttgggctgagctggcccggggcctgttgtggca

SEQ ID NO: 93694 - DNA, 75 bp, Artificial Sequence
  Synthetic
ggccattggttacatcctcctttacccctggcaccccatcacacggtgggtcatcatcccccatgtgcttacttg

SEQ ID NO: 93695 - DNA, 75 bp, Artificial Sequence
  Synthetic
ccctggcaccccatcacacggtgggtcatcatcccccatgtgcttacttgcgcattccggggtggcggcacaccg

SEQ ID NO: 93696 - DNA, 75 bp, Artificial Sequence
  Synthetic
gacgtgggggggttgatcccccccccccggcactgggtgcaagccccagaaaccgacgcctattttaaacagacg

SEQ ID NO: 93697 - DNA, 75 bp, Artificial Sequence
  Synthetic
ccggccaaaaggtggtggatgggtgatgccagggttggtaggtcgtaaatcccggtcatcttggtagccactata

SEQ ID NO: 93698 - DNA, 75 bp, Artificial Sequence
  Synthetic
gccccggccacgcacgcttgtggagcgaatgggcaatatttcctcacaaattgttgcgccttggaggacataggg

SEQ ID NO: 93699 - DNA, 75 bp, Artificial Sequence
  Synthetic
cgttgtggaggccggggccattctggccccggccacgcacgcttgtggagcgaatgggcaatatttcctcacaaa

SEQ ID NO: 93700 - DNA, 75 bp, Artificial Sequence
  Synthetic
tcggtgtctgcctatgtggcgggcatcttagggcttggagaggtctattccggggtgctcactgttggagtggcg

SEQ ID NO: 93701 - DNA, 75 bp, Artificial Sequence
  Synthetic
gctcgggagcttctacgggcccttgtcggtgtccgcctacgtggcgggcatcctagggctcggggaggtttattc

SEQ ID NO: 93702 - DNA, 75 bp, Artificial Sequence
  Synthetic
ccaattactggattttggaatacctctggaaggtgccttttgacttctggcgtggggtgatgagccttacccccc

SEQ ID NO: 93703 - DNA, 75 bp, Artificial Sequence
  Synthetic
tgagctgaagtgggaaagtgagttttggagatggactgagcagttggcctccaactactggattctggaatatct

SEQ ID NO: 93704 - DNA, 75 bp, Artificial Sequence
  Synthetic
gtctttctgttggtcaccatggcgggcatgtcgcaaggcgcgcctgcctcggtgttggggtcacgcccctttgag

SEQ ID NO: 93705 - DNA, 75 bp, Artificial Sequence
  Synthetic
cccggattgacttggcagtcctgttcttgcagggcgaacgggtcgcgcataccgacgggggagcgggtttgggac

SEQ ID NO: 93706 - DNA, 75 bp, Artificial Sequence
  Synthetic
gtctttctgttggtgaccatggcggggttgtcgcaaggcgctcccgcctcggtgttggggtcacgccccttcgaa

SEQ ID NO: 93707 - DNA, 75 bp, Artificial Sequence
  Synthetic
gctgcctgccgtttgccaagcaatcggctggggcgaccctatcacccattggagccacggacaaaatcagtggcc

SEQ ID NO: 93708 - DNA, 75 bp, Artificial Sequence
  Synthetic
gtggttgagctctccgagtgggggattccctgcgccacctgtattctggatcgtcggcctgcctcgtgcggcacc

SEQ ID NO: 93709 - DNA, 75 bp, Artificial Sequence
  Synthetic
cacgaaggggcgcgattcgaggatcgatgtgtggagtttggtaccagttggctcagccagctgtaccatagccgc

SEQ ID NO: 93710 - DNA, 75 bp, Artificial Sequence
  Synthetic
ttccttgcgctacctgcattctggaccgtcggcctgcctcgtgcggcacctgtgtgcgggactgctggcccgaaa

SEQ ID NO: 93711 - DNA, 75 bp, Artificial Sequence
  Synthetic
tagctgggaggcgaaatccggtttgtccgggattcgcatggttatcctcgggcataccagacgggtttatacatg

SEQ ID NO: 93712 - DNA, 75 bp, Artificial Sequence
  Synthetic
ggctgaggctaggctggtccccttgatccttctcctgctatggtggtgggttaaccacctggcggtccttggact

SEQ ID NO: 93713 - DNA, 75 bp, Artificial Sequence
  Synthetic
ctcagtgctcggagccgaattctgctttgatgtcaccttcgaagtggacacgtcggttttgggatgggtggtggc

SEQ ID NO: 93714 - DNA, 75 bp, Artificial Sequence
  Synthetic
tgtcctggtgtcttgggctacccttcgtgagtatgatcctaggcctcgcaaacctggtgttgtacttccgatgga

SEQ ID NO: 93715 - DNA, 75 bp, Artificial Sequence
  Synthetic
gaagccgttgactatcgcttggtgcttggcttcctacatctggccagacgctgtgatgttggtggtggtggggct

SEQ ID NO: 93716 - DNA, 75 bp, Artificial Sequence
  Synthetic
ctcctgagctccatgagcgcggggggctggaggcacaagggtctgattaacaggacgtggtgcaaggggtatcag

SEQ ID NO: 93717 - DNA, 75 bp, Artificial Sequence
  Synthetic
ttggcttcttacatctggccagacgctgtgatgttggtggtggtggggctggtgcttctttttggtctgttcgac

SEQ ID NO: 93718 - DNA, 75 bp, Artificial Sequence
  Synthetic
gcgcttggcgcgggtggtggaatgctgtgtgatggcgggtgagagagccacaaccatcaggctggtgtccaagat

SEQ ID NO: 93719 - DNA, 75 bp, Artificial Sequence
  Synthetic
cccgtggtaactcgccgtggtgatgaggttttgatcggcgtctttcaagatgtgaatcatctgcctccaggattt

SEQ ID NO: 93720 - DNA, 75 bp, Artificial Sequence
  Synthetic
gaccatatgggctctttctcgcgcgccgttaaggagcgcttgcttgagtgggtcgcggcgctggaacctctgtca

SEQ ID NO: 93721 - DNA, 75 bp, Artificial Sequence
  Synthetic
ccgttaaggagcgcttgcttgagtgggtcgcggcgctggaacctctgtcatgcactaggtcggactgtcgcatca

SEQ ID NO: 93722 - DNA, 75 bp, Artificial Sequence
  Synthetic
cccgtggtggctcgccgtggcgatgaggtcttgatcggcgtcttccaagatgtgattcatttgcccccaggattt

SEQ ID NO: 93723 - DNA, 75 bp, Artificial Sequence
  Synthetic
cacacccgtgggagccctaaatccaaggtggtggtctgccattgatgatgtcactgtgtaccctcttccggatgg

SEQ ID NO: 93724 - DNA, 75 bp, Artificial Sequence
  Synthetic
tcagatctgacggggcattatgccatggcttgagtaagggggacaaggtggaactggacgtggctatggaggtct

SEQ ID NO: 93725 - DNA, 75 bp, Artificial Sequence
  Synthetic
gcagtaggaatgctcgtgtctgtgctccattccgggggacgggtgacggcggcacaattcactcggccgtggacc

SEQ ID NO: 93726 - DNA, 75 bp, Artificial Sequence
  Synthetic
tgccaggccgagtcctgctgggtcatcagatccgacggggctttgtgccatggcttgtgtaagggggacaaggta

SEQ ID NO: 93727 - DNA, 75 bp, Artificial Sequence
  Synthetic
tgcgggccatgggcccgtacatggagcggttggcgggaaaacatcctagcatctactgtgggcacgacacaacag

SEQ ID NO: 93728 - DNA, 75 bp, Artificial Sequence
  Synthetic
taaaggagtgttcaaggaggccccgttgtttatgccgacgggagccggaaagagcacccgggtcccgttggagta

SEQ ID NO: 93729 - DNA, 75 bp, Artificial Sequence
  Synthetic
tttttggccaaccctagacagatgctaaggggggtctcggtggtcatatgtgatgagtgccacagtcatgactca

SEQ ID NO: 93730 - DNA, 75 bp, Artificial Sequence
  Synthetic
taaggggggtctcggtggtcatatgtgatgagtgccacagtcatgactcaacggtgttgctggggattggcaggg

SEQ ID NO: 93731 - DNA, 75 bp, Artificial Sequence
  Synthetic
gccactcccgctggctctcccatggtccagcacccttccatcattgagagaaaactggatgtgggtgagatcccc

SEQ ID NO: 93732 - DNA, 75 bp, Artificial Sequence
  Synthetic
tccagcacccttccatcattgagagaaaactggatgtgggtgagatccccttttatgggcatggcatacccctgg

SEQ ID NO: 93733 - DNA, 75 bp, Artificial Sequence
  Synthetic
taagggagctggcgcgtggttgtggggtccaactggtcctttatgccaccgccaccccccctggctctcccatgg

SEQ ID NO: 93734 - DNA, 75 bp, Artificial Sequence
  Synthetic
tgcgagcgcctggctggccagttctcctctaggggtgtaaatgctattgcctattatcgggggaaagacagctca

SEQ ID NO: 93735 - DNA, 75 bp, Artificial Sequence
  Synthetic
tgcgagcgcctggcgggccaattctcctctaggggtgtcaatgccattgcctattacaggggaaaggacagttca

SEQ ID NO: 93736 - DNA, 75 bp, Artificial Sequence
  Synthetic
cgatgcaacggcgaggtcgcacgggcagaggccggtccggtcgatactactacgcgggtgtcggcaaggcacctg

SEQ ID NO: 93737 - DNA, 75 bp, Artificial Sequence
  Synthetic
gggcaggtctgaaaggtccgaatcctgtcccgctactgctgaggtggggcaatgatttaccatcaagagtggccg

SEQ ID NO: 93738 - DNA, 75 bp, Artificial Sequence
  Synthetic
tatgtccgctgcgacgctggccccatcttgatggtgggtctggctatcgcggggggcatcatctatgcgtcttac

SEQ ID NO: 93739 - DNA, 75 bp, Artificial Sequence
  Synthetic
aatgatttgcgatcaaaagtggccggccaccacattgtagacgacctggtcagaagactcggagtggcggaaggt

SEQ ID NO: 93740 - DNA, 75 bp, Artificial Sequence
  Synthetic
gggggaatcctcaccatcagaggccaggacagtgactgatgcggtggcagccatccagctgaactgtgattggtc

SEQ ID NO: 93741 - DNA, 75 bp, Artificial Sequence
  Synthetic
tcccccgttggctgcagcggcttcctacctgatggggttgggcgtcggaggcaacgctcaggcgcgcttggcctc

SEQ ID NO: 93742 - DNA, 75 bp, Artificial Sequence
  Synthetic
caattgtggacaagctctttgccggagggtgggctgcggtcgtgggccactgtcacagtgttatagctgcggcgg

SEQ ID NO: 93743 - DNA, 75 bp, Artificial Sequence
  Synthetic
gtttgaccatggcgggggccttcatgggcggggctagcgtgtccccctcgctggtcacggtcctcttgggggccg

SEQ ID NO: 93744 - DNA, 75 bp, Artificial Sequence
  Synthetic
tacctgatgggattgggcgtcggaggcaacgcgcaggcgcgcttggcttccgcccttctattgggggctgccggt

SEQ ID NO: 93745 - DNA, 75 bp, Artificial Sequence
  Synthetic
cgcccttctattgggggctgccggtactgccctggggacccctgtcgttggtttgaccatggcgggggccttcat

SEQ ID NO: 93746 - DNA, 75 bp, Artificial Sequence
  Synthetic
aaccagtccgggggcgggcctcgcggggatcgctctaggattggtcttgtactcagccaacaactctggcactac

SEQ ID NO: 93747 - DNA, 75 bp, Artificial Sequence
  Synthetic
catttccagggtccgggccctctgccccgtcgtgtcactacctttgtggcattgcggggaggggtggtccggaga

SEQ ID NO: 93748 - DNA, 75 bp, Artificial Sequence
  Synthetic
cggacagttacttccaacaggccgactactgtgacaaagtctcagccatgctcaggcgcctgagcctcactcgga

SEQ ID NO: 93749 - DNA, 75 bp, Artificial Sequence
  Synthetic
gggtatgtctgggacctgtgggaatggatcatgcgccaagtgcgtatggtcatctccagggtccgggccctctgc

SEQ ID NO: 93750 - DNA, 75 bp, Artificial Sequence
  Synthetic
catctccagggtccgggccctctgccccgtagtgtcactccctctgtggcattgtggggaggggtggtccggaga

SEQ ID NO: 93751 - DNA, 75 bp, Artificial Sequence
  Synthetic
gcctcagacacgccgaaggtggtacccttcggcacgtcggggtgggcggaggtggtggtgacgccaacccacgtg

SEQ ID NO: 93752 - DNA, 75 bp, Artificial Sequence
  Synthetic
tcactggggatgtgttgaatgggcaactcaaagatccagtttactcaaccaagctgtgccggcactattggatgg

SEQ ID NO: 93753 - DNA, 75 bp, Artificial Sequence
  Synthetic
ttatggtgagacctcacccctgctagcctcggatacgccgaaggtggtacctttcggcacttccgggtgggcgga

SEQ ID NO: 93754 - DNA, 75 bp, Artificial Sequence
  Synthetic
gtggatggcatacctgtctcgtgggaagccgacgcgcgagcgccggcgatggtctacggtcctggccaaagtgtt

SEQ ID NO: 93755 - DNA, 75 bp, Artificial Sequence
  Synthetic
gaatgtgacaagtgtgaggcacggcaagagaccttggcctccttctcctacatctggtctggtgttccattgact

SEQ ID NO: 93756 - DNA, 75 bp, Artificial Sequence
  Synthetic
agtggcggataccaccaaggtatacgtgaccaatccagataatgtgggtaggagggtggacaaggtgaccttctg

SEQ ID NO: 93757 - DNA, 75 bp, Artificial Sequence
  Synthetic
cattgtgttcccccccctggacttccggatagctgaaaagcttattctgggagacccggggcgggtagccaaggc

SEQ ID NO: 93758 - DNA, 75 bp, Artificial Sequence
  Synthetic
cagtacaccccaaatcagcgcgttaaggagatgctgaggctgtgggagtcaaagaagaccccgtgcgccatctgt

SEQ ID NO: 93759 - DNA, 75 bp, Artificial Sequence
  Synthetic
caccatggttaccccccagggggtgcccgtgggcgagaggtactgtaggtcctcaggcgtacttaccaccagcgc

SEQ ID NO: 93760 - DNA, 75 bp, Artificial Sequence
  Synthetic
aaagaaaaccccgtgcgccatctgcgtggacgccacgtgcttcgacagtagtattactgaagaggatgtggccct

SEQ ID NO: 93761 - DNA, 75 bp, Artificial Sequence
  Synthetic
tgggactaaagaacgtgtcccttctgatcgcgggcgatgactgtctgatcatatgtgagcggcctatatgcgacc

SEQ ID NO: 93762 - DNA, 75 bp, Artificial Sequence
  Synthetic
atatgtgagcggcctatatgcgaccccagtgaggccttgggtagagccttggctatctatgggtacgcatgtgag

SEQ ID NO: 93763 - DNA, 75 bp, Artificial Sequence
  Synthetic
caccatggtcacccccgagggggtgcccgtgggcgagaggtattgtaggtcctcaggtgtactcaccactagcgc

SEQ ID NO: 93764 - DNA, 75 bp, Artificial Sequence
  Synthetic
cccgtgggcgagaggtattgtaggtcctcaggtgtactcaccactagcgcaagcaattgcttgacctgctacatc

SEQ ID NO: 93765 - DNA, 75 bp, Artificial Sequence
  Synthetic
gatcgctggcgatgactgtttgatcatatgtgagcggcctatgtgcgaccctagcgaggccttgggcagagccct

SEQ ID NO: 93766 - DNA, 75 bp, Artificial Sequence
  Synthetic
gagggttaccgcagacacaactaagacaaaaatggaagccggcaaggtgctgagcgacctcaagctcccgggctt

SEQ ID NO: 93767 - DNA, 75 bp, Artificial Sequence
  Synthetic
gcattgcgcacgcgcatgctccggtcgcgtggctgggcggaactagctcggggcctgttgtggcatccaggccta

SEQ ID NO: 93768 - DNA, 75 bp, Artificial Sequence
  Synthetic
ccccccggcactgggtgcaagccccagaaaccgacgcctactgaagtagacgtgatggccccgcgccgaaccggc

SEQ ID NO: 93769 - DNA, 75 bp, Artificial Sequence
  Synthetic
cgcgcggttgggcggagctagctcggggcctgttgtggcatccaggcctacggctccccccccctgagattgctg

SEQ ID NO: 93770 - DNA, 75 bp, Artificial Sequence
  Synthetic
gctaggcacgccgttaaaccgagcccgttatccccctgggcaaacgacgcccatgtacggtccacgtcgcccttc

SEQ ID NO: 93771 - DNA, 75 bp, Artificial Sequence
  Synthetic
ccagaaaccgacgcctatctaagcaggcgttatggcctcgcgccaaaccggcgaccggccaaaaggtggtggatg

SEQ ID NO: 93772 - DNA, 75 bp, Artificial Sequence
  Synthetic
tataggtgggtcttaaggggaggctacagtccctctaatgcccgtggcgagaacgcgcacggtccacaggtgttg

SEQ ID NO: 93773 - DNA, 75 bp, Artificial Sequence
  Synthetic
ctcgtggtggaggccggggccatcctggccccggccacccatgcttgtagcgcaaaggggcaatatttcctcaca

SEQ ID NO: 93774 - DNA, 75 bp, Artificial Sequence
  Synthetic
gcccacgtacggtctacgtcgcccttcaatgtctctcttgaccaataggcgtgagccggcgagttgacaaagacc

SEQ ID NO: 93775 - DNA, 75 bp, Artificial Sequence
  Synthetic
gaactcgggagcctttacggacccttgtcggtctcagcttacgtggctgggatccttgggctcggggaggtttac

SEQ ID NO: 93776 - DNA, 75 bp, Artificial Sequence
  Synthetic
ccgatcatggcagtccttctgctcttcctcgtggtggaggcgggggccatcttggcccccgccacccatgcttgt

SEQ ID NO: 93777 - DNA, 75 bp, Artificial Sequence
  Synthetic
caaactgttgcgccatggaggacatagggttctgcctcgaaggtggatgccttgtggctttagggtgcacaattt

SEQ ID NO: 93778 - DNA, 75 bp, Artificial Sequence
  Synthetic
ctccaattactggattctggaatacctctggaaggtgccttttgacttctggcgtggagtgatgagcctgacacc

SEQ ID NO: 93779 - DNA, 75 bp, Artificial Sequence
  Synthetic
ggcaagtccgcggctcagttggtgggggagctgggtggtctctacgggcccctgtcggtgtcagcctacgtggct

SEQ ID NO: 93780 - DNA, 75 bp, Artificial Sequence
  Synthetic
tggtggtcctcctggttaccatggccggcatgtcgcaaggcgcgccggccgtggagctaggttcccggcctttcg

SEQ ID NO: 93781 - DNA, 75 bp, Artificial Sequence
  Synthetic
cctgtcggtgtcagcctacgtggctggcatcctggggctcggtgaggtctactcaggcgtcctcacgatcggggt

SEQ ID NO: 93782 - DNA, 75 bp, Artificial Sequence
  Synthetic
ttcttgtaggtcaaatgggtctcgcgtgcccactggggagaaggtttgggaacgtgggaacgtctcactgttgtg

SEQ ID NO: 93783 - DNA, 75 bp, Artificial Sequence
  Synthetic
gttttggagatggactgagcaattggcctccaattactggatcctggaatatctctggaaggttccgtttgactt

SEQ ID NO: 93784 - DNA, 75 bp, Artificial Sequence
  Synthetic
ttctcctgcttgagcagagaattgtcatggtcttcctcctggttaccatggcggggatgtctcagggcgcccctg

SEQ ID NO: 93785 - DNA, 75 bp, Artificial Sequence
  Synthetic
acggtgccgtttcagtgacctgcgtgtggggttccgtgtcttggtttgcttccaccggcggtcgcgattccaaga

SEQ ID NO: 93786 - DNA, 75 bp, Artificial Sequence
  Synthetic
catggtcttcctcctggttaccatggcggggatgtctcagggcgcccctgcctcggtgctgggttcccggccgtt

SEQ ID NO: 93787 - DNA, 75 bp, Artificial Sequence
  Synthetic
gtggggttccgtgtcttggtttgcttccaccggcggtcgcgattccaagatcgatgtgtggagtttggttccagt

SEQ ID NO: 93788 - DNA, 75 bp, Artificial Sequence
  Synthetic
gcgtcgtcacgggggaacgggtttgggaccgagggaatgtcacactgttgtgtgattgccccaatgggccctggg

SEQ ID NO: 93789 - DNA, 75 bp, Artificial Sequence
  Synthetic
tggtggtggagctctccgaatggggagtcccctgcgccacatgcattctggacaggcggcctgtctcgtgcggta

SEQ ID NO: 93790 - DNA, 75 bp, Artificial Sequence
  Synthetic
ggaccgagggaatgtcacactgttgtgtgattgccccaatgggccctgggtatggctcccggccttttgccaagc

SEQ ID NO: 93791 - DNA, 75 bp, Artificial Sequence
  Synthetic
ggcccctttcttgcccacagtatgtctatggagctgtttcagtcacatgtgtttggggctccgcgtcttggtttg

SEQ ID NO: 93792 - DNA, 75 bp, Artificial Sequence
  Synthetic
ctatggagctgtttcagtcacatgtgtttggggctccgcgtcttggtttgcttccactgggggccgtgattccaa

SEQ ID NO: 93793 - DNA, 75 bp, Artificial Sequence
  Synthetic
ccgcactcggtacttcggatcgcgactcggtgccggagctatccgaatggggggtcccctgtgccacatgcatcc

SEQ ID NO: 93794 - DNA, 75 bp, Artificial Sequence
  Synthetic
atttggtgaaatgtcccaccccagccattgagcctcccaccggaacgtttggtttcttcccgggagtccctccgc

SEQ ID NO: 93795 - DNA, 75 bp, Artificial Sequence
  Synthetic
tggaccgtcggccgtcttcgtgcggcacttgtgtgcgggactgctggcccgaaaccgggtcggtgagattcccat

SEQ ID NO: 93796 - DNA, 75 bp, Artificial Sequence
  Synthetic
gctggcctcaccggggggttctacgaacctctggtgcggcggtgttcggagctgatgggtaggcgaaatcccgtc

SEQ ID NO: 93797 - DNA, 75 bp, Artificial Sequence
  Synthetic
cccttcgtcaacaggacaacccctttcaccattagagggcccctgggcaaccaggggagggggaacccggtgcgt

SEQ ID NO: 93798 - DNA, 75 bp, Artificial Sequence
  Synthetic
tgtccggggtttgcatggctctcctctggcaggccggacgggttcatacatgttcagggccacttacaggaggtg

SEQ ID NO: 93799 - DNA, 75 bp, Artificial Sequence
  Synthetic
tcaccattagagggcccctgggcaaccaggggagggggaacccggtgcgttcacccctgggttttggctcttaca

SEQ ID NO: 93800 - DNA, 75 bp, Artificial Sequence
  Synthetic
gggctggactcacgggggggttctatgagcccctagtgaggcggtgttcagagctgatgggacgccgaaatccgg

SEQ ID NO: 93801 - DNA, 75 bp, Artificial Sequence
  Synthetic
cgggggaggtgtttgcgggcccggccttgtcctggtgtctgggcctgcccttcgtgagcatgatactgggactag

SEQ ID NO: 93802 - DNA, 75 bp, Artificial Sequence
  Synthetic
tgagcccctagtgaggcggtgttcagagctgatgggacgccgaaatccggtttgcccggggtatgcatggctttc

SEQ ID NO: 93803 - DNA, 75 bp, Artificial Sequence
  Synthetic
tggatgcgggcaacttcataccgccccctcgttggctgctccttgacttcgtgtttgtcctcctgtacttgatga

SEQ ID NO: 93804 - DNA, 75 bp, Artificial Sequence
  Synthetic
ggggatttccgcctcccgcggacgcacctcggtgctcggagccgaattttgcttcgatgtcacgtttgaagtgga

SEQ ID NO: 93805 - DNA, 75 bp, Artificial Sequence
  Synthetic
ccctcgttggctgctccttgacttcgtgtttgtcctcctgtacttgatgaagctggcggaggcacggttggtccc

SEQ ID NO: 93806 - DNA, 75 bp, Artificial Sequence
  Synthetic
gcttcgatgtcacgtttgaagtggacacatcagttttaggatgggttgtggccagcgtggtggcatgggccatag

SEQ ID NO: 93807 - DNA, 75 bp, Artificial Sequence
  Synthetic
cgctcctgagctctatgagcgcgggggggtggaggcacaaagccatcatctacaggacgtggtgtaaagggtacc

SEQ ID NO: 93808 - DNA, 75 bp, Artificial Sequence
  Synthetic
gactgccttcagcccaagccgccgtggctggggaggtgttcgctggaccagccttgtcttggtgtctgggtctac

SEQ ID NO: 93809 - DNA, 75 bp, Artificial Sequence
  Synthetic
tacaggacgtggtgtaaagggtaccaggcggtgcgccagcgggtggttcggagccccctcggggaggggcgtcct

SEQ ID NO: 93810 - DNA, 75 bp, Artificial Sequence
  Synthetic
ggctggggaggtgttcgctggaccagccttgtcttggtgtctgggtctacccttcgtaagtatgatactaggact

SEQ ID NO: 93811 - DNA, 75 bp, Artificial Sequence
  Synthetic
tcctcgtgctgtggaagctcgcgcggggggcttttccgctggccttgttgatgggaatttcggcttctcgtggtc

SEQ ID NO: 93812 - DNA, 75 bp, Artificial Sequence
  Synthetic
cgctgtgatgttggtggtggtggccatggtcctcctgtttggtctcttcgacgcgctcgattgggccttagagga

SEQ ID NO: 93813 - DNA, 75 bp, Artificial Sequence
  Synthetic
atgggaatttcggcttctcgtggtcgcacctcagtgctcggggctgagttttgctttgatgtcaccttcgaagtg

SEQ ID NO: 93814 - DNA, 75 bp, Artificial Sequence
  Synthetic
atggtcctcctgtttggtctcttcgacgcgctcgattgggccttagaggagctcctagtgtcgcggccttcgttg

SEQ ID NO: 93815 - DNA, 75 bp, Artificial Sequence
  Synthetic
cactaccattcggctggtctccaagatgtgtgcgagaggtgcctacttgttcgaccatatgggttctttctcgcg

SEQ ID NO: 93816 - DNA, 75 bp, Artificial Sequence
  Synthetic
agcgctcctgagctctatgagcgcgggggggtggaggcacaaggctgtgatctacaggacgtggtgtaaagggta

SEQ ID NO: 93817 - DNA, 75 bp, Artificial Sequence
  Synthetic
atgtgtgcgagaggtgcctacttgttcgaccatatgggttctttctcgcgcgccgtcaaggagcgcttgcttgag

SEQ ID NO: 93818 - DNA, 75 bp, Artificial Sequence
  Synthetic
ggggggtggaggcacaaggctgtgatctacaggacgtggtgtaaagggtatcaggccatacgacagagggtggtg

SEQ ID NO: 93819 - DNA, 75 bp, Artificial Sequence
  Synthetic
gtgcttggcctcctacatctggccagatgcagtaatgttggtggtggtggcgctggttctcctttttggcctatt

SEQ ID NO: 93820 - DNA, 75 bp, Artificial Sequence
  Synthetic
catacgagatgctgccaggacactgagctgcggccaatgcgtcatggggttacccgtggtggctaggcgtggcga

SEQ ID NO: 93821 - DNA, 75 bp, Artificial Sequence
  Synthetic
tacccgtggtggctaggcgtggcgacgaggttctgataggcgttttccaagatgtgaaccatttgcctccggggt

SEQ ID NO: 93822 - DNA, 75 bp, Artificial Sequence
  Synthetic
gatgcagtaatgttggtggtggtggcgctggttctcctttttggcctattcgatgccctcgattgggccttggag

SEQ ID NO: 93823 - DNA, 75 bp, Artificial Sequence
  Synthetic
gtgttgtgtgatggcgggcgaaaaggcgactaccgtccggttggtgtccaagatgtgtgcgaggggggcctactt

SEQ ID NO: 93824 - DNA, 75 bp, Artificial Sequence
  Synthetic
gcgactaccgtccggttggtgtccaagatgtgtgcgaggggggcctacttgtttgaccacatggggtctttctcg

SEQ ID NO: 93825 - DNA, 75 bp, Artificial Sequence
  Synthetic
gtcattcactaggacggattgtcgcatcatacgggatgccgccaggaccttaagctgcggccagtgcgtcatggg

SEQ ID NO: 93826 - DNA, 75 bp, Artificial Sequence
  Synthetic
gcgactcctgtgggggccctaaacccaaggtggtggtcggccagtgatgacgtaacggtgtacccactcccggat

SEQ ID NO: 93827 - DNA, 75 bp, Artificial Sequence
  Synthetic
aggatgtgaaccacttgcctccggggttcgtacctactgcgcctgttgtcatccgtcggtgcggtaaggggttcc

SEQ ID NO: 93828 - DNA, 75 bp, Artificial Sequence
  Synthetic
catacgatccgacggggccctctgccatggactgtgcaagggggacaaggttgaactggatgtggccatggaggt

SEQ ID NO: 93829 - DNA, 75 bp, Artificial Sequence
  Synthetic
gttcgtacctactgcgcctgttgtcatccgtcggtgcggtaaggggttcctcggggtaacaaaggcagccttgac

SEQ ID NO: 93830 - DNA, 75 bp, Artificial Sequence
  Synthetic
ctacgtcgcgcagcatgggaacatgtctgaacggcttgttgttcaccacattccatggggcttcttcccgaacca

SEQ ID NO: 93831 - DNA, 75 bp, Artificial Sequence
  Synthetic
acgcagtaggaatgctcgtgtctgtgctccattctgggggtcgggtcaccgcagcccgattcactcggccgtgga

SEQ ID NO: 93832 - DNA, 75 bp, Artificial Sequence
  Synthetic
cccaaggtggtggtctgccagtgatgacgtcaccgtgtatcctctccctgacggggcgacttcgttgacgccttg

SEQ ID NO: 93833 - DNA, 75 bp, Artificial Sequence
  Synthetic
gctaaaggggttttcaaggaggctccacttttcatgccaacgggggcgggaaagagcacccgcgtcccccttgag

SEQ ID NO: 93834 - DNA, 75 bp, Artificial Sequence
  Synthetic
cacttttcatgccaacgggggcgggaaagagcacccgcgtcccccttgagtatgggaatatggggcacaaggtct

SEQ ID NO: 93835 - DNA, 75 bp, Artificial Sequence
  Synthetic
gccatggcttgagcaagggggacaaggttgaactggacgtggccatggaggtcgcagacttccgtgggtcgtctg

SEQ ID NO: 93836 - DNA, 75 bp, Artificial Sequence
  Synthetic
ggttgaactggacgtggccatggaggtcgcagacttccgtgggtcgtctgggtcgcctgtcttgtgcgacgaggg

SEQ ID NO: 93837 - DNA, 75 bp, Artificial Sequence
  Synthetic
gaacggctggctgggaaacatccaagcgtctactgtgggcatgatacaacagctttcactcggatcacggactct

SEQ ID NO: 93838 - DNA, 75 bp, Artificial Sequence
  Synthetic
gcgtctactgtgggcatgatacaacagctttcactcggatcacggactctccattgacgtattcgacctatggga

SEQ ID NO: 93839 - DNA, 75 bp, Artificial Sequence
  Synthetic
cggcggccagattcactcggccgtggacccaagtaccaactgatgctaaaaccactactgaacccccgccggtac

SEQ ID NO: 93840 - DNA, 75 bp, Artificial Sequence
  Synthetic
gacccaagtaccaactgatgctaaaaccactactgaacccccgccggtaccagctaaaggtgtctttaaggaggc

SEQ ID NO: 93841 - DNA, 75 bp, Artificial Sequence
  Synthetic
tgtgatgaatgccacagccatgaccccacggttctgttggggatcgggcgagtcagggagctggcgcgtggttgt

SEQ ID NO: 93842 - DNA, 75 bp, Artificial Sequence
  Synthetic
ccacggttctgttggggatcgggcgagtcagggagctggcgcgtggttgtggggtccaactggtactctacgcta

SEQ ID NO: 93843 - DNA, 75 bp, Artificial Sequence
  Synthetic
aatacggcaacatgggccataaagtcctcattctcaatccgtccgtggctacggtgcgtgcgatgggcccctata

SEQ ID NO: 93844 - DNA, 75 bp, Artificial Sequence
  Synthetic
cctcattctcaatccgtccgtggctacggtgcgtgcgatgggcccctatatggagcgcctcgccggaaaacatcc

SEQ ID NO: 93845 - DNA, 75 bp, Artificial Sequence
  Synthetic
accaagctggatgtgggtgagattcccttttatgggcatggtataccccttgagcggatgaggacgggtcggcac

SEQ ID NO: 93846 - DNA, 75 bp, Artificial Sequence
  Synthetic
ctccattgacgtactctacctatggtcggtttctagccaaccctaggcagatgctgaggggggtttccgtggtaa

SEQ ID NO: 93847 - DNA, 75 bp, Artificial Sequence
  Synthetic
ctccgctcgaggagtcaatgctgtagcctattataggggaaaagacacttcaatcatcaaagatggggacctcgt

SEQ ID NO: 93848 - DNA, 75 bp, Artificial Sequence
  Synthetic
tcggtttctagccaaccctaggcagatgctgaggggggtttccgtggtaatctgtgatgagtgccacagtcatga

SEQ ID NO: 93849 - DNA, 75 bp, Artificial Sequence
  Synthetic
gtggagtgcagttagtgctctacgccactgccacgcctccgggctcgcccatgactcagcacccttccatcattg

SEQ ID NO: 93850 - DNA, 75 bp, Artificial Sequence
  Synthetic
cactgccacgcctccgggctcgcccatgactcagcacccttccatcattgagacaaaactggatgtgggagagat

SEQ ID NO: 93851 - DNA, 75 bp, Artificial Sequence
  Synthetic
ggaccgtgccggcgtcggctgaattgtcgatgcagcgccgaggacgcacaggtagaggcagatcgggccggtact

SEQ ID NO: 93852 - DNA, 75 bp, Artificial Sequence
  Synthetic
acttggtattctgccactccaaggcggagtgtgagcgcttggccgggcaattctcagccaggggggtcaacgcca

SEQ ID NO: 93853 - DNA, 75 bp, Artificial Sequence
  Synthetic
tcgcctattatcgggggaaggacagttcgatcattaaggatggggacctcgtggtttgcgcgacagacgcgctct

SEQ ID NO: 93854 - DNA, 75 bp, Artificial Sequence
  Synthetic
ccacggggtacacaggcaactttgactcggtcaccgattgtggtttggtggtggaggaggtcgtcgaggtgaccc

SEQ ID NO: 93855 - DNA, 75 bp, Artificial Sequence
  Synthetic
ttgtctatgcagaggagaggacgcacgggcaggggccggtccgggcgctactattacgccggcgtgggcaaagcg

SEQ ID NO: 93856 - DNA, 75 bp, Artificial Sequence
  Synthetic
gcgggcggcatgatctacgcctcatacactgggtcactagtggtggtaacagactgggatgtgaagggaggtggc

SEQ ID NO: 93857 - DNA, 75 bp, Artificial Sequence
  Synthetic
agcggacgatgtgccgggaaacactgtcgcccggcccgtcggacgacccccaatgggcaggtctgaagggcccaa

SEQ ID NO: 93858 - DNA, 75 bp, Artificial Sequence
  Synthetic
ggtgcccccggtagaccaccggccgggggctgaatctgcgcctgcggatgccaagacagtgacagatgcggtggc

SEQ ID NO: 93859 - DNA, 75 bp, Artificial Sequence
  Synthetic
gccggccaccacattgtagatgacctggtcaggcggctcggtgtggcggagggttatgtccgctgcgacgcggga

SEQ ID NO: 93860 - DNA, 75 bp, Artificial Sequence
  Synthetic
gggttatgtccgctgcgacgcgggacccatcttgatggtgggactcgctatcgcgggggggatgatctacgcctc

SEQ ID NO: 93861 - DNA, 75 bp, Artificial Sequence
  Synthetic
tcgcgggggggatgatctacgcctcctacaccggatcccttgtggtggtaacagattgggatgtgaaggggggcg

SEQ ID NO: 93862 - DNA, 75 bp, Artificial Sequence
  Synthetic
cagggacgcgggccgtcccgactgtatccattgttgacaagctcttcgccgggggttgggccgcggtggttggtc

SEQ ID NO: 93863 - DNA, 75 bp, Artificial Sequence
  Synthetic
actgtcacagcgtgatagctgcggcggtggccgcgtacggggcttctcggagccctccactggccgccgcggcct

SEQ ID NO: 93864 - DNA, 75 bp, Artificial Sequence
  Synthetic
tccgccctcctgttgggagcagctggtaccgccctgggcactccggtcgtgggtctcaccatggccggggcgttc

SEQ ID NO: 93865 - DNA, 75 bp, Artificial Sequence
  Synthetic
ggtcggtgatgaccctgtcgatcggggaagtcctgaccttggctcaggctaagacagccgaggcctacgcagcga

SEQ ID NO: 93866 - DNA, 75 bp, Artificial Sequence
  Synthetic
ggtgggcggctgggagggcgtggtcaatgctgccagccttgtcttcgacttcatgtcagggaaactttcaactga

SEQ ID NO: 93867 - DNA, 75 bp, Artificial Sequence
  Synthetic
ccggagggtgggcggcagtggtgggtcactgccacagcgtcatagctgcggcggtggctgcctacggggcttctc

SEQ ID NO: 93868 - DNA, 75 bp, Artificial Sequence
  Synthetic
ctcactagtcctggggcgggccttgcggggatcgccctgggcctggtgttgtactcagcaaacaactcaggcaca

SEQ ID NO: 93869 - DNA, 75 bp, Artificial Sequence
  Synthetic
ggaggcaacgctcaggcgcgtctggcctcagccctcctgttgggggctgctggtaccgccctggggaccccggtc

SEQ ID NO: 93870 - DNA, 75 bp, Artificial Sequence
  Synthetic
cctcagccctcctgttgggggctgctggtaccgccctggggaccccggtcgtgggattgaccatggctggggcct

SEQ ID NO: 93871 - DNA, 75 bp, Artificial Sequence
  Synthetic
gagcccaaggtggatgaggtgcaggtggggtacgtgtgggacctttgggaatggatcatgcgccaggtgcggatg

SEQ ID NO: 93872 - DNA, 75 bp, Artificial Sequence
  Synthetic
tggggtacgtgtgggacctttgggaatggatcatgcgccaggtgcggatggtggtgtcaagactccgggccctct

SEQ ID NO: 93873 - DNA, 75 bp, Artificial Sequence
  Synthetic
gccgtggcgggttgggagggggtggtcaacgctgccagccttgtctttgacttcatggcggggaaactctccact

SEQ ID NO: 93874 - DNA, 75 bp, Artificial Sequence
  Synthetic
cttcatggcggggaaactctccactgaggacctgtggtatgccatcccggtgctcacgagtcccggggcgggcct

SEQ ID NO: 93875 - DNA, 75 bp, Artificial Sequence
  Synthetic
ctaccacttggttgaaccgtctgctgactacgttaccccggtcttcttgcatcccggacagctatttccaacagg

SEQ ID NO: 93876 - DNA, 75 bp, Artificial Sequence
  Synthetic
ccaagctgtgcaggcattactggatggggactgtgcccgtcaacatgttgggttacggcgagacctcccctctcc

SEQ ID NO: 93877 - DNA, 75 bp, Artificial Sequence
  Synthetic
aggactgtggtggccctggtcaacagggaacctaaggtggatgaggttcaggtcggatatgtctgggacttgtgg

SEQ ID NO: 93878 - DNA, 75 bp, Artificial Sequence
  Synthetic
gggaacctaaggtggatgaggttcaggtcggatatgtctgggacttgtgggagtgggtcatgcgtcaaatacgca

SEQ ID NO: 93879 - DNA, 75 bp, Artificial Sequence
  Synthetic
gaggtggtggtcacgcccacccacgtggtgattaggcgcacttcctgttacaaattgcttcgccagcaaatccta

SEQ ID NO: 93880 - DNA, 75 bp, Artificial Sequence
  Synthetic
tggtgattaggcgcacttcctgttacaaattgcttcgccagcaaatcctatcagctgctgtagctgagccctact

SEQ ID NO: 93881 - DNA, 75 bp, Artificial Sequence
  Synthetic
tggcattgcggggaggggtggtctggagaatggctgttggatggtcatgtggagagccgctgtctgtgcgggtgc

SEQ ID NO: 93882 - DNA, 75 bp, Artificial Sequence
  Synthetic
taccaaattgtgccgacactattggatgggtactgtgccggttaacatgctgggttacggggaaacttcgcccct

SEQ ID NO: 93883 - DNA, 75 bp, Artificial Sequence
  Synthetic
ctgaggtcagcatcgagattgggacggagactgaagactcagaactgactgaggccgatttgccaccggcggctg

SEQ ID NO: 93884 - DNA, 75 bp, Artificial Sequence
  Synthetic
tgggacgccgacgcgcgtgccccggccatggtctacggtcctggccaaagcgttaccattgatggggagaggtac

SEQ ID NO: 93885 - DNA, 75 bp, Artificial Sequence
  Synthetic
gtctgatccagctgaaggagaggataacgtcttcaacgtggctctttctgtactaaaagccttattcccacagag

SEQ ID NO: 93886 - DNA, 75 bp, Artificial Sequence
  Synthetic
tgcttagtgggcaatgaacttacctttgaatgtgacaaatgtgaagctcgccaagagaccttggcttctttctcc

SEQ ID NO: 93887 - DNA, 75 bp, Artificial Sequence
  Synthetic
acaacgtcttcaacgtggctctttccgtattaaaagccttgtttccacagagcgacgccactaggaaactgactg

SEQ ID NO: 93888 - DNA, 75 bp, Artificial Sequence
  Synthetic
agtggtgaggccggtgggttccctgttggtggccgacacaaccaaggtctacgtgaccaatccagacaatgtggg

SEQ ID NO: 93889 - DNA, 75 bp, Artificial Sequence
  Synthetic
acgtgaccaatccagacaatgtggggaggagagttgacaaggtgaccttctggcgcgcccctcgggtgcacgata

SEQ ID NO: 93890 - DNA, 75 bp, Artificial Sequence
  Synthetic
cgtattaaaagccttgtttccacagagcgacgccactaggaaactgactgtgaagatgtcgtgctgcgtggagaa

SEQ ID NO: 93891 - DNA, 75 bp, Artificial Sequence
  Synthetic
ggtgcttagtgggcaatgaacttacctttgaatgtgacaagtgtgaggccaggcaagagacgttggcttccttct

SEQ ID NO: 93892 - DNA, 75 bp, Artificial Sequence
  Synthetic
ccagtggtgaggccggtggggtccctgttagtggctgacactaccaaagtgtatgtcaccaatccagataacgtg

SEQ ID NO: 93893 - DNA, 75 bp, Artificial Sequence
  Synthetic
tgttagtggctgacactaccaaagtgtatgtcaccaatccagataacgtggggaggcgagtcgacaaggtgactt

SEQ ID NO: 93894 - DNA, 75 bp, Artificial Sequence
  Synthetic
tccggatagctgaaaagctcatcttgggagaccctgggcgggttgccaaggcggtgctggggggggcttacgcct

SEQ ID NO: 93895 - DNA, 75 bp, Artificial Sequence
  Synthetic
tagggagatgcttaagctgtgggagtcaaagaaaacaccgtgcgccatctgcgtggacgccacttgcttcgacag

SEQ ID NO: 93896 - DNA, 75 bp, Artificial Sequence
  Synthetic
cttcagaccacccagagtgggtgcgcgccctagggaagtactatgcctctggcacaatggttaccccggaagggg

SEQ ID NO: 93897 - DNA, 75 bp, Artificial Sequence
  Synthetic
cgccctagggaagtactatgcctctggcacaatggttaccccggaaggggtgccagtgggcgagaggtattgtag

SEQ ID NO: 93898 - DNA, 75 bp, Artificial Sequence
  Synthetic
cttccggatagctgaaaagctcatcctgggagacccggggcgggtggctaaggcggtgttggggggggcttacgc

SEQ ID NO: 93899 - DNA, 75 bp, Artificial Sequence
  Synthetic
ttaaggtgaaagccgcctgcgagagagtgggtctgaaaaatgtctcactattgatcgcgggcgatgactgtctga

SEQ ID NO: 93900 - DNA, 75 bp, Artificial Sequence
  Synthetic
agtcaaagaagaccccttgcgccatctgtgtggatgccacgtgcttcgacagtagcattactgaagaggacgtgg

SEQ ID NO: 93901 - DNA, 75 bp, Artificial Sequence
  Synthetic
agtagcattactgaagaggacgtggctttggagacggagctgtatgctctggcctcagaccatccagaatgggtg

SEQ ID NO: 93902 - DNA, 75 bp, Artificial Sequence
  Synthetic
cgtccccgtgggagagaggtactgtagatcctcgggagtcttgacaaccagtgcgagtaactgcttgacttgcta

SEQ ID NO: 93903 - DNA, 75 bp, Artificial Sequence
  Synthetic
agggtggggctgaaaaatgtctcactactcatagcgggcgatgactgtctgatcatatgtgaacggccgatgtgc

SEQ ID NO: 93904 - DNA, 75 bp, Artificial Sequence
  Synthetic
gttcatggcaattactacaagtttcctctggacaaactgcctaacatcatcgtggccctccacggaccagcagcg

SEQ ID NO: 93905 - DNA, 75 bp, Artificial Sequence
  Synthetic
tgtcgagcgagtacagtgaccctatggcgtcagccattggttacatcctcctctacccctggcatcccatcacac

SEQ ID NO: 93906 - DNA, 75 bp, Artificial Sequence
  Synthetic
tcctctggacaaactgcccaacataatcgtggccctccacggtccagcagcgctgagggtcaccgcagacacaac

SEQ ID NO: 93907 - DNA, 75 bp, Artificial Sequence
  Synthetic
gcttagccgtccaccgcaagaaagcgggggcattgcgcacgcgcatgctccggtctcgcggttgggcggagttgg

SEQ ID NO: 93908 - DNA, 75 bp, Artificial Sequence
  Synthetic
gtgcaagccccacaaaccgacgcctatttaaatagacgttaagaaccggcgcctgcccggcgaccggccaaaagt

SEQ ID NO: 93909 - DNA, 75 bp, Artificial Sequence
  Synthetic
gggggcattgcgcacgcgcatgctccggtctcgcggttgggcggagttggctaggggcctgttgtggcatccagg

SEQ ID NO: 93910 - DNA, 75 bp, Artificial Sequence
  Synthetic
tggtggatgggtgatgccagggttggtaggtcgtaaatcccggtcatcttggtaaccactataggtgggtcttaa

SEQ ID NO: 93911 - DNA, 75 bp, Artificial Sequence
  Synthetic
cctgggcaaacgacgcccacgtacggtccacgtcgcccttcaatgtctctcttgaccaataggctttgccggcga

SEQ ID NO: 93912 - DNA, 75 bp, Artificial Sequence
  Synthetic
ctcctgctcttcttggttgtggaagccggggccatactggcccgcaaccacaatgcttgcagagcgaaggagcaa

SEQ ID NO: 93913 - DNA, 75 bp, Artificial Sequence
  Synthetic
cagttggtgggggaactcgggagcttctatgggcccctttcggtgtccgcttacgtggcgggcatcttgaggctc

SEQ ID NO: 93914 - DNA, 75 bp, Artificial Sequence
  Synthetic
gaggccggggccatcttggccccggccacccatgcttgtggagctaatgggcaatacttcctcacaaattgttgc

SEQ ID NO: 93915 - DNA, 75 bp, Artificial Sequence
  Synthetic
cgggtgcactatttgtactgaccgatgctggccactgtatcaggcgggattggctgtgcgacccggcaagtccgc

SEQ ID NO: 93916 - DNA, 75 bp, Artificial Sequence
  Synthetic
cggcctacgtggccgggatactggggctcggggaggtttactccggcgtcctcacggtgggtgttgcgttgacgc

SEQ ID NO: 93917 - DNA, 75 bp, Artificial Sequence
  Synthetic
agcggattgtcatggtcttccttctcgtgacgatggcggggatgtcgcaaggcgcccccgcctccgtcttgggct

SEQ ID NO: 93918 - DNA, 75 bp, Artificial Sequence
  Synthetic
aatggttcgcgcatacccacgggggagcgggtttgggatcgagggaacgtcacactcctgtgtgactgccccaac

SEQ ID NO: 93919 - DNA, 75 bp, Artificial Sequence
  Synthetic
tgatgagcctgacccctctgttggtgtgcgtggcggccctcctcctgctggagcaacggatagtcatggtcttcc

SEQ ID NO: 93920 - DNA, 75 bp, Artificial Sequence
  Synthetic
tttgccaagcaattggttggggcgaccctatcactcattggagccacggacaaaatcagtggcccctctcatgtc

SEQ ID NO: 93921 - DNA, 75 bp, Artificial Sequence
  Synthetic
caaaatcagtggcccctctcatgtccccagtatgtctacggtgctgtttcagtgacctgcgtttggggttccgtg

SEQ ID NO: 93922 - DNA, 75 bp, Artificial Sequence
  Synthetic
gggtcccgcccttttgaggcggggttgacgtgggattcgtgctcctgcaggtcgaacggctcgcgtgtgcctacg

SEQ ID NO: 93923 - DNA, 75 bp, Artificial Sequence
  Synthetic
tcttggtttgcctccactggcggccgcgattcgatgatcgatgtgtggagtttggtgcctgttggctctgccagc

SEQ ID NO: 93924 - DNA, 75 bp, Artificial Sequence
  Synthetic
gtcgaacggctcgcgtgtgcctacgggggagaaggtttggaaccgtgggaatgtcacacttctgtgtgattgccc

SEQ ID NO: 93925 - DNA, 75 bp, Artificial Sequence
  Synthetic
ctccgagtgggggataccatgcgctacttgcatcctggatctccggccgcctccttgcggcacctgtgttaagga

SEQ ID NO: 93926 - DNA, 75 bp, Artificial Sequence
  Synthetic
aggttcccgttccatcggtgcggagcggggccgcggctgacaaaggatttagaaattgtgccctttgtcaacagg

SEQ ID NO: 93927 - DNA, 75 bp, Artificial Sequence
  Synthetic
gggcgcgattccaagctcgatgtgtggagtttggtgccgactggttccgctagttgcaccatagccgccctcggg

SEQ ID NO: 93928 - DNA, 75 bp, Artificial Sequence
  Synthetic
cgctacctgcattctggaccgtcggccggcctcgtgtggcacctgtgtgcgggactgctggcccgagacagggtc

SEQ ID NO: 93929 - DNA, 75 bp, Artificial Sequence
  Synthetic
ccggcctcgtgtggcacctgtgtgcgggactgctggcccgagacagggtcggtcagattcccattccatcggtgc

SEQ ID NO: 93930 - DNA, 75 bp, Artificial Sequence
  Synthetic
ggactcccccgctcaataactgcatgctcctgggcacggaagtgtccgaggtgctgggcggagcggggctcacgg

SEQ ID NO: 93931 - DNA, 75 bp, Artificial Sequence
  Synthetic
gctcctgggcacggaagtgtccgaggtgctgggcggagcggggctcacgggggggttctacgagcccctggtgcg

SEQ ID NO: 93932 - DNA, 75 bp, Artificial Sequence
  Synthetic
gcaatccggtgcggtcccccctgggttttgggtcctacaccatgaccaagatccgggactcgttacatctggtga

SEQ ID NO: 93933 - DNA, 75 bp, Artificial Sequence
  Synthetic
tgggttcatacatgttcagggtcacctgcaggaggtggatgcgggcaacttcattccgccccctcgctggttgct

SEQ ID NO: 93934 - DNA, 75 bp, Artificial Sequence
  Synthetic
gcatgcttttgggcactgaggtgtccgaggcactagggggagcgggcctcacgggggggttctacgagcctctgg

SEQ ID NO: 93935 - DNA, 75 bp, Artificial Sequence
  Synthetic
tatctgatgaagctggctgaggctaggctggtcccgttgatccttctcttgctgtggtggtgggtgaatcagctg

SEQ ID NO: 93936 - DNA, 75 bp, Artificial Sequence
  Synthetic
gtggtcctagggttaccagctgcgcacgcggccgtggcgggggaggtttttgcgggtcctgccttatcttggtgt

SEQ ID NO: 93937 - DNA, 75 bp, Artificial Sequence
  Synthetic
gcgcacgctgctgtggcgggggaggtgtttgctggcccagccttgtcgtggtgcctgggtttgcccttcgttagt

SEQ ID NO: 93938 - DNA, 75 bp, Artificial Sequence
  Synthetic
gtaagggataccaggcgctgcgccagagggtggtgcggagccccctcggagaggggcggcccaccaagccgctga

SEQ ID NO: 93939 - DNA, 75 bp, Artificial Sequence
  Synthetic
gtggtggtaggcctggtgcttctcttcggcctgttcgacgcgttggactgggccctggaggagttgctggtctcc

SEQ ID NO: 93940 - DNA, 75 bp, Artificial Sequence
  Synthetic
gggtgagaaagccactaccgtcaggctggtgtccaagatgtgtgcgcgtggggcctatttgttcgaccacatggg

SEQ ID NO: 93941 - DNA, 75 bp, Artificial Sequence
  Synthetic
tggtgtaaggggtaccaggcgttgcgtcaacgggtggtgcggagccccctcggggagggacggccgaccaaaccc

SEQ ID NO: 93942 - DNA, 75 bp, Artificial Sequence
  Synthetic
ctggtgtccaagatgtgtgcgcgtggggcctatttgttcgaccacatgggctctttctcgcgtgcagtcaaggag

SEQ ID NO: 93943 - DNA, 75 bp, Artificial Sequence
  Synthetic
ggactgtcgcatcatcagagatgccgctcgaaccttgtcctgtggtcagtgcgtcatgggcttgcccgtggtggc

SEQ ID NO: 93944 - DNA, 75 bp, Artificial Sequence
  Synthetic
ctctttggcctgttcgacgcgttggactgggccttggaggagctactagtctcacggccttcgttgcggcgcttg

SEQ ID NO: 93945 - DNA, 75 bp, Artificial Sequence
  Synthetic
gctcgaaccttgtcctgtggtcagtgcgtcatgggcttgcccgtggtggctcgccgtggtgatgaggttttgatc

SEQ ID NO: 93946 - DNA, 75 bp, Artificial Sequence
  Synthetic
gcggctggtatccaagatgtgtgcgaggggggcctatttgtttgaccatatgggctctttttcgcgcgcagtcaa

SEQ ID NO: 93947 - DNA, 75 bp, Artificial Sequence
  Synthetic
gcctgttgtcatccgtcggtgcggtaagggcttcctcggcgtcactaaggctgccttgactggtcgggatcctga

SEQ ID NO: 93948 - DNA, 75 bp, Artificial Sequence
  Synthetic
aagggcttcctcggcgtcactaaggctgccttgactggtcgggatcctgacttacatccagggaacgtcatggtg

SEQ ID NO: 93949 - DNA, 75 bp, Artificial Sequence
  Synthetic
gctttggaacctttgtcattcaccaggacggactgtcgcatcattagagatgctgccaggaccctgagctgcggc

SEQ ID NO: 93950 - DNA, 75 bp, Artificial Sequence
  Synthetic
gttcacgaccttccatggggcttcatcccgaaccatcgccacacctgtgggagccctaaacccaaggtggtggtc

SEQ ID NO: 93951 - DNA, 75 bp, Artificial Sequence
  Synthetic
cccctctcggatggagcaaactcgttgaccccgtgcacatgccaggctgagtcctgttgggtcattcgatctgac

SEQ ID NO: 93952 - DNA, 75 bp, Artificial Sequence
  Synthetic
ggctatggaggtctctgacttccgtggttcgtccggttcgcctgtcctgtgcgacgaggggcacgcagtaggaat

SEQ ID NO: 93953 - DNA, 75 bp, Artificial Sequence
  Synthetic
tgttgtttaccacgttccatggggcctcttcccgaaccatagccacacccgtgggagccctaaatcctaggtggt

SEQ ID NO: 93954 - DNA, 75 bp, Artificial Sequence
  Synthetic
ctcttcccgaaccatagccacacccgtgggagccctaaatcctaggtggtggtcggccagtgatgatgtaacggt

SEQ ID NO: 93955 - DNA, 75 bp, Artificial Sequence
  Synthetic
ctaggccgtggacccaagtcccaacagacgccaaaaccaccacagagcccccaccggttccggcaaaaggagtgt

SEQ ID NO: 93956 - DNA, 75 bp, Artificial Sequence
  Synthetic
ctgagtcatgttgggtcattcgatctgatggggctctttgccatggcctgtgtaagggggacaaggttgaactgg

SEQ ID NO: 93957 - DNA, 75 bp, Artificial Sequence
  Synthetic
tgatggggctctttgccatggcctgtgtaagggggacaaggttgaactggacgtggccatggaggtctctgactt

SEQ ID NO: 93958 - DNA, 75 bp, Artificial Sequence
  Synthetic
gtcccgttggaatatggcaacatgggtcataaagtcctcattctcaacccgtcagtggccacggtacgggccatg

SEQ ID NO: 93959 - DNA, 75 bp, Artificial Sequence
  Synthetic
gtcataaagtcctcattctcaacccgtcagtggccacggtacgggccatgggcccttacatggaacgcttggcgg

SEQ ID NO: 93960 - DNA, 75 bp, Artificial Sequence
  Synthetic
gaatgctcgtgtcggtgctccactctggaggcagagtcaccgcggcaagattcactcggccgtggacccaagttc

SEQ ID NO: 93961 - DNA, 75 bp, Artificial Sequence
  Synthetic
tggaggcagagtcaccgcggcaagattcactcggccgtggacccaagttccaacggacgccaaaaccactaccga

SEQ ID NO: 93962 - DNA, 75 bp, Artificial Sequence
  Synthetic
gtcacggactccccattgacgtactctacctacggtcggttcttagccaaccctaggcagatgctgaggggcgta

SEQ ID NO: 93963 - DNA, 75 bp, Artificial Sequence
  Synthetic
ctacctacggtcggttcttagccaaccctaggcagatgctgaggggcgtatcagtggtcatttgtgatgagtgcc

SEQ ID NO: 93964 - DNA, 75 bp, Artificial Sequence
  Synthetic
ccgggtcccgttggagtacggcaacatggggcacaaggttctgattctcaacccgtcagttgcgacagtgcgggc

SEQ ID NO: 93965 - DNA, 75 bp, Artificial Sequence
  Synthetic
gcacttggctgtggggtccaactggtcctctacgccactgccactcctcctggttctccaatggtccagcatcct

SEQ ID NO: 93966 - DNA, 75 bp, Artificial Sequence
  Synthetic
tggttctccaatggtccagcatccttcaatcattgagacaaaattggacgtgggtgagatccccttttatgggca

SEQ ID NO: 93967 - DNA, 75 bp, Artificial Sequence
  Synthetic
gtggacatgacaccactgctttcactcggattactgactcgccgttgacgtattcgacctatgggcggttcttag

SEQ ID NO: 93968 - DNA, 75 bp, Artificial Sequence
  Synthetic
tcggattactgactcgccgttgacgtattcgacctatgggcggttcttagccaaccctaggcagatgctacgcgg

SEQ ID NO: 93969 - DNA, 75 bp, Artificial Sequence
  Synthetic
ggcgggccaattttcctcccggggggtcaatgctattgcctattacaggggaaaggacagttccatcatcaaaga

SEQ ID NO: 93970 - DNA, 75 bp, Artificial Sequence
  Synthetic
tgttgggtattggacgggtccgggagttggcgcgtggttgtggggtgcaactagtgctctacgccacggccactc

SEQ ID NO: 93971 - DNA, 75 bp, Artificial Sequence
  Synthetic
gttggcgcgtggttgtggggtgcaactagtgctctacgccacggccactccccccggatcccccatgactcagca

SEQ ID NO: 93972 - DNA, 75 bp, Artificial Sequence
  Synthetic
ggaacttcgattccgttaccgactgtgggttggtggtggaggaggtcgttgaggtgacccttgatcccaccatta

SEQ ID NO: 93973 - DNA, 75 bp, Artificial Sequence
  Synthetic
ggcatggcattcccttggaacggatgcggaccggtaggcatctcgtgttctgccattcaaaggcggagtgcgagc

SEQ ID NO: 93974 - DNA, 75 bp, Artificial Sequence
  Synthetic
gtcggcagaactgtcgatgcagcgacgaggtcgcacaggtagaggacggtctggccgatactactacgcgggcgt

SEQ ID NO: 93975 - DNA, 75 bp, Artificial Sequence
  Synthetic
gcctggcgggccaattctcggctcggggagtcaacgccattgcctattacagggggaaggacagttccatcatta

SEQ ID NO: 93976 - DNA, 75 bp, Artificial Sequence
  Synthetic
tggaagctggagtgacctggtacggaatggaacctgatctgacagcaaaccttctgagactatacgatgactgcc

SEQ ID NO: 93977 - DNA, 75 bp, Artificial Sequence
  Synthetic
cgtcgaggtgacccttgatcccaccattaccatctccttgcggacagtgccggcgtcggctgaattgtcgatgca

SEQ ID NO: 93978 - DNA, 75 bp, Artificial Sequence
  Synthetic
gtggacgatctggtcagacgactcggagtggcggagggttatgtccgctgcgacgctgggcccatcttaatggtg

SEQ ID NO: 93979 - DNA, 75 bp, Artificial Sequence
  Synthetic
aagtccgcggcgtaaactggcccctgctcgtgggcgttcagcggacgatgtgccgggagacactgtcgccagggc

SEQ ID NO: 93980 - DNA, 75 bp, Artificial Sequence
  Synthetic
ctcggtgtggcggagggttacgtccgctgcgatgcggggcccatcttgatggtgggcctggctattgcggggggc

SEQ ID NO: 93981 - DNA, 75 bp, Artificial Sequence
  Synthetic
ctggctgctacacggggacgcgggccgtccccacggtttcaattgtggacaagctcttcgccggagggtgggctg

SEQ ID NO: 93982 - DNA, 75 bp, Artificial Sequence
  Synthetic
tataggaatggagaccaggccactcctcaacctgtggtgcaggtccccccggtagaccatcggccggggggggag

SEQ ID NO: 93983 - DNA, 75 bp, Artificial Sequence
  Synthetic
gttgggcgtcggaggcaatgcgcaggcgcgcttggcctccgccctccttttgggagcggctggcacggccctggg

SEQ ID NO: 93984 - DNA, 75 bp, Artificial Sequence
  Synthetic
gcgcgcttggcctccgccctccttttgggagcggctggcacggccctggggacccccgtcgttggtttaaccatg

SEQ ID NO: 93985 - DNA, 75 bp, Artificial Sequence
  Synthetic
ggcctacgcagctaccaccaagtggctcgctggctgctacacggggacgcgggccgtccctactgtatccattgt

SEQ ID NO: 93986 - DNA, 75 bp, Artificial Sequence
  Synthetic
ccttttgggggctgtgggtggctgggagggcgtggtcaatgccgccagccttgttttcgacttcatggcagggaa

SEQ ID NO: 93987 - DNA, 75 bp, Artificial Sequence
  Synthetic
acgtcatagctgcggcggtggctgcatacggggcttctcggagtcccccgttagctgcagccgcttcctacctca

SEQ ID NO: 93988 - DNA, 75 bp, Artificial Sequence
  Synthetic
atacggggcttctcggagtcccccgttagctgcagccgcttcctacctcatgggattgggcgtcgcaggcaacgc

SEQ ID NO: 93989 - DNA, 75 bp, Artificial Sequence
  Synthetic
ggggctggttttgtactcagctaacaactctggcactaccacctggttgaaccgtctgcttaccacacttccgcg

SEQ ID NO: 93990 - DNA, 75 bp, Artificial Sequence
  Synthetic
tggggactcccgtcgtgggtttaaccatggcgggggccttcatgggcggagcgagcgtgtccccttctctagtca

SEQ ID NO: 93991 - DNA, 75 bp, Artificial Sequence
  Synthetic
gcgagcgtgtccccttctctagtcacggttcttctcggagccgtgggtggttgggagggcgtggtcaatgccgcc

SEQ ID NO: 93992 - DNA, 75 bp, Artificial Sequence
  Synthetic
aggtctcagccatgctccggcgcctgagcctcacgcgtaccgtggtggccctggtcaacagggaacctaaggtcg

SEQ ID NO: 93993 - DNA, 75 bp, Artificial Sequence
  Synthetic
gagcctcacgcgtaccgtggtggccctggtcaacagggaacctaaggtcgatgaggtccaggtggggtatgtctg

SEQ ID NO: 93994 - DNA, 75 bp, Artificial Sequence
  Synthetic
tccgggccctatgccccgtggtgtcactacctttgtggcactgcggggagggatggtccggagaatggctgttgg

SEQ ID NO: 93995 - DNA, 75 bp, Artificial Sequence
  Synthetic
cgcggtcctcatgcatcccggatagttatttccaacaggccgactactgtgacaaggtctcagccatgttgcgtc

SEQ ID NO: 93996 - DNA, 75 bp, Artificial Sequence
  Synthetic
gtggatgaggttcaggtgggctatgtctgggacttgtgggagtggatcatgcgccagattcgcatggtcatggcc

SEQ ID NO: 93997 - DNA, 75 bp, Artificial Sequence
  Synthetic
acactactggatggggaccgttccggtcaacatgctgggttacggggaaacgtcacctctcctggcctccgacac

SEQ ID NO: 93998 - DNA, 75 bp, Artificial Sequence
  Synthetic
gcaggcactactggatggggaccgtgccggttaacatgcttgggtacggggaaacctcgcctctcctagcttcgg

SEQ ID NO: 93999 - DNA, 75 bp, Artificial Sequence
  Synthetic
ccctctgaggtttcgtctgaggtcagtatcgagatcgggacggagtcggaagacaccgaactgacagaggccgat

SEQ ID NO: 94000 - DNA, 75 bp, Artificial Sequence
  Synthetic
gaccccgtcggtgtcctcctcgcaggaggacaccccgtcctcggactcatttgaagtcatccaagagtctgatac

SEQ ID NO: 94001 - DNA, 75 bp, Artificial Sequence
  Synthetic
ttgcaagttgggtgcttggtgggcaatgaacttacctttgaatgtgacaagtgtgaggcacggcaagagaccttg

SEQ ID NO: 94002 - DNA, 75 bp, Artificial Sequence
  Synthetic
gtggggtccctattggttgcggataccaccaaggtgtacgtaaccaatccagataacgtgggtagaagggtggac

SEQ ID NO: 94003 - DNA, 75 bp, Artificial Sequence
  Synthetic
ccaccaaggtgtacgtaaccaatccagataacgtgggtagaagggtggacaaggtgactttctggcgcgctccac

SEQ ID NO: 94004 - DNA, 75 bp, Artificial Sequence
  Synthetic
caccggctaaaccaccagtggtgaggccggtggggtccctgttagtggcggacactaccaaagtgtacgtgacaa

SEQ ID NO: 94005 - DNA, 75 bp, Artificial Sequence
  Synthetic
gacactaccaaagtgtacgtgacaaaccctgacaatgtggggaggcgggtcgacaaggtgactttctggcgtgct

SEQ ID NO: 94006 - DNA, 75 bp, Artificial Sequence
  Synthetic
tactacgcctctggtaccatggtcaccccggaaggggtgcccgtgggagagaggtattgcagatcctcgggggta

SEQ ID NO: 94007 - DNA, 75 bp, Artificial Sequence
  Synthetic
accccgtgcgctatctgtgtggatgccacgtgcttcgacagttccataactgaagaggacgtggcactggagacc

SEQ ID NO: 94008 - DNA, 75 bp, Artificial Sequence
  Synthetic
cgcttgcgagcgggtgggactcaagaacgtttccctcctaatcgcgggcgatgactgtctgatcatatgcgagcg

SEQ ID NO: 94009 - DNA, 75 bp, Artificial Sequence
  Synthetic
gaaatactatgcctctggtaccatggttaccccggaaggggtgcccgtgggcgagaggtactgtagatcctcagg

SEQ ID NO: 94010 - DNA, 75 bp, Artificial Sequence
  Synthetic
gcgagaggtactgtagatcctcaggggtcttgaccaccagtgcaagcaactgcttgacctgctacattaaggtga

SEQ ID NO: 94011 - DNA, 75 bp, Artificial Sequence
  Synthetic
ggcgatgactgtctgatcatatgcgagaggcctatatgcgacccgagcgaggccctgggcagagccctggcttcg

SEQ ID NO: 94012 - DNA, 75 bp, Artificial Sequence
  Synthetic
gcgaccccatggcttcggccatcgggtacatcctcctatacccctggcatcccatcacacggtgggtcatcatcc

SEQ ID NO: 94013 - DNA, 75 bp, Artificial Sequence
  Synthetic
tacgggtatgcgtgtgagccctcgtatcatgcatcattggacacggcccccttctgctccacttggcttgctgag

SEQ ID NO: 94014 - DNA, 75 bp, Artificial Sequence
  Synthetic
atcatgcatcattggacacggcccccttctgctccacttggcttgctgagtgtaatgcagatgggaagcgccatt

SEQ ID NO: 94015 - DNA, 75 bp, Artificial Sequence
  Synthetic
cccatcacacggtgggtcatcatcccccacgtgctcacctgcgcgtttaggggtggtggcacaccgtctgatcct

SEQ ID NO: 94016 - DNA, 75 bp, Artificial Sequence
  Synthetic
cagacactacaaagacaaaaatggaagccgggaaggtgctgagcgacctcaagctaccgggcctggctgtccacc

SEQ ID NO: 94017 - DNA, 75 bp, Artificial Sequence
  Synthetic
ccccgagattgctggtatcccggggggtttccccctgtcccccccctacatgggggtggttcatcaattggattt

SEQ ID NO: 94018 - DNA, 75 bp, Artificial Sequence
  Synthetic
ttgggcagagctggccaggggcctgttgtggcatccaggcctccggctccccccccccgagattgctggtatccc

SEQ ID NO: 94019 - DNA, 75 bp, Artificial Sequence
  Synthetic
gcggtggctggggttcttagccctgctcatcgtagcgctctttgggtgaactaaattcatctgttgcggcaaggt

SEQ ID NO: 94020 - DNA, 75 bp, Artificial Sequence
  Synthetic
agagctggggagcctctatgggcccttgtcggtctcagcctacgtggctgggatcttgggtctaggtgaggtgta

SEQ ID NO: 94021 - DNA, 75 bp, Artificial Sequence
  Synthetic
ctgcctcgaaggcggatgccttgtggccctgggctgcacagtttgtaccgaccgctgctggccactgtatcaggc

SEQ ID NO: 94022 - DNA, 75 bp, Artificial Sequence
  Synthetic
tcggtagcctttacgggcccttgtcggtgtcagcctatgtggcgggcatcctagggctcggggaggtgtactcgg

SEQ ID NO: 94023 - DNA, 75 bp, Artificial Sequence
  Synthetic
gctcctgctcgagcaacggattgtcatggtcttcctgttggtgacgatggcggggatgtcgcaaggcgcccctgc

SEQ ID NO: 94024 - DNA, 75 bp, Artificial Sequence
  Synthetic
gagatggactgagcagttggcctccaattactggattctggaatacctctggaaagtgcctttcgacttctggcg

SEQ ID NO: 94025 - DNA, 75 bp, Artificial Sequence
  Synthetic
cttgaccactggggagaaggtgtgggatcgggggaatgtcacactgttgtgtgactgccccaatggtccttgggt

SEQ ID NO: 94026 - DNA, 75 bp, Artificial Sequence
  Synthetic
cttgaccactggggagaaggtgtgggatcgggggattgtcacactgttgtgtgactgccccaatggtccttgggt

SEQ ID NO: 94027 - DNA, 75 bp, Artificial Sequence
  Synthetic
cttgaccactggggagaaggtgtgggatcgggggactgtcacactgttgtgtgactgccccaatggtccttgggt

SEQ ID NO: 94028 - DNA, 75 bp, Artificial Sequence
  Synthetic
cttgaccactggggagaaggtgtgggatcgggggagtgtcacactgttgtgtgactgccccaatggtccttgggt

SEQ ID NO: 94029 - DNA, 75 bp, Artificial Sequence
  Synthetic
gatcgggggaatgtcacactgttgtgtgactgccccaatggtccttgggtgtggttaccagccttttgccaggca

SEQ ID NO: 94030 - DNA, 75 bp, Artificial Sequence
  Synthetic
gatcgggggattgtcacactgttgtgtgactgccccaatggtccttgggtgtggttaccagccttttgccaggca

SEQ ID NO: 94031 - DNA, 75 bp, Artificial Sequence
  Synthetic
gatcgggggactgtcacactgttgtgtgactgccccaatggtccttgggtgtggttaccagccttttgccaggca

SEQ ID NO: 94032 - DNA, 75 bp, Artificial Sequence
  Synthetic
gatcgggggagtgtcacactgttgtgtgactgccccaatggtccttgggtgtggttaccagccttttgccaggca

SEQ ID NO: 94033 - DNA, 75 bp, Artificial Sequence
  Synthetic
tgtaaggcgaatgggtcgcgcgtgatcacaggggaaagggtttgggaccgagggaatgtcacacttttgtgtgat

SEQ ID NO: 94034 - DNA, 75 bp, Artificial Sequence
  Synthetic
tgtaaggcgaatgggtcgcgcgtgatcacaggggatagggtttgggaccgagggaatgtcacacttttgtgtgat

SEQ ID NO: 94035 - DNA, 75 bp, Artificial Sequence
  Synthetic
tgtaaggcgaatgggtcgcgcgtgatcacaggggacagggtttgggaccgagggaatgtcacacttttgtgtgat

SEQ ID NO: 94036 - DNA, 75 bp, Artificial Sequence
  Synthetic
tgtaaggcgaatgggtcgcgcgtgatcacaggggagagggtttgggaccgagggaatgtcacacttttgtgtgat

SEQ ID NO: 94037 - DNA, 75 bp, Artificial Sequence
  Synthetic
tgtatggcgaatgggtcgcgcgtgatcacaggggaaagggtttgggaccgagggaatgtcacacttttgtgtgat

SEQ ID NO: 94038 - DNA, 75 bp, Artificial Sequence
  Synthetic
tgtatggcgaatgggtcgcgcgtgatcacaggggatagggtttgggaccgagggaatgtcacacttttgtgtgat

SEQ ID NO: 94039 - DNA, 75 bp, Artificial Sequence
  Synthetic
tgtatggcgaatgggtcgcgcgtgatcacaggggacagggtttgggaccgagggaatgtcacacttttgtgtgat

SEQ ID NO: 94040 - DNA, 75 bp, Artificial Sequence
  Synthetic
tgtatggcgaatgggtcgcgcgtgatcacaggggagagggtttgggaccgagggaatgtcacacttttgtgtgat

SEQ ID NO: 94041 - DNA, 75 bp, Artificial Sequence
  Synthetic
tgtacggcgaatgggtcgcgcgtgatcacaggggaaagggtttgggaccgagggaatgtcacacttttgtgtgat

SEQ ID NO: 94042 - DNA, 75 bp, Artificial Sequence
  Synthetic
tgtacggcgaatgggtcgcgcgtgatcacaggggatagggtttgggaccgagggaatgtcacacttttgtgtgat

SEQ ID NO: 94043 - DNA, 75 bp, Artificial Sequence
  Synthetic
tgtacggcgaatgggtcgcgcgtgatcacaggggacagggtttgggaccgagggaatgtcacacttttgtgtgat

SEQ ID NO: 94044 - DNA, 75 bp, Artificial Sequence
  Synthetic
tgtacggcgaatgggtcgcgcgtgatcacaggggagagggtttgggaccgagggaatgtcacacttttgtgtgat

SEQ ID NO: 94045 - DNA, 75 bp, Artificial Sequence
  Synthetic
tgtagggcgaatgggtcgcgcgtgatcacaggggaaagggtttgggaccgagggaatgtcacacttttgtgtgat

SEQ ID NO: 94046 - DNA, 75 bp, Artificial Sequence
  Synthetic
tgtagggcgaatgggtcgcgcgtgatcacaggggatagggtttgggaccgagggaatgtcacacttttgtgtgat

SEQ ID NO: 94047 - DNA, 75 bp, Artificial Sequence
  Synthetic
tgtagggcgaatgggtcgcgcgtgatcacaggggacagggtttgggaccgagggaatgtcacacttttgtgtgat

SEQ ID NO: 94048 - DNA, 75 bp, Artificial Sequence
  Synthetic
tgtagggcgaatgggtcgcgcgtgatcacaggggagagggtttgggaccgagggaatgtcacacttttgtgtgat

SEQ ID NO: 94049 - DNA, 75 bp, Artificial Sequence
  Synthetic
gcccctgtcatgccctcagtatgtctacgggtctgcatcagtcacttgcgtatggggttccgcctcttggtttgc

SEQ ID NO: 94050 - DNA, 75 bp, Artificial Sequence
  Synthetic
tacgggtctgcatcagtcacttgcgtatggggttccgcctcttggtttgcctccaccggagggcgcgattcaaag

SEQ ID NO: 94051 - DNA, 75 bp, Artificial Sequence
  Synthetic
tcacaggggaaagggtttgggaccgagggaatgtcacacttttgtgtgattgccccaacggtccctgggtatggc

SEQ ID NO: 94052 - DNA, 75 bp, Artificial Sequence
  Synthetic
tcacaggggatagggtttgggaccgagggaatgtcacacttttgtgtgattgccccaacggtccctgggtatggc

SEQ ID NO: 94053 - DNA, 75 bp, Artificial Sequence
  Synthetic
tcacaggggacagggtttgggaccgagggaatgtcacacttttgtgtgattgccccaacggtccctgggtatggc

SEQ ID NO: 94054 - DNA, 75 bp, Artificial Sequence
  Synthetic
tcacaggggagagggtttgggaccgagggaatgtcacacttttgtgtgattgccccaacggtccctgggtatggc

SEQ ID NO: 94055 - DNA, 75 bp, Artificial Sequence
  Synthetic
cgcactcgggtcgtcggaccgcgatactgtggtggagctttccgagtggggggtcccgtgcgtgacgtgtgttct

SEQ ID NO: 94056 - DNA, 75 bp, Artificial Sequence
  Synthetic
ggatcgtcggccggcttcgtgtggcacctgtgtgcgggactgttggcccgaaaccgggtcggtcagattcccctt

SEQ ID NO: 94057 - DNA, 75 bp, Artificial Sequence
  Synthetic
ctgggggtcgtgactcgaagatcgatgtgtggagcttggtcccagttggctcagccagctgcaccatagccgcac

SEQ ID NO: 94058 - DNA, 75 bp, Artificial Sequence
  Synthetic
caggggagaggcaacccggtgcggtcgcccctgggttttgggtcctacaccatgaccaagatccgggatacccta

SEQ ID NO: 94059 - DNA, 75 bp, Artificial Sequence
  Synthetic
ggtgaaatgtcccaccccagccattgagcctcccaccgggacgtttgggttcttccccgggactcccccgcttaa

SEQ ID NO: 94060 - DNA, 75 bp, Artificial Sequence
  Synthetic
cgatgctggcaacttcatccccccaccacgctggttgctcctggattttgtattcgtcctgttatacctgatgaa

SEQ ID NO: 94061 - DNA, 75 bp, Artificial Sequence
  Synthetic
ctgaactcacagctgcagtggtggtgggtgaaccagctggcggtccttggactgccggctgtggacgccgccgta

SEQ ID NO: 94062 - DNA, 75 bp, Artificial Sequence
  Synthetic
ctgaactcacagctgctgtggtggtgggtgaaccagctggcggtccttggactgccggctgtggacgccgccgta

SEQ ID NO: 94063 - DNA, 75 bp, Artificial Sequence
  Synthetic
ctgaactcacagctgccgtggtggtgggtgaaccagctggcggtccttggactgccggctgtggacgccgccgta

SEQ ID NO: 94064 - DNA, 75 bp, Artificial Sequence
  Synthetic
ctgaactcacagctgcggtggtggtgggtgaaccagctggcggtccttggactgccggctgtggacgccgccgta

SEQ ID NO: 94065 - DNA, 75 bp, Artificial Sequence
  Synthetic
ctgaactcactgctgcagtggtggtgggtgaaccagctggcggtccttggactgccggctgtggacgccgccgta

SEQ ID NO: 94066 - DNA, 75 bp, Artificial Sequence
  Synthetic
ctgaactcactgctgctgtggtggtgggtgaaccagctggcggtccttggactgccggctgtggacgccgccgta

SEQ ID NO: 94067 - DNA, 75 bp, Artificial Sequence
  Synthetic
ctgaactcactgctgccgtggtggtgggtgaaccagctggcggtccttggactgccggctgtggacgccgccgta

SEQ ID NO: 94068 - DNA, 75 bp, Artificial Sequence
  Synthetic
ctgaactcactgctgcggtggtggtgggtgaaccagctggcggtccttggactgccggctgtggacgccgccgta

SEQ ID NO: 94069 - DNA, 75 bp, Artificial Sequence
  Synthetic
ctgaactcaccgctgcagtggtggtgggtgaaccagctggcggtccttggactgccggctgtggacgccgccgta

SEQ ID NO: 94070 - DNA, 75 bp, Artificial Sequence
  Synthetic
ctgaactcaccgctgctgtggtggtgggtgaaccagctggcggtccttggactgccggctgtggacgccgccgta

SEQ ID NO: 94071 - DNA, 75 bp, Artificial Sequence
  Synthetic
ctgaactcaccgctgccgtggtggtgggtgaaccagctggcggtccttggactgccggctgtggacgccgccgta

SEQ ID NO: 94072 - DNA, 75 bp, Artificial Sequence
  Synthetic
ctgaactcaccgctgcggtggtggtgggtgaaccagctggcggtccttggactgccggctgtggacgccgccgta

SEQ ID NO: 94073 - DNA, 75 bp, Artificial Sequence
  Synthetic
ctgaactcacggctgcagtggtggtgggtgaaccagctggcggtccttggactgccggctgtggacgccgccgta

SEQ ID NO: 94074 - DNA, 75 bp, Artificial Sequence
  Synthetic
ctgaactcacggctgctgtggtggtgggtgaaccagctggcggtccttggactgccggctgtggacgccgccgta

SEQ ID NO: 94075 - DNA, 75 bp, Artificial Sequence
  Synthetic
ctgaactcacggctgccgtggtggtgggtgaaccagctggcggtccttggactgccggctgtggacgccgccgta

SEQ ID NO: 94076 - DNA, 75 bp, Artificial Sequence
  Synthetic
ctgaactcacggctgcggtggtggtgggtgaaccagctggcggtccttggactgccggctgtggacgccgccgta

SEQ ID NO: 94077 - DNA, 75 bp, Artificial Sequence
  Synthetic
ctgatctcacagctgcagtggtggtgggtgaaccagctggcggtccttggactgccggctgtggacgccgccgta

SEQ ID NO: 94078 - DNA, 75 bp, Artificial Sequence
  Synthetic
ctgatctcacagctgctgtggtggtgggtgaaccagctggcggtccttggactgccggctgtggacgccgccgta

SEQ ID NO: 94079 - DNA, 75 bp, Artificial Sequence
  Synthetic
ctgatctcacagctgccgtggtggtgggtgaaccagctggcggtccttggactgccggctgtggacgccgccgta

SEQ ID NO: 94080 - DNA, 75 bp, Artificial Sequence
  Synthetic
ctgatctcacagctgcggtggtggtgggtgaaccagctggcggtccttggactgccggctgtggacgccgccgta

SEQ ID NO: 94081 - DNA, 75 bp, Artificial Sequence
  Synthetic
ctgatctcactgctgcagtggtggtgggtgaaccagctggcggtccttggactgccggctgtggacgccgccgta

SEQ ID NO: 94082 - DNA, 75 bp, Artificial Sequence
  Synthetic
ctgatctcactgctgctgtggtggtgggtgaaccagctggcggtccttggactgccggctgtggacgccgccgta

SEQ ID NO: 94083 - DNA, 75 bp, Artificial Sequence
  Synthetic
ctgatctcactgctgccgtggtggtgggtgaaccagctggcggtccttggactgccggctgtggacgccgccgta

SEQ ID NO: 94084 - DNA, 75 bp, Artificial Sequence
  Synthetic
ctgatctcactgctgcggtggtggtgggtgaaccagctggcggtccttggactgccggctgtggacgccgccgta

SEQ ID NO: 94085 - DNA, 75 bp, Artificial Sequence
  Synthetic
ctgatctcaccgctgcagtggtggtgggtgaaccagctggcggtccttggactgccggctgtggacgccgccgta

SEQ ID NO: 94086 - DNA, 75 bp, Artificial Sequence
  Synthetic
ctgatctcaccgctgctgtggtggtgggtgaaccagctggcggtccttggactgccggctgtggacgccgccgta

SEQ ID NO: 94087 - DNA, 75 bp, Artificial Sequence
  Synthetic
ctgatctcaccgctgccgtggtggtgggtgaaccagctggcggtccttggactgccggctgtggacgccgccgta

SEQ ID NO: 94088 - DNA, 75 bp, Artificial Sequence
  Synthetic
ctgatctcaccgctgcggtggtggtgggtgaaccagctggcggtccttggactgccggctgtggacgccgccgta

SEQ ID NO: 94089 - DNA, 75 bp, Artificial Sequence
  Synthetic
ctgatctcacggctgcagtggtggtgggtgaaccagctggcggtccttggactgccggctgtggacgccgccgta

SEQ ID NO: 94090 - DNA, 75 bp, Artificial Sequence
  Synthetic
ctgatctcacggctgctgtggtggtgggtgaaccagctggcggtccttggactgccggctgtggacgccgccgta

SEQ ID NO: 94091 - DNA, 75 bp, Artificial Sequence
  Synthetic
ctgatctcacggctgccgtggtggtgggtgaaccagctggcggtccttggactgccggctgtggacgccgccgta

SEQ ID NO: 94092 - DNA, 75 bp, Artificial Sequence
  Synthetic
ctgatctcacggctgcggtggtggtgggtgaaccagctggcggtccttggactgccggctgtggacgccgccgta

SEQ ID NO: 94093 - DNA, 75 bp, Artificial Sequence
  Synthetic
ctgacctcacagctgcagtggtggtgggtgaaccagctggcggtccttggactgccggctgtggacgccgccgta

SEQ ID NO: 94094 - DNA, 75 bp, Artificial Sequence
  Synthetic
ctgacctcacagctgctgtggtggtgggtgaaccagctggcggtccttggactgccggctgtggacgccgccgta

SEQ ID NO: 94095 - DNA, 75 bp, Artificial Sequence
  Synthetic
ctgacctcacagctgccgtggtggtgggtgaaccagctggcggtccttggactgccggctgtggacgccgccgta

SEQ ID NO: 94096 - DNA, 75 bp, Artificial Sequence
  Synthetic
ctgacctcacagctgcggtggtggtgggtgaaccagctggcggtccttggactgccggctgtggacgccgccgta

SEQ ID NO: 94097 - DNA, 75 bp, Artificial Sequence
  Synthetic
ctgacctcactgctgcagtggtggtgggtgaaccagctggcggtccttggactgccggctgtggacgccgccgta

SEQ ID NO: 94098 - DNA, 75 bp, Artificial Sequence
  Synthetic
ctgacctcactgctgctgtggtggtgggtgaaccagctggcggtccttggactgccggctgtggacgccgccgta

SEQ ID NO: 94099 - DNA, 75 bp, Artificial Sequence
  Synthetic
ctgacctcactgctgccgtggtggtgggtgaaccagctggcggtccttggactgccggctgtggacgccgccgta

SEQ ID NO: 94100 - DNA, 75 bp, Artificial Sequence
  Synthetic
ctgacctcactgctgcggtggtggtgggtgaaccagctggcggtccttggactgccggctgtggacgccgccgta

SEQ ID NO: 94101 - DNA, 75 bp, Artificial Sequence
  Synthetic
ctgacctcaccgctgcagtggtggtgggtgaaccagctggcggtccttggactgccggctgtggacgccgccgta

SEQ ID NO: 94102 - DNA, 75 bp, Artificial Sequence
  Synthetic
ctgacctcaccgctgctgtggtggtgggtgaaccagctggcggtccttggactgccggctgtggacgccgccgta

SEQ ID NO: 94103 - DNA, 75 bp, Artificial Sequence
  Synthetic
ctgacctcaccgctgccgtggtggtgggtgaaccagctggcggtccttggactgccggctgtggacgccgccgta

SEQ ID NO: 94104 - DNA, 75 bp, Artificial Sequence
  Synthetic
ctgacctcaccgctgcggtggtggtgggtgaaccagctggcggtccttggactgccggctgtggacgccgccgta

SEQ ID NO: 94105 - DNA, 75 bp, Artificial Sequence
  Synthetic
ctgacctcacggctgcagtggtggtgggtgaaccagctggcggtccttggactgccggctgtggacgccgccgta

SEQ ID NO: 94106 - DNA, 75 bp, Artificial Sequence
  Synthetic
ctgacctcacggctgctgtggtggtgggtgaaccagctggcggtccttggactgccggctgtggacgccgccgta

SEQ ID NO: 94107 - DNA, 75 bp, Artificial Sequence
  Synthetic
ctgacctcacggctgccgtggtggtgggtgaaccagctggcggtccttggactgccggctgtggacgccgccgta

SEQ ID NO: 94108 - DNA, 75 bp, Artificial Sequence
  Synthetic
ctgacctcacggctgcggtggtggtgggtgaaccagctggcggtccttggactgccggctgtggacgccgccgta

SEQ ID NO: 94109 - DNA, 75 bp, Artificial Sequence
  Synthetic
ctgagctcacagctgcagtggtggtgggtgaaccagctggcggtccttggactgccggctgtggacgccgccgta

SEQ ID NO: 94110 - DNA, 75 bp, Artificial Sequence
  Synthetic
ctgagctcacagctgctgtggtggtgggtgaaccagctggcggtccttggactgccggctgtggacgccgccgta

SEQ ID NO: 94111 - DNA, 75 bp, Artificial Sequence
  Synthetic
ctgagctcacagctgccgtggtggtgggtgaaccagctggcggtccttggactgccggctgtggacgccgccgta

SEQ ID NO: 94112 - DNA, 75 bp, Artificial Sequence
  Synthetic
ctgagctcacagctgcggtggtggtgggtgaaccagctggcggtccttggactgccggctgtggacgccgccgta

SEQ ID NO: 94113 - DNA, 75 bp, Artificial Sequence
  Synthetic
ctgagctcactgctgcagtggtggtgggtgaaccagctggcggtccttggactgccggctgtggacgccgccgta

SEQ ID NO: 94114 - DNA, 75 bp, Artificial Sequence
  Synthetic
ctgagctcactgctgctgtggtggtgggtgaaccagctggcggtccttggactgccggctgtggacgccgccgta

SEQ ID NO: 94115 - DNA, 75 bp, Artificial Sequence
  Synthetic
ctgagctcactgctgccgtggtggtgggtgaaccagctggcggtccttggactgccggctgtggacgccgccgta

SEQ ID NO: 94116 - DNA, 75 bp, Artificial Sequence
  Synthetic
ctgagctcactgctgcggtggtggtgggtgaaccagctggcggtccttggactgccggctgtggacgccgccgta

SEQ ID NO: 94117 - DNA, 75 bp, Artificial Sequence
  Synthetic
ctgagctcaccgctgcagtggtggtgggtgaaccagctggcggtccttggactgccggctgtggacgccgccgta

SEQ ID NO: 94118 - DNA, 75 bp, Artificial Sequence
  Synthetic
ctgagctcaccgctgctgtggtggtgggtgaaccagctggcggtccttggactgccggctgtggacgccgccgta

SEQ ID NO: 94119 - DNA, 75 bp, Artificial Sequence
  Synthetic
ctgagctcaccgctgccgtggtggtgggtgaaccagctggcggtccttggactgccggctgtggacgccgccgta

SEQ ID NO: 94120 - DNA, 75 bp, Artificial Sequence
  Synthetic
ctgagctcaccgctgcggtggtggtgggtgaaccagctggcggtccttggactgccggctgtggacgccgccgta

SEQ ID NO: 94121 - DNA, 75 bp, Artificial Sequence
  Synthetic
ctgagctcacggctgcagtggtggtgggtgaaccagctggcggtccttggactgccggctgtggacgccgccgta

SEQ ID NO: 94122 - DNA, 75 bp, Artificial Sequence
  Synthetic
ctgagctcacggctgctgtggtggtgggtgaaccagctggcggtccttggactgccggctgtggacgccgccgta

SEQ ID NO: 94123 - DNA, 75 bp, Artificial Sequence
  Synthetic
ctgagctcacggctgccgtggtggtgggtgaaccagctggcggtccttggactgccggctgtggacgccgccgta

SEQ ID NO: 94124 - DNA, 75 bp, Artificial Sequence
  Synthetic
ctgagctcacggctgcggtggtggtgggtgaaccagctggcggtccttggactgccggctgtggacgccgccgta

SEQ ID NO: 94125 - DNA, 75 bp, Artificial Sequence
  Synthetic
gtgtctgaggtgctgggcggcgcggggctcacgggggggttctatgaacccctggtgcggcggtgttcagagcta

SEQ ID NO: 94126 - DNA, 75 bp, Artificial Sequence
  Synthetic
actgccggctgtggacgccgccgtagcgggtgaggtttttgcgggtcctgccttgtcgtggtgcctgggcctccc

SEQ ID NO: 94127 - DNA, 75 bp, Artificial Sequence
  Synthetic
gcgggtgaggtttttgcgggtcctgccttgtcgtggtgcctgggcctccccaccgttagcatgatactgggtctg

SEQ ID NO: 94128 - DNA, 75 bp, Artificial Sequence
  Synthetic
ctgaggccaggctagttcctctgatcctgctcctgctgtggtggtgggtgaaccaactggcggtcctaggactgc

SEQ ID NO: 94129 - DNA, 75 bp, Artificial Sequence
  Synthetic
ctatagaacgtggtgtaaggggtatcaggcgatacgtcagcgggtggttcggagccccctcggggaggggcgtcc

SEQ ID NO: 94130 - DNA, 75 bp, Artificial Sequence
  Synthetic
tcctggtgtcttgggctccccttcgtgagtatgatcctgggtctagcaaacctggtgttgtacttccgatggatg

SEQ ID NO: 94131 - DNA, 75 bp, Artificial Sequence
  Synthetic
cttggtcctcctctttggcctattcgacgcgttggactgggccttggaggagatcttggtatcccggccctcgtt

SEQ ID NO: 94132 - DNA, 75 bp, Artificial Sequence
  Synthetic
cttggtcctcctctttggccttttcgacgcgttggactgggccttggaggagatcttggtatcccggccctcgtt

SEQ ID NO: 94133 - DNA, 75 bp, Artificial Sequence
  Synthetic
cttggtcctcctctttggcctcttcgacgcgttggactgggccttggaggagatcttggtatcccggccctcgtt

SEQ ID NO: 94134 - DNA, 75 bp, Artificial Sequence
  Synthetic
cttggtcctcctctttggcctgttcgacgcgttggactgggccttggaggagatcttggtatcccggccctcgtt

SEQ ID NO: 94135 - DNA, 75 bp, Artificial Sequence
  Synthetic
ccacaaccgtccggctggtctccaagatgtgtgcgagaggtgcctatttgttcgatcatatgggttctttttcgc

SEQ ID NO: 94136 - DNA, 75 bp, Artificial Sequence
  Synthetic
cttgagctctatgagcgcgggaggctggaggcacaaagctgtgatctataggacgtggtgtaaagggtaccaggc

SEQ ID NO: 94137 - DNA, 75 bp, Artificial Sequence
  Synthetic
tcattcactaggacggactgtcgcatcataagagatgccgcgaggaccctgtcctgcgggcagtgcgtcatgggt

SEQ ID NO: 94138 - DNA, 75 bp, Artificial Sequence
  Synthetic
ggcctcctacatctggcccgacgccgtgatgttggtggtggtgggactggtgctcctgttcggcctgttcgacgc

SEQ ID NO: 94139 - DNA, 75 bp, Artificial Sequence
  Synthetic
tgctcctgttcggcctgttcgacgcgttggactgggccttggaggagctactggtgtcacggccttcattgcgga

SEQ ID NO: 94140 - DNA, 75 bp, Artificial Sequence
  Synthetic
gcgcgcgtggggcctatttgttcgatcatatgggctctttttcgcgcgctgtgaaggaacgcttgctggagtggg

SEQ ID NO: 94141 - DNA, 75 bp, Artificial Sequence
  Synthetic
cgccacacctgtgggggccctcaaccccaggtggtggtcggccagtgatgacgtcacggtgtacccactcccgga

SEQ ID NO: 94142 - DNA, 75 bp, Artificial Sequence
  Synthetic
cccaggtggtggtcggccagtgatgacgtcacggtgtacccactcccggatggggcaacctcgttgacaccctgc

SEQ ID NO: 94143 - DNA, 75 bp, Artificial Sequence
  Synthetic
agggacgccgctcggaccctctcctgcggccagtgtgtcatgggtttacccgtggtagctcgccgtggcgatgag

SEQ ID NO: 94144 - DNA, 75 bp, Artificial Sequence
  Synthetic
tcatggcctgagtaagggggataaggtggagctggatgtagccatggaggtctcggacttccgtggttcctccgg

SEQ ID NO: 94145 - DNA, 75 bp, Artificial Sequence
  Synthetic
ccctaccgcgcctgtagtcatccgtcggtgcggaaagggcttcctcggtgtcacaaaggcagccttgacaggtcg

SEQ ID NO: 94146 - DNA, 75 bp, Artificial Sequence
  Synthetic
tgcttcattctggtggcagggttaccgcggctcgattcaccaggccgtggacccaagttccaacggatgccaaga

SEQ ID NO: 94147 - DNA, 75 bp, Artificial Sequence
  Synthetic
ggggcttcttcccgaaccatcgccacacctgtgggagcccttaatcctaggtggtggtccgccagtgatgatgtc

SEQ ID NO: 94148 - DNA, 75 bp, Artificial Sequence
  Synthetic
ctaactcgttgacaccctgcacttgccaagcggagtcctgttgggtcatccgatccgatggggcactctgccatg

SEQ ID NO: 94149 - DNA, 75 bp, Artificial Sequence
  Synthetic
ctgtgagggccatgggcccctacatggagcgcctggcgggcaaacacccaagcatttactgtgggcacgatacaa

SEQ ID NO: 94150 - DNA, 75 bp, Artificial Sequence
  Synthetic
gatttccgtggctcgtccggctcgcctgtcttgtgcgacgaggggcacgcagtaggaatgctcgtgtccgtgctc

SEQ ID NO: 94151 - DNA, 75 bp, Artificial Sequence
  Synthetic
aggtttttggccaaccctaggcagatgctgaggggtgtgtctgtggtcatctgtgatgagtgccacagtcatgac

SEQ ID NO: 94152 - DNA, 75 bp, Artificial Sequence
  Synthetic
accgccacgccgcccgggtcgcccatgacccagcatccctctatcattgagactaaattggatgagggagagatc

SEQ ID NO: 94153 - DNA, 75 bp, Artificial Sequence
  Synthetic
accgccacgccgcccgggtcgcccatgacccagcatccctctatcattgagactaaattggatgtgggagagatc

SEQ ID NO: 94154 - DNA, 75 bp, Artificial Sequence
  Synthetic
accgccacgccgcccgggtcgcccatgacccagcatccctctatcattgagactaaattggatgcgggagagatc

SEQ ID NO: 94155 - DNA, 75 bp, Artificial Sequence
  Synthetic
accgccacgccgcccgggtcgcccatgacccagcatccctctatcattgagactaaattggatgggggagagatc

SEQ ID NO: 94156 - DNA, 75 bp, Artificial Sequence
  Synthetic
gagagcgaacgcttggccggccagttttccgcgaggggggtcaatgccatagcctactacaggggtaaggacagt

SEQ ID NO: 94157 - DNA, 75 bp, Artificial Sequence
  Synthetic
gagtgcgaacgcttggccggccagttttccgcgaggggggtcaatgccatagcctactacaggggtaaggacagt

SEQ ID NO: 94158 - DNA, 75 bp, Artificial Sequence
  Synthetic
gagcgcgaacgcttggccggccagttttccgcgaggggggtcaatgccatagcctactacaggggtaaggacagt

SEQ ID NO: 94159 - DNA, 75 bp, Artificial Sequence
  Synthetic
gagggcgaacgcttggccggccagttttccgcgaggggggtcaatgccatagcctactacaggggtaaggacagt

SEQ ID NO: 94160 - DNA, 75 bp, Artificial Sequence
  Synthetic
cgggccatgggcccttacatggagcggctggcggggaaacatcctagcatttactgtggacacgacacaacagca

SEQ ID NO: 94161 - DNA, 75 bp, Artificial Sequence
  Synthetic
cctagccaaccctaggcagatgctgaggggagtttcggtggtcatatgtgatgagtgccacagtcatgactctac

SEQ ID NO: 94162 - DNA, 75 bp, Artificial Sequence
  Synthetic
tgtcgatgcaaaggcgaggacgcacaggtagaggcaggtccggacgctactactacgcgggggtcggtaaggctc

SEQ ID NO: 94163 - DNA, 75 bp, Artificial Sequence
  Synthetic
agggaattggcacgcggctgcggggtccaactggtcctctacgctactgccactccccctggctcccctatggtc

SEQ ID NO: 94164 - DNA, 75 bp, Artificial Sequence
  Synthetic
ttatgggcatggtatccccttggagcggatgcggaccggcaggcatctcgtattctgccactcgaaggcggagtg

SEQ ID NO: 94165 - DNA, 75 bp, Artificial Sequence
  Synthetic
cgagcgtttggcgggccaattctcctcacggggggttaatgccatagcctattatcgggggaaggacagttcaat

SEQ ID NO: 94166 - DNA, 75 bp, Artificial Sequence
  Synthetic
agttgggcaaaagtacgcggcgtcaactggcccctcctggtgggtgttcagcggaccatgtgccgggaaacactg

SEQ ID NO: 94167 - DNA, 75 bp, Artificial Sequence
  Synthetic
ccaccattaccatctccttgcgaacggtgcccgcttcggctgaactgtcgatgcagcggcgaggtcgcacaggca

SEQ ID NO: 94168 - DNA, 75 bp, Artificial Sequence
  Synthetic
ggtgcccgcttcggctgaactgtcgatgcagcggcgaggtcgcacaggcagaggccggtctggtcgatactacta

SEQ ID NO: 94169 - DNA, 75 bp, Artificial Sequence
  Synthetic
cagactgggatgtgaaggggggtggcagccccctttatcggcatggagaccaggccacgccacagccggtcgtgc

SEQ ID NO: 94170 - DNA, 75 bp, Artificial Sequence
  Synthetic
aggtccccccggtagaccatcggccggggggggagtctgcgccatcggatgccaagacagtgacagatgcggtgg

SEQ ID NO: 94171 - DNA, 75 bp, Artificial Sequence
  Synthetic
tgaggatgcaccccgatgtcagctgggcaaaagttcgcggcgtcaactggcccctcttggtgggtgttcagcgga

SEQ ID NO: 94172 - DNA, 75 bp, Artificial Sequence
  Synthetic
agacagccgaggcctacacagcgactgccaagtggcttgctggctgctatacggggacgcgggccgtccccactg

SEQ ID NO: 94173 - DNA, 75 bp, Artificial Sequence
  Synthetic
cccctcttggtgggtgttcagcggacgatgtgccgggaaacactgtcgcccggcccgtcggatgacccccaatgg

SEQ ID NO: 94174 - DNA, 75 bp, Artificial Sequence
  Synthetic
gcaggtctgaaaggcccgaatcctgtcccactactgctgaggtggggcaatgatttgccatccaaagtggccggc

SEQ ID NO: 94175 - DNA, 75 bp, Artificial Sequence
  Synthetic
tgatttgccatccaaagtggccggccaccacatagtggacgatctggtcagacggctcggtgtggcggagggtta

SEQ ID NO: 94176 - DNA, 75 bp, Artificial Sequence
  Synthetic
cggtggcagcctacggggcttcaaggagcccaccgttggcggccgcggcttcctacctgatggggttgggcgtgg

SEQ ID NO: 94177 - DNA, 75 bp, Artificial Sequence
  Synthetic
gagcccaccgttggcggccgcggcttcctacctgatggggttgggcgtgggaggcaacgcgcaaacccgcttggc

SEQ ID NO: 94178 - DNA, 75 bp, Artificial Sequence
  Synthetic
ggggcatgatctatgcgtcttacactgggtccctggtggtggtgacagactgggatgtgaaggggggtggcaacc

SEQ ID NO: 94179 - DNA, 75 bp, Artificial Sequence
  Synthetic
tggacttgaacatggcgggtgcgttcatgggtggtgctagcgtctcgccttccctggtcaccattttactggggg

SEQ ID NO: 94180 - DNA, 75 bp, Artificial Sequence
  Synthetic
tggacttgaacttggcgggtgcgttcatgggtggtgctagcgtctcgccttccctggtcaccattttactggggg

SEQ ID NO: 94181 - DNA, 75 bp, Artificial Sequence
  Synthetic
tggacttgaacctggcgggtgcgttcatgggtggtgctagcgtctcgccttccctggtcaccattttactggggg

SEQ ID NO: 94182 - DNA, 75 bp, Artificial Sequence
  Synthetic
tggacttgaacgtggcgggtgcgttcatgggtggtgctagcgtctcgccttccctggtcaccattttactggggg

SEQ ID NO: 94183 - DNA, 75 bp, Artificial Sequence
  Synthetic
tggacttgatcatggcgggtgcgttcatgggtggtgctagcgtctcgccttccctggtcaccattttactggggg

SEQ ID NO: 94184 - DNA, 75 bp, Artificial Sequence
  Synthetic
tggacttgatcttggcgggtgcgttcatgggtggtgctagcgtctcgccttccctggtcaccattttactggggg

SEQ ID NO: 94185 - DNA, 75 bp, Artificial Sequence
  Synthetic
tggacttgatcctggcgggtgcgttcatgggtggtgctagcgtctcgccttccctggtcaccattttactggggg

SEQ ID NO: 94186 - DNA, 75 bp, Artificial Sequence
  Synthetic
tggacttgatcgtggcgggtgcgttcatgggtggtgctagcgtctcgccttccctggtcaccattttactggggg

SEQ ID NO: 94187 - DNA, 75 bp, Artificial Sequence
  Synthetic
tggacttgaccatggcgggtgcgttcatgggtggtgctagcgtctcgccttccctggtcaccattttactggggg

SEQ ID NO: 94188 - DNA, 75 bp, Artificial Sequence
  Synthetic
tggacttgaccttggcgggtgcgttcatgggtggtgctagcgtctcgccttccctggtcaccattttactggggg

SEQ ID NO: 94189 - DNA, 75 bp, Artificial Sequence
  Synthetic
tggacttgaccctggcgggtgcgttcatgggtggtgctagcgtctcgccttccctggtcaccattttactggggg

SEQ ID NO: 94190 - DNA, 75 bp, Artificial Sequence
  Synthetic
tggacttgaccgtggcgggtgcgttcatgggtggtgctagcgtctcgccttccctggtcaccattttactggggg

SEQ ID NO: 94191 - DNA, 75 bp, Artificial Sequence
  Synthetic
tggacttgagcatggcgggtgcgttcatgggtggtgctagcgtctcgccttccctggtcaccattttactggggg

SEQ ID NO: 94192 - DNA, 75 bp, Artificial Sequence
  Synthetic
tggacttgagcttggcgggtgcgttcatgggtggtgctagcgtctcgccttccctggtcaccattttactggggg

SEQ ID NO: 94193 - DNA, 75 bp, Artificial Sequence
  Synthetic
tggacttgagcctggcgggtgcgttcatgggtggtgctagcgtctcgccttccctggtcaccattttactggggg

SEQ ID NO: 94194 - DNA, 75 bp, Artificial Sequence
  Synthetic
tggacttgagcgtggcgggtgcgttcatgggtggtgctagcgtctcgccttccctggtcaccattttactggggg

SEQ ID NO: 94195 - DNA, 75 bp, Artificial Sequence
  Synthetic
tggtcttgaacatggcgggtgcgttcatgggtggtgctagcgtctcgccttccctggtcaccattttactggggg

SEQ ID NO: 94196 - DNA, 75 bp, Artificial Sequence
  Synthetic
tggtcttgaacttggcgggtgcgttcatgggtggtgctagcgtctcgccttccctggtcaccattttactggggg

SEQ ID NO: 94197 - DNA, 75 bp, Artificial Sequence
  Synthetic
tggtcttgaacctggcgggtgcgttcatgggtggtgctagcgtctcgccttccctggtcaccattttactggggg

SEQ ID NO: 94198 - DNA, 75 bp, Artificial Sequence
  Synthetic
tggtcttgaacgtggcgggtgcgttcatgggtggtgctagcgtctcgccttccctggtcaccattttactggggg

SEQ ID NO: 94199 - DNA, 75 bp, Artificial Sequence
  Synthetic
tggtcttgatcatggcgggtgcgttcatgggtggtgctagcgtctcgccttccctggtcaccattttactggggg

SEQ ID NO: 94200 - DNA, 75 bp, Artificial Sequence
  Synthetic
tggtcttgatcttggcgggtgcgttcatgggtggtgctagcgtctcgccttccctggtcaccattttactggggg

SEQ ID NO: 94201 - DNA, 75 bp, Artificial Sequence
  Synthetic
tggtcttgatcctggcgggtgcgttcatgggtggtgctagcgtctcgccttccctggtcaccattttactggggg

SEQ ID NO: 94202 - DNA, 75 bp, Artificial Sequence
  Synthetic
tggtcttgatcgtggcgggtgcgttcatgggtggtgctagcgtctcgccttccctggtcaccattttactggggg

SEQ ID NO: 94203 - DNA, 75 bp, Artificial Sequence
  Synthetic
tggtcttgaccatggcgggtgcgttcatgggtggtgctagcgtctcgccttccctggtcaccattttactggggg

SEQ ID NO: 94204 - DNA, 75 bp, Artificial Sequence
  Synthetic
tggtcttgaccttggcgggtgcgttcatgggtggtgctagcgtctcgccttccctggtcaccattttactggggg

SEQ ID NO: 94205 - DNA, 75 bp, Artificial Sequence
  Synthetic
tggtcttgaccctggcgggtgcgttcatgggtggtgctagcgtctcgccttccctggtcaccattttactggggg

SEQ ID NO: 94206 - DNA, 75 bp, Artificial Sequence
  Synthetic
tggtcttgaccgtggcgggtgcgttcatgggtggtgctagcgtctcgccttccctggtcaccattttactggggg

SEQ ID NO: 94207 - DNA, 75 bp, Artificial Sequence
  Synthetic
tggtcttgagcatggcgggtgcgttcatgggtggtgctagcgtctcgccttccctggtcaccattttactggggg

SEQ ID NO: 94208 - DNA, 75 bp, Artificial Sequence
  Synthetic
tggtcttgagcttggcgggtgcgttcatgggtggtgctagcgtctcgccttccctggtcaccattttactggggg

SEQ ID NO: 94209 - DNA, 75 bp, Artificial Sequence
  Synthetic
tggtcttgagcctggcgggtgcgttcatgggtggtgctagcgtctcgccttccctggtcaccattttactggggg

SEQ ID NO: 94210 - DNA, 75 bp, Artificial Sequence
  Synthetic
tggtcttgagcgtggcgggtgcgttcatgggtggtgctagcgtctcgccttccctggtcaccattttactggggg

SEQ ID NO: 94211 - DNA, 75 bp, Artificial Sequence
  Synthetic
tggccttgaacatggcgggtgcgttcatgggtggtgctagcgtctcgccttccctggtcaccattttactggggg

SEQ ID NO: 94212 - DNA, 75 bp, Artificial Sequence
  Synthetic
tggccttgaacttggcgggtgcgttcatgggtggtgctagcgtctcgccttccctggtcaccattttactggggg

SEQ ID NO: 94213 - DNA, 75 bp, Artificial Sequence
  Synthetic
tggccttgaacctggcgggtgcgttcatgggtggtgctagcgtctcgccttccctggtcaccattttactggggg

SEQ ID NO: 94214 - DNA, 75 bp, Artificial Sequence
  Synthetic
tggccttgaacgtggcgggtgcgttcatgggtggtgctagcgtctcgccttccctggtcaccattttactggggg

SEQ ID NO: 94215 - DNA, 75 bp, Artificial Sequence
  Synthetic
tggccttgatcatggcgggtgcgttcatgggtggtgctagcgtctcgccttccctggtcaccattttactggggg

SEQ ID NO: 94216 - DNA, 75 bp, Artificial Sequence
  Synthetic
tggccttgatcttggcgggtgcgttcatgggtggtgctagcgtctcgccttccctggtcaccattttactggggg

SEQ ID NO: 94217 - DNA, 75 bp, Artificial Sequence
  Synthetic
tggccttgatcctggcgggtgcgttcatgggtggtgctagcgtctcgccttccctggtcaccattttactggggg

SEQ ID NO: 94218 - DNA, 75 bp, Artificial Sequence
  Synthetic
tggccttgatcgtggcgggtgcgttcatgggtggtgctagcgtctcgccttccctggtcaccattttactggggg

SEQ ID NO: 94219 - DNA, 75 bp, Artificial Sequence
  Synthetic
tggccttgaccatggcgggtgcgttcatgggtggtgctagcgtctcgccttccctggtcaccattttactggggg

SEQ ID NO: 94220 - DNA, 75 bp, Artificial Sequence
  Synthetic
tggccttgaccttggcgggtgcgttcatgggtggtgctagcgtctcgccttccctggtcaccattttactggggg

SEQ ID NO: 94221 - DNA, 75 bp, Artificial Sequence
  Synthetic
tggccttgaccctggcgggtgcgttcatgggtggtgctagcgtctcgccttccctggtcaccattttactggggg

SEQ ID NO: 94222 - DNA, 75 bp, Artificial Sequence
  Synthetic
tggccttgaccgtggcgggtgcgttcatgggtggtgctagcgtctcgccttccctggtcaccattttactggggg

SEQ ID NO: 94223 - DNA, 75 bp, Artificial Sequence
  Synthetic
tggccttgagcatggcgggtgcgttcatgggtggtgctagcgtctcgccttccctggtcaccattttactggggg

SEQ ID NO: 94224 - DNA, 75 bp, Artificial Sequence
  Synthetic
tggccttgagcttggcgggtgcgttcatgggtggtgctagcgtctcgccttccctggtcaccattttactggggg

SEQ ID NO: 94225 - DNA, 75 bp, Artificial Sequence
  Synthetic
tggccttgagcctggcgggtgcgttcatgggtggtgctagcgtctcgccttccctggtcaccattttactggggg

SEQ ID NO: 94226 - DNA, 75 bp, Artificial Sequence
  Synthetic
tggccttgagcgtggcgggtgcgttcatgggtggtgctagcgtctcgccttccctggtcaccattttactggggg

SEQ ID NO: 94227 - DNA, 75 bp, Artificial Sequence
  Synthetic
tgggcttgaacatggcgggtgcgttcatgggtggtgctagcgtctcgccttccctggtcaccattttactggggg

SEQ ID NO: 94228 - DNA, 75 bp, Artificial Sequence
  Synthetic
tgggcttgaacttggcgggtgcgttcatgggtggtgctagcgtctcgccttccctggtcaccattttactggggg

SEQ ID NO: 94229 - DNA, 75 bp, Artificial Sequence
  Synthetic
tgggcttgaacctggcgggtgcgttcatgggtggtgctagcgtctcgccttccctggtcaccattttactggggg

SEQ ID NO: 94230 - DNA, 75 bp, Artificial Sequence
  Synthetic
tgggcttgaacgtggcgggtgcgttcatgggtggtgctagcgtctcgccttccctggtcaccattttactggggg

SEQ ID NO: 94231 - DNA, 75 bp, Artificial Sequence
  Synthetic
tgggcttgatcatggcgggtgcgttcatgggtggtgctagcgtctcgccttccctggtcaccattttactggggg

SEQ ID NO: 94232 - DNA, 75 bp, Artificial Sequence
  Synthetic
tgggcttgatcttggcgggtgcgttcatgggtggtgctagcgtctcgccttccctggtcaccattttactggggg

SEQ ID NO: 94233 - DNA, 75 bp, Artificial Sequence
  Synthetic
tgggcttgatcctggcgggtgcgttcatgggtggtgctagcgtctcgccttccctggtcaccattttactggggg

SEQ ID NO: 94234 - DNA, 75 bp, Artificial Sequence
  Synthetic
tgggcttgatcgtggcgggtgcgttcatgggtggtgctagcgtctcgccttccctggtcaccattttactggggg

SEQ ID NO: 94235 - DNA, 75 bp, Artificial Sequence
  Synthetic
tgggcttgaccatggcgggtgcgttcatgggtggtgctagcgtctcgccttccctggtcaccattttactggggg

SEQ ID NO: 94236 - DNA, 75 bp, Artificial Sequence
  Synthetic
tgggcttgaccttggcgggtgcgttcatgggtggtgctagcgtctcgccttccctggtcaccattttactggggg

SEQ ID NO: 94237 - DNA, 75 bp, Artificial Sequence
  Synthetic
tgggcttgaccctggcgggtgcgttcatgggtggtgctagcgtctcgccttccctggtcaccattttactggggg

SEQ ID NO: 94238 - DNA, 75 bp, Artificial Sequence
  Synthetic
tgggcttgaccgtggcgggtgcgttcatgggtggtgctagcgtctcgccttccctggtcaccattttactggggg

SEQ ID NO: 94239 - DNA, 75 bp, Artificial Sequence
  Synthetic
tgggcttgagcatggcgggtgcgttcatgggtggtgctagcgtctcgccttccctggtcaccattttactggggg

SEQ ID NO: 94240 - DNA, 75 bp, Artificial Sequence
  Synthetic
tgggcttgagcttggcgggtgcgttcatgggtggtgctagcgtctcgccttccctggtcaccattttactggggg

SEQ ID NO: 94241 - DNA, 75 bp, Artificial Sequence
  Synthetic
tgggcttgagcctggcgggtgcgttcatgggtggtgctagcgtctcgccttccctggtcaccattttactggggg

SEQ ID NO: 94242 - DNA, 75 bp, Artificial Sequence
  Synthetic
tgggcttgagcgtggcgggtgcgttcatgggtggtgctagcgtctcgccttccctggtcaccattttactggggg

SEQ ID NO: 94243 - DNA, 75 bp, Artificial Sequence
  Synthetic
ccgtgggaggttgggagggcgtcgtcaaagcggcaagccttgtcttcgacttcatggcggggaaactctcttcag

SEQ ID NO: 94244 - DNA, 75 bp, Artificial Sequence
  Synthetic
ccgtgggaggttgggagggcgtcgtcaaagcggctagccttgtcttcgacttcatggcggggaaactctcttcag

SEQ ID NO: 94245 - DNA, 75 bp, Artificial Sequence
  Synthetic
ccgtgggaggttgggagggcgtcgtcaaagcggccagccttgtcttcgacttcatggcggggaaactctcttcag

SEQ ID NO: 94246 - DNA, 75 bp, Artificial Sequence
  Synthetic
ccgtgggaggttgggagggcgtcgtcaaagcggcgagccttgtcttcgacttcatggcggggaaactctcttcag

SEQ ID NO: 94247 - DNA, 75 bp, Artificial Sequence
  Synthetic
ccgtgggaggttgggagggcgtcgtcaatgcggcaagccttgtcttcgacttcatggcggggaaactctcttcag

SEQ ID NO: 94248 - DNA, 75 bp, Artificial Sequence
  Synthetic
ccgtgggaggttgggagggcgtcgtcaatgcggctagccttgtcttcgacttcatggcggggaaactctcttcag

SEQ ID NO: 94249 - DNA, 75 bp, Artificial Sequence
  Synthetic
ccgtgggaggttgggagggcgtcgtcaatgcggccagccttgtcttcgacttcatggcggggaaactctcttcag

SEQ ID NO: 94250 - DNA, 75 bp, Artificial Sequence
  Synthetic
ccgtgggaggttgggagggcgtcgtcaatgcggcgagccttgtcttcgacttcatggcggggaaactctcttcag

SEQ ID NO: 94251 - DNA, 75 bp, Artificial Sequence
  Synthetic
ccgtgggaggttgggagggcgtcgtcaacgcggcaagccttgtcttcgacttcatggcggggaaactctcttcag

SEQ ID NO: 94252 - DNA, 75 bp, Artificial Sequence
  Synthetic
ccgtgggaggttgggagggcgtcgtcaacgcggctagccttgtcttcgacttcatggcggggaaactctcttcag

SEQ ID NO: 94253 - DNA, 75 bp, Artificial Sequence
  Synthetic
ccgtgggaggttgggagggcgtcgtcaacgcggccagccttgtcttcgacttcatggcggggaaactctcttcag

SEQ ID NO: 94254 - DNA, 75 bp, Artificial Sequence
  Synthetic
ccgtgggaggttgggagggcgtcgtcaacgcggcgagccttgtcttcgacttcatggcggggaaactctcttcag

SEQ ID NO: 94255 - DNA, 75 bp, Artificial Sequence
  Synthetic
ccgtgggaggttgggagggcgtcgtcaaggcggcaagccttgtcttcgacttcatggcggggaaactctcttcag

SEQ ID NO: 94256 - DNA, 75 bp, Artificial Sequence
  Synthetic
ccgtgggaggttgggagggcgtcgtcaaggcggctagccttgtcttcgacttcatggcggggaaactctcttcag

SEQ ID NO: 94257 - DNA, 75 bp, Artificial Sequence
  Synthetic
ccgtgggaggttgggagggcgtcgtcaaggcggccagccttgtcttcgacttcatggcggggaaactctcttcag

SEQ ID NO: 94258 - DNA, 75 bp, Artificial Sequence
  Synthetic
ccgtgggaggttgggagggcgtcgtcaaggcggcgagccttgtcttcgacttcatggcggggaaactctcttcag

SEQ ID NO: 94259 - DNA, 75 bp, Artificial Sequence
  Synthetic
gacagtgacagatgcggtggcagccatccaggtgaactgtgattggtcagtcatgaccctgtcgatcggggaagt

SEQ ID NO: 94260 - DNA, 75 bp, Artificial Sequence
  Synthetic
taccacttggttgaaccgtctgctgacaacattgccgaggtcgtcgtgtatcccagacagttattttcagcaggc

SEQ ID NO: 94261 - DNA, 75 bp, Artificial Sequence
  Synthetic
gacgcgggccgtccccacagtttcaattgtggacaagctcttcgccggagggtgggctgcggtcgtgggccactg

SEQ ID NO: 94262 - DNA, 75 bp, Artificial Sequence
  Synthetic
gcacagtggtggccctggtcaacagggagcctaaggtggatgaggtccaggtggggtacgtctgggacttgtggg

SEQ ID NO: 94263 - DNA, 75 bp, Artificial Sequence
  Synthetic
gcactgtggtggccctggtcaacagggagcctaaggtggatgaggtccaggtggggtacgtctgggacttgtggg

SEQ ID NO: 94264 - DNA, 75 bp, Artificial Sequence
  Synthetic
gcaccgtggtggccctggtcaacagggagcctaaggtggatgaggtccaggtggggtacgtctgggacttgtggg

SEQ ID NO: 94265 - DNA, 75 bp, Artificial Sequence
  Synthetic
gcacggtggtggccctggtcaacagggagcctaaggtggatgaggtccaggtggggtacgtctgggacttgtggg

SEQ ID NO: 94266 - DNA, 75 bp, Artificial Sequence
  Synthetic
gctgcctacggggcttctcggagtcccccgttggcggcggctgcgtcctatctgatggggttgggcgttggaggc

SEQ ID NO: 94267 - DNA, 75 bp, Artificial Sequence
  Synthetic
tgcccttggaacccccgtggttggtttaaccatggcgggggctttcatgggcggggccagcgtctccccctcgct

SEQ ID NO: 94268 - DNA, 75 bp, Artificial Sequence
  Synthetic
ggcattgcggggagggatggtccggagaatggttgttggacggtcatgttgagagtcgctgcctctgcggctgcg

SEQ ID NO: 94269 - DNA, 75 bp, Artificial Sequence
  Synthetic
agaatggttgttggacggtcatgttgagagtcgctgcctctgcggctgcgtgataactggtgatgttctgaatgg

SEQ ID NO: 94270 - DNA, 75 bp, Artificial Sequence
  Synthetic
ggtcactgtcctcttaggggcagtgggcggctgggagggcgttgtcaacgctgctagcctagtcttcgactttat

SEQ ID NO: 94271 - DNA, 75 bp, Artificial Sequence
  Synthetic
ctagccctggggcgggccttgcggggatcgccctggggttggtcttgtactcagccaacaactctggcactacca

SEQ ID NO: 94272 - DNA, 75 bp, Artificial Sequence
  Synthetic
gggctacggtgaaacatcgcctctcctggcctctgacaccccgaaggtagtacctttcgggacgtctggctgggc

SEQ ID NO: 94273 - DNA, 75 bp, Artificial Sequence
  Synthetic
gcttccccggtcctcatgcatccccgacagctatttccaacaggccgactactgtgacaaggtctcagccatgct

SEQ ID NO: 94274 - DNA, 75 bp, Artificial Sequence
  Synthetic
acaagttgttgcgccagcagatcctatcggctgctgtagctgagccctattacgttgatggcatcccggtctcgt

SEQ ID NO: 94275 - DNA, 75 bp, Artificial Sequence
  Synthetic
gtggttgccctggtcaacagggagcctaaggtcgatgaggtccaggtcggatatgtttgggatctgtgggagtgg

SEQ ID NO: 94276 - DNA, 75 bp, Artificial Sequence
  Synthetic
accgttccggtcaacatgttgggttatggggaaacatcgcccctcctggcctcagatacgccgaaggtagtccct

SEQ ID NO: 94277 - DNA, 75 bp, Artificial Sequence
  Synthetic
tctgactcattcgaagtcatccaagagtctgagacagccgaaggggaggaaagtgtcttcaacgtggctctttcc

SEQ ID NO: 94278 - DNA, 75 bp, Artificial Sequence
  Synthetic
tggccccctctgaggtttcatcagaggtcagcatcgagattgggacggagactgaagactcagaactgactgagg

SEQ ID NO: 94279 - DNA, 75 bp, Artificial Sequence
  Synthetic
gttggtggctgacactactaaggtgtatgtcaccaacccagacaatgttgggaggagggtagacaaggtgacctt

SEQ ID NO: 94280 - DNA, 75 bp, Artificial Sequence
  Synthetic
cccgcactccatcgcctgcacttatctcggttacggagagcagctcagatgagaagaccccgtcggtgtcttcct

SEQ ID NO: 94281 - DNA, 75 bp, Artificial Sequence
  Synthetic
gccacacgtaagctaactgttaagatgtcatgctgcgtggagaagagcgtcacgcgcttcttttccttggggttg

SEQ ID NO: 94282 - DNA, 75 bp, Artificial Sequence
  Synthetic
cacgcgcttcttttccttggggttgacagtggctgacgtggctagcctgtgtgagatggaaatccagaaccatac

SEQ ID NO: 94283 - DNA, 75 bp, Artificial Sequence
  Synthetic
tgtgtggatgccacgtgcttcgacagtagcataactgaagaggacgtggcattggagacggaactatatgctctg

SEQ ID NO: 94284 - DNA, 75 bp, Artificial Sequence
  Synthetic
atgtgacaagtgtgaggccaggcaggagaccttggcgtccttctcctacatatggtctggggtaccgctgactcg

SEQ ID NO: 94285 - DNA, 75 bp, Artificial Sequence
  Synthetic
attggagacggaactatatgctctggcctccgaccatccagagtgggtgcgggccctggggaaatactatgcttc

SEQ ID NO: 94286 - DNA, 75 bp, Artificial Sequence
  Synthetic
gcctccgaccatccagagtgggtgcgggccctggggaaatactatgcttctggtaccatggtgaccccggagggg

SEQ ID NO: 94287 - DNA, 75 bp, Artificial Sequence
  Synthetic
tggcggacactaccaaagtgtatgtgaccaacccggacaatgtcgggaggagggttgacaaggtgaccttctggc

SEQ ID NO: 94288 - DNA, 75 bp, Artificial Sequence
  Synthetic
gcatgggttacacttatgaggaggcaataaggactgttaggccgcatgctgccatgggctggggatctaaggtgt

SEQ ID NO: 94289 - DNA, 75 bp, Artificial Sequence
  Synthetic
atcctagcgacgccttgggcagagccctggcgagctatgggtatgcgtgcgagccttcgtatcatgcatcattgg

SEQ ID NO: 94290 - DNA, 75 bp, Artificial Sequence
  Synthetic
gatagctgaaaagcttattctgggtgatccggggcgggttgccaaggcggtgttggggggggcctatgccttcca

SEQ ID NO: 94291 - DNA, 75 bp, Artificial Sequence
  Synthetic
tcgtggccctccacggaccagcagcgttgagggttaccgcagacacaactaaaacaaaaatggaggctggtaagg

SEQ ID NO: 94292 - DNA, 75 bp, Artificial Sequence
  Synthetic
gttgagggttaccgcagacacaactaaaacaaaaatggaggctggtaaggtgctgagcgacctcaagctccctgg

SEQ ID NO: 94293 - DNA, 75 bp, Artificial Sequence
  Synthetic
ggtgaaagccgcctgcgaacgggtggggctcaaaaacgtgtccctcctaatcgcgggcgatgactgtctgatcat

SEQ ID NO: 94294 - DNA, 75 bp, Artificial Sequence
  Synthetic
gggctcaaaaacgtgtccctcctaatcgcgggcgatgactgtctgatcatatgtgagaggcctatgtgcgatccc

SEQ ID NO: 94295 - DNA, 75 bp, Artificial Sequence
  Synthetic
gcccccttctgctccacttggctagccgagtgcaatgcagatgggaagcgccatttcttcctgaccacggacttt

SEQ ID NO: 94296 - DNA, 75 bp, Artificial Sequence
  Synthetic
cggagagcgaacgcttggccggccagttttccgcgaggggggtcaatgccatagcctactacaggggtaaggaca

SEQ ID NO: 94297 - DNA, 75 bp, Artificial Sequence
  Synthetic
cggagtgcgaacgcttggccggccagttttccgcgaggggggtcaatgccatagcctactacaggggtaaggaca

SEQ ID NO: 94298 - DNA, 75 bp, Artificial Sequence
  Synthetic
cggagcgcgaacgcttggccggccagttttccgcgaggggggtcaatgccatagcctactacaggggtaaggaca

SEQ ID NO: 94299 - DNA, 75 bp, Artificial Sequence
  Synthetic
cggagggcgaacgcttggccggccagttttccgcgaggggggtcaatgccatagcctactacaggggtaaggaca

SEQ ID NO: 94300 - DNA, 75 bp, Artificial Sequence
  Synthetic
gcggtgttggggggggcctatgccttccagtacaccccaaaccagcgcgttagggagatgctcaagctatgggag

SEQ ID NO: 94301 - DNA, 75 bp, Artificial Sequence
  Synthetic
aagccccagaaaccgacgcctatctaagtagacgcaatgactcggcgccgactcggcgaccggccaaaaggtggt

SEQ ID NO: 94302 - DNA, 75 bp, Artificial Sequence
  Synthetic
atttcacagcccagcggagtcgttggcggtggttggggttcttagccctgctcatcgtagcgctctttgggtgaa

SEQ ID NO: 94303 - DNA, 75 bp, Artificial Sequence
  Synthetic
accgagcccgttacccacctgggcaaacgacgcccacgtacggtccacgtcgcccttcaatgtctctcttgacca

SEQ ID NO: 94304 - DNA, 75 bp, Artificial Sequence
  Synthetic
acgggcccttgtcggtctcggcctacgtggctgggatcctgggcctgggcgaggtttactcgggtgtcctaacgg

SEQ ID NO: 94305 - DNA, 75 bp, Artificial Sequence
  Synthetic
cgaatgggcaatatttcctcacaaactgttgcgccatggaggacatagggttctgcctggaaggtggatgccttg

SEQ ID NO: 94306 - DNA, 75 bp, Artificial Sequence
  Synthetic
gcagtagagtgtgagcttaagtgggaaagtgagttttggagatggactgaacagttggcctccaattactggatt

SEQ ID NO: 94307 - DNA, 75 bp, Artificial Sequence
  Synthetic
cgaccgctgctggccactgtatcaggcgggtttagccgtgcggcccggcaagtccgccgcccagttggtggggga

SEQ ID NO: 94308 - DNA, 75 bp, Artificial Sequence
  Synthetic
actcggtagcctctacgggcccttgtcggtgtcagcctatgtggctggcatcctcgggctcggggaggtctactc

SEQ ID NO: 94309 - DNA, 75 bp, Artificial Sequence
  Synthetic
ttgacttctggaggggcgtgatgagcctgacccctctgttggtctgtgtggccgctctgctgctgcttgagcaaa

SEQ ID NO: 94310 - DNA, 75 bp, Artificial Sequence
  Synthetic
aggtgtgggaccgcgggaatgtcacgcttctgtgtgattgccccaacggaccatgggtgtggttaccggctttct

SEQ ID NO: 94311 - DNA, 75 bp, Artificial Sequence
  Synthetic
cctgctcgagcaaaggattgtcatggtcttcctgctcgtgaccatggcggggatgtcgcaaggcgcccccgcctc

SEQ ID NO: 94312 - DNA, 75 bp, Artificial Sequence
  Synthetic
gtcttcctgctcgtgaccatggcggggatgtcgcaaggcgcccccgcctcggttttggggtcacgccccttcgag

SEQ ID NO: 94313 - DNA, 75 bp, Artificial Sequence
  Synthetic
ggatgtcgcaaggcgcccccgcctcggttttggggtcacgccccttcgagcctggacttacgtggcagtcctgct

SEQ ID NO: 94314 - DNA, 75 bp, Artificial Sequence
  Synthetic
acccacgggggagcgggtttgggaccgagggaacgtcacactgttgtgtgattgccccaacggcccctgggtttg

SEQ ID NO: 94315 - DNA, 75 bp, Artificial Sequence
  Synthetic
ggtgccagttggttctgccacttgcaccatagccgctctcgggtcgtcggaccgcgatacggtggtggagctctc

SEQ ID NO: 94316 - DNA, 75 bp, Artificial Sequence
  Synthetic
ggagccacggacaaaatcagtggcccctctcgtgtccccagtatgtctatggtgctgtttcagtgacctgcgtgt

SEQ ID NO: 94317 - DNA, 75 bp, Artificial Sequence
  Synthetic
gatgtgtggagtttggtgccagttggctctgccagctgcaccatagccgctctcggctcatcggaccgcgactct

SEQ ID NO: 94318 - DNA, 75 bp, Artificial Sequence
  Synthetic
ggctctcctcgggcaggcctgatgggttcatacatgtccagggccacttgcaggaggtggatgcaggcaacttca

SEQ ID NO: 94319 - DNA, 75 bp, Artificial Sequence
  Synthetic
tggtcccgctgatcttgcttctgctgtggtggtgggtgaaccagctggcggttttaggactgccggctgtggacg

SEQ ID NO: 94320 - DNA, 75 bp, Artificial Sequence
  Synthetic
ccgccgtagcaggtgaggtctttgcgggccctgccctgtcctggtgtctgggactcccgactgtcagtatgatac

SEQ ID NO: 94321 - DNA, 75 bp, Artificial Sequence
  Synthetic
tgggtggtggccagcgtggtggcttgggccatagcgctcctgagctcgatgagcgcaggggggtggaggcacaaa

SEQ ID NO: 94322 - DNA, 75 bp, Artificial Sequence
  Synthetic
gagcgcaggggggtggaggcacaaagccgtgatctataggacgtggtgtaaagggtaccaggctatacgccagag

SEQ ID NO: 94323 - DNA, 75 bp, Artificial Sequence
  Synthetic
tcgcttggtgcttggcctcgtacatctggccggatgctgtgatgatggtggtggtcgccttggtcttactctttg

SEQ ID NO: 94324 - DNA, 75 bp, Artificial Sequence
  Synthetic
cgtcggtcctgggatgggtggtggccagcgtggtagcctgggccatagcgctcttgagctccatgagcgcagggg

SEQ ID NO: 94325 - DNA, 75 bp, Artificial Sequence
  Synthetic
gcattgcgtcagcgggtggttcggagcccactcggggaggggcgacctacgaaaccgctgacaatagcttggtgc

SEQ ID NO: 94326 - DNA, 75 bp, Artificial Sequence
  Synthetic
gtctccaagatgtgcgcgagaggggcctacttgttcgatcatatgggctcattttcgcgcgctgtcaaggagcgc

SEQ ID NO: 94327 - DNA, 75 bp, Artificial Sequence
  Synthetic
gcccactcggggaggggcgacctacgaaaccgctgacaatagcttggtgcttggcttcctacatctggcctgacg

SEQ ID NO: 94328 - DNA, 75 bp, Artificial Sequence
  Synthetic
gcgttggattgggccttggaggagctgctggtctccagaccttcgttgcggcgcctggcacgggtggtggaatgc

SEQ ID NO: 94329 - DNA, 75 bp, Artificial Sequence
  Synthetic
tgtgtgatggctggtgagagggctactaccatcaggctcgtgtccaaaatgtgcgcgaggggggcctacttgttt

SEQ ID NO: 94330 - DNA, 75 bp, Artificial Sequence
  Synthetic
aggtcctgatcggagtctttcaggatgtgaatcatttgcctccgggattcgtcccgaccgcgccggttgtcatcc

SEQ ID NO: 94331 - DNA, 75 bp, Artificial Sequence
  Synthetic
tgtcacaaaggctgccttgactggtcgggaccccgacttacatccagggaacgtcatggtgttgggaacggcgac

SEQ ID NO: 94332 - DNA, 75 bp, Artificial Sequence
  Synthetic
ctgttgggtcatcagatctgacggggctttatgccatggcttgagcaagggggacaaggtagagctggatgtagc

SEQ ID NO: 94333 - DNA, 75 bp, Artificial Sequence
  Synthetic
acgaagggcacgcagtaggaatgctcgtgtcagtgctccattcggcgggagaagtcaccgcggctcgatttacta

SEQ ID NO: 94334 - DNA, 75 bp, Artificial Sequence
  Synthetic
tgccaggctgagtcctgttgggtcattagatccgacggggctttatgccatggtttgagcaagggagataaggtg

SEQ ID NO: 94335 - DNA, 75 bp, Artificial Sequence
  Synthetic
ttagatccgacggggctttatgccatggtttgagcaagggagataaggtggaactggacgtggccatggaggtct

SEQ ID NO: 94336 - DNA, 75 bp, Artificial Sequence
  Synthetic
aaagggagtattcaaggaggccccgttgtttatgccaacgggggccggaaagagcactcgggtccccttggagta

SEQ ID NO: 94337 - DNA, 75 bp, Artificial Sequence
  Synthetic
taggcagatgctacggggtgtatcggtggtcatctgtgatgagtgccacagccatgactcaaccgtgctgctggg

SEQ ID NO: 94338 - DNA, 75 bp, Artificial Sequence
  Synthetic
ttgtttatgccaacgggggccggaaagagcactcgggtccccttggagtatggcaacatgggtcacaaagtcctt

SEQ ID NO: 94339 - DNA, 75 bp, Artificial Sequence
  Synthetic
gtggtcatctgtgatgagtgccacagccatgactcaaccgtgctgctgggcattgggagggtccgggagctggcg

SEQ ID NO: 94340 - DNA, 75 bp, Artificial Sequence
  Synthetic
gcgactggcgggtaagcatccaagcatttactgtggacacgacacaacagcattcactaggatcactgactcgcc

SEQ ID NO: 94341 - DNA, 75 bp, Artificial Sequence
  Synthetic
ttcccccatgacacagcacccttctataattgagacaaagctggatgtgggtgagatccccttttatgggcatgg

SEQ ID NO: 94342 - DNA, 75 bp, Artificial Sequence
  Synthetic
atttactgtggacacgacacaacagcattcactaggatcactgactcgcccttgacgtactctacttatgggagg

SEQ ID NO: 94343 - DNA, 75 bp, Artificial Sequence
  Synthetic
ataattgagacaaagctggatgtgggtgagatccccttttatgggcatggcatacccctcgaacggatgcgaacc

SEQ ID NO: 94344 - DNA, 75 bp, Artificial Sequence
  Synthetic
tgatgagtgtcacagtcatgactcgacggtgctgctgggaataggacgagtcagggagctggcacgtggttgcgg

SEQ ID NO: 94345 - DNA, 75 bp, Artificial Sequence
  Synthetic
cggccagttctccgcgaggggggtaaatgctattgcttattatagggggaaagacagttccatcattcaggacgg

SEQ ID NO: 94346 - DNA, 75 bp, Artificial Sequence
  Synthetic
acggtgctgctgggaataggacgagtcagggagctggcacgtggttgcggggtccaactggtcctctacgccact

SEQ ID NO: 94347 - DNA, 75 bp, Artificial Sequence
  Synthetic
caaactggacgtgggtgagattcccttttatgggcatggcatccccttggagcggatgcgcaccggtaggcatct

SEQ ID NO: 94348 - DNA, 75 bp, Artificial Sequence
  Synthetic
cctctaggggggtaaatgctatagcctattacagggggaaggacagttccatcattaaggacggagacctcgtgg

SEQ ID NO: 94349 - DNA, 75 bp, Artificial Sequence
  Synthetic
tcaggtcctgtctggtcggcggtggaagccggagtgacctggtacggaatggaacctgacctgacagctaaccta

SEQ ID NO: 94350 - DNA, 75 bp, Artificial Sequence
  Synthetic
gtcaccgattgtgggctagtggtggaggaggtcgttgaggtgacccttgatcccaccattaccatctccttgcgc

SEQ ID NO: 94351 - DNA, 75 bp, Artificial Sequence
  Synthetic
tagagggcggtccggccgatactactacgctggcgttggtaaggcgccagcgggggtggtgcggtccgggccggt

SEQ ID NO: 94352 - DNA, 75 bp, Artificial Sequence
  Synthetic
tgacccccaatgggcaggtctgaagggcccgaatcctgtcccactactgctgaggtggggcaatgatttaccatc

SEQ ID NO: 94353 - DNA, 75 bp, Artificial Sequence
  Synthetic
ggtggtgacagactgggatgtgaaggggggtggcgcccccctttatcggcatggagaccaggccacgccacaacc

SEQ ID NO: 94354 - DNA, 75 bp, Artificial Sequence
  Synthetic
agtgatttgccgtcaagagtggccggccaccacattgtggacgacctggtcaggaggctcggtgtggcggagggt

SEQ ID NO: 94355 - DNA, 75 bp, Artificial Sequence
  Synthetic
catcggacgccaagacagtgacagatgcggtggcagccatccaggtggattgcgattggtcagttatgactctgt

SEQ ID NO: 94356 - DNA, 75 bp, Artificial Sequence
  Synthetic
gcttctaggagcccgccgttggcagccgcggcttcctacctgatggggttgggcgtcggaggcaacgcccaaacg

SEQ ID NO: 94357 - DNA, 75 bp, Artificial Sequence
  Synthetic
caagtggcttgctggctgctacacggggacgcgggccgtccccactgtttcaattgtggacaagctcttcgccgg

SEQ ID NO: 94358 - DNA, 75 bp, Artificial Sequence
  Synthetic
tccggttgtgggtttgaccatggctggggcattcatggggggtgctagcgtctccccctctctggtcaccatcct

SEQ ID NO: 94359 - DNA, 75 bp, Artificial Sequence
  Synthetic
tggcagcttatggggcttcaaggagtcctccgttggctgcggccgcttcctacctaatggggttgggcgtcggag

SEQ ID NO: 94360 - DNA, 75 bp, Artificial Sequence
  Synthetic
gtttgaccatggcgggggctttcatgggcggggccagcgtctccccctcgctggtcacggttctcttgggagccg

SEQ ID NO: 94361 - DNA, 75 bp, Artificial Sequence
  Synthetic
cctgtgggagtggatcatgcgccaggtgcgcatggtcatggctagactcagggccctctgccccgtggtgtcgct

SEQ ID NO: 94362 - DNA, 75 bp, Artificial Sequence
  Synthetic
ctgacagctatttccaacaggccgactactgcgataaggtctcagccatgctccgacgcctgagcctcactcgga

SEQ ID NO: 94363 - DNA, 75 bp, Artificial Sequence
  Synthetic
cgtttccaggctccgggccctctgccccgtagtgtcactacctttgtggcattgtggggaggggtggtccggtga

SEQ ID NO: 94364 - DNA, 75 bp, Artificial Sequence
  Synthetic
ttacggggagacctcacccctgctcgcctctgacacgccaaaggtcgtaccttttggcacgtctgggtgggcgga

SEQ ID NO: 94365 - DNA, 75 bp, Artificial Sequence
  Synthetic
gcgctacaccttgcctcaccagttgaggcttaggaacgtggcgccctctgaggtttcatccgagatgaccattga

SEQ ID NO: 94366 - DNA, 75 bp, Artificial Sequence
  Synthetic
aggtttcatccgagatgaccattgaccttgggacggagactgaagattcagaactgactgaagccgatctgccgc

SEQ ID NO: 94367 - DNA, 75 bp, Artificial Sequence
  Synthetic
ggtctacggtcctggccaaagcgtgaccattgacggggaacgctacaccctcccgcaccagctgcggatgaggaa

SEQ ID NO: 94368 - DNA, 75 bp, Artificial Sequence
  Synthetic
ggggaggaaagtgtcttcaacgtggctctttccgtactaaaagccttatttccacagagcgacgcgaccaggaag

SEQ ID NO: 94369 - DNA, 75 bp, Artificial Sequence
  Synthetic
tccacagagcgacgcgaccaggaagctcaccgtcaagatgtcatgctgtgctgaaaagagcgtcacacgtttttt

SEQ ID NO: 94370 - DNA, 75 bp, Artificial Sequence
  Synthetic
aacttacctttgaatgtgacaagtgtgaggctaggcaagagactttggcctccttctcctacatctggtctggtg

SEQ ID NO: 94371 - DNA, 75 bp, Artificial Sequence
  Synthetic
tgaggctaggcaagagactttggcctccttctcctacatctggtctggtgtgccgctaacgcgggccacgccggc

SEQ ID NO: 94372 - DNA, 75 bp, Artificial Sequence
  Synthetic
ccaaagtgtatgttaccaatccggacaatgtgggaaggagggtggacaaggtgaccttctggcgcgctcctaggg

SEQ ID NO: 94373 - DNA, 75 bp, Artificial Sequence
  Synthetic
cttggtgggcaatgaacttacctttgaatgtgacaagtgtgaggcacggcaagagaccttggcttccttctccta

SEQ ID NO: 94374 - DNA, 75 bp, Artificial Sequence
  Synthetic
ggtggcggacactaccaaggtgtacgtgaccaacccagataatgtggggaggagagttgacaaggtaaccttctg

SEQ ID NO: 94375 - DNA, 75 bp, Artificial Sequence
  Synthetic
gtagccaaggcggtgttggggggggcttacgccttccagtacaccccaaaccagcgagttaaggagatgctcaaa

SEQ ID NO: 94376 - DNA, 75 bp, Artificial Sequence
  Synthetic
catgctacatcaaggtggaagccgcctgtgagagggtgggtctgaaaaatgtctcactcctcattgctggcgatg

SEQ ID NO: 94377 - DNA, 75 bp, Artificial Sequence
  Synthetic
cagcaactgcctgacctgttacattaaagtgaaagccgcttgcgatcgagtgggactcaaaaacgtgtctctctt

SEQ ID NO: 94378 - DNA, 75 bp, Artificial Sequence
  Synthetic
ctagtgaggccttgggcagagccctggcttcatacgggtacgcgtgtgagccctcatatcatgcatcactggaca

SEQ ID NO: 94379 - DNA, 75 bp, Artificial Sequence
  Synthetic
gagagttaccgcagacacaactaagacaaaaatggaggcgggcaaggtcttggccgacctcaagctcccgggctt

SEQ ID NO: 94380 - DNA, 75 bp, Artificial Sequence
  Synthetic
ggtcgctaccttatagcgtaatccgtgactacgggctgctcgcagagccctccccggatggggcacagtgcactg

SEQ ID NO: 94381 - DNA, 75 bp, Artificial Sequence
  Synthetic
tagacgtaatggccccgcgccgaaccggcgaccggccaaaaggtggtggatgggtgatgacagggttggtaggtc

SEQ ID NO: 94382 - DNA, 75 bp, Artificial Sequence
  Synthetic
cccccccggcactgggtgcaagccccagaaaccgacgcctatcttagtagacgcaatgactcggcgccgactcgg

SEQ ID NO: 94383 - DNA, 75 bp, Artificial Sequence
  Synthetic
attttagccccggccacccatgcttgtagcgcgaaagggcaatatttactcacaaactgttgcgccctggaggac

SEQ ID NO: 94384 - DNA, 75 bp, Artificial Sequence
  Synthetic
attttagccccggccacccatgcttgtagcgcgaaagggcaatattttctcacaaactgttgcgccctggaggac

SEQ ID NO: 94385 - DNA, 75 bp, Artificial Sequence
  Synthetic
attttagccccggccacccatgcttgtagcgcgaaagggcaatatttcctcacaaactgttgcgccctggaggac

SEQ ID NO: 94386 - DNA, 75 bp, Artificial Sequence
  Synthetic
attttagccccggccacccatgcttgtagcgcgaaagggcaatatttgctcacaaactgttgcgccctggaggac

SEQ ID NO: 94387 - DNA, 75 bp, Artificial Sequence
  Synthetic
cccttgtcggtctcggcttatgtggccgggatcctggggcttggggaggtctactcgggggtcctcaccgtcggg

SEQ ID NO: 94388 - DNA, 75 bp, Artificial Sequence
  Synthetic
gggagctgggtggcctctacgggcccttatcggtctcagcctacgtggcggggatcttgggcctgggtgaggtat

SEQ ID NO: 94389 - DNA, 75 bp, Artificial Sequence
  Synthetic
tggcctcaaactactggattctggaatacctctggaaggtgcctttcgacttttggcggggagtgatgagcctta

SEQ ID NO: 94390 - DNA, 75 bp, Artificial Sequence
  Synthetic
gttttggagatggactgaacagctggcctccaattactggatcttggaatatctctggaaggtcccatttgattt

SEQ ID NO: 94391 - DNA, 75 bp, Artificial Sequence
  Synthetic
tggcgggcatgtcgcaaggcgcgcccgcctcagtgttggggtcacggcctttcgaggccgggttgacttggcagt

SEQ ID NO: 94392 - DNA, 75 bp, Artificial Sequence
  Synthetic
catggtcttcctgttggtgacgatggctgggatgtcgcaaggcgccccggcctccgtcatggggtctcgcccctt

SEQ ID NO: 94393 - DNA, 75 bp, Artificial Sequence
  Synthetic
tgggaacgtgggaacgtcacacttttgtgtgactgccccaacggtccttgggtgtgggtcccggccctttgccag

SEQ ID NO: 94394 - DNA, 75 bp, Artificial Sequence
  Synthetic
tgtgtgactgccccaacggtccttgggtgtgggtcccggccctttgccaggcaatcggatggggcgaccctatca

SEQ ID NO: 94395 - DNA, 75 bp, Artificial Sequence
  Synthetic
gtattccgaccggggagaaggtgtgggaccgtgggaacgtcacactcttgtgcgactgccccaacggcccctggg

SEQ ID NO: 94396 - DNA, 75 bp, Artificial Sequence
  Synthetic
gtctacggcgccgtttcagtgacctgcgtgtggggttctgtgtcttggtttgcttccactgggggtcgcgactcc

SEQ ID NO: 94397 - DNA, 75 bp, Artificial Sequence
  Synthetic
gcgtgtggggttctgtgtcttggtttgcttccactgggggtcgcgactccaaggttgatgtgtggagtttggttc

SEQ ID NO: 94398 - DNA, 75 bp, Artificial Sequence
  Synthetic
gatcgatgtgtggagtttggtgccagttggctctgccacctgcaccatagccgcactcgggtcatcggatcgcga

SEQ ID NO: 94399 - DNA, 75 bp, Artificial Sequence
  Synthetic
gacacagtggttgagctctccgagtggggaattccctgcgccacttgtatcctggacaggcggcctgcctcgtgt

SEQ ID NO: 94400 - DNA, 75 bp, Artificial Sequence
  Synthetic
cacggtggttgagctctccgagtgggggatcccgtgcgtgacgtgtattctggaccgtcggcctgcctcttgcgg

SEQ ID NO: 94401 - DNA, 75 bp, Artificial Sequence
  Synthetic
ccgagaccgggtcggtacgtttcccattccacaggtgtggcgcgggaccgaggctgaccagagaccttgaggctg

SEQ ID NO: 94402 - DNA, 75 bp, Artificial Sequence
  Synthetic
gtttgggttcttcccaggagtccccccccttaacaactgcatgcttctcggcactgaggtgtcagaggtattggg

SEQ ID NO: 94403 - DNA, 75 bp, Artificial Sequence
  Synthetic
tgaacccctggtgcgcaggtgttcggagctgatgggacgccgcaatccggtttgcccggggtttgcatggctctc

SEQ ID NO: 94404 - DNA, 75 bp, Artificial Sequence
  Synthetic
gaagctggcagaggcacggttggtcccgctgatcctcctcctgctatggtggtgggtgaaccagttggcggtcct

SEQ ID NO: 94405 - DNA, 75 bp, Artificial Sequence
  Synthetic
tagatgctggcaacttcatccctcctcctcgttggttgctcttggactttgtgtttgtcctgttatacctgatga

SEQ ID NO: 94406 - DNA, 75 bp, Artificial Sequence
  Synthetic
ggtgggtgaaccagttggcggtccttgatgtgacggctgcacacgccgccgtggctggagaggtgtttgcgggcc

SEQ ID NO: 94407 - DNA, 75 bp, Artificial Sequence
  Synthetic
ggtgggtgaaccagttggcggtccttgatgtgacggctgctcacgccgccgtggctggagaggtgtttgcgggcc

SEQ ID NO: 94408 - DNA, 75 bp, Artificial Sequence
  Synthetic
ggtgggtgaaccagttggcggtccttgatgtgacggctgcccacgccgccgtggctggagaggtgtttgcgggcc

SEQ ID NO: 94409 - DNA, 75 bp, Artificial Sequence
  Synthetic
ggtgggtgaaccagttggcggtccttgatgtgacggctgcgcacgccgccgtggctggagaggtgtttgcgggcc

SEQ ID NO: 94410 - DNA, 75 bp, Artificial Sequence
  Synthetic
ggtgggtgaaccagttggcggtccttgatgtgtcggctgcacacgccgccgtggctggagaggtgtttgcgggcc

SEQ ID NO: 94411 - DNA, 75 bp, Artificial Sequence
  Synthetic
ggtgggtgaaccagttggcggtccttgatgtgtcggctgctcacgccgccgtggctggagaggtgtttgcgggcc

SEQ ID NO: 94412 - DNA, 75 bp, Artificial Sequence
  Synthetic
ggtgggtgaaccagttggcggtccttgatgtgtcggctgcccacgccgccgtggctggagaggtgtttgcgggcc

SEQ ID NO: 94413 - DNA, 75 bp, Artificial Sequence
  Synthetic
ggtgggtgaaccagttggcggtccttgatgtgtcggctgcgcacgccgccgtggctggagaggtgtttgcgggcc

SEQ ID NO: 94414 - DNA, 75 bp, Artificial Sequence
  Synthetic
ggtgggtgaaccagttggcggtccttgatgtgccggctgcacacgccgccgtggctggagaggtgtttgcgggcc

SEQ ID NO: 94415 - DNA, 75 bp, Artificial Sequence
  Synthetic
ggtgggtgaaccagttggcggtccttgatgtgccggctgctcacgccgccgtggctggagaggtgtttgcgggcc

SEQ ID NO: 94416 - DNA, 75 bp, Artificial Sequence
  Synthetic
ggtgggtgaaccagttggcggtccttgatgtgccggctgcccacgccgccgtggctggagaggtgtttgcgggcc

SEQ ID NO: 94417 - DNA, 75 bp, Artificial Sequence
  Synthetic
ggtgggtgaaccagttggcggtccttgatgtgccggctgcgcacgccgccgtggctggagaggtgtttgcgggcc

SEQ ID NO: 94418 - DNA, 75 bp, Artificial Sequence
  Synthetic
ggtgggtgaaccagttggcggtccttgatgtggcggctgcacacgccgccgtggctggagaggtgtttgcgggcc

SEQ ID NO: 94419 - DNA, 75 bp, Artificial Sequence
  Synthetic
ggtgggtgaaccagttggcggtccttgatgtggcggctgctcacgccgccgtggctggagaggtgtttgcgggcc

SEQ ID NO: 94420 - DNA, 75 bp, Artificial Sequence
  Synthetic
ggtgggtgaaccagttggcggtccttgatgtggcggctgcccacgccgccgtggctggagaggtgtttgcgggcc

SEQ ID NO: 94421 - DNA, 75 bp, Artificial Sequence
  Synthetic
ggtgggtgaaccagttggcggtccttgatgtggcggctgcgcacgccgccgtggctggagaggtgtttgcgggcc

SEQ ID NO: 94422 - DNA, 75 bp, Artificial Sequence
  Synthetic
ggtgggtgaaccagttggcggtccttgttgtgacggctgcacacgccgccgtggctggagaggtgtttgcgggcc

SEQ ID NO: 94423 - DNA, 75 bp, Artificial Sequence
  Synthetic
ggtgggtgaaccagttggcggtccttgttgtgacggctgctcacgccgccgtggctggagaggtgtttgcgggcc

SEQ ID NO: 94424 - DNA, 75 bp, Artificial Sequence
  Synthetic
ggtgggtgaaccagttggcggtccttgttgtgacggctgcccacgccgccgtggctggagaggtgtttgcgggcc

SEQ ID NO: 94425 - DNA, 75 bp, Artificial Sequence
  Synthetic
ggtgggtgaaccagttggcggtccttgttgtgacggctgcgcacgccgccgtggctggagaggtgtttgcgggcc

SEQ ID NO: 94426 - DNA, 75 bp, Artificial Sequence
  Synthetic
ggtgggtgaaccagttggcggtccttgttgtgtcggctgcacacgccgccgtggctggagaggtgtttgcgggcc

SEQ ID NO: 94427 - DNA, 75 bp, Artificial Sequence
  Synthetic
ggtgggtgaaccagttggcggtccttgttgtgtcggctgctcacgccgccgtggctggagaggtgtttgcgggcc

SEQ ID NO: 94428 - DNA, 75 bp, Artificial Sequence
  Synthetic
ggtgggtgaaccagttggcggtccttgttgtgtcggctgcccacgccgccgtggctggagaggtgtttgcgggcc

SEQ ID NO: 94429 - DNA, 75 bp, Artificial Sequence
  Synthetic
ggtgggtgaaccagttggcggtccttgttgtgtcggctgcgcacgccgccgtggctggagaggtgtttgcgggcc

SEQ ID NO: 94430 - DNA, 75 bp, Artificial Sequence
  Synthetic
ggtgggtgaaccagttggcggtccttgttgtgccggctgcacacgccgccgtggctggagaggtgtttgcgggcc

SEQ ID NO: 94431 - DNA, 75 bp, Artificial Sequence
  Synthetic
ggtgggtgaaccagttggcggtccttgttgtgccggctgctcacgccgccgtggctggagaggtgtttgcgggcc

SEQ ID NO: 94432 - DNA, 75 bp, Artificial Sequence
  Synthetic
ggtgggtgaaccagttggcggtccttgttgtgccggctgcccacgccgccgtggctggagaggtgtttgcgggcc

SEQ ID NO: 94433 - DNA, 75 bp, Artificial Sequence
  Synthetic
ggtgggtgaaccagttggcggtccttgttgtgccggctgcgcacgccgccgtggctggagaggtgtttgcgggcc

SEQ ID NO: 94434 - DNA, 75 bp, Artificial Sequence
  Synthetic
ggtgggtgaaccagttggcggtccttgttgtggcggctgcacacgccgccgtggctggagaggtgtttgcgggcc

SEQ ID NO: 94435 - DNA, 75 bp, Artificial Sequence
  Synthetic
ggtgggtgaaccagttggcggtccttgttgtggcggctgctcacgccgccgtggctggagaggtgtttgcgggcc

SEQ ID NO: 94436 - DNA, 75 bp, Artificial Sequence
  Synthetic
ggtgggtgaaccagttggcggtccttgttgtggcggctgcccacgccgccgtggctggagaggtgtttgcgggcc

SEQ ID NO: 94437 - DNA, 75 bp, Artificial Sequence
  Synthetic
ggtgggtgaaccagttggcggtccttgttgtggcggctgcgcacgccgccgtggctggagaggtgtttgcgggcc

SEQ ID NO: 94438 - DNA, 75 bp, Artificial Sequence
  Synthetic
ggtgggtgaaccagttggcggtccttgctgtgacggctgcacacgccgccgtggctggagaggtgtttgcgggcc

SEQ ID NO: 94439 - DNA, 75 bp, Artificial Sequence
  Synthetic
ggtgggtgaaccagttggcggtccttgctgtgacggctgctcacgccgccgtggctggagaggtgtttgcgggcc

SEQ ID NO: 94440 - DNA, 75 bp, Artificial Sequence
  Synthetic
ggtgggtgaaccagttggcggtccttgctgtgacggctgcccacgccgccgtggctggagaggtgtttgcgggcc

SEQ ID NO: 94441 - DNA, 75 bp, Artificial Sequence
  Synthetic
ggtgggtgaaccagttggcggtccttgctgtgacggctgcgcacgccgccgtggctggagaggtgtttgcgggcc

SEQ ID NO: 94442 - DNA, 75 bp, Artificial Sequence
  Synthetic
ggtgggtgaaccagttggcggtccttgctgtgtcggctgcacacgccgccgtggctggagaggtgtttgcgggcc

SEQ ID NO: 94443 - DNA, 75 bp, Artificial Sequence
  Synthetic
ggtgggtgaaccagttggcggtccttgctgtgtcggctgctcacgccgccgtggctggagaggtgtttgcgggcc

SEQ ID NO: 94444 - DNA, 75 bp, Artificial Sequence
  Synthetic
ggtgggtgaaccagttggcggtccttgctgtgtcggctgcccacgccgccgtggctggagaggtgtttgcgggcc

SEQ ID NO: 94445 - DNA, 75 bp, Artificial Sequence
  Synthetic
ggtgggtgaaccagttggcggtccttgctgtgtcggctgcgcacgccgccgtggctggagaggtgtttgcgggcc

SEQ ID NO: 94446 - DNA, 75 bp, Artificial Sequence
  Synthetic
ggtgggtgaaccagttggcggtccttgctgtgccggctgcacacgccgccgtggctggagaggtgtttgcgggcc

SEQ ID NO: 94447 - DNA, 75 bp, Artificial Sequence
  Synthetic
ggtgggtgaaccagttggcggtccttgctgtgccggctgctcacgccgccgtggctggagaggtgtttgcgggcc

SEQ ID NO: 94448 - DNA, 75 bp, Artificial Sequence
  Synthetic
ggtgggtgaaccagttggcggtccttgctgtgccggctgcccacgccgccgtggctggagaggtgtttgcgggcc

SEQ ID NO: 94449 - DNA, 75 bp, Artificial Sequence
  Synthetic
ggtgggtgaaccagttggcggtccttgctgtgccggctgcgcacgccgccgtggctggagaggtgtttgcgggcc

SEQ ID NO: 94450 - DNA, 75 bp, Artificial Sequence
  Synthetic
ggtgggtgaaccagttggcggtccttgctgtggcggctgcacacgccgccgtggctggagaggtgtttgcgggcc

SEQ ID NO: 94451 - DNA, 75 bp, Artificial Sequence
  Synthetic
ggtgggtgaaccagttggcggtccttgctgtggcggctgctcacgccgccgtggctggagaggtgtttgcgggcc

SEQ ID NO: 94452 - DNA, 75 bp, Artificial Sequence
  Synthetic
ggtgggtgaaccagttggcggtccttgctgtggcggctgcccacgccgccgtggctggagaggtgtttgcgggcc

SEQ ID NO: 94453 - DNA, 75 bp, Artificial Sequence
  Synthetic
ggtgggtgaaccagttggcggtccttgctgtggcggctgcgcacgccgccgtggctggagaggtgtttgcgggcc

SEQ ID NO: 94454 - DNA, 75 bp, Artificial Sequence
  Synthetic
ggtgggtgaaccagttggcggtccttggtgtgacggctgcacacgccgccgtggctggagaggtgtttgcgggcc

SEQ ID NO: 94455 - DNA, 75 bp, Artificial Sequence
  Synthetic
ggtgggtgaaccagttggcggtccttggtgtgacggctgctcacgccgccgtggctggagaggtgtttgcgggcc

SEQ ID NO: 94456 - DNA, 75 bp, Artificial Sequence
  Synthetic
ggtgggtgaaccagttggcggtccttggtgtgacggctgcccacgccgccgtggctggagaggtgtttgcgggcc

SEQ ID NO: 94457 - DNA, 75 bp, Artificial Sequence
  Synthetic
ggtgggtgaaccagttggcggtccttggtgtgacggctgcgcacgccgccgtggctggagaggtgtttgcgggcc

SEQ ID NO: 94458 - DNA, 75 bp, Artificial Sequence
  Synthetic
ggtgggtgaaccagttggcggtccttggtgtgtcggctgcacacgccgccgtggctggagaggtgtttgcgggcc

SEQ ID NO: 94459 - DNA, 75 bp, Artificial Sequence
  Synthetic
ggtgggtgaaccagttggcggtccttggtgtgtcggctgctcacgccgccgtggctggagaggtgtttgcgggcc

SEQ ID NO: 94460 - DNA, 75 bp, Artificial Sequence
  Synthetic
ggtgggtgaaccagttggcggtccttggtgtgtcggctgcccacgccgccgtggctggagaggtgtttgcgggcc

SEQ ID NO: 94461 - DNA, 75 bp, Artificial Sequence
  Synthetic
ggtgggtgaaccagttggcggtccttggtgtgtcggctgcgcacgccgccgtggctggagaggtgtttgcgggcc

SEQ ID NO: 94462 - DNA, 75 bp, Artificial Sequence
  Synthetic
ggtgggtgaaccagttggcggtccttggtgtgccggctgcacacgccgccgtggctggagaggtgtttgcgggcc

SEQ ID NO: 94463 - DNA, 75 bp, Artificial Sequence
  Synthetic
ggtgggtgaaccagttggcggtccttggtgtgccggctgctcacgccgccgtggctggagaggtgtttgcgggcc

SEQ ID NO: 94464 - DNA, 75 bp, Artificial Sequence
  Synthetic
ggtgggtgaaccagttggcggtccttggtgtgccggctgcccacgccgccgtggctggagaggtgtttgcgggcc

SEQ ID NO: 94465 - DNA, 75 bp, Artificial Sequence
  Synthetic
ggtgggtgaaccagttggcggtccttggtgtgccggctgcgcacgccgccgtggctggagaggtgtttgcgggcc

SEQ ID NO: 94466 - DNA, 75 bp, Artificial Sequence
  Synthetic
ggtgggtgaaccagttggcggtccttggtgtggcggctgcacacgccgccgtggctggagaggtgtttgcgggcc

SEQ ID NO: 94467 - DNA, 75 bp, Artificial Sequence
  Synthetic
ggtgggtgaaccagttggcggtccttggtgtggcggctgctcacgccgccgtggctggagaggtgtttgcgggcc

SEQ ID NO: 94468 - DNA, 75 bp, Artificial Sequence
  Synthetic
ggtgggtgaaccagttggcggtccttggtgtggcggctgcccacgccgccgtggctggagaggtgtttgcgggcc

SEQ ID NO: 94469 - DNA, 75 bp, Artificial Sequence
  Synthetic
ggtgggtgaaccagttggcggtccttggtgtggcggctgcgcacgccgccgtggctggagaggtgtttgcgggcc

SEQ ID NO: 94470 - DNA, 75 bp, Artificial Sequence
  Synthetic
gtgtttgtcctgttatacctgatgaagctggctgaggcacggttggtcccgctaatcttactactgctgtggtgg

SEQ ID NO: 94471 - DNA, 75 bp, Artificial Sequence
  Synthetic
agctggtgaggtgtttgcgggccctgccttgtcctggtgcctggggctcccggtagtcagtatgatactaggttt

SEQ ID NO: 94472 - DNA, 75 bp, Artificial Sequence
  Synthetic
ctagcaaacctggtgttgtacttccgctggatgggtcctcaacgcctgatgttcctcgtgttgtggaagctcgct

SEQ ID NO: 94473 - DNA, 75 bp, Artificial Sequence
  Synthetic
tgatggggatttccgccactcgcggccgcacctctgtgcttggcgccgaattctgctttgatgtcacctttgaag

SEQ ID NO: 94474 - DNA, 75 bp, Artificial Sequence
  Synthetic
cgggggggtggaagcacaaagccataatctataggacgtggtgtaaagggtaccaggcacttcgccagcgcgtgg

SEQ ID NO: 94475 - DNA, 75 bp, Artificial Sequence
  Synthetic
cgggggggtggaagcacaaagccataatctataggacgtggtgtaaagggtaccaggctcttcgccagcgcgtgg

SEQ ID NO: 94476 - DNA, 75 bp, Artificial Sequence
  Synthetic
cgggggggtggaagcacaaagccataatctataggacgtggtgtaaagggtaccaggcccttcgccagcgcgtgg

SEQ ID NO: 94477 - DNA, 75 bp, Artificial Sequence
  Synthetic
cgggggggtggaagcacaaagccataatctataggacgtggtgtaaagggtaccaggcgcttcgccagcgcgtgg

SEQ ID NO: 94478 - DNA, 75 bp, Artificial Sequence
  Synthetic
tggtgtctggcctcttacatctggccggacgctgtgatgttggtggttgtggccatggtcctcctcttcggcctt

SEQ ID NO: 94479 - DNA, 75 bp, Artificial Sequence
  Synthetic
aggagccccctcggggaggggcgtcccaccaaacctttgaccttcgcttggtgcttggcctcatacatctggccg

SEQ ID NO: 94480 - DNA, 75 bp, Artificial Sequence
  Synthetic
cggacgctgtgatgttggtggttgtggccatggtcctcctcttcggccttttcgacgcgctcgattgggccttgg

SEQ ID NO: 94481 - DNA, 75 bp, Artificial Sequence
  Synthetic
ccttggtgttactctttggcctgttcgacgcgttggactgggctttggaggagatcttggtgtcccggccctcgt

SEQ ID NO: 94482 - DNA, 75 bp, Artificial Sequence
  Synthetic
gagtgttgtgtgatggcgggcgagaaggccactaccgtccggcttgtgtccaagatgtgcgcgagaggggcctac

SEQ ID NO: 94483 - DNA, 75 bp, Artificial Sequence
  Synthetic
aggccactaccgtccggcttgtgtccaagatgtgcgcgagaggggcctacctgtttgaccacatggggtcgttct

SEQ ID NO: 94484 - DNA, 75 bp, Artificial Sequence
  Synthetic
ctgtcattcactaggacggactgtcgcatcatacgagacgccgccaggaccctgagctgcggccaatgcgtcatg

SEQ ID NO: 94485 - DNA, 75 bp, Artificial Sequence
  Synthetic
cctgagctgcggccaatgcgtcatgggcttgcccgtggtggctaggcgcggcgatgaggtcctgattggggtctt

SEQ ID NO: 94486 - DNA, 75 bp, Artificial Sequence
  Synthetic
cttgcccgtggtagcgcgccgcggtgatgaggttcttatcggcgtctttcaggatgtgaaccatctgcctcccgg

SEQ ID NO: 94487 - DNA, 75 bp, Artificial Sequence
  Synthetic
tgggagtcacaaaggctgccttgacgggtcgggaccctgacttacatccagggaacgtcatggtgttggggacgg

SEQ ID NO: 94488 - DNA, 75 bp, Artificial Sequence
  Synthetic
cattccatggggcttcttcccgaaccattgcgacacctgtgggggcccttaacccaaggtggtggtcggccagtg

SEQ ID NO: 94489 - DNA, 75 bp, Artificial Sequence
  Synthetic
cattgcgacacctgtgggggcccttaacccaaggtggtggtcggccagtgatgacgtcacggtctatcccctccc

SEQ ID NO: 94490 - DNA, 75 bp, Artificial Sequence
  Synthetic
gggtcatacgatccgatggggctctttgccatggcttgagcaagggggacaaggtagaactggacgtggccatgg

SEQ ID NO: 94491 - DNA, 75 bp, Artificial Sequence
  Synthetic
gggtcattcgatccgatggggctctttgccatggcttgagcaagggggacaaggtagaactggacgtggccatgg

SEQ ID NO: 94492 - DNA, 75 bp, Artificial Sequence
  Synthetic
gggtcatccgatccgatggggctctttgccatggcttgagcaagggggacaaggtagaactggacgtggccatgg

SEQ ID NO: 94493 - DNA, 75 bp, Artificial Sequence
  Synthetic
gggtcatgcgatccgatggggctctttgccatggcttgagcaagggggacaaggtagaactggacgtggccatgg

SEQ ID NO: 94494 - DNA, 75 bp, Artificial Sequence
  Synthetic
atggagccacttcgttgacgccctgcacttgccaggctgagtcctgttgggtcatcaggtccgacggggcgctat

SEQ ID NO: 94495 - DNA, 75 bp, Artificial Sequence
  Synthetic
aaggtagaactggacgtggccatggaggttgctgactttcgtgggtcgtctgggtctcctgtcctatgcgacgag

SEQ ID NO: 94496 - DNA, 75 bp, Artificial Sequence
  Synthetic
gaccgcggctcgattcactcggccgtggacccaagtcccaacagacgccaagactaccactgagccacccccggt

SEQ ID NO: 94497 - DNA, 75 bp, Artificial Sequence
  Synthetic
gctcacctgtcttgtgcgacgaggggcacgcagtaggaatgctcgtgtctgtgcttcattccggtggcagggtga

SEQ ID NO: 94498 - DNA, 75 bp, Artificial Sequence
  Synthetic
tggacccaagtcccaacagacgccaagactaccactgagccacccccggtgccagctaaaggggttttcaaagag

SEQ ID NO: 94499 - DNA, 75 bp, Artificial Sequence
  Synthetic
actaccaccgaaccccccccggtgccagcaaagggagttttcaaggaggctccgttgtttatgccaacgggggcg

SEQ ID NO: 94500 - DNA, 75 bp, Artificial Sequence
  Synthetic
ggagtatggaaacatggggcacaaggtcctgattctcaacccgtcggttgccactgtgagggccatgggccctta

SEQ ID NO: 94501 - DNA, 75 bp, Artificial Sequence
  Synthetic
catggagaggctggcggggaaacatcctagcattttctgtggacacgacacaacagctttcacacggatcacgga

SEQ ID NO: 94502 - DNA, 75 bp, Artificial Sequence
  Synthetic
cctgattttgaacccctcggtcgctactgtgcgggccatgggtccgtacatggaacggctggcggggaaacatcc

SEQ ID NO: 94503 - DNA, 75 bp, Artificial Sequence
  Synthetic
actgtgcgggccatgggtccgtacatggaacggctggcggggaaacatccaagcatatactgtggccatgacacc

SEQ ID NO: 94504 - DNA, 75 bp, Artificial Sequence
  Synthetic
catctgtgatgagtgccacagtcatgactcaactgtgttgctgggtataggcagggtcagggacgtggcgcgggg

SEQ ID NO: 94505 - DNA, 75 bp, Artificial Sequence
  Synthetic
gaggttcttagccaaccctaggcagatgctgcggggcgtttcggtggtcatttgtgacgagtgccacagtcatga

SEQ ID NO: 94506 - DNA, 75 bp, Artificial Sequence
  Synthetic
agagtccgggagttggcgcgtggatgtggagtgcaacttgtgctctacgccactgctactcctcctggatccccg

SEQ ID NO: 94507 - DNA, 75 bp, Artificial Sequence
  Synthetic
ctatgactcagcatccatccataattgagacaaagctggacgttggtgagatccccttttatgggcatggtatcc

SEQ ID NO: 94508 - DNA, 75 bp, Artificial Sequence
  Synthetic
gcggagtgcgagagattggccggccagttctccgcgcggggggttaatgccatcgcctattataggggtaaggac

SEQ ID NO: 94509 - DNA, 75 bp, Artificial Sequence
  Synthetic
ttttccgctaggggggtcaatgccatcgcttattacagggggaaggacagttcaatcatcaaggacggcgactta

SEQ ID NO: 94510 - DNA, 75 bp, Artificial Sequence
  Synthetic
ttgcggactgtccctgcttcggctgaattgtcgatgcagcggcgcggacgcacggggagaggtcggtcgggccgc

SEQ ID NO: 94511 - DNA, 75 bp, Artificial Sequence
  Synthetic
cccgctggcgtggtgcgctcgggtcctgtctggtcggcggtggaggccggagtgacctggtacggaatggaacct

SEQ ID NO: 94512 - DNA, 75 bp, Artificial Sequence
  Synthetic
tggggcaatgatttgccatcaaaagtggccggccaccacatagttgacgatctggtccgtcggctcggtgtggcg

SEQ ID NO: 94513 - DNA, 75 bp, Artificial Sequence
  Synthetic
aagacggccgaggcctacacagcgaccgccaagtggcttgctggctgctacacggggacgcgggccgtccccact

SEQ ID NO: 94514 - DNA, 75 bp, Artificial Sequence
  Synthetic
ccgccaagtggcttgctggctgctacacggggacgcgggccgtccccactgtatccattgttgacaagctcttcg

SEQ ID NO: 94515 - DNA, 75 bp, Artificial Sequence
  Synthetic
cggcggtggctgcctatggagcttctcgaagtcctccactggccgcggcggcgtcctacctcatggggttgggcg

SEQ ID NO: 94516 - DNA, 75 bp, Artificial Sequence
  Synthetic
tcgaagtcctccactggccgcggcggcgtcctacctcatggggttgggcgtcggaggcaacgcacaggcgcgctt

SEQ ID NO: 94517 - DNA, 75 bp, Artificial Sequence
  Synthetic
ggagcccgccgttggcggccgcagcctcctacctgatggggttgggcgtcgggggcaacgctcagacgcgactgg

SEQ ID NO: 94518 - DNA, 75 bp, Artificial Sequence
  Synthetic
tcgtgggactcaccatggcgggggccttcatgggcggtgccagcgtgtccccctccctcgtcactgtcctacttg

SEQ ID NO: 94519 - DNA, 75 bp, Artificial Sequence
  Synthetic
cttcatgggcggtgccagcgtgtccccctccctcgtcactgtcctacttggggctgtgggaggttgggagggcgt

SEQ ID NO: 94520 - DNA, 75 bp, Artificial Sequence
  Synthetic
tgggactgccttgggcactcccgtcgtgggtttaaccatggcgggggcgttcatgggtggtgccagcgtatcccc

SEQ ID NO: 94521 - DNA, 75 bp, Artificial Sequence
  Synthetic
cagaagacctttggtatgccatcccggtactcactagtcctggagcgggcctcgcggggattgcccttggtctgg

SEQ ID NO: 94522 - DNA, 75 bp, Artificial Sequence
  Synthetic
cagaagacctttggtatgccatcccggtactcactagtcctggtgcgggcctcgcggggattgcccttggtctgg

SEQ ID NO: 94523 - DNA, 75 bp, Artificial Sequence
  Synthetic
cagaagacctttggtatgccatcccggtactcactagtcctggcgcgggcctcgcggggattgcccttggtctgg

SEQ ID NO: 94524 - DNA, 75 bp, Artificial Sequence
  Synthetic
cagaagacctttggtatgccatcccggtactcactagtcctggggcgggcctcgcggggattgcccttggtctgg

SEQ ID NO: 94525 - DNA, 75 bp, Artificial Sequence
  Synthetic
tcaacgcggcgagccttgtcttcgacttcatggcggggaaactttcatcagaagatctgtggtatgccatcccgg

SEQ ID NO: 94526 - DNA, 75 bp, Artificial Sequence
  Synthetic
cttcatggcggggaaactttcatcagaagatctgtggtatgccatcccggtgctgaccagcccaggggcgggcct

SEQ ID NO: 94527 - DNA, 75 bp, Artificial Sequence
  Synthetic
cactaccacatggctgaaccgtctgctgacgacgttgccacggtcatcttgcatacccgacagctacttccaaca

SEQ ID NO: 94528 - DNA, 75 bp, Artificial Sequence
  Synthetic
cgtgctccgtcgcctgagcctcactagaacggtggtcgccctggtcaacagggagcccaaagtggatgaggttca

SEQ ID NO: 94529 - DNA, 75 bp, Artificial Sequence
  Synthetic
agaacggtggtcgccctggtcaacagggagcccaaagtggatgaggttcaggttggatacgtctgggatctgtgg

SEQ ID NO: 94530 - DNA, 75 bp, Artificial Sequence
  Synthetic
ctctgccctgtggtgtcactccccttgtggcactgcggggaggggtggtccggtgaatggcttctcgatgggcac

SEQ ID NO: 94531 - DNA, 75 bp, Artificial Sequence
  Synthetic
ctgccctgtggtgtcattacctttatggcactgtggggaggggtggtccggagaatggctgttagatgggcatgt

SEQ ID NO: 94532 - DNA, 75 bp, Artificial Sequence
  Synthetic
gtgatcacaggcgacgtcctaaatgggcaactcaaagagccagtttactctaccaagctgtgccggcactattgg

SEQ ID NO: 94533 - DNA, 75 bp, Artificial Sequence
  Synthetic
tggtacccttcgggacgtcggggtgggctgaggtggtggtgacccctacccacgtggtgatcaggcgcacgtcct

SEQ ID NO: 94534 - DNA, 75 bp, Artificial Sequence
  Synthetic
tactacgttgatggcattccggtctcttgggaggctgacgcgagagcgccggccatggtctacggtccgggccaa

SEQ ID NO: 94535 - DNA, 75 bp, Artificial Sequence
  Synthetic
tacaagttgctgcgccagcaaatcctatcggctgctgtagctgagccctactatgttgacggcatcccggtctcg

SEQ ID NO: 94536 - DNA, 75 bp, Artificial Sequence
  Synthetic
ggaaagcgtcttcaacgtggctctttccgtactaaaagccttatttccacagagcgatgccacacgaaagctaac

SEQ ID NO: 94537 - DNA, 75 bp, Artificial Sequence
  Synthetic
acaacgtcttcaacgtggccctttccgtactaaaagccttatttccacagagtgatgccactaggaagcttactg

SEQ ID NO: 94538 - DNA, 75 bp, Artificial Sequence
  Synthetic
tgcgcactccgctcgaattgcaagttgggtgcttggtgggcaatgaacttacctttgaatgtgacaagtgtgagg

SEQ ID NO: 94539 - DNA, 75 bp, Artificial Sequence
  Synthetic
tgggtgcttggtgggcaatgaacttacctttgaatgtgacaagtgtgaggcacgccaagagacccttgcctcctt

SEQ ID NO: 94540 - DNA, 75 bp, Artificial Sequence
  Synthetic
gggttgacggttgccgacgtggctagcctgtgtgagatggaaatccagaaccatacagcctattgtgacaaggtg

SEQ ID NO: 94541 - DNA, 75 bp, Artificial Sequence
  Synthetic
caccagtggtgaggccggtggggtccttgttggtggcagacaccaccaaggtctacgtgaccaatccggacaatg

SEQ ID NO: 94542 - DNA, 75 bp, Artificial Sequence
  Synthetic
aggcaagagactttggcttccttctcctacatctggtccggggtgccgctgactagggccacgccggccaaacca

SEQ ID NO: 94543 - DNA, 75 bp, Artificial Sequence
  Synthetic
cttgttggtggcagacaccaccaaggtctacgtgaccaatccggacaatgttgggaggagggttgacaaggtgac

SEQ ID NO: 94544 - DNA, 75 bp, Artificial Sequence
  Synthetic
cgggccaggagggctgctcaagcctgcctaagcatgggttacacttatgaggaggcaataaggactgtaaggcca

SEQ ID NO: 94545 - DNA, 75 bp, Artificial Sequence
  Synthetic
ggaatcaaagaagaccccgtgcgccatctgtgtggatgccacttgcttcgacagtagcattactgaagaggacgt

SEQ ID NO: 94546 - DNA, 75 bp, Artificial Sequence
  Synthetic
ggaatcaaagaagaccccgtgcgccatctgtgtggatgccacttgcttcgacagtagcattactgatgaggacgt

SEQ ID NO: 94547 - DNA, 75 bp, Artificial Sequence
  Synthetic
ggaatcaaagaagaccccgtgcgccatctgtgtggatgccacttgcttcgacagtagcattactgacgaggacgt

SEQ ID NO: 94548 - DNA, 75 bp, Artificial Sequence
  Synthetic
ggaatcaaagaagaccccgtgcgccatctgtgtggatgccacttgcttcgacagtagcattactgaggaggacgt

SEQ ID NO: 94549 - DNA, 75 bp, Artificial Sequence
  Synthetic
tgcgcgccctggggaaatactatgcctctggcacaatggtgaccccggaaggggtgccagtgggcgagaggtatt

SEQ ID NO: 94550 - DNA, 75 bp, Artificial Sequence
  Synthetic
tgcgcgccctggggaaatactttgcctctggcacaatggtgaccccggaaggggtgccagtgggcgagaggtatt

SEQ ID NO: 94551 - DNA, 75 bp, Artificial Sequence
  Synthetic
tgcgcgccctggggaaatactctgcctctggcacaatggtgaccccggaaggggtgccagtgggcgagaggtatt

SEQ ID NO: 94552 - DNA, 75 bp, Artificial Sequence
  Synthetic
tgcgcgccctggggaaatactgtgcctctggcacaatggtgaccccggaaggggtgccagtgggcgagaggtatt

SEQ ID NO: 94553 - DNA, 75 bp, Artificial Sequence
  Synthetic
ctctggcacaatggtgaccccggaaggggtgccagtgggcgagaggtattgtaggtcctcgggtgtgttgaccac

SEQ ID NO: 94554 - DNA, 75 bp, Artificial Sequence
  Synthetic
cgggcaccatggtcaccccggaaggggtgcccgttggtgagaggtattgtagatcctcgggcgttttgacaacca

SEQ ID NO: 94555 - DNA, 75 bp, Artificial Sequence
  Synthetic
agaggatcggactgaaaaatgtctcgcttctcatcgcgggcgatgactgcttaattgtgtgcgagaggcctgtat

SEQ ID NO: 94556 - DNA, 75 bp, Artificial Sequence
  Synthetic
aaccctggcttcgtacgggtacgcgtgtgagccctcgtatcacgcttcactggacacagcccccttctgctccac

SEQ ID NO: 94557 - DNA, 75 bp, Artificial Sequence
  Synthetic
atggcttcggccattggttacattctcctctacccctggcatcccatcacacggtgggtcatcatcccgcatgtg

SEQ ID NO: 94558 - DNA, 75 bp, Artificial Sequence
  Synthetic
atggcttcggccattggttacattctcctctacccctggcttcccatcacacggtgggtcatcatcccgcatgtg

SEQ ID NO: 94559 - DNA, 75 bp, Artificial Sequence
  Synthetic
atggcttcggccattggttacattctcctctacccctggcctcccatcacacggtgggtcatcatcccgcatgtg

SEQ ID NO: 94560 - DNA, 75 bp, Artificial Sequence
  Synthetic
atggcttcggccattggttacattctcctctacccctggcgtcccatcacacggtgggtcatcatcccgcatgtg

SEQ ID NO: 94561 - DNA, 75 bp, Artificial Sequence
  Synthetic
aaggccggggcattgcgaacacgcatgctccggtcgcgcggttgggcggagttggctaggggcctgttgtggcat

SEQ ID NO: 94562 - DNA, 75 bp, Artificial Sequence
  Synthetic
tttcccccccctacatgggggtggttcatcaattggattttacaagccagaggagtcgctggcggtggttggggt

SEQ ID NO: 94563 - DNA, 75 bp, Artificial Sequence
  Synthetic
agcccattatccccctgggcaaacgacgcccacgtacggtctacgtcgcccttcaatgtctctcttgaccaatag

SEQ ID NO: 94564 - DNA, 75 bp, Artificial Sequence
  Synthetic
acgcccacgtacggtctacgtcgcccttcaatgtctctcttgaccaataggcaatgccggcgagttgacaaagac

SEQ ID NO: 94565 - DNA, 75 bp, Artificial Sequence
  Synthetic
gccccggccacgcacccttgtaaaacaaatgggcaatatttcctcacaaactgttgtgccttagaagacataggg

SEQ ID NO: 94566 - DNA, 75 bp, Artificial Sequence
  Synthetic
caaatgggcaatatttcctcacaaactgttgtgccttagaagacatagggttctgcctggagggcggatgccttt

SEQ ID NO: 94567 - DNA, 75 bp, Artificial Sequence
  Synthetic
taccgatcatggcagtcctgctgcttcttctcgtggtggaggccggggccattctggccccggccacacacgctt

SEQ ID NO: 94568 - DNA, 75 bp, Artificial Sequence
  Synthetic
gcgggactagctgtgcgaccgggcaattcccacgcccaacttgtgggggagctcggtagcctatacggacccctg

SEQ ID NO: 94569 - DNA, 75 bp, Artificial Sequence
  Synthetic
tcggtgtcggcctacgtggatggcatcttggggctcggtgaggtctactcgggcgtcctcacggttggagtggcg

SEQ ID NO: 94570 - DNA, 75 bp, Artificial Sequence
  Synthetic
gccttgtggccctcgggtgcacagtttgtactgacaaatgctggccattgtatcaggcgggtctggccgtgcggc

SEQ ID NO: 94571 - DNA, 75 bp, Artificial Sequence
  Synthetic
ttgtactgacaaatgctggccattgtatcaggcgggtctggccgtgcggcccggcaagtccgctgcccagctggt

SEQ ID NO: 94572 - DNA, 75 bp, Artificial Sequence
  Synthetic
tgagctaaagtgggaaagtgagttttggagatggattgagcagttggcctccaattactggattctggaatacct

SEQ ID NO: 94573 - DNA, 75 bp, Artificial Sequence
  Synthetic
cgggcatcttggggctcggggaggtctattccggggtgctcacggttggggtggcgttgacgcgccgggtctacc

SEQ ID NO: 94574 - DNA, 75 bp, Artificial Sequence
  Synthetic
ctattccggggtgctcacggttggggtggcgttgacgcgccgggtctacccggtccccaatctgacgtgtgctgt

SEQ ID NO: 94575 - DNA, 75 bp, Artificial Sequence
  Synthetic
gtcttcctgttagtgaccatggcggggatgtcgcaaggcgcccccgcctcggtcctgggatcacggcccttcgat

SEQ ID NO: 94576 - DNA, 75 bp, Artificial Sequence
  Synthetic
tggcctccaactactggattttggaatatctctggaaggttccttttgacttctggcggggtgtgatgagcctga

SEQ ID NO: 94577 - DNA, 75 bp, Artificial Sequence
  Synthetic
atatctctggaaggttccttttgacttctggcggggtgtgatgagcctgactccacttttggtgtgcgtggcggc

SEQ ID NO: 94578 - DNA, 75 bp, Artificial Sequence
  Synthetic
tggcggggatgtctcagggcgcccccgctacggtgctgggatctcggccctttgagccggggttgacgtggcagt

SEQ ID NO: 94579 - DNA, 75 bp, Artificial Sequence
  Synthetic
gctaccggccttttgtcaagcaattggctggggcgaccctatcactcattggagccacggacaaaatcagtggcc

SEQ ID NO: 94580 - DNA, 75 bp, Artificial Sequence
  Synthetic
cctgctcgtgcaggtcgaacgggtcccgcgtgcccactggggagcgggtttgggaccgtgggaatgtcacactgt

SEQ ID NO: 94581 - DNA, 75 bp, Artificial Sequence
  Synthetic
tcgtcggcctgcctcgtgcggcacttgtgtgcgggactgctggcccgagactgggtcggtgcgcttccccttcca

SEQ ID NO: 94582 - DNA, 75 bp, Artificial Sequence
  Synthetic
aagatcgatgtgtggagtttggtgccggttggatcagccagctgcaccatagccgcactcggtagttcggatcgc

SEQ ID NO: 94583 - DNA, 75 bp, Artificial Sequence
  Synthetic
tctggatcgtcggccttcctcgtgtggcacctgtgtgagggactgctggcccgaaaccgggtcggtacgtttccc

SEQ ID NO: 94584 - DNA, 75 bp, Artificial Sequence
  Synthetic
attcactattagagggcccctgggcaaccaggggagggggaacccggtgcgttcccctctgggttttgggagtta

SEQ ID NO: 94585 - DNA, 75 bp, Artificial Sequence
  Synthetic
ccgccatagagcctcctaccgggacgtttgggttcttccctgggaccccccccttgaacaactgcatgctattgg

SEQ ID NO: 94586 - DNA, 75 bp, Artificial Sequence
  Synthetic
cgctggttgctgttggactttgtatttgtcctactctatctgatgaagctggctgaggctaggctggtcccgttg

SEQ ID NO: 94587 - DNA, 75 bp, Artificial Sequence
  Synthetic
cgtgagtatgatcctaggtctcgcaaacctggtgttgtacttccgttggatgggccctcaacgcctgatgttcct

SEQ ID NO: 94588 - DNA, 75 bp, Artificial Sequence
  Synthetic
gcattcccactggctttgttgatggggatttcagccacccgtggccgcacctctgtgctcggagccgagttttgc

SEQ ID NO: 94589 - DNA, 75 bp, Artificial Sequence
  Synthetic
ggtgggtgaaccagctggcggtcctaggactgccggcggcgcacgctgccgtggcgggtgaagtgttcgcgggac

SEQ ID NO: 94590 - DNA, 75 bp, Artificial Sequence
  Synthetic
cagcgtggtagcatgggccatagcgctcctgagctctatgagcgcggggggctggaggcacaaagctgtgattta

SEQ ID NO: 94591 - DNA, 75 bp, Artificial Sequence
  Synthetic
gttggatgggccctcagcgcctgatgttcctcgtgttgtggaagctcgctcggggagctttcccactggctcttc

SEQ ID NO: 94592 - DNA, 75 bp, Artificial Sequence
  Synthetic
gaagccgctgaccatcgcttggtgcttggcttcctacctctggcctgacgccgtgatgttggtggtggtggggct

SEQ ID NO: 94593 - DNA, 75 bp, Artificial Sequence
  Synthetic
ttctgctttgacgtcaccttcgaagtagacacgtcggttttgggatgggtggtggccagtgttgtggcttgggcc

SEQ ID NO: 94594 - DNA, 75 bp, Artificial Sequence
  Synthetic
tagacacgtcggttttgggatgggtggtggccagtgttgtggcttgggccatagcgctcttgagctccatgagcg

SEQ ID NO: 94595 - DNA, 75 bp, Artificial Sequence
  Synthetic
gcgttggactgggccttggaggagttactggtctctcggccttcattgcggaggttggctcgagtggtggaatgc

SEQ ID NO: 94596 - DNA, 75 bp, Artificial Sequence
  Synthetic
ctaccatcaggctggtgtccaagatgtgcgcgcgtggggcctatttgttcgaccatatgggctctttctcgcgcg

SEQ ID NO: 94597 - DNA, 75 bp, Artificial Sequence
  Synthetic
tatcaggcaatacggcagcgggtggttcgcagccccctcggggaggggcggcctaccaaacccctgacgtttgct

SEQ ID NO: 94598 - DNA, 75 bp, Artificial Sequence
  Synthetic
ccgtcaaggaacgcttgctggagtgggacgcggctctggaacccctgtcattcaccaggacggactgtcgcatca

SEQ ID NO: 94599 - DNA, 75 bp, Artificial Sequence
  Synthetic
ggctctggtgctcctgtttggtctgttcgacgcgttggactgggccttggaggagctactagtgtcgcggccctc

SEQ ID NO: 94600 - DNA, 75 bp, Artificial Sequence
  Synthetic
ttcgacgcgttggactgggccttggaggagctactagtgtcgcggccctcattgcggcgccttgcccgggtggtg

SEQ ID NO: 94601 - DNA, 75 bp, Artificial Sequence
  Synthetic
cccgtggtcgcgcgccgtggtgacgaggtcttgatcggcgtttttcaagatgtgaaccacttgcctccggggttt

SEQ ID NO: 94602 - DNA, 75 bp, Artificial Sequence
  Synthetic
caagatgtgcgcgaggggggcctatctgttcgaccatatgggctctttttcgcgcgcggtcaaggaacgcttgct

SEQ ID NO: 94603 - DNA, 75 bp, Artificial Sequence
  Synthetic
ctgttcgaccatatgggctctttttcgcgcgcggtcaaggaacgcttgctggagtgggacgccgcccttgaacct

SEQ ID NO: 94604 - DNA, 75 bp, Artificial Sequence
  Synthetic
gctgagctgcggccagtgcgtcatgggactacccgtggttgcgcgccgtggcgatgaggtgttgatcggcgtttt

SEQ ID NO: 94605 - DNA, 75 bp, Artificial Sequence
  Synthetic
gcgatgaggtgttgatcggcgttttccaagatgtgaaccatttgcctccggggtttgtcccgaccgcgccagtag

SEQ ID NO: 94606 - DNA, 75 bp, Artificial Sequence
  Synthetic
ggctaactcgtcgactccatgcacatgccaggccgagtcctgttgggtcatacgatccgacggggcgttgtgcca

SEQ ID NO: 94607 - DNA, 75 bp, Artificial Sequence
  Synthetic
acaggaagagatccagacctacacccagggaacgtcatggtgttggggacggctacctctcggagcatgggaaca

SEQ ID NO: 94608 - DNA, 75 bp, Artificial Sequence
  Synthetic
gcagtaggaatgctcgtgtccgtgcttcattccgggggtcgggttacggcggcccgattcactcggccgtggacc

SEQ ID NO: 94609 - DNA, 75 bp, Artificial Sequence
  Synthetic
gggtcatacgatctgacggggctctttgccatggtttgtgtaagggggacaaggttgaactggacgtggccatgg

SEQ ID NO: 94610 - DNA, 75 bp, Artificial Sequence
  Synthetic
ttgccatggtttgtgtaagggggacaaggttgaactggacgtggccatggaggtcgcagacttccgtgggtcgtc

SEQ ID NO: 94611 - DNA, 75 bp, Artificial Sequence
  Synthetic
tgcgggccatgggcccgtatatggagcggctggcgggtaaacatcctagcatttactgtgggcacgatactacag

SEQ ID NO: 94612 - DNA, 75 bp, Artificial Sequence
  Synthetic
caccgctgcgagattcacgcggccgtggacccaggtcccgactgacgccaaaaccactactgagcctcctccagt

SEQ ID NO: 94613 - DNA, 75 bp, Artificial Sequence
  Synthetic
tggacccaggtcccgactgacgccaaaaccactactgagcctcctccagtaccagctaaaggtgtcttcaaggaa

SEQ ID NO: 94614 - DNA, 75 bp, Artificial Sequence
  Synthetic
tgagtatgggaatatggggcacaaggtcttgattctgaacccgtccgtggctacagtgcgtgcaatggggcccta

SEQ ID NO: 94615 - DNA, 75 bp, Artificial Sequence
  Synthetic
gtcttgattctgaacccgtccgtggctacagtgcgtgcaatggggccctacatggagcgccttgcggggaaacat

SEQ ID NO: 94616 - DNA, 75 bp, Artificial Sequence
  Synthetic
ggtccaactggtcctctatgccactgccaccccccctggctctcctatggtccagcacccttcaatcattgagac

SEQ ID NO: 94617 - DNA, 75 bp, Artificial Sequence
  Synthetic
gccaccccccctggctctcctatggtccagcacccttcaatcattgagaccaaactggatgtgggtgaaattccc

SEQ ID NO: 94618 - DNA, 75 bp, Artificial Sequence
  Synthetic
ctccccccttacgtactctacctacggtcggttcctcgccaaccctaggcagatgctacggggggtctcggtggt

SEQ ID NO: 94619 - DNA, 75 bp, Artificial Sequence
  Synthetic
ggtcggttcctcgccaaccctaggcagatgctacggggggtctcggtggtcatctgtgatgagtgccacagccat

SEQ ID NO: 94620 - DNA, 75 bp, Artificial Sequence
  Synthetic
cgtattctgccattccaaggcggagtgcgagcgcctggcgggccaattttcctcccggggtgtcaatgccattgc

SEQ ID NO: 94621 - DNA, 75 bp, Artificial Sequence
  Synthetic
cctcccggggtgtcaatgccattgcctattatcggggaaaggacagttctatcatcaaggatggagacctcgtgg

SEQ ID NO: 94622 - DNA, 75 bp, Artificial Sequence
  Synthetic
ctattatcggggaaaggacagttctatcatcaaggatggagacctcgtggtgtgtgctacagacgcgctatccac

SEQ ID NO: 94623 - DNA, 75 bp, Artificial Sequence
  Synthetic
ctgtggagtgcaacttgtgctctacgccaccgctacaccccccggctcaccgatgacccagcacccttccatcat

SEQ ID NO: 94624 - DNA, 75 bp, Artificial Sequence
  Synthetic
atcatcaaggatggagacctcgtggtgtgtgctacagacgcgctatccacggggtatactggaaacttcgattcc

SEQ ID NO: 94625 - DNA, 75 bp, Artificial Sequence
  Synthetic
gccaccgctacaccccccggctcaccgatgacccagcacccttccatcattgagacaaagctggatgtgggtgag

SEQ ID NO: 94626 - DNA, 75 bp, Artificial Sequence
  Synthetic
tcccaccataaccatctccttgcgcacagtgcccgcgtcggcagaattgtcgatgcagcggcgtagtcgcacagg

SEQ ID NO: 94627 - DNA, 75 bp, Artificial Sequence
  Synthetic
gcacctcgtattctgccattccaaggcggagtgcgagcgccttgccgggcagttctcggccaggggtgtcaatgc

SEQ ID NO: 94628 - DNA, 75 bp, Artificial Sequence
  Synthetic
agttctcggccaggggtgtcaatgccgtcgcctattacaggggcaaggacagttcaatcatcaaggacggagacc

SEQ ID NO: 94629 - DNA, 75 bp, Artificial Sequence
  Synthetic
aattgtcgatgcaacgcagaggacgcacagggagaggaaggtccgggcggtactactacgccggggttggcaaag

SEQ ID NO: 94630 - DNA, 75 bp, Artificial Sequence
  Synthetic
aatgacttgccatcgaaagtggccggccaccacattgtggacgacctggtcagacgactcggtgtggcggaaggt

SEQ ID NO: 94631 - DNA, 75 bp, Artificial Sequence
  Synthetic
cgcgcccttgaggatgcatcctgatgtcagctgggcaaaagttcgcggcgtcaactggccccttttggtgggcgt

SEQ ID NO: 94632 - DNA, 75 bp, Artificial Sequence
  Synthetic
ggggggcatgatctatgcgtcttacaccgggtccctcgtggtggttacagactgggatgtgaaggggggtggcaa

SEQ ID NO: 94633 - DNA, 75 bp, Artificial Sequence
  Synthetic
cccaatgggcaggccttaaagggccaaatcctgtcccactcctgctgcggtggggcaatgacttaccaactaagg

SEQ ID NO: 94634 - DNA, 75 bp, Artificial Sequence
  Synthetic
tgacagactgggatgtgaaggggggtggcaaccccctttacaggagtggagaccaggccacacctcaacctgtgg

SEQ ID NO: 94635 - DNA, 75 bp, Artificial Sequence
  Synthetic
tcccccgttggctgcggctgcttcctaccttatggggttgggcgtcggaggcaacgcacaggcgcgtctcgcctc

SEQ ID NO: 94636 - DNA, 75 bp, Artificial Sequence
  Synthetic
gtttaaccatggccggtgccttcatgggtggggctagcgtttccccttcccttgtcaccgtcctcctgggggcgg

SEQ ID NO: 94637 - DNA, 75 bp, Artificial Sequence
  Synthetic
cggcggtggccgcctacggggcttctcggagccctccgctagctgcggccgcttcatacctcatggggttgggcg

SEQ ID NO: 94638 - DNA, 75 bp, Artificial Sequence
  Synthetic
tcggagccctccgctagctgcggccgcttcatacctcatggggttgggcgtcgggggcaacgctcaggcgcgact

SEQ ID NO: 94639 - DNA, 75 bp, Artificial Sequence
  Synthetic
acacttcctcggtcttcctgcatcccagacagttatttccaacaggccgactattgtgacaaagtctcagccatg

SEQ ID NO: 94640 - DNA, 75 bp, Artificial Sequence
  Synthetic
tcgtgggtctaaccatggccggagcgttcatgggcggtgccagtgtgtctccctcactcgtcacggtcctcctag

SEQ ID NO: 94641 - DNA, 75 bp, Artificial Sequence
  Synthetic
ccctcactcgtcacggtcctcctaggggccgtggggggttgggagggcgtggtcaacgccgccagcttagtcttc

SEQ ID NO: 94642 - DNA, 75 bp, Artificial Sequence
  Synthetic
cagtggtggccctggtcaacagggagccaaaggtcgatgaggtccaggtggggtatgtttgggacctgtgggaat

SEQ ID NO: 94643 - DNA, 75 bp, Artificial Sequence
  Synthetic
agtgctcaccagcccgggggccggccttgcggggatagccctaggattggtgttgtactcagctaacaactctgg

SEQ ID NO: 94644 - DNA, 75 bp, Artificial Sequence
  Synthetic
cccgtggtgtcgctacctctgtggcactgcggggaggggtggtctggagaatggttactggacggccatgtggag

SEQ ID NO: 94645 - DNA, 75 bp, Artificial Sequence
  Synthetic
ttacggggaaacttcgcccctcctggcctcggacacgcctaaggttgttccctttggcacgtccggctgggcgga

SEQ ID NO: 94646 - DNA, 75 bp, Artificial Sequence
  Synthetic
tgtggcactgcggtgaggggtggtccggggaatggctgttggacggtcatgtggagagtcgctgtctttgtgggt

SEQ ID NO: 94647 - DNA, 75 bp, Artificial Sequence
  Synthetic
tctaccaagttgtgccggcactattggatgggcactgtgcctgtgaacatgctgggttacggggaaacgtcgcct

SEQ ID NO: 94648 - DNA, 75 bp, Artificial Sequence
  Synthetic
ggctgaggtggtcgtgacccccacccacgtggtgatcaggcgcacctcatgctacaagttgctgcgccaacaaat

SEQ ID NO: 94649 - DNA, 75 bp, Artificial Sequence
  Synthetic
cacgtggtgatcaggcgcacctcatgctacaagttgctgcgccaacaaattctttctgctgctgtggctgagccc

SEQ ID NO: 94650 - DNA, 75 bp, Artificial Sequence
  Synthetic
gacagaggccgatttgccgccggcggctgctgccctccaggctattgagaatgctgcgagaattctcgagcctca

SEQ ID NO: 94651 - DNA, 75 bp, Artificial Sequence
  Synthetic
gtgtgagatggagatccagaaccatacagcctattgtgacaaggtgcgcactccgcttgaattgcaggttgggtg

SEQ ID NO: 94652 - DNA, 75 bp, Artificial Sequence
  Synthetic
ggaaagtgtcttcaacgtggctctttccgtactaaaagccttatttccacagagcgacgccactagaaagttgac

SEQ ID NO: 94653 - DNA, 75 bp, Artificial Sequence
  Synthetic
cgggccacaccggctaagccaccagtggtgcggccggtggggtccttgttagtggcagacaccaccaaggtgtat

SEQ ID NO: 94654 - DNA, 75 bp, Artificial Sequence
  Synthetic
gtgaccaatccggacaatgttgggagaagagtcgacaaggtgaccttttggcgcgcccctcgggttcatgacaaa

SEQ ID NO: 94655 - DNA, 75 bp, Artificial Sequence
  Synthetic
cacctgtggtgaggcccgtggggtcgctgttagtggcagacactaccaaagtgtatgtcaccaatccagacaatg

SEQ ID NO: 94656 - DNA, 75 bp, Artificial Sequence
  Synthetic
gtgtatgtcaccaatccagacaatgtggggagacgagttgacaaggttaccttctggcgtgcccctcgggtccat

SEQ ID NO: 94657 - DNA, 75 bp, Artificial Sequence
  Synthetic
caaggcggtgttggggggggcttacgccttccagtacaccccaaaccagcgagtcaaggagatgctcaagctgtg

SEQ ID NO: 94658 - DNA, 75 bp, Artificial Sequence
  Synthetic
aaggtgaaagccgcttgtgatcgagtgggactcaagaatgtttccctcttgattgcgggcgatgactgtctgatc

SEQ ID NO: 94659 - DNA, 75 bp, Artificial Sequence
  Synthetic
ggagtcaaagaagaccccttgcgccatttgcgtggatgccacttgcttcgacagtagtataactgaagaggacgt

SEQ ID NO: 94660 - DNA, 75 bp, Artificial Sequence
  Synthetic
gtaggtcctcaggggtactcaccacaagcgcgagcaattgcttgacctgctacattaaggtgaaagccgcctgcc

SEQ ID NO: 94661 - DNA, 75 bp, Artificial Sequence
  Synthetic
acccctggcaccccatcacacggtgggtcatcatccctcacgtgctaacctgcgcgtttaggggtggcggcacac

SEQ ID NO: 94662 - DNA, 75 bp, Artificial Sequence
  Synthetic
gcgacccgagcgaggccctgggtagagccctggcttcgtacgggtacgcgtgtgagccctcgtatcatgcatcat

SEQ ID NO: 94663 - DNA, 75 bp, Artificial Sequence
  Synthetic
atggcttcggccattgggtacatcctcctttacccctggcaccccatcacacggtgggtcatcatccctcacgtg

SEQ ID NO: 94664 - DNA, 75 bp, Artificial Sequence
  Synthetic
ttatcgtggccctccatggtccagcagcattgagggttaccgcagacactactaaaaccaaattggaggctggga

SEQ ID NO: 94665 - DNA, 75 bp, Artificial Sequence
  Synthetic
gctggtgcactgcgcacgcgcatgctccggtcgcgcggttgggcggagttggctaggggcctgttgtggcatcca

SEQ ID NO: 94666 - DNA, 75 bp, Artificial Sequence
  Synthetic
ccccccggcactgggtgcgagccccagaaaccgacgcctatcaaagtagacgtaatggccctgcgccgaaccggc

SEQ ID NO: 94667 - DNA, 75 bp, Artificial Sequence
  Synthetic
gaccggccaaaaggtggtggatgggtgatgacagggttggtaggtcgtaaatcccggtcaccttggtagccacta

SEQ ID NO: 94668 - DNA, 75 bp, Artificial Sequence
  Synthetic
ctcgtggtggaggccggggccattttggccccggccacccatgcttgtagcgcgaaggggcaatatttcctcaca

SEQ ID NO: 94669 - DNA, 75 bp, Artificial Sequence
  Synthetic
ggttctgcctcgagggtggatgcctggtggccctggggtgcacgatttgtactgaccgctgttggccactgtatc

SEQ ID NO: 94670 - DNA, 75 bp, Artificial Sequence
  Synthetic
gtgaggcgcatgggcaatatttcctcacaaattgctgtgccatggaggacatagggttctgcctcgagggcggtt

SEQ ID NO: 94671 - DNA, 75 bp, Artificial Sequence
  Synthetic
gagctggggagcctctacgggcccttgtctgtgtcagcctatgtggctggcatactagggctcggggaggtttac

SEQ ID NO: 94672 - DNA, 75 bp, Artificial Sequence
  Synthetic
tgtctgtgtcagcctatgtggctggcatactagggctcggggaggtttactctggcgttctcactatcggggtcg

SEQ ID NO: 94673 - DNA, 75 bp, Artificial Sequence
  Synthetic
tatcaggcgggactggccgtgcggcctggcaagtccgccgcccagctggtgggtgaactgggtagcctctacggg

SEQ ID NO: 94674 - DNA, 75 bp, Artificial Sequence
  Synthetic
tgtgaactgaagtgggaaagtgagttttggagatggacggagcagctggcctcaaactactggattctggaatac

SEQ ID NO: 94675 - DNA, 75 bp, Artificial Sequence
  Synthetic
cccttatcggtgtcagcctacgtggctggcatcttagggctcggggaggtctattcaggggtactcactgtgggc

SEQ ID NO: 94676 - DNA, 75 bp, Artificial Sequence
  Synthetic
tttggagatggacggagcagctggcctcaaactactggattctggaatacatctggaaggttccttttgacttct

SEQ ID NO: 94677 - DNA, 75 bp, Artificial Sequence
  Synthetic
ctcctgctggagcaacggatcgtcatggtcttcctcctggtgactatggcgggtatgtcgcaaggcgtacctgtc

SEQ ID NO: 94678 - DNA, 75 bp, Artificial Sequence
  Synthetic
ctcctgtaggtcgaatgggtcccgcgttcccacgggggagcgagtttgggatcgagggaatgtctcactgttgtg

SEQ ID NO: 94679 - DNA, 75 bp, Artificial Sequence
  Synthetic
ccttctcctgctagagcaacggattgttatggtcttcctcctggttactatggcgggcatgtcgcaaggcgcgcc

SEQ ID NO: 94680 - DNA, 75 bp, Artificial Sequence
  Synthetic
gttatggtcttcctcctggttactatggcgggcatgtcgcaaggcgcgcctgcctcggtgctggggtctcggccg

SEQ ID NO: 94681 - DNA, 75 bp, Artificial Sequence
  Synthetic
ttggagccacggacaaaatcagtggcccctgtcctgcccccagtatgtctacggagccgtttcagtgacttgcgt

SEQ ID NO: 94682 - DNA, 75 bp, Artificial Sequence
  Synthetic
ccgcgtacccacggggcagaaggtttgggagcgtgggaatgtcacactgttgtgtgattgccctaacggtccctg

SEQ ID NO: 94683 - DNA, 75 bp, Artificial Sequence
  Synthetic
tgggagcgtgggaatgtcacactgttgtgtgattgccctaacggtccctgggtatggctgccggccttttgccaa

SEQ ID NO: 94684 - DNA, 75 bp, Artificial Sequence
  Synthetic
tcgacgtgtggagtttggtgccagttggctctgccagctgcaccatagccgcactggggtcgtcggatcgcgatg

SEQ ID NO: 94685 - DNA, 75 bp, Artificial Sequence
  Synthetic
gtggcctctttcttgcccccagtatgtctacgggtccgtttccgtgacttgcgtttggggttccgtctcttggtt

SEQ ID NO: 94686 - DNA, 75 bp, Artificial Sequence
  Synthetic
gtctacgggtccgtttccgtgacttgcgtttggggttccgtctcttggtttgcttccacgggggggcgcgattcc

SEQ ID NO: 94687 - DNA, 75 bp, Artificial Sequence
  Synthetic
gacaggcggcctgcctcgtgtggtacttgtgtgcgggactgctggcccgagactgggtcggtgcgtttccctttc

SEQ ID NO: 94688 - DNA, 75 bp, Artificial Sequence
  Synthetic
agccgcactgggatcgtcggatcgcgacaccgtgccggagctctccgagtggggggtcccttgcgctacctgtat

SEQ ID NO: 94689 - DNA, 75 bp, Artificial Sequence
  Synthetic
cttcgtcaacaggacaactcccttcaccataaggggccccctgggcaaccaggggagaggcaacccggtgcggtc

SEQ ID NO: 94690 - DNA, 75 bp, Artificial Sequence
  Synthetic
tctggaccgtcggcctgcctcgtgcggcacctgtgtgagagactgctggcccgagactgggtcggttagattccc

SEQ ID NO: 94691 - DNA, 75 bp, Artificial Sequence
  Synthetic
tgcccttcgtcaacaggaccactccattcaccattagagggcccctgggcaaccaggggcgggggaacccggtgc

SEQ ID NO: 94692 - DNA, 75 bp, Artificial Sequence
  Synthetic
attcaccattagagggcccctgggcaaccaggggcgggggaacccggtgcgttcccccttgggcttcgggtcgta

SEQ ID NO: 94693 - DNA, 75 bp, Artificial Sequence
  Synthetic
agaggtgtccgaggtgcttgggggtgctggactcactggggggttctatgaaccactggtgcggcggtgttcaga

SEQ ID NO: 94694 - DNA, 75 bp, Artificial Sequence
  Synthetic
ccgctattgagcctcccactgggacgtttgggttcttccccgggacccccccccttaacaactgcatgctcttgg

SEQ ID NO: 94695 - DNA, 75 bp, Artificial Sequence
  Synthetic
tgtccagggccacttgcaggaggtggatgcaggcaacttcatcccgcctccccgctggttgctcttggattttgt

SEQ ID NO: 94696 - DNA, 75 bp, Artificial Sequence
  Synthetic
tcattcttcttctgctatggtggtgggtcaatcagttggcagtcctcggattgccttcggcccaagccgcggtag

SEQ ID NO: 94697 - DNA, 75 bp, Artificial Sequence
  Synthetic
ggtcaatcagttggcagtcctcggattgccttcggcccaagccgcggtagcgggggaggtttttgcgggtccggc

SEQ ID NO: 94698 - DNA, 75 bp, Artificial Sequence
  Synthetic
gatgggcccccaacgcctgatgttccttgtgctgtggaagctcgctcggggagctttcccgctggctttgctgat

SEQ ID NO: 94699 - DNA, 75 bp, Artificial Sequence
  Synthetic
gctttgacgtcacattcgaggtggacacatcagtcttgggatgggtggtggcgagtgtggtggcttgggccatag

SEQ ID NO: 94700 - DNA, 75 bp, Artificial Sequence
  Synthetic
ctagcaaacctggtgttgtactttcgctggatgggtccccaacgcttgatgttccttgttttgtggaagctcgct

SEQ ID NO: 94701 - DNA, 75 bp, Artificial Sequence
  Synthetic
ttctgctttgacgtcacctttgaagtggacacgtcggttttgggttgggtggtggccagtgtcttggcctgggcc

SEQ ID NO: 94702 - DNA, 75 bp, Artificial Sequence
  Synthetic
atgcgttggactgggccttggaggagctgctagtgtcgcggccttcgttgcggcgccttgcaagggtggtggagt

SEQ ID NO: 94703 - DNA, 75 bp, Artificial Sequence
  Synthetic
gctgctagtgtcgcggccttcgttgcggcgccttgcaagggtggtggagtgttgtgtgatggctggtgaaaaggc

SEQ ID NO: 94704 - DNA, 75 bp, Artificial Sequence
  Synthetic
taccaggcggtgcgtcagcgggtggttcggagccccctcggggaggggcgacctaccaagcccctgaccatcgcg

SEQ ID NO: 94705 - DNA, 75 bp, Artificial Sequence
  Synthetic
ggcgctggtgctcctctttggcctgttcgacgcgttggactgggccttggaggagttactagtgtctcggccctc

SEQ ID NO: 94706 - DNA, 75 bp, Artificial Sequence
  Synthetic
tcgaccacatgggctccttctcgcgggctgttaaggaacgcctgcttgagtgggatgcggccttggaacccctgt

SEQ ID NO: 94707 - DNA, 75 bp, Artificial Sequence
  Synthetic
aggcgactaccgtccggctggtgtccaagatgtgtgcgcggggggcctatttgtttgatcatatgggctctttct

SEQ ID NO: 94708 - DNA, 75 bp, Artificial Sequence
  Synthetic
agctgcggccagtgtgtcatgggcttgcccgtggtagctcgccgtggcgatgaggttctcattggcgtctttcaa

SEQ ID NO: 94709 - DNA, 75 bp, Artificial Sequence
  Synthetic
ggagtcactaaggctgccttgacaggtcgggatcctgacttacatccaggaaacgtcatggttttgggaacggcc

SEQ ID NO: 94710 - DNA, 75 bp, Artificial Sequence
  Synthetic
ccatggagcctcatcccggaccattgctactcctgtgggggcccttaacccaaggtggtggtctgccagtgacga

SEQ ID NO: 94711 - DNA, 75 bp, Artificial Sequence
  Synthetic
cgtgacggtttatcccctccctgatggagccaactcgttggtcccttgtacatgccaggccgagtcctgttgggt

SEQ ID NO: 94712 - DNA, 75 bp, Artificial Sequence
  Synthetic
cattgcgacgcccgtgggggccctaaacccaaggtggtggtccgccagtgatgatgtcacggtgtaccccctccc

SEQ ID NO: 94713 - DNA, 75 bp, Artificial Sequence
  Synthetic
tcgcctgtcctgtgcgacgaggggcacgcagtaggcatgctcgtgtctgtgcttcattcaggggggcgggtgacc

SEQ ID NO: 94714 - DNA, 75 bp, Artificial Sequence
  Synthetic
aaggtagaactggacgtggccatggaggtcgctgatttccgtgggtcgtctgggtcacccgtcttgtgtgatgag

SEQ ID NO: 94715 - DNA, 75 bp, Artificial Sequence
  Synthetic
cacgaccgaacccccaccagtaccagcaaaaggagttttcaaagaagcccctcttttcatgcccactggggccgg

SEQ ID NO: 94716 - DNA, 75 bp, Artificial Sequence
  Synthetic
gcaaaaggagttttcaaagaagcccctcttttcatgcccactggggccggtaagagcacacgggtccctttggag

SEQ ID NO: 94717 - DNA, 75 bp, Artificial Sequence
  Synthetic
tactgcggcacgattcactcggccgtggacccaagtccctacagatgccaagaccaccactgaacccccgccggt

SEQ ID NO: 94718 - DNA, 75 bp, Artificial Sequence
  Synthetic
agtgagggccatgggtccttatatggagaaactggcgggtaagcacccaagcatatactgtggacacgatacaac

SEQ ID NO: 94719 - DNA, 75 bp, Artificial Sequence
  Synthetic
accagcaaaaggagtcttcaaggaagccccgttattcatgcctacgggggccggcaagagcacgcgggtcccctt

SEQ ID NO: 94720 - DNA, 75 bp, Artificial Sequence
  Synthetic
gagaaactggcgggtaagcacccaagcatatactgtggacacgatacaacagcattcacacgggtcactgactcc

SEQ ID NO: 94721 - DNA, 75 bp, Artificial Sequence
  Synthetic
ctacggtgcgtgccatgggcccctatatggagcgcctggctggcaaacatcctagcatctactgcggacatgaca

SEQ ID NO: 94722 - DNA, 75 bp, Artificial Sequence
  Synthetic
tgtgacgagtgccacagtcatgactcaactgtgttgctggggatcggtcgggtaagggagctggcgcgggggtgt

SEQ ID NO: 94723 - DNA, 75 bp, Artificial Sequence
  Synthetic
tatggagcgcctggctggcaaacatcctagcatctactgcggacatgacaccactgcgttcacacggatcacgga

SEQ ID NO: 94724 - DNA, 75 bp, Artificial Sequence
  Synthetic
gacccagcatccgtccataattgagaccaaattggatgtgggtgagatccccttttatgggcacggtatccctct

SEQ ID NO: 94725 - DNA, 75 bp, Artificial Sequence
  Synthetic
agatgctacggggggtctctgttgtaatctgtgatgagtgccacagccatgactcaactgtgttgttggggattg

SEQ ID NO: 94726 - DNA, 75 bp, Artificial Sequence
  Synthetic
accaaattggatgtgggtgagatccccttttatgggcacggtatccctctggagcggatgcggaccggccgtcat

SEQ ID NO: 94727 - DNA, 75 bp, Artificial Sequence
  Synthetic
aatctgtgatgagtgccacagccatgactcaactgtgttgttggggattgggcgggtccgggagctggctcgcgg

SEQ ID NO: 94728 - DNA, 75 bp, Artificial Sequence
  Synthetic
ctcttctaggggggtcaatgccattgcctattatagggggaaggacagttccatcatcaaggacggagacctcgt

SEQ ID NO: 94729 - DNA, 75 bp, Artificial Sequence
  Synthetic
tgagaccaaactggatgtgggtgagattcccttttatgggcatggtatacctctggagcggatgcgaaccggccg

SEQ ID NO: 94730 - DNA, 75 bp, Artificial Sequence
  Synthetic
ctgtgactgactgcgggttggtggtggaggaggtcgtcgaggtgacccttgatcccaccattaccatctccttgc

SEQ ID NO: 94731 - DNA, 75 bp, Artificial Sequence
  Synthetic
agttctccgcgagaggggttaacgccatagcctattataggggaaaagacagttcaataatcaaggatggtgacc

SEQ ID NO: 94732 - DNA, 75 bp, Artificial Sequence
  Synthetic
gaacagtgccggcgtcggcagaactgtcgatgcaacggcgaggacgcacagggaggggccggtccgggcgctact

SEQ ID NO: 94733 - DNA, 75 bp, Artificial Sequence
  Synthetic
tgacctggtatggaatggaacctgacttgacagctaaccttctgagactttacgacgactgcccttacaccgcag

SEQ ID NO: 94734 - DNA, 75 bp, Artificial Sequence
  Synthetic
cttgacagctaaccttctgagactttacgacgactgcccttacaccgcagccgtcgcggctgacatcggggaagc

SEQ ID NO: 94735 - DNA, 75 bp, Artificial Sequence
  Synthetic
ttgcgaacggtccctgcatcggctgaactgtcgatgcagcggagaggacgcacgggtcgtgggcggtctgggcgg

SEQ ID NO: 94736 - DNA, 75 bp, Artificial Sequence
  Synthetic
tcccgtctggtcagcagtggaagccggagtgacctggtatggaatggaacctgacttgacagcaaaccttctgag

SEQ ID NO: 94737 - DNA, 75 bp, Artificial Sequence
  Synthetic
gcaatgatttaccatcaaaagtggccggccatcacatagtagacgatctggtccgtcggctcggagtggcggagg

SEQ ID NO: 94738 - DNA, 75 bp, Artificial Sequence
  Synthetic
caatcctgtcccactactgctgaggtggggcaacgatttgccatccaaagtggccggccaccacatagtagacga

SEQ ID NO: 94739 - DNA, 75 bp, Artificial Sequence
  Synthetic
tatcgcaggtggcatgatctacgcgtcttacaccgggtccctagtggtggtttcagactgggatgtgaagggggg

SEQ ID NO: 94740 - DNA, 75 bp, Artificial Sequence
  Synthetic
atccattgttgacaagctcttcgccggagggtgggctgcggttgtcggacactgtcatagtgtgatagccgctgc

SEQ ID NO: 94741 - DNA, 75 bp, Artificial Sequence
  Synthetic
cctacctgatggggttgggcgtcggaggcaatgcgcaggctcgcttggcttctgccctcctgttgggggccgctg

SEQ ID NO: 94742 - DNA, 75 bp, Artificial Sequence
  Synthetic
ctgtttcaattgtggacaagctctttgccggagggtgggctgcggtcgtaggtcactgccacagtgtaatagctg

SEQ ID NO: 94743 - DNA, 75 bp, Artificial Sequence
  Synthetic
aggcaatgcgcaggctcgcttggcttctgccctcctgttgggggccgctggaaccgccttgggcactccagtcgt

SEQ ID NO: 94744 - DNA, 75 bp, Artificial Sequence
  Synthetic
ccctcgtcaccgtcctcctgggggcggttgggggctgggagggcgtggtcaacgccgctagccttgtcttcgact

SEQ ID NO: 94745 - DNA, 75 bp, Artificial Sequence
  Synthetic
gcgtcctacctgatgggattgggcgtcggaggcaacgcacaggcccgcctggcttctgctctcctgttgggggcc

SEQ ID NO: 94746 - DNA, 75 bp, Artificial Sequence
  Synthetic
ggttgggggctgggagggcgtggtcaacgccgctagccttgtcttcgactttatggcagggaaattatcaactga

SEQ ID NO: 94747 - DNA, 75 bp, Artificial Sequence
  Synthetic
tcggaggcaacgcacaggcccgcctggcttctgctctcctgttgggggccgcgggtactgccctgggtacgccgg

SEQ ID NO: 94748 - DNA, 75 bp, Artificial Sequence
  Synthetic
cggggattgccctgggattggtgctgtattcagctaacaactctggcactaccacttggttgaatcgtctgctca

SEQ ID NO: 94749 - DNA, 75 bp, Artificial Sequence
  Synthetic
ccctcactggtcacggtcctcttgggggctgtgggtggttgggagggagtggtcaatgcggccagtcttgtcttc

SEQ ID NO: 94750 - DNA, 75 bp, Artificial Sequence
  Synthetic
gtattcagctaacaactctggcactaccacttggttgaatcgtctgctcactacattaccaagatcatcatgcat

SEQ ID NO: 94751 - DNA, 75 bp, Artificial Sequence
  Synthetic
ggtgctcactagtccaggagccggcctggccggcatcgccttagggctggtgctgtactcagctaacaactctgg

SEQ ID NO: 94752 - DNA, 75 bp, Artificial Sequence
  Synthetic
tgctccggcgcctgagccttactcgcactgtggtggccctggtcaacagggagcccaaggtggatgaggtccagg

SEQ ID NO: 94753 - DNA, 75 bp, Artificial Sequence
  Synthetic
cactgtggtggccctggtcaacagggagcccaaggtggatgaggtccaggtcggatatgtctgggatttgtggga

SEQ ID NO: 94754 - DNA, 75 bp, Artificial Sequence
  Synthetic
gcatcccggacagctatttccaacaggccgactactgtgacaaagtctcagccatgctccgacgcttgagcctca

SEQ ID NO: 94755 - DNA, 75 bp, Artificial Sequence
  Synthetic
gccccgttgtgtcactcccgttgtggcattgtggggaggggtggtccggagagtggctcctggatggccatgtgg

SEQ ID NO: 94756 - DNA, 75 bp, Artificial Sequence
  Synthetic
gcattgtggggaggggtggtccggagagtggctcctggatggccatgtggagagtcgctgcctctgtgggtgtgt

SEQ ID NO: 94757 - DNA, 75 bp, Artificial Sequence
  Synthetic
ctaagctgtgcaggcattactggatgggcactgtaccggtgaacatgttgggctacggggaaacctcgccgcttc

SEQ ID NO: 94758 - DNA, 75 bp, Artificial Sequence
  Synthetic
ctctgccccgtggtgtcactgcctttgtggcactgcggggaggggtggtccggagaatggctgttggacggtcat

SEQ ID NO: 94759 - DNA, 75 bp, Artificial Sequence
  Synthetic
gtgtgattactggggacgtgttgaatggccaactcaaagatccagtttactccacaaagttgtgccggcactatt

SEQ ID NO: 94760 - DNA, 75 bp, Artificial Sequence
  Synthetic
ggatggggacagtacctgtcaacatgctgggatacggggaaacttcacctctcctggcctccgataccccaaagg

SEQ ID NO: 94761 - DNA, 75 bp, Artificial Sequence
  Synthetic
ggaggctgatgcgcgagcaccagctatggtctacggtcctggccaaagcgttaccattgacggggagcgctacac

SEQ ID NO: 94762 - DNA, 75 bp, Artificial Sequence
  Synthetic
cggactcatttgaagtcatccaagagtctgatacagctgaaagtgaggaaagcgtcttcaacgtggctctttccg

SEQ ID NO: 94763 - DNA, 75 bp, Artificial Sequence
  Synthetic
gccgagagatgcctgtgtggggagaagacatcccccgcactccatcgcctgcacttatctcggttacggagagca

SEQ ID NO: 94764 - DNA, 75 bp, Artificial Sequence
  Synthetic
aagatgtcttgctgtgtggagaagagcgtcacgcgcttcttttccttagggttgaccgtggctgacgtggctagc

SEQ ID NO: 94765 - DNA, 75 bp, Artificial Sequence
  Synthetic
ggacaatgtcttcaacgtggctctttccgtactaaaagccttattcccgcagagcgacgccacccgcaagctaac

SEQ ID NO: 94766 - DNA, 75 bp, Artificial Sequence
  Synthetic
ttgaatgtgacaagtgtgaggcacgccaagagaccttggcctccttttcttacatttggtctggggtgccgctga

SEQ ID NO: 94767 - DNA, 75 bp, Artificial Sequence
  Synthetic
ttagtggcggacaccactaaggtgtatgtcaccaacccagacaatgttgggagaagggtggacaaggtgaccttc

SEQ ID NO: 94768 - DNA, 75 bp, Artificial Sequence
  Synthetic
cacctgtggtgaggccggtgggttctctgttggtggcggacactactaaggtgtacgtcactaacccagacaatg

SEQ ID NO: 94769 - DNA, 75 bp, Artificial Sequence
  Synthetic
tctgttggtggcggacactactaaggtgtacgtcactaacccagacaatgtggggaggagggtcgacaaggttac

SEQ ID NO: 94770 - DNA, 75 bp, Artificial Sequence
  Synthetic
ccggctccaggagatacttgaagggactccggtcccctttaccttgactgtgaaaaaggaggtgttcttcaaaga

SEQ ID NO: 94771 - DNA, 75 bp, Artificial Sequence
  Synthetic
ggccctggggaaatactacgcttctggtaccatggtcaccccggaaggggtgcccgtgggagagaggtattgtag

SEQ ID NO: 94772 - DNA, 75 bp, Artificial Sequence
  Synthetic
cttgcctccgaccatccagagtgggtgcgcgccctggggaagtactatgcttctggtaccatggttaccccggaa

SEQ ID NO: 94773 - DNA, 75 bp, Artificial Sequence
  Synthetic
ttaaggtgagagccgcctgcgagagagtgggtctgaaaaatgtctcactcctcatcgctggcgatgactgtttga

SEQ ID NO: 94774 - DNA, 75 bp, Artificial Sequence
  Synthetic
tgcgcgccctggggaagtactatgcttctggtaccatggttaccccggaaggggtacccgtgggagagaggtatt

SEQ ID NO: 94775 - DNA, 75 bp, Artificial Sequence
  Synthetic
tacatcaaggtgaaagccgcttgccagagagtgggactcaagaacgtctcgctgctcatagcaggtgatgactgt

SEQ ID NO: 94776 - DNA, 75 bp, Artificial Sequence
  Synthetic
acggtgggtcatcatccctcacgtgctaacctgcgcgtttaggggtggcggaacaccgtcggacccggtttggtg

SEQ ID NO: 94777 - DNA, 75 bp, Artificial Sequence
  Synthetic
gagcattgcggacacgcatgctccggtcgcgcggttgggcggagctggctagggggctgctatggcatccgggcc

SEQ ID NO: 94778 - DNA, 75 bp, Artificial Sequence
  Synthetic
gcgcacggtccacaggtgttggccctaccggtgtgaataagggcccgacgtcaggctcgtcgttaaaccgagccc

SEQ ID NO: 94779 - DNA, 75 bp, Artificial Sequence
  Synthetic
catcatggcagtccttctgcttcttctcgtggtggaggccggggccatttaggccccggccacccatgcatgtcg

SEQ ID NO: 94780 - DNA, 75 bp, Artificial Sequence
  Synthetic
catcatggcagtccttctgcttcttctcgtggtggaggccggggccattttggccccggccacccatgcatgtcg

SEQ ID NO: 94781 - DNA, 75 bp, Artificial Sequence
  Synthetic
catcatggcagtccttctgcttcttctcgtggtggaggccggggccatttcggccccggccacccatgcatgtcg

SEQ ID NO: 94782 - DNA, 75 bp, Artificial Sequence
  Synthetic
catcatggcagtccttctgcttcttctcgtggtggaggccggggccatttgggccccggccacccatgcatgtcg

SEQ ID NO: 94783 - DNA, 75 bp, Artificial Sequence
  Synthetic
ggttctgcctggagggcggatgcctggtggctctgggatgcacgatttgcactgaccgatgctggccactgtatc

SEQ ID NO: 94784 - DNA, 75 bp, Artificial Sequence
  Synthetic
gagctgggcagcctctatgggcccttgtcggtctcagccaacgtggcggggatcatagggctgggggaggtgtaa

SEQ ID NO: 94785 - DNA, 75 bp, Artificial Sequence
  Synthetic
gagctgggcagcctctatgggcccttgtcggtctcagccaacgtggcggggatcatagggctgggggaggtgtat

SEQ ID NO: 94786 - DNA, 75 bp, Artificial Sequence
  Synthetic
gagctgggcagcctctatgggcccttgtcggtctcagccaacgtggcggggatcatagggctgggggaggtgtac

SEQ ID NO: 94787 - DNA, 75 bp, Artificial Sequence
  Synthetic
gagctgggcagcctctatgggcccttgtcggtctcagccaacgtggcggggatcatagggctgggggaggtgtag

SEQ ID NO: 94788 - DNA, 75 bp, Artificial Sequence
  Synthetic
gagctgggcagcctctatgggcccttgtcggtctcagccaacgtggcggggatcttagggctgggggaggtgtaa

SEQ ID NO: 94789 - DNA, 75 bp, Artificial Sequence
  Synthetic
gagctgggcagcctctatgggcccttgtcggtctcagccaacgtggcggggatcttagggctgggggaggtgtat

SEQ ID NO: 94790 - DNA, 75 bp, Artificial Sequence
  Synthetic
gagctgggcagcctctatgggcccttgtcggtctcagccaacgtggcggggatcttagggctgggggaggtgtac

SEQ ID NO: 94791 - DNA, 75 bp, Artificial Sequence
  Synthetic
gagctgggcagcctctatgggcccttgtcggtctcagccaacgtggcggggatcttagggctgggggaggtgtag

SEQ ID NO: 94792 - DNA, 75 bp, Artificial Sequence
  Synthetic
gagctgggcagcctctatgggcccttgtcggtctcagccaacgtggcggggatcctagggctgggggaggtgtaa

SEQ ID NO: 94793 - DNA, 75 bp, Artificial Sequence
  Synthetic
gagctgggcagcctctatgggcccttgtcggtctcagccaacgtggcggggatcctagggctgggggaggtgtat

SEQ ID NO: 94794 - DNA, 75 bp, Artificial Sequence
  Synthetic
gagctgggcagcctctatgggcccttgtcggtctcagccaacgtggcggggatcctagggctgggggaggtgtac

SEQ ID NO: 94795 - DNA, 75 bp, Artificial Sequence
  Synthetic
gagctgggcagcctctatgggcccttgtcggtctcagccaacgtggcggggatcctagggctgggggaggtgtag

SEQ ID NO: 94796 - DNA, 75 bp, Artificial Sequence
  Synthetic
gagctgggcagcctctatgggcccttgtcggtctcagccaacgtggcggggatcgtagggctgggggaggtgtaa

SEQ ID NO: 94797 - DNA, 75 bp, Artificial Sequence
  Synthetic
gagctgggcagcctctatgggcccttgtcggtctcagccaacgtggcggggatcgtagggctgggggaggtgtat

SEQ ID NO: 94798 - DNA, 75 bp, Artificial Sequence
  Synthetic
gagctgggcagcctctatgggcccttgtcggtctcagccaacgtggcggggatcgtagggctgggggaggtgtac

SEQ ID NO: 94799 - DNA, 75 bp, Artificial Sequence
  Synthetic
gagctgggcagcctctatgggcccttgtcggtctcagccaacgtggcggggatcgtagggctgggggaggtgtag

SEQ ID NO: 94800 - DNA, 75 bp, Artificial Sequence
  Synthetic
gagctgggcagcctctatgggcccttgtcggtctcagcctacgtggcggggatcatagggctgggggaggtgtaa

SEQ ID NO: 94801 - DNA, 75 bp, Artificial Sequence
  Synthetic
gagctgggcagcctctatgggcccttgtcggtctcagcctacgtggcggggatcatagggctgggggaggtgtat

SEQ ID NO: 94802 - DNA, 75 bp, Artificial Sequence
  Synthetic
gagctgggcagcctctatgggcccttgtcggtctcagcctacgtggcggggatcatagggctgggggaggtgtac

SEQ ID NO: 94803 - DNA, 75 bp, Artificial Sequence
  Synthetic
gagctgggcagcctctatgggcccttgtcggtctcagcctacgtggcggggatcatagggctgggggaggtgtag

SEQ ID NO: 94804 - DNA, 75 bp, Artificial Sequence
  Synthetic
gagctgggcagcctctatgggcccttgtcggtctcagcctacgtggcggggatcttagggctgggggaggtgtaa

SEQ ID NO: 94805 - DNA, 75 bp, Artificial Sequence
  Synthetic
gagctgggcagcctctatgggcccttgtcggtctcagcctacgtggcggggatcttagggctgggggaggtgtat

SEQ ID NO: 94806 - DNA, 75 bp, Artificial Sequence
  Synthetic
gagctgggcagcctctatgggcccttgtcggtctcagcctacgtggcggggatcttagggctgggggaggtgtac

SEQ ID NO: 94807 - DNA, 75 bp, Artificial Sequence
  Synthetic
gagctgggcagcctctatgggcccttgtcggtctcagcctacgtggcggggatcttagggctgggggaggtgtag

SEQ ID NO: 94808 - DNA, 75 bp, Artificial Sequence
  Synthetic
gagctgggcagcctctatgggcccttgtcggtctcagcctacgtggcggggatcctagggctgggggaggtgtaa

SEQ ID NO: 94809 - DNA, 75 bp, Artificial Sequence
  Synthetic
gagctgggcagcctctatgggcccttgtcggtctcagcctacgtggcggggatcctagggctgggggaggtgtat

SEQ ID NO: 94810 - DNA, 75 bp, Artificial Sequence
  Synthetic
gagctgggcagcctctatgggcccttgtcggtctcagcctacgtggcggggatcctagggctgggggaggtgtac

SEQ ID NO: 94811 - DNA, 75 bp, Artificial Sequence
  Synthetic
gagctgggcagcctctatgggcccttgtcggtctcagcctacgtggcggggatcctagggctgggggaggtgtag

SEQ ID NO: 94812 - DNA, 75 bp, Artificial Sequence
  Synthetic
gagctgggcagcctctatgggcccttgtcggtctcagcctacgtggcggggatcgtagggctgggggaggtgtaa

SEQ ID NO: 94813 - DNA, 75 bp, Artificial Sequence
  Synthetic
gagctgggcagcctctatgggcccttgtcggtctcagcctacgtggcggggatcgtagggctgggggaggtgtat

SEQ ID NO: 94814 - DNA, 75 bp, Artificial Sequence
  Synthetic
gagctgggcagcctctatgggcccttgtcggtctcagcctacgtggcggggatcgtagggctgggggaggtgtac

SEQ ID NO: 94815 - DNA, 75 bp, Artificial Sequence
  Synthetic
gagctgggcagcctctatgggcccttgtcggtctcagcctacgtggcggggatcgtagggctgggggaggtgtag

SEQ ID NO: 94816 - DNA, 75 bp, Artificial Sequence
  Synthetic
gagctgggcagcctctatgggcccttgtcggtctcagcccacgtggcggggatcatagggctgggggaggtgtaa

SEQ ID NO: 94817 - DNA, 75 bp, Artificial Sequence
  Synthetic
gagctgggcagcctctatgggcccttgtcggtctcagcccacgtggcggggatcatagggctgggggaggtgtat

SEQ ID NO: 94818 - DNA, 75 bp, Artificial Sequence
  Synthetic
gagctgggcagcctctatgggcccttgtcggtctcagcccacgtggcggggatcatagggctgggggaggtgtac

SEQ ID NO: 94819 - DNA, 75 bp, Artificial Sequence
  Synthetic
gagctgggcagcctctatgggcccttgtcggtctcagcccacgtggcggggatcatagggctgggggaggtgtag

SEQ ID NO: 94820 - DNA, 75 bp, Artificial Sequence
  Synthetic
gagctgggcagcctctatgggcccttgtcggtctcagcccacgtggcggggatcttagggctgggggaggtgtaa

SEQ ID NO: 94821 - DNA, 75 bp, Artificial Sequence
  Synthetic
gagctgggcagcctctatgggcccttgtcggtctcagcccacgtggcggggatcttagggctgggggaggtgtat

SEQ ID NO: 94822 - DNA, 75 bp, Artificial Sequence
  Synthetic
gagctgggcagcctctatgggcccttgtcggtctcagcccacgtggcggggatcttagggctgggggaggtgtac

SEQ ID NO: 94823 - DNA, 75 bp, Artificial Sequence
  Synthetic
gagctgggcagcctctatgggcccttgtcggtctcagcccacgtggcggggatcttagggctgggggaggtgtag

SEQ ID NO: 94824 - DNA, 75 bp, Artificial Sequence
  Synthetic
gagctgggcagcctctatgggcccttgtcggtctcagcccacgtggcggggatcctagggctgggggaggtgtaa

SEQ ID NO: 94825 - DNA, 75 bp, Artificial Sequence
  Synthetic
gagctgggcagcctctatgggcccttgtcggtctcagcccacgtggcggggatcctagggctgggggaggtgtat

SEQ ID NO: 94826 - DNA, 75 bp, Artificial Sequence
  Synthetic
gagctgggcagcctctatgggcccttgtcggtctcagcccacgtggcggggatcctagggctgggggaggtgtac

SEQ ID NO: 94827 - DNA, 75 bp, Artificial Sequence
  Synthetic
gagctgggcagcctctatgggcccttgtcggtctcagcccacgtggcggggatcctagggctgggggaggtgtag

SEQ ID NO: 94828 - DNA, 75 bp, Artificial Sequence
  Synthetic
gagctgggcagcctctatgggcccttgtcggtctcagcccacgtggcggggatcgtagggctgggggaggtgtaa

SEQ ID NO: 94829 - DNA, 75 bp, Artificial Sequence
  Synthetic
gagctgggcagcctctatgggcccttgtcggtctcagcccacgtggcggggatcgtagggctgggggaggtgtat

SEQ ID NO: 94830 - DNA, 75 bp, Artificial Sequence
  Synthetic
gagctgggcagcctctatgggcccttgtcggtctcagcccacgtggcggggatcgtagggctgggggaggtgtac

SEQ ID NO: 94831 - DNA, 75 bp, Artificial Sequence
  Synthetic
gagctgggcagcctctatgggcccttgtcggtctcagcccacgtggcggggatcgtagggctgggggaggtgtag

SEQ ID NO: 94832 - DNA, 75 bp, Artificial Sequence
  Synthetic
gagctgggcagcctctatgggcccttgtcggtctcagccgacgtggcggggatcatagggctgggggaggtgtaa

SEQ ID NO: 94833 - DNA, 75 bp, Artificial Sequence
  Synthetic
gagctgggcagcctctatgggcccttgtcggtctcagccgacgtggcggggatcatagggctgggggaggtgtat

SEQ ID NO: 94834 - DNA, 75 bp, Artificial Sequence
  Synthetic
gagctgggcagcctctatgggcccttgtcggtctcagccgacgtggcggggatcatagggctgggggaggtgtac

SEQ ID NO: 94835 - DNA, 75 bp, Artificial Sequence
  Synthetic
gagctgggcagcctctatgggcccttgtcggtctcagccgacgtggcggggatcatagggctgggggaggtgtag

SEQ ID NO: 94836 - DNA, 75 bp, Artificial Sequence
  Synthetic
gagctgggcagcctctatgggcccttgtcggtctcagccgacgtggcggggatcttagggctgggggaggtgtaa

SEQ ID NO: 94837 - DNA, 75 bp, Artificial Sequence
  Synthetic
gagctgggcagcctctatgggcccttgtcggtctcagccgacgtggcggggatcttagggctgggggaggtgtat

SEQ ID NO: 94838 - DNA, 75 bp, Artificial Sequence
  Synthetic
gagctgggcagcctctatgggcccttgtcggtctcagccgacgtggcggggatcttagggctgggggaggtgtac

SEQ ID NO: 94839 - DNA, 75 bp, Artificial Sequence
  Synthetic
gagctgggcagcctctatgggcccttgtcggtctcagccgacgtggcggggatcttagggctgggggaggtgtag

SEQ ID NO: 94840 - DNA, 75 bp, Artificial Sequence
  Synthetic
gagctgggcagcctctatgggcccttgtcggtctcagccgacgtggcggggatcctagggctgggggaggtgtaa

SEQ ID NO: 94841 - DNA, 75 bp, Artificial Sequence
  Synthetic
gagctgggcagcctctatgggcccttgtcggtctcagccgacgtggcggggatcctagggctgggggaggtgtat

SEQ ID NO: 94842 - DNA, 75 bp, Artificial Sequence
  Synthetic
gagctgggcagcctctatgggcccttgtcggtctcagccgacgtggcggggatcctagggctgggggaggtgtac

SEQ ID NO: 94843 - DNA, 75 bp, Artificial Sequence
  Synthetic
gagctgggcagcctctatgggcccttgtcggtctcagccgacgtggcggggatcctagggctgggggaggtgtag

SEQ ID NO: 94844 - DNA, 75 bp, Artificial Sequence
  Synthetic
gagctgggcagcctctatgggcccttgtcggtctcagccgacgtggcggggatcgtagggctgggggaggtgtaa

SEQ ID NO: 94845 - DNA, 75 bp, Artificial Sequence
  Synthetic
gagctgggcagcctctatgggcccttgtcggtctcagccgacgtggcggggatcgtagggctgggggaggtgtat

SEQ ID NO: 94846 - DNA, 75 bp, Artificial Sequence
  Synthetic
gagctgggcagcctctatgggcccttgtcggtctcagccgacgtggcggggatcgtagggctgggggaggtgtac

SEQ ID NO: 94847 - DNA, 75 bp, Artificial Sequence
  Synthetic
gagctgggcagcctctatgggcccttgtcggtctcagccgacgtggcggggatcgtagggctgggggaggtgtag

SEQ ID NO: 94848 - DNA, 75 bp, Artificial Sequence
  Synthetic
gtggccctcgggtgcacggtttgtactgaccattgctggccgctgtatcaggcgggtttggccgtgcgacctggc

SEQ ID NO: 94849 - DNA, 75 bp, Artificial Sequence
  Synthetic
gcccaacctgacgtgtgcagttgaatgtgagctgaagtgggaaagtgagttttggagatggactgaacagctggc

SEQ ID NO: 94850 - DNA, 75 bp, Artificial Sequence
  Synthetic
gtcggtctcagcctacgtggctgggatcctggggctcggtgaggtctactcgggcgtcctcacggtgggggtggc

SEQ ID NO: 94851 - DNA, 75 bp, Artificial Sequence
  Synthetic
tggtcttcctgttggtgacgatggcggggatgacgcaaggcgcccctgccgccgttttggggtctcgccccttag

SEQ ID NO: 94852 - DNA, 75 bp, Artificial Sequence
  Synthetic
tggtcttcctgttggtgacgatggcggggatgacgcaaggcgcccctgccgccgttttggggtctcgcccctttg

SEQ ID NO: 94853 - DNA, 75 bp, Artificial Sequence
  Synthetic
tggtcttcctgttggtgacgatggcggggatgacgcaaggcgcccctgccgccgttttggggtctcgccccttcg

SEQ ID NO: 94854 - DNA, 75 bp, Artificial Sequence
  Synthetic
tggtcttcctgttggtgacgatggcggggatgacgcaaggcgcccctgccgccgttttggggtctcgccccttgg

SEQ ID NO: 94855 - DNA, 75 bp, Artificial Sequence
  Synthetic
tggtcttcctgttggtgacgatggcggggatgtcgcaaggcgcccctgccgccgttttggggtctcgccccttag

SEQ ID NO: 94856 - DNA, 75 bp, Artificial Sequence
  Synthetic
tggtcttcctgttggtgacgatggcggggatgtcgcaaggcgcccctgccgccgttttggggtctcgcccctttg

SEQ ID NO: 94857 - DNA, 75 bp, Artificial Sequence
  Synthetic
tggtcttcctgttggtgacgatggcggggatgtcgcaaggcgcccctgccgccgttttggggtctcgccccttcg

SEQ ID NO: 94858 - DNA, 75 bp, Artificial Sequence
  Synthetic
tggtcttcctgttggtgacgatggcggggatgtcgcaaggcgcccctgccgccgttttggggtctcgccccttgg

SEQ ID NO: 94859 - DNA, 75 bp, Artificial Sequence
  Synthetic
tggtcttcctgttggtgacgatggcggggatgccgcaaggcgcccctgccgccgttttggggtctcgccccttag

SEQ ID NO: 94860 - DNA, 75 bp, Artificial Sequence
  Synthetic
tggtcttcctgttggtgacgatggcggggatgccgcaaggcgcccctgccgccgttttggggtctcgcccctttg

SEQ ID NO: 94861 - DNA, 75 bp, Artificial Sequence
  Synthetic
tggtcttcctgttggtgacgatggcggggatgccgcaaggcgcccctgccgccgttttggggtctcgccccttcg

SEQ ID NO: 94862 - DNA, 75 bp, Artificial Sequence
  Synthetic
tggtcttcctgttggtgacgatggcggggatgccgcaaggcgcccctgccgccgttttggggtctcgccccttgg

SEQ ID NO: 94863 - DNA, 75 bp, Artificial Sequence
  Synthetic
tggtcttcctgttggtgacgatggcggggatggcgcaaggcgcccctgccgccgttttggggtctcgccccttag

SEQ ID NO: 94864 - DNA, 75 bp, Artificial Sequence
  Synthetic
tggtcttcctgttggtgacgatggcggggatggcgcaaggcgcccctgccgccgttttggggtctcgcccctttg

SEQ ID NO: 94865 - DNA, 75 bp, Artificial Sequence
  Synthetic
tggtcttcctgttggtgacgatggcggggatggcgcaaggcgcccctgccgccgttttggggtctcgccccttcg

SEQ ID NO: 94866 - DNA, 75 bp, Artificial Sequence
  Synthetic
tggtcttcctgttggtgacgatggcggggatggcgcaaggcgcccctgccgccgttttggggtctcgccccttgg

SEQ ID NO: 94867 - DNA, 75 bp, Artificial Sequence
  Synthetic
atgatcactggtgagaaggtctgggaacgagggaatgtgacacttgtgtgtgattgccccaacggaccgtgggtg

SEQ ID NO: 94868 - DNA, 75 bp, Artificial Sequence
  Synthetic
atgatcactggtgagaaggtctgggaacgagggaatgtgacacttgtgtgtgattgccccaacggtccgtgggtg

SEQ ID NO: 94869 - DNA, 75 bp, Artificial Sequence
  Synthetic
atgatcactggtgagaaggtctgggaacgagggaatgtgacacttgtgtgtgattgccccaacggcccgtgggtg

SEQ ID NO: 94870 - DNA, 75 bp, Artificial Sequence
  Synthetic
atgatcactggtgagaaggtctgggaacgagggaatgtgacacttgtgtgtgattgccccaacgggccgtgggtg

SEQ ID NO: 94871 - DNA, 75 bp, Artificial Sequence
  Synthetic
atgatcactggtgagaaggtctgggatcgagggaatgtgacacttgtgtgtgattgccccaacggaccgtgggtg

SEQ ID NO: 94872 - DNA, 75 bp, Artificial Sequence
  Synthetic
atgatcactggtgagaaggtctgggatcgagggaatgtgacacttgtgtgtgattgccccaacggtccgtgggtg

SEQ ID NO: 94873 - DNA, 75 bp, Artificial Sequence
  Synthetic
atgatcactggtgagaaggtctgggatcgagggaatgtgacacttgtgtgtgattgccccaacggcccgtgggtg

SEQ ID NO: 94874 - DNA, 75 bp, Artificial Sequence
  Synthetic
atgatcactggtgagaaggtctgggatcgagggaatgtgacacttgtgtgtgattgccccaacgggccgtgggtg

SEQ ID NO: 94875 - DNA, 75 bp, Artificial Sequence
  Synthetic
atgatcactggtgagaaggtctgggaccgagggaatgtgacacttgtgtgtgattgccccaacggaccgtgggtg

SEQ ID NO: 94876 - DNA, 75 bp, Artificial Sequence
  Synthetic
atgatcactggtgagaaggtctgggaccgagggaatgtgacacttgtgtgtgattgccccaacggtccgtgggtg

SEQ ID NO: 94877 - DNA, 75 bp, Artificial Sequence
  Synthetic
atgatcactggtgagaaggtctgggaccgagggaatgtgacacttgtgtgtgattgccccaacggcccgtgggtg

SEQ ID NO: 94878 - DNA, 75 bp, Artificial Sequence
  Synthetic
atgatcactggtgagaaggtctgggaccgagggaatgtgacacttgtgtgtgattgccccaacgggccgtgggtg

SEQ ID NO: 94879 - DNA, 75 bp, Artificial Sequence
  Synthetic
atgatcactggtgagaaggtctgggagcgagggaatgtgacacttgtgtgtgattgccccaacggaccgtgggtg

SEQ ID NO: 94880 - DNA, 75 bp, Artificial Sequence
  Synthetic
atgatcactggtgagaaggtctgggagcgagggaatgtgacacttgtgtgtgattgccccaacggtccgtgggtg

SEQ ID NO: 94881 - DNA, 75 bp, Artificial Sequence
  Synthetic
atgatcactggtgagaaggtctgggagcgagggaatgtgacacttgtgtgtgattgccccaacggcccgtgggtg

SEQ ID NO: 94882 - DNA, 75 bp, Artificial Sequence
  Synthetic
atgatcactggtgagaaggtctgggagcgagggaatgtgacacttgtgtgtgattgccccaacgggccgtgggtg

SEQ ID NO: 94883 - DNA, 75 bp, Artificial Sequence
  Synthetic
ttgatcactggtgagaaggtctgggaacgagggaatgtgacacttgtgtgtgattgccccaacggaccgtgggtg

SEQ ID NO: 94884 - DNA, 75 bp, Artificial Sequence
  Synthetic
ttgatcactggtgagaaggtctgggaacgagggaatgtgacacttgtgtgtgattgccccaacggtccgtgggtg

SEQ ID NO: 94885 - DNA, 75 bp, Artificial Sequence
  Synthetic
ttgatcactggtgagaaggtctgggaacgagggaatgtgacacttgtgtgtgattgccccaacggcccgtgggtg

SEQ ID NO: 94886 - DNA, 75 bp, Artificial Sequence
  Synthetic
ttgatcactggtgagaaggtctgggaacgagggaatgtgacacttgtgtgtgattgccccaacgggccgtgggtg

SEQ ID NO: 94887 - DNA, 75 bp, Artificial Sequence
  Synthetic
ttgatcactggtgagaaggtctgggatcgagggaatgtgacacttgtgtgtgattgccccaacggaccgtgggtg

SEQ ID NO: 94888 - DNA, 75 bp, Artificial Sequence
  Synthetic
ttgatcactggtgagaaggtctgggatcgagggaatgtgacacttgtgtgtgattgccccaacggtccgtgggtg

SEQ ID NO: 94889 - DNA, 75 bp, Artificial Sequence
  Synthetic
ttgatcactggtgagaaggtctgggatcgagggaatgtgacacttgtgtgtgattgccccaacggcccgtgggtg

SEQ ID NO: 94890 - DNA, 75 bp, Artificial Sequence
  Synthetic
ttgatcactggtgagaaggtctgggatcgagggaatgtgacacttgtgtgtgattgccccaacgggccgtgggtg

SEQ ID NO: 94891 - DNA, 75 bp, Artificial Sequence
  Synthetic
ttgatcactggtgagaaggtctgggaccgagggaatgtgacacttgtgtgtgattgccccaacggaccgtgggtg

SEQ ID NO: 94892 - DNA, 75 bp, Artificial Sequence
  Synthetic
ttgatcactggtgagaaggtctgggaccgagggaatgtgacacttgtgtgtgattgccccaacggtccgtgggtg

SEQ ID NO: 94893 - DNA, 75 bp, Artificial Sequence
  Synthetic
ttgatcactggtgagaaggtctgggaccgagggaatgtgacacttgtgtgtgattgccccaacggcccgtgggtg

SEQ ID NO: 94894 - DNA, 75 bp, Artificial Sequence
  Synthetic
ttgatcactggtgagaaggtctgggaccgagggaatgtgacacttgtgtgtgattgccccaacgggccgtgggtg

SEQ ID NO: 94895 - DNA, 75 bp, Artificial Sequence
  Synthetic
ttgatcactggtgagaaggtctgggagcgagggaatgtgacacttgtgtgtgattgccccaacggaccgtgggtg

SEQ ID NO: 94896 - DNA, 75 bp, Artificial Sequence
  Synthetic
ttgatcactggtgagaaggtctgggagcgagggaatgtgacacttgtgtgtgattgccccaacggtccgtgggtg

SEQ ID NO: 94897 - DNA, 75 bp, Artificial Sequence
  Synthetic
ttgatcactggtgagaaggtctgggagcgagggaatgtgacacttgtgtgtgattgccccaacggcccgtgggtg

SEQ ID NO: 94898 - DNA, 75 bp, Artificial Sequence
  Synthetic
ttgatcactggtgagaaggtctgggagcgagggaatgtgacacttgtgtgtgattgccccaacgggccgtgggtg

SEQ ID NO: 94899 - DNA, 75 bp, Artificial Sequence
  Synthetic
ctgatcactggtgagaaggtctgggaacgagggaatgtgacacttgtgtgtgattgccccaacggaccgtgggtg

SEQ ID NO: 94900 - DNA, 75 bp, Artificial Sequence
  Synthetic
ctgatcactggtgagaaggtctgggaacgagggaatgtgacacttgtgtgtgattgccccaacggtccgtgggtg

SEQ ID NO: 94901 - DNA, 75 bp, Artificial Sequence
  Synthetic
ctgatcactggtgagaaggtctgggaacgagggaatgtgacacttgtgtgtgattgccccaacggcccgtgggtg

SEQ ID NO: 94902 - DNA, 75 bp, Artificial Sequence
  Synthetic
ctgatcactggtgagaaggtctgggaacgagggaatgtgacacttgtgtgtgattgccccaacgggccgtgggtg

SEQ ID NO: 94903 - DNA, 75 bp, Artificial Sequence
  Synthetic
ctgatcactggtgagaaggtctgggatcgagggaatgtgacacttgtgtgtgattgccccaacggaccgtgggtg

SEQ ID NO: 94904 - DNA, 75 bp, Artificial Sequence
  Synthetic
ctgatcactggtgagaaggtctgggatcgagggaatgtgacacttgtgtgtgattgccccaacggtccgtgggtg

SEQ ID NO: 94905 - DNA, 75 bp, Artificial Sequence
  Synthetic
ctgatcactggtgagaaggtctgggatcgagggaatgtgacacttgtgtgtgattgccccaacggcccgtgggtg

SEQ ID NO: 94906 - DNA, 75 bp, Artificial Sequence
  Synthetic
ctgatcactggtgagaaggtctgggatcgagggaatgtgacacttgtgtgtgattgccccaacgggccgtgggtg

SEQ ID NO: 94907 - DNA, 75 bp, Artificial Sequence
  Synthetic
ctgatcactggtgagaaggtctgggaccgagggaatgtgacacttgtgtgtgattgccccaacggaccgtgggtg

SEQ ID NO: 94908 - DNA, 75 bp, Artificial Sequence
  Synthetic
ctgatcactggtgagaaggtctgggaccgagggaatgtgacacttgtgtgtgattgccccaacggtccgtgggtg

SEQ ID NO: 94909 - DNA, 75 bp, Artificial Sequence
  Synthetic
ctgatcactggtgagaaggtctgggaccgagggaatgtgacacttgtgtgtgattgccccaacggcccgtgggtg

SEQ ID NO: 94910 - DNA, 75 bp, Artificial Sequence
  Synthetic
ctgatcactggtgagaaggtctgggaccgagggaatgtgacacttgtgtgtgattgccccaacgggccgtgggtg

SEQ ID NO: 94911 - DNA, 75 bp, Artificial Sequence
  Synthetic
ctgatcactggtgagaaggtctgggagcgagggaatgtgacacttgtgtgtgattgccccaacggaccgtgggtg

SEQ ID NO: 94912 - DNA, 75 bp, Artificial Sequence
  Synthetic
ctgatcactggtgagaaggtctgggagcgagggaatgtgacacttgtgtgtgattgccccaacggtccgtgggtg

SEQ ID NO: 94913 - DNA, 75 bp, Artificial Sequence
  Synthetic
ctgatcactggtgagaaggtctgggagcgagggaatgtgacacttgtgtgtgattgccccaacggcccgtgggtg

SEQ ID NO: 94914 - DNA, 75 bp, Artificial Sequence
  Synthetic
ctgatcactggtgagaaggtctgggagcgagggaatgtgacacttgtgtgtgattgccccaacgggccgtgggtg

SEQ ID NO: 94915 - DNA, 75 bp, Artificial Sequence
  Synthetic
gtgatcactggtgagaaggtctgggaacgagggaatgtgacacttgtgtgtgattgccccaacggaccgtgggtg

SEQ ID NO: 94916 - DNA, 75 bp, Artificial Sequence
  Synthetic
gtgatcactggtgagaaggtctgggaacgagggaatgtgacacttgtgtgtgattgccccaacggtccgtgggtg

SEQ ID NO: 94917 - DNA, 75 bp, Artificial Sequence
  Synthetic
gtgatcactggtgagaaggtctgggaacgagggaatgtgacacttgtgtgtgattgccccaacggcccgtgggtg

SEQ ID NO: 94918 - DNA, 75 bp, Artificial Sequence
  Synthetic
gtgatcactggtgagaaggtctgggaacgagggaatgtgacacttgtgtgtgattgccccaacgggccgtgggtg

SEQ ID NO: 94919 - DNA, 75 bp, Artificial Sequence
  Synthetic
gtgatcactggtgagaaggtctgggatcgagggaatgtgacacttgtgtgtgattgccccaacggaccgtgggtg

SEQ ID NO: 94920 - DNA, 75 bp, Artificial Sequence
  Synthetic
gtgatcactggtgagaaggtctgggatcgagggaatgtgacacttgtgtgtgattgccccaacggtccgtgggtg

SEQ ID NO: 94921 - DNA, 75 bp, Artificial Sequence
  Synthetic
gtgatcactggtgagaaggtctgggatcgagggaatgtgacacttgtgtgtgattgccccaacggcccgtgggtg

SEQ ID NO: 94922 - DNA, 75 bp, Artificial Sequence
  Synthetic
gtgatcactggtgagaaggtctgggatcgagggaatgtgacacttgtgtgtgattgccccaacgggccgtgggtg

SEQ ID NO: 94923 - DNA, 75 bp, Artificial Sequence
  Synthetic
gtgatcactggtgagaaggtctgggaccgagggaatgtgacacttgtgtgtgattgccccaacggaccgtgggtg

SEQ ID NO: 94924 - DNA, 75 bp, Artificial Sequence
  Synthetic
gtgatcactggtgagaaggtctgggaccgagggaatgtgacacttgtgtgtgattgccccaacggtccgtgggtg

SEQ ID NO: 94925 - DNA, 75 bp, Artificial Sequence
  Synthetic
gtgatcactggtgagaaggtctgggaccgagggaatgtgacacttgtgtgtgattgccccaacggcccgtgggtg

SEQ ID NO: 94926 - DNA, 75 bp, Artificial Sequence
  Synthetic
gtgatcactggtgagaaggtctgggaccgagggaatgtgacacttgtgtgtgattgccccaacgggccgtgggtg

SEQ ID NO: 94927 - DNA, 75 bp, Artificial Sequence
  Synthetic
gtgatcactggtgagaaggtctgggagcgagggaatgtgacacttgtgtgtgattgccccaacggaccgtgggtg

SEQ ID NO: 94928 - DNA, 75 bp, Artificial Sequence
  Synthetic
gtgatcactggtgagaaggtctgggagcgagggaatgtgacacttgtgtgtgattgccccaacggtccgtgggtg

SEQ ID NO: 94929 - DNA, 75 bp, Artificial Sequence
  Synthetic
gtgatcactggtgagaaggtctgggagcgagggaatgtgacacttgtgtgtgattgccccaacggcccgtgggtg

SEQ ID NO: 94930 - DNA, 75 bp, Artificial Sequence
  Synthetic
gtgatcactggtgagaaggtctgggagcgagggaatgtgacacttgtgtgtgattgccccaacgggccgtgggtg

SEQ ID NO: 94931 - DNA, 75 bp, Artificial Sequence
  Synthetic
tggagatgggttccaggcctttcgaggccgggctgacttggcagtcctgttcttgcaggtccaacgggtcccgtg

SEQ ID NO: 94932 - DNA, 75 bp, Artificial Sequence
  Synthetic
tgggctggggtgatcctatcactcactggagccacggacaaaatcagtggcccctgtcgtgcccccaatatgtct

SEQ ID NO: 94933 - DNA, 75 bp, Artificial Sequence
  Synthetic
tccactggtggtcgcgattcaaagatcgatgtgtggagtttggtaccagttggatctgccaactgtaccatagcc

SEQ ID NO: 94934 - DNA, 75 bp, Artificial Sequence
  Synthetic
tccactggtggtcgcgattcaaagatcgatgtgtggagtttggtaccagttggatctgccatctgtaccatagcc

SEQ ID NO: 94935 - DNA, 75 bp, Artificial Sequence
  Synthetic
tccactggtggtcgcgattcaaagatcgatgtgtggagtttggtaccagttggatctgccacctgtaccatagcc

SEQ ID NO: 94936 - DNA, 75 bp, Artificial Sequence
  Synthetic
tccactggtggtcgcgattcaaagatcgatgtgtggagtttggtaccagttggatctgccagctgtaccatagcc

SEQ ID NO: 94937 - DNA, 75 bp, Artificial Sequence
  Synthetic
tccactggtggtcgcgattcaaagatcgatgtgtggagtttggtaccagttggttctgccaactgtaccatagcc

SEQ ID NO: 94938 - DNA, 75 bp, Artificial Sequence
  Synthetic
tccactggtggtcgcgattcaaagatcgatgtgtggagtttggtaccagttggttctgccatctgtaccatagcc

SEQ ID NO: 94939 - DNA, 75 bp, Artificial Sequence
  Synthetic
tccactggtggtcgcgattcaaagatcgatgtgtggagtttggtaccagttggttctgccacctgtaccatagcc

SEQ ID NO: 94940 - DNA, 75 bp, Artificial Sequence
  Synthetic
tccactggtggtcgcgattcaaagatcgatgtgtggagtttggtaccagttggttctgccagctgtaccatagcc

SEQ ID NO: 94941 - DNA, 75 bp, Artificial Sequence
  Synthetic
tccactggtggtcgcgattcaaagatcgatgtgtggagtttggtaccagttggctctgccaactgtaccatagcc

SEQ ID NO: 94942 - DNA, 75 bp, Artificial Sequence
  Synthetic
tccactggtggtcgcgattcaaagatcgatgtgtggagtttggtaccagttggctctgccatctgtaccatagcc

SEQ ID NO: 94943 - DNA, 75 bp, Artificial Sequence
  Synthetic
tccactggtggtcgcgattcaaagatcgatgtgtggagtttggtaccagttggctctgccacctgtaccatagcc

SEQ ID NO: 94944 - DNA, 75 bp, Artificial Sequence
  Synthetic
tccactggtggtcgcgattcaaagatcgatgtgtggagtttggtaccagttggctctgccagctgtaccatagcc

SEQ ID NO: 94945 - DNA, 75 bp, Artificial Sequence
  Synthetic
tccactggtggtcgcgattcaaagatcgatgtgtggagtttggtaccagttgggtctgccaactgtaccatagcc

SEQ ID NO: 94946 - DNA, 75 bp, Artificial Sequence
  Synthetic
tccactggtggtcgcgattcaaagatcgatgtgtggagtttggtaccagttgggtctgccatctgtaccatagcc

SEQ ID NO: 94947 - DNA, 75 bp, Artificial Sequence
  Synthetic
tccactggtggtcgcgattcaaagatcgatgtgtggagtttggtaccagttgggtctgccacctgtaccatagcc

SEQ ID NO: 94948 - DNA, 75 bp, Artificial Sequence
  Synthetic
tccactggtggtcgcgattcaaagatcgatgtgtggagtttggtaccagttgggtctgccagctgtaccatagcc

SEQ ID NO: 94949 - DNA, 75 bp, Artificial Sequence
  Synthetic
tccactggtggtcgcgattcaaagatcgatgtgtggagtttggttccagttggatctgccaactgtaccatagcc

SEQ ID NO: 94950 - DNA, 75 bp, Artificial Sequence
  Synthetic
tccactggtggtcgcgattcaaagatcgatgtgtggagtttggttccagttggatctgccatctgtaccatagcc

SEQ ID NO: 94951 - DNA, 75 bp, Artificial Sequence
  Synthetic
tccactggtggtcgcgattcaaagatcgatgtgtggagtttggttccagttggatctgccacctgtaccatagcc

SEQ ID NO: 94952 - DNA, 75 bp, Artificial Sequence
  Synthetic
tccactggtggtcgcgattcaaagatcgatgtgtggagtttggttccagttggatctgccagctgtaccatagcc

SEQ ID NO: 94953 - DNA, 75 bp, Artificial Sequence
  Synthetic
tccactggtggtcgcgattcaaagatcgatgtgtggagtttggttccagttggttctgccaactgtaccatagcc

SEQ ID NO: 94954 - DNA, 75 bp, Artificial Sequence
  Synthetic
tccactggtggtcgcgattcaaagatcgatgtgtggagtttggttccagttggttctgccatctgtaccatagcc

SEQ ID NO: 94955 - DNA, 75 bp, Artificial Sequence
  Synthetic
tccactggtggtcgcgattcaaagatcgatgtgtggagtttggttccagttggttctgccacctgtaccatagcc

SEQ ID NO: 94956 - DNA, 75 bp, Artificial Sequence
  Synthetic
tccactggtggtcgcgattcaaagatcgatgtgtggagtttggttccagttggttctgccagctgtaccatagcc

SEQ ID NO: 94957 - DNA, 75 bp, Artificial Sequence
  Synthetic
tccactggtggtcgcgattcaaagatcgatgtgtggagtttggttccagttggctctgccaactgtaccatagcc

SEQ ID NO: 94958 - DNA, 75 bp, Artificial Sequence
  Synthetic
tccactggtggtcgcgattcaaagatcgatgtgtggagtttggttccagttggctctgccatctgtaccatagcc

SEQ ID NO: 94959 - DNA, 75 bp, Artificial Sequence
  Synthetic
tccactggtggtcgcgattcaaagatcgatgtgtggagtttggttccagttggctctgccacctgtaccatagcc

SEQ ID NO: 94960 - DNA, 75 bp, Artificial Sequence
  Synthetic
tccactggtggtcgcgattcaaagatcgatgtgtggagtttggttccagttggctctgccagctgtaccatagcc

SEQ ID NO: 94961 - DNA, 75 bp, Artificial Sequence
  Synthetic
tccactggtggtcgcgattcaaagatcgatgtgtggagtttggttccagttgggtctgccaactgtaccatagcc

SEQ ID NO: 94962 - DNA, 75 bp, Artificial Sequence
  Synthetic
tccactggtggtcgcgattcaaagatcgatgtgtggagtttggttccagttgggtctgccatctgtaccatagcc

SEQ ID NO: 94963 - DNA, 75 bp, Artificial Sequence
  Synthetic
tccactggtggtcgcgattcaaagatcgatgtgtggagtttggttccagttgggtctgccacctgtaccatagcc

SEQ ID NO: 94964 - DNA, 75 bp, Artificial Sequence
  Synthetic
tccactggtggtcgcgattcaaagatcgatgtgtggagtttggttccagttgggtctgccagctgtaccatagcc

SEQ ID NO: 94965 - DNA, 75 bp, Artificial Sequence
  Synthetic
tccactggtggtcgcgattcaaagatcgatgtgtggagtttggtcccagttggatctgccaactgtaccatagcc

SEQ ID NO: 94966 - DNA, 75 bp, Artificial Sequence
  Synthetic
tccactggtggtcgcgattcaaagatcgatgtgtggagtttggtcccagttggatctgccatctgtaccatagcc

SEQ ID NO: 94967 - DNA, 75 bp, Artificial Sequence
  Synthetic
tccactggtggtcgcgattcaaagatcgatgtgtggagtttggtcccagttggatctgccacctgtaccatagcc

SEQ ID NO: 94968 - DNA, 75 bp, Artificial Sequence
  Synthetic
tccactggtggtcgcgattcaaagatcgatgtgtggagtttggtcccagttggatctgccagctgtaccatagcc

SEQ ID NO: 94969 - DNA, 75 bp, Artificial Sequence
  Synthetic
tccactggtggtcgcgattcaaagatcgatgtgtggagtttggtcccagttggttctgccaactgtaccatagcc

SEQ ID NO: 94970 - DNA, 75 bp, Artificial Sequence
  Synthetic
tccactggtggtcgcgattcaaagatcgatgtgtggagtttggtcccagttggttctgccatctgtaccatagcc

SEQ ID NO: 94971 - DNA, 75 bp, Artificial Sequence
  Synthetic
tccactggtggtcgcgattcaaagatcgatgtgtggagtttggtcccagttggttctgccacctgtaccatagcc

SEQ ID NO: 94972 - DNA, 75 bp, Artificial Sequence
  Synthetic
tccactggtggtcgcgattcaaagatcgatgtgtggagtttggtcccagttggttctgccagctgtaccatagcc

SEQ ID NO: 94973 - DNA, 75 bp, Artificial Sequence
  Synthetic
tccactggtggtcgcgattcaaagatcgatgtgtggagtttggtcccagttggctctgccaactgtaccatagcc

SEQ ID NO: 94974 - DNA, 75 bp, Artificial Sequence
  Synthetic
tccactggtggtcgcgattcaaagatcgatgtgtggagtttggtcccagttggctctgccatctgtaccatagcc

SEQ ID NO: 94975 - DNA, 75 bp, Artificial Sequence
  Synthetic
tccactggtggtcgcgattcaaagatcgatgtgtggagtttggtcccagttggctctgccacctgtaccatagcc

SEQ ID NO: 94976 - DNA, 75 bp, Artificial Sequence
  Synthetic
tccactggtggtcgcgattcaaagatcgatgtgtggagtttggtcccagttggctctgccagctgtaccatagcc

SEQ ID NO: 94977 - DNA, 75 bp, Artificial Sequence
  Synthetic
tccactggtggtcgcgattcaaagatcgatgtgtggagtttggtcccagttgggtctgccaactgtaccatagcc

SEQ ID NO: 94978 - DNA, 75 bp, Artificial Sequence
  Synthetic
tccactggtggtcgcgattcaaagatcgatgtgtggagtttggtcccagttgggtctgccatctgtaccatagcc

SEQ ID NO: 94979 - DNA, 75 bp, Artificial Sequence
  Synthetic
tccactggtggtcgcgattcaaagatcgatgtgtggagtttggtcccagttgggtctgccacctgtaccatagcc

SEQ ID NO: 94980 - DNA, 75 bp, Artificial Sequence
  Synthetic
tccactggtggtcgcgattcaaagatcgatgtgtggagtttggtcccagttgggtctgccagctgtaccatagcc

SEQ ID NO: 94981 - DNA, 75 bp, Artificial Sequence
  Synthetic
tccactggtggtcgcgattcaaagatcgatgtgtggagtttggtgccagttggatctgccaactgtaccatagcc

SEQ ID NO: 94982 - DNA, 75 bp, Artificial Sequence
  Synthetic
tccactggtggtcgcgattcaaagatcgatgtgtggagtttggtgccagttggatctgccatctgtaccatagcc

SEQ ID NO: 94983 - DNA, 75 bp, Artificial Sequence
  Synthetic
tccactggtggtcgcgattcaaagatcgatgtgtggagtttggtgccagttggatctgccacctgtaccatagcc

SEQ ID NO: 94984 - DNA, 75 bp, Artificial Sequence
  Synthetic
tccactggtggtcgcgattcaaagatcgatgtgtggagtttggtgccagttggatctgccagctgtaccatagcc

SEQ ID NO: 94985 - DNA, 75 bp, Artificial Sequence
  Synthetic
tccactggtggtcgcgattcaaagatcgatgtgtggagtttggtgccagttggttctgccaactgtaccatagcc

SEQ ID NO: 94986 - DNA, 75 bp, Artificial Sequence
  Synthetic
tccactggtggtcgcgattcaaagatcgatgtgtggagtttggtgccagttggttctgccatctgtaccatagcc

SEQ ID NO: 94987 - DNA, 75 bp, Artificial Sequence
  Synthetic
tccactggtggtcgcgattcaaagatcgatgtgtggagtttggtgccagttggttctgccacctgtaccatagcc

SEQ ID NO: 94988 - DNA, 75 bp, Artificial Sequence
  Synthetic
tccactggtggtcgcgattcaaagatcgatgtgtggagtttggtgccagttggttctgccagctgtaccatagcc

SEQ ID NO: 94989 - DNA, 75 bp, Artificial Sequence
  Synthetic
tccactggtggtcgcgattcaaagatcgatgtgtggagtttggtgccagttggctctgccaactgtaccatagcc

SEQ ID NO: 94990 - DNA, 75 bp, Artificial Sequence
  Synthetic
tccactggtggtcgcgattcaaagatcgatgtgtggagtttggtgccagttggctctgccatctgtaccatagcc

SEQ ID NO: 94991 - DNA, 75 bp, Artificial Sequence
  Synthetic
tccactggtggtcgcgattcaaagatcgatgtgtggagtttggtgccagttggctctgccacctgtaccatagcc

SEQ ID NO: 94992 - DNA, 75 bp, Artificial Sequence
  Synthetic
tccactggtggtcgcgattcaaagatcgatgtgtggagtttggtgccagttggctctgccagctgtaccatagcc

SEQ ID NO: 94993 - DNA, 75 bp, Artificial Sequence
  Synthetic
tccactggtggtcgcgattcaaagatcgatgtgtggagtttggtgccagttgggtctgccaactgtaccatagcc

SEQ ID NO: 94994 - DNA, 75 bp, Artificial Sequence
  Synthetic
tccactggtggtcgcgattcaaagatcgatgtgtggagtttggtgccagttgggtctgccatctgtaccatagcc

SEQ ID NO: 94995 - DNA, 75 bp, Artificial Sequence
  Synthetic
tccactggtggtcgcgattcaaagatcgatgtgtggagtttggtgccagttgggtctgccacctgtaccatagcc

SEQ ID NO: 94996 - DNA, 75 bp, Artificial Sequence
  Synthetic
tccactggtggtcgcgattcaaagatcgatgtgtggagtttggtgccagttgggtctgccagctgtaccatagcc

SEQ ID NO: 94997 - DNA, 75 bp, Artificial Sequence
  Synthetic
tcgatgtgtggagtttggtaccagttggatctgccagctgtaccatagccgcactcgggtcatcggatggtgaca

SEQ ID NO: 94998 - DNA, 75 bp, Artificial Sequence
  Synthetic
tcgatgtgtggagtttggtaccagttggatctgccagctgtaccatagccgcactcgggtcttcggatggtgaca

SEQ ID NO: 94999 - DNA, 75 bp, Artificial Sequence
  Synthetic
tcgatgtgtggagtttggtaccagttggatctgccagctgtaccatagccgcactcgggtcctcggatggtgaca

SEQ ID NO: 95000 - DNA, 75 bp, Artificial Sequence
  Synthetic
tcgatgtgtggagtttggtaccagttggatctgccagctgtaccatagccgcactcgggtcgtcggatggtgaca

SEQ ID NO: 95001 - DNA, 75 bp, Artificial Sequence
  Synthetic
tcgatgtgtggagtttggtaccagttggttctgccagctgtaccatagccgcactcgggtcatcggatggtgaca

SEQ ID NO: 95002 - DNA, 75 bp, Artificial Sequence
  Synthetic
tcgatgtgtggagtttggtaccagttggttctgccagctgtaccatagccgcactcgggtcttcggatggtgaca

SEQ ID NO: 95003 - DNA, 75 bp, Artificial Sequence
  Synthetic
tcgatgtgtggagtttggtaccagttggttctgccagctgtaccatagccgcactcgggtcctcggatggtgaca

SEQ ID NO: 95004 - DNA, 75 bp, Artificial Sequence
  Synthetic
tcgatgtgtggagtttggtaccagttggttctgccagctgtaccatagccgcactcgggtcgtcggatggtgaca

SEQ ID NO: 95005 - DNA, 75 bp, Artificial Sequence
  Synthetic
tcgatgtgtggagtttggtaccagttggctctgccagctgtaccatagccgcactcgggtcatcggatggtgaca

SEQ ID NO: 95006 - DNA, 75 bp, Artificial Sequence
  Synthetic
tcgatgtgtggagtttggtaccagttggctctgccagctgtaccatagccgcactcgggtcttcggatggtgaca

SEQ ID NO: 95007 - DNA, 75 bp, Artificial Sequence
  Synthetic
tcgatgtgtggagtttggtaccagttggctctgccagctgtaccatagccgcactcgggtcctcggatggtgaca

SEQ ID NO: 95008 - DNA, 75 bp, Artificial Sequence
  Synthetic
tcgatgtgtggagtttggtaccagttggctctgccagctgtaccatagccgcactcgggtcgtcggatggtgaca

SEQ ID NO: 95009 - DNA, 75 bp, Artificial Sequence
  Synthetic
tcgatgtgtggagtttggtaccagttgggtctgccagctgtaccatagccgcactcgggtcatcggatggtgaca

SEQ ID NO: 95010 - DNA, 75 bp, Artificial Sequence
  Synthetic
tcgatgtgtggagtttggtaccagttgggtctgccagctgtaccatagccgcactcgggtcttcggatggtgaca

SEQ ID NO: 95011 - DNA, 75 bp, Artificial Sequence
  Synthetic
tcgatgtgtggagtttggtaccagttgggtctgccagctgtaccatagccgcactcgggtcctcggatggtgaca

SEQ ID NO: 95012 - DNA, 75 bp, Artificial Sequence
  Synthetic
tcgatgtgtggagtttggtaccagttgggtctgccagctgtaccatagccgcactcgggtcgtcggatggtgaca

SEQ ID NO: 95013 - DNA, 75 bp, Artificial Sequence
  Synthetic
tcgatgtgtggagtttggttccagttggatctgccagctgtaccatagccgcactcgggtcatcggatggtgaca

SEQ ID NO: 95014 - DNA, 75 bp, Artificial Sequence
  Synthetic
tcgatgtgtggagtttggttccagttggatctgccagctgtaccatagccgcactcgggtcttcggatggtgaca

SEQ ID NO: 95015 - DNA, 75 bp, Artificial Sequence
  Synthetic
tcgatgtgtggagtttggttccagttggatctgccagctgtaccatagccgcactcgggtcctcggatggtgaca

SEQ ID NO: 95016 - DNA, 75 bp, Artificial Sequence
  Synthetic
tcgatgtgtggagtttggttccagttggatctgccagctgtaccatagccgcactcgggtcgtcggatggtgaca

SEQ ID NO: 95017 - DNA, 75 bp, Artificial Sequence
  Synthetic
tcgatgtgtggagtttggttccagttggttctgccagctgtaccatagccgcactcgggtcatcggatggtgaca

SEQ ID NO: 95018 - DNA, 75 bp, Artificial Sequence
  Synthetic
tcgatgtgtggagtttggttccagttggttctgccagctgtaccatagccgcactcgggtcttcggatggtgaca

SEQ ID NO: 95019 - DNA, 75 bp, Artificial Sequence
  Synthetic
tcgatgtgtggagtttggttccagttggttctgccagctgtaccatagccgcactcgggtcctcggatggtgaca

SEQ ID NO: 95020 - DNA, 75 bp, Artificial Sequence
  Synthetic
tcgatgtgtggagtttggttccagttggttctgccagctgtaccatagccgcactcgggtcgtcggatggtgaca

SEQ ID NO: 95021 - DNA, 75 bp, Artificial Sequence
  Synthetic
tcgatgtgtggagtttggttccagttggctctgccagctgtaccatagccgcactcgggtcatcggatggtgaca

SEQ ID NO: 95022 - DNA, 75 bp, Artificial Sequence
  Synthetic
tcgatgtgtggagtttggttccagttggctctgccagctgtaccatagccgcactcgggtcttcggatggtgaca

SEQ ID NO: 95023 - DNA, 75 bp, Artificial Sequence
  Synthetic
tcgatgtgtggagtttggttccagttggctctgccagctgtaccatagccgcactcgggtcctcggatggtgaca

SEQ ID NO: 95024 - DNA, 75 bp, Artificial Sequence
  Synthetic
tcgatgtgtggagtttggttccagttggctctgccagctgtaccatagccgcactcgggtcgtcggatggtgaca

SEQ ID NO: 95025 - DNA, 75 bp, Artificial Sequence
  Synthetic
tcgatgtgtggagtttggttccagttgggtctgccagctgtaccatagccgcactcgggtcatcggatggtgaca

SEQ ID NO: 95026 - DNA, 75 bp, Artificial Sequence
  Synthetic
tcgatgtgtggagtttggttccagttgggtctgccagctgtaccatagccgcactcgggtcttcggatggtgaca

SEQ ID NO: 95027 - DNA, 75 bp, Artificial Sequence
  Synthetic
tcgatgtgtggagtttggttccagttgggtctgccagctgtaccatagccgcactcgggtcctcggatggtgaca

SEQ ID NO: 95028 - DNA, 75 bp, Artificial Sequence
  Synthetic
tcgatgtgtggagtttggttccagttgggtctgccagctgtaccatagccgcactcgggtcgtcggatggtgaca

SEQ ID NO: 95029 - DNA, 75 bp, Artificial Sequence
  Synthetic
tcgatgtgtggagtttggtcccagttggatctgccagctgtaccatagccgcactcgggtcatcggatggtgaca

SEQ ID NO: 95030 - DNA, 75 bp, Artificial Sequence
  Synthetic
tcgatgtgtggagtttggtcccagttggatctgccagctgtaccatagccgcactcgggtcttcggatggtgaca

SEQ ID NO: 95031 - DNA, 75 bp, Artificial Sequence
  Synthetic
tcgatgtgtggagtttggtcccagttggatctgccagctgtaccatagccgcactcgggtcctcggatggtgaca

SEQ ID NO: 95032 - DNA, 75 bp, Artificial Sequence
  Synthetic
tcgatgtgtggagtttggtcccagttggatctgccagctgtaccatagccgcactcgggtcgtcggatggtgaca

SEQ ID NO: 95033 - DNA, 75 bp, Artificial Sequence
  Synthetic
tcgatgtgtggagtttggtcccagttggttctgccagctgtaccatagccgcactcgggtcatcggatggtgaca

SEQ ID NO: 95034 - DNA, 75 bp, Artificial Sequence
  Synthetic
tcgatgtgtggagtttggtcccagttggttctgccagctgtaccatagccgcactcgggtcttcggatggtgaca

SEQ ID NO: 95035 - DNA, 75 bp, Artificial Sequence
  Synthetic
tcgatgtgtggagtttggtcccagttggttctgccagctgtaccatagccgcactcgggtcctcggatggtgaca

SEQ ID NO: 95036 - DNA, 75 bp, Artificial Sequence
  Synthetic
tcgatgtgtggagtttggtcccagttggttctgccagctgtaccatagccgcactcgggtcgtcggatggtgaca

SEQ ID NO: 95037 - DNA, 75 bp, Artificial Sequence
  Synthetic
tcgatgtgtggagtttggtcccagttggctctgccagctgtaccatagccgcactcgggtcatcggatggtgaca

SEQ ID NO: 95038 - DNA, 75 bp, Artificial Sequence
  Synthetic
tcgatgtgtggagtttggtcccagttggctctgccagctgtaccatagccgcactcgggtcttcggatggtgaca

SEQ ID NO: 95039 - DNA, 75 bp, Artificial Sequence
  Synthetic
tcgatgtgtggagtttggtcccagttggctctgccagctgtaccatagccgcactcgggtcctcggatggtgaca

SEQ ID NO: 95040 - DNA, 75 bp, Artificial Sequence
  Synthetic
tcgatgtgtggagtttggtcccagttggctctgccagctgtaccatagccgcactcgggtcgtcggatggtgaca

SEQ ID NO: 95041 - DNA, 75 bp, Artificial Sequence
  Synthetic
tcgatgtgtggagtttggtcccagttgggtctgccagctgtaccatagccgcactcgggtcatcggatggtgaca

SEQ ID NO: 95042 - DNA, 75 bp, Artificial Sequence
  Synthetic
tcgatgtgtggagtttggtcccagttgggtctgccagctgtaccatagccgcactcgggtcttcggatggtgaca

SEQ ID NO: 95043 - DNA, 75 bp, Artificial Sequence
  Synthetic
tcgatgtgtggagtttggtcccagttgggtctgccagctgtaccatagccgcactcgggtcctcggatggtgaca

SEQ ID NO: 95044 - DNA, 75 bp, Artificial Sequence
  Synthetic
tcgatgtgtggagtttggtcccagttgggtctgccagctgtaccatagccgcactcgggtcgtcggatggtgaca

SEQ ID NO: 95045 - DNA, 75 bp, Artificial Sequence
  Synthetic
tcgatgtgtggagtttggtgccagttggatctgccagctgtaccatagccgcactcgggtcatcggatggtgaca

SEQ ID NO: 95046 - DNA, 75 bp, Artificial Sequence
  Synthetic
tcgatgtgtggagtttggtgccagttggatctgccagctgtaccatagccgcactcgggtcttcggatggtgaca

SEQ ID NO: 95047 - DNA, 75 bp, Artificial Sequence
  Synthetic
tcgatgtgtggagtttggtgccagttggatctgccagctgtaccatagccgcactcgggtcctcggatggtgaca

SEQ ID NO: 95048 - DNA, 75 bp, Artificial Sequence
  Synthetic
tcgatgtgtggagtttggtgccagttggatctgccagctgtaccatagccgcactcgggtcgtcggatggtgaca

SEQ ID NO: 95049 - DNA, 75 bp, Artificial Sequence
  Synthetic
tcgatgtgtggagtttggtgccagttggttctgccagctgtaccatagccgcactcgggtcatcggatggtgaca

SEQ ID NO: 95050 - DNA, 75 bp, Artificial Sequence
  Synthetic
tcgatgtgtggagtttggtgccagttggttctgccagctgtaccatagccgcactcgggtcttcggatggtgaca

SEQ ID NO: 95051 - DNA, 75 bp, Artificial Sequence
  Synthetic
tcgatgtgtggagtttggtgccagttggttctgccagctgtaccatagccgcactcgggtcctcggatggtgaca

SEQ ID NO: 95052 - DNA, 75 bp, Artificial Sequence
  Synthetic
tcgatgtgtggagtttggtgccagttggttctgccagctgtaccatagccgcactcgggtcgtcggatggtgaca

SEQ ID NO: 95053 - DNA, 75 bp, Artificial Sequence
  Synthetic
tcgatgtgtggagtttggtgccagttggctctgccagctgtaccatagccgcactcgggtcatcggatggtgaca

SEQ ID NO: 95054 - DNA, 75 bp, Artificial Sequence
  Synthetic
tcgatgtgtggagtttggtgccagttggctctgccagctgtaccatagccgcactcgggtcttcggatggtgaca

SEQ ID NO: 95055 - DNA, 75 bp, Artificial Sequence
  Synthetic
tcgatgtgtggagtttggtgccagttggctctgccagctgtaccatagccgcactcgggtcctcggatggtgaca

SEQ ID NO: 95056 - DNA, 75 bp, Artificial Sequence
  Synthetic
tcgatgtgtggagtttggtgccagttggctctgccagctgtaccatagccgcactcgggtcgtcggatggtgaca

SEQ ID NO: 95057 - DNA, 75 bp, Artificial Sequence
  Synthetic
tcgatgtgtggagtttggtgccagttgggtctgccagctgtaccatagccgcactcgggtcatcggatggtgaca

SEQ ID NO: 95058 - DNA, 75 bp, Artificial Sequence
  Synthetic
tcgatgtgtggagtttggtgccagttgggtctgccagctgtaccatagccgcactcgggtcttcggatggtgaca

SEQ ID NO: 95059 - DNA, 75 bp, Artificial Sequence
  Synthetic
tcgatgtgtggagtttggtgccagttgggtctgccagctgtaccatagccgcactcgggtcctcggatggtgaca

SEQ ID NO: 95060 - DNA, 75 bp, Artificial Sequence
  Synthetic
tcgatgtgtggagtttggtgccagttgggtctgccagctgtaccatagccgcactcgggtcgtcggatggtgaca

SEQ ID NO: 95061 - DNA, 75 bp, Artificial Sequence
  Synthetic
gatcgtcggcctgcatcgtgtggcacctgtgtgcgggactgttggcccgaaaccgggtctgtcagattcccattc

SEQ ID NO: 95062 - DNA, 75 bp, Artificial Sequence
  Synthetic
gatcgtcggcctgcttcgtgtggcacctgtgtgcgggactgttggcccgaaaccgggtctgtcagattcccattc

SEQ ID NO: 95063 - DNA, 75 bp, Artificial Sequence
  Synthetic
gatcgtcggcctgcctcgtgtggcacctgtgtgcgggactgttggcccgaaaccgggtctgtcagattcccattc

SEQ ID NO: 95064 - DNA, 75 bp, Artificial Sequence
  Synthetic
gatcgtcggcctgcgtcgtgtggcacctgtgtgcgggactgttggcccgaaaccgggtctgtcagattcccattc

SEQ ID NO: 95065 - DNA, 75 bp, Artificial Sequence
  Synthetic
cctgtgtgcgggactgttggcccgaaaccgggtctgtcagattcccattccataggtgtggcacggggcctcggc

SEQ ID NO: 95066 - DNA, 75 bp, Artificial Sequence
  Synthetic
cctgtgtgcgggactgttggcccgaaaccgggtctgtcagattcccattccattggtgtggcacggggcctcggc

SEQ ID NO: 95067 - DNA, 75 bp, Artificial Sequence
  Synthetic
cctgtgtgcgggactgttggcccgaaaccgggtctgtcagattcccattccatcggtgtggcacggggcctcggc

SEQ ID NO: 95068 - DNA, 75 bp, Artificial Sequence
  Synthetic
cctgtgtgcgggactgttggcccgaaaccgggtctgtcagattcccattccatgggtgtggcacggggcctcggc

SEQ ID NO: 95069 - DNA, 75 bp, Artificial Sequence
  Synthetic
tggggctccgtgtcttggtttgcttccaccggcggccgcgactccaagattgatgtgtggagtttggtgccaact

SEQ ID NO: 95070 - DNA, 75 bp, Artificial Sequence
  Synthetic
ggtggttgagctttctgagtggggaataccctgcgccacttgcattctggacaggcggcctttctcgtgtggcac

SEQ ID NO: 95071 - DNA, 75 bp, Artificial Sequence
  Synthetic
ataccctgcgccacttgcattctggacaggcggcctttctcgtgtggcacctgtgtgagggactgctggcccgaa

SEQ ID NO: 95072 - DNA, 75 bp, Artificial Sequence
  Synthetic
cattgagcctcccactgagacgttcgggttcatccccggagtgccgcccctcaacaactgcatgctcctgggcac

SEQ ID NO: 95073 - DNA, 75 bp, Artificial Sequence
  Synthetic
cattgagcctcccactgagacgttcgggttcttccccggagtgccgcccctcaacaactgcatgctcctgggcac

SEQ ID NO: 95074 - DNA, 75 bp, Artificial Sequence
  Synthetic
cattgagcctcccactgagacgttcgggttcctccccggagtgccgcccctcaacaactgcatgctcctgggcac

SEQ ID NO: 95075 - DNA, 75 bp, Artificial Sequence
  Synthetic
cattgagcctcccactgagacgttcgggttcgtccccggagtgccgcccctcaacaactgcatgctcctgggcac

SEQ ID NO: 95076 - DNA, 75 bp, Artificial Sequence
  Synthetic
cattgagcctcccactgtgacgttcgggttcatccccggagtgccgcccctcaacaactgcatgctcctgggcac

SEQ ID NO: 95077 - DNA, 75 bp, Artificial Sequence
  Synthetic
cattgagcctcccactgtgacgttcgggttcttccccggagtgccgcccctcaacaactgcatgctcctgggcac

SEQ ID NO: 95078 - DNA, 75 bp, Artificial Sequence
  Synthetic
cattgagcctcccactgtgacgttcgggttcctccccggagtgccgcccctcaacaactgcatgctcctgggcac

SEQ ID NO: 95079 - DNA, 75 bp, Artificial Sequence
  Synthetic
cattgagcctcccactgtgacgttcgggttcgtccccggagtgccgcccctcaacaactgcatgctcctgggcac

SEQ ID NO: 95080 - DNA, 75 bp, Artificial Sequence
  Synthetic
cattgagcctcccactgcgacgttcgggttcatccccggagtgccgcccctcaacaactgcatgctcctgggcac

SEQ ID NO: 95081 - DNA, 75 bp, Artificial Sequence
  Synthetic
cattgagcctcccactgcgacgttcgggttcttccccggagtgccgcccctcaacaactgcatgctcctgggcac

SEQ ID NO: 95082 - DNA, 75 bp, Artificial Sequence
  Synthetic
cattgagcctcccactgcgacgttcgggttcctccccggagtgccgcccctcaacaactgcatgctcctgggcac

SEQ ID NO: 95083 - DNA, 75 bp, Artificial Sequence
  Synthetic
cattgagcctcccactgcgacgttcgggttcgtccccggagtgccgcccctcaacaactgcatgctcctgggcac

SEQ ID NO: 95084 - DNA, 75 bp, Artificial Sequence
  Synthetic
cattgagcctcccactgggacgttcgggttcatccccggagtgccgcccctcaacaactgcatgctcctgggcac

SEQ ID NO: 95085 - DNA, 75 bp, Artificial Sequence
  Synthetic
cattgagcctcccactgggacgttcgggttcttccccggagtgccgcccctcaacaactgcatgctcctgggcac

SEQ ID NO: 95086 - DNA, 75 bp, Artificial Sequence
  Synthetic
cattgagcctcccactgggacgttcgggttcctccccggagtgccgcccctcaacaactgcatgctcctgggcac

SEQ ID NO: 95087 - DNA, 75 bp, Artificial Sequence
  Synthetic
cattgagcctcccactgggacgttcgggttcgtccccggagtgccgcccctcaacaactgcatgctcctgggcac

SEQ ID NO: 95088 - DNA, 75 bp, Artificial Sequence
  Synthetic
aacccctggtgcgcaggtgttcggaactgataggacgccggaatccagtatgcccggggtatgcatggctttcct

SEQ ID NO: 95089 - DNA, 75 bp, Artificial Sequence
  Synthetic
aacccctggtgcgcaggtgttcggaactgataggacgccggaatccagtttgcccggggtatgcatggctttcct

SEQ ID NO: 95090 - DNA, 75 bp, Artificial Sequence
  Synthetic
aacccctggtgcgcaggtgttcggaactgataggacgccggaatccagtctgcccggggtatgcatggctttcct

SEQ ID NO: 95091 - DNA, 75 bp, Artificial Sequence
  Synthetic
aacccctggtgcgcaggtgttcggaactgataggacgccggaatccagtgtgcccggggtatgcatggctttcct

SEQ ID NO: 95092 - DNA, 75 bp, Artificial Sequence
  Synthetic
aacccctggtgcgcaggtgttcggaactgattggacgccggaatccagtatgcccggggtatgcatggctttcct

SEQ ID NO: 95093 - DNA, 75 bp, Artificial Sequence
  Synthetic
aacccctggtgcgcaggtgttcggaactgattggacgccggaatccagtttgcccggggtatgcatggctttcct

SEQ ID NO: 95094 - DNA, 75 bp, Artificial Sequence
  Synthetic
aacccctggtgcgcaggtgttcggaactgattggacgccggaatccagtctgcccggggtatgcatggctttcct

SEQ ID NO: 95095 - DNA, 75 bp, Artificial Sequence
  Synthetic
aacccctggtgcgcaggtgttcggaactgattggacgccggaatccagtgtgcccggggtatgcatggctttcct

SEQ ID NO: 95096 - DNA, 75 bp, Artificial Sequence
  Synthetic
aacccctggtgcgcaggtgttcggaactgatcggacgccggaatccagtatgcccggggtatgcatggctttcct

SEQ ID NO: 95097 - DNA, 75 bp, Artificial Sequence
  Synthetic
aacccctggtgcgcaggtgttcggaactgatcggacgccggaatccagtttgcccggggtatgcatggctttcct

SEQ ID NO: 95098 - DNA, 75 bp, Artificial Sequence
  Synthetic
aacccctggtgcgcaggtgttcggaactgatcggacgccggaatccagtctgcccggggtatgcatggctttcct

SEQ ID NO: 95099 - DNA, 75 bp, Artificial Sequence
  Synthetic
aacccctggtgcgcaggtgttcggaactgatcggacgccggaatccagtgtgcccggggtatgcatggctttcct

SEQ ID NO: 95100 - DNA, 75 bp, Artificial Sequence
  Synthetic
aacccctggtgcgcaggtgttcggaactgatgggacgccggaatccagtatgcccggggtatgcatggctttcct

SEQ ID NO: 95101 - DNA, 75 bp, Artificial Sequence
  Synthetic
aacccctggtgcgcaggtgttcggaactgatgggacgccggaatccagtttgcccggggtatgcatggctttcct

SEQ ID NO: 95102 - DNA, 75 bp, Artificial Sequence
  Synthetic
aacccctggtgcgcaggtgttcggaactgatgggacgccggaatccagtctgcccggggtatgcatggctttcct

SEQ ID NO: 95103 - DNA, 75 bp, Artificial Sequence
  Synthetic
aacccctggtgcgcaggtgttcggaactgatgggacgccggaatccagtgtgcccggggtatgcatggctttcct

SEQ ID NO: 95104 - DNA, 75 bp, Artificial Sequence
  Synthetic
aacccctggtgcgcaggtgttcggatctgataggacgccggaatccagtatgcccggggtatgcatggctttcct

SEQ ID NO: 95105 - DNA, 75 bp, Artificial Sequence
  Synthetic
aacccctggtgcgcaggtgttcggatctgataggacgccggaatccagtttgcccggggtatgcatggctttcct

SEQ ID NO: 95106 - DNA, 75 bp, Artificial Sequence
  Synthetic
aacccctggtgcgcaggtgttcggatctgataggacgccggaatccagtctgcccggggtatgcatggctttcct

SEQ ID NO: 95107 - DNA, 75 bp, Artificial Sequence
  Synthetic
aacccctggtgcgcaggtgttcggatctgataggacgccggaatccagtgtgcccggggtatgcatggctttcct

SEQ ID NO: 95108 - DNA, 75 bp, Artificial Sequence
  Synthetic
aacccctggtgcgcaggtgttcggatctgattggacgccggaatccagtatgcccggggtatgcatggctttcct

SEQ ID NO: 95109 - DNA, 75 bp, Artificial Sequence
  Synthetic
aacccctggtgcgcaggtgttcggatctgattggacgccggaatccagtttgcccggggtatgcatggctttcct

SEQ ID NO: 95110 - DNA, 75 bp, Artificial Sequence
  Synthetic
aacccctggtgcgcaggtgttcggatctgattggacgccggaatccagtctgcccggggtatgcatggctttcct

SEQ ID NO: 95111 - DNA, 75 bp, Artificial Sequence
  Synthetic
aacccctggtgcgcaggtgttcggatctgattggacgccggaatccagtgtgcccggggtatgcatggctttcct

SEQ ID NO: 95112 - DNA, 75 bp, Artificial Sequence
  Synthetic
aacccctggtgcgcaggtgttcggatctgatcggacgccggaatccagtatgcccggggtatgcatggctttcct

SEQ ID NO: 95113 - DNA, 75 bp, Artificial Sequence
  Synthetic
aacccctggtgcgcaggtgttcggatctgatcggacgccggaatccagtttgcccggggtatgcatggctttcct

SEQ ID NO: 95114 - DNA, 75 bp, Artificial Sequence
  Synthetic
aacccctggtgcgcaggtgttcggatctgatcggacgccggaatccagtctgcccggggtatgcatggctttcct

SEQ ID NO: 95115 - DNA, 75 bp, Artificial Sequence
  Synthetic
aacccctggtgcgcaggtgttcggatctgatcggacgccggaatccagtgtgcccggggtatgcatggctttcct

SEQ ID NO: 95116 - DNA, 75 bp, Artificial Sequence
  Synthetic
aacccctggtgcgcaggtgttcggatctgatgggacgccggaatccagtatgcccggggtatgcatggctttcct

SEQ ID NO: 95117 - DNA, 75 bp, Artificial Sequence
  Synthetic
aacccctggtgcgcaggtgttcggatctgatgggacgccggaatccagtttgcccggggtatgcatggctttcct

SEQ ID NO: 95118 - DNA, 75 bp, Artificial Sequence
  Synthetic
aacccctggtgcgcaggtgttcggatctgatgggacgccggaatccagtctgcccggggtatgcatggctttcct

SEQ ID NO: 95119 - DNA, 75 bp, Artificial Sequence
  Synthetic
aacccctggtgcgcaggtgttcggatctgatgggacgccggaatccagtgtgcccggggtatgcatggctttcct

SEQ ID NO: 95120 - DNA, 75 bp, Artificial Sequence
  Synthetic
aacccctggtgcgcaggtgttcggacctgataggacgccggaatccagtatgcccggggtatgcatggctttcct

SEQ ID NO: 95121 - DNA, 75 bp, Artificial Sequence
  Synthetic
aacccctggtgcgcaggtgttcggacctgataggacgccggaatccagtttgcccggggtatgcatggctttcct

SEQ ID NO: 95122 - DNA, 75 bp, Artificial Sequence
  Synthetic
aacccctggtgcgcaggtgttcggacctgataggacgccggaatccagtctgcccggggtatgcatggctttcct

SEQ ID NO: 95123 - DNA, 75 bp, Artificial Sequence
  Synthetic
aacccctggtgcgcaggtgttcggacctgataggacgccggaatccagtgtgcccggggtatgcatggctttcct

SEQ ID NO: 95124 - DNA, 75 bp, Artificial Sequence
  Synthetic
aacccctggtgcgcaggtgttcggacctgattggacgccggaatccagtatgcccggggtatgcatggctttcct

SEQ ID NO: 95125 - DNA, 75 bp, Artificial Sequence
  Synthetic
aacccctggtgcgcaggtgttcggacctgattggacgccggaatccagtttgcccggggtatgcatggctttcct

SEQ ID NO: 95126 - DNA, 75 bp, Artificial Sequence
  Synthetic
aacccctggtgcgcaggtgttcggacctgattggacgccggaatccagtctgcccggggtatgcatggctttcct

SEQ ID NO: 95127 - DNA, 75 bp, Artificial Sequence
  Synthetic
aacccctggtgcgcaggtgttcggacctgattggacgccggaatccagtgtgcccggggtatgcatggctttcct

SEQ ID NO: 95128 - DNA, 75 bp, Artificial Sequence
  Synthetic
aacccctggtgcgcaggtgttcggacctgatcggacgccggaatccagtatgcccggggtatgcatggctttcct

SEQ ID NO: 95129 - DNA, 75 bp, Artificial Sequence
  Synthetic
aacccctggtgcgcaggtgttcggacctgatcggacgccggaatccagtttgcccggggtatgcatggctttcct

SEQ ID NO: 95130 - DNA, 75 bp, Artificial Sequence
  Synthetic
aacccctggtgcgcaggtgttcggacctgatcggacgccggaatccagtctgcccggggtatgcatggctttcct

SEQ ID NO: 95131 - DNA, 75 bp, Artificial Sequence
  Synthetic
aacccctggtgcgcaggtgttcggacctgatcggacgccggaatccagtgtgcccggggtatgcatggctttcct

SEQ ID NO: 95132 - DNA, 75 bp, Artificial Sequence
  Synthetic
aacccctggtgcgcaggtgttcggacctgatgggacgccggaatccagtatgcccggggtatgcatggctttcct

SEQ ID NO: 95133 - DNA, 75 bp, Artificial Sequence
  Synthetic
aacccctggtgcgcaggtgttcggacctgatgggacgccggaatccagtttgcccggggtatgcatggctttcct

SEQ ID NO: 95134 - DNA, 75 bp, Artificial Sequence
  Synthetic
aacccctggtgcgcaggtgttcggacctgatgggacgccggaatccagtctgcccggggtatgcatggctttcct

SEQ ID NO: 95135 - DNA, 75 bp, Artificial Sequence
  Synthetic
aacccctggtgcgcaggtgttcggacctgatgggacgccggaatccagtgtgcccggggtatgcatggctttcct

SEQ ID NO: 95136 - DNA, 75 bp, Artificial Sequence
  Synthetic
aacccctggtgcgcaggtgttcggagctgataggacgccggaatccagtatgcccggggtatgcatggctttcct

SEQ ID NO: 95137 - DNA, 75 bp, Artificial Sequence
  Synthetic
aacccctggtgcgcaggtgttcggagctgataggacgccggaatccagtttgcccggggtatgcatggctttcct

SEQ ID NO: 95138 - DNA, 75 bp, Artificial Sequence
  Synthetic
aacccctggtgcgcaggtgttcggagctgataggacgccggaatccagtctgcccggggtatgcatggctttcct

SEQ ID NO: 95139 - DNA, 75 bp, Artificial Sequence
  Synthetic
aacccctggtgcgcaggtgttcggagctgataggacgccggaatccagtgtgcccggggtatgcatggctttcct

SEQ ID NO: 95140 - DNA, 75 bp, Artificial Sequence
  Synthetic
aacccctggtgcgcaggtgttcggagctgattggacgccggaatccagtatgcccggggtatgcatggctttcct

SEQ ID NO: 95141 - DNA, 75 bp, Artificial Sequence
  Synthetic
aacccctggtgcgcaggtgttcggagctgattggacgccggaatccagtttgcccggggtatgcatggctttcct

SEQ ID NO: 95142 - DNA, 75 bp, Artificial Sequence
  Synthetic
aacccctggtgcgcaggtgttcggagctgattggacgccggaatccagtctgcccggggtatgcatggctttcct

SEQ ID NO: 95143 - DNA, 75 bp, Artificial Sequence
  Synthetic
aacccctggtgcgcaggtgttcggagctgattggacgccggaatccagtgtgcccggggtatgcatggctttcct

SEQ ID NO: 95144 - DNA, 75 bp, Artificial Sequence
  Synthetic
aacccctggtgcgcaggtgttcggagctgatcggacgccggaatccagtatgcccggggtatgcatggctttcct

SEQ ID NO: 95145 - DNA, 75 bp, Artificial Sequence
  Synthetic
aacccctggtgcgcaggtgttcggagctgatcggacgccggaatccagtttgcccggggtatgcatggctttcct

SEQ ID NO: 95146 - DNA, 75 bp, Artificial Sequence
  Synthetic
aacccctggtgcgcaggtgttcggagctgatcggacgccggaatccagtctgcccggggtatgcatggctttcct

SEQ ID NO: 95147 - DNA, 75 bp, Artificial Sequence
  Synthetic
aacccctggtgcgcaggtgttcggagctgatcggacgccggaatccagtgtgcccggggtatgcatggctttcct

SEQ ID NO: 95148 - DNA, 75 bp, Artificial Sequence
  Synthetic
aacccctggtgcgcaggtgttcggagctgatgggacgccggaatccagtatgcccggggtatgcatggctttcct

SEQ ID NO: 95149 - DNA, 75 bp, Artificial Sequence
  Synthetic
aacccctggtgcgcaggtgttcggagctgatgggacgccggaatccagtttgcccggggtatgcatggctttcct

SEQ ID NO: 95150 - DNA, 75 bp, Artificial Sequence
  Synthetic
aacccctggtgcgcaggtgttcggagctgatgggacgccggaatccagtctgcccggggtatgcatggctttcct

SEQ ID NO: 95151 - DNA, 75 bp, Artificial Sequence
  Synthetic
aacccctggtgcgcaggtgttcggagctgatgggacgccggaatccagtgtgcccggggtatgcatggctttcct

SEQ ID NO: 95152 - DNA, 75 bp, Artificial Sequence
  Synthetic
actgataggacgccggaatccagtatgcccggggtatgcatggctttcctcgggtcgacctgacgggttcataca

SEQ ID NO: 95153 - DNA, 75 bp, Artificial Sequence
  Synthetic
actgataggacgccggaatccagtttgcccggggtatgcatggctttcctcgggtcgacctgacgggttcataca

SEQ ID NO: 95154 - DNA, 75 bp, Artificial Sequence
  Synthetic
actgataggacgccggaatccagtctgcccggggtatgcatggctttcctcgggtcgacctgacgggttcataca

SEQ ID NO: 95155 - DNA, 75 bp, Artificial Sequence
  Synthetic
actgataggacgccggaatccagtgtgcccggggtatgcatggctttcctcgggtcgacctgacgggttcataca

SEQ ID NO: 95156 - DNA, 75 bp, Artificial Sequence
  Synthetic
actgattggacgccggaatccagtatgcccggggtatgcatggctttcctcgggtcgacctgacgggttcataca

SEQ ID NO: 95157 - DNA, 75 bp, Artificial Sequence
  Synthetic
actgattggacgccggaatccagtttgcccggggtatgcatggctttcctcgggtcgacctgacgggttcataca

SEQ ID NO: 95158 - DNA, 75 bp, Artificial Sequence
  Synthetic
actgattggacgccggaatccagtctgcccggggtatgcatggctttcctcgggtcgacctgacgggttcataca

SEQ ID NO: 95159 - DNA, 75 bp, Artificial Sequence
  Synthetic
actgattggacgccggaatccagtgtgcccggggtatgcatggctttcctcgggtcgacctgacgggttcataca

SEQ ID NO: 95160 - DNA, 75 bp, Artificial Sequence
  Synthetic
actgatcggacgccggaatccagtatgcccggggtatgcatggctttcctcgggtcgacctgacgggttcataca

SEQ ID NO: 95161 - DNA, 75 bp, Artificial Sequence
  Synthetic
actgatcggacgccggaatccagtttgcccggggtatgcatggctttcctcgggtcgacctgacgggttcataca

SEQ ID NO: 95162 - DNA, 75 bp, Artificial Sequence
  Synthetic
actgatcggacgccggaatccagtctgcccggggtatgcatggctttcctcgggtcgacctgacgggttcataca

SEQ ID NO: 95163 - DNA, 75 bp, Artificial Sequence
  Synthetic
actgatcggacgccggaatccagtgtgcccggggtatgcatggctttcctcgggtcgacctgacgggttcataca

SEQ ID NO: 95164 - DNA, 75 bp, Artificial Sequence
  Synthetic
actgatgggacgccggaatccagtatgcccggggtatgcatggctttcctcgggtcgacctgacgggttcataca

SEQ ID NO: 95165 - DNA, 75 bp, Artificial Sequence
  Synthetic
actgatgggacgccggaatccagtttgcccggggtatgcatggctttcctcgggtcgacctgacgggttcataca

SEQ ID NO: 95166 - DNA, 75 bp, Artificial Sequence
  Synthetic
actgatgggacgccggaatccagtctgcccggggtatgcatggctttcctcgggtcgacctgacgggttcataca

SEQ ID NO: 95167 - DNA, 75 bp, Artificial Sequence
  Synthetic
actgatgggacgccggaatccagtgtgcccggggtatgcatggctttcctcgggtcgacctgacgggttcataca

SEQ ID NO: 95168 - DNA, 75 bp, Artificial Sequence
  Synthetic
tctgataggacgccggaatccagtatgcccggggtatgcatggctttcctcgggtcgacctgacgggttcataca

SEQ ID NO: 95169 - DNA, 75 bp, Artificial Sequence
  Synthetic
tctgataggacgccggaatccagtttgcccggggtatgcatggctttcctcgggtcgacctgacgggttcataca

SEQ ID NO: 95170 - DNA, 75 bp, Artificial Sequence
  Synthetic
tctgataggacgccggaatccagtctgcccggggtatgcatggctttcctcgggtcgacctgacgggttcataca

SEQ ID NO: 95171 - DNA, 75 bp, Artificial Sequence
  Synthetic
tctgataggacgccggaatccagtgtgcccggggtatgcatggctttcctcgggtcgacctgacgggttcataca

SEQ ID NO: 95172 - DNA, 75 bp, Artificial Sequence
  Synthetic
tctgattggacgccggaatccagtatgcccggggtatgcatggctttcctcgggtcgacctgacgggttcataca

SEQ ID NO: 95173 - DNA, 75 bp, Artificial Sequence
  Synthetic
tctgattggacgccggaatccagtttgcccggggtatgcatggctttcctcgggtcgacctgacgggttcataca

SEQ ID NO: 95174 - DNA, 75 bp, Artificial Sequence
  Synthetic
tctgattggacgccggaatccagtctgcccggggtatgcatggctttcctcgggtcgacctgacgggttcataca

SEQ ID NO: 95175 - DNA, 75 bp, Artificial Sequence
  Synthetic
tctgattggacgccggaatccagtgtgcccggggtatgcatggctttcctcgggtcgacctgacgggttcataca

SEQ ID NO: 95176 - DNA, 75 bp, Artificial Sequence
  Synthetic
tctgatcggacgccggaatccagtatgcccggggtatgcatggctttcctcgggtcgacctgacgggttcataca

SEQ ID NO: 95177 - DNA, 75 bp, Artificial Sequence
  Synthetic
tctgatcggacgccggaatccagtttgcccggggtatgcatggctttcctcgggtcgacctgacgggttcataca

SEQ ID NO: 95178 - DNA, 75 bp, Artificial Sequence
  Synthetic
tctgatcggacgccggaatccagtctgcccggggtatgcatggctttcctcgggtcgacctgacgggttcataca

SEQ ID NO: 95179 - DNA, 75 bp, Artificial Sequence
  Synthetic
tctgatcggacgccggaatccagtgtgcccggggtatgcatggctttcctcgggtcgacctgacgggttcataca

SEQ ID NO: 95180 - DNA, 75 bp, Artificial Sequence
  Synthetic
tctgatgggacgccggaatccagtatgcccggggtatgcatggctttcctcgggtcgacctgacgggttcataca

SEQ ID NO: 95181 - DNA, 75 bp, Artificial Sequence
  Synthetic
tctgatgggacgccggaatccagtttgcccggggtatgcatggctttcctcgggtcgacctgacgggttcataca

SEQ ID NO: 95182 - DNA, 75 bp, Artificial Sequence
  Synthetic
tctgatgggacgccggaatccagtctgcccggggtatgcatggctttcctcgggtcgacctgacgggttcataca

SEQ ID NO: 95183 - DNA, 75 bp, Artificial Sequence
  Synthetic
tctgatgggacgccggaatccagtgtgcccggggtatgcatggctttcctcgggtcgacctgacgggttcataca

SEQ ID NO: 95184 - DNA, 75 bp, Artificial Sequence
  Synthetic
cctgataggacgccggaatccagtatgcccggggtatgcatggctttcctcgggtcgacctgacgggttcataca

SEQ ID NO: 95185 - DNA, 75 bp, Artificial Sequence
  Synthetic
cctgataggacgccggaatccagtttgcccggggtatgcatggctttcctcgggtcgacctgacgggttcataca

SEQ ID NO: 95186 - DNA, 75 bp, Artificial Sequence
  Synthetic
cctgataggacgccggaatccagtctgcccggggtatgcatggctttcctcgggtcgacctgacgggttcataca

SEQ ID NO: 95187 - DNA, 75 bp, Artificial Sequence
  Synthetic
cctgataggacgccggaatccagtgtgcccggggtatgcatggctttcctcgggtcgacctgacgggttcataca

SEQ ID NO: 95188 - DNA, 75 bp, Artificial Sequence
  Synthetic
cctgattggacgccggaatccagtatgcccggggtatgcatggctttcctcgggtcgacctgacgggttcataca

SEQ ID NO: 95189 - DNA, 75 bp, Artificial Sequence
  Synthetic
cctgattggacgccggaatccagtttgcccggggtatgcatggctttcctcgggtcgacctgacgggttcataca

SEQ ID NO: 95190 - DNA, 75 bp, Artificial Sequence
  Synthetic
cctgattggacgccggaatccagtctgcccggggtatgcatggctttcctcgggtcgacctgacgggttcataca

SEQ ID NO: 95191 - DNA, 75 bp, Artificial Sequence
  Synthetic
cctgattggacgccggaatccagtgtgcccggggtatgcatggctttcctcgggtcgacctgacgggttcataca

SEQ ID NO: 95192 - DNA, 75 bp, Artificial Sequence
  Synthetic
cctgatcggacgccggaatccagtatgcccggggtatgcatggctttcctcgggtcgacctgacgggttcataca

SEQ ID NO: 95193 - DNA, 75 bp, Artificial Sequence
  Synthetic
cctgatcggacgccggaatccagtttgcccggggtatgcatggctttcctcgggtcgacctgacgggttcataca

SEQ ID NO: 95194 - DNA, 75 bp, Artificial Sequence
  Synthetic
cctgatcggacgccggaatccagtctgcccggggtatgcatggctttcctcgggtcgacctgacgggttcataca

SEQ ID NO: 95195 - DNA, 75 bp, Artificial Sequence
  Synthetic
cctgatcggacgccggaatccagtgtgcccggggtatgcatggctttcctcgggtcgacctgacgggttcataca

SEQ ID NO: 95196 - DNA, 75 bp, Artificial Sequence
  Synthetic
cctgatgggacgccggaatccagtatgcccggggtatgcatggctttcctcgggtcgacctgacgggttcataca

SEQ ID NO: 95197 - DNA, 75 bp, Artificial Sequence
  Synthetic
cctgatgggacgccggaatccagtttgcccggggtatgcatggctttcctcgggtcgacctgacgggttcataca

SEQ ID NO: 95198 - DNA, 75 bp, Artificial Sequence
  Synthetic
cctgatgggacgccggaatccagtctgcccggggtatgcatggctttcctcgggtcgacctgacgggttcataca

SEQ ID NO: 95199 - DNA, 75 bp, Artificial Sequence
  Synthetic
cctgatgggacgccggaatccagtgtgcccggggtatgcatggctttcctcgggtcgacctgacgggttcataca

SEQ ID NO: 95200 - DNA, 75 bp, Artificial Sequence
  Synthetic
gctgataggacgccggaatccagtatgcccggggtatgcatggctttcctcgggtcgacctgacgggttcataca

SEQ ID NO: 95201 - DNA, 75 bp, Artificial Sequence
  Synthetic
gctgataggacgccggaatccagtttgcccggggtatgcatggctttcctcgggtcgacctgacgggttcataca

SEQ ID NO: 95202 - DNA, 75 bp, Artificial Sequence
  Synthetic
gctgataggacgccggaatccagtctgcccggggtatgcatggctttcctcgggtcgacctgacgggttcataca

SEQ ID NO: 95203 - DNA, 75 bp, Artificial Sequence
  Synthetic
gctgataggacgccggaatccagtgtgcccggggtatgcatggctttcctcgggtcgacctgacgggttcataca

SEQ ID NO: 95204 - DNA, 75 bp, Artificial Sequence
  Synthetic
gctgattggacgccggaatccagtatgcccggggtatgcatggctttcctcgggtcgacctgacgggttcataca

SEQ ID NO: 95205 - DNA, 75 bp, Artificial Sequence
  Synthetic
gctgattggacgccggaatccagtttgcccggggtatgcatggctttcctcgggtcgacctgacgggttcataca

SEQ ID NO: 95206 - DNA, 75 bp, Artificial Sequence
  Synthetic
gctgattggacgccggaatccagtctgcccggggtatgcatggctttcctcgggtcgacctgacgggttcataca

SEQ ID NO: 95207 - DNA, 75 bp, Artificial Sequence
  Synthetic
gctgattggacgccggaatccagtgtgcccggggtatgcatggctttcctcgggtcgacctgacgggttcataca

SEQ ID NO: 95208 - DNA, 75 bp, Artificial Sequence
  Synthetic
gctgatcggacgccggaatccagtatgcccggggtatgcatggctttcctcgggtcgacctgacgggttcataca

SEQ ID NO: 95209 - DNA, 75 bp, Artificial Sequence
  Synthetic
gctgatcggacgccggaatccagtttgcccggggtatgcatggctttcctcgggtcgacctgacgggttcataca

SEQ ID NO: 95210 - DNA, 75 bp, Artificial Sequence
  Synthetic
gctgatcggacgccggaatccagtctgcccggggtatgcatggctttcctcgggtcgacctgacgggttcataca

SEQ ID NO: 95211 - DNA, 75 bp, Artificial Sequence
  Synthetic
gctgatcggacgccggaatccagtgtgcccggggtatgcatggctttcctcgggtcgacctgacgggttcataca

SEQ ID NO: 95212 - DNA, 75 bp, Artificial Sequence
  Synthetic
gctgatgggacgccggaatccagtatgcccggggtatgcatggctttcctcgggtcgacctgacgggttcataca

SEQ ID NO: 95213 - DNA, 75 bp, Artificial Sequence
  Synthetic
gctgatgggacgccggaatccagtttgcccggggtatgcatggctttcctcgggtcgacctgacgggttcataca

SEQ ID NO: 95214 - DNA, 75 bp, Artificial Sequence
  Synthetic
gctgatgggacgccggaatccagtctgcccggggtatgcatggctttcctcgggtcgacctgacgggttcataca

SEQ ID NO: 95215 - DNA, 75 bp, Artificial Sequence
  Synthetic
gctgatgggacgccggaatccagtgtgcccggggtatgcatggctttcctcgggtcgacctgacgggttcataca

SEQ ID NO: 95216 - DNA, 75 bp, Artificial Sequence
  Synthetic
taacaactgcatgcttctcggcacggaagtgtcagaggcattgggcggggcaggccttactggggggttttacga

SEQ ID NO: 95217 - DNA, 75 bp, Artificial Sequence
  Synthetic
cacgctggttgctcctggaatttgtatttgtcctgttgtacctgatgaagctggctgaggcacggttggtcccgc

SEQ ID NO: 95218 - DNA, 75 bp, Artificial Sequence
  Synthetic
cacgctggttgctcctggaatttgtttttgtcctgttgtacctgatgaagctggctgaggcacggttggtcccgc

SEQ ID NO: 95219 - DNA, 75 bp, Artificial Sequence
  Synthetic
cacgctggttgctcctggaatttgtctttgtcctgttgtacctgatgaagctggctgaggcacggttggtcccgc

SEQ ID NO: 95220 - DNA, 75 bp, Artificial Sequence
  Synthetic
cacgctggttgctcctggaatttgtgtttgtcctgttgtacctgatgaagctggctgaggcacggttggtcccgc

SEQ ID NO: 95221 - DNA, 75 bp, Artificial Sequence
  Synthetic
cacgctggttgctcctggattttgtatttgtcctgttgtacctgatgaagctggctgaggcacggttggtcccgc

SEQ ID NO: 95222 - DNA, 75 bp, Artificial Sequence
  Synthetic
cacgctggttgctcctggattttgtttttgtcctgttgtacctgatgaagctggctgaggcacggttggtcccgc

SEQ ID NO: 95223 - DNA, 75 bp, Artificial Sequence
  Synthetic
cacgctggttgctcctggattttgtctttgtcctgttgtacctgatgaagctggctgaggcacggttggtcccgc

SEQ ID NO: 95224 - DNA, 75 bp, Artificial Sequence
  Synthetic
cacgctggttgctcctggattttgtgtttgtcctgttgtacctgatgaagctggctgaggcacggttggtcccgc

SEQ ID NO: 95225 - DNA, 75 bp, Artificial Sequence
  Synthetic
cacgctggttgctcctggactttgtatttgtcctgttgtacctgatgaagctggctgaggcacggttggtcccgc

SEQ ID NO: 95226 - DNA, 75 bp, Artificial Sequence
  Synthetic
cacgctggttgctcctggactttgtttttgtcctgttgtacctgatgaagctggctgaggcacggttggtcccgc

SEQ ID NO: 95227 - DNA, 75 bp, Artificial Sequence
  Synthetic
cacgctggttgctcctggactttgtctttgtcctgttgtacctgatgaagctggctgaggcacggttggtcccgc

SEQ ID NO: 95228 - DNA, 75 bp, Artificial Sequence
  Synthetic
cacgctggttgctcctggactttgtgtttgtcctgttgtacctgatgaagctggctgaggcacggttggtcccgc

SEQ ID NO: 95229 - DNA, 75 bp, Artificial Sequence
  Synthetic
cacgctggttgctcctggagtttgtatttgtcctgttgtacctgatgaagctggctgaggcacggttggtcccgc

SEQ ID NO: 95230 - DNA, 75 bp, Artificial Sequence
  Synthetic
cacgctggttgctcctggagtttgtttttgtcctgttgtacctgatgaagctggctgaggcacggttggtcccgc

SEQ ID NO: 95231 - DNA, 75 bp, Artificial Sequence
  Synthetic
cacgctggttgctcctggagtttgtctttgtcctgttgtacctgatgaagctggctgaggcacggttggtcccgc

SEQ ID NO: 95232 - DNA, 75 bp, Artificial Sequence
  Synthetic
cacgctggttgctcctggagtttgtgtttgtcctgttgtacctgatgaagctggctgaggcacggttggtcccgc

SEQ ID NO: 95233 - DNA, 75 bp, Artificial Sequence
  Synthetic
ctgccggctgtggacgccgccgtggagggcgaggtttttgcgggccctgccctgtcgtggtgtttgggcctcccc

SEQ ID NO: 95234 - DNA, 75 bp, Artificial Sequence
  Synthetic
ctgccggctgtggacgccgccgtggtgggcgaggtttttgcgggccctgccctgtcgtggtgtttgggcctcccc

SEQ ID NO: 95235 - DNA, 75 bp, Artificial Sequence
  Synthetic
ctgccggctgtggacgccgccgtggcgggcgaggtttttgcgggccctgccctgtcgtggtgtttgggcctcccc

SEQ ID NO: 95236 - DNA, 75 bp, Artificial Sequence
  Synthetic
ctgccggctgtggacgccgccgtggggggcgaggtttttgcgggccctgccctgtcgtggtgtttgggcctcccc

SEQ ID NO: 95237 - DNA, 75 bp, Artificial Sequence
  Synthetic
caaacctggtgttgtatttccggtggatgggccctcaacgcctcatgttccttgtgttgtggaagctcgctcggg

SEQ ID NO: 95238 - DNA, 75 bp, Artificial Sequence
  Synthetic
tggcggaggcacggttggtccctcttatacttctcctgctatggtggtgggttaaccagctcgcggtcctcggac

SEQ ID NO: 95239 - DNA, 75 bp, Artificial Sequence
  Synthetic
cacttcggtgttgggctgggtggtggccagcgtggtggcttgggccatagcactcctgagctccatgagcgcggg

SEQ ID NO: 95240 - DNA, 75 bp, Artificial Sequence
  Synthetic
ttgtcatggtgtctgggcctacccttcgtgagcatgatcctgggtctagcaaacctggtgttgtactttcgctgg

SEQ ID NO: 95241 - DNA, 75 bp, Artificial Sequence
  Synthetic
tcgtgagcatgatcctgggtctagcaaacctggtgttgtactttcgctggatgggccctcaacgcctaatgttcc

SEQ ID NO: 95242 - DNA, 75 bp, Artificial Sequence
  Synthetic
aggcgatacgtcagcgggtggtgcggagccccctcggggaggggcgtcctaccaaacccttgactttagcttggt

SEQ ID NO: 95243 - DNA, 75 bp, Artificial Sequence
  Synthetic
aggcgatacgtcagcgggtggtgcggagccccctcggggaggggcgtcctaccaaacccttgacttttgcttggt

SEQ ID NO: 95244 - DNA, 75 bp, Artificial Sequence
  Synthetic
aggcgatacgtcagcgggtggtgcggagccccctcggggaggggcgtcctaccaaacccttgactttcgcttggt

SEQ ID NO: 95245 - DNA, 75 bp, Artificial Sequence
  Synthetic
aggcgatacgtcagcgggtggtgcggagccccctcggggaggggcgtcctaccaaacccttgactttggcttggt

SEQ ID NO: 95246 - DNA, 75 bp, Artificial Sequence
  Synthetic
gggtggaagcacaaggctatcatctacaggacgtggtgtaaagggtatcaggctatccggcagcgagtggtgcgg

SEQ ID NO: 95247 - DNA, 75 bp, Artificial Sequence
  Synthetic
cacaacaatccggctggtctccaagatgtgcgccagaggggcctatttgttcgaccatatgggctctttctcgcg

SEQ ID NO: 95248 - DNA, 75 bp, Artificial Sequence
  Synthetic
acaggacgtggtgtaaagggtatcaggctatccggcagcgagtggtgcggagccccctcggggaggggcggccga

SEQ ID NO: 95249 - DNA, 75 bp, Artificial Sequence
  Synthetic
cattcaccaggacggactgtcgcatcatcagagatgccgcgaggaccctgtcctgcggccagtgcgtcatgggtt

SEQ ID NO: 95250 - DNA, 75 bp, Artificial Sequence
  Synthetic
gctgtgatgttggtggtggtggccatggtgctcctgtttggccttttcgacgcgctcgattgggccttggaggag

SEQ ID NO: 95251 - DNA, 75 bp, Artificial Sequence
  Synthetic
catcagagatgccgcgaggaccctgtcctgcggccagtgcgtcatgggtttacctgtggtagcacgccgcggaga

SEQ ID NO: 95252 - DNA, 75 bp, Artificial Sequence
  Synthetic
catcagagatgccgcgaggaccctgtcctgcggccagtgcgtcatgggtttacctgtggtagcacgccgcggtga

SEQ ID NO: 95253 - DNA, 75 bp, Artificial Sequence
  Synthetic
catcagagatgccgcgaggaccctgtcctgcggccagtgcgtcatgggtttacctgtggtagcacgccgcggcga

SEQ ID NO: 95254 - DNA, 75 bp, Artificial Sequence
  Synthetic
catcagagatgccgcgaggaccctgtcctgcggccagtgcgtcatgggtttacctgtggtagcacgccgcgggga

SEQ ID NO: 95255 - DNA, 75 bp, Artificial Sequence
  Synthetic
ttgtgtgatggcgggtgagcgggccactactattaggctggtctccaagatgtgcgcaagaggggcctatttgtt

SEQ ID NO: 95256 - DNA, 75 bp, Artificial Sequence
  Synthetic
ttgtcccaaccgcgccagtagtcatccggcggtgcggaaagggcttcctgggagtaacaaaggcagccttgacag

SEQ ID NO: 95257 - DNA, 75 bp, Artificial Sequence
  Synthetic
ttgtcccaaccgcgccagtagtcatccggcggtgcggaaagggcttcctgggagttacaaaggcagccttgacag

SEQ ID NO: 95258 - DNA, 75 bp, Artificial Sequence
  Synthetic
ttgtcccaaccgcgccagtagtcatccggcggtgcggaaagggcttcctgggagtcacaaaggcagccttgacag

SEQ ID NO: 95259 - DNA, 75 bp, Artificial Sequence
  Synthetic
ttgtcccaaccgcgccagtagtcatccggcggtgcggaaagggcttcctgggagtgacaaaggcagccttgacag

SEQ ID NO: 95260 - DNA, 75 bp, Artificial Sequence
  Synthetic
actactattaggctggtctccaagatgtgcgcaagaggggcctatttgtttgatcacatgggctcttttacgcgt

SEQ ID NO: 95261 - DNA, 75 bp, Artificial Sequence
  Synthetic
attcactaggacggactgtcgcatcatacgagatgctgccaggactctgagctgtggccagtgtgtcatgggctt

SEQ ID NO: 95262 - DNA, 75 bp, Artificial Sequence
  Synthetic
gccacgcccgtgggggccctcaatcccaggtggtggtctgccagtgacgacgtcacggtgtacccacttccggat

SEQ ID NO: 95263 - DNA, 75 bp, Artificial Sequence
  Synthetic
cgtcggtgcggaaaggggttcctcggtgtcacaaaggctgccttgactggtcgggatccagacttacatccagga

SEQ ID NO: 95264 - DNA, 75 bp, Artificial Sequence
  Synthetic
cattagatccgacggggctatgtgccatggcttgtgtaagggggacaaggtggaattggatgtggctatggaggt

SEQ ID NO: 95265 - DNA, 75 bp, Artificial Sequence
  Synthetic
cattagatccgacggggctttgtgccatggcttgtgtaagggggacaaggtggaattggatgtggctatggaggt

SEQ ID NO: 95266 - DNA, 75 bp, Artificial Sequence
  Synthetic
cattagatccgacggggctctgtgccatggcttgtgtaagggggacaaggtggaattggatgtggctatggaggt

SEQ ID NO: 95267 - DNA, 75 bp, Artificial Sequence
  Synthetic
cattagatccgacggggctgtgtgccatggcttgtgtaagggggacaaggtggaattggatgtggctatggaggt

SEQ ID NO: 95268 - DNA, 75 bp, Artificial Sequence
  Synthetic
tcccctgtcttgtgcgacgaggggcacgcagtaggaatgctcgtgtcagtgctacattccggtggtagggtcacc

SEQ ID NO: 95269 - DNA, 75 bp, Artificial Sequence
  Synthetic
tcccctgtcttgtgcgacgaggggcacgcagtaggaatgctcgtgtcagtgcttcattccggtggtagggtcacc

SEQ ID NO: 95270 - DNA, 75 bp, Artificial Sequence
  Synthetic
tcccctgtcttgtgcgacgaggggcacgcagtaggaatgctcgtgtcagtgctccattccggtggtagggtcacc

SEQ ID NO: 95271 - DNA, 75 bp, Artificial Sequence
  Synthetic
tcccctgtcttgtgcgacgaggggcacgcagtaggaatgctcgtgtcagtgctgcattccggtggtagggtcacc

SEQ ID NO: 95272 - DNA, 75 bp, Artificial Sequence
  Synthetic
tcccctgtcttgtgcgacgaggggcacgcagtaggaatgctcgtgtctgtgctacattccggtggtagggtcacc

SEQ ID NO: 95273 - DNA, 75 bp, Artificial Sequence
  Synthetic
tcccctgtcttgtgcgacgaggggcacgcagtaggaatgctcgtgtctgtgcttcattccggtggtagggtcacc

SEQ ID NO: 95274 - DNA, 75 bp, Artificial Sequence
  Synthetic
tcccctgtcttgtgcgacgaggggcacgcagtaggaatgctcgtgtctgtgctccattccggtggtagggtcacc

SEQ ID NO: 95275 - DNA, 75 bp, Artificial Sequence
  Synthetic
tcccctgtcttgtgcgacgaggggcacgcagtaggaatgctcgtgtctgtgctgcattccggtggtagggtcacc

SEQ ID NO: 95276 - DNA, 75 bp, Artificial Sequence
  Synthetic
tcccctgtcttgtgcgacgaggggcacgcagtaggaatgctcgtgtccgtgctacattccggtggtagggtcacc

SEQ ID NO: 95277 - DNA, 75 bp, Artificial Sequence
  Synthetic
tcccctgtcttgtgcgacgaggggcacgcagtaggaatgctcgtgtccgtgcttcattccggtggtagggtcacc

SEQ ID NO: 95278 - DNA, 75 bp, Artificial Sequence
  Synthetic
tcccctgtcttgtgcgacgaggggcacgcagtaggaatgctcgtgtccgtgctccattccggtggtagggtcacc

SEQ ID NO: 95279 - DNA, 75 bp, Artificial Sequence
  Synthetic
tcccctgtcttgtgcgacgaggggcacgcagtaggaatgctcgtgtccgtgctgcattccggtggtagggtcacc

SEQ ID NO: 95280 - DNA, 75 bp, Artificial Sequence
  Synthetic
tcccctgtcttgtgcgacgaggggcacgcagtaggaatgctcgtgtcggtgctacattccggtggtagggtcacc

SEQ ID NO: 95281 - DNA, 75 bp, Artificial Sequence
  Synthetic
tcccctgtcttgtgcgacgaggggcacgcagtaggaatgctcgtgtcggtgcttcattccggtggtagggtcacc

SEQ ID NO: 95282 - DNA, 75 bp, Artificial Sequence
  Synthetic
tcccctgtcttgtgcgacgaggggcacgcagtaggaatgctcgtgtcggtgctccattccggtggtagggtcacc

SEQ ID NO: 95283 - DNA, 75 bp, Artificial Sequence
  Synthetic
tcccctgtcttgtgcgacgaggggcacgcagtaggaatgctcgtgtcggtgctgcattccggtggtagggtcacc

SEQ ID NO: 95284 - DNA, 75 bp, Artificial Sequence
  Synthetic
tcccctgtcttgtgcgacgaggggcacgctgtaggaatgctcgtgtcagtgctacattccggtggtagggtcacc

SEQ ID NO: 95285 - DNA, 75 bp, Artificial Sequence
  Synthetic
tcccctgtcttgtgcgacgaggggcacgctgtaggaatgctcgtgtcagtgcttcattccggtggtagggtcacc

SEQ ID NO: 95286 - DNA, 75 bp, Artificial Sequence
  Synthetic
tcccctgtcttgtgcgacgaggggcacgctgtaggaatgctcgtgtcagtgctccattccggtggtagggtcacc

SEQ ID NO: 95287 - DNA, 75 bp, Artificial Sequence
  Synthetic
tcccctgtcttgtgcgacgaggggcacgctgtaggaatgctcgtgtcagtgctgcattccggtggtagggtcacc

SEQ ID NO: 95288 - DNA, 75 bp, Artificial Sequence
  Synthetic
tcccctgtcttgtgcgacgaggggcacgctgtaggaatgctcgtgtctgtgctacattccggtggtagggtcacc

SEQ ID NO: 95289 - DNA, 75 bp, Artificial Sequence
  Synthetic
tcccctgtcttgtgcgacgaggggcacgctgtaggaatgctcgtgtctgtgcttcattccggtggtagggtcacc

SEQ ID NO: 95290 - DNA, 75 bp, Artificial Sequence
  Synthetic
tcccctgtcttgtgcgacgaggggcacgctgtaggaatgctcgtgtctgtgctccattccggtggtagggtcacc

SEQ ID NO: 95291 - DNA, 75 bp, Artificial Sequence
  Synthetic
tcccctgtcttgtgcgacgaggggcacgctgtaggaatgctcgtgtctgtgctgcattccggtggtagggtcacc

SEQ ID NO: 95292 - DNA, 75 bp, Artificial Sequence
  Synthetic
tcccctgtcttgtgcgacgaggggcacgctgtaggaatgctcgtgtccgtgctacattccggtggtagggtcacc

SEQ ID NO: 95293 - DNA, 75 bp, Artificial Sequence
  Synthetic
tcccctgtcttgtgcgacgaggggcacgctgtaggaatgctcgtgtccgtgcttcattccggtggtagggtcacc

SEQ ID NO: 95294 - DNA, 75 bp, Artificial Sequence
  Synthetic
tcccctgtcttgtgcgacgaggggcacgctgtaggaatgctcgtgtccgtgctccattccggtggtagggtcacc

SEQ ID NO: 95295 - DNA, 75 bp, Artificial Sequence
  Synthetic
tcccctgtcttgtgcgacgaggggcacgctgtaggaatgctcgtgtccgtgctgcattccggtggtagggtcacc

SEQ ID NO: 95296 - DNA, 75 bp, Artificial Sequence
  Synthetic
tcccctgtcttgtgcgacgaggggcacgctgtaggaatgctcgtgtcggtgctacattccggtggtagggtcacc

SEQ ID NO: 95297 - DNA, 75 bp, Artificial Sequence
  Synthetic
tcccctgtcttgtgcgacgaggggcacgctgtaggaatgctcgtgtcggtgcttcattccggtggtagggtcacc

SEQ ID NO: 95298 - DNA, 75 bp, Artificial Sequence
  Synthetic
tcccctgtcttgtgcgacgaggggcacgctgtaggaatgctcgtgtcggtgctccattccggtggtagggtcacc

SEQ ID NO: 95299 - DNA, 75 bp, Artificial Sequence
  Synthetic
tcccctgtcttgtgcgacgaggggcacgctgtaggaatgctcgtgtcggtgctgcattccggtggtagggtcacc

SEQ ID NO: 95300 - DNA, 75 bp, Artificial Sequence
  Synthetic
tcccctgtcttgtgcgacgaggggcacgccgtaggaatgctcgtgtcagtgctacattccggtggtagggtcacc

SEQ ID NO: 95301 - DNA, 75 bp, Artificial Sequence
  Synthetic
tcccctgtcttgtgcgacgaggggcacgccgtaggaatgctcgtgtcagtgcttcattccggtggtagggtcacc

SEQ ID NO: 95302 - DNA, 75 bp, Artificial Sequence
  Synthetic
tcccctgtcttgtgcgacgaggggcacgccgtaggaatgctcgtgtcagtgctccattccggtggtagggtcacc

SEQ ID NO: 95303 - DNA, 75 bp, Artificial Sequence
  Synthetic
tcccctgtcttgtgcgacgaggggcacgccgtaggaatgctcgtgtcagtgctgcattccggtggtagggtcacc

SEQ ID NO: 95304 - DNA, 75 bp, Artificial Sequence
  Synthetic
tcccctgtcttgtgcgacgaggggcacgccgtaggaatgctcgtgtctgtgctacattccggtggtagggtcacc

SEQ ID NO: 95305 - DNA, 75 bp, Artificial Sequence
  Synthetic
tcccctgtcttgtgcgacgaggggcacgccgtaggaatgctcgtgtctgtgcttcattccggtggtagggtcacc

SEQ ID NO: 95306 - DNA, 75 bp, Artificial Sequence
  Synthetic
tcccctgtcttgtgcgacgaggggcacgccgtaggaatgctcgtgtctgtgctccattccggtggtagggtcacc

SEQ ID NO: 95307 - DNA, 75 bp, Artificial Sequence
  Synthetic
tcccctgtcttgtgcgacgaggggcacgccgtaggaatgctcgtgtctgtgctgcattccggtggtagggtcacc

SEQ ID NO: 95308 - DNA, 75 bp, Artificial Sequence
  Synthetic
tcccctgtcttgtgcgacgaggggcacgccgtaggaatgctcgtgtccgtgctacattccggtggtagggtcacc

SEQ ID NO: 95309 - DNA, 75 bp, Artificial Sequence
  Synthetic
tcccctgtcttgtgcgacgaggggcacgccgtaggaatgctcgtgtccgtgcttcattccggtggtagggtcacc

SEQ ID NO: 95310 - DNA, 75 bp, Artificial Sequence
  Synthetic
tcccctgtcttgtgcgacgaggggcacgccgtaggaatgctcgtgtccgtgctccattccggtggtagggtcacc

SEQ ID NO: 95311 - DNA, 75 bp, Artificial Sequence
  Synthetic
tcccctgtcttgtgcgacgaggggcacgccgtaggaatgctcgtgtccgtgctgcattccggtggtagggtcacc

SEQ ID NO: 95312 - DNA, 75 bp, Artificial Sequence
  Synthetic
tcccctgtcttgtgcgacgaggggcacgccgtaggaatgctcgtgtcggtgctacattccggtggtagggtcacc

SEQ ID NO: 95313 - DNA, 75 bp, Artificial Sequence
  Synthetic
tcccctgtcttgtgcgacgaggggcacgccgtaggaatgctcgtgtcggtgcttcattccggtggtagggtcacc

SEQ ID NO: 95314 - DNA, 75 bp, Artificial Sequence
  Synthetic
tcccctgtcttgtgcgacgaggggcacgccgtaggaatgctcgtgtcggtgctccattccggtggtagggtcacc

SEQ ID NO: 95315 - DNA, 75 bp, Artificial Sequence
  Synthetic
tcccctgtcttgtgcgacgaggggcacgccgtaggaatgctcgtgtcggtgctgcattccggtggtagggtcacc

SEQ ID NO: 95316 - DNA, 75 bp, Artificial Sequence
  Synthetic
tcccctgtcttgtgcgacgaggggcacgcggtaggaatgctcgtgtcagtgctacattccggtggtagggtcacc

SEQ ID NO: 95317 - DNA, 75 bp, Artificial Sequence
  Synthetic
tcccctgtcttgtgcgacgaggggcacgcggtaggaatgctcgtgtcagtgcttcattccggtggtagggtcacc

SEQ ID NO: 95318 - DNA, 75 bp, Artificial Sequence
  Synthetic
tcccctgtcttgtgcgacgaggggcacgcggtaggaatgctcgtgtcagtgctccattccggtggtagggtcacc

SEQ ID NO: 95319 - DNA, 75 bp, Artificial Sequence
  Synthetic
tcccctgtcttgtgcgacgaggggcacgcggtaggaatgctcgtgtcagtgctgcattccggtggtagggtcacc

SEQ ID NO: 95320 - DNA, 75 bp, Artificial Sequence
  Synthetic
tcccctgtcttgtgcgacgaggggcacgcggtaggaatgctcgtgtctgtgctacattccggtggtagggtcacc

SEQ ID NO: 95321 - DNA, 75 bp, Artificial Sequence
  Synthetic
tcccctgtcttgtgcgacgaggggcacgcggtaggaatgctcgtgtctgtgcttcattccggtggtagggtcacc

SEQ ID NO: 95322 - DNA, 75 bp, Artificial Sequence
  Synthetic
tcccctgtcttgtgcgacgaggggcacgcggtaggaatgctcgtgtctgtgctccattccggtggtagggtcacc

SEQ ID NO: 95323 - DNA, 75 bp, Artificial Sequence
  Synthetic
tcccctgtcttgtgcgacgaggggcacgcggtaggaatgctcgtgtctgtgctgcattccggtggtagggtcacc

SEQ ID NO: 95324 - DNA, 75 bp, Artificial Sequence
  Synthetic
tcccctgtcttgtgcgacgaggggcacgcggtaggaatgctcgtgtccgtgctacattccggtggtagggtcacc

SEQ ID NO: 95325 - DNA, 75 bp, Artificial Sequence
  Synthetic
tcccctgtcttgtgcgacgaggggcacgcggtaggaatgctcgtgtccgtgcttcattccggtggtagggtcacc

SEQ ID NO: 95326 - DNA, 75 bp, Artificial Sequence
  Synthetic
tcccctgtcttgtgcgacgaggggcacgcggtaggaatgctcgtgtccgtgctccattccggtggtagggtcacc

SEQ ID NO: 95327 - DNA, 75 bp, Artificial Sequence
  Synthetic
tcccctgtcttgtgcgacgaggggcacgcggtaggaatgctcgtgtccgtgctgcattccggtggtagggtcacc

SEQ ID NO: 95328 - DNA, 75 bp, Artificial Sequence
  Synthetic
tcccctgtcttgtgcgacgaggggcacgcggtaggaatgctcgtgtcggtgctacattccggtggtagggtcacc

SEQ ID NO: 95329 - DNA, 75 bp, Artificial Sequence
  Synthetic
tcccctgtcttgtgcgacgaggggcacgcggtaggaatgctcgtgtcggtgcttcattccggtggtagggtcacc

SEQ ID NO: 95330 - DNA, 75 bp, Artificial Sequence
  Synthetic
tcccctgtcttgtgcgacgaggggcacgcggtaggaatgctcgtgtcggtgctccattccggtggtagggtcacc

SEQ ID NO: 95331 - DNA, 75 bp, Artificial Sequence
  Synthetic
tcccctgtcttgtgcgacgaggggcacgcggtaggaatgctcgtgtcggtgctgcattccggtggtagggtcacc

SEQ ID NO: 95332 - DNA, 75 bp, Artificial Sequence
  Synthetic
cgactcctgtgggggccctaaacccaaggtggtggtcggccagtgatgacgtgacggtttaccctctccctgatg

SEQ ID NO: 95333 - DNA, 75 bp, Artificial Sequence
  Synthetic
gcaaaaggagttttcaaggaggccccattgtttatgcctacgggggcgggaaagagaacccgcgtaccgttggag

SEQ ID NO: 95334 - DNA, 75 bp, Artificial Sequence
  Synthetic
gcaaaaggagttttcaaggaggccccattgtttatgcctacgggggcgggaaagagtacccgcgtaccgttggag

SEQ ID NO: 95335 - DNA, 75 bp, Artificial Sequence
  Synthetic
gcaaaaggagttttcaaggaggccccattgtttatgcctacgggggcgggaaagagcacccgcgtaccgttggag

SEQ ID NO: 95336 - DNA, 75 bp, Artificial Sequence
  Synthetic
gcaaaaggagttttcaaggaggccccattgtttatgcctacgggggcgggaaagaggacccgcgtaccgttggag

SEQ ID NO: 95337 - DNA, 75 bp, Artificial Sequence
  Synthetic
tgtgaaggccatgggcccttacatggagcggctggcaggaaaacatccaagcatatactgtggacacgacacaac

SEQ ID NO: 95338 - DNA, 75 bp, Artificial Sequence
  Synthetic
tgtgaaggccatgggcccttacatggagcggctggcaggaaaacatccaagcatatactgtggtcacgacacaac

SEQ ID NO: 95339 - DNA, 75 bp, Artificial Sequence
  Synthetic
tgtgaaggccatgggcccttacatggagcggctggcaggaaaacatccaagcatatactgtggccacgacacaac

SEQ ID NO: 95340 - DNA, 75 bp, Artificial Sequence
  Synthetic
tgtgaaggccatgggcccttacatggagcggctggcaggaaaacatccaagcatatactgtgggcacgacacaac

SEQ ID NO: 95341 - DNA, 75 bp, Artificial Sequence
  Synthetic
tgtgaaggccatgggcccttacatggagcggctggcaggaaaacatccaagcatttactgtggacacgacacaac

SEQ ID NO: 95342 - DNA, 75 bp, Artificial Sequence
  Synthetic
tgtgaaggccatgggcccttacatggagcggctggcaggaaaacatccaagcatttactgtggtcacgacacaac

SEQ ID NO: 95343 - DNA, 75 bp, Artificial Sequence
  Synthetic
tgtgaaggccatgggcccttacatggagcggctggcaggaaaacatccaagcatttactgtggccacgacacaac

SEQ ID NO: 95344 - DNA, 75 bp, Artificial Sequence
  Synthetic
tgtgaaggccatgggcccttacatggagcggctggcaggaaaacatccaagcatttactgtgggcacgacacaac

SEQ ID NO: 95345 - DNA, 75 bp, Artificial Sequence
  Synthetic
tgtgaaggccatgggcccttacatggagcggctggcaggaaaacatccaagcatctactgtggacacgacacaac

SEQ ID NO: 95346 - DNA, 75 bp, Artificial Sequence
  Synthetic
tgtgaaggccatgggcccttacatggagcggctggcaggaaaacatccaagcatctactgtggtcacgacacaac

SEQ ID NO: 95347 - DNA, 75 bp, Artificial Sequence
  Synthetic
tgtgaaggccatgggcccttacatggagcggctggcaggaaaacatccaagcatctactgtggccacgacacaac

SEQ ID NO: 95348 - DNA, 75 bp, Artificial Sequence
  Synthetic
tgtgaaggccatgggcccttacatggagcggctggcaggaaaacatccaagcatctactgtgggcacgacacaac

SEQ ID NO: 95349 - DNA, 75 bp, Artificial Sequence
  Synthetic
tgtgaaggccatgggcccttacatggagcggctggcaggaaaacatccaagcatgtactgtggacacgacacaac

SEQ ID NO: 95350 - DNA, 75 bp, Artificial Sequence
  Synthetic
tgtgaaggccatgggcccttacatggagcggctggcaggaaaacatccaagcatgtactgtggtcacgacacaac

SEQ ID NO: 95351 - DNA, 75 bp, Artificial Sequence
  Synthetic
tgtgaaggccatgggcccttacatggagcggctggcaggaaaacatccaagcatgtactgtggccacgacacaac

SEQ ID NO: 95352 - DNA, 75 bp, Artificial Sequence
  Synthetic
tgtgaaggccatgggcccttacatggagcggctggcaggaaaacatccaagcatgtactgtgggcacgacacaac

SEQ ID NO: 95353 - DNA, 75 bp, Artificial Sequence
  Synthetic
tgtgatggccatgggcccttacatggagcggctggcaggaaaacatccaagcatatactgtggacacgacacaac

SEQ ID NO: 95354 - DNA, 75 bp, Artificial Sequence
  Synthetic
tgtgatggccatgggcccttacatggagcggctggcaggaaaacatccaagcatatactgtggtcacgacacaac

SEQ ID NO: 95355 - DNA, 75 bp, Artificial Sequence
  Synthetic
tgtgatggccatgggcccttacatggagcggctggcaggaaaacatccaagcatatactgtggccacgacacaac

SEQ ID NO: 95356 - DNA, 75 bp, Artificial Sequence
  Synthetic
tgtgatggccatgggcccttacatggagcggctggcaggaaaacatccaagcatatactgtgggcacgacacaac

SEQ ID NO: 95357 - DNA, 75 bp, Artificial Sequence
  Synthetic
tgtgatggccatgggcccttacatggagcggctggcaggaaaacatccaagcatttactgtggacacgacacaac

SEQ ID NO: 95358 - DNA, 75 bp, Artificial Sequence
  Synthetic
tgtgatggccatgggcccttacatggagcggctggcaggaaaacatccaagcatttactgtggtcacgacacaac

SEQ ID NO: 95359 - DNA, 75 bp, Artificial Sequence
  Synthetic
tgtgatggccatgggcccttacatggagcggctggcaggaaaacatccaagcatttactgtggccacgacacaac

SEQ ID NO: 95360 - DNA, 75 bp, Artificial Sequence
  Synthetic
tgtgatggccatgggcccttacatggagcggctggcaggaaaacatccaagcatttactgtgggcacgacacaac

SEQ ID NO: 95361 - DNA, 75 bp, Artificial Sequence
  Synthetic
tgtgatggccatgggcccttacatggagcggctggcaggaaaacatccaagcatctactgtggacacgacacaac

SEQ ID NO: 95362 - DNA, 75 bp, Artificial Sequence
  Synthetic
tgtgatggccatgggcccttacatggagcggctggcaggaaaacatccaagcatctactgtggtcacgacacaac

SEQ ID NO: 95363 - DNA, 75 bp, Artificial Sequence
  Synthetic
tgtgatggccatgggcccttacatggagcggctggcaggaaaacatccaagcatctactgtggccacgacacaac

SEQ ID NO: 95364 - DNA, 75 bp, Artificial Sequence
  Synthetic
tgtgatggccatgggcccttacatggagcggctggcaggaaaacatccaagcatctactgtgggcacgacacaac

SEQ ID NO: 95365 - DNA, 75 bp, Artificial Sequence
  Synthetic
tgtgatggccatgggcccttacatggagcggctggcaggaaaacatccaagcatgtactgtggacacgacacaac

SEQ ID NO: 95366 - DNA, 75 bp, Artificial Sequence
  Synthetic
tgtgatggccatgggcccttacatggagcggctggcaggaaaacatccaagcatgtactgtggtcacgacacaac

SEQ ID NO: 95367 - DNA, 75 bp, Artificial Sequence
  Synthetic
tgtgatggccatgggcccttacatggagcggctggcaggaaaacatccaagcatgtactgtggccacgacacaac

SEQ ID NO: 95368 - DNA, 75 bp, Artificial Sequence
  Synthetic
tgtgatggccatgggcccttacatggagcggctggcaggaaaacatccaagcatgtactgtgggcacgacacaac

SEQ ID NO: 95369 - DNA, 75 bp, Artificial Sequence
  Synthetic
tgtgacggccatgggcccttacatggagcggctggcaggaaaacatccaagcatatactgtggacacgacacaac

SEQ ID NO: 95370 - DNA, 75 bp, Artificial Sequence
  Synthetic
tgtgacggccatgggcccttacatggagcggctggcaggaaaacatccaagcatatactgtggtcacgacacaac

SEQ ID NO: 95371 - DNA, 75 bp, Artificial Sequence
  Synthetic
tgtgacggccatgggcccttacatggagcggctggcaggaaaacatccaagcatatactgtggccacgacacaac

SEQ ID NO: 95372 - DNA, 75 bp, Artificial Sequence
  Synthetic
tgtgacggccatgggcccttacatggagcggctggcaggaaaacatccaagcatatactgtgggcacgacacaac

SEQ ID NO: 95373 - DNA, 75 bp, Artificial Sequence
  Synthetic
tgtgacggccatgggcccttacatggagcggctggcaggaaaacatccaagcatttactgtggacacgacacaac

SEQ ID NO: 95374 - DNA, 75 bp, Artificial Sequence
  Synthetic
tgtgacggccatgggcccttacatggagcggctggcaggaaaacatccaagcatttactgtggtcacgacacaac

SEQ ID NO: 95375 - DNA, 75 bp, Artificial Sequence
  Synthetic
tgtgacggccatgggcccttacatggagcggctggcaggaaaacatccaagcatttactgtggccacgacacaac

SEQ ID NO: 95376 - DNA, 75 bp, Artificial Sequence
  Synthetic
tgtgacggccatgggcccttacatggagcggctggcaggaaaacatccaagcatttactgtgggcacgacacaac

SEQ ID NO: 95377 - DNA, 75 bp, Artificial Sequence
  Synthetic
tgtgacggccatgggcccttacatggagcggctggcaggaaaacatccaagcatctactgtggacacgacacaac

SEQ ID NO: 95378 - DNA, 75 bp, Artificial Sequence
  Synthetic
tgtgacggccatgggcccttacatggagcggctggcaggaaaacatccaagcatctactgtggtcacgacacaac

SEQ ID NO: 95379 - DNA, 75 bp, Artificial Sequence
  Synthetic
tgtgacggccatgggcccttacatggagcggctggcaggaaaacatccaagcatctactgtggccacgacacaac

SEQ ID NO: 95380 - DNA, 75 bp, Artificial Sequence
  Synthetic
tgtgacggccatgggcccttacatggagcggctggcaggaaaacatccaagcatctactgtgggcacgacacaac

SEQ ID NO: 95381 - DNA, 75 bp, Artificial Sequence
  Synthetic
tgtgacggccatgggcccttacatggagcggctggcaggaaaacatccaagcatgtactgtggacacgacacaac

SEQ ID NO: 95382 - DNA, 75 bp, Artificial Sequence
  Synthetic
tgtgacggccatgggcccttacatggagcggctggcaggaaaacatccaagcatgtactgtggtcacgacacaac

SEQ ID NO: 95383 - DNA, 75 bp, Artificial Sequence
  Synthetic
tgtgacggccatgggcccttacatggagcggctggcaggaaaacatccaagcatgtactgtggccacgacacaac

SEQ ID NO: 95384 - DNA, 75 bp, Artificial Sequence
  Synthetic
tgtgacggccatgggcccttacatggagcggctggcaggaaaacatccaagcatgtactgtgggcacgacacaac

SEQ ID NO: 95385 - DNA, 75 bp, Artificial Sequence
  Synthetic
tgtgagggccatgggcccttacatggagcggctggcaggaaaacatccaagcatatactgtggacacgacacaac

SEQ ID NO: 95386 - DNA, 75 bp, Artificial Sequence
  Synthetic
tgtgagggccatgggcccttacatggagcggctggcaggaaaacatccaagcatatactgtggtcacgacacaac

SEQ ID NO: 95387 - DNA, 75 bp, Artificial Sequence
  Synthetic
tgtgagggccatgggcccttacatggagcggctggcaggaaaacatccaagcatatactgtggccacgacacaac

SEQ ID NO: 95388 - DNA, 75 bp, Artificial Sequence
  Synthetic
tgtgagggccatgggcccttacatggagcggctggcaggaaaacatccaagcatatactgtgggcacgacacaac

SEQ ID NO: 95389 - DNA, 75 bp, Artificial Sequence
  Synthetic
tgtgagggccatgggcccttacatggagcggctggcaggaaaacatccaagcatttactgtggacacgacacaac

SEQ ID NO: 95390 - DNA, 75 bp, Artificial Sequence
  Synthetic
tgtgagggccatgggcccttacatggagcggctggcaggaaaacatccaagcatttactgtggtcacgacacaac

SEQ ID NO: 95391 - DNA, 75 bp, Artificial Sequence
  Synthetic
tgtgagggccatgggcccttacatggagcggctggcaggaaaacatccaagcatttactgtggccacgacacaac

SEQ ID NO: 95392 - DNA, 75 bp, Artificial Sequence
  Synthetic
tgtgagggccatgggcccttacatggagcggctggcaggaaaacatccaagcatttactgtgggcacgacacaac

SEQ ID NO: 95393 - DNA, 75 bp, Artificial Sequence
  Synthetic
tgtgagggccatgggcccttacatggagcggctggcaggaaaacatccaagcatctactgtggacacgacacaac

SEQ ID NO: 95394 - DNA, 75 bp, Artificial Sequence
  Synthetic
tgtgagggccatgggcccttacatggagcggctggcaggaaaacatccaagcatctactgtggtcacgacacaac

SEQ ID NO: 95395 - DNA, 75 bp, Artificial Sequence
  Synthetic
tgtgagggccatgggcccttacatggagcggctggcaggaaaacatccaagcatctactgtggccacgacacaac

SEQ ID NO: 95396 - DNA, 75 bp, Artificial Sequence
  Synthetic
tgtgagggccatgggcccttacatggagcggctggcaggaaaacatccaagcatctactgtgggcacgacacaac

SEQ ID NO: 95397 - DNA, 75 bp, Artificial Sequence
  Synthetic
tgtgagggccatgggcccttacatggagcggctggcaggaaaacatccaagcatgtactgtggacacgacacaac

SEQ ID NO: 95398 - DNA, 75 bp, Artificial Sequence
  Synthetic
tgtgagggccatgggcccttacatggagcggctggcaggaaaacatccaagcatgtactgtggtcacgacacaac

SEQ ID NO: 95399 - DNA, 75 bp, Artificial Sequence
  Synthetic
tgtgagggccatgggcccttacatggagcggctggcaggaaaacatccaagcatgtactgtggccacgacacaac

SEQ ID NO: 95400 - DNA, 75 bp, Artificial Sequence
  Synthetic
tgtgagggccatgggcccttacatggagcggctggcaggaaaacatccaagcatgtactgtgggcacgacacaac

SEQ ID NO: 95401 - DNA, 75 bp, Artificial Sequence
  Synthetic
gagcggctggcaggaaaacatccaagcatatactgtggacacgacacaacagctttcacaagaatcactgactcg

SEQ ID NO: 95402 - DNA, 75 bp, Artificial Sequence
  Synthetic
gagcggctggcaggaaaacatccaagcatatactgtggacacgacacaacagctttcactagaatcactgactcg

SEQ ID NO: 95403 - DNA, 75 bp, Artificial Sequence
  Synthetic
gagcggctggcaggaaaacatccaagcatatactgtggacacgacacaacagctttcaccagaatcactgactcg

SEQ ID NO: 95404 - DNA, 75 bp, Artificial Sequence
  Synthetic
gagcggctggcaggaaaacatccaagcatatactgtggacacgacacaacagctttcacgagaatcactgactcg

SEQ ID NO: 95405 - DNA, 75 bp, Artificial Sequence
  Synthetic
gagcggctggcaggaaaacatccaagcatatactgtggtcacgacacaacagctttcacaagaatcactgactcg

SEQ ID NO: 95406 - DNA, 75 bp, Artificial Sequence
  Synthetic
gagcggctggcaggaaaacatccaagcatatactgtggtcacgacacaacagctttcactagaatcactgactcg

SEQ ID NO: 95407 - DNA, 75 bp, Artificial Sequence
  Synthetic
gagcggctggcaggaaaacatccaagcatatactgtggtcacgacacaacagctttcaccagaatcactgactcg

SEQ ID NO: 95408 - DNA, 75 bp, Artificial Sequence
  Synthetic
gagcggctggcaggaaaacatccaagcatatactgtggtcacgacacaacagctttcacgagaatcactgactcg

SEQ ID NO: 95409 - DNA, 75 bp, Artificial Sequence
  Synthetic
gagcggctggcaggaaaacatccaagcatatactgtggccacgacacaacagctttcacaagaatcactgactcg

SEQ ID NO: 95410 - DNA, 75 bp, Artificial Sequence
  Synthetic
gagcggctggcaggaaaacatccaagcatatactgtggccacgacacaacagctttcactagaatcactgactcg

SEQ ID NO: 95411 - DNA, 75 bp, Artificial Sequence
  Synthetic
gagcggctggcaggaaaacatccaagcatatactgtggccacgacacaacagctttcaccagaatcactgactcg

SEQ ID NO: 95412 - DNA, 75 bp, Artificial Sequence
  Synthetic
gagcggctggcaggaaaacatccaagcatatactgtggccacgacacaacagctttcacgagaatcactgactcg

SEQ ID NO: 95413 - DNA, 75 bp, Artificial Sequence
  Synthetic
gagcggctggcaggaaaacatccaagcatatactgtgggcacgacacaacagctttcacaagaatcactgactcg

SEQ ID NO: 95414 - DNA, 75 bp, Artificial Sequence
  Synthetic
gagcggctggcaggaaaacatccaagcatatactgtgggcacgacacaacagctttcactagaatcactgactcg

SEQ ID NO: 95415 - DNA, 75 bp, Artificial Sequence
  Synthetic
gagcggctggcaggaaaacatccaagcatatactgtgggcacgacacaacagctttcaccagaatcactgactcg

SEQ ID NO: 95416 - DNA, 75 bp, Artificial Sequence
  Synthetic
gagcggctggcaggaaaacatccaagcatatactgtgggcacgacacaacagctttcacgagaatcactgactcg

SEQ ID NO: 95417 - DNA, 75 bp, Artificial Sequence
  Synthetic
gagcggctggcaggaaaacatccaagcatttactgtggacacgacacaacagctttcacaagaatcactgactcg

SEQ ID NO: 95418 - DNA, 75 bp, Artificial Sequence
  Synthetic
gagcggctggcaggaaaacatccaagcatttactgtggacacgacacaacagctttcactagaatcactgactcg

SEQ ID NO: 95419 - DNA, 75 bp, Artificial Sequence
  Synthetic
gagcggctggcaggaaaacatccaagcatttactgtggacacgacacaacagctttcaccagaatcactgactcg

SEQ ID NO: 95420 - DNA, 75 bp, Artificial Sequence
  Synthetic
gagcggctggcaggaaaacatccaagcatttactgtggacacgacacaacagctttcacgagaatcactgactcg

SEQ ID NO: 95421 - DNA, 75 bp, Artificial Sequence
  Synthetic
gagcggctggcaggaaaacatccaagcatttactgtggtcacgacacaacagctttcacaagaatcactgactcg

SEQ ID NO: 95422 - DNA, 75 bp, Artificial Sequence
  Synthetic
gagcggctggcaggaaaacatccaagcatttactgtggtcacgacacaacagctttcactagaatcactgactcg

SEQ ID NO: 95423 - DNA, 75 bp, Artificial Sequence
  Synthetic
gagcggctggcaggaaaacatccaagcatttactgtggtcacgacacaacagctttcaccagaatcactgactcg

SEQ ID NO: 95424 - DNA, 75 bp, Artificial Sequence
  Synthetic
gagcggctggcaggaaaacatccaagcatttactgtggtcacgacacaacagctttcacgagaatcactgactcg

SEQ ID NO: 95425 - DNA, 75 bp, Artificial Sequence
  Synthetic
gagcggctggcaggaaaacatccaagcatttactgtggccacgacacaacagctttcacaagaatcactgactcg

SEQ ID NO: 95426 - DNA, 75 bp, Artificial Sequence
  Synthetic
gagcggctggcaggaaaacatccaagcatttactgtggccacgacacaacagctttcactagaatcactgactcg

SEQ ID NO: 95427 - DNA, 75 bp, Artificial Sequence
  Synthetic
gagcggctggcaggaaaacatccaagcatttactgtggccacgacacaacagctttcaccagaatcactgactcg

SEQ ID NO: 95428 - DNA, 75 bp, Artificial Sequence
  Synthetic
gagcggctggcaggaaaacatccaagcatttactgtggccacgacacaacagctttcacgagaatcactgactcg

SEQ ID NO: 95429 - DNA, 75 bp, Artificial Sequence
  Synthetic
gagcggctggcaggaaaacatccaagcatttactgtgggcacgacacaacagctttcacaagaatcactgactcg

SEQ ID NO: 95430 - DNA, 75 bp, Artificial Sequence
  Synthetic
gagcggctggcaggaaaacatccaagcatttactgtgggcacgacacaacagctttcactagaatcactgactcg

SEQ ID NO: 95431 - DNA, 75 bp, Artificial Sequence
  Synthetic
gagcggctggcaggaaaacatccaagcatttactgtgggcacgacacaacagctttcaccagaatcactgactcg

SEQ ID NO: 95432 - DNA, 75 bp, Artificial Sequence
  Synthetic
gagcggctggcaggaaaacatccaagcatttactgtgggcacgacacaacagctttcacgagaatcactgactcg

SEQ ID NO: 95433 - DNA, 75 bp, Artificial Sequence
  Synthetic
gagcggctggcaggaaaacatccaagcatctactgtggacacgacacaacagctttcacaagaatcactgactcg

SEQ ID NO: 95434 - DNA, 75 bp, Artificial Sequence
  Synthetic
gagcggctggcaggaaaacatccaagcatctactgtggacacgacacaacagctttcactagaatcactgactcg

SEQ ID NO: 95435 - DNA, 75 bp, Artificial Sequence
  Synthetic
gagcggctggcaggaaaacatccaagcatctactgtggacacgacacaacagctttcaccagaatcactgactcg

SEQ ID NO: 95436 - DNA, 75 bp, Artificial Sequence
  Synthetic
gagcggctggcaggaaaacatccaagcatctactgtggacacgacacaacagctttcacgagaatcactgactcg

SEQ ID NO: 95437 - DNA, 75 bp, Artificial Sequence
  Synthetic
gagcggctggcaggaaaacatccaagcatctactgtggtcacgacacaacagctttcacaagaatcactgactcg

SEQ ID NO: 95438 - DNA, 75 bp, Artificial Sequence
  Synthetic
gagcggctggcaggaaaacatccaagcatctactgtggtcacgacacaacagctttcactagaatcactgactcg

SEQ ID NO: 95439 - DNA, 75 bp, Artificial Sequence
  Synthetic
gagcggctggcaggaaaacatccaagcatctactgtggtcacgacacaacagctttcaccagaatcactgactcg

SEQ ID NO: 95440 - DNA, 75 bp, Artificial Sequence
  Synthetic
gagcggctggcaggaaaacatccaagcatctactgtggtcacgacacaacagctttcacgagaatcactgactcg

SEQ ID NO: 95441 - DNA, 75 bp, Artificial Sequence
  Synthetic
gagcggctggcaggaaaacatccaagcatctactgtggccacgacacaacagctttcacaagaatcactgactcg

SEQ ID NO: 95442 - DNA, 75 bp, Artificial Sequence
  Synthetic
gagcggctggcaggaaaacatccaagcatctactgtggccacgacacaacagctttcactagaatcactgactcg

SEQ ID NO: 95443 - DNA, 75 bp, Artificial Sequence
  Synthetic
gagcggctggcaggaaaacatccaagcatctactgtggccacgacacaacagctttcaccagaatcactgactcg

SEQ ID NO: 95444 - DNA, 75 bp, Artificial Sequence
  Synthetic
gagcggctggcaggaaaacatccaagcatctactgtggccacgacacaacagctttcacgagaatcactgactcg

SEQ ID NO: 95445 - DNA, 75 bp, Artificial Sequence
  Synthetic
gagcggctggcaggaaaacatccaagcatctactgtgggcacgacacaacagctttcacaagaatcactgactcg

SEQ ID NO: 95446 - DNA, 75 bp, Artificial Sequence
  Synthetic
gagcggctggcaggaaaacatccaagcatctactgtgggcacgacacaacagctttcactagaatcactgactcg

SEQ ID NO: 95447 - DNA, 75 bp, Artificial Sequence
  Synthetic
gagcggctggcaggaaaacatccaagcatctactgtgggcacgacacaacagctttcaccagaatcactgactcg

SEQ ID NO: 95448 - DNA, 75 bp, Artificial Sequence
  Synthetic
gagcggctggcaggaaaacatccaagcatctactgtgggcacgacacaacagctttcacgagaatcactgactcg

SEQ ID NO: 95449 - DNA, 75 bp, Artificial Sequence
  Synthetic
gagcggctggcaggaaaacatccaagcatgtactgtggacacgacacaacagctttcacaagaatcactgactcg

SEQ ID NO: 95450 - DNA, 75 bp, Artificial Sequence
  Synthetic
gagcggctggcaggaaaacatccaagcatgtactgtggacacgacacaacagctttcactagaatcactgactcg

SEQ ID NO: 95451 - DNA, 75 bp, Artificial Sequence
  Synthetic
gagcggctggcaggaaaacatccaagcatgtactgtggacacgacacaacagctttcaccagaatcactgactcg

SEQ ID NO: 95452 - DNA, 75 bp, Artificial Sequence
  Synthetic
gagcggctggcaggaaaacatccaagcatgtactgtggacacgacacaacagctttcacgagaatcactgactcg

SEQ ID NO: 95453 - DNA, 75 bp, Artificial Sequence
  Synthetic
gagcggctggcaggaaaacatccaagcatgtactgtggtcacgacacaacagctttcacaagaatcactgactcg

SEQ ID NO: 95454 - DNA, 75 bp, Artificial Sequence
  Synthetic
gagcggctggcaggaaaacatccaagcatgtactgtggtcacgacacaacagctttcactagaatcactgactcg

SEQ ID NO: 95455 - DNA, 75 bp, Artificial Sequence
  Synthetic
gagcggctggcaggaaaacatccaagcatgtactgtggtcacgacacaacagctttcaccagaatcactgactcg

SEQ ID NO: 95456 - DNA, 75 bp, Artificial Sequence
  Synthetic
gagcggctggcaggaaaacatccaagcatgtactgtggtcacgacacaacagctttcacgagaatcactgactcg

SEQ ID NO: 95457 - DNA, 75 bp, Artificial Sequence
  Synthetic
gagcggctggcaggaaaacatccaagcatgtactgtggccacgacacaacagctttcacaagaatcactgactcg

SEQ ID NO: 95458 - DNA, 75 bp, Artificial Sequence
  Synthetic
gagcggctggcaggaaaacatccaagcatgtactgtggccacgacacaacagctttcactagaatcactgactcg

SEQ ID NO: 95459 - DNA, 75 bp, Artificial Sequence
  Synthetic
gagcggctggcaggaaaacatccaagcatgtactgtggccacgacacaacagctttcaccagaatcactgactcg

SEQ ID NO: 95460 - DNA, 75 bp, Artificial Sequence
  Synthetic
gagcggctggcaggaaaacatccaagcatgtactgtggccacgacacaacagctttcacgagaatcactgactcg

SEQ ID NO: 95461 - DNA, 75 bp, Artificial Sequence
  Synthetic
gagcggctggcaggaaaacatccaagcatgtactgtgggcacgacacaacagctttcacaagaatcactgactcg

SEQ ID NO: 95462 - DNA, 75 bp, Artificial Sequence
  Synthetic
gagcggctggcaggaaaacatccaagcatgtactgtgggcacgacacaacagctttcactagaatcactgactcg

SEQ ID NO: 95463 - DNA, 75 bp, Artificial Sequence
  Synthetic
gagcggctggcaggaaaacatccaagcatgtactgtgggcacgacacaacagctttcaccagaatcactgactcg

SEQ ID NO: 95464 - DNA, 75 bp, Artificial Sequence
  Synthetic
gagcggctggcaggaaaacatccaagcatgtactgtgggcacgacacaacagctttcacgagaatcactgactcg

SEQ ID NO: 95465 - DNA, 75 bp, Artificial Sequence
  Synthetic
ctgcgcgtttcacgcggccgtggacccaagttccaaccgatgccaagactaccaccgagcccccaccagttccag

SEQ ID NO: 95466 - DNA, 75 bp, Artificial Sequence
  Synthetic
ccaagttccaaccgatgccaagactaccaccgagcccccaccagttccagcaaaaggggttttcaaggaagctcc

SEQ ID NO: 95467 - DNA, 75 bp, Artificial Sequence
  Synthetic
gctgaggggcgtgtcggtggttatttgtgatgagtgccacagtcatgactcaacagtgttgttggggattgggcg

SEQ ID NO: 95468 - DNA, 75 bp, Artificial Sequence
  Synthetic
tgtgatgagtgccacagtcatgactcaacagtgttgttggggattgggcgtgtccgggagctggcgcgtgggtgt

SEQ ID NO: 95469 - DNA, 75 bp, Artificial Sequence
  Synthetic
atggaaacatggggcacaaggtcctaattctcaacccgtcggtcgctacagtgaaggccatgggcccttacatgg

SEQ ID NO: 95470 - DNA, 75 bp, Artificial Sequence
  Synthetic
aattctcaacccgtcggtcgctacagtgaaggccatgggcccttacatggagcgcttggcgggtaaacacccaag

SEQ ID NO: 95471 - DNA, 75 bp, Artificial Sequence
  Synthetic
gactcaacatccctctatcattgagacaaaactggatgtgggagaaatccccttttatgggcatggtatacccct

SEQ ID NO: 95472 - DNA, 75 bp, Artificial Sequence
  Synthetic
cattgacgtattcaacctatgggaggtttttagccaaccctaggcagatgctgaggggggtctcagtggttattt

SEQ ID NO: 95473 - DNA, 75 bp, Artificial Sequence
  Synthetic
gtttttagccaaccctaggcagatgctgaggggggtctcagtggttatttgtgatgaatgccacagtcatgactc

SEQ ID NO: 95474 - DNA, 75 bp, Artificial Sequence
  Synthetic
agtgcgagcgtttggctggtcagttttctgccagaggggtcaatgccatcgcctattacaggggcaaagacagtt

SEQ ID NO: 95475 - DNA, 75 bp, Artificial Sequence
  Synthetic
gggtacagctcgtgctctacgccaccgccacgccgcccggatcgcctatgacccagcatccatcaatcattgaga

SEQ ID NO: 95476 - DNA, 75 bp, Artificial Sequence
  Synthetic
cgccacgccgcccggatcgcctatgacccagcatccatcaatcattgagactaaattggatgtgggtgagatccc

SEQ ID NO: 95477 - DNA, 75 bp, Artificial Sequence
  Synthetic
gcacagtgccagcgtcggcagaactgtcgatgcaaaggcgaggacgcacgggtagaggcagatctgggcgctact

SEQ ID NO: 95478 - DNA, 75 bp, Artificial Sequence
  Synthetic
tcgtgttcttccgatctaaggcagagtgcgagaggttggcaggtcagttctcatcccgaggggtcaacgccattg

SEQ ID NO: 95479 - DNA, 75 bp, Artificial Sequence
  Synthetic
catcatcaaggacggtgacctggtcgtctgcgctaccgacgcgctctcgacgggttacactgggaacttcgattc

SEQ ID NO: 95480 - DNA, 75 bp, Artificial Sequence
  Synthetic
gcgggcgtggtgcggtccggtcctgtctggtcagcagtggaagccggagtgacctggtatggaatggaacctgac

SEQ ID NO: 95481 - DNA, 75 bp, Artificial Sequence
  Synthetic
gcaatgatttaccatctaaagtggccggccatcacattgtggacgacctggtccgtaggctcggagtggccgagg

SEQ ID NO: 95482 - DNA, 75 bp, Artificial Sequence
  Synthetic
gcaatgatttaccatctaaagtggccggccatcacattgtggacgacctggtccgtaggctcggtgtggccgagg

SEQ ID NO: 95483 - DNA, 75 bp, Artificial Sequence
  Synthetic
gcaatgatttaccatctaaagtggccggccatcacattgtggacgacctggtccgtaggctcggcgtggccgagg

SEQ ID NO: 95484 - DNA, 75 bp, Artificial Sequence
  Synthetic
gcaatgatttaccatctaaagtggccggccatcacattgtggacgacctggtccgtaggctcggggtggccgagg

SEQ ID NO: 95485 - DNA, 75 bp, Artificial Sequence
  Synthetic
ctgggcaaaggtacgcggcgtcaattggcccctcctggtgggtgttcagcggaccatgtgccgggaaacactgtc

SEQ ID NO: 95486 - DNA, 75 bp, Artificial Sequence
  Synthetic
ggccatcacatagtcgacgacctggtccgtcggctcggtgtggcggagggatacgtccgttgtgacgctgggccc

SEQ ID NO: 95487 - DNA, 75 bp, Artificial Sequence
  Synthetic
ggccatccaagtggactgtgattggtcagtcatgaccctgtcgatcggggaagtgctgtccttggcccaggctaa

SEQ ID NO: 95488 - DNA, 75 bp, Artificial Sequence
  Synthetic
caccgggtctatagtggtggtaacagactgggatgtaaaggggggtggcaaccccctttatcggagcggcgacca

SEQ ID NO: 95489 - DNA, 75 bp, Artificial Sequence
  Synthetic
gctaagtggctagctggctgctacacggggacgcgggccgtccccactgtatccattgttgacaagctctttgcc

SEQ ID NO: 95490 - DNA, 75 bp, Artificial Sequence
  Synthetic
gctaagtggctagctggctgctacacggggacgcgggccgtccccactgtttccattgttgacaagctctttgcc

SEQ ID NO: 95491 - DNA, 75 bp, Artificial Sequence
  Synthetic
gctaagtggctagctggctgctacacggggacgcgggccgtccccactgtctccattgttgacaagctctttgcc

SEQ ID NO: 95492 - DNA, 75 bp, Artificial Sequence
  Synthetic
gctaagtggctagctggctgctacacggggacgcgggccgtccccactgtgtccattgttgacaagctctttgcc

SEQ ID NO: 95493 - DNA, 75 bp, Artificial Sequence
  Synthetic
agtggcggcctacggggcttcaaggagtcccccgttggcagctgcggcttcatacctaatgggattgggcgtagg

SEQ ID NO: 95494 - DNA, 75 bp, Artificial Sequence
  Synthetic
agtggcggcctacggggcttcaaggagtcccccgttggcagctgcggcttcatacctaatgggattgggcgttgg

SEQ ID NO: 95495 - DNA, 75 bp, Artificial Sequence
  Synthetic
agtggcggcctacggggcttcaaggagtcccccgttggcagctgcggcttcatacctaatgggattgggcgtcgg

SEQ ID NO: 95496 - DNA, 75 bp, Artificial Sequence
  Synthetic
agtggcggcctacggggcttcaaggagtcccccgttggcagctgcggcttcatacctaatgggattgggcgtggg

SEQ ID NO: 95497 - DNA, 75 bp, Artificial Sequence
  Synthetic
agtggcggcctacggggcttcaaggagtcccccgttggcagctgcggcttcttacctaatgggattgggcgtagg

SEQ ID NO: 95498 - DNA, 75 bp, Artificial Sequence
  Synthetic
agtggcggcctacggggcttcaaggagtcccccgttggcagctgcggcttcttacctaatgggattgggcgttgg

SEQ ID NO: 95499 - DNA, 75 bp, Artificial Sequence
  Synthetic
agtggcggcctacggggcttcaaggagtcccccgttggcagctgcggcttcttacctaatgggattgggcgtcgg

SEQ ID NO: 95500 - DNA, 75 bp, Artificial Sequence
  Synthetic
agtggcggcctacggggcttcaaggagtcccccgttggcagctgcggcttcttacctaatgggattgggcgtggg

SEQ ID NO: 95501 - DNA, 75 bp, Artificial Sequence
  Synthetic
agtggcggcctacggggcttcaaggagtcccccgttggcagctgcggcttcctacctaatgggattgggcgtagg

SEQ ID NO: 95502 - DNA, 75 bp, Artificial Sequence
  Synthetic
agtggcggcctacggggcttcaaggagtcccccgttggcagctgcggcttcctacctaatgggattgggcgttgg

SEQ ID NO: 95503 - DNA, 75 bp, Artificial Sequence
  Synthetic
agtggcggcctacggggcttcaaggagtcccccgttggcagctgcggcttcctacctaatgggattgggcgtcgg

SEQ ID NO: 95504 - DNA, 75 bp, Artificial Sequence
  Synthetic
agtggcggcctacggggcttcaaggagtcccccgttggcagctgcggcttcctacctaatgggattgggcgtggg

SEQ ID NO: 95505 - DNA, 75 bp, Artificial Sequence
  Synthetic
agtggcggcctacggggcttcaaggagtcccccgttggcagctgcggcttcgtacctaatgggattgggcgtagg

SEQ ID NO: 95506 - DNA, 75 bp, Artificial Sequence
  Synthetic
agtggcggcctacggggcttcaaggagtcccccgttggcagctgcggcttcgtacctaatgggattgggcgttgg

SEQ ID NO: 95507 - DNA, 75 bp, Artificial Sequence
  Synthetic
agtggcggcctacggggcttcaaggagtcccccgttggcagctgcggcttcgtacctaatgggattgggcgtcgg

SEQ ID NO: 95508 - DNA, 75 bp, Artificial Sequence
  Synthetic
agtggcggcctacggggcttcaaggagtcccccgttggcagctgcggcttcgtacctaatgggattgggcgtggg

SEQ ID NO: 95509 - DNA, 75 bp, Artificial Sequence
  Synthetic
tgtggcggcctacggggcttcaaggagtcccccgttggcagctgcggcttcatacctaatgggattgggcgtagg

SEQ ID NO: 95510 - DNA, 75 bp, Artificial Sequence
  Synthetic
tgtggcggcctacggggcttcaaggagtcccccgttggcagctgcggcttcatacctaatgggattgggcgttgg

SEQ ID NO: 95511 - DNA, 75 bp, Artificial Sequence
  Synthetic
tgtggcggcctacggggcttcaaggagtcccccgttggcagctgcggcttcatacctaatgggattgggcgtcgg

SEQ ID NO: 95512 - DNA, 75 bp, Artificial Sequence
  Synthetic
tgtggcggcctacggggcttcaaggagtcccccgttggcagctgcggcttcatacctaatgggattgggcgtggg

SEQ ID NO: 95513 - DNA, 75 bp, Artificial Sequence
  Synthetic
tgtggcggcctacggggcttcaaggagtcccccgttggcagctgcggcttcttacctaatgggattgggcgtagg

SEQ ID NO: 95514 - DNA, 75 bp, Artificial Sequence
  Synthetic
tgtggcggcctacggggcttcaaggagtcccccgttggcagctgcggcttcttacctaatgggattgggcgttgg

SEQ ID NO: 95515 - DNA, 75 bp, Artificial Sequence
  Synthetic
tgtggcggcctacggggcttcaaggagtcccccgttggcagctgcggcttcttacctaatgggattgggcgtcgg

SEQ ID NO: 95516 - DNA, 75 bp, Artificial Sequence
  Synthetic
tgtggcggcctacggggcttcaaggagtcccccgttggcagctgcggcttcttacctaatgggattgggcgtggg

SEQ ID NO: 95517 - DNA, 75 bp, Artificial Sequence
  Synthetic
tgtggcggcctacggggcttcaaggagtcccccgttggcagctgcggcttcctacctaatgggattgggcgtagg

SEQ ID NO: 95518 - DNA, 75 bp, Artificial Sequence
  Synthetic
tgtggcggcctacggggcttcaaggagtcccccgttggcagctgcggcttcctacctaatgggattgggcgttgg

SEQ ID NO: 95519 - DNA, 75 bp, Artificial Sequence
  Synthetic
tgtggcggcctacggggcttcaaggagtcccccgttggcagctgcggcttcctacctaatgggattgggcgtcgg

SEQ ID NO: 95520 - DNA, 75 bp, Artificial Sequence
  Synthetic
tgtggcggcctacggggcttcaaggagtcccccgttggcagctgcggcttcctacctaatgggattgggcgtggg

SEQ ID NO: 95521 - DNA, 75 bp, Artificial Sequence
  Synthetic
tgtggcggcctacggggcttcaaggagtcccccgttggcagctgcggcttcgtacctaatgggattgggcgtagg

SEQ ID NO: 95522 - DNA, 75 bp, Artificial Sequence
  Synthetic
tgtggcggcctacggggcttcaaggagtcccccgttggcagctgcggcttcgtacctaatgggattgggcgttgg

SEQ ID NO: 95523 - DNA, 75 bp, Artificial Sequence
  Synthetic
tgtggcggcctacggggcttcaaggagtcccccgttggcagctgcggcttcgtacctaatgggattgggcgtcgg

SEQ ID NO: 95524 - DNA, 75 bp, Artificial Sequence
  Synthetic
tgtggcggcctacggggcttcaaggagtcccccgttggcagctgcggcttcgtacctaatgggattgggcgtggg

SEQ ID NO: 95525 - DNA, 75 bp, Artificial Sequence
  Synthetic
cgtggcggcctacggggcttcaaggagtcccccgttggcagctgcggcttcatacctaatgggattgggcgtagg

SEQ ID NO: 95526 - DNA, 75 bp, Artificial Sequence
  Synthetic
cgtggcggcctacggggcttcaaggagtcccccgttggcagctgcggcttcatacctaatgggattgggcgttgg

SEQ ID NO: 95527 - DNA, 75 bp, Artificial Sequence
  Synthetic
cgtggcggcctacggggcttcaaggagtcccccgttggcagctgcggcttcatacctaatgggattgggcgtcgg

SEQ ID NO: 95528 - DNA, 75 bp, Artificial Sequence
  Synthetic
cgtggcggcctacggggcttcaaggagtcccccgttggcagctgcggcttcatacctaatgggattgggcgtggg

SEQ ID NO: 95529 - DNA, 75 bp, Artificial Sequence
  Synthetic
cgtggcggcctacggggcttcaaggagtcccccgttggcagctgcggcttcttacctaatgggattgggcgtagg

SEQ ID NO: 95530 - DNA, 75 bp, Artificial Sequence
  Synthetic
cgtggcggcctacggggcttcaaggagtcccccgttggcagctgcggcttcttacctaatgggattgggcgttgg

SEQ ID NO: 95531 - DNA, 75 bp, Artificial Sequence
  Synthetic
cgtggcggcctacggggcttcaaggagtcccccgttggcagctgcggcttcttacctaatgggattgggcgtcgg

SEQ ID NO: 95532 - DNA, 75 bp, Artificial Sequence
  Synthetic
cgtggcggcctacggggcttcaaggagtcccccgttggcagctgcggcttcttacctaatgggattgggcgtggg

SEQ ID NO: 95533 - DNA, 75 bp, Artificial Sequence
  Synthetic
cgtggcggcctacggggcttcaaggagtcccccgttggcagctgcggcttcctacctaatgggattgggcgtagg

SEQ ID NO: 95534 - DNA, 75 bp, Artificial Sequence
  Synthetic
cgtggcggcctacggggcttcaaggagtcccccgttggcagctgcggcttcctacctaatgggattgggcgttgg

SEQ ID NO: 95535 - DNA, 75 bp, Artificial Sequence
  Synthetic
cgtggcggcctacggggcttcaaggagtcccccgttggcagctgcggcttcctacctaatgggattgggcgtcgg

SEQ ID NO: 95536 - DNA, 75 bp, Artificial Sequence
  Synthetic
cgtggcggcctacggggcttcaaggagtcccccgttggcagctgcggcttcctacctaatgggattgggcgtggg

SEQ ID NO: 95537 - DNA, 75 bp, Artificial Sequence
  Synthetic
cgtggcggcctacggggcttcaaggagtcccccgttggcagctgcggcttcgtacctaatgggattgggcgtagg

SEQ ID NO: 95538 - DNA, 75 bp, Artificial Sequence
  Synthetic
cgtggcggcctacggggcttcaaggagtcccccgttggcagctgcggcttcgtacctaatgggattgggcgttgg

SEQ ID NO: 95539 - DNA, 75 bp, Artificial Sequence
  Synthetic
cgtggcggcctacggggcttcaaggagtcccccgttggcagctgcggcttcgtacctaatgggattgggcgtcgg

SEQ ID NO: 95540 - DNA, 75 bp, Artificial Sequence
  Synthetic
cgtggcggcctacggggcttcaaggagtcccccgttggcagctgcggcttcgtacctaatgggattgggcgtggg

SEQ ID NO: 95541 - DNA, 75 bp, Artificial Sequence
  Synthetic
ggtggcggcctacggggcttcaaggagtcccccgttggcagctgcggcttcatacctaatgggattgggcgtagg

SEQ ID NO: 95542 - DNA, 75 bp, Artificial Sequence
  Synthetic
ggtggcggcctacggggcttcaaggagtcccccgttggcagctgcggcttcatacctaatgggattgggcgttgg

SEQ ID NO: 95543 - DNA, 75 bp, Artificial Sequence
  Synthetic
ggtggcggcctacggggcttcaaggagtcccccgttggcagctgcggcttcatacctaatgggattgggcgtcgg

SEQ ID NO: 95544 - DNA, 75 bp, Artificial Sequence
  Synthetic
ggtggcggcctacggggcttcaaggagtcccccgttggcagctgcggcttcatacctaatgggattgggcgtggg

SEQ ID NO: 95545 - DNA, 75 bp, Artificial Sequence
  Synthetic
ggtggcggcctacggggcttcaaggagtcccccgttggcagctgcggcttcttacctaatgggattgggcgtagg

SEQ ID NO: 95546 - DNA, 75 bp, Artificial Sequence
  Synthetic
ggtggcggcctacggggcttcaaggagtcccccgttggcagctgcggcttcttacctaatgggattgggcgttgg

SEQ ID NO: 95547 - DNA, 75 bp, Artificial Sequence
  Synthetic
ggtggcggcctacggggcttcaaggagtcccccgttggcagctgcggcttcttacctaatgggattgggcgtcgg

SEQ ID NO: 95548 - DNA, 75 bp, Artificial Sequence
  Synthetic
ggtggcggcctacggggcttcaaggagtcccccgttggcagctgcggcttcttacctaatgggattgggcgtggg

SEQ ID NO: 95549 - DNA, 75 bp, Artificial Sequence
  Synthetic
ggtggcggcctacggggcttcaaggagtcccccgttggcagctgcggcttcctacctaatgggattgggcgtagg

SEQ ID NO: 95550 - DNA, 75 bp, Artificial Sequence
  Synthetic
ggtggcggcctacggggcttcaaggagtcccccgttggcagctgcggcttcctacctaatgggattgggcgttgg

SEQ ID NO: 95551 - DNA, 75 bp, Artificial Sequence
  Synthetic
ggtggcggcctacggggcttcaaggagtcccccgttggcagctgcggcttcctacctaatgggattgggcgtcgg

SEQ ID NO: 95552 - DNA, 75 bp, Artificial Sequence
  Synthetic
ggtggcggcctacggggcttcaaggagtcccccgttggcagctgcggcttcctacctaatgggattgggcgtggg

SEQ ID NO: 95553 - DNA, 75 bp, Artificial Sequence
  Synthetic
ggtggcggcctacggggcttcaaggagtcccccgttggcagctgcggcttcgtacctaatgggattgggcgtagg

SEQ ID NO: 95554 - DNA, 75 bp, Artificial Sequence
  Synthetic
ggtggcggcctacggggcttcaaggagtcccccgttggcagctgcggcttcgtacctaatgggattgggcgttgg

SEQ ID NO: 95555 - DNA, 75 bp, Artificial Sequence
  Synthetic
ggtggcggcctacggggcttcaaggagtcccccgttggcagctgcggcttcgtacctaatgggattgggcgtcgg

SEQ ID NO: 95556 - DNA, 75 bp, Artificial Sequence
  Synthetic
ggtggcggcctacggggcttcaaggagtcccccgttggcagctgcggcttcgtacctaatgggattgggcgtggg

SEQ ID NO: 95557 - DNA, 75 bp, Artificial Sequence
  Synthetic
gaactgccctgggcacacccgtcgtgggattaaccatggcgggtgcgttcatggggggtgccagcgtttccccct

SEQ ID NO: 95558 - DNA, 75 bp, Artificial Sequence
  Synthetic
gtactgccctgggcacacccgtcgtgggattaaccatggcgggtgcgttcatggggggtgccagcgtttccccct

SEQ ID NO: 95559 - DNA, 75 bp, Artificial Sequence
  Synthetic
gcactgccctgggcacacccgtcgtgggattaaccatggcgggtgcgttcatggggggtgccagcgtttccccct

SEQ ID NO: 95560 - DNA, 75 bp, Artificial Sequence
  Synthetic
ggactgccctgggcacacccgtcgtgggattaaccatggcgggtgcgttcatggggggtgccagcgtttccccct

SEQ ID NO: 95561 - DNA, 75 bp, Artificial Sequence
  Synthetic
gggattaaccatggcgggtgcgttcatggggggtgccagcgtttccccctccttggtcaccatccttctgggggc

SEQ ID NO: 95562 - DNA, 75 bp, Artificial Sequence
  Synthetic
ttgccacagcgtcatagctgcggcggtggcagcgtacggggcttctcgaagccccccgctggcggcggctgcttc

SEQ ID NO: 95563 - DNA, 75 bp, Artificial Sequence
  Synthetic
agatctgtggtatgctatcccagtgctgaccagtccgggggcgggccttgaggggatcgcccttaggttggtctt

SEQ ID NO: 95564 - DNA, 75 bp, Artificial Sequence
  Synthetic
agatctgtggtatgctatcccagtgctgaccagtccgggggcgggccttgaggggatcgccctttggttggtctt

SEQ ID NO: 95565 - DNA, 75 bp, Artificial Sequence
  Synthetic
agatctgtggtatgctatcccagtgctgaccagtccgggggcgggccttgaggggatcgcccttcggttggtctt

SEQ ID NO: 95566 - DNA, 75 bp, Artificial Sequence
  Synthetic
agatctgtggtatgctatcccagtgctgaccagtccgggggcgggccttgaggggatcgcccttgggttggtctt

SEQ ID NO: 95567 - DNA, 75 bp, Artificial Sequence
  Synthetic
agatctgtggtatgctatcccagtgctgaccagtccgggggcgggccttgtggggatcgcccttaggttggtctt

SEQ ID NO: 95568 - DNA, 75 bp, Artificial Sequence
  Synthetic
agatctgtggtatgctatcccagtgctgaccagtccgggggcgggccttgtggggatcgccctttggttggtctt

SEQ ID NO: 95569 - DNA, 75 bp, Artificial Sequence
  Synthetic
agatctgtggtatgctatcccagtgctgaccagtccgggggcgggccttgtggggatcgcccttcggttggtctt

SEQ ID NO: 95570 - DNA, 75 bp, Artificial Sequence
  Synthetic
agatctgtggtatgctatcccagtgctgaccagtccgggggcgggccttgtggggatcgcccttgggttggtctt

SEQ ID NO: 95571 - DNA, 75 bp, Artificial Sequence
  Synthetic
agatctgtggtatgctatcccagtgctgaccagtccgggggcgggccttgcggggatcgcccttaggttggtctt

SEQ ID NO: 95572 - DNA, 75 bp, Artificial Sequence
  Synthetic
agatctgtggtatgctatcccagtgctgaccagtccgggggcgggccttgcggggatcgccctttggttggtctt

SEQ ID NO: 95573 - DNA, 75 bp, Artificial Sequence
  Synthetic
agatctgtggtatgctatcccagtgctgaccagtccgggggcgggccttgcggggatcgcccttcggttggtctt

SEQ ID NO: 95574 - DNA, 75 bp, Artificial Sequence
  Synthetic
agatctgtggtatgctatcccagtgctgaccagtccgggggcgggccttgcggggatcgcccttgggttggtctt

SEQ ID NO: 95575 - DNA, 75 bp, Artificial Sequence
  Synthetic
agatctgtggtatgctatcccagtgctgaccagtccgggggcgggccttggggggatcgcccttaggttggtctt

SEQ ID NO: 95576 - DNA, 75 bp, Artificial Sequence
  Synthetic
agatctgtggtatgctatcccagtgctgaccagtccgggggcgggccttggggggatcgccctttggttggtctt

SEQ ID NO: 95577 - DNA, 75 bp, Artificial Sequence
  Synthetic
agatctgtggtatgctatcccagtgctgaccagtccgggggcgggccttggggggatcgcccttcggttggtctt

SEQ ID NO: 95578 - DNA, 75 bp, Artificial Sequence
  Synthetic
agatctgtggtatgctatcccagtgctgaccagtccgggggcgggccttggggggatcgcccttgggttggtctt

SEQ ID NO: 95579 - DNA, 75 bp, Artificial Sequence
  Synthetic
ccgctctcctgttgggggctgctggtactgccctgggcaccccggtagtgggtctaaccatggccggggcgttca

SEQ ID NO: 95580 - DNA, 75 bp, Artificial Sequence
  Synthetic
caacattgccaagatcgtcgtgcattccagacagatactttcagcaggctgactactgagacaaggtctcggccg

SEQ ID NO: 95581 - DNA, 75 bp, Artificial Sequence
  Synthetic
caacattgccaagatcgtcgtgcattccagacagatactttcagcaggctgactactgtgacaaggtctcggccg

SEQ ID NO: 95582 - DNA, 75 bp, Artificial Sequence
  Synthetic
caacattgccaagatcgtcgtgcattccagacagatactttcagcaggctgactactgcgacaaggtctcggccg

SEQ ID NO: 95583 - DNA, 75 bp, Artificial Sequence
  Synthetic
caacattgccaagatcgtcgtgcattccagacagatactttcagcaggctgactactgggacaaggtctcggccg

SEQ ID NO: 95584 - DNA, 75 bp, Artificial Sequence
  Synthetic
caacattgccaagatcgtcgtgcattccagacagttactttcagcaggctgactactgagacaaggtctcggccg

SEQ ID NO: 95585 - DNA, 75 bp, Artificial Sequence
  Synthetic
caacattgccaagatcgtcgtgcattccagacagttactttcagcaggctgactactgtgacaaggtctcggccg

SEQ ID NO: 95586 - DNA, 75 bp, Artificial Sequence
  Synthetic
caacattgccaagatcgtcgtgcattccagacagttactttcagcaggctgactactgcgacaaggtctcggccg

SEQ ID NO: 95587 - DNA, 75 bp, Artificial Sequence
  Synthetic
caacattgccaagatcgtcgtgcattccagacagttactttcagcaggctgactactgggacaaggtctcggccg

SEQ ID NO: 95588 - DNA, 75 bp, Artificial Sequence
  Synthetic
caacattgccaagatcgtcgtgcattccagacagctactttcagcaggctgactactgagacaaggtctcggccg

SEQ ID NO: 95589 - DNA, 75 bp, Artificial Sequence
  Synthetic
caacattgccaagatcgtcgtgcattccagacagctactttcagcaggctgactactgtgacaaggtctcggccg

SEQ ID NO: 95590 - DNA, 75 bp, Artificial Sequence
  Synthetic
caacattgccaagatcgtcgtgcattccagacagctactttcagcaggctgactactgcgacaaggtctcggccg

SEQ ID NO: 95591 - DNA, 75 bp, Artificial Sequence
  Synthetic
caacattgccaagatcgtcgtgcattccagacagctactttcagcaggctgactactgggacaaggtctcggccg

SEQ ID NO: 95592 - DNA, 75 bp, Artificial Sequence
  Synthetic
caacattgccaagatcgtcgtgcattccagacaggtactttcagcaggctgactactgagacaaggtctcggccg

SEQ ID NO: 95593 - DNA, 75 bp, Artificial Sequence
  Synthetic
caacattgccaagatcgtcgtgcattccagacaggtactttcagcaggctgactactgtgacaaggtctcggccg

SEQ ID NO: 95594 - DNA, 75 bp, Artificial Sequence
  Synthetic
caacattgccaagatcgtcgtgcattccagacaggtactttcagcaggctgactactgcgacaaggtctcggccg

SEQ ID NO: 95595 - DNA, 75 bp, Artificial Sequence
  Synthetic
caacattgccaagatcgtcgtgcattccagacaggtactttcagcaggctgactactgggacaaggtctcggccg

SEQ ID NO: 95596 - DNA, 75 bp, Artificial Sequence
  Synthetic
caacattgcctagatcgtcgtgcattccagacagatactttcagcaggctgactactgagacaaggtctcggccg

SEQ ID NO: 95597 - DNA, 75 bp, Artificial Sequence
  Synthetic
caacattgcctagatcgtcgtgcattccagacagatactttcagcaggctgactactgtgacaaggtctcggccg

SEQ ID NO: 95598 - DNA, 75 bp, Artificial Sequence
  Synthetic
caacattgcctagatcgtcgtgcattccagacagatactttcagcaggctgactactgcgacaaggtctcggccg

SEQ ID NO: 95599 - DNA, 75 bp, Artificial Sequence
  Synthetic
caacattgcctagatcgtcgtgcattccagacagatactttcagcaggctgactactgggacaaggtctcggccg

SEQ ID NO: 95600 - DNA, 75 bp, Artificial Sequence
  Synthetic
caacattgcctagatcgtcgtgcattccagacagttactttcagcaggctgactactgagacaaggtctcggccg

SEQ ID NO: 95601 - DNA, 75 bp, Artificial Sequence
  Synthetic
caacattgcctagatcgtcgtgcattccagacagttactttcagcaggctgactactgtgacaaggtctcggccg

SEQ ID NO: 95602 - DNA, 75 bp, Artificial Sequence
  Synthetic
caacattgcctagatcgtcgtgcattccagacagttactttcagcaggctgactactgcgacaaggtctcggccg

SEQ ID NO: 95603 - DNA, 75 bp, Artificial Sequence
  Synthetic
caacattgcctagatcgtcgtgcattccagacagttactttcagcaggctgactactgggacaaggtctcggccg

SEQ ID NO: 95604 - DNA, 75 bp, Artificial Sequence
  Synthetic
caacattgcctagatcgtcgtgcattccagacagctactttcagcaggctgactactgagacaaggtctcggccg

SEQ ID NO: 95605 - DNA, 75 bp, Artificial Sequence
  Synthetic
caacattgcctagatcgtcgtgcattccagacagctactttcagcaggctgactactgtgacaaggtctcggccg

SEQ ID NO: 95606 - DNA, 75 bp, Artificial Sequence
  Synthetic
caacattgcctagatcgtcgtgcattccagacagctactttcagcaggctgactactgcgacaaggtctcggccg

SEQ ID NO: 95607 - DNA, 75 bp, Artificial Sequence
  Synthetic
caacattgcctagatcgtcgtgcattccagacagctactttcagcaggctgactactgggacaaggtctcggccg

SEQ ID NO: 95608 - DNA, 75 bp, Artificial Sequence
  Synthetic
caacattgcctagatcgtcgtgcattccagacaggtactttcagcaggctgactactgagacaaggtctcggccg

SEQ ID NO: 95609 - DNA, 75 bp, Artificial Sequence
  Synthetic
caacattgcctagatcgtcgtgcattccagacaggtactttcagcaggctgactactgtgacaaggtctcggccg

SEQ ID NO: 95610 - DNA, 75 bp, Artificial Sequence
  Synthetic
caacattgcctagatcgtcgtgcattccagacaggtactttcagcaggctgactactgcgacaaggtctcggccg

SEQ ID NO: 95611 - DNA, 75 bp, Artificial Sequence
  Synthetic
caacattgcctagatcgtcgtgcattccagacaggtactttcagcaggctgactactgggacaaggtctcggccg

SEQ ID NO: 95612 - DNA, 75 bp, Artificial Sequence
  Synthetic
caacattgcccagatcgtcgtgcattccagacagatactttcagcaggctgactactgagacaaggtctcggccg

SEQ ID NO: 95613 - DNA, 75 bp, Artificial Sequence
  Synthetic
caacattgcccagatcgtcgtgcattccagacagatactttcagcaggctgactactgtgacaaggtctcggccg

SEQ ID NO: 95614 - DNA, 75 bp, Artificial Sequence
  Synthetic
caacattgcccagatcgtcgtgcattccagacagatactttcagcaggctgactactgcgacaaggtctcggccg

SEQ ID NO: 95615 - DNA, 75 bp, Artificial Sequence
  Synthetic
caacattgcccagatcgtcgtgcattccagacagatactttcagcaggctgactactgggacaaggtctcggccg

SEQ ID NO: 95616 - DNA, 75 bp, Artificial Sequence
  Synthetic
caacattgcccagatcgtcgtgcattccagacagttactttcagcaggctgactactgagacaaggtctcggccg

SEQ ID NO: 95617 - DNA, 75 bp, Artificial Sequence
  Synthetic
caacattgcccagatcgtcgtgcattccagacagttactttcagcaggctgactactgtgacaaggtctcggccg

SEQ ID NO: 95618 - DNA, 75 bp, Artificial Sequence
  Synthetic
caacattgcccagatcgtcgtgcattccagacagttactttcagcaggctgactactgcgacaaggtctcggccg

SEQ ID NO: 95619 - DNA, 75 bp, Artificial Sequence
  Synthetic
caacattgcccagatcgtcgtgcattccagacagttactttcagcaggctgactactgggacaaggtctcggccg

SEQ ID NO: 95620 - DNA, 75 bp, Artificial Sequence
  Synthetic
caacattgcccagatcgtcgtgcattccagacagctactttcagcaggctgactactgagacaaggtctcggccg

SEQ ID NO: 95621 - DNA, 75 bp, Artificial Sequence
  Synthetic
caacattgcccagatcgtcgtgcattccagacagctactttcagcaggctgactactgtgacaaggtctcggccg

SEQ ID NO: 95622 - DNA, 75 bp, Artificial Sequence
  Synthetic
caacattgcccagatcgtcgtgcattccagacagctactttcagcaggctgactactgcgacaaggtctcggccg

SEQ ID NO: 95623 - DNA, 75 bp, Artificial Sequence
  Synthetic
caacattgcccagatcgtcgtgcattccagacagctactttcagcaggctgactactgggacaaggtctcggccg

SEQ ID NO: 95624 - DNA, 75 bp, Artificial Sequence
  Synthetic
caacattgcccagatcgtcgtgcattccagacaggtactttcagcaggctgactactgagacaaggtctcggccg

SEQ ID NO: 95625 - DNA, 75 bp, Artificial Sequence
  Synthetic
caacattgcccagatcgtcgtgcattccagacaggtactttcagcaggctgactactgtgacaaggtctcggccg

SEQ ID NO: 95626 - DNA, 75 bp, Artificial Sequence
  Synthetic
caacattgcccagatcgtcgtgcattccagacaggtactttcagcaggctgactactgcgacaaggtctcggccg

SEQ ID NO: 95627 - DNA, 75 bp, Artificial Sequence
  Synthetic
caacattgcccagatcgtcgtgcattccagacaggtactttcagcaggctgactactgggacaaggtctcggccg

SEQ ID NO: 95628 - DNA, 75 bp, Artificial Sequence
  Synthetic
caacattgccgagatcgtcgtgcattccagacagatactttcagcaggctgactactgagacaaggtctcggccg

SEQ ID NO: 95629 - DNA, 75 bp, Artificial Sequence
  Synthetic
caacattgccgagatcgtcgtgcattccagacagatactttcagcaggctgactactgtgacaaggtctcggccg

SEQ ID NO: 95630 - DNA, 75 bp, Artificial Sequence
  Synthetic
caacattgccgagatcgtcgtgcattccagacagatactttcagcaggctgactactgcgacaaggtctcggccg

SEQ ID NO: 95631 - DNA, 75 bp, Artificial Sequence
  Synthetic
caacattgccgagatcgtcgtgcattccagacagatactttcagcaggctgactactgggacaaggtctcggccg

SEQ ID NO: 95632 - DNA, 75 bp, Artificial Sequence
  Synthetic
caacattgccgagatcgtcgtgcattccagacagttactttcagcaggctgactactgagacaaggtctcggccg

SEQ ID NO: 95633 - DNA, 75 bp, Artificial Sequence
  Synthetic
caacattgccgagatcgtcgtgcattccagacagttactttcagcaggctgactactgtgacaaggtctcggccg

SEQ ID NO: 95634 - DNA, 75 bp, Artificial Sequence
  Synthetic
caacattgccgagatcgtcgtgcattccagacagttactttcagcaggctgactactgcgacaaggtctcggccg

SEQ ID NO: 95635 - DNA, 75 bp, Artificial Sequence
  Synthetic
caacattgccgagatcgtcgtgcattccagacagttactttcagcaggctgactactgggacaaggtctcggccg

SEQ ID NO: 95636 - DNA, 75 bp, Artificial Sequence
  Synthetic
caacattgccgagatcgtcgtgcattccagacagctactttcagcaggctgactactgagacaaggtctcggccg

SEQ ID NO: 95637 - DNA, 75 bp, Artificial Sequence
  Synthetic
caacattgccgagatcgtcgtgcattccagacagctactttcagcaggctgactactgtgacaaggtctcggccg

SEQ ID NO: 95638 - DNA, 75 bp, Artificial Sequence
  Synthetic
caacattgccgagatcgtcgtgcattccagacagctactttcagcaggctgactactgcgacaaggtctcggccg

SEQ ID NO: 95639 - DNA, 75 bp, Artificial Sequence
  Synthetic
caacattgccgagatcgtcgtgcattccagacagctactttcagcaggctgactactgggacaaggtctcggccg

SEQ ID NO: 95640 - DNA, 75 bp, Artificial Sequence
  Synthetic
caacattgccgagatcgtcgtgcattccagacaggtactttcagcaggctgactactgagacaaggtctcggccg

SEQ ID NO: 95641 - DNA, 75 bp, Artificial Sequence
  Synthetic
caacattgccgagatcgtcgtgcattccagacaggtactttcagcaggctgactactgtgacaaggtctcggccg

SEQ ID NO: 95642 - DNA, 75 bp, Artificial Sequence
  Synthetic
caacattgccgagatcgtcgtgcattccagacaggtactttcagcaggctgactactgcgacaaggtctcggccg

SEQ ID NO: 95643 - DNA, 75 bp, Artificial Sequence
  Synthetic
caacattgccgagatcgtcgtgcattccagacaggtactttcagcaggctgactactgggacaaggtctcggccg

SEQ ID NO: 95644 - DNA, 75 bp, Artificial Sequence
  Synthetic
tccagacagatactttcagcaggctgactactgagacaaggtctcggccgtgctccgacgcctgagcctcacccg

SEQ ID NO: 95645 - DNA, 75 bp, Artificial Sequence
  Synthetic
tccagacagatactttcagcaggctgactactgtgacaaggtctcggccgtgctccgacgcctgagcctcacccg

SEQ ID NO: 95646 - DNA, 75 bp, Artificial Sequence
  Synthetic
tccagacagatactttcagcaggctgactactgcgacaaggtctcggccgtgctccgacgcctgagcctcacccg

SEQ ID NO: 95647 - DNA, 75 bp, Artificial Sequence
  Synthetic
tccagacagatactttcagcaggctgactactgggacaaggtctcggccgtgctccgacgcctgagcctcacccg

SEQ ID NO: 95648 - DNA, 75 bp, Artificial Sequence
  Synthetic
tccagacagttactttcagcaggctgactactgagacaaggtctcggccgtgctccgacgcctgagcctcacccg

SEQ ID NO: 95649 - DNA, 75 bp, Artificial Sequence
  Synthetic
tccagacagttactttcagcaggctgactactgtgacaaggtctcggccgtgctccgacgcctgagcctcacccg

SEQ ID NO: 95650 - DNA, 75 bp, Artificial Sequence
  Synthetic
tccagacagttactttcagcaggctgactactgcgacaaggtctcggccgtgctccgacgcctgagcctcacccg

SEQ ID NO: 95651 - DNA, 75 bp, Artificial Sequence
  Synthetic
tccagacagttactttcagcaggctgactactgggacaaggtctcggccgtgctccgacgcctgagcctcacccg

SEQ ID NO: 95652 - DNA, 75 bp, Artificial Sequence
  Synthetic
tccagacagctactttcagcaggctgactactgagacaaggtctcggccgtgctccgacgcctgagcctcacccg

SEQ ID NO: 95653 - DNA, 75 bp, Artificial Sequence
  Synthetic
tccagacagctactttcagcaggctgactactgtgacaaggtctcggccgtgctccgacgcctgagcctcacccg

SEQ ID NO: 95654 - DNA, 75 bp, Artificial Sequence
  Synthetic
tccagacagctactttcagcaggctgactactgcgacaaggtctcggccgtgctccgacgcctgagcctcacccg

SEQ ID NO: 95655 - DNA, 75 bp, Artificial Sequence
  Synthetic
tccagacagctactttcagcaggctgactactgggacaaggtctcggccgtgctccgacgcctgagcctcacccg

SEQ ID NO: 95656 - DNA, 75 bp, Artificial Sequence
  Synthetic
tccagacaggtactttcagcaggctgactactgagacaaggtctcggccgtgctccgacgcctgagcctcacccg

SEQ ID NO: 95657 - DNA, 75 bp, Artificial Sequence
  Synthetic
tccagacaggtactttcagcaggctgactactgtgacaaggtctcggccgtgctccgacgcctgagcctcacccg

SEQ ID NO: 95658 - DNA, 75 bp, Artificial Sequence
  Synthetic
tccagacaggtactttcagcaggctgactactgcgacaaggtctcggccgtgctccgacgcctgagcctcacccg

SEQ ID NO: 95659 - DNA, 75 bp, Artificial Sequence
  Synthetic
tccagacaggtactttcagcaggctgactactgggacaaggtctcggccgtgctccgacgcctgagcctcacccg

SEQ ID NO: 95660 - DNA, 75 bp, Artificial Sequence
  Synthetic
catgtcagggaaactttcaactgaagacctgtggtatgccatcccagtgctcactagcccaggggcgggcctagc

SEQ ID NO: 95661 - DNA, 75 bp, Artificial Sequence
  Synthetic
tggggtacgtatgggacttgtgggagtagatcatgcgccaggtgcgtatggtgatggccaggctccgggccctct

SEQ ID NO: 95662 - DNA, 75 bp, Artificial Sequence
  Synthetic
tggggtacgtatgggacttgtgggagttgatcatgcgccaggtgcgtatggtgatggccaggctccgggccctct

SEQ ID NO: 95663 - DNA, 75 bp, Artificial Sequence
  Synthetic
tggggtacgtatgggacttgtgggagtcgatcatgcgccaggtgcgtatggtgatggccaggctccgggccctct

SEQ ID NO: 95664 - DNA, 75 bp, Artificial Sequence
  Synthetic
tggggtacgtatgggacttgtgggagtggatcatgcgccaggtgcgtatggtgatggccaggctccgggccctct

SEQ ID NO: 95665 - DNA, 75 bp, Artificial Sequence
  Synthetic
tcactagcccaggggcgggcctagcaggggtcgctctagggttggtgttgtactcagcaaacaactcgggtacta

SEQ ID NO: 95666 - DNA, 75 bp, Artificial Sequence
  Synthetic
gtagatcatgcgccaggtgcgtatggtgatggccaggctccgggccctctgccccgtagtgtcgctaccattgtg

SEQ ID NO: 95667 - DNA, 75 bp, Artificial Sequence
  Synthetic
gtagatcatgcgccaggtgcgtatggtgatggccaggctccgggccctctgccccgttgtgtcgctaccattgtg

SEQ ID NO: 95668 - DNA, 75 bp, Artificial Sequence
  Synthetic
gtagatcatgcgccaggtgcgtatggtgatggccaggctccgggccctctgccccgtcgtgtcgctaccattgtg

SEQ ID NO: 95669 - DNA, 75 bp, Artificial Sequence
  Synthetic
gtagatcatgcgccaggtgcgtatggtgatggccaggctccgggccctctgccccgtggtgtcgctaccattgtg

SEQ ID NO: 95670 - DNA, 75 bp, Artificial Sequence
  Synthetic
gttgatcatgcgccaggtgcgtatggtgatggccaggctccgggccctctgccccgtagtgtcgctaccattgtg

SEQ ID NO: 95671 - DNA, 75 bp, Artificial Sequence
  Synthetic
gttgatcatgcgccaggtgcgtatggtgatggccaggctccgggccctctgccccgttgtgtcgctaccattgtg

SEQ ID NO: 95672 - DNA, 75 bp, Artificial Sequence
  Synthetic
gttgatcatgcgccaggtgcgtatggtgatggccaggctccgggccctctgccccgtcgtgtcgctaccattgtg

SEQ ID NO: 95673 - DNA, 75 bp, Artificial Sequence
  Synthetic
gttgatcatgcgccaggtgcgtatggtgatggccaggctccgggccctctgccccgtggtgtcgctaccattgtg

SEQ ID NO: 95674 - DNA, 75 bp, Artificial Sequence
  Synthetic
gtcgatcatgcgccaggtgcgtatggtgatggccaggctccgggccctctgccccgtagtgtcgctaccattgtg

SEQ ID NO: 95675 - DNA, 75 bp, Artificial Sequence
  Synthetic
gtcgatcatgcgccaggtgcgtatggtgatggccaggctccgggccctctgccccgttgtgtcgctaccattgtg

SEQ ID NO: 95676 - DNA, 75 bp, Artificial Sequence
  Synthetic
gtcgatcatgcgccaggtgcgtatggtgatggccaggctccgggccctctgccccgtcgtgtcgctaccattgtg

SEQ ID NO: 95677 - DNA, 75 bp, Artificial Sequence
  Synthetic
gtcgatcatgcgccaggtgcgtatggtgatggccaggctccgggccctctgccccgtggtgtcgctaccattgtg

SEQ ID NO: 95678 - DNA, 75 bp, Artificial Sequence
  Synthetic
gtggatcatgcgccaggtgcgtatggtgatggccaggctccgggccctctgccccgtagtgtcgctaccattgtg

SEQ ID NO: 95679 - DNA, 75 bp, Artificial Sequence
  Synthetic
gtggatcatgcgccaggtgcgtatggtgatggccaggctccgggccctctgccccgttgtgtcgctaccattgtg

SEQ ID NO: 95680 - DNA, 75 bp, Artificial Sequence
  Synthetic
gtggatcatgcgccaggtgcgtatggtgatggccaggctccgggccctctgccccgtcgtgtcgctaccattgtg

SEQ ID NO: 95681 - DNA, 75 bp, Artificial Sequence
  Synthetic
gtggatcatgcgccaggtgcgtatggtgatggccaggctccgggccctctgccccgtggtgtcgctaccattgtg

SEQ ID NO: 95682 - DNA, 75 bp, Artificial Sequence
  Synthetic
ccacttggttgaatcgtctgctgacaacgttgccaaggtcatcttgcattccagacagctatttccaacaggctg

SEQ ID NO: 95683 - DNA, 75 bp, Artificial Sequence
  Synthetic
agagtcgctgcctctgtggatgcgtgataacaggtgatgttctgaatgggcaactcaaagaaccagtttactcta

SEQ ID NO: 95684 - DNA, 75 bp, Artificial Sequence
  Synthetic
agagtcgctgcctctgtggttgcgtgataacaggtgatgttctgaatgggcaactcaaagaaccagtttactcta

SEQ ID NO: 95685 - DNA, 75 bp, Artificial Sequence
  Synthetic
agagtcgctgcctctgtggctgcgtgataacaggtgatgttctgaatgggcaactcaaagaaccagtttactcta

SEQ ID NO: 95686 - DNA, 75 bp, Artificial Sequence
  Synthetic
agagtcgctgcctctgtgggtgcgtgataacaggtgatgttctgaatgggcaactcaaagaaccagtttactcta

SEQ ID NO: 95687 - DNA, 75 bp, Artificial Sequence
  Synthetic
gataacaggtgatgttctgaatgggcaactcaaagaaccagtttactctacaaagctgtgccggcattactggat

SEQ ID NO: 95688 - DNA, 75 bp, Artificial Sequence
  Synthetic
tggcctcagacacccccaaggtagtacccttcgggacgtccggctgggcagaggtggtggtgaccccaacccacg

SEQ ID NO: 95689 - DNA, 75 bp, Artificial Sequence
  Synthetic
cccagtggtgtcactacctttgtggcactgcggggagggatggtctggtgaatggctcctggacggtcatgtgga

SEQ ID NO: 95690 - DNA, 75 bp, Artificial Sequence
  Synthetic
aactcaaagaaccagtttactctaccaagctgtgcaggcactactggatggggactgtgccggtcaacatgttgg

SEQ ID NO: 95691 - DNA, 75 bp, Artificial Sequence
  Synthetic
caagctgtgcaggcactactggatggggactgtgccggtcaacatgttgggttacggggaaacctcgcccctcct

SEQ ID NO: 95692 - DNA, 75 bp, Artificial Sequence
  Synthetic
aggtggtggtgacccccacccatgtggtgatccggcgcacttcctgttacaagttgcttcgccagcaaattcttt

SEQ ID NO: 95693 - DNA, 75 bp, Artificial Sequence
  Synthetic
agtgtcttcaacgtggctctttcagtattaaaagccttgtttccacagagcgaagctacaaggaagcttaccgtc

SEQ ID NO: 95694 - DNA, 75 bp, Artificial Sequence
  Synthetic
agtgtcttcaacgtggctctttcagtattaaaagccttgtttccacagagcgatgctacaaggaagcttaccgtc

SEQ ID NO: 95695 - DNA, 75 bp, Artificial Sequence
  Synthetic
agtgtcttcaacgtggctctttcagtattaaaagccttgtttccacagagcgacgctacaaggaagcttaccgtc

SEQ ID NO: 95696 - DNA, 75 bp, Artificial Sequence
  Synthetic
agtgtcttcaacgtggctctttcagtattaaaagccttgtttccacagagcgaggctacaaggaagcttaccgtc

SEQ ID NO: 95697 - DNA, 75 bp, Artificial Sequence
  Synthetic
agtgtcttcaacgtggctctttcagtattaatagccttgtttccacagagcgaagctacaaggaagcttaccgtc

SEQ ID NO: 95698 - DNA, 75 bp, Artificial Sequence
  Synthetic
agtgtcttcaacgtggctctttcagtattaatagccttgtttccacagagcgatgctacaaggaagcttaccgtc

SEQ ID NO: 95699 - DNA, 75 bp, Artificial Sequence
  Synthetic
agtgtcttcaacgtggctctttcagtattaatagccttgtttccacagagcgacgctacaaggaagcttaccgtc

SEQ ID NO: 95700 - DNA, 75 bp, Artificial Sequence
  Synthetic
agtgtcttcaacgtggctctttcagtattaatagccttgtttccacagagcgaggctacaaggaagcttaccgtc

SEQ ID NO: 95701 - DNA, 75 bp, Artificial Sequence
  Synthetic
agtgtcttcaacgtggctctttcagtattaacagccttgtttccacagagcgaagctacaaggaagcttaccgtc

SEQ ID NO: 95702 - DNA, 75 bp, Artificial Sequence
  Synthetic
agtgtcttcaacgtggctctttcagtattaacagccttgtttccacagagcgatgctacaaggaagcttaccgtc

SEQ ID NO: 95703 - DNA, 75 bp, Artificial Sequence
  Synthetic
agtgtcttcaacgtggctctttcagtattaacagccttgtttccacagagcgacgctacaaggaagcttaccgtc

SEQ ID NO: 95704 - DNA, 75 bp, Artificial Sequence
  Synthetic
agtgtcttcaacgtggctctttcagtattaacagccttgtttccacagagcgaggctacaaggaagcttaccgtc

SEQ ID NO: 95705 - DNA, 75 bp, Artificial Sequence
  Synthetic
agtgtcttcaacgtggctctttcagtattaagagccttgtttccacagagcgaagctacaaggaagcttaccgtc

SEQ ID NO: 95706 - DNA, 75 bp, Artificial Sequence
  Synthetic
agtgtcttcaacgtggctctttcagtattaagagccttgtttccacagagcgatgctacaaggaagcttaccgtc

SEQ ID NO: 95707 - DNA, 75 bp, Artificial Sequence
  Synthetic
agtgtcttcaacgtggctctttcagtattaagagccttgtttccacagagcgacgctacaaggaagcttaccgtc

SEQ ID NO: 95708 - DNA, 75 bp, Artificial Sequence
  Synthetic
agtgtcttcaacgtggctctttcagtattaagagccttgtttccacagagcgaggctacaaggaagcttaccgtc

SEQ ID NO: 95709 - DNA, 75 bp, Artificial Sequence
  Synthetic
agtgtcttcaacgtggctctttctgtattaaaagccttgtttccacagagcgaagctacaaggaagcttaccgtc

SEQ ID NO: 95710 - DNA, 75 bp, Artificial Sequence
  Synthetic
agtgtcttcaacgtggctctttctgtattaaaagccttgtttccacagagcgatgctacaaggaagcttaccgtc

SEQ ID NO: 95711 - DNA, 75 bp, Artificial Sequence
  Synthetic
agtgtcttcaacgtggctctttctgtattaaaagccttgtttccacagagcgacgctacaaggaagcttaccgtc

SEQ ID NO: 95712 - DNA, 75 bp, Artificial Sequence
  Synthetic
agtgtcttcaacgtggctctttctgtattaaaagccttgtttccacagagcgaggctacaaggaagcttaccgtc

SEQ ID NO: 95713 - DNA, 75 bp, Artificial Sequence
  Synthetic
agtgtcttcaacgtggctctttctgtattaatagccttgtttccacagagcgaagctacaaggaagcttaccgtc

SEQ ID NO: 95714 - DNA, 75 bp, Artificial Sequence
  Synthetic
agtgtcttcaacgtggctctttctgtattaatagccttgtttccacagagcgatgctacaaggaagcttaccgtc

SEQ ID NO: 95715 - DNA, 75 bp, Artificial Sequence
  Synthetic
agtgtcttcaacgtggctctttctgtattaatagccttgtttccacagagcgacgctacaaggaagcttaccgtc

SEQ ID NO: 95716 - DNA, 75 bp, Artificial Sequence
  Synthetic
agtgtcttcaacgtggctctttctgtattaatagccttgtttccacagagcgaggctacaaggaagcttaccgtc

SEQ ID NO: 95717 - DNA, 75 bp, Artificial Sequence
  Synthetic
agtgtcttcaacgtggctctttctgtattaacagccttgtttccacagagcgaagctacaaggaagcttaccgtc

SEQ ID NO: 95718 - DNA, 75 bp, Artificial Sequence
  Synthetic
agtgtcttcaacgtggctctttctgtattaacagccttgtttccacagagcgatgctacaaggaagcttaccgtc

SEQ ID NO: 95719 - DNA, 75 bp, Artificial Sequence
  Synthetic
agtgtcttcaacgtggctctttctgtattaacagccttgtttccacagagcgacgctacaaggaagcttaccgtc

SEQ ID NO: 95720 - DNA, 75 bp, Artificial Sequence
  Synthetic
agtgtcttcaacgtggctctttctgtattaacagccttgtttccacagagcgaggctacaaggaagcttaccgtc

SEQ ID NO: 95721 - DNA, 75 bp, Artificial Sequence
  Synthetic
agtgtcttcaacgtggctctttctgtattaagagccttgtttccacagagcgaagctacaaggaagcttaccgtc

SEQ ID NO: 95722 - DNA, 75 bp, Artificial Sequence
  Synthetic
agtgtcttcaacgtggctctttctgtattaagagccttgtttccacagagcgatgctacaaggaagcttaccgtc

SEQ ID NO: 95723 - DNA, 75 bp, Artificial Sequence
  Synthetic
agtgtcttcaacgtggctctttctgtattaagagccttgtttccacagagcgacgctacaaggaagcttaccgtc

SEQ ID NO: 95724 - DNA, 75 bp, Artificial Sequence
  Synthetic
agtgtcttcaacgtggctctttctgtattaagagccttgtttccacagagcgaggctacaaggaagcttaccgtc

SEQ ID NO: 95725 - DNA, 75 bp, Artificial Sequence
  Synthetic
agtgtcttcaacgtggctctttccgtattaaaagccttgtttccacagagcgaagctacaaggaagcttaccgtc

SEQ ID NO: 95726 - DNA, 75 bp, Artificial Sequence
  Synthetic
agtgtcttcaacgtggctctttccgtattaaaagccttgtttccacagagcgatgctacaaggaagcttaccgtc

SEQ ID NO: 95727 - DNA, 75 bp, Artificial Sequence
  Synthetic
agtgtcttcaacgtggctctttccgtattaaaagccttgtttccacagagcgacgctacaaggaagcttaccgtc

SEQ ID NO: 95728 - DNA, 75 bp, Artificial Sequence
  Synthetic
agtgtcttcaacgtggctctttccgtattaaaagccttgtttccacagagcgaggctacaaggaagcttaccgtc

SEQ ID NO: 95729 - DNA, 75 bp, Artificial Sequence
  Synthetic
agtgtcttcaacgtggctctttccgtattaatagccttgtttccacagagcgaagctacaaggaagcttaccgtc

SEQ ID NO: 95730 - DNA, 75 bp, Artificial Sequence
  Synthetic
agtgtcttcaacgtggctctttccgtattaatagccttgtttccacagagcgatgctacaaggaagcttaccgtc

SEQ ID NO: 95731 - DNA, 75 bp, Artificial Sequence
  Synthetic
agtgtcttcaacgtggctctttccgtattaatagccttgtttccacagagcgacgctacaaggaagcttaccgtc

SEQ ID NO: 95732 - DNA, 75 bp, Artificial Sequence
  Synthetic
agtgtcttcaacgtggctctttccgtattaatagccttgtttccacagagcgaggctacaaggaagcttaccgtc

SEQ ID NO: 95733 - DNA, 75 bp, Artificial Sequence
  Synthetic
agtgtcttcaacgtggctctttccgtattaacagccttgtttccacagagcgaagctacaaggaagcttaccgtc

SEQ ID NO: 95734 - DNA, 75 bp, Artificial Sequence
  Synthetic
agtgtcttcaacgtggctctttccgtattaacagccttgtttccacagagcgatgctacaaggaagcttaccgtc

SEQ ID NO: 95735 - DNA, 75 bp, Artificial Sequence
  Synthetic
agtgtcttcaacgtggctctttccgtattaacagccttgtttccacagagcgacgctacaaggaagcttaccgtc

SEQ ID NO: 95736 - DNA, 75 bp, Artificial Sequence
  Synthetic
agtgtcttcaacgtggctctttccgtattaacagccttgtttccacagagcgaggctacaaggaagcttaccgtc

SEQ ID NO: 95737 - DNA, 75 bp, Artificial Sequence
  Synthetic
agtgtcttcaacgtggctctttccgtattaagagccttgtttccacagagcgaagctacaaggaagcttaccgtc

SEQ ID NO: 95738 - DNA, 75 bp, Artificial Sequence
  Synthetic
agtgtcttcaacgtggctctttccgtattaagagccttgtttccacagagcgatgctacaaggaagcttaccgtc

SEQ ID NO: 95739 - DNA, 75 bp, Artificial Sequence
  Synthetic
agtgtcttcaacgtggctctttccgtattaagagccttgtttccacagagcgacgctacaaggaagcttaccgtc

SEQ ID NO: 95740 - DNA, 75 bp, Artificial Sequence
  Synthetic
agtgtcttcaacgtggctctttccgtattaagagccttgtttccacagagcgaggctacaaggaagcttaccgtc

SEQ ID NO: 95741 - DNA, 75 bp, Artificial Sequence
  Synthetic
agtgtcttcaacgtggctctttcggtattaaaagccttgtttccacagagcgaagctacaaggaagcttaccgtc

SEQ ID NO: 95742 - DNA, 75 bp, Artificial Sequence
  Synthetic
agtgtcttcaacgtggctctttcggtattaaaagccttgtttccacagagcgatgctacaaggaagcttaccgtc

SEQ ID NO: 95743 - DNA, 75 bp, Artificial Sequence
  Synthetic
agtgtcttcaacgtggctctttcggtattaaaagccttgtttccacagagcgacgctacaaggaagcttaccgtc

SEQ ID NO: 95744 - DNA, 75 bp, Artificial Sequence
  Synthetic
agtgtcttcaacgtggctctttcggtattaaaagccttgtttccacagagcgaggctacaaggaagcttaccgtc

SEQ ID NO: 95745 - DNA, 75 bp, Artificial Sequence
  Synthetic
agtgtcttcaacgtggctctttcggtattaatagccttgtttccacagagcgaagctacaaggaagcttaccgtc

SEQ ID NO: 95746 - DNA, 75 bp, Artificial Sequence
  Synthetic
agtgtcttcaacgtggctctttcggtattaatagccttgtttccacagagcgatgctacaaggaagcttaccgtc

SEQ ID NO: 95747 - DNA, 75 bp, Artificial Sequence
  Synthetic
agtgtcttcaacgtggctctttcggtattaatagccttgtttccacagagcgacgctacaaggaagcttaccgtc

SEQ ID NO: 95748 - DNA, 75 bp, Artificial Sequence
  Synthetic
agtgtcttcaacgtggctctttcggtattaatagccttgtttccacagagcgaggctacaaggaagcttaccgtc

SEQ ID NO: 95749 - DNA, 75 bp, Artificial Sequence
  Synthetic
agtgtcttcaacgtggctctttcggtattaacagccttgtttccacagagcgaagctacaaggaagcttaccgtc

SEQ ID NO: 95750 - DNA, 75 bp, Artificial Sequence
  Synthetic
agtgtcttcaacgtggctctttcggtattaacagccttgtttccacagagcgatgctacaaggaagcttaccgtc

SEQ ID NO: 95751 - DNA, 75 bp, Artificial Sequence
  Synthetic
agtgtcttcaacgtggctctttcggtattaacagccttgtttccacagagcgacgctacaaggaagcttaccgtc

SEQ ID NO: 95752 - DNA, 75 bp, Artificial Sequence
  Synthetic
agtgtcttcaacgtggctctttcggtattaacagccttgtttccacagagcgaggctacaaggaagcttaccgtc

SEQ ID NO: 95753 - DNA, 75 bp, Artificial Sequence
  Synthetic
agtgtcttcaacgtggctctttcggtattaagagccttgtttccacagagcgaagctacaaggaagcttaccgtc

SEQ ID NO: 95754 - DNA, 75 bp, Artificial Sequence
  Synthetic
agtgtcttcaacgtggctctttcggtattaagagccttgtttccacagagcgatgctacaaggaagcttaccgtc

SEQ ID NO: 95755 - DNA, 75 bp, Artificial Sequence
  Synthetic
agtgtcttcaacgtggctctttcggtattaagagccttgtttccacagagcgacgctacaaggaagcttaccgtc

SEQ ID NO: 95756 - DNA, 75 bp, Artificial Sequence
  Synthetic
agtgtcttcaacgtggctctttcggtattaagagccttgtttccacagagcgaggctacaaggaagcttaccgtc

SEQ ID NO: 95757 - DNA, 75 bp, Artificial Sequence
  Synthetic
tgcttggtgggcaatgaacttacctttgaatgtgacaagtgtgaggctaggcaagagaccttggcatccttctcc

SEQ ID NO: 95758 - DNA, 75 bp, Artificial Sequence
  Synthetic
tgcttggtgggcaatgaacttacctttgaatgtgacaagtgtgaggctaggcaagagaccttggcttccttctcc

SEQ ID NO: 95759 - DNA, 75 bp, Artificial Sequence
  Synthetic
tgcttggtgggcaatgaacttacctttgaatgtgacaagtgtgaggctaggcaagagaccttggcctccttctcc

SEQ ID NO: 95760 - DNA, 75 bp, Artificial Sequence
  Synthetic
tgcttggtgggcaatgaacttacctttgaatgtgacaagtgtgaggctaggcaagagaccttggcgtccttctcc

SEQ ID NO: 95761 - DNA, 75 bp, Artificial Sequence
  Synthetic
ttgaatgtgacaagtgtgaggctaggcaagagaccttggcatccttctcctacatttggtctggagtgccgctga

SEQ ID NO: 95762 - DNA, 75 bp, Artificial Sequence
  Synthetic
ttgaatgtgacaagtgtgaggctaggcaagagaccttggcttccttctcctacatttggtctggagtgccgctga

SEQ ID NO: 95763 - DNA, 75 bp, Artificial Sequence
  Synthetic
ttgaatgtgacaagtgtgaggctaggcaagagaccttggcctccttctcctacatttggtctggagtgccgctga

SEQ ID NO: 95764 - DNA, 75 bp, Artificial Sequence
  Synthetic
ttgaatgtgacaagtgtgaggctaggcaagagaccttggcgtccttctcctacatttggtctggagtgccgctga

SEQ ID NO: 95765 - DNA, 75 bp, Artificial Sequence
  Synthetic
atggtggctgacaccaccaaggtgtatgtgaccaacccagacaatgttgggaggagagtggacaaggtaaccttc

SEQ ID NO: 95766 - DNA, 75 bp, Artificial Sequence
  Synthetic
atggtggctgacaccaccaaggtgtatgtgaccaacccagacaatgttgggaggagagtggacaaggttaccttc

SEQ ID NO: 95767 - DNA, 75 bp, Artificial Sequence
  Synthetic
atggtggctgacaccaccaaggtgtatgtgaccaacccagacaatgttgggaggagagtggacaaggtcaccttc

SEQ ID NO: 95768 - DNA, 75 bp, Artificial Sequence
  Synthetic
atggtggctgacaccaccaaggtgtatgtgaccaacccagacaatgttgggaggagagtggacaaggtgaccttc

SEQ ID NO: 95769 - DNA, 75 bp, Artificial Sequence
  Synthetic
ttggtggctgacaccaccaaggtgtatgtgaccaacccagacaatgttgggaggagagtggacaaggtaaccttc

SEQ ID NO: 95770 - DNA, 75 bp, Artificial Sequence
  Synthetic
ttggtggctgacaccaccaaggtgtatgtgaccaacccagacaatgttgggaggagagtggacaaggttaccttc

SEQ ID NO: 95771 - DNA, 75 bp, Artificial Sequence
  Synthetic
ttggtggctgacaccaccaaggtgtatgtgaccaacccagacaatgttgggaggagagtggacaaggtcaccttc

SEQ ID NO: 95772 - DNA, 75 bp, Artificial Sequence
  Synthetic
ttggtggctgacaccaccaaggtgtatgtgaccaacccagacaatgttgggaggagagtggacaaggtgaccttc

SEQ ID NO: 95773 - DNA, 75 bp, Artificial Sequence
  Synthetic
ctggtggctgacaccaccaaggtgtatgtgaccaacccagacaatgttgggaggagagtggacaaggtaaccttc

SEQ ID NO: 95774 - DNA, 75 bp, Artificial Sequence
  Synthetic
ctggtggctgacaccaccaaggtgtatgtgaccaacccagacaatgttgggaggagagtggacaaggttaccttc

SEQ ID NO: 95775 - DNA, 75 bp, Artificial Sequence
  Synthetic
ctggtggctgacaccaccaaggtgtatgtgaccaacccagacaatgttgggaggagagtggacaaggtcaccttc

SEQ ID NO: 95776 - DNA, 75 bp, Artificial Sequence
  Synthetic
ctggtggctgacaccaccaaggtgtatgtgaccaacccagacaatgttgggaggagagtggacaaggtgaccttc

SEQ ID NO: 95777 - DNA, 75 bp, Artificial Sequence
  Synthetic
gtggtggctgacaccaccaaggtgtatgtgaccaacccagacaatgttgggaggagagtggacaaggtaaccttc

SEQ ID NO: 95778 - DNA, 75 bp, Artificial Sequence
  Synthetic
gtggtggctgacaccaccaaggtgtatgtgaccaacccagacaatgttgggaggagagtggacaaggttaccttc

SEQ ID NO: 95779 - DNA, 75 bp, Artificial Sequence
  Synthetic
gtggtggctgacaccaccaaggtgtatgtgaccaacccagacaatgttgggaggagagtggacaaggtcaccttc

SEQ ID NO: 95780 - DNA, 75 bp, Artificial Sequence
  Synthetic
gtggtggctgacaccaccaaggtgtatgtgaccaacccagacaatgttgggaggagagtggacaaggtgaccttc

SEQ ID NO: 95781 - DNA, 75 bp, Artificial Sequence
  Synthetic
atgtgaccaacccagacaatgttgggaggagagtggacaaggtaaccttctggcgagctccaagagttcacgaca

SEQ ID NO: 95782 - DNA, 75 bp, Artificial Sequence
  Synthetic
atgtgaccaacccagacaatgttgggaggagagtggacaaggtaaccttctggcgagctccaagtgttcacgaca

SEQ ID NO: 95783 - DNA, 75 bp, Artificial Sequence
  Synthetic
atgtgaccaacccagacaatgttgggaggagagtggacaaggtaaccttctggcgagctccaagcgttcacgaca

SEQ ID NO: 95784 - DNA, 75 bp, Artificial Sequence
  Synthetic
atgtgaccaacccagacaatgttgggaggagagtggacaaggtaaccttctggcgagctccaagggttcacgaca

SEQ ID NO: 95785 - DNA, 75 bp, Artificial Sequence
  Synthetic
atgtgaccaacccagacaatgttgggaggagagtggacaaggtaaccttctggcgagctcctagagttcacgaca

SEQ ID NO: 95786 - DNA, 75 bp, Artificial Sequence
  Synthetic
atgtgaccaacccagacaatgttgggaggagagtggacaaggtaaccttctggcgagctcctagtgttcacgaca

SEQ ID NO: 95787 - DNA, 75 bp, Artificial Sequence
  Synthetic
atgtgaccaacccagacaatgttgggaggagagtggacaaggtaaccttctggcgagctcctagcgttcacgaca

SEQ ID NO: 95788 - DNA, 75 bp, Artificial Sequence
  Synthetic
atgtgaccaacccagacaatgttgggaggagagtggacaaggtaaccttctggcgagctcctagggttcacgaca

SEQ ID NO: 95789 - DNA, 75 bp, Artificial Sequence
  Synthetic
atgtgaccaacccagacaatgttgggaggagagtggacaaggtaaccttctggcgagctcccagagttcacgaca

SEQ ID NO: 95790 - DNA, 75 bp, Artificial Sequence
  Synthetic
atgtgaccaacccagacaatgttgggaggagagtggacaaggtaaccttctggcgagctcccagtgttcacgaca

SEQ ID NO: 95791 - DNA, 75 bp, Artificial Sequence
  Synthetic
atgtgaccaacccagacaatgttgggaggagagtggacaaggtaaccttctggcgagctcccagcgttcacgaca

SEQ ID NO: 95792 - DNA, 75 bp, Artificial Sequence
  Synthetic
atgtgaccaacccagacaatgttgggaggagagtggacaaggtaaccttctggcgagctcccagggttcacgaca

SEQ ID NO: 95793 - DNA, 75 bp, Artificial Sequence
  Synthetic
atgtgaccaacccagacaatgttgggaggagagtggacaaggtaaccttctggcgagctccgagagttcacgaca

SEQ ID NO: 95794 - DNA, 75 bp, Artificial Sequence
  Synthetic
atgtgaccaacccagacaatgttgggaggagagtggacaaggtaaccttctggcgagctccgagtgttcacgaca

SEQ ID NO: 95795 - DNA, 75 bp, Artificial Sequence
  Synthetic
atgtgaccaacccagacaatgttgggaggagagtggacaaggtaaccttctggcgagctccgagcgttcacgaca

SEQ ID NO: 95796 - DNA, 75 bp, Artificial Sequence
  Synthetic
atgtgaccaacccagacaatgttgggaggagagtggacaaggtaaccttctggcgagctccgagggttcacgaca

SEQ ID NO: 95797 - DNA, 75 bp, Artificial Sequence
  Synthetic
atgtgaccaacccagacaatgttgggaggagagtggacaaggttaccttctggcgagctccaagagttcacgaca

SEQ ID NO: 95798 - DNA, 75 bp, Artificial Sequence
  Synthetic
atgtgaccaacccagacaatgttgggaggagagtggacaaggttaccttctggcgagctccaagtgttcacgaca

SEQ ID NO: 95799 - DNA, 75 bp, Artificial Sequence
  Synthetic
atgtgaccaacccagacaatgttgggaggagagtggacaaggttaccttctggcgagctccaagcgttcacgaca

SEQ ID NO: 95800 - DNA, 75 bp, Artificial Sequence
  Synthetic
atgtgaccaacccagacaatgttgggaggagagtggacaaggttaccttctggcgagctccaagggttcacgaca

SEQ ID NO: 95801 - DNA, 75 bp, Artificial Sequence
  Synthetic
atgtgaccaacccagacaatgttgggaggagagtggacaaggttaccttctggcgagctcctagagttcacgaca

SEQ ID NO: 95802 - DNA, 75 bp, Artificial Sequence
  Synthetic
atgtgaccaacccagacaatgttgggaggagagtggacaaggttaccttctggcgagctcctagtgttcacgaca

SEQ ID NO: 95803 - DNA, 75 bp, Artificial Sequence
  Synthetic
atgtgaccaacccagacaatgttgggaggagagtggacaaggttaccttctggcgagctcctagcgttcacgaca

SEQ ID NO: 95804 - DNA, 75 bp, Artificial Sequence
  Synthetic
atgtgaccaacccagacaatgttgggaggagagtggacaaggttaccttctggcgagctcctagggttcacgaca

SEQ ID NO: 95805 - DNA, 75 bp, Artificial Sequence
  Synthetic
atgtgaccaacccagacaatgttgggaggagagtggacaaggttaccttctggcgagctcccagagttcacgaca

SEQ ID NO: 95806 - DNA, 75 bp, Artificial Sequence
  Synthetic
atgtgaccaacccagacaatgttgggaggagagtggacaaggttaccttctggcgagctcccagtgttcacgaca

SEQ ID NO: 95807 - DNA, 75 bp, Artificial Sequence
  Synthetic
atgtgaccaacccagacaatgttgggaggagagtggacaaggttaccttctggcgagctcccagcgttcacgaca

SEQ ID NO: 95808 - DNA, 75 bp, Artificial Sequence
  Synthetic
atgtgaccaacccagacaatgttgggaggagagtggacaaggttaccttctggcgagctcccagggttcacgaca

SEQ ID NO: 95809 - DNA, 75 bp, Artificial Sequence
  Synthetic
atgtgaccaacccagacaatgttgggaggagagtggacaaggttaccttctggcgagctccgagagttcacgaca

SEQ ID NO: 95810 - DNA, 75 bp, Artificial Sequence
  Synthetic
atgtgaccaacccagacaatgttgggaggagagtggacaaggttaccttctggcgagctccgagtgttcacgaca

SEQ ID NO: 95811 - DNA, 75 bp, Artificial Sequence
  Synthetic
atgtgaccaacccagacaatgttgggaggagagtggacaaggttaccttctggcgagctccgagcgttcacgaca

SEQ ID NO: 95812 - DNA, 75 bp, Artificial Sequence
  Synthetic
atgtgaccaacccagacaatgttgggaggagagtggacaaggttaccttctggcgagctccgagggttcacgaca

SEQ ID NO: 95813 - DNA, 75 bp, Artificial Sequence
  Synthetic
atgtgaccaacccagacaatgttgggaggagagtggacaaggtcaccttctggcgagctccaagagttcacgaca

SEQ ID NO: 95814 - DNA, 75 bp, Artificial Sequence
  Synthetic
atgtgaccaacccagacaatgttgggaggagagtggacaaggtcaccttctggcgagctccaagtgttcacgaca

SEQ ID NO: 95815 - DNA, 75 bp, Artificial Sequence
  Synthetic
atgtgaccaacccagacaatgttgggaggagagtggacaaggtcaccttctggcgagctccaagcgttcacgaca

SEQ ID NO: 95816 - DNA, 75 bp, Artificial Sequence
  Synthetic
atgtgaccaacccagacaatgttgggaggagagtggacaaggtcaccttctggcgagctccaagggttcacgaca

SEQ ID NO: 95817 - DNA, 75 bp, Artificial Sequence
  Synthetic
atgtgaccaacccagacaatgttgggaggagagtggacaaggtcaccttctggcgagctcctagagttcacgaca

SEQ ID NO: 95818 - DNA, 75 bp, Artificial Sequence
  Synthetic
atgtgaccaacccagacaatgttgggaggagagtggacaaggtcaccttctggcgagctcctagtgttcacgaca

SEQ ID NO: 95819 - DNA, 75 bp, Artificial Sequence
  Synthetic
atgtgaccaacccagacaatgttgggaggagagtggacaaggtcaccttctggcgagctcctagcgttcacgaca

SEQ ID NO: 95820 - DNA, 75 bp, Artificial Sequence
  Synthetic
atgtgaccaacccagacaatgttgggaggagagtggacaaggtcaccttctggcgagctcctagggttcacgaca

SEQ ID NO: 95821 - DNA, 75 bp, Artificial Sequence
  Synthetic
atgtgaccaacccagacaatgttgggaggagagtggacaaggtcaccttctggcgagctcccagagttcacgaca

SEQ ID NO: 95822 - DNA, 75 bp, Artificial Sequence
  Synthetic
atgtgaccaacccagacaatgttgggaggagagtggacaaggtcaccttctggcgagctcccagtgttcacgaca

SEQ ID NO: 95823 - DNA, 75 bp, Artificial Sequence
  Synthetic
atgtgaccaacccagacaatgttgggaggagagtggacaaggtcaccttctggcgagctcccagcgttcacgaca

SEQ ID NO: 95824 - DNA, 75 bp, Artificial Sequence
  Synthetic
atgtgaccaacccagacaatgttgggaggagagtggacaaggtcaccttctggcgagctcccagggttcacgaca

SEQ ID NO: 95825 - DNA, 75 bp, Artificial Sequence
  Synthetic
atgtgaccaacccagacaatgttgggaggagagtggacaaggtcaccttctggcgagctccgagagttcacgaca

SEQ ID NO: 95826 - DNA, 75 bp, Artificial Sequence
  Synthetic
atgtgaccaacccagacaatgttgggaggagagtggacaaggtcaccttctggcgagctccgagtgttcacgaca

SEQ ID NO: 95827 - DNA, 75 bp, Artificial Sequence
  Synthetic
atgtgaccaacccagacaatgttgggaggagagtggacaaggtcaccttctggcgagctccgagcgttcacgaca

SEQ ID NO: 95828 - DNA, 75 bp, Artificial Sequence
  Synthetic
atgtgaccaacccagacaatgttgggaggagagtggacaaggtcaccttctggcgagctccgagggttcacgaca

SEQ ID NO: 95829 - DNA, 75 bp, Artificial Sequence
  Synthetic
atgtgaccaacccagacaatgttgggaggagagtggacaaggtgaccttctggcgagctccaagagttcacgaca

SEQ ID NO: 95830 - DNA, 75 bp, Artificial Sequence
  Synthetic
atgtgaccaacccagacaatgttgggaggagagtggacaaggtgaccttctggcgagctccaagtgttcacgaca

SEQ ID NO: 95831 - DNA, 75 bp, Artificial Sequence
  Synthetic
atgtgaccaacccagacaatgttgggaggagagtggacaaggtgaccttctggcgagctccaagcgttcacgaca

SEQ ID NO: 95832 - DNA, 75 bp, Artificial Sequence
  Synthetic
atgtgaccaacccagacaatgttgggaggagagtggacaaggtgaccttctggcgagctccaagggttcacgaca

SEQ ID NO: 95833 - DNA, 75 bp, Artificial Sequence
  Synthetic
atgtgaccaacccagacaatgttgggaggagagtggacaaggtgaccttctggcgagctcctagagttcacgaca

SEQ ID NO: 95834 - DNA, 75 bp, Artificial Sequence
  Synthetic
atgtgaccaacccagacaatgttgggaggagagtggacaaggtgaccttctggcgagctcctagtgttcacgaca

SEQ ID NO: 95835 - DNA, 75 bp, Artificial Sequence
  Synthetic
atgtgaccaacccagacaatgttgggaggagagtggacaaggtgaccttctggcgagctcctagcgttcacgaca

SEQ ID NO: 95836 - DNA, 75 bp, Artificial Sequence
  Synthetic
atgtgaccaacccagacaatgttgggaggagagtggacaaggtgaccttctggcgagctcctagggttcacgaca

SEQ ID NO: 95837 - DNA, 75 bp, Artificial Sequence
  Synthetic
atgtgaccaacccagacaatgttgggaggagagtggacaaggtgaccttctggcgagctcccagagttcacgaca

SEQ ID NO: 95838 - DNA, 75 bp, Artificial Sequence
  Synthetic
atgtgaccaacccagacaatgttgggaggagagtggacaaggtgaccttctggcgagctcccagtgttcacgaca

SEQ ID NO: 95839 - DNA, 75 bp, Artificial Sequence
  Synthetic
atgtgaccaacccagacaatgttgggaggagagtggacaaggtgaccttctggcgagctcccagcgttcacgaca

SEQ ID NO: 95840 - DNA, 75 bp, Artificial Sequence
  Synthetic
atgtgaccaacccagacaatgttgggaggagagtggacaaggtgaccttctggcgagctcccagggttcacgaca

SEQ ID NO: 95841 - DNA, 75 bp, Artificial Sequence
  Synthetic
atgtgaccaacccagacaatgttgggaggagagtggacaaggtgaccttctggcgagctccgagagttcacgaca

SEQ ID NO: 95842 - DNA, 75 bp, Artificial Sequence
  Synthetic
atgtgaccaacccagacaatgttgggaggagagtggacaaggtgaccttctggcgagctccgagtgttcacgaca

SEQ ID NO: 95843 - DNA, 75 bp, Artificial Sequence
  Synthetic
atgtgaccaacccagacaatgttgggaggagagtggacaaggtgaccttctggcgagctccgagcgttcacgaca

SEQ ID NO: 95844 - DNA, 75 bp, Artificial Sequence
  Synthetic
atgtgaccaacccagacaatgttgggaggagagtggacaaggtgaccttctggcgagctccgagggttcacgaca

SEQ ID NO: 95845 - DNA, 75 bp, Artificial Sequence
  Synthetic
tgaatgtgacaagtgtgaagcacgccaagagaccttggcttccttctcctacatctggtccggtgtgccgctgac

SEQ ID NO: 95846 - DNA, 75 bp, Artificial Sequence
  Synthetic
tagtggcagacacaacaaaggtctacgtgaccaacccggacaatgtgggtaggagggtggacaaggtgaccttct

SEQ ID NO: 95847 - DNA, 75 bp, Artificial Sequence
  Synthetic
tgctgccatgggctggggatctaaggtgtcggtcaaagacctgcccacccccgaggggaagatggcggtccacga

SEQ ID NO: 95848 - DNA, 75 bp, Artificial Sequence
  Synthetic
tgctgccatgggctggggatctaaggtgtcggtcaaagacctgcccacccccgtggggaagatggcggtccacga

SEQ ID NO: 95849 - DNA, 75 bp, Artificial Sequence
  Synthetic
tgctgccatgggctggggatctaaggtgtcggtcaaagacctgcccacccccgcggggaagatggcggtccacga

SEQ ID NO: 95850 - DNA, 75 bp, Artificial Sequence
  Synthetic
tgctgccatgggctggggatctaaggtgtcggtcaaagacctgcccacccccggggggaagatggcggtccacga

SEQ ID NO: 95851 - DNA, 75 bp, Artificial Sequence
  Synthetic
cgtgaccaacccggacaatgtgggtaggagggtggacaaggtgaccttctggcgcgctcctcgggttcacgacaa

SEQ ID NO: 95852 - DNA, 75 bp, Artificial Sequence
  Synthetic
tagggagatgctaaagctatgggagtcaaagaaaacaccatgcgccatctgtgtggacgctacgtgcttcgacag

SEQ ID NO: 95853 - DNA, 75 bp, Artificial Sequence
  Synthetic
ctagagacggagctttatgcactggcctctgaccatccagagtgggtgcgagccttggggaaatactacgcctca

SEQ ID NO: 95854 - DNA, 75 bp, Artificial Sequence
  Synthetic
ctagagacggagctttatgctctggcctctgaccatccagagtgggtgcgagccttggggaaatactacgcctca

SEQ ID NO: 95855 - DNA, 75 bp, Artificial Sequence
  Synthetic
ctagagacggagctttatgccctggcctctgaccatccagagtgggtgcgagccttggggaaatactacgcctca

SEQ ID NO: 95856 - DNA, 75 bp, Artificial Sequence
  Synthetic
ctagagacggagctttatgcgctggcctctgaccatccagagtgggtgcgagccttggggaaatactacgcctca

SEQ ID NO: 95857 - DNA, 75 bp, Artificial Sequence
  Synthetic
cctctgaccatccagagtgggtgcgagccttggggaaatactacgcctcaggcaccatggtgacaccggaagggg

SEQ ID NO: 95858 - DNA, 75 bp, Artificial Sequence
  Synthetic
cctctgaccatccagagtgggtgcgagccttggggaaatactacgcctcaggcaccatggtgactccggaagggg

SEQ ID NO: 95859 - DNA, 75 bp, Artificial Sequence
  Synthetic
cctctgaccatccagagtgggtgcgagccttggggaaatactacgcctcaggcaccatggtgaccccggaagggg

SEQ ID NO: 95860 - DNA, 75 bp, Artificial Sequence
  Synthetic
cctctgaccatccagagtgggtgcgagccttggggaaatactacgcctcaggcaccatggtgacgccggaagggg

SEQ ID NO: 95861 - DNA, 75 bp, Artificial Sequence
  Synthetic
ccagtacaccccaaatcagcgggttagggagatgctcaaactgtgggagtcaaagaaaacaccgtgcgccatctg

SEQ ID NO: 95862 - DNA, 75 bp, Artificial Sequence
  Synthetic
caaagaaaacaccgtgcgccatctgcgtggatgccacttgcttcgacagtagcattactgaagaggacgtggccc

SEQ ID NO: 95863 - DNA, 75 bp, Artificial Sequence
  Synthetic
gcactatggtcaccccggaaggggtgccagtgggcgagaggtattgtaggtcctcgggggtcttgaccaccagtg

SEQ ID NO: 95864 - DNA, 75 bp, Artificial Sequence
  Synthetic
gtgggactgaaaaatgtctcactcttgatcgcgggcgatgactgtctgatcatatgtgagcggccaatatgcgac

SEQ ID NO: 95865 - DNA, 75 bp, Artificial Sequence
  Synthetic
atcaattggatttcacaagccagaggagtcgctggcggtggttggggttcttagccctgctcatcgtggccctat

SEQ ID NO: 95866 - DNA, 75 bp, Artificial Sequence
  Synthetic
atcaattggatttcacaagccagaggagtcgctggcggtggttggggttcttagccctgctcatcgtggcccttt

SEQ ID NO: 95867 - DNA, 75 bp, Artificial Sequence
  Synthetic
atcaattggatttcacaagccagaggagtcgctggcggtggttggggttcttagccctgctcatcgtggccctct

SEQ ID NO: 95868 - DNA, 75 bp, Artificial Sequence
  Synthetic
atcaattggatttcacaagccagaggagtcgctggcggtggttggggttcttagccctgctcatcgtggccctgt

SEQ ID NO: 95869 - DNA, 75 bp, Artificial Sequence
  Synthetic
tgagggttaccgcagacacaactaaaacaaagatggaagctgggaaggtcttgagcgacctcaagctcccgggcc

SEQ ID NO: 95870 - DNA, 75 bp, Artificial Sequence
  Synthetic
ggtggttactaaccccctggcagggtcaaagcctgatggtgctaatgcactacgctacggcggcgggtcactacc

SEQ ID NO: 95871 - DNA, 75 bp, Artificial Sequence
  Synthetic
ggtggttactaaccccctggcagggtcaaagcctgatggtgctaatgcactacgctacggcggcgggtctctacc

SEQ ID NO: 95872 - DNA, 75 bp, Artificial Sequence
  Synthetic
ggtggttactaaccccctggcagggtcaaagcctgatggtgctaatgcactacgctacggcggcgggtccctacc

SEQ ID NO: 95873 - DNA, 75 bp, Artificial Sequence
  Synthetic
ggtggttactaaccccctggcagggtcaaagcctgatggtgctaatgcactacgctacggcggcgggtcgctacc

SEQ ID NO: 95874 - DNA, 75 bp, Artificial Sequence
  Synthetic
ggtggttactaaccccctggcagggtcaaagcctgatggtgctaatgcacttcgctacggcggcgggtcactacc

SEQ ID NO: 95875 - DNA, 75 bp, Artificial Sequence
  Synthetic
ggtggttactaaccccctggcagggtcaaagcctgatggtgctaatgcacttcgctacggcggcgggtctctacc

SEQ ID NO: 95876 - DNA, 75 bp, Artificial Sequence
  Synthetic
ggtggttactaaccccctggcagggtcaaagcctgatggtgctaatgcacttcgctacggcggcgggtccctacc

SEQ ID NO: 95877 - DNA, 75 bp, Artificial Sequence
  Synthetic
ggtggttactaaccccctggcagggtcaaagcctgatggtgctaatgcacttcgctacggcggcgggtcgctacc

SEQ ID NO: 95878 - DNA, 75 bp, Artificial Sequence
  Synthetic
ggtggttactaaccccctggcagggtcaaagcctgatggtgctaatgcactccgctacggcggcgggtcactacc

SEQ ID NO: 95879 - DNA, 75 bp, Artificial Sequence
  Synthetic
ggtggttactaaccccctggcagggtcaaagcctgatggtgctaatgcactccgctacggcggcgggtctctacc

SEQ ID NO: 95880 - DNA, 75 bp, Artificial Sequence
  Synthetic
ggtggttactaaccccctggcagggtcaaagcctgatggtgctaatgcactccgctacggcggcgggtccctacc

SEQ ID NO: 95881 - DNA, 75 bp, Artificial Sequence
  Synthetic
ggtggttactaaccccctggcagggtcaaagcctgatggtgctaatgcactccgctacggcggcgggtcgctacc

SEQ ID NO: 95882 - DNA, 75 bp, Artificial Sequence
  Synthetic
ggtggttactaaccccctggcagggtcaaagcctgatggtgctaatgcactgcgctacggcggcgggtcactacc

SEQ ID NO: 95883 - DNA, 75 bp, Artificial Sequence
  Synthetic
ggtggttactaaccccctggcagggtcaaagcctgatggtgctaatgcactgcgctacggcggcgggtctctacc

SEQ ID NO: 95884 - DNA, 75 bp, Artificial Sequence
  Synthetic
ggtggttactaaccccctggcagggtcaaagcctgatggtgctaatgcactgcgctacggcggcgggtccctacc

SEQ ID NO: 95885 - DNA, 75 bp, Artificial Sequence
  Synthetic
ggtggttactaaccccctggcagggtcaaagcctgatggtgctaatgcactgcgctacggcggcgggtcgctacc

SEQ ID NO: 95886 - DNA, 75 bp, Artificial Sequence
  Synthetic
gcgcaagcaactgcatgacctgctacatcaaggtgaaggccgcctgtgagagggtggggctgaaaaatgtctcac

SEQ ID NO: 95887 - DNA, 75 bp, Artificial Sequence
  Synthetic
gcgcaagcaactgcatgacctgctacatcaaggtgaaggccgcctgtgagagggtggggctgaaaaatgtctctc

SEQ ID NO: 95888 - DNA, 75 bp, Artificial Sequence
  Synthetic
gcgcaagcaactgcatgacctgctacatcaaggtgaaggccgcctgtgagagggtggggctgaaaaatgtctccc

SEQ ID NO: 95889 - DNA, 75 bp, Artificial Sequence
  Synthetic
gcgcaagcaactgcatgacctgctacatcaaggtgaaggccgcctgtgagagggtggggctgaaaaatgtctcgc

SEQ ID NO: 95890 - DNA, 75 bp, Artificial Sequence
  Synthetic
gcgcaagcaactgcttgacctgctacatcaaggtgaaggccgcctgtgagagggtggggctgaaaaatgtctcac

SEQ ID NO: 95891 - DNA, 75 bp, Artificial Sequence
  Synthetic
gcgcaagcaactgcttgacctgctacatcaaggtgaaggccgcctgtgagagggtggggctgaaaaatgtctctc

SEQ ID NO: 95892 - DNA, 75 bp, Artificial Sequence
  Synthetic
gcgcaagcaactgcttgacctgctacatcaaggtgaaggccgcctgtgagagggtggggctgaaaaatgtctccc

SEQ ID NO: 95893 - DNA, 75 bp, Artificial Sequence
  Synthetic
gcgcaagcaactgcttgacctgctacatcaaggtgaaggccgcctgtgagagggtggggctgaaaaatgtctcgc

SEQ ID NO: 95894 - DNA, 75 bp, Artificial Sequence
  Synthetic
gcgcaagcaactgcctgacctgctacatcaaggtgaaggccgcctgtgagagggtggggctgaaaaatgtctcac

SEQ ID NO: 95895 - DNA, 75 bp, Artificial Sequence
  Synthetic
gcgcaagcaactgcctgacctgctacatcaaggtgaaggccgcctgtgagagggtggggctgaaaaatgtctctc

SEQ ID NO: 95896 - DNA, 75 bp, Artificial Sequence
  Synthetic
gcgcaagcaactgcctgacctgctacatcaaggtgaaggccgcctgtgagagggtggggctgaaaaatgtctccc

SEQ ID NO: 95897 - DNA, 75 bp, Artificial Sequence
  Synthetic
gcgcaagcaactgcctgacctgctacatcaaggtgaaggccgcctgtgagagggtggggctgaaaaatgtctcgc

SEQ ID NO: 95898 - DNA, 75 bp, Artificial Sequence
  Synthetic
gcgcaagcaactgcgtgacctgctacatcaaggtgaaggccgcctgtgagagggtggggctgaaaaatgtctcac

SEQ ID NO: 95899 - DNA, 75 bp, Artificial Sequence
  Synthetic
gcgcaagcaactgcgtgacctgctacatcaaggtgaaggccgcctgtgagagggtggggctgaaaaatgtctctc

SEQ ID NO: 95900 - DNA, 75 bp, Artificial Sequence
  Synthetic
gcgcaagcaactgcgtgacctgctacatcaaggtgaaggccgcctgtgagagggtggggctgaaaaatgtctccc

SEQ ID NO: 95901 - DNA, 75 bp, Artificial Sequence
  Synthetic
gcgcaagcaactgcgtgacctgctacatcaaggtgaaggccgcctgtgagagggtggggctgaaaaatgtctcgc

SEQ ID NO: 95902 - DNA, 75 bp, Artificial Sequence
  Synthetic
tgcgcacgcgcatgctccggtcgcacggttgggctgagttggctaggggcctgttgtggcatccaagcctacggc

SEQ ID NO: 95903 - DNA, 75 bp, Artificial Sequence
  Synthetic
tgcgcacgcgcatgctccggtcgcacggttgggctgagttggctaggggcctgttgtggcatccatgcctacggc

SEQ ID NO: 95904 - DNA, 75 bp, Artificial Sequence
  Synthetic
tgcgcacgcgcatgctccggtcgcacggttgggctgagttggctaggggcctgttgtggcatccacgcctacggc

SEQ ID NO: 95905 - DNA, 75 bp, Artificial Sequence
  Synthetic
tgcgcacgcgcatgctccggtcgcacggttgggctgagttggctaggggcctgttgtggcatccaggcctacggc

SEQ ID NO: 95906 - DNA, 75 bp, Artificial Sequence
  Synthetic
tgcgcacgcgcatgctccggtcgctcggttgggctgagttggctaggggcctgttgtggcatccaagcctacggc

SEQ ID NO: 95907 - DNA, 75 bp, Artificial Sequence
  Synthetic
tgcgcacgcgcatgctccggtcgctcggttgggctgagttggctaggggcctgttgtggcatccatgcctacggc

SEQ ID NO: 95908 - DNA, 75 bp, Artificial Sequence
  Synthetic
tgcgcacgcgcatgctccggtcgctcggttgggctgagttggctaggggcctgttgtggcatccacgcctacggc

SEQ ID NO: 95909 - DNA, 75 bp, Artificial Sequence
  Synthetic
tgcgcacgcgcatgctccggtcgctcggttgggctgagttggctaggggcctgttgtggcatccaggcctacggc

SEQ ID NO: 95910 - DNA, 75 bp, Artificial Sequence
  Synthetic
tgcgcacgcgcatgctccggtcgcccggttgggctgagttggctaggggcctgttgtggcatccaagcctacggc

SEQ ID NO: 95911 - DNA, 75 bp, Artificial Sequence
  Synthetic
tgcgcacgcgcatgctccggtcgcccggttgggctgagttggctaggggcctgttgtggcatccatgcctacggc

SEQ ID NO: 95912 - DNA, 75 bp, Artificial Sequence
  Synthetic
tgcgcacgcgcatgctccggtcgcccggttgggctgagttggctaggggcctgttgtggcatccacgcctacggc

SEQ ID NO: 95913 - DNA, 75 bp, Artificial Sequence
  Synthetic
tgcgcacgcgcatgctccggtcgcccggttgggctgagttggctaggggcctgttgtggcatccaggcctacggc

SEQ ID NO: 95914 - DNA, 75 bp, Artificial Sequence
  Synthetic
tgcgcacgcgcatgctccggtcgcgcggttgggctgagttggctaggggcctgttgtggcatccaagcctacggc

SEQ ID NO: 95915 - DNA, 75 bp, Artificial Sequence
  Synthetic
tgcgcacgcgcatgctccggtcgcgcggttgggctgagttggctaggggcctgttgtggcatccatgcctacggc

SEQ ID NO: 95916 - DNA, 75 bp, Artificial Sequence
  Synthetic
tgcgcacgcgcatgctccggtcgcgcggttgggctgagttggctaggggcctgttgtggcatccacgcctacggc

SEQ ID NO: 95917 - DNA, 75 bp, Artificial Sequence
  Synthetic
tgcgcacgcgcatgctccggtcgcgcggttgggctgagttggctaggggcctgttgtggcatccaggcctacggc

SEQ ID NO: 95918 - DNA, 75 bp, Artificial Sequence
  Synthetic
aagcgcacggtccacaggtgttggtcctaccggtgtaataaggacccggcgctaggcacgccgttaaaccgagac

SEQ ID NO: 95919 - DNA, 75 bp, Artificial Sequence
  Synthetic
ccgcggcggcctgcagccggggtagcccaagaaaccttcgggtgagggcgggtggcatttctttttctgtaccga

SEQ ID NO: 95920 - DNA, 75 bp, Artificial Sequence
  Synthetic
tcatggcagtccttctgcttcttctcgttgcggaggccggggccattctggccccggccacgcatgcttgcggaa

SEQ ID NO: 95921 - DNA, 75 bp, Artificial Sequence
  Synthetic
attccgctgcccagctcgtttggggaatcggtaacctctaccggcccctgtcggtgtcggcctacgtggctggca

SEQ ID NO: 95922 - DNA, 75 bp, Artificial Sequence
  Synthetic
ttgacgcgccgggtctacccggtcccgaacttgacttgtacagtagaatgtgagctaaagtgggaaagtgagttt

SEQ ID NO: 95923 - DNA, 75 bp, Artificial Sequence
  Synthetic
ggtggccctagggtgcaccatttgtacagaccgatgctggccactgtatcaggcggggttggccgtgcggcccgg

SEQ ID NO: 95924 - DNA, 75 bp, Artificial Sequence
  Synthetic
caagtccgccgcccagttggtgggggaactcggaagcttctacgggcccttatcggtctccgcttatgtggcggg

SEQ ID NO: 95925 - DNA, 75 bp, Artificial Sequence
  Synthetic
cgtggagtgatgagcctgacgcccctgttggtgtgcgttgcggcccttctactgcttgagcaaaggattgtcatg

SEQ ID NO: 95926 - DNA, 75 bp, Artificial Sequence
  Synthetic
tcgggggtcctcaccgtcggggtggcgttgacgcggcgggtctacccggttcctaacctcacgtgtgcagtagaa

SEQ ID NO: 95927 - DNA, 75 bp, Artificial Sequence
  Synthetic
cgttgacgcggcgggtctacccggttcctaacctcacgtgtgcagtagaatgtgagctaaagtgggaaagtgagt

SEQ ID NO: 95928 - DNA, 75 bp, Artificial Sequence
  Synthetic
gtcttcctgctcgtgaccatggcggggatgtcgcaaggcgctcctgcttcggtcttggggtcacgcccctttgag

SEQ ID NO: 95929 - DNA, 75 bp, Artificial Sequence
  Synthetic
ctccaactactggattctggaatatctctggaaggtgccttttgacttctggcggggagtgatgagcctgacacc

SEQ ID NO: 95930 - DNA, 75 bp, Artificial Sequence
  Synthetic
tggtgtttctcctggtaacaatggcggggatgtctcagggcgtcccggtcagcgtgctggggtccaggccttttg

SEQ ID NO: 95931 - DNA, 75 bp, Artificial Sequence
  Synthetic
agcctgggatcacttggcagtcctgttcctgcagggcgaacgggtcccgcgtgcccacgggggaacgggtttggg

SEQ ID NO: 95932 - DNA, 75 bp, Artificial Sequence
  Synthetic
ggggttccgtgtcttggtttgcctccactggaggtcgtgattcaaagatcgatgtgtggaatttggtgccagttg

SEQ ID NO: 95933 - DNA, 75 bp, Artificial Sequence
  Synthetic
tcggctggggcgaccctatcactcactggagccacggacaaaatcagtggcccctgtcgtgcccccagtatgtct

SEQ ID NO: 95934 - DNA, 75 bp, Artificial Sequence
  Synthetic
ccttgggttttgggtcctacaccatgaccaagatccgagactccttacatttggtgaaatgtcccaccccagcca

SEQ ID NO: 95935 - DNA, 75 bp, Artificial Sequence
  Synthetic
gaccaagatccgagactccttacatttggtgaaatgtcccaccccagccattgagcctcccaccgggacgtttgg

SEQ ID NO: 95936 - DNA, 75 bp, Artificial Sequence
  Synthetic
tagctgggaggcgaaatccggtctgtcccgggtttgcatggctatcctcgggcaggcctgatgggttcatacatg

SEQ ID NO: 95937 - DNA, 75 bp, Artificial Sequence
  Synthetic
ggcaggcctgatgggttcatacatgttcaaggccacttgcaggaggtggatgcgggcaacttcatcccccctcct

SEQ ID NO: 95938 - DNA, 75 bp, Artificial Sequence
  Synthetic
atctggtgatatgtcccaccccggcaattgagcctcccaccggcacgtttgggttcttcccgggagtcccccccc

SEQ ID NO: 95939 - DNA, 75 bp, Artificial Sequence
  Synthetic
gcgggcctcaccggggggttctatgaaccgctggtgcgacggtgttcagagctgatgggtaggcggaatccggtt

SEQ ID NO: 95940 - DNA, 75 bp, Artificial Sequence
  Synthetic
tgaatcagctggcagtcctaggactgcctgcggcgcacgctgctgtagcgggggaggtttttgcgggaccggcct

SEQ ID NO: 95941 - DNA, 75 bp, Artificial Sequence
  Synthetic
gatgcgggcaacttcatcccaccgccacgctggttgcttctggactttgtatttgtcctgttatacctgatgaag

SEQ ID NO: 95942 - DNA, 75 bp, Artificial Sequence
  Synthetic
ggtgaatcagttggcggttctcggactgcctgctgctaacgccgctgtggctggagaagtgtttgcgggccctgc

SEQ ID NO: 95943 - DNA, 75 bp, Artificial Sequence
  Synthetic
ggggatttctgccactcgcgggcgcacctcagtgctcggagccgaattctgctttgatgtcacctttgaagtgga

SEQ ID NO: 95944 - DNA, 75 bp, Artificial Sequence
  Synthetic
ccgtgatgctggtggtggtggggctggtgcttctctttggcctgttcgacgcgttggactgggccctggaggagt

SEQ ID NO: 95945 - DNA, 75 bp, Artificial Sequence
  Synthetic
gctagtgtcgtggcctgggccattgcgctccttagctccatgagcgcgggggggtggaggcacaaggccgtgatc

SEQ ID NO: 95946 - DNA, 75 bp, Artificial Sequence
  Synthetic
ggggtggaggcacaaggccgtgatctataggacgtggtgtaaaggataccaggccgtgcgtcagcgggtggtccg

SEQ ID NO: 95947 - DNA, 75 bp, Artificial Sequence
  Synthetic
gtgcgcgcgaggggcctatttgttcgaccacatgggctctttttcgcgcgctgtcaaggagcgccttcttgagtg

SEQ ID NO: 95948 - DNA, 75 bp, Artificial Sequence
  Synthetic
gtttggcttcttacatctggcctgacgctgtgatgttggtggtggtggccctggtgctcctctttggtctgttcg

SEQ ID NO: 95949 - DNA, 75 bp, Artificial Sequence
  Synthetic
tcagggacgcggccaggaccttgtcttgcggccaatgcgtcatgggcttgcccgtggtcgcacgccgtggggttg

SEQ ID NO: 95950 - DNA, 75 bp, Artificial Sequence
  Synthetic
cccgtggtcgcacgccgtggggttgaggttctgattggcgtctttcaggatgtgaaccatttgcctccggggttt

SEQ ID NO: 95951 - DNA, 75 bp, Artificial Sequence
  Synthetic
cggcggctggctcgggtggtggaatgctgtgtgatggctggtgagaaggccactaccatccggctggtctccaag

SEQ ID NO: 95952 - DNA, 75 bp, Artificial Sequence
  Synthetic
tgccgtcaaggagcgcctgctggagtgggatgcggcccttgagcctctttcattcaccaggacggactgtcgcat

SEQ ID NO: 95953 - DNA, 75 bp, Artificial Sequence
  Synthetic
aacggcctgctgttcactactttccatggggcttcttcccgaaccatcgctacacctgtgggagcccttaaccct

SEQ ID NO: 95954 - DNA, 75 bp, Artificial Sequence
  Synthetic
agctgcggccagtgcgtcatgggcttgcccgtggtggctcggcgcggcgatgaggttctgatcggcgtctttcag

SEQ ID NO: 95955 - DNA, 75 bp, Artificial Sequence
  Synthetic
agctaactcgttgactccttgcacgtgccaggcggagtcctgttgggtcatacgatctgacggggccctttgcca

SEQ ID NO: 95956 - DNA, 75 bp, Artificial Sequence
  Synthetic
tgccaggcggagtcctgttgggtcatacgatctgacggggccctttgccatggcttgtgcaagggagacaaggtg

SEQ ID NO: 95957 - DNA, 75 bp, Artificial Sequence
  Synthetic
ccgacggtgcggaaagggctttctcggagtcacaaaggctgccttgactggacgggatcctgacttacatccagg

SEQ ID NO: 95958 - DNA, 75 bp, Artificial Sequence
  Synthetic
gaacgtcatggttctgggaacggctacctcgcgcagcatgggaacatgtctgaacgggctgctgtttaccacgtt

SEQ ID NO: 95959 - DNA, 75 bp, Artificial Sequence
  Synthetic
acctgtcttgtgcgacgaggggcacgcagtaggaatgctggtgtccgtgcttcattcagggggtcgggttacggc

SEQ ID NO: 95960 - DNA, 75 bp, Artificial Sequence
  Synthetic
gcagtaggaatgctggtgtccgtgcttcattcagggggtcgggttacggcggctagattcactcggccgtggacc

SEQ ID NO: 95961 - DNA, 75 bp, Artificial Sequence
  Synthetic
gctacccctgtgggggcccttaacccaaggtggtggtcggccagtgatgacgtgacggtttacccactcccggat

SEQ ID NO: 95962 - DNA, 75 bp, Artificial Sequence
  Synthetic
ttgtttatgccaacgggggctggaaagagcacccgggtcccgttggagtatggcaacatgggtcacaaggtcctt

SEQ ID NO: 95963 - DNA, 75 bp, Artificial Sequence
  Synthetic
cattcgatccgacggggccttgtgccatggcttgtgcaagggggacaaggtggagctggacgtggccatggaggt

SEQ ID NO: 95964 - DNA, 75 bp, Artificial Sequence
  Synthetic
gcgcctggcgggcaaacatcccagcatctactgtgggcacgacactacagctttcactaggatcactgattctcc

SEQ ID NO: 95965 - DNA, 75 bp, Artificial Sequence
  Synthetic
tcgcctgtcttgtgcgacgaggggcacgcagtaggaatgctcgtgtccgtgcttcattctggtggtcgggtcacc

SEQ ID NO: 95966 - DNA, 75 bp, Artificial Sequence
  Synthetic
atctactgtgggcacgacactacagctttcactaggatcactgattctcctctgacgtactcaacctatgggagg

SEQ ID NO: 95967 - DNA, 75 bp, Artificial Sequence
  Synthetic
taccactgagcccccgccagtaccagcaaaaggggtgttcaaggaggctccacttttcatgcccaccggggccgg

SEQ ID NO: 95968 - DNA, 75 bp, Artificial Sequence
  Synthetic
tgatgagtgccacagtcatgactcgactgtgttgttggggataggtagggtcagggaattggcgcgtggctgtgg

SEQ ID NO: 95969 - DNA, 75 bp, Artificial Sequence
  Synthetic
actgtgttgttggggataggtagggtcagggaattggcgcgtggctgtggggtccagttggtcctctatgccacc

SEQ ID NO: 95970 - DNA, 75 bp, Artificial Sequence
  Synthetic
gcaaaaggggtgttcaaggaggctccacttttcatgcccaccggggccggcaagagcacgcgggtcccactggag

SEQ ID NO: 95971 - DNA, 75 bp, Artificial Sequence
  Synthetic
agtacgggccatgggcccctacatggaaaagctagccggtaagcatcccagtattttctgtgggcacgatacaac

SEQ ID NO: 95972 - DNA, 75 bp, Artificial Sequence
  Synthetic
aaagcttgatgtgggtgagatccccttttatgggcatggtatccctctggagaggatgcggaccgggaggcacct

SEQ ID NO: 95973 - DNA, 75 bp, Artificial Sequence
  Synthetic
ccattgacgtattcgacctatggtaggttcctagccaaccctaggcagatgctgaggggagtgtctgtggtgata

SEQ ID NO: 95974 - DNA, 75 bp, Artificial Sequence
  Synthetic
tgtgacgagtgccacagtcatgactctactgtgttgttggggattgggcgagtcagggaactggctcgtggctgc

SEQ ID NO: 95975 - DNA, 75 bp, Artificial Sequence
  Synthetic
gacccagcatccttcaatcatagagacaaaactggacgtgggtgagatccccttttatgggcatggtatccccct

SEQ ID NO: 95976 - DNA, 75 bp, Artificial Sequence
  Synthetic
acaaaactggacgtgggtgagatccccttttatgggcatggtatccccctcgagcggatgcggacgggccggcac

SEQ ID NO: 95977 - DNA, 75 bp, Artificial Sequence
  Synthetic
ctcgtcccgaggggtgaacgccatcgcttattatagggggaaggacagttctatcatcaaggatggggacctggt

SEQ ID NO: 95978 - DNA, 75 bp, Artificial Sequence
  Synthetic
gatcccaccataaccatctccttgcgaactgtgccagcgtcggcagaactgtcgatgcaacggcgaggacgcaca

SEQ ID NO: 95979 - DNA, 75 bp, Artificial Sequence
  Synthetic
tgtcccgctactgctgaggtggggcaatgatttaccatcaaaagtggccggccaccacattgtggacgacctggt

SEQ ID NO: 95980 - DNA, 75 bp, Artificial Sequence
  Synthetic
gtctggtcagcagtggaagctggagtgacctggtatggaatggaacctgacttgacagcaaaccttctgagactt

SEQ ID NO: 95981 - DNA, 75 bp, Artificial Sequence
  Synthetic
tgctggtgtggttcggtcgggtcctgtctggtcagcagtggaagctggagtgacctggtatggaatggaacctga

SEQ ID NO: 95982 - DNA, 75 bp, Artificial Sequence
  Synthetic
gggacgcgggccgtccccacagtttcaattgtggacaagctcttcgccggcgggtgggcagcggtggtcgcacat

SEQ ID NO: 95983 - DNA, 75 bp, Artificial Sequence
  Synthetic
tcccccgttggccgcagctgcttcttacctaatggggttgggcgtcgcgggcaacgcgcaggcgcgcctcgcctc

SEQ ID NO: 95984 - DNA, 75 bp, Artificial Sequence
  Synthetic
accgccctagggacgccggtcgtgggattaaccatggccggtgctttcatgggtggagctagtgtttccccttcc

SEQ ID NO: 95985 - DNA, 75 bp, Artificial Sequence
  Synthetic
atggcagggaagttgtctacggacgacctgtggtatgctatcccggtactgactagtcctggggcgggcctcgcg

SEQ ID NO: 95986 - DNA, 75 bp, Artificial Sequence
  Synthetic
attgccatagcgtcatagctgcggcggtggctgcgtacggggcctctaggagccccccgctcgcagcggcggctt

SEQ ID NO: 95987 - DNA, 75 bp, Artificial Sequence
  Synthetic
ggtggctgcgtacggggcctctaggagccccccgctcgcagcggcggcttcttacctcatggggttgggcgtcgg

SEQ ID NO: 95988 - DNA, 75 bp, Artificial Sequence
  Synthetic
cacttggttgaaccgtctgctgacgacgcttccccgatcttcatgcatcccggatagttatttccaacaggccga

SEQ ID NO: 95989 - DNA, 75 bp, Artificial Sequence
  Synthetic
gcactgctctgggcacgcccgtcgtggggttaaccatggcgggggcgttcatgggcggtgctagcgtgtctccct

SEQ ID NO: 95990 - DNA, 75 bp, Artificial Sequence
  Synthetic
ggggttaaccatggcgggggcgttcatgggcggtgctagcgtgtctccctcactagtcacggtcctcttgggggc

SEQ ID NO: 95991 - DNA, 75 bp, Artificial Sequence
  Synthetic
gcccaaggtcgatgaggttcaggtggggtatgtttgggacctgtgggaatggatcatgcgccaagtgcgtatggt

SEQ ID NO: 95992 - DNA, 75 bp, Artificial Sequence
  Synthetic
tcatggcagggaaactttccacggacgatctgtggtatgcaatcccagtgctcaccagcccgggggcgggcctcg

SEQ ID NO: 95993 - DNA, 75 bp, Artificial Sequence
  Synthetic
cattgccagagtccgggccctctgccccgtggtgtcactacctctgtggcattgtggggaggggtggtctggaga

SEQ ID NO: 95994 - DNA, 75 bp, Artificial Sequence
  Synthetic
accacatggttgaatcgtctgctgaccacgttgcctcgttcatcatgcatcccagacagctatttccaacaggcc

SEQ ID NO: 95995 - DNA, 75 bp, Artificial Sequence
  Synthetic
actcaaagatccagtttactcaaccaagctgtgccggcactattggatggggaccgttccggtcaacatgttggg

SEQ ID NO: 95996 - DNA, 75 bp, Artificial Sequence
  Synthetic
ccacgttgcctcgttcatcatgcatcccagacagctatttccaacaggccgactactgtgacaaagtgtccgcca

SEQ ID NO: 95997 - DNA, 75 bp, Artificial Sequence
  Synthetic
ggaccgttccggtcaacatgttgggttatggggaaacgtcgcctctcctggcctccgacacgcctaaggtcgtcc

SEQ ID NO: 95998 - DNA, 75 bp, Artificial Sequence
  Synthetic
agttgctgcgccagcaaatactctctgcagctgtagctgagccctattacgtggatggcattcctgtctcgtggg

SEQ ID NO: 95999 - DNA, 75 bp, Artificial Sequence
  Synthetic
gtggtgtccagactccgggccctctgccccgttgtgtcacttcctctgtggcattgcggtgaggggtggtccgga

SEQ ID NO: 96000 - DNA, 75 bp, Artificial Sequence
  Synthetic
gtggatggcattcctgtctcgtgggaggccgacgctcgcgcgccggcaatggtctacggtcctggccaaagcgtc

SEQ ID NO: 96001 - DNA, 75 bp, Artificial Sequence
  Synthetic
ggtctacggtcctggccaaagcgtcaccattgacggggagcgctacactcttccgcatcaactgcggatgaggaa

SEQ ID NO: 96002 - DNA, 75 bp, Artificial Sequence
  Synthetic
ccaagttgtgccggcattattggatggggactgttccggtcaacatgttgggctatggggaaacgtcgcccctgc

SEQ ID NO: 96003 - DNA, 75 bp, Artificial Sequence
  Synthetic
tggtgatccggcgcacttcctgttacaaattgctgcgccagcaaatactttcagctgctgtagctgagccctact

SEQ ID NO: 96004 - DNA, 75 bp, Artificial Sequence
  Synthetic
cgtcttcaacgtggctctttccgtactaaaagccttatttccacagagtgacgccactcgtaagctaacagtcag

SEQ ID NO: 96005 - DNA, 75 bp, Artificial Sequence
  Synthetic
tgcgaggattcttgaaccgcacatagatgtcatcatggaggactgcagtacaccctctctctgtggaagtagccg

SEQ ID NO: 96006 - DNA, 75 bp, Artificial Sequence
  Synthetic
cgggccaccccggccaagccgccagtggtgcggccggtggggtccttgttggtggctgacaccaccaaggtgtac

SEQ ID NO: 96007 - DNA, 75 bp, Artificial Sequence
  Synthetic
gtgaccaatccagacaatgtggggaggagagttgacaaggtgactttctggcgcgcccctcgggttcatgacaaa

SEQ ID NO: 96008 - DNA, 75 bp, Artificial Sequence
  Synthetic
cagcaactgcttgacttgctacatcaaggtgaaagccgcttgcgatcgggtgggactcaagaacgtttccctcct

SEQ ID NO: 96009 - DNA, 75 bp, Artificial Sequence
  Synthetic
ccctcatatcatgcatcactggacacggcccccttctgctccacttggctagccgagtgcaatgcagatgggaag

SEQ ID NO: 96010 - DNA, 75 bp, Artificial Sequence
  Synthetic
ggtcatcattccgcacgtgctaacctgcgcgtttaggggtggtggcacaccgtctgatcctgtgtggtgccaggt

SEQ ID NO: 96011 - DNA, 75 bp, Artificial Sequence
  Synthetic
cctctgaccatccagaatgggtgcgagccctggggaaatactatgcttctggcacaatggttacccctgacgggg

SEQ ID NO: 96012 - DNA, 75 bp, Artificial Sequence
  Synthetic
gcgagcaactgcttgacctgctacatcaaggtccgagccgcgtgcgagcgggtggggctgaaaaatgtctcactc

SEQ ID NO: 96013 - DNA, 75 bp, Artificial Sequence
  Synthetic
tcaaggtccgagccgcgtgcgagcgggtggggctgaaaaatgtctcactcctcatcgctggcgacgactgtctga

SEQ ID NO: 96014 - DNA, 75 bp, Artificial Sequence
  Synthetic
ctggcttcatatgggtatgcgtgtgagccctcatatcatgcatcactggacacagcccccttctgctccacttgg

SEQ ID NO: 96015 - DNA, 75 bp, Artificial Sequence
  Synthetic
cccccccccggcactgggtgcaagccccagaaaccgacgcctactaaagcaggcattaaggcctcgcgccgaacc

SEQ ID NO: 96016 - DNA, 75 bp, Artificial Sequence
  Synthetic
aggcattaaggcctcgcgccgaaccggcgaccggccaaaaggtggtggatgggtgatgccagggttggtaggtcg

SEQ ID NO: 96017 - DNA, 75 bp, Artificial Sequence
  Synthetic
cattttggccccggccacccacgcttgtgaggcgcatgggcaatatttcctcacgaattgctgtgccatggagga

SEQ ID NO: 96018 - DNA, 75 bp, Artificial Sequence
  Synthetic
ggcacggtccacaggtgttggatgggtgatgccagggttggtaggtcgtaaatcccggtcatcatcttggtagcc

SEQ ID NO: 96019 - DNA, 75 bp, Artificial Sequence
  Synthetic
tttgtaccgaccgatgctggccactgtatcaggcgggattggccgtgcggcccggcaagtccgctgcccagctgg

SEQ ID NO: 96020 - DNA, 75 bp, Artificial Sequence
  Synthetic
gctggcatcttagggcttggagaggtctactcgggggtccttaccgtgggcgttgcgttgacgcgcagggtctac

SEQ ID NO: 96021 - DNA, 75 bp, Artificial Sequence
  Synthetic
cttctggcggggcgtgatgagcctgacccccttgttggtgtgcgtggcggcccttctcctgcttgagcaacggat

SEQ ID NO: 96022 - DNA, 75 bp, Artificial Sequence
  Synthetic
tgtcatggtcttcctcctggtcactatggcgggcatgtcgcaaggcgcgcccgcttcagtgctggggtcccggcc

SEQ ID NO: 96023 - DNA, 75 bp, Artificial Sequence
  Synthetic
ccatcttggccccggccacacacgcttgcagagcgaaggaccaatacttcctcacaaactgctgtgccccggaag

SEQ ID NO: 96024 - DNA, 75 bp, Artificial Sequence
  Synthetic
atggcgggcatgtcgcaaggcgcgcccgcttcagtgctggggtcccggccttttgagccggggttgacatggcag

SEQ ID NO: 96025 - DNA, 75 bp, Artificial Sequence
  Synthetic
ttgcagagcgaaggaccaatacttcctcacaaactgctgtgccccggaagacatagggttctgccttgagggcgg

SEQ ID NO: 96026 - DNA, 75 bp, Artificial Sequence
  Synthetic
ttgggagcgtgggaacgtctcactgttgtgtgactgccccaacggtccctgggtgtggcttccagccttttgcca

SEQ ID NO: 96027 - DNA, 75 bp, Artificial Sequence
  Synthetic
tgtatcaggcgggattggctgtgcgtcccggcaagtccgccgcccagttggtgggggagctcgggagcctttacg

SEQ ID NO: 96028 - DNA, 75 bp, Artificial Sequence
  Synthetic
tcccggcaagtccgccgcccagttggtgggggagctcgggagcctttacgggcccctgtcggtgtccgcctatgt

SEQ ID NO: 96029 - DNA, 75 bp, Artificial Sequence
  Synthetic
ttgtgtgactgccccaacggtccctgggtgtggcttccagccttttgccaagcagttggctggggtgaccctatc

SEQ ID NO: 96030 - DNA, 75 bp, Artificial Sequence
  Synthetic
tgtctatggttccgtttcagtgacttgcgtttggggttccgtgtcttggtttgcctccacgggtggccgcgactc

SEQ ID NO: 96031 - DNA, 75 bp, Artificial Sequence
  Synthetic
ttgcctccacgggtggccgcgactccaagatcgacgtgtggagtttggttccagttggctcagccagctgtacca

SEQ ID NO: 96032 - DNA, 75 bp, Artificial Sequence
  Synthetic
cggcacctgtgtgagggactgctggcccgagaccgggtcggtgaggttcccattccatcggtgtggcgcgggtcc

SEQ ID NO: 96033 - DNA, 75 bp, Artificial Sequence
  Synthetic
ttgtcatggtcttccttcttgtgactatggcggggatgtcgcaaggcgcccccgcctcggtcctaggctcacgac

SEQ ID NO: 96034 - DNA, 75 bp, Artificial Sequence
  Synthetic
tatggcggggatgtcgcaaggcgcccccgcctcggtcctaggctcacgaccatttgagccgggattgacatggca

SEQ ID NO: 96035 - DNA, 75 bp, Artificial Sequence
  Synthetic
tttgggatcgagggaatgtcacacttctgtgtgatttgcccaacggcccctgggtctggatcccggccatttgcc

SEQ ID NO: 96036 - DNA, 75 bp, Artificial Sequence
  Synthetic
cctccacttggtgaaatgccccactcccgccattgagcctcccaccgggacgtttgggttcttccccggagtccc

SEQ ID NO: 96037 - DNA, 75 bp, Artificial Sequence
  Synthetic
cccgccattgagcctcccaccgggacgtttgggttcttccccggagtccctccccttaacaactgcatgctactg

SEQ ID NO: 96038 - DNA, 75 bp, Artificial Sequence
  Synthetic
ctatgaacccctggtgcggcggtgttcagagctgatggggcgccgaaatccggtttgcccggggtttgcatggct

SEQ ID NO: 96039 - DNA, 75 bp, Artificial Sequence
  Synthetic
cgaagatcgatgtgtggagtttggtgcctgttggctctgccagctgcaccatagccgctctcggttcatcggatc

SEQ ID NO: 96040 - DNA, 75 bp, Artificial Sequence
  Synthetic
aggtggatgcgggcaacttcatcccacccccacgctggttgctcttggatttcgtgtttgtcctgttatatctga

SEQ ID NO: 96041 - DNA, 75 bp, Artificial Sequence
  Synthetic
acccccacgctggttgctcttggatttcgtgtttgtcctgttatatctgatgaagctggcggaggcacggctggt

SEQ ID NO: 96042 - DNA, 75 bp, Artificial Sequence
  Synthetic
tagggctgccggctgttggcgccgctgtagcgggggaggtgtttgcgggcccggctttgtcctggtgcttgggcc

SEQ ID NO: 96043 - DNA, 75 bp, Artificial Sequence
  Synthetic
tgtagcgggggaggtgtttgcgggcccggctttgtcctggtgcttgggcctgcccttcgtgagtatgatactggg

SEQ ID NO: 96044 - DNA, 75 bp, Artificial Sequence
  Synthetic
tgttcctcgttttgtggaagctcgctcggggagcttttccgcttgcccttctgatgggtatttcggcaacccgtg

SEQ ID NO: 96045 - DNA, 75 bp, Artificial Sequence
  Synthetic
gggcacggaagtgtccgaggcactgggcggtgcggggctaacaggggggttctacgagcccctggtgcggcggtg

SEQ ID NO: 96046 - DNA, 75 bp, Artificial Sequence
  Synthetic
ctgatgggtatttcggcaacccgtggccgcacctctgtgctcggagctgagttttgctttgacgtcacctttgaa

SEQ ID NO: 96047 - DNA, 75 bp, Artificial Sequence
  Synthetic
catacatgttcaggggcacttgcaggaagtggatgcaggcaacttcattccgcccccccgctggttgctcttgga

SEQ ID NO: 96048 - DNA, 75 bp, Artificial Sequence
  Synthetic
tgatttacaggacgtggtgcaaggggtaccaggcggtgcgccagagggtggttcggagccccctcggggaggggc

SEQ ID NO: 96049 - DNA, 75 bp, Artificial Sequence
  Synthetic
gtaccaggcggtgcgccagagggtggttcggagccccctcggggaggggcgacctactaaaccgctgaccattgc

SEQ ID NO: 96050 - DNA, 75 bp, Artificial Sequence
  Synthetic
tcccgttgatacttctcctgctgtggtggtgggtgaaccagctggcggttttaggactgccggcggctcatgctg

SEQ ID NO: 96051 - DNA, 75 bp, Artificial Sequence
  Synthetic
tggcgctggttctcctctttggcctgttcgacgcgttggactgggctttggaggagctgctggtgtcccggccct

SEQ ID NO: 96052 - DNA, 75 bp, Artificial Sequence
  Synthetic
gttcgacgcgttggactgggctttggaggagctgctggtgtcccggccctcattgcggcgcctagcacgggtggt

SEQ ID NO: 96053 - DNA, 75 bp, Artificial Sequence
  Synthetic
ccaagatgtgtgcgaagggggcctatttgttcgaccatatgggctctttctcgcgcgctgtcaaggaacgcttgc

SEQ ID NO: 96054 - DNA, 75 bp, Artificial Sequence
  Synthetic
gctgtcattcactaggacggactgtcgcatcatacgggacgccgctaggactcttagctgtggccagtgcgtcat

SEQ ID NO: 96055 - DNA, 75 bp, Artificial Sequence
  Synthetic
agtggacacgtcagttttgggatgggtggtggccagcgtgatagcctgggccattgcgctcctgagctccatgag

SEQ ID NO: 96056 - DNA, 75 bp, Artificial Sequence
  Synthetic
tccaggatgtgaaccatttgcctcccgggtttgtccccaccgcgccagtagtcatccgtcggtgcggcaagggct

SEQ ID NO: 96057 - DNA, 75 bp, Artificial Sequence
  Synthetic
ggtaccagtggttgcgtcacgaagtggtgcggacccccctcggggaggggcggcccaccaagccgttgaccatcg

SEQ ID NO: 96058 - DNA, 75 bp, Artificial Sequence
  Synthetic
cgggtttgtccccaccgcgccagtagtcatccgtcggtgcggcaagggctttctcggagtgacgaaggcggcctt

SEQ ID NO: 96059 - DNA, 75 bp, Artificial Sequence
  Synthetic
cggcccaccaagccgttgaccatcgcttggtgctttgcttcctacatctggcccgaagccgtgatgctggtggtt

SEQ ID NO: 96060 - DNA, 75 bp, Artificial Sequence
  Synthetic
cagctacctctcggagcatgggaacgtgcctgaatggcttgctgttcacgactttccatggggcttcatcccgaa

SEQ ID NO: 96061 - DNA, 75 bp, Artificial Sequence
  Synthetic
ggaggagatcttggtgtcccggccctcgttgcggcgtttggctcgggtggttgagtgctgtgtgatggcgggtga

SEQ ID NO: 96062 - DNA, 75 bp, Artificial Sequence
  Synthetic
ttgagtgctgtgtgatggcgggtgagaaggccacaaccgtccggctggtctccaagatgtgtgcgcgtggggcct

SEQ ID NO: 96063 - DNA, 75 bp, Artificial Sequence
  Synthetic
gacgacgtcacggtgtacccccttccagacggggcaacctcgttgacgccctgcacttgccaggcagagtcctgt

SEQ ID NO: 96064 - DNA, 75 bp, Artificial Sequence
  Synthetic
ctgcattgggacgcggccttggaacccctgtctttcaccaggacggactgtcgcatcatcagagatgctgctcgg

SEQ ID NO: 96065 - DNA, 75 bp, Artificial Sequence
  Synthetic
taaggtagaactggatgtggccatggaggtcgctgacttccgtgggtcatctgggtcgcctgtcctttgcgacga

SEQ ID NO: 96066 - DNA, 75 bp, Artificial Sequence
  Synthetic
ccctgtctttcaccaggacggactgtcgcatcatcagagatgctgctcggacctttgtctgcggtcagtgtgtca

SEQ ID NO: 96067 - DNA, 75 bp, Artificial Sequence
  Synthetic
gaggtcgctgacttccgtgggtcatctgggtcgcctgtcctttgcgacgagggacacgcagtaggaatgctcgtg

SEQ ID NO: 96068 - DNA, 75 bp, Artificial Sequence
  Synthetic
gtggacccaagtcccaacagatgctaaaaccaccactgaacccccgccggtgccggcaaaaggagtcttcaaaga

SEQ ID NO: 96069 - DNA, 75 bp, Artificial Sequence
  Synthetic
aaaaccaccactgaacccccgccggtgccggcaaaaggagtcttcaaagaggccccacttttcatgcccacggga

SEQ ID NO: 96070 - DNA, 75 bp, Artificial Sequence
  Synthetic
ttccttggtgtcactaaggctgccttgacgggtcgggatcctgacttacatccagggaacgtcatggtgttgggg

SEQ ID NO: 96071 - DNA, 75 bp, Artificial Sequence
  Synthetic
ggtcctgattttgaatccgtccgtggctacggtgcgtgctatgggcccctacatggagcgcctggctggaaaaca

SEQ ID NO: 96072 - DNA, 75 bp, Artificial Sequence
  Synthetic
gactttccatggggcttcatcccgaaccatcgccacacctgtaggagcctcaaatccaaggtggtggtccgccga

SEQ ID NO: 96073 - DNA, 75 bp, Artificial Sequence
  Synthetic
gctacggtgcgtgctatgggcccctacatggagcgcctggctggaaaacacccaagcatctactgcggacatgac

SEQ ID NO: 96074 - DNA, 75 bp, Artificial Sequence
  Synthetic
cgggaggttcttggccaaccctaggcagatgctgcggggggtctccgttgtaatctgcgatgagtgccacagcca

SEQ ID NO: 96075 - DNA, 75 bp, Artificial Sequence
  Synthetic
cttgcacttgccaggctgagtcctgttgggtcatgagatccgacggggccctatgccatggcttgagcaaggggg

SEQ ID NO: 96076 - DNA, 75 bp, Artificial Sequence
  Synthetic
gggcgggtccgggaattggcacgcggctgtggggtgcaacttgtgctctacgccacggccactcccccgggctcg

SEQ ID NO: 96077 - DNA, 75 bp, Artificial Sequence
  Synthetic
cgtggacccaagtcccaacagacgccaagactaccactgagtccccaccggttccggcaaaaggagtgttcaagg

SEQ ID NO: 96078 - DNA, 75 bp, Artificial Sequence
  Synthetic
ccatagcctattataggggcaaggactcttcaataatcaaggatggtgacctagtggtctgcgctacagacgcgc

SEQ ID NO: 96079 - DNA, 75 bp, Artificial Sequence
  Synthetic
tacatggaacgcttggcggggaaacatccaagcatttactgtgggcacgatacaacagcattcactaggatcacc

SEQ ID NO: 96080 - DNA, 75 bp, Artificial Sequence
  Synthetic
gtggtggaggaggtcgtcgaggtgacccttgatcccaccattaccatctccttgcgaacggtccctgcgtcggct

SEQ ID NO: 96081 - DNA, 75 bp, Artificial Sequence
  Synthetic
cccttgatcccaccattaccatctccttgcgaacggtccctgcgtcggctgaactgtcgatgcagcggagaggac

SEQ ID NO: 96082 - DNA, 75 bp, Artificial Sequence
  Synthetic
cttgcgaacggtccctgcgtcggctgaactgtcgatgcagcggagaggacgcacgggccgagggcggtccggacg

SEQ ID NO: 96083 - DNA, 75 bp, Artificial Sequence
  Synthetic
gcagatgctgaggggagtttcggtggtcatttgtgatgagtgccacagtcatgactcaactgtgttgctggggat

SEQ ID NO: 96084 - DNA, 75 bp, Artificial Sequence
  Synthetic
aggacgggttagggaattggcacgtggctgtggggtccaactggtcctctacgccaccgccacaccccctggctc

SEQ ID NO: 96085 - DNA, 75 bp, Artificial Sequence
  Synthetic
gtggggcaacgatttgccatcaaaagtggccggccaccacatagtagacgacctggtccggcgccttggtgtggc

SEQ ID NO: 96086 - DNA, 75 bp, Artificial Sequence
  Synthetic
tgaactgtcgatgcagcggcgaggtcgcacgggcaggggccggtctggtcggtactactacgctggtgtagggaa

SEQ ID NO: 96087 - DNA, 75 bp, Artificial Sequence
  Synthetic
ccatcgcgggcggcatgatctacgcgtcttacaccgggtctctagtggtggtaacagactgggatgtgaagggag

SEQ ID NO: 96088 - DNA, 75 bp, Artificial Sequence
  Synthetic
ggtggggcaatgatttaccatcaaaagtggccggccaccacattgtggacgatctggtcagaagactcggtgtgg

SEQ ID NO: 96089 - DNA, 75 bp, Artificial Sequence
  Synthetic
cacggagcccgccgttggcagcggctgcgtcctatctgatgggattgggcgtcggaggcaacgctcaggcccgct

SEQ ID NO: 96090 - DNA, 75 bp, Artificial Sequence
  Synthetic
cgctggaaccgctctgggcacgccggtcgtggggttaaccatggccggcgcgttcatgggtggggccagcgtgtc

SEQ ID NO: 96091 - DNA, 75 bp, Artificial Sequence
  Synthetic
taaaatttactcaacaggacatgggacacgggtcacagctataaatacccgtgtcccccctactcacatgtcaga

SEQ ID NO: 96092 - DNA, 75 bp, Artificial Sequence
  Synthetic
gaatcctgaggcggcattgcaattatggcttatggttctcgctaccgaggttatcggcgtcgccgacgcatgttc

SEQ ID NO: 96093 - DNA, 75 bp, Artificial Sequence
  Synthetic
tcccgttcacgtgctagacgtggtaatggtcgtcggtattcccgagctccgcggagacgtgtctatcggcgtcgc

SEQ ID NO: 96094 - DNA, 75 bp, Artificial Sequence
  Synthetic
gataagaggtttgtccgggtacgatcggaccgcacaatgagattgcgtactacgaatgatgaggcctatctcaac

SEQ ID NO: 96095 - DNA, 75 bp, Artificial Sequence
  Synthetic
tatgccccctgtcgttattacggaaggtggctttgcaggcactcctggcgtcccttatcgaatgactggtcagct

SEQ ID NO: 96096 - DNA, 75 bp, Artificial Sequence
  Synthetic
ggagtacacgtttgcgttctgtccctcggctcgtgactctcaccgcactacggcaactgacttccctgtgggtca

SEQ ID NO: 96097 - DNA, 75 bp, Artificial Sequence
  Synthetic
gcggggtatgtatcagaggtcgttgactgacgtctacgcccgtggatacaaggaaattgtctcgcttgcgtcgaa

SEQ ID NO: 96098 - DNA, 75 bp, Artificial Sequence
  Synthetic
tagtggagcgaactggctatggagaaggctggttgtcagcctgaagaatccaatttggaagctcttccctagttt

SEQ ID NO: 96099 - DNA, 75 bp, Artificial Sequence
  Synthetic
gactgtacagcgcgaaattcctcttgacagtgaccgggcatccggtcaggtccgaacgatgtacaacatcggtcc

SEQ ID NO: 96100 - DNA, 75 bp, Artificial Sequence
  Synthetic
gacagtgaccgggcatccggtcaggtccgaacgatgtacaacatcggtcctacccctgaaggtgagaccgaattg

SEQ ID NO: 96101 - DNA, 75 bp, Artificial Sequence
  Synthetic
gcgcaggatgtatatcgcgtcattttcgagggaacgcttgatctcgactggcataatgtgtttaatgccaaaccg

SEQ ID NO: 96102 - DNA, 75 bp, Artificial Sequence
  Synthetic
tcgagggaacgcttgatctcgactggcataatgtgtttaatgccaaaccggataagaggtttgtccgggtacgat

SEQ ID NO: 96103 - DNA, 75 bp, Artificial Sequence
  Synthetic
gacagtgaccgggcgtccggtcaggtccgaacgatgtacaacatcggtcctacccctgaaggtgagactgaattg

SEQ ID NO: 96104 - DNA, 75 bp, Artificial Sequence
  Synthetic
gataagaggtttgtccgggtacgatcagatcgtacaatgagattgcgtactacgaatgatgaggcctatctcaat

SEQ ID NO: 96105 - DNA, 75 bp, Artificial Sequence
  Synthetic
aactatcagttttgggatggtgtcaatgcgaacatgcactataacgaaaaagagtcggggtctgatatcaaaatg

SEQ ID NO: 96106 - DNA, 75 bp, Artificial Sequence
  Synthetic
atgcgaacatgcactataacgaaaaagagtcggggtctgatatcaaaatggacccggatttggagtccaatgaaa

SEQ ID NO: 96107 - DNA, 75 bp, Artificial Sequence
  Synthetic
agagtcggggtctgatatcaaaatggacccggatttggagtccaatgaaaatactctgtcgaagttttcagctga

SEQ ID NO: 96108 - DNA, 75 bp, Artificial Sequence
  Synthetic
atactctgtcgaagttttcggctgagggtctgtcgggtgctggagatctgtgggtgtttgatttcttctcctgcg

SEQ ID NO: 96109 - DNA, 75 bp, Artificial Sequence
  Synthetic
atactctgtcgaagttttcagctgaaggtctgtcgggtgctggagatctgtgggtgtttgatttcttctcctgcg

SEQ ID NO: 96110 - DNA, 75 bp, Artificial Sequence
  Synthetic
gtagcaaagacgctgcggatgagcttaggtttcagcctaatgggactttcttttggcacgaaagatagttattca

SEQ ID NO: 96111 - DNA, 75 bp, Artificial Sequence
  Synthetic
atttcccaagctatgggtgtgtctacataaataaacaaacaattcgcgtttaaccaatcataatctgctccgtgt

SEQ ID NO: 96112 - DNA, 75 bp, Artificial Sequence
  Synthetic
tcctctcgtggatccttgttagatatccatatggcgggtcgtccccagtggacgagtttcttgcccttgtatttg

SEQ ID NO: 96113 - DNA, 75 bp, Artificial Sequence
  Synthetic
caagccgccgaaatacgcgtgagagccaaggcttcttgcccagagtgtcttgcccatcctcgatggaccatacaa

SEQ ID NO: 96114 - DNA, 75 bp, Artificial Sequence
  Synthetic
tctgtggcgtagaactgaccttgatgaccaagccaccatttgtattgtggaaagaacggaattcctccgttgagg

SEQ ID NO: 96115 - DNA, 75 bp, Artificial Sequence
  Synthetic
tcatcaaaaatcgcgtagtcgacgttgtctgtgtcttcttgcagtgaaaacaagccgccgaaatacgcgtgagag

SEQ ID NO: 96116 - DNA, 75 bp, Artificial Sequence
  Synthetic
cactaggctctgacctctcctcccacgacctatacacgggttaggtatcctggccgccccacgggttagggttag

SEQ ID NO: 96117 - DNA, 75 bp, Artificial Sequence
  Synthetic
caccaccccacttctgactacttccaatcggggctcgcggcttagcgagtccctggggtgattacttacgtacgt

SEQ ID NO: 96118 - DNA, 75 bp, Artificial Sequence
  Synthetic
tctcgttcacgtgctagacgtggtaatggtcgtcggtattcccgcgctccgcggagacgtgtttatcggcgtcgc

SEQ ID NO: 96119 - DNA, 75 bp, Artificial Sequence
  Synthetic
gtgcaggttgaagcgccctgtgtggccattcctcaagttcaggaaacgctgatgcatcaataaccacggagtctg

SEQ ID NO: 96120 - DNA, 75 bp, Artificial Sequence
  Synthetic
gggatctatacggctctggatcttcgcgatagcgccagtcggcatatttgctgagctgggcaaagcaggtacata

SEQ ID NO: 96121 - DNA, 75 bp, Artificial Sequence
  Synthetic
gagttcgtggatcatgtgccataagcagttcgaaaaactcctctcgacttgttgcagcgacgatatcatgccatc

SEQ ID NO: 96122 - DNA, 75 bp, Artificial Sequence
  Synthetic
gataagaggtttgtccgggtacgatctgatcgtacaatgagattacgtactacgaatgatgaggcctatctcaac

SEQ ID NO: 96123 - DNA, 75 bp, Artificial Sequence
  Synthetic
cagttgatcggacaacacgatcgctctgttctggtcgttccagtccccctgccacaatgtcaccatctttgcacg

SEQ ID NO: 96124 - DNA, 75 bp, Artificial Sequence
  Synthetic
catagtcgaagccctcacgtggtgtagagtgcgtagctgaaacatttgggtgatgattgtcgacatcaaagatgc

SEQ ID NO: 96125 - DNA, 75 bp, Artificial Sequence
  Synthetic
cgacctatacacgggttaggtatcctggccgccccacgggttagggttagggttagggttagggttagggttcgt

SEQ ID NO: 96126 - DNA, 75 bp, Artificial Sequence
  Synthetic
tggtacgacgagatctgaatttcctgccgaagtcgacaaaagcgtgtagatgagttccaccatcagcatgggctt

SEQ ID NO: 96127 - DNA, 75 bp, Artificial Sequence
  Synthetic
ctcgtgcgacgatgcattctcctcgaagttctccaaggtgatcgctaactttccaggggtcgagttccccgcact

SEQ ID NO: 96128 - DNA, 75 bp, Artificial Sequence
  Synthetic
tgagaataggtgagtaggaagtagcgggcattgcagtggaatgtcatatgactaagctgtgtcctgttgagcgta

SEQ ID NO: 96129 - DNA, 75 bp, Artificial Sequence
  Synthetic
tctcgttcgcgtgccagacgtggtaatggtcgtcggtattcccgcgctccgcggagacgtgtgtatcggcgacgc

SEQ ID NO: 96130 - DNA, 75 bp, Artificial Sequence
  Synthetic
cgaacacgtcgatcagtcctgaatgtttccactcggaaattgaaggatactatgccccctgtcgttattacggaa

SEQ ID NO: 96131 - DNA, 75 bp, Artificial Sequence
  Synthetic
ggtggctttgcaggcacccctggtgtcccctatcgaatgactggtcagctggagtacacgtttgcgttctgtccc

SEQ ID NO: 96132 - DNA, 75 bp, Artificial Sequence
  Synthetic
gataagaggtttgtccgggtacgatctgatcgcacaatgagattgcgtactacgaatgatgaggcctatctcaac

SEQ ID NO: 96133 - DNA, 75 bp, Artificial Sequence
  Synthetic
atactctgtcgaagttttcagcggaaggtctgtcgggtgctggagatttgtgggtgtttgatttcttctcctgcg

SEQ ID NO: 96134 - DNA, 75 bp, Artificial Sequence
  Synthetic
accaaacagagaatctgtgaggtacgataaaaggcggagaagcaatcgagatcgtacgggtagaaggtgtgaacc

SEQ ID NO: 96135 - DNA, 75 bp, Artificial Sequence
  Synthetic
ctatctgagggtaaggggtctaaacaacatcgtcctatacatgaatgacttatataagaacatgccagggatcct

SEQ ID NO: 96136 - DNA, 75 bp, Artificial Sequence
  Synthetic
ccgagcgcgaggccgaagctcgaacctgagggaaccttctaccgatatgtcgtctgttttcgacgaatacgagca

SEQ ID NO: 96137 - DNA, 75 bp, Artificial Sequence
  Synthetic
actctccaatattgcggccacgatatcccaccccatcattcactcaaggttgaatgcagtaggcctaattaacta

SEQ ID NO: 96138 - DNA, 75 bp, Artificial Sequence
  Synthetic
gctcctcgctgctcagacccgccctaacggaactcatggagggggagagaaagggagcactttaaaagttgaggt

SEQ ID NO: 96139 - DNA, 75 bp, Artificial Sequence
  Synthetic
tgacgggtcacaccagcttgcagatatagacttcgttgaggtgtctgcgaaattgttagtctcttgcactcgacg

SEQ ID NO: 96140 - DNA, 75 bp, Artificial Sequence
  Synthetic
cccagtatttaccctaaacagtgatgatccagaggatagatggaattttgcggtattctgtcttcggattgctgt

SEQ ID NO: 96141 - DNA, 75 bp, Artificial Sequence
  Synthetic
gcgggtctcaggcttatatgcagggaataagtacgatctgctgtttccatctgtcttagatgataacctgaatga

SEQ ID NO: 96142 - DNA, 75 bp, Artificial Sequence
  Synthetic
tagcgaggatgccaacaaaccactcaggcaaggtgctcttatatccctcttatgctcccattctcaggtgatgag

SEQ ID NO: 96143 - DNA, 75 bp, Artificial Sequence
  Synthetic
gaagatgcttcaactgatttcccggttatgctgtctgtacacagtgctctttgctacaacaagagaaatcccaaa

SEQ ID NO: 96144 - DNA, 75 bp, Artificial Sequence
  Synthetic
aaaccatgttgcccttgcagggaaacagaatgaggccacactggctgttcttgagatcgatggctttgctaacag

SEQ ID NO: 96145 - DNA, 75 bp, Artificial Sequence
  Synthetic
aataaggggcctatcggcagaagagaaatgctcaatactcactgagtatctactgtcagatgctgtaaaaccatt

SEQ ID NO: 96146 - DNA, 75 bp, Artificial Sequence
  Synthetic
tgtgccccagttcaacaataggagtggagtgtctgaggagagagcacagagattcatggtaatcgcaggatctct

SEQ ID NO: 96147 - DNA, 75 bp, Artificial Sequence
  Synthetic
gcttaggcccgaacaagtgagttctatcatgtctcccaacataatcacgttcccagccaatctatattacatgtc

SEQ ID NO: 96148 - DNA, 75 bp, Artificial Sequence
  Synthetic
ccctcgggcatgcagcaacggtactccgtttgtcacggctggggttgaagatgatgcaccagaagatatcactga

SEQ ID NO: 96149 - DNA, 75 bp, Artificial Sequence
  Synthetic
taggaagagccttaatttgatcagagaacgagaggacaaagatactatcttgtcattgttgttccctcaggaacc

SEQ ID NO: 96150 - DNA, 75 bp, Artificial Sequence
  Synthetic
cactctggaaagaatcctatctatccaagttcaggtatgggtcacagtagcaaaggccatgactgcatatgagac

SEQ ID NO: 96151 - DNA, 75 bp, Artificial Sequence
  Synthetic
actgcttgagcttcgcccagtacgagacattggtgctcgagtgaaagacccgtttacccggcaacccgcatcatt

SEQ ID NO: 96152 - DNA, 75 bp, Artificial Sequence
  Synthetic
agcagatgagtcagaaacaagaagaataaataagtatatgcagcaaggtcgagttcagaagaagtacattcttca

SEQ ID NO: 96153 - DNA, 75 bp, Artificial Sequence
  Synthetic
catacaagagctagatctgagtgccccagcaaggtacgacgcatttacactgagtaaggtttgcttcgagcatac

SEQ ID NO: 96154 - DNA, 75 bp, Artificial Sequence
  Synthetic
tcctgtatgcaggagtgcaattcaactcacaatcagacattctctggcagtccgtattttcctagtcagtgagct

SEQ ID NO: 96155 - DNA, 75 bp, Artificial Sequence
  Synthetic
attaccgaacccaaaggaagattacctagtacggtacttgttcagaggaatagggacggcttcatcttcttggta

SEQ ID NO: 96156 - DNA, 75 bp, Artificial Sequence
  Synthetic
caagaggggccgcaatacagcaggtgggagctctacatattacaacttggtcggggatgtagactcatacatcag

SEQ ID NO: 96157 - DNA, 75 bp, Artificial Sequence
  Synthetic
taaggcatctcatcttctatccgtacctgaggtcaggtgtgcaagacatgggaactccttatacttagcggaagg

SEQ ID NO: 96158 - DNA, 75 bp, Artificial Sequence
  Synthetic
gaacaccgggcttactgcatttttcctaacactcaaatatggaatcaataccaagacgtcagccctcgcactcag

SEQ ID NO: 96159 - DNA, 75 bp, Artificial Sequence
  Synthetic
aagcggagccatcatgagtcttcttgaattgcatataccacatgagactatctattacaatacacttttctcgaa

SEQ ID NO: 96160 - DNA, 75 bp, Artificial Sequence
  Synthetic
cagcctcacaggtgatatccaaaaaatgaaacagctcatgcgtttatatcggatgaaaggtgaaaatgcaccata

SEQ ID NO: 96161 - DNA, 75 bp, Artificial Sequence
  Synthetic
tgagatgaaccctccacagcgacatttcggacctacaccaacacagtttctaaactcggtcgtttataggaatct

SEQ ID NO: 96162 - DNA, 75 bp, Artificial Sequence
  Synthetic
catgacattgttaggtgacagtgaccagatgagctttgcaccagctgagtatgcacaactttattcttttgccat

SEQ ID NO: 96163 - DNA, 75 bp, Artificial Sequence
  Synthetic
acaagcggaagtgccatgtaaagatggatatgtccaggagttctgcccattatggagagagaatgcagaagaaag

SEQ ID NO: 96164 - DNA, 75 bp, Artificial Sequence
  Synthetic
gggcatggcatcagtcttagataagggaactggcaagtaccaattcgccagggactttatgagcacatcattctg

SEQ ID NO: 96165 - DNA, 75 bp, Artificial Sequence
  Synthetic
tgacctgacctcagataaggcagttggatatatcacatctgtggtaccctacaggtctgtatcattactacattg

SEQ ID NO: 96166 - DNA, 75 bp, Artificial Sequence
  Synthetic
gagacttggagtagagtatgctcaggcccagggaagtagcattaatgaggacatggctgctgagctaaaactaac

SEQ ID NO: 96167 - DNA, 75 bp, Artificial Sequence
  Synthetic
tgacattgagattcctccagggtccaatcaaagcttattagatcaactggctactaatttatccctgattgccat

SEQ ID NO: 96168 - DNA, 75 bp, Artificial Sequence
  Synthetic
cccggcagcaaggagaggcctagcagctgctgcccaacgagtatccgaagaaatcggcagcatggacattcccac

SEQ ID NO: 96169 - DNA, 75 bp, Artificial Sequence
  Synthetic
gcattctgtgagggagggcggggtagtgatcatcaaagtactgtatgcaatggggtactacttccatttactcat

SEQ ID NO: 96170 - DNA, 75 bp, Artificial Sequence
  Synthetic
tcaacaggcgggagtcctcaccgggctcagtgacgaaggcccccgaactccacagggcggatcaaacaagccgca

SEQ ID NO: 96171 - DNA, 75 bp, Artificial Sequence
  Synthetic
gaatttattcactccatgctccacgaaaggatatatactctccaatggctatgcctgtagaggggatatggagtg

SEQ ID NO: 96172 - DNA, 75 bp, Artificial Sequence
  Synthetic
agggcaaccagatgccggggatggggagacccaattcttggattttatgagagcagtggcgaacagcatgcggga

SEQ ID NO: 96173 - DNA, 75 bp, Artificial Sequence
  Synthetic
ttacctgatattcgttatgggctacttaggcgggcccaccttcgtgcacgaagtggtaaggatggcaaaaactct

SEQ ID NO: 96174 - DNA, 75 bp, Artificial Sequence
  Synthetic
agcgccaaatcctgcacagagcaccacccatccagaacctcctccaacccctggggcatcccaagacaacgacac

SEQ ID NO: 96175 - DNA, 75 bp, Artificial Sequence
  Synthetic
aatacaacgacacggtacacttctatctaaatcagatgaaattacattgactaggctatttacctcacagcagcg

SEQ ID NO: 96176 - DNA, 75 bp, Artificial Sequence
  Synthetic
tgactgggggtactgatcgacaacacccagcctgccttcgcaggatcacaccaaaccctccgcccaaaaccctcc

SEQ ID NO: 96177 - DNA, 75 bp, Artificial Sequence
  Synthetic
tcgtgtaacagatatcctatccagccctttaccgaagctaatgaagctcttgagagaaaatattgatgctgcact

SEQ ID NO: 96178 - DNA, 75 bp, Artificial Sequence
  Synthetic
cacactccccgacccacaaccccgcacgaccacaccaacaaaagctcccccccaccctctcccccactcccagcc

SEQ ID NO: 96179 - DNA, 75 bp, Artificial Sequence
  Synthetic
aattgaagccgggggacagcccgtccgtccattctgtgcggaaagtttggtgagcacactaacagatatgacccg

SEQ ID NO: 96180 - DNA, 75 bp, Artificial Sequence
  Synthetic
acacgatcccacccacccgggacaacacaggcacagctcggttcgtcgacaatctgcccagagcccaaggtatta

SEQ ID NO: 96181 - DNA, 75 bp, Artificial Sequence
  Synthetic
gacaactcagatcattgccagccacattgacacagtcattcggtctgtaatttacatggaggctgagggtgacct

SEQ ID NO: 96182 - DNA, 75 bp, Artificial Sequence
  Synthetic
gaaaaaaatacgggtagaagagagacatccagagaccaggacgagtcaccaagttctctgttctcccttctaccc

SEQ ID NO: 96183 - DNA, 75 bp, Artificial Sequence
  Synthetic
cgccgacacagtgttcttatttactccttacaatctatccacagacggtaaaaagagaacatcacttaagcagtg

SEQ ID NO: 96184 - DNA, 75 bp, Artificial Sequence
  Synthetic
agtgaattagggtgaagatggccacttttacagatgcggagatagatgacatatttgagaccagtgggactgtca

SEQ ID NO: 96185 - DNA, 75 bp, Artificial Sequence
  Synthetic
caccaaacagatcttggaagtcacaatactgggtctcagagccaaagatatcaataaagtaggtgatgtaatcag

SEQ ID NO: 96186 - DNA, 75 bp, Artificial Sequence
  Synthetic
ttgacagcataattacggcccagggcaaatcagctgagaccgtcggaagaagcgcgatcccgcagggcaagacca

SEQ ID NO: 96187 - DNA, 75 bp, Artificial Sequence
  Synthetic
tttagtactcagaggtgcggtttccctagaggacctcatcccattaaggacatacctaaagcgcagtacctgccc

SEQ ID NO: 96188 - DNA, 75 bp, Artificial Sequence
  Synthetic
aagctctaagcacagcatgggagaagcacggaaatgtccagccacacgccagtcaggacgcccctgaccaacaag

SEQ ID NO: 96189 - DNA, 75 bp, Artificial Sequence
  Synthetic
taaatacctgaaagcggtcctaggtattactaaactcaaagaaatgttcacagatacctcgttactgtacttgac

SEQ ID NO: 96190 - DNA, 75 bp, Artificial Sequence
  Synthetic
acagaacagaaaaacagccatccacacctgagcaggcgactctacacaacaacccgccgatcacatccactgaac

SEQ ID NO: 96191 - DNA, 75 bp, Artificial Sequence
  Synthetic
tcgtgctcaacaaaaattctacatgaaaaccataggtaatgctgccaagggatattacagtaataatgactctta

SEQ ID NO: 96192 - DNA, 75 bp, Artificial Sequence
  Synthetic
cgcctcccactcaggccgcaagcgagaccagcgacacacagctcaagaccggagcaagcaactcccttctgtcca

SEQ ID NO: 96193 - DNA, 75 bp, Artificial Sequence
  Synthetic
agggcaatcgtacgccaatcagttatcttcctaactgatgactccctcactgacttaattataccagattagaaa

SEQ ID NO: 96194 - DNA, 75 bp, Artificial Sequence
  Synthetic
tgctcgacaaactgagcaataaatcgtccaatgctaaaaagggcccatggtcgggttcccaagaagggcatcacc

SEQ ID NO: 96195 - DNA, 75 bp, Artificial Sequence
  Synthetic
aaagttaaattcctactctttagaactcgtattcggattcagttagttaactttaagcaagagtgcgcaaggtcg

SEQ ID NO: 96196 - DNA, 75 bp, Artificial Sequence
  Synthetic
aacctccggcccaacaacacgggaaccagccgagctatggaagcaaccagggaagaccgcagcatcaggccaagg

SEQ ID NO: 96197 - DNA, 75 bp, Artificial Sequence
  Synthetic
ttagttaactttaagcaagagtgcgcaaggtcgtccctaattatagttatgtcattcaccaaatctctgtttggt

SEQ ID NO: 96198 - DNA, 75 bp, Artificial Sequence
  Synthetic
ccgtccctggaaaccggggcacagacgagaacacagcatatcatggacaacggaaggagtcacaaccatcagctg

SEQ ID NO: 96199 - DNA, 75 bp, Artificial Sequence
  Synthetic
gtgcaacccctcatgcgccccagtcagggcagagccaagacaatactcctgtacctgtggatcgtgtccagctac

SEQ ID NO: 96200 - DNA, 75 bp, Artificial Sequence
  Synthetic
ctgccgactttgcgcaggcgatgatgtctatgatggaggcattatcacagaaggtaagtaaagttgatcatcagc

SEQ ID NO: 96201 - DNA, 75 bp, Artificial Sequence
  Synthetic
tggacctagtcttgaaacagacatcctccattcctatgatgcgatctgaaatccaacagctcaagacatctgttg

SEQ ID NO: 96202 - DNA, 75 bp, Artificial Sequence
  Synthetic
cgatcatggaagctaacttaggcatgatgaaaattctggaccctggttgtgctaacgtttcatccttaagtgatc

SEQ ID NO: 96203 - DNA, 75 bp, Artificial Sequence
  Synthetic
tccgggcagtagcccgatcccacccagtcctagtttcaggccccggagacccatctccttacgtgacacaagggg

SEQ ID NO: 96204 - DNA, 75 bp, Artificial Sequence
  Synthetic
gtgaaatgacgctcaataaactctcacaaccggtgcagcacccctctgaattgattaagtctgccactgcaagcg

SEQ ID NO: 96205 - DNA, 75 bp, Artificial Sequence
  Synthetic
ggcctgatatgggagtggagaaggacactgtccgcgcattaatcacctcgcgcccgatgcatccaagctcctcgg

SEQ ID NO: 96206 - DNA, 75 bp, Artificial Sequence
  Synthetic
ctaagctcctgagcaagctagatgcagccaggtcaattgaagagatcaggaagatcaaacgccttgcgctgaatg

SEQ ID NO: 96207 - DNA, 75 bp, Artificial Sequence
  Synthetic
gttgatgaccatcacaactcataacaggctcccgtcactttaacgtcacacggaatccctcgggggccccccctc

SEQ ID NO: 96208 - DNA, 75 bp, Artificial Sequence
  Synthetic
gcaaatccacgcttcaacacccaaaacaacagccctctctcaccccccccaatcccccgaatgatcgcacaactg

SEQ ID NO: 96209 - DNA, 75 bp, Artificial Sequence
  Synthetic
caaccaacccagcggcattagaaattaagaaaaaatacgggtagaatcaaagtgccttgattgcaccaaaatgga

SEQ ID NO: 96210 - DNA, 75 bp, Artificial Sequence
  Synthetic
ctcatccaggacaatcgggctgtactttgattctgccctcccttccagcagcctgttagcatttccgattgtctt

SEQ ID NO: 96211 - DNA, 75 bp, Artificial Sequence
  Synthetic
acaagacacaggagatgggaagaagcaaatcaccccacaatacaggatccagcgtcttgattcgtggacagacag

SEQ ID NO: 96212 - DNA, 75 bp, Artificial Sequence
  Synthetic
taaggaagactcggtattcatcaccacctacgggttcatctttcaaattgggaatgaagaagccaccgtcggtgt

SEQ ID NO: 96213 - DNA, 75 bp, Artificial Sequence
  Synthetic
gatcaatgacaatcccaggcacgagctactctcttccgcaatgctctgcttagggagtgtcccgaacgacggaga

SEQ ID NO: 96214 - DNA, 75 bp, Artificial Sequence
  Synthetic
tcttgttgagctggcgagagcctgcctcaccatggtggtaacttgcaagaagagtgcaactaacactgagagaat

SEQ ID NO: 96215 - DNA, 75 bp, Artificial Sequence
  Synthetic
agtcttctcagtagtgcaggcacctcgggtgctgcaaagctgtatggttgtggcaaataggtactcatcagtgaa

SEQ ID NO: 96216 - DNA, 75 bp, Artificial Sequence
  Synthetic
tgcagtgaagcatgtgaaggcgccagaaaagatccctgggagcggaaccctagagtataaagtgaattttgtctc

SEQ ID NO: 96217 - DNA, 75 bp, Artificial Sequence
  Synthetic
tttgaccgtggtgccgagaagggatgtctacaggatcccaactgcagtattgaaagtgtctggctcaagcctgta

SEQ ID NO: 96218 - DNA, 75 bp, Artificial Sequence
  Synthetic
caatcttgcgctcaatgtcactattgatgtggacgtggatccgaagagcccgttagtcaaatccctttctaaatc

SEQ ID NO: 96219 - DNA, 75 bp, Artificial Sequence
  Synthetic
cgatagcggatactatgcgaatctttttctgcatatcgggcttatgtccactgtagataagaagggaaagaaagt

SEQ ID NO: 96220 - DNA, 75 bp, Artificial Sequence
  Synthetic
gacatttgacaagatagaggaaaagataaggagactcaatctatctgtcgggctcagtgatgtgctcggaccctc

SEQ ID NO: 96221 - DNA, 75 bp, Artificial Sequence
  Synthetic
tgtgcttgtgaaggcgagaggtgcacggactaagttacttgctcctttcttctctagcagtgggacagcctgcta

SEQ ID NO: 96222 - DNA, 75 bp, Artificial Sequence
  Synthetic
tcctatagcaaatgcctctccccaggttgccaagatactctggagccaaactgcgcacctgcggagtgtgaaagt

SEQ ID NO: 96223 - DNA, 75 bp, Artificial Sequence
  Synthetic
catcattcaagccggcactcagcgtgctgtcgcagtgaccgctgatcatgaggtaacctccactaagatagagag

SEQ ID NO: 96224 - DNA, 75 bp, Artificial Sequence
  Synthetic
gaggcatgccattgctaaatacaatcctttcaggaaataagttgcatccctaagactgcaatccacctgctttcc

SEQ ID NO: 96225 - DNA, 75 bp, Artificial Sequence
  Synthetic
cgaatcaccatgacaccagacaatgatccatctcgactgcttatagttagttcacctgtctagcaaattagaaaa

SEQ ID NO: 96226 - DNA, 75 bp, Artificial Sequence
  Synthetic
aacacgggtagaagagtctggatcccgaccggcacattcaggactcaatatgggctccaaaccttctaccaggat

SEQ ID NO: 96227 - DNA, 75 bp, Artificial Sequence
  Synthetic
cccagcacctcttatgctgatcacccggattatgctgatattgggctgtatccgtccgacaagctctcttgacgg

SEQ ID NO: 96228 - DNA, 75 bp, Artificial Sequence
  Synthetic
caggcctcttgcagctgcgggaattgtagtaacaggagataaggcagtcaatgtatatacctcgtctcagacagg

SEQ ID NO: 96229 - DNA, 75 bp, Artificial Sequence
  Synthetic
gtcaatcatagtcaagttgctcccgaatatgcccagggataaggaggcgtgtgcgaaagccccattagaggcata

SEQ ID NO: 96230 - DNA, 75 bp, Artificial Sequence
  Synthetic
taacagaacactgactactttgctcactcctcttggcgactccatccgcaagattcaagggtctgtgtccacgtc

SEQ ID NO: 96231 - DNA, 75 bp, Artificial Sequence
  Synthetic
tggaggaaggagacaaaaacgctttataggtgctgttattggcagtgtagctcttggggttgcaacagcggcaca

SEQ ID NO: 96232 - DNA, 75 bp, Artificial Sequence
  Synthetic
gataacagcagctgcggccctaatacaagccaaccagaatgccgccaacatcctccggcttaaggagagcattgc

SEQ ID NO: 96233 - DNA, 75 bp, Artificial Sequence
  Synthetic
tgcaaccaatgaagctgtgcatgaagtcaccgatggattatcacaactatcagtggcagttgggaagatgcagca

SEQ ID NO: 96234 - DNA, 75 bp, Artificial Sequence
  Synthetic
gtttgtcaatgaccagtttaataatacggcgcgagaactggactgtataaaaatcacacaacaggttggtgtaga

SEQ ID NO: 96235 - DNA, 75 bp, Artificial Sequence
  Synthetic
actcaacctatacctaactgaattgactacagtattcgggccacagatcacctcccctgcattaactcagctgac

SEQ ID NO: 96236 - DNA, 75 bp, Artificial Sequence
  Synthetic
catccaggcactttataatttagctggtggcaatatggattacttattaactaagttaggtatagggaacaatca

SEQ ID NO: 96237 - DNA, 75 bp, Artificial Sequence
  Synthetic
actcagctcattaattggtagcggcctgatcactggttaccctatactgtatgactcacagactcaactcttggg

SEQ ID NO: 96238 - DNA, 75 bp, Artificial Sequence
  Synthetic
catacaagtgaatttgccctcagtcgggaacttaaataatatgcgtgccacctatttggagaccttatctgtaag

SEQ ID NO: 96239 - DNA, 75 bp, Artificial Sequence
  Synthetic
tacaaccaaaggatatgcctcagcacttgtcccgaaagtagtgacacaaattggttctgtgatagaagagcttga

SEQ ID NO: 96240 - DNA, 75 bp, Artificial Sequence
  Synthetic
cacctcatactgtatagagtctgatctggatttatattgtactagaatagtgacattccccatgtccccaggtat

SEQ ID NO: 96241 - DNA, 75 bp, Artificial Sequence
  Synthetic
ttattcctgtttgagcggcaacacatcagcttgcatgtattcaaagactgaaggcgcactcactacgccgtatat

SEQ ID NO: 96242 - DNA, 75 bp, Artificial Sequence
  Synthetic
ggcccttaaaggctcagttattgccaattgtaagataacaacatgtagatgtacagaccctcctggtatcatatc

SEQ ID NO: 96243 - DNA, 75 bp, Artificial Sequence
  Synthetic
gcaaaattatggagaagctgtatccctgatagatagacattcgtgcaatgtcttatcattagacgggataactct

SEQ ID NO: 96244 - DNA, 75 bp, Artificial Sequence
  Synthetic
gaggctcagtggggaatttgatgcaacttatcaaaagaacatctcaatactagagtctcaagtcatcgtgacagg

SEQ ID NO: 96245 - DNA, 75 bp, Artificial Sequence
  Synthetic
caatcttgatatatcaactgaacttggaaacgtcaacaattcaatcagcaatgccttggataggttggcagaaag

SEQ ID NO: 96246 - DNA, 75 bp, Artificial Sequence
  Synthetic
caacagcaagctagaaaaagtcaatgtcagactaaccagcacatctgctctcattacctatattgttctaactgt

SEQ ID NO: 96247 - DNA, 75 bp, Artificial Sequence
  Synthetic
catttctctagttttcggtgcactcagtctgggtttagcgtgttacctgatgtacaaacagaaggcacaacaaaa

SEQ ID NO: 96248 - DNA, 75 bp, Artificial Sequence
  Synthetic
gaccttgctatggcttgggaataataccctcgatcagatgagagccactacaagagcatgaatgcagataagagg

SEQ ID NO: 96249 - DNA, 75 bp, Artificial Sequence
  Synthetic
tggatatatacccaacaacagcctgtgtgtcaattccgataacctgtcaagtagaagacttaagaaaaaactatt

SEQ ID NO: 96250 - DNA, 75 bp, Artificial Sequence
  Synthetic
gggaacaggcaaccaaagagcaatacacgggtagaacggtcagaggagccacccttcaatcggaaattaggcttc

SEQ ID NO: 96251 - DNA, 75 bp, Artificial Sequence
  Synthetic
ataacatccgttctaccacatcaccaacaacaagagtcaatcatggaccgcgcggtcaatagagtcgtgctggag

SEQ ID NO: 96252 - DNA, 75 bp, Artificial Sequence
  Synthetic
aatgaggaaagagaagcaaagaacacatggcgcctggttttccggatcgcagtcttacttttaatggtaatgact

SEQ ID NO: 96253 - DNA, 75 bp, Artificial Sequence
  Synthetic
ctagctatctccgcagctgccctggcatacagcacgggggccagtacgccgcacgacctcgcaggcatatcgact

SEQ ID NO: 96254 - DNA, 75 bp, Artificial Sequence
  Synthetic
gtgatctccaagacagaagataaggttacgtctttactcagttcgaggcaagatgtgatagataggatatacaag

SEQ ID NO: 96255 - DNA, 75 bp, Artificial Sequence
  Synthetic
caggtggctcttgaatccccgctggcgctactaaacactgaatctataattatgaatgcaataccctctctttct

SEQ ID NO: 96256 - DNA, 75 bp, Artificial Sequence
  Synthetic
tatcaaattaacggggctgcgaacaatagcggatgtggggcgcctgttcatgacccagattatatcggggggata

SEQ ID NO: 96257 - DNA, 75 bp, Artificial Sequence
  Synthetic
ggcaaagaactcatagtgggcgacatcagtgatgtcacatcattttatccttctgcatatcaagaacacttgaat

SEQ ID NO: 96258 - DNA, 75 bp, Artificial Sequence
  Synthetic
ttcatcccggcgcctactacaggatccggttgcactcggataccctcatttgacatgagcaccacccattattgt

SEQ ID NO: 96259 - DNA, 75 bp, Artificial Sequence
  Synthetic
tatactcacaatgtgatactatccggttgcagagatcactcacactcacatcaatacttagcacttggtgtgctt

SEQ ID NO: 96260 - DNA, 75 bp, Artificial Sequence
  Synthetic
cggacatctgcaacagggagggtattcttttctactctgcgctccatcaatttagatgacacccaaaatcggaag

SEQ ID NO: 96261 - DNA, 75 bp, Artificial Sequence
  Synthetic
tcctgcagtgtgagtgcaacccctttaggttgtgatatgctgtgctctaaggtcacagggactgaagaggaggat

SEQ ID NO: 96262 - DNA, 75 bp, Artificial Sequence
  Synthetic
tacaagtcagttgcccccacatcaatggtgcacggaaggctagggtttgacggtcaataccatgagaaggactta

SEQ ID NO: 96263 - DNA, 75 bp, Artificial Sequence
  Synthetic
gacaccacggtcttatttaaggattgggtggcaaattacccaggagcgggaggagggtcttttattgacgaccgt

SEQ ID NO: 96264 - DNA, 75 bp, Artificial Sequence
  Synthetic
gtatggttcccagtttacggagggctcaaacccaattcacccagtgacactgcacaagaagggaaatatgtaata

SEQ ID NO: 96265 - DNA, 75 bp, Artificial Sequence
  Synthetic
tacaagcgccataacaacacatgccccgatgaacaagattaccaaattcggatggctaagttttcatataaaccc

SEQ ID NO: 96266 - DNA, 75 bp, Artificial Sequence
  Synthetic
gggcgatttggtggaaagcgcgtacagcaagccatcttatccatcaaagtgtcaacatccttgggtaaggacccg

SEQ ID NO: 96267 - DNA, 75 bp, Artificial Sequence
  Synthetic
gtgctgactattccacctaatacaatcacactcatgggagccgaaggcagaatcctcacagtagggacatctcac

SEQ ID NO: 96268 - DNA, 75 bp, Artificial Sequence
  Synthetic
ttcttgtaccaacgagggtcttcatatttctcccctgccttattatatcccatgacagtaaataacaaaacggct

SEQ ID NO: 96269 - DNA, 75 bp, Artificial Sequence
  Synthetic
acactccatagtccttatacgtttaatgctttcactcggccaggtagtgtcccttgccaggcatcagcaagatgc

SEQ ID NO: 96270 - DNA, 75 bp, Artificial Sequence
  Synthetic
cccaactcatgcatcactggggtctatactgatccatatcccttaatcttccataggaatcatactctacgaggg

SEQ ID NO: 96271 - DNA, 75 bp, Artificial Sequence
  Synthetic
gtcttcgggacgatgcttgatgatgagcaagcgagacttaaccccgtatctgcagtattcgacaacatatcccgt

SEQ ID NO: 96272 - DNA, 75 bp, Artificial Sequence
  Synthetic
agtcgtgtcactcgggtgagttcaagcagcaccaaggcagcatacacgacatcgacatgttttaaagttgtcaag

SEQ ID NO: 96273 - DNA, 75 bp, Artificial Sequence
  Synthetic
accaataaagcttattgtcttagtattgcagaaatatccaataccctattcggggaatttaggatcgttccctta

SEQ ID NO: 96274 - DNA, 75 bp, Artificial Sequence
  Synthetic
ttagttgagatcctcaaggataatagagtttaagaagctagacttggccgattgaaccaagtataggatggttgg

SEQ ID NO: 96275 - DNA, 75 bp, Artificial Sequence
  Synthetic
gaagacgacaccgcaccaatcatctcccacaatgcttagagtcaagctgaatattaacataagccaggatcccat

SEQ ID NO: 96276 - DNA, 75 bp, Artificial Sequence
  Synthetic
gttgttgggcagccacaatccgacaatgctgacatgattattctgagtccctcccactatcactttattaagaaa

SEQ ID NO: 96277 - DNA, 75 bp, Artificial Sequence
  Synthetic
aaatacaaaaagcattgagatataagggaaaacaaccaacaggagggaacacgggtaggacatggcgggctccgg

SEQ ID NO: 96278 - DNA, 75 bp, Artificial Sequence
  Synthetic
tcctgaaagggcagagcaccagatcatcctaccagagtcacatctatcctctccattggtcaagcacaaattgct

SEQ ID NO: 96279 - DNA, 75 bp, Artificial Sequence
  Synthetic
atactactggaaattgactgggctaccgcttcctgatgaatgcgactttgatcatctcattatcagcaggcaatg

SEQ ID NO: 96280 - DNA, 75 bp, Artificial Sequence
  Synthetic
gaagaaaatactggagtcggccactcctgacacagagagaatgataaaactcgggcgggcagtgcaccagactct

SEQ ID NO: 96281 - DNA, 75 bp, Artificial Sequence
  Synthetic
caaccacaattccaagataactggagtgctccatcccaggtgtttagaagaactggctagtattgaggtcccaga

SEQ ID NO: 96282 - DNA, 75 bp, Artificial Sequence
  Synthetic
ttcaactaacaaattccggaagattgaaaagaagatccagattcacaacacaaggtatggagacctgttcacaaa

SEQ ID NO: 96283 - DNA, 75 bp, Artificial Sequence
  Synthetic
gctgtgcacgcatgttgagaagaaattgctaggatcatcccggtctaataatgtcccacgatcagaggaattcag

SEQ ID NO: 96284 - DNA, 75 bp, Artificial Sequence
  Synthetic
tagcatccgtacagatccggcattctggtttcactcaaaatggtccagagccaagttcgcgtggctccatataaa

SEQ ID NO: 96285 - DNA, 75 bp, Artificial Sequence
  Synthetic
acaagtccaaaggcatctgattgtagcagcaaggacacggtctgcagtcaacaagttagtaacattaagtcataa

SEQ ID NO: 96286 - DNA, 75 bp, Artificial Sequence
  Synthetic
gataggccacgtctttgttactcctgagcttgtcattgtgacacatacagatgagaacaaattcacatgcctcac

SEQ ID NO: 96287 - DNA, 75 bp, Artificial Sequence
  Synthetic
ccaggaacttgtattgatgtatgcggatatgatggaaggcagggacatggtcaatataatatcttctacagcagc

SEQ ID NO: 96288 - DNA, 75 bp, Artificial Sequence
  Synthetic
acatcttagaaacctatccgagaaaattgatgatattctgcgattagtagatgccctggcaaaggacttaggtaa

SEQ ID NO: 96289 - DNA, 75 bp, Artificial Sequence
  Synthetic
tcaagtctatgatgttgtagcattaatggagggattcgcatacggtgccgttcagctgcttgagccatcaggtac

SEQ ID NO: 96290 - DNA, 75 bp, Artificial Sequence
  Synthetic
atttgcaggagatttctttgcatttaacctacaggagctcaaagacactttaatcgaacttctcccaaataatat

SEQ ID NO: 96291 - DNA, 75 bp, Artificial Sequence
  Synthetic
agcggaatcagtaactcacgctattgccactgtattctccggcttagagcagaatcaagcagctgagatgttgtg

SEQ ID NO: 96292 - DNA, 75 bp, Artificial Sequence
  Synthetic
cttgctacgtttgtggggtcatccattgcttgagtctcgtagtgcagcaagagcagtcaggagccagatgtgcgc

SEQ ID NO: 96293 - DNA, 75 bp, Artificial Sequence
  Synthetic
accaaagatggtagacttcgatatgatcctccaggtattatctttctttaaaggaacaatcatcaatggatacag

SEQ ID NO: 96294 - DNA, 75 bp, Artificial Sequence
  Synthetic
aaagaagaactcaggtgtgtggccgcgtgtcaaagtagatacaatatacgggaatatcattgggcagctacatgc

SEQ ID NO: 96295 - DNA, 75 bp, Artificial Sequence
  Synthetic
tgattcagcagagatctcacatgatgtcatgttgagggagtacaagagtttatctgctcttgaatttgagccatg

SEQ ID NO: 96296 - DNA, 75 bp, Artificial Sequence
  Synthetic
tatagattatgaccctgttaccaatctaagcatgttcctaaaagacaaggcaatcgcacatcctagtgataattg

SEQ ID NO: 96297 - DNA, 75 bp, Artificial Sequence
  Synthetic
gctcgcctcatttaggcggaacctactctctgaagaccagaagaaacagataaaagaggcaacttcaactaaccg

SEQ ID NO: 96298 - DNA, 75 bp, Artificial Sequence
  Synthetic
cctcctgatagagttcttagaatcaaatgattttgatccatataaagaaatggaatacctgacaaccctcgagta

SEQ ID NO: 96299 - DNA, 75 bp, Artificial Sequence
  Synthetic
cctaagagatgacagtgtggcagtatcgtactcactcaaagagaaagaggtgaaagtgaatgggcggatttttgc

SEQ ID NO: 96300 - DNA, 75 bp, Artificial Sequence
  Synthetic
taagttaacaaagaaactaaggaactgccaggtgatggcagaaggaattctagctgaccagattgcacctttctt

SEQ ID NO: 96301 - DNA, 75 bp, Artificial Sequence
  Synthetic
tcagggaaatggggtcattcaagatagcatatccttgacaaagagtatgttagcgatgagtcaactgtcctttaa

SEQ ID NO: 96302 - DNA, 75 bp, Artificial Sequence
  Synthetic
cagcaataagaaacgtatcactgactgcaaagagagggtttcctcaaaccgcaatcatgatcagaagagcaagaa

SEQ ID NO: 96303 - DNA, 75 bp, Artificial Sequence
  Synthetic
tcgtagaagagttgccacttttatcacgactgacctacaaaagtattgtcttaactggagatatcagacagtcaa

SEQ ID NO: 96304 - DNA, 75 bp, Artificial Sequence
  Synthetic
actatttgctcatgctatcaatcagctgatgggcctacctcatttctttgagtggattcatcttaggctgatgga

SEQ ID NO: 96305 - DNA, 75 bp, Artificial Sequence
  Synthetic
cactacaatgtttgtaggggatcctttcaatcctccaagtgacccgactgactgtgatctatcaagagtcccaaa

SEQ ID NO: 96306 - DNA, 75 bp, Artificial Sequence
  Synthetic
tgatgacatatatattgtcagtgctagagggggcattgagggactctgccagaagctatggacgatgatctcaat

SEQ ID NO: 96307 - DNA, 75 bp, Artificial Sequence
  Synthetic
tgctgcaatccaacttgctgcagcaagatctcattgtcgagttgcctgcatggtacaaggtgacaatcaagtaat

SEQ ID NO: 96308 - DNA, 75 bp, Artificial Sequence
  Synthetic
agctgtaacgagagaggtaagatcagatgattccccggatatggtgttgacgcagttgcatcaagctagtgataa

SEQ ID NO: 96309 - DNA, 75 bp, Artificial Sequence
  Synthetic
tttcttcaaggagttgattcatgtcaatcatttgattggccataacctgaaggatcgtgaaaccattaggtcaga

SEQ ID NO: 96310 - DNA, 75 bp, Artificial Sequence
  Synthetic
cacattcttcatatacagcaaacgaatattcaaagatggagcaatactcagtcaggtcctcaaaaattcatctaa

SEQ ID NO: 96311 - DNA, 75 bp, Artificial Sequence
  Synthetic
attggtgctaatatcaggcgaccttagcgaaaacactgtaatgtcctgtgccaacattgcatccactgtggcacg

SEQ ID NO: 96312 - DNA, 75 bp, Artificial Sequence
  Synthetic
actatgtgagaatgggcttcctaaggatttctgttactatttgaactacctaatgagttgcgtgcagacatactt

SEQ ID NO: 96313 - DNA, 75 bp, Artificial Sequence
  Synthetic
tgattcggagttttctattacccacagctcgcaatcagattccaaccagtcctggatcgaggatatctctttcgt

SEQ ID NO: 96314 - DNA, 75 bp, Artificial Sequence
  Synthetic
acactcatacgtgttaacccctgcccagctggggggactgagcaaccttcaatactcaaggctctacacaaggaa

SEQ ID NO: 96315 - DNA, 75 bp, Artificial Sequence
  Synthetic
tattggtgacccagggaccactgctttcgcagaggtcaagcgactagaagcagtggggttgctgagtcccagcat

SEQ ID NO: 96316 - DNA, 75 bp, Artificial Sequence
  Synthetic
catgactaacatcttaaccaggccacctggcaatggagactgggccagcctatgcaacgacccatactcttttaa

SEQ ID NO: 96317 - DNA, 75 bp, Artificial Sequence
  Synthetic
ttttgagactgttgcaagcccaaatattgtcctcaagaaacatacgcagaaagtcctatttgagacatgttcaaa

SEQ ID NO: 96318 - DNA, 75 bp, Artificial Sequence
  Synthetic
ccccttattatccggggtacatacagaggacaatgaggcagaagagaaagcattggctgaattcttactcaatca

SEQ ID NO: 96319 - DNA, 75 bp, Artificial Sequence
  Synthetic
agaagtgattcacccacgtgtcgcacatgctatcatggaagcaagctctgtgggtaggagaaagcaaattcaagg

SEQ ID NO: 96320 - DNA, 75 bp, Artificial Sequence
  Synthetic
gcttgttgacacaacgaacactgtgattaagattgcactgactaggaggcccctcggtatcaaaaggctgatgcg

SEQ ID NO: 96321 - DNA, 75 bp, Artificial Sequence
  Synthetic
gataatcaattactcgagcatgcatgcaatgttgttcagagatgatattttcttatccaatagatccaaccaccc

SEQ ID NO: 96322 - DNA, 75 bp, Artificial Sequence
  Synthetic
attagtttcttctaatatgtgctcgctgacgctagcagattatgcccggaacagaagctggtcacccctgacagg

SEQ ID NO: 96323 - DNA, 75 bp, Artificial Sequence
  Synthetic
gggcaggaaaatactgggtgtatccaaccctgataccatagaacttgtggagggagagattctcagcgtcagtgg

SEQ ID NO: 96324 - DNA, 75 bp, Artificial Sequence
  Synthetic
agggtgcacaaaatgtgacagcggagatgagcagtttacttggttccatcttccaagcaatatagagctgactga

SEQ ID NO: 96325 - DNA, 75 bp, Artificial Sequence
  Synthetic
tgacaccagcaaaaatcccccaatgagagtgccatatctcgggtcgaagactcaagagaggagagctgcctcgct

SEQ ID NO: 96326 - DNA, 75 bp, Artificial Sequence
  Synthetic
cgcgaaaatagcccacatgtcaccacatgtgaaagcagcactaagggcatcatccgtgttaatctgggcttatgg

SEQ ID NO: 96327 - DNA, 75 bp, Artificial Sequence
  Synthetic
ggacaacgaagtgaactggactgctgctcttaatattgcaaggtctcgatgcaacataagctcagagtatcttcg

SEQ ID NO: 96328 - DNA, 75 bp, Artificial Sequence
  Synthetic
gctattgtcacccctgcctacagctgggaatctccaacatagattggatgatggcataacccagatgacatttac

SEQ ID NO: 96329 - DNA, 75 bp, Artificial Sequence
  Synthetic
ccctgcatctctctacagagtgtcgccttacgttcatatatccaatgattctcaaaggctattcaccgaagaagg

SEQ ID NO: 96330 - DNA, 75 bp, Artificial Sequence
  Synthetic
ggtcaaagagggaaacgtggtttaccaacaaattatgctcttgggtttatccctaattgaatcactcttcccaat

SEQ ID NO: 96331 - DNA, 75 bp, Artificial Sequence
  Synthetic
gacaacaaccagaacatatgatgagatcacattacacctccacagtaaatttagctgctgtatccgagaagcgcc

SEQ ID NO: 96332 - DNA, 75 bp, Artificial Sequence
  Synthetic
tgttgcggttccattcgagctcctcgggctggcaccggaattaaggatggtaacctcaaataagttcatgtatga

SEQ ID NO: 96333 - DNA, 75 bp, Artificial Sequence
  Synthetic
tcctagccctatatcagagagagattttgcgagacttgacttagctatcttcaagagttacgagcttaatttgga

SEQ ID NO: 96334 - DNA, 75 bp, Artificial Sequence
  Synthetic
atcatattccacgctggagctaatgaacattctttcgatatctagcgggaagctgattggccaatccgtggtttc

SEQ ID NO: 96335 - DNA, 75 bp, Artificial Sequence
  Synthetic
ttatgatgaaggtacctctataaagaatgatgctataatagtgtatgacaacacacgaaattggattagtgaggc

SEQ ID NO: 96336 - DNA, 75 bp, Artificial Sequence
  Synthetic
gcaaaactcaaatgtggtccgcctgtttgagtatgcagcactcgaagtgctccttgactgtgcttatcaactcta

SEQ ID NO: 96337 - DNA, 75 bp, Artificial Sequence
  Synthetic
gtaaaaatcttccaacgatgctagctgcacttgagatgaagtcgtcaccaactgccccacccgctccgcggcgat

SEQ ID NO: 96338 - DNA, 75 bp, Artificial Sequence
  Synthetic
gtcgtcgctcagtctgtggctggcattcttggaaagctcatgttctcctacggcccgctgctctttaatataacg

SEQ ID NO: 96339 - DNA, 75 bp, Artificial Sequence
  Synthetic
ccccagtgctaacgtcgccctgagtgtcttacaaaatgctgtcgcttccggaacaggggcgaacgagacaatgaa

SEQ ID NO: 96340 - DNA, 75 bp, Artificial Sequence
  Synthetic
ccccacaccgctagatgcctggaccgagcttgcgcatcatttctccaaatggcgactgatgacagacggacgatc

SEQ ID NO: 96341 - DNA, 75 bp, Artificial Sequence
  Synthetic
gaatgagaaggcggcatatggggcggcttctgaggttctgaaagacgacgagacgacgcgtatgctcaagatgca

SEQ ID NO: 96342 - DNA, 75 bp, Artificial Sequence
  Synthetic
cgacggggcccctctggtcggccccttgacttcacgatcttacagggacagcgcgcattcgattgcaatcagtta

SEQ ID NO: 96343 - DNA, 75 bp, Artificial Sequence
  Synthetic
ggtgaacgaatgcagtcttacggagatgcgccagacatatcagagtctgaagaggcgttgccgactgctttatta

SEQ ID NO: 96344 - DNA, 75 bp, Artificial Sequence
  Synthetic
gcacacaacgccgcccgagggaacggcttcgtgaactggggcgtggactcggtcggcgatcacccgacgccttat

SEQ ID NO: 96345 - DNA, 75 bp, Artificial Sequence
  Synthetic
tggagagttgctgtgtctagctgcggctttaggactcacactcgtcctgatggtcccatccgcgtcgagggtctt

SEQ ID NO: 96346 - DNA, 75 bp, Artificial Sequence
  Synthetic
cctcacattcgccggagaatccagtatcttggctacgtgcctgaagatgtgatcgacgaacgtttctgcggggat

SEQ ID NO: 96347 - DNA, 75 bp, Artificial Sequence
  Synthetic
gatcgacgaacgtttctgcggggatgatctgcgctacctcctacacgagcgaatgtgcgaggcgcttgcgatctc

SEQ ID NO: 96348 - DNA, 75 bp, Artificial Sequence
  Synthetic
ggagggcgcgctcacccaggctaacatcacgggtcacgtgataaccggaatccttacgagccttgcgatcttcct

SEQ ID NO: 96349 - DNA, 75 bp, Artificial Sequence
  Synthetic
gcaacaccaccgagcgcggctgctgaagcggaagcgcagcattaaacgtgacatcgtgaagcgcatgacctacat

SEQ ID NO: 96350 - DNA, 75 bp, Artificial Sequence
  Synthetic
aatcattaatcgcgacctcgtctcggccttttcactgccggacgataggtttgccgcgctcgggacaggcgtgcc

SEQ ID NO: 96351 - DNA, 75 bp, Artificial Sequence
  Synthetic
ctccctcgcccgcaggatgggatcgcagtttccggaaagcgctggcgcaggaagtgactttagggctcgtctcat

SEQ ID NO: 96352 - DNA, 75 bp, Artificial Sequence
  Synthetic
tcgcgacgcgacaagtccggacggaccagtcatcctcgacatcagctacatgtcaatcatacacgctttccgact

SEQ ID NO: 96353 - DNA, 75 bp, Artificial Sequence
  Synthetic
ggcgctagcggaggaagcggaacgtgccagggatgacagcgactggcggcgctggccctaggtgcgggcacctcg

SEQ ID NO: 96354 - DNA, 75 bp, Artificial Sequence
  Synthetic
gcgttttctgccaatctcacgcccagagcgggtgatctaccagccgattctggaatccgtctatgtgtcgcacct

SEQ ID NO: 96355 - DNA, 75 bp, Artificial Sequence
  Synthetic
agggatgacagcgactggcggcgctggccctaggtgcgggcacctcgcgatggtgttgccgggagattaggatac

SEQ ID NO: 96356 - DNA, 75 bp, Artificial Sequence
  Synthetic
gtaaaaactctttcgccatggacgcgtacacagccagagcgctttcggttttggagggcctagccatttcaggag

SEQ ID NO: 96357 - DNA, 75 bp, Artificial Sequence
  Synthetic
ctcgctcgcaaagctgaacgccaccagactgcaggccttcgtgaatgccaacccggagagcttcgctgaggcgag

SEQ ID NO: 96358 - DNA, 75 bp, Artificial Sequence
  Synthetic
atccacgctcacacagagacccgactacggaggcgacgatgtcgatcttcgcgatgaggttcaacagtacgactt

SEQ ID NO: 96359 - DNA, 75 bp, Artificial Sequence
  Synthetic
acctatggacgtttggcgaacagtgtatcccaggctgcctgagcccgtgcgtcggatcttcgacctgaccggaca

SEQ ID NO: 96360 - DNA, 75 bp, Artificial Sequence
  Synthetic
cgcgcccagtgattggaacgccgacgacgagggaggcaagacgcaataacttctacgccgccgttgacgtggcat

SEQ ID NO: 96361 - DNA, 75 bp, Artificial Sequence
  Synthetic
acattcgtttgtcactggcagagacatcggcatgtggcttgcttcgcctctgctacaggaatctctattcctact

SEQ ID NO: 96362 - DNA, 75 bp, Artificial Sequence
  Synthetic
tcgctaccctgaacatcacatcgaccttcgtgatgccgggctacatccagaatccgcagaccctagcgatcctag

SEQ ID NO: 96363 - DNA, 75 bp, Artificial Sequence
  Synthetic
atgcgcacgtgcggcatgggaggctaccgctgacccctcggagatcggttttacacgtgacgtgtatatccatcg

SEQ ID NO: 96364 - DNA, 75 bp, Artificial Sequence
  Synthetic
cgcgtgacgagatcccatacacgccgtccacgttccggagggtgcagcggattcgtatctgcacaaatgaccact

SEQ ID NO: 96365 - DNA, 75 bp, Artificial Sequence
  Synthetic
ccagcccattcctgagtacccactggaggacgtgcggcagttccgtcgagacgcggtttactttacgaatatgct

SEQ ID NO: 96366 - DNA, 75 bp, Artificial Sequence
  Synthetic
cgaatgtgcgagaggagcggcatgcatactctcactacgaagcggtcacctccccaggcgttgtgctcccggccc

SEQ ID NO: 96367 - DNA, 75 bp, Artificial Sequence
  Synthetic
ggacgctcgacccaataacggccaacgagtgatcttggaccggatcatcatgcagcaacgcgcgggagccgggcg

SEQ ID NO: 96368 - DNA, 75 bp, Artificial Sequence
  Synthetic
ctgccgggggcggccctcgttgctacgcaatttcggcgaccacccttcagatccatatcgacgcgatgcagaatg

SEQ ID NO: 96369 - DNA, 75 bp, Artificial Sequence
  Synthetic
actgcggatgtcgattagagagctactcgatgatggcttatacgtgcagatcggaaccgcacttcggcccaccgt

SEQ ID NO: 96370 - DNA, 75 bp, Artificial Sequence
  Synthetic
aagtcctaaccccgcttatcttcccagaccaggatgatgtcattatggcggaattcatctggcagcggcttgcca

SEQ ID NO: 96371 - DNA, 75 bp, Artificial Sequence
  Synthetic
tctgagcatccatcacggactcccgcctgagagcacgctgagggccctaccctatacataccaacgtgaaagctc

SEQ ID NO: 96372 - DNA, 75 bp, Artificial Sequence
  Synthetic
atggcatcgataacaatgcggtaataaacatggggacgaatgtggagctccttcgggacaacgcagctgtagagg

SEQ ID NO: 96373 - DNA, 75 bp, Artificial Sequence
  Synthetic
ggacgggccgacgacgcgcgtcactctgcagctgctgcgcccggtcgcagcattctacatgctgtataatgcgga

SEQ ID NO: 96374 - DNA, 75 bp, Artificial Sequence
  Synthetic
gagggacaccatttatggcaacgccaagggatcacgttgtgcttgcaagctacgagcccgtcaatctctgcacta

SEQ ID NO: 96375 - DNA, 75 bp, Artificial Sequence
  Synthetic
cgagcaggcattcccagacgagatgatcgaccttgtccccaacgtctcgctcgtaagcttgtacatccagcgccc

SEQ ID NO: 96376 - DNA, 75 bp, Artificial Sequence
  Synthetic
tccaccttacgtgcacgcgctactgggtcaccgcgccccccagggtggtatacgattcaatggaggcggacattc

SEQ ID NO: 96377 - DNA, 75 bp, Artificial Sequence
  Synthetic
cccggtcgaacgcgtgagttacgagaccgccctgagcgtcgtcacacgcgacttcgcctcgttcagatcgcgcgt

SEQ ID NO: 96378 - DNA, 75 bp, Artificial Sequence
  Synthetic
tcgccgtttatacctacagagacgagttctgggacgcgctcaggagttacgtgctacaggcgctaggcatgccgg

SEQ ID NO: 96379 - DNA, 75 bp, Artificial Sequence
  Synthetic
gcggataatggatttagccgctgctctcgatgcgggtagccagtatgctttaccctcgaatgcgctgtaggactt

SEQ ID NO: 96380 - DNA, 75 bp, Artificial Sequence
  Synthetic
cgcaccactatcccactcgcccggttaccgagttccggcagaatctcgcaatcgcaatactctcgcgcctcttcg

SEQ ID NO: 96381 - DNA, 75 bp, Artificial Sequence
  Synthetic
tatgctttaccctcgaatgcgctgtaggacttcagccaccctgcagcgtagggcttgggcccggagtaaggatac

SEQ ID NO: 96382 - DNA, 75 bp, Artificial Sequence
  Synthetic
actgcttagcgatacgaagacacactacttatattataaatactccaagtggaaggataaagatgcagaggaacg

SEQ ID NO: 96383 - DNA, 75 bp, Artificial Sequence
  Synthetic
acgtctactgtgccatggcgccagagatcaaccccccggtcgcggcccaaggcgttgtgggtgggctcgctcata

SEQ ID NO: 96384 - DNA, 75 bp, Artificial Sequence
  Synthetic
tacttatattataaatactccaagtggaaggataaagatgcagaggaacgatcgtcgctttttgggattcccgtc

SEQ ID NO: 96385 - DNA, 75 bp, Artificial Sequence
  Synthetic
gactgcaagccgctctgcgtgccttcaggttggggcgctagccgtcggctccacccggcaggggcccccgcttgt

SEQ ID NO: 96386 - DNA, 75 bp, Artificial Sequence
  Synthetic
ggcaggggcccccgcttgtcgtgcgttactcgggacccatgggcgtggtccgtgagtgcgatagagtcaagatac

SEQ ID NO: 96387 - DNA, 75 bp, Artificial Sequence
  Synthetic
cagtcgcagcgaccgataaacgatttgcagccagaagaggagttcctcaggaactatgcattatccaacgcggaa

SEQ ID NO: 96388 - DNA, 75 bp, Artificial Sequence
  Synthetic
gtaaaaatttcctattctgagcggccacgccaggggcacgatggaacgattcattcgcaaattcaaaccggttgg

SEQ ID NO: 96389 - DNA, 75 bp, Artificial Sequence
  Synthetic
cagagcgaggtttacgcattcctcaagcacagagcgcaggaagaaatggccgtctatggcgacctagcattgagg

SEQ ID NO: 96390 - DNA, 75 bp, Artificial Sequence
  Synthetic
aggagcggcacttggcctgaggacgatcgaggctttgtctgacatatggacgtgcggccacaagcgattctcatg

SEQ ID NO: 96391 - DNA, 75 bp, Artificial Sequence
  Synthetic
cactggtatgcgctaatacaacagttagccgacgactatgggcatgctcctctgggactcacgtgtatggagcga

SEQ ID NO: 96392 - DNA, 75 bp, Artificial Sequence
  Synthetic
catgtaccaaggccagtgtgttgtgcagaaccttgacgcctttgtcgcgcgcgcaattgtctcgggagacagtat

SEQ ID NO: 96393 - DNA, 75 bp, Artificial Sequence
  Synthetic
ttcatagatgacaacggaagccccttccatcaaagtacgcgcgatctatcgaaaatctctgatgagacgtactcg

SEQ ID NO: 96394 - DNA, 75 bp, Artificial Sequence
  Synthetic
gcttgcgagcaaaatcgtcgagatcgcaggtgcgttgggaaacaaccgggatgaggtgcggtgccaggtggcggc

SEQ ID NO: 96395 - DNA, 75 bp, Artificial Sequence
  Synthetic
agttcggtcgtgctcttctttgagatgtcgattaacgaatctcttcatgagttcaacgtaatcctgcgtgcgcgt

SEQ ID NO: 96396 - DNA, 75 bp, Artificial Sequence
  Synthetic
gtgtgcagacagaagtggaaatcaagacctagcgcgactgagcgccctgactactcaggcggtgcagcgcgcggc

SEQ ID NO: 96397 - DNA, 75 bp, Artificial Sequence
  Synthetic
gaggcaggcgtctcaatcgatacccgctacggagacttcgcggtgaaccgcctcgccgtggtgcgagagttatac

SEQ ID NO: 96398 - DNA, 75 bp, Artificial Sequence
  Synthetic
ggaactcgcagggatggagagagtgaacccgaacaacatgatacgcgatgacgcgacgcgcgcatatgtcgacga

SEQ ID NO: 96399 - DNA, 75 bp, Artificial Sequence
  Synthetic
accttgatgctcgcccatccgaagaaaatctgtaatatgctgagggctagctattcatggtttgtgaagaactgg

SEQ ID NO: 96400 - DNA, 75 bp, Artificial Sequence
  Synthetic
ctcgcggagtctgatcccacatttgttcgttccgatgcgagatggggtggcacccgagatagtcgactcactggc

SEQ ID NO: 96401 - DNA, 75 bp, Artificial Sequence
  Synthetic
gggatcgcagcgcctgagttgaacgtgctcgtttcggagggaggcgacgaccggaactcgaaggacgtcacttat

SEQ ID NO: 96402 - DNA, 75 bp, Artificial Sequence
  Synthetic
gatcgggcctgtactatatctcttctacgacacgctcaatgcggacacgctggttttccagcgcgacccccgggc

SEQ ID NO: 96403 - DNA, 75 bp, Artificial Sequence
  Synthetic
cggagctggaaacgcatacggaacccttatgagggcatcatacaagcgaccgcttttcaccgcgcctcactgcag

SEQ ID NO: 96404 - DNA, 75 bp, Artificial Sequence
  Synthetic
tctcgcaacgacgaaccactacctcgcgtgggctccgaacgcaccgcgatacgggactccagagacggccatgtg

SEQ ID NO: 96405 - DNA, 75 bp, Artificial Sequence
  Synthetic
gctaatattgagaagatcgatgacaccatcgcttacgccgcgaccctcaccgggacggttgccggcctgccagtc

SEQ ID NO: 96406 - DNA, 75 bp, Artificial Sequence
  Synthetic
gatcgctttcttcgactactctctgcgcgcgctgttcgaccagacggatctgaagacgatcatcacgaggaacgt

SEQ ID NO: 96407 - DNA, 75 bp, Artificial Sequence
  Synthetic
tttcgccgtatgatgcaaagcacatacaccacggagttcgatcctcaggaccccgcgcacgtccagctagcttcg

SEQ ID NO: 96408 - DNA, 75 bp, Artificial Sequence
  Synthetic
ggaggcggatctgaacttcatcaggggtcaggcgacaagacggggtgcacgtctctacttccagcgctttggggt

SEQ ID NO: 96409 - DNA, 75 bp, Artificial Sequence
  Synthetic
ttactactcgcagtgcagacaatggctggatacgggcgggcttggattgtcaatgcgggcgacgacccagatcgt

SEQ ID NO: 96410 - DNA, 75 bp, Artificial Sequence
  Synthetic
tgaggggcaagggatcgggccagtggaggatatgtataaccgctcggtcgctgagcggccaatcgcaatcacgta

SEQ ID NO: 96411 - DNA, 75 bp, Artificial Sequence
  Synthetic
atgctccctccatctcccggcaaccacgtggcgcgtgtggcaaaagagacggagaaatattttctacgtgcatac

SEQ ID NO: 96412 - DNA, 75 bp, Artificial Sequence
  Synthetic
tctcgaacaggctagaacatgggagacgttgttcttcccttcgctgttgttcaggggatggatcgcgggagtgta

SEQ ID NO: 96413 - DNA, 75 bp, Artificial Sequence
  Synthetic
gaagaggcgcggcgtcatgggtatgacatcattcctccagaggacatgtacagttcgttgctgcgactcgctaaa

SEQ ID NO: 96414 - DNA, 75 bp, Artificial Sequence
  Synthetic
cactgagagggagatggcgcaatggttcaactcgcacgagacgtgccaaacctgctacgcggcgagccagacttc

SEQ ID NO: 96415 - DNA, 75 bp, Artificial Sequence
  Synthetic
aacacgtcatcgggattcagtacagaagtcgaagtgcggaaacgctacggacccaaagcggagcggaaggcagaa

SEQ ID NO: 96416 - DNA, 75 bp, Artificial Sequence
  Synthetic
ctatgcacgtgtgctcgcgatggacgtacgtaccgaagaggagacgggggcgatggcgatgcggtcgctgcggcc

SEQ ID NO: 96417 - DNA, 75 bp, Artificial Sequence
  Synthetic
cttgcgacacggaggagaggatctggcggggatccgatcgcgagatctgaacgatggcgaagtcctgacaaggca

SEQ ID NO: 96418 - DNA, 75 bp, Artificial Sequence
  Synthetic
gggggatcactggtgtgctactgtgtgccggtcgacgaccgaagcggtatacgttaccgcgacgtttatccaccg

SEQ ID NO: 96419 - DNA, 75 bp, Artificial Sequence
  Synthetic
ggacgtcccaatcaaggcaacacgaactatctacgcgataaacgtaaacgtgttggcgccgcaacacatcctcac

SEQ ID NO: 96420 - DNA, 75 bp, Artificial Sequence
  Synthetic
acttatgcgagggcgagggctcagtgacggcttccagcgattgataagcgctgaggcggtcgcgtggtgctactt

SEQ ID NO: 96421 - DNA, 75 bp, Artificial Sequence
  Synthetic
ccttccattgaacgaatacttcgcgcgcgccggcggaactacccatccgtcttctgacgagataggcggaaaggt

SEQ ID NO: 96422 - DNA, 75 bp, Artificial Sequence
  Synthetic
gcagtggcttccggatcgggcggactgcattgtgctttttaggctgctcgcgtacgcccaacagttatacacccc

SEQ ID NO: 96423 - DNA, 75 bp, Artificial Sequence
  Synthetic
gataattggggacctggaggcgactggatcgcgggtgatggatgcagcagacacctttcgcaataccggcgacgt

SEQ ID NO: 96424 - DNA, 75 bp, Artificial Sequence
  Synthetic
gccttttctgtcgcgacttggtgcttggaccgacttggcggtcttcttccgcgagatctacaaccagacggacgc

SEQ ID NO: 96425 - DNA, 75 bp, Artificial Sequence
  Synthetic
tgggatatggacattagccctggactactcgaactacgacacgcacatgacgcaccacaacttccgatcagggat

SEQ ID NO: 96426 - DNA, 75 bp, Artificial Sequence
  Synthetic
tagcgaggctgtcctgcgagacatccacggggcgatgcttgcgctggtgcgcttccacgttcacaactccgcaca

SEQ ID NO: 96427 - DNA, 75 bp, Artificial Sequence
  Synthetic
gatcgcgggacttcggcaggccaccgcacgacatcacgcgttgcgctacggtgaatgggatgtgggacagctcat

SEQ ID NO: 96428 - DNA, 75 bp, Artificial Sequence
  Synthetic
gcatggcttcacgcggccttgcgctcctccccctcaaatccgccgcacgcctcgccgttagaatctcttgtgggc

SEQ ID NO: 96429 - DNA, 75 bp, Artificial Sequence
  Synthetic
cgaagctgggtacggagaaggacgcgtcgctcataccctgtggaacggcaagaagagagtgtgccggatgggccg

SEQ ID NO: 96430 - DNA, 75 bp, Artificial Sequence
  Synthetic
cgacaaacatatttcgaattgggcacccgcgaatgtcggccatcgttcaccggtctccggtgacgcgggaaatta

SEQ ID NO: 96431 - DNA, 75 bp, Artificial Sequence
  Synthetic
acatatttcgaattgggcacccgcgaatgtcggccatcgttcaccggtctccggtgacgcgggaaattaagatac

SEQ ID NO: 96432 - DNA, 75 bp, Artificial Sequence
  Synthetic
agccgcctatgaggcgctgcctcagacggatcgagagccccccgcagacgcaccattccgatttcgtccaccagg

SEQ ID NO: 96433 - DNA, 75 bp, Artificial Sequence
  Synthetic
gtaaaatgttcgggccacacacggtgattctgctgcatcagtctttacggcgttataggaaggagctctatggac

SEQ ID NO: 96434 - DNA, 75 bp, Artificial Sequence
  Synthetic
cacacgcccgatcagaacaatggccctcgtcggtagcgacgcagctgactacgtgcttgtgaccccatgggacgg

SEQ ID NO: 96435 - DNA, 75 bp, Artificial Sequence
  Synthetic
caagttttcaaatacgacgcgattggacgttaaacgacctatggcgtgagaatggacgttacgctacagatgtgt

SEQ ID NO: 96436 - DNA, 75 bp, Artificial Sequence
  Synthetic
ttcggacctcgcgatggtttctacgcacctgtccggcgagaactcaacactagtagcgaactcactgcacaacat

SEQ ID NO: 96437 - DNA, 75 bp, Artificial Sequence
  Synthetic
acgctgagggtgatgtatcatggcttacaatcaggcaggtgcgtgcacacggcatcatcttcgtgggacccgcag

SEQ ID NO: 96438 - DNA, 75 bp, Artificial Sequence
  Synthetic
cacctgtccggcgagaactcaacactagtagcgaactcactgcacaacatggcgatgggacgtgtcattcaggat

SEQ ID NO: 96439 - DNA, 75 bp, Artificial Sequence
  Synthetic
gggcacggttcccgatgcgcgatgcagttctttcacccgatgtgataatacggagcgtcagagacgcgaaagatt

SEQ ID NO: 96440 - DNA, 75 bp, Artificial Sequence
  Synthetic
tggagacgcagattggacgcggacgcataaaactaaggcgtaccttcgggaacgcggttcgtaactacgcatggg

SEQ ID NO: 96441 - DNA, 75 bp, Artificial Sequence
  Synthetic
gtacggctgctgacgcttcaggcggcaaagatcgacagggcaatcgacgtcatctttcgtaccatagagctttgc

SEQ ID NO: 96442 - DNA, 75 bp, Artificial Sequence
  Synthetic
cgcgagcgacctattttcatgggagcgaagtagaaacagtcacgcatggagatatccgcggaaagaagctgttcg

SEQ ID NO: 96443 - DNA, 75 bp, Artificial Sequence
  Synthetic
ggacatgaggcgtcagcggcgaagaccacgttcgcgcccttctcggcggagaagacccagacgcatgcaaaacag

SEQ ID NO: 96444 - DNA, 75 bp, Artificial Sequence
  Synthetic
gactgccgccgcgcgcgccgctcgcttacccagaagtagatgtagagttcgcaagcgatgggcccgtgggtgaga

SEQ ID NO: 96445 - DNA, 75 bp, Artificial Sequence
  Synthetic
ggaatctatatccctcaggatcgaatgatgattatctcgtcagagagaaggaaggagatcgagaatgtccagggc

SEQ ID NO: 96446 - DNA, 75 bp, Artificial Sequence
  Synthetic
gaaggagatcgagaatgtccagggctacatgcgcgctcaggctacgaccttcattacgaaggttagccgtggatt

SEQ ID NO: 96447 - DNA, 75 bp, Artificial Sequence
  Synthetic
aacttgtgagcatgctggactacgccgtacatggctacgacaccgtcctctacgtgggcgctggcgatggacgga

SEQ ID NO: 96448 - DNA, 75 bp, Artificial Sequence
  Synthetic
cggttacgcagttctcgcggaaggaccccgaacgtttcagacgaactcgttgggtgctgatcgatcccatcgtgc

SEQ ID NO: 96449 - DNA, 75 bp, Artificial Sequence
  Synthetic
gtttgatggctccagataccgtcggcgcaacttcttctccgcggaagacggctacacgctatgccggatactgga

SEQ ID NO: 96450 - DNA, 75 bp, Artificial Sequence
  Synthetic
gagaagagggctggcctagcaacgtcaccacctcgaggcgtcgtgtcgatacgccgcgtgatttggctcgatacc

SEQ ID NO: 96451 - DNA, 75 bp, Artificial Sequence
  Synthetic
tccgaccgtcctctacgccccatgcgagtcgaacggatatggcgtacatccattcgcgctgaatgtggtgcagac

SEQ ID NO: 96452 - DNA, 75 bp, Artificial Sequence
  Synthetic
aatgcaacggcgctaccttgttgctgtgggacgtacgtagcgatcgagggacccaggctgatcgggagtgggagg

SEQ ID NO: 96453 - DNA, 75 bp, Artificial Sequence
  Synthetic
ccaggagctccaccttgactccatacaactcttccccgcctatgccgaccttgcttcacgtggggttatccatat

SEQ ID NO: 96454 - DNA, 75 bp, Artificial Sequence
  Synthetic
agacgtgcaggcgggaggacgatttgggtgagagcgttgcgatagcaaattcggcgtggctggactcggcgcttc

SEQ ID NO: 96455 - DNA, 75 bp, Artificial Sequence
  Synthetic
cgcttttccgcccccttggaacgagacgaacgtcgatacgcgcttgctctccaccagcacgcccatgggcctgta

SEQ ID NO: 96456 - DNA, 75 bp, Artificial Sequence
  Synthetic
tgaagagacgtgttcctttctcagatgttctaaggtgtaccgtttcggtgctatgcttccaaccgggagctccgg

SEQ ID NO: 96457 - DNA, 75 bp, Artificial Sequence
  Synthetic
ctctaaaatcgtgcgtcccaccgttcggctcgcgctcacagaccctgacgtaggtgcgctcatctcacaaattcc

SEQ ID NO: 96458 - DNA, 75 bp, Artificial Sequence
  Synthetic
cggatatgtacgagttacgctccttcttagcgctctcgggacatgaatggctgggcgagccgatgagcgtgactc

SEQ ID NO: 96459 - DNA, 75 bp, Artificial Sequence
  Synthetic
ttccgactgagcccttacgccgtaggatccagcgctaccacgggaaggaccgcggcaggtcgctgcgcacacgtt

SEQ ID NO: 96460 - DNA, 75 bp, Artificial Sequence
  Synthetic
cgctctcctagcccccgcctacgaggacagtttcctagaggagctgaataagtggaagcccgaagtaacgttcaa

SEQ ID NO: 96461 - DNA, 75 bp, Artificial Sequence
  Synthetic
tgatccagacgctgcacatcgaacaatgtgatggcctacagagcgagctcacaccgcgggcggacctgttctatc

SEQ ID NO: 96462 - DNA, 75 bp, Artificial Sequence
  Synthetic
accgacggaacgcagcgagctgtcctctgcctacgcgaaagtgctcgatctccacgttgagacacgaccgtcccc

SEQ ID NO: 96463 - DNA, 75 bp, Artificial Sequence
  Synthetic
tgacgaatcgtcggaatacgccggaatccgtcttccgtgtagtgtcgcgaagtgaaatctcaacgctttgggtcg

SEQ ID NO: 96464 - DNA, 75 bp, Artificial Sequence
  Synthetic
tcagcccctcttccccgatgttaatctgtcacctggattcctcgcgcagaagcgctatatcggccatcgaacgac

SEQ ID NO: 96465 - DNA, 75 bp, Artificial Sequence
  Synthetic
gcgcgcgtctcctctcttatgatgattacacgatgagcggagcggaggtgatgctgcggtgttcgaccgagtcgc

SEQ ID NO: 96466 - DNA, 75 bp, Artificial Sequence
  Synthetic
atatggttgtggatggactggggttcctcctacttctcatgttatggggtgaagtggcgaatacgctgtcgttcg

SEQ ID NO: 96467 - DNA, 75 bp, Artificial Sequence
  Synthetic
cacctccaccgtaatcatggcgctgctcgagaagattggattcgaccacgatcctgcggacctagccatcatttt

SEQ ID NO: 96468 - DNA, 75 bp, Artificial Sequence
  Synthetic
atccggggtgggctgggcagtatgcagttgtattccgacgtcgtagagtccctcccgtgcccgacgtgtggctat

SEQ ID NO: 96469 - DNA, 75 bp, Artificial Sequence
  Synthetic
tgagctactgaacctagagagacgagtcgcgctccgcctgtccgaatttgtcactagcgacagactacgatttga

SEQ ID NO: 96470 - DNA, 75 bp, Artificial Sequence
  Synthetic
gccgattcatcggattgcgcgcaaactcctcacttctgcgcatccgagagccatgtgcgcacgacacgcccgatc

SEQ ID NO: 96471 - DNA, 75 bp, Artificial Sequence
  Synthetic
cgtgcatgccctgaacaagcgcgggattggaggcgacgaattcacgatgtcactcgatgtgtgcaccgatggttc

SEQ ID NO: 96472 - DNA, 75 bp, Artificial Sequence
  Synthetic
taatcaagcgcatggggatagacttgtctgggcatctgtacgtgtcactggttacggacaaatacgtggcggatt

SEQ ID NO: 96473 - DNA, 75 bp, Artificial Sequence
  Synthetic
gcgcgagaaccgtattgtgttcccagccgaattcaccgtcgcagagagagacgcagcggcgctgcacgccgaaca

SEQ ID NO: 96474 - DNA, 75 bp, Artificial Sequence
  Synthetic
tgcgcacgtggtttcaaatgattctcacgtggagtgtcttaggagcggaggagaagaaggacgcgatagcgcgtg

SEQ ID NO: 96475 - DNA, 75 bp, Artificial Sequence
  Synthetic
aatacagatgctatgtgcggcacatcaggggcgaggcgtccgcgtgacgttgcaggtccgacaggaacatagaag

SEQ ID NO: 96476 - DNA, 75 bp, Artificial Sequence
  Synthetic
cgcacggcgaggtaatagagtggaaggatcaaatggaatcgaagccatggcacctgcgagaggatctgatcgccg

SEQ ID NO: 96477 - DNA, 75 bp, Artificial Sequence
  Synthetic
cgcgctacgccgcatgcgaatcaagatgcgaacccctaggatgagacagattaggagcgccgcccgtgcaattcg

SEQ ID NO: 96478 - DNA, 75 bp, Artificial Sequence
  Synthetic
cactgcgcgcctttcggctcttggctccagagcacctccacccgtacatcgacgatgcagtgggtcacctccgag

SEQ ID NO: 96479 - DNA, 75 bp, Artificial Sequence
  Synthetic
gtaaaatcttgttcgccatggaggatttcgagatactcatcaagggaccggaccgctacaagccccatgttcagc

SEQ ID NO: 96480 - DNA, 75 bp, Artificial Sequence
  Synthetic
gtaaaaaacgctacagaagcatgacgtctaagcggctgggtacaaggttgaccggcttcctgagtcgaataggct

SEQ ID NO: 96481 - DNA, 75 bp, Artificial Sequence
  Synthetic
gggtcacctccgagtttttccggacccgggacggcgaacccaggaggggtgagcggctacgcgggcataagctac

SEQ ID NO: 96482 - DNA, 75 bp, Artificial Sequence
  Synthetic
atgaatacaccgaatttgatatggtattaacgccgcacaccgacgacacacgcggcccctaccaggctagagagg

SEQ ID NO: 96483 - DNA, 75 bp, Artificial Sequence
  Synthetic
cggggatttcgaaagcagtgagaagcgacacaacgaagcgagttttaagcgcggcggggcgagcggcggagcgcg

SEQ ID NO: 96484 - DNA, 75 bp, Artificial Sequence
  Synthetic
taatggccaccgatacgctgttcaatgaacctgagcgccaggacccaggagcccctcacagtctttgcgtgccca

SEQ ID NO: 96485 - DNA, 75 bp, Artificial Sequence
  Synthetic
ccatatcatctgaggtcgggcaacgtgcgataactggtgcggtggaaggcatgatcacatccgcaacgacgggag

SEQ ID NO: 96486 - DNA, 75 bp, Artificial Sequence
  Synthetic
tagccgcgagcgcagggatcagatatactcataagaagataaacagacgagacgcggagcaggagattgcgaacc

SEQ ID NO: 96487 - DNA, 75 bp, Artificial Sequence
  Synthetic
aaagcctaggtgagtcggtcaagcgtgccgtaatcctgaacgttgcgggggtccaccagaccgtaccagacccgt

SEQ ID NO: 96488 - DNA, 75 bp, Artificial Sequence
  Synthetic
cagacgatcactgctggatggcgtggcgcccaaccgatggcggtcagtatgcgactcagactgagctcggatcga

SEQ ID NO: 96489 - DNA, 75 bp, Artificial Sequence
  Synthetic
tgaacccggcggaaattgagactcaaacgaagctgcgcgagttggaactggctaacagacgggaggaggcgcaga

SEQ ID NO: 96490 - DNA, 75 bp, Artificial Sequence
  Synthetic
tcgcggccccagggaaaactgcgaggacgatatgctcacacgtgcggtcttggtgcgccgagaggcgatgtcaca

SEQ ID NO: 96491 - DNA, 75 bp, Artificial Sequence
  Synthetic
taaagcataataagatcatgatcgagcgggagagggacgcgttgaaggacgtgacgcagtttgcgaaaatccaag

SEQ ID NO: 96492 - DNA, 75 bp, Artificial Sequence
  Synthetic
cggacgctgaggtacggagatttcgtgactgtatgatgctgcagatcttcgtcatcgattcatccgcgacggtat

SEQ ID NO: 96493 - DNA, 75 bp, Artificial Sequence
  Synthetic
aacatatcgacgacgacgcgagcgccgagacgaaagacctggagaacgccctacgtgcggcaaagaccctcgtga

SEQ ID NO: 96494 - DNA, 75 bp, Artificial Sequence
  Synthetic
acgtaggtccagagaacgtgagacaaaacaggcagaccagctacgctatgcggggtaatgcagaaaacatcatta

SEQ ID NO: 96495 - DNA, 75 bp, Artificial Sequence
  Synthetic
aagaagagcgtcatcagctagataaggttactaaagcgctgattcgggaagataggttgcgctcggcggacgaga

SEQ ID NO: 96496 - DNA, 75 bp, Artificial Sequence
  Synthetic
cgcgccctttcacgactaaatgggcgagaacgttgaacaacaaatacgcggttcgggtaaagcggaagtcccact

SEQ ID NO: 96497 - DNA, 75 bp, Artificial Sequence
  Synthetic
ggcgactcatcgaggggatgcgccacaattacaaggccctcgcaaagagcgtcgaggcggagaggaatgcgctga

SEQ ID NO: 96498 - DNA, 75 bp, Artificial Sequence
  Synthetic
gtagggtatcggtggcaactgagaacgcggttcgggcgctcctactggaagtacaccaggtaatgtacaactacc

SEQ ID NO: 96499 - DNA, 75 bp, Artificial Sequence
  Synthetic
ttgaggaggcggtcgaacagaccatcgacattggaggggagatagcggagcatgcgactgccgcgatccctttgg

SEQ ID NO: 96500 - DNA, 75 bp, Artificial Sequence
  Synthetic
tacccccagaccacaggctccgacgtggcgaattcgagcgctccattaagaaacgactcgaacgcattcccaggg

SEQ ID NO: 96501 - DNA, 75 bp, Artificial Sequence
  Synthetic
taggcgaggcggtggcgagcggaatggcgaccgcgcggggagcgatgcagatttatcgccttggtaagacgattc

SEQ ID NO: 96502 - DNA, 75 bp, Artificial Sequence
  Synthetic
acgcggtgcgcggcaacggaagcgtggccgaacgcgtccacaacgtgctcgcagatattctcgggtgccgtgccg

SEQ ID NO: 96503 - DNA, 75 bp, Artificial Sequence
  Synthetic
acgcgatcacgggactacacacgagccattgcgagattccggcgatccaccagggggcaattgagacgcttctcg

SEQ ID NO: 96504 - DNA, 75 bp, Artificial Sequence
  Synthetic
tccgaggcggtccaacttcatacaccgcagcttcggtatcgcagtggattctgtcgactccgcttttcgagtatg

SEQ ID NO: 96505 - DNA, 75 bp, Artificial Sequence
  Synthetic
tttcggatgcgcccacgagcgactcctctctagcacagatcacgagcacacgagcgcgccacttgaaggagatag

SEQ ID NO: 96506 - DNA, 75 bp, Artificial Sequence
  Synthetic
cgcgccatgccgacgggaatgacgacgccatgttgcggtacgtcgctttacacctgctattatcatgcacgccag

SEQ ID NO: 96507 - DNA, 75 bp, Artificial Sequence
  Synthetic
agtccgagctcgatcatctgaacgcggaggtcgcacctgtggtgcggaagatgtgccaagacatctcagcgatcg

SEQ ID NO: 96508 - DNA, 75 bp, Artificial Sequence
  Synthetic
gcgtggcattccaggatacggttattcctctcgcccagtgcgttgagaacccccatcggcaggagcggcggacgg

SEQ ID NO: 96509 - DNA, 75 bp, Artificial Sequence
  Synthetic
cgccggaccacatgcggggcaagcaccggatagcccaaatgaacgccgctcacgagctcagagttcctctaaaac

SEQ ID NO: 96510 - DNA, 75 bp, Artificial Sequence
  Synthetic
agacgcttgcaagtttgtgcgatgctacattaggcgagtggctgatggtgaacccgcactgccctcaatatggat

SEQ ID NO: 96511 - DNA, 75 bp, Artificial Sequence
  Synthetic
accgccctatgatccacacctatacctccccctgggacagcgactacgtgctcatcctacacgtagtaggtccgt

SEQ ID NO: 96512 - DNA, 75 bp, Artificial Sequence
  Synthetic
cccccgcgtctcaaggaatgatggggaacctacgcctcctacttagtcggcttgaagcaggacccgctttcttta

SEQ ID NO: 96513 - DNA, 75 bp, Artificial Sequence
  Synthetic
accacaccgggcaggctttcgtgttctgtctcgacctcgcgctggacctgttccatttcgaggaagtccagagcc

SEQ ID NO: 96514 - DNA, 75 bp, Artificial Sequence
  Synthetic
ccaataaagagacaactatcgcccccgtgcgtaatctgggatccagccacgcgctctacggcggcatctgcgggg

SEQ ID NO: 96515 - DNA, 75 bp, Artificial Sequence
  Synthetic
ccagccacccttttcatcaccgtcacacagcgataaggcggacgttcattcaggtgtgcaccgacttcttcatgt

SEQ ID NO: 96516 - DNA, 75 bp, Artificial Sequence
  Synthetic
gccacagggagatcctcacatgcctcattccctatcgtgcacctcgaaaatgcttcgtctgtctcgttttatgcg

SEQ ID NO: 96517 - DNA, 75 bp, Artificial Sequence
  Synthetic
cctccgcccgccacccgggcgcgacgcgggtgcacagcacgcgcatggcttggagtgcggatgattcaccgctgc

SEQ ID NO: 96518 - DNA, 75 bp, Artificial Sequence
  Synthetic
acgcggatattgatgacagcgggataggcgaggtcatgcgtacacgtgtgcgagacgtcgaggactcatgcattg

SEQ ID NO: 96519 - DNA, 75 bp, Artificial Sequence
  Synthetic
acatcggctcaatcccctacgaaacgtcctatggacagatgcttgataacgcgcgtagcttttcctccacaccgc

SEQ ID NO: 96520 - DNA, 75 bp, Artificial Sequence
  Synthetic
ggaagtgcgtcgttcgtctaagcgctgaaggcacgcgagtacagacgtcgggcgacctacgcacggtcgtcgagc

SEQ ID NO: 96521 - DNA, 75 bp, Artificial Sequence
  Synthetic
agctccagcaggcgttacttcgtggcccaatctctatgcagcggcggacagtccttaacgccatcatgcatgggt

SEQ ID NO: 96522 - DNA, 75 bp, Artificial Sequence
  Synthetic
agtacgcttggtgctacacctctggaacctgcgtgatagtgaaaccccgtagcgcaacgcgcgagggcgcagact

SEQ ID NO: 96523 - DNA, 75 bp, Artificial Sequence
  Synthetic
cagtccttgtccaggcacgccggcggaacctgcccgcgcccgtgagacgtcggtgctagaggcacagtgctcagt

SEQ ID NO: 96524 - DNA, 75 bp, Artificial Sequence
  Synthetic
acgccggcggaacctgcccgcgcccgtgagacgtcggtgctagaggcacagtgctcagttcagcgtttgtcctac

SEQ ID NO: 96525 - DNA, 75 bp, Artificial Sequence
  Synthetic
gtaaaaattctctcgtcagtacggcagagtgtgcggcagtgcggtgtaccttccatgtcaactaggctcattctt

SEQ ID NO: 96526 - DNA, 75 bp, Artificial Sequence
  Synthetic
tcatgacgaaagttctccggttccgtgattagcctcggggtccttggggcgtgctatccccgcgggcaagactaa

SEQ ID NO: 96527 - DNA, 75 bp, Artificial Sequence
  Synthetic
gtaaaaattctctcgtcagtacggcagagtctacggtacacgcgaaggtaagcactgcatgacatccagacttat

SEQ ID NO: 96528 - DNA, 75 bp, Artificial Sequence
  Synthetic
ctagcaccaggtgacgtcattgtaagcgtcggcgaccagctcgttcagcgtggggtagacgtcagagtagcgaga

SEQ ID NO: 96529 - DNA, 75 bp, Artificial Sequence
  Synthetic
acgaaagttctccggttccgtgattagcctcggggtccttggggcgtgctatccccgcgggcaagactaagatac

SEQ ID NO: 96530 - DNA, 75 bp, Artificial Sequence
  Synthetic
attgttagcaccaggcgacgtgattgaaagcgtcgccgacaagctacgggaacgtgacattgacatcaaaatatt

SEQ ID NO: 96531 - DNA, 75 bp, Artificial Sequence
  Synthetic
tacgactatcagtcgacggaccagaatgagttaccggcaggagcacgtgctgcggagacttcgccaggacagaca

SEQ ID NO: 96532 - DNA, 75 bp, Artificial Sequence
  Synthetic
aaaacatgcggacgaccatgcatccataccgccgacagattctgcagcgaataacgaacgaccgacacgggaacc

SEQ ID NO: 96533 - DNA, 75 bp, Artificial Sequence
  Synthetic
cgggaatttggagaccgcgcgggatctggaacgtccagggtggaggtggatccaggaacaaagggaagcgctcaa

SEQ ID NO: 96534 - DNA, 75 bp, Artificial Sequence
  Synthetic
ataacgaacgaccgacacgggaacctggagttcgttcgtcagctggatcgcccggggtagcagtggatagaggag

SEQ ID NO: 96535 - DNA, 75 bp, Artificial Sequence
  Synthetic
cgtaccagcacggagagcacgagcggaagcgctgacgctcacgttcgggatcaggcgagtcgaagcgacgctgcc

SEQ ID NO: 96536 - DNA, 75 bp, Artificial Sequence
  Synthetic
cagagggaaatgctgaatgtgcggggaaagaacagacggagaatggtactggagctgacgtttgccataaggaga

SEQ ID NO: 96537 - DNA, 75 bp, Artificial Sequence
  Synthetic
cagggagatactgcatctcgggatggacttcatgctgcggggcatggacgtgccgtcggaggtggtggagatact

SEQ ID NO: 96538 - DNA, 75 bp, Artificial Sequence
  Synthetic
gtagaagcgacgctaccgcaggagatcctagcaacgggggcggagctactagtgcaatcaaagacggtacccagc

SEQ ID NO: 96539 - DNA, 75 bp, Artificial Sequence
  Synthetic
cgcaatactgcgcaatcgagcgaaagtccggcgggaagtcatagcatggagtctcgcggcccggaagcggggcct

SEQ ID NO: 96540 - DNA, 75 bp, Artificial Sequence
  Synthetic
gaaacggtggaagtagtcgcacgtctgagaaacagatggaaaattcaacacacggtgatgatatggcacgcgaag

SEQ ID NO: 96541 - DNA, 75 bp, Artificial Sequence
  Synthetic
ggagttccttttgttgccactgcacgaatacgtgacgcactgcgcgaaagaggatatccggatatacgagtcctc

SEQ ID NO: 96542 - DNA, 75 bp, Artificial Sequence
  Synthetic
gtgaagcgggcggggttgggcgagtttttgttgctaccccgcgattacgcgaggctctgcgcagcagaggacatg

SEQ ID NO: 96543 - DNA, 75 bp, Artificial Sequence
  Synthetic
gaggctctgcgcagcagaggacatgcagatatacaggtctatgggtctgatagctttctgccggatcgagatcgc

SEQ ID NO: 96544 - DNA, 75 bp, Artificial Sequence
  Synthetic
gggtctgaaatccctattccggatagagatcgcgtcctgttatttggcgcggccgcgcttaaggagctcggagtt

SEQ ID NO: 96545 - DNA, 75 bp, Artificial Sequence
  Synthetic
ggtcaggatgagaatgctgcgcagaaagacgcggaggcgaagctgcgtcgggacaaggtgcgttcagcaatgacg

SEQ ID NO: 96546 - DNA, 75 bp, Artificial Sequence
  Synthetic
ttcgtgtcgtttgctgccgcgccgcttaaggaactcggattacgcgcggatgagggagctgcgcagaaagatgcg

SEQ ID NO: 96547 - DNA, 75 bp, Artificial Sequence
  Synthetic
gtcgagcggatccacagcgcgcagcgtgtaaacgaggagttccccatcaagaagagagagcgtcagcatttgact

SEQ ID NO: 96548 - DNA, 75 bp, Artificial Sequence
  Synthetic
gagtctagactcaggagggagaaggtgcgtcgtccaatagagatcgatcggatccatagtgtacagcggctaaac

SEQ ID NO: 96549 - DNA, 75 bp, Artificial Sequence
  Synthetic
ccggtcgttctagtgacgaacgacccccaatacgtccaacgtgcccacatcctctatactgcgccgactggggat

SEQ ID NO: 96550 - DNA, 75 bp, Artificial Sequence
  Synthetic
gaggaattcccagtacggaatacgagggagaggagagcggtgcccgtcgccttagcaaccaacgacgcgaaattt

SEQ ID NO: 96551 - DNA, 75 bp, Artificial Sequence
  Synthetic
ctatcctggaaggagaccgctcggaaggctacgcagcgccgcgatatacgggcctatgcgtatggcgaacatgat

SEQ ID NO: 96552 - DNA, 75 bp, Artificial Sequence
  Synthetic
gtacgacaagcgcatatactcttcaccgcacccacaggcgacccatcatggaaggggactgcgcggctggcgact

SEQ ID NO: 96553 - DNA, 75 bp, Artificial Sequence
  Synthetic
aagtcgcctggcgaggcgctccttacgctggttgatgcgctctagccgcacagggtgacagtacgcagaggatta

SEQ ID NO: 96554 - DNA, 75 bp, Artificial Sequence
  Synthetic
cagcggaaggagatcagagcttacgcacataaagaaaacgagacccccgcgggagaagcactgatcacgcttatt

SEQ ID NO: 96555 - DNA, 75 bp, Artificial Sequence
  Synthetic
gtaaatatgtcatggctgcggtggagcagcggatcacctcagcgagatcagcactacgacgcattttcaaccaca

SEQ ID NO: 96556 - DNA, 75 bp, Artificial Sequence
  Synthetic
cgggagaagcactgatcacgcttattgacgcgctgtgaccgtagagggtgacagtacgcagaggattaaagatac

SEQ ID NO: 96557 - DNA, 75 bp, Artificial Sequence
  Synthetic
cctggcgaggcgctccttacgctggttgatgcgctctagccgcacagggtgacagtacgcagaggattaaggtac

SEQ ID NO: 96558 - DNA, 75 bp, Artificial Sequence
  Synthetic
aactgttcacccaaacgcaaagatgttatgaatactacaaattttcacagtggcagcattcggagaatgagaagc

SEQ ID NO: 96559 - DNA, 75 bp, Artificial Sequence
  Synthetic
gcggatatctatacaccgtcccagttgtgcgagaaaacggatggcaggagataccgagatgcgttggcgcacgcc

SEQ ID NO: 96560 - DNA, 75 bp, Artificial Sequence
  Synthetic
ctcgagatgccctcgacgtctattaccgttccatacaaccgatcagtcggatacagccagaggaagagtttctgc

SEQ ID NO: 96561 - DNA, 75 bp, Artificial Sequence
  Synthetic
gtaaaaatttccacgctacaggtatggcaacgaaacgcatcggagcgagaatgtccggctttttaagtcgaatag

SEQ ID NO: 96562 - DNA, 75 bp, Artificial Sequence
  Synthetic
gtaactacgcgttagacgacgggatggagtctgacctataccgcttcatgcagcaccgagcgcgtgaggaaatgg

SEQ ID NO: 96563 - DNA, 75 bp, Artificial Sequence
  Synthetic
cggtttatggtgacatggcgttgcgccactggtatgcgttggtgcaacaactcgcggatgattttgggatcgttc

SEQ ID NO: 96564 - DNA, 75 bp, Artificial Sequence
  Synthetic
cgctaggattgtcgtgcatggagaggtttattgacgaaaacggagacccgttccaccagagtacgcgagacctct

SEQ ID NO: 96565 - DNA, 75 bp, Artificial Sequence
  Synthetic
cgaaaatctcagacgaggtgaggtctagttcagtcgtcctgctctttgagatgtcgatatgtgaggcgctgctgg

SEQ ID NO: 96566 - DNA, 75 bp, Artificial Sequence
  Synthetic
agtacaatgtcacgttgcgctcccgagagtcgaatatcacacccacagtgcgtgtcggccgacttgaaatcgatc

SEQ ID NO: 96567 - DNA, 75 bp, Artificial Sequence
  Synthetic
ggatcgaaatcattcgcgagttgtacacacttatgttgccacaccccaagaagatttgcaacatgctgcgggcga

SEQ ID NO: 96568 - DNA, 75 bp, Artificial Sequence
  Synthetic
gctactcctggttcgtaaagaattgggggattgctgcctccgaagttacgttgctagaatcgacggctggggacg

SEQ ID NO: 96569 - DNA, 75 bp, Artificial Sequence
  Synthetic
acaggaactcaaaggatgtcacatatcaaagatggcggaggatccgaaacccttaccgtgatatcatacttggga

SEQ ID NO: 96570 - DNA, 75 bp, Artificial Sequence
  Synthetic
ccaggttccatcgcgaatcactcgccgcgaacctcaagaaagttgacgaggcggtcgagtacgctcgtagcttag

SEQ ID NO: 96571 - DNA, 75 bp, Artificial Sequence
  Synthetic
caaacaccccggtttctctgtctctatttcggaccctgatgcatgatacctatacccaggagttcgacccgcaga

SEQ ID NO: 96572 - DNA, 75 bp, Artificial Sequence
  Synthetic
accagggccacgtgcaactggccagcctgcttctggcggtgcagacgatggctggctatggacgggcgtgggtgg

SEQ ID NO: 96573 - DNA, 75 bp, Artificial Sequence
  Synthetic
tcaatgcgagcgatgatcccgagaggatgctacagccgacgaaagacaacttcgttgaacgcgtgtcgagagaga

SEQ ID NO: 96574 - DNA, 75 bp, Artificial Sequence
  Synthetic
cagaacgttttttcgttaacgcctatgaggaggcgagagtccacggcttcgatatcattcccccggaggacatgt

SEQ ID NO: 96575 - DNA, 75 bp, Artificial Sequence
  Synthetic
acacctcactgctgcgcttggccaagaacacgtcttccggcttctcgacggaagttgaagttaggaaatcgtatg

SEQ ID NO: 96576 - DNA, 75 bp, Artificial Sequence
  Synthetic
gacctaaagcggcacgtcgggaggagctagtgcgagtacggtcacggcagaaggctctatacttgttgcgagagg

SEQ ID NO: 96577 - DNA, 75 bp, Artificial Sequence
  Synthetic
gacataacatctactccccacacatgatgcaaatgcggtacgactcgcccgagtgtttccagacacgcggtacac

SEQ ID NO: 96578 - DNA, 75 bp, Artificial Sequence
  Synthetic
gcgatgtcccgatcaaggcgactagaactatttacgcgatcaacgtcaacgtgctcgctccacaacatatactaa

SEQ ID NO: 96579 - DNA, 75 bp, Artificial Sequence
  Synthetic
cgcttcccttgaatgaatacttcgcgcgcgcgggcggaccaacacacccttcggttgcgtcaatcggtggtaagg

SEQ ID NO: 96580 - DNA, 75 bp, Artificial Sequence
  Synthetic
tcatcatcggcgacctggaagcgacgggttctcgggtgatggatgccgcagatacattcaggaacaccgcggatt

SEQ ID NO: 96581 - DNA, 75 bp, Artificial Sequence
  Synthetic
ctgcgatctggacgctcgccctcgactactcaaattacgacacgcacatgacacagcacaacttccggcgtggaa

SEQ ID NO: 96582 - DNA, 75 bp, Artificial Sequence
  Synthetic
tgatcgcgggcattcgaagcgctatcgcgcgacaccacgcattacggtatggacagtgggacgtcttccaattgc

SEQ ID NO: 96583 - DNA, 75 bp, Artificial Sequence
  Synthetic
gtaaaaatttcctttgtttgtggtcgcgccagagacacgatggagcagttcattcgcaagttcaagccaaccgct

SEQ ID NO: 96584 - DNA, 75 bp, Artificial Sequence
  Synthetic
gcgccagagacacgatggagcagttcattcgcaagttcaagccaaccgctgatcaggccctcgccttaagaacca

SEQ ID NO: 96585 - DNA, 75 bp, Artificial Sequence
  Synthetic
tcgaggcgggctatggtgaggggcgcgtagcgaacactctatggaatgggaagcgacgggtccttcggatggacg

SEQ ID NO: 96586 - DNA, 75 bp, Artificial Sequence
  Synthetic
gatcaggccctcgccttaagaaccatcagcgcactgtctgacatatggaactgcggacacagaagatacgattgt

SEQ ID NO: 96587 - DNA, 75 bp, Artificial Sequence
  Synthetic
cgacggcttacgaggcattgcctgaggcggagcggacggtccccccagacgcaccattccgcttccggccccccg

SEQ ID NO: 96588 - DNA, 75 bp, Artificial Sequence
  Synthetic
atgtaccgaggtcagtgcgtagtccagaacattggcagtctggcggcgctagcgttaacgtcggaagatcacgcg

SEQ ID NO: 96589 - DNA, 75 bp, Artificial Sequence
  Synthetic
ggactcacccaattcgtacactttcgcttgccgcacccgcaaccggtaacaacgtcgttctcgttgtgccgtggg

SEQ ID NO: 96590 - DNA, 75 bp, Artificial Sequence
  Synthetic
agaacattggcagtctggcggcgctagcgttaacgtcggaagatcacgcgctcgcagaacgcatcatcgatgtag

SEQ ID NO: 96591 - DNA, 75 bp, Artificial Sequence
  Synthetic
cgggagtcctcggaagcaataggagcgaggtgcgtgtgcaggtcgcagcgtgcgcgcaacgcaatggacccatgg

SEQ ID NO: 96592 - DNA, 75 bp, Artificial Sequence
  Synthetic
atgggtcagacttagcgcgcgtttctacgcacctttcaggggagaactcaacattagtggcgaattcgttgcata

SEQ ID NO: 96593 - DNA, 75 bp, Artificial Sequence
  Synthetic
acctgggtgcgcttcagcgcgagtcgatggacgcggtggcaaacgtagcggaatcgctcgggatggtgaaggcgg

SEQ ID NO: 96594 - DNA, 75 bp, Artificial Sequence
  Synthetic
acatggctatgggtcgcgtcatccaggacgaggttcaggcgagggctcccggggtttttgaggtcctttccgaga

SEQ ID NO: 96595 - DNA, 75 bp, Artificial Sequence
  Synthetic
accatcagaatgaagaggaccagacgagatcctacgtggacgattcgcgcactctctttccgcatctctacgtcg

SEQ ID NO: 96596 - DNA, 75 bp, Artificial Sequence
  Synthetic
tgtacgtgggcgacgacacgcttcactatattcgcatgcttacgctaaggcccgagcacgtcgaccgcgcgatcg

SEQ ID NO: 96597 - DNA, 75 bp, Artificial Sequence
  Synthetic
atgtcattttcaagacaatcgagctatgtggacacgaggcttcggcgtccaagacaacgttcgcgcccttttccg

SEQ ID NO: 96598 - DNA, 75 bp, Artificial Sequence
  Synthetic
cgatgaacggtgatgcaacgccggaagtcgtagactcgctggcggttgggaatgttctgtatctgttccatgatg

SEQ ID NO: 96599 - DNA, 75 bp, Artificial Sequence
  Synthetic
agtcgtagactcgctggcggttgggaatgttctgtatctgttccatgatgacttccaggctgtggagtacgtctt

SEQ ID NO: 96600 - DNA, 75 bp, Artificial Sequence
  Synthetic
cggaaaagacccagacgcacgcgaagcaaggcatttacattccgcaggacagaatgatgattatctcctcggagc

SEQ ID NO: 96601 - DNA, 75 bp, Artificial Sequence
  Synthetic
ccaacgcgacccacgcgctctgccatcgaccaaccattacctggcgtgggcccccaacgcaccgagatatggcga

SEQ ID NO: 96602 - DNA, 75 bp, Artificial Sequence
  Synthetic
cccccaacgcaccgagatatggcgaagaagagctcgtgatgtgggtcgcgtacttccatcactcgacacgtccgt

SEQ ID NO: 96603 - DNA, 75 bp, Artificial Sequence
  Synthetic
gccgaaaggagatcgaaaatgtggcagggtacatgcgagcgcaggtcaccaccttcgtcacgaaggtcagccgcg

SEQ ID NO: 96604 - DNA, 75 bp, Artificial Sequence
  Synthetic
agaagagctcgtgatgtgggtcgcgtacttccatcactcgacacgtccgtttttcgatgactcggagatgcgaac

SEQ ID NO: 96605 - DNA, 75 bp, Artificial Sequence
  Synthetic
gcttcagcgaggatctcgcgcatcgcattctgctcttcaaatccgctctcgtcgggtatcgacgcatgaaagcca

SEQ ID NO: 96606 - DNA, 75 bp, Artificial Sequence
  Synthetic
tgtgatagcacggaacatcgaggccgacctcaacttccatgcgagccaggcgacacgtcgcggcggacgacttta

SEQ ID NO: 96607 - DNA, 75 bp, Artificial Sequence
  Synthetic
ccatcagggagggaagcgtctaccgtcgccgcaacttccactcccatgaagacgggtacacgttatgccgtgtgt

SEQ ID NO: 96608 - DNA, 75 bp, Artificial Sequence
  Synthetic
cttccagcgctttgggcgcgagggtcagggggccgccgatgtcgacgccatgtatcaacgccagttacagggacg

SEQ ID NO: 96609 - DNA, 75 bp, Artificial Sequence
  Synthetic
acgaccccacaattctttacgcacccattgattcgggcgggtatggcgtacaccccttcgccctaaacgtcgtcc

SEQ ID NO: 96610 - DNA, 75 bp, Artificial Sequence
  Synthetic
caccctgctggagcattacctagcccgcgcaaatacctatgagcgcttgttctttccctccctgctcctgcgagg

SEQ ID NO: 96611 - DNA, 75 bp, Artificial Sequence
  Synthetic
agacacgggaactccacctcgactctcagcagctgttccctgtgtaccgggacctcgtcgcgcgccgggttataa

SEQ ID NO: 96612 - DNA, 75 bp, Artificial Sequence
  Synthetic
ctggaccgctggcgtgtacacggaagccgaaatgcatggctggttcgccggagcccacacatgccagctatgtta

SEQ ID NO: 96613 - DNA, 75 bp, Artificial Sequence
  Synthetic
gccgaaatgcatggctggttcgccggagcccacacatgccagctatgttacgccgctgcacacaccgcccatcgg

SEQ ID NO: 96614 - DNA, 75 bp, Artificial Sequence
  Synthetic
tggacgcattcccaccctcctggaacgaaagcgatgtggacacgcgactcatatcgacaaagacgccaatggggc

SEQ ID NO: 96615 - DNA, 75 bp, Artificial Sequence
  Synthetic
gagcccacacatgccagctatgttacgccgctgcacacaccgcccatcggagggttttgagtgtagacgtgagaa

SEQ ID NO: 96616 - DNA, 75 bp, Artificial Sequence
  Synthetic
ccgctgaggagacggggtcgcacgcgctgcgctcactgcggcccctacgacacgggggcgaagatttggcgggga

SEQ ID NO: 96617 - DNA, 75 bp, Artificial Sequence
  Synthetic
tgttctctaagatcgtccgccaaacgcctcgcctcgccctaacggaccccgagctcatggccctagtcgaccagc

SEQ ID NO: 96618 - DNA, 75 bp, Artificial Sequence
  Synthetic
tcagatcccaggacatgcaagacaacgaaatgctcacccgtcagggcgatcactggtgcgcgaccgtttgcagaa

SEQ ID NO: 96619 - DNA, 75 bp, Artificial Sequence
  Synthetic
ttcccctaggagagcactccccgactcgtctgtcgtcgaccatgatgcggggcgccctgctgaaagagcccagag

SEQ ID NO: 96620 - DNA, 75 bp, Artificial Sequence
  Synthetic
cacgaacgcttctctctccggcgtacgaggaacagttttccaaaacgctgagctcgtggagggagcctgttgagt

SEQ ID NO: 96621 - DNA, 75 bp, Artificial Sequence
  Synthetic
catcccgagaggcggtgtatgttacttccaccatgatgcaccgcttcttgcgcggccgagggatcggacatgctt

SEQ ID NO: 96622 - DNA, 75 bp, Artificial Sequence
  Synthetic
tcttgcgtgcgctgtcttcggacgcgattgcgcggtgctatctgcactggctcccagagaaagacgaatgcatcg

SEQ ID NO: 96623 - DNA, 75 bp, Artificial Sequence
  Synthetic
tctcgccgatcgggcaacacgaagtgacgtctgcgtatgctaaggtcctagatctgcgagtcgagaaacgtgaag

SEQ ID NO: 96624 - DNA, 75 bp, Artificial Sequence
  Synthetic
tcctgtttcggctcctcgcctacgctcagcgattatactcccccccctcccttctgcggctgggcgcgtggactg

SEQ ID NO: 96625 - DNA, 75 bp, Artificial Sequence
  Synthetic
ccccaatcccgttttttccagaccagaacctgtcccctggcttcttggcgcaaaagatgtacgtcggccaccgaa

SEQ ID NO: 96626 - DNA, 75 bp, Artificial Sequence
  Synthetic
acctcggagttttcttccgtgagatgtttcgagaggttcaggtgagcgaggcgagcgcaagaagtgtacattctg

SEQ ID NO: 96627 - DNA, 75 bp, Artificial Sequence
  Synthetic
cgacgacgcgaccactgcgatcttacgtcgatcaaattgaccgaatcctacgcggcgacacggtaatgaggggta

SEQ ID NO: 96628 - DNA, 75 bp, Artificial Sequence
  Synthetic
gcgagcgcaagaagtgtacattctgccctgttggcgttggtccgctaccacgtgcatctcatcgcacagcatggc

SEQ ID NO: 96629 - DNA, 75 bp, Artificial Sequence
  Synthetic
tccttacgtcaagtgcgatcatgagcctactcgaaaagattggcttcgatcacgatccgaccgatctcgctacag

SEQ ID NO: 96630 - DNA, 75 bp, Artificial Sequence
  Synthetic
tacacgcgcccacgcgccccgcccgctcggcctcacccaattcgccgacgttaaacggacttgacctaaaagaac

SEQ ID NO: 96631 - DNA, 75 bp, Artificial Sequence
  Synthetic
tctttgagctgctgaatcttgaaccgcgagttgcacgacgcctagcggagttcgtcacgagtgacagactacgct

SEQ ID NO: 96632 - DNA, 75 bp, Artificial Sequence
  Synthetic
aagaaccaattggctaccttgcgcctggacggaccatcgtccgccacttcgtggcggcgcaggaaattaagatac

SEQ ID NO: 96633 - DNA, 75 bp, Artificial Sequence
  Synthetic
ttgatgtgcatctgttaaaccggcggggaatcgggggtgacgagttttcgatgtctctcgacgtttgtaccgagg

SEQ ID NO: 96634 - DNA, 75 bp, Artificial Sequence
  Synthetic
gtaaaatcttgttcgccatggaggatttcgagatacttatcaaaggaccggatcgctttaaacctcatgtacagc

SEQ ID NO: 96635 - DNA, 75 bp, Artificial Sequence
  Synthetic
gttcgcgcgacgagcggatcgactgtccacccgagttcacgcctgtcgagagagacgccgtctcactccatggag

SEQ ID NO: 96636 - DNA, 75 bp, Artificial Sequence
  Synthetic
acgaatacgacgaattcgacattgtgctgacaccgcatacccacgactcacgcgggccgtacaagcatgaagaga

SEQ ID NO: 96637 - DNA, 75 bp, Artificial Sequence
  Synthetic
aacaaatccagatgctttacgcctcccacttcggcagctcgtgtcgagtagtctttcaggtacgacccgagcatc

SEQ ID NO: 96638 - DNA, 75 bp, Artificial Sequence
  Synthetic
ggatggcgaccgacacactcttcgacgaacctaaacatcaagaaccgggagcgcctcatagcctttgcgtgcctg

SEQ ID NO: 96639 - DNA, 75 bp, Artificial Sequence
  Synthetic
gatcggccctaagacgcatccgtgttaaaatgcgtgcgcctcgccagcgtatcgtccgaagtgcgagtcgcgcag

SEQ ID NO: 96640 - DNA, 75 bp, Artificial Sequence
  Synthetic
tggcggcgagcgcggggataagatatacacagaggaggatcaacaggcttgaggcagagcaggaactcgctaacg

SEQ ID NO: 96641 - DNA, 75 bp, Artificial Sequence
  Synthetic
cagacgatcactgttggatggcgtggcgtccgacggatggcggtcagtacgcgacacaaactgatctagggatgg

SEQ ID NO: 96642 - DNA, 75 bp, Artificial Sequence
  Synthetic
gtaaaaatttcctcatttccgagcgaaattgctgcaaacgcaacgatgtctgccgacaagcaaattccgatgatc

SEQ ID NO: 96643 - DNA, 75 bp, Artificial Sequence
  Synthetic
cagtgcgatctgcgtcgcaggcgctcgctgagggacagttcctgtaaggggacgttccgcctgacataatcctac

SEQ ID NO: 96644 - DNA, 75 bp, Artificial Sequence
  Synthetic
ttgcggcctcggggaagactgcgaggacaatatgttcgcatgtgcggtcctggtgcgccgagaagcggtgccata

SEQ ID NO: 96645 - DNA, 75 bp, Artificial Sequence
  Synthetic
cgaaagccctttacccgaacaatcgtcctcaagagtacggggaaagatgactacgtcgcgaaaatgtgcaacgcg

SEQ ID NO: 96646 - DNA, 75 bp, Artificial Sequence
  Synthetic
cggatacagaggtgcgtaggttccgcgactgtatgatgctgcagattttcgccatagactcatctgctactgtgt

SEQ ID NO: 96647 - DNA, 75 bp, Artificial Sequence
  Synthetic
ttggggtgtgagtacttagttgtacgtcatggactcgggatgcacgtggctggcagcaatacccccacccatggg

SEQ ID NO: 96648 - DNA, 75 bp, Artificial Sequence
  Synthetic
acgtaggtcctgagaacgtgaggccggttaggcaaacctgttacacgatgcgaggaaacgcggagaacatcatca

SEQ ID NO: 96649 - DNA, 75 bp, Artificial Sequence
  Synthetic
tgcatgctgctgctgattcccggagcggggtcgttccgtctaatcgatagggatcagtcgacgtttgtggtcgtt

SEQ ID NO: 96650 - DNA, 75 bp, Artificial Sequence
  Synthetic
cgcggccattcacggagaagtgggcgaggacgatgagtgagaaatatgcagttcgggcgaaacagcggttacatt

SEQ ID NO: 96651 - DNA, 75 bp, Artificial Sequence
  Synthetic
tcgagtgacgggctggaggtgcagcaggaccggtggcctgggatgcgcttcgaagcggtcgatatgtttccaaga

SEQ ID NO: 96652 - DNA, 75 bp, Artificial Sequence
  Synthetic
gcagagtatctgtcgcgactgagaacgcggtcagggcgcttttgctggaggtgttccaaattatgtacatctatc

SEQ ID NO: 96653 - DNA, 75 bp, Artificial Sequence
  Synthetic
tgctgtcgtatcgtggtgggtgatgtcgccgcagattcagagattagattcggaagcgcttcaggaacggtgccg

SEQ ID NO: 96654 - DNA, 75 bp, Artificial Sequence
  Synthetic
tccctcccgatcatagatatagacgcggcgaattcgagcgcaccatcaagggacgacttctccacgtgtcaagag

SEQ ID NO: 96655 - DNA, 75 bp, Artificial Sequence
  Synthetic
ccgtacacagctggggagagcatggaggctcaggacgagatctcgttgccgggattggatttcagcgtgccggat

SEQ ID NO: 96656 - DNA, 75 bp, Artificial Sequence
  Synthetic
atatggtgcgtagcggcggatgcgtcgccgagcgcgtccacaacatgctcgcgagcattgtcggatgccgtgccg

SEQ ID NO: 96657 - DNA, 75 bp, Artificial Sequence
  Synthetic
tcggatcttcgtgaataccgcgaaaagctccgcgaggagaaagaggaacgcgcggctgcgatcctctcggcgttg

SEQ ID NO: 96658 - DNA, 75 bp, Artificial Sequence
  Synthetic
tcaaaggtggtccagactcgtacacggcggcatctacgtcgcgatggatcctgtcgactcctcttttcgagtacg

SEQ ID NO: 96659 - DNA, 75 bp, Artificial Sequence
  Synthetic
cgcacaactcaacaatcgagaacgcttggtcgcctgcacggagtgaagacctccgacttggtaacgctgcgcccg

SEQ ID NO: 96660 - DNA, 75 bp, Artificial Sequence
  Synthetic
cgcgccacgcggacggaaacgacgacgcgatgctacggtacgttgcgctgcatttactgttgtcatgcacgccgg

SEQ ID NO: 96661 - DNA, 75 bp, Artificial Sequence
  Synthetic
ccgcagccgccgacgcccggccgtaatggccactctgcgttgatgagctcagcgccagttccaccgccgctagtg

SEQ ID NO: 96662 - DNA, 75 bp, Artificial Sequence
  Synthetic
gcgccgggtttcaggacacggttatccctctcgcgcaatgcctcaacgatccacacagacaggagcggcggacgg

SEQ ID NO: 96663 - DNA, 75 bp, Artificial Sequence
  Synthetic
ccgacatcctcctcgacgggctcgccggccctttccaccacgggattgaagcgcactcagaagctagcgcccccc

SEQ ID NO: 96664 - DNA, 75 bp, Artificial Sequence
  Synthetic
aaacgcttggacagctgtgcgacgcgacgctgggcgaatggatgagaataaacccgcactgcccacagtatggct

SEQ ID NO: 96665 - DNA, 75 bp, Artificial Sequence
  Synthetic
cccgtcgcggagtcagcgggacccacgttcggggccgactccaaccgattcatcgaggaagcgctcgaggcggtc

SEQ ID NO: 96666 - DNA, 75 bp, Artificial Sequence
  Synthetic
ctccggcgtcccaaggaatggttgggaatctacgcctcctgctcagccggttggaggcgggagataccttcttcg

SEQ ID NO: 96667 - DNA, 75 bp, Artificial Sequence
  Synthetic
atgcaggatgacgcgtccggacggctgaactttggaggcgaacccgagtcagtgggtctgttctcgcagaatctt

SEQ ID NO: 96668 - DNA, 75 bp, Artificial Sequence
  Synthetic
ccttcaaggaagctaccatcgcccccgtacgaaaccttggggttactcatgcgctatatggtggcatatgcgggg

SEQ ID NO: 96669 - DNA, 75 bp, Artificial Sequence
  Synthetic
ggcagctttgacatcccaccgagccagttgcccgcctacgaaatcgacgagacgcggaataagtacaaatacgtc

SEQ ID NO: 96670 - DNA, 75 bp, Artificial Sequence
  Synthetic
gtcacaaagagattctcacatgccttgtcccgtaccgagcgccacgaaaatgtttcctctgtcttgtgttgtgca

SEQ ID NO: 96671 - DNA, 75 bp, Artificial Sequence
  Synthetic
gggatgcggacatccacgcgcctgcatgcgctcgcttgcgacgaccgcgtctacttcgttcccagcgctgaataa

SEQ ID NO: 96672 - DNA, 75 bp, Artificial Sequence
  Synthetic
acgcggagatagaagacaacggagtagacgaagtcgtccgaacacgcgtaagaggcgtcgaagactcatgcatcg

SEQ ID NO: 96673 - DNA, 75 bp, Artificial Sequence
  Synthetic
gtaaaacttctgggagcgatggcaaatccgcaaaatcgagtgcaaacagaaagacagcagagcaacagctcacca

SEQ ID NO: 96674 - DNA, 75 bp, Artificial Sequence
  Synthetic
cgtctacttcgttcccagcgctgaataagcgctgaatgcaggggcgtgattcgcggaggggggagattaggatac

SEQ ID NO: 96675 - DNA, 75 bp, Artificial Sequence
  Synthetic
ggaggtgcgtcgtccgactgaattcagagggtgtccgggtacggacgtcgggagaccttcgtacggttgtcgagc

SEQ ID NO: 96676 - DNA, 75 bp, Artificial Sequence
  Synthetic
tatctaagaggcgatgaagtacacgacgaccctggaatcgcattgtctgtcttcgccctacaagagatcatccga

SEQ ID NO: 96677 - DNA, 75 bp, Artificial Sequence
  Synthetic
aatacgcatggtgctatacgtccgggacttgtgtgatagtgaagccccgcagcgcgacacgtgaaggagcggact

SEQ ID NO: 96678 - DNA, 75 bp, Artificial Sequence
  Synthetic
aaagtccgagagtcacagacttcactgcgcaatgaggggcgtgaggtcaaccccgcgccccccgagattgagcaa

SEQ ID NO: 96679 - DNA, 75 bp, Artificial Sequence
  Synthetic
ttatgacgaaagttctccggttccgcgactagtcacgaagtccttggggcgtgctaaccccgcgggcaagaccaa

SEQ ID NO: 96680 - DNA, 75 bp, Artificial Sequence
  Synthetic
atcttttcggcgctgagcgacctgcgcgatgagagaccctatcgaatagaacggaggctacccacgtattacaga

SEQ ID NO: 96681 - DNA, 75 bp, Artificial Sequence
  Synthetic
acgaaagttctccggttccgcgactagtcacgaagtccttggggcgtgctaaccccgcgggcaagaccaagatac

SEQ ID NO: 96682 - DNA, 75 bp, Artificial Sequence
  Synthetic
ttcgagtcgtctcaatcgcaggagcgtttcttccgagtggatagccacttcgaaaggatcgccgcaccagttgat

SEQ ID NO: 96683 - DNA, 75 bp, Artificial Sequence
  Synthetic
aacacgactctggaggagccagccaggctgatgtctttagtgcttgcgcgggtagacaccatacgcgaggccgga

SEQ ID NO: 96684 - DNA, 75 bp, Artificial Sequence
  Synthetic
cggcggtcgaggcgcttaaagacgatgaaactacgcgtatgctcaaagcgcatgttaatgagacatcgctgcgag

SEQ ID NO: 96685 - DNA, 75 bp, Artificial Sequence
  Synthetic
tctttcctcctttacaacgcgcctacgcacttcattgatggacgtgaaataatcgacgccgacggcttaggcgtt

SEQ ID NO: 96686 - DNA, 75 bp, Artificial Sequence
  Synthetic
aagcggagcgcaccttggcgaaactgaaacgaaagtgtctccttttgcgttgtgccgagttgatgtgtctcgccc

SEQ ID NO: 96687 - DNA, 75 bp, Artificial Sequence
  Synthetic
gacgtctccggtctgctccgccttgtcgagccgagagttcgtcacctgctgcagagacagatagaccagctgacc

SEQ ID NO: 96688 - DNA, 75 bp, Artificial Sequence
  Synthetic
ttacgatcgggatctcagtcgtcctaatgatcacgagcgctgccgacgctctggaggcacaattaaagagaataa

SEQ ID NO: 96689 - DNA, 75 bp, Artificial Sequence
  Synthetic
gtcctgaatcaggaccaggaggacaccatggtggatacctaccctggcgcatgccccgacgctgttttccgagtg

SEQ ID NO: 96690 - DNA, 75 bp, Artificial Sequence
  Synthetic
caccgcgctctcacagcccacgtggtgcatcaccagcgggatgattacagaaacgcgatgcaatggctgcaggcc

SEQ ID NO: 96691 - DNA, 75 bp, Artificial Sequence
  Synthetic
agcgcagaaaaaagagcttaaagcgtgacctcgtaaagaagcagatgtatgtatctttcgtccggagaatggggt

SEQ ID NO: 96692 - DNA, 75 bp, Artificial Sequence
  Synthetic
tacggagagtacaagcgtatagacttctcgcgatcgctgctcacagacgtattttcccctgacacggtttacatt

SEQ ID NO: 96693 - DNA, 75 bp, Artificial Sequence
  Synthetic
gtaaaattctctaccgacatggacgcgtacactgcacgagcactatctgttctggagggactcgcaatctccggc

SEQ ID NO: 96694 - DNA, 75 bp, Artificial Sequence
  Synthetic
cagagttaccagctgcccgccaacccgcagctcctatgggaggtaccgcggtgcggaatcccaaatcttgtgttg

SEQ ID NO: 96695 - DNA, 75 bp, Artificial Sequence
  Synthetic
gacccgcgatcacaccgagacccgacaactgaagcaacgatgtcaatcttcgcgatgagattcaatagcacgact

SEQ ID NO: 96696 - DNA, 75 bp, Artificial Sequence
  Synthetic
aatgcggcgctcggcgtgccacaaggaacgtatattacgcccaacccaaggatcacgtcgatcacgatcgcttcg

SEQ ID NO: 96697 - DNA, 75 bp, Artificial Sequence
  Synthetic
tcacgtcccgtgatcggaacgccaacgacacgagaagcgaggcggaataacttctacgcagctgtggatgtcgca

SEQ ID NO: 96698 - DNA, 75 bp, Artificial Sequence
  Synthetic
cgtgtcacaactaccacctcgtttgcgcagttgctcgggaccattcccaccgcggcccagatggatgacgtgcga

SEQ ID NO: 96699 - DNA, 75 bp, Artificial Sequence
  Synthetic
aagatctatctagcgttgatgttcccgaaccagatcctgctcgacattagatcggagcccggacatcaggttgat

SEQ ID NO: 96700 - DNA, 75 bp, Artificial Sequence
  Synthetic
gcgcgcgacgaaattccctatacgccgtcaaccttcagacgcgtacagcgcatacgtgtgtgcacgtccgattat

SEQ ID NO: 96701 - DNA, 75 bp, Artificial Sequence
  Synthetic
gttgtcgcgcagtccgtcgcaggggtcttgggtaagttgctcttctcttatggaccagcactgttcaacattacc

SEQ ID NO: 96702 - DNA, 75 bp, Artificial Sequence
  Synthetic
tcgaacgtcagggaagagttccacccttacgcgcaccatgaggcgatcactactccaggcgtaatcttgcccgca

SEQ ID NO: 96703 - DNA, 75 bp, Artificial Sequence
  Synthetic
ccccacacggccagagctcttgaccgcgcctgcgcttcttttctgcaaatggcgacagacgacaggcgcaccatc

SEQ ID NO: 96704 - DNA, 75 bp, Artificial Sequence
  Synthetic
cctgccggaggtggagtcgcgtgctacgctatatcaacccatacgcttcagatccatttggacccgatgcaggcg

SEQ ID NO: 96705 - DNA, 75 bp, Artificial Sequence
  Synthetic
cgccatgggccctcagggcgacctctcgactttgtcatcacgcagggacagcgtgcgttcgactgcaaccagctc

SEQ ID NO: 96706 - DNA, 75 bp, Artificial Sequence
  Synthetic
gctccccttgcaggcatcatctttccggacagggaagatgtaatcatggccgagtttacgtggcagagactagcg

SEQ ID NO: 96707 - DNA, 75 bp, Artificial Sequence
  Synthetic
gcccagaaccccgctcggggcaacggttatgcgggctggggagttgacgccgtgggtgaccatccgactccgtac

SEQ ID NO: 96708 - DNA, 75 bp, Artificial Sequence
  Synthetic
aatgcgatcgacaacaacgcggtggtcgaccagggcacggagatcgagctgtccgttgagggagctgttatgcgc

SEQ ID NO: 96709 - DNA, 75 bp, Artificial Sequence
  Synthetic
ccgcatgtgagacgtcgtattcagtatctcggctatgtcccagaagatgtaatcgatgagaggttctgcggcgac

SEQ ID NO: 96710 - DNA, 75 bp, Artificial Sequence
  Synthetic
gctgggacgcccttcacagcaacaagtaggaaccatatcatgctgactagctacgagcccgtcgatacgtgtacc

SEQ ID NO: 96711 - DNA, 75 bp, Artificial Sequence
  Synthetic
gacctgcgctacccgcttcatgaaacgatgtgcgaggctctagcgatctcgggtcacgtaaacgagaggaactac

SEQ ID NO: 96712 - DNA, 75 bp, Artificial Sequence
  Synthetic
gcacacatcacctgccaccgctattgggtaacgtcgcccccgcgtgttgtctacgactccatggaggcggatatc

SEQ ID NO: 96713 - DNA, 75 bp, Artificial Sequence
  Synthetic
gttgagatgatgcggcagcatcacgtcgtgagattcgcgcatctcagccaagttatcaatcgggacctcgtatcc

SEQ ID NO: 96714 - DNA, 75 bp, Artificial Sequence
  Synthetic
ttggcggtctacacatacaaggacgacttctgggatgcgctgcgtggttacgttcttcagactctgggaatgccg

SEQ ID NO: 96715 - DNA, 75 bp, Artificial Sequence
  Synthetic
gccttttccctaccggatgagagattcaacatgctcgcggcgggcgtcccacgggatgccaccggaccggatgga

SEQ ID NO: 96716 - DNA, 75 bp, Artificial Sequence
  Synthetic
atgcaccactaccccctgcgacccgtcacggagtttagacagaacttggcgattgccattctctctcgcctgttt

SEQ ID NO: 96717 - DNA, 75 bp, Artificial Sequence
  Synthetic
ccgctcgtgctcgacataagctacatggctatcatacacgcgttccgcctgcgctttctcccagtctccaggcca

SEQ ID NO: 96718 - DNA, 75 bp, Artificial Sequence
  Synthetic
gattgccattctctctcgcctgtttgatgtatactgcgcgatgtcaccagagatcaacgcgcctgtggctgccca

SEQ ID NO: 96719 - DNA, 75 bp, Artificial Sequence
  Synthetic
gagcgtattgtctatcagcccatgctcgaatccgtctacgcctcccacctctcactggcaaaacttcacgcgaac

SEQ ID NO: 96720 - DNA, 75 bp, Artificial Sequence
  Synthetic
gtaaaaatttcctttgttcgtggtcgcgccagagacacgatggagcagttcatccgcaagttcaagccaaccgct

SEQ ID NO: 96721 - DNA, 75 bp, Artificial Sequence
  Synthetic
aatttacagacgtttgtcacagcaaactcggagagcttcgtggaggcgcggcctctggacacttggagggccgtc

SEQ ID NO: 96722 - DNA, 75 bp, Artificial Sequence
  Synthetic
gatcaggccctcgccttaagaaccatcaacgcgctgtctgacatatggaattgcggacacaggagatacgattgt

SEQ ID NO: 96723 - DNA, 75 bp, Artificial Sequence
  Synthetic
tatccccgcttgcccgagcccgtccgccaaatttttgacctcacaggtcagcattcgttcgtgacgggacgtgac

SEQ ID NO: 96724 - DNA, 75 bp, Artificial Sequence
  Synthetic
atcggattatggctgcgctcacccctggtacaggattcgctcttcctgctgtgcgctcgaacggcttggcaggca

SEQ ID NO: 96725 - DNA, 75 bp, Artificial Sequence
  Synthetic
gtggacgaccctgcggacatcggctttacgcgcgacgtctacattcaccgccagccagctccggaatacccgttg

SEQ ID NO: 96726 - DNA, 75 bp, Artificial Sequence
  Synthetic
gaggacgtgcgccaattccgacgagacgcggtctatttcacgaatatgctggaggcgcgaccagcaaacggcaat

SEQ ID NO: 96727 - DNA, 75 bp, Artificial Sequence
  Synthetic
cgatgaacggtgatgccacgccggaagtcgtagactcgctggcagttgggaatgttctgtatctgttccatgatg

SEQ ID NO: 96728 - DNA, 75 bp, Artificial Sequence
  Synthetic
agtcgtagactcgctggcagttgggaatgttctgtatctgttccatgatgacttccaggctgcggagtacgtctt

SEQ ID NO: 96729 - DNA, 75 bp, Artificial Sequence
  Synthetic
cgagtgatcctggaccgggtaatcatgcagcagcgagctggggcgggacgtctacggatgtctatccgcgaacta

SEQ ID NO: 96730 - DNA, 75 bp, Artificial Sequence
  Synthetic
ctcgacgacggcttgtttgtgcaaatcggatcagccctgcgaccgattactctgagcattcatcacggactgccg

SEQ ID NO: 96731 - DNA, 75 bp, Artificial Sequence
  Synthetic
aggagagctcgtgatgtgggtcgcgtacttccatcactcgacacgtccgtttttcgacgattcggagatgcgaac

SEQ ID NO: 96732 - DNA, 75 bp, Artificial Sequence
  Synthetic
ccggaggagaccctgcgcgccttacccttcgaatatcgtcgcgagagtgcgaacggccctacggcacgtgtcacc

SEQ ID NO: 96733 - DNA, 75 bp, Artificial Sequence
  Synthetic
cttcagatgctccggcccgtttccgccttcttcatgctgtacaacgcggacgaacaggcgttccccgacgagatg

SEQ ID NO: 96734 - DNA, 75 bp, Artificial Sequence
  Synthetic
cttccagcgctttgggcgcgagggtcagggggtcgccgacgtcgacgccatgtatcaacgccagttacagggacg

SEQ ID NO: 96735 - DNA, 75 bp, Artificial Sequence
  Synthetic
atcgacctcgtccctaagatgtcactcgtgagcctatacgtacaacagccccccgtggagcgcgtcagttacgac

SEQ ID NO: 96736 - DNA, 75 bp, Artificial Sequence
  Synthetic
caccttgctggagcattacctagcccgcgcaaatgcctatgagcgcttgttctttccctccctactcctgcgagg

SEQ ID NO: 96737 - DNA, 75 bp, Artificial Sequence
  Synthetic
acggcgctgagcgtcataaatcgcgactttgtttcgttccgatctcgcgtgcgcctgatggatttgtcagctgca

SEQ ID NO: 96738 - DNA, 75 bp, Artificial Sequence
  Synthetic
gagcccacacatgccagctatgttacgccgctgcacacaccgcccatcggagggtactgagtgtggacgtgagaa

SEQ ID NO: 96739 - DNA, 75 bp, Artificial Sequence
  Synthetic
ttcgatgcggggagccagtatgctcttccctctaacgcgatgtagggattcagccccccgcgcgttgcgtgaaca

SEQ ID NO: 96740 - DNA, 75 bp, Artificial Sequence
  Synthetic
atgctcttccctctaacgcgatgtagggattcagccccccgcgcgttgcgtgaacagggccagggtgcaagatac

SEQ ID NO: 96741 - DNA, 75 bp, Artificial Sequence
  Synthetic
gtaaaaatctgtcgaccatggaggagttcgaggtgctgatcaagaacgcagatggaaaatataaagtggggtcgt

SEQ ID NO: 96742 - DNA, 75 bp, Artificial Sequence
  Synthetic
catccagagaggcggtgtacgttacttccaccatgatgcaccgcttcttgcgcggccgagggattgggcacgcat

SEQ ID NO: 96743 - DNA, 75 bp, Artificial Sequence
  Synthetic
atacggagttcgatatcgtgctcacgccacatacgaaagaggatgaagctgcatacgttttagagaagcggctct

SEQ ID NO: 96744 - DNA, 75 bp, Artificial Sequence
  Synthetic
gttctgatatagaatatgagaagcaagagagggttgggatgccgatgtcgattgcgattccgaacgcagcggcgg

SEQ ID NO: 96745 - DNA, 75 bp, Artificial Sequence
  Synthetic
ttggaatagactacctcgaggggcgactgacccgagaagacgcggaggcagcgctcgacgataaagatgatgtga

SEQ ID NO: 96746 - DNA, 75 bp, Artificial Sequence
  Synthetic
gctatgcggtatggtcgcacaccgaccaggggaactatcgcgcgcgaatggcttgtggggacgttgagatgaagc

SEQ ID NO: 96747 - DNA, 75 bp, Artificial Sequence
  Synthetic
gcgagcgcaagaagcgtacattctgccctgctggcgttagtccgctaccacgtgcatctcatcgcacaacatggc

SEQ ID NO: 96748 - DNA, 75 bp, Artificial Sequence
  Synthetic
cgcgtacggcgagaacgtgctgttttcatcggttgtcctggtgcaaagagggacggtgccacacccgattagagg

SEQ ID NO: 96749 - DNA, 75 bp, Artificial Sequence
  Synthetic
cggaacgggcgcgcgagtgcgtgctactatgcctgctattggtcgaagaggacgggaagatctcggtcgggccac

SEQ ID NO: 96750 - DNA, 75 bp, Artificial Sequence
  Synthetic
attgttggcaccaggcgacgtgattgaaagcgtcgccgacaagctgcgagaacgtgacattgacatcaaaatact

SEQ ID NO: 96751 - DNA, 75 bp, Artificial Sequence
  Synthetic
gaacccgtgagggggcgcgcatccagtgcttcgcgcccacaaagagtgcgtacatactgcccaagccgcagtacc

SEQ ID NO: 96752 - DNA, 75 bp, Artificial Sequence
  Synthetic
aaaacatgcggacgatcatgcatccataccgccgacagatcctgcagcgaataacgaacggtcgaaacgggaatc

SEQ ID NO: 96753 - DNA, 75 bp, Artificial Sequence
  Synthetic
ggaccatgtggcgcgatgagctcgagtccttttttaaggtacaggcgaagaaacggcccatatgcaatctgtccg

SEQ ID NO: 96754 - DNA, 75 bp, Artificial Sequence
  Synthetic
ataacgaacggtcgaaacgggaatctggagttcgttcgtcagttggatcgcccggggcagcggtggatagaagaa

SEQ ID NO: 96755 - DNA, 75 bp, Artificial Sequence
  Synthetic
tttacaccgagatggcggtgcgatccctgctgttagacatattttgcatactttactgtttcctccccgcgggtc

SEQ ID NO: 96756 - DNA, 75 bp, Artificial Sequence
  Synthetic
ataagatgagggaaggtgagttccgcaccactcgccaggcgcgtgcggcgctgcttcctcggaaggtcttaaaga

SEQ ID NO: 96757 - DNA, 75 bp, Artificial Sequence
  Synthetic
gtggaagcgacgttgccgcaggagatcctagcaacgggagcggagctactagtgcaatcaaggacggtgcccaac

SEQ ID NO: 96758 - DNA, 75 bp, Artificial Sequence
  Synthetic
gcccaggaggagtggcgcagcgcatacataacctgttggcgcatgtgctccacttcggtgaggttcagacgagcc

SEQ ID NO: 96759 - DNA, 75 bp, Artificial Sequence
  Synthetic
gaaacagtggaagtaatcgcgcgcctgagaaacagatggaaagttcagcacacggtgatgatatggcacgcgaaa

SEQ ID NO: 96760 - DNA, 75 bp, Artificial Sequence
  Synthetic
cgcgcgcgttccgggacgaccccttctcctgggtcttacgtacgcccctggtggcgcacgcggagcgcgcgcgcg

SEQ ID NO: 96761 - DNA, 75 bp, Artificial Sequence
  Synthetic
acgatgacgaggcgctcacttactacgttgcactgaacttcctgctggcgggcatcccgggtgcgtgtttagaga

SEQ ID NO: 96762 - DNA, 75 bp, Artificial Sequence
  Synthetic
ttcgtatcgtttgctgccgcgccgcttaaggaactcggattacgcgcggatgagggagctgcgcagaaagacgcg

SEQ ID NO: 96763 - DNA, 75 bp, Artificial Sequence
  Synthetic
gcctcgatatcgttcgtattgagcccaggcgggaggcgcgagtgcaatacgagttaaagatgcagaagacgacga

SEQ ID NO: 96764 - DNA, 75 bp, Artificial Sequence
  Synthetic
gagtctagactcagaagggagaaggtgcgtcgtccaatagaaatcgatcggatccatagcgtacaacggctaaat

SEQ ID NO: 96765 - DNA, 75 bp, Artificial Sequence
  Synthetic
agtactgcgacgttcccctgcacgcatggctcagccaggagtacggcgcgccgcaagttgggacggatgcctcaa

SEQ ID NO: 96766 - DNA, 75 bp, Artificial Sequence
  Synthetic
gaggagttcccagtacggagtacgagagagaggagagcggtgcccgtcgctttagcaaccaacgacgcgaagtac

SEQ ID NO: 96767 - DNA, 75 bp, Artificial Sequence
  Synthetic
aagggatgcgtggaatgctggggcgcgcgctcgagcaggtacgcgcgggggggctactccgaattagaaaacgtg

SEQ ID NO: 96768 - DNA, 75 bp, Artificial Sequence
  Synthetic
gtgcgacaagcacatatactcttcaccgcacccacaggcgacccatcatggaaggagactgcgcggttagcgacc

SEQ ID NO: 96769 - DNA, 75 bp, Artificial Sequence
  Synthetic
cggaacaccccgctgtaagaacgtacgcctctgttcacgcgttgatggggtttgtgtgtaatggcttgaaggagg

SEQ ID NO: 96770 - DNA, 75 bp, Artificial Sequence
  Synthetic
cagcggaaggagatcagggcttacgcgcataaagaaaacgaaacccccgcgggagaagcgttgatcacgcttatt

SEQ ID NO: 96771 - DNA, 75 bp, Artificial Sequence
  Synthetic
tggcttcagtcatcgtgccctaccgtgcgccacgaaagagcttccttttggtcgtctttggggacgagcgcctgg

SEQ ID NO: 96772 - DNA, 75 bp, Artificial Sequence
  Synthetic
gtaaaatgttcggatcgcacacggtgctactgctacatcactcactacgaaggatacgcaaggaagtttatttgc

SEQ ID NO: 96773 - DNA, 75 bp, Artificial Sequence
  Synthetic
cgggagaagcgttgatcacgcttattgacgcgttgtgaccgtagagggtgacagtacgcagaggattaaagatac

SEQ ID NO: 96774 - DNA, 75 bp, Artificial Sequence
  Synthetic
acgattctgccgtcgccgacatcgaggcctcgcggctcgggaaaacgcgatcgtcgttcctggggacgtgcgttg

SEQ ID NO: 96775 - DNA, 75 bp, Artificial Sequence
  Synthetic
catggatcactatcaggcgggaatggacgttgaacgaattgtggaaggaaaacgggaaatacggaacggatgtct

SEQ ID NO: 96776 - DNA, 75 bp, Artificial Sequence
  Synthetic
tacggttgactaaggcgggcgtccccctagtccgagtgccggagggtgtccgaaggatcgtggaggcctacctgt

SEQ ID NO: 96777 - DNA, 75 bp, Artificial Sequence
  Synthetic
acgcagatggagacgtgtcgcggctatcaatcaggcaagcacgagcacatgggttgatattcgtcggacccagga

SEQ ID NO: 96778 - DNA, 75 bp, Artificial Sequence
  Synthetic
gggggtcaactcaggggacgtatgtcgccataaagcctcgaagcgcaacccgcgagatggcggatttcatgacga

SEQ ID NO: 96779 - DNA, 75 bp, Artificial Sequence
  Synthetic
acgcccggtttcttctgagggatgcggaggtaggccctgacgtggtcgtagaccctgccgccaaaacgaaggaaa

SEQ ID NO: 96780 - DNA, 75 bp, Artificial Sequence
  Synthetic
cgaaggtgttgcggtaccgcgattagcgccgcggactccttgggtaatgcgaagcccgtcgaccgatcaggatac

SEQ ID NO: 96781 - DNA, 75 bp, Artificial Sequence
  Synthetic
gtaaaatgttcggatcgcacacggtgctactgctgcatcactcactacgaaggatacgcaaggaagtttatctgc

SEQ ID NO: 96782 - DNA, 75 bp, Artificial Sequence
  Synthetic
tcgagacacagataggacgcgagagattacggttacgtcgagcattcggcatcatcctacgagactacgcgtgga

SEQ ID NO: 96783 - DNA, 75 bp, Artificial Sequence
  Synthetic
catggatcaccatcaaacgagaatggacgttgaacgaattatggaaggaaaacgggaaatacggaacggatgtct

SEQ ID NO: 96784 - DNA, 75 bp, Artificial Sequence
  Synthetic
ctcgtgcggtgcatttccatggcagcgaagtcgagagcataacccatggacctcacgaaggcagaaggttctacg

SEQ ID NO: 96785 - DNA, 75 bp, Artificial Sequence
  Synthetic
acgcggacggagacgtgtcatggttatcagtcagacaagcacgagcacacgggttgatattcgtcggacctagaa

SEQ ID NO: 96786 - DNA, 75 bp, Artificial Sequence
  Synthetic
gatatccacctcgagcgccgttggcttatcccagcgtggactgtgaactggtgggagatggtccagtcgacgaga

SEQ ID NO: 96787 - DNA, 75 bp, Artificial Sequence
  Synthetic
acgcgcggtttcttctgaaggacacggaggtgggccccgacgtggtcgtagacccagccgctaaggcgaaggaaa

SEQ ID NO: 96788 - DNA, 75 bp, Artificial Sequence
  Synthetic
aactcgtcagcatgctcgactacgcggtacatggttttgataatgtgatctatgtagggtcgggggacggtagaa

SEQ ID NO: 96789 - DNA, 75 bp, Artificial Sequence
  Synthetic
tcgagacacagataggacgcgagagactacggttgcggcgagcgttcggtgtcatcttgcgagactacgcatgga

SEQ ID NO: 96790 - DNA, 75 bp, Artificial Sequence
  Synthetic
cactacgtctgttcaggaagaaggaccgtcgtcgattcgctagcgtagactggatcctaatcgacccgatcgcac

SEQ ID NO: 96791 - DNA, 75 bp, Artificial Sequence
  Synthetic
ctcgcgcggtacatttccatggcagcgaagtcgagagcataacccatggacctcacggaggcagaaggttctacg

SEQ ID NO: 96792 - DNA, 75 bp, Artificial Sequence
  Synthetic
agccgatagaggacgtcgataacgttgtggtgatacgagaaacgatcgatacgccgcgagatctacgacgctttc

SEQ ID NO: 96793 - DNA, 75 bp, Artificial Sequence
  Synthetic
gatatccaccccgagcgccgctggcttatcccagcgtggactgcgagctggtgggagatggcccggtcgacgaga

SEQ ID NO: 96794 - DNA, 75 bp, Artificial Sequence
  Synthetic
gcagagatggaacgaccttgcttttatgggacgttcgaagcgaccgttgcgatttagatgacgcagcgtgggagc

SEQ ID NO: 96795 - DNA, 75 bp, Artificial Sequence
  Synthetic
agctcgtcagcatgctcgactacgcggtgcatggttttgataacgtaatttatgtggggtcgggggacggcagaa

SEQ ID NO: 96796 - DNA, 75 bp, Artificial Sequence
  Synthetic
aggtctgtctgcgtgaagacgagctcggagaggatgtggcgagtgcgaacggcgactggcttgacgccgcgctgc

SEQ ID NO: 96797 - DNA, 75 bp, Artificial Sequence
  Synthetic
cgctacgtctgttcaggaagaaggaccgtcgtcgattcgctagtgtaagctggattctaatcgatccaatcgcac

SEQ ID NO: 96798 - DNA, 75 bp, Artificial Sequence
  Synthetic
taaagcggcgggtccctttcgcaggaaccttcaagtgcttcacctcgatattatgctaccaacctggggcacccg

SEQ ID NO: 96799 - DNA, 75 bp, Artificial Sequence
  Synthetic
agccgatagaagatatcgataacgtcgtggtgatacgggaaacgatcgatgcgccgcgagatctgcgacgcttcc

SEQ ID NO: 96800 - DNA, 75 bp, Artificial Sequence
  Synthetic
aggatatgtatgagcttcgatctttcctcgccttcaattcgcgtagatggctcggaacgccgtccctggtgactt

SEQ ID NO: 96801 - DNA, 75 bp, Artificial Sequence
  Synthetic
gcagagatgggacgactttgcttttatgggacgttcgaagcgaccgttgtgatttggatgacacagcgtgggagc

SEQ ID NO: 96802 - DNA, 75 bp, Artificial Sequence
  Synthetic
tggccgcggatggaatacgtcaacgcattcctatttatcacggccgcggcaaagggcggttgctaaggacaagac

SEQ ID NO: 96803 - DNA, 75 bp, Artificial Sequence
  Synthetic
aggtctgtctgcgtgaagacgagctcggagaggatgtggcgagtgggaacggcgactggcttgacgccgcgctat

SEQ ID NO: 96804 - DNA, 75 bp, Artificial Sequence
  Synthetic
tcatccagacgttgcatgtcgaacccgcggacgcactcacgcatacttccgctcctcgtgcggatctcttctatt

SEQ ID NO: 96805 - DNA, 75 bp, Artificial Sequence
  Synthetic
tgaagcggcgaatccccttcacaggaacttttaagtgtctcacctcgatattgtgctaccagcccggggcgcccg

SEQ ID NO: 96806 - DNA, 75 bp, Artificial Sequence
  Synthetic
taaccaatcgacggaacccgccggagaaggtgttcgacgtcgctgctcggagcgagatctcgaccctctgggtgg

SEQ ID NO: 96807 - DNA, 75 bp, Artificial Sequence
  Synthetic
aggatatgtacgagcttaggtccttcctcgcctttaattcgcgtagatggctcggaacaccatccctggtgactt

SEQ ID NO: 96808 - DNA, 75 bp, Artificial Sequence
  Synthetic
gggatccccttctctcgtatgacgattacagtatggatcggacggagatcatgttgcgctgctccagtgacacac

SEQ ID NO: 96809 - DNA, 75 bp, Artificial Sequence
  Synthetic
tgatcgcggatgggatacgtcgacgcatccctatctatcatggccgcgacagggggcgattgctgaggacgagac

SEQ ID NO: 96810 - DNA, 75 bp, Artificial Sequence
  Synthetic
acatggtgactgatggacttggtttcgtgttattgcttatgctggagggggaagtcaaaaacaccgtgaaattcg

SEQ ID NO: 96811 - DNA, 75 bp, Artificial Sequence
  Synthetic
tcatccaaacgctgcatgtcgaacccgtggatgcgctcacgcatacctctgcccctcgcgcagatctcttctatc

SEQ ID NO: 96812 - DNA, 75 bp, Artificial Sequence
  Synthetic
acccgggctgggcgtgcaattatgcagttgtattcagaaggcgggctgtcgctgctgtaccggacgtctggctct

SEQ ID NO: 96813 - DNA, 75 bp, Artificial Sequence
  Synthetic
taaccaatcgacggaacccgccagagaaggtattcgacgtcgtcgctcggagtgagatctcgaccctctgggtgg

SEQ ID NO: 96814 - DNA, 75 bp, Artificial Sequence
  Synthetic
gccgcttcataggcctacgagccaactcatcctccctcaggttacgcgagcccatctcccacgccacttcagacc

SEQ ID NO: 96815 - DNA, 75 bp, Artificial Sequence
  Synthetic
gggatccccttctttcgtacgacgattacagtatggagcgaacggagatcatgttgcgctgctccagtgactcac

SEQ ID NO: 96816 - DNA, 75 bp, Artificial Sequence
  Synthetic
tgataaagtcctttgggattgatttgtcaggacacctgtacgtgacgctcatcacgggcaggtatctctcagacc

SEQ ID NO: 96817 - DNA, 75 bp, Artificial Sequence
  Synthetic
acatggtgaccgatggacttggctttgtgttattacttatgctggaaggagaagtcaaaaacaccgtgaagttcg

SEQ ID NO: 96818 - DNA, 75 bp, Artificial Sequence
  Synthetic
tgcgaacgtggttccgcatgattctagattggagcagtaagggccgcgaggagaagatgctggcgcttgcgcacg

SEQ ID NO: 96819 - DNA, 75 bp, Artificial Sequence
  Synthetic
acccaggttgggcgtgtaattatgcagttgtgttcaggaggcgggctgtcgccgctgtaccagacgtctggctct

SEQ ID NO: 96820 - DNA, 75 bp, Artificial Sequence
  Synthetic
cacgggccgaagtgattgagtggaaggacgagatggaggatgggccctggcatcgcaaggaggacctaattgctg

SEQ ID NO: 96821 - DNA, 75 bp, Artificial Sequence
  Synthetic
gccgcttcataggattacgcgccaactcatcctccctcagattacgcgaacccatctcacacgccacttcagatc

SEQ ID NO: 96822 - DNA, 75 bp, Artificial Sequence
  Synthetic
cgctaaatgtgtttcgatccatggcccgcgcagccttgcacccgtacgttgacgctgtggtagagcacctccggt

SEQ ID NO: 96823 - DNA, 75 bp, Artificial Sequence
  Synthetic
tgataaagtctcttgggattgatctgtctgggcacttatatgtgacgctcgtcacggggaggtacctctcagatc

SEQ ID NO: 96824 - DNA, 75 bp, Artificial Sequence
  Synthetic
gtagagcacctccggtatctcgggcctgggtacgcgagcccatgaggggtgagcgatggcgcggacataacttac

SEQ ID NO: 96825 - DNA, 75 bp, Artificial Sequence
  Synthetic
tacgaacgtggttccgcatgatcctagattggagcagtaaaggccgcgaggagaagatgctagcgctcgcatctg

SEQ ID NO: 96826 - DNA, 75 bp, Artificial Sequence
  Synthetic
cccgctcaacaatgacaagacataccacgattattacaagtattcgaagtggaaagacagcaaagcaaccgcccg

SEQ ID NO: 96827 - DNA, 75 bp, Artificial Sequence
  Synthetic
cacgggccgaagtgattgagtggaaagatgagatggaggataagccctggcatcgtaaggaggacttaattgccg

SEQ ID NO: 96828 - DNA, 75 bp, Artificial Sequence
  Synthetic
taccaccttgcatggcgtcccagtactctcagaaaactcctggagagacattccacgaacgacacaggcgcgtcc

SEQ ID NO: 96829 - DNA, 75 bp, Artificial Sequence
  Synthetic
cgctgaatgtatttcggtccatggcccgcgaagccttgcacccgtacgttgacgctgtggtggagcacctccgat

SEQ ID NO: 96830 - DNA, 75 bp, Artificial Sequence
  Synthetic
tcgagacgttgtcgagtactactataggtcacatatccctgtcgtggagctacaaccagaagaggagttcctgag

SEQ ID NO: 96831 - DNA, 75 bp, Artificial Sequence
  Synthetic
gaactacttgcttgacggaaaagatgcgggccctctactcgccttcctgcggcatcgatcacaggaggagatggc

SEQ ID NO: 96832 - DNA, 75 bp, Artificial Sequence
  Synthetic
gtaaaattctctaccgacatggacgcgtacaccgcacgagcactgtctgttctggagggactcgcaatctccggc

SEQ ID NO: 96833 - DNA, 75 bp, Artificial Sequence
  Synthetic
gtggagcacctccgatatctcgggcctgggtacgcgagcccatgaggggtgagcgatggcgcggacataacttac

SEQ ID NO: 96834 - DNA, 75 bp, Artificial Sequence
  Synthetic
agtgtacggggacatggcactcagacactggtacgcgctggtgcagcagctgtcagacgattacggacacgcgcc

SEQ ID NO: 96835 - DNA, 75 bp, Artificial Sequence
  Synthetic
gacccgcgatcacaccgggacccaacaactgaagctacgatgtcaatcttcgcgatgagattcaacagcacgacc

SEQ ID NO: 96836 - DNA, 75 bp, Artificial Sequence
  Synthetic
cctcgggctagcgtgtatggagcgcttcatcgacgaccatggggatccatttcaccaaagcacccgagacctgtc

SEQ ID NO: 96837 - DNA, 75 bp, Artificial Sequence
  Synthetic
tcacgtcccgtgatcggaacgcccacaacacgagaagcgaggcgaaacaacttctacgcagccgtggatgtcgca

SEQ ID NO: 96838 - DNA, 75 bp, Artificial Sequence
  Synthetic
taagatctctgacgagagatactcgagttcggtcgtgttgttttttgagatgtccatctgcgaagccttgcacga

SEQ ID NO: 96839 - DNA, 75 bp, Artificial Sequence
  Synthetic
ttcgcgaccttaagcatcacctcgacgttcgtgatgcctggatacatacagaatccccagacgctcgcgattcta

SEQ ID NO: 96840 - DNA, 75 bp, Artificial Sequence
  Synthetic
gttcaatgtgattctgcgctctcgtgagtcgggaatcccacttacgacgcggtttggccggcaggaagtagatag

SEQ ID NO: 96841 - DNA, 75 bp, Artificial Sequence
  Synthetic
gcgcgcgacgaaatcccctacacgccgtcaacctttagacgcgtgcagcgcatacgtgtgtgcacgtctgattat

SEQ ID NO: 96842 - DNA, 75 bp, Artificial Sequence
  Synthetic
gatcgcgattgtacgcgagctatacaccttgatgctgactcacccgaagaaggtgtgcaacatgcttagggcgag

SEQ ID NO: 96843 - DNA, 75 bp, Artificial Sequence
  Synthetic
tcgaacgtcagggaagagttccacccctacgcgcaccatgaggcgatcactactccgggcgtaatcttgcccgca

SEQ ID NO: 96844 - DNA, 75 bp, Artificial Sequence
  Synthetic
aggtgtgcaacatgcttagggcgagttactcgtggtttgtgaagaactggggtattgcggcaccagaggttaatc

SEQ ID NO: 96845 - DNA, 75 bp, Artificial Sequence
  Synthetic
cctgccggaggcggggtcgcgtgctacgctatatcaacccatacacttcagatccatttggacccaatgcaggcg

SEQ ID NO: 96846 - DNA, 75 bp, Artificial Sequence
  Synthetic
cttacagcgccatcgtgctggctacagaattccacaagtcatcgctacgtgcgaatctcgacaaggttgatgaag

SEQ ID NO: 96847 - DNA, 75 bp, Artificial Sequence
  Synthetic
gctccccttgcaggcatcatctttccggacagggaagatgtgatcatggccgaatttacgtggcagagactggca

SEQ ID NO: 96848 - DNA, 75 bp, Artificial Sequence
  Synthetic
cgaccgcctacgcatcgaaactagcggggacgccaatggaactgcgcgtttttcgcacgatgatggcaaacacgt

SEQ ID NO: 96849 - DNA, 75 bp, Artificial Sequence
  Synthetic
aatgcgatcgacaacaacgcggtggtcgaccagggcacggagatcgagctgtccgttgaaggggctgttatgcgc

SEQ ID NO: 96850 - DNA, 75 bp, Artificial Sequence
  Synthetic
acaccacggagtttgacccacgcgaccagtcgcacttgcagttggcctcgctgcttctggcgatccaaactatgg

SEQ ID NO: 96851 - DNA, 75 bp, Artificial Sequence
  Synthetic
gccgggacgcccttcacagcaacaagtaggaaccacatcatgctgactagctacgagcccgtcgatacgtgcacc

SEQ ID NO: 96852 - DNA, 75 bp, Artificial Sequence
  Synthetic
cgggatatgggcgtgcttggatcgtaaacgcgggcgacgaccctgagcgaatgcttaagccctctcgcgacaatc

SEQ ID NO: 96853 - DNA, 75 bp, Artificial Sequence
  Synthetic
gctcacatcacctgccaccgctattgggtaacgtcgcccccacgcgttgtctatgactccatggaagcggatatc

SEQ ID NO: 96854 - DNA, 75 bp, Artificial Sequence
  Synthetic
acgtgacgcgagtcgctagggaaacggaaaagtttttcgtcaaagcttacgaggaggcgcgaatgcacggacacg

SEQ ID NO: 96855 - DNA, 75 bp, Artificial Sequence
  Synthetic
ttggcggtctacacatacaaggacggcttctgggacgcgttgcgtggttacgttcttcagactctgggaatgccg

SEQ ID NO: 96856 - DNA, 75 bp, Artificial Sequence
  Synthetic
acatcatccctcctgaggatatgtacagctcactattgcgactcgcgaaaaacacctcatccgggttttcgactg

SEQ ID NO: 96857 - DNA, 75 bp, Artificial Sequence
  Synthetic
atgcaccactatcccctgcgacccgtcacagagtttagacagaacttggcgattgccatcctctctcgcttgttt

SEQ ID NO: 96858 - DNA, 75 bp, Artificial Sequence
  Synthetic
aagtggaagtcaagaagaaatacggaccgcgggcggaacggcgtgacgaaatcgttaggatcaaatctcggcaga

SEQ ID NO: 96859 - DNA, 75 bp, Artificial Sequence
  Synthetic
gattgccatcctctctcgcttgtttgatgtatactgtgcgatgtcgccagagatcaacgcgcccgtggccgccca

SEQ ID NO: 96860 - DNA, 75 bp, Artificial Sequence
  Synthetic
aggaccgttagctgggattgcccaccggctacaggctgctctgcgtgccttcagactcggtcgatagacggtaag

SEQ ID NO: 96861 - DNA, 75 bp, Artificial Sequence
  Synthetic
aggcattgtacctgatgcgcgagggacacaagatttactcccctgatatgatgaacatgtcctatacgactccta

SEQ ID NO: 96862 - DNA, 75 bp, Artificial Sequence
  Synthetic
ctccactccgtctgtgtctgagctgtcgtgcgttacccggcccccgagagcgagggggcgagggggcggagagga

SEQ ID NO: 96863 - DNA, 75 bp, Artificial Sequence
  Synthetic
catgctatcaaacacgcgggacccgggacgtaccaatcaaagccacgcgcacgatctacgcgataaatgtgaacg

SEQ ID NO: 96864 - DNA, 75 bp, Artificial Sequence
  Synthetic
gtaaaacttccggaagcaatggcgaatccgcaaccccgagaacagacaccgcaacagcaaacagaaagttcacct

SEQ ID NO: 96865 - DNA, 75 bp, Artificial Sequence
  Synthetic
acgatctacgcgataaatgtgaacgtgttagcgcctcaacacatactgacgctgcctcttaacgagtacttcgca

SEQ ID NO: 96866 - DNA, 75 bp, Artificial Sequence
  Synthetic
cgtctgtgtctgagctgtcgtgcgttacccggcccccgagagcgagggggcgagggggcggagaggataagttac

SEQ ID NO: 96867 - DNA, 75 bp, Artificial Sequence
  Synthetic
tacctacgcggagctgaagtgtatgatgacccgggcgtcgcactctcgatcttcgcactccaggagatcattaga

SEQ ID NO: 96868 - DNA, 75 bp, Artificial Sequence
  Synthetic
aaggttagagaggcccagaccgcgttacgcaatgagggacgggaagcggatcctgcgccccccgagatcgagcag

SEQ ID NO: 96869 - DNA, 75 bp, Artificial Sequence
  Synthetic
ggatcgcgcgtcatggatgcggctgatacattccggaatacgagtgacacgggcgtatggaccttagcgctggat

SEQ ID NO: 96870 - DNA, 75 bp, Artificial Sequence
  Synthetic
atcttctcagcgctaagcgacttacgcagcgaaagaccgtacaggctcgaggagcggcttccagtctactaccga

SEQ ID NO: 96871 - DNA, 75 bp, Artificial Sequence
  Synthetic
tattcaaattacgacacgcacatgacgcaggataacttccggcaaggaatgatctccgggatacggcaagcggta

SEQ ID NO: 96872 - DNA, 75 bp, Artificial Sequence
  Synthetic
gcaaggcaccactctctaaggtacgagggctggagtgtcgatcagctcattgaagcggggtacggcgcggggcgt

SEQ ID NO: 96873 - DNA, 75 bp, Artificial Sequence
  Synthetic
ttcgagtcctcgcagtcgcgcgaacgcttcttcagagtcgatacccacttcgaacgattgactcggacggcggtg

SEQ ID NO: 96874 - DNA, 75 bp, Artificial Sequence
  Synthetic
gacggatcgctagaagacccggcgcatttaatgtccatcatactctctcgcgtagaggaaattcgccaggcggga

SEQ ID NO: 96875 - DNA, 75 bp, Artificial Sequence
  Synthetic
gttgcgggaacgctgtggaatgggaaaagacgtgtctgccgcatggatcgcgccgattacgagcgcctgccactg

SEQ ID NO: 96876 - DNA, 75 bp, Artificial Sequence
  Synthetic
tccttcttgctgcgcgctgcgccaacacactttatcgacgggcgagaaatcatcaacgccgaggcgctgggagtc

SEQ ID NO: 96877 - DNA, 75 bp, Artificial Sequence
  Synthetic
gaagatagagaagtaccgccagacgcccccttcagattccgcccgccgggtactagtccgattcgttcgctcaca

SEQ ID NO: 96878 - DNA, 75 bp, Artificial Sequence
  Synthetic
catcaacgccgaggcgctgggagtcgacatccctggactgctgaacctcgtggagccacgagtgagacacttact

SEQ ID NO: 96879 - DNA, 75 bp, Artificial Sequence
  Synthetic
ttggtaaaggaggcgcggactttagattttgtgctagtcacgccgtgggacggctccgatctcgcacgcgtctcg

SEQ ID NO: 96880 - DNA, 75 bp, Artificial Sequence
  Synthetic
acagcggcagattgaccagctcaccgtgttgaaccaagatcaagacgatgtactgttggacgtctatcccggagc

SEQ ID NO: 96881 - DNA, 75 bp, Artificial Sequence
  Synthetic
actcatctatcgggagagaactctacgctagttgcgaactcattacacaacatggctatgggacgggtaatacaa

SEQ ID NO: 96882 - DNA, 75 bp, Artificial Sequence
  Synthetic
atgcccagactccattttcagtgtccatcaggcgttgaccgctcacgtgacgcacaaccaacgtgacgactatcg

SEQ ID NO: 96883 - DNA, 75 bp, Artificial Sequence
  Synthetic
gatgaagtgcagacgcggcatcccggaactttcgaagttttgtcggagatgtacgtcggtgacgacaccctacac

SEQ ID NO: 96884 - DNA, 75 bp, Artificial Sequence
  Synthetic
cgcggcgatgcagtggcttcaggcttatggagagttcaagcgcatcgacttttcacgagcactgctcacggacgt

SEQ ID NO: 96885 - DNA, 75 bp, Artificial Sequence
  Synthetic
tacgtgaaactattaacccttgattcggcgcggatcgaccgcgcaatcaatacaattttccagacgatagagctc

SEQ ID NO: 96886 - DNA, 75 bp, Artificial Sequence
  Synthetic
gttctcccctgacactgtatatatccagagctaccagcttcccccgaatcctcagctcgtgtgggaagtgccgcg

SEQ ID NO: 96887 - DNA, 75 bp, Artificial Sequence
  Synthetic
cagagctaccagcttcccccgaatcctcagctcgtgtgggaagtgccgcgtagcggggtgtcaaatctggtcatc

SEQ ID NO: 96888 - DNA, 75 bp, Artificial Sequence
  Synthetic
tgtgggcatgaagcgtccgccgcgaagacgacctttgcgccattctccgcggagaaaacccagacccacgcgaaa

SEQ ID NO: 96889 - DNA, 75 bp, Artificial Sequence
  Synthetic
tagcggggtgtcaaatctggtcatcaacgctgccctcggggtccctcatggtacatacatcactccaaatccgcg

SEQ ID NO: 96890 - DNA, 75 bp, Artificial Sequence
  Synthetic
ggagaaaacccagacccacgcgaaacagggcgtatatataccgcaggaccgaatgatggtaatctcctccgagag

SEQ ID NO: 96891 - DNA, 75 bp, Artificial Sequence
  Synthetic
catctcggcgatcactgtcgcttcgcgtgtaacgactaccacgtctttcgctcagctactaggcacgatccccac

SEQ ID NO: 96892 - DNA, 75 bp, Artificial Sequence
  Synthetic
ggccgcgcagatggatgacgtcaggaaaatctaccttgccttgctcttcccgaatcaaatcctattggacatccg

SEQ ID NO: 96893 - DNA, 75 bp, Artificial Sequence
  Synthetic
tcggataccggcggtttaaggcgacgatgttcgacggggctaaatttcgacgaaggaagttcttctccgaggagg

SEQ ID NO: 96894 - DNA, 75 bp, Artificial Sequence
  Synthetic
cccggaacccggtcaccaagttgacgtcgtcgctcagtctgtagccggcatccttggaaagctcatgttttctta

SEQ ID NO: 96895 - DNA, 75 bp, Artificial Sequence
  Synthetic
acggttacacattgtgccgactgctgaaccccacagtcttatacgctcccgtcgaatgcaatggatatggcgtac

SEQ ID NO: 96896 - DNA, 75 bp, Artificial Sequence
  Synthetic
cggcccactgctcttcaatataacaccccacaccgccaggtgcctagatcgagcttgcgcatcattcctccaaat

SEQ ID NO: 96897 - DNA, 75 bp, Artificial Sequence
  Synthetic
atccgtttgcgttgaacgtagtccagacctgtgagacgcatctagactcgatccagttattccccacgtacgcgg

SEQ ID NO: 96898 - DNA, 75 bp, Artificial Sequence
  Synthetic
ggcaactgatgacagacggacgatccgacggggcccctccggtcggcccctcgatttcacgatcctgcaggggca

SEQ ID NO: 96899 - DNA, 75 bp, Artificial Sequence
  Synthetic
atctggtgagcaggaacgtgatcaggaccgcatttccgccaccctggaatgagacagacgtagatagccgtcttc

SEQ ID NO: 96900 - DNA, 75 bp, Artificial Sequence
  Synthetic
gcgcgcattcgactgcaatcagttagcacacaacgccccccgaggaaacggcttcgtgaactggggcgtggactc

SEQ ID NO: 96901 - DNA, 75 bp, Artificial Sequence
  Synthetic
tgtccacgcagacgcccatggggctatactcgcgcatcgtacgtccgaccgtgagaatggccttgaccgatcctg

SEQ ID NO: 96902 - DNA, 75 bp, Artificial Sequence
  Synthetic
ggttggagaccacccgacgccttaccctcacatccgccggagaatccagtaccttggctacgtgcccgaagatgt

SEQ ID NO: 96903 - DNA, 75 bp, Artificial Sequence
  Synthetic
acatcgccaccttggtcacccagatcccactcggggaacacgctccggatagactctcctccacgatgatgcata

SEQ ID NO: 96904 - DNA, 75 bp, Artificial Sequence
  Synthetic
gatcgacgaacgcttctgcggagacgacctgcgctacctcctacacgagcgaatgtgcgaagcgcttgcgatttc

SEQ ID NO: 96905 - DNA, 75 bp, Artificial Sequence
  Synthetic
gcgctttgctgaaggaaagccgtgcacgtgcgctcttagcgcccgcctacgaggatcgcttcattgaaagcatga

SEQ ID NO: 96906 - DNA, 75 bp, Artificial Sequence
  Synthetic
agggcacgtcaacgaaaggaattacattgaagtcatgaggcagcatcaggtcgtcaggttcgctcacatcagcca

SEQ ID NO: 96907 - DNA, 75 bp, Artificial Sequence
  Synthetic
acaagtggcgtccgtacgatcttttcaagcctaccgcaggcacggagcttacggccgcatacgccaaagtgcttg

SEQ ID NO: 96908 - DNA, 75 bp, Artificial Sequence
  Synthetic
gattattaatcgcgatctcgtctcggccttttcgttgccggatgacaggtttgccgcgctcgggacgggcgtgcc

SEQ ID NO: 96909 - DNA, 75 bp, Artificial Sequence
  Synthetic
agaagcagtgtgtcggtcaccgcacgacagtccgcccctcgaggacgtatatggaccacatcgaccggatactgc

SEQ ID NO: 96910 - DNA, 75 bp, Artificial Sequence
  Synthetic
ttgccgcgctcgggacgggcgtgcctcgcgacgcgacaagcccggacggaccagtcatcctcgacattagttaca

SEQ ID NO: 96911 - DNA, 75 bp, Artificial Sequence
  Synthetic
tgtcgatcatacatgccttccgactgcgtttcctgccaatctcacgcccagagcgggtgatttatcagccaattc

SEQ ID NO: 96912 - DNA, 75 bp, Artificial Sequence
  Synthetic
acgacccggcggatctcgccatcatcttcgagctgctgaatctagacagacgtgtcgcgcgacgactcgcggaat

SEQ ID NO: 96913 - DNA, 75 bp, Artificial Sequence
  Synthetic
tggaatccgtctatgtgtcacacctctcgctcgcaaaactgaacgccaccagactacaggctttcgtgaacgcca

SEQ ID NO: 96914 - DNA, 75 bp, Artificial Sequence
  Synthetic
ctcgctcgcaaaactgaacgccaccagactacaggctttcgtgaacgccaatccggagagcttcgctgaggcgag

SEQ ID NO: 96915 - DNA, 75 bp, Artificial Sequence
  Synthetic
atccggagagcttcgctgaggcgaggcctatggacgtttggcggacagtgtaccccaggctgcccgagcccgtgc

SEQ ID NO: 96916 - DNA, 75 bp, Artificial Sequence
  Synthetic
tgtctttagacgtatgcaccgacggatcgagagaccagcggattacattcccgcctgagttcacgcttgcggaga

SEQ ID NO: 96917 - DNA, 75 bp, Artificial Sequence
  Synthetic
gtcggatctttgacctgaccgggcaacattcgttcgtcaccggtagagacatcggcatgtggctcgcttcacctc

SEQ ID NO: 96918 - DNA, 75 bp, Artificial Sequence
  Synthetic
gagacgccgccgcgttacatgccgagcagatccagctactgttcgccgcccatcagggaaggagcgtccgcgtcg

SEQ ID NO: 96919 - DNA, 75 bp, Artificial Sequence
  Synthetic
tgctacaggaatctctattcctactgtgcgcgcgcgcggcgtgggaagctaccgctgacccctcggagatcggct

SEQ ID NO: 96920 - DNA, 75 bp, Artificial Sequence
  Synthetic
cgctacaagttcgccccgagcaccgaagcgctttacgtaaagcgcggatcaagatgcgaaccccaaggttacgag

SEQ ID NO: 96921 - DNA, 75 bp, Artificial Sequence
  Synthetic
tcacacgtgacgtatatatccaccgtcagcccattcctgagtacccactggaggacgtgcggcagttccgtcggg

SEQ ID NO: 96922 - DNA, 75 bp, Artificial Sequence
  Synthetic
tcagcccattcctgagtacccactggaggacgtgcggcagttccgtcgggacgcagtttacttcacaaatatgct

SEQ ID NO: 96923 - DNA, 75 bp, Artificial Sequence
  Synthetic
ggacgctcgacccaataacggccagcgagtgatcttggatcggatcatcatgcagcaacgcgcgggagccgggcg

SEQ ID NO: 96924 - DNA, 75 bp, Artificial Sequence
  Synthetic
agtagcactgcacgacggatcgccacagcggcgggcactgcgataagcaaagcggcgtcgtcagaaataggacag

SEQ ID NO: 96925 - DNA, 75 bp, Artificial Sequence
  Synthetic
gctgcggatgtcgatcagagaactactcgatgatggtttatacgtgcagatcggaaccgcgcttcggcccatcgt

SEQ ID NO: 96926 - DNA, 75 bp, Artificial Sequence
  Synthetic
agggcgataagtggggcaatcgaaggagcggtaaactccgcattgactggcgaggcactgggtgaatccatgaag

SEQ ID NO: 96927 - DNA, 75 bp, Artificial Sequence
  Synthetic
tctgagcatccaccacggactcccgcctgagagcacgctaagggccctgccctatacgtaccagcgcgaaagctc

SEQ ID NO: 96928 - DNA, 75 bp, Artificial Sequence
  Synthetic
aaagccgtgatcctgaacgtcgccggggtccatcagactgtccctgacccgctaaatgctgcagagatcgaaaca

SEQ ID NO: 96929 - DNA, 75 bp, Artificial Sequence
  Synthetic
ggatggaccgacggcgcgtgtcactctgcagttgctgcgcccggtcgcggcattctacatgctgtataatgcgga

SEQ ID NO: 96930 - DNA, 75 bp, Artificial Sequence
  Synthetic
caggtcaaactacgcgagcttgaacaggagaataaacgtgaagaggcggctattaggcacaacgcaattatgttg

SEQ ID NO: 96931 - DNA, 75 bp, Artificial Sequence
  Synthetic
ctgcagttgctgcgcccggtcgcggcattctacatgctgtataatgcggatgagcaggcattcccagacgagatg

SEQ ID NO: 96932 - DNA, 75 bp, Artificial Sequence
  Synthetic
aaacgagagggtgatgtgctcaagaatgtgaagcatcttcaaaagttgcaggcgatcacggagagtgaggagcag

SEQ ID NO: 96933 - DNA, 75 bp, Artificial Sequence
  Synthetic
tcgtgagcctatacatccagcgacccccggtcgaacgcgtgagttacgagactgccctgagcgtcgttacacgcg

SEQ ID NO: 96934 - DNA, 75 bp, Artificial Sequence
  Synthetic
aatgaaatcaaagatctggacgctgtactggaaacgacgcggaccctcgtccgggaggagaggaccaagctcgac

SEQ ID NO: 96935 - DNA, 75 bp, Artificial Sequence
  Synthetic
acttcgcctcgttcaggtcacgcgtgcgaataatggacttagccgctgctctcgatgcgggtagccagtatgctt

SEQ ID NO: 96936 - DNA, 75 bp, Artificial Sequence
  Synthetic
aaggtcgctggcgcactggtgcgggaggacatgctacgtacggccgacgagcgaaagctaattgaaggaatgcga

SEQ ID NO: 96937 - DNA, 75 bp, Artificial Sequence
  Synthetic
tatgctttaccctcgaacgcgctgtaggacctcagccaccctgcggcgtggggcatgggcccggagtaaggatac

SEQ ID NO: 96938 - DNA, 75 bp, Artificial Sequence
  Synthetic
gtaaaaatttccttcttcgttcgtggtcgcgccagagacacgatggaaaggttcatccgcaagttcaagcccacc

SEQ ID NO: 96939 - DNA, 75 bp, Artificial Sequence
  Synthetic
cataattaccaggcgctcgcgaagaatgtagaggcggaacggtccgcgctcatagaggaagcgattgagcagacg

SEQ ID NO: 96940 - DNA, 75 bp, Artificial Sequence
  Synthetic
gccgatcaggcactcgctctacgtactgtcgacgctctatccgacatctggaactgtggtcaccgtcgctatgcc

SEQ ID NO: 96941 - DNA, 75 bp, Artificial Sequence
  Synthetic
gttgatataggtggagagatcgccgaacacgcgaccgcatcgattcccttcgtcggagaggccgtggcgagcggc

SEQ ID NO: 96942 - DNA, 75 bp, Artificial Sequence
  Synthetic
tgcatgtatcgagggcaatgcgtagtccagaacatccaacacctagccgcctatgcggagaccgctgaagatcgt

SEQ ID NO: 96943 - DNA, 75 bp, Artificial Sequence
  Synthetic
atggcgacggcgaggggggcgatacagatctatcggctaggcaagacgatccatgcgctcacgggcctacacacc

SEQ ID NO: 96944 - DNA, 75 bp, Artificial Sequence
  Synthetic
cagcttgccacccgaattgtggacgtcgctagtgcgctgggaaataaccgtaatgagatccgcgttcaggtgagt

SEQ ID NO: 96945 - DNA, 75 bp, Artificial Sequence
  Synthetic
caccatatggaggtcccgtctatacatcaaggagctatcgagacactgctcacttccgaacatccgacgagtgac

SEQ ID NO: 96946 - DNA, 75 bp, Artificial Sequence
  Synthetic
gcgtgcaatcagaggacagggccgctgaacttaactactcttgccgaccagatgtctcgagcgatcgctgaggct

SEQ ID NO: 96947 - DNA, 75 bp, Artificial Sequence
  Synthetic
gcaagtctggctcgaatcgctggctccagatcaaagcacctaaaagagatcgaagcggaggtgtcgcacctgcag

SEQ ID NO: 96948 - DNA, 75 bp, Artificial Sequence
  Synthetic
gcccgctcagtgggaatggtacagctggaacgcgcagtgcaggacgacgaatctagatattacatcgacgattcg

SEQ ID NO: 96949 - DNA, 75 bp, Artificial Sequence
  Synthetic
aaggaggtcgtgcccgcgtacaagagagtatgccaatcggtacggagaaccgcgcccgagcacctacgaaaacag

SEQ ID NO: 96950 - DNA, 75 bp, Artificial Sequence
  Synthetic
cggagcctctttcctcacttgtacgttccgatgcgcggagatgagacgcctgagataattgactcaatcgcaatc

SEQ ID NO: 96951 - DNA, 75 bp, Artificial Sequence
  Synthetic
tgcgaggttgtgcgtacgacagcggctcatgagcttaaggtccccctgcagcagaggcccatgatacacacctac

SEQ ID NO: 96952 - DNA, 75 bp, Artificial Sequence
  Synthetic
gggaatgttctcttcctgttctatgagaactttcgtgctgataagtacgtatatcagcgtgacccggaagctcta

SEQ ID NO: 96953 - DNA, 75 bp, Artificial Sequence
  Synthetic
acgtccccctgggacagtgacgccgtcgtgctcttgcatgtgatcggaccgtatcactctgggcaggcgttcgtc

SEQ ID NO: 96954 - DNA, 75 bp, Artificial Sequence
  Synthetic
ccgattacgaaccattatctcgcgtgggccccgaatgcaccgagacatggcgacgaggagccagtgatgtgggtt

SEQ ID NO: 96955 - DNA, 75 bp, Artificial Sequence
  Synthetic
atgtgcgtggacctctccctcgacctctttcactttgaagagatacactccgctgcccaccggtttcaccgacgc

SEQ ID NO: 96956 - DNA, 75 bp, Artificial Sequence
  Synthetic
gcctacttccagtactcactacgtcaggcgttagcgggagccgagacgcgtaccatcatcgcgcggaccctcgag

SEQ ID NO: 96957 - DNA, 75 bp, Artificial Sequence
  Synthetic
catcacgcacagctcaggacgttcggccaggcgtgcgcagacttcttcctcatgtccgcgcgccaccccgacgcc

SEQ ID NO: 96958 - DNA, 75 bp, Artificial Sequence
  Synthetic
tccgacataaactacatccgtactcagtcaacacgaagaggaaatcgacttttcttccaacgatttggacgtgac

SEQ ID NO: 96959 - DNA, 75 bp, Artificial Sequence
  Synthetic
accaaggttcaccggaccagaatggaatggagtgttagcgagtctccgctgcatgtgggctccgtcccttacgaa

SEQ ID NO: 96960 - DNA, 75 bp, Artificial Sequence
  Synthetic
ggccagggcgcaggtgacacggacgcactgtatcagcgcgctgtcggagaccggtctagtattgcgcggtactgc

SEQ ID NO: 96961 - DNA, 75 bp, Artificial Sequence
  Synthetic
gcatgtgggctccgtcccttacgaaacatctttcggccagatgctggaaaacgcccgcacgtttgcctcaaggcc

SEQ ID NO: 96962 - DNA, 75 bp, Artificial Sequence
  Synthetic
gacggcgcgatttccttcgagcggctgttcttcccctcgttgctgttccgcggctggatcgccggagtgtacacg

SEQ ID NO: 96963 - DNA, 75 bp, Artificial Sequence
  Synthetic
ggtcccatcgctatgcagagacggacgatcttgaacgcgattatgcatggtgcggttatggtgcaaacgcgccgg

SEQ ID NO: 96964 - DNA, 75 bp, Artificial Sequence
  Synthetic
gacgcagagtttcaggcttggtttgacggcgaatggacatgccagtcatgctatgccgccgaacggacgacgcac

SEQ ID NO: 96965 - DNA, 75 bp, Artificial Sequence
  Synthetic
cgtcgggttctatgcgttgacactcgaacatcagatgacaccggagctcaggcgattcgttcgctgagaccgctg

SEQ ID NO: 96966 - DNA, 75 bp, Artificial Sequence
  Synthetic
tacctgcgaggatcagaggtgcatgatgaccccggcgtcgcgttgtcggtcttcgccttacaagagatcatcaga

SEQ ID NO: 96967 - DNA, 75 bp, Artificial Sequence
  Synthetic
cgacatggaggcgtgacgcttgatggaatccgttcgagggacttgctagacaacgaggttctcacacgtcagggc

SEQ ID NO: 96968 - DNA, 75 bp, Artificial Sequence
  Synthetic
aaagtacgtgaggcacagactgcactgagaaacgaggggcgcgaggtggaccctgcccctcccgagattgagcag

SEQ ID NO: 96969 - DNA, 75 bp, Artificial Sequence
  Synthetic
gaccattggtgcgcgaccgtttgccgcaacccgcgtgaagccgtatacatcaccgcaacgcttgtccatcgattc

SEQ ID NO: 96970 - DNA, 75 bp, Artificial Sequence
  Synthetic
atcttctcagccctgagcgacctaaggtcggagcgaccgtaccgcgtggaagagcgtctgcctgtctactacagg

SEQ ID NO: 96971 - DNA, 75 bp, Artificial Sequence
  Synthetic
atgagaggacgcggcgttgcccaggacttcatcaggaccgtctcagctgaggctatctccagatgctatctgcag

SEQ ID NO: 96972 - DNA, 75 bp, Artificial Sequence
  Synthetic
tttgaaccatcgcaatcccgagagcggttctttagggtggacacacacttcgaacgcatgacgagcacggcggct

SEQ ID NO: 96973 - DNA, 75 bp, Artificial Sequence
  Synthetic
tggctccccgagcgcgacgaatgcgtggtgctgttccggttgctcgcttatgcgcaacaattatacacatactcc

SEQ ID NO: 96974 - DNA, 75 bp, Artificial Sequence
  Synthetic
gacggcgcgctagaagacccagcacacctaatgtcgataattctgtcgcgagttgaggagatacggcagaacggg

SEQ ID NO: 96975 - DNA, 75 bp, Artificial Sequence
  Synthetic
aacttcgtagaactcggggcgtggacggatttaggagtattcttcagcgaactgtttcgcggcgtcaggctggga

SEQ ID NO: 96976 - DNA, 75 bp, Artificial Sequence
  Synthetic
tctttcttactacgatcggcgccaacgcattttattgacggtcgagagataatcgacgcggagggcctgggggtt

SEQ ID NO: 96977 - DNA, 75 bp, Artificial Sequence
  Synthetic
cgcattttattgacggtcgagagataatcgacgcggagggcctgggggttgacatcccagggctgctgaacctgg

SEQ ID NO: 96978 - DNA, 75 bp, Artificial Sequence
  Synthetic
gaagcgagcactaggaatgtccatgcagccttactcgcgctcgtccgatatcatgtgcatctggttgcccagaat

SEQ ID NO: 96979 - DNA, 75 bp, Artificial Sequence
  Synthetic
ggctatacccgaccttgcgcgcccccctcccgaccacgccccctgcaccgccgttaggtctatggacggactatg

SEQ ID NO: 96980 - DNA, 75 bp, Artificial Sequence
  Synthetic
gcaaaggcagatcgaccagctgactgtgctgaaccaggaccaggacgatactctgctcgacgtgtatccaggagc

SEQ ID NO: 96981 - DNA, 75 bp, Artificial Sequence
  Synthetic
atgacctattctctaattggctaccttgcgcctggactgaccatcgtccgctacatttgtagcggcgcggggaaa

SEQ ID NO: 96982 - DNA, 75 bp, Artificial Sequence
  Synthetic
tctctaattggctaccttgcgcctggactgaccatcgtccgctacatttgtagcggcgcggggaaattaagatac

SEQ ID NO: 96983 - DNA, 75 bp, Artificial Sequence
  Synthetic
gtaaaaactctcacgcaacaggcatggcaacgaagcgaatcggcgcgcgcatgtccggcttcttaagtcggcttg

SEQ ID NO: 96984 - DNA, 75 bp, Artificial Sequence
  Synthetic
gctcggggatatcaaaagcagtaaccagcaataccgcacgacagatcgtctcagcggcgggcaacgcgattagca

SEQ ID NO: 96985 - DNA, 75 bp, Artificial Sequence
  Synthetic
cttctcgcccgataccgtgtacatccagagctatcagattccggcgaacccccagctaatctgggaagtcccgcg

SEQ ID NO: 96986 - DNA, 75 bp, Artificial Sequence
  Synthetic
cagagctatcagattccggcgaacccccagctaatctgggaagtcccgcggagcggcgtgtcgaatctcgtcctt

SEQ ID NO: 96987 - DNA, 75 bp, Artificial Sequence
  Synthetic
gggcggcatcctcggagttagggcagcgagcgatcagcggagcgatcgagggagcggtcaactcagccttaacag

SEQ ID NO: 96988 - DNA, 75 bp, Artificial Sequence
  Synthetic
gtgaggcgttaggcgaatcaatgaagaaggcggtgatactgaatgttgctggagtccatcagaccgttccggacc

SEQ ID NO: 96989 - DNA, 75 bp, Artificial Sequence
  Synthetic
cgagttacgacaaccacgtctttcgctcagctgcttgggaccatccctacagccgctcagatggatgatgtgcgg

SEQ ID NO: 96990 - DNA, 75 bp, Artificial Sequence
  Synthetic
ctctgaacgcggttgaaatcgagacgcaggtaaagcttcgcgagctggaccaggagaataagcgtgaggaggcag

SEQ ID NO: 96991 - DNA, 75 bp, Artificial Sequence
  Synthetic
aagatctatcttgcgttgatgtttccgaatcagattcttctcgacatcaggccagaacctgggcaccaagtcgac

SEQ ID NO: 96992 - DNA, 75 bp, Artificial Sequence
  Synthetic
cgaatcagattcttctcgacatcaggccagaacctgggcaccaagtcgacgtcgttgcacaatcggtggcggggg

SEQ ID NO: 96993 - DNA, 75 bp, Artificial Sequence
  Synthetic
caattcggcataacgccctaatgctcaagcgggaagaagagatccttaacgacgtaaaacatctccagaacatcc

SEQ ID NO: 96994 - DNA, 75 bp, Artificial Sequence
  Synthetic
aagtgattaccgagggagacgagcaaaacgagattaaagatctagaggccgtcttggggacgacgcggacgctcg

SEQ ID NO: 96995 - DNA, 75 bp, Artificial Sequence
  Synthetic
gagcgtgtgcgtcctttctacagatggcgaccgacgaccggcgtaccatccggtttgggccctcggggcgaccct

SEQ ID NO: 96996 - DNA, 75 bp, Artificial Sequence
  Synthetic
tcagggaagaaagaacgaagcttgataagatcgccaatgcgttgatgcgagaggacgcattgcgtaccacggatg

SEQ ID NO: 96997 - DNA, 75 bp, Artificial Sequence
  Synthetic
cggtttgggccctcggggcgacccttagactttacgatccagcaggggcagcgcgcgttcgactgcaaccagctc

SEQ ID NO: 96998 - DNA, 75 bp, Artificial Sequence
  Synthetic
agcggaagctaatagaggggatgcgccacaactaccaagcgcttgcgaagagcgtcgaagcggagaggtcggcgt

SEQ ID NO: 96999 - DNA, 75 bp, Artificial Sequence
  Synthetic
tgatcgaagaggcgatcgagcagacggtggacatcggcggagagatcgcggaacacgcaactgcatcaattccat

SEQ ID NO: 97000 - DNA, 75 bp, Artificial Sequence
  Synthetic
cctcacgtgcgtcgacggattcaatatctaggatatgtaccggaggacgttatcgacgagaggttctgcggagac

SEQ ID NO: 97001 - DNA, 75 bp, Artificial Sequence
  Synthetic
ttgtcggtgaggcggtggcaagcgggatggcgaccgcacgcggcgctatacagatctaccgcctcgggaagacga

SEQ ID NO: 97002 - DNA, 75 bp, Artificial Sequence
  Synthetic
gacctgcggttcctgcttcacgaccgcttgtgcgaggccttagcgatctccggccacgtcaacgaaaggaactac

SEQ ID NO: 97003 - DNA, 75 bp, Artificial Sequence
  Synthetic
gcttgtgcgaggccttagcgatctccggccacgtcaacgaaaggaactacgtcgaagtgatgaggcagcatcatg

SEQ ID NO: 97004 - DNA, 75 bp, Artificial Sequence
  Synthetic
tccacgcgctgacagggctgcatacgcatcatatggaagtaccatcgattcatcaaggtgccctcgaaactctcc

SEQ ID NO: 97005 - DNA, 75 bp, Artificial Sequence
  Synthetic
tgacggctgaccacccaactaacgacgcgagtcttattcggatcgcaggatcaaggtcacgtcatctgaaagaga

SEQ ID NO: 97006 - DNA, 75 bp, Artificial Sequence
  Synthetic
tctttgcgttgggagcgggcgtgccgcgcgatgccacgggacctgacggcccgattatcctcgacgtcagctata

SEQ ID NO: 97007 - DNA, 75 bp, Artificial Sequence
  Synthetic
tcgaagcggaggtaactcacccccagacggagattgcacctgcctacaagaaggcgtgccagtcgatcaggaaaa

SEQ ID NO: 97008 - DNA, 75 bp, Artificial Sequence
  Synthetic
tgtccatcatccacgcgtaccggctacgcttccttccaatcgcgcgacctgagcgtattatccatcagcccatcc

SEQ ID NO: 97009 - DNA, 75 bp, Artificial Sequence
  Synthetic
ccgcgcccgaacacctgagaaagcagtgcgaagtgatcagaaccaccgcctcccatgagcttcgagtccctctgc

SEQ ID NO: 97010 - DNA, 75 bp, Artificial Sequence
  Synthetic
tagagtcgatttatgtatcgcatttatcgctggcgaaactgaacgcatcacgactgcaaacgttcgtcaacgcaa

SEQ ID NO: 97011 - DNA, 75 bp, Artificial Sequence
  Synthetic
atcgctggcgaaactgaacgcatcacgactgcaaacgttcgtcaacgcaaacacggagagcttcgctgaagcgcg

SEQ ID NO: 97012 - DNA, 75 bp, Artificial Sequence
  Synthetic
agcagcgtcccatggtccatacgtatacatcgccctgggatagcgacacagtcgtgatactacacatcgtcgggc

SEQ ID NO: 97013 - DNA, 75 bp, Artificial Sequence
  Synthetic
cctaccataccgggcaggcgttcgttatgtgcgtagacctctcattggatctcttccattttgaagaagtccacc

SEQ ID NO: 97014 - DNA, 75 bp, Artificial Sequence
  Synthetic
gacggattttcgacctcacgggccaacactcgttcatcacaggccgggacattgggatctggctcgcctcccctt

SEQ ID NO: 97015 - DNA, 75 bp, Artificial Sequence
  Synthetic
ctgcggtgcatccatttcatcgacgtcaacacgccattctgcggacgttcgggcaggcatgctcagacttctttc

SEQ ID NO: 97016 - DNA, 75 bp, Artificial Sequence
  Synthetic
tgatgtctgcccggcatcccgattccacgaaggttcacaagacaaggatggagtggagtgtcggcgaagcccccc

SEQ ID NO: 97017 - DNA, 75 bp, Artificial Sequence
  Synthetic
ttactcgcgacgtatacatctacagacaaccagtgcccgagtacccgctcgaggacgtacggcagttccgacgtg

SEQ ID NO: 97018 - DNA, 75 bp, Artificial Sequence
  Synthetic
tgcatatcggttcaatcccctatgagacctccttcggccagatgctcgagaatgcccgcacgttctccacccgcc

SEQ ID NO: 97019 - DNA, 75 bp, Artificial Sequence
  Synthetic
acgcagtgtacttcactaacatcctggatgccagacccgccaatggaaggagggtcgtgctcgaccgcataatta

SEQ ID NO: 97020 - DNA, 75 bp, Artificial Sequence
  Synthetic
ccgagttgcagcaggcattgctgcgcgggcccatcgctatgcagcgacgtacgattctcaacgccatcatgcacg

SEQ ID NO: 97021 - DNA, 75 bp, Artificial Sequence
  Synthetic
tgcagcagcgcgcgggagctggccagttacggatgtcgatacgcgagctactcgatgacgggctgtatgtccagg

SEQ ID NO: 97022 - DNA, 75 bp, Artificial Sequence
  Synthetic
gagcagttatgattcagacacgccggaggatgccgctcgcgacgcggaggtgccagcgttagaggcgcggtgcct

SEQ ID NO: 97023 - DNA, 75 bp, Artificial Sequence
  Synthetic
tcggttcggctcttcgccccattgtcttgagcatacaccatggactgcctccggaaagtgtgctgcgcgcgttgc

SEQ ID NO: 97024 - DNA, 75 bp, Artificial Sequence
  Synthetic
gtaaaatgtcatggctgtagtggagcagcggattacttcagcaaacaacgcaatacgacgcatattaccgaatct

SEQ ID NO: 97025 - DNA, 75 bp, Artificial Sequence
  Synthetic
cctttgagtatcggcgtgagagttcagacggacctactgcacgcgtcaccttgcagctgctaagacccgttcccg

SEQ ID NO: 97026 - DNA, 75 bp, Artificial Sequence
  Synthetic
cacgccggaggatgccgctcgcgacgcggaggtgccagcgttagaggcgcggtgcctgcgatggggttaggatac

SEQ ID NO: 97027 - DNA, 75 bp, Artificial Sequence
  Synthetic
cccactcaaagatgacaagacataccacgactattacaagtattcgaagtggaaagacagcaaagcaaccgcccg

SEQ ID NO: 97028 - DNA, 75 bp, Artificial Sequence
  Synthetic
ccttcttcatgctgtacaacgcggatgaacaggcgttccccgacgagatgatcgacctcgtgcctaacgtttcac

SEQ ID NO: 97029 - DNA, 75 bp, Artificial Sequence
  Synthetic
taccaccttgcatggcgttccagtactctcagaaaattcctggagagacattccacggacgacacagacgcgccc

SEQ ID NO: 97030 - DNA, 75 bp, Artificial Sequence
  Synthetic
tcgtaagcttgtatatccagcgcccacccgtagaacgtgtgagctacgataccgccctaagcgtcgtcacccgag

SEQ ID NO: 97031 - DNA, 75 bp, Artificial Sequence
  Synthetic
tcgagacgtcgtcgagtactactataggtcacagatccccgtcgtggagctacaaccagaagaggagttcctgag

SEQ ID NO: 97032 - DNA, 75 bp, Artificial Sequence
  Synthetic
actttacctcctttcggtcccgtgtacggatcatggatctcgctgctgctctcgacgcgggtagccattatgctt

SEQ ID NO: 97033 - DNA, 75 bp, Artificial Sequence
  Synthetic
aaactactcgcttgacgaaaaagatgcgggccccctactcgccttcctacggcatcgatcacaggaggagatggc

SEQ ID NO: 97034 - DNA, 75 bp, Artificial Sequence
  Synthetic
ttatgctttaccctcgaacgcgttgtaggacttcagccaccctgcagcgtgggcgtcggcccggagtaaggatac

SEQ ID NO: 97035 - DNA, 75 bp, Artificial Sequence
  Synthetic
agtttatggggacatggcgctcagacactggtacgcgctggtgcagcagctgtcagatgactacggacacgcgcc

SEQ ID NO: 97036 - DNA, 75 bp, Artificial Sequence
  Synthetic
ccttgggctagcgtgtatggagcgcttcatcgatgaccatggagatccatttcaccaaagcacccgagatctgtc

SEQ ID NO: 97037 - DNA, 75 bp, Artificial Sequence
  Synthetic
taagatctctgatgagagatactcaagttcggtcgtgctgttttttgagatgtccatctgcgaggccttgcacga

SEQ ID NO: 97038 - DNA, 75 bp, Artificial Sequence
  Synthetic
gttcaacgtggttctgcgttctcgtgagtcgggaatcccacttacgacgcggtttggtcggcaggaagtggatag

SEQ ID NO: 97039 - DNA, 75 bp, Artificial Sequence
  Synthetic
gatcgcgattgtgcgcgagctgtacaccttgatgctgactcacccgaagaaggtgtgtaacatgcttagggcgag

SEQ ID NO: 97040 - DNA, 75 bp, Artificial Sequence
  Synthetic
aggtgtgtaacatgcttagggcgagttactcgtggttcgtgaagaattggggcattgcggcaccagaagttaacc

SEQ ID NO: 97041 - DNA, 75 bp, Artificial Sequence
  Synthetic
tcttggaatcgagcggcagcgacgaccggaactccaaagacataacgttccataggtggcggagggtgcggaatc

SEQ ID NO: 97042 - DNA, 75 bp, Artificial Sequence
  Synthetic
cttacagcgccatcgtgctggctacagagttccacaagtcgtcgctacgtgcgaatctcgacaaggttgacgaag

SEQ ID NO: 97043 - DNA, 75 bp, Artificial Sequence
  Synthetic
cgaccgcctacgcgtcgaaactagcggggacgccaatggaactgcgcgtttttcgcgcgatgatggcaaacacgt

SEQ ID NO: 97044 - DNA, 75 bp, Artificial Sequence
  Synthetic
acaccacggagtttgacccacgtgaccaatcgcacctgcaattggcctcgctgcttctggcgattcaaaccatgg

SEQ ID NO: 97045 - DNA, 75 bp, Artificial Sequence
  Synthetic
cgggatatgggcgcgcttggatcgtaaacgcgggcgacgaccctgagcgaatgctaaagccttctcgcgacaatc

SEQ ID NO: 97046 - DNA, 75 bp, Artificial Sequence
  Synthetic
acgtgacgcgagttgctagggaaacggagaagtttttcgtcaaagcttacgaggaggcgcgaatgcacggacatg

SEQ ID NO: 97047 - DNA, 75 bp, Artificial Sequence
  Synthetic
acatcatccctcctgaggatatgtacagctcactattgcggctcgcgaaaaacacttcatccggattctcgactg

SEQ ID NO: 97048 - DNA, 75 bp, Artificial Sequence
  Synthetic
aggtggaagtcaagaagaaatacggaccgcgggcggaacggcgtgacgaaattgttaggattaaatctcggcaga

SEQ ID NO: 97049 - DNA, 75 bp, Artificial Sequence
  Synthetic
aagccttgtacctgatgcgcgagggacacaagatttactcccctgacatgatgaacatgtcctatacgactccta

SEQ ID NO: 97050 - DNA, 75 bp, Artificial Sequence
  Synthetic
catgctatcagacacgcgggacccgggacgtaccgatcaaagccacgcgcacgatctacgcgataaatgtgaacg

SEQ ID NO: 97051 - DNA, 75 bp, Artificial Sequence
  Synthetic
acgatctacgcgataaatgtgaacgtactggcgcctcaacacatactgacgctgcctcttaacgaatacttcgcg

SEQ ID NO: 97052 - DNA, 75 bp, Artificial Sequence
  Synthetic
cgtgcgggtggatcgacgcatccggcgagctccgaaataggcggaaagattataatcggagatctcgaagctacg

SEQ ID NO: 97053 - DNA, 75 bp, Artificial Sequence
  Synthetic
ggatcacgcgtcatggatgcggctgatacattccggaacacgagtgacacgggcgtatggaccctagcgctggat

SEQ ID NO: 97054 - DNA, 75 bp, Artificial Sequence
  Synthetic
tattcaaattacgacacgcacatgacacaggacaacttccggcgaggaatgatctctgggatacgacaagcggtg

SEQ ID NO: 97055 - DNA, 75 bp, Artificial Sequence
  Synthetic
gcaaggcaccactctctaaggtacgagggctggagcgtcgatcagctcatcgaagcgggatacggcgcgggacgt

SEQ ID NO: 97056 - DNA, 75 bp, Artificial Sequence
  Synthetic
gttgcaggaacgctgtggaacgggaaaagacgcgtctgccgcatggatcgcgccgattacgagcgcctgcccttg

SEQ ID NO: 97057 - DNA, 75 bp, Artificial Sequence
  Synthetic
gaagacagagaagtacctccagacgctcctttcagattccgtccgccgggcactagtccaattcgttcgctcgca

SEQ ID NO: 97058 - DNA, 75 bp, Artificial Sequence
  Synthetic
ttggtgaaggaggcgcggaccttagattttgtgctagtcacgccgtgggatggctccgatctcgcacgcgtctca

SEQ ID NO: 97059 - DNA, 75 bp, Artificial Sequence
  Synthetic
actcatctgtcgggagagaactctacgctagtcgcgaactcattacacaacatggccatgggacgggtaatacaa

SEQ ID NO: 97060 - DNA, 75 bp, Artificial Sequence
  Synthetic
gatgaagtgcagacgcggcatcccggaactttcgaagttttgtcagagatgtacgtcggcgacgataccctacac

SEQ ID NO: 97061 - DNA, 75 bp, Artificial Sequence
  Synthetic
tacgtgaaactattaacccttgattcggcgcagattgaccgcgcaattaatacaattttccagacgatagaactc

SEQ ID NO: 97062 - DNA, 75 bp, Artificial Sequence
  Synthetic
tgtgggcatgaagcatccgccgcaaagacaacctttgcgccattctccgcggagaaaacccagacccacgcgaaa

SEQ ID NO: 97063 - DNA, 75 bp, Artificial Sequence
  Synthetic
ggagaaaacccagacccacgcgaaacagggcgtatacataccgcaggaccgaatgatggtgatttcctccgagag

SEQ ID NO: 97064 - DNA, 75 bp, Artificial Sequence
  Synthetic
gcgcaaggaaatcgaggacgtgcaggggtacatgcgtgctcaggcgacgacgttcgtgactaaggttagtcgcgg

SEQ ID NO: 97065 - DNA, 75 bp, Artificial Sequence
  Synthetic
cgttcgtgactaaggttagtcgcggttttagcgaagacctcgctcacaggatcctgctcttaaaagccagcctgg

SEQ ID NO: 97066 - DNA, 75 bp, Artificial Sequence
  Synthetic
tcgggtaccggcggtttaaggcgacgatattcgacgggaccaaatttcggcgaaggaagttcttctccgaggaag

SEQ ID NO: 97067 - DNA, 75 bp, Artificial Sequence
  Synthetic
acggttacacattgtgccgactgctgaacccagcagtcttgtacgctcccgtcgagtgcaatggatacggcgtgc

SEQ ID NO: 97068 - DNA, 75 bp, Artificial Sequence
  Synthetic
atccgtttgcattgaacgtagtccagacctgcgagacacatctagactcgatccagttattccccacgtacgcgg

SEQ ID NO: 97069 - DNA, 75 bp, Artificial Sequence
  Synthetic
acctggtgagcaggaacgtgatcaggactgcatttccgccaccctggaatgagacagacgtagacagccgtcttc

SEQ ID NO: 97070 - DNA, 75 bp, Artificial Sequence
  Synthetic
tgtccacgcagacgcccatggggttatactcgcgaatcgtacgtccgaccgtgagaatggccttgaccgatcctg

SEQ ID NO: 97071 - DNA, 75 bp, Artificial Sequence
  Synthetic
acatcgccgccttggtcacccagatcccactcggggaacacgctccagatagactctcctccacaatgatgcata

SEQ ID NO: 97072 - DNA, 75 bp, Artificial Sequence
  Synthetic
gcgctttgctgaaggaaagccgcgcgcgcgcacttttagcgcccgcctacgaggatcgcttcattgagagcatga

SEQ ID NO: 97073 - DNA, 75 bp, Artificial Sequence
  Synthetic
acaagtggcgtccacacgattttttcaagcctaccgcgggcgtggagcttacggccgcgtacgccaaagtgcttg

SEQ ID NO: 97074 - DNA, 75 bp, Artificial Sequence
  Synthetic
accttcaaattagcgcccgggacgcgcctacgcctttgttccccgacatgaacctctctcccgcctttctcgccc

SEQ ID NO: 97075 - DNA, 75 bp, Artificial Sequence
  Synthetic
aacctctctcccgcctttctcgcccagaagcagtgtgtcggtcaccgcacgacagtccgcccctcgaggacgtat

SEQ ID NO: 97076 - DNA, 75 bp, Artificial Sequence
  Synthetic
agaagcagtgtgtcggtcaccgcacgacagtccgcccctcgaggacgtatatggatcacatcgaccggatactac

SEQ ID NO: 97077 - DNA, 75 bp, Artificial Sequence
  Synthetic
gtggagacgtagttatgcgcgggatcatcaccgcgaacacgataatgacgttactcgaaaagattggattcgacc

SEQ ID NO: 97078 - DNA, 75 bp, Artificial Sequence
  Synthetic
acgacccggcggatctcgccatcatcttcgagttgctgaatctagacagacgtgtcgcacgacgactcgcagaat

SEQ ID NO: 97079 - DNA, 75 bp, Artificial Sequence
  Synthetic
tcgtaacaggagatcggctacgcttcgacgtacacgccctcaacaagcgcggaatagggggggacgagtttacaa

SEQ ID NO: 97080 - DNA, 75 bp, Artificial Sequence
  Synthetic
tgtctttagacgtatgcaccgacgggtcgagggaccagcggattacattcccgcctgagttcacgctcgcggaga

SEQ ID NO: 97081 - DNA, 75 bp, Artificial Sequence
  Synthetic
gagacgccgctgcgttacatgctgagcagatccagctactgttcgccgcccaccagggaaggagcgtccgcgtcg

SEQ ID NO: 97082 - DNA, 75 bp, Artificial Sequence
  Synthetic
cgctgcaagttcgccccgaacaccgaagcgctttacgtaaagcgcggatcaagatgcggaccccaaggttgcgag

SEQ ID NO: 97083 - DNA, 75 bp, Artificial Sequence
  Synthetic
ttatccggagtgcagcacgcgccatccgctccgcgtcgttagcgcttgctgaaggacagttcctctaggggagcc

SEQ ID NO: 97084 - DNA, 75 bp, Artificial Sequence
  Synthetic
ccatccgctccgcgtcgttagcgcttgctgaaggacagttcctctaggggagccgtccgctcgacataaggatac

SEQ ID NO: 97085 - DNA, 75 bp, Artificial Sequence
  Synthetic
gtaaaaaatcctcatttcggacgagcagcatcaggcaagcgagatgtcttctgagaagcaaactccacctatgat

SEQ ID NO: 97086 - DNA, 75 bp, Artificial Sequence
  Synthetic
caagaaacctttcacgaggacgatcgtccttaagagtgaaggtaaagatgacttcgtggcgaggatgtgcagcac

SEQ ID NO: 97087 - DNA, 75 bp, Artificial Sequence
  Synthetic
cttagaatgcgagtatgtcgtagtgaagcatggcgtcggtacgcatgtcgttggtagcaacacacccatccacgg

SEQ ID NO: 97088 - DNA, 75 bp, Artificial Sequence
  Synthetic
ttgcttgctggtggtcattccaaatgcaggatcatatagattgattgatcgcgaccaatcgacgtttctggtggt

SEQ ID NO: 97089 - DNA, 75 bp, Artificial Sequence
  Synthetic
gtcacgagatggaattgaggtacaacaagaccggtggccgggcatgcgattcgaggcggttgacatgtacccgcg

SEQ ID NO: 97090 - DNA, 75 bp, Artificial Sequence
  Synthetic
cgcgtgtaagattagattcggtacgaaggagaatgattcggaggtacgttttggcaaggcgtcgggaaatgtgcc

SEQ ID NO: 97091 - DNA, 75 bp, Artificial Sequence
  Synthetic
gccatacactccggacaacgtgacggacgaccaggaagagttcactctccctggcgtatgcttccatacgcctga

SEQ ID NO: 97092 - DNA, 75 bp, Artificial Sequence
  Synthetic
ggaggagctgcgagagtaccgggagcggctgcgagaagagaaggagttacgtacggcgaatattttagaggtgtt

SEQ ID NO: 97093 - DNA, 75 bp, Artificial Sequence
  Synthetic
tagatcgactcagcagtctaggtccctaggcagaatccacggaatcagaaatagcgacctcaccgctctaaagcc

SEQ ID NO: 97094 - DNA, 75 bp, Artificial Sequence
  Synthetic
cgcggttccgccaccagtccgtaggagcgcgtcaatcacgcgcgtctcggacgagatcgatcgcaccccgacgcc

SEQ ID NO: 97095 - DNA, 75 bp, Artificial Sequence
  Synthetic
tccgaagccgacgctgagccccattcccaacccgagccgcggcctggggatcccttctgcgattccgtccgtcaa

SEQ ID NO: 97096 - DNA, 75 bp, Artificial Sequence
  Synthetic
gaaaaccatccgccctgccgacatcccaccggttgaatccgaggaactgaagtttgtgcctgagtatgagcggat

SEQ ID NO: 97097 - DNA, 75 bp, Artificial Sequence
  Synthetic
tgccgaggctgcattcgagtcactcctcgaggataactcgagtctcgggctgcagttcggcgggaaaccggagcg

SEQ ID NO: 97098 - DNA, 75 bp, Artificial Sequence
  Synthetic
gatcggcatgttttcgcagaacctaggggcttatgagatcgaccccctgtccctccccgtctacgaaattgacgc

SEQ ID NO: 97099 - DNA, 75 bp, Artificial Sequence
  Synthetic
cgcaaagaaccgttacaagtgcatcggaacgaggacgtcgacgcaactgaatgcgctcgtgtgcgacggccgtgt

SEQ ID NO: 97100 - DNA, 75 bp, Artificial Sequence
  Synthetic
gtgtctactttgttccaggtgctaactaaagcgcctatgcgggaacgctagcgcggaggggggattctaagatac

SEQ ID NO: 97101 - DNA, 75 bp, Artificial Sequence
  Synthetic
gtaaaaatttcccaacaatgctagcagccctggagatgaagcagtcaccaaccgcgccacccgcctacgcggcga

SEQ ID NO: 97102 - DNA, 75 bp, Artificial Sequence
  Synthetic
ccccaatggccaatgttgcactcggggtattacagaatgcgatcacgtcgaccaccggagcgaacgagaatgcga

SEQ ID NO: 97103 - DNA, 75 bp, Artificial Sequence
  Synthetic
agaatgaaaaagcggcttacggtgcagcagtagaagtattaaaggacgacgagacgacccgtatgctgaagacgc

SEQ ID NO: 97104 - DNA, 75 bp, Artificial Sequence
  Synthetic
atgtgaacagcgccgccttggaggagatgcgacggtcgctcggtaaactaaagaggaaatgcgtattactgcatt

SEQ ID NO: 97105 - DNA, 75 bp, Artificial Sequence
  Synthetic
gtgtggaggtcctgtgcctcgcagtgacgattggcctatccatcgcattaaccatcgcgggagtcgcggacgcgc

SEQ ID NO: 97106 - DNA, 75 bp, Artificial Sequence
  Synthetic
tggaaaacaaacttaaggccataaacacgtctagtcatgtcatcaccggactactcaccgctaccgcaatcggaa

SEQ ID NO: 97107 - DNA, 75 bp, Artificial Sequence
  Synthetic
ttcagcgcatccgccaaagccaccagcgaaggaaacgccgcctgaaacgtgactatgtgaagaaacagatgtacg

SEQ ID NO: 97108 - DNA, 75 bp, Artificial Sequence
  Synthetic
tttcgttcgcgcagcgtatggggacgcagattccggaaagcggcggtgcggcgaatgacttccatgcgcgtcttc

SEQ ID NO: 97109 - DNA, 75 bp, Artificial Sequence
  Synthetic
aggcgctagcggaggaggcgggacgctacaaggatttcagtgactggcggcactggccttagttggcgggcacct

SEQ ID NO: 97110 - DNA, 75 bp, Artificial Sequence
  Synthetic
aggatttcagtgactggcggcactggccttagttggcgggcaccttgcgatggtgtcgccggggaattaagatac

SEQ ID NO: 97111 - DNA, 75 bp, Artificial Sequence
  Synthetic
gtaaaaattccctcgtcagtacggcagagtatacggtacacgcggacgtaagcatcatatgacatccagactcgt

SEQ ID NO: 97112 - DNA, 75 bp, Artificial Sequence
  Synthetic
acttttggcacccggcgacgtaatcgaaagcgtcgcggacaagttacgtgaacgtgatatcgatataaaagtaaa

SEQ ID NO: 97113 - DNA, 75 bp, Artificial Sequence
  Synthetic
ggatgcatccgtatctgaagcaagtgctactacgactgtcgatcgacagaaacgggaatctggagttcgtacgtc

SEQ ID NO: 97114 - DNA, 75 bp, Artificial Sequence
  Synthetic
agctggatcgaccgggactgatgtggatacaggagcagcgcgagacgctaaatctccgggggagaagacgacgtg

SEQ ID NO: 97115 - DNA, 75 bp, Artificial Sequence
  Synthetic
cgatggtgctggatctgacgttcacaattcgacgcgtggaagcgacacttcctcaggagatcatgtcgatcggag

SEQ ID NO: 97116 - DNA, 75 bp, Artificial Sequence
  Synthetic
cggaactactgactcagaagccggacctgccgcccgaggtcgtggagacgatcgcaaggctatgaaatcggtgga

SEQ ID NO: 97117 - DNA, 75 bp, Artificial Sequence
  Synthetic
gaatccagcgggcggtgattctgtggcacgcgacggcgaaacgcatgggcctgggcgagtttttgtgtcaactcc

SEQ ID NO: 97118 - DNA, 75 bp, Artificial Sequence
  Synthetic
aggactacgcgaggctctgcgccgccgaggacatacagatattaaagtgtatgggactgatgtctttcttccgga

SEQ ID NO: 97119 - DNA, 75 bp, Artificial Sequence
  Synthetic
tcgagaccgtctcgtattgtttggctccgcgccgcttaaggaactcggagtacgccaggatgagggatctgcgca

SEQ ID NO: 97120 - DNA, 75 bp, Artificial Sequence
  Synthetic
gaaagatgcggaatcgcgactcagaagggagaaggtgcgtaatccagtagaggttgagcgtatccacagcgtgca

SEQ ID NO: 97121 - DNA, 75 bp, Artificial Sequence
  Synthetic
gcggctgaacgaagaattccccgcgaaagcgatatccacacggaaagcggtgcccgtcgctctagtcacgaatga

SEQ ID NO: 97122 - DNA, 75 bp, Artificial Sequence
  Synthetic
cgcgaaattcgtcccacaggcgcacattctcttcactgcccctaccggggaccctacgtggaaggaaacggctcg

SEQ ID NO: 97123 - DNA, 75 bp, Artificial Sequence
  Synthetic
cgaggcgacgaagaagaaggagatacgcgcatacgcgcacaatgacgcggagatccccgctggtgacgcattaat

SEQ ID NO: 97124 - DNA, 75 bp, Artificial Sequence
  Synthetic
ctggtgacgcattaattacgcttatagacgcgctgtgaccgtatagggtgacagtacgcaggggattaaggatac

SEQ ID NO: 97125 - DNA, 75 bp, Artificial Sequence
  Synthetic
gtaaaatgttcggatcgcacacgatactgctattacaccagtcactccggaaactcaagccagacgtatacctgc

SEQ ID NO: 97126 - DNA, 75 bp, Artificial Sequence
  Synthetic
catggttcaccatcaggacgggttggacgataaaccagctgtggaaggagaatggaaaacacgccactgacgtct

SEQ ID NO: 97127 - DNA, 75 bp, Artificial Sequence
  Synthetic
acgcagagggcgatgtctgctggttaacgatccgccaagcacgagcgcacgggatactattcgtggggcccaaga

SEQ ID NO: 97128 - DNA, 75 bp, Artificial Sequence
  Synthetic
gcgctaagttcacactcaaagacgtcaccgtcgcggcagatgtagtcgtgaacccaaacgcatcggccaaggaag

SEQ ID NO: 97129 - DNA, 75 bp, Artificial Sequence
  Synthetic
ttgagactcagattggaagagaaaggttacgtttacgtcgccagtttggcaccataatcagacagtacgcgtgga

SEQ ID NO: 97130 - DNA, 75 bp, Artificial Sequence
  Synthetic
ctcgagcggtacatttccacgggagcgaggttgagagcgtgacacatggtccgcacggcggccggagattctacg

SEQ ID NO: 97131 - DNA, 75 bp, Artificial Sequence
  Synthetic
gcaatccaccacgcgcgccgctcgcgtaccccgggagagattatgaatttacaggtgatggaccggtcgacgaga

SEQ ID NO: 97132 - DNA, 75 bp, Artificial Sequence
  Synthetic
agctcgtgagcatgctggactacgccgtccacggcttcgacagggtcatctacgttgggtccggcgatggacgca

SEQ ID NO: 97133 - DNA, 75 bp, Artificial Sequence
  Synthetic
ctctcgaactattccgaaagaaggatcagaagcgatttctcagtgtggaatgggttctcgtcgatcctatcgcca

SEQ ID NO: 97134 - DNA, 75 bp, Artificial Sequence
  Synthetic
actggggtggcactcatgacaacgtaatcgttcgcagggagctggtgcagactccgcgtgatttgagggagtacc

SEQ ID NO: 97135 - DNA, 75 bp, Artificial Sequence
  Synthetic
agggagatgagaccaccctgctgctgtgggacgtacgtagcgatagaggcgacaagagcgacgccgagtgggaag

SEQ ID NO: 97136 - DNA, 75 bp, Artificial Sequence
  Synthetic
agacctgtctgagagaggacgccctgggcgaagacgtcgcgagtgggaatggtgactggctggatgcggcgctcc

SEQ ID NO: 97137 - DNA, 75 bp, Artificial Sequence
  Synthetic
tgaagcggagagtgccgtttgcggcgaccttcaagtgtctgacgtctgtgttatgttaccaacccggcgcacccg

SEQ ID NO: 97138 - DNA, 75 bp, Artificial Sequence
  Synthetic
cggacatgtatgagctgcgatcgtttctcgcgttccgatcgcgcggatggttgggaactcccacgctcgtgaacc

SEQ ID NO: 97139 - DNA, 75 bp, Artificial Sequence
  Synthetic
tggtgacgagcgagattcgaactcgaatacctcgatatcatggaagagatagaggcagaatcttgcgaacgcggc

SEQ ID NO: 97140 - DNA, 75 bp, Artificial Sequence
  Synthetic
ttatacagacgctgcacattgaacccgcgaatgcactcgaacacgagtcgtgcccgcgtgcggacctcttttatc

SEQ ID NO: 97141 - DNA, 75 bp, Artificial Sequence
  Synthetic
tgactaacaggagaaatccaccagaaaaggcgctagaggtcgccatgcgcagcgaaatcgccacactctggatcg

SEQ ID NO: 97142 - DNA, 75 bp, Artificial Sequence
  Synthetic
ggggtccactggcctcttatgacgattatagcatggattgcgccgaaatcatgttacgctgcttttccgccgatc

SEQ ID NO: 97143 - DNA, 75 bp, Artificial Sequence
  Synthetic
gaatggttgctgatggtcttgggttcctgctgttgctgatgctgttaggtgacatcaaaaacaccgtgtcgttcg

SEQ ID NO: 97144 - DNA, 75 bp, Artificial Sequence
  Synthetic
accccggatgggccgcgaattatgcgatcgtcttccggcgccgggatgttgacgcggtgccggatgtatggctct

SEQ ID NO: 97145 - DNA, 75 bp, Artificial Sequence
  Synthetic
gcagattcataggcctacgcgcgaattcatccttgctcagagtacaggagccaattgctcacgccacctctgacc

SEQ ID NO: 97146 - DNA, 75 bp, Artificial Sequence
  Synthetic
tcatcaagcgccttggcatcgatctgtccggacatttgttcgttacccttgtgtcgggccgatacctggcagacc

SEQ ID NO: 97147 - DNA, 75 bp, Artificial Sequence
  Synthetic
tgcggacctggtttcggatgatcctcgagtggagctcgaaaaatcgcgatgaaaagttacgcgctctggcgtatg

SEQ ID NO: 97148 - DNA, 75 bp, Artificial Sequence
  Synthetic
cgaatgcggaggtaatcgagtggaaggaggagatggaagaacgtccatggcataggcgagaggatctgatcgcgg

SEQ ID NO: 97149 - DNA, 75 bp, Artificial Sequence
  Synthetic
cactgaatgtatttcgtaccatggcaaacgagcgtctgcgtccgtatgtggacggtgtggtagagtatctccgtt

SEQ ID NO: 97150 - DNA, 75 bp, Artificial Sequence
  Synthetic
tagagtatctccgttatgacgggcccgggtaagcgaacccacggaggggcgtgctgtcaggcgaacataacatac

SEQ ID NO: 97151 - DNA, 75 bp, Artificial Sequence
  Synthetic
gtaaaatttcctctgacgatgctagcagcacttgagatgaagcagtcaccaaccgcaccgccagcctacgcggcg

SEQ ID NO: 97152 - DNA, 75 bp, Artificial Sequence
  Synthetic
cagcacttgagatgaagcagtcaccaaccgcaccgccagcctacgcggcgaccccaatggccaatgtcgctcttg

SEQ ID NO: 97153 - DNA, 75 bp, Artificial Sequence
  Synthetic
gcgttctacaaaacgcgattacgtctaccacgggagcgaacgaaaccgctaggaacgaaaaagcagcgtatggag

SEQ ID NO: 97154 - DNA, 75 bp, Artificial Sequence
  Synthetic
cggcggtcgaggcgcttaaagacgatgagactacgcgtatgctcaaggcgcatgttaacgagacatctctgcgag

SEQ ID NO: 97155 - DNA, 75 bp, Artificial Sequence
  Synthetic
aagcggagcgcaccctggcgaaactgaaacgaaagtgtctccttttgcattgtgccgagttgatgtgtctcgctc

SEQ ID NO: 97156 - DNA, 75 bp, Artificial Sequence
  Synthetic
ttacgatcgggatctcagtcgtcctaatgattacgagcgctgccgacgctctggaggcgcagttaaagagaataa

SEQ ID NO: 97157 - DNA, 75 bp, Artificial Sequence
  Synthetic
atatgtccagccacgtcatcactgggttattaacagccgcggcgataggcctacagcgcgccagacagagccacc

SEQ ID NO: 97158 - DNA, 75 bp, Artificial Sequence
  Synthetic
agcgcagaaagaagagtctaaagcgtgacctcgtaaagaagcagatgtatgtatctttcgtccggaggatggggt

SEQ ID NO: 97159 - DNA, 75 bp, Artificial Sequence
  Synthetic
cgcggattccggaaagcagcgctgcggggcctgactttcatgctcgtcttttggctctggcagaggaggcgggac

SEQ ID NO: 97160 - DNA, 75 bp, Artificial Sequence
  Synthetic
gccacaaggaaaccagtgactggcgacactggccttgataggcgggcacctagcgatggtgtcgcctgggggaat

SEQ ID NO: 97161 - DNA, 75 bp, Artificial Sequence
  Synthetic
ggaaaccagtgactggcgacactggccttgataggcgggcacctagcgatggtgtcgcctgggggaataggatac

SEQ ID NO: 97162 - DNA, 75 bp, Artificial Sequence
  Synthetic
gtaaaatttccacgctacaggtatggcaacgaaacgcatcggagcgagaatgtccggctttttaagtcgaatagg

SEQ ID NO: 97163 - DNA, 75 bp, Artificial Sequence
  Synthetic
gcaacgaaacgcatcggagcgagaatgtccggctttttaagtcgaataggatctggaatctcgaaggcggtaacg

SEQ ID NO: 97164 - DNA, 75 bp, Artificial Sequence
  Synthetic
agtagtaccgcacgacgaatcgccacagcggcgggtactgcgataagcaaagcggcgtcgtcggaaataggacag

SEQ ID NO: 97165 - DNA, 75 bp, Artificial Sequence
  Synthetic
agagcgataagtggggcgatcgaaggagcggtaaactctgcattgactggcgaggcgctgggtgaatccatgaag

SEQ ID NO: 97166 - DNA, 75 bp, Artificial Sequence
  Synthetic
agagccgtaatcctgaacgtcgccggggtccaccagactgtccctgacccgctaaacgctgcagagatcgagaca

SEQ ID NO: 97167 - DNA, 75 bp, Artificial Sequence
  Synthetic
caggtcaaactacgcgagcttgaacaggagaataaacgtgaggaggcagctattaggcacaacgcaattatgcta

SEQ ID NO: 97168 - DNA, 75 bp, Artificial Sequence
  Synthetic
aaacgagagggtgatgtactcaagaacgtgaagcatcttcaaaggttgcaggcgatcacggagagtgaggagcag

SEQ ID NO: 97169 - DNA, 75 bp, Artificial Sequence
  Synthetic
aatgaaatcaaagacctggacgctgtactggagacgacgcgaaccctcgtccgggaggagagaaccaagctcgac

SEQ ID NO: 97170 - DNA, 75 bp, Artificial Sequence
  Synthetic
gaggttgctggcgcgctggtgcgggaggacatgctacgtacggccgacgagcgaaagctaattgaaggaatgcga

SEQ ID NO: 97171 - DNA, 75 bp, Artificial Sequence
  Synthetic
cataattatcaggcgctcgcaaagaatgtggaagcggaacggtctgcgctcatagaggaggcgattgagcaaacg

SEQ ID NO: 97172 - DNA, 75 bp, Artificial Sequence
  Synthetic
gttgatataggtggggagatcgccgaacacgcgaccgcatcgattcccttcgtcggagaggccgtggcgagtggt

SEQ ID NO: 97173 - DNA, 75 bp, Artificial Sequence
  Synthetic
atggcgacggcgaggggggcgatacagatctatcggctaggcaaaacaatccatgcgctcacgggtctacatacc

SEQ ID NO: 97174 - DNA, 75 bp, Artificial Sequence
  Synthetic
caccatatggaggtcccgtctatacatcaaggggctatcgagacactgctcacttctgaacatccgacgagtgac

SEQ ID NO: 97175 - DNA, 75 bp, Artificial Sequence
  Synthetic
gcaagtctggctcggatcgctggctccagatcaaaacacctgaaagagatcgaggcggaggtgtcgcacctgcag

SEQ ID NO: 97176 - DNA, 75 bp, Artificial Sequence
  Synthetic
aaggaggtcgtacccgcgtacaagaaagtatgccaatcggtacggaggaccgcgcccgagcacctacggaaacag

SEQ ID NO: 97177 - DNA, 75 bp, Artificial Sequence
  Synthetic
tgcgaggttgtgcggacgacggcggctcatgagcttaaggttcccctgcagcagaggcccatgatacacacctac

SEQ ID NO: 97178 - DNA, 75 bp, Artificial Sequence
  Synthetic
acgtccccttgggacagtgacgccgtcgtgctcttgcatgtgatcgggccgtatcactctgggcaggcgttcgtc

SEQ ID NO: 97179 - DNA, 75 bp, Artificial Sequence
  Synthetic
atgtgtgtagacctctccctcgacctctttcactttgaagaaatacactccgctacccaccgatttcaccgacgc

SEQ ID NO: 97180 - DNA, 75 bp, Artificial Sequence
  Synthetic
caccacgcgcagctcaggacattcggccaggcgtgcgctgacttctttctcatgtccgcgcgccatcctgacgcc

SEQ ID NO: 97181 - DNA, 75 bp, Artificial Sequence
  Synthetic
accaaggttcaccggaccaggatggagtggagtgttagcgagtctccgctgcatgtgggttctgtcccttacgag

SEQ ID NO: 97182 - DNA, 75 bp, Artificial Sequence
  Synthetic
gcatgtgggttctgtcccttacgagacatctttcggccagatgctggaaaatgcccgcacgttcgcctcaaggcc

SEQ ID NO: 97183 - DNA, 75 bp, Artificial Sequence
  Synthetic
ggagctgcagcaagcgctgctacgtggtcccatcgctatgcagagacggacgatcttgaacgcgattatgcatgg

SEQ ID NO: 97184 - DNA, 75 bp, Artificial Sequence
  Synthetic
ggtcccatcgctatgcagagacggacgatcttgaacgcgattatgcatggtgcggttatgatacaaacgcgccgg

SEQ ID NO: 97185 - DNA, 75 bp, Artificial Sequence
  Synthetic
cgcgccggaagtttccgctcgcagcgcggaggtgccagcgttagaggcgcggtacctgcgatgggaataggttac

SEQ ID NO: 97186 - DNA, 75 bp, Artificial Sequence
  Synthetic
gtaaaacttccggaagcaatggccaacccgcaaccacgagaacagactccacaacaacagactgagagctcacca

SEQ ID NO: 97187 - DNA, 75 bp, Artificial Sequence
  Synthetic
tacctgcgaggatcagaggtgcatgatgatcccggcgtcgcgttgtcggtcttcgccctacaggagatcatcaga

SEQ ID NO: 97188 - DNA, 75 bp, Artificial Sequence
  Synthetic
aaagtacgcgaggcgcaaaccgcactgagaaacgaggggcgtgaggtagaccccgcccctcccgagattgaacag

SEQ ID NO: 97189 - DNA, 75 bp, Artificial Sequence
  Synthetic
atcttctcagctctaagcgacctaaggtcggagcgaccgtaccgcgtggaagagcgtctacctgtctactacaga

SEQ ID NO: 97190 - DNA, 75 bp, Artificial Sequence
  Synthetic
tttgaaccatcgcaatcccgagaacggttctttagggtggacacgcacttcgaacgcatgacaagcgcggcggct

SEQ ID NO: 97191 - DNA, 75 bp, Artificial Sequence
  Synthetic
gatggcgcactagaggacccagcacacctaatgtcgataattctgtcgcgagtcgaggagatacgacagaacggg

SEQ ID NO: 97192 - DNA, 75 bp, Artificial Sequence
  Synthetic
tctttcttactgcgatcggcgccaacgcatttcattgatggtcgggagataatcgacgcggagggcttaggagtt

SEQ ID NO: 97193 - DNA, 75 bp, Artificial Sequence
  Synthetic
cgcatttcattgatggtcgggagataatcgacgcggagggcttaggagttgacatcccagggctgctgaatatgg

SEQ ID NO: 97194 - DNA, 75 bp, Artificial Sequence
  Synthetic
tcgagccacgcgttaggcatctactgcaaagacagatcgaccagctgactgtgctgaaccaggaccaggacgata

SEQ ID NO: 97195 - DNA, 75 bp, Artificial Sequence
  Synthetic
gcaaagacagatcgaccagctgactgtgctgaaccaggaccaggacgatactttgctcgacgtgtatccgggagc

SEQ ID NO: 97196 - DNA, 75 bp, Artificial Sequence
  Synthetic
gtgcccagagcctgttttcaacgtgcatcgtgcacttacggctcacattacattgaatcagcgtgacgagtatag

SEQ ID NO: 97197 - DNA, 75 bp, Artificial Sequence
  Synthetic
ggccgcaatgcagtggctgcaggcgtatggagaattcaagaggattgatttctcgcgcgcgctactaacggacgt

SEQ ID NO: 97198 - DNA, 75 bp, Artificial Sequence
  Synthetic
cttttcgcccgataccgtgtacatccagagctatcagatcccggcgaacccccagctgatctgggaagttccacg

SEQ ID NO: 97199 - DNA, 75 bp, Artificial Sequence
  Synthetic
cagagctatcagatcccggcgaacccccagctgatctgggaagttccacggagcggcgtgtcgaatcttgtcctc

SEQ ID NO: 97200 - DNA, 75 bp, Artificial Sequence
  Synthetic
aatgccgcattgggaatacctcatgggacgtacatcactccgaacccccggatttcggcgataacggtcgcgtcg

SEQ ID NO: 97201 - DNA, 75 bp, Artificial Sequence
  Synthetic
cgagtcacgacaaccacgtctttcgcccagctactcgggaccatccctacagctgctcagatggatgatgtgcgg

SEQ ID NO: 97202 - DNA, 75 bp, Artificial Sequence
  Synthetic
aagatctatctcgcgttgatgtttccgaatcagatccttctcgacatcaggccagagcctggtcaccaagtcgac

SEQ ID NO: 97203 - DNA, 75 bp, Artificial Sequence
  Synthetic
cgaatcagatccttctcgacatcaggccagagcctggtcaccaagtcgacgtcgttgcgcaatcggtcgcggggg

SEQ ID NO: 97204 - DNA, 75 bp, Artificial Sequence
  Synthetic
tgcttgggaaattcatcttctcttatggaccagtgctattcaacatcacgcctcacaccgcccgatgtcttgacc

SEQ ID NO: 97205 - DNA, 75 bp, Artificial Sequence
  Synthetic
gagcgtgtgcatccttcctacagatggcgactgacgaccggcgtactatccggtttgggccctcggggcgaccct

SEQ ID NO: 97206 - DNA, 75 bp, Artificial Sequence
  Synthetic
cggtttgggccctcggggcgacccttggacttcacgatccagcagggacagcgcgcgtttgactgcaaccagctc

SEQ ID NO: 97207 - DNA, 75 bp, Artificial Sequence
  Synthetic
gcacataactccgcgcgaggaaatggcttcatgaattggggcgccgactcagttggcgaccatcctacgccttac

SEQ ID NO: 97208 - DNA, 75 bp, Artificial Sequence
  Synthetic
cctcacgtgcgtcgacggatccaatatctaggatacgtgccggaggatgttatcgacgaaaggttctgcggggac

SEQ ID NO: 97209 - DNA, 75 bp, Artificial Sequence
  Synthetic
gacctgcggttcttgctccacgaccgcttgtgcgaggctctagcgatctccggccatgtcaacgaaaggaactac

SEQ ID NO: 97210 - DNA, 75 bp, Artificial Sequence
  Synthetic
gcttgtgcgaggctctagcgatctccggccatgtcaacgaaaggaactacgtcgaggtgatgaggcagcatcacg

SEQ ID NO: 97211 - DNA, 75 bp, Artificial Sequence
  Synthetic
tcgtgagattcgcgcacatcagccagataatcaaccgcgacctcgtatccgccttctcactgcctgatgaccgct

SEQ ID NO: 97212 - DNA, 75 bp, Artificial Sequence
  Synthetic
tctttgcattgggggcgggcgtgccgcgcgatgccacgggacctgatggcccgattatcctcgacgtcagctaca

SEQ ID NO: 97213 - DNA, 75 bp, Artificial Sequence
  Synthetic
tgtccatcatccacgcgtatcggctacgcttccttccaatcgcgcggcctgagcgtattatccatcagcctatcc

SEQ ID NO: 97214 - DNA, 75 bp, Artificial Sequence
  Synthetic
tagagtcgatttatgtatcgcatttatcactggcaaaactgaacgcatcacgactgcagacgttcgtcaacgcaa

SEQ ID NO: 97215 - DNA, 75 bp, Artificial Sequence
  Synthetic
atcactggcaaaactgaacgcatcacgactgcagacgttcgtcaacgcaaacacggagagcttcgccgaagcgcg

SEQ ID NO: 97216 - DNA, 75 bp, Artificial Sequence
  Synthetic
gcccatggacgtctggcgcacagtgtacccacggcttcctgaacctgtcagacggattttcgacctcacgggcca

SEQ ID NO: 97217 - DNA, 75 bp, Artificial Sequence
  Synthetic
gacggattttcgacctcacgggccaacactcgttcatcacaggccgggacatcgggatctggctcgcctccccct

SEQ ID NO: 97218 - DNA, 75 bp, Artificial Sequence
  Synthetic
ttactcgcgacgtatacatctacagacagccggtgcccgagtacccactcgaagacgtgcggcagttccgacgtg

SEQ ID NO: 97219 - DNA, 75 bp, Artificial Sequence
  Synthetic
atgcagtgtacttcactaacatcctggatgccagacccgccaatggaaggagagtcgtgctcgaccgcataatta

SEQ ID NO: 97220 - DNA, 75 bp, Artificial Sequence
  Synthetic
tgcagcagcgcgcgggagctggccggttacggatgtcaatacgcgagctactcgatgacgggctgtatgtccagg

SEQ ID NO: 97221 - DNA, 75 bp, Artificial Sequence
  Synthetic
tcggctcggctcttcgccccattgttctgagcatacaccatggactgcctccggagagtgtactgcgcgcgttgc

SEQ ID NO: 97222 - DNA, 75 bp, Artificial Sequence
  Synthetic
cctttgagtatcggcgtgagagttcagacggacctactgcacgcgttaccttgcagctgctaagacccgtccccg

SEQ ID NO: 97223 - DNA, 75 bp, Artificial Sequence
  Synthetic
ccttcttcatgctgtacaacgcggacgaacaggcgttccccgacgagatgatcgatctcgtgcctaacgtttcgc

SEQ ID NO: 97224 - DNA, 75 bp, Artificial Sequence
  Synthetic
tcgtaagcttgtacatccagcgcccacccgtagaacgcgtgagctacgataccgccttaagcgtcgtcacccgag

SEQ ID NO: 97225 - DNA, 75 bp, Artificial Sequence
  Synthetic
actttacctcctttcggtctcgtgtgcggatcatggatctcgctgctgctctcgacgcgggtagccattatgctt

SEQ ID NO: 97226 - DNA, 75 bp, Artificial Sequence
  Synthetic
ttatgctttaccctcgaacgcgctgtaggacttcagccaccctacagcgtgggcgtcggcccggagtaaggatac

SEQ ID NO: 97227 - DNA, 75 bp, Artificial Sequence
  Synthetic
atggcgaatccgcaaccccgagaacagacaccacaacaacaaacggccagttcaccctacttacgcggagctgaa

SEQ ID NO: 97228 - DNA, 75 bp, Artificial Sequence
  Synthetic
gtatatgatgacccaggagtcgcgctctcaatcttcgcactccaggagatcataagaaaagttagagaggcccag

SEQ ID NO: 97229 - DNA, 75 bp, Artificial Sequence
  Synthetic
accgcgctacgcaatgaaggacgggaagcggaccccgcaccccccgagatcgagcagatcttctcagcgctaagc

SEQ ID NO: 97230 - DNA, 75 bp, Artificial Sequence
  Synthetic
cgagcagatcttctcagcgctaagcgacttacgcagcgaaagaccgtataggctcgaagagcggcttccagtcta

SEQ ID NO: 97231 - DNA, 75 bp, Artificial Sequence
  Synthetic
ctaccgattcgagtcctcgcagtcgcgcgagcgcttcttcagagtcgatacccacttcgaacgattgactcggac

SEQ ID NO: 97232 - DNA, 75 bp, Artificial Sequence
  Synthetic
ggcagtggatggatcgctagaggatccagcgcatttgatgtccatcatactttctcgcgtagaggaaattcgcca

SEQ ID NO: 97233 - DNA, 75 bp, Artificial Sequence
  Synthetic
agcgggatccttcttgctgcgcgctgcgccaacgcacttcatcgacggacgagaaatcatcaacgccgaggcgct

SEQ ID NO: 97234 - DNA, 75 bp, Artificial Sequence
  Synthetic
gggagtcgacatccctggactgctgaatctcgtggagccacgagtgaggcacttactacagcggcagattgacca

SEQ ID NO: 97235 - DNA, 75 bp, Artificial Sequence
  Synthetic
gctcaccgtgctgaaccaagatcaagacgatgtactgttggacgtctatcccggagcatgcccagactccatttt

SEQ ID NO: 97236 - DNA, 75 bp, Artificial Sequence
  Synthetic
tagtgtccatcaggcgctgactgctcacgtgacgcacaaccaacgtgacgattatcgcgcggcgatgcagtggct

SEQ ID NO: 97237 - DNA, 75 bp, Artificial Sequence
  Synthetic
tcaggcttacggagagttcaagcgcatcgacttttcacgagcattgctcacggacgtgttctcccctgacactgt

SEQ ID NO: 97238 - DNA, 75 bp, Artificial Sequence
  Synthetic
tgccgcgcagcggggtgtcaaatctggttatcaacgctgccctcggggtccctcacggcacatatatcaccccga

SEQ ID NO: 97239 - DNA, 75 bp, Artificial Sequence
  Synthetic
ggttatcaacgctgccctcggggtccctcacggcacatatatcaccccgaatccgcgcatctcggcgatcactgt

SEQ ID NO: 97240 - DNA, 75 bp, Artificial Sequence
  Synthetic
cgcttcgcgtgtaacgactaccacgtctttcgctcagctactaggtacgatccccacagccgcgcagatggatga

SEQ ID NO: 97241 - DNA, 75 bp, Artificial Sequence
  Synthetic
tgtcaggaagatctacctcgccttgctttttccgaatcaaatcctattggatatacgcccagaacccggccatca

SEQ ID NO: 97242 - DNA, 75 bp, Artificial Sequence
  Synthetic
agttgacgtcgtcgctcagtctgtggctggcatcctcgggaagctcatgttctcctacggcccgctgctctttaa

SEQ ID NO: 97243 - DNA, 75 bp, Artificial Sequence
  Synthetic
cataacaccccacaccgctaggtgcctagatcgagcttgcgcatcatttctccaaatggcaaccgatgacagacg

SEQ ID NO: 97244 - DNA, 75 bp, Artificial Sequence
  Synthetic
gacgatccgacggggcccctccggccggcccctcgatttcacgatcctgcagggacagcgcgcattcgactgcaa

SEQ ID NO: 97245 - DNA, 75 bp, Artificial Sequence
  Synthetic
ccagttagcgcataacgctgcccgaggaaacggcttcgtgaactggggcgtggactcggttggcgatcacccaac

SEQ ID NO: 97246 - DNA, 75 bp, Artificial Sequence
  Synthetic
gccttacccccacattcgccggagaatccagtatcttggctacgtgcccgaagatgtgatcgacgagcgtttttg

SEQ ID NO: 97247 - DNA, 75 bp, Artificial Sequence
  Synthetic
cggagatgacctgcgctacctcctacacgaacgaatgtgcgaagcgcttgcgatttcagggcacgtcaacgaaag

SEQ ID NO: 97248 - DNA, 75 bp, Artificial Sequence
  Synthetic
gaattacattgaagtcatgaggcagcaccaggtcgtcaggttcgctcacatcagccaaatcatcaatcgcgacct

SEQ ID NO: 97249 - DNA, 75 bp, Artificial Sequence
  Synthetic
cgtctcggccttttcactgccggatgacaggtttgccgcgctcgggacgggtgtgcctcgcgacgcgacaagtcc

SEQ ID NO: 97250 - DNA, 75 bp, Artificial Sequence
  Synthetic
gtgtgcctcgcgacgcgacaagtccggacgggccagtcatcctcgacatcagttacatgtcgatcatacatgcct

SEQ ID NO: 97251 - DNA, 75 bp, Artificial Sequence
  Synthetic
aggcgagacctatggacgtttggcgaacggtgtaccccaggctgcccgagcctgtacgtcggatctttgacctga

SEQ ID NO: 97252 - DNA, 75 bp, Artificial Sequence
  Synthetic
ccggacaacattcgttcgtcactggcagagacatcggcatgtggctcgcctcgcctctgctgcaggaatctctat

SEQ ID NO: 97253 - DNA, 75 bp, Artificial Sequence
  Synthetic
tcctgctgtgcgcgcgcgcggcatgggaagctaccgctgacccctcggagatcggcttcacgcgtgacgtgtata

SEQ ID NO: 97254 - DNA, 75 bp, Artificial Sequence
  Synthetic
tccaccgtcagcccattcctgagtacccactggaggacgtgcgacagttccgccgggacgcggtttactttacga

SEQ ID NO: 97255 - DNA, 75 bp, Artificial Sequence
  Synthetic
atatgctggacgctcgacccaataacggccagcgagtgatcttggaccggatcatcatgcagcaacgcgcgggag

SEQ ID NO: 97256 - DNA, 75 bp, Artificial Sequence
  Synthetic
ccgggcggctgcggatgtcgatcagagagctactcgatgacggtttatacgtgcagatcggaaccgcactccggc

SEQ ID NO: 97257 - DNA, 75 bp, Artificial Sequence
  Synthetic
ccatcgttctgagtatccaccacgggctcccgcctgagagcacgctgagggccctaccctatacataccaacgtg

SEQ ID NO: 97258 - DNA, 75 bp, Artificial Sequence
  Synthetic
agagctcggatggaccgacagcgcgtgtcactctgcagctgctacgccctgtcgcggcgttctacatgctgtata

SEQ ID NO: 97259 - DNA, 75 bp, Artificial Sequence
  Synthetic
tgtcactctgcagctgctacgccctgtcgcggcgttctacatgctgtataacgcggatgagcaggcgttcccaga

SEQ ID NO: 97260 - DNA, 75 bp, Artificial Sequence
  Synthetic
cgagatgatcgacctcgttcccaacgtctcgctcgtaagcctatacatccagcgacccccggtcgaacgcgtgag

SEQ ID NO: 97261 - DNA, 75 bp, Artificial Sequence
  Synthetic
agcgacccccggtcgaacgcgtgagttacgaaaccgccctgagcgtcgtcacacgcgacttcgcctcgttcaggt

SEQ ID NO: 97262 - DNA, 75 bp, Artificial Sequence
  Synthetic
ctgctctcgatgcgggtagccagtatgctttaccctcgaacgcgctgtaggacctcagccaccctgcggcgtggg

SEQ ID NO: 97263 - DNA, 75 bp, Artificial Sequence
  Synthetic
gtaaaattttcctcatttcgagcgaacgccattcttctttgcaagatgtcttccgataagcagaacgttccaatg

SEQ ID NO: 97264 - DNA, 75 bp, Artificial Sequence
  Synthetic
attaagaagccattcacacgagtaatcgtgctgaaaagtgatgggaaggatgacttcgtcgcgaagatgtgcgct

SEQ ID NO: 97265 - DNA, 75 bp, Artificial Sequence
  Synthetic
gtcctgggatgcgaatatgttgtggtgcgtcatggcttgggcacccaaatcgcagggagtgacacgccagctcat

SEQ ID NO: 97266 - DNA, 75 bp, Artificial Sequence
  Synthetic
ggatgtctacttttaacgataccaggaccgggatcgtttaggatgattgatcgtgaccagtcgacgtttctcgtg

SEQ ID NO: 97267 - DNA, 75 bp, Artificial Sequence
  Synthetic
gtctccggagacggactcgaggttcagcaagatcggtggactggaatgcgattcgaggcggtggacatgtaccca

SEQ ID NO: 97268 - DNA, 75 bp, Artificial Sequence
  Synthetic
cgtgcgtgccgtatccgatacggggaaaaggagaacgactcggagattcgattcggacgcgcctcgggaaccgtt

SEQ ID NO: 97269 - DNA, 75 bp, Artificial Sequence
  Synthetic
ccgccatatacgcccgatggtgtgtcagaagaacaggaagaggtcgccctgcccggaatcagcttccacaccccg

SEQ ID NO: 97270 - DNA, 75 bp, Artificial Sequence
  Synthetic
gaggaggattacaaagagtatcgtgaacgtcttagggaagagcgtgatttacgctccgctaatatcctggaggcg

SEQ ID NO: 97271 - DNA, 75 bp, Artificial Sequence
  Synthetic
ctgcgcacgacacatcagtcacgtacccttgggcgcatccacgggatacggaattcggagcttaccactctacgg

SEQ ID NO: 97272 - DNA, 75 bp, Artificial Sequence
  Synthetic
ccacccgcgccgccaacgctgcgtaggggcgtctctagctcaaacgaacgtagcgctgatcgaacacccacaccg

SEQ ID NO: 97273 - DNA, 75 bp, Artificial Sequence
  Synthetic
cccaagcctattgcccctacgtaccccacggcagccgccccgcgaaccacggccgcgccgcctccgatcccgtcg

SEQ ID NO: 97274 - DNA, 75 bp, Artificial Sequence
  Synthetic
gtgaagcgggtcagtaagaccgcccctcaggaggctgagagtcagtgcccaaaatttacacacgagtatgatcag

SEQ ID NO: 97275 - DNA, 75 bp, Artificial Sequence
  Synthetic
ctcgcggagagggcgttcgagtcactgctcgaggacgatccaaacgcgcgtttcagttacggcggcgccccagaa

SEQ ID NO: 97276 - DNA, 75 bp, Artificial Sequence
  Synthetic
acggttggcctgttctcccagtgtttggggacgtacgaagttgaccctttgatgctgccagcgtatgagatcgac

SEQ ID NO: 97277 - DNA, 75 bp, Artificial Sequence
  Synthetic
cagaccaagaaccgctataagtacgtcggaatgaagacgtcgtcgcagttgaatgcgctcgtatgcgacgaccgc

SEQ ID NO: 97278 - DNA, 75 bp, Artificial Sequence
  Synthetic
cgcgtctacttcgttccaagtgccaattaggcgctagtgcgggaacgctagcgcggaggggggaaaataagatac

SEQ ID NO: 97279 - DNA, 75 bp, Artificial Sequence
  Synthetic
gtaaaattcttcaccgacatggacgcgtacactgcacgagcgctttccgtactcgagggactcgccatttccggc

SEQ ID NO: 97280 - DNA, 75 bp, Artificial Sequence
  Synthetic
gacccgcgatcgcaccgagacccaacgaccgaagcaacgatgtcaatcttcgccatgagattcaacagcacaacc

SEQ ID NO: 97281 - DNA, 75 bp, Artificial Sequence
  Synthetic
tcacgaccagtcatcgggacgcccacgacgcgagaggcacgccggaataacttctacgccgcggtcgacgtcgca

SEQ ID NO: 97282 - DNA, 75 bp, Artificial Sequence
  Synthetic
ttcgctacacttaacatcacgtctacgttcgttatgcctggctacatccagaatccccaaaccttggcgatcctg

SEQ ID NO: 97283 - DNA, 75 bp, Artificial Sequence
  Synthetic
gcaagggatgagattccgtatacaccgtcgacgtttaggcgggttcagcgaatccgagtatgcacaaccgattat

SEQ ID NO: 97284 - DNA, 75 bp, Artificial Sequence
  Synthetic
tcgaacgttcgagaggagcactacccttacacaacgcacggcgcggtcacaactcccggagtactcttacaacca

SEQ ID NO: 97285 - DNA, 75 bp, Artificial Sequence
  Synthetic
ccgcagaacggcaacatcgcgtgctacgcaatttcgcctagctcgctgcaaattcatctcgacccaatgcaggct

SEQ ID NO: 97286 - DNA, 75 bp, Artificial Sequence
  Synthetic
ttacccctcgcgaatctcatttttccggatcgcgaagatgtaatcatggcggagttcacatggcaacgcgtcgcg

SEQ ID NO: 97287 - DNA, 75 bp, Artificial Sequence
  Synthetic
aatggcatccaaaacaatgtggtggtggacttgggcgtagagattgaactggaggtggaaggcgcgacgaagcct

SEQ ID NO: 97288 - DNA, 75 bp, Artificial Sequence
  Synthetic
gcaggtgttccgtttacagcgacgggccgcaatcagatcacgctgaccagccacgagcccctcgaccgctgcgtc

SEQ ID NO: 97289 - DNA, 75 bp, Artificial Sequence
  Synthetic
gcgcagattacttgccatagatactgggtcacctcgccaccgcgcgtcgtctatgattcgatggaagcggacatc

SEQ ID NO: 97290 - DNA, 75 bp, Artificial Sequence
  Synthetic
ctcgccgtatatacatacaaagatgatttctgggacgcactgaaaagctatgtgctacagactctcgggatgccc

SEQ ID NO: 97291 - DNA, 75 bp, Artificial Sequence
  Synthetic
gcccatcactacccgctccatccggtgacggaatttcgacagaatctcgcgatcgcaatcctttcacgcctcttt

SEQ ID NO: 97292 - DNA, 75 bp, Artificial Sequence
  Synthetic
gacgtctactgcgcgatgtcacccgaaatcaacgtcccagccgcggcccaagggccgctcgccggacttgcccat

SEQ ID NO: 97293 - DNA, 75 bp, Artificial Sequence
  Synthetic
cgactacaggctgctctgcgtgccttcaggctgggtcagtaggtggttagctccactccacctaggcacggcttg

SEQ ID NO: 97294 - DNA, 75 bp, Artificial Sequence
  Synthetic
acctaggcacggcttgtcgtgcgttacccggctcttcaagagcggaagagcgagggggcgggaaggataggatac

SEQ ID NO: 97295 - DNA, 75 bp, Artificial Sequence
  Synthetic
tgctccaggagtccctcttcctgctgtgcgcgcgtgttgcttgggaagccaccgcggatccctcagagattgggt

SEQ ID NO: 97296 - DNA, 75 bp, Artificial Sequence
  Synthetic
gtaaaatgtcatggctgtagtggagcagcggattacctcagcaagaaataccttgagacgcatattcccggaaca

SEQ ID NO: 97297 - DNA, 75 bp, Artificial Sequence
  Synthetic
actgtttagcgatacgaagacacactacttatattacaagtattccaagtggaaagataaggatgcagaggagcg

SEQ ID NO: 97298 - DNA, 75 bp, Artificial Sequence
  Synthetic
tacttatattacaagtattccaagtggaaagataaggatgcagaggagcgaccgtcgctttttgggattcccgtc

SEQ ID NO: 97299 - DNA, 75 bp, Artificial Sequence
  Synthetic
ctgaaggagcgcgattggaacgacataccaaggaaccatcagacgcggccccgagacgtactagactactactac

SEQ ID NO: 97300 - DNA, 75 bp, Artificial Sequence
  Synthetic
cagtcgcagcggccgataaacgacctgcagccggaagaggagttcctcaggaactatgcattatccaacgcggaa

SEQ ID NO: 97301 - DNA, 75 bp, Artificial Sequence
  Synthetic
cagagcgaagtttatgcattcctcaagcacagagcgcaggaagaaatggccgtctatggcgacctggcgttgaga

SEQ ID NO: 97302 - DNA, 75 bp, Artificial Sequence
  Synthetic
cactggtatgcgctaatacaacagttggccgacgactatggacatgctcctctgggacttgcgtgcatggagcga

SEQ ID NO: 97303 - DNA, 75 bp, Artificial Sequence
  Synthetic
ttcatagatgacaacggaagccccttccatcaaagtacgcgcgacctgtcgaaaatctctgatgagacgtactcg

SEQ ID NO: 97304 - DNA, 75 bp, Artificial Sequence
  Synthetic
agttcggtcgtgctcttcttcgagatgtcgataaacgaatctcttcatgagttcaacgtaattctgcgtgcgcgt

SEQ ID NO: 97305 - DNA, 75 bp, Artificial Sequence
  Synthetic
gaggcaggcgtctcggtcgacacccgctacggagaattcgcggtgaaccgcctcgccgtggtacgagagttatac

SEQ ID NO: 97306 - DNA, 75 bp, Artificial Sequence
  Synthetic
accttgatgctcgcccatccgaagaaaatctgtaacatgctaagggccagctattcgtggtttgtgaagaactgg

SEQ ID NO: 97307 - DNA, 75 bp, Artificial Sequence
  Synthetic
ggaatcgcggcgcctgaattaaacgtgcttgtttcggagggaggcgacgaccggaactcgaaggacgtcacttac

SEQ ID NO: 97308 - DNA, 75 bp, Artificial Sequence
  Synthetic
cggagctggaaacgcatacggaacccttatgaaagcatcatacaagcgaccgctttccaccgcgcatcactgcag

SEQ ID NO: 97309 - DNA, 75 bp, Artificial Sequence
  Synthetic
gctaatattgagaagatcgacgacaccatcgcttatgccgcgactctcaccgggacggttgccggcctaccgatc

SEQ ID NO: 97310 - DNA, 75 bp, Artificial Sequence
  Synthetic
tttcgccgtatgatgcaaagtacgtacaccacggaattcgaccctcaggaccccgcgcacgtccagctagcttcg

SEQ ID NO: 97311 - DNA, 75 bp, Artificial Sequence
  Synthetic
ttactactcgctgtgcagacaatggctgggtacgggcgggcttggattgtcaatgcaggtgacgacccagatcgt

SEQ ID NO: 97312 - DNA, 75 bp, Artificial Sequence
  Synthetic
atgctccccccatctcctggcaaccacgtggctcgtgtggcaaaagagacagagaaatattttctacgtgcatac

SEQ ID NO: 97313 - DNA, 75 bp, Artificial Sequence
  Synthetic
gaagaggcgcggcgtcatgggtatgatatcattcctccagaggacatgtacagctcgttgctgcggctcgctaaa

SEQ ID NO: 97314 - DNA, 75 bp, Artificial Sequence
  Synthetic
aacacgtcatcgggattcagtacggaggtcgaagtgcggaaacgttacggacccaaagcggagcggaaggcggaa

SEQ ID NO: 97315 - DNA, 75 bp, Artificial Sequence
  Synthetic
agcgtgaagatcaaatcacggcagaaggcgctgttcttgatgagagagggacataatatctattcacgcgagatg

SEQ ID NO: 97316 - DNA, 75 bp, Artificial Sequence
  Synthetic
acataatatctattcacgcgagatgatgcagatgcagtatacgacgccgcaatgctatcagacacgcggaacccg

SEQ ID NO: 97317 - DNA, 75 bp, Artificial Sequence
  Synthetic
ggatgtcccaatcaaggcgacacgaactatctacgctataaacgtgaacgtgttggcgccgcaacacatcctcac

SEQ ID NO: 97318 - DNA, 75 bp, Artificial Sequence
  Synthetic
ccttccattgaacgaatacttcgcgcgcgccggcggaaccacccacccgtcttctgacgagataggcggaaaagt

SEQ ID NO: 97319 - DNA, 75 bp, Artificial Sequence
  Synthetic
gataattggcgacctggaagcgactggatcgcgagtgatggatgcagccgataccttccgcaataccggcgatgt

SEQ ID NO: 97320 - DNA, 75 bp, Artificial Sequence
  Synthetic
tgggatatggacattggccttggactactcgaactacgatacacacatgacgcaccacaacttccgatcagggat

SEQ ID NO: 97321 - DNA, 75 bp, Artificial Sequence
  Synthetic
gatcgcagggcttcggcaggctaccgcgcggcatcacgcgttgcgatacggtgaatgggatgtgggacagcttat

SEQ ID NO: 97322 - DNA, 75 bp, Artificial Sequence
  Synthetic
cgaagctgggtacggggaaggacgcgtcgctcataccctgtggaacggcaaaaggagagtgtgccggatgggccg

SEQ ID NO: 97323 - DNA, 75 bp, Artificial Sequence
  Synthetic
agtcgcctatgaggcgctgcctcagacggatcgagagccccccgcagacgcgccattccgatttcgcccaccggg

SEQ ID NO: 97324 - DNA, 75 bp, Artificial Sequence
  Synthetic
cacacgcccaatcagaacaatggccctcgtcggtggcgacgcagctgactacgtgctcgtgaccccatgggacgg

SEQ ID NO: 97325 - DNA, 75 bp, Artificial Sequence
  Synthetic
ttcggacctcgcgatggtttctacgcacctgtccggcgagaactcaacgctagtagcgaactcgctgcacaacat

SEQ ID NO: 97326 - DNA, 75 bp, Artificial Sequence
  Synthetic
cacctgtccggcgagaactcaacgctagtagcgaactcgctgcacaacatggcgatgggacgtgtcatccaggat

SEQ ID NO: 97327 - DNA, 75 bp, Artificial Sequence
  Synthetic
gaggtgcagatccagcaaccggcaaccttcgaggtcctctctgagatgtatgtcggcgatgacactctccactat

SEQ ID NO: 97328 - DNA, 75 bp, Artificial Sequence
  Synthetic
gtacgactgctgacgctccaggcggcaaagatcgacagagcaatcgacgtcatcttccgtaccatagagctttgc

SEQ ID NO: 97329 - DNA, 75 bp, Artificial Sequence
  Synthetic
ggacacgaggcgtcggcggcgaagactacgttcgcacccttctcggcggagaaaacccaaacgcatgcaaaacag

SEQ ID NO: 97330 - DNA, 75 bp, Artificial Sequence
  Synthetic
ggaatctatatcccccaggaccggatgatgattatctcgtcagagagaaggaaggagatcgagaacgtccaaggc

SEQ ID NO: 97331 - DNA, 75 bp, Artificial Sequence
  Synthetic
gaaggagatcgagaacgtccaaggctacatgcgcgcccaggcaacgaccttcatcacgaaagttagccgtggatt

SEQ ID NO: 97332 - DNA, 75 bp, Artificial Sequence
  Synthetic
cagcgaggacctcgcacaccggattctgctcgtgaaggcgagtctagtcggctacagacgtttcaaagcgacgat

SEQ ID NO: 97333 - DNA, 75 bp, Artificial Sequence
  Synthetic
gtttgatggctccaaataccgccggcgtaacttcttctccgcggaagacggctacacgctatgccgaatactaga

SEQ ID NO: 97334 - DNA, 75 bp, Artificial Sequence
  Synthetic
tccgactgtcctctacgccccatacgagtcgaacggatatggcgtacatccattcgcgctgaatgtggtacagac

SEQ ID NO: 97335 - DNA, 75 bp, Artificial Sequence
  Synthetic
ccaggaactccaccttgactccatacaactcttccccgcctatgccgaccttgcttcacgtggggttatccgtat

SEQ ID NO: 97336 - DNA, 75 bp, Artificial Sequence
  Synthetic
cgctttcccgcccccttggaacgagacgaacgtcgatacgcgcttgctctccaccaacacgcccatgggcctgta

SEQ ID NO: 97337 - DNA, 75 bp, Artificial Sequence
  Synthetic
ctctaaaatcgtacgtcctaccgttcgactcgcgctcacagaccccgacgtaggtgcgctcatctcacaaattcc

SEQ ID NO: 97338 - DNA, 75 bp, Artificial Sequence
  Synthetic
gttaggggaatacgcccccgacagactctcctctacgatgatgcatagcgcgctcctgaaagagagtagggcccg

SEQ ID NO: 97339 - DNA, 75 bp, Artificial Sequence
  Synthetic
cgcgctcctagcccccgcctacgaggacagtttcctagaggagttgaataagtggaggcccgaagtaacgttcaa

SEQ ID NO: 97340 - DNA, 75 bp, Artificial Sequence
  Synthetic
accgacggaacgcagcgagctgtcttctgcctacgcgaaagtgcttgaccttcacgttgagacacgaccgtcccc

SEQ ID NO: 97341 - DNA, 75 bp, Artificial Sequence
  Synthetic
tcagcccctcttccccgacgttaatctgtcacctggattcctcgcgcagaaacgctatattggccatcgaacgac

SEQ ID NO: 97342 - DNA, 75 bp, Artificial Sequence
  Synthetic
gtcgcgacccgcaagaacgtatatggaccagatcgaccgaatcctgcgaggtgacatcgtgatgcggggggtgat

SEQ ID NO: 97343 - DNA, 75 bp, Artificial Sequence
  Synthetic
tacctccactgtaatcatggcgctgctcgagaagattggattcgaccacgatcctgcggacctagccattatttt

SEQ ID NO: 97344 - DNA, 75 bp, Artificial Sequence
  Synthetic
tgagctgctgaacctagaaagacgagtcgcgcgccgcctgtccgaatttgtcactagcgacaggctacgatttga

SEQ ID NO: 97345 - DNA, 75 bp, Artificial Sequence
  Synthetic
cgtacatgctctgaataagcgcggaattggaggcgacgaattcacgatgtcactcgatgtgtgcacggatggttc

SEQ ID NO: 97346 - DNA, 75 bp, Artificial Sequence
  Synthetic
gcgcgagaaccgtattgtgttcccggccgaattcaccgtcgcagagagagacgcagcggcgttgcacgccgaaca

SEQ ID NO: 97347 - DNA, 75 bp, Artificial Sequence
  Synthetic
aatccagatgctatgtgcggcacatcagggacgaggcgtccgcgtgacactgcaggttcgacaggaacatagaag

SEQ ID NO: 97348 - DNA, 75 bp, Artificial Sequence
  Synthetic
cgcgctgcgccgcatgcgaatcaagatgcgaacccctagggtgagacagatcaggagtgccgcccgtgcaattcg

SEQ ID NO: 97349 - DNA, 75 bp, Artificial Sequence
  Synthetic
gcaattcgtaccgcgtctcttgcgctcgctgagggacagttcctctaggggaacgtccgcccgacataaggatac

SEQ ID NO: 97350 - DNA, 75 bp, Artificial Sequence
  Synthetic
gtaaaacttccgggagagatggcgaatccgcaaccccgagaacagacaccacaacaacagacagaaagctcacct

SEQ ID NO: 97351 - DNA, 75 bp, Artificial Sequence
  Synthetic
tacctacgcggagctgaggtatatgacgacccaggagtcgcgctctcgatcttcgcactccaggagattattaga

SEQ ID NO: 97352 - DNA, 75 bp, Artificial Sequence
  Synthetic
aaggttcgagaggctcagaccgcgctacgcaatgaaggacgggaagcggaccctgcgccccccgaaatcgagcag

SEQ ID NO: 97353 - DNA, 75 bp, Artificial Sequence
  Synthetic
atcttctcagcgctaagcgacttacgtagcgaaaggccgtacaggctcgaagagcggcttccagtctactaccga

SEQ ID NO: 97354 - DNA, 75 bp, Artificial Sequence
  Synthetic
tttgagtcctcacagtcgcgcgagcgcttcttcagagtcgatacccacttcgaacggttgactcggacggcggtg

SEQ ID NO: 97355 - DNA, 75 bp, Artificial Sequence
  Synthetic
gatggatcgctagaagacccggcacacttgatgtctatcatactctctcgcgtagaagagattcgccaagcgggg

SEQ ID NO: 97356 - DNA, 75 bp, Artificial Sequence
  Synthetic
tccttcttgctgcgcgctgcgccaacacacttcatcgacgggcgagaaatcatcaacgccgaagcgctgggagtc

SEQ ID NO: 97357 - DNA, 75 bp, Artificial Sequence
  Synthetic
gacatccctggactgctgaacctcgtggagccacgagtgagacacctactgcagcgacagattgaccagctcacc

SEQ ID NO: 97358 - DNA, 75 bp, Artificial Sequence
  Synthetic
gtgctaaaccaagatcaagacgatgtactgttggacgtctatcccggagcatgcccagattccattttcagtgtc

SEQ ID NO: 97359 - DNA, 75 bp, Artificial Sequence
  Synthetic
atgcccagattccattttcagtgtccatcaggcgctgactgcgcacgtgacgcataaccaacgtgacgactatcg

SEQ ID NO: 97360 - DNA, 75 bp, Artificial Sequence
  Synthetic
tatggagagttcaagcgcgtcgacttttcacgagcactgctcacggacgtgttctctcctgacactgtgtatatc

SEQ ID NO: 97361 - DNA, 75 bp, Artificial Sequence
  Synthetic
aacgctgctctcggggtcccccatggtacgtacatcactcctaatccgcgcatctcggcgatcactgtcgcctcg

SEQ ID NO: 97362 - DNA, 75 bp, Artificial Sequence
  Synthetic
cgtgtgacgactaccacgtccttcgctcagctgctaggcacgatccccacggccgcgcagatggatgacgtcagg

SEQ ID NO: 97363 - DNA, 75 bp, Artificial Sequence
  Synthetic
aagatctacctcgctttgctctttccaaatcaaatcctattggacatacgcccagaacccggtcatcaggtcgac

SEQ ID NO: 97364 - DNA, 75 bp, Artificial Sequence
  Synthetic
cgcacagtggatcctaggcgtttttactcacgcaaataattgtcactcttttgctgggtgtaacctgacataatg

SEQ ID NO: 97365 - DNA, 75 bp, Artificial Sequence
  Synthetic
ggacagttaatcagtttcttccaagacataccaatcttctttgaagaagcactcaatgtggccttggctgtggtt

SEQ ID NO: 97366 - DNA, 75 bp, Artificial Sequence
  Synthetic
acattgcttgctgtaataaagggcattgtgaacgtttggagatcaggacttcttcaactgcttgtgttcctggtt

SEQ ID NO: 97367 - DNA, 75 bp, Artificial Sequence
  Synthetic
ctggcgggaagatcatgctcttttaaagttggtcatcatacaaattttgagtcattcacggtcaaattaggaggt

SEQ ID NO: 97368 - DNA, 75 bp, Artificial Sequence
  Synthetic
gtcttccatgaattgccttcactatgtagggtcaacaactctcatagtctaattagactttctcatgaaagcagt

SEQ ID NO: 97369 - DNA, 75 bp, Artificial Sequence
  Synthetic
caggcattgtcagttgagtatgtggatatgcaccctgtcctgtgttcatccagcccacccgtactcgacaactac

SEQ ID NO: 97370 - DNA, 75 bp, Artificial Sequence
  Synthetic
actcagtgcacagaaggctctccagagtttgattggattcttggatggacaattaagggattgggacatgacttt

SEQ ID NO: 97371 - DNA, 75 bp, Artificial Sequence
  Synthetic
ttgagggacccgagaatttgttgtgaacctaaaaagagaactaatattgagtttaaattccaactgaatttaaca

SEQ ID NO: 97372 - DNA, 75 bp, Artificial Sequence
  Synthetic
gacagtcttgagacccatcactataggagcaagattgaggcaggaatccgacacctatttggggattacacaact

SEQ ID NO: 97373 - DNA, 75 bp, Artificial Sequence
  Synthetic
aatggcaatcactcaaagatgagtgtgattatgaggaatactacctgggagggtcaatgctcaaatagccatgta

SEQ ID NO: 97374 - DNA, 75 bp, Artificial Sequence
  Synthetic
aacacactgaggcttcttgtcagaaatgcaggtcaacatgttggaagaaggccactggcgttttttagttggtca

SEQ ID NO: 97375 - DNA, 75 bp, Artificial Sequence
  Synthetic
ctttctgacccaaagggtattgacatgccaggtggttactgtcttgagaggtggatgttggttgctggagatttg

SEQ ID NO: 97376 - DNA, 75 bp, Artificial Sequence
  Synthetic
aaatgctttggcaatacagctgttgccaagtgtaatttgaaccatgattctgagttctgtgatatgttgaggctg

SEQ ID NO: 97377 - DNA, 75 bp, Artificial Sequence
  Synthetic
tttgatttcaacaagaatgcaattgaaaaactgaacaatcaaaccaagactgctgtcaacatgttgactcactca

SEQ ID NO: 97378 - DNA, 75 bp, Artificial Sequence
  Synthetic
ataaatagtctaatatctgacaatttgttgatgaggaacaaactgaaagagattttaaaggtcccatactgcaac

SEQ ID NO: 97379 - DNA, 75 bp, Artificial Sequence
  Synthetic
tacacaagattctggtacataaatcatacaaaatctggtgagcactcactgcctcggtgctggcttgttaataat

SEQ ID NO: 97380 - DNA, 75 bp, Artificial Sequence
  Synthetic
ggttcctacttgaatgagagtgattttagaaatgagtggatcctggaaagtgatcacctaatagcagagatgttg

SEQ ID NO: 97381 - DNA, 75 bp, Artificial Sequence
  Synthetic
agtaaagaataccaagataggcaggggaaaactcctctaacactggttgacttgtgcttttggagtgcaatcttt

SEQ ID NO: 97382 - DNA, 75 bp, Artificial Sequence
  Synthetic
ttcaccacaagcctctttttgcacctggttgggttcccaacacatagacatatacaaggtgatccgtgcccttta

SEQ ID NO: 97383 - DNA, 75 bp, Artificial Sequence
  Synthetic
cctcacaggctggatagaaatggtgcttgtaggtgtggtaggtatcaaaaacttggaaaacaggtgacctggaag

SEQ ID NO: 97384 - DNA, 75 bp, Artificial Sequence
  Synthetic
cttgtaggtgtggtaggtatcaaaaacttggaaaacaggtgacctggaagaggaagcattgatcccataggccct

SEQ ID NO: 97385 - DNA, 75 bp, Artificial Sequence
  Synthetic
ccagctctgtcggcccggagacccgggccgacagagcgccccccagtccgcggcaatgccgcggactgggagggc

SEQ ID NO: 97386 - DNA, 75 bp, Artificial Sequence
  Synthetic
atctgcctacattacaaatgcgctcttggcttggaacactagcgtgtttggtagtagttggatgggaatggtgtc

SEQ ID NO: 97387 - DNA, 75 bp, Artificial Sequence
  Synthetic
aggtagatgaccatcaagaacagactgaaacatgatgcagtcgagaagagcacagtgaggctccttattggagtt

SEQ ID NO: 97388 - DNA, 75 bp, Artificial Sequence
  Synthetic
ggcttccttgtttttcttcttcggaacaatgacaccattatgcgctctacagaggtggccaaatttttcccaaac

SEQ ID NO: 97389 - DNA, 75 bp, Artificial Sequence
  Synthetic
ttcttgttcaaaaattctagattgttccccagttagtctgacatcaacaagtttcaagtctttccttccatgtat

SEQ ID NO: 97390 - DNA, 75 bp, Artificial Sequence
  Synthetic
gtcgaagagcttcttgatgtcatctgctccctgaacagtgatgactgaattctgtggcaacaagccaataacgta

SEQ ID NO: 97391 - DNA, 75 bp, Artificial Sequence
  Synthetic
actcaataggccaggttgagcatcctcgaggtcttttaatagaatgccgtgtgagtgcctacttccatttttaaa

SEQ ID NO: 97392 - DNA, 75 bp, Artificial Sequence
  Synthetic
acctttctcatcatgaggttttctgaaacagtgcacataatttcctgaggaaggttggaaaactgccaattccac

SEQ ID NO: 97393 - DNA, 75 bp, Artificial Sequence
  Synthetic
gggatcagttggagggccttcaatgtccatccaaatcgtgtctgatgagtctaatttcttcattgcttcctttat

SEQ ID NO: 97394 - DNA, 75 bp, Artificial Sequence
  Synthetic
gatcgcttcttgcatttcagaaagatttgatagtctgatgttttgtccgttcttctcaggagctcgagggcctgt

SEQ ID NO: 97395 - DNA, 75 bp, Artificial Sequence
  Synthetic
tgtaggttttgcatttaaatcaacacttgtgttgtcccaagatctcccaagtatctgtgaccttgatccaatgta

SEQ ID NO: 97396 - DNA, 75 bp, Artificial Sequence
  Synthetic
tggccagccttccccggacaagcacaacttgtagagaaggttctcataagggtttctattgccaggcctctcatc

SEQ ID NO: 97397 - DNA, 75 bp, Artificial Sequence
  Synthetic
tatgaacataccttctctccttttaacatttaatgcgaccttcacaatagaggagaagttgttgggtgttacttt

SEQ ID NO: 97398 - DNA, 75 bp, Artificial Sequence
  Synthetic
tctataagtgatgcaccagcttttacagcagctgaaagactgaaattataaccagatatgttgagtgcactctca

SEQ ID NO: 97399 - DNA, 75 bp, Artificial Sequence
  Synthetic
tcctttgttataatctgtaggcagtcatgctctagagttagtttttccaaatcatcaagattggggtatttgaca

SEQ ID NO: 97400 - DNA, 75 bp, Artificial Sequence
  Synthetic
gtgtagagaagaccgagtgatgttagcgcctgcacaacgttattcattgtttctcccccttgaactgtcatgcag

SEQ ID NO: 97401 - DNA, 75 bp, Artificial Sequence
  Synthetic
gcaatagttagagctggcattgaaccaaactgattattcagtttagagggatcagatacatcccacaacctgaca

SEQ ID NO: 97402 - DNA, 75 bp, Artificial Sequence
  Synthetic
accccacctgcaacccccttttgctgttggaatcctaaagttctaagaattcctgctcttttttccaactgtgac

SEQ ID NO: 97403 - DNA, 75 bp, Artificial Sequence
  Synthetic
tgtgtcaagtttcccatgtacatccttgggctgctgctttccctatctccaatctttttctttagtttttctaga

SEQ ID NO: 97404 - DNA, 75 bp, Artificial Sequence
  Synthetic
tccgaggccaagtccatcaattcgtctttacccaagtcaccaacttttagaactgtgttgttctgaacacttctc

SEQ ID NO: 97405 - DNA, 75 bp, Artificial Sequence
  Synthetic
atagtcatcagtccatcaacttccttgtttaagtctctgagtttatcaagatcggtgtctcctcgtttagacttg

SEQ ID NO: 97406 - DNA, 75 bp, Artificial Sequence
  Synthetic
cgtaggagtctttggacttgagaaacttgtgtaaaatcaagggagtctgcaattagcttcgcatccttaaggaca

SEQ ID NO: 97407 - DNA, 75 bp, Artificial Sequence
  Synthetic
cttgttttggttggctctgtgaaaacccctagttccctccttagagattgagtccagcggaagctcgggatttct

SEQ ID NO: 97408 - DNA, 75 bp, Artificial Sequence
  Synthetic
cgggatttctttggagtgagccatggtttgcgctgtgcggaagacttagacaaaatgcctaggatccactgtgcg

SEQ ID NO: 97409 - DNA, 75 bp, Artificial Sequence
  Synthetic
cgcacagtggatcctaggcgtttttactcacgcaaaaatttgtccacactattgctaggtgtgacctaacataat

SEQ ID NO: 97410 - DNA, 75 bp, Artificial Sequence
  Synthetic
gggacagttaatcagtttctttcaggacataccgatcttctttgaagaagcactcaatgtagccttggctgtggt

SEQ ID NO: 97411 - DNA, 75 bp, Artificial Sequence
  Synthetic
gacataccgatcttctttgaagaagcactcaatgtagccttggctgtggttacactgcttgctattataaagggc

SEQ ID NO: 97412 - DNA, 75 bp, Artificial Sequence
  Synthetic
attgtgaatgtttggagatcaggaattcttcagctgtttgtgttcttaattctggcgggaaggtcatgctctttt

SEQ ID NO: 97413 - DNA, 75 bp, Artificial Sequence
  Synthetic
ttcttcagctgtttgtgttcttaattctggcgggaaggtcatgctcttttaaagttggtcatcatacaaatttcg

SEQ ID NO: 97414 - DNA, 75 bp, Artificial Sequence
  Synthetic
agtcatttacagttaagctaggaggtgtcttccatgaattaccttcactatgtagggtcaacaactcttacagtc

SEQ ID NO: 97415 - DNA, 75 bp, Artificial Sequence
  Synthetic
taattaggctttctcatgacagcaatcaggcattgtcagttgagtatgtagatgtgcaccctgtcctctgttcat

SEQ ID NO: 97416 - DNA, 75 bp, Artificial Sequence
  Synthetic
gatgtgcaccctgtcctctgttcatctagtccaatcatactcgacaactacactcaatgtatagaaggttcccca

SEQ ID NO: 97417 - DNA, 75 bp, Artificial Sequence
  Synthetic
gagtttgattggattcttggatggacaattaagggattgggacatgactttttgagggatccaagaatctgctgt

SEQ ID NO: 97418 - DNA, 75 bp, Artificial Sequence
  Synthetic
tttgagggatccaagaatctgctgtgagcctaaaaaggcaactaatattgaattcacattccaattgaatttgac

SEQ ID NO: 97419 - DNA, 75 bp, Artificial Sequence
  Synthetic
agatagtcctgagacccatcactataggagcaagattgaggtaggcatccgacatttattcgggaactacataac

SEQ ID NO: 97420 - DNA, 75 bp, Artificial Sequence
  Synthetic
gacatttattcgggaactacataactaatgatagctattcaaagatgtctgtagttatgaggaacaccacctggg

SEQ ID NO: 97421 - DNA, 75 bp, Artificial Sequence
  Synthetic
aaggtcaatgctcaaatagccatgtgaatacactaagatttcttgttaaaaatgcaggttaccatgttggaagaa

SEQ ID NO: 97422 - DNA, 75 bp, Artificial Sequence
  Synthetic
agccactggcattttttagttggtcactttctgacccaaagggtaatgatatgccaggtggttactgtcttgaga

SEQ ID NO: 97423 - DNA, 75 bp, Artificial Sequence
  Synthetic
gatggatgttggttgctggagatttgaagtgctttggcaacacagctgttgccaagtgtaatttgaatcacgatt

SEQ ID NO: 97424 - DNA, 75 bp, Artificial Sequence
  Synthetic
ctgctgtcagcatgttgactcactcaataaatagtctgatatctgataatttattgatgaggaacaaattgaaag

SEQ ID NO: 97425 - DNA, 75 bp, Artificial Sequence
  Synthetic
agattttgaaggtcccatattgcaactacacaagattctggtacataaaccacacgaaatctggtgagcactcac

SEQ ID NO: 97426 - DNA, 75 bp, Artificial Sequence
  Synthetic
ctacacaagattctggtacataaaccacacgaaatctggtgagcactcactgcctcggtgttggctggtcagtaa

SEQ ID NO: 97427 - DNA, 75 bp, Artificial Sequence
  Synthetic
gagcaaagaataccaagataggcaggggagaactcccctaacactggttgacctgtgtttttggagtgcaatctt

SEQ ID NO: 97428 - DNA, 75 bp, Artificial Sequence
  Synthetic
tttcaccacaagtctctttttacatctggttgggttcccaacacatagacacatactgggtgacccgtgcccttt

SEQ ID NO: 97429 - DNA, 75 bp, Artificial Sequence
  Synthetic
gagaaagcattgattccatcagccctccagctccgtcggcccggaaacccgggccgatggagcgccccccagtcc

SEQ ID NO: 97430 - DNA, 75 bp, Artificial Sequence
  Synthetic
gcggcattgccgcggactgggagggcatctgcctacattacaaatgcgctcttggcttggaacactaatgtgttt

SEQ ID NO: 97431 - DNA, 75 bp, Artificial Sequence
  Synthetic
catctgcctacattacaaatgcgctcttggcttggaacactaatgtgtttggtagcaattgaattggaacggtgt

SEQ ID NO: 97432 - DNA, 75 bp, Artificial Sequence
  Synthetic
tggcttccttgtttttcttcttcggaacaatgacaccattgtgtgctctgcagaggtggccaaatttttcccaaa

SEQ ID NO: 97433 - DNA, 75 bp, Artificial Sequence
  Synthetic
aacaatgacaccattgtgtgctctgcagaggtggccaaatttttcccaaacttcctgttcaaagactctagactg

SEQ ID NO: 97434 - DNA, 75 bp, Artificial Sequence
  Synthetic
tgctccttgaacagtaataactgaaccctgtggcaataagccaatgacgtaactcagtagaccaggctgagcatt

SEQ ID NO: 97435 - DNA, 75 bp, Artificial Sequence
  Synthetic
ttcgaggtcctttaatagtatgccgtgtgagtgcctacttccatttttaaaacctttctcatcatgaggttttct

SEQ ID NO: 97436 - DNA, 75 bp, Artificial Sequence
  Synthetic
tgtgagtgcctacttccatttttaaaacctttctcatcatgaggttttctgaaacagtgtacatagtttcctgaa

SEQ ID NO: 97437 - DNA, 75 bp, Artificial Sequence
  Synthetic
aacctttctcatcatgaggttttctgaaacagtgtacatagtttcctgaagaaggttgaaaaactgctaactcca

SEQ ID NO: 97438 - DNA, 75 bp, Artificial Sequence
  Synthetic
cgatcgcctcttgcatttcagaaaggtttgatagtctgatgttttgtccattcttctcaggagctcggggacctg

SEQ ID NO: 97439 - DNA, 75 bp, Artificial Sequence
  Synthetic
ttcttctcaggagctcggggacctgttacaggtcttgcatttaaatcgacacttgtgttgtcccaagacctcccg

SEQ ID NO: 97440 - DNA, 75 bp, Artificial Sequence
  Synthetic
ttacaggtcttgcatttaaatcgacacttgtgttgtcccaagacctcccgagtatttgtgaccttgatccaatgt

SEQ ID NO: 97441 - DNA, 75 bp, Artificial Sequence
  Synthetic
acttgtgttgtcccaagacctcccgagtatttgtgaccttgatccaatgtatggccaaccctccccagacagaca

SEQ ID NO: 97442 - DNA, 75 bp, Artificial Sequence
  Synthetic
cagcttgtagagaagattctcataagggtttctattacccggtctctcatctatgaacatgccttctcttctttt

SEQ ID NO: 97443 - DNA, 75 bp, Artificial Sequence
  Synthetic
gacgttcaatgcggccttgacaatagaagagaagttgttgggtgtgacttttattgtctccagcatgttgccacc

SEQ ID NO: 97444 - DNA, 75 bp, Artificial Sequence
  Synthetic
ttattgtctccagcatgttgccaccatctataagtgatgcaccagcttttacagcagctgaaagactgaaattat

SEQ ID NO: 97445 - DNA, 75 bp, Artificial Sequence
  Synthetic
atcctttgttataatctgtaggcagtcgtgttctaaagttagtttttccaggtcatcaagattggggtatttgac

SEQ ID NO: 97446 - DNA, 75 bp, Artificial Sequence
  Synthetic
agtgtagagaagaccaagtgatgttagtgcctgcacaacattgttcattgtttctcctccctgaactgtcatgca

SEQ ID NO: 97447 - DNA, 75 bp, Artificial Sequence
  Synthetic
aaccccacctgcaacccccctttgttgttggaatcctagagttctaagaatccctgctcttttttccaattgtga

SEQ ID NO: 97448 - DNA, 75 bp, Artificial Sequence
  Synthetic
ctgcgtcaagtttcccatgtacatccttgggctattgctttctctatccccaatcttcttctttagtttttctag

SEQ ID NO: 97449 - DNA, 75 bp, Artificial Sequence
  Synthetic
gtctgaggctaagtccattaattcatctttgcccaaatcaccaactttaagaactgtgttgttctgaacactttt

SEQ ID NO: 97450 - DNA, 75 bp, Artificial Sequence
  Synthetic
gaactgtgttgttctgaacacttttcatgctcatcagtccatcaacttccttatttaagtctctaagtttatcaa

SEQ ID NO: 97451 - DNA, 75 bp, Artificial Sequence
  Synthetic
caatgagctttgcatcattgaggacacttgatttggttggttctgtgaacacccctagttccctccttagagatt

SEQ ID NO: 97452 - DNA, 75 bp, Artificial Sequence
  Synthetic
cgcacagtggatcctaggcgtttttactcacgcaaaaatttgtccacactattgttgggtgtgacctaacacaat

SEQ ID NO: 97453 - DNA, 75 bp, Artificial Sequence
  Synthetic
tacactgcttgctattataaagggcattgtgaatgtttggaaatcaggaattcttcagctgtttgtgttcttggt

SEQ ID NO: 97454 - DNA, 75 bp, Artificial Sequence
  Synthetic
attgtgaatgtttggaaatcaggaattcttcagctgtttgtgttcttggttctggcgggaaggtcatgctctttc

SEQ ID NO: 97455 - DNA, 75 bp, Artificial Sequence
  Synthetic
taattaggctttctcataacagcaatcaggcattatcagttgagtatgtggatgtgcaccctgtcctctgttcgt

SEQ ID NO: 97456 - DNA, 75 bp, Artificial Sequence
  Synthetic
tttgagggatccaagaatctgctgtgagcctaaaaagacaactaatactgaatttacattccagttgaatttaac

SEQ ID NO: 97457 - DNA, 75 bp, Artificial Sequence
  Synthetic
taatgacagctattcaaaaatgtctgtggttatgaggaacacctcctgggaaggtcaatgctcaaatagtcatgt

SEQ ID NO: 97458 - DNA, 75 bp, Artificial Sequence
  Synthetic
aaggtcaatgctcaaatagtcatgtgaatacactaagatttcttgttaaaaatgcaggttaccttgttggaagaa

SEQ ID NO: 97459 - DNA, 75 bp, Artificial Sequence
  Synthetic
aatgcaggttaccttgttggaagaaagccactggcattttttagttggtcactttctgacccaaagggtaatgac

SEQ ID NO: 97460 - DNA, 75 bp, Artificial Sequence
  Synthetic
atgccaggtggttactgtcttgaaaggtggatgttggttgctggagatttgaagtgctttggcaacacagctgtc

SEQ ID NO: 97461 - DNA, 75 bp, Artificial Sequence
  Synthetic
ctgagttctgtgacatgttgaggctgtttgacttcaataagaatgccatcgaaaaactgaacaaccaaactaaga

SEQ ID NO: 97462 - DNA, 75 bp, Artificial Sequence
  Synthetic
ctgctgtcaacatgttgactcactcaataaatagtctaatatctgataatttattgatgagaaacaaactgaaag

SEQ ID NO: 97463 - DNA, 75 bp, Artificial Sequence
  Synthetic
aataaatagtctaatatctgataatttattgatgagaaacaaactgaaagaggttttgaaagtcccatattgcaa

SEQ ID NO: 97464 - DNA, 75 bp, Artificial Sequence
  Synthetic
ctacacaagattctggtacataaaccacacgaaatctggtgagcactcactgcctcggtgttggctagtcagtaa

SEQ ID NO: 97465 - DNA, 75 bp, Artificial Sequence
  Synthetic
tggttcctatttgaatgagagtgattttagaaatgagtggatcttggaaagtgatcacctaatagcagagatgtt

SEQ ID NO: 97466 - DNA, 75 bp, Artificial Sequence
  Synthetic
gtgatcacctaatagcagagatgttaagcaaagaataccaagacaggcaggggaagactcccctaacactggttg

SEQ ID NO: 97467 - DNA, 75 bp, Artificial Sequence
  Synthetic
atctgtgtttttggagtgcaatctttttcaccacaagtctctttttacacctggttgggttcccaacacatagac

SEQ ID NO: 97468 - DNA, 75 bp, Artificial Sequence
  Synthetic
tttcaccacaagtctctttttacacctggttgggttcccaacacatagacatatacagggtgacccgtgcccttt

SEQ ID NO: 97469 - DNA, 75 bp, Artificial Sequence
  Synthetic
gcctcacaggctcgatagaaatggtgcttgcaggtgtggcaggtatcaaaaacttggaaaacaagtaacctggaa

SEQ ID NO: 97470 - DNA, 75 bp, Artificial Sequence
  Synthetic
gagaaagcattgatttcatcagccctccagctctgtcggcccggaaacccgggccgacagagcgccccccagtcc

SEQ ID NO: 97471 - DNA, 75 bp, Artificial Sequence
  Synthetic
tccagctctgtcggcccggaaacccgggccgacagagcgccccccagtccgcggcaatgccgcggactgggaggg

SEQ ID NO: 97472 - DNA, 75 bp, Artificial Sequence
  Synthetic
catctgcctacattacaaatgcgctcttggcttggaacactaatgtgtttggtagcagttgaatgggaatggtgt

SEQ ID NO: 97473 - DNA, 75 bp, Artificial Sequence
  Synthetic
gcacagtgtggctccttcgtggagttagcttccttgtttttcttcttaggaacaatgacaccattgtgtgctctg

SEQ ID NO: 97474 - DNA, 75 bp, Artificial Sequence
  Synthetic
aacaatgacaccattgtgtgctctgcagaggtggccaaatttttcccaaacttcttgttcaaagattctggactg

SEQ ID NO: 97475 - DNA, 75 bp, Artificial Sequence
  Synthetic
tgccccttgaacagtgataactgaaccctgtggcaataagccaatgacgtaactcaatagaccaggttgagcatc

SEQ ID NO: 97476 - DNA, 75 bp, Artificial Sequence
  Synthetic
tgtgagtgcctacttccatttttaaaacccttctcatcatgaggttttctgaaacagtgtacatagtttcctgaa

SEQ ID NO: 97477 - DNA, 75 bp, Artificial Sequence
  Synthetic
aacccttctcatcatgaggttttctgaaacagtgtacatagtttcctgaagaaggttggaaaactgccaactcca

SEQ ID NO: 97478 - DNA, 75 bp, Artificial Sequence
  Synthetic
cgatcgcttcttgcatttcagaaagatttgatagtctgatattttgtccattcttttcaggagctcggggacctg

SEQ ID NO: 97479 - DNA, 75 bp, Artificial Sequence
  Synthetic
ttcttttcaggagctcggggacctgttacaggtcttgcagttaaatcgacacttgtgttgtcccaggacctcccg

SEQ ID NO: 97480 - DNA, 75 bp, Artificial Sequence
  Synthetic
agtatttgtgaccttgatccaatgtatggccaaccctctccagacaaacacagcttgtagagaagattctcataa

SEQ ID NO: 97481 - DNA, 75 bp, Artificial Sequence
  Synthetic
aaccccacctgcagcccccctttgttgttggaatcccagggttctaagaatccctgctcttttttccaattgtga

SEQ ID NO: 97482 - DNA, 75 bp, Artificial Sequence
  Synthetic
ctgtgtcaagtttcccatgtacatccttgggctattgccttccctatctccaatcttcttctttagtttttctag

SEQ ID NO: 97483 - DNA, 75 bp, Artificial Sequence
  Synthetic
gaactgtgttgttctgaacacttttcatgctcatcaatctatcaacttctttgtttaagtccctaagtttatcaa

SEQ ID NO: 97484 - DNA, 75 bp, Artificial Sequence
  Synthetic
gatcagtgtctcctcgtttggacttacgtaggagtctttgaacttgagaaacttgtgtgaaatcaagggagtctg

SEQ ID NO: 97485 - DNA, 75 bp, Artificial Sequence
  Synthetic
caatgagctttgcatcattaagcacacttgacttggttggttctgtgaacatccctagttctctccttagagatt

SEQ ID NO: 97486 - DNA, 75 bp, Artificial Sequence
  Synthetic
gagtccagcggaagctggggatttctttggagtgagccatggttcgcgttgtgtagaagactaagacaaaaatgc

SEQ ID NO: 97487 - DNA, 75 bp, Artificial Sequence
  Synthetic
gggatttctttggagtgagccatggttcgcgttgtgtagaagactaagacaaaaatgcctaggatccactgtgcg

SEQ ID NO: 97488 - DNA, 75 bp, Artificial Sequence
  Synthetic
cgcacagtggatcctaggcgtttttactcacgcaataatttgtccacactattgttgggtgtgacctagcataat

SEQ ID NO: 97489 - DNA, 75 bp, Artificial Sequence
  Synthetic
tctggcgggaaggtcatgctctttcaaagttggtcatcatacaaattttgagtcatttacagttaagctaggagg

SEQ ID NO: 97490 - DNA, 75 bp, Artificial Sequence
  Synthetic
gatgtgcaccctgtcctctgttcgtccagtccaaccatactcgacaactacactcaatgtataaaaggctctcca

SEQ ID NO: 97491 - DNA, 75 bp, Artificial Sequence
  Synthetic
tttgagggatccaagaatctgctgtgagcctaaaaagacaactaatgctgaatttacattccaattgaatttaac

SEQ ID NO: 97492 - DNA, 75 bp, Artificial Sequence
  Synthetic
gacatttattcgggaactacataactaatgatagctattcaaaaatgtctgtggttatgaggaacactacctggg

SEQ ID NO: 97493 - DNA, 75 bp, Artificial Sequence
  Synthetic
gaagtgctttggcaacacagctgtcgccaagtgtaatttgaatcatgattctgagttctgtgacatgttgaggct

SEQ ID NO: 97494 - DNA, 75 bp, Artificial Sequence
  Synthetic
ctgagttctgtgacatgttgaggctgtttgatttcaataagaatgccattgaaaaactgaacaaccaaactaaaa

SEQ ID NO: 97495 - DNA, 75 bp, Artificial Sequence
  Synthetic
aagcaaagaataccaagataggcaggggaagactcccctaacactggttgatctatgtttctggagtgcaatctt

SEQ ID NO: 97496 - DNA, 75 bp, Artificial Sequence
  Synthetic
ttccccagtcagtctgacatcaacaagttttaaatctttccttccatgtatgtcgaaaagctttttgatgtcatc

SEQ ID NO: 97497 - DNA, 75 bp, Artificial Sequence
  Synthetic
caggatcagttggcgggccttcaatgtccatccagattgtgtctgatgaatctaatttcctcattgcttccttta

SEQ ID NO: 97498 - DNA, 75 bp, Artificial Sequence
  Synthetic
tctaatttcctcattgcttcctttacgatcgcttcttgcatttcagaaagatttgatagtctgatattttgtcca

SEQ ID NO: 97499 - DNA, 75 bp, Artificial Sequence
  Synthetic
acttgtgttgtcccaagacctcccgagtatttgtgaccttgatccaatatatggccaaccctccccagacaaaca

SEQ ID NO: 97500 - DNA, 75 bp, Artificial Sequence
  Synthetic
ggcaatggtaagagctggcattgaaccaaattggttattcagtttggagggatcagatacatcccacaacctgac

SEQ ID NO: 97501 - DNA, 75 bp, Artificial Sequence
  Synthetic
ctgcgtcaagtttcccatgtacatccttggactattgctttccctatctccaatcttcttctttagtttttctag

SEQ ID NO: 97502 - DNA, 75 bp, Artificial Sequence
  Synthetic
atctgaggccaagtccattaattcatctttgcccaaatcaccaactttcagaactgtgttgttctgaacactttt

SEQ ID NO: 97503 - DNA, 75 bp, Artificial Sequence
  Synthetic
catgctcatcagtctatcaacttctttatttaagtccctaagtttatcaagatcagtgtctcctcgtttggactt

SEQ ID NO: 97504 - DNA, 75 bp, Artificial Sequence
  Synthetic
cgcacagtggatcctaggcgtttttactcacgcaaaaattagaccacattattgttaggtagaacctgacataat

SEQ ID NO: 97505 - DNA, 75 bp, Artificial Sequence
  Synthetic
ggggcagttgatcagtttctttcaggacataccgatcttctttgaagaagcactcaatgtagccttggctgtggt

SEQ ID NO: 97506 - DNA, 75 bp, Artificial Sequence
  Synthetic
tacactgcttgccattataaagggcattgtgaacatttggaaatcaggaattcttcaactgcttgtgtatttaat

SEQ ID NO: 97507 - DNA, 75 bp, Artificial Sequence
  Synthetic
tctggcgggaagatcatgctcttttaaagttggtcatcatacaaattttgagtcattcacagttaatctaggggg

SEQ ID NO: 97508 - DNA, 75 bp, Artificial Sequence
  Synthetic
aaagttggtcatcatacaaattttgagtcattcacagttaatctagggggtgtctttcatgaattaccttcatta

SEQ ID NO: 97509 - DNA, 75 bp, Artificial Sequence
  Synthetic
tgcagggtcaacaactcttacagtctaattaggctttctcataacagcgatcaggcattatcagttgagtatgta

SEQ ID NO: 97510 - DNA, 75 bp, Artificial Sequence
  Synthetic
gatgtacaccctgtcctcggttcatccagccctaccatattcgacaactatactcaatgtataaaagactcccca

SEQ ID NO: 97511 - DNA, 75 bp, Artificial Sequence
  Synthetic
gagtttgattggattcttggatggacaattaaaggactgggacatgattttttgagggatccaagaatctgttgt

SEQ ID NO: 97512 - DNA, 75 bp, Artificial Sequence
  Synthetic
gagcctaaaaagacaactaatgttgaatttacattccaattgaatttaacggacagtgttgagactcatcactat

SEQ ID NO: 97513 - DNA, 75 bp, Artificial Sequence
  Synthetic
ggacagtgttgagactcatcactataggggtaagattgaggcaggtatcagacatttgttcggggactacataac

SEQ ID NO: 97514 - DNA, 75 bp, Artificial Sequence
  Synthetic
taatgatagctatccgaagatgtctgtggttatgaggaataccacctgggaaggtcaatgcccaaatagccatgt

SEQ ID NO: 97515 - DNA, 75 bp, Artificial Sequence
  Synthetic
gtggttatgaggaataccacctgggaaggtcaatgcccaaatagccatgtaaatacactgagatttttggtcaaa

SEQ ID NO: 97516 - DNA, 75 bp, Artificial Sequence
  Synthetic
aatgcaggttaccttgttggaagaaaaccactggcattctttagttggtcactttctgacccaaagggtaatgat

SEQ ID NO: 97517 - DNA, 75 bp, Artificial Sequence
  Synthetic
gccaagtgtaacttaaaccatgattctgagttctgtgacatgttgaggctgtttgatttcaacaagaatgccatt

SEQ ID NO: 97518 - DNA, 75 bp, Artificial Sequence
  Synthetic
gaaaaactgaacaaccaaaccaaaactgctgtcaatatgttgactcactcaataaatagtctaatatctgacaac

SEQ ID NO: 97519 - DNA, 75 bp, Artificial Sequence
  Synthetic
ctgctgtcaatatgttgactcactcaataaatagtctaatatctgacaacctattgatgaggaacaaactgaggg

SEQ ID NO: 97520 - DNA, 75 bp, Artificial Sequence
  Synthetic
ctacacaagattctggtacataaaccacacgaaatctggtgagcactcactgcctcggtgctggctggttaataa

SEQ ID NO: 97521 - DNA, 75 bp, Artificial Sequence
  Synthetic
gtgatcacctaatagcagagatgttaagtaaagagtaccaagataggcaggggaaaactcctctgacacttgttg

SEQ ID NO: 97522 - DNA, 75 bp, Artificial Sequence
  Synthetic
atatacaaggtgatccgtgccctttgcctcataggctcgatagaaatggtgcttgcaggtgtggtaggtatcaaa

SEQ ID NO: 97523 - DNA, 75 bp, Artificial Sequence
  Synthetic
gacttggcaaacgggtaatctggaggagaaagcattgatctcactggccccccagctctgtcggcccggaaaccc

SEQ ID NO: 97524 - DNA, 75 bp, Artificial Sequence
  Synthetic
gggccgacagggcgccccccagtccgcggcagtgccgcggactgggagggcatttgcctacattacaaatgcact

SEQ ID NO: 97525 - DNA, 75 bp, Artificial Sequence
  Synthetic
gcggcagtgccgcggactgggagggcatttgcctacattacaaatgcacttttggcttggaacactagtgtgttt

SEQ ID NO: 97526 - DNA, 75 bp, Artificial Sequence
  Synthetic
ggtagcagttgaatgggaactgtatcaggaagatgaccatcaagaacagactgaaacatgatgcaatcaagaagg

SEQ ID NO: 97527 - DNA, 75 bp, Artificial Sequence
  Synthetic
ctgaaacatgatgcaatcaagaagggcacagtgcggttcctttgtggagttggcttccttgcttttcttcttcgg

SEQ ID NO: 97528 - DNA, 75 bp, Artificial Sequence
  Synthetic
tggcttccttgcttttcttcttcggaacaatgacaccgttgtgtgctctgcagaggtggccgaatttttcccaaa

SEQ ID NO: 97529 - DNA, 75 bp, Artificial Sequence
  Synthetic
cttcctgttcaaagactctggactgttccccagtcagcctgacatcaacaagtttcaagtctttccttccatgta

SEQ ID NO: 97530 - DNA, 75 bp, Artificial Sequence
  Synthetic
agtttcaagtctttccttccatgtatgtcgaagagtttcttgatatcatctgctccttgaacagtgatcactgaa

SEQ ID NO: 97531 - DNA, 75 bp, Artificial Sequence
  Synthetic
tgtcgaagagtttcttgatatcatctgctccttgaacagtgatcactgaattctgtggcaataagccaatgacat

SEQ ID NO: 97532 - DNA, 75 bp, Artificial Sequence
  Synthetic
aacttaatagaccaggttgagcattttcgaggtcctttagcaatatgccatgtgagtgcctacttccattcttaa

SEQ ID NO: 97533 - DNA, 75 bp, Artificial Sequence
  Synthetic
caggatcagttggtgggccctcaatgtccatccagattgtttctgatgagtccaatttcctcattgcttccttta

SEQ ID NO: 97534 - DNA, 75 bp, Artificial Sequence
  Synthetic
tgatcgcttcttgcatttcagaaagatttgatagtctgatgttttgtccattcttctcaggagccctaggacctg

SEQ ID NO: 97535 - DNA, 75 bp, Artificial Sequence
  Synthetic
ttacaggtcttgcatttaaatcaacacttgtgttgtcccaagacctcccgattatttgtgaccttgatccaatgt

SEQ ID NO: 97536 - DNA, 75 bp, Artificial Sequence
  Synthetic
acttgtgttgtcccaagacctcccgattatttgtgaccttgatccaatgtatggccaaccctccccggacagaca

SEQ ID NO: 97537 - DNA, 75 bp, Artificial Sequence
  Synthetic
cagcttgtagagaagattctcataagggtttctattgcccggtctctcatctatgaacatgccttctcttctttt

SEQ ID NO: 97538 - DNA, 75 bp, Artificial Sequence
  Synthetic
aacattcaatgcggccttgacaatagaggagaaattgttgggtgtgactttgattgtctctagcatgttgccacc

SEQ ID NO: 97539 - DNA, 75 bp, Artificial Sequence
  Synthetic
atctataagtgatgcaccagcttttacagcagctgaaagactgaaattgtaaccagatatgttgagtgcactctc

SEQ ID NO: 97540 - DNA, 75 bp, Artificial Sequence
  Synthetic
atcctttgttataatttgcaagcagtcgtgttccaaagttaatttttctaagtcatcgagattggggtatttgac

SEQ ID NO: 97541 - DNA, 75 bp, Artificial Sequence
  Synthetic
agtcatcgagattggggtatttgacagtgtagagaaggccaagtgatgttagtgcctgcacaacattgttcattg

SEQ ID NO: 97542 - DNA, 75 bp, Artificial Sequence
  Synthetic
tttctcctccctgaactgtcatgcaggcaatggttagagctggcattgagccaaactgattgttcagtttagagg

SEQ ID NO: 97543 - DNA, 75 bp, Artificial Sequence
  Synthetic
gatcagatacatcccacagtctgacgaccccacctgcagcccccttttgttgttggaatcctagagctcttagaa

SEQ ID NO: 97544 - DNA, 75 bp, Artificial Sequence
  Synthetic
tgttggaatcctagagctcttagaatccctgctcttttttccaactgtgactgtgtcaagtttcccatgtacatc

SEQ ID NO: 97545 - DNA, 75 bp, Artificial Sequence
  Synthetic
cttgggctgttgctttccctatctccaatctttttctttagtttttctagatctgaagccaagtccattaattca

SEQ ID NO: 97546 - DNA, 75 bp, Artificial Sequence
  Synthetic
tctttgcccaaatcaccgactttcagaactgtgttgttctgaacacttttcatgctcatcagtctatcaacttcc

SEQ ID NO: 97547 - DNA, 75 bp, Artificial Sequence
  Synthetic
ttatttaagtctctgagtttatcaagatctgcgtctcctcgtttagacttacgtaggagtctttgaacttgagaa

SEQ ID NO: 97548 - DNA, 75 bp, Artificial Sequence
  Synthetic
acttgtgtaaaatcaagggagtctgcaatgagttttgcatcattaaggacatttgttttggttggttctgtgaat

SEQ ID NO: 97549 - DNA, 75 bp, Artificial Sequence
  Synthetic
gtccctagttccctccttaaagactgagtccagcggaagctggggatttctttggagagtgccatggtccaggtt

SEQ ID NO: 97550 - DNA, 75 bp, Artificial Sequence
  Synthetic
gggatttctttggagagtgccatggtccaggttttgcagaagactaagacaaaaatgcctaggatccactgtgcg

SEQ ID NO: 97551 - DNA, 75 bp, Artificial Sequence
  Synthetic
cgcacagtggatcctaggcgtttttactcacgcaattatttgtccacactattgttgagtgtgactcgacacaat

SEQ ID NO: 97552 - DNA, 75 bp, Artificial Sequence
  Synthetic
gggacagttaattagcttcttccaagacataccgatcttttttgaagaagctcttaatgtagccttggctgtggt

SEQ ID NO: 97553 - DNA, 75 bp, Artificial Sequence
  Synthetic
cacactgcttgccatgataaaaggcgttgtgaacgtttggagatcagggcttcttcaactgcttgtgttcttggt

SEQ ID NO: 97554 - DNA, 75 bp, Artificial Sequence
  Synthetic
tctggcgggaagatcatgctcttttaaagttggtcatcacacaagttttgagtcattcacggttaatctcggagg

SEQ ID NO: 97555 - DNA, 75 bp, Artificial Sequence
  Synthetic
tgtcttccatgaactaccttcactatgtagggtcaacaactcttacagtctaattagactttctcataatagcag

SEQ ID NO: 97556 - DNA, 75 bp, Artificial Sequence
  Synthetic
tcaggcattatctgttgagtatgtggatgtacaccctgtcctctgttcatccagtccacccatactcggcaacta

SEQ ID NO: 97557 - DNA, 75 bp, Artificial Sequence
  Synthetic
cactcaatgtatagaaggctccccagagtttgattggatccttggatggacaatgaaaggattggggcacgactt

SEQ ID NO: 97558 - DNA, 75 bp, Artificial Sequence
  Synthetic
tttgagggacccaaaagtctgttgtgaacccaaaaagagtaccaatattgaatttacattccaattgaatttgac

SEQ ID NO: 97559 - DNA, 75 bp, Artificial Sequence
  Synthetic
agacagtcctgatactcatcactataggagcaagattgaggcaggtatccgacacttattcgggaactacataac

SEQ ID NO: 97560 - DNA, 75 bp, Artificial Sequence
  Synthetic
taatgatagttgttcaaagatgagtgtgattatgagaaataccacgtgggaaagtcaatgctcaaacagccatgt

SEQ ID NO: 97561 - DNA, 75 bp, Artificial Sequence
  Synthetic
aaacacactgagatttctcgtcaaaaatgcaggttcccatgtaggaagaaagccattggcattttttagttggtc

SEQ ID NO: 97562 - DNA, 75 bp, Artificial Sequence
  Synthetic
actttctgacccaaagggcattgacatgccaggtggttactgtcttgaaaggtggatgttggttgctggagattt

SEQ ID NO: 97563 - DNA, 75 bp, Artificial Sequence
  Synthetic
atgccaggtggttactgtcttgaaaggtggatgttggttgctggagatttgaagtgctttggtaatacagctgtt

SEQ ID NO: 97564 - DNA, 75 bp, Artificial Sequence
  Synthetic
gaaaaactaaacaaccaaaccaaaactgctgtcaacatgctgactcaatcaataaatagtctaatatctgacaat

SEQ ID NO: 97565 - DNA, 75 bp, Artificial Sequence
  Synthetic
ttattgatgagaaacaaactaaaagagattttaaaggtcccatactgcaactacacaagattctggtatataaac

SEQ ID NO: 97566 - DNA, 75 bp, Artificial Sequence
  Synthetic
cacacaaagtctggtgagcactcgttgcctcggtgttggctggttaataatggttcctacttaaatgagagtgat

SEQ ID NO: 97567 - DNA, 75 bp, Artificial Sequence
  Synthetic
tttagaaatgagtggatcttagagagtgatcacctaatagcagagatgttgagcaaagagtaccaagataggcag

SEQ ID NO: 97568 - DNA, 75 bp, Artificial Sequence
  Synthetic
gggaaaactcctctaacactggttgacctgtgtttttggagtgcaatctttttcaccacaagtctgtttctacac

SEQ ID NO: 97569 - DNA, 75 bp, Artificial Sequence
  Synthetic
ctagttggattcccaacacatagacacatacaaggcgaaccatgccctctgccccataggcttgacagaaacggt

SEQ ID NO: 97570 - DNA, 75 bp, Artificial Sequence
  Synthetic
gcttgcaggtgtggtaggtatcaaaaacttggaaaacaagtgacctggaagagaaagcattgacttcattagccc

SEQ ID NO: 97571 - DNA, 75 bp, Artificial Sequence
  Synthetic
catctgcctacattacaaatgcgctcctggcttgaaacactagtgtgtttggtagcagttgattgggaatggtga

SEQ ID NO: 97572 - DNA, 75 bp, Artificial Sequence
  Synthetic
tgggaagatgaccatcaagaacagactgaaacatgatacagtcgagaagggcacaatgcggctcctttgtggagt

SEQ ID NO: 97573 - DNA, 75 bp, Artificial Sequence
  Synthetic
tggcttccttgtttttcttctttggaacaataacaccattgtgcgctctacaaaggtgaccaaatttttcccaga

SEQ ID NO: 97574 - DNA, 75 bp, Artificial Sequence
  Synthetic
cctcctgttcaaaaatcctggactgttctccagtgagtctgacatctacaagttttaggtctttccttccatgta

SEQ ID NO: 97575 - DNA, 75 bp, Artificial Sequence
  Synthetic
tatcgaagagttttttgatgtcatctgccccttggacagtgatgactgaattttgtggcaataagccaataacgt

SEQ ID NO: 97576 - DNA, 75 bp, Artificial Sequence
  Synthetic
aactcaatagaccaggttgagcattttcaagatcctttaacagtatgccgtgtgagtgcctgcttccatttttaa

SEQ ID NO: 97577 - DNA, 75 bp, Artificial Sequence
  Synthetic
aacctttctcatcatgaggttttctgaaacagtgcacatagtttcctgaagaaggttggaaaactgccaattcca

SEQ ID NO: 97578 - DNA, 75 bp, Artificial Sequence
  Synthetic
gaaggttggaaaactgccaattccacaggatcagttggcggaccctcaatatccatccagattgtgtctgatgag

SEQ ID NO: 97579 - DNA, 75 bp, Artificial Sequence
  Synthetic
tctagcttcctcattgcttcctttatgattgcttcttgcatttcagaaaggtttgatagtctgatgttttgtcca

SEQ ID NO: 97580 - DNA, 75 bp, Artificial Sequence
  Synthetic
ttcttctcaggagctcgtggacctgttacaggttttgcatttaaatcaacacttgtgttatcccaagaccttccg

SEQ ID NO: 97581 - DNA, 75 bp, Artificial Sequence
  Synthetic
agtatttgtgaccttgatccaatgtatggccaaccttccccagacaaacacagcttgtagagaagattttcataa

SEQ ID NO: 97582 - DNA, 75 bp, Artificial Sequence
  Synthetic
gggtttctattgcccggcctctcatctataaacatgccttctcttcttttgacatttaatgcggctctcacaata

SEQ ID NO: 97583 - DNA, 75 bp, Artificial Sequence
  Synthetic
gaggagaagttgttgggtgtgactctgattgtctccagcatgttgccaccatcgatgagcgatgcaccagccttt

SEQ ID NO: 97584 - DNA, 75 bp, Artificial Sequence
  Synthetic
acagcagctgacaggctgaaattgtaaccagatatattgagtgcactctcatcttttgttataatctgtagacaa

SEQ ID NO: 97585 - DNA, 75 bp, Artificial Sequence
  Synthetic
tcgtgttccaaagttagtttttccagatcgtcaaggttggggtatttgacagtgtagagaagaccaagtgatgtc

SEQ ID NO: 97586 - DNA, 75 bp, Artificial Sequence
  Synthetic
agtgcctgcacaacattgttcattgtctctcctccctgaactgtcatgcaggcaatggttagagctggcattgaa

SEQ ID NO: 97587 - DNA, 75 bp, Artificial Sequence
  Synthetic
ccaaactgattatttagtttagagggatcagatacatcccacaacctgacaaccccacctgcaacccccttttgt

SEQ ID NO: 97588 - DNA, 75 bp, Artificial Sequence
  Synthetic
tgctggaatcctaaagttctaagaatccctgctcttttctctaactgtgactgtgtcaagtttcccatgtacatc

SEQ ID NO: 97589 - DNA, 75 bp, Artificial Sequence
  Synthetic
cttgggctgctggtttccctatctccaatcttcttctttaatttttctagatctgaggccaagtccatcaactca

SEQ ID NO: 97590 - DNA, 75 bp, Artificial Sequence
  Synthetic
tccttgcccaaatcaccaactttcaggactgtgttgttctgaacacttctcatgctcatcagtttgtcaacttct

SEQ ID NO: 97591 - DNA, 75 bp, Artificial Sequence
  Synthetic
ctatttaagtctctgagtttatcaagatcagtgtctcctcgtttagatttacgtaggagtctttggacttcagaa

SEQ ID NO: 97592 - DNA, 75 bp, Artificial Sequence
  Synthetic
acctgtgtaaaatcaagagagtctgcaatgagctttgcatccttaaggacatttgttttggttggttctgtgaac

SEQ ID NO: 97593 - DNA, 75 bp, Artificial Sequence
  Synthetic
atttgttttggttggttctgtgaacatccctagttctctcctcagagattgagtccagcgaaagctggggatttc

SEQ ID NO: 97594 - DNA, 75 bp, Artificial Sequence
  Synthetic
gggatttctttggagtgagccatggtttgggttgcgcagaagactaagacaaaaatgcctaggatccactgtgcg

SEQ ID NO: 97595 - DNA, 75 bp, Artificial Sequence
  Synthetic
attgttgggtgtgacctaacataatgggacagttaatcagtttctttcaggacataccgatcttctttgaagaag

SEQ ID NO: 97596 - DNA, 75 bp, Artificial Sequence
  Synthetic
gatgtgcaccctgtcctctgttcgtccagtccaactatactcgacaactacactcaatgtataaaaggctcccca

SEQ ID NO: 97597 - DNA, 75 bp, Artificial Sequence
  Synthetic
aattcacattccaattgaatttaacagatagtcctgagacccaccactataggagcaggattgaggcaggcatcc

SEQ ID NO: 97598 - DNA, 75 bp, Artificial Sequence
  Synthetic
gtggttatgaggaacaccacctgggaaggtcaatgctcaaatagtcatgtgaatacattaagatttcttgttaaa

SEQ ID NO: 97599 - DNA, 75 bp, Artificial Sequence
  Synthetic
ggtggatgttggttgctggagatttgaagtgctttggtaacacagctgtcgccaagtgtaatctgaatcatgatt

SEQ ID NO: 97600 - DNA, 75 bp, Artificial Sequence
  Synthetic
ctgctgtcaacatgttaactcactcaataaatagtctaatatctgataatttattgatgaggaacaaactgaaag

SEQ ID NO: 97601 - DNA, 75 bp, Artificial Sequence
  Synthetic
gcctcacagactcgataggaatggtgcttgcaggtgtggcaggtatcagaaacttggaaaacaagtaacctggaa

SEQ ID NO: 97602 - DNA, 75 bp, Artificial Sequence
  Synthetic
gcttgcaggtgtggcaggtatcagaaacttggaaaacaagtaacctggaagagaaagcactgatttcaccagccc

SEQ ID NO: 97603 - DNA, 75 bp, Artificial Sequence
  Synthetic
ggtagcagttgaatgggaatggtgtcgggaagatggccatcaagaacagactgaaacataatgcagtcgagaaga

SEQ ID NO: 97604 - DNA, 75 bp, Artificial Sequence
  Synthetic
aacaatgacaccattgtgtgctctgcagaggtggccaaatttttcccaaacttcctgttcaaagattctggactg

SEQ ID NO: 97605 - DNA, 75 bp, Artificial Sequence
  Synthetic
ttctccggtcagtctgacatcaacaagctttaaatctttccttccatgtatgtcgaaaagctttttgatgtcgtc

SEQ ID NO: 97606 - DNA, 75 bp, Artificial Sequence
  Synthetic
tgccccttgaacagtgataactgaaccatgtggcaataagccaatgacgtaacttaatagaccaggttgagcatc

SEQ ID NO: 97607 - DNA, 75 bp, Artificial Sequence
  Synthetic
gaaggttggaatactgccaactccacagggtcagttggcgggccttcaatgtccatccagattgtgtctgatgaa

SEQ ID NO: 97608 - DNA, 75 bp, Artificial Sequence
  Synthetic
tctaacttcatcattgcttcctttacgatcgcttcttgcatttcagaaagatttgaaagtctgatattttgtcca

SEQ ID NO: 97609 - DNA, 75 bp, Artificial Sequence
  Synthetic
ctgcgtcaagtttcccatgtacatcctcgggctattgctttccctatctccaatcttcctctttagtttttctag

SEQ ID NO: 97610 - DNA, 75 bp, Artificial Sequence
  Synthetic
acgtaggagtctttgaacttgagaaacttgtgtgaaatcaagggagtctgcaatgagctttgcatcattaaggac

SEQ ID NO: 97611 - DNA, 75 bp, Artificial Sequence
  Synthetic
cgcacagtggatcctaggcgaaatttgacaatggatgaaaaagtctttgttttgaaagattttatcagaagacaa

SEQ ID NO: 97612 - DNA, 75 bp, Artificial Sequence
  Synthetic
gtgcctgacatacctgaactgtcttatcagaaggaggcattactttctcaagtcgaagtaccaatggtcttaaca

SEQ ID NO: 97613 - DNA, 75 bp, Artificial Sequence
  Synthetic
gagggcttcaagctcctatcatgcctggtcgagattgaatcctgcaggaagaattcttgtgagtgcaactttgaa

SEQ ID NO: 97614 - DNA, 75 bp, Artificial Sequence
  Synthetic
cagaaatttgttgatacaatactctctgaaaatggggtggttgcacccacactaccaaaggtgatacctgacggt

SEQ ID NO: 97615 - DNA, 75 bp, Artificial Sequence
  Synthetic
tacaggttcttcaataagacattgatactccttgaaacatttgtccgtgtgaatcctgaagagtttgaaaagaag

SEQ ID NO: 97616 - DNA, 75 bp, Artificial Sequence
  Synthetic
tggaaaaccgacatggcaaaattgcttagtttaaaagaggacattcacagaacgggtattacactggttcctgtg

SEQ ID NO: 97617 - DNA, 75 bp, Artificial Sequence
  Synthetic
gttgacggtagaggcaactacaacacagatttgctgccagattgggcgactgaaagattcagatggttgcttatt

SEQ ID NO: 97618 - DNA, 75 bp, Artificial Sequence
  Synthetic
gatctgctgagagaatcaagaggagctcctacaatggagattgaggatcaggagtaccataggttgattcatagc

SEQ ID NO: 97619 - DNA, 75 bp, Artificial Sequence
  Synthetic
ctctctaaaacaagtaatcagagcctcgggtttgaaaatatagaatgcttaaaaagggttcatctgaattatgag

SEQ ID NO: 97620 - DNA, 75 bp, Artificial Sequence
  Synthetic
gaaagactcaatgagcaattgcttaaagacattgtgggagaagttagggaatccaagattagggaagagttgatc

SEQ ID NO: 97621 - DNA, 75 bp, Artificial Sequence
  Synthetic
aaattgaaaacttggtacagagaagaaatctacaggaaaggccttgggaattttgttcagacagatagaaagtcc

SEQ ID NO: 97622 - DNA, 75 bp, Artificial Sequence
  Synthetic
ctactacagactttggtgttgtcgagtgcccactctgactcattggcccctgagtgtcccatgtgctgtagtaaa

SEQ ID NO: 97623 - DNA, 75 bp, Artificial Sequence
  Synthetic
atccttgacttatgttatcaactctcaatgagaattgcaaaccaaacatcactggagaataattttgatgaacct

SEQ ID NO: 97624 - DNA, 75 bp, Artificial Sequence
  Synthetic
cctcttcccacaacccagatagaaaaagtttatctgtcattgttatcagcgtgcaataagataaaaggaaagaaa

SEQ ID NO: 97625 - DNA, 75 bp, Artificial Sequence
  Synthetic
gtgtttaacaccagaagaaacacacttctatttttggacttaatcattttgaactttgtggcacatgtttataag

SEQ ID NO: 97626 - DNA, 75 bp, Artificial Sequence
  Synthetic
acacaaccttctgaaatggaaaccttgaaaaaagcaggtctgattatcggtgagatgttattacttcccaacgac

SEQ ID NO: 97627 - DNA, 75 bp, Artificial Sequence
  Synthetic
agggttttagatattttggttgcaaggaggcttctattgaagaaagttgagtcctgctgcaattggttggacagg

SEQ ID NO: 97628 - DNA, 75 bp, Artificial Sequence
  Synthetic
tgtagacatttgttaaggaaagaagagcctgttctatgggactgtgtgtcagagttcacaaatgttccagacttt

SEQ ID NO: 97629 - DNA, 75 bp, Artificial Sequence
  Synthetic
gagttgttgctatctttagctgaggagctctgttcagagaagcctgttatgcactacaaacctccaagttcattg

SEQ ID NO: 97630 - DNA, 75 bp, Artificial Sequence
  Synthetic
attggcgattgtgcccataaggacctgatgtcaatgtcagatggagagtttgagagtttatttaaatgtctgtcg

SEQ ID NO: 97631 - DNA, 75 bp, Artificial Sequence
  Synthetic
catatatcactttctctcgtaaattcaatgaagacatcattctcttccagacttctagtaaatgaaaaggattat

SEQ ID NO: 97632 - DNA, 75 bp, Artificial Sequence
  Synthetic
aagagatactatggcacagttagattaaaagaatgctatgtgcagaggttctttttaagagaaggcttgtatggg

SEQ ID NO: 97633 - DNA, 75 bp, Artificial Sequence
  Synthetic
cttttattttaccaaaaaacaggtgagaaatcacgttgttactccctttacctttctgataaagggaaccttgta

SEQ ID NO: 97634 - DNA, 75 bp, Artificial Sequence
  Synthetic
gaacttggatctttttattctgatcctaaacgattctttttgcccatattctctgaatttgtgcttctagctaca

SEQ ID NO: 97635 - DNA, 75 bp, Artificial Sequence
  Synthetic
tgcgcagagatgttaagctggttagattttgatgagaagttggttgacgcagtaacccccttattgaaaatcctg

SEQ ID NO: 97636 - DNA, 75 bp, Artificial Sequence
  Synthetic
gttttaagtatattgagttcaccaacaaaaaggagtcaaacatttctacaaggattaaggtatttcatcatggcg

SEQ ID NO: 97637 - DNA, 75 bp, Artificial Sequence
  Synthetic
tatgtcaatcaggcccatcatatccaattgatgagcaagttggctgttgaatgcaaatcagcctcagatgtttta

SEQ ID NO: 97638 - DNA, 75 bp, Artificial Sequence
  Synthetic
attcagaggcttagtgtaaaaattgtggatatggtgttaagtgatggttctgatccagacatgcatatgacgagg

SEQ ID NO: 97639 - DNA, 75 bp, Artificial Sequence
  Synthetic
aagtttaagtttgtcttaaatgtaagttacttatgtcatttgatcacaaaagaaactccagatagactcacagat

SEQ ID NO: 97640 - DNA, 75 bp, Artificial Sequence
  Synthetic
caaattaagtgttttgagaaattcatggaaccaaaactagagtttggtagtctcattgttaacccatctttaaat

SEQ ID NO: 97641 - DNA, 75 bp, Artificial Sequence
  Synthetic
ggctttctgtctaaggaacaagaagatgtcatgattgagggtgtagagaagttcttctcaaaagagcttcttact

SEQ ID NO: 97642 - DNA, 75 bp, Artificial Sequence
  Synthetic
gtggaagatttaaagagaccaggggtttctagagagctactgagttattgtgtgtcactttttaacaagggaagg

SEQ ID NO: 97643 - DNA, 75 bp, Artificial Sequence
  Synthetic
ctaagagttaatggtacattgggtacagacccctatagacccagtttcacaagcactgcattagacttatctagc

SEQ ID NO: 97644 - DNA, 75 bp, Artificial Sequence
  Synthetic
aacaagagtgttgttattccgaaattaaacgaagtgggagagattgtgtcggaatacgacaaacaaaaattggtt

SEQ ID NO: 97645 - DNA, 75 bp, Artificial Sequence
  Synthetic
tccacttgcattacttcaatggcagaaagatttaagacaaagggaaggtataatctagatcccgatacaatcgac

SEQ ID NO: 97646 - DNA, 75 bp, Artificial Sequence
  Synthetic
tttctgattatgaggaacttgactaatcttttgtctgcaagaaaacttgacagcagcaagaaggaagagttgtca

SEQ ID NO: 97647 - DNA, 75 bp, Artificial Sequence
  Synthetic
ttgttatatgagcacttgtctgaagatgtcatgaaagcatttgaagagataaagtatgaagttgagatcacttta

SEQ ID NO: 97648 - DNA, 75 bp, Artificial Sequence
  Synthetic
agcaaaatgaggctctcaagggaacttgagtgtggccacaaaaaaccatgtacactggaaggtgtgtgggcaccc

SEQ ID NO: 97649 - DNA, 75 bp, Artificial Sequence
  Synthetic
ttcaatgtcttgaaagtaattaggagtgagacaagtgttcatgaaattagggattttgatcctgacctcttgggg

SEQ ID NO: 97650 - DNA, 75 bp, Artificial Sequence
  Synthetic
gaagatgtctatgaaaagttatgtgtggctgtttatgattctccattaagacctaccttctttttggaaaagcct

SEQ ID NO: 97651 - DNA, 75 bp, Artificial Sequence
  Synthetic
cttgacatctgtccattggaactcctactgaaaaacttaacaacaaaatcttatgaagatgatgaattctttgat

SEQ ID NO: 97652 - DNA, 75 bp, Artificial Sequence
  Synthetic
tgtttcaagtacatcctgattcaagcaggatttgatcagaggttaggggcttatgaacataaaaataggtccaga

SEQ ID NO: 97653 - DNA, 75 bp, Artificial Sequence
  Synthetic
ttggggctctcagaggaagcttttaggctaaaggaggatgtgagagtgagcaatagacagagtaattcagaagcc

SEQ ID NO: 97654 - DNA, 75 bp, Artificial Sequence
  Synthetic
atagctgacagactagacaagagtttcttcaccagtgctgctctaaggaacttgtgcttttattcggaggaatcc

SEQ ID NO: 97655 - DNA, 75 bp, Artificial Sequence
  Synthetic
ccaacagagtacacatgtattagcccaaatgtgggtaatttgaaatttggtttgagttacaaagagcaagttggt

SEQ ID NO: 97656 - DNA, 75 bp, Artificial Sequence
  Synthetic
tcaaatagagaactttacgtaggtgacttaaacacaaagatgatgacaagattagttgaagactttactgaggca

SEQ ID NO: 97657 - DNA, 75 bp, Artificial Sequence
  Synthetic
gtggctaactcaatgaattacacatgtcttaactctgaaaaagagtttgagagggcaatctgtgatatgaagatg

SEQ ID NO: 97658 - DNA, 75 bp, Artificial Sequence
  Synthetic
gctgtgaacaatggggacctgtgctgttctctagatcattcaaaatggggccctttcatgagtccagctcttttt

SEQ ID NO: 97659 - DNA, 75 bp, Artificial Sequence
  Synthetic
catgcattctttggagctcttaagtttaaaattagtaagacaggtgaacaagtagatctcgggccagttctaaat

SEQ ID NO: 97660 - DNA, 75 bp, Artificial Sequence
  Synthetic
gtgttaaagtggcatttacataaagctgtagaagtaccaatcagtgttgctgaggcatattgcacaggcatgttg

SEQ ID NO: 97661 - DNA, 75 bp, Artificial Sequence
  Synthetic
aaaagaaggttgggtttaatgagtttaagctgccaatcagtgtgtgaagagttctttcaccagaaattattatta

SEQ ID NO: 97662 - DNA, 75 bp, Artificial Sequence
  Synthetic
gaagaaggagtgcccagtcatattatgtctgtcttagacatgggacagggcatacttcacaattcatctgatctt

SEQ ID NO: 97663 - DNA, 75 bp, Artificial Sequence
  Synthetic
tatggtttgattactgagcaattcataaactactgtttggatttcctctttgacgtgataccggtgtcttacacg

SEQ ID NO: 97664 - DNA, 75 bp, Artificial Sequence
  Synthetic
tctagtgatgatcagatcacaacgttcaaattgccaactatgtcttcaagtgaagatgggttagacggttttgat

SEQ ID NO: 97665 - DNA, 75 bp, Artificial Sequence
  Synthetic
tggttagagcttttatgtttccacgattttttgtcctcaaaattcaacaaatttgtgagccccaagagtgtttct

SEQ ID NO: 97666 - DNA, 75 bp, Artificial Sequence
  Synthetic
gggacttttgttgctgagtttaaatcaaggttctttgtcatgggtgaggaaacacctctgttaaccaagtttgta

SEQ ID NO: 97667 - DNA, 75 bp, Artificial Sequence
  Synthetic
tctgcagcattgcataatgtcaagtgtaaaactccaacacaacttgctgaaactattgatacgatttgtgatcaa

SEQ ID NO: 97668 - DNA, 75 bp, Artificial Sequence
  Synthetic
tgtgtggctaatggtgtcggaattgaaattgtcacaaaaatatcagaaagagtgaacaggttaattaggtactct

SEQ ID NO: 97669 - DNA, 75 bp, Artificial Sequence
  Synthetic
ggttaccctcaaacgccctttcttgctgttgaaaaacaagatgttaaggactggactgatggctcaagaggttac

SEQ ID NO: 97670 - DNA, 75 bp, Artificial Sequence
  Synthetic
agattacaaaggaatattgaacactacctacaagggagtgaacaattggaatttgtgaggaagtgcgcaaaaaag

SEQ ID NO: 97671 - DNA, 75 bp, Artificial Sequence
  Synthetic
gttttgttaaaaataaagaaagggcaagtttttgaggaatacttagttcagctaatagggaaagatggggatgat

SEQ ID NO: 97672 - DNA, 75 bp, Artificial Sequence
  Synthetic
gctttgaaaggctttttgtcttatgcaggctgtgaatcagatgaaattaaggatgtccttaagtaccgctggcta

SEQ ID NO: 97673 - DNA, 75 bp, Artificial Sequence
  Synthetic
aatttatctgcaaatggtgacttaaggcttgtgttgaggacaaaacttatgtcaacaagaagggtgcttgaaaga

SEQ ID NO: 97674 - DNA, 75 bp, Artificial Sequence
  Synthetic
gagcaaattccaactcttatcaagacgttacagtcaaaactctcaaaaaattttacaaaaggagtcaagaaaatt

SEQ ID NO: 97675 - DNA, 75 bp, Artificial Sequence
  Synthetic
ctggcagaatcaatcaacaagtcagcgttccaatcatctgttgcttcaggtttcatcggtttttgtaagagtatg

SEQ ID NO: 97676 - DNA, 75 bp, Artificial Sequence
  Synthetic
ggtagcaagtgtgttagagatggcagtggaggtttcatgtacattcgtgaggttttaaataagcagagggtatgt

SEQ ID NO: 97677 - DNA, 75 bp, Artificial Sequence
  Synthetic
ccctgtgagatatgtgcacaaaaccctgggatcattttttgttctgatgcattgaccttaataccagaattttcg

SEQ ID NO: 97678 - DNA, 75 bp, Artificial Sequence
  Synthetic
agatcaatattatgggattatttttctctggtgttaacaaatgcctgtgagttaggagaatgggtgttctcttca

SEQ ID NO: 97679 - DNA, 75 bp, Artificial Sequence
  Synthetic
gtacaacctccaaaagtgcccattctactaaataaccccaatctcttttgggctgttaaacctagaggaacccgt

SEQ ID NO: 97680 - DNA, 75 bp, Artificial Sequence
  Synthetic
ttaattgaagatcaattaggattaggtcatgtattgcaatcagtaaggaggagttaccctaaagtttttgaagag

SEQ ID NO: 97681 - DNA, 75 bp, Artificial Sequence
  Synthetic
cacttagtaccgttcatgaatgacctacaggttagtcgcactactgatttcacaagactgaggtacttagatgtg

SEQ ID NO: 97682 - DNA, 75 bp, Artificial Sequence
  Synthetic
tgtgttgctcttgacatgatgaatgaaaatttgggaattgtgtctcatctgttgaaggcaaaggataattcaata

SEQ ID NO: 97683 - DNA, 75 bp, Artificial Sequence
  Synthetic
tatattgttaaacaaagtgagtgtgctgtcgcacatataagacaagttgaatatgtaaatcaggaattagggtta

SEQ ID NO: 97684 - DNA, 75 bp, Artificial Sequence
  Synthetic
agccctcaacagatttgcagtaattttaaaatacagttggtcttttcatctatgattaatcctttagttattaca

SEQ ID NO: 97685 - DNA, 75 bp, Artificial Sequence
  Synthetic
acatctgtgctaaagcctttcttctggtttaatgaggttttgaatctagaagatgaaagtcagattgatgtcggt

SEQ ID NO: 97686 - DNA, 75 bp, Artificial Sequence
  Synthetic
gagctcactgactttacaatactgataaaaaagtacaacttgaatagagcaatgatgctggatgatttaacaatg

SEQ ID NO: 97687 - DNA, 75 bp, Artificial Sequence
  Synthetic
ggttatgtggtgtcaacaattagtgagcccaccatacatttagtttcacttaaaagaaactcaaattcaattgtg

SEQ ID NO: 97688 - DNA, 75 bp, Artificial Sequence
  Synthetic
ggtgaacaaaactctgaaatgcttcatggagaacaagtggaagatatgtattccatagtgctgcacatccaactt

SEQ ID NO: 97689 - DNA, 75 bp, Artificial Sequence
  Synthetic
gagcacaaaaggcattcaacaaagtaccatttatcaagaacagttgtttattcttacacagttgaatgtgagact

SEQ ID NO: 97690 - DNA, 75 bp, Artificial Sequence
  Synthetic
aacatcactgacattgagaaagaaccaagcttagcaactgtaaagaatgtggtgctgagagcatctggatccatc

SEQ ID NO: 97691 - DNA, 75 bp, Artificial Sequence
  Synthetic
gagggccatcaatttttagatggtgttaaccttgttgcttcccagcctatattcacagggaaaaaagtcataaac

SEQ ID NO: 97692 - DNA, 75 bp, Artificial Sequence
  Synthetic
ctaagtgagctgctggctgactcagaaatcacagaaacatacaaagagggcgatgcagtgggatcaattcttcta

SEQ ID NO: 97693 - DNA, 75 bp, Artificial Sequence
  Synthetic
aactttggtacattttatgaacatattgacgacagatatgcttatgaaattgtggggcctgagtgttccgattcc

SEQ ID NO: 97694 - DNA, 75 bp, Artificial Sequence
  Synthetic
cctctagtgctcgatggaggctctatcttagctgatggcaaaaagctttccagcataaaagtcgaactcactggg

SEQ ID NO: 97695 - DNA, 75 bp, Artificial Sequence
  Synthetic
gatgtcatcctaaaggcattaggggccctagaatcagaaaaggaagtgcaaagcctgctgacagggttgtggcca

SEQ ID NO: 97696 - DNA, 75 bp, Artificial Sequence
  Synthetic
ttcattagaataaacaatctaaaagtgaagatggctcaggaggacttccttttaatgtatgagatgcacagggaa

SEQ ID NO: 97697 - DNA, 75 bp, Artificial Sequence
  Synthetic
tcattgttaaaatctcttgaggtcttcagcgaatggtgcgagtttgtggactttagtgtctgctatagcaaatct

SEQ ID NO: 97698 - DNA, 75 bp, Artificial Sequence
  Synthetic
ttaagggacttggtgatatcagacagctccggcagcctgaggctcaaaggcatcacctgtaaacccatcaatctg

SEQ ID NO: 97699 - DNA, 75 bp, Artificial Sequence
  Synthetic
tcaaattcagtcaccgaaattgagtaggccacagaggaccagcaacacccccgggcatccccggtgggggcccca

SEQ ID NO: 97700 - DNA, 75 bp, Artificial Sequence
  Synthetic
ctggggcccccggggggtgggagtgatgatctacgccacccgcattcattccggtggagcgcttggctcctccgg

SEQ ID NO: 97701 - DNA, 75 bp, Artificial Sequence
  Synthetic
aactgtgatgcatgtgggcagctgctcccaacaaatgttgcagagatcagagtttttcagcatgacatttaaaca

SEQ ID NO: 97702 - DNA, 75 bp, Artificial Sequence
  Synthetic
cctcaagcagaggtaatgatcagagcatttaatcagattcttgtcagcaaaccagcaacacttgcagttgtacct

SEQ ID NO: 97703 - DNA, 75 bp, Artificial Sequence
  Synthetic
cccatagagactgtgaatggcagtcctcctaaattctgtgactgttggtgcccctttttgagactctgaggaact

SEQ ID NO: 97704 - DNA, 75 bp, Artificial Sequence
  Synthetic
ggatgggttggatttagattttgaattgcccatgtttgtaaatgggttcaagttgtgaaaatctcaacttatagg

SEQ ID NO: 97705 - DNA, 75 bp, Artificial Sequence
  Synthetic
atgtttgtaaatgggttcaagttgtgaaaatctcaacttataggcgtgaaagttacgcctaggatccactgtgcg

SEQ ID NO: 97706 - DNA, 75 bp, Artificial Sequence
  Synthetic
cgcacagtggatcctaggcgtttttgctcacgctattatttgtccacactattgttgggggtgacctgacataat

SEQ ID NO: 97707 - DNA, 75 bp, Artificial Sequence
  Synthetic
ggggcagttaatcagtttcttccaagacataccgatcttctttgaagaagcactcaatgtagccctggctgtggt

SEQ ID NO: 97708 - DNA, 75 bp, Artificial Sequence
  Synthetic
cacattgcttgccattataaagggcattgtgaacgtttggaaatcaggaattcttcaactgcttgtgtttttggt

SEQ ID NO: 97709 - DNA, 75 bp, Artificial Sequence
  Synthetic
tctggcgggaagatcatgctcctttaaagttggtcatcatacaaattttgagtcattcacggttaatctaggagg

SEQ ID NO: 97710 - DNA, 75 bp, Artificial Sequence
  Synthetic
tgtctttcatgaattaccttcactatgcagggttaacaactcttacagtctaattaggctttctcatagtagtaa

SEQ ID NO: 97711 - DNA, 75 bp, Artificial Sequence
  Synthetic
tcaagcattatcagttgagtatgtggatgttagtcctgttctctgttcatccagtccaaccatacttgacaacta

SEQ ID NO: 97712 - DNA, 75 bp, Artificial Sequence
  Synthetic
cactcaatgtacaatgggctccccagagtttgattggattcttgggtggacaattaagggattgggacatgactt

SEQ ID NO: 97713 - DNA, 75 bp, Artificial Sequence
  Synthetic
cttaagggatccaagaatctgttgtgaacctaaaaagagttctaatgttgaatttagattccaattgaacttaac

SEQ ID NO: 97714 - DNA, 75 bp, Artificial Sequence
  Synthetic
agacagtcctgagacccatcactatagaagcaagattgaggcaggtatccgacatttattcgggaactacataac

SEQ ID NO: 97715 - DNA, 75 bp, Artificial Sequence
  Synthetic
taatgatagctattcaaagatgtctataatcatgaggaacaccacctgggaaaatcaatgctcaaatagccatgt

SEQ ID NO: 97716 - DNA, 75 bp, Artificial Sequence
  Synthetic
gaatacattgagatttcttgtcaaaaatgcaggttaccctgttgggagaaagccactggcattttttagttggtc

SEQ ID NO: 97717 - DNA, 75 bp, Artificial Sequence
  Synthetic
aatgcaggttaccctgttgggagaaagccactggcattttttagttggtcactctctgacccaaggggcgttgac

SEQ ID NO: 97718 - DNA, 75 bp, Artificial Sequence
  Synthetic
gccaagtgtaatttgaatcatgattctgagttctgtgacatgttgaggttgtttgatttcaacaagaatgccatt

SEQ ID NO: 97719 - DNA, 75 bp, Artificial Sequence
  Synthetic
gaaaaactgaacaaccaaaccaaagctgctgttaacatgttaactcattcaataaatagtctaatatctgacaac

SEQ ID NO: 97720 - DNA, 75 bp, Artificial Sequence
  Synthetic
ctgctgttaacatgttaactcattcaataaatagtctaatatctgacaacttattgatgagaaacaaactgaaag

SEQ ID NO: 97721 - DNA, 75 bp, Artificial Sequence
  Synthetic
gtgatcacctaatagcagagatgctaagtaaagagtaccaagataggcaggggaaaactcccctaacactggttg

SEQ ID NO: 97722 - DNA, 75 bp, Artificial Sequence
  Synthetic
atatacagggtgatccgtgccccttgcctcacaggctcgatagaaatggcgcttgcaggtgtggtaggtatcaaa

SEQ ID NO: 97723 - DNA, 75 bp, Artificial Sequence
  Synthetic
aacttggaaaacaagtaacctggaagagaaagcattgacctcattagccctccagctctgtcggcccggaagccc

SEQ ID NO: 97724 - DNA, 75 bp, Artificial Sequence
  Synthetic
gggccgacagggcgccccccagtccgcggcagtgccgcggactgggagggcatttgcctacatcacaaatgcgct

SEQ ID NO: 97725 - DNA, 75 bp, Artificial Sequence
  Synthetic
tttagcttggaacaccaatgtgtttggtagtagttgagtggggatggtgtcaggaagatgaccatcaagaacaga

SEQ ID NO: 97726 - DNA, 75 bp, Artificial Sequence
  Synthetic
caggaagatgaccatcaagaacagactgaaacatgatgcagtcaagaagagcacagtggggctcctttgtggagt

SEQ ID NO: 97727 - DNA, 75 bp, Artificial Sequence
  Synthetic
tgtcgaagagctttttgatgtcatctgctccttgaacagtgatgactgaattctgtggcaataagcctatgacgt

SEQ ID NO: 97728 - DNA, 75 bp, Artificial Sequence
  Synthetic
aactcagtagaccaggttgagcattttcgaggtccttcaacagtatgccgtgtgaatgcctacttccatttttaa

SEQ ID NO: 97729 - DNA, 75 bp, Artificial Sequence
  Synthetic
gagggttggaaaactgccaattccacaggatcagttggagggccctcaatgtccatccaaattgtatctgatgag

SEQ ID NO: 97730 - DNA, 75 bp, Artificial Sequence
  Synthetic
ttcttctcaggagctcgaggacctatcacaggtcttgtatttaaatcgacacttgtgttgtcccaagacctcccg

SEQ ID NO: 97731 - DNA, 75 bp, Artificial Sequence
  Synthetic
agtatttgtgaccttgatccaatgtatggccatccctccccggataagcacagcttgtagaggagattctcataa

SEQ ID NO: 97732 - DNA, 75 bp, Artificial Sequence
  Synthetic
gggttcctattgcccggcctctcatctacaaacatgccttctcttcttttaacatttaatgcggccttgacaata

SEQ ID NO: 97733 - DNA, 75 bp, Artificial Sequence
  Synthetic
aacatttaatgcggccttgacaatagaggagaagttgttaggtgtgactttgattgtctccagcatgttgccacc

SEQ ID NO: 97734 - DNA, 75 bp, Artificial Sequence
  Synthetic
atcctttgttatgatctgtaggcagtcgtgttccaaagttagtttttccaaatcatcaagattggggtatttgac

SEQ ID NO: 97735 - DNA, 75 bp, Artificial Sequence
  Synthetic
tgcaatggttagagctggcattgaaccaaattgattatttagtttggagggatcagatacatcccacagcctgac

SEQ ID NO: 97736 - DNA, 75 bp, Artificial Sequence
  Synthetic
aaccccacctgcagcccccttttgttgttggaatcccagagttctaagaatccctgctcttttttccaactgtga

SEQ ID NO: 97737 - DNA, 75 bp, Artificial Sequence
  Synthetic
ctgcgttaagttccccatgtacatccttgggctgttgctttctctgtccccaatcttcttcttcagtttttctag

SEQ ID NO: 97738 - DNA, 75 bp, Artificial Sequence
  Synthetic
gtctgaagctaagtccattaattcatctttgcccagatcaccaactttcagaactgtgttgttctgaacactttt

SEQ ID NO: 97739 - DNA, 75 bp, Artificial Sequence
  Synthetic
catgctcatcattctatcaacttctttattcaagtctctgagtttatcaagatcagcgtctcctcgtttggactt

SEQ ID NO: 97740 - DNA, 75 bp, Artificial Sequence
  Synthetic
acgtaagagtctttggacttgagaaacttgtgtaaaatcaagggagtctgcgatgagctttgcatcatttaggac

SEQ ID NO: 97741 - DNA, 75 bp, Artificial Sequence
  Synthetic
acttgttttggttggttctgtgaacatccctagttccctccttaaagattgagtccagcggaagctggggatttc

SEQ ID NO: 97742 - DNA, 75 bp, Artificial Sequence
  Synthetic
gcgcacagtggatcctaggcgtaactttcacgcctataagttgagattttcacaacttgaacccatttacaaaca

SEQ ID NO: 97743 - DNA, 75 bp, Artificial Sequence
  Synthetic
tgggcaattcaaaatctaaatccaacccatccagttcctcagagtctcaaaaaggggcaccaacagtcacagaat

SEQ ID NO: 97744 - DNA, 75 bp, Artificial Sequence
  Synthetic
ttaggaggactgccattcacagtctctatgggaggtacaactgcaagtgttgctggtttgctgacaagaatctga

SEQ ID NO: 97745 - DNA, 75 bp, Artificial Sequence
  Synthetic
ttaaatgctctgatcattacctctgcttgaggtgtttaaatgtcatgctgaaaaactctgatctttgcaacattt

SEQ ID NO: 97746 - DNA, 75 bp, Artificial Sequence
  Synthetic
gttgggagcagctgcccacatgcatcacagttccggaggagccaagcgctccaccggaatgaatgcgggtggcgt

SEQ ID NO: 97747 - DNA, 75 bp, Artificial Sequence
  Synthetic
agatcatcactcccacccccgggggccccagtggggcccccaccggggatgcccgggggtgttgctggtcctctg

SEQ ID NO: 97748 - DNA, 75 bp, Artificial Sequence
  Synthetic
tggcctactcaatttcggtgactgaatttgacagattgatgggtttacaggtgatgcctttgagcctcaggctgc

SEQ ID NO: 97749 - DNA, 75 bp, Artificial Sequence
  Synthetic
cggagctgtctgatatcaccaagtcccttaaagatttgctatagcagacactaaagtccacaaactcgcaccatt

SEQ ID NO: 97750 - DNA, 75 bp, Artificial Sequence
  Synthetic
cgctgaagacctcaagagattttaacaatgattccctgtgcatctcatacattaaaaggaagtcctcctgagcca

SEQ ID NO: 97751 - DNA, 75 bp, Artificial Sequence
  Synthetic
tcttcacttttagattgtttattctaatgaatggccacaaccctgtcagcaggctttgcacttccttttctgatt

SEQ ID NO: 97752 - DNA, 75 bp, Artificial Sequence
  Synthetic
ctagggcccctaatgcctttaggatgacatccccagtgagttcgacttttatgctggaaagctttttgccatcag

SEQ ID NO: 97753 - DNA, 75 bp, Artificial Sequence
  Synthetic
ctaagatagagcctccatcgagcactagaggggaatcggaacactcaggccccacaatttcataagcatatctgt

SEQ ID NO: 97754 - DNA, 75 bp, Artificial Sequence
  Synthetic
cgtcaatatgttcataaaatgtaccaaagtttagaagaattgatcccactgcatcgccctctttgtatgtttctg

SEQ ID NO: 97755 - DNA, 75 bp, Artificial Sequence
  Synthetic
tgatttctgagtcagccagcagctcacttaggtttatgacttttttccctgtgaatataggctgggaagcaacaa

SEQ ID NO: 97756 - DNA, 75 bp, Artificial Sequence
  Synthetic
ggttaacaccatctaaaaattgatggccctcgatggatccagatgctctcagcaccacattctttacagttgcta

SEQ ID NO: 97757 - DNA, 75 bp, Artificial Sequence
  Synthetic
agcttggttctttctcaatgtcagtgatgttagtctcacattcaactgtgtaagaataaacaactgttcttgata

SEQ ID NO: 97758 - DNA, 75 bp, Artificial Sequence
  Synthetic
aatggtactttgttgaatgccttttgtgctcaagttggatgtgcagcactatggaatacatatcttccacttgtt

SEQ ID NO: 97759 - DNA, 75 bp, Artificial Sequence
  Synthetic
ctccatgaagcatttcagagttttgttcacccacaattgaatttgagtttcttttaagtgaaactaaatgtatgg

SEQ ID NO: 97760 - DNA, 75 bp, Artificial Sequence
  Synthetic
tgggctcactaattgttgacaccacataacccattgttaaatcatccagcatcattgctctattcaagttgtact

SEQ ID NO: 97761 - DNA, 75 bp, Artificial Sequence
  Synthetic
tttttatcagtattgtaaagtcagtgagctcaccgacatcaatctgactttcatcttctagattcaaaacctcat

SEQ ID NO: 97762 - DNA, 75 bp, Artificial Sequence
  Synthetic
taaaccagaagaaagactttagcacagatgttgtaataactaaaggattaatcatagatgaaaagaccaactgta

SEQ ID NO: 97763 - DNA, 75 bp, Artificial Sequence
  Synthetic
ttttaaaattactgcaaatctgttgagggcttaaccctaattcctgatttacatattcaacttgtcttatatgtg

SEQ ID NO: 97764 - DNA, 75 bp, Artificial Sequence
  Synthetic
cgacagcacactcactttgtttaacaatatatattgaattatcctttgccttcaacagatgagacacaattccca

SEQ ID NO: 97765 - DNA, 75 bp, Artificial Sequence
  Synthetic
aattttcattcatcatgtcaagagcaacacacacatctaagtacctcagtcttgtgaaatcagtagtgcgactaa

SEQ ID NO: 97766 - DNA, 75 bp, Artificial Sequence
  Synthetic
cctgtaggtcattcatgaacggtactaagtgctcttcaaaaactttagggtaactcctccttactgattgcaata

SEQ ID NO: 97767 - DNA, 75 bp, Artificial Sequence
  Synthetic
catgacctaatcctaattgatcttcaattaaacgggttcctctaggtttaacagcccaaaagagattggggttat

SEQ ID NO: 97768 - DNA, 75 bp, Artificial Sequence
  Synthetic
ttagtagaatgggcacttttggaggttgtactgaagagaacacccattctcctaactcacaggcatttgttaaca

SEQ ID NO: 97769 - DNA, 75 bp, Artificial Sequence
  Synthetic
ccagagaaaaataatcccataatattgatctcgaaaattctggtattaaggtcaatgcatcagaacaaaaaatga

SEQ ID NO: 97770 - DNA, 75 bp, Artificial Sequence
  Synthetic
tcccagggttttgtgcacatatctcacagggacataccctctgcttatttaaaacctcacgaatgtacatgaaac

SEQ ID NO: 97771 - DNA, 75 bp, Artificial Sequence
  Synthetic
ctccactgccatctctaacacacttgctacccatactcttacaaaaaccgatgaaacctgaagcaacagatgatt

SEQ ID NO: 97772 - DNA, 75 bp, Artificial Sequence
  Synthetic
ggaacgctgacttgttgattgattctgccagaattttcttgactccttttgtaaaattttttgagagttttgact

SEQ ID NO: 97773 - DNA, 75 bp, Artificial Sequence
  Synthetic
gtaacgtcttgataagagttggaatttgctctctttcaagcacccttcttgttgacataagttttgtcctcaaca

SEQ ID NO: 97774 - DNA, 75 bp, Artificial Sequence
  Synthetic
caagccttaagtcaccatttgcagataaatttagccagcggtacttaaggacatccttaatttcatctgattcac

SEQ ID NO: 97775 - DNA, 75 bp, Artificial Sequence
  Synthetic
agcctgcataagacaaaaagcctttcaaagcatcatccccatctttccctattagctgaactaagtattcctcaa

SEQ ID NO: 97776 - DNA, 75 bp, Artificial Sequence
  Synthetic
aaacttgccctttctttatttttaacaaaaccttttttgcgcacttcctcacaaattccaattgttcactccctt

SEQ ID NO: 97777 - DNA, 75 bp, Artificial Sequence
  Synthetic
gtaggtagtgttcaatattcctttgtaatctgtaacctcttgagccatcagtccagtccttaacatcttgttttt

SEQ ID NO: 97778 - DNA, 75 bp, Artificial Sequence
  Synthetic
caacagcaagaaagggcgtttgagggtaaccagagtacctaattaacctgttcactctttctgatatttttgtga

SEQ ID NO: 97779 - DNA, 75 bp, Artificial Sequence
  Synthetic
caatttcaattccgacaccattagccacacattgatcacaaatcgtatcaatagtttcagcaagttgtgttggag

SEQ ID NO: 97780 - DNA, 75 bp, Artificial Sequence
  Synthetic
ttttacacttgacattatgcaatgctgcagatacaaacttggttaacagaggtgtttcctcacccatgacaaaga

SEQ ID NO: 97781 - DNA, 75 bp, Artificial Sequence
  Synthetic
accttgatttaaactcagcaacaaaagtcccagaaacactcttggggctcacaaatttgttgaattttgaggaca

SEQ ID NO: 97782 - DNA, 75 bp, Artificial Sequence
  Synthetic
aaaaatcgtggaaacataaaagctctaaccaatcaaaaccgtctaacccatcttcacttgaagacatagttggca

SEQ ID NO: 97783 - DNA, 75 bp, Artificial Sequence
  Synthetic
atttgaacgttgtgatctgatcatcactagacgtgtaagacaccggtatcacgtcaaagaggaaatccaaacagt

SEQ ID NO: 97784 - DNA, 75 bp, Artificial Sequence
  Synthetic
agtttatgaattgctcagtaatcaaaccataaagatcagatgaattgtgaagtatgccctgtcccatgtctaaga

SEQ ID NO: 97785 - DNA, 75 bp, Artificial Sequence
  Synthetic
cagacataatatgactgggcactccttcttctaataataatttctggtgaaagaactcttcacacactgattggc

SEQ ID NO: 97786 - DNA, 75 bp, Artificial Sequence
  Synthetic
agcttaaactcattaaacccaaccttcttttcaacatgcctgtgcaatatgcctcagcaacactgattggtactt

SEQ ID NO: 97787 - DNA, 75 bp, Artificial Sequence
  Synthetic
ctacagctttatgtaaatgccactttaacacatttagaactggcccgagatctacttgttcacctgtcttactaa

SEQ ID NO: 97788 - DNA, 75 bp, Artificial Sequence
  Synthetic
ttttaaacttaagagctccaaagaatgcatgaaaaagagctggactcatgaaagggccccattttgaatgatcta

SEQ ID NO: 97789 - DNA, 75 bp, Artificial Sequence
  Synthetic
gagaacagcacaggtccccattgttcacagccatcttcatatcacagattgccctctcaaactctttttcagagt

SEQ ID NO: 97790 - DNA, 75 bp, Artificial Sequence
  Synthetic
taagacatgtgtaattcattgagttagccactgcctcagtaaagtcttcaactaatcttgtcatcatctttgtgt

SEQ ID NO: 97791 - DNA, 75 bp, Artificial Sequence
  Synthetic
ttaagtcacctacgtaaagttctctatttgaaccaacttgctctttgtaactcaaaccaaatttcaaattaccca

SEQ ID NO: 97792 - DNA, 75 bp, Artificial Sequence
  Synthetic
catttgggctaatacatgtgtactctgttggggattcctccgaataaaagcacaagttccttagagcagcactgg

SEQ ID NO: 97793 - DNA, 75 bp, Artificial Sequence
  Synthetic
tgaagaaactcttgtctagtctgtcagctatggcttctgaattactctgtctattgctcactctcacatcctcct

SEQ ID NO: 97794 - DNA, 75 bp, Artificial Sequence
  Synthetic
ttagcctaaaagcttcctctgagagccccaatctggacctatttttatgttcataagcccctaacctctgatcaa

SEQ ID NO: 97795 - DNA, 75 bp, Artificial Sequence
  Synthetic
atcctgcttgaatcaggatgtacttgaaacaatcaaagaattcatcatcttcataagattttgttgttaagtttt

SEQ ID NO: 97796 - DNA, 75 bp, Artificial Sequence
  Synthetic
tcagtaggagttccaatggacagatgtcaagaggcttttccaaaaagaaggtaggtcttaatggagaatcataaa

SEQ ID NO: 97797 - DNA, 75 bp, Artificial Sequence
  Synthetic
cagccacacataacttttcatagacatcttcccccaagaggtcaggatcaaaatccctaatttcatgaacacttg

SEQ ID NO: 97798 - DNA, 75 bp, Artificial Sequence
  Synthetic
tctcactcctaattactttcaagacattgaagggtgcccacacaccttccagtgtacatggttttttgtggccac

SEQ ID NO: 97799 - DNA, 75 bp, Artificial Sequence
  Synthetic
actcaagttcccttgagagcctcattttgcttaaagtgatctcaacttcatactttatctcttcaaatgctttca

SEQ ID NO: 97800 - DNA, 75 bp, Artificial Sequence
  Synthetic
tgacatcttcagacaagtgctcatataacaatgacaactcttccttcttgctgctgtcaagttttcttgcagaca

SEQ ID NO: 97801 - DNA, 75 bp, Artificial Sequence
  Synthetic
aaagattagtcaagttcctcataatcagaaagtcgattgtatcgggatctagattataccttccctttgtcttaa

SEQ ID NO: 97802 - DNA, 75 bp, Artificial Sequence
  Synthetic
atctttctgccattgaagtaatgcaagtggaaaccaatttttgtttgtcgtattccgacacaatctctcccactt

SEQ ID NO: 97803 - DNA, 75 bp, Artificial Sequence
  Synthetic
cgtttaatttcggaataacaacactcttgttgctagataagtctaatgcagtgcttgtgaaactgggtctatagg

SEQ ID NO: 97804 - DNA, 75 bp, Artificial Sequence
  Synthetic
ggtctgtacccaatgtaccattaactcttagccttcccttgttaaaaagtgacacacaataactcagtagctctc

SEQ ID NO: 97805 - DNA, 75 bp, Artificial Sequence
  Synthetic
tagaaacccctggtctctttaaatcttccacagtaagaagctcttttgagaagaacttctctacaccctcaatca

SEQ ID NO: 97806 - DNA, 75 bp, Artificial Sequence
  Synthetic
tgacatcttcttgttccttagacagaaagccatttaaagatgggttaacaatgagactaccaaactctagttttg

SEQ ID NO: 97807 - DNA, 75 bp, Artificial Sequence
  Synthetic
gttccatgaatttctcaaaacacttaatttgatctgtgagtctatctggagtttcttttgtgatcaaatgacata

SEQ ID NO: 97808 - DNA, 75 bp, Artificial Sequence
  Synthetic
agtaacttacatttaagacaaacttaaacttcctcgtcatatgcatgtctggatcagaaccatcacttaacacca

SEQ ID NO: 97809 - DNA, 75 bp, Artificial Sequence
  Synthetic
tatccacaatttttacactaagcctctgaattaaaacatctgaggctgatttgcattcaacagccaacttgctca

SEQ ID NO: 97810 - DNA, 75 bp, Artificial Sequence
  Synthetic
tcaattggatatgatgggcctgattgacatacgccatgatgaaataccttaatccttgtagaaatgtttgactcc

SEQ ID NO: 97811 - DNA, 75 bp, Artificial Sequence
  Synthetic
tttttgttggtgaactcaatatacttaaaaccaggattttcaataagggggttactgcgtcaaccaacttctcat

SEQ ID NO: 97812 - DNA, 75 bp, Artificial Sequence
  Synthetic
caaaatctaaccagcttaacatctctgcgcatgtagctagaagcacaaattcagagaatatgggcaaaaagaatc

SEQ ID NO: 97813 - DNA, 75 bp, Artificial Sequence
  Synthetic
gtttaggatcagaataaaaagatccaagttctacaaggttccctttatcagaaaggtaaagggagtaacaacgtg

SEQ ID NO: 97814 - DNA, 75 bp, Artificial Sequence
  Synthetic
atttctcacctgttttttggtaaaataaaagcccatacaagcctactcttaaaaagaacctctgcacatagcatt

SEQ ID NO: 97815 - DNA, 75 bp, Artificial Sequence
  Synthetic
cttttaatctaactgtgccatagtatctcttataatccttttcatttactagaagtctggaagagaatgatgtct

SEQ ID NO: 97816 - DNA, 75 bp, Artificial Sequence
  Synthetic
tcattgaatttacgagagaaagtgatatatgcgacagacatttaaataaactctcaaactctccatctgacattg

SEQ ID NO: 97817 - DNA, 75 bp, Artificial Sequence
  Synthetic
acatcaggtccttatgggcacaatcgccaatcaatgaacttggaggtttgtagtgcataacaggcttctctgaac

SEQ ID NO: 97818 - DNA, 75 bp, Artificial Sequence
  Synthetic
agagctcctcagctaaagatagcaacaactcaaagtctggaacatttgtgaactctgacacacagtcccatagaa

SEQ ID NO: 97819 - DNA, 75 bp, Artificial Sequence
  Synthetic
caggctcttctttccttaacaaatgtctacacctgtccaaccaattgcagcaggactcaactttcttcaatagaa

SEQ ID NO: 97820 - DNA, 75 bp, Artificial Sequence
  Synthetic
gcctccttgcaaccaaaatatctaaaaccctgtcgttgggaagtaataacatctcaccgataatcagacctgctt

SEQ ID NO: 97821 - DNA, 75 bp, Artificial Sequence
  Synthetic
ttttcaaggtttccatttcagaaggttgtgtcttataaacatgtgccacaaagttcaaaatgattaagtccaaaa

SEQ ID NO: 97822 - DNA, 75 bp, Artificial Sequence
  Synthetic
atagaagtgtgtttcttctggtgttaaacactttctttccttttatcttattgcacgctgataacaatgacagat

SEQ ID NO: 97823 - DNA, 75 bp, Artificial Sequence
  Synthetic
aaactttttctatctgggttgtgggaagaggaggttcatcaaaattattctccagtgatgtttggtttgcaattc

SEQ ID NO: 97824 - DNA, 75 bp, Artificial Sequence
  Synthetic
tcattgagagttgataacataagtcaaggattttactacagcacatgggacactcaggggccaatgagtcagagt

SEQ ID NO: 97825 - DNA, 75 bp, Artificial Sequence
  Synthetic
gggcactcgacaacaccaaagtctgtagtagggactttctatctgtctgaacaaaattcccaaggcctttcctgt

SEQ ID NO: 97826 - DNA, 75 bp, Artificial Sequence
  Synthetic
agatttcttctctgtaccaagttttcaatttgatcaactcttccctaatcttggattccctaacttctcccacaa

SEQ ID NO: 97827 - DNA, 75 bp, Artificial Sequence
  Synthetic
tgtctttaagcaattgctcattgagtctttcctcataattcagatgaaccctttttaagcattctatattttcaa

SEQ ID NO: 97828 - DNA, 75 bp, Artificial Sequence
  Synthetic
acccgaggctctgattacttgttttagagaggctatgaatcaacctatggtactcctgatcctcaatctccattg

SEQ ID NO: 97829 - DNA, 75 bp, Artificial Sequence
  Synthetic
taggagctcctcttgattctctcagcagatcaataagcaaccatctgaatctttcagtcgcccaatctggcagca

SEQ ID NO: 97830 - DNA, 75 bp, Artificial Sequence
  Synthetic
aatctgtgttgtagttgcctctaccgtcaaccacaggaaccagtgtaatacccgttctgtgaatgtcctctttta

SEQ ID NO: 97831 - DNA, 75 bp, Artificial Sequence
  Synthetic
aactaagcaattttgccatgtcggttttccacttcttttcaaactcttcaggattcacacggacaaatgtttcaa

SEQ ID NO: 97832 - DNA, 75 bp, Artificial Sequence
  Synthetic
ggagtatcaatgtcttattgaagaacctgtaaccgtcaggtatcacctttggtagtgtgggtgcaaccaccccat

SEQ ID NO: 97833 - DNA, 75 bp, Artificial Sequence
  Synthetic
tttcagagagtattgtatcaacaaatttctgttcaaagttgcactcacaagaattcttcctgcaggattcaatct

SEQ ID NO: 97834 - DNA, 75 bp, Artificial Sequence
  Synthetic
cgaccaggcatgataggagcttgaagccctctgttaagaccattggtacttcgacttgagaaagtaatgcctcct

SEQ ID NO: 97835 - DNA, 75 bp, Artificial Sequence
  Synthetic
tctgataagacagttcaggtatgtcaggcacttgtcttctgataaaatctttcaaaacaaagactttttcatcca

SEQ ID NO: 97836 - DNA, 75 bp, Artificial Sequence
  Synthetic
ttgtcttctgataaaatctttcaaaacaaagactttttcatccattgtcaaatttcgcctaggatccactgtgcg

SEQ ID NO: 97837 - DNA, 75 bp, Artificial Sequence
  Synthetic
gggccgacagagcgccccccagtccgcggcaatgcccgcggactgggagggcatctgcctacatcacaaatgcgc

SEQ ID NO: 97838 - DNA, 75 bp, Artificial Sequence
  Synthetic
tcgggaagatgaccatcaagaacagactgaaacatgatgcaatcgagaagagcacagtgtggctccttcgtggag

SEQ ID NO: 97839 - DNA, 75 bp, Artificial Sequence
  Synthetic
cacttgatttggttggttctgtgaacatccctagttctctccttagagattgagtccagcggaagctggggattt

SEQ ID NO: 97840 - DNA, 75 bp, Artificial Sequence
  Synthetic
gggatttctttggagtgagccatagttcgcgttgtgtagaagactaagacaaaaatgcctaggatcaccttgtgc

SEQ ID NO: 97841 - DNA, 75 bp, Artificial Sequence
  Synthetic
cgcacagtggatcctaggcgtttttactcacgcaataatttgtccacactattgttgggtgtgacctgacataat

SEQ ID NO: 97842 - DNA, 75 bp, Artificial Sequence
  Synthetic
aataaatagtctaatatctgataatttattgatgagaaacaaactgaaagaatttttgaaggtcccatattgcaa

SEQ ID NO: 97843 - DNA, 75 bp, Artificial Sequence
  Synthetic
aagcaaagaataccaagacaggcaggggaagactcccttaacactggttgatctgtgtttttggagtgcgatctt

SEQ ID NO: 97844 - DNA, 75 bp, Artificial Sequence
  Synthetic
cgggaagatgaccatcaagaacagactgaaacataatgcaatcgagaagagcacagtgtggctccttcgtggagt

SEQ ID NO: 97845 - DNA, 75 bp, Artificial Sequence
  Synthetic
cgcacagtggatcctaggcgtttttactcacgcaaaaattagaccacattattgttaggtaggacctgacacaat

SEQ ID NO: 97846 - DNA, 75 bp, Artificial Sequence
  Synthetic
tacactgcttgccattatgaagggcattgtgaacgtttggaaatcaggaattcttcaactgcttgtgtttttgat

SEQ ID NO: 97847 - DNA, 75 bp, Artificial Sequence
  Synthetic
aaagttggtcatcatacaaattttgagtcattcacggttaatctagggggtgtctttcatgaattaccctcatta

SEQ ID NO: 97848 - DNA, 75 bp, Artificial Sequence
  Synthetic
gatgtgcaccctgtcctctgttcatccagcccaaccatactcgacaactatactcaatgtataaaaggctcccca

SEQ ID NO: 97849 - DNA, 75 bp, Artificial Sequence
  Synthetic
agacagtgttgagactcatcactataggggtaagattgaggcaggtatccgacatttgttcgggaactacataac

SEQ ID NO: 97850 - DNA, 75 bp, Artificial Sequence
  Synthetic
gtggttatgaggaacaccacctgggaaggtcaatgcccaaatagccatgtaaatacattgagatttctggtcaaa

SEQ ID NO: 97851 - DNA, 75 bp, Artificial Sequence
  Synthetic
gaaaaactgaacaaccaaactaaaactgctgtcaacatgttgactcactcaataaatagtttgatatctgacaac

SEQ ID NO: 97852 - DNA, 75 bp, Artificial Sequence
  Synthetic
ctgctgtcaacatgttgactcactcaataaatagtttgatatctgacaacctattgatgaggaacaagctgaggg

SEQ ID NO: 97853 - DNA, 75 bp, Artificial Sequence
  Synthetic
agattttgaaggtcccatactgcaactacacaagattctggtacataaaccacacgaaatctggtgagcactcac

SEQ ID NO: 97854 - DNA, 75 bp, Artificial Sequence
  Synthetic
atgtacaaggtgatccgtgccctttgcctcataggctcgatggaaatggtgcttgcaggtgtggtaggtatcaaa

SEQ ID NO: 97855 - DNA, 75 bp, Artificial Sequence
  Synthetic
aacttggcaaacaggtaacctggaggagaaagcattgatctcactagccccccagctctgtcggcccgggaaccc

SEQ ID NO: 97856 - DNA, 75 bp, Artificial Sequence
  Synthetic
gcggcaatgccgcggactgggagggcatttgcctacattacaaatgcactcttggcttggaacactagtgtgttt

SEQ ID NO: 97857 - DNA, 75 bp, Artificial Sequence
  Synthetic
tggcttccttgtttttcttcttcggaacaataacaccattgtgtgctctgcagaggtggccgaatttttcccaaa

SEQ ID NO: 97858 - DNA, 75 bp, Artificial Sequence
  Synthetic
tgtcgaagagtttcttgatatcatctgctccttgaacagtgatcactgaattctgtggcaacaagccaatgacgt

SEQ ID NO: 97859 - DNA, 75 bp, Artificial Sequence
  Synthetic
aacctttctcatcatgaggttttctgaaacagtgtacatagtttcctgaagaaggttggaaaactgccaattcca

SEQ ID NO: 97860 - DNA, 75 bp, Artificial Sequence
  Synthetic
tccaatttcctcattgcttcctttatgattgcttcttgcatctcagaaagatttgatagtctgatgttttgtcca

SEQ ID NO: 97861 - DNA, 75 bp, Artificial Sequence
  Synthetic
tgattgcttcttgcatctcagaaagatttgatagtctgatgttttgtccattcctctcaggagccctaggaccag

SEQ ID NO: 97862 - DNA, 75 bp, Artificial Sequence
  Synthetic
acttgtgttgtcccaagacctcccgattatttgtgaccttgatccaatatatggccaaccctctccggacaaaca

SEQ ID NO: 97863 - DNA, 75 bp, Artificial Sequence
  Synthetic
gatcagacacatcccacagtctgacgaccccacctgcagcccccctttgttgttggaatcctagagctcttagaa

SEQ ID NO: 97864 - DNA, 75 bp, Artificial Sequence
  Synthetic
tccctgctcttttttccagctgtgactgcgttaagtttcccatgtacatcctcgggctgttgctttccctatctc

SEQ ID NO: 97865 - DNA, 75 bp, Artificial Sequence
  Synthetic
caatcttcttctttagtttttctagatctgaagctaagtccattaattcatctttgcccaaatcgccgactttca

SEQ ID NO: 97866 - DNA, 75 bp, Artificial Sequence
  Synthetic
gaactgtgttgttctgaacacttctcatgctcatcagtctatcaacttccttattcaagtctctgagtttatcaa

SEQ ID NO: 97867 - DNA, 75 bp, Artificial Sequence
  Synthetic
gatctgcatcacctcgtttagatttacgtaggagtctttgaacttgagaaacttgtgtaaaatcaagggagtctg

SEQ ID NO: 97868 - DNA, 75 bp, Artificial Sequence
  Synthetic
caatgagctttgcatcattgaggacacttgttttggttggttctgtgaatgtccctagttccctccttaaagatt

SEQ ID NO: 97869 - DNA, 75 bp, Artificial Sequence
  Synthetic
gagtccagcggaagctggggatttccttggagagagccatggttcaagttttgcagaagactaagacaaaaatgc

SEQ ID NO: 97870 - DNA, 75 bp, Artificial Sequence
  Synthetic
gggatttccttggagagagccatggttcaagttttgcagaagactaagacaaaaatgcctaggatccactgtgcg

SEQ ID NO: 97871 - DNA, 75 bp, Artificial Sequence
  Synthetic
tgtgagtgcctacttccatttttaaaacctttctcatcatgaggttttctgaaacagtgcacacagtttcctgaa

SEQ ID NO: 97872 - DNA, 75 bp, Artificial Sequence
  Synthetic
ttcgaggtcctttaatagtatgccgtgtgagtgcctacttccatttttaaaacccttctcatcatgaggttttct

SEQ ID NO: 97873 - DNA, 75 bp, Artificial Sequence
  Synthetic
ctagaacaacgatggcaactatggaggaattgcagagggaaatcaatgcccacgagggtcaactggtgatagcca

SEQ ID NO: 97874 - DNA, 75 bp, Artificial Sequence
  Synthetic
ggaattgcagagggaaatcaatgcccacgagggtcaactggtgatagccaggcagaaggtgagggatgcagaaaa

SEQ ID NO: 97875 - DNA, 75 bp, Artificial Sequence
  Synthetic
cacgagggtcaactggtgatagccaggcagaaggtgagggatgcagaaaagcagtatgaaaaggatccagatgag

SEQ ID NO: 97876 - DNA, 75 bp, Artificial Sequence
  Synthetic
agcaaagattgatgaattagagaggcaactggcagatcggattgcaaccggaaaaaatcttggaaaggaacaaga

SEQ ID NO: 97877 - DNA, 75 bp, Artificial Sequence
  Synthetic
catctgaaagagagatcaatgctcagttatggaaatgttcttgatttaaaccacctggatattgatgagccgaca

SEQ ID NO: 97878 - DNA, 75 bp, Artificial Sequence
  Synthetic
ccacctggatattgatgagccgacaggacagacagcagactggctgagcattgttgtctatcttacatcctttgt

SEQ ID NO: 97879 - DNA, 75 bp, Artificial Sequence
  Synthetic
ggacagacagcagactggctgagcattgttgtctatcttacatcctttgttgtcccgatacttctgaaagctctg

SEQ ID NO: 97880 - DNA, 75 bp, Artificial Sequence
  Synthetic
ggaagccaaaacatctatatgtatccttgccaaatgcacagtcgagtatgaaagcagaggagattacacctggta

SEQ ID NO: 97881 - DNA, 75 bp, Artificial Sequence
  Synthetic
ttatcctgcacaaattaaggcaagacagatgattagtcctgtcatgagtgtgattggattcctggctttggcaaa

SEQ ID NO: 97882 - DNA, 75 bp, Artificial Sequence
  Synthetic
cgctgtccaccaacatgtcttttcattgcaggtattgctgagcttggggcatttttttccatcttgcaggacatg

SEQ ID NO: 97883 - DNA, 75 bp, Artificial Sequence
  Synthetic
atttttttccatcttgcaggacatgcggaatacaatcatggcatccaagactgtcggaacctctgaggagaagct

SEQ ID NO: 97884 - DNA, 75 bp, Artificial Sequence
  Synthetic
tgtgattattatatactactgaatcattatcaatcatatttgcactattattatcaggggaatcagtatatcagg

SEQ ID NO: 97885 - DNA, 75 bp, Artificial Sequence
  Synthetic
ttattactcagagggtgggtcagttaatccgttgtgggtgggtttagttcctggctgccttaagtagcctttttt

SEQ ID NO: 97886 - DNA, 75 bp, Artificial Sequence
  Synthetic
aatccgttgtgggtgggtttagttcctggctgccttaagtagcctttttttgtatatatggatgtagatttcatt

SEQ ID NO: 97887 - DNA, 75 bp, Artificial Sequence
  Synthetic
tgtatatatggatgtagatttcatttgatccttaaactaatcatgctctctttccttttcctcctgctttctctg

SEQ ID NO: 97888 - DNA, 75 bp, Artificial Sequence
  Synthetic
tgatccttaaactaatcatgctctctttccttttcctcctgctttctctgcttactaacaacaacattctacctc

SEQ ID NO: 97889 - DNA, 75 bp, Artificial Sequence
  Synthetic
tttccttttcctcctgctttctctgcttactaacaacaacattctacctcaacacaaaactacctcaactaaact

SEQ ID NO: 97890 - DNA, 75 bp, Artificial Sequence
  Synthetic
agtctggccagcctttgcactaaggaatgtgtatgacatgaaaattgagtgtccccacacagttagttttggaga

SEQ ID NO: 97891 - DNA, 75 bp, Artificial Sequence
  Synthetic
gaacagtgttataggatatgttgaactgcctcctatgccactggctgacacaacgcaaatggtgccggaaagctc

SEQ ID NO: 97892 - DNA, 75 bp, Artificial Sequence
  Synthetic
ttgcagcatggataatcaccaatcattaaacacaatcacaaaatacacccaaataatctggagaggaaaggctga

SEQ ID NO: 97893 - DNA, 75 bp, Artificial Sequence
  Synthetic
tcaatcccaatccagccaaaattcatttgagacagtgtctactgaggttgaccttaaaggaacctgtgtattaaa

SEQ ID NO: 97894 - DNA, 75 bp, Artificial Sequence
  Synthetic
acacaagatgatagaagaatcataccgcagtcggaagtcaataacttgttatgatctgtcctgcaacagcaccta

SEQ ID NO: 97895 - DNA, 75 bp, Artificial Sequence
  Synthetic
ttgcaaaccaactctgtacatgatcgtaccaatccatgcatgtaatatgatgaagagctgtttaattgcactagg

SEQ ID NO: 97896 - DNA, 75 bp, Artificial Sequence
  Synthetic
accttatagggtccaggttgtttatgaaagaacctattgcatgacaggggttttaattgaagggaaatgctttgt

SEQ ID NO: 97897 - DNA, 75 bp, Artificial Sequence
  Synthetic
tgttgcagtcaaaggaaacacatacaagatctttgaacaggttaaaaagtcatttgaatctaattgtaatgacac

SEQ ID NO: 97898 - DNA, 75 bp, Artificial Sequence
  Synthetic
tgaaaataaagtgcaagggtactacatttgtattatagggggaaattcctcacccgtatatgtaccaacactgga

SEQ ID NO: 97899 - DNA, 75 bp, Artificial Sequence
  Synthetic
cacccgtatatgtaccaacactggatgattttaggtcaatggaagcattctcaggaatttttagatcaccacatg

SEQ ID NO: 97900 - DNA, 75 bp, Artificial Sequence
  Synthetic
gagaagaccatgatctagctggagaagaggttgcatcatattctattgttggacctgctaatgctaaggtgcccc

SEQ ID NO: 97901 - DNA, 75 bp, Artificial Sequence
  Synthetic
atagtgccagctcagacacattaggcttaattgcttattctggtataccatcttattcttctctcagcatcctca

SEQ ID NO: 97902 - DNA, 75 bp, Artificial Sequence
  Synthetic
caagctcaacagaagcaaagcatgtgttcagccctggattattcccccagctaaaccatacaaagtgtgacaaaa

SEQ ID NO: 97903 - DNA, 75 bp, Artificial Sequence
  Synthetic
ctgctataccattgacatggacagggatgattgaccttcctggatactatgaagctatacatccttgcacagttt

SEQ ID NO: 97904 - DNA, 75 bp, Artificial Sequence
  Synthetic
tctgtgtcttgtcaggtcccggggcttcatgtgaggctttttctgaaggtggaatcttcaatataacttctccaa

SEQ ID NO: 97905 - DNA, 75 bp, Artificial Sequence
  Synthetic
tgtgtctagtgtcaaagcagaatcgttttagactaacagaacaacaggtgaattttgtatgccagagggttgatg

SEQ ID NO: 97906 - DNA, 75 bp, Artificial Sequence
  Synthetic
ttgacattattgtctattgtaatggtcagagaaaagtaatattaacaaagactctggttattgggcaatgtatat

SEQ ID NO: 97907 - DNA, 75 bp, Artificial Sequence
  Synthetic
atactataacgagcctattctcactattacctggggtagcacattcaattgcagttgaactgtgtgttcctgggt

SEQ ID NO: 97908 - DNA, 75 bp, Artificial Sequence
  Synthetic
tccatgggtgggccacagctgcattacttgttacattttgctttggttgggttctcatcccagcaatcacattca

SEQ ID NO: 97909 - DNA, 75 bp, Artificial Sequence
  Synthetic
ttatattgacaattttaaagttcattgcaaatatcttccacacaagcaatcaggagaataggttaaagtcagtac

SEQ ID NO: 97910 - DNA, 75 bp, Artificial Sequence
  Synthetic
tcagaaagataaaggaagaatttgaaaggacaaaaggatcaatggtgtgtgatatatgtaaatatgagtgtgaga

SEQ ID NO: 97911 - DNA, 75 bp, Artificial Sequence
  Synthetic
cttatagagaactaaaggcacatggggtctcatgcccacaatcccaatgcccttattgtttcacccactgtgagc

SEQ ID NO: 97912 - DNA, 75 bp, Artificial Sequence
  Synthetic
ggtctcatgcccacaatcccaatgcccttattgtttcacccactgtgagcccacagaagctgcatttcaggccca

SEQ ID NO: 97913 - DNA, 75 bp, Artificial Sequence
  Synthetic
ccacagaagctgcatttcaggcccattataaagtgtgtcaagttactcatagatttagggatgatttaaagaaga

SEQ ID NO: 97914 - DNA, 75 bp, Artificial Sequence
  Synthetic
cagttactccccagaactttacacctggttgctatcgaacattgaatttattcagatataagagtaggtgttata

SEQ ID NO: 97915 - DNA, 75 bp, Artificial Sequence
  Synthetic
ttcagatataagagtaggtgttatatttttacaatgtgggtttttcttttagtcttagaatcaatcttatgggca

SEQ ID NO: 97916 - DNA, 75 bp, Artificial Sequence
  Synthetic
agtcttagaatcaatcttatgggcagccagtgcatcagaaatacctttaaatccagtatggaacgacaatgccca

SEQ ID NO: 97917 - DNA, 75 bp, Artificial Sequence
  Synthetic
gccagtgcatcagaaatacctttaaatccagtatggaacgacaatgcccatggggtgggttctatcccaatgcat

SEQ ID NO: 97918 - DNA, 75 bp, Artificial Sequence
  Synthetic
atccagtatggaacgacaatgcccatggggtgggttctatcccaatgcatacagacttggaattggacttttcct

SEQ ID NO: 97919 - DNA, 75 bp, Artificial Sequence
  Synthetic
tgacatcaagctcaaagtacacctaccgaaggaaactaacaaacccacttgaagaatctcaggcaattgacctcc

SEQ ID NO: 97920 - DNA, 75 bp, Artificial Sequence
  Synthetic
atgtagaaatagaagagcaaacaattggtgtagatgtgcatgcattgggtcattggtttgatggccgccttaatc

SEQ ID NO: 97921 - DNA, 75 bp, Artificial Sequence
  Synthetic
ttaagacatcctttcactgttacggtgcatgcaccaagtatgagtacccatggcatactgcaaaatgccactatg

SEQ ID NO: 97922 - DNA, 75 bp, Artificial Sequence
  Synthetic
tggcatactgcaaaatgccactatgaaagggattaccaatatgagacaagttggggttgtaacccttcagactgt

SEQ ID NO: 97923 - DNA, 75 bp, Artificial Sequence
  Synthetic
cctggtgtaggtacaggctgtactgcatgtgggttatatcttgatcagttgaaacctgttggaagtgcttacaaa

SEQ ID NO: 97924 - DNA, 75 bp, Artificial Sequence
  Synthetic
atcattacaatacgatatagcagaagagtttgtgttcaatttggagaggaaaatctctgtaaaattatagatatg

SEQ ID NO: 97925 - DNA, 75 bp, Artificial Sequence
  Synthetic
aatgattgctttgtttctaggcatgttaaagtctgtataatcggcacagtttctaaattttctcaaggtgataca

SEQ ID NO: 97926 - DNA, 75 bp, Artificial Sequence
  Synthetic
ctcctattctttggaccacttgaaggtggtggtctaatatttaaacattggtgcacatcaacatgccagtttggg

SEQ ID NO: 97927 - DNA, 75 bp, Artificial Sequence
  Synthetic
gacccaggagatattatgagtccaagagataagggatttttatgccctgagttcccaggtagctttagaaagaag

SEQ ID NO: 97928 - DNA, 75 bp, Artificial Sequence
  Synthetic
tgtaattttgccacaacccctgtttgtgaatatgatgggaatatggtttcaggttataaaaaagtaatggccaca

SEQ ID NO: 97929 - DNA, 75 bp, Artificial Sequence
  Synthetic
attgattcttttcaatccttcaatacaagcactatgcatttcactgatgagaggatagaatggaaagaccctgat

SEQ ID NO: 97930 - DNA, 75 bp, Artificial Sequence
  Synthetic
gggatgttaagggaccatattaacattctggttacaaaggatattgactttgataatcttggtgaaaatccctgc

SEQ ID NO: 97931 - DNA, 75 bp, Artificial Sequence
  Synthetic
aagattggattacaaacatcctccattgaaggggcatgggggtctggtgtaggctttacacttacatgtttgata

SEQ ID NO: 97932 - DNA, 75 bp, Artificial Sequence
  Synthetic
tcactgacagaatgctctacattcttgacctcaatcaaagcttgtgacaaggcaatctgttatggtgcagagagt

SEQ ID NO: 97933 - DNA, 75 bp, Artificial Sequence
  Synthetic
gtgacacttacaagaggtcaaaatacagtgaaagtgtcaggaaagggcggacatagcggctcatccttcaaatgc

SEQ ID NO: 97934 - DNA, 75 bp, Artificial Sequence
  Synthetic
tgtcatggggaagaatgctcacagataggactccatgctgctgcacctcatcttgacaaggttaacgggatttca

SEQ ID NO: 97935 - DNA, 75 bp, Artificial Sequence
  Synthetic
gagatggagaacagtaaagtgtttgatgatggggcaccacagtgtgggataaaatgctggtttgttaaatcaggg

SEQ ID NO: 97936 - DNA, 75 bp, Artificial Sequence
  Synthetic
gaatggatttctgggattttcagcggtaattggattgtacttattgttctatgtgtatttctactattctcattg

SEQ ID NO: 97937 - DNA, 75 bp, Artificial Sequence
  Synthetic
gtattgcttagtattctctgtcctgtcagaaagcataaaaagtcatagatcgttaaatttattaccatgttactg

SEQ ID NO: 97938 - DNA, 75 bp, Artificial Sequence
  Synthetic
tgtatagctttaacatatacattaatttttgtatttcattatattttatctaacacactaaaaaaaatagtagct

SEQ ID NO: 97939 - DNA, 75 bp, Artificial Sequence
  Synthetic
tagtagtagactccctaaagagctactataacaacgatggcaactatggaggaactgcagagggaaatcaatgcc

SEQ ID NO: 97940 - DNA, 75 bp, Artificial Sequence
  Synthetic
ggaactgcagagggaaatcaatgcccatgaaggccaactggtgatagccaggcagaaggtgagggatgcagaaaa

SEQ ID NO: 97941 - DNA, 75 bp, Artificial Sequence
  Synthetic
catgaaggccaactggtgatagccaggcagaaggtgagggatgcagaaaaacaatatgagaaggatccagatgaa

SEQ ID NO: 97942 - DNA, 75 bp, Artificial Sequence
  Synthetic
gggcagactgcagactggcttagtattgttatatatctgacatcttttgttgtcccgatacttctgaaggcctta

SEQ ID NO: 97943 - DNA, 75 bp, Artificial Sequence
  Synthetic
agacaaccaaagataacaaagggaccaggattcgattcaaggatgacagctcttttgaggatgttaacgggattc

SEQ ID NO: 97944 - DNA, 75 bp, Artificial Sequence
  Synthetic
caggattcgattcaaggatgacagctcttttgaggatgttaacgggattcgaaagccaaagcatctatatgtgtc

SEQ ID NO: 97945 - DNA, 75 bp, Artificial Sequence
  Synthetic
gaaagccaaagcatctatatgtgtccttgcccaatgcccaatcaagcatgaaggcagaagagatcacaccaggta

SEQ ID NO: 97946 - DNA, 75 bp, Artificial Sequence
  Synthetic
ggtacagaacagcaatctgtggactctatcctgcacagatcaaagccagacaaatgattagccctgtcatgagtg

SEQ ID NO: 97947 - DNA, 75 bp, Artificial Sequence
  Synthetic
ctatcctgcacagatcaaagccagacaaatgattagccctgtcatgagtgtaattggatttttggcgctggcaaa

SEQ ID NO: 97948 - DNA, 75 bp, Artificial Sequence
  Synthetic
agattggagtgaccgtattgaacagtggttaagtgaaccttgtaagctactcccggacacagcagcagtaagcct

SEQ ID NO: 97949 - DNA, 75 bp, Artificial Sequence
  Synthetic
tcatggaggccctgcaacaaacagggattacctacggcagcgccaggtggcactgggtaatatggaaacaaaaga

SEQ ID NO: 97950 - DNA, 75 bp, Artificial Sequence
  Synthetic
atcaaaggccatacgtcaacatgctgaatctgcaggttgcagcatggttgaggatattgagtcaccatcatcgat

SEQ ID NO: 97951 - DNA, 75 bp, Artificial Sequence
  Synthetic
attcttctccattttacaggacatgcgaaacacaattatggcctcaaagacagtgggaacatctgaggaaaagct

SEQ ID NO: 97952 - DNA, 75 bp, Artificial Sequence
  Synthetic
cgaaacacaattatggcctcaaagacagtgggaacatctgaggaaaagctacggaagaaatcatcattctatcag

SEQ ID NO: 97953 - DNA, 75 bp, Artificial Sequence
  Synthetic
acggaagaaatcatcattctatcagtcttatctcaggcgaacccaatcaatgggaatacaactggaccaaagaat

SEQ ID NO: 97954 - DNA, 75 bp, Artificial Sequence
  Synthetic
accttggagatgatatggatcctgagctaaggacattggcacaaagcctgattgatgtaaaagtgaaggaaatct

SEQ ID NO: 97955 - DNA, 75 bp, Artificial Sequence
  Synthetic
gctaaggacattggcacaaagcctgattgatgtaaaagtgaaggaaatctctaaccaagagcctttaaaactata

SEQ ID NO: 97956 - DNA, 75 bp, Artificial Sequence
  Synthetic
attgatgtaaaagtgaaggaaatctctaaccaagagcctttaaaactataattagtgaatgtataacccttatta

SEQ ID NO: 97957 - DNA, 75 bp, Artificial Sequence
  Synthetic
attatcaatcatatttacactattattatcaggggaatcatcatatcagggtatgggtacatttatgggtgggaa

SEQ ID NO: 97958 - DNA, 75 bp, Artificial Sequence
  Synthetic
caggctgccttaagtagcctttttttgtatatatggatgtagatttcatttggtccttaaactaattttgctctc

SEQ ID NO: 97959 - DNA, 75 bp, Artificial Sequence
  Synthetic
tgtatatatggatgtagatttcatttggtccttaaactaattttgctctctttcctctttctctggcttcctctg

SEQ ID NO: 97960 - DNA, 75 bp, Artificial Sequence
  Synthetic
tggtccttaaactaattttgctctctttcctctttctctggcttcctctgcttactaacaacaacattctacctc

SEQ ID NO: 97961 - DNA, 75 bp, Artificial Sequence
  Synthetic
aacacaaaactatctcaacctaactacctcattagcttgctccttgattgtctttttagggagcatactactact

SEQ ID NO: 97962 - DNA, 75 bp, Artificial Sequence
  Synthetic
acacaaaactatctcaacctaactacctcattagcttgctccttgattgtctttttagggagcatactactacta

SEQ ID NO: 97963 - DNA, 75 bp, Artificial Sequence
  Synthetic
ctgaacaagagagcattaacagacagggaaggggttgcagcatcaatccaggccaagattgatgaactgaaaagg

SEQ ID NO: 97964 - DNA, 75 bp, Artificial Sequence
  Synthetic
gggaaggggttgcagcatcaatccaggccaagattgatgaactgaaaaggcagctagcggataggattgcaactg

SEQ ID NO: 97965 - DNA, 75 bp, Artificial Sequence
  Synthetic
cagctagcggataggattgcaactggaaaaaaccttggaaaggaacaggatcccactggagtagaacctggagac

SEQ ID NO: 97966 - DNA, 75 bp, Artificial Sequence
  Synthetic
catctgaaagagagatcaatgctcagttatggaaatgtattggacttgaaccatctggatattgatgagcctact

SEQ ID NO: 97967 - DNA, 75 bp, Artificial Sequence
  Synthetic
ttgttatatatctgacatcttttgttgtcccgatacttctgaaggccttatatatgcttacaacaagagggaggc

SEQ ID NO: 97968 - DNA, 75 bp, Artificial Sequence
  Synthetic
ctatcctgcacagatcaaagccagaaaaatgattagccctgtcatgagtgtaatcggatttttggcgctggcaaa

SEQ ID NO: 97969 - DNA, 75 bp, Artificial Sequence
  Synthetic
taatcggatttttggcgctggcaaaagattggagtgaccgtattgaacagtggttaagtgaaccttgtaagctac

SEQ ID NO: 97970 - DNA, 75 bp, Artificial Sequence
  Synthetic
agattggagtgaccgtattgaacagtggttaagtgaaccttgtaagctactcccggatacagcagcagtaagcct

SEQ ID NO: 97971 - DNA, 75 bp, Artificial Sequence
  Synthetic
tcccggatacagcagcagtaagcctccatggaggccctgcaacaaacagggattacctacggcagcgccaggtgg

SEQ ID NO: 97972 - DNA, 75 bp, Artificial Sequence
  Synthetic
aggatattgagtcaccatcatcgatatgggtttttgccggagcaccagatcgctgtccaccgacatgcttgttta

SEQ ID NO: 97973 - DNA, 75 bp, Artificial Sequence
  Synthetic
atgggtttttgccggagcaccagatcgctgtccaccgacatgcttgtttattgcagggattgctgaacttggtgc

SEQ ID NO: 97974 - DNA, 75 bp, Artificial Sequence
  Synthetic
cagtgggaacatctgaggagaagctacggaaaaaatcatcattctatcaatcttatctcaggcgaacccaatcaa

SEQ ID NO: 97975 - DNA, 75 bp, Artificial Sequence
  Synthetic
tgggaatacaactggaccaaagaattatagtgctctttatggttgcctggggtaaagaggctgtggataatcacc

SEQ ID NO: 97976 - DNA, 75 bp, Artificial Sequence
  Synthetic
ggtaaagaggctgtggataatcaccacttgataaatgctggggatcatgagctaaggacgctggcacaaagcctg

SEQ ID NO: 97977 - DNA, 75 bp, Artificial Sequence
  Synthetic
ctaaccaagagcctttaaaactataattagtgaaggtataacccttattatgtgattattatatactactgaatc

SEQ ID NO: 97978 - DNA, 75 bp, Artificial Sequence
  Synthetic
caggctgccttaagtagcctttttttgtatatatggatgtagatttcatttggtccttaaactaatcttgctctc

SEQ ID NO: 97979 - DNA, 75 bp, Artificial Sequence
  Synthetic
tttcctctttttctggcttcctctgcttactaacaacaacattctacctcaacacaaaactacctcaactacctc

SEQ ID NO: 97980 - DNA, 75 bp, Artificial Sequence
  Synthetic
cttactaacaacaacattctacctcaacacaaaactacctcaactacctctatagcttgctccctgattgtcttt

SEQ ID NO: 97981 - DNA, 75 bp, Artificial Sequence
  Synthetic
cctcaacacaaaactacctcaactacctctatagcttgctccctgattgtctttttagggagcaacttactacta

SEQ ID NO: 97982 - DNA, 75 bp, Artificial Sequence
  Synthetic
tagtagtagacaccgcaaaagaaagcagtcaatcagcaacatggggatatggaagtggctagtgatggccagttt

SEQ ID NO: 97983 - DNA, 75 bp, Artificial Sequence
  Synthetic
ggaagtggctagtgatggccagtttagtatggccagcttacacactgagaaatgtgtatgacatgaaaattgaat

SEQ ID NO: 97984 - DNA, 75 bp, Artificial Sequence
  Synthetic
gcccccatactgtaagttttggtgagaacagtgtgatagggtatgtggagttacctcctataccattagctgaca

SEQ ID NO: 97985 - DNA, 75 bp, Artificial Sequence
  Synthetic
caacacaaatggtaccggaaagttcttgcagtatggacaaccaccagtcattgaatacaataacaaaatataccc

SEQ ID NO: 97986 - DNA, 75 bp, Artificial Sequence
  Synthetic
aagtaagttggagaggtaaggctgatcaggcacaggccagccagaactcatttgaagcagtgtctgctgaagttg

SEQ ID NO: 97987 - DNA, 75 bp, Artificial Sequence
  Synthetic
acctcaaaggaacttgtgttttaaagcataaaatgttagaagagtcataccgcagcagaaaatcaatagcttgtt

SEQ ID NO: 97988 - DNA, 75 bp, Artificial Sequence
  Synthetic
atgacctctcttgtaatagtacctattgcaagcctaccctgtatatgattgtgccaatccatgcatgcaatatga

SEQ ID NO: 97989 - DNA, 75 bp, Artificial Sequence
  Synthetic
tgaaaagttgtttaattgcattaggaccccacagggtccaagtggtctatgaaagaacctactgcatgacagggg

SEQ ID NO: 97990 - DNA, 75 bp, Artificial Sequence
  Synthetic
cccagaccgaagtgttgtaagcattattaagcatggtatctttgacattgcaagtgtccacattgtttgcttctt

SEQ ID NO: 97991 - DNA, 75 bp, Artificial Sequence
  Synthetic
taagaataaggtacagggatattacatctgcattgtagggggaaactctgcacctatatatgtgccaacacttga

SEQ ID NO: 97992 - DNA, 75 bp, Artificial Sequence
  Synthetic
tgactttagatcaatggaagcattctcagggatctttagatcaccacatggggaggaccatgatttggctggaga

SEQ ID NO: 97993 - DNA, 75 bp, Artificial Sequence
  Synthetic
agaaattgcttcatactctattgttggacctgccaatgcaaaagtacctcatagtgccagttcagacacattgag

SEQ ID NO: 97994 - DNA, 75 bp, Artificial Sequence
  Synthetic
tctgactgcctattcaggtataccatcttattcctcacttagtatccttgcaggttcagcagaagctaagcatgt

SEQ ID NO: 97995 - DNA, 75 bp, Artificial Sequence
  Synthetic
atttagtcctggattcttcccacagcttaatcatacaaaatgtgataagactgctataccattgatgtggacagg

SEQ ID NO: 97996 - DNA, 75 bp, Artificial Sequence
  Synthetic
aatgattgacttgcctgggtattatgaggccatacatccttgtacagtcttctgtgttttatcaggcccaggggc

SEQ ID NO: 97997 - DNA, 75 bp, Artificial Sequence
  Synthetic
atcatgtgaagcattttcagaaggtggcattttcaacataacatccccaatgtgtttagtctcaaaacagaaccg

SEQ ID NO: 97998 - DNA, 75 bp, Artificial Sequence
  Synthetic
attccggctgacagaacagcaagtaaactttgtttgtcagagagttgatatggacattattgtgtattgtaatgg

SEQ ID NO: 97999 - DNA, 75 bp, Artificial Sequence
  Synthetic
tcagaggaaagtgatactaacaaaaaccttagttataggacagtgtatatataccataacaagtttgttctcact

SEQ ID NO: 98000 - DNA, 75 bp, Artificial Sequence
  Synthetic
gttacctggggtagcacattctattgctgttgagttatgcgtccctgggtttcatgggtgggctacagctgcttt

SEQ ID NO: 98001 - DNA, 75 bp, Artificial Sequence
  Synthetic
gcttgttacattttgctttggctgggttctaataccagcaatgacatttattgtgctaacaattttgaaattcat

SEQ ID NO: 98002 - DNA, 75 bp, Artificial Sequence
  Synthetic
tgcaaatattttccatacaagtaaccaagagaataagcttaaatcagtactgaggaagataaaagaggaatttga

SEQ ID NO: 98003 - DNA, 75 bp, Artificial Sequence
  Synthetic
aaaaacaaaaggatcaatggtgtgtgatgtgtgtaaatatgagtgtgagacctacaaggagttgaaggcacatgg

SEQ ID NO: 98004 - DNA, 75 bp, Artificial Sequence
  Synthetic
ggtttcatgtccccaatctcaatgcccatattgcttcactcattgtgaacctacagaagcagcattccaggctca

SEQ ID NO: 98005 - DNA, 75 bp, Artificial Sequence
  Synthetic
ttatagggtatgtcaagtcacccataggttcagagatgatttaaagaagactgtcactcctcaaaattttacacc

SEQ ID NO: 98006 - DNA, 75 bp, Artificial Sequence
  Synthetic
tgtttgttatcggacgttaaaccttttcagatataaaagtagatgttacatttttacaatgtgggtcttcctcct

SEQ ID NO: 98007 - DNA, 75 bp, Artificial Sequence
  Synthetic
tttttacaatgtgggtcttcctcctggttttggagtccatactttgggctgctagtgcatcggaaatacccttaa

SEQ ID NO: 98008 - DNA, 75 bp, Artificial Sequence
  Synthetic
acagacttagagctggatttttctttaacatcaagttccaagtatacataccgtaggaaactaacaaatccgcta

SEQ ID NO: 98009 - DNA, 75 bp, Artificial Sequence
  Synthetic
gaagaatcacaggcaattaaccttcatattgaaatagaagaacagacaattggagttgatgtgcatgctttaggc

SEQ ID NO: 98010 - DNA, 75 bp, Artificial Sequence
  Synthetic
ttaagacatcctttcactgctatggtgcttgtacaaaatatgaatatccatggcatacagcaaagtgtcactatg

SEQ ID NO: 98011 - DNA, 75 bp, Artificial Sequence
  Synthetic
cctggggtcggcacaggctgtacaatatgcggattgtaccttgaccaattaaagcctgttggtagtgcatacaaa

SEQ ID NO: 98012 - DNA, 75 bp, Artificial Sequence
  Synthetic
attattacaataaggtatagtaggagagtttgtgttcaatttggtgaagaaaatctttgcaaagtcatagatatg

SEQ ID NO: 98013 - DNA, 75 bp, Artificial Sequence
  Synthetic
aatgattgttttgtgtctagacatgtcaaggtctgcataattggtacagtttctaaattctcccaaggtgacaca

SEQ ID NO: 98014 - DNA, 75 bp, Artificial Sequence
  Synthetic
ttattgttctttgggccgcttgaaggtggtggtttaattttcaaacattggtgcacatctacatgccagtttgga

SEQ ID NO: 98015 - DNA, 75 bp, Artificial Sequence
  Synthetic
gtgcacatctacatgccagtttggagacccgggagatatcatgagcccaagagataaaggttttttatgtcctga

SEQ ID NO: 98016 - DNA, 75 bp, Artificial Sequence
  Synthetic
atttccaggcagttttaggaaaaaatgcaactttgccactacccctgtttgtgaatatgatggaaatatggtctc

SEQ ID NO: 98017 - DNA, 75 bp, Artificial Sequence
  Synthetic
aggatataagaaagtaatggctacaattgattcatttcaatccttcaatactagtaccatgcattttactgatga

SEQ ID NO: 98018 - DNA, 75 bp, Artificial Sequence
  Synthetic
gaggatagaatggaaagatcctgacgggatgttaagggatcacatcaatattttagtgacaaaagacattgattt

SEQ ID NO: 98019 - DNA, 75 bp, Artificial Sequence
  Synthetic
tgacaatcttggtgaaaatccttgtaagattggcttacagacatcctccattgaaggggcatggggctcaggtgt

SEQ ID NO: 98020 - DNA, 75 bp, Artificial Sequence
  Synthetic
aggcttcacgcttacatgcttgatatcactaacagagtgccctaccttcttaacatcaatcaaggcctgtgacaa

SEQ ID NO: 98021 - DNA, 75 bp, Artificial Sequence
  Synthetic
agctatatgttatggtgcagaaagcgtaacattaacaagagggcaaaacacagtcaaagtatcagggaaaggcgg

SEQ ID NO: 98022 - DNA, 75 bp, Artificial Sequence
  Synthetic
gcatagtggctcaacatttaaatgctgtcatggagaagactgttcacagagcgggcttcatgctgctgcacctca

SEQ ID NO: 98023 - DNA, 75 bp, Artificial Sequence
  Synthetic
tcttgataaggtcaatgggatctctgaaatagaaaatagtaaagtatatgatgatggagcaccacagtgtgggat

SEQ ID NO: 98024 - DNA, 75 bp, Artificial Sequence
  Synthetic
taaatgttggtttgtcaaatctggagagtggatctcagggattttcagtggtaactggattgtcctcattgtcct

SEQ ID NO: 98025 - DNA, 75 bp, Artificial Sequence
  Synthetic
gtaactggattgtcctcattgtcctctgtgtgtttctactattttcattggtgttgcttagcatcctttgtcctg

SEQ ID NO: 98026 - DNA, 75 bp, Artificial Sequence
  Synthetic
ctgtgtgtttctactattttcattggtgttgcttagcatcctttgtcctgttagaaaacacaaaaagtcatagct

SEQ ID NO: 98027 - DNA, 75 bp, Artificial Sequence
  Synthetic
aactgatattatctacatgatattatattcaatcttaatatgtgtattaatttgtatattccattatattctatc

SEQ ID NO: 98028 - DNA, 75 bp, Artificial Sequence
  Synthetic
tagtagtagactccctaaagagctactatagcaacgatggcaactatggaagaactacagagggaaatcaatgcc

SEQ ID NO: 98029 - DNA, 75 bp, Artificial Sequence
  Synthetic
agaactacagagggaaatcaatgcccatgagggccagctggtgatagccaggcagaaggtgagggatgcagaaaa

SEQ ID NO: 98030 - DNA, 75 bp, Artificial Sequence
  Synthetic
acagtatgaaaaggatccagatgaactgaacaaaagagcattaacagacagagaaggggttgcagcatctatcca

SEQ ID NO: 98031 - DNA, 75 bp, Artificial Sequence
  Synthetic
ggctaagattgatgaattgaaaagacagttggcagataggattgcaactggaaagaaccttggaaaggaacagga

SEQ ID NO: 98032 - DNA, 75 bp, Artificial Sequence
  Synthetic
cccaactggggttgaacctggagaccatcttaaggagagatcaatgcttagctatggcaatgtactggatttaaa

SEQ ID NO: 98033 - DNA, 75 bp, Artificial Sequence
  Synthetic
ccatctggatattgatgagcctacagggcagacagcagactggctaagtattgtcatatatctaacatcatttgt

SEQ ID NO: 98034 - DNA, 75 bp, Artificial Sequence
  Synthetic
tgtcccgatccttctaaaggccttgtatatgttaacaacaagagggagacaaacaaccaaagacaataagggaac

SEQ ID NO: 98035 - DNA, 75 bp, Artificial Sequence
  Synthetic
taggattcggttcaaggatgatagctcttttgaggatgtcaatggaattcggaaaccaaagcatttatatgtgtc

SEQ ID NO: 98036 - DNA, 75 bp, Artificial Sequence
  Synthetic
cttacctaatgcccaatccagcatgaaggcagaagagataacacctggtaggtatagaacagcaatttgtggact

SEQ ID NO: 98037 - DNA, 75 bp, Artificial Sequence
  Synthetic
ctaccctgcacagatcaaagcgagacaaatgattagccctgtcatgagtgtaattggattcttggcactggcaaa

SEQ ID NO: 98038 - DNA, 75 bp, Artificial Sequence
  Synthetic
ggactggagtgaccgcattgaacagtggcttagtgaaccttgtaaactcctcccggacacagcagcagtaagtct

SEQ ID NO: 98039 - DNA, 75 bp, Artificial Sequence
  Synthetic
tcatggaggtcctgcaacaaacagggactatctccggcagcggcaggtagcactgggcaatatggaaacgaagga

SEQ ID NO: 98040 - DNA, 75 bp, Artificial Sequence
  Synthetic
gactatctccggcagcggcaggtagcactgggcaatatggaaacgaaggagtcaaaggccatacgtcaacatgct

SEQ ID NO: 98041 - DNA, 75 bp, Artificial Sequence
  Synthetic
gtcaaaggccatacgtcaacatgctgaagctgcaggctgtagcatgattgaagatattgagtcaccgtcatcaat

SEQ ID NO: 98042 - DNA, 75 bp, Artificial Sequence
  Synthetic
atgggtctttgccggcgcccctgatcgctgcccaccaacatgcctattcattgcagggattgctgaacttggggc

SEQ ID NO: 98043 - DNA, 75 bp, Artificial Sequence
  Synthetic
atttatttccatcctacaggacatgaggaatacaattatggcttcaaagacagtgggaacatctgaagaaaaatt

SEQ ID NO: 98044 - DNA, 75 bp, Artificial Sequence
  Synthetic
gagaaataaatcatcattctaccagtcttatctcaggcgaacacaatcaatgggaatacaactggaccaaaggat

SEQ ID NO: 98045 - DNA, 75 bp, Artificial Sequence
  Synthetic
tatagtgctctttatggttgcctggggtaaagaggcagtagataatttccaccttggagatgatatggatcctga

SEQ ID NO: 98046 - DNA, 75 bp, Artificial Sequence
  Synthetic
gttgagaacactggcacagagtttgattgatgttaaagtgaaggagatctccaaccaagagcctttaaaactata

SEQ ID NO: 98047 - DNA, 75 bp, Artificial Sequence
  Synthetic
attgatgttaaagtgaaggagatctccaaccaagagcctttaaaactataatcaatgaatgtataacccttatta

SEQ ID NO: 98048 - DNA, 75 bp, Artificial Sequence
  Synthetic
atcaatgaatgtataacccttattatatgatcactatatactactgaatcattatcaatcacatttacactatta

SEQ ID NO: 98049 - DNA, 75 bp, Artificial Sequence
  Synthetic
ttatcagggggatcattatatcagggtatgggtgcatttatgggcgggaattattacttaaagggtgggtcagtt

SEQ ID NO: 98050 - DNA, 75 bp, Artificial Sequence
  Synthetic
actctacctcaacacaacctaactacctcatttgcttgctccttgattgtcttttttagggagcatactactact

SEQ ID NO: 98051 - DNA, 75 bp, Artificial Sequence
  Synthetic
tagtagtagactccctaaagagctactataccaacgatggcaactatgggggaattgcagagggaaatcaatgcc

SEQ ID NO: 98052 - DNA, 75 bp, Artificial Sequence
  Synthetic
tgtcccgatacttctgaaggccttatatatgctcacaacaagagggaggcagacaaccaaagataacaaagggac

SEQ ID NO: 98053 - DNA, 75 bp, Artificial Sequence
  Synthetic
ggtaaagaggctgtggataatcaccactgggcaaatgctattggatctgagttaaggacgctggcacaaagcctt

SEQ ID NO: 98054 - DNA, 75 bp, Artificial Sequence
  Synthetic
cctcaacacaaaactacctcaactacctctatagcttgctccctgattgtctttttagggagcatcctactacta

SEQ ID NO: 98055 - DNA, 75 bp, Artificial Sequence
  Synthetic
atggggatgtggaagtggctagtgatagccagtttagtatggcctgctttgacactgagaaatgtatatgacatg

SEQ ID NO: 98056 - DNA, 75 bp, Artificial Sequence
  Synthetic
aaaattgaatgcccccacacagtgagtttcggagaaaacagtgtgataggttatgtggagttaccccctatgcca

SEQ ID NO: 98057 - DNA, 75 bp, Artificial Sequence
  Synthetic
ttggccgacacagcacagatggtgcctgaaagttcttgcagcatggacaatcatcaatcgatgaatacaataaca

SEQ ID NO: 98058 - DNA, 75 bp, Artificial Sequence
  Synthetic
aaatatacccaggtaatctggagaggaaaggcagatccaggacaatccagtcagaattcatttgaaacagtatct

SEQ ID NO: 98059 - DNA, 75 bp, Artificial Sequence
  Synthetic
actgaaattgacttgaaaggaacgtgtgttttaaaacataaaatggtggaagagtcatatcgcagccggaagtca

SEQ ID NO: 98060 - DNA, 75 bp, Artificial Sequence
  Synthetic
ataacctgttatgacctttcttgtaatagtacttattgcaagccaacattgtatatgatcgtaccgatccatgca

SEQ ID NO: 98061 - DNA, 75 bp, Artificial Sequence
  Synthetic
tgcaatatgatgaaaagctgtctaattgcattagggccatacagggtacaggtagtgtatgaaagaacctactgc

SEQ ID NO: 98062 - DNA, 75 bp, Artificial Sequence
  Synthetic
atgacaggggtcctgattgaaggaaaatgttttgtcccagatcaaagtgtagtcagtattattaagcatgggatc

SEQ ID NO: 98063 - DNA, 75 bp, Artificial Sequence
  Synthetic
tttgatattgcaagtgttcatatagtatgtttctttgttgcagttaaagggaacacctataaactctttgaacag

SEQ ID NO: 98064 - DNA, 75 bp, Artificial Sequence
  Synthetic
gtcaagaaatcatttgagtcaacttgcaatgacactgagaataaagtgcagggttattacatctgcattgtggga

SEQ ID NO: 98065 - DNA, 75 bp, Artificial Sequence
  Synthetic
ggaaattctgcaccgatttatgtccctacgcttgatgattttaggtccatggaggcattcacagggatctttaga

SEQ ID NO: 98066 - DNA, 75 bp, Artificial Sequence
  Synthetic
tcaccacatggagaagaccatgatctggctggggaagagattgcttcatactctatagtcggacctgccaatgca

SEQ ID NO: 98067 - DNA, 75 bp, Artificial Sequence
  Synthetic
aaagtccctcatagtgcaagctcggatacattgagcctaattgcttattcaggtataccatcttattcttccctg

SEQ ID NO: 98068 - DNA, 75 bp, Artificial Sequence
  Synthetic
agtatcttgacaagttcaacagaggctaagcatgtatttagccctgggttgttcccaaagcttaaccatacaaac

SEQ ID NO: 98069 - DNA, 75 bp, Artificial Sequence
  Synthetic
tgtgataagagtgctataccgctcacatggactgggatgattgacttacctggatactatgaggccatacaccct

SEQ ID NO: 98070 - DNA, 75 bp, Artificial Sequence
  Synthetic
tgtacagttttttgtgtactatcaggccctggagcatcatgtgaggcattttctgaaggtggaatttttaacata

SEQ ID NO: 98071 - DNA, 75 bp, Artificial Sequence
  Synthetic
acttcccctatgtgcttagtttcaaaacagaatcggtttcggctaacagagcagcaggtaaactttgtgtgtcaa

SEQ ID NO: 98072 - DNA, 75 bp, Artificial Sequence
  Synthetic
agagtagacatggacattgtcgtgtactgcaatggacagcggaaagtaatattaacaaaaactttagttattggg

SEQ ID NO: 98073 - DNA, 75 bp, Artificial Sequence
  Synthetic
cagtgtatatacactataacaagcttgttttcattactacctggggtagcacattctattgctgtggagctatgt

SEQ ID NO: 98074 - DNA, 75 bp, Artificial Sequence
  Synthetic
gtacctggatttcatggctgggccacagctgctttgcttgttacattctgctttggatgggtcctgataccagca

SEQ ID NO: 98075 - DNA, 75 bp, Artificial Sequence
  Synthetic
atcacatttattatactaacagtcttaaagtttgttgccaacattttccacacaagcaaccaagagaacaggtta

SEQ ID NO: 98076 - DNA, 75 bp, Artificial Sequence
  Synthetic
cacaagcaaccaagagaacaggttaaaatcagtattgagaaaaataaaggaggagtttgaaaagacaaagggttc

SEQ ID NO: 98077 - DNA, 75 bp, Artificial Sequence
  Synthetic
aaatcagtattgagaaaaataaaggaggagtttgaaaagacaaagggttcaatggtatgtgatgtttgcaagtat

SEQ ID NO: 98078 - DNA, 75 bp, Artificial Sequence
  Synthetic
atctcaatgcccttactgttttactcattgtgagcctacagaggcagcatttcaagcccactataaagtctgtca

SEQ ID NO: 98079 - DNA, 75 bp, Artificial Sequence
  Synthetic
ggttactcataggttcagggatgatcttaaaaagactgtcacgcctcaaaactttacaccagggtgttatcggac

SEQ ID NO: 98080 - DNA, 75 bp, Artificial Sequence
  Synthetic
attaaatttatttagatacaagagcagatgttacatttttacaatgtgggtctttcttctcattctagaatctgt

SEQ ID NO: 98081 - DNA, 75 bp, Artificial Sequence
  Synthetic
actgtgggctgctagtgcatcagaaacaccgttaactcctgtttggaatgataatgcccatggtgtaggttctgt

SEQ ID NO: 98082 - DNA, 75 bp, Artificial Sequence
  Synthetic
gcctatgcacacagatcttgagcttgatttttctctaacatccagttctaagtatacatatcgcagaaagctaac

SEQ ID NO: 98083 - DNA, 75 bp, Artificial Sequence
  Synthetic
agtatacatatcgcagaaagctaacaaacccactggaagaggcacaatcaattgatctccatattgaaatagaag

SEQ ID NO: 98084 - DNA, 75 bp, Artificial Sequence
  Synthetic
aaacccactggaagaggcacaatcaattgatctccatattgaaatagaagagcaaacaatcggtgttgatgtgca

SEQ ID NO: 98085 - DNA, 75 bp, Artificial Sequence
  Synthetic
tgctctaggacattggtttgatggccgtctcaaccttaaaacatcctttcactgttatggtgcctgtacaaagta

SEQ ID NO: 98086 - DNA, 75 bp, Artificial Sequence
  Synthetic
cgtctcaaccttaaaacatcctttcactgttatggtgcctgtacaaagtatgagtatccatggcatactgcaaag

SEQ ID NO: 98087 - DNA, 75 bp, Artificial Sequence
  Synthetic
tgcatataaaatcattacaataagatatagtagaagagtctgtgttcaatttggagaagaaaacctttgtaaaat

SEQ ID NO: 98088 - DNA, 75 bp, Artificial Sequence
  Synthetic
catagacatgaatgattgttttgtatctagacatgttaaagtctgtatcatcgggacagtttctaagttttcaca

SEQ ID NO: 98089 - DNA, 75 bp, Artificial Sequence
  Synthetic
aggtgatacactattatttttcgggccacttgagggtggtggcttgatatttaaacattggtgcacatctacatg

SEQ ID NO: 98090 - DNA, 75 bp, Artificial Sequence
  Synthetic
ccacttgagggtggtggcttgatatttaaacattggtgcacatctacatgtcagtttggtgacccaggagatatc

SEQ ID NO: 98091 - DNA, 75 bp, Artificial Sequence
  Synthetic
atgagtccaagggacaagggttttttatgccctgagttcccaggtagttttaggaaaaaatgtaattttgctact

SEQ ID NO: 98092 - DNA, 75 bp, Artificial Sequence
  Synthetic
acccctatctgtgagtatgatggaaatatggtctcaggttacaaaaaagtgatggcaacaattgactctttccaa

SEQ ID NO: 98093 - DNA, 75 bp, Artificial Sequence
  Synthetic
tccttcaacacaagcactatgcacttcactgatgagaggatagagtggaaagaccctgatggaatgttaagggac

SEQ ID NO: 98094 - DNA, 75 bp, Artificial Sequence
  Synthetic
catataaatattttagtaacaaaggatattgattttgataatctgggtgaaaacccctgcaaaattggcttgcag

SEQ ID NO: 98095 - DNA, 75 bp, Artificial Sequence
  Synthetic
acatcttctattgaaggggcatggggttctggtgtaggctttacacttacatgtttagtatcattgacagagtgt

SEQ ID NO: 98096 - DNA, 75 bp, Artificial Sequence
  Synthetic
cctacttttttaacctccattaaggcctgtgacaaagctatttgttatggtgcagaaagtgtgacactaaccaga

SEQ ID NO: 98097 - DNA, 75 bp, Artificial Sequence
  Synthetic
tgcagaaagtgtgacactaaccagaggacaaaatacagtaaaggtgtcaggaaaaggtggtcatagtggttcaac

SEQ ID NO: 98098 - DNA, 75 bp, Artificial Sequence
  Synthetic
tgttcacaaattgggctccatgctgctgcaccccaccttgataaagttaatgggatttctgaaatagaaaacagt

SEQ ID NO: 98099 - DNA, 75 bp, Artificial Sequence
  Synthetic
aatgtggtataaaatgttggtttgtcaaatcaggggaatggatctcagggatatttagtggtaactggattgtgc

SEQ ID NO: 98100 - DNA, 75 bp, Artificial Sequence
  Synthetic
tcattgtcctctgtgtattcttactgttttcattggtcttacttagtatcctttgccctgtcaggaagcataaaa

SEQ ID NO: 98101 - DNA, 75 bp, Artificial Sequence
  Synthetic
aatcatagctagctgatgctgttatcaggttattgtatatagttttaacatatatactaatttttatattccagg

SEQ ID NO: 98102 - DNA, 75 bp, Artificial Sequence
  Synthetic
gctagctgatgctgttatcaggttattgtatatagttttaacatatatactaatttttatattccaggacacttt

SEQ ID NO: 98103 - DNA, 75 bp, Artificial Sequence
  Synthetic
tagtagtagacaccgcaaaagaaagcagtcaagtagcaacatgggggtatggaagtggctagtaatggccagttt

SEQ ID NO: 98104 - DNA, 75 bp, Artificial Sequence
  Synthetic
agtctggccagcttgtacactgagaaatgtgtatgacatgaaaattgaatgcccccatacagtcagttttggtga

SEQ ID NO: 98105 - DNA, 75 bp, Artificial Sequence
  Synthetic
gaatagtgtaattgggtatgtggaattaccccctatgccattagctgatacaacacagttggtgccagaaagctc

SEQ ID NO: 98106 - DNA, 75 bp, Artificial Sequence
  Synthetic
ttgcagtatggacaatcaccagtcattaaataccataacaaaatatacccaggtaagctggagaaagaaggctga

SEQ ID NO: 98107 - DNA, 75 bp, Artificial Sequence
  Synthetic
tcaggcacagtccagccaaaattcatttgaaacagtatctgttgaggttgaccttaaagggacttgtgttttaaa

SEQ ID NO: 98108 - DNA, 75 bp, Artificial Sequence
  Synthetic
gcacaaaatgatagaagagtcataccgtagcagaaagtcaataacatgttatgacctttcctgcaacagtaccta

SEQ ID NO: 98109 - DNA, 75 bp, Artificial Sequence
  Synthetic
ctgcaaacctaccctgtacatgattgtaccaatccatgcatgtaatatgatgaaaagctgtctaattgcactagg

SEQ ID NO: 98110 - DNA, 75 bp, Artificial Sequence
  Synthetic
cccttacagagtgcaggtggtttatgaaagaacttattgcatgacaggggtcttaatagaaggaaaatgttttgt

SEQ ID NO: 98111 - DNA, 75 bp, Artificial Sequence
  Synthetic
tccagaccaaagtgttgtcagtattattaaacatgggatatttgacattgcaagtgttaaaattgtttgtttctt

SEQ ID NO: 98112 - DNA, 75 bp, Artificial Sequence
  Synthetic
tgtggcagttaagggaaacacttataaactgtttgagcaggttaaaaagtcatttgattctacatgcaatgacac

SEQ ID NO: 98113 - DNA, 75 bp, Artificial Sequence
  Synthetic
tgaaaacaaagtacagggatattacatctgtatcgttggaggaaattcagcacccatatatgtaccaacacttga

SEQ ID NO: 98114 - DNA, 75 bp, Artificial Sequence
  Synthetic
tgatttcaggtcaatggaggcattctcagggatctttaggtcaccacatggagaagaccatgatctggctggaga

SEQ ID NO: 98115 - DNA, 75 bp, Artificial Sequence
  Synthetic
agaggttgcttcatattcaattgttggacctgccaatgcaaaagttccacataatgctagctctgacacgttaag

SEQ ID NO: 98116 - DNA, 75 bp, Artificial Sequence
  Synthetic
tctaattgcctactcaggaataccatcttattcctcgctcagtatccttacaagctcaacagaggctaaacatgt

SEQ ID NO: 98117 - DNA, 75 bp, Artificial Sequence
  Synthetic
ttttagtcctggattctttccacaacttaatcatacaaagtgtgataaaactgctataccgctaacttggaccgg

SEQ ID NO: 98118 - DNA, 75 bp, Artificial Sequence
  Synthetic
gatgattgatttaccaggatattatgaagctatacacccttgtacagtattttgtgttttgtcaggtcctggggc

SEQ ID NO: 98119 - DNA, 75 bp, Artificial Sequence
  Synthetic
atcatgtgaggcattttcagaaggtgggattttcaatataacatcccctatgtgcttagtgtcaaaacagaaccg

SEQ ID NO: 98120 - DNA, 75 bp, Artificial Sequence
  Synthetic
attccggctaacaaagcagcaggtcaactttgtgtgtcaaagagtagacatggatattgttgtatactgtaatgg

SEQ ID NO: 98121 - DNA, 75 bp, Artificial Sequence
  Synthetic
ccagagaaaagtgatactaactaagacaatggtcattgggcaatgtatatatactataacaagtttattttcact

SEQ ID NO: 98122 - DNA, 75 bp, Artificial Sequence
  Synthetic
attacctggtgtagcacattcaattgctgttgaattatgtgttccaggcttccatgggtgggcaacagctgcact

SEQ ID NO: 98123 - DNA, 75 bp, Artificial Sequence
  Synthetic
gcttgtcacattctgctttgggtgggttctcatacctgcagttacatttattatactaacagtcttaaaatttgt

SEQ ID NO: 98124 - DNA, 75 bp, Artificial Sequence
  Synthetic
tgcaaatatctttcacacaagtaaccaagagaacaggcttaaatcagtcctaagaaaaataaaggaagaatttga

SEQ ID NO: 98125 - DNA, 75 bp, Artificial Sequence
  Synthetic
gaagacaaaaggatcaatggtgtgtgatgtctgtaaatatgagtgtgaaacttataaggaactgaaagcacatgg

SEQ ID NO: 98126 - DNA, 75 bp, Artificial Sequence
  Synthetic
ggtttcatgtcctcagtcccaatgcccttactgcttcacccactgtgagcctacagaagctgcattccaggccca

SEQ ID NO: 98127 - DNA, 75 bp, Artificial Sequence
  Synthetic
ttacagagtatgtcaagtaacccacaggtttagggatgacctaaaaaagactgttacacctcaaaacttcacacc

SEQ ID NO: 98128 - DNA, 75 bp, Artificial Sequence
  Synthetic
tggctgttatcggacattaaacttatttaggtataagagtagatgttacatctttactatgtgggtttttctctt

SEQ ID NO: 98129 - DNA, 75 bp, Artificial Sequence
  Synthetic
agttctggaatctatattgtgggctgcaagtgcatctgaggttcccttgaatcctatatggaatgataatgcaca

SEQ ID NO: 98130 - DNA, 75 bp, Artificial Sequence
  Synthetic
tggagtgggttctgtaccaatgcatacagatctggagcttgacttctcgttaacatcaagttctaaatacacata

SEQ ID NO: 98131 - DNA, 75 bp, Artificial Sequence
  Synthetic
ccgtagaaagctaacaaacccgcttgaggaaacacaagcaattgatcttcatattgaaatagaggaacagacaat

SEQ ID NO: 98132 - DNA, 75 bp, Artificial Sequence
  Synthetic
cggtgttgatgtacatgctctagggcattggtttgatggtcgtctcaacctaaaaacatcatttcactgctatgg

SEQ ID NO: 98133 - DNA, 75 bp, Artificial Sequence
  Synthetic
cattggtttgatggtcgtctcaacctaaaaacatcatttcactgctatggggcatgcacaaagtatgaataccca

SEQ ID NO: 98134 - DNA, 75 bp, Artificial Sequence
  Synthetic
tggcataccgcaaaatgccattacgaaagagattatcagtatgagacaagttggggctgtaacccatcagactgc

SEQ ID NO: 98135 - DNA, 75 bp, Artificial Sequence
  Synthetic
cctggagtaggtacaggctgtacagcatgtggattataccttgaccaactaaaacctgttggtagtgcatacaag

SEQ ID NO: 98136 - DNA, 75 bp, Artificial Sequence
  Synthetic
attatcacaatcagatatagcaggagagtttgtgtccagtttggtgaagaaaacctttgtaaggttattgatatg

SEQ ID NO: 98137 - DNA, 75 bp, Artificial Sequence
  Synthetic
aatgactgctttgtgtctagacatgtaaaagtgtgcataattggtacagtttctaagttttctcaaggtgataca

SEQ ID NO: 98138 - DNA, 75 bp, Artificial Sequence
  Synthetic
ctattgttctttggaccacttgagggtggtggtctaatattcaagcactggtgcacatctacatgccagtttggt

SEQ ID NO: 98139 - DNA, 75 bp, Artificial Sequence
  Synthetic
gaccctggtgatataatgagtccgagagataaaggatttctatgtcctgaattcccaggcagctttaggaaaaag

SEQ ID NO: 98140 - DNA, 75 bp, Artificial Sequence
  Synthetic
tgcaattttgctactacccctctctgtgagtatgatggaaatatgatctcaggttataagaaagtaatggcaaca

SEQ ID NO: 98141 - DNA, 75 bp, Artificial Sequence
  Synthetic
attgattcttttcaatcattcaatacaagcaccatgcattttactgatgagcgaattgaatggaaagatcctgat

SEQ ID NO: 98142 - DNA, 75 bp, Artificial Sequence
  Synthetic
ggaatgttacgggatcatataaatattttagtaacaaaggatatagactttgataaccttggagaaaacccttgc

SEQ ID NO: 98143 - DNA, 75 bp, Artificial Sequence
  Synthetic
aaaattggcttgcaaacatcctccattgaaggagcatggggctctggtgttggtttcacactcacatgtttagta

SEQ ID NO: 98144 - DNA, 75 bp, Artificial Sequence
  Synthetic
tcattaacagaatgccctacttttctaacttcaattaaagcttgtgacaaagctatctgttatggtgcagagagt

SEQ ID NO: 98145 - DNA, 75 bp, Artificial Sequence
  Synthetic
gttaccctaacaagagggcagaatacagttaaagtatcagggaagggtggacatagtggatcaacatttaagtgc

SEQ ID NO: 98146 - DNA, 75 bp, Artificial Sequence
  Synthetic
tgtcatggagaagattgttcacagactgggcttcatgctgctgcacctcaccttgataaagtcaatggaatctct

SEQ ID NO: 98147 - DNA, 75 bp, Artificial Sequence
  Synthetic
gaaattgaaaatagcaaggtatatgatgatggggctccacagtgtgggataaaatgttggtttgtaaaatctggg

SEQ ID NO: 98148 - DNA, 75 bp, Artificial Sequence
  Synthetic
gagtggatttcaggaatctttagtggcaactggattgtgctcattgtactctgtgtattcctgctattctcattg

SEQ ID NO: 98149 - DNA, 75 bp, Artificial Sequence
  Synthetic
gtattgcttagtgtcctttgtcctgtaagaaagcataaaaagtcatagctagttactcttactgtattattaata

SEQ ID NO: 98150 - DNA, 75 bp, Artificial Sequence
  Synthetic
agttactcttactgtattattaatatgtacagccttaacatatatattaatttgtatattttattatactctatc

SEQ ID NO: 98151 - DNA, 75 bp, Artificial Sequence
  Synthetic
tagtagtagacaccgcaagacaaagcggtcaatcaacaacatggggatatggaagtggctagtaatggccagttt

SEQ ID NO: 98152 - DNA, 75 bp, Artificial Sequence
  Synthetic
agtctggccagcctttgcactaagaaacgtttatgacatgaaaattgagtgcccccacacagtcagttttggaga

SEQ ID NO: 98153 - DNA, 75 bp, Artificial Sequence
  Synthetic
aaacagtgttataggttatgtcgaattgcctcctatgccactggctgacacagcacaaatggtgccagaaagctc

SEQ ID NO: 98154 - DNA, 75 bp, Artificial Sequence
  Synthetic
ctgcagcatggataatcaccaatcattaaatacaatcacaaaatatactcaaatagtatggagaggaaaagctga

SEQ ID NO: 98155 - DNA, 75 bp, Artificial Sequence
  Synthetic
ccagtcacagtccagccagaactcgtttgagacagtgtctactgaggttgatcttaaaggaacctgtgtgttaaa

SEQ ID NO: 98156 - DNA, 75 bp, Artificial Sequence
  Synthetic
atcttaaaggaacctgtgtgttaaaacacaaaatggttgaagaatcataccgcagtcggaagtcaataacttgtt

SEQ ID NO: 98157 - DNA, 75 bp, Artificial Sequence
  Synthetic
acacaaaatggttgaagaatcataccgcagtcggaagtcaataacttgttatgatctatcttgcaatagtaccta

SEQ ID NO: 98158 - DNA, 75 bp, Artificial Sequence
  Synthetic
ctgcaagccaacactttacatgattgtcccaatccatgcatgtaatatgatgaaaagttgtttaattgcactagg

SEQ ID NO: 98159 - DNA, 75 bp, Artificial Sequence
  Synthetic
gccttatagggtccaggttgtttatgaaagaacctactgcatgacaggagttttaattgaggggaaatgttttgt

SEQ ID NO: 98160 - DNA, 75 bp, Artificial Sequence
  Synthetic
tcctgaccagagtgttgtcagtatcatcaagcatgggatttttgatattgcaagcgttcacattgtttgtttctt

SEQ ID NO: 98161 - DNA, 75 bp, Artificial Sequence
  Synthetic
tgttgcggttaaaggaagtacatataaactttttgaacaggttaaaaaatcatttgaatctaactgtaatgatac

SEQ ID NO: 98162 - DNA, 75 bp, Artificial Sequence
  Synthetic
tgagaacaaggtgcagggacattacatatgcattgttgggggaaattcagcacccatatatgtaccaacactgga

SEQ ID NO: 98163 - DNA, 75 bp, Artificial Sequence
  Synthetic
cacccatatatgtaccaacactggatgactttaggtcgatggaagcattctcagggatttttaagtcaccacatg

SEQ ID NO: 98164 - DNA, 75 bp, Artificial Sequence
  Synthetic
gggaagaccatgatctagctggggaagaggttgcatcatattctattgttggacctgctaatgcaaaggtgcccc

SEQ ID NO: 98165 - DNA, 75 bp, Artificial Sequence
  Synthetic
acagtgccagttcagacacactgagcttaattgcctattctggtataccatcttattcttctcttagcatcctca

SEQ ID NO: 98166 - DNA, 75 bp, Artificial Sequence
  Synthetic
cttaattgcctattctggtataccatcttattcttctcttagcatcctcacaagcttaacagaagcaaagcatgt

SEQ ID NO: 98167 - DNA, 75 bp, Artificial Sequence
  Synthetic
tcttattcttctcttagcatcctcacaagcttaacagaagcaaagcatgtattcagccctggattatttcctcag

SEQ ID NO: 98168 - DNA, 75 bp, Artificial Sequence
  Synthetic
cttaaccatacaaagtgtgacaaaactgccataccattgacatggacaggaatgattgaccttcccggatactat

SEQ ID NO: 98169 - DNA, 75 bp, Artificial Sequence
  Synthetic
gaagctgtacatccttgcacagttttctgtgtcctatcaggtcctggagcttcttgtgaggcattctctgaaggg

SEQ ID NO: 98170 - DNA, 75 bp, Artificial Sequence
  Synthetic
ttcttgtgaggcattctctgaagggggaatccttaacataacttctccaatgtgtctagtgtcaaagcagaatcg

SEQ ID NO: 98171 - DNA, 75 bp, Artificial Sequence
  Synthetic
tgtgtctagtgtcaaagcagaatcgctttagattaactgaacagcaggtaaactttgtatgccaaagagttgatg

SEQ ID NO: 98172 - DNA, 75 bp, Artificial Sequence
  Synthetic
ttgacattgttgtgtattgcaatggtcagagaaaagtaatcttaacaaagactttagttattgggcaatgtatat

SEQ ID NO: 98173 - DNA, 75 bp, Artificial Sequence
  Synthetic
acactataacaagcttattttcactactacctggggttgcacattcaattgcagttgaattgtgtgttcctggat

SEQ ID NO: 98174 - DNA, 75 bp, Artificial Sequence
  Synthetic
tccatgggtgggctacagctgcactacttgtcacattctgttttggttgggttcttatcccagcaattacattca

SEQ ID NO: 98175 - DNA, 75 bp, Artificial Sequence
  Synthetic
acttgtcacattctgttttggttgggttcttatcccagcaattacattcattatactgacaatattaaaattcat

SEQ ID NO: 98176 - DNA, 75 bp, Artificial Sequence
  Synthetic
tgcaaatattttccacacaagcaatcaggagaatagactgaagtcagtgctaagaaagataaaggaagaatttga

SEQ ID NO: 98177 - DNA, 75 bp, Artificial Sequence
  Synthetic
aaggacaaagggatcaatggtgtgtgatgtttgtaaatatgaatgtgaaacttataaggaattgaaagcacatgg

SEQ ID NO: 98178 - DNA, 75 bp, Artificial Sequence
  Synthetic
agtatcatgcccacaatcacaatgcccatattgtttcacccactgtgagcccacagaagctgcatttcaggccca

SEQ ID NO: 98179 - DNA, 75 bp, Artificial Sequence
  Synthetic
ccatattgtttcacccactgtgagcccacagaagctgcatttcaggcccattacaaagtctgtcaagtcactcat

SEQ ID NO: 98180 - DNA, 75 bp, Artificial Sequence
  Synthetic
agatttagggatgacttgaagaagacagttacccctcaaaacttcacacctggttgctatcgtacattgaatttg

SEQ ID NO: 98181 - DNA, 75 bp, Artificial Sequence
  Synthetic
tttagatataaaagcaggtgttatatctttacaatgtgggtctttctcttagtcttagagtcaatcctttgggcc

SEQ ID NO: 98182 - DNA, 75 bp, Artificial Sequence
  Synthetic
gctagtgcatcagaaacacctttaaatcctgtttggaatgataatgcccacggggtaggttctgtgcctatgcat

SEQ ID NO: 98183 - DNA, 75 bp, Artificial Sequence
  Synthetic
acagatttggaactagatttttccctgacatcaagctctaagtacacctaccgaaggaagctaacaaatccactt

SEQ ID NO: 98184 - DNA, 75 bp, Artificial Sequence
  Synthetic
gaagagtctcaagcaattaatctccatattgaaatagaagaacagacaattggtgtagatgtacatgctttaggc

SEQ ID NO: 98185 - DNA, 75 bp, Artificial Sequence
  Synthetic
cattggtttgatggccgccttaatcttaagacatccttccactgttatggtgcatgtacaaaatatgaataccca

SEQ ID NO: 98186 - DNA, 75 bp, Artificial Sequence
  Synthetic
tgcatgtacaaaatatgaatacccatggcatactgcaaaatgccattatgaaagggactatcaatatgagacaag

SEQ ID NO: 98187 - DNA, 75 bp, Artificial Sequence
  Synthetic
ctggggttgtaacccatcagattgtcctggtgtaggtacaggttgtactgcatgtgggttatatcttgatcaatt

SEQ ID NO: 98188 - DNA, 75 bp, Artificial Sequence
  Synthetic
catgtgggttatatcttgatcaattaaaacctgttggcagtgcctacaaaattatcacaataagatatagcagaa

SEQ ID NO: 98189 - DNA, 75 bp, Artificial Sequence
  Synthetic
gggtctgtgtccaatttggggaagagaatctctgtaagattatagatatgaatgattgcttcgtgtctagacatg

SEQ ID NO: 98190 - DNA, 75 bp, Artificial Sequence
  Synthetic
aatgattgcttcgtgtctagacatgttaaagtttgtataattggcacagtttcgaaattctctcaaggtgataca

SEQ ID NO: 98191 - DNA, 75 bp, Artificial Sequence
  Synthetic
ttaaagtttgtataattggcacagtttcgaaattctctcaaggtgatacactattattctttggaccacttgaag

SEQ ID NO: 98192 - DNA, 75 bp, Artificial Sequence
  Synthetic
gtggtggtttaatattcaaacattggtgtacatcaacatgtcagtttggggatcctggagatatcatgagtccaa

SEQ ID NO: 98193 - DNA, 75 bp, Artificial Sequence
  Synthetic
gtgtacatcaacatgtcagtttggggatcctggagatatcatgagtccaagagataaaggatttttatgtcctga

SEQ ID NO: 98194 - DNA, 75 bp, Artificial Sequence
  Synthetic
attccctggtagttttagaaagaagtgtaactttgcaaccactcctatttgtgagtatgatgggaatatggtctc

SEQ ID NO: 98195 - DNA, 75 bp, Artificial Sequence
  Synthetic
aggttataagaaagtaatggccacaattgattctttccaatccttcaatactagtactatgcatttcactgatga

SEQ ID NO: 98196 - DNA, 75 bp, Artificial Sequence
  Synthetic
gaggatagaatggaaagatcctgatgggatgttgagagaccatataagcatcttggtaacaaaggatattgattt

SEQ ID NO: 98197 - DNA, 75 bp, Artificial Sequence
  Synthetic
tgataaccttggtgagaacccatgcaaaattggattacaaacatcatccattgaaggggcatggggctctggtgt

SEQ ID NO: 98198 - DNA, 75 bp, Artificial Sequence
  Synthetic
ttgaaggggcatggggctctggtgtaggatatacacttacatgtttgatctcactgacagagtgccctactttct

SEQ ID NO: 98199 - DNA, 75 bp, Artificial Sequence
  Synthetic
tgacctcaatcaaggcttgtgataaagcaatctgttatggtgcagagagtgtgacattaacaagggggcagaaca

SEQ ID NO: 98200 - DNA, 75 bp, Artificial Sequence
  Synthetic
cagttaaggtgtcagggaaaggcggacatagcggttcatcctttaaatgctgtcatggagaagactgctctcaga

SEQ ID NO: 98201 - DNA, 75 bp, Artificial Sequence
  Synthetic
taggactccatgcagctgcaccacatcttgacaaagtcaacggaatttctgaaatagaaaacagtaaagtgtttg

SEQ ID NO: 98202 - DNA, 75 bp, Artificial Sequence
  Synthetic
gaaatagaaaacagtaaagtgtttgatgatggggcaccacaatgtggaataaagtgctggtttgtgaaatcagga

SEQ ID NO: 98203 - DNA, 75 bp, Artificial Sequence
  Synthetic
atgatggggcaccacaatgtggaataaagtgctggtttgtgaaatcaggagaatggatttctgggatttttaatg

SEQ ID NO: 98204 - DNA, 75 bp, Artificial Sequence
  Synthetic
gtaactggattgtgcttattgtcctgtgtgtcttcttactattctcactggtattacttagtattctctgtcctg

SEQ ID NO: 98205 - DNA, 75 bp, Artificial Sequence
  Synthetic
ttagaaaacataagaagtcatgagtcatcaggtatgttaacatactgttatggataactttaacatatatattaa

SEQ ID NO: 98206 - DNA, 75 bp, Artificial Sequence
  Synthetic
catcaggtatgttaacatactgttatggataactttaacatatatattaatttttatatctcattatattttatc

SEQ ID NO: 98207 - DNA, 75 bp, Artificial Sequence
  Synthetic
atagtagctttctaaccacaaaacttagatttttcttctgtatgatgtcttaacatcttgcggtgtctactacta

SEQ ID NO: 98208 - DNA, 75 bp, Artificial Sequence
  Synthetic
tagtagtatactccctaaaaagctactgtaacaacgatggcaactatggaggaactgcagaaggaaatcaatgcc

SEQ ID NO: 98209 - DNA, 75 bp, Artificial Sequence
  Synthetic
ctgtaacaacgatggcaactatggaggaactgcagaaggaaatcaatgcccatgagggccaattggtaatagcca

SEQ ID NO: 98210 - DNA, 75 bp, Artificial Sequence
  Synthetic
catgagggccaattggtaatagccaggcagaaggtgagggatgcagaaaaacagtatgagaaggacccagatgag

SEQ ID NO: 98211 - DNA, 75 bp, Artificial Sequence
  Synthetic
ggcagaaggtgagggatgcagaaaaacagtatgagaaggacccagatgagctgaataagagaacattaacagaca

SEQ ID NO: 98212 - DNA, 75 bp, Artificial Sequence
  Synthetic
gagaaggggttgcagcatctatccaggccaaaattgatgaattaaagaggcagctagcagataggattgcaactg

SEQ ID NO: 98213 - DNA, 75 bp, Artificial Sequence
  Synthetic
cagctagcagataggattgcaactggaaagaaccttggaaaggaacaggatcccaccggggttgagcctggagac

SEQ ID NO: 98214 - DNA, 75 bp, Artificial Sequence
  Synthetic
catctgaaagagagatcaatgctcagctatggaaatgtcctggatctgaaccacctggatattgatgaacctact

SEQ ID NO: 98215 - DNA, 75 bp, Artificial Sequence
  Synthetic
ggacagaccgcagattggctcagcattgtcatatatctaacatcctttgttgtcccaatacttctgaaagcccta

SEQ ID NO: 98216 - DNA, 75 bp, Artificial Sequence
  Synthetic
tgtcccaatacttctgaaagccctatacatgctgacaacaagagggaggcaaacaaccaaggataataaagggac

SEQ ID NO: 98217 - DNA, 75 bp, Artificial Sequence
  Synthetic
cagaattcgattcaaggatgacagctcttttgaggatgttaatgggattcggaagccaaagcatttatatgtgtc

SEQ ID NO: 98218 - DNA, 75 bp, Artificial Sequence
  Synthetic
tcttttgaggatgttaatgggattcggaagccaaagcatttatatgtgtccttgcccaatgcccagtcaagcatg

SEQ ID NO: 98219 - DNA, 75 bp, Artificial Sequence
  Synthetic
ggaagccaaagcatttatatgtgtccttgcccaatgcccagtcaagcatgaaggcagaagacatcacaccaggaa

SEQ ID NO: 98220 - DNA, 75 bp, Artificial Sequence
  Synthetic
ggtataggacagcaatctgtggactctaccctgcacagattaaggccagacaaatgattagtcctgtcatgagtg

SEQ ID NO: 98221 - DNA, 75 bp, Artificial Sequence
  Synthetic
tgattgggtttttggcacttgcaaaggactggagtgatcgtatcgagcaatggttgagtgaaccctgtaagctgc

SEQ ID NO: 98222 - DNA, 75 bp, Artificial Sequence
  Synthetic
ggactggagtgatcgtatcgagcaatggttgagtgaaccctgtaagctgctcccggatacagcagcagtgagcct

SEQ ID NO: 98223 - DNA, 75 bp, Artificial Sequence
  Synthetic
ccatggaggccctgcaacaaatagggactatttacggcagcgccaagtagcactgggtaatatggaaacaaaaga

SEQ ID NO: 98224 - DNA, 75 bp, Artificial Sequence
  Synthetic
gtcaaaagccatacgccagcatgctgaatctgcaggctgtagcatgattgaagatatcgagtcaccatcatcgat

SEQ ID NO: 98225 - DNA, 75 bp, Artificial Sequence
  Synthetic
atgggtttttgctggagcacctgaccgttgcccaccaacatgcttattcattgcagggattgctgaacttggagc

SEQ ID NO: 98226 - DNA, 75 bp, Artificial Sequence
  Synthetic
attcttctctatcctgcaggacatgcggaatacaattatggcctcaaagacagtgggaacatctgaagaaaagtt

SEQ ID NO: 98227 - DNA, 75 bp, Artificial Sequence
  Synthetic
cagtgggaacatctgaagaaaagttacgaaagaaatcatcattctatcagtcttatctcaggcgaacacagtcga

SEQ ID NO: 98228 - DNA, 75 bp, Artificial Sequence
  Synthetic
tcttatctcaggcgaacacagtcgatgggaatacaactagaccagagaattatagtgctctttatggtcgcctgg

SEQ ID NO: 98229 - DNA, 75 bp, Artificial Sequence
  Synthetic
ggtaaagaggcagtagacaatttccaccttggagatgatatggatcctgagttaagaacattggcacagagtttg

SEQ ID NO: 98230 - DNA, 75 bp, Artificial Sequence
  Synthetic
attgatgttaaagtgaaggaaatctctaaccaagagcctttaaaactttaatcagtggatgtataacccttatta

SEQ ID NO: 98231 - DNA, 75 bp, Artificial Sequence
  Synthetic
ctaaccaagagcctttaaaactttaatcagtggatgtataacccttattatgtgatcattatatactactgaatt

SEQ ID NO: 98232 - DNA, 75 bp, Artificial Sequence
  Synthetic
ttatcaggggaatcatcatatcagggtatgggtacatttatgggtgggaatcattactcagagggtgggtcagtt

SEQ ID NO: 98233 - DNA, 75 bp, Artificial Sequence
  Synthetic
aatccgttgtgggtgggtttaggtccaggctgccttaagtagcctttttctgtatatatggatgtagatttcatt

SEQ ID NO: 98234 - DNA, 75 bp, Artificial Sequence
  Synthetic
tgatcattgaactaatcatgctctctttcctctttctctggctttttctgcttactaacaacaacattctacctc

SEQ ID NO: 98235 - DNA, 75 bp, Artificial Sequence
  Synthetic
aacacaaaactacctcaacttaactacctcatttacttgctccttgattgtctttttagggagtatactactact

SEQ ID NO: 98236 - DNA, 75 bp, Artificial Sequence
  Synthetic
agtatggccagcttatacactaagaaatgtgtatgacatgaaaattgagtgcccccacacagtcagctttggtga

SEQ ID NO: 98237 - DNA, 75 bp, Artificial Sequence
  Synthetic
aaacagcgtgatagggtatgtggaattaccccctatgccactggctgatacagcacaaatggtgcctgaaagctc

SEQ ID NO: 98238 - DNA, 75 bp, Artificial Sequence
  Synthetic
ttgtaacatggacaaccaccaatcaatgaatacaataacaaaatatacccaggtaagctggaggggtaaggctga

SEQ ID NO: 98239 - DNA, 75 bp, Artificial Sequence
  Synthetic
tcaggcacaagccagtcagaattcatttgaagcagtgtctgctgaggttgaccttaaaggaacttgtgttttgaa

SEQ ID NO: 98240 - DNA, 75 bp, Artificial Sequence
  Synthetic
gcacaaaatgctagaagaatcataccgcagcagaaaatcaataacatgttatgacctttcctgcaacaataccta

SEQ ID NO: 98241 - DNA, 75 bp, Artificial Sequence
  Synthetic
ctgtaagcccactctgtatatgattgtaccaattcatgcatgtaacatgatgaaaagttgcttaattgcactagg

SEQ ID NO: 98242 - DNA, 75 bp, Artificial Sequence
  Synthetic
gccttatagagtacaagtaatttatgaaagaacctactgcatgacaggggtcctgatagaaggaaaatgttttgt

SEQ ID NO: 98243 - DNA, 75 bp, Artificial Sequence
  Synthetic
tccagaccaaagtgtagttagtatcatcaagcatgggatctttgatatagcaagtgttcatattgtttgtttctt

SEQ ID NO: 98244 - DNA, 75 bp, Artificial Sequence
  Synthetic
tgtggcagttaaaggaaacacatataaactttttgaacaggtcaagaagtcgtttcaatcgacatgcaatgatac

SEQ ID NO: 98245 - DNA, 75 bp, Artificial Sequence
  Synthetic
tgaaaataaagtacaaggatattatatctgcatcgtgggagggaactctgcacctatatatgtgccaacacttga

SEQ ID NO: 98246 - DNA, 75 bp, Artificial Sequence
  Synthetic
tgatttcaggtccatggaggcattttcagggatttttagatcaccacacggagaggaccatgatctagctggaga

SEQ ID NO: 98247 - DNA, 75 bp, Artificial Sequence
  Synthetic
agagattgcttcttactctattgttggacctgctaatgcaaaagtgccccacagtgctagctcagacacattaag

SEQ ID NO: 98248 - DNA, 75 bp, Artificial Sequence
  Synthetic
cctgattgcctattctggtatcccatcctactcttcacttagcatccttacaggctcaacagaagctaagcatgt

SEQ ID NO: 98249 - DNA, 75 bp, Artificial Sequence
  Synthetic
atttagccccggtttctttccacagcttaaccatacaaagtgtgataagactgccatcccacttacgtggacagg

SEQ ID NO: 98250 - DNA, 75 bp, Artificial Sequence
  Synthetic
gatgattgacttgccaggatactatgaggctatacacccttgtacagttttttgtgttctatcaggccccggggc

SEQ ID NO: 98251 - DNA, 75 bp, Artificial Sequence
  Synthetic
atcatgtgaagcattctctgaaggtggaatcttcaacataacatcccctatgtgcttagtatcaaaacaaaatcg

SEQ ID NO: 98252 - DNA, 75 bp, Artificial Sequence
  Synthetic
attccggttaacagaacagcaagtaaacttcgtatgtcaaagggttgatatggatattattgtatattgcaatgg

SEQ ID NO: 98253 - DNA, 75 bp, Artificial Sequence
  Synthetic
ccagaggaaagtaatacttacaaaaaccttagtcataggacagtgtatatatactataacaagtttattctcact

SEQ ID NO: 98254 - DNA, 75 bp, Artificial Sequence
  Synthetic
gctacctggggtggcacattccattgctgttgaactttgtgtgcctgggttccatggctgggctacagctgccct

SEQ ID NO: 98255 - DNA, 75 bp, Artificial Sequence
  Synthetic
ccttgtcacattctgcttcgggtgggtcctcataccagcaataacattcattatcctgacagttttaaagtttat

SEQ ID NO: 98256 - DNA, 75 bp, Artificial Sequence
  Synthetic
tgcaaatatctttcatacaagtaaccaagagaataggcttagagcagtattaagaaaaataaaggaagaattcga

SEQ ID NO: 98257 - DNA, 75 bp, Artificial Sequence
  Synthetic
gaagacaaaagggtcaatggtgtgtgatgtctgtaagtatgagtgtgaaacttataaagaattgaaggcacatgg

SEQ ID NO: 98258 - DNA, 75 bp, Artificial Sequence
  Synthetic
ggtttcatgccctcagtcccaatgtccatactgcttcactcattgtgaacctacagaagcagcattccaggctca

SEQ ID NO: 98259 - DNA, 75 bp, Artificial Sequence
  Synthetic
ttatagagtatgtcaagtcacccacagattcagggatgacttaaagaagacggtcactcctcaaaattttacacc

SEQ ID NO: 98260 - DNA, 75 bp, Artificial Sequence
  Synthetic
tggctgctataggacactaaacctgtttagatataaaagtagatgttatatctttacaatgtgggtctgcctcct

SEQ ID NO: 98261 - DNA, 75 bp, Artificial Sequence
  Synthetic
agtcctagagtcaatactttgggctgccagtgcttcagaagtaccattaaatcctgtatggaacgataatgccca

SEQ ID NO: 98262 - DNA, 75 bp, Artificial Sequence
  Synthetic
tggggtaggatcagtaccgatgcacacagacttagagctggacttttccctaacatcaagttcaaagtatacata

SEQ ID NO: 98263 - DNA, 75 bp, Artificial Sequence
  Synthetic
tcgcagaaggctaacaaatccacttgaagaaacacaagcaattaaccttcatattgaaatagaagaacaaacaat

SEQ ID NO: 98264 - DNA, 75 bp, Artificial Sequence
  Synthetic
tggtgttgatgtgcatgccttgggtcattggtttgacggtcggctaaaccttaaaacatctttccattgttacgg

SEQ ID NO: 98265 - DNA, 75 bp, Artificial Sequence
  Synthetic
tgcctgcacaaaatatgagtatccttggcacactgcaaaatgtcactatgaacgggattaccagtatgagacaag

SEQ ID NO: 98266 - DNA, 75 bp, Artificial Sequence
  Synthetic
ttggggctgcaacccagctgattgtccaggggtgggaacaggttgtacagcatgtggactatatattgatcagtt

SEQ ID NO: 98267 - DNA, 75 bp, Artificial Sequence
  Synthetic
aaagcctgttggtagtgcatataaaattattacaatcagatatagcaggaaagtgtgtgttcagtttggggagga

SEQ ID NO: 98268 - DNA, 75 bp, Artificial Sequence
  Synthetic
aaatctatgtaaggtgatcgacatgaatgattgctttgtctctagacatgtcaaagtatgtataatcggcacagt

SEQ ID NO: 98269 - DNA, 75 bp, Artificial Sequence
  Synthetic
ctccaaattctcccaaggtgatacactattattctttggaccacttgagggcggtggtttaatatttaaacattg

SEQ ID NO: 98270 - DNA, 75 bp, Artificial Sequence
  Synthetic
gtgcacatctacatgtcagtttggagaccctggagatattatgagtccaagggataagggatttttatgccctga

SEQ ID NO: 98271 - DNA, 75 bp, Artificial Sequence
  Synthetic
atttcctgggagttttaggaagaaatgtaattttgctactacccctctttgtgagtatgatggtaatatggtttc

SEQ ID NO: 98272 - DNA, 75 bp, Artificial Sequence
  Synthetic
aggttacaagaaagtaatggcaacaattgattctttccaatcctttaataccagtactatgcacttcactgatga

SEQ ID NO: 98273 - DNA, 75 bp, Artificial Sequence
  Synthetic
gagaatagagtggaaagaccctgatggaatgttaagggaccatataaacattctggtaactaaggacatcgactt

SEQ ID NO: 98274 - DNA, 75 bp, Artificial Sequence
  Synthetic
tgataacctgggtgaaaacccttgtaagattggcttacaaacatcttcaattgaaggggcttggggttctggtgt

SEQ ID NO: 98275 - DNA, 75 bp, Artificial Sequence
  Synthetic
aggctttacacttacatgtctagtatctttaacagagtgtcctactttcttaacctcgattaaggcttgtgacaa

SEQ ID NO: 98276 - DNA, 75 bp, Artificial Sequence
  Synthetic
agccatttgttatggtgcagaaagtgtggcgttaacaagaggccagaacacagttaaggtgtcaggcaaaggtgg

SEQ ID NO: 98277 - DNA, 75 bp, Artificial Sequence
  Synthetic
tcatagcggttcaacttttaaatgctgccatggagaagagtgttcacaaattggactccatgctgctgcacccca

SEQ ID NO: 98278 - DNA, 75 bp, Artificial Sequence
  Synthetic
ccttgataaagtcaatgggatttcagaagtcgagaacaataaagtatatgatgatggggcaccccaatgtggggt

SEQ ID NO: 98279 - DNA, 75 bp, Artificial Sequence
  Synthetic
aaagtgctggtttgtaaaatctggagaatggatctcagggatctttagtggaaattggattgtgcttattgtcct

SEQ ID NO: 98280 - DNA, 75 bp, Artificial Sequence
  Synthetic
ttgtgtattcttactgttttcactggtgttactcagtgtcctttgtcccgtaagaaagcataagaagtcatagct

SEQ ID NO: 98281 - DNA, 75 bp, Artificial Sequence
  Synthetic
aatcaaggtcatcccctttgtatcatatataactttatcacatatattaatttgtatttcctattataacctatc

SEQ ID NO: 98282 - DNA, 75 bp, Artificial Sequence
  Synthetic
taacacactaaaaaaaatagtagctgtctaaccatataacttagatttttcttctgtatgatgtcttaacatcct

SEQ ID NO: 98283 - DNA, 75 bp, Artificial Sequence
  Synthetic
atagtagctgtctaaccatataacttagatttttcttctgtatgatgtcttaacatcctgcggagtctactacta

SEQ ID NO: 98284 - DNA, 75 bp, Artificial Sequence
  Synthetic
catgagggccagttagtgatagccaggcaaaaggtaagagatgcagaaaagcaatatgaaaaagacccagatgag

SEQ ID NO: 98285 - DNA, 75 bp, Artificial Sequence
  Synthetic
ctgaacaaaagaacattgacagacagggagggagttgcagcatccatccaggcaaagattgatgagcttaagcga

SEQ ID NO: 98286 - DNA, 75 bp, Artificial Sequence
  Synthetic
caactagcagacagaattgcaacagggaaaaatcttggcaaggagcaagacccgacaggagttgagcccggagac

SEQ ID NO: 98287 - DNA, 75 bp, Artificial Sequence
  Synthetic
cacctaaaagagagatcaatgctcagctatggaaatgtcttggatctaaaccatctggatattgatgagccaaca

SEQ ID NO: 98288 - DNA, 75 bp, Artificial Sequence
  Synthetic
ggacagactgcagattggttgagcattgtcatctatttgacatcatttgttgttccaatactcctgaaagccctg

SEQ ID NO: 98289 - DNA, 75 bp, Artificial Sequence
  Synthetic
tacatgttaacaacaagaggaaggcaaaccaccaaggacaacaaagggaccagaattcggttcaaggatgatagc

SEQ ID NO: 98290 - DNA, 75 bp, Artificial Sequence
  Synthetic
tcatttgaggatgttaatggtatccgaaagccaaaacatctgtatttatctctacccaatgcacagtcaagcatg

SEQ ID NO: 98291 - DNA, 75 bp, Artificial Sequence
  Synthetic
aaggcagaagagattacacctggtaggtaccggacagcaatctgtggtctctatcctgcacaaattaaggcaagg

SEQ ID NO: 98292 - DNA, 75 bp, Artificial Sequence
  Synthetic
caaatgatcagtccagtcatgagtgtgattggatttttagcactggctaaggattggagtgaccgtattgagcag

SEQ ID NO: 98293 - DNA, 75 bp, Artificial Sequence
  Synthetic
tggctaagtgagccttgcaaactcctcccagatgcagctgcagtcagccttcatggtggtcctgcaacaaataga

SEQ ID NO: 98294 - DNA, 75 bp, Artificial Sequence
  Synthetic
gactacttacggcaacgtcaggtagcattaggcaatatggagacaaaagaatcaaaagccatccgccaacatgca

SEQ ID NO: 98295 - DNA, 75 bp, Artificial Sequence
  Synthetic
gaaactgcaggttgtagcatgattgacgatattgagtcaccatcatcgatatgggtatttgctggggcacctgac

SEQ ID NO: 98296 - DNA, 75 bp, Artificial Sequence
  Synthetic
cgttgtccacctacatgtctgtttatagcaggaatcgcagagcttggagcattcttctctatattgcaggacatg

SEQ ID NO: 98297 - DNA, 75 bp, Artificial Sequence
  Synthetic
aggaacacaattatggcatctaaaacagtgggaacatctgaggaaaagttaagaaagaagtcttcattctaccag

SEQ ID NO: 98298 - DNA, 75 bp, Artificial Sequence
  Synthetic
tcttatctcaggagaacacagtcaatgggaatacagctagatcagagaataattgtgctctttatggttgcatgg

SEQ ID NO: 98299 - DNA, 75 bp, Artificial Sequence
  Synthetic
ggaaaagaagcagttgataatttccatctcggagatgatatggatcctgagctaagaacactagcacagagcctg

SEQ ID NO: 98300 - DNA, 75 bp, Artificial Sequence
  Synthetic
attgatgtgaaagtgaaggagatctctaaccaagagcctttaaaactataatcagtgaatgtataacccttatta

SEQ ID NO: 98301 - DNA, 75 bp, Artificial Sequence
  Synthetic
tgtgatttatatactactgaatcattatcaatcatatttacactattattatcaggggaatcattatatcagggt

SEQ ID NO: 98302 - DNA, 75 bp, Artificial Sequence
  Synthetic
atggggcacatttatgggtgggaattattactcaggggtgggtcagttaatccgttgtgggtgggtttaggtgta

SEQ ID NO: 98303 - DNA, 75 bp, Artificial Sequence
  Synthetic
ggctgccttaagtagccattttctgtatatatggatgtagatttcaattgatccttgaactaatcctgctctctt

SEQ ID NO: 98304 - DNA, 75 bp, Artificial Sequence
  Synthetic
tccttttcctcctgctctctctgcttactaacaacaacattctacctcatcacaaaactacctcaacctaactac

SEQ ID NO: 98305 - DNA, 75 bp, Artificial Sequence
  Synthetic
tcacaaaactacctcaacctaactacctcatttgctttttccttgattgtctttttagggagcatactactacta

SEQ ID NO: 98306 - DNA, 75 bp, Artificial Sequence
  Synthetic
tagtagtaggctccctaaagagctactataacaacgatggcaactatggaggaactgcagagggaaatcaatgcc

SEQ ID NO: 98307 - DNA, 75 bp, Artificial Sequence
  Synthetic
tgtcccgatacttctgaaggccttatatatgctcacaacaagagggaggcagacaactaaagataacaaagggac

SEQ ID NO: 98308 - DNA, 75 bp, Artificial Sequence
  Synthetic
cgctgtccaccgacatgcttgtttattgcagggattgctgaacttggcgcattcttctccattttacaggacatg

SEQ ID NO: 98309 - DNA, 75 bp, Artificial Sequence
  Synthetic
ctaaccaagagcctttaaaactataattagtgaatgtataacccttattatgtgatcattatatactactgaatc

SEQ ID NO: 98310 - DNA, 75 bp, Artificial Sequence
  Synthetic
cctcaacacaaaactaccctaactacctcattagcttgctccttgattgtctttttagggagcatccttctacta

SEQ ID NO: 98311 - DNA, 75 bp, Artificial Sequence
  Synthetic
tcctgaccagagtgtagttagtatcattaaacatgggatcttcgatattgcaagtgtccacattgtttgcttttt

SEQ ID NO: 98312 - DNA, 75 bp, Artificial Sequence
  Synthetic
ttatagagtttgtcaagtcactcatcgatttagagatgacctaaagaagactgttactccccagaactttacacc

SEQ ID NO: 98313 - DNA, 75 bp, Artificial Sequence
  Synthetic
tgggtgttaccgtacattaaatttatttagatataaaagtaggtgttacattttcacaatgtggatctgtctttt

SEQ ID NO: 98314 - DNA, 75 bp, Artificial Sequence
  Synthetic
cctggggtcggcacaggctgtacagcatgtgggttatatctagaccagttaaaaccagttggcagtgcatacaaa

SEQ ID NO: 98315 - DNA, 75 bp, Artificial Sequence
  Synthetic
catgtgggttatatctagaccagttaaaaccagttggcagtgcatacaaaattattacaataaggtatagtagga

SEQ ID NO: 98316 - DNA, 75 bp, Artificial Sequence
  Synthetic
ttagaaaacacaaaaaatcataaccaactgatgttctttcatgttatcatgtgtaaccctgatatatatatttct

SEQ ID NO: 98317 - DNA, 75 bp, Artificial Sequence
  Synthetic
gtgtaaccctgatatatatatttctttttatattctaatacatactatctaatacactaaaaaaaatagtagctg

SEQ ID NO: 98318 - DNA, 75 bp, Artificial Sequence
  Synthetic
atagtagctgtctaaccataaaacttagatttctcttctgtatgatgtcttaacatcttgcggagtctactacta

SEQ ID NO: 98319 - DNA, 75 bp, Artificial Sequence
  Synthetic
catagtgctctttatggttgcctggggtaaagaggctgtggataatttccaccttggagatgatatggatcctga

SEQ ID NO: 98320 - DNA, 75 bp, Artificial Sequence
  Synthetic
aatccgttgtgggtgggtttaggttcaggctgccttaagtagcctttttttgtatatatgaatgcagatttcatt

SEQ ID NO: 98321 - DNA, 75 bp, Artificial Sequence
  Synthetic
cttactaacaacaacattctacctcaacacaacctaactacctcattagcttgctccttgattgtctttttaggg

SEQ ID NO: 98322 - DNA, 75 bp, Artificial Sequence
  Synthetic
cattctacctcaacacaacctaactacctcattagcttgctccttgattgtctttttagggagcatactactact

SEQ ID NO: 98323 - DNA, 75 bp, Artificial Sequence
  Synthetic
tactagaataacgatggcaactatggaggaattgcagagggaaatcaatgcccacgagggtcaactggtgatagc

SEQ ID NO: 98324 - DNA, 75 bp, Artificial Sequence
  Synthetic
cccacgagggtcaactggtgatagccaggcagaaggttagggatgcagaaaagcagtatgaaaaggatccagatg

SEQ ID NO: 98325 - DNA, 75 bp, Artificial Sequence
  Synthetic
caagcaaagattgatgaattaaagaggcaactggcagatcggatcgcaaccgggaagaatcttggaaaggaacaa

SEQ ID NO: 98326 - DNA, 75 bp, Artificial Sequence
  Synthetic
tgtatatgttaacaacaagggggaggcagaccaccaaggacaataagggaactcggattcgattcaaggatgata

SEQ ID NO: 98327 - DNA, 75 bp, Artificial Sequence
  Synthetic
tagatatagaacagcaatttgtgggctttatcctgcacaaattaaggcaagacagatgattagtcctgtcatgag

SEQ ID NO: 98328 - DNA, 75 bp, Artificial Sequence
  Synthetic
tcttccagacacagcagcagttagcctccttggtggtcctgctaccaacagggactacctacggcagcggcaagt

SEQ ID NO: 98329 - DNA, 75 bp, Artificial Sequence
  Synthetic
ctgcggaagaaatcttcattctatcagtcttatctcaggagaacacaatcaatgggaatacaactggatcagagg

SEQ ID NO: 98330 - DNA, 75 bp, Artificial Sequence
  Synthetic
ccacctaggagatgatatggatcctgagctgcgaacactagcacagagcctgattgatgttaaagtgaaggaaat

SEQ ID NO: 98331 - DNA, 75 bp, Artificial Sequence
  Synthetic
gagctgcgaacactagcacagagcctgattgatgttaaagtgaaggaaatttctaaccaagagcctttaaaattg

SEQ ID NO: 98332 - DNA, 75 bp, Artificial Sequence
  Synthetic
gggtaagggcacatttatgggtgggaatcattactcagagggtgggtcagttaatccgttgtgggtgggtttagt

SEQ ID NO: 98333 - DNA, 75 bp, Artificial Sequence
  Synthetic
ctttctctgcttactaacaacaacattctacctcaacacaaaactacctcaactaaactacctcattaaattgct

SEQ ID NO: 98334 - DNA, 75 bp, Artificial Sequence
  Synthetic
atccagtatggaacgacaatgcccatggggttgggtccatacccatgcacacagatttagagctagacttttcct

SEQ ID NO: 98335 - DNA, 75 bp, Artificial Sequence
  Synthetic
atagtagctttctaaccacaaaacttagatttttcttctgtatgatgtcttaacatcttgcggagtctactacta

SEQ ID NO: 98336 - DNA, 75 bp, Artificial Sequence
  Synthetic
tagtagtagactccctaaagagctactagaacaacgatggcaactatggaggaattacagagggaaatcaatgcc

SEQ ID NO: 98337 - DNA, 75 bp, Artificial Sequence
  Synthetic
catgagggtcaattagtgatagccaggcagaaggtgagggatgcagaaaaacagtatgaaaaggatccagatgag

SEQ ID NO: 98338 - DNA, 75 bp, Artificial Sequence
  Synthetic
ggcagaaggtgagggatgcagaaaaacagtatgaaaaggatccagatgagttgaacaagagagcattaactaacc

SEQ ID NO: 98339 - DNA, 75 bp, Artificial Sequence
  Synthetic
gagagggcgttgcagtatctatccaggcaaaaattgatgagttaaaaatgcaactggcagataggattgcaactg

SEQ ID NO: 98340 - DNA, 75 bp, Artificial Sequence
  Synthetic
ggaaaaaccttgggaaggaacaagatccaacaggggtggagcctggagaccatctgaaagagaggtcaatgctca

SEQ ID NO: 98341 - DNA, 75 bp, Artificial Sequence
  Synthetic
gttatggtaatgtgctggatttaaaccatttggatattgatgaacctacaggacagacagcagactggctgagca

SEQ ID NO: 98342 - DNA, 75 bp, Artificial Sequence
  Synthetic
ggacagacagcagactggctgagcatcatcgtctatcttacatcctttgtcgtcccgatacttctgaaagctctg

SEQ ID NO: 98343 - DNA, 75 bp, Artificial Sequence
  Synthetic
tatatgttgacaacaagggggaggcaaactaccaaggataataaagggacccggattcgatttaaggatgatagc

SEQ ID NO: 98344 - DNA, 75 bp, Artificial Sequence
  Synthetic
tcgttcgaggatgttaacggtatccggaaaccaaaacatctttacgtgtccttgccaaatgcacagtcaagcatg

SEQ ID NO: 98345 - DNA, 75 bp, Artificial Sequence
  Synthetic
aaggcagaagagattacacctggtagatatagaacagcagtctgtgggctctaccctgcacagattaaggcacgg

SEQ ID NO: 98346 - DNA, 75 bp, Artificial Sequence
  Synthetic
cagatgatcagtccagttatgagtgtaattggttttctagcattagcaaaggactggagtgatcgtatcgaacaa

SEQ ID NO: 98347 - DNA, 75 bp, Artificial Sequence
  Synthetic
taattggttttctagcattagcaaaggactggagtgatcgtatcgaacaatggttaattgaaccttgcaagcttc

SEQ ID NO: 98348 - DNA, 75 bp, Artificial Sequence
  Synthetic
ttccagatacagcagcagttagcctccttggtggtcctgcaacaaacagggactacttacggcagcggcaagtgg

SEQ ID NO: 98349 - DNA, 75 bp, Artificial Sequence
  Synthetic
cattaggcaatatggagacaaaggagtcaaaggctatacgccagcatgcagaagcagctggctgtagcatgattg

SEQ ID NO: 98350 - DNA, 75 bp, Artificial Sequence
  Synthetic
aagatattgagtcaccatcatcaatatgggtttttgctggagcaccagaccgttgtccaccaacatgtttgttta

SEQ ID NO: 98351 - DNA, 75 bp, Artificial Sequence
  Synthetic
atgggtttttgctggagcaccagaccgttgtccaccaacatgtttgtttatagcaggtattgctgagcttggggc

SEQ ID NO: 98352 - DNA, 75 bp, Artificial Sequence
  Synthetic
atttttttccatcctgcaggacatgcgaaatacaatcatggcatctaagacagttggaacatctgaggagaagct

SEQ ID NO: 98353 - DNA, 75 bp, Artificial Sequence
  Synthetic
acggaagaaatcatcattttatcagtcctacctcagaaggacacaatcaatggggatacaactagaccagagaat

SEQ ID NO: 98354 - DNA, 75 bp, Artificial Sequence
  Synthetic
tattgtgctcttcatggttgcctggggaaaggaggctgtggacaacttccacttaggggatgatatggatcctga

SEQ ID NO: 98355 - DNA, 75 bp, Artificial Sequence
  Synthetic
gctaaggacactggcacagagcttgattgatgtcaaagtgaaggaaatctccaaccaagagcctttgaaactcta

SEQ ID NO: 98356 - DNA, 75 bp, Artificial Sequence
  Synthetic
attaatgaatgtattaatccttttatgtgattatcatatactactgaatcattatcaatcatatttgcactatta

SEQ ID NO: 98357 - DNA, 75 bp, Artificial Sequence
  Synthetic
tgtgattatcatatactactgaatcattatcaatcatatttgcactattattatcaggggaatcagtatatcagg

SEQ ID NO: 98358 - DNA, 75 bp, Artificial Sequence
  Synthetic
gcatgggaacatttatgggtgggaatcattactcaggggtgggtcagttaatccgttgtgggtgggtttagctcc

SEQ ID NO: 98359 - DNA, 75 bp, Artificial Sequence
  Synthetic
tcattactcaggggtgggtcagttaatccgttgtgggtgggtttagctccaggctaccttaagtagccttttttt

SEQ ID NO: 98360 - DNA, 75 bp, Artificial Sequence
  Synthetic
gtatatatggatgtagatttcatttgatccttaactaatcttgttttctttccctttctttctgctttctctgct

SEQ ID NO: 98361 - DNA, 75 bp, Artificial Sequence
  Synthetic
gatccttaactaatcttgttttctttccctttctttctgctttctctgcttactaacaacaacattctacctcaa

SEQ ID NO: 98362 - DNA, 75 bp, Artificial Sequence
  Synthetic
tcaacacaaaactacctcaacttaactacctcatttgattgctccttgattgtctttttagggagcatactacta

SEQ ID NO: 98363 - DNA, 75 bp, Artificial Sequence
  Synthetic
atggcaactatggaggaattgcagagggaaatcaatgcccatgagggccaactggtgatagccaggctcaaggtg

SEQ ID NO: 98364 - DNA, 75 bp, Artificial Sequence
  Synthetic
agggatgcagaaaaaccctatgagaaggatccagatgaactgaacatgagaacattaactgacagggaaggggtt

SEQ ID NO: 98365 - DNA, 75 bp, Artificial Sequence
  Synthetic
gataacaaagggaccaggattcgattcaaggatgacagctcttttgaggatgttaacgggattcgaaagccaaag

SEQ ID NO: 98366 - DNA, 75 bp, Artificial Sequence
  Synthetic
ctgcaacaaacagggattacctacggcagcgccaggtggcactgggtaatatggaaacaaaagaatcaaaggcca

SEQ ID NO: 98367 - DNA, 75 bp, Artificial Sequence
  Synthetic
tacgtcaacatgctgaatctgcaggttgcagcatggttgaggatattgagtcaccatcatcgatatgggtttttg

SEQ ID NO: 98368 - DNA, 75 bp, Artificial Sequence
  Synthetic
ccggagcaccagatcgctgtccaccgacatgcctgtttattgcagggattgctgaacttggcgcattcttctcca

SEQ ID NO: 98369 - DNA, 75 bp, Artificial Sequence
  Synthetic
gcgaacccaatcaatgggaatacaactggaccaaagaatcatagtgctctttatggttgcctggggtaaagaggc

SEQ ID NO: 98370 - DNA, 75 bp, Artificial Sequence
  Synthetic
ctggaccaaagaatcatagtgctctttatggttgcctggggtaaagaggctgtggataacttccagccaggggac

SEQ ID NO: 98371 - DNA, 75 bp, Artificial Sequence
  Synthetic
gatatggaccctgaattaaggacactagcacaaagcctgattgatgttaaagtgaaggaaatttctaaccaagaa

SEQ ID NO: 98372 - DNA, 75 bp, Artificial Sequence
  Synthetic
atactactgaatcattatcaatcatatttacactattataatcaggggaatcattatatcagggtaggggtacat

SEQ ID NO: 98373 - DNA, 75 bp, Artificial Sequence
  Synthetic
tcattatatcagggtaggggtacatttatgggtgggaatcattattcaaagggtgggtcagttaatctactgtgg

SEQ ID NO: 98374 - DNA, 75 bp, Artificial Sequence
  Synthetic
ttatgggtgggaatcattattcaaagggtgggtcagttaatctactgtgggtgggtttagttccaggctgcctta

SEQ ID NO: 98375 - DNA, 75 bp, Artificial Sequence
  Synthetic
gggtgggtcagttaatctactgtgggtgggtttagttccaggctgccttaagtagcctttttttgtatatatgga

SEQ ID NO: 98376 - DNA, 75 bp, Artificial Sequence
  Synthetic
tgtaaatttcatttggtcatatactaatcaagccttcttttcttttcttcctgccttttctgcttactaacaaca

SEQ ID NO: 98377 - DNA, 75 bp, Artificial Sequence
  Synthetic
tgcttactaacaacaacaacctacctcaacacaaaactatctcaacctaactacctcatttgcttgctcccttga

SEQ ID NO: 98378 - DNA, 75 bp, Artificial Sequence
  Synthetic
tagtagtagacaccgcaaaagaaagcagtcaatcaacaacatggagatatggaagtggcttgtgatggccagttt

SEQ ID NO: 98379 - DNA, 75 bp, Artificial Sequence
  Synthetic
agtatggcctgccttagcactgaggaatgtccatgacatgaaaattgagtgcccccacacagtcagttttggaaa

SEQ ID NO: 98380 - DNA, 75 bp, Artificial Sequence
  Synthetic
aaacagtgtaattggttatgttgaattgcctcctatgccattggcagatacaatacaaatggtgcctgaaagttc

SEQ ID NO: 98381 - DNA, 75 bp, Artificial Sequence
  Synthetic
ttgtagcatggacaaccaccagtccttgagcacagtgacaaagcatacacaagtgagttggagagggaaagctga

SEQ ID NO: 98382 - DNA, 75 bp, Artificial Sequence
  Synthetic
ccaggcacagtctagccagacttcatttgagacagtgtctgttgaagttgatcttaaggggacctgtgtattaaa

SEQ ID NO: 98383 - DNA, 75 bp, Artificial Sequence
  Synthetic
acacaaattggtagaagaatcataccgtagccggaagtcactaacttgttatgacctctcttgtaacagtaccta

SEQ ID NO: 98384 - DNA, 75 bp, Artificial Sequence
  Synthetic
ctgcaagccaacactgtacatgatcgtaccaatccatgcatgcaacatgatgaagagctgcataattgcactagg

SEQ ID NO: 98385 - DNA, 75 bp, Artificial Sequence
  Synthetic
gccgcatagagtacaagtggtatacgagagaacatattgcatgactggggttctattagaagggaagtgttttgt

SEQ ID NO: 98386 - DNA, 75 bp, Artificial Sequence
  Synthetic
ttctattagaagggaagtgttttgtcccagatcagagtgtagtcagcattgtcaggcacggtatctttgacattg

SEQ ID NO: 98387 - DNA, 75 bp, Artificial Sequence
  Synthetic
caagtgttcatattgcatgtttctttgtagcgatcacagggaacacatataagctttttgaacaagttaagaagt

SEQ ID NO: 98388 - DNA, 75 bp, Artificial Sequence
  Synthetic
catttgggacaacatgcaatgacactgaaaataaggtgcaaggttactacatctgtattcttggaggaaactccc

SEQ ID NO: 98389 - DNA, 75 bp, Artificial Sequence
  Synthetic
cacctatttatgtcccaacacttgatgattttagatccatggaggcattctcgggaatattcaaatcaccacatg

SEQ ID NO: 98390 - DNA, 75 bp, Artificial Sequence
  Synthetic
gagaagatcatgacctagctggggaagaaattgcttcatactctattgttggacctgctaatgcaaaggtccccc

SEQ ID NO: 98391 - DNA, 75 bp, Artificial Sequence
  Synthetic
atagtgccagctcagatacactaagtctaattgctttttcaggaataccatcttactcttctcttagtattctca

SEQ ID NO: 98392 - DNA, 75 bp, Artificial Sequence
  Synthetic
tcttactcttctcttagtattctcaccagttcaacagaagctaagcatgtgtttagccctggactattcccacag

SEQ ID NO: 98393 - DNA, 75 bp, Artificial Sequence
  Synthetic
cttaatcatacaaaatgtgataagactgctataccattaacatggactggaataattgacttgcctggatattat

SEQ ID NO: 98394 - DNA, 75 bp, Artificial Sequence
  Synthetic
aataattgacttgcctggatattatgaggctgtacatccttgcacagtgttctgtgtcttgtcaggtccaggtgc

SEQ ID NO: 98395 - DNA, 75 bp, Artificial Sequence
  Synthetic
atcatgtgaggcattttcagaaggtgggatctttaacataacctctcctatgtgtctggtatcaaagcaaaacag

SEQ ID NO: 98396 - DNA, 75 bp, Artificial Sequence
  Synthetic
gtttcgactaacagaacagcaagtcaactttgtatgccagagagttgatatggacatcgtggtttattgtaatgg

SEQ ID NO: 98397 - DNA, 75 bp, Artificial Sequence
  Synthetic
tcagaggaaggtgatattaacaaaaaccttagttattggacaatgtatatacaccataacaagtctattctcact

SEQ ID NO: 98398 - DNA, 75 bp, Artificial Sequence
  Synthetic
gctacctggggtagcacactctattgctgttgagttgtgtgtacctggatttcatgggtgggctacggctgcttt

SEQ ID NO: 98399 - DNA, 75 bp, Artificial Sequence
  Synthetic
ttcatgggtgggctacggctgctttacttatcaccttttgttttgggtgggttcttataccagcacttacattta

SEQ ID NO: 98400 - DNA, 75 bp, Artificial Sequence
  Synthetic
ttgtacttactgtattgaagttcattgcaaatatctttcacacaagtaatcaagagaataggctaaaaatggtct

SEQ ID NO: 98401 - DNA, 75 bp, Artificial Sequence
  Synthetic
tgaaaaaaatcaaggaagagtttgaaaggacaaagggatcaatggtatgtgatatctgtaaatatgagtgtgaaa

SEQ ID NO: 98402 - DNA, 75 bp, Artificial Sequence
  Synthetic
ccaacaaagagttgaaggcacatggagtttcatgtcctcaatctcaatgcccttattgctttacccactgtgaac

SEQ ID NO: 98403 - DNA, 75 bp, Artificial Sequence
  Synthetic
ctacagaatcagcatctcaggcccattatagagtttgtcaagtcactcatcgatttagagatgacctaaagaaga

SEQ ID NO: 98404 - DNA, 75 bp, Artificial Sequence
  Synthetic
agtccttgagtcaatcctgtgggctgctagtgcatcagaaatacccttaagccctacgtggaatgataatgctca

SEQ ID NO: 98405 - DNA, 75 bp, Artificial Sequence
  Synthetic
tggggttggatccatacccatgcatacagatctagagcttgacttttctttaacatcaagttctaagtatacata

SEQ ID NO: 98406 - DNA, 75 bp, Artificial Sequence
  Synthetic
ccggagaaagctaacaaatccacttgaagaatcacaagcagtcaatttccatgtggaaatagaagagcaggcaat

SEQ ID NO: 98407 - DNA, 75 bp, Artificial Sequence
  Synthetic
tggtgttgacgttcatgcattgggacactggtttgatggtcgtttaaatctcaagacatcctttcattgttacgg

SEQ ID NO: 98408 - DNA, 75 bp, Artificial Sequence
  Synthetic
tgcatgcacaaaatatgaatacccatggcatactgcaaagtgccactatgaaagggattatcaatatgagacaag

SEQ ID NO: 98409 - DNA, 75 bp, Artificial Sequence
  Synthetic
tggcatactgcaaagtgccactatgaaagggattatcaatatgagacaagttggggttgtaacccatcagattgc

SEQ ID NO: 98410 - DNA, 75 bp, Artificial Sequence
  Synthetic
ttagaaaacacaaagaatcataaccaactgatgttctttcatgttatcatgtgtaaccttgatatatatatttcc

SEQ ID NO: 98411 - DNA, 75 bp, Artificial Sequence
  Synthetic
gtgtaaccttgatatatatatttcctcttatattctaatacatactatctaatacactaaagaagatagtagctg

SEQ ID NO: 98412 - DNA, 75 bp, Artificial Sequence
  Synthetic
tcattattcaaagggtgggtcagttaatccgttgcgggtgggtttaggttcaggctgccttaagtagcctttttt

SEQ ID NO: 98413 - DNA, 75 bp, Artificial Sequence
  Synthetic
aatccgttgcgggtgggtttaggttcaggctgccttaagtagcctttttttatacatatggatgtagatttcatt

SEQ ID NO: 98414 - DNA, 75 bp, Artificial Sequence
  Synthetic
ttctgatagaaggaaaatgttttgtcccagaccgaagtgttgtaagcattattaagcatggtatctttgacattg

SEQ ID NO: 98415 - DNA, 75 bp, Artificial Sequence
  Synthetic
tgtggcagttaaaggaaacacttacaagatttttgagcagataaaaaagtcatttgagtccacatgcaatgatac

SEQ ID NO: 98416 - DNA, 75 bp, Artificial Sequence
  Synthetic
tttttacaatgtgggtcttcctcctggttttggagtccatactgtgggctgcaagtgcatcggaaatacccttaa

SEQ ID NO: 98417 - DNA, 75 bp, Artificial Sequence
  Synthetic
accctgtatggaatgacaacgcccatggagtaggttctgtaccgatgcacacagacttagagctggatttttctt

SEQ ID NO: 98418 - DNA, 75 bp, Artificial Sequence
  Synthetic
tggagttgatgtgcatgctttaggccattggtttgatggtcgtctcaatcttaagacatcctttcactgctatgg

SEQ ID NO: 98419 - DNA, 75 bp, Artificial Sequence
  Synthetic
ttggggctgtaatccatctgactgccctggggtaggtacgggctgtacagcatgcggattgtaccttgaccaatt

SEQ ID NO: 98420 - DNA, 75 bp, Artificial Sequence
  Synthetic
cctggggtaggtacgggctgtacagcatgcggattgtaccttgaccaattaaagcctgttggtagtgcatacaaa

SEQ ID NO: 98421 - DNA, 75 bp, Artificial Sequence
  Synthetic
attattacaataagatacagcagaagggtatgtgtccaatttggggaagaaaatctatgtaagatcatagacatg

SEQ ID NO: 98422 - DNA, 75 bp, Artificial Sequence
  Synthetic
aatgactgttttgtatccagacatgtcaaggtatgcataattggtacagtctctaaattttcccagggtgacacg

SEQ ID NO: 98423 - DNA, 75 bp, Artificial Sequence
  Synthetic
ctattattctttggacctctcgagggtggcggcttaatattcaaacactggtgtacatctacctgccaatttggg

SEQ ID NO: 98424 - DNA, 75 bp, Artificial Sequence
  Synthetic
gaccctggagatatcatgagtccaagggacaaaggatttttatgccctgaattcccaggtagtttcaggaagaaa

SEQ ID NO: 98425 - DNA, 75 bp, Artificial Sequence
  Synthetic
tgcaacttcgctactacccctctctgtgaatatgatggaaatatggtatcagggtacaaaaaagtaatggcaaca

SEQ ID NO: 98426 - DNA, 75 bp, Artificial Sequence
  Synthetic
attgattcctttcaatcctttaacactagtactatgcacttcactgatgagagaatagaatggaaagaccctgat

SEQ ID NO: 98427 - DNA, 75 bp, Artificial Sequence
  Synthetic
ggaatgttacgagaccacattaatattctagtaactaaggatattgactttgagaatcttggtgaaaatccctgt

SEQ ID NO: 98428 - DNA, 75 bp, Artificial Sequence
  Synthetic
aaaattggcttacagacatcctcaattgagggggcatggggctctggtgttggcttcaccctcacatgtttagta

SEQ ID NO: 98429 - DNA, 75 bp, Artificial Sequence
  Synthetic
tcattgacagagtgccctacctttttaacatcaattaaggcttgcgataaagccatctgctatggtgcagaaagt

SEQ ID NO: 98430 - DNA, 75 bp, Artificial Sequence
  Synthetic
gtaacattaacaagaggccagaatacagtcaaagtgtcagggaagggaggccatagtggctcaacttttaaatgc

SEQ ID NO: 98431 - DNA, 75 bp, Artificial Sequence
  Synthetic
tgtcatggggaagaatgttcacagattggactccatgctgctgcacctcaccttgataaggttaatgggatttct

SEQ ID NO: 98432 - DNA, 75 bp, Artificial Sequence
  Synthetic
gaaattgagaataataaagtttatgatgatggtgcaccccagtgtgggataaagtgctggtttgtaaaatctgga

SEQ ID NO: 98433 - DNA, 75 bp, Artificial Sequence
  Synthetic
gaatggatttcagggattttcagtgggaactggattgtgctcattgtcctctgtgtgtttttattgttttcattg

SEQ ID NO: 98434 - DNA, 75 bp, Artificial Sequence
  Synthetic
aatccgttgtgggtgggttaggtccaggctgccttaagtagcctttttctgtatatatggatgtagatttcattt

SEQ ID NO: 98435 - DNA, 75 bp, Artificial Sequence
  Synthetic
cactctacctcaacacaacctaactacctcatttgcttgctccttgattgtctttttagggagcatactactact

SEQ ID NO: 98436 - DNA, 75 bp, Artificial Sequence
  Synthetic
agtatggcctgttttgacactgagaaatgtctatgacatgaaaattgagtgcccccatacagtaagttttgggga

SEQ ID NO: 98437 - DNA, 75 bp, Artificial Sequence
  Synthetic
aaacagtgtgataggttatgtagaattaccccccgtgccattggccgacacagcacagatggtgcctgagagttc

SEQ ID NO: 98438 - DNA, 75 bp, Artificial Sequence
  Synthetic
ttgtaacatggataatcaccaatcgttgaatacaataacaaaatatacccaagtaagttggagaggaaaggctga

SEQ ID NO: 98439 - DNA, 75 bp, Artificial Sequence
  Synthetic
tcagtcacagtctagtcaaaattcatttgagacagtgtccactgaagttgacttgaaaggaacatgtgttctaaa

SEQ ID NO: 98440 - DNA, 75 bp, Artificial Sequence
  Synthetic
acacaaaatggtggaagaatcataccgtagtaggaaatcagtaacctgttacgacctgtcttgcaatagcactta

SEQ ID NO: 98441 - DNA, 75 bp, Artificial Sequence
  Synthetic
cgtagtaggaaatcagtaacctgttacgacctgtcttgcaatagcacttactgcaagccaacactatacatgatt

SEQ ID NO: 98442 - DNA, 75 bp, Artificial Sequence
  Synthetic
gtaccaattcatgcatgcaatatgatgaaaagctgtttgattgcattgggaccatacagagtacaggtggtttat

SEQ ID NO: 98443 - DNA, 75 bp, Artificial Sequence
  Synthetic
gagagaagttactgtatgacaggagtcctgattgaagggaaatgctttgtcccagatcaaagtgtggtcagtatt

SEQ ID NO: 98444 - DNA, 75 bp, Artificial Sequence
  Synthetic
cccagatcaaagtgtggtcagtattatcaagcatgggatctttgatattgcaagtgttcatattgtatgtttctt

SEQ ID NO: 98445 - DNA, 75 bp, Artificial Sequence
  Synthetic
tgttgcagttaaagggaatacttataaaatttttgaacaggttaagaaatcctttgaatcaacatgcaatgatac

SEQ ID NO: 98446 - DNA, 75 bp, Artificial Sequence
  Synthetic
aaaatttttgaacaggttaagaaatcctttgaatcaacatgcaatgatacagagaataaagtgcaaggatattat

SEQ ID NO: 98447 - DNA, 75 bp, Artificial Sequence
  Synthetic
agagaataaagtgcaaggatattatatttgtattgtagggggaaactctgcaccaatatatgttccaacacttga

SEQ ID NO: 98448 - DNA, 75 bp, Artificial Sequence
  Synthetic
tgatttcagatccatggaagcatttacaggaatcttcagatcaccacatggggaagatcatgatctggctggaga

SEQ ID NO: 98449 - DNA, 75 bp, Artificial Sequence
  Synthetic
agaaattgcatcttattctatagtcggagctgccaatgcaaaagttcctcatagtgctagctcagatacattgag

SEQ ID NO: 98450 - DNA, 75 bp, Artificial Sequence
  Synthetic
attgattgcctattcaggtataccatcttattcttcccttagcatcctaacaagttcaacagaagctaagcatgt

SEQ ID NO: 98451 - DNA, 75 bp, Artificial Sequence
  Synthetic
attcagccctgggttgttcccaaaacttaatcacacaaattgtgataaaagtgccataccactcatatggactgg

SEQ ID NO: 98452 - DNA, 75 bp, Artificial Sequence
  Synthetic
gatgattgatttacctggatactacgaagctgtccacccttgtacagttttttgcgtattatcaggtcctggggc

SEQ ID NO: 98453 - DNA, 75 bp, Artificial Sequence
  Synthetic
atcatgtgaagccttttctgaaggcgggattttcaacataacctctcccatgtgcttagtgtcaaaacaaaatcg

SEQ ID NO: 98454 - DNA, 75 bp, Artificial Sequence
  Synthetic
attccggttaacagaacagcaagtgaattttgtgtgtcagcgagtggacatggacattgttgtgtactgcaacgg

SEQ ID NO: 98455 - DNA, 75 bp, Artificial Sequence
  Synthetic
gcagaggaaagtaatattaacaaaaactctagttattggacagtgtatatatactataacaagcttattctcatt

SEQ ID NO: 98456 - DNA, 75 bp, Artificial Sequence
  Synthetic
actacctggagtagcacattctattgctgttgaattgtgtgtacctgggttccatggttgggccacagctgctct

SEQ ID NO: 98457 - DNA, 75 bp, Artificial Sequence
  Synthetic
gcttgttacattctgtttcggatgggttcttataccagcaattacatttatcatactaacagtcctaaagttcat

SEQ ID NO: 98458 - DNA, 75 bp, Artificial Sequence
  Synthetic
gttcttataccagcaattacatttatcatactaacagtcctaaagttcattgctaatatttttcacacaagtaat

SEQ ID NO: 98459 - DNA, 75 bp, Artificial Sequence
  Synthetic
caagagaataggctaaaatcagtacttagaaagataaaggaagagtttgaaaaaacaaaaggctcaatggtatgt

SEQ ID NO: 98460 - DNA, 75 bp, Artificial Sequence
  Synthetic
ttagaaagataaaggaagagtttgaaaaaacaaaaggctcaatggtatgtgatgtctgcaagtatgagtgtgaaa

SEQ ID NO: 98461 - DNA, 75 bp, Artificial Sequence
  Synthetic
gatgtctgcaagtatgagtgtgaaacctataaagaattaaaggcacacggggtatcatgcccccaatctcaatgt

SEQ ID NO: 98462 - DNA, 75 bp, Artificial Sequence
  Synthetic
ccttactgttttactcattgtgaacccacagaagcagcattccaagctcattacaaggtatgccaagttactcac

SEQ ID NO: 98463 - DNA, 75 bp, Artificial Sequence
  Synthetic
agattcagggatgatctaaagaaaactgttactcctcaaaattttacaccaggatgttaccggacactaaattta

SEQ ID NO: 98464 - DNA, 75 bp, Artificial Sequence
  Synthetic
tttagatacaaaagcaggtgctacatctttacaatgtggatatttcttcttgtcttagaatccatactgtgggct

SEQ ID NO: 98465 - DNA, 75 bp, Artificial Sequence
  Synthetic
gcaagtgcatcagagacaccattaactcctgtctggaatgacaatgcccatggggtaggttctgttcctatgcat

SEQ ID NO: 98466 - DNA, 75 bp, Artificial Sequence
  Synthetic
ctcctgtctggaatgacaatgcccatggggtaggttctgttcctatgcatacagatttagagcttgatttctctt

SEQ ID NO: 98467 - DNA, 75 bp, Artificial Sequence
  Synthetic
taacatccagttccaagtatacataccgtaggaagttaacaaacccacttgaggaagcacaatccattgacctac

SEQ ID NO: 98468 - DNA, 75 bp, Artificial Sequence
  Synthetic
gaggaagcacaatccattgacctacatattgaaatagaagaacagacaattggtgttgatgtgcatgctctagga

SEQ ID NO: 98469 - DNA, 75 bp, Artificial Sequence
  Synthetic
tggtgttgatgtgcatgctctaggacactggtttgatggtcgtcttaaccttaaaacatcctttcactgttatgg

SEQ ID NO: 98470 - DNA, 75 bp, Artificial Sequence
  Synthetic
cactggtttgatggtcgtcttaaccttaaaacatcctttcactgttatggtgcttgtacaaagtatgaataccct

SEQ ID NO: 98471 - DNA, 75 bp, Artificial Sequence
  Synthetic
ttaaaacatcctttcactgttatggtgcttgtacaaagtatgaatacccttggcatactgcaaagtgccactatg

SEQ ID NO: 98472 - DNA, 75 bp, Artificial Sequence
  Synthetic
tggcatactgcaaagtgccactatgaaagagattaccaatatgagacgagctggggttgtaatccatcagattgt

SEQ ID NO: 98473 - DNA, 75 bp, Artificial Sequence
  Synthetic
cctggggtgggcacaggctgtacagcatgtggtttatacctagatcaactgaaaccagttggtagtgcttataaa

SEQ ID NO: 98474 - DNA, 75 bp, Artificial Sequence
  Synthetic
gaaaccagttggtagtgcttataaaattatcacaataaggtacagcaggagagtctgtgttcagtttggggagga

SEQ ID NO: 98475 - DNA, 75 bp, Artificial Sequence
  Synthetic
aaacctttgtaagataatagacatgaatgattgttttgtatctaggcatgttaaggtctgcataattggtacagt

SEQ ID NO: 98476 - DNA, 75 bp, Artificial Sequence
  Synthetic
atctaaattctctcagggtgataccttattgttttttggaccgcttgaaggtggtggtctaatatttaaacactg

SEQ ID NO: 98477 - DNA, 75 bp, Artificial Sequence
  Synthetic
gtgtacatccacatgtcaatttggtgacccaggagatatcatgagtccaagagacaaaggttttttatgccctga

SEQ ID NO: 98478 - DNA, 75 bp, Artificial Sequence
  Synthetic
gtttccaggtagtttcaggaagaaatgcaactttgctactacccctatttgtgagtatgatggaaatatggtctc

SEQ ID NO: 98479 - DNA, 75 bp, Artificial Sequence
  Synthetic
aggttacaagaaagtgatggcgacaattgattccttccaatcttttaatacaagcactatgcacttcactgatga

SEQ ID NO: 98480 - DNA, 75 bp, Artificial Sequence
  Synthetic
aaggatagagtggaaagaccctgatggaatgctaagggaccatataaacattttagtaacgaaggacattgactt

SEQ ID NO: 98481 - DNA, 75 bp, Artificial Sequence
  Synthetic
tgataaccttggtgaaaatccttgcaaaattggcctacaaacatcttctattgagggggcctggggttctggtgt

SEQ ID NO: 98482 - DNA, 75 bp, Artificial Sequence
  Synthetic
ttgagggggcctggggttctggtgtggggttcacattaacatgtctggtatcactaacagaatgtcctacctttt

SEQ ID NO: 98483 - DNA, 75 bp, Artificial Sequence
  Synthetic
tcactaacagaatgtcctacctttttgacctcaataaaggcttgtgataaggctatctgttatggtgcagagagt

SEQ ID NO: 98484 - DNA, 75 bp, Artificial Sequence
  Synthetic
tgacctcaataaaggcttgtgataaggctatctgttatggtgcagagagtgtaacattgacaagaggacaaaata

SEQ ID NO: 98485 - DNA, 75 bp, Artificial Sequence
  Synthetic
cagtcaaggtatcagggaaaggtggccatagtggttcaacatttaagtgttgccatggggaggactgttcacaaa

SEQ ID NO: 98486 - DNA, 75 bp, Artificial Sequence
  Synthetic
ccatagtggttcaacatttaagtgttgccatggggaggactgttcacaaattggactccatgctgctgcacctca

SEQ ID NO: 98487 - DNA, 75 bp, Artificial Sequence
  Synthetic
ttggactccatgctgctgcacctcaccttgacaaggtaaatgggatttctgagatagaaaatagtaaagtatatg

SEQ ID NO: 98488 - DNA, 75 bp, Artificial Sequence
  Synthetic
atgatggggcaccgcaatgtgggataaaatgttggtttgttaaatcaggggaatggatttcagggatattcagtg

SEQ ID NO: 98489 - DNA, 75 bp, Artificial Sequence
  Synthetic
gtaattggattgtactcattgtcctctgtgtatttctattgttctccttggttttactaagcattctctgtcccg

SEQ ID NO: 98490 - DNA, 75 bp, Artificial Sequence
  Synthetic
taaggaagcataaaaaatcatagctaaattctgtgactatcctgttcttatgtatagctttaacatatatactaa

SEQ ID NO: 98491 - DNA, 75 bp, Artificial Sequence
  Synthetic
tagtagtagacaccgcaagagagagcagtctactagcaaaaggaatatgtgggggttactggtagtggccggttt

SEQ ID NO: 98492 - DNA, 75 bp, Artificial Sequence
  Synthetic
aatcggcccatgtatatcactgagaaatgtttatgacatgaagatagagtgcccgcatacagtcaactttggtga

SEQ ID NO: 98493 - DNA, 75 bp, Artificial Sequence
  Synthetic
aaacagtgtgataggctatgtggaattgccgccagtgccaatagctgatattacccagatggttcccgaaagttc

SEQ ID NO: 98494 - DNA, 75 bp, Artificial Sequence
  Synthetic
ttgtaatatggataaccaccagtccctcagcacatttacaaaatacacacaactcatttggaggaaaaaggctga

SEQ ID NO: 98495 - DNA, 75 bp, Artificial Sequence
  Synthetic
gcaggcacaagcaagccagaattcatttgaaactgtctcaagagaggttgattttaaagggacttgtgtgttcaa

SEQ ID NO: 98496 - DNA, 75 bp, Artificial Sequence
  Synthetic
gcataaaatggttgaggagtcttacaaaaatcggaagtctatcatttgttatgatctatcatgcaatattaccca

SEQ ID NO: 98497 - DNA, 75 bp, Artificial Sequence
  Synthetic
ttgtaaaccaaccctttacatgataattccagtgcatgcatgcaacatgatgaaaagctgcttaattgcacttgg

SEQ ID NO: 98498 - DNA, 75 bp, Artificial Sequence
  Synthetic
cccatttagggttcaagtggtctatgagagaacttattgcatgtcgggcatactcacagaagggcggtgcttcgt

SEQ ID NO: 98499 - DNA, 75 bp, Artificial Sequence
  Synthetic
accataccagagtgtagtgagtattatcaagcatgggatctttgatattgcaagtatccatatcatctgcttttt

SEQ ID NO: 98500 - DNA, 75 bp, Artificial Sequence
  Synthetic
tatagctgtggaagggaacacctacaaattatttgaagaggtaaagaagtcatttgccctaaattgtaatgatac

SEQ ID NO: 98501 - DNA, 75 bp, Artificial Sequence
  Synthetic
agagaataaaattcagggttattacatatgcatcataggagggaattcagcacctgtttatgccccatcacctga

SEQ ID NO: 98502 - DNA, 75 bp, Artificial Sequence
  Synthetic
tgactttagatccatggaggcattttcaggtattttcaggtcgccgcatggagaaaatcatgatctaaatggggg

SEQ ID NO: 98503 - DNA, 75 bp, Artificial Sequence
  Synthetic
aagaaatgcaccatattctattgttggcccaacagatggaaaggttcctcatagttccaagcactacaacattga

SEQ ID NO: 98504 - DNA, 75 bp, Artificial Sequence
  Synthetic
gtttgacagcattttccagaaattcccgacatattcttcatttagtattcttgcaggttctgtggagccaaagca

SEQ ID NO: 98505 - DNA, 75 bp, Artificial Sequence
  Synthetic
tgtcttccagccaggattatttccaaagttgaatcatacaaaatgcacaaagtctgcaattccattggtctggac

SEQ ID NO: 98506 - DNA, 75 bp, Artificial Sequence
  Synthetic
tggtcgaattgatattcccggttactatgaggctgtccatcccttgacagtttattgtgagctgtctggcccagg

SEQ ID NO: 98507 - DNA, 75 bp, Artificial Sequence
  Synthetic
ggcatcatgtgaagccttttctgaaggggggatcttcaatatcacatctccgatgtgtcttgtgtcaaaacaaaa

SEQ ID NO: 98508 - DNA, 75 bp, Artificial Sequence
  Synthetic
tagattcagatccctcagacagcaagttagctttgtgtgccagagagttgacatggatatagttgtgtattgtaa

SEQ ID NO: 98509 - DNA, 75 bp, Artificial Sequence
  Synthetic
tggccagaaaaagaccatattaaccaaaacacttgtgataggtcagtgtatttacacaataacgagcctgttttc

SEQ ID NO: 98510 - DNA, 75 bp, Artificial Sequence
  Synthetic
tctgctgccgagtgttgcacactcaattgctgtagagctttgtgttcctgggtttcatggttgggcaactgcagc

SEQ ID NO: 98511 - DNA, 75 bp, Artificial Sequence
  Synthetic
actgctaataacattctgctttggctgggttttgataccggcattaacttttatcatattaaccatactcaagtt

SEQ ID NO: 98512 - DNA, 75 bp, Artificial Sequence
  Synthetic
tattgcaaatatctttcatacaagcaatcaggaaaataaattaaaggctgtcctaaggaaaattaaagaggagtt

SEQ ID NO: 98513 - DNA, 75 bp, Artificial Sequence
  Synthetic
tgaaaaaacaaaaggctcaatggtatgtgatatttgtaaatatgaatgtgatacatacaaagagctaaaggctca

SEQ ID NO: 98514 - DNA, 75 bp, Artificial Sequence
  Synthetic
cggcctatcatgtccacaatctcaatgcccatattgctttacacactgtgaaccaacagagtcggcttttcaggc

SEQ ID NO: 98515 - DNA, 75 bp, Artificial Sequence
  Synthetic
tcactataaagtctgtcaagtgacacacagattcagggaagaattaaaaaagacagttacaccacaaaactttac

SEQ ID NO: 98516 - DNA, 75 bp, Artificial Sequence
  Synthetic
ccctggttgttacaggacattaaaccttttcaggtataaaagtaggtgctacatctttacaatgtggatcctctt

SEQ ID NO: 98517 - DNA, 75 bp, Artificial Sequence
  Synthetic
actagtctttgaatctatcttgtgggctgcaagtgcttctgatgtccctttatcaactgactggaatgacaatgc

SEQ ID NO: 98518 - DNA, 75 bp, Artificial Sequence
  Synthetic
acatggtgttgggtcagtgcctatgcacactgatcttgaacttgacttttcactcacgtcaagttctaaatatac

SEQ ID NO: 98519 - DNA, 75 bp, Artificial Sequence
  Synthetic
atacaggcggaaactcacaaaccctgtggatacctctcaggcagtggacttgcatattgaactagaagagcaaac

SEQ ID NO: 98520 - DNA, 75 bp, Artificial Sequence
  Synthetic
aattgggttggatgtccatgccttagggcactggtttgatggccgtttaaatctcaagacatcctttcactgtta

SEQ ID NO: 98521 - DNA, 75 bp, Artificial Sequence
  Synthetic
cggagcatgcactaaatatgagtacccatggcatacagctaagtgccattttgaaagagattttcagtatgaaac

SEQ ID NO: 98522 - DNA, 75 bp, Artificial Sequence
  Synthetic
aagttggggctgtaatccccctgactgccctggtgtagggactgggtgcactgcatgtggtctttatattgatca

SEQ ID NO: 98523 - DNA, 75 bp, Artificial Sequence
  Synthetic
gttaaggccagtgggaaatgcttacaaaattataacaattaggtatagcagaaaggtttgtgtacaatttggtga

SEQ ID NO: 98524 - DNA, 75 bp, Artificial Sequence
  Synthetic
tgaaaatctctgtaaaaccattgacatgaatgattgttttgtatccaaacatgttaaagtttgtatcattgggac

SEQ ID NO: 98525 - DNA, 75 bp, Artificial Sequence
  Synthetic
agtctctaaattttctcaaggtgatactctattgttcttgggccctatggaaggaggcgggatcatctttaaaca

SEQ ID NO: 98526 - DNA, 75 bp, Artificial Sequence
  Synthetic
ttggtgtacatccacctgccaatttggggaccctggtgatattatgagtcccaaggataagggattcagctgccc

SEQ ID NO: 98527 - DNA, 75 bp, Artificial Sequence
  Synthetic
tgagttttcagggagttttagaaagaaatgcaattttgcaacaacccccgcgtgtgaatatggtggtaatatggt

SEQ ID NO: 98528 - DNA, 75 bp, Artificial Sequence
  Synthetic
ttcaggctacaggaaagtgatggcaactattgattcattccaagcatttaatacaagtactatacatttcacaga

SEQ ID NO: 98529 - DNA, 75 bp, Artificial Sequence
  Synthetic
tgagcgaattgagtggaaagacccagatgggatgcttcgtgatcacatcaatatattagtaacaagggacattga

SEQ ID NO: 98530 - DNA, 75 bp, Artificial Sequence
  Synthetic
ctttgacaacctggctgagaatccatgtaaaattggcctccaagtatctgccattgaaggtgcatggggatctgg

SEQ ID NO: 98531 - DNA, 75 bp, Artificial Sequence
  Synthetic
ggttggctttacattaacatgtcaagtctccctaacggagtgttcaacattcctgacctcaattaaagcatgtga

SEQ ID NO: 98532 - DNA, 75 bp, Artificial Sequence
  Synthetic
taaggcaatttgttatggtgcacagagtgtaacacttgtgagagggcaaaacacagttaaaatttctggtaaagg

SEQ ID NO: 98533 - DNA, 75 bp, Artificial Sequence
  Synthetic
ggggcatagtggttctgccttcaaatgctgccatggggaggattgttcacagacaggattgcaggcagatgcacc

SEQ ID NO: 98534 - DNA, 75 bp, Artificial Sequence
  Synthetic
acaccttgataaagtcaatggcatttcagaagtagagaatgataaagtgtatgatgatggggcacctgagtgtgg

SEQ ID NO: 98535 - DNA, 75 bp, Artificial Sequence
  Synthetic
tataaagtgttggtttgtaaaatcaggagaatgggtagcagggatatttagtggaaattggattgtgcttgttgt

SEQ ID NO: 98536 - DNA, 75 bp, Artificial Sequence
  Synthetic
cctctgtattttccttataatatctctcattttgcttagcatcttatgccctgttaggaagcacaaaaagtcata

SEQ ID NO: 98537 - DNA, 75 bp, Artificial Sequence
  Synthetic
gataaactgttacattccagttaacccctgtaaatagttactaatatttaacagctccaatttattttgttgtac

SEQ ID NO: 98538 - DNA, 75 bp, Artificial Sequence
  Synthetic
cttactagctctattactaaaaaaaatagaaacttttccaactaaataacatagattgtttctctgctgagtgtc

SEQ ID NO: 98539 - DNA, 75 bp, Artificial Sequence
  Synthetic
tagaaacttttccaactaaataacatagattgtttctctgctgagtgtcttgacattctgcggagcatactacta

SEQ ID NO: 98540 - DNA, 75 bp, Artificial Sequence
  Synthetic
tagtagtagacaccgcaaaagaaagcagtcaatcagcaacatggggatatggaagtggctagtaatggccagttt

SEQ ID NO: 98541 - DNA, 75 bp, Artificial Sequence
  Synthetic
atagtagctttctaaccacaaaacttagattcttcttctgtatgatgtcttaacatcttgcggagtctactacta

SEQ ID NO: 98542 - DNA, 75 bp, Artificial Sequence
  Synthetic
ctaaccaagagcctttaaaactataattagtaaatgtataacccttattatgtaatcattatatacaactgaatc

SEQ ID NO: 98543 - DNA, 75 bp, Artificial Sequence
  Synthetic
agttaaacaagagagcattgacagatcgagagggtgttgcagtatccatccaagcaaagattgatgaattaaaga

SEQ ID NO: 98544 - DNA, 75 bp, Artificial Sequence
  Synthetic
tgtgatcggattcctggctctggcaaaagattggagtgaccgcattgagcagtggttaagtgaaccctgtaagct

SEQ ID NO: 98545 - DNA, 75 bp, Artificial Sequence
  Synthetic
ggcattaggcaatatggaaacaaaagagtctaaggctatacgccaacatgcagaggcagcaggctgtagcatgat

SEQ ID NO: 98546 - DNA, 75 bp, Artificial Sequence
  Synthetic
tgaggacattgagtcaccatcctcaatatgggtgtttgctggagcaccagaccgctgtccaccaacatgtctttt

SEQ ID NO: 98547 - DNA, 75 bp, Artificial Sequence
  Synthetic
agtcttatctcaggagaacacaatcaatgggaatacaactggatcagaggataattgtgctcttcatggtagctt

SEQ ID NO: 98548 - DNA, 75 bp, Artificial Sequence
  Synthetic
tctgcttactaacaacaacattctacctcaacacaaaactacctcaactaaactacctcattaaattgctcctta

SEQ ID NO: 98549 - DNA, 75 bp, Artificial Sequence
  Synthetic
aagaaagcagtcaatcagcaacatggggatgtggaagtggctagtaatagccagtttagtatggcctgctttggc

SEQ ID NO: 98550 - DNA, 75 bp, Artificial Sequence
  Synthetic
gggatgtggaagtggctagtaatagccagtttagtatggcctgctttggcactgagaaatgtgtatgacatgaaa

SEQ ID NO: 98551 - DNA, 75 bp, Artificial Sequence
  Synthetic
tgtggagttaccccctatgccattggctgacacagcacagatggtgcctgagagttcttgcagcatggataatca

SEQ ID NO: 98552 - DNA, 75 bp, Artificial Sequence
  Synthetic
gctgacacagcacagatggtgcctgagagttcttgcagcatggataatcatcagtcaataaatactataacaaaa

SEQ ID NO: 98553 - DNA, 75 bp, Artificial Sequence
  Synthetic
agagttcttgcagcatggataatcatcagtcaataaatactataacaaaatacacccaggtaacctggagaggaa

SEQ ID NO: 98554 - DNA, 75 bp, Artificial Sequence
  Synthetic
tacacccaggtaacctggagaggaaaggcagatccgggacaatccagtcaaaattcattcgaaacattgtctgct

SEQ ID NO: 98555 - DNA, 75 bp, Artificial Sequence
  Synthetic
gaagttgacttgaaaggaacatgtgttttaaagcataagatggtggaagaatcataccgcagccggaagtcaata

SEQ ID NO: 98556 - DNA, 75 bp, Artificial Sequence
  Synthetic
ttttaaagcataagatggtggaagaatcataccgcagccggaagtcaataacctgttatgacctttcttgtaata

SEQ ID NO: 98557 - DNA, 75 bp, Artificial Sequence
  Synthetic
gtacttattgcaagccaacattatatatgattgtaccaattcatgcatgtaatatgatgaagagctgtctaattg

SEQ ID NO: 98558 - DNA, 75 bp, Artificial Sequence
  Synthetic
gttttgtcccagatcaaagtgttgttagcattattaagcatgggatctttgatattgcaagtgttcatattgtat

SEQ ID NO: 98559 - DNA, 75 bp, Artificial Sequence
  Synthetic
tagcattattaagcatgggatctttgatattgcaagtgttcatattgtatgtttctttgtcgcagttaaggggaa

SEQ ID NO: 98560 - DNA, 75 bp, Artificial Sequence
  Synthetic
cacctataaactctttgaacaggttaagaaatcgtttgagtcaacttgcaatgatactgagaataaagtacaggg

SEQ ID NO: 98561 - DNA, 75 bp, Artificial Sequence
  Synthetic
gtattacatctgtattgtgggaggaaattctgcaccgatctatgtccctacacttgatgatttcaggtccatgga

SEQ ID NO: 98562 - DNA, 75 bp, Artificial Sequence
  Synthetic
cacttgatgatttcaggtccatggaggcttttacgggaatctttaagtcaccacatggagaagaccatgaccttg

SEQ ID NO: 98563 - DNA, 75 bp, Artificial Sequence
  Synthetic
ctggggaggagattgcttcatactctatagttggacctgcaaatgcaaaagtccctcatagtgcaagctcagaca

SEQ ID NO: 98564 - DNA, 75 bp, Artificial Sequence
  Synthetic
tatagttggacctgcaaatgcaaaagtccctcatagtgcaagctcagacacactgagtctaattgcttattcagg

SEQ ID NO: 98565 - DNA, 75 bp, Artificial Sequence
  Synthetic
gataagagtgcaataccacttacatggactgggatgattgatttacctggatactatgaggccatacacccttgc

SEQ ID NO: 98566 - DNA, 75 bp, Artificial Sequence
  Synthetic
ctggagcatcatgtgaagcattttctgaaggtggaattttcaacataacttcccccatgtgcttagtttcaaagc

SEQ ID NO: 98567 - DNA, 75 bp, Artificial Sequence
  Synthetic
gcaatggacagaggaaagtaatattaacaaaaactttagttattgggcaatgtatatatactatcacaagcttgt

SEQ ID NO: 98568 - DNA, 75 bp, Artificial Sequence
  Synthetic
tttcactactacctggggtagcacattctattgctgtggaattatgtgtgcctggattccatggctgggccacag

SEQ ID NO: 98569 - DNA, 75 bp, Artificial Sequence
  Synthetic
ttctattgctgtggaattatgtgtgcctggattccatggctgggccacagctgctttgcttgttacatactgttt

SEQ ID NO: 98570 - DNA, 75 bp, Artificial Sequence
  Synthetic
tggatgggtccttataccagctatcacatttattatactaacagtcttaaagtttattgctaacatttttcacac

SEQ ID NO: 98571 - DNA, 75 bp, Artificial Sequence
  Synthetic
acatttattatactaacagtcttaaagtttattgctaacatttttcacacaagcaaccaggagaacaggctgaaa

SEQ ID NO: 98572 - DNA, 75 bp, Artificial Sequence
  Synthetic
agtttgaaaagacaaagggttcaatggtatgtgatgtttgcaagtatgaatgtgaaacctataaagaattaaagg

SEQ ID NO: 98573 - DNA, 75 bp, Artificial Sequence
  Synthetic
cacatggggtatcttgtccccaatctcaatgcccttactgttttactcattgtgagcctacagaggcagcatttc

SEQ ID NO: 98574 - DNA, 75 bp, Artificial Sequence
  Synthetic
tcaatgcccttactgttttactcattgtgagcctacagaggcagcatttcaagcccactataaagtatgccaggt

SEQ ID NO: 98575 - DNA, 75 bp, Artificial Sequence
  Synthetic
aagcccactataaagtatgccaggttactcacaggttcagggatgatcttaaaaagactgtcactcctcagaatt

SEQ ID NO: 98576 - DNA, 75 bp, Artificial Sequence
  Synthetic
tcacaccaggttgttatcggacattaaatttatttagatacaaaagtagatgttacatttttacaatgtgggtat

SEQ ID NO: 98577 - DNA, 75 bp, Artificial Sequence
  Synthetic
tccttctcattctggaatctgtactgtgggctgccagtgcatcagaaacaccgctaactcctgtttggaatgata

SEQ ID NO: 98578 - DNA, 75 bp, Artificial Sequence
  Synthetic
atgcccatggtgttggttctgtgcctatgcacacagatctggagcttgatttttctctgacatccagttctaagt

SEQ ID NO: 98579 - DNA, 75 bp, Artificial Sequence
  Synthetic
tatgcacacagatctggagcttgatttttctctgacatccagttctaagtacacataccgcaggaagctaacaaa

SEQ ID NO: 98580 - DNA, 75 bp, Artificial Sequence
  Synthetic
acacataccgcaggaagctaacaaacccactggaggaggcacaatcaattgatctccatattgagatagaagagc

SEQ ID NO: 98581 - DNA, 75 bp, Artificial Sequence
  Synthetic
aaacaatcggtgttgacgtgcacgctctaggacattggtttgatggccgtcttaacattaaaacatccttccact

SEQ ID NO: 98582 - DNA, 75 bp, Artificial Sequence
  Synthetic
tctaggacattggtttgatggccgtcttaacattaaaacatccttccactgttatggtgcttgtacaaagtacga

SEQ ID NO: 98583 - DNA, 75 bp, Artificial Sequence
  Synthetic
gtacccatggcatactgcaaagtgtcactatgaacgagattaccaatatgagacaagttggggctgtaatccatc

SEQ ID NO: 98584 - DNA, 75 bp, Artificial Sequence
  Synthetic
agactgccccggggtgggtacaggctgtacagcatgtgggctttatcttgaccagctaaagcctgttggcagtgc

SEQ ID NO: 98585 - DNA, 75 bp, Artificial Sequence
  Synthetic
atataaaatcattacaataagatatagcagaagagtctgtgttcagtttggagaagaaaacctttgcaaaattat

SEQ ID NO: 98586 - DNA, 75 bp, Artificial Sequence
  Synthetic
tgatacactattgtttttcgggccacttgaaggcggtggattgatatttaaacactggtgtacatctacatgtca

SEQ ID NO: 98587 - DNA, 75 bp, Artificial Sequence
  Synthetic
gtttggtgacccaggagacatcatgagcccaagagacaaaggttttttatgccctgagttcccaggtagttttag

SEQ ID NO: 98588 - DNA, 75 bp, Artificial Sequence
  Synthetic
gccctgagttcccaggtagttttaggaaaaaatgtaattttgctactactcctatttgtgagtatgatggaaata

SEQ ID NO: 98589 - DNA, 75 bp, Artificial Sequence
  Synthetic
gaaaaaatgtaattttgctactactcctatttgtgagtatgatggaaatatggtttcaggctacaaaaaagtgat

SEQ ID NO: 98590 - DNA, 75 bp, Artificial Sequence
  Synthetic
ggcaacaattgactctttccaatccttcaatacaagcactatgcactttactgatgagaggatagaatggaaaga

SEQ ID NO: 98591 - DNA, 75 bp, Artificial Sequence
  Synthetic
ctgatgagaggatagaatggaaagaccctgatgggatgttgagggaccatataaatattttagtaacaaaggata

SEQ ID NO: 98592 - DNA, 75 bp, Artificial Sequence
  Synthetic
cccctgtaaaattggcttgcagacatcttctattgaaggggcatggggttctggtgtaggctttacacttacatg

SEQ ID NO: 98593 - DNA, 75 bp, Artificial Sequence
  Synthetic
tcttctattgaaggggcatggggttctggtgtaggctttacacttacatgcttggtatcgttaacagagtgtcct

SEQ ID NO: 98594 - DNA, 75 bp, Artificial Sequence
  Synthetic
gtgacaaagccatttgttatggtgcagaaagtgtgacattaacgagaggacaaaatacagtgaaggtatcaggaa

SEQ ID NO: 98595 - DNA, 75 bp, Artificial Sequence
  Synthetic
caaaatacagtgaaggtatcaggaaaaggtggtcatagtggttcaactttcaaatgttgccatggggaagactgt

SEQ ID NO: 98596 - DNA, 75 bp, Artificial Sequence
  Synthetic
caaatgttgccatggggaagactgttcaaaaattgggctccatgctgctgcaccccaccttgacaaagttaatgg

SEQ ID NO: 98597 - DNA, 75 bp, Artificial Sequence
  Synthetic
gatctctgaaatagaaaacagtaaagtatatgatgatggagcaccacaatgtggtataaaatgttggtttgtcaa

SEQ ID NO: 98598 - DNA, 75 bp, Artificial Sequence
  Synthetic
ttgtcctctgtgtattcttactgttttcattggtcttactcagtattctttgccctgtcaggaagcataaaaaat

SEQ ID NO: 98599 - DNA, 75 bp, Artificial Sequence
  Synthetic
catagctagatgataccgctatcaagttattgtatatagctttaacatgtatactaagttttatattcctggaca

SEQ ID NO: 98600 - DNA, 75 bp, Artificial Sequence
  Synthetic
ctttagctaacacactaaaaaaaatagtagctttttaaccacaaaacttagatttttcttctgtatgatgtctta

SEQ ID NO: 98601 - DNA, 75 bp, Artificial Sequence
  Synthetic
ttagctaacacactaaaaaaaatagtagctttttaaccacaaaacttagatttttcttctgtatgatgtcttaac

SEQ ID NO: 98602 - DNA, 75 bp, Artificial Sequence
  Synthetic
caagcaaagattgatgaattaaagagacaactggcagatcggatcgcaaccgggaagaatcttggaaaggaacaa

SEQ ID NO: 98603 - DNA, 75 bp, Artificial Sequence
  Synthetic
caggacagacagcagactggctgagcattgttgtctatcttacatcctttgtcgttccgatacttctgaaagccc

SEQ ID NO: 98604 - DNA, 75 bp, Artificial Sequence
  Synthetic
tgtatatgttaacaacaagggggaggcagaccaccaaggacaataaggggactcggattcgattcaaggatgata

SEQ ID NO: 98605 - DNA, 75 bp, Artificial Sequence
  Synthetic
actcggattcgattcaaggatgatagttccttcgaggatgtcaatggcatccggaaaccaaaacatctatatgtg

SEQ ID NO: 98606 - DNA, 75 bp, Artificial Sequence
  Synthetic
cctcccagacacagcagcagttagcctccttggtggtcctgctaccaacagggactacctacggcagcggcaagt

SEQ ID NO: 98607 - DNA, 75 bp, Artificial Sequence
  Synthetic
tgaggacattgagtcaccatcctcaatatgggtgtttgctggagcacctgaccgctgtccaccaacatgtctttt

SEQ ID NO: 98608 - DNA, 75 bp, Artificial Sequence
  Synthetic
gggggaaagaagcagtggataacttccacctaggagatgatatggatcctgagctgcgaacactagcacagagcc

SEQ ID NO: 98609 - DNA, 75 bp, Artificial Sequence
  Synthetic
ctgaataaaagaacattaacagacagagaaggggttgcagcatctatccaggccaagattgatgaattgaaaagg

SEQ ID NO: 98610 - DNA, 75 bp, Artificial Sequence
  Synthetic
cagttagcagataggattgcaaccggaaagaaccttgggaaagaacaggatcccacaggggttgagcctggagac

SEQ ID NO: 98611 - DNA, 75 bp, Artificial Sequence
  Synthetic
catctgaaagagagatcaatgcttagttatggaaatgtattggatttgaaccacctggatattgatgagcctact

SEQ ID NO: 98612 - DNA, 75 bp, Artificial Sequence
  Synthetic
ggacagactgcagattggctcagtattgttatatatttaacatcctttgttgtcccaatacttctaaaggcccta

SEQ ID NO: 98613 - DNA, 75 bp, Artificial Sequence
  Synthetic
tatatgcttacaacaagagggaggcagacaaccaaagataataaagggactaggattcgattcaaggatgacagc

SEQ ID NO: 98614 - DNA, 75 bp, Artificial Sequence
  Synthetic
tcctctgaggatgttaacgggattcggaaaccaaaacatttatatgtttccttgcccaatgcccagtcaagcatg

SEQ ID NO: 98615 - DNA, 75 bp, Artificial Sequence
  Synthetic
aaggcagaagagatcacaccagggagatacaggacagcaatctgtggactctaccctgcacagattaaggctaga

SEQ ID NO: 98616 - DNA, 75 bp, Artificial Sequence
  Synthetic
cagatgatcagccctgtcatgagtgttattggatttttggctctggcaaaagattggagtgaccgtattgagcag

SEQ ID NO: 98617 - DNA, 75 bp, Artificial Sequence
  Synthetic
tcccagatacagcagcagtaagtctccacgggggccctgcaacaaacagggattacctacggcagcgccaagtgg

SEQ ID NO: 98618 - DNA, 75 bp, Artificial Sequence
  Synthetic
cattgggcaatatggaaacaaaagagtcaaaggctatacgtcaacatgctgaatctgcaggttgtagcatgattg

SEQ ID NO: 98619 - DNA, 75 bp, Artificial Sequence
  Synthetic
aggacattgaatcaccatcatcgatatgggtgtttgctggagcaccagaccgctgtccgccaacatgcttattta

SEQ ID NO: 98620 - DNA, 75 bp, Artificial Sequence
  Synthetic
ttgcagggattgctgaacttggagcattcttttcaatcttacaggacatgcggaataccattatggcatcaaaga

SEQ ID NO: 98621 - DNA, 75 bp, Artificial Sequence
  Synthetic
cagtaggaacatctgaagagaaattacggaaaaaatcatcattctatcagtcttatctcaggcgaacacaatcaa

SEQ ID NO: 98622 - DNA, 75 bp, Artificial Sequence
  Synthetic
tgggaatacaactggaccagaggattatagtgctattcatggttgcctggggtaaagaggtagtggataacttcc

SEQ ID NO: 98623 - DNA, 75 bp, Artificial Sequence
  Synthetic
tatagtgctattcatggttgcctggggtaaagaggtagtggataacttccaccttggagatgacatggatcctga

SEQ ID NO: 98624 - DNA, 75 bp, Artificial Sequence
  Synthetic
gttgagaacattggcacaaagcttgattgatgttaaagtgaaggaaatctccaaccaagagcctttaaaactata

SEQ ID NO: 98625 - DNA, 75 bp, Artificial Sequence
  Synthetic
atcagtgaatttataacccttattatgtgatcactatatactactgaatcattatcaatcatatttgtactatta

SEQ ID NO: 98626 - DNA, 75 bp, Artificial Sequence
  Synthetic
ttatcaggggaaatcatcatatcagggtatgggtgcatttatgggtgggaattattactcaacgggtgggtcagt

SEQ ID NO: 98627 - DNA, 75 bp, Artificial Sequence
  Synthetic
ggtatgggtgcatttatgggtgggaattattactcaacgggtgggtcagttaatccattgtgggtgggtttaggt

SEQ ID NO: 98628 - DNA, 75 bp, Artificial Sequence
  Synthetic
taatccattgtgggtgggtttaggtccaggctgccttaagtagcctttttctgtatatatggatgtagatttcat

SEQ ID NO: 98629 - DNA, 75 bp, Artificial Sequence
  Synthetic
ttttcctctttttcttgctttctctgcttactaacaacaacactctacctcaacacaaaactaactcaacataac

SEQ ID NO: 98630 - DNA, 75 bp, Artificial Sequence
  Synthetic
acacaaaactaactcaacataactacctcatttgcttgctccttgattgtctttttagggagcatactactacta

SEQ ID NO: 98631 - DNA, 75 bp, Artificial Sequence
  Synthetic
tagtagtagactccgcaaaagaaagcagtcaatcagcaacatggggatgtggaagtggctagtaatagccagttt

SEQ ID NO: 98632 - DNA, 75 bp, Artificial Sequence
  Synthetic
ctcctgtttggaatgataatgcccatggtgttggttctgtgcctatgcacacagatctggagcttgatttttctc

SEQ ID NO: 98633 - DNA, 75 bp, Artificial Sequence
  Synthetic
ttctaagttttcacaaggtgatacactattgtttttcgggccacttgaaggcggtggattgatatttaaacactg

SEQ ID NO: 98634 - DNA, 75 bp, Artificial Sequence
  Synthetic
ctattgtttttcgggccacttgaaggcggtggattgatatttaaacactggtgtacatctacatgtcagtttggt

SEQ ID NO: 98635 - DNA, 75 bp, Artificial Sequence
  Synthetic
aaaatgttggtttgtcaaatcaggggaatggatttcagggatatttagtggcaattggattgtgctcattgtcct

SEQ ID NO: 98636 - DNA, 75 bp, Artificial Sequence
  Synthetic
agtagtagactccctaaagagctactagaataacgatggcaactatggaggaactgcagagggaaatcaatgccc

SEQ ID NO: 98637 - DNA, 75 bp, Artificial Sequence
  Synthetic
atgagggtcaactggtgatagccaggcagaaggtgagggatgcagaaaagcaatatgagaaagatccagatgagt

SEQ ID NO: 98638 - DNA, 75 bp, Artificial Sequence
  Synthetic
taaacaaaagaacattgacagatcgagagggtgttgcagtatccattcaagcaaagattgatgaattaaagaggc

SEQ ID NO: 98639 - DNA, 75 bp, Artificial Sequence
  Synthetic
agctagcagataggattgcaacagggaagaatcttggaaaggaacaggacccgacaggggtagaacctggggatc

SEQ ID NO: 98640 - DNA, 75 bp, Artificial Sequence
  Synthetic
atctgaaagagagatcaatgctcagttatggaaatgtgctcgacctaaaccacctggatattgatgagccgacag

SEQ ID NO: 98641 - DNA, 75 bp, Artificial Sequence
  Synthetic
ttatggaaatgtgctcgacctaaaccacctggatattgatgagccgacaggacagacagcagactggttgagtat

SEQ ID NO: 98642 - DNA, 75 bp, Artificial Sequence
  Synthetic
cacctggatattgatgagccgacaggacagacagcagactggttgagtattgttgtctatcttacatcatttgtt

SEQ ID NO: 98643 - DNA, 75 bp, Artificial Sequence
  Synthetic
gtcccgatacttctaaaagctctgtatatgttaacaacaagggggaggcagaccaccaaggacaataaagggact

SEQ ID NO: 98644 - DNA, 75 bp, Artificial Sequence
  Synthetic
cggattcgattcaaagatgatagctccttcgaggatgtcaatggcattcggaagcccaaacatctatatgtgtct

SEQ ID NO: 98645 - DNA, 75 bp, Artificial Sequence
  Synthetic
ttgcctaatgcacagtcaagtatgaaggcagaagagattacacctggtagatataggacagcaatctgtggactt

SEQ ID NO: 98646 - DNA, 75 bp, Artificial Sequence
  Synthetic
taccctgcacaaattaaggcaagacagatgattagtccagtcatgagtgtgatcggattcctggctttggcaaaa

SEQ ID NO: 98647 - DNA, 75 bp, Artificial Sequence
  Synthetic
tccagacacagcagcagtcggcctccttggtggtcctgcaaccaacagggactacctacggcaacggcaagtggc

SEQ ID NO: 98648 - DNA, 75 bp, Artificial Sequence
  Synthetic
aggcagcaggctgtagcatgattgaggacattgagtcaccatcatcaatatgggtgtttgccggggcaccagatc

SEQ ID NO: 98649 - DNA, 75 bp, Artificial Sequence
  Synthetic
gctgtccaccaacatgtcttttcattgcaggtattgctgagcttggggcatttttttccattttgcaggacatgc

SEQ ID NO: 98650 - DNA, 75 bp, Artificial Sequence
  Synthetic
ggaatacgatcatggcatccaagacagttggaacctctgaagagaagctaaggaagaaatcttcattctatcagt

SEQ ID NO: 98651 - DNA, 75 bp, Artificial Sequence
  Synthetic
cttatctcaggagaacacaatcaatgggaatacaactggaccagaggataattgtgctcttcatggtagcttggg

SEQ ID NO: 98652 - DNA, 75 bp, Artificial Sequence
  Synthetic
ggaaagaagcagtaaataatttccacctaggagatgatatggatcccgagctgcgaacattggcacagagcctga

SEQ ID NO: 98653 - DNA, 75 bp, Artificial Sequence
  Synthetic
ttgatgttaaagtgaaggaaatatccaaccaagaacctttaaaactgtaatcagtgaatgtataaccctcattat

SEQ ID NO: 98654 - DNA, 75 bp, Artificial Sequence
  Synthetic
gtgattattatatactactgaatcattatcaatcatacttgtactattattatcaggggaatcagtatatcaggg

SEQ ID NO: 98655 - DNA, 75 bp, Artificial Sequence
  Synthetic
tggctgccttaagtagccttttttttgtatatatggatgtagatttcatttgatctttaaactaatcttgctctc

SEQ ID NO: 98656 - DNA, 75 bp, Artificial Sequence
  Synthetic
acacaaaactacctcaactaaactacctcatttgattgctccttgattgtctttttagggagcatactactacta

SEQ ID NO: 98657 - DNA, 75 bp, Artificial Sequence
  Synthetic
ttgtagcatggacaaccaccagtccttgagcacagtaacaaagtatacacaagtgagttggagagggaaagctga

SEQ ID NO: 98658 - DNA, 75 bp, Artificial Sequence
  Synthetic
aataattgacttgcctggatattatgaggctgtacatccttgcacagtgttctgtgttttatcaggtccaggtgc

SEQ ID NO: 98659 - DNA, 75 bp, Artificial Sequence
  Synthetic
cctacaaagagttgaaggcacatggagtttcatgtcctcaatctcaatgcccttattgttttacccactgtgaac

SEQ ID NO: 98660 - DNA, 75 bp, Artificial Sequence
  Synthetic
ttggggttgtaacccatcagattgcccaggggtgggtacaggatgtacagcatgtgggttatatctagaccagtt

SEQ ID NO: 98661 - DNA, 75 bp, Artificial Sequence
  Synthetic
tagtagtagactccctaaataacaaactctgaaaagaatggataaatatagagaaattcacaataagttgaagga

SEQ ID NO: 98662 - DNA, 75 bp, Artificial Sequence
  Synthetic
actctgaaaagaatggataaatatagagaaattcacaataagttgaaggagttttctcctggtacattaactgca

SEQ ID NO: 98663 - DNA, 75 bp, Artificial Sequence
  Synthetic
gtagagtgtatagattatcttgatagactttacgccgtgagacatgacattgtagaccaaatgattaagcatgac

SEQ ID NO: 98664 - DNA, 75 bp, Artificial Sequence
  Synthetic
tggtctgataataaggattcagaagaagcaatagggaaagtactattatttgcaggggtcccttcaaacattata

SEQ ID NO: 98665 - DNA, 75 bp, Artificial Sequence
  Synthetic
acagcactagagaagaaaataataccaaatcatcctacaggaaagagtctaaaggccttcttcaagatgacacct

SEQ ID NO: 98666 - DNA, 75 bp, Artificial Sequence
  Synthetic
gataattataaaattagtggaacaacaattgagtttgttgaggttactgtcacggcagatgttgacaagggaata

SEQ ID NO: 98667 - DNA, 75 bp, Artificial Sequence
  Synthetic
agagagaagaagcttaaatatgaggcaggcttaacctatattgaacaagagttgcataagttcttcctaaagggt

SEQ ID NO: 98668 - DNA, 75 bp, Artificial Sequence
  Synthetic
gagatcccacaaccctataaaataacatttaatgtagttgcagttcgcacagatggctccaatattactacacaa

SEQ ID NO: 98669 - DNA, 75 bp, Artificial Sequence
  Synthetic
tggcctagtagaagaaatgatggtgttgtccagtatatgaggctagttcaagctgagataagttatgttagagag

SEQ ID NO: 98670 - DNA, 75 bp, Artificial Sequence
  Synthetic
cacttgatcaaaactgaggagagagctgcactagaagccatgtttaatttaaaattcaacataagtacacacaaa

SEQ ID NO: 98671 - DNA, 75 bp, Artificial Sequence
  Synthetic
agccagccctattacataccagattataaggggatggaaccaataggagcaaatattgaagacttagtggactat

SEQ ID NO: 98672 - DNA, 75 bp, Artificial Sequence
  Synthetic
tcgaaagactggttgtctagagctagaaatttttcattttttgaagttaaaggtacagcagtgttcgagtgcttt

SEQ ID NO: 98673 - DNA, 75 bp, Artificial Sequence
  Synthetic
aattcaaatgaggccaatcattgtcaaagatatcctatgtcccgaaagcctagaaatttcctactcatacaatgt

SEQ ID NO: 98674 - DNA, 75 bp, Artificial Sequence
  Synthetic
tctttaatcacatcttataaacctgctaccacattgtcagatcaaattgatagtagaagggcctgttcatacatt

SEQ ID NO: 98675 - DNA, 75 bp, Artificial Sequence
  Synthetic
ctaaacttaattccagatacaccagcatcctatctgatccatgatatggcatatagatacataaacctaacaaga

SEQ ID NO: 98676 - DNA, 75 bp, Artificial Sequence
  Synthetic
gaagatatgattaattattatgccccgcggatacagtttaaacagacacaaaatgtaagagagccaggaacgttt

SEQ ID NO: 98677 - DNA, 75 bp, Artificial Sequence
  Synthetic
aagttgacatcaagtatgttgagagcagaatcaaaagcaatgctagatttacttaataatcataaaagtggtgaa

SEQ ID NO: 98678 - DNA, 75 bp, Artificial Sequence
  Synthetic
aagcatggtgcacaaatagagagcctaaatattgctagtcatattgtacagtctgaatctgttagcctgattaca

SEQ ID NO: 98679 - DNA, 75 bp, Artificial Sequence
  Synthetic
aaaatattatctgatttagaattgaatataactgagccatcaactcaagaatattccacaactaagcatacttat

SEQ ID NO: 98680 - DNA, 75 bp, Artificial Sequence
  Synthetic
gtcgatacagtgttagacaagttttttcaaaatgaaacccagaagtacctgatagatgtgttgaaaaaaacaaca

SEQ ID NO: 98681 - DNA, 75 bp, Artificial Sequence
  Synthetic
gcatggcacataggtcatctcataagggatataacagaaagtttaattgctcattcaggattaaaaagatcaaag

SEQ ID NO: 98682 - DNA, 75 bp, Artificial Sequence
  Synthetic
tattggtccttacactcatacaataacggcaatgtcatattatttattctcccatcaaagtcgcttgaagtagca

SEQ ID NO: 98683 - DNA, 75 bp, Artificial Sequence
  Synthetic
ggttcctttattaggttcattacagttttcagaataggacctggtttagtagataaagataacttggatacaata

SEQ ID NO: 98684 - DNA, 75 bp, Artificial Sequence
  Synthetic
ttaattgatggtgactctcagtggggggtatccaaagttatgagcattgatttaaataggctgctagcattaaat

SEQ ID NO: 98685 - DNA, 75 bp, Artificial Sequence
  Synthetic
atagcttttgaaaaggctttaattgcaacagccacatggttccaatactatacagaagaccaagggcaattccca

SEQ ID NO: 98686 - DNA, 75 bp, Artificial Sequence
  Synthetic
ttacaatatgcaattagatctgtgtttgcaaatcattttctgttagctatatgccaaaagatgaaactctgtgcc

SEQ ID NO: 98687 - DNA, 75 bp, Artificial Sequence
  Synthetic
atctttgacaatttacgttatcttatacctgcagtaacatcattatactctgggtttccatcactgatagaaaaa

SEQ ID NO: 98688 - DNA, 75 bp, Artificial Sequence
  Synthetic
ttatttgaacgtccatttaagtcttcattagaggtatatatatattataatattaagagcctgttagttgcactt

SEQ ID NO: 98689 - DNA, 75 bp, Artificial Sequence
  Synthetic
gctcaaaataataaagccagattctattctaaggtaaagttactaggcttaacagttgaccaatcaactgttggt

SEQ ID NO: 98690 - DNA, 75 bp, Artificial Sequence
  Synthetic
gcaagtggagtttatccttcattcatgtcacgtatagtatacaaacattacaggagcttaatatctgaagtaaca

SEQ ID NO: 98691 - DNA, 75 bp, Artificial Sequence
  Synthetic
acctgtttctttttatttgaaaagggtcttcatggaaatatgaatgaagaagcaaaaattcatcttgagacagtt

SEQ ID NO: 98692 - DNA, 75 bp, Artificial Sequence
  Synthetic
gaatgggcacttaaattcagagagaaggaagaaaagtatggggaatctctagtagaaaatggatatatgatgtgg

SEQ ID NO: 98693 - DNA, 75 bp, Artificial Sequence
  Synthetic
aggaagaaaagtatggggaatctctagtagaaaatggatatatgatgtgggagctgcgagcaaatgcagagttgg

SEQ ID NO: 98694 - DNA, 75 bp, Artificial Sequence
  Synthetic
cagaacaacaattgtactgtcaagatgctattgagttggcagcaatagaattaaataaagtcttggctacaaagt

SEQ ID NO: 98695 - DNA, 75 bp, Artificial Sequence
  Synthetic
ctagtgttgttgctaatagtatattgagtaagaactgggaagaaccatattttagtcaaacaagaaatatcagcc

SEQ ID NO: 98696 - DNA, 75 bp, Artificial Sequence
  Synthetic
tgaaaggcatgtcagggcaggttcaggaagatggccatttatcatcatctgtaacaattatagaggccatccgct

SEQ ID NO: 98697 - DNA, 75 bp, Artificial Sequence
  Synthetic
atttatcaaattcaagacataatcctagcctcctaaaattatatgaggaaacaagggagcagaaagcaatggcaa

SEQ ID NO: 98698 - DNA, 75 bp, Artificial Sequence
  Synthetic
gaattgtgagaaaatatcaaaggacagaggcagataggggcttttttatcacaacacttcctactagatgcaggc

SEQ ID NO: 98699 - DNA, 75 bp, Artificial Sequence
  Synthetic
ttgaaattattgaggactactatgatgccattgccaagaatatttctgaagagtacatatcatatggaggtgaaa

SEQ ID NO: 98700 - DNA, 75 bp, Artificial Sequence
  Synthetic
aaaagattcttgcaattcaaggggcacttgagaaggccttgagatgggcatcaggtgaaagctttatcgaactta

SEQ ID NO: 98701 - DNA, 75 bp, Artificial Sequence
  Synthetic
gtaaccacaaatttattaggatgaagcgtaaactcatgtatgttagtgcagatgctacaaagtggtcaccaggag

SEQ ID NO: 98702 - DNA, 75 bp, Artificial Sequence
  Synthetic
ataattcagcaaagttccgtaggttcacctccatgctacataacggacttcccaataataagctaaaaaactgtg

SEQ ID NO: 98703 - DNA, 75 bp, Artificial Sequence
  Synthetic
taattgatgcacttaaacaagtttataagacagatttttttatgtcaaggaaactaaggaattatattgacagca

SEQ ID NO: 98704 - DNA, 75 bp, Artificial Sequence
  Synthetic
tggaaagccttgacccacacatcaaacagtttttagattttttccctgatgggcaccatggggaagtgaagggaa

SEQ ID NO: 98705 - DNA, 75 bp, Artificial Sequence
  Synthetic
actggctgcagggtaacttgaacaagtgttcttcacttttcggtgttgcaatgtcattactatttaaacaggtat

SEQ ID NO: 98706 - DNA, 75 bp, Artificial Sequence
  Synthetic
ggactaacttattccctgagcttgattgtttctttgagtttgcacatcactctgatgatgcattattcatttatg

SEQ ID NO: 98707 - DNA, 75 bp, Artificial Sequence
  Synthetic
gatacttggaaccagtagatgatgggactgactggtttttgtttgtctcacaacagattcaagcaggccatttgc

SEQ ID NO: 98708 - DNA, 75 bp, Artificial Sequence
  Synthetic
actggtttagtgtaaatacagagatgtggaagagtatgtttaatctacatgagcatatacttcttctaggctcca

SEQ ID NO: 98709 - DNA, 75 bp, Artificial Sequence
  Synthetic
tcaagatctcaccaaagaaaactacagtgtccccgacaaatgctgaatttttatcaacattttttgaaggttgtg

SEQ ID NO: 98710 - DNA, 75 bp, Artificial Sequence
  Synthetic
ctgtatcaataccatttgttaaaatactcttaggttctctatcagacttaccaggattaggttattttgacgatt

SEQ ID NO: 98711 - DNA, 75 bp, Artificial Sequence
  Synthetic
tagcagccgcacaaagtaggtgtgttaaggctctggaccttggagcatcacctcaggttgcacaactagctgtag

SEQ ID NO: 98712 - DNA, 75 bp, Artificial Sequence
  Synthetic
cattgtgcaccagtaaagttgaaagattatatggtacagcgccaggcatggtaaaccaccctgcagcatacttgc

SEQ ID NO: 98713 - DNA, 75 bp, Artificial Sequence
  Synthetic
aggttaagcatactgatacaccaattccattgggaggaaatggtgcaatgtcaataatggagttagcaacagctg

SEQ ID NO: 98714 - DNA, 75 bp, Artificial Sequence
  Synthetic
ggattgggatgtcagataaaaatctattaaagcgcgcacttctgggatactcacacaagagacaaaaatcaatgc

SEQ ID NO: 98715 - DNA, 75 bp, Artificial Sequence
  Synthetic
tatatatattaggtctattcaagtttctgatgaagttatctgatgaaacatttcaacatgagaggttagggcaat

SEQ ID NO: 98716 - DNA, 75 bp, Artificial Sequence
  Synthetic
tttcttttatcgggaaagtacagtggaagatcttcactccaaaatctgaattcgagtttgctgatatgtacacat

SEQ ID NO: 98717 - DNA, 75 bp, Artificial Sequence
  Synthetic
caaaatttttagagttatggagtagtcaacatgtaacttatgattatattattccgaagggcagagacaatcttc

SEQ ID NO: 98718 - DNA, 75 bp, Artificial Sequence
  Synthetic
tcatttatttagtccgaaagctcaatgatccaagtattgttacagcaatgaccatgcagtcacctttgcagctcc

SEQ ID NO: 98719 - DNA, 75 bp, Artificial Sequence
  Synthetic
gatttagaatgcaagctaagcagcacatgaaggtgtgtagattggatggagaatgggttactttcagggaagttc

SEQ ID NO: 98720 - DNA, 75 bp, Artificial Sequence
  Synthetic
tggcagctgcaaacagttttgcggagaattatagtgctactagccaagatatggatctatttcaaacgttaacaa

SEQ ID NO: 98721 - DNA, 75 bp, Artificial Sequence
  Synthetic
gttgtacattttctaaagagtatgcttggaaagatttcctgaatggaattcactgtgatgttatcccgacaaaac

SEQ ID NO: 98722 - DNA, 75 bp, Artificial Sequence
  Synthetic
aggttcaaagggccaaagttgcacgaacattcacagtcagagaaaaggatcagatcatacaaaatagtattcctg

SEQ ID NO: 98723 - DNA, 75 bp, Artificial Sequence
  Synthetic
ctgtcattgggtacaaatttgctgtaactgtagaggaaatgtcagatgtactggacacagccaagttcccagact

SEQ ID NO: 98724 - DNA, 75 bp, Artificial Sequence
  Synthetic
ctctatctgttgacctaaagacaatgaaagacggagtttatcgtgagttagggttggacatatccttacctgatg

SEQ ID NO: 98725 - DNA, 75 bp, Artificial Sequence
  Synthetic
ttatgaaaagaattgcacctatgctctataaatcttctaaatcaagggtagtcattgtccaagggaatgttgaag

SEQ ID NO: 98726 - DNA, 75 bp, Artificial Sequence
  Synthetic
ctataaatcttctaaatcaagggtagtcattgtccaagggaatgttgaagggacagctgaggctatatgtcgcta

SEQ ID NO: 98727 - DNA, 75 bp, Artificial Sequence
  Synthetic
ctggctaaaatcaatgtcattggtaaagactataagagtgaagcctcataaagaagtccttcaagcagtttctat

SEQ ID NO: 98728 - DNA, 75 bp, Artificial Sequence
  Synthetic
aagactataagagtgaagcctcataaagaagtccttcaagcagtttctatttttaatcgcaaagaagatatagga

SEQ ID NO: 98729 - DNA, 75 bp, Artificial Sequence
  Synthetic
aagaagtccttcaagcagtttctatttttaatcgcaaagaagatataggacaacagaaagacttagctgctctta

SEQ ID NO: 98730 - DNA, 75 bp, Artificial Sequence
  Synthetic
aactgtgcatagaagtttggagatggtgtaaagcaaatagtgctccatatagagattggttccaggctctatggt

SEQ ID NO: 98731 - DNA, 75 bp, Artificial Sequence
  Synthetic
tcgaggataaaaccttttcagagtggttagataggttttgtagggttggagttccaccaattgatccagagatcc

SEQ ID NO: 98732 - DNA, 75 bp, Artificial Sequence
  Synthetic
agtgtgcagcattaatgatagctgatataaagggtgattactcagtcttgcagttacaagcgaataggcgagcat

SEQ ID NO: 98733 - DNA, 75 bp, Artificial Sequence
  Synthetic
attcaggtaagcaatatgatgcatattgtgtacaaacatataatgaagtgacaaagctttatgagggagacctaa

SEQ ID NO: 98734 - DNA, 75 bp, Artificial Sequence
  Synthetic
gggtaacatttaattttggtcttgactgtgcaaggcttgagatcttttgggataaaaaggcatatatattagaaa

SEQ ID NO: 98735 - DNA, 75 bp, Artificial Sequence
  Synthetic
catcgattacacaaaagcatgtattgaagatcatgatggatgaggtttcgaaagagttgattaagtgtgggatga

SEQ ID NO: 98736 - DNA, 75 bp, Artificial Sequence
  Synthetic
gatttaatacagaacaggtccaaggagtacggcacatggtgttatttaagacagagtctggatttgaatggggaa

SEQ ID NO: 98737 - DNA, 75 bp, Artificial Sequence
  Synthetic
aaccaaatattccatgtattgtttataagaactgtgtcctaaggacaagccttaggactacgcaagcaattaacc

SEQ ID NO: 98738 - DNA, 75 bp, Artificial Sequence
  Synthetic
ataaatttatgattacaataaaggatgatgggcttcgtgctattgcacaacatgatgaagatagcccaagattcc

SEQ ID NO: 98739 - DNA, 75 bp, Artificial Sequence
  Synthetic
tattagctcatgcatttcacacaataagagatattaggtatcaagcggtagatgctgtaagtaatgtatggttca

SEQ ID NO: 98740 - DNA, 75 bp, Artificial Sequence
  Synthetic
tccacaaaggagtaaaactgtatttaaatcccatcatttcatctggtttacttgagaattttatgaagaatcttc

SEQ ID NO: 98741 - DNA, 75 bp, Artificial Sequence
  Synthetic
cagctgcaatccctcctgctgcatattcactgatcatgaaccgtgcaaaaatatctgttgacctctttatgttta

SEQ ID NO: 98742 - DNA, 75 bp, Artificial Sequence
  Synthetic
acgatttacttaagctaattaaccctaggaatacattggatctatcaggccttgaaacaacaggggatgaattca

SEQ ID NO: 98743 - DNA, 75 bp, Artificial Sequence
  Synthetic
gtactgtaagttcaatgtcaagccgattatggtctgaagaaatgagcttagtagatgatgatgaagagcttgatg

SEQ ID NO: 98744 - DNA, 75 bp, Artificial Sequence
  Synthetic
atgagttcacaattgacttgcaagatgtggattttgagaatatagatatagaagcagacattgaacatttcctgc

SEQ ID NO: 98745 - DNA, 75 bp, Artificial Sequence
  Synthetic
cctattaatcagcacagaggaaactgaatcaaagaaaatgaggggcatagtgaaaatacttgagcctgttagatt

SEQ ID NO: 98746 - DNA, 75 bp, Artificial Sequence
  Synthetic
gattaaaagctgggtatcacgtgggttatctattgagaaagtatatagtcctgttaatattatcttaatgtcacg

SEQ ID NO: 98747 - DNA, 75 bp, Artificial Sequence
  Synthetic
gtatatctccaaaacatttaatttgagtaccaaacaggtctcattattagatccatatgatttaacagaattaga

SEQ ID NO: 98748 - DNA, 75 bp, Artificial Sequence
  Synthetic
gagcattgtccgaggatggggagaatgtgttattgaccagttcgaaagtctcgatagagaggctcagaatatggt

SEQ ID NO: 98749 - DNA, 75 bp, Artificial Sequence
  Synthetic
tgttaataaaggaatatgccctgaggatgttattcctgattcattattttcatttaggcacaccatggtactgtt

SEQ ID NO: 98750 - DNA, 75 bp, Artificial Sequence
  Synthetic
gaggaggttattcccgcaggattctatttcctctttctattaggctttctttctttttcattttccggagcatac

SEQ ID NO: 98751 - DNA, 75 bp, Artificial Sequence
  Synthetic
tattcccgcaggattctatttcctctttctattaggctttctttctttttcattttccggagcatactactacta

SEQ ID NO: 98752 - DNA, 75 bp, Artificial Sequence
  Synthetic
catgagggtcaactggtgatagccaggcagaaggtgagggatgcagaaaaacaatatgaaaaggatccagatgag

SEQ ID NO: 98753 - DNA, 75 bp, Artificial Sequence
  Synthetic
ttattggatttttggctctggcaaaagattggagtgaccgtattgagcagtggctaagtgaaccttgtaagctac

SEQ ID NO: 98754 - DNA, 75 bp, Artificial Sequence
  Synthetic
atcagtgaatttataacccttattatgtgatcactatatactactgaatcattatcaatcatatttacactatta

SEQ ID NO: 98755 - DNA, 75 bp, Artificial Sequence
  Synthetic
tgatccttaaactaatcctgctctttttcctctttttcttgctttctctgcttactaacaacaacactctacctc

SEQ ID NO: 98756 - DNA, 75 bp, Artificial Sequence
  Synthetic
aacactctacctcaacacaacactactacctcatttgcttgctccttgattgtctttttagggagcatactacta

SEQ ID NO: 98757 - DNA, 75 bp, Artificial Sequence
  Synthetic
tagtagtagactccgcaaaagaaagcagttaatcagcaacatgggtttatggaagtggctaataatggccgtttt

SEQ ID NO: 98758 - DNA, 75 bp, Artificial Sequence
  Synthetic
ggtgtggccatgttttgccctaaggaatgtatatgacatgaagattgaatgcccccatacagtcaattttgggga

SEQ ID NO: 98759 - DNA, 75 bp, Artificial Sequence
  Synthetic
aaacagtgtggtcgggtatgtggagctaccgcctatgccaatcgctgacatcactcagatgatgccagagagctc

SEQ ID NO: 98760 - DNA, 75 bp, Artificial Sequence
  Synthetic
ttgcagcatggataaccaccaatctctaaacacaatcacaaagtacacccaagtgagttggagaaagaaagctga

SEQ ID NO: 98761 - DNA, 75 bp, Artificial Sequence
  Synthetic
ccgagcacagtcaagccaaacctcctttgagacagtttcttccgaggtggactttaaaggaacctgtgtattaaa

SEQ ID NO: 98762 - DNA, 75 bp, Artificial Sequence
  Synthetic
tttgagacagtttcttccgaggtggactttaaaggaacctgtgtattaaagcacaagatggtagaggattcctat

SEQ ID NO: 98763 - DNA, 75 bp, Artificial Sequence
  Synthetic
actttaaaggaacctgtgtattaaagcacaagatggtagaggattcctatcgcagccgtaagtcaataatctgtt

SEQ ID NO: 98764 - DNA, 75 bp, Artificial Sequence
  Synthetic
atgatctttcatgcaatagtacattctgtaagcctaccctttatctaattgtgcctgtgcatgcctgtaacatga

SEQ ID NO: 98765 - DNA, 75 bp, Artificial Sequence
  Synthetic
tgaagagctgcctaatagcattaggcccctatagagttcaagatgtctatgagaggacatactgtatgtcagggg

SEQ ID NO: 98766 - DNA, 75 bp, Artificial Sequence
  Synthetic
tccttctagaaggaaaatgctttgtaccagaccggagtgttgtgagcattataaaacatggcatatttgatattg

SEQ ID NO: 98767 - DNA, 75 bp, Artificial Sequence
  Synthetic
caagtgtccatattgtttgcttttttgttgcaatcaagggcagtacatataaaatccttgaacaagttaaaaaat

SEQ ID NO: 98768 - DNA, 75 bp, Artificial Sequence
  Synthetic
catttgaactaacatgcaatgatactgataataagattcaggggtattatatatgtcttgtgggagggaattcag

SEQ ID NO: 98769 - DNA, 75 bp, Artificial Sequence
  Synthetic
atatgtcttgtgggagggaattcagcacccatatatgtgccaacccttgatgacttcaggtcaatggaggcattt

SEQ ID NO: 98770 - DNA, 75 bp, Artificial Sequence
  Synthetic
gctgggatttttaagtccccacatggggaagatcacgaccttgcaggggaggaagtagcctcttattccattgta

SEQ ID NO: 98771 - DNA, 75 bp, Artificial Sequence
  Synthetic
ggaagtagcctcttattccattgtagggcctgccaatgcaaaagtaccccacagtgccagtgcagatacactgag

SEQ ID NO: 98772 - DNA, 75 bp, Artificial Sequence
  Synthetic
tttagttgccttttcaggaatcccatcctactcatccttcagtgtcctcacaggatctacagatgcccgtcatgt

SEQ ID NO: 98773 - DNA, 75 bp, Artificial Sequence
  Synthetic
ctttagcccaggtttctttccacaactaaaccagacaaggtgtgataaaactgccataccattaacctggacagg

SEQ ID NO: 98774 - DNA, 75 bp, Artificial Sequence
  Synthetic
aatgattgacctacctggttattatgaagcagtacacccttgcactgtcttctgtgttttgtccggtcctggtgc

SEQ ID NO: 98775 - DNA, 75 bp, Artificial Sequence
  Synthetic
gtcatgtgaagccttttctgaaggcgggatctttaatataacttctcccatgtgtttagtctcagagcaaaatcg

SEQ ID NO: 98776 - DNA, 75 bp, Artificial Sequence
  Synthetic
ctttaggtcatcagagcaacaagtgaactttgtttgtcaaagagtagatatggatattgtggtctattgtaatgg

SEQ ID NO: 98777 - DNA, 75 bp, Artificial Sequence
  Synthetic
gcaaaagaaagtaatattaacaaaaactctagtaattggccaatgtatatatacaataaccagcttattttcatt

SEQ ID NO: 98778 - DNA, 75 bp, Artificial Sequence
  Synthetic
gcttcctggtgttgcacattctattgctgtagaactgtgtgttcctggcttccacggttgggctacagctgcttt

SEQ ID NO: 98779 - DNA, 75 bp, Artificial Sequence
  Synthetic
gcttgtaacattttgctttggctgggttttaatacctgcagtcacccttgtcatattaacaattttaaagtttat

SEQ ID NO: 98780 - DNA, 75 bp, Artificial Sequence
  Synthetic
tgcaaacatcttccatacaagcaatcaggaaaatcggctcaaatcagttttgaagaaaatcaaggaagaatttga

SEQ ID NO: 98781 - DNA, 75 bp, Artificial Sequence
  Synthetic
gaagactaaaggctccatggtttgcgatgtgtgtaaatatgaatgtgagacatataaagagttgaaggcacatgg

SEQ ID NO: 98782 - DNA, 75 bp, Artificial Sequence
  Synthetic
agtatcatgtcctcaatctcaatgcccatactgcttcacccactgtgagcctacagaagcagcatttcaagccca

SEQ ID NO: 98783 - DNA, 75 bp, Artificial Sequence
  Synthetic
ctacaaagtatgccaagtcactcatagatttcgggatgatttaaagaaaacagtgaccccccaaaattttacacc

SEQ ID NO: 98784 - DNA, 75 bp, Artificial Sequence
  Synthetic
aggctgttatcgtaccttgaatctgtttagatataaaagccgatgttacatcttcacaatgtgggtatttttgct

SEQ ID NO: 98785 - DNA, 75 bp, Artificial Sequence
  Synthetic
gatcctggaatccattttatgggctgcaagtgcttctgaaacaccctcaacccctatttggaatgataatgctca

SEQ ID NO: 98786 - DNA, 75 bp, Artificial Sequence
  Synthetic
cggagtaggatctatcccgatgcacacagaccttgaattagatttttccctgacatctagctctaagtacactta

SEQ ID NO: 98787 - DNA, 75 bp, Artificial Sequence
  Synthetic
tgacatctagctctaagtacacttatcgacggaagctcacaaacccacttgagaagactcaagcagtagatcttc

SEQ ID NO: 98788 - DNA, 75 bp, Artificial Sequence
  Synthetic
atattgagttagctgtacagaccataggtgtagacgtgcatgctttggggcattggtttgacggccgcttaaatc

SEQ ID NO: 98789 - DNA, 75 bp, Artificial Sequence
  Synthetic
taaagacctcctttcattgttatggtgcatgtacaaaatatgaatacccatggcatactgccaagtgtcactatg

SEQ ID NO: 98790 - DNA, 75 bp, Artificial Sequence
  Synthetic
aaagggattatcaatatgagacaagctggggttgcaatcctgcagattgtcctggagttggaacaggctgtactg

SEQ ID NO: 98791 - DNA, 75 bp, Artificial Sequence
  Synthetic
catgtggtctatatttagaccaattaaaacctgttggcagtgcctataagatcattacaataaaatatagcagaa

SEQ ID NO: 98792 - DNA, 75 bp, Artificial Sequence
  Synthetic
gagtttgtgttcagtttggagaagaaaacctgtgcaaggtaattgacatgaatgactgctttgtatcaagacatg

SEQ ID NO: 98793 - DNA, 75 bp, Artificial Sequence
  Synthetic
ttaaaatctgtataataggtacagtctcaaaattttctcaaggtgatacactattattttttggcccgctagagg

SEQ ID NO: 98794 - DNA, 75 bp, Artificial Sequence
  Synthetic
gtggtggcttaatcttcaaacattggtgcacatccacgtgccagtttggggaccctggggatattatgagcccaa

SEQ ID NO: 98795 - DNA, 75 bp, Artificial Sequence
  Synthetic
gagataaaggcttcctttgtcctgaattccccgggagctttcgaaagaaatgcaactttgcaactactcctgtct

SEQ ID NO: 98796 - DNA, 75 bp, Artificial Sequence
  Synthetic
gtgagtatgacgggaacatggtctcagggtacaagaaagtcatggctacaattgattcctttcaatcctttaata

SEQ ID NO: 98797 - DNA, 75 bp, Artificial Sequence
  Synthetic
ctagcatgatgcatttcactgatgaaagaattgagtggaaagatcctgatgggatgttgcgggaccatatcaaca

SEQ ID NO: 98798 - DNA, 75 bp, Artificial Sequence
  Synthetic
ttttggttaccaaggatattgactttgacaaccttggtgacaatccatgcaaagttgggctacagacatcggcta

SEQ ID NO: 98799 - DNA, 75 bp, Artificial Sequence
  Synthetic
ttgaaggggcatggggttcaggtgttggcttcacactgacatgtcaagtttccttaacagagtgtcctacttttc

SEQ ID NO: 98800 - DNA, 75 bp, Artificial Sequence
  Synthetic
tgacatcaattaaagcatgtgataaagcaatttgttatggtgcagaaagcataacacttacaaggggacagaata

SEQ ID NO: 98801 - DNA, 75 bp, Artificial Sequence
  Synthetic
ctgtcaaagtttcagggaagggtggacacagtggctcaacctttaaatgctgtcatggggaagagtgctcacaaa

SEQ ID NO: 98802 - DNA, 75 bp, Artificial Sequence
  Synthetic
ttgggctccatgctgccgcacctcatctagataaagttaacgggatctcagagatggaaaacagcaaagtctatg

SEQ ID NO: 98803 - DNA, 75 bp, Artificial Sequence
  Synthetic
atgatggagcaccagaatgtggcataaagtgctggtttgtgaagtcaggtgaatggatttcaggcatcttcaatg

SEQ ID NO: 98804 - DNA, 75 bp, Artificial Sequence
  Synthetic
gtaattggatagttctcattgtgttatgtgcatttttaatcttttcacttgtattattaagcctcctttgtcctg

SEQ ID NO: 98805 - DNA, 75 bp, Artificial Sequence
  Synthetic
ttagaaagcacaagaaggcatagtcctatagtactaaacacataactacttcatttataattaacttttattaac

SEQ ID NO: 98806 - DNA, 75 bp, Artificial Sequence
  Synthetic
tgctgtattttattatattttatctaacacactaaaaaaaatagtagcttcttaaccatataacttaaccttttc

SEQ ID NO: 98807 - DNA, 75 bp, Artificial Sequence
  Synthetic
atagtagcttcttaaccatataacttaaccttttcttctgtatgatgtcttaacatcttgcggagtctactacta

SEQ ID NO: 98808 - DNA, 75 bp, Artificial Sequence
  Synthetic
acattctacctcaacacaacctaactacctcattagcttgctccttgattgtctttttagggagcatactctact

SEQ ID NO: 98809 - DNA, 75 bp, Artificial Sequence
  Synthetic
tgtacagccttaacatatatattaatttgtatattttattatactctatctaacacactaaaaaaaaaatagtag

SEQ ID NO: 98810 - DNA, 75 bp, Artificial Sequence
  Synthetic
atagtagctgtctaaccatataacttagatttctcctctgtatgatgtcttaacatcttgcggagtctactacta

SEQ ID NO: 98811 - DNA, 75 bp, Artificial Sequence
  Synthetic
ttttcctctttttcttgctttctctgcttactaacaacaacactctacctcaacacaaaactacttcaacataac

SEQ ID NO: 98812 - DNA, 75 bp, Artificial Sequence
  Synthetic
acacaaaactacttcaacataactacctcatttgcttgctccttgattgtctttttagggagcatactactacta

SEQ ID NO: 98813 - DNA, 75 bp, Artificial Sequence
  Synthetic
ttctattagaagggaagtgttttgtcccagatcagagtgtagtcggcattgtcaagcacggtatctttgacattg

SEQ ID NO: 98814 - DNA, 75 bp, Artificial Sequence
  Synthetic
ctgtgtgtttctactattttcattggtgttgcttagcatcctttgtcctgttagaaaacacaaaaaatcataaat

SEQ ID NO: 98815 - DNA, 75 bp, Artificial Sequence
  Synthetic
cgttaaatttattaccatgttactgtgtatagctataacatatacattaattattgtatttcattatattttatc

SEQ ID NO: 98816 - DNA, 75 bp, Artificial Sequence
  Synthetic
taacacactaaagaaaatagtagctttctaaccacaaaacttagattctacttctgtatgatgtcttaacatctt

SEQ ID NO: 98817 - DNA, 75 bp, Artificial Sequence
  Synthetic
atagtagctttctaaccacaaaacttagattctacttctgtatgatgtcttaacatcttgcggagtctactacta

SEQ ID NO: 98818 - DNA, 75 bp, Artificial Sequence
  Synthetic
tagtagtagactccctaaagagctacgaaaacaacgatggcaactatggaggaattgcagagagaaatcaatgcc

SEQ ID NO: 98819 - DNA, 75 bp, Artificial Sequence
  Synthetic
ggaattgcagagagaaatcaatgcccatgagggtcaactggtgattgctaggcagaaggtgagagatgcagagaa

SEQ ID NO: 98820 - DNA, 75 bp, Artificial Sequence
  Synthetic
ggcagaaggtgagagatgcagagaaacagtatgaaaaggaccctgatgagctaaataagagaacattgacagaca

SEQ ID NO: 98821 - DNA, 75 bp, Artificial Sequence
  Synthetic
gagaaggtgttgctgcatcaatccaggcaaagattgatgaactaaaaagacagctagcagataggattgcaacag

SEQ ID NO: 98822 - DNA, 75 bp, Artificial Sequence
  Synthetic
ggaaaaatcttggaaaggaacaggacccaacgggggtagagcctggggatcatctgaaggagagatcaatgctta

SEQ ID NO: 98823 - DNA, 75 bp, Artificial Sequence
  Synthetic
gctatggaaatgtactggatttgaaccatctggatattgatgagcccacggggcaaacagcagattggctgagta

SEQ ID NO: 98824 - DNA, 75 bp, Artificial Sequence
  Synthetic
ttgttatttacctaacatcctttgttgtcccaatactactgaaggccttgtatatgttgacgacacgggggcgac

SEQ ID NO: 98825 - DNA, 75 bp, Artificial Sequence
  Synthetic
aaactaccaaagataataagggaaccagaattcgcttcaaagacgacagctcatttgaggatgtgaatggaatcc

SEQ ID NO: 98826 - DNA, 75 bp, Artificial Sequence
  Synthetic
ggaaaccaaagcatctagatgtgtccctaccaaatgcacagtcgagcatgaaagcagaagagattacacctggga

SEQ ID NO: 98827 - DNA, 75 bp, Artificial Sequence
  Synthetic
caaatgatcagcccggtaatgagtgtgattggttatttagcacttgcaaaggactggagtgaccgcatcgaacag

SEQ ID NO: 98828 - DNA, 75 bp, Artificial Sequence
  Synthetic
tggttaggtgaaccttgtaagcttctccctgatacagcagcagtgagcctccttggtggtcctgcaacaaatagg

SEQ ID NO: 98829 - DNA, 75 bp, Artificial Sequence
  Synthetic
gattacttacggcagagacaagtagcattaggaaacatggagacaaaagaatcaaaggcaatacgccagcatgct

SEQ ID NO: 98830 - DNA, 75 bp, Artificial Sequence
  Synthetic
gagactgcaggctgtagcatgatagaggatattgagtcaccatcatcaatatgggtctttgctggagcaccagac

SEQ ID NO: 98831 - DNA, 75 bp, Artificial Sequence
  Synthetic
cgttgcccaccaacatgcttgtttattgcagggattgctgagttgggggcatttatctcggtcttacaggacatg

SEQ ID NO: 98832 - DNA, 75 bp, Artificial Sequence
  Synthetic
cgaaacacaataatggcatcaaagacagtaggaacatctgaagagaagcttcgcaagaaatcctcattttaccaa

SEQ ID NO: 98833 - DNA, 75 bp, Artificial Sequence
  Synthetic
tcataccttggaagaacacaatcaatgggaatacaactggaccagagaattattgttctcttcatggttgcttgg

SEQ ID NO: 98834 - DNA, 75 bp, Artificial Sequence
  Synthetic
ggcaaagaggcagtggacaatttccatctaggggacgatgtggaccctgaattgaggacactagcacaaagcctg

SEQ ID NO: 98835 - DNA, 75 bp, Artificial Sequence
  Synthetic
attgatgttaaagtgaaggaaatctctgaccaagaaccattaaagctataatcaatgaatgtataatcctattat

SEQ ID NO: 98836 - DNA, 75 bp, Artificial Sequence
  Synthetic
gtgatcactatatactactgaattattatcaatcatatttgcattattataatcaggggaattattatatcaggg

SEQ ID NO: 98837 - DNA, 75 bp, Artificial Sequence
  Synthetic
ttatcaatcatatttgcattattataatcaggggaattattatatcagggtttgggtacatttatgggtgggaat

SEQ ID NO: 98838 - DNA, 75 bp, Artificial Sequence
  Synthetic
aggctgccttaagtagcctttttttgtatatatggatgtagatttcatttggtcatatactaatcatgccttctt

SEQ ID NO: 98839 - DNA, 75 bp, Artificial Sequence
  Synthetic
gtatatatggatgtagatttcatttggtcatatactaatcatgccttcttttcttatctttctgccttatctgct

SEQ ID NO: 98840 - DNA, 75 bp, Artificial Sequence
  Synthetic
tactaacagcaacaacctacctcaacacaactacctcatttgcttgctccttgattgtctatttagggagcatac

SEQ ID NO: 98841 - DNA, 75 bp, Artificial Sequence
  Synthetic
agcaacaacctacctcaacacaactacctcatttgcttgctccttgattgtctatttagggagcatactactact

SEQ ID NO: 98842 - DNA, 75 bp, Artificial Sequence
  Synthetic
ctatcctgcacagatcaaagccagacaaatgattagccctgtcatgagtgtaatcggatttttggcactggcgaa

SEQ ID NO: 98843 - DNA, 75 bp, Artificial Sequence
  Synthetic
tatagtgctctttatggttgcctggggtaaagaggctgtggataatttccaccttggagatgatatggatcctga

SEQ ID NO: 98844 - DNA, 75 bp, Artificial Sequence
  Synthetic
ggtaaagaggctgtggataatttccaccttggagatgatatggatcctgagttaaggacgctggcacaaagcctg

SEQ ID NO: 98845 - DNA, 75 bp, Artificial Sequence
  Synthetic
tgtatatatggatgtagatttcatttggtccttgaactaatcttgctttctttcctctttttctggcttcctctg

SEQ ID NO: 98846 - DNA, 75 bp, Artificial Sequence
  Synthetic
cttactaataacaacattctacctcaacacaaaactacctcaacctaactacctcattagctcgctccttgattg

SEQ ID NO: 98847 - DNA, 75 bp, Artificial Sequence
  Synthetic
acacaaaactacctcaacctaactacctcattagctcgctccttgattgtctttttagggagcatcctactacta

SEQ ID NO: 98848 - DNA, 75 bp, Artificial Sequence
  Synthetic
tagtagtagactccgcaaaaaagagcagtgaatcagcaacatggggatatggaagtggctagtgatggccagttt

SEQ ID NO: 98849 - DNA, 75 bp, Artificial Sequence
  Synthetic
aaacagcgtgataggttatgtggaattgccccctatgccattggctgatacagcacaactggtgcctgaaagttc

SEQ ID NO: 98850 - DNA, 75 bp, Artificial Sequence
  Synthetic
ttgtaacatggacaaccaccaatcaatgaatacaataacaaaatatacccaggtaagttggagaagtaaggttga

SEQ ID NO: 98851 - DNA, 75 bp, Artificial Sequence
  Synthetic
ccaggcacaagccagccaaaattcatttgaagcagtgtctgctgaagttgatcttaaaggaacatgtgttttaaa

SEQ ID NO: 98852 - DNA, 75 bp, Artificial Sequence
  Synthetic
gcataaaatgctggaggaatcataccgcagtagaaaatcaattacttgctatgacctctcatgcaacagcaccta

SEQ ID NO: 98853 - DNA, 75 bp, Artificial Sequence
  Synthetic
ctgtaagcccaccctctacatgatcgtaccaattcatgcatgtaacatgatgaaaggttgcttaattgcattagg

SEQ ID NO: 98854 - DNA, 75 bp, Artificial Sequence
  Synthetic
gccttacagagtacaagtggtctacgaaagaacctactgcatgacaggggtcctgatagaaggaaaatgttttgt

SEQ ID NO: 98855 - DNA, 75 bp, Artificial Sequence
  Synthetic
tccagaccagagtgttgttagtatcatcaaacatgggatttttgatatagcaagtgttcacattgtttgtttctt

SEQ ID NO: 98856 - DNA, 75 bp, Artificial Sequence
  Synthetic
tgtagcggttaagggaaacacatataaactgtttgaacaggtcaaaaagtcatttcaatccacatgtaatgatac

SEQ ID NO: 98857 - DNA, 75 bp, Artificial Sequence
  Synthetic
tgaaaataaagtgcagggatattacatctgtattgtggggggaaactctgcaccaatatgtgtaccaacacttga

SEQ ID NO: 98858 - DNA, 75 bp, Artificial Sequence
  Synthetic
tgattttaggtccatggaggcattttcagggatttttagatcaccacatggagaagaccatgacctagctgggga

SEQ ID NO: 98859 - DNA, 75 bp, Artificial Sequence
  Synthetic
agagattgcttcttactctattgttggacctgccaatgcaaaagtgcctcacagtgctagctcagatacattaag

SEQ ID NO: 98860 - DNA, 75 bp, Artificial Sequence
  Synthetic
cctaattgcctattctggtataccatcctattcttcactcagcattcttgcaggctctacagaagctaagcatgt

SEQ ID NO: 98861 - DNA, 75 bp, Artificial Sequence
  Synthetic
atttagccctggtttttttccacaacttaatcacacaaagtgtgacaagactgccatcccgcttacttggacagg

SEQ ID NO: 98862 - DNA, 75 bp, Artificial Sequence
  Synthetic
gatgattgacttgcctggatactacgaagctatacatccttgtacagtcttctgtgttttatcaggccctggggc

SEQ ID NO: 98863 - DNA, 75 bp, Artificial Sequence
  Synthetic
atcatgtgaagcattttctgaaggcgggattttcaacataacatcccctatgtgcttagtatcaaaacaaaatcg

SEQ ID NO: 98864 - DNA, 75 bp, Artificial Sequence
  Synthetic
attccggttgacagagcagcaggtaaactttgtgtgtcagagggttgatatggacattattgtgtattgtaatgg

SEQ ID NO: 98865 - DNA, 75 bp, Artificial Sequence
  Synthetic
acagaggaaagtgatactgacaaaaaccttagtcataggacagtgtatatatactataacaagtttattctcact

SEQ ID NO: 98866 - DNA, 75 bp, Artificial Sequence
  Synthetic
actgcctggggtagcacactctattgctgttgaactctgtgtgcctgggttccatggttgggctacagctgccct

SEQ ID NO: 98867 - DNA, 75 bp, Artificial Sequence
  Synthetic
acttgtcacattctgctttggatgggttcttataccagcaataacatttgttatcctcacaattttaaagttcat

SEQ ID NO: 98868 - DNA, 75 bp, Artificial Sequence
  Synthetic
tgcaaatattttccacacaagtaaccaagggaataggcttaaatcagtattaaagaaaataaaggaagaatttga

SEQ ID NO: 98869 - DNA, 75 bp, Artificial Sequence
  Synthetic
aaagacaaaagggtcaatggtgtgtgatgtctgtaagtacgagtgtgaaacttataaagaactgaaggcgcatgg

SEQ ID NO: 98870 - DNA, 75 bp, Artificial Sequence
  Synthetic
ggtttcatgccctcaatctcaatgtccatattgctttactcattgtgaacctacagaagcagcattccaggccca

SEQ ID NO: 98871 - DNA, 75 bp, Artificial Sequence
  Synthetic
ttatagagtgtgccaagtcacccatagattcagggatgacttaaagaagactgttactcctcaaaactttacacc

SEQ ID NO: 98872 - DNA, 75 bp, Artificial Sequence
  Synthetic
tggttgttatcggacactaaacttgttcagatataaaagtagatgttatatttttacaatgtgggtctgccttct

SEQ ID NO: 98873 - DNA, 75 bp, Artificial Sequence
  Synthetic
ggtcctggagtcaatactttgggctgcaagtgcttcagaagtacccttaaatcctatatggaatgataatgctca

SEQ ID NO: 98874 - DNA, 75 bp, Artificial Sequence
  Synthetic
tggggtagggtctgtgccaatgcatacagatttagagctggacttttccttgacatcaagctcaaagtatacata

SEQ ID NO: 98875 - DNA, 75 bp, Artificial Sequence
  Synthetic
ccgcagaaggctgacaaatccacttgaggaaacacaagcaattaaccttcacattgaaatagaagaacaaacaat

SEQ ID NO: 98876 - DNA, 75 bp, Artificial Sequence
  Synthetic
tggtgttgatgtacatgccctaggtcattggtttgatggcaggcttaacctgaaaacatctttccactgttatgg

SEQ ID NO: 98877 - DNA, 75 bp, Artificial Sequence
  Synthetic
cgcctgcacaaaatatgagtatccctggcatactgcaaagtgtcactatgaacgggattaccagtatgagacaag

SEQ ID NO: 98878 - DNA, 75 bp, Artificial Sequence
  Synthetic
ttggggctgtaacccagctgattgcccaggggtgggaacaggttgcacagcatgtggattataccttgatcaatt

SEQ ID NO: 98879 - DNA, 75 bp, Artificial Sequence
  Synthetic
aaagcctgttggtagtgcatataaaattattacaataagatatagcagaaaagtttgtgttcagtttggggaaga

SEQ ID NO: 98880 - DNA, 75 bp, Artificial Sequence
  Synthetic
aaatctatgtaaagtgatagacatgaatgattgctttgtatctagacatgtcaaagtatgtataattggtacagt

SEQ ID NO: 98881 - DNA, 75 bp, Artificial Sequence
  Synthetic
ctctaaattttctcaaggtgatacactattattctttggaccacttgagggcggtggtctaatatttaaacactg

SEQ ID NO: 98882 - DNA, 75 bp, Artificial Sequence
  Synthetic
gtgcacatctacatgccagtttggagacccaggagatattatgagtcctcgagataagggatttttatgccctga

SEQ ID NO: 98883 - DNA, 75 bp, Artificial Sequence
  Synthetic
attccctggaagctttaggaaaaaatgcaattttgccactacccctctttgtgagtatgatggcaatatggtttc

SEQ ID NO: 98884 - DNA, 75 bp, Artificial Sequence
  Synthetic
aggttacaagaaagtaatggcaactattgactcttttcaatccttcaacaccagtactatgcactttactgatga

SEQ ID NO: 98885 - DNA, 75 bp, Artificial Sequence
  Synthetic
gagaatagagtggaaagacccagatggaatgttaagggaccatataaacattctggtaactaaggatattgactt

SEQ ID NO: 98886 - DNA, 75 bp, Artificial Sequence
  Synthetic
tgataatctcggtgaaaacccatgtaaagttggcttgcagacatcctcaattgaaggggcctggggatctggtgt

SEQ ID NO: 98887 - DNA, 75 bp, Artificial Sequence
  Synthetic
aggttttacacttacatgcctagtatctttaacagagtgtcctactttcttgacttcaattaaggcgtgtgacaa

SEQ ID NO: 98888 - DNA, 75 bp, Artificial Sequence
  Synthetic
agccatatgctatggtgcagaaagtgtgacattaacgagaggccagaacacagtaaaggtgtcaggtaaaggtgg

SEQ ID NO: 98889 - DNA, 75 bp, Artificial Sequence
  Synthetic
tcatagtggttcaaccttcaaatgctgtcatggagaagaatgttcacaaattggactccatgctgctgcacctca

SEQ ID NO: 98890 - DNA, 75 bp, Artificial Sequence
  Synthetic
ccttgataaagtcaatggaatttctgaaattgaaaataacaaagtatatgatgatggagcaccccagtgtggagt

SEQ ID NO: 98891 - DNA, 75 bp, Artificial Sequence
  Synthetic
aaagtgctggtttgtaaaatctggagaatggatttcagggatcttcagtggaaattggattgtgctcattgttct

SEQ ID NO: 98892 - DNA, 75 bp, Artificial Sequence
  Synthetic
ttgtgtattcttattgttttcactggcgttgctcagtgtcctttgtcctgtcaggaggcataaaaagtcataaat

SEQ ID NO: 98893 - DNA, 75 bp, Artificial Sequence
  Synthetic
aattgatattattttcacactattatgtataaccttactatatatgttaagttgtattttctattataacctacc

SEQ ID NO: 98894 - DNA, 75 bp, Artificial Sequence
  Synthetic
taacacactaaaaaaaatagtagctgtctaaccatacaacttagattttttctctgtatgatgtcttaacatctt

SEQ ID NO: 98895 - DNA, 75 bp, Artificial Sequence
  Synthetic
atagtagctgtctaaccatacaacttagattttttctctgtatgatgtcttaacatcttgcggagtctactacta

SEQ ID NO: 98896 - DNA, 75 bp, Artificial Sequence
  Synthetic
gccagtgcatcagaaacaccgttaactcctgtttggaatgacaatgcccatggtgtaggctctgtgcctatgcac

SEQ ID NO: 98897 - DNA, 75 bp, Artificial Sequence
  Synthetic
acagatctggagcttgatttttctctgacatctagttctaagtatacataccgcaggaagctaacaaacccactg

SEQ ID NO: 98898 - DNA, 75 bp, Artificial Sequence
  Synthetic
gaagaagcacaatcaattgatctccatatcgaaatagaagagcaaactatcggtgttgacgtacatgctctggga

SEQ ID NO: 98899 - DNA, 75 bp, Artificial Sequence
  Synthetic
cattggtttgatggccgtctcaaccttaaaacatcctttcactgttatggtgcctgtacaaagtatgagtacccg

SEQ ID NO: 98900 - DNA, 75 bp, Artificial Sequence
  Synthetic
tggcacactgcaaagtgtcattatgaacgagattaccaatatgagacgagctggggttctaatccaacagactgc

SEQ ID NO: 98901 - DNA, 75 bp, Artificial Sequence
  Synthetic
tagtagtagactccctaaagagctactagaataacgatggcaactatggaggaactgcagagggaaatcaatgcc

SEQ ID NO: 98902 - DNA, 75 bp, Artificial Sequence
  Synthetic
ttaaacaagagaacattaacagatcgagagggtgttgcagtatccatccaagcaaagattgatgaattgaagagg

SEQ ID NO: 98903 - DNA, 75 bp, Artificial Sequence
  Synthetic
caactggcagatcggattgcaaccggaaagaatcttgggaaagagcaagacccaacaggggtagaacctggagat

SEQ ID NO: 98904 - DNA, 75 bp, Artificial Sequence
  Synthetic
gaaagaatcttgggaaagagcaagacccaacaggggtagaacctggagatcatctgaaagagagatcaatgctca

SEQ ID NO: 98905 - DNA, 75 bp, Artificial Sequence
  Synthetic
ggacagacagcagactggttgagtattgttgtctatctcacatcacttgttgtcccgatacttctaaaagctctg

SEQ ID NO: 98906 - DNA, 75 bp, Artificial Sequence
  Synthetic
tttgcttaatgcacagtcaagtatgaaggcagaagagattacacctggtagatataggacagcaatctgtggacc

SEQ ID NO: 98907 - DNA, 75 bp, Artificial Sequence
  Synthetic
gaggcagcaggctgcagcatgattgaggatattgagtcaccatcctcaatatgggtgtctgctggggcaccagac

SEQ ID NO: 98908 - DNA, 75 bp, Artificial Sequence
  Synthetic
ttactaacaacaacattctacctcaacacaactacctcatttgattgctccttgattgtctctttagggagccta

SEQ ID NO: 98909 - DNA, 75 bp, Artificial Sequence
  Synthetic
acaacaacattctacctcaacacaactacctcatttgattgctccttgattgtctctttagggagcctactacta

SEQ ID NO: 98910 - DNA, 75 bp, Artificial Sequence
  Synthetic
gatggcaactatggaagaactacagagggaaatcaatgcccatgagggccagctggtgatagccaggcagaaggt

SEQ ID NO: 98911 - DNA, 75 bp, Artificial Sequence
  Synthetic
atacgtcaacatgctgaagctgcaggctgtagcatgattgaagatattgagtcaccttcgtcaatatgggtcttt

SEQ ID NO: 98912 - DNA, 75 bp, Artificial Sequence
  Synthetic
gcaggggcccctgatcgcagcccaccgacatgcatgttcattgcagggattgatgaacttggggcatttttttcc

SEQ ID NO: 98913 - DNA, 75 bp, Artificial Sequence
  Synthetic
gtataacccttattatgtaatcactatatactactgaatcattatcaatcacattcgcactattattatcagggg

SEQ ID NO: 98914 - DNA, 75 bp, Artificial Sequence
  Synthetic
aatcattatatcagggtatgggtgcatttatgggtgggaattattacttaaagggtgggtcagttaatccgttgt

SEQ ID NO: 98915 - DNA, 75 bp, Artificial Sequence
  Synthetic
ctctggctttttttgcttactaacaacaacactctacctcaacacaaaactaccccaacctaactacctcatttg

SEQ ID NO: 98916 - DNA, 75 bp, Artificial Sequence
  Synthetic
ctgaataagagagcattaacagacagggaaggggttgcagcatcaatccaggccaagattgatgaactgaaaagg

SEQ ID NO: 98917 - DNA, 75 bp, Artificial Sequence
  Synthetic
catctgaaagagagatcaatgcttagttatggaaatgtattggacttgaatcatctggatattgatgagcctact

SEQ ID NO: 98918 - DNA, 75 bp, Artificial Sequence
  Synthetic
cttgcccaatgcccaatcgagcatgaaggcagaagagatcacaccgggtaggtacagaacagcaatctttgaact

SEQ ID NO: 98919 - DNA, 75 bp, Artificial Sequence
  Synthetic
ggtaaagaggctgtggataatccccacaccggagatgatgcagaccctgagctaagaacgctggcacaaagcctg

SEQ ID NO: 98920 - DNA, 75 bp, Artificial Sequence
  Synthetic
tctataacagcaatggcaactatggaagaattgcaaaaggagatcaatgcccatgagggtcagcttgtgatagca

SEQ ID NO: 98921 - DNA, 75 bp, Artificial Sequence
  Synthetic
aggcaaaaagtaagggatgcagaaagacaatatgagaaggacccagatgaattaaataaaagagcattaacagac

SEQ ID NO: 98922 - DNA, 75 bp, Artificial Sequence
  Synthetic
agggagggggttgcagcatccattcaggcaaaaattgacgaattgaagagacaattggcagataggattgcaact

SEQ ID NO: 98923 - DNA, 75 bp, Artificial Sequence
  Synthetic
ggaaaaaaccttggaaaagagcaagacccgacaggtgttgaacctggagaccatttaaaagaaagatcaatgctt

SEQ ID NO: 98924 - DNA, 75 bp, Artificial Sequence
  Synthetic
agttatgggaatgtactggacttaaaccatctagacattgatgaaccaacaggacagactgcagattggctgagc

SEQ ID NO: 98925 - DNA, 75 bp, Artificial Sequence
  Synthetic
attgttgtttaccttacatccttcgtggttccaatactcctgaaggccctttatatgctaacaacaaggggaaga

SEQ ID NO: 98926 - DNA, 75 bp, Artificial Sequence
  Synthetic
cagacaaccaaggataataaaggaacaagaattcgattcaaagatgacagctcctttgaggatgtgaatggaatc

SEQ ID NO: 98927 - DNA, 75 bp, Artificial Sequence
  Synthetic
cggaagccaaagcatctctatgtgtccttgcccaatgcacagtctagcatgaaagcagaagagataacacctgga

SEQ ID NO: 98928 - DNA, 75 bp, Artificial Sequence
  Synthetic
agatacaggacggcaatctgtggattatatcctgctcagattaaagctagacagatggtcagccctgtcatgagt

SEQ ID NO: 98929 - DNA, 75 bp, Artificial Sequence
  Synthetic
gtgatcggatttctggccttggctaaggattggggtgatagaattgagcagtggctgagtgaaccctgtaaactc

SEQ ID NO: 98930 - DNA, 75 bp, Artificial Sequence
  Synthetic
cttcctgacacagcagcagttagcctccatggtggtcctgcaactaatagagattatctccgacagaggcaggca

SEQ ID NO: 98931 - DNA, 75 bp, Artificial Sequence
  Synthetic
gctttaggaaacatggaaaccaaagaatcaaaggcaattcgtcaacatgcagagacagctggctgtagcatgata

SEQ ID NO: 98932 - DNA, 75 bp, Artificial Sequence
  Synthetic
aatcaaaggcaattcgtcaacatgcagagacagctggctgtagcatgatagaagacattgaatcaccatcatcag

SEQ ID NO: 98933 - DNA, 75 bp, Artificial Sequence
  Synthetic
tctgggtgtttgctggggcaccagaccgttgcccgccaacatgtttatttattgcaggaattgcagagcttggtg

SEQ ID NO: 98934 - DNA, 75 bp, Artificial Sequence
  Synthetic
cctttttttccatcttgcaggatatgcggaatacaatcatggcatccaagacagtgggtacatctgaggaaaagc

SEQ ID NO: 98935 - DNA, 75 bp, Artificial Sequence
  Synthetic
taagaaagaaatcatcattctaccaatcttatctcaggaggacacagtcaatgggaatacaactggaccaaagaa

SEQ ID NO: 98936 - DNA, 75 bp, Artificial Sequence
  Synthetic
taattgttctcttcatggttgcctggggaaaggaagcagtggacaatttccaccttggagatgatatggatcctg

SEQ ID NO: 98937 - DNA, 75 bp, Artificial Sequence
  Synthetic
agttgagaacactagcacagagtctgattgatttgaaggtgaaggaaatttcaaaccaagaacctttaaaattat

SEQ ID NO: 98938 - DNA, 75 bp, Artificial Sequence
  Synthetic
aatcgatgaatgtataacccttattatgtgatcattatatactactgaattattaccaatcataattgcactatt

SEQ ID NO: 98939 - DNA, 75 bp, Artificial Sequence
  Synthetic
actatcaggggaatcaacatatcagggtaggggtacatttatgggtgggaattattactcagagggtgggtcagt

SEQ ID NO: 98940 - DNA, 75 bp, Artificial Sequence
  Synthetic
taatccgttgtgggtgggtttagttccaagctgccttaagtagctttttttgtatataaagatgtagatatcaat

SEQ ID NO: 98941 - DNA, 75 bp, Artificial Sequence
  Synthetic
tgatccttaaactaattttgctcttctttcttctttcttgctttctctgctcactaacaacaacattctacctca

SEQ ID NO: 98942 - DNA, 75 bp, Artificial Sequence
  Synthetic
ctttctctgctcactaacaacaacattctacctcaacacaaaactacctcactttaactacctcatttgcttttt

SEQ ID NO: 98943 - DNA, 75 bp, Artificial Sequence
  Synthetic
gaaattgaaaatagcaaggtatatgatgatggggctccacagtgtgggataaaatgttggtttgtaacatctgga

SEQ ID NO: 98944 - DNA, 75 bp, Artificial Sequence
  Synthetic
taacacactaaaaaaaatagtagctgtctaaccatataacttagatttctcctctgtatgatgtcttaacatctt

SEQ ID NO: 98945 - DNA, 75 bp, Artificial Sequence
  Synthetic
attctacctcaacacaacctaactacctcattagcttgctccttgattgtctttttagggagcatactactacta

SEQ ID NO: 98946 - DNA, 75 bp, Artificial Sequence
  Synthetic
attgatgtcaaagtgaaggaaatctccaaccaagagcctttgaaactctaattaattgatgtattaatcctttta

SEQ ID NO: 98947 - DNA, 75 bp, Artificial Sequence
  Synthetic
tactaacaacaacattctacctcaacacacctcaacttaactacctcatttgattgctccttgattgtcttttag

SEQ ID NO: 98948 - DNA, 75 bp, Artificial Sequence
  Synthetic
tacctcaacacacctcaacttaactacctcatttgattgctccttgattgtcttttagggagcatactactacta

SEQ ID NO: 98949 - DNA, 75 bp, Artificial Sequence
  Synthetic
tagtagtagactccggaagagacaaactctgaaaagaatggataaatatagagaaattcacaataagttgaagga

SEQ ID NO: 98950 - DNA, 75 bp, Artificial Sequence
  Synthetic
gagtgggcacttaaattcagagagaaggaagaaaagtatggggaatctctggtagaaaatggatatatgatgtgg

SEQ ID NO: 98951 - DNA, 75 bp, Artificial Sequence
  Synthetic
gatctgcgcgaaaatgcagagttggcagaacaacaattgtactgtcaagatgctattgagttggcagcaatagaa

SEQ ID NO: 98952 - DNA, 75 bp, Artificial Sequence
  Synthetic
ctacaaatcttctaaatcaagggtagtcattgtccaagggaatgttgaagggacagctgaggctatatgtgccta

SEQ ID NO: 98953 - DNA, 75 bp, Artificial Sequence
  Synthetic
tgtgattatcatatactactgaatcattatcaatcatatttacactattattatcaggggaatcagtatatcagg

SEQ ID NO: 98954 - DNA, 75 bp, Artificial Sequence
  Synthetic
aagaagtccttcaagcagtttctatttttaatcgcaaagaagatataggacaaccggaagacttagctgctctta

SEQ ID NO: 98955 - DNA, 75 bp, Artificial Sequence
  Synthetic
aggatgaaagttcatacacaggagatctattaatcagcacagaggaaactgaatcaaagaaaatgaggggcatag

SEQ ID NO: 98956 - DNA, 75 bp, Artificial Sequence
  Synthetic
tagtagtagactccggaagtgacaaattctgaaaagaatggataaatatagagaaattcacaataaactgaagga

SEQ ID NO: 98957 - DNA, 75 bp, Artificial Sequence
  Synthetic
gttctctcctggtacactaactgcagtagagtgtatagactacctagacaggctctatgctgtgagacatgacat

SEQ ID NO: 98958 - DNA, 75 bp, Artificial Sequence
  Synthetic
tgttgatcagatgataaaacatgactggtctgacaataaagattcagaggaagcaatagggaaagtgttattatt

SEQ ID NO: 98959 - DNA, 75 bp, Artificial Sequence
  Synthetic
tgcagaggttccatcaaatatcataacagcattagaaaagaagatcataccgaatcatccaacagggaagaatct

SEQ ID NO: 98960 - DNA, 75 bp, Artificial Sequence
  Synthetic
taaggcattcttcaagatgacacctgataattataagattcgtgggacaaccattgagtttgttgaagtgactgt

SEQ ID NO: 98961 - DNA, 75 bp, Artificial Sequence
  Synthetic
aactgctgatgttgataagggggttagagaaaaaagattaaaatatgaagctggcttagtatatattgaacaaga

SEQ ID NO: 98962 - DNA, 75 bp, Artificial Sequence
  Synthetic
attacacaaattctttctcaagggtgaaatcccacagccctacaagataaccctcaatgtggttgcagtccgtac

SEQ ID NO: 98963 - DNA, 75 bp, Artificial Sequence
  Synthetic
agatggctccaatatttcaacacagtggccaagtagaagaaatgatggtgttgttcaatacatgaggctggttca

SEQ ID NO: 98964 - DNA, 75 bp, Artificial Sequence
  Synthetic
ggctgaaataagttatgtaagggagcacttagttaaaacagaagagagggctgcattggaagccatgttcaacct

SEQ ID NO: 98965 - DNA, 75 bp, Artificial Sequence
  Synthetic
aaagtttaatataagcacacacaagaatcagccatattatataccagattataaaggtattgaaccaataggagc

SEQ ID NO: 98966 - DNA, 75 bp, Artificial Sequence
  Synthetic
gaatcttgaggatctagttgattactcaaaggaatggttatccagggctaggaatttttcattctttgaagtaaa

SEQ ID NO: 98967 - DNA, 75 bp, Artificial Sequence
  Synthetic
aggtacagcagtctttaattgttttaattcaaatgaagtgaaccactgtcaaaaataccctatgtctcgtaagcc

SEQ ID NO: 98968 - DNA, 75 bp, Artificial Sequence
  Synthetic
taggaatttcttattgatccaatgctctttaatcacatcatataaacctgccactaccctttctgatcaaatcga

SEQ ID NO: 98969 - DNA, 75 bp, Artificial Sequence
  Synthetic
tagcaggcgagcttgctcatatattttgaatcttattccagacacacctggatcatatctaattcatgatatggc

SEQ ID NO: 98970 - DNA, 75 bp, Artificial Sequence
  Synthetic
atatagatatgtaaacctcacaagagaagatatgatcaattactatgcaccaaggatacagtttaagcagacaca

SEQ ID NO: 98971 - DNA, 75 bp, Artificial Sequence
  Synthetic
aaatgtaaaggaaccgggtacatttaaactaacatcaagcatgttaagggcagagtcaaaggcaatgttggatct

SEQ ID NO: 98972 - DNA, 75 bp, Artificial Sequence
  Synthetic
tcttaacaatcacaaaagtggtgaaaaacatggtgaacaaatagaaagtttaaatattgctagccatatagtgca

SEQ ID NO: 98973 - DNA, 75 bp, Artificial Sequence
  Synthetic
atctgagtcagttagcctgataactaaaatactctctgatctggagttaaatataactgaaccatcaacccagga

SEQ ID NO: 98974 - DNA, 75 bp, Artificial Sequence
  Synthetic
atactcaacaaccaagcacacttatgttgatacggttttagataaattctttcaaaatgaaactcaaaaatatct

SEQ ID NO: 98975 - DNA, 75 bp, Artificial Sequence
  Synthetic
aatagatgtcttaaagaagactacagcatggcatatagggcatcttgtaagagacataactgaaagcttaattgc

SEQ ID NO: 98976 - DNA, 75 bp, Artificial Sequence
  Synthetic
ccactcaggtttaaagagatcaaaatactggtcactacactcctataacaacggcaatgttatattgtttattct

SEQ ID NO: 98977 - DNA, 75 bp, Artificial Sequence
  Synthetic
cccatcaaaatcattagaagttgctgggtcctttattagattcatcactgttttccgaattggtcctggtttagt

SEQ ID NO: 98978 - DNA, 75 bp, Artificial Sequence
  Synthetic
ggataaagataacttagacacagtattgcttgatggtgaatcccaatggggaatatcaaaggttatgagcattga

SEQ ID NO: 98979 - DNA, 75 bp, Artificial Sequence
  Synthetic
tttgaacaggctattagcactaaatatagcctttgagaaggcattaattgcaacagctacatggttccagtatta

SEQ ID NO: 98980 - DNA, 75 bp, Artificial Sequence
  Synthetic
tactgaggatcaaggacagtttccactgcaatatgctatcagatctgtatttgcaaatcacttcctcctggcaat

SEQ ID NO: 98981 - DNA, 75 bp, Artificial Sequence
  Synthetic
atgtcagaaaatgaagctttgtgcaatttttgataatctcaggtatttaatacctgctgttacatccctgtactc

SEQ ID NO: 98982 - DNA, 75 bp, Artificial Sequence
  Synthetic
tggttttccatcattgatagagaagttgtttgagcgcccgtttaaatctgcattagaagtgtatatatattacaa

SEQ ID NO: 98983 - DNA, 75 bp, Artificial Sequence
  Synthetic
tattaaaagtttattggtagcacttgcacaaaataacaaggccagattttattctaaagttaaattgctgggact

SEQ ID NO: 98984 - DNA, 75 bp, Artificial Sequence
  Synthetic
gactgttgaccaatcaactgttggtgcaagtggaatttacccttcatttatgtcacgtatagtttataaacacta

SEQ ID NO: 98985 - DNA, 75 bp, Artificial Sequence
  Synthetic
taggagtcttatatctgaggtcacaacttgtttcttcttatttgaaaagggacttcatgggaatatgaatgaaga

SEQ ID NO: 98986 - DNA, 75 bp, Artificial Sequence
  Synthetic
agctaaaatacatctggagacagtagaatgggcactcaaattcagagagaaggaggaaaaatatggggagtcact

SEQ ID NO: 98987 - DNA, 75 bp, Artificial Sequence
  Synthetic
agtagagaacggttacatgatgtgggaacttcgagaaaatgctgaattggctgaacagcaactatattgtcaaga

SEQ ID NO: 98988 - DNA, 75 bp, Artificial Sequence
  Synthetic
tgctgtggaattggcagcaatagaattaaataaggtcttgtcaacaaagtctaatgtggttgctaatagcatatt

SEQ ID NO: 98989 - DNA, 75 bp, Artificial Sequence
  Synthetic
aagtaaaaactgggaagaaccttatttcagccagacaaggaatataagtttaaaaggtatgtcaggacaagttca

SEQ ID NO: 98990 - DNA, 75 bp, Artificial Sequence
  Synthetic
agaagatgggcacctatcttcatctgtcacaatcattgaggctatccgctacttgtctaactcaagacacaatcc

SEQ ID NO: 98991 - DNA, 75 bp, Artificial Sequence
  Synthetic
cagtctccttaagctgtatgaagaaacaagggaacaaaaagcaatggctaggattgtaagaaagtaccagaggac

SEQ ID NO: 98992 - DNA, 75 bp, Artificial Sequence
  Synthetic
agaggctgatagaggttttttcatcacaacactccctacacgctgccggcttgaaattattgaagactactatga

SEQ ID NO: 98993 - DNA, 75 bp, Artificial Sequence
  Synthetic
tgccatagctaagaatataactgaggagtatatttcatatggaggtgagaagaaaattcttgctattcagggagc

SEQ ID NO: 98994 - DNA, 75 bp, Artificial Sequence
  Synthetic
actagaaaaagctctaagatgggcatcaggtgaaagttttattgaactcagtaaccagaagtttattagaatgaa

SEQ ID NO: 98995 - DNA, 75 bp, Artificial Sequence
  Synthetic
gcggaaacttatgtatgttagtgcagatgctactaaatggtcaccaggggacaattcagcaaaatttcgtcgatt

SEQ ID NO: 98996 - DNA, 75 bp, Artificial Sequence
  Synthetic
tacatccatgctacataatggtctccctaacaataagttaaaaaattgtgtgattgatgccctcaagcaagttta

SEQ ID NO: 98997 - DNA, 75 bp, Artificial Sequence
  Synthetic
caagacagacttcttcatgtcaagaaaattaagaaattatattgataacatggaaagccttgatccacatataaa

SEQ ID NO: 98998 - DNA, 75 bp, Artificial Sequence
  Synthetic
acaatttttagacttctttcctgatggacatcatggggaagttaaaggaaattggctacaaggtaatttgaataa

SEQ ID NO: 98999 - DNA, 75 bp, Artificial Sequence
  Synthetic
atgttcatccctctttggtgtggcaatgtcactactgtttaaacaggtatggaataatctatttccagaacttga

SEQ ID NO: 99000 - DNA, 75 bp, Artificial Sequence
  Synthetic
ttgtttctttgagtttgctcaccattcagatgatgccttgtttatttatggttatttagaacctgtagatgatgg

SEQ ID NO: 99001 - DNA, 75 bp, Artificial Sequence
  Synthetic
aactgattggtttttgtttgtatcccaacaaatacaagcaggtcatttacattggtttagtgttaatactgaaat

SEQ ID NO: 99002 - DNA, 75 bp, Artificial Sequence
  Synthetic
gtggaaaagcatgtttaatctccatgagcatattcttctcttaggttctataaaaatatcacctaagaagactac

SEQ ID NO: 99003 - DNA, 75 bp, Artificial Sequence
  Synthetic
agtatccccaaccaatgctgaattcttgtcaacattctttgagggttgtgcagtttcaataccatttgttaagat

SEQ ID NO: 99004 - DNA, 75 bp, Artificial Sequence
  Synthetic
cctgttaggctctttatcagatctaccaggtttaggctattttgatgacttagcagcagcacagagtcggtgtgt

SEQ ID NO: 99005 - DNA, 75 bp, Artificial Sequence
  Synthetic
taaagctctggatctaggagcctctcctcaagtagcacagttagctgttgcattatgcactagcaaggttgaaag

SEQ ID NO: 99006 - DNA, 75 bp, Artificial Sequence
  Synthetic
attatatggtactgcaccaggcatggtaaaccatcctgctgcatatttacaggtcaagcatggtgacacgcccat

SEQ ID NO: 99007 - DNA, 75 bp, Artificial Sequence
  Synthetic
cccacttggaggaaatggtgcaatgtctatcatggaattggcaacagcagggatagggatgtcagataaaaatct

SEQ ID NO: 99008 - DNA, 75 bp, Artificial Sequence
  Synthetic
gttaaagcgtgcacttataggttattcacacaagagacagaagtctatgctatatatattgggcctctttaagtt

SEQ ID NO: 99009 - DNA, 75 bp, Artificial Sequence
  Synthetic
cctaatgaaattatctgaggagacattccaacatgagaggctaggacaattttcatttatcggaaaggtacaatg

SEQ ID NO: 99010 - DNA, 75 bp, Artificial Sequence
  Synthetic
gaagatcttcacaccaaaatctgaatttgaatttgctgatatgtacacatccaaattcttggaactatggagtaa

SEQ ID NO: 99011 - DNA, 75 bp, Artificial Sequence
  Synthetic
tcagcatgtaacttatgattatataatcccaaagggcagagacaatcttcttatctatttagttaggaagttgaa

SEQ ID NO: 99012 - DNA, 75 bp, Artificial Sequence
  Synthetic
tgacccgagtattgtaacagccatgacaatgcagtcacctttacagctaagatttcgaatgcaggcaaagcagca

SEQ ID NO: 99013 - DNA, 75 bp, Artificial Sequence
  Synthetic
tatgaaagtatgcaggttggatggagactgggtaacttttagggaagttttagccgctgctaatagctttgcaga

SEQ ID NO: 99014 - DNA, 75 bp, Artificial Sequence
  Synthetic
gagttatactcctaccagccaggatatggacctgtttcaaacattaacaagctgtacattttctaaagagtatgc

SEQ ID NO: 99015 - DNA, 75 bp, Artificial Sequence
  Synthetic
atggaaagacttcttgaatgggattcattgtgatgtcataccaacaaaacaaattcagagggctaaagttgcaag

SEQ ID NO: 99016 - DNA, 75 bp, Artificial Sequence
  Synthetic
aacatttacagtcagagaaaaggaccagattatacaaaatagtatcccagctgttattggttacaagtttgctgt

SEQ ID NO: 99017 - DNA, 75 bp, Artificial Sequence
  Synthetic
cactgtggatgaaatgtctgatgtattagatactgccaaattcccagattcactatctgttgatttaaagactat

SEQ ID NO: 99018 - DNA, 75 bp, Artificial Sequence
  Synthetic
gaaggacggggtttaccgagaattaggtttagatatatcattaccagacgtgatgaagaggattgcaccaatgct

SEQ ID NO: 99019 - DNA, 75 bp, Artificial Sequence
  Synthetic
gtacaaatcttctaagtcacgggtagttatagtccaaggaaatgttgaaggaacagctgaagctatatgtgccta

SEQ ID NO: 99020 - DNA, 75 bp, Artificial Sequence
  Synthetic
ctggttgaaatcaatgtcattggtaaaaacaataagagtgaaacctcataaagaagtccttcaagcagtatcaat

SEQ ID NO: 99021 - DNA, 75 bp, Artificial Sequence
  Synthetic
ttttaaccgcaaagaggatataggacagcaaaaagatttggctgctcttaagctatgtatagaggtgtggagatg

SEQ ID NO: 99022 - DNA, 75 bp, Artificial Sequence
  Synthetic
gtgtaaggcaaataatgcaccatacagagactggtttcaagccctctggtttgaagacaaaacattctcagaatg

SEQ ID NO: 99023 - DNA, 75 bp, Artificial Sequence
  Synthetic
gctagatagattttgcagagtaggggttccacctattgacccagaaattcagtgtgcagcactgatgattgctga

SEQ ID NO: 99024 - DNA, 75 bp, Artificial Sequence
  Synthetic
cataaagggagattattcagttttacaattgcaagcaaacagaagagcatattcaggtaagcaatatgatgcata

SEQ ID NO: 99025 - DNA, 75 bp, Artificial Sequence
  Synthetic
ctgtgtgcaaacctataatgaggcaacaaagttatatgaaggagacttgagagtaacatttaattttggtctcga

SEQ ID NO: 99026 - DNA, 75 bp, Artificial Sequence
  Synthetic
ttgtgctagacttgagatattttgggataagaaggcttatatattagaaacatcgattacacagaagcatgtatt

SEQ ID NO: 99027 - DNA, 75 bp, Artificial Sequence
  Synthetic
gaaaataatgatggatgaggtttcaaaggagctattaaagtgtgggatgaggtttaacacagagcaggttcaagg

SEQ ID NO: 99028 - DNA, 75 bp, Artificial Sequence
  Synthetic
agtacgacatatggtattgtttaagactgaatctggatttgaatggggaaagccaaatattccttgtattgtgta

SEQ ID NO: 99029 - DNA, 75 bp, Artificial Sequence
  Synthetic
taaaaactgtgtccttaggacaagccttaggacaacacaggcaattaatcataaattcatgattacaataaagga

SEQ ID NO: 99030 - DNA, 75 bp, Artificial Sequence
  Synthetic
tgacgggcttcgtgctattgcacaacatgatgaagacagtccgaggtttttattagctcatgcttttcatacaat

SEQ ID NO: 99031 - DNA, 75 bp, Artificial Sequence
  Synthetic
aagggatattagataccaagcagtagatgcagtaagcaatgtttggtttatacacaaaggagtgaagctatatct

SEQ ID NO: 99032 - DNA, 75 bp, Artificial Sequence
  Synthetic
gaatcccattatttcttcagggctgcttgaaaattttatgaagaatcttcctgctgctataccacctgctgcata

SEQ ID NO: 99033 - DNA, 75 bp, Artificial Sequence
  Synthetic
ttcattgattatgaatcgtgctaaaatctctgttgatttatttatgtttaatgacctactaagacttatcaatcc

SEQ ID NO: 99034 - DNA, 75 bp, Artificial Sequence
  Synthetic
aaaaaatacattggatctctcaggccttgaaacaaccggaaatgggtttagcactgttagctcaatgtcaagtcg

SEQ ID NO: 99035 - DNA, 75 bp, Artificial Sequence
  Synthetic
attgtggtctgaggagatgagtttagttgatgatgatgaagaacttgatgatgaattcacaattgacctgcaaga

SEQ ID NO: 99036 - DNA, 75 bp, Artificial Sequence
  Synthetic
tgttgattttgaaaatatagatatggaggcagatattgagcactttcttcaagatgaaagctcttacactgggga

SEQ ID NO: 99037 - DNA, 75 bp, Artificial Sequence
  Synthetic
tttgttgattagcacggaggagactgaatctaagaaaatgagaggtatagtaaagatacttgagccggtcaggtt

SEQ ID NO: 99038 - DNA, 75 bp, Artificial Sequence
  Synthetic
gattaaaagttgggtatcaagggggttatctattgaaaaggtatatagtcctgtcaacataatattgatgtcaag

SEQ ID NO: 99039 - DNA, 75 bp, Artificial Sequence
  Synthetic
gtatatctctaaaaccttcaatctgagcaccaagcaggtatccttactggacccttatgatttaactgaattaga

SEQ ID NO: 99040 - DNA, 75 bp, Artificial Sequence
  Synthetic
aagtattgttagaggttggggagagtgtgttattgatcagtttgaaagtcttgatagagaagctcaaaacatggt

SEQ ID NO: 99041 - DNA, 75 bp, Artificial Sequence
  Synthetic
agtcaacaaggggatatgtcctgaggatgttattccagactcattattctcattcagacatactatggtgctgtt

SEQ ID NO: 99042 - DNA, 75 bp, Artificial Sequence
  Synthetic
acgaaggttatttcctcaggattccatttcctctttctattaggctttctttctttttcattttccggagcgtac

SEQ ID NO: 99043 - DNA, 75 bp, Artificial Sequence
  Synthetic
tatttcctcaggattccatttcctctttctattaggctttctttctttttcattttccggagcgtactactacta

SEQ ID NO: 99044 - DNA, 75 bp, Artificial Sequence
  Synthetic
gcccccacacagtaagtttcggagaaaacagtgtaatagggtatgtggaattaccccctatgccgttggctgata

SEQ ID NO: 99045 - DNA, 75 bp, Artificial Sequence
  Synthetic
ataaatactataacaaaatacacccaggtaatctggagaggaaaggcagatccgggacaatccagtcaaaattca

SEQ ID NO: 99046 - DNA, 75 bp, Artificial Sequence
  Synthetic
tttgaaacagtgtctactgaagttgacttgaaaggaacatgtgttttaaagcataagatggtggaagaatcatac

SEQ ID NO: 99047 - DNA, 75 bp, Artificial Sequence
  Synthetic
tgaagagctgtctaattgcattagggccatacagagtgcaggtagtgtatgagaggacctactgtatgacaggag

SEQ ID NO: 99048 - DNA, 75 bp, Artificial Sequence
  Synthetic
gccatacagagtgcaggtagtgtatgagaggacctactgtatgacaggagtattaattgaaggaaaatgttttgt

SEQ ID NO: 99049 - DNA, 75 bp, Artificial Sequence
  Synthetic
aaactctttgaacaggttaagaaatcgtttgagtcaacttgcaatgatactgagaataaagtacagggttattac

SEQ ID NO: 99050 - DNA, 75 bp, Artificial Sequence
  Synthetic
tgatttcaggtccatggaggcatttacgggaatcttcaaatcaccgcacggagaagaccatgatcttgctgggga

SEQ ID NO: 99051 - DNA, 75 bp, Artificial Sequence
  Synthetic
tctaattgcttattcaggtataccatcttattcttccctgagtatcttgacaagttcaacagatgctaagcatgt

SEQ ID NO: 99052 - DNA, 75 bp, Artificial Sequence
  Synthetic
tgtgcttagtttcaaagcaaaatcggttccggctaacagagcagcaggtaaactttgtgtgtcaaagagtagaca

SEQ ID NO: 99053 - DNA, 75 bp, Artificial Sequence
  Synthetic
tggacattgttgtgtactgcaacggacagaggaaagtaatattaacaaaaactttagttattgggcaatgtatat

SEQ ID NO: 99054 - DNA, 75 bp, Artificial Sequence
  Synthetic
actttagttattgggcaatgtatatatactataacaagcttgttctcactactacctggagtagcacattctatt

SEQ ID NO: 99055 - DNA, 75 bp, Artificial Sequence
  Synthetic
tccatggctgggccacagctgctttgcttgttacattctgttttggatgggtccttataccagctgtcacattta

SEQ ID NO: 99056 - DNA, 75 bp, Artificial Sequence
  Synthetic
tttttacaatgtgggtattccttctcattctggaatctgtactgtgggcagctagtgcatcagagacaccgttaa

SEQ ID NO: 99057 - DNA, 75 bp, Artificial Sequence
  Synthetic
cattggtttgatggccgtcttaatcttaaaacatccttccactgttacggtgcttgtacaaagtacgagtaccca

SEQ ID NO: 99058 - DNA, 75 bp, Artificial Sequence
  Synthetic
ttggggctgtaatccatcagactgccccggggtgggtacaggctgtacagcatgtgggctttatcttgaccagtt

SEQ ID NO: 99059 - DNA, 75 bp, Artificial Sequence
  Synthetic
catgtgggctttatcttgaccagttaaagccagttggcagtgcatataaaatcattacaataagatatagtagaa

SEQ ID NO: 99060 - DNA, 75 bp, Artificial Sequence
  Synthetic
atcattacaataagatatagtagaagagtctgtgttcagtttggagaagaaaacctttgcaaaattatagacatg

SEQ ID NO: 99061 - DNA, 75 bp, Artificial Sequence
  Synthetic
aaacctttgcaaaattatagacatgaatgactgctttgtatctagacatgttaaagtctgtatcattgggacagt

SEQ ID NO: 99062 - DNA, 75 bp, Artificial Sequence
  Synthetic
tgtaattttgctactactcctatttgtgaatatgatggaaatatggtctcaggttacaaaaaagtgatggcaaca

SEQ ID NO: 99063 - DNA, 75 bp, Artificial Sequence
  Synthetic
ggaatgttgagggaccatataaatattttagtaacaaaggatattgattttgataatcttggtgaaaacccctgt

SEQ ID NO: 99064 - DNA, 75 bp, Artificial Sequence
  Synthetic
tcattaacagagtgtcctacttttttaacctctattaaggcctgtgataaagctatttgttacggtgcagaaagt

SEQ ID NO: 99065 - DNA, 75 bp, Artificial Sequence
  Synthetic
taacctctattaaggcctgtgataaagctatttgttacggtgcagaaagtgtgacattaacaaggggacaaaata

SEQ ID NO: 99066 - DNA, 75 bp, Artificial Sequence
  Synthetic
cagtgaaggtatcaggaaaaggcggtcacagtggttcaactttcaaatgttgccatggggaagactgctcaaaga

SEQ ID NO: 99067 - DNA, 75 bp, Artificial Sequence
  Synthetic
ttgggctccatgctgctgcaccccaccttgataaagttaacgggatctctgaaatagaaaacagtaaagtatatg

SEQ ID NO: 99068 - DNA, 75 bp, Artificial Sequence
  Synthetic
ctgtgtcttcttgctgttttcattggtcttactcagtatcctttgccctgtcaggaagcataagaaatcatagct

SEQ ID NO: 99069 - DNA, 75 bp, Artificial Sequence
  Synthetic
tcaggaagcataagaaatcatagctagatgatgctgctatcaagttattgtatatagctttaacatatatactaa

SEQ ID NO: 99070 - DNA, 75 bp, Artificial Sequence
  Synthetic
caggacagacagcagactggctgagcattgttgtctatcttacatcctttgctgttccgatacttctgaaagccc

SEQ ID NO: 99071 - DNA, 75 bp, Artificial Sequence
  Synthetic
cattgcaggtatcgctgagcttggggcatttttttccatcttgcaggatatgcggaatacaatcatggcatccaa

SEQ ID NO: 99072 - DNA, 75 bp, Artificial Sequence
  Synthetic
gacagttggaacctctgaggagaaactgcggaagaaatcttcattctatcagtcttatctcaggagaacacaatc

SEQ ID NO: 99073 - DNA, 75 bp, Artificial Sequence
  Synthetic
tctgcttattaacaacaacattctacctcaacacaaaactacctcaactaaactacctcatttgattgctccttg

SEQ ID NO: 99074 - DNA, 75 bp, Artificial Sequence
  Synthetic
tagtagtagactccctaagtgacaaacctcgaaaagaatggataaatatagagaaattcacaataaactgaagga

SEQ ID NO: 99075 - DNA, 75 bp, Artificial Sequence
  Synthetic
acctcgaaaagaatggataaatatagagaaattcacaataaactgaaggagttttctcctggtacattaactgca

SEQ ID NO: 99076 - DNA, 75 bp, Artificial Sequence
  Synthetic
gtagagtgtatagattatcttgacagactttatgcagtaagacatgacattgtagaccagatgattaaacatgac

SEQ ID NO: 99077 - DNA, 75 bp, Artificial Sequence
  Synthetic
aagcaatagggaaagtgctactatttgctggggtcccttcaaacattataacagcactagagaagaaaataatac

SEQ ID NO: 99078 - DNA, 75 bp, Artificial Sequence
  Synthetic
cgaaccaccctactgggaagactcttaaggcttttttcaagatgacacctgacaattataaaattagtggaacaa

SEQ ID NO: 99079 - DNA, 75 bp, Artificial Sequence
  Synthetic
gacaattataaaattagtggaacaaccattgagtttgttgaagtaactgtcacagcagatgttgacaaagggata

SEQ ID NO: 99080 - DNA, 75 bp, Artificial Sequence
  Synthetic
agagaaaagaaattaaagtatgaagcaggtttaaattatgttgaacaagagttacacaagttttttctaaagggt

SEQ ID NO: 99081 - DNA, 75 bp, Artificial Sequence
  Synthetic
gttacacaagttttttctaaagggtgaaattccacaaccttataaaataacctttaatgtagttgcagtgcgtac

SEQ ID NO: 99082 - DNA, 75 bp, Artificial Sequence
  Synthetic
cctttaatgtagttgcagtgcgtacagacggttctaatatcactacacaatggcctagtagaagaaatgatggtg

SEQ ID NO: 99083 - DNA, 75 bp, Artificial Sequence
  Synthetic
tggcctagtagaagaaatgatggtgttgttcagtacatgagactagttcaagctgaaataagttatgttagggaa

SEQ ID NO: 99084 - DNA, 75 bp, Artificial Sequence
  Synthetic
agccagccatattacataccagattataaagggattgaaccaattggggcaaatattgaagatttagttgactat

SEQ ID NO: 99085 - DNA, 75 bp, Artificial Sequence
  Synthetic
aaatattgaagatttagttgactattctaaagaatggctatccagagctaggaatttttctttctttgaagtcaa

SEQ ID NO: 99086 - DNA, 75 bp, Artificial Sequence
  Synthetic
aggtacagcagttttcgattgctttaattcaaatgaggcaaatcattgtcagaaatatcccatgtcccgtaaacc

SEQ ID NO: 99087 - DNA, 75 bp, Artificial Sequence
  Synthetic
taggaactttctgctaatacaatgttccttaattacatcttacaagcctgcaactactctttcagatcagattga

SEQ ID NO: 99088 - DNA, 75 bp, Artificial Sequence
  Synthetic
caactactctttcagatcagattgatagcagaagggcttgttcgtacatcttgaatctaattccagacacaccag

SEQ ID NO: 99089 - DNA, 75 bp, Artificial Sequence
  Synthetic
catcatatttagttcatgacatggcatatagatatataaatctgacaagagaagatatgattaattattatgccc

SEQ ID NO: 99090 - DNA, 75 bp, Artificial Sequence
  Synthetic
gaagatatgattaattattatgccccacgaatacagtttaagcagacacagaatataagagagccagggacattc

SEQ ID NO: 99091 - DNA, 75 bp, Artificial Sequence
  Synthetic
cacgaatacagtttaagcagacacagaatataagagagccagggacattcaagctgacatcaagtatgctcaggg

SEQ ID NO: 99092 - DNA, 75 bp, Artificial Sequence
  Synthetic
cagaatcaaaagcaatgctagatctgcttaataatcataaaagtggtgagaagcatggggcacaaatagaaagtc

SEQ ID NO: 99093 - DNA, 75 bp, Artificial Sequence
  Synthetic
gcttaataatcataaaagtggtgagaagcatggggcacaaatagaaagtctaaatatagcaagtcatattgtgca

SEQ ID NO: 99094 - DNA, 75 bp, Artificial Sequence
  Synthetic
gtcagagtctgtcagtttaattacaaagatattatctgatttggaattgaacataactgagccatcaactcaaga

SEQ ID NO: 99095 - DNA, 75 bp, Artificial Sequence
  Synthetic
atattctacaactaagcacacttatgttgatacagtgctggataagttttttcagaatgagacacagaagtattt

SEQ ID NO: 99096 - DNA, 75 bp, Artificial Sequence
  Synthetic
aatagacgtactaaagaagacaacagcatggcatataggccatctaataagggatataacagagagcttgattgc

SEQ ID NO: 99097 - DNA, 75 bp, Artificial Sequence
  Synthetic
acattcaggattgaaaagatcaaagtactggtccctacattcttataataatggaaatgttatattatttatcct

SEQ ID NO: 99098 - DNA, 75 bp, Artificial Sequence
  Synthetic
atggaaatgttatattatttatcctcccatcaaaatcacttgaagtggcagggtcctttattagatttattacag

SEQ ID NO: 99099 - DNA, 75 bp, Artificial Sequence
  Synthetic
tttttaggataggacccggtcttgtggataaggacaacctggatactattttgattgatggtgactcacaatggg

SEQ ID NO: 99100 - DNA, 75 bp, Artificial Sequence
  Synthetic
gagtatcaaaagttatgagtattgatttaaacaggttgttagctttaaacatagcctttgaaaaggctttaattg

SEQ ID NO: 99101 - DNA, 75 bp, Artificial Sequence
  Synthetic
cgacagccacatggtttcaatactacacagaagaccaagggcaatttcccttgcaatatgcaataagatctgtct

SEQ ID NO: 99102 - DNA, 75 bp, Artificial Sequence
  Synthetic
tcgcaaatcatttcctattagctatatgtcagaaaatgaaactctgtgcaatttttgataatttgcgctatttaa

SEQ ID NO: 99103 - DNA, 75 bp, Artificial Sequence
  Synthetic
ctttttgaacgtccctttaagtcttcattggaggtatatatatattacaatataaaaagcttattagttgctctt

SEQ ID NO: 99104 - DNA, 75 bp, Artificial Sequence
  Synthetic
tataaaaagcttattagttgctcttgcacagaataataaggctagattctattctaaagtaaagttgttaggttt

SEQ ID NO: 99105 - DNA, 75 bp, Artificial Sequence
  Synthetic
gacagttgaccaatcaactgtaggtgcaagtggcatatatccttcttttatgtcgcgtatagtttacaaacatta

SEQ ID NO: 99106 - DNA, 75 bp, Artificial Sequence
  Synthetic
taggagtttgatatctgaagtgacaacctgttttttcttatttgaaaagggtcttcatggtaatatgaatgaaga

SEQ ID NO: 99107 - DNA, 75 bp, Artificial Sequence
  Synthetic
agcaaagattcatcttgagacagtagaatgggcacttaaatttagagaaaaggaagaaaagtatggagaatcatt

SEQ ID NO: 99108 - DNA, 75 bp, Artificial Sequence
  Synthetic
aggaagaaaagtatggagaatcattggtggaaaacggatatatgatgtgggagctccgggaaaattctgatttgg

SEQ ID NO: 99109 - DNA, 75 bp, Artificial Sequence
  Synthetic
ctgagcaacaactatactgtcaggatgctgtagagttagcagcaatagaattgaataaagttttatctacaaaat

SEQ ID NO: 99110 - DNA, 75 bp, Artificial Sequence
  Synthetic
ccagtgtcgtagctaacagtatattaaataagaattgggaagaaccatattttagtcaaacaagaaatattagct

SEQ ID NO: 99111 - DNA, 75 bp, Artificial Sequence
  Synthetic
aaataagaattgggaagaaccatattttagtcaaacaagaaatattagcttgaaaggtatgtcagggcaggtcca

SEQ ID NO: 99112 - DNA, 75 bp, Artificial Sequence
  Synthetic
agaggatggccacctctcatcatctgtcacaattatagaagctatccgttacttatcaaactcaaggcataaccc

SEQ ID NO: 99113 - DNA, 75 bp, Artificial Sequence
  Synthetic
acttatcaaactcaaggcataaccctagcctcttaaagttatatgaagagacaagagagcagaaagcaatggcac

SEQ ID NO: 99114 - DNA, 75 bp, Artificial Sequence
  Synthetic
gaattgtgagaaaataccaaaggacagaagcagatagaggcttttttatcacaacacttcctacaagatgcaggc

SEQ ID NO: 99115 - DNA, 75 bp, Artificial Sequence
  Synthetic
ttgaaatcattgaggattattatgatgccattgctaaaaatatatctgaagaatatatatcgtatggaggtgaaa

SEQ ID NO: 99116 - DNA, 75 bp, Artificial Sequence
  Synthetic
gaatatatatcgtatggaggtgaaaaaaagatcctggcaattcaaggggcacttgaaaaagcacttagatgggca

SEQ ID NO: 99117 - DNA, 75 bp, Artificial Sequence
  Synthetic
aaaagatcctggcaattcaaggggcacttgaaaaagcacttagatgggcatcaggtgaaagcttcattgagctta

SEQ ID NO: 99118 - DNA, 75 bp, Artificial Sequence
  Synthetic
gtaatcacaaattcattaggatgaagcgtaaactcatgtatgttagtgcagatgcaacaaaatggtcaccaggag

SEQ ID NO: 99119 - DNA, 75 bp, Artificial Sequence
  Synthetic
ataattcagcaaaattccgtagattcacttctatgttgcataatggacttcctaataataagctaaagaactgtg

SEQ ID NO: 99120 - DNA, 75 bp, Artificial Sequence
  Synthetic
tgattgatgcactcaaacaagtttacaagacagatttctttatgtcaagaaaactaagaaactatattgatagta

SEQ ID NO: 99121 - DNA, 75 bp, Artificial Sequence
  Synthetic
gcaattcttggattttttcccagatgggcaccatggagaggtaaaagggaattggttgcagggtaatcttaataa

SEQ ID NO: 99122 - DNA, 75 bp, Artificial Sequence
  Synthetic
gtgttcttccctttttggtgttgcaatgtcattactgttcaaacaagtatggaacaatttatttcctgagcttga

SEQ ID NO: 99123 - DNA, 75 bp, Artificial Sequence
  Synthetic
ttgtttctttgaatttgctcaccattctgatgatgcattattcatttatggatacttagaacctgtagatgatgg

SEQ ID NO: 99124 - DNA, 75 bp, Artificial Sequence
  Synthetic
tctgatgatgcattattcatttatggatacttagaacctgtagatgatgggactgactggttcttatttgtgtct

SEQ ID NO: 99125 - DNA, 75 bp, Artificial Sequence
  Synthetic
gatacttagaacctgtagatgatgggactgactggttcttatttgtgtctcaacaaattcaggcaggccatttac

SEQ ID NO: 99126 - DNA, 75 bp, Artificial Sequence
  Synthetic
attggtttagtgtgaatactgaaatgtggaagagtatgtttaatctgcatgaacatatacttcttttaggttcta

SEQ ID NO: 99127 - DNA, 75 bp, Artificial Sequence
  Synthetic
gaacatatacttcttttaggttctattaagatatcacccaagaagactacagtatctcctacaaatgctgaattc

SEQ ID NO: 99128 - DNA, 75 bp, Artificial Sequence
  Synthetic
ttaagatatcacccaagaagactacagtatctcctacaaatgctgaattcctatcaacattttttgaaggctgtg

SEQ ID NO: 99129 - DNA, 75 bp, Artificial Sequence
  Synthetic
ctgtatcaataccatttgtcaaaatattattgggctccttatcagatctacctggcttaggctattttgatgatt

SEQ ID NO: 99130 - DNA, 75 bp, Artificial Sequence
  Synthetic
tagctgcagcacagagtagatgtgtcaaggcactggatttaggagcatcaccccaagttgcacagctggctgtag

SEQ ID NO: 99131 - DNA, 75 bp, Artificial Sequence
  Synthetic
cattgtgtactagtaaagttgaacggttgtatggtacagcaccaggtatggtgaaccaccctgcagcttacttgc

SEQ ID NO: 99132 - DNA, 75 bp, Artificial Sequence
  Synthetic
aagtcaagcatgctgatacacctatcccattgggagggaatggtgcaatgtctataatggagttagcaacagctg

SEQ ID NO: 99133 - DNA, 75 bp, Artificial Sequence
  Synthetic
cccattgggagggaatggtgcaatgtctataatggagttagcaacagctgggatagggatgtcagataaaaatct

SEQ ID NO: 99134 - DNA, 75 bp, Artificial Sequence
  Synthetic
attgaagcgtgcacttttaggatattcacacaagagacaaaaatcaatgttatatatattaggtcttttcaaatt

SEQ ID NO: 99135 - DNA, 75 bp, Artificial Sequence
  Synthetic
tttgatgaaattatctgatgaaacatttcaacatgaaaggttagggcaattctcctttattggaaaggtacaatg

SEQ ID NO: 99136 - DNA, 75 bp, Artificial Sequence
  Synthetic
gaagatttttactccaaaatctgaattcgagtttgctgatatgtatacatcaaaatttctagaattatggagcag

SEQ ID NO: 99137 - DNA, 75 bp, Artificial Sequence
  Synthetic
attccaaagggtagggacaatctccttatttacttggtccggaagctcaatgacccaagtatagtcacagcgatg

SEQ ID NO: 99138 - DNA, 75 bp, Artificial Sequence
  Synthetic
accatgcagtcacctctacagctaagattcaggatgcaagccaaacaacatatgaaggtgtgtagactagatgga

SEQ ID NO: 99139 - DNA, 75 bp, Artificial Sequence
  Synthetic
gagtgggttactttcagggaggttctggctgcagctaatagttttgctgagaattatagtcctactagccaagat

SEQ ID NO: 99140 - DNA, 75 bp, Artificial Sequence
  Synthetic
tggctgcagctaatagttttgctgagaattatagtcctactagccaagatatggacctattccaaacattaacaa

SEQ ID NO: 99141 - DNA, 75 bp, Artificial Sequence
  Synthetic
gttgtacattttcaaaagagtatgcttggaaggattttttaaatggaattcattgtgatgttatcccaacaaagc

SEQ ID NO: 99142 - DNA, 75 bp, Artificial Sequence
  Synthetic
aaccttcacagtcagggaaaaagatcaaatcatacaaaatagcattccggctgttatcggttacaaatttgctgt

SEQ ID NO: 99143 - DNA, 75 bp, Artificial Sequence
  Synthetic
ctgttatcggttacaaatttgctgtaactgtagaagaaatgtcagatgtattagatacagctaagtttccagact

SEQ ID NO: 99144 - DNA, 75 bp, Artificial Sequence
  Synthetic
ttagatacagctaagtttccagactccttgtctgttgacttaaaaaccatgaaagatggggtttatcgtgagcta

SEQ ID NO: 99145 - DNA, 75 bp, Artificial Sequence
  Synthetic
ccttgtctgttgacttaaaaaccatgaaagatggggtttatcgtgagctaggtctggacatatcattacctgatg

SEQ ID NO: 99146 - DNA, 75 bp, Artificial Sequence
  Synthetic
tcatgaagagaattgcaccaatgctttataaatcttctaaatcaagggttgttattgtccaaggaaatgttgaag

SEQ ID NO: 99147 - DNA, 75 bp, Artificial Sequence
  Synthetic
ggacagctgaggccatatgtgcatactggttaaaatcaatgtcgttagtaaagactataagagtaaagccccata

SEQ ID NO: 99148 - DNA, 75 bp, Artificial Sequence
  Synthetic
aggaagttcttcaagcagtctcaatttttaaccgtaaagaagatataggacagcaaaaagatttagctgccctta

SEQ ID NO: 99149 - DNA, 75 bp, Artificial Sequence
  Synthetic
agctctgtatagaagtatggaggtggtgtaaagcaaataatgcaccatatagagattggtttcaagctctctggt

SEQ ID NO: 99150 - DNA, 75 bp, Artificial Sequence
  Synthetic
agagattggtttcaagctctctggtttgaagacaaaacattctcagagtggttagatagattttgcagggttgga

SEQ ID NO: 99151 - DNA, 75 bp, Artificial Sequence
  Synthetic
gttccaccaattgacccagaaatccagtgtgcagccttgatgatagctgatataaaaggtgattattcagtattg

SEQ ID NO: 99152 - DNA, 75 bp, Artificial Sequence
  Synthetic
caattacaagctaataggcgagcttactcaggtaaacaatatgatgcatattgtgtacaaacttataatgaaata

SEQ ID NO: 99153 - DNA, 75 bp, Artificial Sequence
  Synthetic
acaaagctttatgagggagacttgagggtcacatttaattttggtcttgactgtgcaaggcttgagatcttctgg

SEQ ID NO: 99154 - DNA, 75 bp, Artificial Sequence
  Synthetic
ctgtgcaaggcttgagatcttctgggataaaagggcatatatattagaaacttcaatcacacagaaacatgtatt

SEQ ID NO: 99155 - DNA, 75 bp, Artificial Sequence
  Synthetic
aaagataatgatggatgaagtttcgaaagagttagttaagtgtgggatgaggtttaatacagaacaggtccaggg

SEQ ID NO: 99156 - DNA, 75 bp, Artificial Sequence
  Synthetic
ggtttaatacagaacaggtccagggggtacgtcacatggtgttattcaaaacagagtcaggatttgagtggggga

SEQ ID NO: 99157 - DNA, 75 bp, Artificial Sequence
  Synthetic
aaccaaatattccatgcattgtttataagaactgtgttctaagaacaagccttaggactacacaagcaattaacc

SEQ ID NO: 99158 - DNA, 75 bp, Artificial Sequence
  Synthetic
ataagtttatgatcacaataaaggatgatgggttgcgtgctattgcacagcatgacgaggatagtccaagattct

SEQ ID NO: 99159 - DNA, 75 bp, Artificial Sequence
  Synthetic
aagagatatcaggtatcaagcagtagatgccgtaagtaatgtatggtttgttcataaaggtgtgaagctatattt

SEQ ID NO: 99160 - DNA, 75 bp, Artificial Sequence
  Synthetic
aaatcccattatttcatctggcctacttgaaaattttatgaagaatcttccagctgctatccctcctgctgcata

SEQ ID NO: 99161 - DNA, 75 bp, Artificial Sequence
  Synthetic
ttcattgattatgaatcgagcaaagatatcagtggatttgtttatgtttaatgacctactcaagctaattaatcc

SEQ ID NO: 99162 - DNA, 75 bp, Artificial Sequence
  Synthetic
tcaaaacacattagacctttcaggtcttgaaacgacaggagatggattcagcactgtaagttcaatgtcaagtcg

SEQ ID NO: 99163 - DNA, 75 bp, Artificial Sequence
  Synthetic
atgagttcacaattgacttgcaggatgtggattttgagaatatagatatggaggcagacattgagcactttttgc

SEQ ID NO: 99164 - DNA, 75 bp, Artificial Sequence
  Synthetic
aggatgaaagctcatatactggagatctactaattagcacagaagaaactgaatcaaagaaaatgaggggtatag

SEQ ID NO: 99165 - DNA, 75 bp, Artificial Sequence
  Synthetic
tgaaaattcttgagcctgttaggctaatcaagagttgggtatcacgtggtctatctattgaaaaagtatacagtc

SEQ ID NO: 99166 - DNA, 75 bp, Artificial Sequence
  Synthetic
ctgtaaatattatcttaatgtcaagatatatttctaagacatttaacttgagtaccaaacaggtttcattgttag

SEQ ID NO: 99167 - DNA, 75 bp, Artificial Sequence
  Synthetic
atccatatgacttgacagaattagagagcattgttcggggatggggggagtgtgttattgatcaatttgaaagtc

SEQ ID NO: 99168 - DNA, 75 bp, Artificial Sequence
  Synthetic
catttaggcacactatggtgttgttaagaaggttatttccacaggattctattgcctccttctactaggctttct

SEQ ID NO: 99169 - DNA, 75 bp, Artificial Sequence
  Synthetic
tatttccacaggattctattgcctccttctactaggctttctttctttttcattttccggagcatactactacta

SEQ ID NO: 99170 - DNA, 75 bp, Artificial Sequence
  Synthetic
tacactcaggtaatctggagagggaaggcggatccgggacaatccagtcagaattcatttgaaacagtgtctact

SEQ ID NO: 99171 - DNA, 75 bp, Artificial Sequence
  Synthetic
ttttaaagcataaaatggtggaagaatcataccgcagtcggaagtcaataacctgttacgacctttcttgcaata

SEQ ID NO: 99172 - DNA, 75 bp, Artificial Sequence
  Synthetic
gtacttattgcaagccaacattatatatgattgtaccgatccatgcatgtaatatgatgaagagctgtctaattg

SEQ ID NO: 99173 - DNA, 75 bp, Artificial Sequence
  Synthetic
gtttctttgttgcagttaagggaaacacctataagctctttgaacaggttaagaaatcatttgagtcaacttgca

SEQ ID NO: 99174 - DNA, 75 bp, Artificial Sequence
  Synthetic
cacctataagctctttgaacaggttaagaaatcatttgagtcaacttgcaatgacactgagaataaagtacaggg

SEQ ID NO: 99175 - DNA, 75 bp, Artificial Sequence
  Synthetic
cacttgatgatttcaggtccatggaagcatttacaggaatctttaaatcaccacatggagaagaccatgaccttg

SEQ ID NO: 99176 - DNA, 75 bp, Artificial Sequence
  Synthetic
atcttgacaagttcaacagatgctaagcatgtgtttagccctgggttgttcccaaagcttaaccatacaaactgt

SEQ ID NO: 99177 - DNA, 75 bp, Artificial Sequence
  Synthetic
agcatgtgtttagccctgggttgttcccaaagcttaaccatacaaactgtgataagagtgccataccgctcacat

SEQ ID NO: 99178 - DNA, 75 bp, Artificial Sequence
  Synthetic
ggactgggatgattgatttacctggatactatgaggccatacacccttgcacagttttttgtgtactgtcaggcc

SEQ ID NO: 99179 - DNA, 75 bp, Artificial Sequence
  Synthetic
gcaacggacagcggaaagtaatattaacaaaaactttagttattgggcaatgtatatatactataacaagcttgt

SEQ ID NO: 99180 - DNA, 75 bp, Artificial Sequence
  Synthetic
acatttattatactaacagtcttaaagtttattgctaacatttttcacacaagcaaccaagagaataggttgaaa

SEQ ID NO: 99181 - DNA, 75 bp, Artificial Sequence
  Synthetic
aagcccactataaagtatgccaggtcacccataggttcagggatgatcttaaaaagactgtcactcctcagaatt

SEQ ID NO: 99182 - DNA, 75 bp, Artificial Sequence
  Synthetic
ccgttaactcctgtttggaatgacaatgcccatggtgttggttctgtgcctatgcacacagatctggagcttgat

SEQ ID NO: 99183 - DNA, 75 bp, Artificial Sequence
  Synthetic
tctaggacattggtttgatggccgtcttaaccttaaaacatccttccattgttatggtgcctgtacaaagtatga

SEQ ID NO: 99184 - DNA, 75 bp, Artificial Sequence
  Synthetic
ctggtgtaggctttacacttacatgcttggtatcattaacagagtgtcctacttttttaacctccattaaggcct

SEQ ID NO: 99185 - DNA, 75 bp, Artificial Sequence
  Synthetic
gtgacaaagctatttgttatggtgcagaaagtgtgacattaacaagaggacaaaatacagtgagggtatcaggaa

SEQ ID NO: 99186 - DNA, 75 bp, Artificial Sequence
  Synthetic
tgccctgtcaggaagcataagaaatcatagctagataatgctgctatcaagctattgtatgtaactttaacatat

SEQ ID NO: 99187 - DNA, 75 bp, Artificial Sequence
  Synthetic
atactaatttttatattccaggacactttatctaacacactaaaaaaaatagtagctttctaaccacaaaactta

SEQ ID NO: 99188 - DNA, 75 bp, Artificial Sequence
  Synthetic
tctaacacactaaaaaaaatagtagctttctaaccacaaaacttagatttttcttctgtatgatgtcttaacatc

SEQ ID NO: 99189 - DNA, 75 bp, Artificial Sequence
  Synthetic
agagctactagaacaacgatggcaactatggaggaattgcagagggaaatcaatgcccacgagggtcaactggtg

SEQ ID NO: 99190 - DNA, 75 bp, Artificial Sequence
  Synthetic
ccatccaagcaaagattgatgaattgaagaggcaactggcagatcggattgcaaccggaaagaatcttggaaagg

SEQ ID NO: 99191 - DNA, 75 bp, Artificial Sequence
  Synthetic
cctttgttgtcccgatacttctgaaagctctgtatatgttaacaacaagggggaggcagaccaccaaggacaata

SEQ ID NO: 99192 - DNA, 75 bp, Artificial Sequence
  Synthetic
tgatagttccttcgaggatgtcaatggcatccggaagccaaaacatctatatgtgtccttgccaaatgcacagtc

SEQ ID NO: 99193 - DNA, 75 bp, Artificial Sequence
  Synthetic
atgtgtccttgccaaatgcacagtcaagtatgaaagcagaagagattacacctggtagatatagaacagcaattt

SEQ ID NO: 99194 - DNA, 75 bp, Artificial Sequence
  Synthetic
tggcaaaagattggagtgaccgcattgagcagtggttaagtgaaccctgtaagcttcttccagacacagcagcag

SEQ ID NO: 99195 - DNA, 75 bp, Artificial Sequence
  Synthetic
ctatcagtcttatctcaggagaacacaatcaatgggaatacaactggatcagaggataattgtgctcttcatggt

SEQ ID NO: 99196 - DNA, 75 bp, Artificial Sequence
  Synthetic
agaggataattgtgctcttcatggtagcctgggggaaagaagcagtggataacttccacctaggagatgatatgg

SEQ ID NO: 99197 - DNA, 75 bp, Artificial Sequence
  Synthetic
atcctgagctgcgaacactagcacagagcctgattgatgttaaagtgaaggaaatttccaaccaagagcctttaa

SEQ ID NO: 99198 - DNA, 75 bp, Artificial Sequence
  Synthetic
aattataatcagtgaatgtataaccctcattatgtgattattatatactactgaatcattatcaatcatatttgc

SEQ ID NO: 99199 - DNA, 75 bp, Artificial Sequence
  Synthetic
taacaacaacattctacctcagcacaaaactacctcaactaaactacctcatttgattgctccttgattgtcttt

SEQ ID NO: 99200 - DNA, 75 bp, Artificial Sequence
  Synthetic
agtatggcctgccttagcactgaggaatgtctatgacatgaaaattgagtgcccccacacagtcagttttggaga

SEQ ID NO: 99201 - DNA, 75 bp, Artificial Sequence
  Synthetic
aaatagcgtacttggttatgtggaattgcctcctatgccattggcagacacaatacaaatggttcctgaaagttc

SEQ ID NO: 99202 - DNA, 75 bp, Artificial Sequence
  Synthetic
ttgtagcatggacaaccaccagtccatgagcacagcaacgaagtatactcaagtgagctggagagggaaagctga

SEQ ID NO: 99203 - DNA, 75 bp, Artificial Sequence
  Synthetic
acacaaaatggtagaaaagtcataccgtagcagaaagtcactaacttgttatgacctctcttgtaacagtaccta

SEQ ID NO: 99204 - DNA, 75 bp, Artificial Sequence
  Synthetic
ctgtaaaccaacactgtatatgattgtgccaatccatgcatgtaacatgatgaaaagttgcatcattgcactagg

SEQ ID NO: 99205 - DNA, 75 bp, Artificial Sequence
  Synthetic
gccttatagagtacaagtggtttacgagaggacatattgcatgacaggggtcctattagaagggaaatgttttgt

SEQ ID NO: 99206 - DNA, 75 bp, Artificial Sequence
  Synthetic
cccagatcagagtgtagtcagcattgtcaagcacagcatctttgacattgcaagtgttcatattgcatgtttttt

SEQ ID NO: 99207 - DNA, 75 bp, Artificial Sequence
  Synthetic
tgtagcaattacaggaaacacatataagctttttgaacaagttaagacgtcatttgggacaacatgtaacgatac

SEQ ID NO: 99208 - DNA, 75 bp, Artificial Sequence
  Synthetic
tgaagacaaggtgcaaggctattacatctgtattcttggaggaaactctccacctatttatgtcccaacacttga

SEQ ID NO: 99209 - DNA, 75 bp, Artificial Sequence
  Synthetic
cacctatttatgtcccaacacttgatgattttaggtccatggaggcattctcaggaatattcagatcaccacatg

SEQ ID NO: 99210 - DNA, 75 bp, Artificial Sequence
  Synthetic
tcttactcttctcttagtatcctcaccagttcaacagaggctaagcatgtatttagccctggattatttccacag

SEQ ID NO: 99211 - DNA, 75 bp, Artificial Sequence
  Synthetic
gaggctgtacatccttgcacagttttctgtgttttgtcaggtccaggtgcatcatgtgaggcattttcagaaggt

SEQ ID NO: 99212 - DNA, 75 bp, Artificial Sequence
  Synthetic
ggaattttcaacataacctcacctatgtgcctagtatcaaagcaaaacaggtttcgactaacagaacagcaagtc

SEQ ID NO: 99213 - DNA, 75 bp, Artificial Sequence
  Synthetic
aactttgtatgccaaagagttgacatggatatcgtggtttattgtaatggtcaaaggaaggtgatattaacaaaa

SEQ ID NO: 99214 - DNA, 75 bp, Artificial Sequence
  Synthetic
accttagttattggacaatgtatatatactataacaagtttattctcactgctacctggggtagcacactctatt

SEQ ID NO: 99215 - DNA, 75 bp, Artificial Sequence
  Synthetic
gctgttgagctgtgtgtacctgggtttcatgggtgggctacagctgctttacttgtcacattttgtttcgggtgg

SEQ ID NO: 99216 - DNA, 75 bp, Artificial Sequence
  Synthetic
ttcatgggtgggctacagctgctttacttgtcacattttgtttcgggtgggttctcataccggcaattacatttg

SEQ ID NO: 99217 - DNA, 75 bp, Artificial Sequence
  Synthetic
taaagaaaatcaaggaagagtttgaaaagacaaagggctcaatggtttgtgatatctgtaaatatgagtgtgaga

SEQ ID NO: 99218 - DNA, 75 bp, Artificial Sequence
  Synthetic
cctacaaagagttgaaggcacatggggtttcatgtcctcaatcccaatgtccttattgttttacccactgtgaac

SEQ ID NO: 99219 - DNA, 75 bp, Artificial Sequence
  Synthetic
ccacagaatcagcattccaggcccattatagagtatgtcaagttactcatcggttcagagaagacctaaagaaga

SEQ ID NO: 99220 - DNA, 75 bp, Artificial Sequence
  Synthetic
ctgttactcctcagaacttcacacctgggtgttatcgtacattgaatttatttagatataaaagtaggtgttaca

SEQ ID NO: 99221 - DNA, 75 bp, Artificial Sequence
  Synthetic
ttttcacaatgtggatctttcttttagtccttgagtcaatcctatgggctgcaagtgcgtcagaaacacccttaa

SEQ ID NO: 99222 - DNA, 75 bp, Artificial Sequence
  Synthetic
gccctacatggaatgataatgcccacggggttgggtccatacccatgcacacagatttagagctagacttttctc

SEQ ID NO: 99223 - DNA, 75 bp, Artificial Sequence
  Synthetic
taacatcaagttctaagtatacatacaggaggaagctaacaaatccacttgaagaagcacaggcagtcagtttcc

SEQ ID NO: 99224 - DNA, 75 bp, Artificial Sequence
  Synthetic
atgttgaaatagaagagcaaacaatcggtgttgatgttcatgcattagggcattggtttgatggtcgtttgaatc

SEQ ID NO: 99225 - DNA, 75 bp, Artificial Sequence
  Synthetic
tcaaaacatcctttcattgttacggtgcatgtacaaagtatgaatacccatggcatactgcaaagtgccattatg

SEQ ID NO: 99226 - DNA, 75 bp, Artificial Sequence
  Synthetic
aaagggattatcagtatgagacaagttggggttgtaacccatcagattgcccaggagtgggtacaggatgcacag

SEQ ID NO: 99227 - DNA, 75 bp, Artificial Sequence
  Synthetic
catgtgggttatatctcgaccagttaaaaccggttggcagtgcatataaaatcattacaataaggtatagtagga

SEQ ID NO: 99228 - DNA, 75 bp, Artificial Sequence
  Synthetic
gagtttgtgttcaatttggtgaagagaacctttgtaaagtcatagatatggatgattgttttgtgtctagacatg

SEQ ID NO: 99229 - DNA, 75 bp, Artificial Sequence
  Synthetic
tcaaggtttgtataattggcacagtttctaaattctcccaaggtgatacattattgttctttggaccacttgaag

SEQ ID NO: 99230 - DNA, 75 bp, Artificial Sequence
  Synthetic
gcggtggcttaatttttaaacattggtgcacatctacatgccagtttggagaccctggagatatcatgagcccaa

SEQ ID NO: 99231 - DNA, 75 bp, Artificial Sequence
  Synthetic
gtgcacatctacatgccagtttggagaccctggagatatcatgagcccaagagacaaaggttttttatgtcctga

SEQ ID NO: 99232 - DNA, 75 bp, Artificial Sequence
  Synthetic
aggttataagaaagtaatggctacaattgattcatttcaatccatcaatactagcaccatgcatttcactgatga

SEQ ID NO: 99233 - DNA, 75 bp, Artificial Sequence
  Synthetic
gagaatagaatggaaagatcctgatgggatgttaagggaccacatcaatattttagtaacaaaagatattgattt

SEQ ID NO: 99234 - DNA, 75 bp, Artificial Sequence
  Synthetic
tgacaatcttggtgaaaacccttgtaagattggcttacagacatcctccatcgaaggggcatggggctcaggtgt

SEQ ID NO: 99235 - DNA, 75 bp, Artificial Sequence
  Synthetic
aggcttcacactcacatgcttaatatcattaacagagtgccctactttcttaacatcaatcaaggcctgtgacaa

SEQ ID NO: 99236 - DNA, 75 bp, Artificial Sequence
  Synthetic
agctatatgctatggtgcagagagcgtgacattaacaagagggcaaaatacagtcaaagtatcagggaagggtgg

SEQ ID NO: 99237 - DNA, 75 bp, Artificial Sequence
  Synthetic
gcatagtggctcaacattcaaatgctgtcatggagaagactgttcacagagtgggctccatgctgctgcacctca

SEQ ID NO: 99238 - DNA, 75 bp, Artificial Sequence
  Synthetic
ccttgataaggtcaatgggatctctgaaatggaaaatagtaaagtatatgatgatggagcaccacaatgtgggat

SEQ ID NO: 99239 - DNA, 75 bp, Artificial Sequence
  Synthetic
caaatgttggtttgtcaaatctggagagtggatctcaggaatcttcagtggtaactggattgtcctcattgtcct

SEQ ID NO: 99240 - DNA, 75 bp, Artificial Sequence
  Synthetic
ctgtgtatttctactattttcattggtattgcttagcatcctctgtcctgtcagaaaacacaaaaaatcataaat

SEQ ID NO: 99241 - DNA, 75 bp, Artificial Sequence
  Synthetic
gagaaggtgttgcagcatcaatccaggcaaaaattgatgaactaaaaagacagctagcagataggattgcaacag

SEQ ID NO: 99242 - DNA, 75 bp, Artificial Sequence
  Synthetic
ggaaaaatctcgggaaagaacaagacccaacaggggtggagcctggagatcacctaaaggaaagatcaatgctta

SEQ ID NO: 99243 - DNA, 75 bp, Artificial Sequence
  Synthetic
gctatggaaatgtgctagatttgaaccatctagatattgatgagcctacagggcaaacagcagattggctaagta

SEQ ID NO: 99244 - DNA, 75 bp, Artificial Sequence
  Synthetic
ttgttatttacttaacatcctttgttgtcccaatactactgaaggccttatatatgttgacaacacgggggcgac

SEQ ID NO: 99245 - DNA, 75 bp, Artificial Sequence
  Synthetic
aaaccaccaaggataataagggaaccagaattcgctttaaagacgacagctcatttgaggatgtgaatggaatcc

SEQ ID NO: 99246 - DNA, 75 bp, Artificial Sequence
  Synthetic
ggaaaccaaagcatctctatgtgtcactaccaaacgcacaatcaagcatgaaggcagaagagattacacctggga

SEQ ID NO: 99247 - DNA, 75 bp, Artificial Sequence
  Synthetic
gatacagaacagcaatttgtggattatatcctgcacagatcaaggccagacaaatgatcagcccggtaatgagtg

SEQ ID NO: 99248 - DNA, 75 bp, Artificial Sequence
  Synthetic
caaatgatcagcccggtaatgagtgtgattggcttcttagcacttgcaaaggactggagtgaccgcattgagcag

SEQ ID NO: 99249 - DNA, 75 bp, Artificial Sequence
  Synthetic
gattacttacggcaaagacaggtagcattaggaaacatggagacaaaagaatcaaaggccatacgccagcatgct

SEQ ID NO: 99250 - DNA, 75 bp, Artificial Sequence
  Synthetic
gagaccgcaggttgtagcatgatagaggatattgagtcaccatcatcaatatgggtctttgctggagcacctgac

SEQ ID NO: 99251 - DNA, 75 bp, Artificial Sequence
  Synthetic
cgttgtccaccaacatgcttgttcatcgcagggattgctgagttgggggcattcttctcggtcttacaagacatg

SEQ ID NO: 99252 - DNA, 75 bp, Artificial Sequence
  Synthetic
cggaacacgattatggcatcaaagacagtagggacatctgaagagaaactgcgcaagaaatcctcattttaccag

SEQ ID NO: 99253 - DNA, 75 bp, Artificial Sequence
  Synthetic
tcataccttagaagaacacaatcaatgggaatacaactggaccagagaatcattgttctcttcatggttgcttgg

SEQ ID NO: 99254 - DNA, 75 bp, Artificial Sequence
  Synthetic
cattgttctcttcatggttgcttggggcaaagaggcagtggacaacttccacttaggggacgatatggaccctga

SEQ ID NO: 99255 - DNA, 75 bp, Artificial Sequence
  Synthetic
attgatgttaaagtgaaggaaatttctaaccaagaaccattaaagctataattaatgaatgtataatcctattat

SEQ ID NO: 99256 - DNA, 75 bp, Artificial Sequence
  Synthetic
gtgatcactatatactactgaatcattatcaatcatatttacactattataatcaggggaatcattatatcaggg

SEQ ID NO: 99257 - DNA, 75 bp, Artificial Sequence
  Synthetic
atctactgtgggtgggtttagttccaggctgccttaagtagccctttttgtatatatggatgtaaatttcatttg

SEQ ID NO: 99258 - DNA, 75 bp, Artificial Sequence
  Synthetic
aacaacaaactacctcaacctaactacctcatttgcttgccccttgattgtctttttagggagcatactactact

SEQ ID NO: 99259 - DNA, 75 bp, Artificial Sequence
  Synthetic
ttgcagggattgctgaacttggagcattcttttcaatcttacaggacatgcggaataccattacggcgtcaaaga

SEQ ID NO: 99260 - DNA, 75 bp, Artificial Sequence
  Synthetic
tttttctctttttcttgctttctctgcttactaacaacaacactctacctcaacacaaaactaccccaacataac

SEQ ID NO: 99261 - DNA, 75 bp, Artificial Sequence
  Synthetic
acacaaaactaccccaacataactacctcatttgcttgctccttgattgtctttttagggagcatactactacta

SEQ ID NO: 99262 - DNA, 75 bp, Artificial Sequence
  Synthetic
tggttgttatcggacgttaaaccttttcagatataaaagcaggtgctacatcctcacaatgtggaatctcctcct

SEQ ID NO: 99263 - DNA, 75 bp, Artificial Sequence
  Synthetic
tcctcacaatgtggaatctcctcctggtccccgggtaccgagcttgggctgcaagtgcatcggaaatacccttaa

SEQ ID NO: 99264 - DNA, 75 bp, Artificial Sequence
  Synthetic
tggcatacagcaaagtgtcactatgagcgggattatcagtatgaaacaagttggggctgtaatccatctgactgc

SEQ ID NO: 99265 - DNA, 75 bp, Artificial Sequence
  Synthetic
ctgtgtgtttttattgttttcattgatattactcagtattctttgccctgtaagaaagcacaaaaagtcatagct

SEQ ID NO: 99266 - DNA, 75 bp, Artificial Sequence
  Synthetic
gatccttaaactaatcttgctttctttcctctttctctggctttttttgcttactaacaacaacactctacctca

SEQ ID NO: 99267 - DNA, 75 bp, Artificial Sequence
  Synthetic
aacactctacctcaacacaataactacctcatttgcttgctccttgattgtctttttagggagcatactactact

SEQ ID NO: 99268 - DNA, 75 bp, Artificial Sequence
  Synthetic
tagtagtagactccctaaataacaattaactaaaaaaatggagaaatacagagaaattcacaacaaactgaagga

SEQ ID NO: 99269 - DNA, 75 bp, Artificial Sequence
  Synthetic
gtttacagttggtacactcacagcagtggaatgcatcgattatttagatagactttatgcagttaggcatgatat

SEQ ID NO: 99270 - DNA, 75 bp, Artificial Sequence
  Synthetic
tgttgatcagatgataaaacatgattggtctgacaataaggattcagaggagccaatagggaaagtcttgttgtt

SEQ ID NO: 99271 - DNA, 75 bp, Artificial Sequence
  Synthetic
tgcaggagtaccaaataatgttatcacagccatggagaagaaagttatccctaatcatccaacaggaaaaaactt

SEQ ID NO: 99272 - DNA, 75 bp, Artificial Sequence
  Synthetic
aaaggcatttttcaagatgaccccagacaattacaaaattacaggatcaacaattgagttcatagaggtcacagt

SEQ ID NO: 99273 - DNA, 75 bp, Artificial Sequence
  Synthetic
aacagcagatgttgatagaggaattagagagaagaggctcaagtatgaagcaggcttggcctatgtagagcaaga

SEQ ID NO: 99274 - DNA, 75 bp, Artificial Sequence
  Synthetic
gctgcacaactttttcctgaagggcgagctggcccagccatatagaatagtttttaatgttgtagcagtgaggac

SEQ ID NO: 99275 - DNA, 75 bp, Artificial Sequence
  Synthetic
tgatggttcaaacatcacaacacaatggccaagtcggcgtaatgatggtgttgtgcagtatatgcggcttgtaca

SEQ ID NO: 99276 - DNA, 75 bp, Artificial Sequence
  Synthetic
agccgagatcagttatgtaagggaacatctagtgaagcctgaggaacgagcagcccttgaggctatgtttaattt

SEQ ID NO: 99277 - DNA, 75 bp, Artificial Sequence
  Synthetic
aaagttcaatataagttctgtaaaaaaccagccatattatattcctgattatagaggcattgatccaataggtgc

SEQ ID NO: 99278 - DNA, 75 bp, Artificial Sequence
  Synthetic
aaatatagatgacttggttcaatactcccgtgagtggttgtctaaggcacagaatttttcattcttcgaagtaaa

SEQ ID NO: 99279 - DNA, 75 bp, Artificial Sequence
  Synthetic
aggaacatctgtttttgagtgctttaatgtcaatgaagctgaccactgcttaaagtaccctatgtccagacaccc

SEQ ID NO: 99280 - DNA, 75 bp, Artificial Sequence
  Synthetic
aagaaatttcctcctaattcaatgctctttaataacaccttataaaccagctactatactttcagaccagataga

SEQ ID NO: 99281 - DNA, 75 bp, Artificial Sequence
  Synthetic
tagtcgcagagcctgttcattcattctgaatcttataccggatacacctgcatcatttttaatacatgatatggc

SEQ ID NO: 99282 - DNA, 75 bp, Artificial Sequence
  Synthetic
atatcggtatattaacctaacacgtgatgatgtgattaacttttatgcacctagaattaactttcaacctaccca

SEQ ID NO: 99283 - DNA, 75 bp, Artificial Sequence
  Synthetic
gaatattaaggaacctggaacattcaagttaacttcaagtatgttgcgggcagaatcaaaagcaatgttagatct

SEQ ID NO: 99284 - DNA, 75 bp, Artificial Sequence
  Synthetic
tttgaataatcataagcctggtgaaaagcatgggttaaaaattgaaagcctgaatgtcggaagtcacattgtgca

SEQ ID NO: 99285 - DNA, 75 bp, Artificial Sequence
  Synthetic
atcagaatcagttagtctgataactaaaatcctctcggacttagagctaaacatcactgagccatcatctcaaga

SEQ ID NO: 99286 - DNA, 75 bp, Artificial Sequence
  Synthetic
atttcaaaccacaaagcatacatatgttgataatgtcttagacagattttttcaaaatgagacacagaaatattt

SEQ ID NO: 99287 - DNA, 75 bp, Artificial Sequence
  Synthetic
aattgatatccttcggaaaacaacagcctggcacttaggtcatcttattcgagacataacagaaagcttgatagc

SEQ ID NO: 99288 - DNA, 75 bp, Artificial Sequence
  Synthetic
acattctggtcttaagaggtcaaaatattggtcattacactcttgcaataatggaaatgttgtgttgtttattct

SEQ ID NO: 99289 - DNA, 75 bp, Artificial Sequence
  Synthetic
tccatccaaatctttagaagtggcagggtcctttataaggtttataacagtttttaggatggggccaggtttagt

SEQ ID NO: 99290 - DNA, 75 bp, Artificial Sequence
  Synthetic
tgataaagataatctagacactgtattagttgatggggattcgcaatggggtgtatcaaaagttatgagtattga

SEQ ID NO: 99291 - DNA, 75 bp, Artificial Sequence
  Synthetic
tttgaatagattgcttgcactgaatatagcatttgaaaaggcattgattgctacagcaacttggtttcaatatta

SEQ ID NO: 99292 - DNA, 75 bp, Artificial Sequence
  Synthetic
tacagaagatcagggccaatttccactacagcatgcaatacggtctgtgtttgcaaaccattttctgctatctgt

SEQ ID NO: 99293 - DNA, 75 bp, Artificial Sequence
  Synthetic
ctgtcaaaaaatgaaattatgtgccatctttgataatttaagatatttgatccctgctgtgacatctttatactc

SEQ ID NO: 99294 - DNA, 75 bp, Artificial Sequence
  Synthetic
aggttttccttcactgattgagaagcttttcgatcgaccatttaaatcatcattagaagtttatatctattataa

SEQ ID NO: 99295 - DNA, 75 bp, Artificial Sequence
  Synthetic
tataaagagtttattagttgcactagcacagaataataaagcgaggttttattcaaaagtaaagttgctgggttt

SEQ ID NO: 99296 - DNA, 75 bp, Artificial Sequence
  Synthetic
aacagtggaccagtcaactgttggtgcaagtggagtttatccctctttcatgtctcgagtagtttacaagcacta

SEQ ID NO: 99297 - DNA, 75 bp, Artificial Sequence
  Synthetic
tgggagcttgatctcagaagttactacgtgcttctttttgtttgagaaaggcctacatggcaatatgaatgagga

SEQ ID NO: 99298 - DNA, 75 bp, Artificial Sequence
  Synthetic
ggcaaagattcatctggaaacagtggaatgggctctcaagtttcgagagaaggaggaaatgtttggagaatccct

SEQ ID NO: 99299 - DNA, 75 bp, Artificial Sequence
  Synthetic
tgttgaaaatggttacatgattggtgagttgaaagaggacccaagattggctgaacagcaattatactgtcaaga

SEQ ID NO: 99300 - DNA, 75 bp, Artificial Sequence
  Synthetic
tgcagtggagcttgcagctattgagctcaataaagttcttgtcacaaagtcacaggttgtggcaaatagtattct

SEQ ID NO: 99301 - DNA, 75 bp, Artificial Sequence
  Synthetic
taataaaaattgggaagaaccatatttcagtcagacaagaaatatcagtttaaaaggcatgtcagggcaggttca

SEQ ID NO: 99302 - DNA, 75 bp, Artificial Sequence
  Synthetic
agaagatggacatctttcatcatctgttaccataattgaggctattcggtatttatccaattcccgacataaccc

SEQ ID NO: 99303 - DNA, 75 bp, Artificial Sequence
  Synthetic
gagtttattgaaactatatgaagaaacaagagagcacaaggcaatggctaggattgttaggaagtatcagcgtac

SEQ ID NO: 99304 - DNA, 75 bp, Artificial Sequence
  Synthetic
tgaggccgatcgtggtttctttattacaacactacctactaggtgtcgattagagatcattgaagactattatga

SEQ ID NO: 99305 - DNA, 75 bp, Artificial Sequence
  Synthetic
tgcaatagctaaaaacattactgaagaatatatatcttatggaggggagaagaaaatcttagctattcaatctgc

SEQ ID NO: 99306 - DNA, 75 bp, Artificial Sequence
  Synthetic
ttcggaaaaagcattaagatgggcatctggcgaaagtttcatagaactaagtaaccagaagtttataagaatgaa

SEQ ID NO: 99307 - DNA, 75 bp, Artificial Sequence
  Synthetic
aaggaagttgatgtatgtaagtgccgatgcaactaaatggtcacctggtgataattcagctaaatttagaagatt

SEQ ID NO: 99308 - DNA, 75 bp, Artificial Sequence
  Synthetic
tacagctatgctgcacaatggtctaccaaatgataagttgaaggattgtgtaattgatgcactaaaacaagtcta

SEQ ID NO: 99309 - DNA, 75 bp, Artificial Sequence
  Synthetic
taagacagacttttttatgtctaggaagctacggaattatctagacaatatggaatcacatgatcctcatattaa

SEQ ID NO: 99310 - DNA, 75 bp, Artificial Sequence
  Synthetic
gcaattccttgatttctttccagatggtcatcacggagaagtgaaaggaaactggttacaggggaacctcaacaa

SEQ ID NO: 99311 - DNA, 75 bp, Artificial Sequence
  Synthetic
atgctcacctttatttggtgttgcaatgtcacttttatttaagcaggtttggagcagtttgtttccggagttgga

SEQ ID NO: 99312 - DNA, 75 bp, Artificial Sequence
  Synthetic
ctgcttttttgaatttgcccaccactctgatgatgctctgttcatttatgggtacttagagcctgtagatgacgg

SEQ ID NO: 99313 - DNA, 75 bp, Artificial Sequence
  Synthetic
gacagattggttcctatacgtttcccagcaaatacaagctggtaatctccattggttcagtgtaaatacagaaat

SEQ ID NO: 99314 - DNA, 75 bp, Artificial Sequence
  Synthetic
gtggaagagcatgtttaatctccatgaacacatattgttgctaggttcaataaaaatctcccctaaaaagacaac

SEQ ID NO: 99315 - DNA, 75 bp, Artificial Sequence
  Synthetic
agtatcccctactaatgcagagttcttatctactttttttgaaggctgtgcagtttcaataccatttattaagat

SEQ ID NO: 99316 - DNA, 75 bp, Artificial Sequence
  Synthetic
cctgctaggatctttatcagatcttccagggttgggttattttgatgacttggctgcagcacaaagtaggtgtgt

SEQ ID NO: 99317 - DNA, 75 bp, Artificial Sequence
  Synthetic
taaagtactagaccttggtgcctctccgcagatagctcagttggctgttgcactgtgtactagtaaggttgaaag

SEQ ID NO: 99318 - DNA, 75 bp, Artificial Sequence
  Synthetic
attatatggaacagcagttggaatggtaaatcatccagctgcttatttgcaagttaagcatgctgatactcctat

SEQ ID NO: 99319 - DNA, 75 bp, Artificial Sequence
  Synthetic
tccgctgggtggtagtggggccatgtccataatggagttagctactgctggaattggtatgtcagataaaaatct

SEQ ID NO: 99320 - DNA, 75 bp, Artificial Sequence
  Synthetic
tcttaaaagagccctggtaggatatatgcataagagacaaaaatcaatgctttatatcttaggattattcaaatt

SEQ ID NO: 99321 - DNA, 75 bp, Artificial Sequence
  Synthetic
tttaatgaacctatcagatgagaccttccagcatgagagactaggccagttctcatttattggcaaagtccagtg

SEQ ID NO: 99322 - DNA, 75 bp, Artificial Sequence
  Synthetic
gaaagtgttcactccaaagtcagagtttgagttttcagacatgtatacacctaagtttttacagttatggagtga

SEQ ID NO: 99323 - DNA, 75 bp, Artificial Sequence
  Synthetic
gcagcatgtaacttatgattatattattcccaaggggagggataatttattaatttatctagtaaggaagttaaa

SEQ ID NO: 99324 - DNA, 75 bp, Artificial Sequence
  Synthetic
tgatcctagcattgtaacagctatgacaatgcagtctcctctccagctacggttccgtatgcaagctaaacagca

SEQ ID NO: 99325 - DNA, 75 bp, Artificial Sequence
  Synthetic
catgaaagtatgcagactggaaggtgattgggttacctttagagaggtcttagctgctgctaatagctatgcaga

SEQ ID NO: 99326 - DNA, 75 bp, Artificial Sequence
  Synthetic
cacttattcacttacgaatcaggaccttgacctcttccagacactgacaaactgtacattttctaaagagtatgc

SEQ ID NO: 99327 - DNA, 75 bp, Artificial Sequence
  Synthetic
ctggaaggattttctaaatggtgttcattgtgatgtcattccaacaaaacaagtacagagggcaaaagttgcaag

SEQ ID NO: 99328 - DNA, 75 bp, Artificial Sequence
  Synthetic
gacctttactgttcgggagaaggaccaaattatccaaaatagcatccctgctgttataggttataaatttgctgt

SEQ ID NO: 99329 - DNA, 75 bp, Artificial Sequence
  Synthetic
cacagtggatgaaatgtcagatgtgttggacacagcccgatttcctgattcattgtctgttgatttaaaaacaat

SEQ ID NO: 99330 - DNA, 75 bp, Artificial Sequence
  Synthetic
gaaagacggtgtgtacagggaattaggtttggacatttcaataccagacgttatgaaaagggttgcacctatgct

SEQ ID NO: 99331 - DNA, 75 bp, Artificial Sequence
  Synthetic
ctataaatctgcaaagtcccgggttgtaattgtacaaggtaatgttgaggggacagctgaggcgatatgtgcata

SEQ ID NO: 99332 - DNA, 75 bp, Artificial Sequence
  Synthetic
ttggttaaaatcaatgtcacttgtaaagacaataagggtaaagccccataaggaggtacttcaggctgtttctat

SEQ ID NO: 99333 - DNA, 75 bp, Artificial Sequence
  Synthetic
attcaaccgtaaggaagatattggacagcaaaaggatctagcagcattaaggctttgtattgaagtttggaggtg

SEQ ID NO: 99334 - DNA, 75 bp, Artificial Sequence
  Synthetic
gtgtaaggcaaataatgctccttaccgagagtggttccatgctctttggtttgaagataaaactttttcagaatg

SEQ ID NO: 99335 - DNA, 75 bp, Artificial Sequence
  Synthetic
gcttgaccggtttacaagagtaggtgtaccaccaattgacccagagattcaatgtgcagcattaatgattgcaga

SEQ ID NO: 99336 - DNA, 75 bp, Artificial Sequence
  Synthetic
cgttaagggtgattattctgtccttcaactccaagcaaatcgacgtgcatattctgggaagcagtatgatgctta

SEQ ID NO: 99337 - DNA, 75 bp, Artificial Sequence
  Synthetic
ctgtgtgcaaacatacaatgagatgacaaagttatatgaaggagatttacgtgttacatttaattttggcctgga

SEQ ID NO: 99338 - DNA, 75 bp, Artificial Sequence
  Synthetic
ttgtgcccgtttagagatcttttgggagaaacaggcatacatattagaaacatcgattacacaaaaacatgttct

SEQ ID NO: 99339 - DNA, 75 bp, Artificial Sequence
  Synthetic
gaagataatgatggatgaagtctctaaggagttaattaggtgtgggatgaggtttaacacggagcaggttcaagg

SEQ ID NO: 99340 - DNA, 75 bp, Artificial Sequence
  Synthetic
tgttcgccatatggtgttgtttaaaacagagtcaggctttgagtggggaaaaccaaatgtaccgtgcattgttta

SEQ ID NO: 99341 - DNA, 75 bp, Artificial Sequence
  Synthetic
taagaactgtgtcctccgtacaagcttgcggacaacacaagccattaatcataagtttatgataacaattaaaga

SEQ ID NO: 99342 - DNA, 75 bp, Artificial Sequence
  Synthetic
tgatggccttcgagccattgcccagcatgatgaagatagtcctagatttcttttagctcatgcttttcacacaat

SEQ ID NO: 99343 - DNA, 75 bp, Artificial Sequence
  Synthetic
tagagacattagataccaggcagttgatgcagtaagtaatgtctggttcatccataggggcataaaactgtactt

SEQ ID NO: 99344 - DNA, 75 bp, Artificial Sequence
  Synthetic
aaatccaataatttcatctggactgtttgaaaattttatgaaaaacttgccagctgcaattcctcctgcagctta

SEQ ID NO: 99345 - DNA, 75 bp, Artificial Sequence
  Synthetic
ctcattaattatgaatagggcaaaaatatcagttgatctgtttatgtttaacgatctgttaagattaataaatcc

SEQ ID NO: 99346 - DNA, 75 bp, Artificial Sequence
  Synthetic
acataatacattagacttatctggtcttgaaacaaccggtgagggatttagtactgttatctctatgtctagtcg

SEQ ID NO: 99347 - DNA, 75 bp, Artificial Sequence
  Synthetic
gctgtggtcagaggagatgagcttagtagatgatgaggaggaattagaggatgagtttactattgatctacaaga

SEQ ID NO: 99348 - DNA, 75 bp, Artificial Sequence
  Synthetic
tgttgactttgagaacatagatatggaggctgatatagagcactttttgcaggatgaaagctcttatactggtga

SEQ ID NO: 99349 - DNA, 75 bp, Artificial Sequence
  Synthetic
tctattaatcagtgctgaggagacagaggtaaaaaaaatgagaggaatagttaaaatcttggagccagttaggtt

SEQ ID NO: 99350 - DNA, 75 bp, Artificial Sequence
  Synthetic
aataaaaagctgggtatcaaggggcttatcaatagagaaggtttatagtcctgtaaatataattttaatggctag

SEQ ID NO: 99351 - DNA, 75 bp, Artificial Sequence
  Synthetic
gtatatttctaaaacatttaacttgacaaataagcaagtttccttattagatccgtatgatttgaccgaattaga

SEQ ID NO: 99352 - DNA, 75 bp, Artificial Sequence
  Synthetic
aagtattgttcgaggttggggggaatgtgtcattgaccagtttgacacatttgatagggaggcacagctgttggt

SEQ ID NO: 99353 - DNA, 75 bp, Artificial Sequence
  Synthetic
gcagaataagggtatttgtccagaggatgtaatacctgactcactgttttcctttagacacaccatggttctatt

SEQ ID NO: 99354 - DNA, 75 bp, Artificial Sequence
  Synthetic
aagaagattatttcctcaggactctgtttcatcattttattaggtttaaattctttttcattttccggagcatac

SEQ ID NO: 99355 - DNA, 75 bp, Artificial Sequence
  Synthetic
tatttcctcaggactctgtttcatcattttattaggtttaaattctttttcattttccggagcatactactacta

SEQ ID NO: 99356 - DNA, 75 bp, Artificial Sequence
  Synthetic
aatgtgtatgacatgaaaattgaatgcccccacacagtaagtttcggagaaaacagtgtaatagggtatgtggag

SEQ ID NO: 99357 - DNA, 75 bp, Artificial Sequence
  Synthetic
gagagaacctactgtatgacaggagtcttgattgaaggaaaatgttttgtcccagatcaaagtgttgttagcatt

SEQ ID NO: 99358 - DNA, 75 bp, Artificial Sequence
  Synthetic
attaagcatgggatctttgatattgcaagtgttcatgttgtatgtttctttgttgcagttaaagggaacacctat

SEQ ID NO: 99359 - DNA, 75 bp, Artificial Sequence
  Synthetic
taacctccattaaggcctgtgataaagctatttgttacggtgcagaaagtgtaacattaacaagaggacaaaata

SEQ ID NO: 99360 - DNA, 75 bp, Artificial Sequence
  Synthetic
tcaggaagcataagaaatcatagctagatggtgctgctatcaagctattgtatatagctttaacatatatactaa

SEQ ID NO: 99361 - DNA, 75 bp, Artificial Sequence
  Synthetic
cgggaagaatcttggaaaggaacaagacccaacaggagtagaacctggagatcatctgaaagagagatcaatgct

SEQ ID NO: 99362 - DNA, 75 bp, Artificial Sequence
  Synthetic
tccttgccaaatgctcagtcaagtatgaaagcagaagagattacacctggtagatatagaacagcaatttgtggg

SEQ ID NO: 99363 - DNA, 75 bp, Artificial Sequence
  Synthetic
ctgcttactaacaacaacattctacctcaacacaaaactacctcaactaaactacctcatttgattgctccttga

SEQ ID NO: 99364 - DNA, 75 bp, Artificial Sequence
  Synthetic
cacttaattaagactgaagagagagctgcattagaagccatgtttaatttaaagttcaatataagtacacacaaa

SEQ ID NO: 99365 - DNA, 75 bp, Artificial Sequence
  Synthetic
ctgcattagaagccatgtttaatttaaagttcaatataagtacacacaaaagccagccatattacataccagatt

SEQ ID NO: 99366 - DNA, 75 bp, Artificial Sequence
  Synthetic
caactactctttcggatcagattgatagtagaagggcttgttcgtatatcttgaatctaattccagacacaccag

SEQ ID NO: 99367 - DNA, 75 bp, Artificial Sequence
  Synthetic
tactggtccctacattcttataataatggaaatgttatattatttatccttccatcaaaatcacttgaagtggca

SEQ ID NO: 99368 - DNA, 75 bp, Artificial Sequence
  Synthetic
atggaaatgttatattatttatccttccatcaaaatcacttgaagtggcagggtcctttattagatttatcacag

SEQ ID NO: 99369 - DNA, 75 bp, Artificial Sequence
  Synthetic
tacctgcagtaacatcattgtactccggtttcccttcactgatagaaaaactttttgaacgtccctttaagtctt

SEQ ID NO: 99370 - DNA, 75 bp, Artificial Sequence
  Synthetic
aaataagaattgggaagaaccatattttagtcaaacaagaaatattagcttaaaaggtatgtcagggcaggttca

SEQ ID NO: 99371 - DNA, 75 bp, Artificial Sequence
  Synthetic
gatacttagaacctgtagatgatggtactgactggttcttatttgtatctcaacagattcaggcaggccatttac

SEQ ID NO: 99372 - DNA, 75 bp, Artificial Sequence
  Synthetic
ttaagatatcacccaagaagactacagtatctcctacaaatgctgaattcctgtcaacattttttgaaggttgtg

SEQ ID NO: 99373 - DNA, 75 bp, Artificial Sequence
  Synthetic
tcagcatgtaacctatgattacattattccaaagggtagggacaatctccttatttatttggtccggaagctcaa

SEQ ID NO: 99374 - DNA, 75 bp, Artificial Sequence
  Synthetic
ctgtgcaaggcttgagatcttctgggataaaaaggcatatatattagaaacttcaatcacacaaaaacatgtgtt

SEQ ID NO: 99375 - DNA, 75 bp, Artificial Sequence
  Synthetic
tactagctcatgcatttcatacaataagagatatcaggtatcaagcagtagatgccgtaagtaatgtatggtttg

SEQ ID NO: 99376 - DNA, 75 bp, Artificial Sequence
  Synthetic
tgtggattttgagaatatagatatggaggcagacattgagcactttttgcaggatgagagctcatatactggaga

SEQ ID NO: 99377 - DNA, 75 bp, Artificial Sequence
  Synthetic
ttgatagagaggcccaaagcatggttgtcaataaagggatatgccctgaagatgtcattcctgactcattatttt

SEQ ID NO: 99378 - DNA, 75 bp, Artificial Sequence
  Synthetic
tgtcaataaagggatatgccctgaagatgtcattcctgactcattattttcatttaggcacactatggtgttgtt

SEQ ID NO: 99379 - DNA, 75 bp, Artificial Sequence
  Synthetic
tagtagtagactccctaaagagctactataacaacgatggcaactatggaagaactacagagggagatcaatgcc

SEQ ID NO: 99380 - DNA, 75 bp, Artificial Sequence
  Synthetic
ttaaacaaaagagcattgacagacagagaaggggttgcagcatccatccaagccaagattgatgaattaaagagg

SEQ ID NO: 99381 - DNA, 75 bp, Artificial Sequence
  Synthetic
caactggcagataggattgcaactggaaagaaccttgggaaagaacaggatccaacaggggttgaacctggagac

SEQ ID NO: 99382 - DNA, 75 bp, Artificial Sequence
  Synthetic
catctaaaagagagatcaatgctcagctatgggaatgtattggatttgaaccacctggatattgatgagcctaca

SEQ ID NO: 99383 - DNA, 75 bp, Artificial Sequence
  Synthetic
ggacagactgcagactggctaagtattgttgtctacctaacatcctttgttgtgccaatacttctgaaagccctg

SEQ ID NO: 99384 - DNA, 75 bp, Artificial Sequence
  Synthetic
tatatgctgactacaagagggagacagacaaccaaagataataaagggaccaggattcgattcaaggatgacagc

SEQ ID NO: 99385 - DNA, 75 bp, Artificial Sequence
  Synthetic
tcttttgaggatgtcaatgggattaggaaaccaaaacatctgtatgtgtccttacccaatgcccagtcaagcatg

SEQ ID NO: 99386 - DNA, 75 bp, Artificial Sequence
  Synthetic
aaggcagaagagatcacaccaggtagatacagaacagcaatttgtggactctatcctgcacagattaaagccaga

SEQ ID NO: 99387 - DNA, 75 bp, Artificial Sequence
  Synthetic
caaatgattagcccagtcatgagtgtgatcggtttcttggcactggcaaaagattgggctgatcggattgagcaa

SEQ ID NO: 99388 - DNA, 75 bp, Artificial Sequence
  Synthetic
tggctaagtgaaccttgtaaactactcccagatacagcagcagtaagcctccatggaggccctgcaacaaacagg

SEQ ID NO: 99389 - DNA, 75 bp, Artificial Sequence
  Synthetic
gattacctacggcaacgacaggtggcattgggcaatatggagacaaaagagtcaaaggccatacgccaacatgct

SEQ ID NO: 99390 - DNA, 75 bp, Artificial Sequence
  Synthetic
gagactgcaggttgtagcatgattgaagatattgagtcaccatcgtcgatatgggtctttgctggagcaccagat

SEQ ID NO: 99391 - DNA, 75 bp, Artificial Sequence
  Synthetic
cgctgtccaccaacatgcttattcattgcagggatcgctgaacttggagcattcttttctatcctacaggacatg

SEQ ID NO: 99392 - DNA, 75 bp, Artificial Sequence
  Synthetic
agaaatacaattatggcttcaaagacagtgggaacatctgaagaaaaattgcggaaaaaatcatcgttctatcaa

SEQ ID NO: 99393 - DNA, 75 bp, Artificial Sequence
  Synthetic
tcttatctcaggcgaacacaatcaatggggattcaactggaccagaggatcattgtgcttttcatggttgcctgg

SEQ ID NO: 99394 - DNA, 75 bp, Artificial Sequence
  Synthetic
ggtaaagaggcagtggacaatttccacctaggggatgatatggatcctgagctgagaacactggcacagagcctg

SEQ ID NO: 99395 - DNA, 75 bp, Artificial Sequence
  Synthetic
attgatgttaaagtgaaggaaatatctaaccaagagcctttaaaactgtaatcagtaagtgtataaccctcatta

SEQ ID NO: 99396 - DNA, 75 bp, Artificial Sequence
  Synthetic
tgtgatcactatatactactgaattattataaatcagatttgcactattattatcaggggaatcactatatcagg

SEQ ID NO: 99397 - DNA, 75 bp, Artificial Sequence
  Synthetic
gtatgggtacatttatgggtgggaattattactcagagggtgggtcagttaatccgttgtgggagggtttaggtc

SEQ ID NO: 99398 - DNA, 75 bp, Artificial Sequence
  Synthetic
tagactgccttaagtagtctttttctgtatatatgggtgtaaatttcatttgatcattgaactaatcttgctttt

SEQ ID NO: 99399 - DNA, 75 bp, Artificial Sequence
  Synthetic
ttcctcctttcctggctttctcttctcactaacaacaacattctacctcagcaaaaaactacctcaactcaacta

SEQ ID NO: 99400 - DNA, 75 bp, Artificial Sequence
  Synthetic
gcaaaaaactacctcaactcaactacctcatttgattgctccttgattgtctttttagggagcatactactacta

SEQ ID NO: 99401 - DNA, 75 bp, Artificial Sequence
  Synthetic
atggcaactatggaggaactgcagagggaaatcaatgcccatgagggtcaactggtgatagccaggcagaaggtg

SEQ ID NO: 99402 - DNA, 75 bp, Artificial Sequence
  Synthetic
tcatggttgcctggggtaaagaggcagtggataacttccggcttggagatgacatggatcctgagttgagaacat

SEQ ID NO: 99403 - DNA, 75 bp, Artificial Sequence
  Synthetic
cctttaaaactataatcagtgaatttataacccttattatgtgatcactatatactactgaatcattatcaatca

SEQ ID NO: 99404 - DNA, 75 bp, Artificial Sequence
  Synthetic
gggtgggtttaggtccaggctgccttaagtagcctttttctgtatatatggatgtagatttcatttgatccttaa

SEQ ID NO: 99405 - DNA, 75 bp, Artificial Sequence
  Synthetic
ttttcttgctttctctgcttactaacaacaacactctacctcaacacaactacctcatttgcttgctccttgatt

SEQ ID NO: 99406 - DNA, 75 bp, Artificial Sequence
  Synthetic
tagtagtagactccctaaagagctactataacaatgatggcgactattgaggaactgcagagggaaatcaatgcc

SEQ ID NO: 99407 - DNA, 75 bp, Artificial Sequence
  Synthetic
catagtgctctttatggtcgcctggggtaaagaggctgtggataatttccacgcgtgggatggtatggatcctga

SEQ ID NO: 99408 - DNA, 75 bp, Artificial Sequence
  Synthetic
cctcaacacaaaactacctcaactacctcattagcttgctccttgattgtctttttagggagcatccttctacta

SEQ ID NO: 99409 - DNA, 75 bp, Artificial Sequence
  Synthetic
tagtagtagactccctaaagagctactatagcaacgatggcgactaatggggaactgcagagggaaatcaatgcc

SEQ ID NO: 99410 - DNA, 75 bp, Artificial Sequence
  Synthetic
ggtaaagaggctgtggatgaactccactcgggagatggtgagcatcatgcatcaaggacattggcacaaagcctg

SEQ ID NO: 99411 - DNA, 75 bp, Artificial Sequence
  Synthetic
atcagactgccccggggtaggtacaggctgtacagcatgtgggctttatcttgaccagttaaaaccagttggtag

SEQ ID NO: 99412 - DNA, 75 bp, Artificial Sequence
  Synthetic
ccacttgagggtggtggcttgatatttaaacattggtgcacatctacatgtcagttcggtgaccccggagatatc

SEQ ID NO: 99413 - DNA, 75 bp, Artificial Sequence
  Synthetic
tcattgtcctctgtgtattcttactgttttcattggtcttactcagtatcctttgccctgtcaggaagcataaaa

SEQ ID NO: 99414 - DNA, 75 bp, Artificial Sequence
  Synthetic
ctgtcaggaagcataaaaaatcatagctagctgatgctgttatcaggttattgtatatagtttaacataaaacca

SEQ ID NO: 99415 - DNA, 75 bp, Artificial Sequence
  Synthetic
cagctagcggataggattgcaactggaaaaaaccttggaaaggaacaggatcctactggggtggaacctggagac

SEQ ID NO: 99416 - DNA, 75 bp, Artificial Sequence
  Synthetic
cttgcccaatgcccaatcaagcatgaaggcagaagagatcacaccagggaggtacaggacagcaatctgcggact

SEQ ID NO: 99417 - DNA, 75 bp, Artificial Sequence
  Synthetic
ggtacaggacagcaatctgcggactctaccctgcacagattaaagccagacaaatgattagccctgttatgagtg

SEQ ID NO: 99418 - DNA, 75 bp, Artificial Sequence
  Synthetic
ttgcagggattgctgaactcggcgccttcttctccattttacaagacatgcgaaacacaattatggcctcaaaga

SEQ ID NO: 99419 - DNA, 75 bp, Artificial Sequence
  Synthetic
accttggagatgatatggatcctgagctaaggacactggcacaaagcttgattgatgtgaaagtgaaggaaatct

SEQ ID NO: 99420 - DNA, 75 bp, Artificial Sequence
  Synthetic
gtaacattaacaagaggccagaatacagtcaaagtgtcagggaagggtggttatagtggctcaacttttaaatgc

SEQ ID NO: 99421 - DNA, 75 bp, Artificial Sequence
  Synthetic
tagtagtagactccctaaagagctactataataacgatggcaactatggaggaattgcaaaaggagatcaatgcc

SEQ ID NO: 99422 - DNA, 75 bp, Artificial Sequence
  Synthetic
cacgagggtcagctggtgatagcacggcagaaggtgagagatgcagaaagacagtatgaaaaagacccagatgaa

SEQ ID NO: 99423 - DNA, 75 bp, Artificial Sequence
  Synthetic
ttgaataaaagaacattaacagatagagagggggttgcagcatccatccaggccaaaattgatgagcttaaaagg

SEQ ID NO: 99424 - DNA, 75 bp, Artificial Sequence
  Synthetic
cagctagcagatagaattgcaactggcaagaaccttggtaaagagcaagacccaacaggagtcgagccaggggac

SEQ ID NO: 99425 - DNA, 75 bp, Artificial Sequence
  Synthetic
catcttaaagaaagatcgatgctgagttatggaaatgttctggacttgaatcatctagacattgatgaacctact

SEQ ID NO: 99426 - DNA, 75 bp, Artificial Sequence
  Synthetic
ggacaaacagcagattggctcagcattgttatctacctgacatcgtttgtggtcccaattcttttaaaggctcta

SEQ ID NO: 99427 - DNA, 75 bp, Artificial Sequence
  Synthetic
tacatgctaacaacacgaggaagacagactactaaagacaacaaagggaccagaatcagatttaaggacgatagt

SEQ ID NO: 99428 - DNA, 75 bp, Artificial Sequence
  Synthetic
tcatttgaggatgtcaacgggattcgcaagcccaaacatctttatgtctcactgcctaatgcacaatccagtatg

SEQ ID NO: 99429 - DNA, 75 bp, Artificial Sequence
  Synthetic
aaagcagaggagattacacctggcagatacagaacagctgtttgtggactttatcctgcccagatcaaagcacga

SEQ ID NO: 99430 - DNA, 75 bp, Artificial Sequence
  Synthetic
cagatgatcagcccagtaatgagtgtgataggattcatggcacttgctaaagattggagtgaacggattgagcaa

SEQ ID NO: 99431 - DNA, 75 bp, Artificial Sequence
  Synthetic
tggttaagtgaaccctgtaagcttcttcctgacacatcagcagttagcctccttggtggccctgcaacaaacaag

SEQ ID NO: 99432 - DNA, 75 bp, Artificial Sequence
  Synthetic
gactaccttcggcagagacaggttgctttaggcaatatggaaaccaaagagtcaaaggcaatacgacagcaggct

SEQ ID NO: 99433 - DNA, 75 bp, Artificial Sequence
  Synthetic
gaggcttcaggctgcagcatgattgaagatattgaatcaccatcatcaatttgggtgtttgctggggcaccagat

SEQ ID NO: 99434 - DNA, 75 bp, Artificial Sequence
  Synthetic
cggtgcccaccaacatgtctctttattgcagggatggcagagcttggggcattcttttctatcctgcaggacatg

SEQ ID NO: 99435 - DNA, 75 bp, Artificial Sequence
  Synthetic
cgcaatacaatcatggcatcaaaaaccgttgggacatctgaggagaagctgagaaaaaaatcatcgttctaccaa

SEQ ID NO: 99436 - DNA, 75 bp, Artificial Sequence
  Synthetic
tcatatctcaggcggacacaatcaatggggatacaactggatcagaggattattgtcttatttatggtggcctgg

SEQ ID NO: 99437 - DNA, 75 bp, Artificial Sequence
  Synthetic
ggaaaggaagctgttgataatttccatcttggtgatgatatggatcctgaacttaggacacttgctcagagtttg

SEQ ID NO: 99438 - DNA, 75 bp, Artificial Sequence
  Synthetic
attgacgttaaagtgaaggaaatttccaaccaggagccactgaaactgtaatcaatgaatgtataacccttatta

SEQ ID NO: 99439 - DNA, 75 bp, Artificial Sequence
  Synthetic
tgtgattattatatactactgaatcattatcaatcatatttgcactattattatcagggaaaatctatatatcag

SEQ ID NO: 99440 - DNA, 75 bp, Artificial Sequence
  Synthetic
ggtatgggcacatttatgggtgggaatcattattcagagggtgggtcagttaatccgttgtgggtgggtttagtt

SEQ ID NO: 99441 - DNA, 75 bp, Artificial Sequence
  Synthetic
ttgagctaccttaagtagctgtttttctgtatatatagatgtagatttcaattgatccttagactaatcatgctt

SEQ ID NO: 99442 - DNA, 75 bp, Artificial Sequence
  Synthetic
ttttctgctttctctcttacttccttgcctactaacaacaacaccctacctcaacacaaaactacctcaatttaa

SEQ ID NO: 99443 - DNA, 75 bp, Artificial Sequence
  Synthetic
tcaacacaaaactacctcaatttaactacctcatttgctttttccttgattgtctttttagggagcatactacta

SEQ ID NO: 99444 - DNA, 75 bp, Artificial Sequence
  Synthetic
taacacactaaagaaaatagtagcttactaaccacataacttagattctacttctgtatgatgtcttaacatctt

SEQ ID NO: 99445 - DNA, 75 bp, Artificial Sequence
  Synthetic
atagtagcttactaaccacataacttagattctacttctgtatgatgtcttaacatcttgcggagtctagtacta

SEQ ID NO: 99446 - DNA, 75 bp, Artificial Sequence
  Synthetic
gtgatcactatatactactgaatcattatcaatcatatttgtactattataatcaggggaatcattatatcaggg

SEQ ID NO: 99447 - DNA, 75 bp, Artificial Sequence
  Synthetic
gtatatatggatgtagatttcatttggtcatatactaatcatgccttcttttcttttctttctgccttttctgct

SEQ ID NO: 99448 - DNA, 75 bp, Artificial Sequence
  Synthetic
agtatggcctgttttgacactgagaaatgtttatgacatgaaaattgagtgcccccacacagtaagcttcgggga

SEQ ID NO: 99449 - DNA, 75 bp, Artificial Sequence
  Synthetic
aaatagtgtgataggctatgtggaattaccccccatgccattggctgacacagcacagctggtgcctgagagttc

SEQ ID NO: 99450 - DNA, 75 bp, Artificial Sequence
  Synthetic
ttgcagcatggataatcaccaatcattaaatacaataacaaaatatacccaagtaagttggagaggaaaggctga

SEQ ID NO: 99451 - DNA, 75 bp, Artificial Sequence
  Synthetic
tcagtcacagtctagccaaaattcatttgagacagtgtctactgaagttgacttgaaaggaacatgtgttctgaa

SEQ ID NO: 99452 - DNA, 75 bp, Artificial Sequence
  Synthetic
acacaagatggtagaagaatcttaccgcagtagaaaatcaataacctgttatgacctatcatgcaatagcactta

SEQ ID NO: 99453 - DNA, 75 bp, Artificial Sequence
  Synthetic
ttgcaagccaacactatacatgattgtaccaattcatgcatgtaacatgatgaaaagctgtttgattgcattggg

SEQ ID NO: 99454 - DNA, 75 bp, Artificial Sequence
  Synthetic
gtaccaattcatgcatgtaacatgatgaaaagctgtttgattgcattgggaccatacagagtacaggtagtttat

SEQ ID NO: 99455 - DNA, 75 bp, Artificial Sequence
  Synthetic
gagagaacctattgcatgacaggagtcctaattgaaggaaaatgttttgtcccagatcagagtgtggttagtatt

SEQ ID NO: 99456 - DNA, 75 bp, Artificial Sequence
  Synthetic
cccagatcagagtgtggttagtattatcaaacatgggatctttgatatcgcaagtgttcatattgtgtgcttctt

SEQ ID NO: 99457 - DNA, 75 bp, Artificial Sequence
  Synthetic
aaaatttttgaacaggttaagaaatcctttgaatcaacatgcaatgatacagagaataaagtgcagggttattat

SEQ ID NO: 99458 - DNA, 75 bp, Artificial Sequence
  Synthetic
atctgtattgtagggggaaactctgcaccaatatatgttccaacacttgatgatttcagatccatggaagcattc

SEQ ID NO: 99459 - DNA, 75 bp, Artificial Sequence
  Synthetic
acaggaatctttagatcaccacatggagaagaccatgatctagctggagaagaaactgcaacttactctatagtt

SEQ ID NO: 99460 - DNA, 75 bp, Artificial Sequence
  Synthetic
ggacctgccaatgcaaaagttcctcacagtgctagctcagatacattgagcctgattgccttctcaggtatacca

SEQ ID NO: 99461 - DNA, 75 bp, Artificial Sequence
  Synthetic
acagtgctagctcagatacattgagcctgattgccttctcaggtataccatcttattcttcccttagcatcctga

SEQ ID NO: 99462 - DNA, 75 bp, Artificial Sequence
  Synthetic
cctgattgccttctcaggtataccatcttattcttcccttagcatcctgacaagttcaacagaagctaaacatgt

SEQ ID NO: 99463 - DNA, 75 bp, Artificial Sequence
  Synthetic
attcagccctgggttgttcccaaaacttaatcacacaaattgtgataaaggtgccataccactcatgtggactgg

SEQ ID NO: 99464 - DNA, 75 bp, Artificial Sequence
  Synthetic
gatgattgatgtacctcgatactatgatggtatccacccctttacagtattttgtgtattatcaggacctggggc

SEQ ID NO: 99465 - DNA, 75 bp, Artificial Sequence
  Synthetic
atcatgtgaggccttttctgaaggcgggattttcaacataacctcccccatgtgcttagtgtcaaagcaaaatcg

SEQ ID NO: 99466 - DNA, 75 bp, Artificial Sequence
  Synthetic
tgtgcttagtgtcaaagcaaaatcgattccggttaacagaacagcaggtgaattttgtatgtcagcgagtggatg

SEQ ID NO: 99467 - DNA, 75 bp, Artificial Sequence
  Synthetic
tggacatcgttgtgtactgcaacgggcagagaaaagtaatattgacaaaaactttagttattggacaatgtatat

SEQ ID NO: 99468 - DNA, 75 bp, Artificial Sequence
  Synthetic
actttagttattggacaatgtatatacactataacaagcttattttcattactgcctggagtagcacactctatt

SEQ ID NO: 99469 - DNA, 75 bp, Artificial Sequence
  Synthetic
gctgtagaattgtgtgtacctggattccatggttgggccacagctgctctgcttgttacattctgttttggatgg

SEQ ID NO: 99470 - DNA, 75 bp, Artificial Sequence
  Synthetic
tccatggttgggccacagctgctctgcttgttacattctgttttggatgggttcttataccagcagtaacattta

SEQ ID NO: 99471 - DNA, 75 bp, Artificial Sequence
  Synthetic
tcatactggcaatcctaaagttcattgctaatattttccacacaagtaaccaagagaacaggctaaaatcagtac

SEQ ID NO: 99472 - DNA, 75 bp, Artificial Sequence
  Synthetic
cctataaagagttaaaggcacacggggtgtcatgcccccagtctcaatgcccttattgctttactcattgtgaac

SEQ ID NO: 99473 - DNA, 75 bp, Artificial Sequence
  Synthetic
ccacagaagcagcattccaagcccattacaaagtatgccaagttactcacaggttcagggatgatctaaagaaaa

SEQ ID NO: 99474 - DNA, 75 bp, Artificial Sequence
  Synthetic
ctgtcactcctcagaacttcacaccaggatgttaccgtacactgaatttatttagatacaaaagtaggtgctaca

SEQ ID NO: 99475 - DNA, 75 bp, Artificial Sequence
  Synthetic
tctttacaatgtggatatttcttcttgtcctagaatctatactatgggctgcaagtgcatcagagacaccattga

SEQ ID NO: 99476 - DNA, 75 bp, Artificial Sequence
  Synthetic
tgtcctagaatctatactatgggctgcaagtgcatcagagacaccattgactcctgtctggaatgacaatgccca

SEQ ID NO: 99477 - DNA, 75 bp, Artificial Sequence
  Synthetic
tggagtaggttctattcctatgcacacagatttagaacttgatttctctttaacatctagttccaagtatacata

SEQ ID NO: 99478 - DNA, 75 bp, Artificial Sequence
  Synthetic
ccgcaggaagctaacaaacccacttgaagcacaatccattgatctacatattgaaatagaagaacaaacaattgg

SEQ ID NO: 99479 - DNA, 75 bp, Artificial Sequence
  Synthetic
gaagcacaatccattgatctacatattgaaatagaagaacaaacaattggtgtggatgtacatgctttaggacac

SEQ ID NO: 99480 - DNA, 75 bp, Artificial Sequence
  Synthetic
catactgcaaagtgccactatgaaagggattaccaatatgagacaagctggggttgtaatccatcagattgtccc

SEQ ID NO: 99481 - DNA, 75 bp, Artificial Sequence
  Synthetic
gggattaccaatatgagacaagctggggttgtaatccatcagattgtcccgggtgtggcacaggctgtacagcat

SEQ ID NO: 99482 - DNA, 75 bp, Artificial Sequence
  Synthetic
accagttggcagtgcttataaaatcatcacaataaggtatagcaggagagtctgtgttcaattcggggaggaaaa

SEQ ID NO: 99483 - DNA, 75 bp, Artificial Sequence
  Synthetic
cctttgtaagataatagacatgaatgattgttttgtatctaggcatgttaaggtctgtataattggtacagtatc

SEQ ID NO: 99484 - DNA, 75 bp, Artificial Sequence
  Synthetic
taaattctctcagggtgatacattattgtttttcggaccacttgaaggtggtggtctaatatttaaacactggcg

SEQ ID NO: 99485 - DNA, 75 bp, Artificial Sequence
  Synthetic
ttgtttttcggaccacttgaaggtggtggtctaatatttaaacactggcgcacatccacatgtcaatttggtgac

SEQ ID NO: 99486 - DNA, 75 bp, Artificial Sequence
  Synthetic
ccaggagacatcatgagcccaagagacaaaggttttttatgccctgagttcccaggtagtttcaggaagaaatgc

SEQ ID NO: 99487 - DNA, 75 bp, Artificial Sequence
  Synthetic
aactttgctactactcctatttgtgagtatgacggaaatatggtctcaggttacaagaaagtaatggcaacaatt

SEQ ID NO: 99488 - DNA, 75 bp, Artificial Sequence
  Synthetic
gattcctttcaatcttttaatacaagcactatgcactttactgatgaaaggatagagtggaaagaccctgatgga

SEQ ID NO: 99489 - DNA, 75 bp, Artificial Sequence
  Synthetic
gatagagtggaaagaccctgatggaatgctgagggatcatataaacatcttagtaacaaaagacatcgactttga

SEQ ID NO: 99490 - DNA, 75 bp, Artificial Sequence
  Synthetic
tcaaggtatcaggaaaaggtggccatagtggttcaacatttaagtgttgccatggggaggactgttcgccaaatg

SEQ ID NO: 99491 - DNA, 75 bp, Artificial Sequence
  Synthetic
gactccatgctgctgcacctcacctagacaaggtcaatgggatttctgagatagaaaatagcaaagaatatgatg

SEQ ID NO: 99492 - DNA, 75 bp, Artificial Sequence
  Synthetic
ttctgtgactatcctgttcttatgtatagctttaacatatatactaatttttatattccagtatactctatctaa

SEQ ID NO: 99493 - DNA, 75 bp, Artificial Sequence
  Synthetic
acagtatgaaaaggatccagatgagttgaacaagagaacattaactgaccgagagggtgttgcagtatctatcca

SEQ ID NO: 99494 - DNA, 75 bp, Artificial Sequence
  Synthetic
ggcaaagattgatgagttaaaaaggcaactggcagataggattgcaactgggaagaactttggaaaagaacaaga

SEQ ID NO: 99495 - DNA, 75 bp, Artificial Sequence
  Synthetic
tccaacaggggtagagcctggagaccatctgaaagagagatcaatgctcagttatggtaatgtgttggatttaaa

SEQ ID NO: 99496 - DNA, 75 bp, Artificial Sequence
  Synthetic
ccatttggatattgatgaacccacaggacagacagcagactggctaagcattgttgtctatctgacatcctttgt

SEQ ID NO: 99497 - DNA, 75 bp, Artificial Sequence
  Synthetic
ggacagacagcagactggctaagcattgttgtctatctgacatcctttgttgtcccgatacttctgaaagctcta

SEQ ID NO: 99498 - DNA, 75 bp, Artificial Sequence
  Synthetic
tcgttcgaggatgttaatggtatccgaaaaccaaaacatctgtatgtgtccttgccaaatgcacagtcaagtatg

SEQ ID NO: 99499 - DNA, 75 bp, Artificial Sequence
  Synthetic
aaggcagaagagattacacctggtagatatagaacagcagtctgtggactctaccctgcacagatcaaggcacgg

SEQ ID NO: 99500 - DNA, 75 bp, Artificial Sequence
  Synthetic
cagatgatcagcccagtcatgagtgtaattggttttttggcattggcaaaagattggagtgatcgtattgaacaa

SEQ ID NO: 99501 - DNA, 75 bp, Artificial Sequence
  Synthetic
taattggttttttggcattggcaaaagattggagtgatcgtattgaacaatggttaagcgaaccttgcaagctcc

SEQ ID NO: 99502 - DNA, 75 bp, Artificial Sequence
  Synthetic
aagacattgagtcaccatcatcaatatgggtatttgctggggcaccagaccgctgtccgccaacatgtttgttta

SEQ ID NO: 99503 - DNA, 75 bp, Artificial Sequence
  Synthetic
atgggtatttgctggggcaccagaccgctgtccgccaacatgtttgtttatagcaggtattgctgagcttggagc

SEQ ID NO: 99504 - DNA, 75 bp, Artificial Sequence
  Synthetic
gcgaaagaaatcatcattctatcagtcttacctcaggaggacacaattaatggggatacaactggatcaaaggat

SEQ ID NO: 99505 - DNA, 75 bp, Artificial Sequence
  Synthetic
tattgtgctctttatggttgcttgggggaaggaagctgtggacaacttccacttaggagatgacatggatcctga

SEQ ID NO: 99506 - DNA, 75 bp, Artificial Sequence
  Synthetic
gctaagaacactggcacagagcttgattgatgtcaaagtgaaggaaatttccaaccaagagcctttaaaactcta

SEQ ID NO: 99507 - DNA, 75 bp, Artificial Sequence
  Synthetic
attgatgtcaaagtgaaggaaatttccaaccaagagcctttaaaactctaattagtgaatgtattaatcctttta

SEQ ID NO: 99508 - DNA, 75 bp, Artificial Sequence
  Synthetic
ttatcaggggaatcagtatatcagggcaagggaacatttatgggtgggaatcattactcaagggtgggtcagtta

SEQ ID NO: 99509 - DNA, 75 bp, Artificial Sequence
  Synthetic
gatccttaattaatcttgctttctttccttttctttctgctttctctgcttactaacaacaacattctacctcaa

SEQ ID NO: 99510 - DNA, 75 bp, Artificial Sequence
  Synthetic
tcaacacaaaactacatcaacttaactacctcatttaattgctccttgattgtctttttagggagcatactacta

SEQ ID NO: 99511 - DNA, 75 bp, Artificial Sequence
  Synthetic
tagtagtagactccctaaagagctactatactaatgatgccgactagtggggaactgcagagggaaatcaatgcc

SEQ ID NO: 99512 - DNA, 75 bp, Artificial Sequence
  Synthetic
ggcagaaggtgagggatgcagaaaaacaatatgagaaggatccagatgaactgaacaaaagagcattaacagata

SEQ ID NO: 99513 - DNA, 75 bp, Artificial Sequence
  Synthetic
ggtaaagaggctgtggataatccccacgcaggagatgatgtagatccatcgctaggaatgctggcacaaagcctg

SEQ ID NO: 99514 - DNA, 75 bp, Artificial Sequence
  Synthetic
cctcaacacaaaactacctcaactacctcattagcttgctccctgattgtctttttagggagcaacctactacta

SEQ ID NO: 99515 - DNA, 75 bp, Artificial Sequence
  Synthetic
ggaagtggctagtgatggccagtttagtatggccagcttacacactgagaaatgcgtatgacatgaagattgaat

SEQ ID NO: 99516 - DNA, 75 bp, Artificial Sequence
  Synthetic
cctggggtaggtacgggctgtacagcatgcggattgtaccttgaccaattaagggctgttggtagtgcatacaaa

SEQ ID NO: 99517 - DNA, 75 bp, Artificial Sequence
  Synthetic
tgtatagctttaacatatatactaatttttatattccagtatactctatctaacacactaaaaaaaaaatagcag

SEQ ID NO: 99518 - DNA, 75 bp, Artificial Sequence
  Synthetic
accggacactaaatttatttagatacaaaagcaggtgctacatctttacaatgtggatatttcttcttgtcttag

SEQ ID NO: 99519 - DNA, 75 bp, Artificial Sequence
  Synthetic
tcaatactatgggctgcaagtgcatcagagacaccattaactcctgtctggaatgacaatgcccatggggtaggt

SEQ ID NO: 99520 - DNA, 75 bp, Artificial Sequence
  Synthetic
tcaatactttgggctgcaagtgcatcagagacaccattaactcctgtctggaatgacaatgcccatggggtaggt

SEQ ID NO: 99521 - DNA, 75 bp, Artificial Sequence
  Synthetic
tcaatactctgggctgcaagtgcatcagagacaccattaactcctgtctggaatgacaatgcccatggggtaggt

SEQ ID NO: 99522 - DNA, 75 bp, Artificial Sequence
  Synthetic
tcaatactgtgggctgcaagtgcatcagagacaccattaactcctgtctggaatgacaatgcccatggggtaggt

SEQ ID NO: 99523 - DNA, 75 bp, Artificial Sequence
  Synthetic
tcaattctatgggctgcaagtgcatcagagacaccattaactcctgtctggaatgacaatgcccatggggtaggt

SEQ ID NO: 99524 - DNA, 75 bp, Artificial Sequence
  Synthetic
tcaattctttgggctgcaagtgcatcagagacaccattaactcctgtctggaatgacaatgcccatggggtaggt

SEQ ID NO: 99525 - DNA, 75 bp, Artificial Sequence
  Synthetic
tcaattctctgggctgcaagtgcatcagagacaccattaactcctgtctggaatgacaatgcccatggggtaggt

SEQ ID NO: 99526 - DNA, 75 bp, Artificial Sequence
  Synthetic
tcaattctgtgggctgcaagtgcatcagagacaccattaactcctgtctggaatgacaatgcccatggggtaggt

SEQ ID NO: 99527 - DNA, 75 bp, Artificial Sequence
  Synthetic
tcaatcctatgggctgcaagtgcatcagagacaccattaactcctgtctggaatgacaatgcccatggggtaggt

SEQ ID NO: 99528 - DNA, 75 bp, Artificial Sequence
  Synthetic
tcaatcctttgggctgcaagtgcatcagagacaccattaactcctgtctggaatgacaatgcccatggggtaggt

SEQ ID NO: 99529 - DNA, 75 bp, Artificial Sequence
  Synthetic
tcaatcctctgggctgcaagtgcatcagagacaccattaactcctgtctggaatgacaatgcccatggggtaggt

SEQ ID NO: 99530 - DNA, 75 bp, Artificial Sequence
  Synthetic
tcaatcctgtgggctgcaagtgcatcagagacaccattaactcctgtctggaatgacaatgcccatggggtaggt

SEQ ID NO: 99531 - DNA, 75 bp, Artificial Sequence
  Synthetic
tcaatgctatgggctgcaagtgcatcagagacaccattaactcctgtctggaatgacaatgcccatggggtaggt

SEQ ID NO: 99532 - DNA, 75 bp, Artificial Sequence
  Synthetic
tcaatgctttgggctgcaagtgcatcagagacaccattaactcctgtctggaatgacaatgcccatggggtaggt

SEQ ID NO: 99533 - DNA, 75 bp, Artificial Sequence
  Synthetic
tcaatgctctgggctgcaagtgcatcagagacaccattaactcctgtctggaatgacaatgcccatggggtaggt

SEQ ID NO: 99534 - DNA, 75 bp, Artificial Sequence
  Synthetic
tcaatgctgtgggctgcaagtgcatcagagacaccattaactcctgtctggaatgacaatgcccatggggtaggt

SEQ ID NO: 99535 - DNA, 75 bp, Artificial Sequence
  Synthetic
tctatactatgggctgcaagtgcatcagagacaccattaactcctgtctggaatgacaatgcccatggggtaggt

SEQ ID NO: 99536 - DNA, 75 bp, Artificial Sequence
  Synthetic
tctatactttgggctgcaagtgcatcagagacaccattaactcctgtctggaatgacaatgcccatggggtaggt

SEQ ID NO: 99537 - DNA, 75 bp, Artificial Sequence
  Synthetic
tctatactctgggctgcaagtgcatcagagacaccattaactcctgtctggaatgacaatgcccatggggtaggt

SEQ ID NO: 99538 - DNA, 75 bp, Artificial Sequence
  Synthetic
tctatactgtgggctgcaagtgcatcagagacaccattaactcctgtctggaatgacaatgcccatggggtaggt

SEQ ID NO: 99539 - DNA, 75 bp, Artificial Sequence
  Synthetic
tctattctatgggctgcaagtgcatcagagacaccattaactcctgtctggaatgacaatgcccatggggtaggt

SEQ ID NO: 99540 - DNA, 75 bp, Artificial Sequence
  Synthetic
tctattctttgggctgcaagtgcatcagagacaccattaactcctgtctggaatgacaatgcccatggggtaggt

SEQ ID NO: 99541 - DNA, 75 bp, Artificial Sequence
  Synthetic
tctattctctgggctgcaagtgcatcagagacaccattaactcctgtctggaatgacaatgcccatggggtaggt

SEQ ID NO: 99542 - DNA, 75 bp, Artificial Sequence
  Synthetic
tctattctgtgggctgcaagtgcatcagagacaccattaactcctgtctggaatgacaatgcccatggggtaggt

SEQ ID NO: 99543 - DNA, 75 bp, Artificial Sequence
  Synthetic
tctatcctatgggctgcaagtgcatcagagacaccattaactcctgtctggaatgacaatgcccatggggtaggt

SEQ ID NO: 99544 - DNA, 75 bp, Artificial Sequence
  Synthetic
tctatcctttgggctgcaagtgcatcagagacaccattaactcctgtctggaatgacaatgcccatggggtaggt

SEQ ID NO: 99545 - DNA, 75 bp, Artificial Sequence
  Synthetic
tctatcctctgggctgcaagtgcatcagagacaccattaactcctgtctggaatgacaatgcccatggggtaggt

SEQ ID NO: 99546 - DNA, 75 bp, Artificial Sequence
  Synthetic
tctatcctgtgggctgcaagtgcatcagagacaccattaactcctgtctggaatgacaatgcccatggggtaggt

SEQ ID NO: 99547 - DNA, 75 bp, Artificial Sequence
  Synthetic
tctatgctatgggctgcaagtgcatcagagacaccattaactcctgtctggaatgacaatgcccatggggtaggt

SEQ ID NO: 99548 - DNA, 75 bp, Artificial Sequence
  Synthetic
tctatgctttgggctgcaagtgcatcagagacaccattaactcctgtctggaatgacaatgcccatggggtaggt

SEQ ID NO: 99549 - DNA, 75 bp, Artificial Sequence
  Synthetic
tctatgctctgggctgcaagtgcatcagagacaccattaactcctgtctggaatgacaatgcccatggggtaggt

SEQ ID NO: 99550 - DNA, 75 bp, Artificial Sequence
  Synthetic
tctatgctgtgggctgcaagtgcatcagagacaccattaactcctgtctggaatgacaatgcccatggggtaggt

SEQ ID NO: 99551 - DNA, 75 bp, Artificial Sequence
  Synthetic
tccatactatgggctgcaagtgcatcagagacaccattaactcctgtctggaatgacaatgcccatggggtaggt

SEQ ID NO: 99552 - DNA, 75 bp, Artificial Sequence
  Synthetic
tccatactttgggctgcaagtgcatcagagacaccattaactcctgtctggaatgacaatgcccatggggtaggt

SEQ ID NO: 99553 - DNA, 75 bp, Artificial Sequence
  Synthetic
tccatactctgggctgcaagtgcatcagagacaccattaactcctgtctggaatgacaatgcccatggggtaggt

SEQ ID NO: 99554 - DNA, 75 bp, Artificial Sequence
  Synthetic
tccatactgtgggctgcaagtgcatcagagacaccattaactcctgtctggaatgacaatgcccatggggtaggt

SEQ ID NO: 99555 - DNA, 75 bp, Artificial Sequence
  Synthetic
tccattctatgggctgcaagtgcatcagagacaccattaactcctgtctggaatgacaatgcccatggggtaggt

SEQ ID NO: 99556 - DNA, 75 bp, Artificial Sequence
  Synthetic
tccattctttgggctgcaagtgcatcagagacaccattaactcctgtctggaatgacaatgcccatggggtaggt

SEQ ID NO: 99557 - DNA, 75 bp, Artificial Sequence
  Synthetic
tccattctctgggctgcaagtgcatcagagacaccattaactcctgtctggaatgacaatgcccatggggtaggt

SEQ ID NO: 99558 - DNA, 75 bp, Artificial Sequence
  Synthetic
tccattctgtgggctgcaagtgcatcagagacaccattaactcctgtctggaatgacaatgcccatggggtaggt

SEQ ID NO: 99559 - DNA, 75 bp, Artificial Sequence
  Synthetic
tccatcctatgggctgcaagtgcatcagagacaccattaactcctgtctggaatgacaatgcccatggggtaggt

SEQ ID NO: 99560 - DNA, 75 bp, Artificial Sequence
  Synthetic
tccatcctttgggctgcaagtgcatcagagacaccattaactcctgtctggaatgacaatgcccatggggtaggt

SEQ ID NO: 99561 - DNA, 75 bp, Artificial Sequence
  Synthetic
tccatcctctgggctgcaagtgcatcagagacaccattaactcctgtctggaatgacaatgcccatggggtaggt

SEQ ID NO: 99562 - DNA, 75 bp, Artificial Sequence
  Synthetic
tccatcctgtgggctgcaagtgcatcagagacaccattaactcctgtctggaatgacaatgcccatggggtaggt

SEQ ID NO: 99563 - DNA, 75 bp, Artificial Sequence
  Synthetic
tccatgctatgggctgcaagtgcatcagagacaccattaactcctgtctggaatgacaatgcccatggggtaggt

SEQ ID NO: 99564 - DNA, 75 bp, Artificial Sequence
  Synthetic
tccatgctttgggctgcaagtgcatcagagacaccattaactcctgtctggaatgacaatgcccatggggtaggt

SEQ ID NO: 99565 - DNA, 75 bp, Artificial Sequence
  Synthetic
tccatgctctgggctgcaagtgcatcagagacaccattaactcctgtctggaatgacaatgcccatggggtaggt

SEQ ID NO: 99566 - DNA, 75 bp, Artificial Sequence
  Synthetic
tccatgctgtgggctgcaagtgcatcagagacaccattaactcctgtctggaatgacaatgcccatggggtaggt

SEQ ID NO: 99567 - DNA, 75 bp, Artificial Sequence
  Synthetic
tcgatactatgggctgcaagtgcatcagagacaccattaactcctgtctggaatgacaatgcccatggggtaggt

SEQ ID NO: 99568 - DNA, 75 bp, Artificial Sequence
  Synthetic
tcgatactttgggctgcaagtgcatcagagacaccattaactcctgtctggaatgacaatgcccatggggtaggt

SEQ ID NO: 99569 - DNA, 75 bp, Artificial Sequence
  Synthetic
tcgatactctgggctgcaagtgcatcagagacaccattaactcctgtctggaatgacaatgcccatggggtaggt

SEQ ID NO: 99570 - DNA, 75 bp, Artificial Sequence
  Synthetic
tcgatactgtgggctgcaagtgcatcagagacaccattaactcctgtctggaatgacaatgcccatggggtaggt

SEQ ID NO: 99571 - DNA, 75 bp, Artificial Sequence
  Synthetic
tcgattctatgggctgcaagtgcatcagagacaccattaactcctgtctggaatgacaatgcccatggggtaggt

SEQ ID NO: 99572 - DNA, 75 bp, Artificial Sequence
  Synthetic
tcgattctttgggctgcaagtgcatcagagacaccattaactcctgtctggaatgacaatgcccatggggtaggt

SEQ ID NO: 99573 - DNA, 75 bp, Artificial Sequence
  Synthetic
tcgattctctgggctgcaagtgcatcagagacaccattaactcctgtctggaatgacaatgcccatggggtaggt

SEQ ID NO: 99574 - DNA, 75 bp, Artificial Sequence
  Synthetic
tcgattctgtgggctgcaagtgcatcagagacaccattaactcctgtctggaatgacaatgcccatggggtaggt

SEQ ID NO: 99575 - DNA, 75 bp, Artificial Sequence
  Synthetic
tcgatcctatgggctgcaagtgcatcagagacaccattaactcctgtctggaatgacaatgcccatggggtaggt

SEQ ID NO: 99576 - DNA, 75 bp, Artificial Sequence
  Synthetic
tcgatcctttgggctgcaagtgcatcagagacaccattaactcctgtctggaatgacaatgcccatggggtaggt

SEQ ID NO: 99577 - DNA, 75 bp, Artificial Sequence
  Synthetic
tcgatcctctgggctgcaagtgcatcagagacaccattaactcctgtctggaatgacaatgcccatggggtaggt

SEQ ID NO: 99578 - DNA, 75 bp, Artificial Sequence
  Synthetic
tcgatcctgtgggctgcaagtgcatcagagacaccattaactcctgtctggaatgacaatgcccatggggtaggt

SEQ ID NO: 99579 - DNA, 75 bp, Artificial Sequence
  Synthetic
tcgatgctatgggctgcaagtgcatcagagacaccattaactcctgtctggaatgacaatgcccatggggtaggt

SEQ ID NO: 99580 - DNA, 75 bp, Artificial Sequence
  Synthetic
tcgatgctttgggctgcaagtgcatcagagacaccattaactcctgtctggaatgacaatgcccatggggtaggt

SEQ ID NO: 99581 - DNA, 75 bp, Artificial Sequence
  Synthetic
tcgatgctctgggctgcaagtgcatcagagacaccattaactcctgtctggaatgacaatgcccatggggtaggt

SEQ ID NO: 99582 - DNA, 75 bp, Artificial Sequence
  Synthetic
tcgatgctgtgggctgcaagtgcatcagagacaccattaactcctgtctggaatgacaatgcccatggggtaggt

SEQ ID NO: 99583 - DNA, 75 bp, Artificial Sequence
  Synthetic
tcagagacaccattaactcctgtctggaatgacaatgcccatggggtaggttctgttcctatgcatacagatata

SEQ ID NO: 99584 - DNA, 75 bp, Artificial Sequence
  Synthetic
tcagagacaccattaactcctgtctggaatgacaatgcccatggggtaggttctgttcctatgcatacagattta

SEQ ID NO: 99585 - DNA, 75 bp, Artificial Sequence
  Synthetic
tcagagacaccattaactcctgtctggaatgacaatgcccatggggtaggttctgttcctatgcatacagatcta

SEQ ID NO: 99586 - DNA, 75 bp, Artificial Sequence
  Synthetic
tcagagacaccattaactcctgtctggaatgacaatgcccatggggtaggttctgttcctatgcatacagatgta

SEQ ID NO: 99587 - DNA, 75 bp, Artificial Sequence
  Synthetic
cttgatttctctttaacatccagttccaagtatacataccgtaggaagttaacaaacccacttgaggaagcacaa

SEQ ID NO: 99588 - DNA, 75 bp, Artificial Sequence
  Synthetic
acacaagatggttgaagaatcataccgcagtcggaagtcaataacttgttatgatctgtcttgtaatagtaccta

SEQ ID NO: 99589 - DNA, 75 bp, Artificial Sequence
  Synthetic
tcctgaccagagtgttgtcagtatcatcaagcatgggatctttgatattgcaagtgttcacactgtttgtttctt

SEQ ID NO: 99590 - DNA, 75 bp, Artificial Sequence
  Synthetic
cgttgcggttaaaggaagcacatataaactctttgaacaggctaaaaaatcatttcaatctaactgtaatgatac

SEQ ID NO: 99591 - DNA, 75 bp, Artificial Sequence
  Synthetic
tgagaacaaggtgcagggatattacatctgcattgttgggggaagttcggcacccatatatgtaccaacactgga

SEQ ID NO: 99592 - DNA, 75 bp, Artificial Sequence
  Synthetic
cacccatatatgtaccaacactggatgattttaggtcgatggaagcattctcagggctttttaaatcaccacatg

SEQ ID NO: 99593 - DNA, 75 bp, Artificial Sequence
  Synthetic
tcttattcttctcttagcatcctcacaagctcaacagaagcaaagcatgtattcagccctgggttatttcctcag

SEQ ID NO: 99594 - DNA, 75 bp, Artificial Sequence
  Synthetic
tgtgtctagtgtcaaagcagaatcgctttagattaactgaacagcaggtgaacttcgtatgccagagagttgatg

SEQ ID NO: 99595 - DNA, 75 bp, Artificial Sequence
  Synthetic
cccatgggtgggctacagctgcactacttgttacattctgttttggttgggttcttatcccagcaattacattca

SEQ ID NO: 99596 - DNA, 75 bp, Artificial Sequence
  Synthetic
acttgttacattctgttttggttgggttcttatcccagcaattacattcattatcctgacaatattaaaattcat

SEQ ID NO: 99597 - DNA, 75 bp, Artificial Sequence
  Synthetic
ccatattgtttcacccactgtgagcctacagaagctgcatttcaggcccattacaaagtctgtcaagttactcat

SEQ ID NO: 99598 - DNA, 75 bp, Artificial Sequence
  Synthetic
tttagatataaaagtaggtgttatatttttacaatgtgggtctttctcttagtcttagagtcaatcctttgggct

SEQ ID NO: 99599 - DNA, 75 bp, Artificial Sequence
  Synthetic
gccagtgcatcagaaacacctttaaatcctgtttggaatgataatgcccacggggtaggttctgtgccgatgcat

SEQ ID NO: 99600 - DNA, 75 bp, Artificial Sequence
  Synthetic
acagatttggaactagatttctcactgacatcaagctctaagtacacctaccgaaggaagttaacaaatccactt

SEQ ID NO: 99601 - DNA, 75 bp, Artificial Sequence
  Synthetic
gaagagtctcaagcaattgatctccatattgaaatagaagaccagacaattggtgtagatgtacatgccttaggc

SEQ ID NO: 99602 - DNA, 75 bp, Artificial Sequence
  Synthetic
ctggggttgtagcccatcagattgtcctggtgtaggtacaggttgtactgcatgtgggttgtatcttgatcaatt

SEQ ID NO: 99603 - DNA, 75 bp, Artificial Sequence
  Synthetic
catgtgggttgtatcttgatcaattaaaacctgttggtagtgcctacaaaattattacaataagatatagcagaa

SEQ ID NO: 99604 - DNA, 75 bp, Artificial Sequence
  Synthetic
ttaaagtttgtataattggcacagtttcaaaattctctcaaggtgatacactcttattctttggaccacttgaag

SEQ ID NO: 99605 - DNA, 75 bp, Artificial Sequence
  Synthetic
gaggatagaatggaaagatcgtgatgggatgttgagagaccatataaacatcttggtaacaaaagatattgattt

SEQ ID NO: 99606 - DNA, 75 bp, Artificial Sequence
  Synthetic
tgataaccttggtgagaatccatgtaaaattggattgcaaacatcatccattgaaggggcatggggctctggtgt

SEQ ID NO: 99607 - DNA, 75 bp, Artificial Sequence
  Synthetic
ttgaaggggcatggggctctggtgtaggatttacacttacatgtttgatatcattgacggagtgccctactttct

SEQ ID NO: 99608 - DNA, 75 bp, Artificial Sequence
  Synthetic
atgatggggcaccacaatgtggaataaagtgctggtctgtgaaatcaggagaatggatttctgggattttcagtg

SEQ ID NO: 99609 - DNA, 75 bp, Artificial Sequence
  Synthetic
ttagaaaacataagaagtcatgattcatcaggtatttaaacatactgttatggctaactttaacatatatattaa

SEQ ID NO: 99610 - DNA, 75 bp, Artificial Sequence
  Synthetic
tggctaactttaacatatatattaagttttatatctcgttatattttatctaacacactaaaaaaaaatagtagc

SEQ ID NO: 99611 - DNA, 75 bp, Artificial Sequence
  Synthetic
tagtagtaggctccctaaaaagctactgtaacaacgatggcaactatggaggaactgcagaaggaaatcaatgcc

SEQ ID NO: 99612 - DNA, 75 bp, Artificial Sequence
  Synthetic
ggcagaaggtgagggatgcagagaaacagtatgagaaggacccagatgagctgaataagagagcgttaacagaca

SEQ ID NO: 99613 - DNA, 75 bp, Artificial Sequence
  Synthetic
caactagcagataggattgcaactggaaaaaaccttggaaaggaacaggatcccaccggggttgaacctggagac

SEQ ID NO: 99614 - DNA, 75 bp, Artificial Sequence
  Synthetic
ggacagactgcagattggcttagcattgtcatatatctgacatcctttgttgtcccgatacttctgaaggcccta

SEQ ID NO: 99615 - DNA, 75 bp, Artificial Sequence
  Synthetic
tgtcccgatacttctgaaggccctatatatgctgacaacaagagggaggcaaacaactaaggataataaagggac

SEQ ID NO: 99616 - DNA, 75 bp, Artificial Sequence
  Synthetic
ggaagccaaagcatttatatgtgtccttgcccaatgcccagtcaagcatgaaggcagaagaaatcacaccaggga

SEQ ID NO: 99617 - DNA, 75 bp, Artificial Sequence
  Synthetic
tgattggatttttagcacttgcaaaggactggagtgatcgtattgagcaatggttaagtgaaccctgtaagctgc

SEQ ID NO: 99618 - DNA, 75 bp, Artificial Sequence
  Synthetic
ggactggagtgatcgtattgagcaatggttaagtgaaccctgtaagctgctcccggacacagcagcagtgagcct

SEQ ID NO: 99619 - DNA, 75 bp, Artificial Sequence
  Synthetic
tcttatctcaggcgaacacagtcgatgggaatacagctggaccagaggatcatagtgctctttatggttgcctgg

SEQ ID NO: 99620 - DNA, 75 bp, Artificial Sequence
  Synthetic
atcagtggatgtataacccttattatgtgatcattatatactactgaattattatcaattatatttgcactatta

SEQ ID NO: 99621 - DNA, 75 bp, Artificial Sequence
  Synthetic
aacacaaaactacctcaacttaactacctcatttgcttgctccttgattgtctgtttagggagcctactactact

SEQ ID NO: 99622 - DNA, 75 bp, Artificial Sequence
  Synthetic
acacaaaactacctcaacttaactacctcatttgcttgctccttgattgtctgtttagggagcctactactacta

SEQ ID NO: 99623 - DNA, 75 bp, Artificial Sequence
  Synthetic
tagtagtagactccctaaagagctactataccaacgatggcgactagtggggaactgcagagggaaatcaatgcc

SEQ ID NO: 99624 - DNA, 75 bp, Artificial Sequence
  Synthetic
ggtaaagaggctgtggataatcgccacttgatgaatatcgtggatcctgagccaagggcgctggcacaaagcctg

SEQ ID NO: 99625 - DNA, 75 bp, Artificial Sequence
  Synthetic
gctttctctgctcactaacaacaacattctacctcaacacaaaactacctcactttaactacctcatttgctttt

SEQ ID NO: 99626 - DNA, 75 bp, Artificial Sequence
  Synthetic
cgcagtagaaaatcaataacctgttatgacctatcatgcaatagtacttattgcaagcctacactatacatgatt

SEQ ID NO: 99627 - DNA, 75 bp, Artificial Sequence
  Synthetic
cccagatcagagtgtggttagtattatcaagcatgggatttttgatatcgcaagtgttcatattgtgtgcttctt

SEQ ID NO: 99628 - DNA, 75 bp, Artificial Sequence
  Synthetic
cctgattgccttctcaggtataccatctgattcttcccttagcatcctgacaagttcaacagaagccaaacatgt

SEQ ID NO: 99629 - DNA, 75 bp, Artificial Sequence
  Synthetic
gatgattgatttacctggatactatgaggctatccacccctgtacagtattttgtgtattatcaggtcctggggc

SEQ ID NO: 99630 - DNA, 75 bp, Artificial Sequence
  Synthetic
tgtgcttagtgtcaaagcaaaatcgattccggttaacagaacagcaagtgaattttgtatgtcagcgagtggacg

SEQ ID NO: 99631 - DNA, 75 bp, Artificial Sequence
  Synthetic
gctgttgaactgtgtgtacctggattccatggttgggccacagctgctctgcttgttacattctgttttggatgg

SEQ ID NO: 99632 - DNA, 75 bp, Artificial Sequence
  Synthetic
tccatggttgggccacagctgctctgcttgttacattctgttttggatgggttcttataccagcaatcacattta

SEQ ID NO: 99633 - DNA, 75 bp, Artificial Sequence
  Synthetic
tctttacaatgtggatatttcttctagtcttagaatctatactgtgggctgcaagtgcatcagagacaccattga

SEQ ID NO: 99634 - DNA, 75 bp, Artificial Sequence
  Synthetic
agtcttagaatctatactgtgggctgcaagtgcatcagagacaccattgactcctgtttggaatgacaatgccca

SEQ ID NO: 99635 - DNA, 75 bp, Artificial Sequence
  Synthetic
ccgtaggaagctaacaaacccacttgaagaagcacaatccattgatctacatattgaaatagaagaacaaacaat

SEQ ID NO: 99636 - DNA, 75 bp, Artificial Sequence
  Synthetic
aaagggattaccaatatgagacaagctggggttgtaatccatcagattgtcctggggtgggcacaggctgtacag

SEQ ID NO: 99637 - DNA, 75 bp, Artificial Sequence
  Synthetic
catgtggtttatatctagaccgactaaaaccagttggcagtgcttataaaatcatcacaataaggtatagcagga

SEQ ID NO: 99638 - DNA, 75 bp, Artificial Sequence
  Synthetic
gtggtggtctaatatttaaacactggtgcacatccacatgtcaatttggcgacccaggagacatcatgagcccaa

SEQ ID NO: 99639 - DNA, 75 bp, Artificial Sequence
  Synthetic
aaaattggcctacaaacatcttccattgagggggcctggggttctggtgtagggtttacattaacatgtctggta

SEQ ID NO: 99640 - DNA, 75 bp, Artificial Sequence
  Synthetic
gtaacattaacaagagggcaaaatacagtcaaggtatcaggaaaaggtggccatagtggttcaacatttaagtgt

SEQ ID NO: 99641 - DNA, 75 bp, Artificial Sequence
  Synthetic
gtaattggattgtactcattgttctctgcgtatttctattgttctcattggttttactgagcattctctgtcccg

SEQ ID NO: 99642 - DNA, 75 bp, Artificial Sequence
  Synthetic
gaaagcagtcaatcagcaacatggggatgtggaagtggctagtaatagccagtttagtatggcctgttttggcac

SEQ ID NO: 99643 - DNA, 75 bp, Artificial Sequence
  Synthetic
tgagaaatgtgtatgacatgaaaattgaatgccctcacacagtaagtttcggagaaaacagtgtgatagggtttg

SEQ ID NO: 99644 - DNA, 75 bp, Artificial Sequence
  Synthetic
cacccaggtaacctggagaggaaaggcagatccgggacaatccagtcagaattcattcgaaacagtgtctactga

SEQ ID NO: 99645 - DNA, 75 bp, Artificial Sequence
  Synthetic
ctgttatgacctttcttgtaatagtacttattgcaagccaacattatatatgattgtaccaatccatgcatgtaa

SEQ ID NO: 99646 - DNA, 75 bp, Artificial Sequence
  Synthetic
tatgatgaagagctgtctcattgcattagggccatacagagtgcaggtagtgtatgagagaacctactgtatgac

SEQ ID NO: 99647 - DNA, 75 bp, Artificial Sequence
  Synthetic
attacatctgcattgtgggaggaaattctgcaccaatctatgtccctacacttgatgatttcaggtccatggagg

SEQ ID NO: 99648 - DNA, 75 bp, Artificial Sequence
  Synthetic
cttgatgatttcaggtccatggaggcattcacgggaatctttaaatcaccgcatggagaagaccatgaccttgct

SEQ ID NO: 99649 - DNA, 75 bp, Artificial Sequence
  Synthetic
tagttggacctgcaaatgcaaaagtccctcatagtgcaagctcagacacactaagtttaattgcttattcaggta

SEQ ID NO: 99650 - DNA, 75 bp, Artificial Sequence
  Synthetic
actgggatgattgacttacctggatactatgaggccatacacccttgcacagttttttgtgtactgtcaggcccc

SEQ ID NO: 99651 - DNA, 75 bp, Artificial Sequence
  Synthetic
ggagcatcatgtgaagcattttctgaaggtggcattttcaacataacttcccccatgtgcttagtctcaaaacaa

SEQ ID NO: 99652 - DNA, 75 bp, Artificial Sequence
  Synthetic
aatcggttccggctaacagagcagcaggtgaacttcgtgtgtcaaagagtagacatggacattgttgtgtactgc

SEQ ID NO: 99653 - DNA, 75 bp, Artificial Sequence
  Synthetic
ctattgctgtggaactatgtgtgcctggattccatggctgggccacagctgctttgcttgttacattctgttttg

SEQ ID NO: 99654 - DNA, 75 bp, Artificial Sequence
  Synthetic
gatgggtccttataccggctgtcacatttgttatactaacaatcttaaagtttgttgctaacatttttcacacaa

SEQ ID NO: 99655 - DNA, 75 bp, Artificial Sequence
  Synthetic
atttgttatactaacaatcttaaagtttgttgctaacatttttcacacaagcaaccaagagaacaggctaaaatc

SEQ ID NO: 99656 - DNA, 75 bp, Artificial Sequence
  Synthetic
gcccactataaagtatgccaggtaactcacaggttcagggatgatcttaaaaagactgtcactcctcaaaatttc

SEQ ID NO: 99657 - DNA, 75 bp, Artificial Sequence
  Synthetic
ttacatttttacaatgtgggtattccttctcattctggaatctgtactgtgggctgctagtgcatcagaaacacc

SEQ ID NO: 99658 - DNA, 75 bp, Artificial Sequence
  Synthetic
tctccatattgaaatagaagagcaaacaatcggtgttgatgtgcacgctctaggacattggtttgatggccgtct

SEQ ID NO: 99659 - DNA, 75 bp, Artificial Sequence
  Synthetic
acaatcggtgttgatgtgcacgctctaggacattggtttgatggccgtcttaaccttaaaacatcctttcactgt

SEQ ID NO: 99660 - DNA, 75 bp, Artificial Sequence
  Synthetic
tatggtgcctgtacaaagtacgagtacccatggcatactgcaaagtgtcactatgaacgagattaccaatatgag

SEQ ID NO: 99661 - DNA, 75 bp, Artificial Sequence
  Synthetic
gaagaaaacctttgtaaaattatagacatgaatgattgctttgtatctagacatgttaaagtctgtattattgga

SEQ ID NO: 99662 - DNA, 75 bp, Artificial Sequence
  Synthetic
acatgaatgattgctttgtatctagacatgttaaagtctgtattattggaacagtttctaagttttcacaaggtg

SEQ ID NO: 99663 - DNA, 75 bp, Artificial Sequence
  Synthetic
ttggtgatccaggagacatcatgagcccaagggacaaaggttttttatgccctgagttcccaggtagttttagaa

SEQ ID NO: 99664 - DNA, 75 bp, Artificial Sequence
  Synthetic
aaaaatgtaattttgctactacccctatttgtgagtatgatggaaatacggtctcaggttacaaaaaagtgatgg

SEQ ID NO: 99665 - DNA, 75 bp, Artificial Sequence
  Synthetic
tggtatcattaacagagtgtcctacttttttgacctccattaaagcctgtgacaaagctatttgttatggtgcag

SEQ ID NO: 99666 - DNA, 75 bp, Artificial Sequence
  Synthetic
gacaaagctatttgttatggtgcagaaagtgtaacattaacaagaggacaaaatacagtgaaggtatcagggaaa

SEQ ID NO: 99667 - DNA, 75 bp, Artificial Sequence
  Synthetic
ggtggtcatagtggttcaactttcaaatgttgccatggggaagactgttcacaaattgggctccatgctgctgca

SEQ ID NO: 99668 - DNA, 75 bp, Artificial Sequence
  Synthetic
aatgttgccatggggaagactgttcacaaattgggctccatgctgctgcacctcaccttgataaagttaatggga

SEQ ID NO: 99669 - DNA, 75 bp, Artificial Sequence
  Synthetic
cattggtcttacttagtatcctttgccctgtcaggaagcataaaaaatcatagctagatgatgccgctatcaagt

SEQ ID NO: 99670 - DNA, 75 bp, Artificial Sequence
  Synthetic
ccctgtcaggaagcataaaaaatcatagctagatgatgccgctatcaagttattgtatatagctttaacatatat

SEQ ID NO: 99671 - DNA, 75 bp, Artificial Sequence
  Synthetic
aacaagacccaacaggggtagaacctggagatcatctgaaagagagatcaatgctcagttatggaaatgttcttg

SEQ ID NO: 99672 - DNA, 75 bp, Artificial Sequence
  Synthetic
ttggggcatttttttccatcttgcaggacatgcggaatacaatcatggcatccaagacagttggaacctctgagg

SEQ ID NO: 99673 - DNA, 75 bp, Artificial Sequence
  Synthetic
taacaacaacattctacctcaacacaaaactacctcaactaaactacctcattaaattgctccttgattgtcttt

SEQ ID NO: 99674 - DNA, 75 bp, Artificial Sequence
  Synthetic
gaagtgacaaacctcgaaaagaatggataaatatagagaaattcacaataaactgaaggagttttctcctggtac

SEQ ID NO: 99675 - DNA, 75 bp, Artificial Sequence
  Synthetic
taaacatgactggtctgataataaggattcagaggaagcaatagggaaagtgctactatttgctggggtcccttc

SEQ ID NO: 99676 - DNA, 75 bp, Artificial Sequence
  Synthetic
tctaaagggtgaaattccacagccttataaaataacctttaatgtagtcgcagtgcgtacagatggttctaatat

SEQ ID NO: 99677 - DNA, 75 bp, Artificial Sequence
  Synthetic
tataaaataacctttaatgtagtcgcagtgcgtacagatggttctaatatcacaacacaatggcctagtagaaga

SEQ ID NO: 99678 - DNA, 75 bp, Artificial Sequence
  Synthetic
ataccagattataaggggattgagccaataggagcaaatattgaagacttagttgactattctaaagaatggctg

SEQ ID NO: 99679 - DNA, 75 bp, Artificial Sequence
  Synthetic
agttgactattctaaagaatggctgtccagagctagaaatttctctttctttgaagtcaaaggtacagcagtttt

SEQ ID NO: 99680 - DNA, 75 bp, Artificial Sequence
  Synthetic
atcagattgatagtagaagggcttgttcatacatcttgaacctaattccagacacaccagcatcatatttagttc

SEQ ID NO: 99681 - DNA, 75 bp, Artificial Sequence
  Synthetic
agcagacacagaatataagagagccagggacgttcaaactgacatcaagtatgcttagagcagaatcaaaagcaa

SEQ ID NO: 99682 - DNA, 75 bp, Artificial Sequence
  Synthetic
tatttatccttccatcaaaatcacttgaagtagcaggttcctttattagatttatcacagtttttaggataggac

SEQ ID NO: 99683 - DNA, 75 bp, Artificial Sequence
  Synthetic
agatctgtctttgcaaatcatttcttattagctatatgtcaaaaaatgaaactctgtgcaatttttgataatttg

SEQ ID NO: 99684 - DNA, 75 bp, Artificial Sequence
  Synthetic
tattagctatatgtcaaaaaatgaaactctgtgcaatttttgataatttgcgctacttaatacctgcagtaacat

SEQ ID NO: 99685 - DNA, 75 bp, Artificial Sequence
  Synthetic
agttgctcttgcgcagaataataaggctagattctattctaaggtaaagttgttaggtttgacagttgaccaatc

SEQ ID NO: 99686 - DNA, 75 bp, Artificial Sequence
  Synthetic
gagaatcattggtggaaaatggatatatgatgtgggagcttcgagaaaattctaatttggctgagcaacaactat

SEQ ID NO: 99687 - DNA, 75 bp, Artificial Sequence
  Synthetic
actgtcaggatgctgtagagttagcagcaatagaattgaataaggttttatctacaaaatccagtgttgtagcca

SEQ ID NO: 99688 - DNA, 75 bp, Artificial Sequence
  Synthetic
acagcatattaaataagaattgggaagaaccatattttagtcaaacaagaaatattagcttaaagggtatgtcag

SEQ ID NO: 99689 - DNA, 75 bp, Artificial Sequence
  Synthetic
agaaccatattttagtcaaacaagaaatattagcttaaagggtatgtcaggacaggttcaagaggatggtcacct

SEQ ID NO: 99690 - DNA, 75 bp, Artificial Sequence
  Synthetic
ggcataaccctagcctcttgaagttgtatgaagagacaagagagcaaaaagcaatggcacggattgtgagaaaat

SEQ ID NO: 99691 - DNA, 75 bp, Artificial Sequence
  Synthetic
ttcaaggggcacttgaaaaagcacttagatgggcatcaggtgaaagctttatcgaactcagtaatcacaaattca

SEQ ID NO: 99692 - DNA, 75 bp, Artificial Sequence
  Synthetic
attgatagtatggagagccttgacccacatatcaagcaattcttggatttttttccagatgggcaccatggagag

SEQ ID NO: 99693 - DNA, 75 bp, Artificial Sequence
  Synthetic
ttttccagatgggcaccatggagaggtaaaaggaaactggttgcagggtaacctgaataagtgttcttccctctt

SEQ ID NO: 99694 - DNA, 75 bp, Artificial Sequence
  Synthetic
tagatgatgggactgactggttcttatttgtgtctcaacagattcaagcaggccatttacattggtttagtgtga

SEQ ID NO: 99695 - DNA, 75 bp, Artificial Sequence
  Synthetic
ttaggttctattaagatatcacccaagaagactacagtgtctcctacaaatgctgaattcctgtcaacatttttt

SEQ ID NO: 99696 - DNA, 75 bp, Artificial Sequence
  Synthetic
agaagactacagtgtctcctacaaatgctgaattcctgtcaacattttttgagggttgtgctgtatcaataccat

SEQ ID NO: 99697 - DNA, 75 bp, Artificial Sequence
  Synthetic
atacacctatcccattgggagggaatggtgcaatgtctataatggagttagcaacagccgggatagggatgtcag

SEQ ID NO: 99698 - DNA, 75 bp, Artificial Sequence
  Synthetic
acaaaaatctgttgaagcgtgcacttttaggatattcacacaagagacaaaaatcaatgttgtatatattaggtc

SEQ ID NO: 99699 - DNA, 75 bp, Artificial Sequence
  Synthetic
tttttaaatttttgatgaaattatctgatgaaacatttcaacatgaaaggttagggcaattttcctttatcggga

SEQ ID NO: 99700 - DNA, 75 bp, Artificial Sequence
  Synthetic
aggtacaatggaagatttttactccaaaatcagaattcgagtttgctgatatgtatacatcaaaatttctagaac

SEQ ID NO: 99701 - DNA, 75 bp, Artificial Sequence
  Synthetic
aaaatcagaattcgagtttgctgatatgtatacatcaaaatttctagaactatggagcagtcaacatgtaaccta

SEQ ID NO: 99702 - DNA, 75 bp, Artificial Sequence
  Synthetic
ccaacaaagcaggttcaaagggccaaggtagcaagaaccttcacagtcagggaaaaagatcagatcatacaaaat

SEQ ID NO: 99703 - DNA, 75 bp, Artificial Sequence
  Synthetic
aggtagcaagaaccttcacagtcagggaaaaagatcagatcatacaaaatagtattccagctgttatcggttaca

SEQ ID NO: 99704 - DNA, 75 bp, Artificial Sequence
  Synthetic
taaaaactatgaaagatggggtttatcgtgagctaggtctggacatatcgctacctgatgtcatgaagagaattg

SEQ ID NO: 99705 - DNA, 75 bp, Artificial Sequence
  Synthetic
gctctctggtttgaagacaaaacattctcagagtggttggatagattttgcagagttggagttccaccaattgac

SEQ ID NO: 99706 - DNA, 75 bp, Artificial Sequence
  Synthetic
ttcagtactgcaattacaagctaataggcgagcgtactcaggtaaacaatatgatgcatattgtgtacaaacata

SEQ ID NO: 99707 - DNA, 75 bp, Artificial Sequence
  Synthetic
aggcgagcgtactcaggtaaacaatatgatgcatattgtgtacaaacatataatgaggtaacaaagctttatgag

SEQ ID NO: 99708 - DNA, 75 bp, Artificial Sequence
  Synthetic
ttggtcttgactgtgcaaggcttgagatcttctgggataaaaaggcatatatattagaaacttcaatcacacaga

SEQ ID NO: 99709 - DNA, 75 bp, Artificial Sequence
  Synthetic
agcatgtattaaagataatgatggatgaagtttcaaaagagttgattaagtgcgggatgaggtttaatacagaac

SEQ ID NO: 99710 - DNA, 75 bp, Artificial Sequence
  Synthetic
tcaagcagtagatgctgtaagtaatgtatggtttgttcacaaaggtgtaaagctatatttaaatcccattatttc

SEQ ID NO: 99711 - DNA, 75 bp, Artificial Sequence
  Synthetic
taattaatcctcaaaacacattagacctttcaggtcttgagacgacaggagatggatttagcactgtaagttcaa

SEQ ID NO: 99712 - DNA, 75 bp, Artificial Sequence
  Synthetic
tgtcaagtcgattatggtctgaagaaatgagcttggtagatgatgatgaagaacttgatgatgagttcacaattg

SEQ ID NO: 99713 - DNA, 75 bp, Artificial Sequence
  Synthetic
aatgagcttggtagatgatgatgaagaacttgatgatgagttcacaattgacctgcaggatgtggattttgagaa

SEQ ID NO: 99714 - DNA, 75 bp, Artificial Sequence
  Synthetic
atactggagatctactaattagcacagaagaaactgaatcaaagaaaatgaggggtatagtaaaaatccttgagc

SEQ ID NO: 99715 - DNA, 75 bp, Artificial Sequence
  Synthetic
ctgttagactaatcaagagttgggtatcacgcggtctatctattgaaaaagtatacagccccgtaaatattatct

SEQ ID NO: 99716 - DNA, 75 bp, Artificial Sequence
  Synthetic
taatgtcaagatatatttctaaaacatttaacttgagtaccaaacaggtctcattattagatccatatgacttga

SEQ ID NO: 99717 - DNA, 75 bp, Artificial Sequence
  Synthetic
cagaattagagagtattgttcggggatggggggagtgtgttattgatcagtttgaaaatcttgatagagaggctc

SEQ ID NO: 99718 - DNA, 75 bp, Artificial Sequence
  Synthetic
tatggtattgttaagaaggttatttccacaggattctatttcctctttctactaggctttctttctttttcattt

SEQ ID NO: 99719 - DNA, 75 bp, Artificial Sequence
  Synthetic
aagcagtatgaaaaagatccagatgagttaaacaagagagcattgacagatcgagaaggtgttgcagtatccatt

SEQ ID NO: 99720 - DNA, 75 bp, Artificial Sequence
  Synthetic
caagcaaagattgatgaattaaagagacaattggcagacaggattgcaaccgggaagaatcttggaaaggaacaa

SEQ ID NO: 99721 - DNA, 75 bp, Artificial Sequence
  Synthetic
cagttatggaaatgttcttgacctgaaccacctggatattgatgagccaacagggcagacagcagactggctgag

SEQ ID NO: 99722 - DNA, 75 bp, Artificial Sequence
  Synthetic
cattgttgtctatcttacatcctttgttgtcccgatacttctgaaagctctgtatatgttaacaacaagaggggg

SEQ ID NO: 99723 - DNA, 75 bp, Artificial Sequence
  Synthetic
gcagaccaccaaggacaataaaggaacccggattcgattcaaggatgatagctcttttgaagatgtcaatggtat

SEQ ID NO: 99724 - DNA, 75 bp, Artificial Sequence
  Synthetic
acccggattcgattcaaggatgatagctcttttgaagatgtcaatggtatccggaagccgaaacatctatatgtg

SEQ ID NO: 99725 - DNA, 75 bp, Artificial Sequence
  Synthetic
tgtaattggattcctggctttggcaaaagattggagtgaccgcattgagcaatggttaagtgaaccgtgtaagct

SEQ ID NO: 99726 - DNA, 75 bp, Artificial Sequence
  Synthetic
tcttccagatacagcagcagttagcctccttggtggtcctgcaaccaacagggactatctacggcagcgacaagt

SEQ ID NO: 99727 - DNA, 75 bp, Artificial Sequence
  Synthetic
gggactatctacggcagcgacaagtggcattgggcaacatggaaacaaaagagtctaaagctatacgccagcatg

SEQ ID NO: 99728 - DNA, 75 bp, Artificial Sequence
  Synthetic
cagaggcagcaggctgtagcatgattgaggacattgagtcaccatcatcaatatgggtgtttgctggggcaccag

SEQ ID NO: 99729 - DNA, 75 bp, Artificial Sequence
  Synthetic
atatgggtgtttgctggggcaccagaccgctgcccaccaacatgtctttttattgcaagtattggagagcttggg

SEQ ID NO: 99730 - DNA, 75 bp, Artificial Sequence
  Synthetic
tgcggaatacaatcatggcatccaagacagttggaacctctgaggagaagctacggaagaaatcttcattctatc

SEQ ID NO: 99731 - DNA, 75 bp, Artificial Sequence
  Synthetic
aatgggaatacaactggatcagaggataattgtgctcttcatggtatcctggggaaaagaggcagtggataattt

SEQ ID NO: 99732 - DNA, 75 bp, Artificial Sequence
  Synthetic
tcccaaccaagagcctttaaaactataatcagtgaatgtataaccctcattatgtgatcattatatactactgaa

SEQ ID NO: 99733 - DNA, 75 bp, Artificial Sequence
  Synthetic
ttctggctgccttaagtagcctttttttgtatatatggatgtagatttcatttgatctttaaactaatcttgctc

SEQ ID NO: 99734 - DNA, 75 bp, Artificial Sequence
  Synthetic
tttttccttttcttcctgctttctctgcttactaacaacaacattctacctcaacacacaactacctcaactaaa

SEQ ID NO: 99735 - DNA, 75 bp, Artificial Sequence
  Synthetic
tctgcttactaacaacaacattctacctcaacacacaactacctcaactaaactacctcatttgattgctccttg

SEQ ID NO: 99736 - DNA, 75 bp, Artificial Sequence
  Synthetic
tagtagtagactccctaaataacaagctctgaaaagaatggataaatatagagaaattcacagcaaactgaagga

SEQ ID NO: 99737 - DNA, 75 bp, Artificial Sequence
  Synthetic
gtttcctcctggtacattaactgcggtagagtgtatagattatttagataggctgtatgcagttagacatgacat

SEQ ID NO: 99738 - DNA, 75 bp, Artificial Sequence
  Synthetic
tgtagatcagatgattaagcatgactggtctgataacaaagattcagaagaagcaatagggaaagtccttctatt

SEQ ID NO: 99739 - DNA, 75 bp, Artificial Sequence
  Synthetic
tgcaggagtcccatccaacattataacagcattggaaaagaagatcataccaaatcatcctacagggaaaaacct

SEQ ID NO: 99740 - DNA, 75 bp, Artificial Sequence
  Synthetic
taaggcattttttaagatgacacctgacaattataaaattaatgggacaactattgaatttgttgaggtaactgt

SEQ ID NO: 99741 - DNA, 75 bp, Artificial Sequence
  Synthetic
cacggctgatgttgataaggggatacgagaaaagaaattaaaatatgaggcaggtttaaattatattgaacaaga

SEQ ID NO: 99742 - DNA, 75 bp, Artificial Sequence
  Synthetic
attgcataagttttttctaaagggtgaaataccacagccgtataagataacattcactgttgttgcagttcggac

SEQ ID NO: 99743 - DNA, 75 bp, Artificial Sequence
  Synthetic
agatggttcaaatattacaacacagtggcccagtagaagaaatgatggggttgttcaatatatgagactagttca

SEQ ID NO: 99744 - DNA, 75 bp, Artificial Sequence
  Synthetic
ggctgagataagctatgtcagagagcacttgataaagacagatgaacgagctgcattagaagccatgtttaattt

SEQ ID NO: 99745 - DNA, 75 bp, Artificial Sequence
  Synthetic
aaagttcaatataagtacacataaaaatcaaccatactatataccagattataaggggattgaaccaattggagc

SEQ ID NO: 99746 - DNA, 75 bp, Artificial Sequence
  Synthetic
aagtattgaggacttagttgattatgctaaagagtggctatctagggctagaaatttttcattctttgaggttaa

SEQ ID NO: 99747 - DNA, 75 bp, Artificial Sequence
  Synthetic
agggacagcagtttttgactgctttaattcaaatgaggcaaatcattgtcagaaatatccaatgtcacgaaagcc

SEQ ID NO: 99748 - DNA, 75 bp, Artificial Sequence
  Synthetic
aagaaattttttactgatacaatgttctttaattacatcatacaagcctgctactacattatctgatcagattga

SEQ ID NO: 99749 - DNA, 75 bp, Artificial Sequence
  Synthetic
tagcaggcgagcctgtgcatacatattaaatcttatacctgatacgccagcatcacatttaattcatgacatggc

SEQ ID NO: 99750 - DNA, 75 bp, Artificial Sequence
  Synthetic
atataggtatataaaccttacacgagaggacatgatcaattattatgcacctcgaatacagtttaagcaaacaca

SEQ ID NO: 99751 - DNA, 75 bp, Artificial Sequence
  Synthetic
aaatgtgagagaacctggcacatttaagttaacctcaagcatgttacgggcagaatctaaggcaatgttagatgt

SEQ ID NO: 99752 - DNA, 75 bp, Artificial Sequence
  Synthetic
tctcaataatcataaaagtggtgaaaagcatggagaacagattgaaagtttaaatattgctagccatatagtaca

SEQ ID NO: 99753 - DNA, 75 bp, Artificial Sequence
  Synthetic
atctgaatctgtcagtcttgtgacaaagatactgtctgatctagaattaaatatcactgagccctcaacccagga

SEQ ID NO: 99754 - DNA, 75 bp, Artificial Sequence
  Synthetic
gtattcaaccactaagcacacttatgttgatacagtgttagataagttctttcagaatgaaacccagaagtattt

SEQ ID NO: 99755 - DNA, 75 bp, Artificial Sequence
  Synthetic
gatagatgtcttgaagaaaacaacagcatggcatatagggcatttaataagggatataacagagagccttattgc

SEQ ID NO: 99756 - DNA, 75 bp, Artificial Sequence
  Synthetic
acactctggattaaaacggtcaaaatactggtctttacactcgtacaacaatggtaatgtggtgttatttattct

SEQ ID NO: 99757 - DNA, 75 bp, Artificial Sequence
  Synthetic
tccatcaaagtccttagaagtagctgggtctttcattaggtttattacggtgttcagaataggacctggtctggt

SEQ ID NO: 99758 - DNA, 75 bp, Artificial Sequence
  Synthetic
agataaggataatttagacacaatattgattgatggtgaatctcagtggggagtttctaaagtgatgagcattga

SEQ ID NO: 99759 - DNA, 75 bp, Artificial Sequence
  Synthetic
tctaaataggttgttagccttaaacattgcctttgaaaaggcattgattgcaacagctacatggtttcaatacta

SEQ ID NO: 99760 - DNA, 75 bp, Artificial Sequence
  Synthetic
tactgaagaccagggacaatttccattacaatatgcaattagatcagtttttgcaaatcattttttactggctat

SEQ ID NO: 99761 - DNA, 75 bp, Artificial Sequence
  Synthetic
atgccaaaagatgaaactctgtgcaatctttgacaacttgcgttacctcattcctgcagttacatcactatattc

SEQ ID NO: 99762 - DNA, 75 bp, Artificial Sequence
  Synthetic
tggatttccctcattgatagaaaagttatttgagcgcccctttaaatcagcacttgaggtatatatctattataa

SEQ ID NO: 99763 - DNA, 75 bp, Artificial Sequence
  Synthetic
tattaagagcttgttggtcgcacttgcacagaataacaaggctaggttctattctaaagtaaaattactaggctt

SEQ ID NO: 99764 - DNA, 75 bp, Artificial Sequence
  Synthetic
gacagttgaccaatcaactgttggtgcaagtgggatttatccctcatttatgtcacgtatagtctataagcacta

SEQ ID NO: 99765 - DNA, 75 bp, Artificial Sequence
  Synthetic
cagaagcttaatatcagaggtgacaacatgttttttcttatttgaaaagggacttcatggaaacatgaatgagga

SEQ ID NO: 99766 - DNA, 75 bp, Artificial Sequence
  Synthetic
ggctaaaatacatcttgaaacagtagagtgggcactcaaatttaaagaaaaggaagaacggtatggagaatcatt

SEQ ID NO: 99767 - DNA, 75 bp, Artificial Sequence
  Synthetic
agtagaaaacggttacatgatgtgggaacttcgagagaattctgagttggctgaacaacaattgtattgtcagga

SEQ ID NO: 99768 - DNA, 75 bp, Artificial Sequence
  Synthetic
tgctatagaattggcagcaatagaattaaataaagtattatcgacaaagtccagtgtggtcgctaacagcatatt

SEQ ID NO: 99769 - DNA, 75 bp, Artificial Sequence
  Synthetic
gaataaaaattgggaggaaccatactttagtcaaacaaggaatataagcttaaaaggtatgtcaggacaagttca

SEQ ID NO: 99770 - DNA, 75 bp, Artificial Sequence
  Synthetic
agaggatggacacctctcttcatctgttacaattattgaagctatccgttatctgtctaattcaagacacaaccc

SEQ ID NO: 99771 - DNA, 75 bp, Artificial Sequence
  Synthetic
tagcctcttgaaactttatgaagaaacaagagatcagaaggctatggcaagaattgtgcgaaaataccagaggac

SEQ ID NO: 99772 - DNA, 75 bp, Artificial Sequence
  Synthetic
tgaggcagatcgaggcttttttattacaacattgccaacacgctgcaggcttgagattattgaagactattatga

SEQ ID NO: 99773 - DNA, 75 bp, Artificial Sequence
  Synthetic
tgccattgctaaaaatataactgaagaatatatatcatatgggggtgaaaaaaagatccttgcaattcagggggc

SEQ ID NO: 99774 - DNA, 75 bp, Artificial Sequence
  Synthetic
actggaaaaggccctgagatgggcatcaggtgagagttttattgaacttagcaatcagaaatttattaggatgaa

SEQ ID NO: 99775 - DNA, 75 bp, Artificial Sequence
  Synthetic
acgtaaattgatgtatgttagcgcagatgctactaagtggtcaccaggagacaactcagctaaatttcgtagatt

SEQ ID NO: 99776 - DNA, 75 bp, Artificial Sequence
  Synthetic
cacttccatgctgcataatggtttacctaatgacaaacttaaaaattgtgtaatcgatgccctaaaacatgttta

SEQ ID NO: 99777 - DNA, 75 bp, Artificial Sequence
  Synthetic
taagacagacttttttatgtcacgaaaactaagaaactatattgatggtatggaaagccttgatcctcatattaa

SEQ ID NO: 99778 - DNA, 75 bp, Artificial Sequence
  Synthetic
gcaatttttagatttctttccagatggtcaccatggggaagtgaaagggaattggttacagggtaacttaaataa

SEQ ID NO: 99779 - DNA, 75 bp, Artificial Sequence
  Synthetic
gtgctcatcactatttggtgttgcaatgtccttgttattcaagcaagtttggcatagtctgtttccagagcttga

SEQ ID NO: 99780 - DNA, 75 bp, Artificial Sequence
  Synthetic
ctgtttttttgaatttgcccatcattcagatgatgccttatttatctatggttacctggaacctgttgatgatgg

SEQ ID NO: 99781 - DNA, 75 bp, Artificial Sequence
  Synthetic
aactgactggttcttatttgtgtcccaacagatccaagcaggacatttacactggtttagtgttaatactgaaat

SEQ ID NO: 99782 - DNA, 75 bp, Artificial Sequence
  Synthetic
gtggaaaagcatgttcaatttacatgagcatatacttcttttgggttcaataaagatatcaccaaagaaaaccac

SEQ ID NO: 99783 - DNA, 75 bp, Artificial Sequence
  Synthetic
agtttctcctacaaatgctgagttcctctcaacattttttgaaggttgtgctgtctcaataccctttgttaaaat

SEQ ID NO: 99784 - DNA, 75 bp, Artificial Sequence
  Synthetic
actactgggttcactatctgatttaccaggtttgggctattttgatgatttagcagcagcacagagcaggtgtgt

SEQ ID NO: 99785 - DNA, 75 bp, Artificial Sequence
  Synthetic
aaaggcgttagacctaggggcttcacctcaagtggcacaactagccgtagctctgtgcaccagtaaggttgaaag

SEQ ID NO: 99786 - DNA, 75 bp, Artificial Sequence
  Synthetic
actatatggaacagcaccaggtatggtgaatcaccctgctgcatatttgcaagtaaaacatagtgatacacccat

SEQ ID NO: 99787 - DNA, 75 bp, Artificial Sequence
  Synthetic
cccactagggggaaatggtgcaatgtctattatggagttagcaacagctgggatagggatgtcagataagaactt

SEQ ID NO: 99788 - DNA, 75 bp, Artificial Sequence
  Synthetic
attaaaacgagcactcatagggtattcacataagagacagaaatcaatgctttatattttgggtctatttaagtt

SEQ ID NO: 99789 - DNA, 75 bp, Artificial Sequence
  Synthetic
cttaatgaagttatctgatgagacatttcaacatgaaaggttagggcaattctcctttatcggaaaggtacagtg

SEQ ID NO: 99790 - DNA, 75 bp, Artificial Sequence
  Synthetic
gaagatcttcactcctaagtctgaatttgaatttgctgacatgtacacatcaaaatttctagaaatatggagcaa

SEQ ID NO: 99791 - DNA, 75 bp, Artificial Sequence
  Synthetic
tcagcacgtaacatatgattatatcattccgaagggcagagacaatcttctaatctacctagtccggaaattaaa

SEQ ID NO: 99792 - DNA, 75 bp, Artificial Sequence
  Synthetic
tgatccaagtattgtaacagctatgactatgcagtcaccattgcaattaagatttaggatgcaagcaaagcaaca

SEQ ID NO: 99793 - DNA, 75 bp, Artificial Sequence
  Synthetic
catgaaagtgtgtagattggatggtgaatgggtaacattcagagaggtccttgctgctgccaatagttttgctga

SEQ ID NO: 99794 - DNA, 75 bp, Artificial Sequence
  Synthetic
aaactatagcccaacaagtcaagatatggatctgtttcaaacattaacaagctgtacattctccaaagaatatgc

SEQ ID NO: 99795 - DNA, 75 bp, Artificial Sequence
  Synthetic
atggaaggatttcttaaacgggattcactgtgatgtcataccaactaaacaaattcaaagggccaaggttgcaag

SEQ ID NO: 99796 - DNA, 75 bp, Artificial Sequence
  Synthetic
gaccttcacagtcagagagaaagatcaaataatacaaaatagtattccagctgttattggttataagtttgctgt

SEQ ID NO: 99797 - DNA, 75 bp, Artificial Sequence
  Synthetic
gactgtggatgagatgtcagatgtgctagatacagccaagtttcctgattcgttatcagttgacttaaagactat

SEQ ID NO: 99798 - DNA, 75 bp, Artificial Sequence
  Synthetic
gaaagatggggtctatcgtgaactaggactggacatatcccttcctgatgtcatgaagagaattgcgcctatgct

SEQ ID NO: 99799 - DNA, 75 bp, Artificial Sequence
  Synthetic
ttataaatcatctaagtcaagggttgttattgttcaaggaaatgttgaaggcactgctgaggccatttgtgctta

SEQ ID NO: 99800 - DNA, 75 bp, Artificial Sequence
  Synthetic
ccggttaaaatcaatgtccttagtaaagaccataagggtaaaaccccataaagaggttttgcaagcagtttcaat

SEQ ID NO: 99801 - DNA, 75 bp, Artificial Sequence
  Synthetic
tttcaatcgcaaagaagatattggccagcaaaaggatttagctgcccttaagctatgtattgaagtatggagatg

SEQ ID NO: 99802 - DNA, 75 bp, Artificial Sequence
  Synthetic
gtgtaaagcaaataatgctccatacagagattggtttcaagctctctggtttgaggataagaccttctcagaatg

SEQ ID NO: 99803 - DNA, 75 bp, Artificial Sequence
  Synthetic
gctagatagattttgtagggtaggggttccacctattgacccagagatccagtgtgcagcactgatgatagctga

SEQ ID NO: 99804 - DNA, 75 bp, Artificial Sequence
  Synthetic
tataaaaggggactattcggtcctccaattgcaagccaatagacgggcatactcaggtaagcaatatgatgcata

SEQ ID NO: 99805 - DNA, 75 bp, Artificial Sequence
  Synthetic
ctgtgtacagacatataacgaagtaacaaaattgtatgagggagatttgagagttacattcaattttggtcttga

SEQ ID NO: 99806 - DNA, 75 bp, Artificial Sequence
  Synthetic
ttgtgcaagacttgaaatattctgggataaaaaggcatatatattggagacatcaatcacccaaaagcatgtact

SEQ ID NO: 99807 - DNA, 75 bp, Artificial Sequence
  Synthetic
gaaaatcatgatggatgaagtttcaaaggagctattaaagtgtggaatgagattcaatacagagcaggttcaagg

SEQ ID NO: 99808 - DNA, 75 bp, Artificial Sequence
  Synthetic
agtaagacatatggtcctcttcaaaacggaatctgggttcgaatggggaaaaccaaatattccctgcattgtata

SEQ ID NO: 99809 - DNA, 75 bp, Artificial Sequence
  Synthetic
caagaactgtgtcctcagaacaagccttaggacaacgcaagcaattaaccataaattcatgatcacagtaaagga

SEQ ID NO: 99810 - DNA, 75 bp, Artificial Sequence
  Synthetic
tgatgggcttcgagctattgcacaacatgatgaagacagccccagattcctactagcccatgccttccatacaat

SEQ ID NO: 99811 - DNA, 75 bp, Artificial Sequence
  Synthetic
aagggatattagataccaagcggtagatgcagttagtaatgtatggtttatacataaaggagtgaagttgtactt

SEQ ID NO: 99812 - DNA, 75 bp, Artificial Sequence
  Synthetic
gaatcccattatatcatctggcttattagagaattttagaagaacccctcctgctgctatcccacctgctgctta

SEQ ID NO: 99813 - DNA, 75 bp, Artificial Sequence
  Synthetic
ttcactgattatgaatcgtgcaaaaatctctgttgatctatttatgttcaatgatttattaaaacttattaatcc

SEQ ID NO: 99814 - DNA, 75 bp, Artificial Sequence
  Synthetic
taagaatacacttgatctgtcaggtcttgagacaacaggggatggttttaccactgtcagttcgatgtcaagcag

SEQ ID NO: 99815 - DNA, 75 bp, Artificial Sequence
  Synthetic
actctggtctgaagaaatgagccttgttgatgatgaagaagagcttgacgatgagttcacaattgacttacagga

SEQ ID NO: 99816 - DNA, 75 bp, Artificial Sequence
  Synthetic
tgtggactttgaaaacatagacatggaagcagatattgaacattttttacaagatgagagttcttatactgggga

SEQ ID NO: 99817 - DNA, 75 bp, Artificial Sequence
  Synthetic
tttgttgattagtacagaggaaactgagtctaagaaaatgagaggcatagtgaaaatacttgaacctatcagact

SEQ ID NO: 99818 - DNA, 75 bp, Artificial Sequence
  Synthetic
aattaaaagctgggtatcaaggggattgtccattgaaaaagtatatagccctgttaatataattttgatgtcaag

SEQ ID NO: 99819 - DNA, 75 bp, Artificial Sequence
  Synthetic
gtacatctcaaagacctttaatctaagtaataagcaggtttctctattggacccttatgatttgacagaattaga

SEQ ID NO: 99820 - DNA, 75 bp, Artificial Sequence
  Synthetic
gagtattgtccgtggttggggggaatgtgtaattgatcagtttgagagtcttgatagagaggctcagagcatggt

SEQ ID NO: 99821 - DNA, 75 bp, Artificial Sequence
  Synthetic
ggttaataaggggatatgtcctgaggatgttattcctgattcactgttttcatttagacacaccatggttttgtt

SEQ ID NO: 99822 - DNA, 75 bp, Artificial Sequence
  Synthetic
aagaaggttatttccacaggattctatttcatctttctattaggctttctttctttttcattttccggagcatac

SEQ ID NO: 99823 - DNA, 75 bp, Artificial Sequence
  Synthetic
tatttccacaggattctatttcatctttctattaggctttctttctttttcattttccggagcatactactacta

SEQ ID NO: 99824 - DNA, 75 bp, Artificial Sequence
  Synthetic
actttaaaggaacctgtgtattaaagcacaagatgatagaggattcctatcgcagccgtagatcaataatctgtt

SEQ ID NO: 99825 - DNA, 75 bp, Artificial Sequence
  Synthetic
gtcctgtgaagcattttcagaaggggggatctttaatataacttctcccatgtgtttagtctcaaagcaaaatcg

SEQ ID NO: 99826 - DNA, 75 bp, Artificial Sequence
  Synthetic
cattggtttgacggccgcttaaatctaaagacctcctttcattgttatggtgcatgcacaaagtatgaataccca

SEQ ID NO: 99827 - DNA, 75 bp, Artificial Sequence
  Synthetic
tgtacagccttaacatatatattaatttgtatattttattatactctatctaacacactaaaaaaatagtagctg

SEQ ID NO: 99828 - DNA, 75 bp, Artificial Sequence
  Synthetic
tagtagtagactccctaaagagctactataacaacgatggcaactatggaggaactacagagagagatcaatgcc

SEQ ID NO: 99829 - DNA, 75 bp, Artificial Sequence
  Synthetic
catgagggtcaactggtgatagccaggcagaaggtaagagatgcagaaaaacagtatgaaaaggatccagatgag

SEQ ID NO: 99830 - DNA, 75 bp, Artificial Sequence
  Synthetic
tatataaccttactatatatattactttgtatttcctattataacctacctaacacactaaaaaaatagtagctg

SEQ ID NO: 99831 - DNA, 75 bp, Artificial Sequence
  Synthetic
ttaaataagagaacattaacagacagagaaggggttgcagcatccatccaggccaagattgatgagttaaaaagg

SEQ ID NO: 99832 - DNA, 75 bp, Artificial Sequence
  Synthetic
cagctagcagataggattgcaaccggaaagaaccttggaaaggaacaggatccaacaggggttgaacctggagac

SEQ ID NO: 99833 - DNA, 75 bp, Artificial Sequence
  Synthetic
catctgaaggaaagatcaatgcttagctatgggaatgtactggatttgaaccatctggatattgatgagcccaca

SEQ ID NO: 99834 - DNA, 75 bp, Artificial Sequence
  Synthetic
ggacagactgcagactggttaagtattgttatctatttgacatcctttgttgtaccgatccttctgaaagccctg

SEQ ID NO: 99835 - DNA, 75 bp, Artificial Sequence
  Synthetic
tatatgctaacaacgagggggagacaaacaaccaaagacaacaaagggaccagaattcggttcaaggatgacagt

SEQ ID NO: 99836 - DNA, 75 bp, Artificial Sequence
  Synthetic
tcttttgaggatgtcaatgggatccggaaaccaaaacatctgtatgtatccttgcccaatgctcaatcaagcatg

SEQ ID NO: 99837 - DNA, 75 bp, Artificial Sequence
  Synthetic
aaggcagaagagattacacctggtaggtacaggacagcaatctgtggactctatcctgcacagatcaaggccaga

SEQ ID NO: 99838 - DNA, 75 bp, Artificial Sequence
  Synthetic
cagatgattagcccagtcatgagtgtaattggtttcctggcactggctaaagactggagtgaccgaattgagcaa

SEQ ID NO: 99839 - DNA, 75 bp, Artificial Sequence
  Synthetic
tggcttagtgaaccttgtaaactacttccagatacagcagcagtaagcctccatggaggccctgcaacaaacagg

SEQ ID NO: 99840 - DNA, 75 bp, Artificial Sequence
  Synthetic
gactatctacggcaaagacaggtggcactgggtaatatggaaacaaaagagtcaaaggccatacgccaacatgct

SEQ ID NO: 99841 - DNA, 75 bp, Artificial Sequence
  Synthetic
gagactgcaggctgtagcatgatcgaagatattgagtcaccatcatcgatatgggtctttgctggagcacctgat

SEQ ID NO: 99842 - DNA, 75 bp, Artificial Sequence
  Synthetic
cgctgtccaccaacatgcctgtttattgcagggattgctgaacttggagcatttttttctatcctccaggatatg

SEQ ID NO: 99843 - DNA, 75 bp, Artificial Sequence
  Synthetic
cggaacacaattatggcttcaaagacagtgggaacatctgaagagaaattgcggaaaaaatcatcattctatcaa

SEQ ID NO: 99844 - DNA, 75 bp, Artificial Sequence
  Synthetic
tcctatctcaggcgaacacaatcaatgggaatacaactggaccagaggattattgtgctctttatggttgcctgg

SEQ ID NO: 99845 - DNA, 75 bp, Artificial Sequence
  Synthetic
gggaaagaggcagtggacaatttccacctaggggatgatatggatcctgagttgcgaacactggcacagagtttg

SEQ ID NO: 99846 - DNA, 75 bp, Artificial Sequence
  Synthetic
attgatgttaaagtgaaggagatatccaaccaagagcctttaaaattgtaatcagtaaatacataaccctcatta

SEQ ID NO: 99847 - DNA, 75 bp, Artificial Sequence
  Synthetic
tgtgatcactatatactactgaatcattatcaatcatatttacactattattatcaggggaatcattgtatcagg

SEQ ID NO: 99848 - DNA, 75 bp, Artificial Sequence
  Synthetic
gtatgggtacatttatgggtgggaattattactcagagggtgggttagttaatccgttgtgggtgggtttaggtt

SEQ ID NO: 99849 - DNA, 75 bp, Artificial Sequence
  Synthetic
tgggctgccttaagtagcctttttttgtatatatggatgtagatttcatttgatcctggaactaatcttgctttc

SEQ ID NO: 99850 - DNA, 75 bp, Artificial Sequence
  Synthetic
tgtatatatggatgtagatttcatttgatcctggaactaatcttgctttctttcctctttttctggccttctctg

SEQ ID NO: 99851 - DNA, 75 bp, Artificial Sequence
  Synthetic
tgatcctggaactaatcttgctttctttcctctttttctggccttctctgctcactaacaacaacattccacatc

SEQ ID NO: 99852 - DNA, 75 bp, Artificial Sequence
  Synthetic
aacaacacactacctcaacctaactacctcatttgcttgctccttgattgtctttttagggagcatactactact

SEQ ID NO: 99853 - DNA, 75 bp, Artificial Sequence
  Synthetic
acaacacactacctcaacctaactacctcatttgcttgctccttgattgtctttttagggagcatactactacta

SEQ ID NO: 99854 - DNA, 75 bp, Artificial Sequence
  Synthetic
tagtagtagactccgcaaaagaaagcagtcaatcagcaacatggggatatggaagtggctagtaatggccagttt

SEQ ID NO: 99855 - DNA, 75 bp, Artificial Sequence
  Synthetic
agcatggccagcttacacactacgaaatgtgtatgacatgaaaattgagtgccctcacacagtcagctttggtga

SEQ ID NO: 99856 - DNA, 75 bp, Artificial Sequence; identical to SEQ ID NO: 98849
  Synthetic

SEQ ID NO: 99857 - DNA, 75 bp, Artificial Sequence
  Synthetic
ttgtaacacggacaaccaccaatcaatgaacacaataacaaaatacacccagataagttggagaggtaaggctga

SEQ ID NO: 99858 - DNA, 75 bp, Artificial Sequence
  Synthetic
acaggcacaagccagccaaaattcatttgaagcagtgtctgctgaagttgaccttaaaggaacttgtgttttgaa

SEQ ID NO: 99859 - DNA, 75 bp, Artificial Sequence
  Synthetic
gcacaaaatgctagaggagtcataccgcagtagaaaatcaataacttgttatgacctttcctgtaacagcaccta

SEQ ID NO: 99860 - DNA, 75 bp, Artificial Sequence
  Synthetic
ctgtaagcccaccctgtacatgattgtaccaattcatgcatgtaacatgatgaaaagttgtttgattgcactagg

SEQ ID NO: 99861 - DNA, 75 bp, Artificial Sequence
  Synthetic
gccttacagagtacaagtggtctatgaaagaacctactgcatgacaggggtcctgatagaaggaaaatgttttgt

SEQ ID NO: 99862 - DNA, 75 bp, Artificial Sequence
  Synthetic
tccagaccaaagtgttgtcagtatcatcaagcatgggatttttgatatagcaagtgttcacattgtttgtttctt

SEQ ID NO: 99863 - DNA, 75 bp, Artificial Sequence
  Synthetic
tgtggcagttaagggaaacacatataaactgtttgaacagttaaagaagtcgtttcagtctacatgcaatgatac

SEQ ID NO: 99864 - DNA, 75 bp, Artificial Sequence
  Synthetic
tgataataaagtgcaaggatattacatctgcattgtggggggaaactctgcaccaatatatgtaccaacacttga

SEQ ID NO: 99865 - DNA, 75 bp, Artificial Sequence
  Synthetic
tgattttaggtccatggaggcattttcagggatctttaggtcaccacatggagaggaccatgatctagctgggga

SEQ ID NO: 99866 - DNA, 75 bp, Artificial Sequence
  Synthetic
agagattgcttcttactctattgttggacctgccaatgcaaaagtgcctcacagtgctagctcagacacattaag

SEQ ID NO: 99867 - DNA, 75 bp, Artificial Sequence
  Synthetic
cctaattgcctattcaggtataccatcctattcttcactcagcatccttgcaggctcaacagaagctaagcatgt

SEQ ID NO: 99868 - DNA, 75 bp, Artificial Sequence
  Synthetic
atttagccctggtttttttccacagcttaatcacacgaagtgtgacaagactgctatcccactcacttggacagg

SEQ ID NO: 99869 - DNA, 75 bp, Artificial Sequence
  Synthetic
gatgattgacttgcctgggtactatgaggctatacatccttgtacagttttctgtgttttatcaggccccggggc

SEQ ID NO: 99870 - DNA, 75 bp, Artificial Sequence
  Synthetic
atcctgtgaagcattctctgaaggtgggatcttcaacataacatcccctatgtgcttagtatcaaaacaaaatcg

SEQ ID NO: 99871 - DNA, 75 bp, Artificial Sequence
  Synthetic
attccggttgacagagcagcaagtaaactttgtctgtcaaagggttgatatggatattattgtgtattgtaatgg

SEQ ID NO: 99872 - DNA, 75 bp, Artificial Sequence
  Synthetic
ccagaggaaagtgatattaacaaaaactttagtcataggacagtgtatatatactataacaagtttattttcact

SEQ ID NO: 99873 - DNA, 75 bp, Artificial Sequence
  Synthetic
actgcctggggtagcacactctattgctgttgaactatgtgtgcctgggttccatggttgggctacagctgccct

SEQ ID NO: 99874 - DNA, 75 bp, Artificial Sequence
  Synthetic
acttgtcacattttgttttggatgggttcttataccagcaataacgtttgttatccttacaattttaaagtttat

SEQ ID NO: 99875 - DNA, 75 bp, Artificial Sequence
  Synthetic
tgcaaacatttttcacacaagtaaccaagagaataggcttaaatcagtattaaggaaaataaaggaagaatttga

SEQ ID NO: 99876 - DNA, 75 bp, Artificial Sequence
  Synthetic
aaagacaaaagggtcaatggtatgtgatatttgtaaatacgagtgtgaaacttataaagagctaaaggcacatgg

SEQ ID NO: 99877 - DNA, 75 bp, Artificial Sequence
  Synthetic
ggtttcatgccctcagtctcaatgtccatactgcttcactcattgtgaaccaacagaagcggcattccaggccca

SEQ ID NO: 99878 - DNA, 75 bp, Artificial Sequence
  Synthetic
ccatactgcttcactcattgtgaaccaacagaagcggcattccaggcccattatagagtgtgccaagtcacccat

SEQ ID NO: 99879 - DNA, 75 bp, Artificial Sequence
  Synthetic
agattcagagatgacttaaaaaagactgttactcctcagaactttacacctggttgctatcggacactaaacctg

SEQ ID NO: 99880 - DNA, 75 bp, Artificial Sequence
  Synthetic
ttcagatataaaagtagatgttatatttttacaatgtgggtctgccttttggtcctggagtcaatactttgggct

SEQ ID NO: 99881 - DNA, 75 bp, Artificial Sequence
  Synthetic
gccagtgcttcagaagtacccttaaatcctgtatggaatgataatgcccatggggtagggtctgtaccgatgcac

SEQ ID NO: 99882 - DNA, 75 bp, Artificial Sequence
  Synthetic
acagatttagagctggacttttccctgacatcaagctcaaagtatacataccgcagaaggctgacaaatccactt

SEQ ID NO: 99883 - DNA, 75 bp, Artificial Sequence
  Synthetic
gaagaaacacaagcaattaaccttcacattgaaatagaggaacaaacaattggtgttgatgttcatgccttaggc

SEQ ID NO: 99884 - DNA, 75 bp, Artificial Sequence
  Synthetic
cattggtttgatggtcggcttaaccttaaaacatctttccactgttatggtgcctgcacgaaatacgagtatccc

SEQ ID NO: 99885 - DNA, 75 bp, Artificial Sequence
  Synthetic
tggcacactgcaaagtgtcattatgagcgggattaccagtatgagacaagttggggctgtaacccagctgattgc

SEQ ID NO: 99886 - DNA, 75 bp, Artificial Sequence
  Synthetic
ccaggggtgggaacaggttgcacagcatgtggattataccttgatcaattaaagcctgttggtagtgcatataag

SEQ ID NO: 99887 - DNA, 75 bp, Artificial Sequence
  Synthetic
attattacaataagatatagcaggaaagtttgtgtccagtttggggaggaaaatctatgtaaggtgatagatatg

SEQ ID NO: 99888 - DNA, 75 bp, Artificial Sequence
  Synthetic
aatgattgctttgtctccagacatgttaaagtatgtataattggtacagtctcaaaattctcccaaggtgataca

SEQ ID NO: 99889 - DNA, 75 bp, Artificial Sequence
  Synthetic
ctattattctttggaccacttgagggcggtggtttgatattcaaacactggtgtacatctacatgccagtttgga

SEQ ID NO: 99890 - DNA, 75 bp, Artificial Sequence
  Synthetic
gacccaggagatattatgagtccacgggataagggatttttatgccccgaattccctggaagttttaggaagaag

SEQ ID NO: 99891 - DNA, 75 bp, Artificial Sequence
  Synthetic
tgtaattttgctaccacccctctttgtgagtatgatggcaatatggtctcaggttacaagaaagtgatggcaaca

SEQ ID NO: 99892 - DNA, 75 bp, Artificial Sequence
  Synthetic
attgattcctttcaatcctttaacaccagtactatgcactttactgatgagagaatagaatggaaagaccccgat

SEQ ID NO: 99893 - DNA, 75 bp, Artificial Sequence
  Synthetic
gggatgttaagggaccatataaacattctggtaactaaggacattgactttgataatctcggtgaaaacccctgt

SEQ ID NO: 99894 - DNA, 75 bp, Artificial Sequence
  Synthetic
aaaattggcttgcagacatcctcaattgaaggggcctggggttctggtgtaggttttacacttacatgtctagta

SEQ ID NO: 99895 - DNA, 75 bp, Artificial Sequence
  Synthetic
tctttaacagagtgtcccactttcttgacatcaattaaggcttgcgataaagccatttgttatggtgcagaaagt

SEQ ID NO: 99896 - DNA, 75 bp, Artificial Sequence
  Synthetic
gtgacattaacaagaggccagaacacagtaaaagtgtcaggtaaaggtggtcatagtggttcaactttcaaatgc

SEQ ID NO: 99897 - DNA, 75 bp, Artificial Sequence
  Synthetic
tgtcatggagaagagtgttcacaaattggactccatgctgcagcaccccatcttgataaagtcaatggaatttct

SEQ ID NO: 99898 - DNA, 75 bp, Artificial Sequence
  Synthetic
gaaattgaaaataataaagtatatgatgatggggcacctcaatgtggggtaaagtgctggtttgtagagtctgga

SEQ ID NO: 99899 - DNA, 75 bp, Artificial Sequence
  Synthetic
gaatggatctcagggatctttagtgggaattggattgtgctcatcgtcctctgtatattcttattgttttcactg

SEQ ID NO: 99900 - DNA, 75 bp, Artificial Sequence
  Synthetic
gtattactcagtgtcctatgtcctgttaggaaacacaaaaagtcataaataattgatatcattcccatactattg

SEQ ID NO: 99901 - DNA, 75 bp, Artificial Sequence
  Synthetic
aattgatatcattcccatactattgtatataaccttactatatatattactttgtatttcctattataacctacc

SEQ ID NO: 99902 - DNA, 75 bp, Artificial Sequence
  Synthetic
tatataaccttactatatatattactttgtatttcctattataacctacctaacacactaaaaaaaatagtagct

SEQ ID NO: 99903 - DNA, 75 bp, Artificial Sequence
  Synthetic
atagtagctgtctaaccatacaacttagattttttttctgtatgatgtcttaacatcttgcggagtctactacta

SEQ ID NO: 99904 - DNA, 75 bp, Artificial Sequence
  Synthetic
tagtagtagactccggaaataacaaactctgaaaagaatggataaatatagagaaattcacaataaacttaagga

SEQ ID NO: 99905 - DNA, 75 bp, Artificial Sequence
  Synthetic
gttctctcctggtacattgactgcagtagagtgtatagattacttggataggctctatgcagtaagacatgatat

SEQ ID NO: 99906 - DNA, 75 bp, Artificial Sequence
  Synthetic
tgtagatcagatgataaagcatgattggtctgacaataaggattcagaggaggcaataggaaaagtacttttatt

SEQ ID NO: 99907 - DNA, 75 bp, Artificial Sequence
  Synthetic
tgcaggggtcccatccaacattataacagcattggaaaagaaggtcataccaaatcatcctacagggaagaacct

SEQ ID NO: 99908 - DNA, 75 bp, Artificial Sequence
  Synthetic
taaggcattttttaagatgacacctgacaactacaaaattagtggaacaaatattgagtttgttgaggttactgt

SEQ ID NO: 99909 - DNA, 75 bp, Artificial Sequence
  Synthetic
tactgctgatgttgacaaaggaataagagaaaagaaattaaaatatgaggcgggtttatcatatattgaacagga

SEQ ID NO: 99910 - DNA, 75 bp, Artificial Sequence
  Synthetic
actacacaagttctttctaaagggtgaaattccacagccctataagataactttaaatgtggttgcagtgcggac

SEQ ID NO: 99911 - DNA, 75 bp, Artificial Sequence
  Synthetic
agatgggtccaacatttcaacacagtggccaagtagaaggaatgatggtgttgttcaatatatgaggttagttca

SEQ ID NO: 99912 - DNA, 75 bp, Artificial Sequence
  Synthetic
ggctgagataagttatgtgagggagcatttgattaaaacagaagagagagctgcattggaagctatgttcaatct

SEQ ID NO: 99913 - DNA, 75 bp, Artificial Sequence
  Synthetic
aaaattcaatataagcacacataagagtcagccatattacataccagactataaaggtattgaaccaataggggc

SEQ ID NO: 99914 - DNA, 75 bp, Artificial Sequence
  Synthetic
aaatattgacgacctagttgactattcaaaagagtggttatctagagctagaaatttttcattttttgaggtcaa

SEQ ID NO: 99915 - DNA, 75 bp, Artificial Sequence
  Synthetic
ggggacagcagtatttgattgttttaactcaaatgaagccaaccactgtcagaaatatcctatgtctcgtaaacc

SEQ ID NO: 99916 - DNA, 75 bp, Artificial Sequence
  Synthetic
aagaaactttctgttaatccagtgttctttaattacatcatataaacctgccactactctatctgaccaaattga

SEQ ID NO: 99917 - DNA, 75 bp, Artificial Sequence
  Synthetic
tagtaggcaggcttgctcatatatcctaaatctcattccagatacacctgcatcacacctgattcatgatatggc

SEQ ID NO: 99918 - DNA, 75 bp, Artificial Sequence
  Synthetic
ttatagatatataaatctcacaagagaggatatgatcagttactatgcaccaagaatacagtttaagcagacaca

SEQ ID NO: 99919 - DNA, 75 bp, Artificial Sequence
  Synthetic
aaatgtaaaggagccaggcacatttaagctaacatcaagcatgttaagggcagaatcaaaggcaatgttggatgt

SEQ ID NO: 99920 - DNA, 75 bp, Artificial Sequence
  Synthetic
tcttaataaccataagagtggtgagaaacatggtgagctgatagaaagcttaaacattgctagccatatagtaca

SEQ ID NO: 99921 - DNA, 75 bp, Artificial Sequence
  Synthetic
atctgagtcagtcagcttgataacaaaaatactatctgatctggaattgaatataactgagccatcaacccagga

SEQ ID NO: 99922 - DNA, 75 bp, Artificial Sequence
  Synthetic
gtacacaacgactaagcacacttatgttgacacagtcctggacaaattctttcaaaatgagacccaaaaatactt

SEQ ID NO: 99923 - DNA, 75 bp, Artificial Sequence
  Synthetic
aatagatgtcttgaagaagactacagcatggcatataggtcatctagtaagggacataacagaaagtttaattgc

SEQ ID NO: 99924 - DNA, 75 bp, Artificial Sequence
  Synthetic
ccattcaggtcttaagaggtcaaagtattggtccctccactcctataataatggcaatgtaattctatttatcct

SEQ ID NO: 99925 - DNA, 75 bp, Artificial Sequence
  Synthetic
cccatcaaaatcactagaggtagctgggtcctttattagattcattactgttttcagaatcgggccgggtttggt

SEQ ID NO: 99926 - DNA, 75 bp, Artificial Sequence
  Synthetic
tgacaaggataatttagacacaatattgcttgacggtgattcgcaatggggaatttcaaaagtcatgagtattga

SEQ ID NO: 99927 - DNA, 75 bp, Artificial Sequence
  Synthetic
cttgaacagactgttggccttgaatattgcctttgaaaaatctttaattgcaacagctacatggttccaatacta

SEQ ID NO: 99928 - DNA, 75 bp, Artificial Sequence
  Synthetic
cactgaggatcagggtcaattccctctacagtatgcaattagatctgtctttgcaaatcattttttactggcaat

SEQ ID NO: 99929 - DNA, 75 bp, Artificial Sequence
  Synthetic
atgtcagaaaatgaaactttgtgcaatttttgataatctccggtatttaatacctgcagtcacatctttatactc

SEQ ID NO: 99930 - DNA, 75 bp, Artificial Sequence
  Synthetic
tggatttccttcattaatagaaaaactgtttgagcgtccttttaaatctgcattagaagtctatatatattataa

SEQ ID NO: 99931 - DNA, 75 bp, Artificial Sequence
  Synthetic
tatcaagagcttgctggtagcacttgcacagaataataaagctagattttactctaaagtgaaattgctaggctt

SEQ ID NO: 99932 - DNA, 75 bp, Artificial Sequence
  Synthetic
aacagttgatcaatcaactgttggtgcaagtgggatttacccttcctttatgtcacgtatagtttataaacatta

SEQ ID NO: 99933 - DNA, 75 bp, Artificial Sequence
  Synthetic
taggagtctaatatcagaggtgacaacatgcttctttttatttgaaaaagggctccatgggaacatgaatgaaga

SEQ ID NO: 99934 - DNA, 75 bp, Artificial Sequence
  Synthetic
agctaaaatacatctagagacagtagggtgggcacttaaatttcgagaaaaagatgagagatatggggaatcatt

SEQ ID NO: 99935 - DNA, 75 bp, Artificial Sequence
  Synthetic
agtggaaaatggctacatgatgtgggagcttcgtgaaaatgctgagctggctgaacagcaactgtactgtcaaga

SEQ ID NO: 99936 - DNA, 75 bp, Artificial Sequence
  Synthetic
tgctgtagaactggcagcaatagagctaaataaagttttatcaaccaagtccagtgtggttgccaatagcatatt

SEQ ID NO: 99937 - DNA, 75 bp, Artificial Sequence
  Synthetic
gaataaaaactgggaggaaccctattttagccagacaagaaacataagtttaaagggcatgtcagggcaagttca

SEQ ID NO: 99938 - DNA, 75 bp, Artificial Sequence
  Synthetic
ggaggatgggcatttatcatcttctgttacaattattgaggccatccgttacttatctaactcaagacataatcc

SEQ ID NO: 99939 - DNA, 75 bp, Artificial Sequence
  Synthetic
cagtcttttaaagctatatgaggaaacaagggatcagaaggcgatggctaggattgtaaggaagtatcagaggac

SEQ ID NO: 99940 - DNA, 75 bp, Artificial Sequence
  Synthetic
agaggcagacagaggcttttttatcacaacactcccgacacgttgccggctggagatcattgaagactactatga

SEQ ID NO: 99941 - DNA, 75 bp, Artificial Sequence
  Synthetic
tgctattgctaagaatataactgaagaatatatctcgtatggaggtgaaaaaaagattcttgctattcaaggggc

SEQ ID NO: 99942 - DNA, 75 bp, Artificial Sequence
  Synthetic
actagaaaaggctcttaggtgggcatctggtgaaagtttcattgaactcagcaatcaaaaatttattagaatgaa

SEQ ID NO: 99943 - DNA, 75 bp, Artificial Sequence
  Synthetic
acggaaacttatgtacgttagtgcagatgctactaaatggtcaccgggagacaactcagcaaaattccgaagatt

SEQ ID NO: 99944 - DNA, 75 bp, Artificial Sequence
  Synthetic
cacatctatgctccataatggtctacctaataataagctaaagaattgtgtgattgatgcacttaaacaggttta

SEQ ID NO: 99945 - DNA, 75 bp, Artificial Sequence
  Synthetic
caagactgatttttttatgtcaagaaagttgagaaattatattgatagcatggagagtcttgacccacatataaa

SEQ ID NO: 99946 - DNA, 75 bp, Artificial Sequence
  Synthetic
gcaattcctggatttttttcctgatgggcatcatggagaggttaagggaaactggttacaaggtaatttaaataa

SEQ ID NO: 99947 - DNA, 75 bp, Artificial Sequence
  Synthetic
gtgttcatctttatttggtgtagcaatgtcattactgtttaagcaggtatggaataatctatttcctgaacttga

SEQ ID NO: 99948 - DNA, 75 bp, Artificial Sequence
  Synthetic
ttgcttctttgagtttgcccatcattcagatgatgctttatttatttatggatatctagaacctgtagatgatgg

SEQ ID NO: 99949 - DNA, 75 bp, Artificial Sequence
  Synthetic
aactgattggtttctatttgtatctcagcaaatacaagcaggtcatttgcactggttcagtgtaaatactgaaat

SEQ ID NO: 99950 - DNA, 75 bp, Artificial Sequence
  Synthetic
gtggaaaagcatgtttaatcttcatgaacatatactccttttgggctcaataaagatatcaccaaagaagactac

SEQ ID NO: 99951 - DNA, 75 bp, Artificial Sequence
  Synthetic
agtctctccaaccaatgctgaattcctatcaacattttttgagggttgtgcagtgtcgataccatttgtaaagat

SEQ ID NO: 99952 - DNA, 75 bp, Artificial Sequence
  Synthetic
cttattgggttcattatcagatctgccaggcttaggctattttgatgatctggcagcagcacaaagtcgatgtgt

SEQ ID NO: 99953 - DNA, 75 bp, Artificial Sequence
  Synthetic
taaagccttagatttaggggcctccccccaggtggcacagttagctgtcgcattatgcacgagcaaggtagaaag

SEQ ID NO: 99954 - DNA, 75 bp, Artificial Sequence
  Synthetic
attgtatggtacagcaccaggtatggtaaatcaccctgctgcatacttacaggttaagcatgatgatacacctat

SEQ ID NO: 99955 - DNA, 75 bp, Artificial Sequence
  Synthetic
tcctctaggaggaaatggtgcaatgtctataatggagctagcaacagctgggatagggatgtcagataaaaattt

SEQ ID NO: 99956 - DNA, 75 bp, Artificial Sequence
  Synthetic
attaaaacgtgcacttatagggtattcacataagaggcaaaaatcaatgttatatatattaggtctcttcaagtt

SEQ ID NO: 99957 - DNA, 75 bp, Artificial Sequence
  Synthetic
cttgatgaacttatctgaggagacattccagcatgagagactagggcggttctcattcattgggaaggtgcagtg

SEQ ID NO: 99958 - DNA, 75 bp, Artificial Sequence
  Synthetic
gaaaatttttacaccaaaatctgaatttgagtttgctgacatgtacacctcaaagtttttagagctatggagcaa

SEQ ID NO: 99959 - DNA, 75 bp, Artificial Sequence
  Synthetic
tcaacatgtaacatatgattatataatcccaaagggcagggataaccttcttatctatttagttaggaagttgaa

SEQ ID NO: 99960 - DNA, 75 bp, Artificial Sequence
  Synthetic
tgatccaagtattgtaacagctatgacaatgcagtcacctctacaactaagatttagaatgcaggcaaagcaaca

SEQ ID NO: 99961 - DNA, 75 bp, Artificial Sequence
  Synthetic
catgaaagtttgcagattagatggggactgggtaacatttagggaagttttggctgctgcaaatagttttgcaga

SEQ ID NO: 99962 - DNA, 75 bp, Artificial Sequence
  Synthetic
gaattatactcctactagtcaagatatggacttgttccaaacattgacaaactgtacattctctaaagaatatgc

SEQ ID NO: 99963 - DNA, 75 bp, Artificial Sequence
  Synthetic
atggaaggattttttgaatgggatccattgtgatgtcataccgacaaaacagattcaaagggccaaggttgcaag

SEQ ID NO: 99964 - DNA, 75 bp, Artificial Sequence
  Synthetic
gacattcacagtgagagaaaaggaccaaatcatacaaaatagcatcccagctgtaattggttataaatttgctgt

SEQ ID NO: 99965 - DNA, 75 bp, Artificial Sequence
  Synthetic
cactgtagatgaaatgtctgacgtattggatactgcaaagtttccggactcgctatctgttgatttaaagaccat

SEQ ID NO: 99966 - DNA, 75 bp, Artificial Sequence
  Synthetic
gaaggatggagtttatcgggaattaggactggatatatcattaccagatgttatgaagaggattgcaccaatgct

SEQ ID NO: 99967 - DNA, 75 bp, Artificial Sequence
  Synthetic
ttataagtcttctaagtcccgggtggttattgttcaagggaatgttgaaggaacagccgaagccatatgtgctta

SEQ ID NO: 99968 - DNA, 75 bp, Artificial Sequence
  Synthetic
ttggctaaaatcaatgtcattagtaaagactataagggtaaaacctcataaagaggtccttcaggcagtatcaat

SEQ ID NO: 99969 - DNA, 75 bp, Artificial Sequence
  Synthetic
ttttaaccgtaaagaagatattggacagcagaaagatttggctgctcttaaactgtgtatagaggtatggaggtg

SEQ ID NO: 99970 - DNA, 75 bp, Artificial Sequence
  Synthetic
gtgcaaagcaaacaatgcaccatatcacgactggtttcaagctctctggtttgaagataaaacattttcagaatg

SEQ ID NO: 99971 - DNA, 75 bp, Artificial Sequence
  Synthetic
gttggatagattctgcagagtaggggttccgcctattgatccagaaattcagtgtgcagctttgatgatagctga

SEQ ID NO: 99972 - DNA, 75 bp, Artificial Sequence
  Synthetic
tataaaaggtgattattcagtgttgcaactacaggctaataggagggcatactcaggtaaacaatatgatgctta

SEQ ID NO: 99973 - DNA, 75 bp, Artificial Sequence
  Synthetic
ttgtgtgcaaacatataatgaggcaacaaaattatatgaaggggatttgagggttacattcaacttcggtcttga

SEQ ID NO: 99974 - DNA, 75 bp, Artificial Sequence
  Synthetic
ctgtgcaagacttgagatattttgggacaaaaaggcttatatcctagagacatcaatcacacaaaaacatgtgtt

SEQ ID NO: 99975 - DNA, 75 bp, Artificial Sequence
  Synthetic
aaagattatgatggatgaggtttcaaaggagttattgaagtgtgggatgagatttaatacagagcaagttcaagg

SEQ ID NO: 99976 - DNA, 75 bp, Artificial Sequence
  Synthetic
cgtgcgacatatggtgttgttcaagacggagtctgggtttgagtggggaaaaccaaatatcccgtgtattgtcta

SEQ ID NO: 99977 - DNA, 75 bp, Artificial Sequence
  Synthetic
caagaactgtgcccttagaacaagccttagaactacacaggcaatcaaccataaatttatgattacaataaaaga

SEQ ID NO: 99978 - DNA, 75 bp, Artificial Sequence
  Synthetic
tgatggacttcgtgctattgcacaacatgatgaagatagtcccaggtttttgttagcccatgcttttcatactat

SEQ ID NO: 99979 - DNA, 75 bp, Artificial Sequence
  Synthetic
aagagatattaggtaccaagctgttgatgcagtgagtaatgtatggtttttacacaagggagttaaactttattt

SEQ ID NO: 99980 - DNA, 75 bp, Artificial Sequence
  Synthetic
gaatcccattatttcctctggcttgcttgagaactttatgaaaaatctccctgctgctattccaccggctgcata

SEQ ID NO: 99981 - DNA, 75 bp, Artificial Sequence
  Synthetic
ctcgttgatcatgaatcgtgcaaaaatatcagttgacctctttaggtttaatgacctattgaaacttatcaatcc

SEQ ID NO: 99982 - DNA, 75 bp, Artificial Sequence
  Synthetic
caataatacactagacctctctggtcttgaaacaactggagatggctttagtactgttagctcaatgtcaagtcg

SEQ ID NO: 99983 - DNA, 75 bp, Artificial Sequence
  Synthetic
attatggtctgaggagatgagcttagttgatgatgatgaagagctggatgatgagtttacaattgacctacaaga

SEQ ID NO: 99984 - DNA, 75 bp, Artificial Sequence
  Synthetic
tgttgactttgagaatatagatatggaggctgacatcgaacattttttgcaagatgaaagttcttatacagggga

SEQ ID NO: 99985 - DNA, 75 bp, Artificial Sequence
  Synthetic
cttgctaattagcacagaagaaaccgaatctaaaaaaatgagaggcattgtaaaaatacttgagcctgtgaggtt

SEQ ID NO: 99986 - DNA, 75 bp, Artificial Sequence
  Synthetic
aattaaaagctgggtatcacgtggattatctattgaaaaggtatatagccctgtcaatataatactgatgtccag

SEQ ID NO: 99987 - DNA, 75 bp, Artificial Sequence
  Synthetic
atatatttcaaaaacattcaatttgagcactaaacaggtttccttattagatccttatgatttaactgagctgga

SEQ ID NO: 99988 - DNA, 75 bp, Artificial Sequence
  Synthetic
aagtattgttcgaggctggggggaatgtgtgattgaccaatttgagagccttgatagggaagcccagaatatggt

SEQ ID NO: 99989 - DNA, 75 bp, Artificial Sequence
  Synthetic
agttaacaaaggaatatgcccagaggatgttatccctgattcattattttcattcagacacacaatggtattgtt

SEQ ID NO: 99990 - DNA, 75 bp, Artificial Sequence
  Synthetic
gagacggctattcccgcaggattctatttcctctttttattaggctttctttctttttcattttccggagcatac

SEQ ID NO: 99991 - DNA, 75 bp, Artificial Sequence
  Synthetic
tattcccgcaggattctatttcctctttttattaggctttctttctttttcattttccggagcatactactacta

SEQ ID NO: 99992 - DNA, 75 bp, Artificial Sequence
  Synthetic
tgatcctggaactaatcttgctttctttcctctttttctggccttctctgctcactaacaacaacattctacctc

SEQ ID NO: 99993 - DNA, 75 bp, Artificial Sequence
  Synthetic
ccatactgcttcactcattgtgaaccaacagaagcagcattccaggcccattgtagagtgtgtcaagtcacccat

SEQ ID NO: 99994 - DNA, 75 bp, Artificial Sequence
  Synthetic
atggcgtctgtacaaccacgtcacatataaaataataaatattcacaaggaggagtggttatatgatgtaatcca

SEQ ID NO: 99995 - DNA, 75 bp, Artificial Sequence
  Synthetic
acttccgcatctcgtcagactgcatccggtctccggcgagtgaacatctctgggaagagctccacgcacgtggtg

SEQ ID NO: 99996 - DNA, 75 bp, Artificial Sequence
  Synthetic
agggtgactgtagtctgagctcatgggttcaagaccacagcccgatggtagtggtgttaccgtctcgaacctagc

SEQ ID NO: 99997 - DNA, 75 bp, Artificial Sequence
  Synthetic
aggagtggttatatgatgtaatccataaccactcccaggaaatgacgtatgatagccaatcagaattgagtatta

SEQ ID NO: 99998 - DNA, 75 bp, Artificial Sequence
  Synthetic
ccatatgataactggaaagaggaagaacacttactatggagcttacttgctcctgggactgaacgtctcatgatc

SEQ ID NO: 99999 - DNA, 75 bp, Artificial Sequence
  Synthetic
ctatggctttcaatcctcctgtgattagagctttttctcaacctgcttttacttatgtcttcaaatttccatatc

SEQ ID NO: 100000 - DNA, 75 bp, Artificial Sequence
  Synthetic
tagagctttttctcaacctgcttttacttatgtcttcaaatttccatatccacaatggaaagaaaaagaatggct

SEQ ID NO: 100001 - DNA, 75 bp, Artificial Sequence
  Synthetic
ctgaagatgatcctgtcagggaagatattttatgctcactagcagaccaacactatgctgctattttcaccaagg

SEQ ID NO: 100002 - DNA, 75 bp, Artificial Sequence
  Synthetic
gcttcatgcacttttagctcatggaactgaacaatctatgatacaattaagaaactgcgctcctcatccggatga

SEQ ID NO: 100003 - DNA, 75 bp, Artificial Sequence
  Synthetic
actgaacaatctatgatacaattaagaaactgcgctcctcatccggatgaagacataatccgtgatgacttgctt

SEQ ID NO: 100004 - DNA, 75 bp, Artificial Sequence
  Synthetic
cttactacatggctgtaacttcactcatggggcagaaacagagaacacactttccacgatgcgacataatatgcc

SEQ ID NO: 100005 - DNA, 75 bp, Artificial Sequence
  Synthetic
catggggcagaaacagagaacacactttccacgatgcgacataatatgccaggctgagatcggctcagaatatct

SEQ ID NO: 100006 - DNA, 75 bp, Artificial Sequence
  Synthetic
atttctttagaagatcgccattttggggctgttctctgcaaggctgtttacatggcaacaactactctcatgtca

SEQ ID NO: 100007 - DNA, 75 bp, Artificial Sequence
  Synthetic
gggctgttctctgcaaggctgtttacatggcaacaactactctcatgtcacacaaacaaaggaatatgtttcctc

SEQ ID NO: 100008 - DNA, 75 bp, Artificial Sequence
  Synthetic
acactgtcacatacttgttggaggagcaggtctgagcaagagaaatgctaaaatttcatgtgctacgctcctagg

SEQ ID NO: 100009 - DNA, 75 bp, Artificial Sequence
  Synthetic
ttcttgcacttcgaccatttgaaccagctgaggctaatattttccatctcctcaagcgcattgaacgcgaagcat

SEQ ID NO: 100010 - DNA, 75 bp, Artificial Sequence
  Synthetic
gttgtgacatcatagttcagtctgagctaggagagaaaaacttacactgccatattatagttgggggagaaggac

SEQ ID NO: 100011 - DNA, 75 bp, Artificial Sequence
  Synthetic
gctaggagagaaaaacttacactgccatattatagttgggggagaaggactaagcaagaggaatgctaaatcatc

SEQ ID NO: 100012 - DNA, 75 bp, Artificial Sequence
  Synthetic
aaatttcatgtgctacgctcctaggccttgtgatggctgaattaacacaacgctgcaaactacttcttgcacagc

SEQ ID NO: 100013 - DNA, 75 bp, Artificial Sequence
  Synthetic
gtccatttgaaccagatgaagctagaatattccatctactcagacgcgttgaacgcgaagcatggtcagggcaca

SEQ ID NO: 100014 - DNA, 75 bp, Artificial Sequence
  Synthetic
ctgtgctcagttctatggtttaatactagctgagataattcaacgctgcaaatctcttctggctacacgtccttt

SEQ ID NO: 100015 - DNA, 75 bp, Artificial Sequence
  Synthetic
aatattccatctactcagacgcgttgaacgcgaagcatggtcagggcacactggtaactgggttcaaattcttca

SEQ ID NO: 100016 - DNA, 75 bp, Artificial Sequence
  Synthetic
aatctcttctggctacacgtccttttgaacctgaggaggctgacatatttcacactctaaaaaaggctgagcgag

SEQ ID NO: 100017 - DNA, 75 bp, Artificial Sequence
  Synthetic
atacagagacaagcgaggtgaccttcatgctcaacacattgatcctttacgctttttcaaacactacctgctgcc

SEQ ID NO: 100018 - DNA, 75 bp, Artificial Sequence
  Synthetic
catgctcaacacattgatcctttacgctttttcaaacactacctgctgccaaaaaatcgattgatctctccttcc

SEQ ID NO: 100019 - DNA, 75 bp, Artificial Sequence
  Synthetic
aggcatggggtggagttactggcggcaacatgcagatccttcaatatagagatcgcagaggagaccttcatgcac

SEQ ID NO: 100020 - DNA, 75 bp, Artificial Sequence
  Synthetic
agcaagcctgacgtctgcactactccagataactggtttgtcctagctgataaaacatacgctcacactattgtt

SEQ ID NO: 100021 - DNA, 75 bp, Artificial Sequence
  Synthetic
caaaaactaccttttacctaaaaatagatgtatttcatcttacagcaaacctgatgtttgtacttctcctgacaa

SEQ ID NO: 100022 - DNA, 75 bp, Artificial Sequence
  Synthetic
agatgtatttcatcttacagcaaacctgatgtttgtacttctcctgacaactggttcattttagctgaaaaaact

SEQ ID NO: 100023 - DNA, 75 bp, Artificial Sequence
  Synthetic
taaaacatacgctcacactattgttaatgggcttccgctgctagaacataacagaaaggcctatctacaagagtt

SEQ ID NO: 100024 - DNA, 75 bp, Artificial Sequence
  Synthetic
tactctcacactcttattaacgggctgccgcttccagaacattacagaaaaaactaccacgcaaccctagataac

SEQ ID NO: 100025 - DNA, 75 bp, Artificial Sequence
  Synthetic
cggcagacatattggattccaagatggcgtctgtacaaccacgtcacatataaaataataaatattcacaaggag

SEQ ID NO: 100026 - DNA, 75 bp, Artificial Sequence
  Synthetic
tgccgcttccagaacattacagaaaaaactaccacgcaaccctagataacgaagtcattccagggcctcaaacaa

SEQ ID NO: 100027 - DNA, 75 bp, Artificial Sequence
  Synthetic
tctaccatggcctttgggggacgtggtgcgtgggaacatctgcctgaggtaggagaacaacgcctaattacttct

SEQ ID NO: 100028 - DNA, 75 bp, Artificial Sequence
  Synthetic
tggcctatggaggacgtggtccgtgggaacatcttcctgaggtaggagatcagcgcctagctgcgtcttctgtta

SEQ ID NO: 100029 - DNA, 75 bp, Artificial Sequence
  Synthetic
cttacttgataaatgtgatgaacttaacttacttgtatatgaagacttagttagtgcttgtcctgaccttttact

SEQ ID NO: 100030 - DNA, 75 bp, Artificial Sequence
  Synthetic
cagcgcctagctgcgtcttctgttagcactacttataaacctaacaaaaaagaaaaacttatgctaaacttgcta

SEQ ID NO: 100031 - DNA, 75 bp, Artificial Sequence
  Synthetic
aatacttctactgcttataaagctaacaaaaaagaaaaactaatgctaaacttacttgataaatgtgatgaactt

SEQ ID NO: 100032 - DNA, 75 bp, Artificial Sequence
  Synthetic
tatgcttgaaggtcagccaggtggtgcacgcctaattgaacaggtgctaggcatgcatcatattaaagtgtgtgc

SEQ ID NO: 100033 - DNA, 75 bp, Artificial Sequence
  Synthetic
gacaaatgtaaagagctaaatctattagtttatgaagacttagtagctaattgtcctgaactactccttatgctt

SEQ ID NO: 100034 - DNA, 75 bp, Artificial Sequence
  Synthetic
gcacgcctaattgaacaggtgctaggcatgcatcatattaaagtgtgtgctaattatacagctctatcattccta

SEQ ID NO: 100035 - DNA, 75 bp, Artificial Sequence
  Synthetic
tttcatttacatcctaatcaattattaacttctagcaataaagcactaaaactattgttgattcaagggtacaac

SEQ ID NO: 100036 - DNA, 75 bp, Artificial Sequence
  Synthetic
ttatagaacaagtcttgggcatgcaccatattaatgtttgttctaactttacagctctcacatatctttttcatc

SEQ ID NO: 100037 - DNA, 75 bp, Artificial Sequence
  Synthetic
taacttctagcaataaagcactaaaactattgttgattcaagggtacaacccattgcaagtagggcacgccatct

SEQ ID NO: 100038 - DNA, 75 bp, Artificial Sequence
  Synthetic
acagctctcacatatctttttcatctacatcctgttacttcgcttgactcagacaataaagctttacagcttttg

SEQ ID NO: 100039 - DNA, 75 bp, Artificial Sequence
  Synthetic
gctgtgtacttaacaaacagatgggcaagcagaacactatctgcttttatggtcctgcttcaacaggtaaaacaa

SEQ ID NO: 100040 - DNA, 75 bp, Artificial Sequence
  Synthetic
caagcagaacactatctgcttttatggtcctgcttcaacaggtaaaacaaatattgcaaaggccatagtccaagg

SEQ ID NO: 100041 - DNA, 75 bp, Artificial Sequence
  Synthetic
ttgattcaaggctataatcctctagccgttggtcacgccctgtgctgtgtcctgaacaaacaattcgggaaacaa

SEQ ID NO: 100042 - DNA, 75 bp, Artificial Sequence
  Synthetic
cgttcgcctttatggctgtgttaatcatctaaacaaagggtttgtctttaacgattgcagacaacgccttataat

SEQ ID NO: 100043 - DNA, 75 bp, Artificial Sequence
  Synthetic
caagattgggttgaacctgctaaatgcattttaggtggaaccgaatgtagaattgatgttaaacacaaagacagt

SEQ ID NO: 100044 - DNA, 75 bp, Artificial Sequence
  Synthetic
cagacaacgcctagttgtttggtgggaggagtgcttaatgcaccaggattgggtggaacctgcaaagtgtatctt

SEQ ID NO: 100045 - DNA, 75 bp, Artificial Sequence
  Synthetic
gaggagtgcttaatgcaccaggattgggtggaacctgcaaagtgtatcttgggcgggacagaatgcagaattgac

SEQ ID NO: 100046 - DNA, 75 bp, Artificial Sequence
  Synthetic
gggcgggacagaatgcagaattgacgtcaagcatagagacagtgtacttttaactcaaacacctgtaattatatc

SEQ ID NO: 100047 - DNA, 75 bp, Artificial Sequence
  Synthetic
taactcaaacacctgtaattatatccactaaccacgatatctacgcggttgttggtggcaattctgtttctcatg

SEQ ID NO: 100048 - DNA, 75 bp, Artificial Sequence
  Synthetic
aagagcgaattcttcaactaaattttatgaaacaactgccacaaacatttggagaaatttctccagttgaaattg

SEQ ID NO: 100049 - DNA, 75 bp, Artificial Sequence
  Synthetic
tgagtacgaatgtactcttactggctttaaacaaaaatggaacttagataaagttccaaactcatttcctcttgg

SEQ ID NO: 100050 - DNA, 75 bp, Artificial Sequence
  Synthetic
caacttcctcaaacatttggagaaatcactgctactgagattgcagctcttctacagtggtgtttcaatgagtac

SEQ ID NO: 100051 - DNA, 75 bp, Artificial Sequence
  Synthetic
tttaaacaaaaatggaacttagataaagttccaaactcatttcctcttggggacctttgtcctacacattcacag

SEQ ID NO: 100052 - DNA, 75 bp, Artificial Sequence
  Synthetic
tctacagtggtgtttcaatgagtacgactgtactctgacaggatttaaacaaaaatggaatttagataaaattcc

SEQ ID NO: 100053 - DNA, 75 bp, Artificial Sequence
  Synthetic
gactgtactctgacaggatttaaacaaaaatggaatttagataaaattccaaactcatttcctcttggggtcctt

SEQ ID NO: 100054 - DNA, 75 bp, Artificial Sequence
  Synthetic
gactacgtgcttcacgaaaacggattctgcactgactgcggcggctatattcctcatagtgctgacgactctgtg

SEQ ID NO: 100055 - DNA, 75 bp, Artificial Sequence
  Synthetic
tctgcactgactgcggcggctatattcctcatagtgctgacgactctgtgtatactgacgtggctagcgagacat

SEQ ID NO: 100056 - DNA, 75 bp, Artificial Sequence
  Synthetic
tgtcctactcattcacaggactttacacttcacgaaaacggatactgcactgattgcggtggttaccttcctcat

SEQ ID NO: 100057 - DNA, 75 bp, Artificial Sequence
  Synthetic
gcattaatacattagccttttaatatgctactttctagatgcttatgtattaactcctacaggtgacttggggga

SEQ ID NO: 100058 - DNA, 75 bp, Artificial Sequence
  Synthetic
tgctactttctagatgcttatgtattaactcctacaggtgacttgggggatacggacggagagaactcccagccg

SEQ ID NO: 100059 - DNA, 75 bp, Artificial Sequence
  Synthetic
atcgcgcaagcgaaactagcacaggagacatcacaccaagtaagtaaatacgcatgcgcaagtaattcttttact

SEQ ID NO: 100060 - DNA, 75 bp, Artificial Sequence
  Synthetic
agacatcacaccaagtaagtaaatacgcatgcgcaagtaattcttttactttcacttcgctatttttaccaattt

SEQ ID NO: 100061 - DNA, 75 bp, Artificial Sequence
  Synthetic
gagacatcgaacgtggataatcgtccatccaagaagagacgtgtgattccagaaactccaccaaacagtccagta

SEQ ID NO: 100062 - DNA, 75 bp, Artificial Sequence
  Synthetic
catccaagaagagacgtgtgattccagaaactccaccaaacagtccagtaagtcgccaaagcctttctagctttt

SEQ ID NO: 100063 - DNA, 75 bp, Artificial Sequence
  Synthetic
gtcctgaactactccttatgcttgaaggtcaaccaggaggggcacgccttatagaacaagtcttgggcatgcacc

SEQ ID NO: 100064 - DNA, 75 bp, Artificial Sequence
  Synthetic
tagatacgtggcagtcacaacctagagacgaagatgagctccgaatctatgaagcacaggcatcgcgcatcaaag

SEQ ID NO: 100065 - DNA, 75 bp, Artificial Sequence
  Synthetic
gacatcgcaagtggactattgtccacccaagaaacgtcgtctaactgctccagcaagtcctccaaactcacctgc

SEQ ID NO: 100066 - DNA, 75 bp, Artificial Sequence
  Synthetic
cagcaagtcctccaaactcacctgcgagctctgtaagtactattactttctttaacacttggcacgcacagccac

SEQ ID NO: 100067 - DNA, 75 bp, Artificial Sequence
  Synthetic
gaagcacaggcatcgcgcatcaaagagaacgccgagtccactccggagagagagaagacaccagtgggagaacca

SEQ ID NO: 100068 - DNA, 75 bp, Artificial Sequence
  Synthetic
gtgacgaagatgagctcagggaatatgaaagacaagcatcgctcctacaaaagaaaagggagtccagaaagaggg

SEQ ID NO: 100069 - DNA, 75 bp, Artificial Sequence
  Synthetic
tgaaagacaagcatcgctcctacaaaagaaaagggagtccagaaagaggggagaggaagagacactggcagacaa

SEQ ID NO: 100070 - DNA, 75 bp, Artificial Sequence
  Synthetic
caagaagagtcgcagtcggagcccgatccgacaacatggggagaaaagcttggagtctactcctcgctacaacca

SEQ ID NO: 100071 - DNA, 75 bp, Artificial Sequence
  Synthetic
atccgacaacatggggagaaaagcttggagtctactcctcgctacaaccaggagagccgccaatcgtcttacact

SEQ ID NO: 100072 - DNA, 75 bp, Artificial Sequence
  Synthetic
ctcatcacaggagcaggagccgcagcccgatccgacacagtggggagagaggctcgggctcatatcatcaggaac

SEQ ID NO: 100073 - DNA, 75 bp, Artificial Sequence
  Synthetic
gcttcgaagacctcagaccaagcgacgaagacgaaggagaaaacatcgggggggaatagaaccaatccttatact

SEQ ID NO: 100074 - DNA, 75 bp, Artificial Sequence
  Synthetic
cgaagacgaaggagaaaacatcgggggggaatagaaccaatccttatactgtgttcagtcaacacagggctaatc

SEQ ID NO: 100075 - DNA, 75 bp, Artificial Sequence
  Synthetic
atccagatgctcctggatggtgtgggttttactggcattctactaggcttgctagagatggcactaattgtatct

SEQ ID NO: 100076 - DNA, 75 bp, Artificial Sequence
  Synthetic
gttttactggcattctactaggcttgctagagatggcactaattgtatctttaatgaaatgaaacaagaatttca

SEQ ID NO: 100077 - DNA, 75 bp, Artificial Sequence
  Synthetic
cggggaaaaaagacaatagaacaaatccatacactgtattcagtcaacacagagcttccaatcctgaagctccag

SEQ ID NO: 100078 - DNA, 75 bp, Artificial Sequence
  Synthetic
ggaattgcaaataaatgggaaaattacctgggacaatgttagagaactattgtttagccagaaaaaaaagctaga

SEQ ID NO: 100079 - DNA, 75 bp, Artificial Sequence
  Synthetic
ggtggtgtgggttctactggcactctactcgcattgctagagatggtactaattcaatctttaatgaaatgaaac

SEQ ID NO: 100080 - DNA, 75 bp, Artificial Sequence
  Synthetic
tactcgcattgctagagatggtactaattcaatctttaatgaaatgaaacaacagtttcaacagctacaaattga

SEQ ID NO: 100081 - DNA, 75 bp, Artificial Sequence
  Synthetic
aaacactagatcaaaaatacagaaatatgttctggcactttagaaataactctgattgtgaaagatgtaattact

SEQ ID NO: 100082 - DNA, 75 bp, Artificial Sequence
  Synthetic
tatgttctggcactttagaaataactctgattgtgaaagatgtaattactgggatgatgtgtaccgtagacactt

SEQ ID NO: 100083 - DNA, 75 bp, Artificial Sequence
  Synthetic
gggatgatgtgtaccgtagacacttagctaatgtttcctcacagacagaagcagacgagataactgacgaggaaa

SEQ ID NO: 100084 - DNA, 75 bp, Artificial Sequence
  Synthetic
agctaatgtttcctcacagacagaagcagacgagataactgacgaggaaatgctttctgctgctgaaagcatgga

SEQ ID NO: 100085 - DNA, 75 bp, Artificial Sequence
  Synthetic
gcagacgagataactgacgaggaaatgctttctgctgctgaaagcatggaagcagatgcctccaattaagagaca

SEQ ID NO: 100086 - DNA, 75 bp, Artificial Sequence
  Synthetic
tgaaccagttaataaagctgatcgtgctgctcaagctcatgataaatcatattctgaattaataaagagtggaaa

SEQ ID NO: 100087 - DNA, 75 bp, Artificial Sequence
  Synthetic
gcctagagggtgggtgctgcctggatacagatatcttgggccatttaatccacttgataacggtgaacctgtaaa

SEQ ID NO: 100088 - DNA, 75 bp, Artificial Sequence
  Synthetic
taacgctgatcgcgctgctcaattacatgatcacgcctactctgaactaataaagagtggtaaaaatccatacct

SEQ ID NO: 100089 - DNA, 75 bp, Artificial Sequence
  Synthetic
taaagagtggtaaaaatccatacctgtatttcaataaagctgatgaaaaattcattgatgatctaaaagacgatt

SEQ ID NO: 100090 - DNA, 75 bp, Artificial Sequence
  Synthetic
taggaaataaagagcgagctcaaaaaagacatttttactttgcaaactcaaataaaggtgctaaaaaaccaaaaa

SEQ ID NO: 100091 - DNA, 75 bp, Artificial Sequence
  Synthetic
aagacatttttactttgcaaactcaaataaaggtgctaaaaaaccaaaaaataacgagcctaaaccaggcacttc

SEQ ID NO: 100092 - DNA, 75 bp, Artificial Sequence
  Synthetic
gtggctcctgctctgggaaataaagagagagcccaaaaaagacacttttactttgctaactcaaataaaggtgca

SEQ ID NO: 100093 - DNA, 75 bp, Artificial Sequence
  Synthetic
aaaaatgtctgaaaatgaaatccaagaccagcaaccatctgactcaatggaagagcgaggaggcggaggaggtgc

SEQ ID NO: 100094 - DNA, 75 bp, Artificial Sequence
  Synthetic
aaaaaaacaaaaaaaagtgaacctaaaccaggaacctcaaaaatgtctgacactgacattcaagaccaacaacct

SEQ ID NO: 100095 - DNA, 75 bp, Artificial Sequence
  Synthetic
ggttctggtgtgggtatatccacaggtggctgggtaggaggcagctacttcactgactcatatgtcataacaaaa

SEQ ID NO: 100096 - DNA, 75 bp, Artificial Sequence
  Synthetic
ccaaatgcatctcatccatgggatgaggacgtcatgcctgatcttccatacaagacctggaaactttttcaatat

SEQ ID NO: 100097 - DNA, 75 bp, Artificial Sequence
  Synthetic
cactgactcatatgtcataacaaaaaacaccagacaatttctggtaaaaatacaaaatgaccacaaatacagaac

SEQ ID NO: 100098 - DNA, 75 bp, Artificial Sequence
  Synthetic
tggaggaggaaaaggatctggtgtggggatttccactggagggtgggtcggaggttctcacttttcagacaaata

SEQ ID NO: 100099 - DNA, 75 bp, Artificial Sequence
  Synthetic
tgaaaatattattccaagcaatgctggaggaaaatcacaaagatgcgtcagcacaccatggtcatatttcaactt

SEQ ID NO: 100100 - DNA, 75 bp, Artificial Sequence
  Synthetic
ggaggaaaatcacaaagatgcgtcagcacaccatggtcatatttcaacttcaatcaatacagcagtcatttttca

SEQ ID NO: 100101 - DNA, 75 bp, Artificial Sequence
  Synthetic
acctctacaaaacagaggccattgaaacaacaaaccaaagtggaaaatcacagcgctgcgtcacaactccatgga

SEQ ID NO: 100102 - DNA, 75 bp, Artificial Sequence
  Synthetic
aacaacaaaccaaagtggaaaatcacagcgctgcgtcacaactccatggacatactttaactttaatcaatacag

SEQ ID NO: 100103 - DNA, 75 bp, Artificial Sequence
  Synthetic
ccacaagactggcagcgcctaacaaatgaatataagcgctttaaacctagaaaaatgcatgtaaaaatttacaat

SEQ ID NO: 100104 - DNA, 75 bp, Artificial Sequence
  Synthetic
atgaatataagcgctttaaacctagaaaaatgcatgtaaaaatttacaatctacaaataaaacaaatactttcaa

SEQ ID NO: 100105 - DNA, 75 bp, Artificial Sequence
  Synthetic
ctgtcacttctcaccacaggattggcagcgccttacaaatgaatataagcgcttcagacctaaagcaatgcaagt

SEQ ID NO: 100106 - DNA, 75 bp, Artificial Sequence
  Synthetic
atggtgctgacactacatacaacaacgacctaacagctggtgttcacatcttttgtgatggtgaacacgcatatc

SEQ ID NO: 100107 - DNA, 75 bp, Artificial Sequence
  Synthetic
cgacctaacagctggtgttcacatcttttgtgatggtgaacacgcatatccaaatgcaacacatccatgggatga

SEQ ID NO: 100108 - DNA, 75 bp, Artificial Sequence
  Synthetic
ttttgtgatggtgaacacgcatatccaaatgcaacacatccatgggatgaagacgtgatgccagaacttccatat

SEQ ID NO: 100109 - DNA, 75 bp, Artificial Sequence
  Synthetic
gaaacatggtatctgtttcaatatggatacattccagttattcatgaacttgctgaaatggaagacgcaaatgct

SEQ ID NO: 100110 - DNA, 75 bp, Artificial Sequence
  Synthetic
gtagaaaaagctatagcactacaaataccattcttcatgcttgaaaacagtgaccatgaagttctaagaactgga

SEQ ID NO: 100111 - DNA, 75 bp, Artificial Sequence
  Synthetic
tgatcttccatacaagacctggaaactttttcaatatggatatattcctattgaaaatgaactcgcagatcttga

SEQ ID NO: 100112 - DNA, 75 bp, Artificial Sequence
  Synthetic
ctttttcaatatggatatattcctattgaaaatgaactcgcagatcttgatggaaatgcagctggaggcaatgct

SEQ ID NO: 100113 - DNA, 75 bp, Artificial Sequence
  Synthetic
taccattcttcatgcttgaaaacagtgaccatgaagttctaagaactggagaaagcacagaattcacttttgatt

SEQ ID NO: 100114 - DNA, 75 bp, Artificial Sequence
  Synthetic
acagaaaaagcacttctgtatcagatgcctttttttctacttgaaaacagtgaccaccaagtacttagaactggt

SEQ ID NO: 100115 - DNA, 75 bp, Artificial Sequence
  Synthetic
aagagcatacattcctcctggattaatgtttaatccaaaagttccaacaagaagagctcaatacattagacagca

SEQ ID NO: 100116 - DNA, 75 bp, Artificial Sequence
  Synthetic
cggaaacacagcatcaagcaacaccagaattcaaccatatgcaaaacctacaagctggatgacaggaccaggtct

SEQ ID NO: 100117 - DNA, 75 bp, Artificial Sequence
  Synthetic
agaattcaaccatatgcaaaacctacaagctggatgacaggaccaggtctactcagtgcacaaagagtaggacca

SEQ ID NO: 100118 - DNA, 75 bp, Artificial Sequence
  Synthetic
gaagagttcagtacataagacaaaacggaagcacagcagccagcacaggcagaattcagccatactcaaaaccaa

SEQ ID NO: 100119 - DNA, 75 bp, Artificial Sequence
  Synthetic
ggatccatttgatggatcaattgcaatggatcatcctccaggcactatttttataaaaatggcaaaaattccagt

SEQ ID NO: 100120 - DNA, 75 bp, Artificial Sequence
  Synthetic
gctggctcagacactgcatcatggatggttgttgttaatccagacggaactgccgttaactcaggaatggcagga

SEQ ID NO: 100121 - DNA, 75 bp, Artificial Sequence
  Synthetic
caagctggatgacaggacctggcctgctcagtgcacaaagagtaggaccacagtcatcagacactgctccattca

SEQ ID NO: 100122 - DNA, 75 bp, Artificial Sequence
  Synthetic
caggatctctaagaccaactgacttagaatacaaaatacaatggtaccaaactcctgcaggtaccaacagtgatg

SEQ ID NO: 100123 - DNA, 75 bp, Artificial Sequence
  Synthetic
cggaagcacagcagccagcacaggcagaattcagccatactcaaaaccaacaagctggatgacaggacctggcct

SEQ ID NO: 100124 - DNA, 75 bp, Artificial Sequence
  Synthetic
tggtttgcactaacccagaaggaacacacataaacacaggtgctgcaggatttggatctggctttgatcctccaa

SEQ ID NO: 100125 - DNA, 75 bp, Artificial Sequence
  Synthetic
actcctgcaggtaccaacagtgatggaaacataatttcaaatccaccactgtccatgcttagagatcaagctctc

SEQ ID NO: 100126 - DNA, 75 bp, Artificial Sequence
  Synthetic
tggttgttgttaatccagacggaactgccgttaactcaggaatggcaggagttggatcaggatttgatcctcctt

SEQ ID NO: 100127 - DNA, 75 bp, Artificial Sequence
  Synthetic
acaccagaaggaacaggaaataatggaaacataattgcaaacccatcactctcaatgcttagagaccaactccta

SEQ ID NO: 100128 - DNA, 75 bp, Artificial Sequence
  Synthetic
gaaacataattgcaaacccatcactctcaatgcttagagaccaactcctatacaaaggaaaccagaccacataca

SEQ ID NO: 100129 - DNA, 75 bp, Artificial Sequence
  Synthetic
ccaataaccagagaaaatccaatttggtgcaaaaagccaagatcagataaaaacacaataattgatcctttcgat

SEQ ID NO: 100130 - DNA, 75 bp, Artificial Sequence
  Synthetic
cctatcaccagagaaaatccaatctggtgcaaaaaaccaagggctgacaaacacacaatcatggatccatttgat

SEQ ID NO: 100131 - DNA, 75 bp, Artificial Sequence
  Synthetic
actgcacaggacaagtcagctgcgaaattgtctgggaagttgaaagatacgcaacaaagaactggagaccagaaa

SEQ ID NO: 100132 - DNA, 75 bp, Artificial Sequence
  Synthetic
acacacaatcatggatccatttgatggatcaattgcaatggatcatcctccaggcactatttttataaaaatggc

SEQ ID NO: 100133 - DNA, 75 bp, Artificial Sequence
  Synthetic
aaaaattccagttccaactgcctcaaatgcagactcatacctaaacatatactgtactggacaagtcagctgtga

SEQ ID NO: 100134 - DNA, 75 bp, Artificial Sequence
  Synthetic
gaagacacaccgcacttggtcttggaattggaggagaagaaaacataaatccaacttaccatgtagacaaaaatg

SEQ ID NO: 100135 - DNA, 75 bp, Artificial Sequence
  Synthetic
aattggaggagaagaaaacataaatccaacttaccatgtagacaaaaatggaaaatacattcagccaacaacatg

SEQ ID NO: 100136 - DNA, 75 bp, Artificial Sequence
  Synthetic
ggacatgtgctatcctatcaaaacaaacataaataaagtgttgtaatctcttaagcctgttcattgcttatgctt

SEQ ID NO: 100137 - DNA, 75 bp, Artificial Sequence
  Synthetic
actgggaggagagagcaactacacgcctacataccacgtggatccaacaggagcatacatccagcccacgtcata

SEQ ID NO: 100138 - DNA, 75 bp, Artificial Sequence
  Synthetic
gccggcagacatattggattccaagatggcgtctgtacaaccacgtcacatgtaaaatagtaaatattcacaagg

SEQ ID NO: 100139 - DNA, 75 bp, Artificial Sequence
  Synthetic
cctctccaatggacaagaggaaagaaaagggtgactgtaatcccgagctcatgagttcgaggctacagtccgatg

SEQ ID NO: 100140 - DNA, 75 bp, Artificial Sequence
  Synthetic
cgaacctagccgacagcccttgtacattgtggggggagctgttttgtttgcttatgcaatcgcgaaactctatat

SEQ ID NO: 100141 - DNA, 75 bp, Artificial Sequence
  Synthetic
cattgtggggggagctgttttgtttgcttatgcaatcgcgaaactctatatcttttaatgtgttgttgttgtaca

SEQ ID NO: 100142 - DNA, 75 bp, Artificial Sequence
  Synthetic
tggcgttcacatcttttgtgatggagagcatgcttacccaaatgcatctcatccatgggatgaggacgtcatgcc

SEQ ID NO: 100143 - DNA, 75 bp, Artificial Sequence
  Synthetic
aacagtttcaacagctacaaattgataataaaataggatgggataacactagagagctattgtttaatcaaaaga

SEQ ID NO: 100144 - DNA, 75 bp, Artificial Sequence
  Synthetic
agaattcagccatactcaaaaccaacaagctggatgacaggacctggcctgctcagtgcacagagagtaggacca

SEQ ID NO: 100145 - DNA, 75 bp, Artificial Sequence
  Synthetic
caacgctgcaaatctcttctggctacacgtccttttgaacctgaagaggctgacatatttcacactctaaaaaag

SEQ ID NO: 100146 - DNA, 75 bp, Artificial Sequence
  Synthetic
catataaaataataaatattcacaaggaggagtggttatatgatgtaatccataaccactcccaggaaatgacgt

SEQ ID NO: 100147 - DNA, 75 bp, Artificial Sequence
  Synthetic
attgggtggaacctgcaaagtgtatcttgggcgggacagaatgcagaattgacgtcaagcatagagacagtgtac

SEQ ID NO: 100148 - DNA, 75 bp, Artificial Sequence
  Synthetic
tgcctcaacaggtaaaacaaatatggccaaggcaatcgtccaagggattagactttatgggtgtgttaatcattt

SEQ ID NO: 100149 - DNA, 75 bp, Artificial Sequence
  Synthetic
atacgcatgcgcaagtaattcttttactttcacttcgctatttttaccaatttttacttttaggtgacttggggg

SEQ ID NO: 100150 - DNA, 75 bp, Artificial Sequence
  Synthetic
tttaactcaaacacctgtaattatatccactaaccacgatatctacgtggttgttggtggcaattctgtttccca

SEQ ID NO: 100151 - DNA, 75 bp, Artificial Sequence
  Synthetic
tgttcacgcggctccattaaaagaaagagtgattcagctaaattttatgaaacaacttcctcaaacatttggaga

SEQ ID NO: 100152 - DNA, 75 bp, Artificial Sequence
  Synthetic
cttttaactttgactgtgaatgggttaataatgaaagagcatacattcctcctggattgatgttcaatccaaaag

SEQ ID NO: 100153 - DNA, 75 bp, Artificial Sequence
  Synthetic
ggtgagagcactgaatttacttttaactttgactgtgaatgggttaacaatgaaagagcatacattcctcctgga

SEQ ID NO: 100154 - DNA, 75 bp, Artificial Sequence
  Synthetic
aacaaatactttcaaatggtgctgacacaacatacaacaatgacctcacagctggcgttcacatcttttgtgatg

SEQ ID NO: 100155 - DNA, 75 bp, Artificial Sequence
  Synthetic
tggacaagcggaaagtgaagggtgactgtagtcctgagctcatgggttcaagaccacagcccgatggtagtggtg

SEQ ID NO: 100156 - DNA, 75 bp, Artificial Sequence
  Synthetic
gccggcagacatattggattccaagatggcgcatgtgcaaccacgtcacatataaaataataaatattcacaagg

SEQ ID NO: 100157 - DNA, 75 bp, Artificial Sequence
  Synthetic
gcttcttcaaaaactaccttttacctaaaaatagatgtatttcatcttacagcaaacctgatgtttgtacttctc

SEQ ID NO: 100158 - DNA, 75 bp, Artificial Sequence
  Synthetic
ataaatattcacaaggaggagtggctacgtatggggtgatcataaacacgcccaggaagtgacatatgtcaacca

SEQ ID NO: 100159 - DNA, 75 bp, Artificial Sequence
  Synthetic
tacgtatggggtgatcataaacacgcccaggaagtgacatatgtcaaccaatcagcatcgagcatatatcctata

SEQ ID NO: 100160 - DNA, 75 bp, Artificial Sequence
  Synthetic
gtgaacatctctgggaagagctccacgcacgtggtgagtgacactatggccttttctgctcctgtacttagagct

SEQ ID NO: 100161 - DNA, 75 bp, Artificial Sequence
  Synthetic
ttttctcaacctactttcacctatgttgttaaatttccatataataactggaaagaagatgaacctttactatgg

SEQ ID NO: 100162 - DNA, 75 bp, Artificial Sequence
  Synthetic
ttgttaaatttccatataataactggaaagaagatgaacctttactatggagcttacttgctcctgggactgaaa

SEQ ID NO: 100163 - DNA, 75 bp, Artificial Sequence
  Synthetic
gtctcatgattcaactaaaaaactgcgcaccacatcctgaagatgatcctgtcagggaagatattttatgctcac

SEQ ID NO: 100164 - DNA, 75 bp, Artificial Sequence
  Synthetic
cgcaccacatcctgaagatgatcctgtcagggaagatattttatgctcactagcagatctacactatggtgctgt

SEQ ID NO: 100165 - DNA, 75 bp, Artificial Sequence
  Synthetic
ttttgccaaagcttgctacatagctacatctacactaatggggcagaaacaaagaacactctttccacgctgcga

SEQ ID NO: 100166 - DNA, 75 bp, Artificial Sequence
  Synthetic
aaagaacactctttccacgctgcgacattgttcgccatcctgaaattggctctgtttttgtacactgtcacatac

SEQ ID NO: 100167 - DNA, 75 bp, Artificial Sequence
  Synthetic
ttgttggaggagccggtcttagcaaaagaaatgctaaaatttcacgcgctacacttttgggtcttgtgatggctg

SEQ ID NO: 100168 - DNA, 75 bp, Artificial Sequence
  Synthetic
aagaaatgctaaaatttcacgcgctacacttttgggtcttgtgatggctgaactaacacaacgctgcaagctact

SEQ ID NO: 100169 - DNA, 75 bp, Artificial Sequence
  Synthetic
tcttgcacatcgtccatttgaaccagctgaagctactatctatcatgaacttaaacgcattgaacgcgaagcatg

SEQ ID NO: 100170 - DNA, 75 bp, Artificial Sequence
  Synthetic
gctgaagctactatctatcatgaacttaaacgcattgaacgcgaagcatggtcagggcatactggtaactgggtt

SEQ ID NO: 100171 - DNA, 75 bp, Artificial Sequence
  Synthetic
caaattcttcaatacaaagataaacgaggtgaacttcacgctcaaccaattgatcctttacgctttctaaaacat

SEQ ID NO: 100172 - DNA, 75 bp, Artificial Sequence
  Synthetic
attctagctgacaaaacatactctcacactattattaatgggcttccgctgctagaacgtaacagaaaagcctat

SEQ ID NO: 100173 - DNA, 75 bp, Artificial Sequence
  Synthetic
cttcctgaggtaggagaacaacgcttaattacttctaatacttctactgcctataaagctaacaaaaaagaaaaa

SEQ ID NO: 100174 - DNA, 75 bp, Artificial Sequence
  Synthetic
tcctcatagtgctgacaattctatgtacactgatcgcgcaagcgaaactagcacaggagacatcacaccaagtaa

SEQ ID NO: 100175 - DNA, 75 bp, Artificial Sequence
  Synthetic
ggggattcggacggagaagacaccgagcctgagacatcgcaagtggactattgtccacccaagaaacgtcgtcta

SEQ ID NO: 100176 - DNA, 75 bp, Artificial Sequence
  Synthetic
aaccgggtggagcacgactaattgaacaggtgcttggcatgcaccatattaaagtttgtgctaaacatactgcct

SEQ ID NO: 100177 - DNA, 75 bp, Artificial Sequence
  Synthetic
tcattgatgatctaaaagacgattggtcaattggtggaattattggatcagtttttttaaaataaagcgcgccgt

SEQ ID NO: 100178 - DNA, 75 bp, Artificial Sequence
  Synthetic
aaagcactaaaactattgttgattcaagggtacaacccattacaagtaggacatgccatctgttgcgtacttaac

SEQ ID NO: 100179 - DNA, 75 bp, Artificial Sequence
  Synthetic
aaacagatgggcaagcagaacactatctgcttttatggtcctgcttcaacaggcaaaacaaactttgcaaaggcc

SEQ ID NO: 100180 - DNA, 75 bp, Artificial Sequence
  Synthetic
tctgcttttatggtcctgcttcaacaggcaaaacaaactttgcaaaggccatagttcagggcgttcgcctttatg

SEQ ID NO: 100181 - DNA, 75 bp, Artificial Sequence
  Synthetic
gctgtgttaatcatttaaacaaaggatttgtatttaacgattgcagacaacgccttataatttggtgggaagaat

SEQ ID NO: 100182 - DNA, 75 bp, Artificial Sequence
  Synthetic
aacaccagtaattatttccactaaccatgacatctactctgtagttggtggcaatactgtttctcatgttcatgc

SEQ ID NO: 100183 - DNA, 75 bp, Artificial Sequence
  Synthetic
cagttaaattttatgaaacaactaccacaaacatttggagaaatatctccagctgaaattgcagaacttttgcaa

SEQ ID NO: 100184 - DNA, 75 bp, Artificial Sequence
  Synthetic
cacaaacatttggagaaatatctccagctgaaattgcagaacttttgcaatggtgctttaatgagtacgactgta

SEQ ID NO: 100185 - DNA, 75 bp, Artificial Sequence
  Synthetic
ctcttgctggctttaaacaaaaatggaacttagacaaagttccaaactcatttcctattggagacctttgtccta

SEQ ID NO: 100186 - DNA, 75 bp, Artificial Sequence
  Synthetic
tcttagttatatatcatcgggcgctgagccggcggacatattggattccaagatggcgtcagtgctacaacgtca

SEQ ID NO: 100187 - DNA, 75 bp, Artificial Sequence
  Synthetic
atgtgttgttgttgtacctgcgccatcttagttatatatcatcgggcgctgagccggcggacatattggattcca

SEQ ID NO: 100188 - DNA, 75 bp, Artificial Sequence
  Synthetic
gaacttagacaaagttccaaactcatttcctattggagacctttgtcctacacattcacaggacttcacgcttca

SEQ ID NO: 100189 - DNA, 75 bp, Artificial Sequence
  Synthetic
cgaaaacggattctgctctgactgtggcggctatcttcctcatagtgctgacgactctgtttacactgacgtggc

SEQ ID NO: 100190 - DNA, 75 bp, Artificial Sequence
  Synthetic
ggcggctatcttcctcatagtgctgacgactctgtttacactgacgtggctagtgaaacaacaagcggtgactgc

SEQ ID NO: 100191 - DNA, 75 bp, Artificial Sequence
  Synthetic
tttaatccacttgataacggtgaacctgtaaataacgctgatcgcgctgctcaattacatgatcacgcctactct

SEQ ID NO: 100192 - DNA, 75 bp, Artificial Sequence
  Synthetic
gacccaggtaggctttaatacattagctttactatctattactattgacatttgcttatgtattaactcctacag

SEQ ID NO: 100193 - DNA, 75 bp, Artificial Sequence
  Synthetic
gctttactatctattactattgacatttgcttatgtattaactcctacaggtaacctgggggatacggacggaaa

SEQ ID NO: 100194 - DNA, 75 bp, Artificial Sequence
  Synthetic
ggactccaagtcagaagcatcggaagtggattatcgtccacccaagaaaaggcgtgtgatttcagcaactccacc

SEQ ID NO: 100195 - DNA, 75 bp, Artificial Sequence
  Synthetic
tgaaaaattcattgatgatctaaaagacgattggtcaattggtggaattattggatccagtttttttaaaataaa

SEQ ID NO: 100196 - DNA, 75 bp, Artificial Sequence
  Synthetic
gtggattatcgtccacccaagaaaaggcgtgtgatttcagcaactccaccaaacagtccagtaagtggtccaagc

SEQ ID NO: 100197 - DNA, 75 bp, Artificial Sequence
  Synthetic
ttttctgcctttttagatacttggcaatcacaacctagagacgaagatgagctcagaatctacgaagaacaggca

SEQ ID NO: 100198 - DNA, 75 bp, Artificial Sequence
  Synthetic
aatcacaacctagagacgaagatgagctcagaatctacgaagaacaggcatcgcagttccaagagaacaccgagt

SEQ ID NO: 100199 - DNA, 75 bp, Artificial Sequence
  Synthetic
ccacttcagaaagagagaaggcgcaactgggagaatcgcaagagccgcagccggagcccaatccgacggcatggg

SEQ ID NO: 100200 - DNA, 75 bp, Artificial Sequence
  Synthetic
actgggagaatcgcaagagccgcagccggagcccaatccgacggcatggggagaaaaacttggagtatgctcatc

SEQ ID NO: 100201 - DNA, 75 bp, Artificial Sequence
  Synthetic
acaacaaccaggacaaccgccaatcgtcctatactgcttcgaagacctcagaccaagcgatgaagacgaaggaga

SEQ ID NO: 100202 - DNA, 75 bp, Artificial Sequence
  Synthetic
gtcctatactgcttcgaagacctcagaccaagcgatgaagacgaaggagaaaacatcggggggaactagaacaaa

SEQ ID NO: 100203 - DNA, 75 bp, Artificial Sequence
  Synthetic
tacaaagggaaccaaaccacatacaatctagtgggggacatatggatgtttccaaatcaagtctgggacagatat

SEQ ID NO: 100204 - DNA, 75 bp, Artificial Sequence
  Synthetic
tccttatactgtattcagtcaacacagggctaatcattcaaatgctcctggctggtgtgggttttattggcattc

SEQ ID NO: 100205 - DNA, 75 bp, Artificial Sequence
  Synthetic
agggctaatcattcaaatgctcctggctggtgtgggttttattggcattcaactaggcttgctagaaatggcact

SEQ ID NO: 100206 - DNA, 75 bp, Artificial Sequence
  Synthetic
aatagtatttttaatgaaatgaaacaaaaatttcaagaactgcaaatagatgggaaaatcaattgggatactact

SEQ ID NO: 100207 - DNA, 75 bp, Artificial Sequence
  Synthetic
aaaaatttcaagaactgcaaatagatgggaaaatcaattgggatactactagagaactattgtttactcagaaaa

SEQ ID NO: 100208 - DNA, 75 bp, Artificial Sequence
  Synthetic
acacacagtcatggatccatttgatggatccattgcaatggatcatcctccaggcactatctttataaaaatggc

SEQ ID NO: 100209 - DNA, 75 bp, Artificial Sequence
  Synthetic
tgcaagtaaagatttacaacttgcaaataaaacaaatactttcaaatggtgctgacacaacatacaacaatgacc

SEQ ID NO: 100210 - DNA, 75 bp, Artificial Sequence
  Synthetic
aaacattagatcaaagctacagaaacatgttgtaccactttagacacagtcctgattgctctagatgtgaatatt

SEQ ID NO: 100211 - DNA, 75 bp, Artificial Sequence
  Synthetic
catgttgtaccactttagacacagtcctgattgctctagatgtgaatattgggatgatgtttaccgtaaacactt

SEQ ID NO: 100212 - DNA, 75 bp, Artificial Sequence
  Synthetic
aataaaacaaatactttcaaatggtgctgacacaacatacaacaatgacctcacagctggcgttcacatcttttg

SEQ ID NO: 100213 - DNA, 75 bp, Artificial Sequence
  Synthetic
tggagggtgggtgcttcctggttataaataccttggtccatttaatcctcttgaaaacggtgaaccagttaataa

SEQ ID NO: 100214 - DNA, 75 bp, Artificial Sequence
  Synthetic
ttgaaaacggtgaaccagttaataaagctgatcgtgctgctcaaatccatgataaatcatattctgaactaataa

SEQ ID NO: 100215 - DNA, 75 bp, Artificial Sequence
  Synthetic
caggcacttcaaaaatgtctgaaaatgaaattcaagaccaacaaccatcaggctcagcagatgaacaacgagggg

SEQ ID NO: 100216 - DNA, 75 bp, Artificial Sequence
  Synthetic
gggaggggggaaaggttctggtgtgggtatatccacgggcggttgggtaggaggtagctactttactgactcata

SEQ ID NO: 100217 - DNA, 75 bp, Artificial Sequence
  Synthetic
tgttataaccaaaaacaccagacaatttctagttaaaatacaaaacaaccatcaatataaaacagaattaatatc

SEQ ID NO: 100218 - DNA, 75 bp, Artificial Sequence
  Synthetic
caacgatgtgtcagcacaccttggtcttactttaacttcaatcaatacagcagtcatttttcaccacaagactgg

SEQ ID NO: 100219 - DNA, 75 bp, Artificial Sequence
  Synthetic
tgacgtcaaacacagagatagtgtattattgacacaaactccagtaattatttccactaaccacgatatctacgc

SEQ ID NO: 100220 - DNA, 75 bp, Artificial Sequence
  Synthetic
ctacatacaacaacgacctaacagctggtgttcacatcttttgtgatggcgaacacgcatatccaaatgcaacac

SEQ ID NO: 100221 - DNA, 75 bp, Artificial Sequence
  Synthetic
gctgtgaaattgtatgggaggtagaaagatacgcaacaaagaactggcgtccagaaagaagacatactgcactcg

SEQ ID NO: 100222 - DNA, 75 bp, Artificial Sequence
  Synthetic
aagatacgcaacaaagaactggcgtccagaaagaagacatactgcactcgggatgtcactgggaggagagagcaa

SEQ ID NO: 100223 - DNA, 75 bp, Artificial Sequence
  Synthetic
agagctaccataccaaacatggtatttgtttcaatacggatacattccagttatacatgaacttgctgaaatgga

SEQ ID NO: 100224 - DNA, 75 bp, Artificial Sequence
  Synthetic
ccaggcactatttttataaaagtggcaaaaatcccagttccaactgcctcaaatgcagactcatacctaaacata

SEQ ID NO: 100225 - DNA, 75 bp, Artificial Sequence
  Synthetic
ggatgtcactgggaggagagagcaactacacgcctacataccacgtggatccaacaggagcatacatccagccca

SEQ ID NO: 100226 - DNA, 75 bp, Artificial Sequence
  Synthetic
gaacacgcatatccaaatgcaacacatccttgggatgaagacgtaatgccagagctaccataccaaacatggtat

SEQ ID NO: 100227 - DNA, 75 bp, Artificial Sequence
  Synthetic
atttgcttacaaataccattttttatgcttgaaaacagcgaccacgaagttttaagaacaggtgaaagcacagaa

SEQ ID NO: 100228 - DNA, 75 bp, Artificial Sequence
  Synthetic
ttgtttcaatacggatacattccagttatacatgaacttgctgaaatggaagacaataatgctgtagaaaaagca

SEQ ID NO: 100229 - DNA, 75 bp, Artificial Sequence
  Synthetic
tttaagaacaggtgaaagcacagaatttactttcaacttcgactgtgaatggataaacaatgaaagagcatacat

SEQ ID NO: 100230 - DNA, 75 bp, Artificial Sequence
  Synthetic
tcctccaggcttaatgtttaatccactagtacctactagaagagcacaatacataagaagaaacaacaatcctca

SEQ ID NO: 100231 - DNA, 75 bp, Artificial Sequence
  Synthetic
ctagtacctactagaagagcacaatacataagaagaaacaacaatcctcaaactgctgaaagcacatccagaatt

SEQ ID NO: 100232 - DNA, 75 bp, Artificial Sequence
  Synthetic
gctccatacgcaaaaccaacaagctggatgactggaccaggtttacttagtgcacaaagagtaggcccagctact

SEQ ID NO: 100233 - DNA, 75 bp, Artificial Sequence
  Synthetic
ggatgactggaccaggtttacttagtgcacaaagagtaggcccagctacttcagacacaggatcatggatggttg

SEQ ID NO: 100234 - DNA, 75 bp, Artificial Sequence
  Synthetic
cagttagaccagaaaacgcaagcattgacacaggaatgtctggaattggaagcggatttgatccaccacaaggtt

SEQ ID NO: 100235 - DNA, 75 bp, Artificial Sequence
  Synthetic
tgacacaggaatgtctggaattggaagcggatttgatccaccacaaggttcactagcaccaacaaaccaagaata

SEQ ID NO: 100236 - DNA, 75 bp, Artificial Sequence
  Synthetic
caaaattcaatggtaccaaacaccacaaggaacaaacaacactggaaacatcatttcaaatcaaccattatcaat

SEQ ID NO: 100237 - DNA, 75 bp, Artificial Sequence
  Synthetic
gctaagagatcaagccttatatagaggcaatcaaacaacctataagctatgctcagatgtatggatgtttccaaa

SEQ ID NO: 100238 - DNA, 75 bp, Artificial Sequence
  Synthetic
tcaaatttgggacagatacccaataaccagagaaaatccaatatggtgtaaaaaacccagatcagacaaacatac

SEQ ID NO: 100239 - DNA, 75 bp, Artificial Sequence
  Synthetic
accagagaaaatccaatatggtgtaaaaaacccagatcagacaaacatacaacaattgatccttttgatggatcc

SEQ ID NO: 100240 - DNA, 75 bp, Artificial Sequence
  Synthetic
acacaacatttggtcttggaattggaggagctgacaacttaaatccaacctaccatgttgacaaaaacggagttt

SEQ ID NO: 100241 - DNA, 75 bp, Artificial Sequence
  Synthetic
gtgctttccagttaaaacaaacatcaataaagtgttgtaatttcttaagcctctttattgcttacgcttataagt

SEQ ID NO: 100242 - DNA, 75 bp, Artificial Sequence
  Synthetic
aacagatgcctccaattaaaaggcaacctggagggtgggtgcttcctggttacaaataccttggtccatttaatc

SEQ ID NO: 100243 - DNA, 75 bp, Artificial Sequence
  Synthetic
tcccccccaatggacaagtggaaaacccagggtgactgtaatcccgagctcatgagttcgaggataggggccgat

SEQ ID NO: 100244 - DNA, 75 bp, Artificial Sequence
  Synthetic
ctcagggggaggaacaggaagtattggaggaggaaaaggatctggtgtggggatttccactggagggtgggtcgg

SEQ ID NO: 100245 - DNA, 75 bp, Artificial Sequence
  Synthetic
tagccgttacacccttgtgcattgtgggaggagctgttttgcttacgcaaccgcgaaattttatatatttagtgt

SEQ ID NO: 100246 - DNA, 75 bp, Artificial Sequence
  Synthetic
taaaaagtggaaaaaatccttacttatatttcaataaagctgatgaaaaattcattgacgatttgaaaaacgact

SEQ ID NO: 100247 - DNA, 75 bp, Artificial Sequence
  Synthetic
agtgttgtactacgtcggccatcttagttatatatcaggcgccgccttagttacgtcacgataaaatgttatata

SEQ ID NO: 100248 - DNA, 75 bp, Artificial Sequence
  Synthetic
aaaatgttatataactaaggcggcgcatgatatataactaagatggccgacgtagtacgacactacactaaatat

SEQ ID NO: 100249 - DNA, 75 bp, Artificial Sequence
  Synthetic
gtgcaaaaaaccaagggctgacaaacacacaatcatggatccatttgatggatccattgcaatggatcatcctcc

SEQ ID NO: 100250 - DNA, 75 bp, Artificial Sequence
  Synthetic
gaaagtgaagggtgactgtagtcctgagctcatgggttcaagaccacagcccgatggtagtggtgttaccgtctc

SEQ ID NO: 100251 - DNA, 75 bp, Artificial Sequence
  Synthetic
agggtgactgtaatcccgagctcatgagttcgaggctacagtccgatggcagtggtgttgccgtctcgaacctag

SEQ ID NO: 100252 - DNA, 75 bp, Artificial Sequence
  Synthetic
agtggtgttgccgtctcgaacctagccgttacacccttgtgcattgtgggaggagctgttttgcttacgcaaccg

SEQ ID NO: 100253 - DNA, 75 bp, Artificial Sequence
  Synthetic
acctagccgttacacccttgtgcattgtgggaggagctgttttgcttacgcaaccgcgaaactctatatctttta

SEQ ID NO: 100254 - DNA, 75 bp, Artificial Sequence
  Synthetic
caaggaggagtggctacgtatggggtgatcataaacacgcccaggaagtgacgtatgtcaaccaatcagcatcga

SEQ ID NO: 100255 - DNA, 75 bp, Artificial Sequence
  Synthetic
caggcactatttttataaaaatggcaaaaattccagtaccaactgcaacaaatgcagactcatatctaaacatat

SEQ ID NO: 100256 - DNA, 75 bp, Artificial Sequence
  Synthetic
aatgcagactcatatctaaacatatactgtactggacaagtcagctgtgagattgtatgggaagtagaaagatac

SEQ ID NO: 100257 - DNA, 75 bp, Artificial Sequence
  Synthetic
actgtactggacaagtcagctgtgagattgtatgggaagtagaaagatacgcaacaaagaactggcgtccagaaa

SEQ ID NO: 100258 - DNA, 75 bp, Artificial Sequence
  Synthetic
ttgactgtgagtggatcaacaacgaaagagcatacattcctcctggattaatgtttaatccaaaagttcctacaa

SEQ ID NO: 100259 - DNA, 75 bp, Artificial Sequence
  Synthetic
tacagaggaaatcaaacaacctataacctatgctcagatgtatggatgttcccaaatcaaatttgggacagatat

SEQ ID NO: 100260 - DNA, 75 bp, Artificial Sequence
  Synthetic
tacattgtggggggagctgttttgtttgcttatgcaatcgcgaaactctatatcttttaatgttgttgttgtaca

SEQ ID NO: 100261 - DNA, 75 bp, Artificial Sequence
  Synthetic
ttgactgtgaatgggttaacaatgaaagagcatacattcctcctggactaatgtttaatccaaaagttccaacaa

SEQ ID NO: 100262 - DNA, 75 bp, Artificial Sequence
  Synthetic
ggattccaagatggcgtctgtacaaccacgtcacatataaaataataaatattcacaaggaggagtggttatatg

SEQ ID NO: 100263 - DNA, 75 bp, Artificial Sequence
  Synthetic
ccacgtcacatataaaataataaatattcacaaggaggagtggttatatgatgtaatccataaccactcccagga

SEQ ID NO: 100264 - DNA, 75 bp, Artificial Sequence
  Synthetic
aagtactattactttctttaacacttggcacgcacagccacgtgacgaagatgagctcagggaatatgaaagaca

SEQ ID NO: 100265 - DNA, 75 bp, Artificial Sequence
  Synthetic
gacgcaccacaaaacacctcagggggaggaacaggaagtattggaggaggaaaaggatctggtgtggggatttcc

SEQ ID NO: 100266 - DNA, 75 bp, Artificial Sequence
  Synthetic
gtttctcatgttcacgcggctccattaaaagaaagagtgattcagctaaattttatgaaacaacttcctcaaaca

SEQ ID NO: 100267 - DNA, 75 bp, Artificial Sequence
  Synthetic
tggagtgcgcatgtcaccaatcagcatcgagcatatatcctatataagccgatgcacttccgcatctcgtcagac

SEQ ID NO: 100268 - DNA, 75 bp, Artificial Sequence
  Synthetic
tggtgagtgacactatggccttttctgctcctgtaattagagctttttctcaacctgcttttacttatgttgtta

SEQ ID NO: 100269 - DNA, 75 bp, Artificial Sequence
  Synthetic
gggtgggtcggaggttctcacttttcagacaaatatgtggttactaaaaacacaagacaatttataaccacaatt

SEQ ID NO: 100270 - DNA, 75 bp, Artificial Sequence
  Synthetic
ggccttctaccatggcctttgggggacgtggtgcgtgggaacatctgcctgaggtaggagaacaacgcctaataa

SEQ ID NO: 100271 - DNA, 75 bp, Artificial Sequence
  Synthetic
cttagttagtgcttgtcctgaccttttacttatgcttgaaggtcagccaggtggtgcacgcctaattgaacaggt

SEQ ID NO: 100272 - DNA, 75 bp, Artificial Sequence
  Synthetic
gtggtgcacgcctaattgaacaggtgcttggcatgcatcatattaaagtgtgtgctaattacacagcgttatctt

SEQ ID NO: 100273 - DNA, 75 bp, Artificial Sequence
  Synthetic
ctaaaactattgttgattcaagggtacaacccattgcaagtgggccacgccatctgttgtgtccttaacaaacag

SEQ ID NO: 100274 - DNA, 75 bp, Artificial Sequence
  Synthetic
atgggcaagcagaacacaatttgcttttatggccctgcttcaacaggcaaaacaaatattgcaaaggccatagtt

SEQ ID NO: 100275 - DNA, 75 bp, Artificial Sequence
  Synthetic
tttatggccctgcttcaacaggcaaaacaaatattgcaaaggccatagttcaaggcgttcgtctatatggctgtg

SEQ ID NO: 100276 - DNA, 75 bp, Artificial Sequence
  Synthetic
ttaatcatttaaacaaagggtttgtctttaacgattgcagacaacgccttataatttggtgggaggagtgtttaa

SEQ ID NO: 100277 - DNA, 75 bp, Artificial Sequence
  Synthetic
ctttaacgattgcagacaacgccttataatttggtgggaggagtgtttaatgcaccaagactgggtggaacctgc

SEQ ID NO: 100278 - DNA, 75 bp, Artificial Sequence
  Synthetic
caactaacctagaatacaaacttcagtggtaccagacaccagaaggaacaggaaataatggaaacataattgcaa

SEQ ID NO: 100279 - DNA, 75 bp, Artificial Sequence
  Synthetic
cttaaaagagcgaatccttcagctaaattttatgaaacaactgccacaaacatttggagaaatttctccagttga

SEQ ID NO: 100280 - DNA, 75 bp, Artificial Sequence
  Synthetic
aattttatgaaacaactgccacaaacatttggagaaatttctccagttgaaattgcagaattactgcaatggtgc

SEQ ID NO: 100281 - DNA, 75 bp, Artificial Sequence
  Synthetic
tttaatgagtacgactgtactcttactggctttaaacaaaaatggaacttagataaagttccaaactcatttcct

SEQ ID NO: 100282 - DNA, 75 bp, Artificial Sequence
  Synthetic
tatggatgtttccaaatcaagtctgggacagatttcctatcaccagagaaaatccaatctggtgcaaaaaaccaa

SEQ ID NO: 100283 - DNA, 75 bp, Artificial Sequence
  Synthetic
ggtaggcattaatacattagccttttaatatgctactttctagatgcttatgtattaactcctacaggtgacttg

SEQ ID NO: 100284 - DNA, 75 bp, Artificial Sequence
  Synthetic
tgtaccatttcagacataatgctgattgtcctagatgtgattattgggatgatgtctaccgtaaacacttagctc

SEQ ID NO: 100285 - DNA, 75 bp, Artificial Sequence
  Synthetic
tgatcagtgtatgccagtaaaaacaaacatcaataaagtgttgtaatctcataagcctcttttttgcttctgctt

SEQ ID NO: 100286 - DNA, 75 bp, Artificial Sequence
  Synthetic
aacggtgaaccagttaataaagctgatcgtgctgctcaagctcatgataaatcatattctgaattaataaaaagt

SEQ ID NO: 100287 - DNA, 75 bp, Artificial Sequence
  Synthetic
tgaacctgaagaggctgacatatttcacactttaaaaaaggctgagcgagaggcatggggtggagttactggcgg

SEQ ID NO: 100288 - DNA, 75 bp, Artificial Sequence
  Synthetic
ataaagctgatgaaaaattcattaacgatttgaaaaacgactggtctcttggtggcattattggctcaagtttct

SEQ ID NO: 100289 - DNA, 75 bp, Artificial Sequence
  Synthetic
actgtactggacaagtcagctgtgaaattgtatgggaagtagaaagatacgcaacaaagaactggcgtccagaaa

SEQ ID NO: 100290 - DNA, 75 bp, Artificial Sequence
  Synthetic
acttcaaaaatgtctgaaaatgaaatccaagaccaacaaccatctggctcgatggacgaacagcgaggaggcgga

SEQ ID NO: 100291 - DNA, 75 bp, Artificial Sequence
  Synthetic
tccaagaccaacaaccatctggctcgatggacgaacagcgaggaggcggagggggcgccgttggcagtgtgggag

SEQ ID NO: 100292 - DNA, 75 bp, Artificial Sequence
  Synthetic
gggggaaaggttctggtgtgggtatatccacaggtggctgggtaggaggcagctatttcactgactcatatgtca

SEQ ID NO: 100293 - DNA, 75 bp, Artificial Sequence
  Synthetic
agctatttcactgactcatatgtcataacaaaaaacaccagacaatttctagtaaaaatacaaaatgatcataaa

SEQ ID NO: 100294 - DNA, 75 bp, Artificial Sequence
  Synthetic
cctaacaaatgaatacaagcgcttcaagcctagaaaaatgcatgtaaaaatctacaacctacaaataaaacaaat

SEQ ID NO: 100295 - DNA, 75 bp, Artificial Sequence
  Synthetic
cgcatatccaaatgcaacacatccatgggacgaagacatcatgccagaacttccatatgaaacatggtatttgtt

SEQ ID NO: 100296 - DNA, 75 bp, Artificial Sequence
  Synthetic
tcaatatggatacattccagttattcatgaactggcagaaatggaagacgcaaatgctgtagaaaaagcaatagc

SEQ ID NO: 100297 - DNA, 75 bp, Artificial Sequence
  Synthetic
actgcaaataccattcttcatgcttgaaaacagtgaccacgaagtgttaagaactggagaaagcacagaattcac

SEQ ID NO: 100298 - DNA, 75 bp, Artificial Sequence
  Synthetic
aacaacgaaagagcatacattcctcctggattaatgtttaatccaaaagttcctacaagaagagctcaatacata

SEQ ID NO: 100299 - DNA, 75 bp, Artificial Sequence
  Synthetic
ctggattaatgtttaatccaaaagttcctacaagaagagctcaatacataagacaacacggaagcacagcatcaa

SEQ ID NO: 100300 - DNA, 75 bp, Artificial Sequence
  Synthetic
ttgagtattaaacctatataagctgctgcacttcctgatttaatcagactgcatccggtctccggcgagtgaaca

SEQ ID NO: 100301 - DNA, 75 bp, Artificial Sequence
  Synthetic
ctgcacttcctgatttaatcagactgcatccggtctccggcgagtgaacatctctggaaaaagctccacgcttgt

SEQ ID NO: 100302 - DNA, 75 bp, Artificial Sequence
  Synthetic
gcaacaccagaattccaccatacgcaaaacctacaagctggatgacaggaccaggtctactcagtgcacaaagag

SEQ ID NO: 100303 - DNA, 75 bp, Artificial Sequence
  Synthetic
aaaacctacaagctggatgacaggaccaggtctactcagtgcacaaagagtaggaccagctgcttcagactcagc

SEQ ID NO: 100304 - DNA, 75 bp, Artificial Sequence
  Synthetic
agcatggatggttgttgtaaatccagacggagctgctattaattcaggaatggctggaattggtacaggctttga

SEQ ID NO: 100305 - DNA, 75 bp, Artificial Sequence
  Synthetic
gacggagctgctattaattcaggaatggctggaattggtacaggctttgatcctcctggtggatctttaagacca

SEQ ID NO: 100306 - DNA, 75 bp, Artificial Sequence
  Synthetic
actgatttagaatataaaatacaatggtaccaaactcctgcaggtacaaacagtgatggaaacataatttcaaat

SEQ ID NO: 100307 - DNA, 75 bp, Artificial Sequence
  Synthetic
ggtaccaaactcctgcaggtacaaacagtgatggaaacataatttcaaatccaccactatccatgctcagagacc

SEQ ID NO: 100308 - DNA, 75 bp, Artificial Sequence
  Synthetic
ccgagcctgagacatcgcaagtggactattgtccacccaagaaacgtcgtttaactgctccagcaactcctccaa

SEQ ID NO: 100309 - DNA, 75 bp, Artificial Sequence
  Synthetic
tccaatctggtgcaaaaaaccaagatcagataaaagcacaataattgatccttttgatggatcaatcgcaatgga

SEQ ID NO: 100310 - DNA, 75 bp, Artificial Sequence
  Synthetic
tacaaattgataataaaataggatgggataacactagagaactattgtttaatcaaaagaaaacactagatcaaa

SEQ ID NO: 100311 - DNA, 75 bp, Artificial Sequence
  Synthetic
tcatcctcctggaacaatcttcataaaaatggcaaaaattccagttccttcaaacaacaacgcagactcatacct

SEQ ID NO: 100312 - DNA, 75 bp, Artificial Sequence
  Synthetic
ggtcttggaattggaggagaagaaaacataaatccaacctatcatgtagacaaaaatggaaaatacattcaacca

SEQ ID NO: 100313 - DNA, 75 bp, Artificial Sequence
  Synthetic
ggacaagaggaaagaaaagggtgactgtaatcccgagctcattagttcgaggctatagtccgatggcagtggtgt

SEQ ID NO: 100314 - DNA, 75 bp, Artificial Sequence
  Synthetic
tgtaatcccgagctcattagttcgaggctatagtccgatggcagtggtgttgccgtctcgaacctagccgttact

SEQ ID NO: 100315 - DNA, 75 bp, Artificial Sequence
  Synthetic
gaaggtcaaccaggaggggcacgccttatagaacaagtcgtgggcatgcaccctattaatgtttgttctaacttt

SEQ ID NO: 100316 - DNA, 75 bp, Artificial Sequence
  Synthetic
actgctctcacatatctttttcatcgacatcctgttacttcgcttgcctcatacaataaagctttacagcttttg

SEQ ID NO: 100317 - DNA, 75 bp, Artificial Sequence
  Synthetic
ctttatgggtgtgttaatcatttgaacaaaggatttgtatttaatgactgcagacaacgcctacttgtttggtgg

SEQ ID NO: 100318 - DNA, 75 bp, Artificial Sequence
  Synthetic
ttgccggcagacatattggattccaagatggcgtctgtacaaccacgtcacatataaaataataaatattcacaa

SEQ ID NO: 100319 - DNA, 75 bp, Artificial Sequence
  Synthetic
acctaaaccaggaacctcaaaaatgtctgacactgacattcaagaccaacaacctgatactgtggacgcaccaca

SEQ ID NO: 100320 - DNA, 75 bp, Artificial Sequence
  Synthetic
atccttcaatatagagatcgcagaggagaccttcatgcacaaacagtggatcctcttcgcttcttcaaaaactac

SEQ ID NO: 100321 - DNA, 75 bp, Artificial Sequence
  Synthetic
aaacaaacatcaataaagtgttgtaatcttataagcctcttttttgcttctgcttacaagttcctcctcaatgga

SEQ ID NO: 100322 - DNA, 75 bp, Artificial Sequence
  Synthetic
cacagcccgatggtagtggtgttaccgtctcgaacctagccgacagcccttgtacattgtggggggagctgtttt

SEQ ID NO: 100323 - DNA, 75 bp, Artificial Sequence
  Synthetic
ccacctatcgtcttgcactgcttcgaagacctcagaccaagtgatgaagacgagggagagtacatcggggaaaaa

SEQ ID NO: 100324 - DNA, 75 bp, Artificial Sequence
  Synthetic
ataaccactcccaggaaatgacgtatgatagccaatcagaattgagtattaaacctatataagctgctgcacttc

SEQ ID NO: 100325 - DNA, 75 bp, Artificial Sequence
  Synthetic
gtggttgtacagacgccatcttggaatccaatatgtctgccggctcagtcatgcctgcgctgcgcgcagcgcgct

SEQ ID NO: 100326 - DNA, 75 bp, Artificial Sequence
  Synthetic
ggctttcaatcctcctgtgattagagctttttctcaacctgcttttacttatgtcttcaaatttccatatccaca

SEQ ID NO: 100327 - DNA, 75 bp, Artificial Sequence
  Synthetic
aaacactgtttgcttttacgggcctgcctcaacaggtaaaacaaatatggccaaggcaatcgtccaagggattag

SEQ ID NO: 100328 - DNA, 75 bp, Artificial Sequence
  Synthetic
atgggtgtgttaatcatttgaacaaaggatttgtatttaatgactgcagacaacgcctagttgtttggtgggagg

SEQ ID NO: 100329 - DNA, 75 bp, Artificial Sequence
  Synthetic
aggaggagtggctacgtatggggtgatcataaacacgcccaggaagtgacatatgtcaaccaatcagcatcgagc

SEQ ID NO: 100330 - DNA, 75 bp, Artificial Sequence
  Synthetic
tggggcagaaacaaagaacactctttccacgctgcgacattgtttgccagtctgaaattggctcagattttctac

SEQ ID NO: 100331 - DNA, 75 bp, Artificial Sequence
  Synthetic
aggagtggttatatgatgtaatccataaccactcccaggaaatgacgtatgctagccaatcagaattgagtatta

SEQ ID NO: 100332 - DNA, 75 bp, Artificial Sequence
  Synthetic
tgcaatcgcgaaactctatatcttttaatgtgttgttgttgtacatgcgccatcttagttttatatcagctggcg

SEQ ID NO: 100333 - DNA, 75 bp, Artificial Sequence
  Synthetic
ccttagttatataacatgcatgttatataactaaggcgccagctgatataaaactaagatggcgcatgtacaaca

SEQ ID NO: 100334 - DNA, 75 bp, Artificial Sequence
  Synthetic
tgatataaaactaagatggcgcatgtacaacaacaacacattaaaagatatagagtttcgcgattgcataagcaa

SEQ ID NO: 100335 - DNA, 75 bp, Artificial Sequence
  Synthetic
aaaatcgattgatttctccttccagcaaacctgacgtctgcacttctccagataactggtttattctagctgaca

SEQ ID NO: 100336 - DNA, 75 bp, Artificial Sequence
  Synthetic
acatattggattccaagatggcgtcagtactacaacgtcacatataaaataataaatattcacgaggaggagtgg

SEQ ID NO: 100337 - DNA, 75 bp, Artificial Sequence
  Synthetic
agcgcaggcatgactgagccggcggacatattggattccaagatggcgtcagtactacaacgtcacatataaaat

SEQ ID NO: 100338 - DNA, 75 bp, Artificial Sequence
  Synthetic
ctatcgatggggtgatcataaacacgcccaggaagtgacgtatgtcagccaatcagcctcgagcatatagcctat

SEQ ID NO: 100339 - DNA, 75 bp, Artificial Sequence
  Synthetic
aaagtgaagtcatcccggggccttctgccatggcctttgggggacgtggtgcgtgggaacaacttcctgaggtag

SEQ ID NO: 100340 - DNA, 75 bp, Artificial Sequence
  Synthetic
tttttctcaacctgctttcacttatgttgttaaatttccatatgaaaactggaaagatgatgaacacttactatg

SEQ ID NO: 100341 - DNA, 75 bp, Artificial Sequence
  Synthetic
atataaatattcacaaggaggagtggctacgtatggggtgatcataaacacgcccaggaagtgacgtatgtcagc

SEQ ID NO: 100342 - DNA, 75 bp, Artificial Sequence
  Synthetic
gagcttacttgctcctgggactgaacgtctcatgattcaactaagaaactgcgcaccacatcctgaagatgatcc

SEQ ID NO: 100343 - DNA, 75 bp, Artificial Sequence
  Synthetic
tataaaccgatgcacttccgcatttcgtcagactgcatccggtctccggcgagtgaacatctctgggaagagctc

SEQ ID NO: 100344 - DNA, 75 bp, Artificial Sequence
  Synthetic
cgtcagactgcatccggtctccggcgagtgaacatctctgggaagagctccacacttgtggtgagtcaaattatg

SEQ ID NO: 100345 - DNA, 75 bp, Artificial Sequence
  Synthetic
tcacttacatcctgatcaattattaacttctagcaataaagcactaaaactattgttgattcaagggtacaaccc

SEQ ID NO: 100346 - DNA, 75 bp, Artificial Sequence
  Synthetic
tttttgctaaagcttgctacatagctacaactacactaatggggcagaaacagagaacaccttttccacgatgcg

SEQ ID NO: 100347 - DNA, 75 bp, Artificial Sequence
  Synthetic
gagtgaacatctctgggaagagctccacacttgtggtgagtcaaattatggctttcaatccacctgttattagag

SEQ ID NO: 100348 - DNA, 75 bp, Artificial Sequence
  Synthetic
cattctcttcacctgcttttacttatgtcttcaaatttccatatccatcatggaaagaaaaagaatggcttcttc

SEQ ID NO: 100349 - DNA, 75 bp, Artificial Sequence
  Synthetic
tgtcttcaaatttccatatccatcatggaaagaaaaagaatggcttcttcatgcacttctggctcatggtaccga

SEQ ID NO: 100350 - DNA, 75 bp, Artificial Sequence
  Synthetic
ctcagaacatctacactgtcacatacttgttggaggagccggccttagcaaaagaaatgctaaaatttcacgtgc

SEQ ID NO: 100351 - DNA, 75 bp, Artificial Sequence
  Synthetic
tacaactacactaatggggcagaaacagagaacaccttttccacgatgcgacattatatgccagtctgaaattgg

SEQ ID NO: 100352 - DNA, 75 bp, Artificial Sequence
  Synthetic
gcaagccatgatccagctgagaaactgtgttcctcatccggatgaagatataatccgtgatgacttactactttc

SEQ ID NO: 100353 - DNA, 75 bp, Artificial Sequence
  Synthetic
tgtgttcctcatccggatgaagatataatccgtgatgacttactactttctctagaagatcgccattttggggca

SEQ ID NO: 100354 - DNA, 75 bp, Artificial Sequence
  Synthetic
gaactaacacaacgctgcaagcagcttcttgcacttcgaccatttgaaccagctgaggctaatattttccatctc

SEQ ID NO: 100355 - DNA, 75 bp, Artificial Sequence
  Synthetic
cttgttggaggagccggccttagcaaaagaaatgctaaaatttcacgtgctacacttctgggtcttgtgatggct

SEQ ID NO: 100356 - DNA, 75 bp, Artificial Sequence
  Synthetic
attctctgcaaggctgtctatatggctactactacttttatgtcacagaaacaaagaaatatgtttcctcgctgt

SEQ ID NO: 100357 - DNA, 75 bp, Artificial Sequence
  Synthetic
agattgggtagaacctgctaagtgtattttaggcggaactgaatgtagaattgatgttaaacataaagatagtgt

SEQ ID NO: 100358 - DNA, 75 bp, Artificial Sequence
  Synthetic
ggtcagggcatactggtaactgggttcaaattcttcagtacaaagataagcgaggtgatcttcacgctcaaccaa

SEQ ID NO: 100359 - DNA, 75 bp, Artificial Sequence
  Synthetic
tcaaattcttcagtacaaagataagcgaggtgatcttcacgctcaaccaattgatcctttgcgctttttaaagca

SEQ ID NO: 100360 - DNA, 75 bp, Artificial Sequence
  Synthetic
gggagacaaacctacactgccatattatagttgggggagaaggcttaagcaagagaaatgcaaaaacatcatgtc

SEQ ID NO: 100361 - DNA, 75 bp, Artificial Sequence
  Synthetic
atttccactaaccatgacatctactctgtagttggtggcaatactgtttctcatgttcatgcagcaccattaaaa

SEQ ID NO: 100362 - DNA, 75 bp, Artificial Sequence
  Synthetic
ctactactacttttatgtcacagaaacaaagaaatatgtttcctcgctgtgacataatagtccaatctgagcttg

SEQ ID NO: 100363 - DNA, 75 bp, Artificial Sequence
  Synthetic
tatagttgggggagaaggcttaagcaagagaaatgcaaaaacatcatgtcctcaactatatggactgatactagg

SEQ ID NO: 100364 - DNA, 75 bp, Artificial Sequence
  Synthetic
ggaattaatccaacgctgcaaaactcttctggctacgcgtccttttgaaccggaagaggcagaaatttatcatgc

SEQ ID NO: 100365 - DNA, 75 bp, Artificial Sequence
  Synthetic
tattctagctgacaaaacatacgttcacactattattaatgggcttccgctgctagaacataacagaaaagccta

SEQ ID NO: 100366 - DNA, 75 bp, Artificial Sequence
  Synthetic
cttctggctacgcgtccttttgaaccggaagaggcagaaatttatcatgctttaaaacgagctgagcgagaagct

SEQ ID NO: 100367 - DNA, 75 bp, Artificial Sequence
  Synthetic
tggggtggagttactagcggcaacctacaaattctccaatacagagatcgcagaggagaccttcacgcacaacaa

SEQ ID NO: 100368 - DNA, 75 bp, Artificial Sequence
  Synthetic
tacaaattctccaatacagagatcgcagaggagaccttcacgcacaacaagtggatgctcttcgcttcttcaaaa

SEQ ID NO: 100369 - DNA, 75 bp, Artificial Sequence
  Synthetic
ttaattacttctactgcttctactgcttataaagctaacaaaaaagaaaaattaatgttaaacttacttgataaa

SEQ ID NO: 100370 - DNA, 75 bp, Artificial Sequence
  Synthetic
actacctattgcctaaaaatagatgcattacatcttacagcagacctgatgtctgtacttctccagaaaactggt

SEQ ID NO: 100371 - DNA, 75 bp, Artificial Sequence
  Synthetic
cttataaagctaacaaaaaagaaaaattaatgttaaacttacttgataaatgtgatgaacttaatttacttgttt

SEQ ID NO: 100372 - DNA, 75 bp, Artificial Sequence
  Synthetic
cattacatcttacagcagacctgatgtctgtacttctccagaaaactggtttgttttagctgaaaaaacttactg

SEQ ID NO: 100373 - DNA, 75 bp, Artificial Sequence
  Synthetic
tcacactcttgttaacgggctgccgcttccagaacattacagaaaacactaccacgcaaccctagataacgaagt

SEQ ID NO: 100374 - DNA, 75 bp, Artificial Sequence
  Synthetic
cttccagaacattacagaaaacactaccacgcaaccctagataacgaagttctaccagggcctcagacaatggcc

SEQ ID NO: 100375 - DNA, 75 bp, Artificial Sequence
  Synthetic
cagccaggtggtgcacgcctaattgaacaggtgcttggcatgcatcatattaaggtgtgtgctaaacacacagca

SEQ ID NO: 100376 - DNA, 75 bp, Artificial Sequence
  Synthetic
tttgggggacgtggtccgtgggaacatcttcctgaggtaggagatcaacgtttagctgcttcttctgttagtaca

SEQ ID NO: 100377 - DNA, 75 bp, Artificial Sequence
  Synthetic
ttaacctttttatttcatctacatccggatcaattattaacttctagcaataaagctttaaaattactgttgatt

SEQ ID NO: 100378 - DNA, 75 bp, Artificial Sequence
  Synthetic
atcttcctgaggtaggagatcaacgtttagctgcttcttctgttagtacaacatataaaccaaacaaaaaagaga

SEQ ID NO: 100379 - DNA, 75 bp, Artificial Sequence
  Synthetic
cggatcaattattaacttctagcaataaagctttaaaattactgttgattcaagggtacaacccacttcaagtag

SEQ ID NO: 100380 - DNA, 75 bp, Artificial Sequence
  Synthetic
aacttatgcttaacttactagataaatgcagcgaattaaatcttttagtttatgaagacttagtagctaactgtc

SEQ ID NO: 100381 - DNA, 75 bp, Artificial Sequence
  Synthetic
gacatgccatctgttgtgtacttaacaaacagatgggcaagcagaacactatttgcttttatggtcctgcttcaa

SEQ ID NO: 100382 - DNA, 75 bp, Artificial Sequence
  Synthetic
caaacagatgggcaagcagaacactatttgcttttatggtcctgcttcaacaggcaaaacaaactttgcaaaagc

SEQ ID NO: 100383 - DNA, 75 bp, Artificial Sequence
  Synthetic
atgcagcgaattaaatcttttagtttatgaagacttagtagctaactgtcctgaacttttgcttatgcttgaagg

SEQ ID NO: 100384 - DNA, 75 bp, Artificial Sequence
  Synthetic
tcaaccaggtggggcacgcttaatagaacaagtcctaggcatgcaccatattaatgtttgctctaactttactgc

SEQ ID NO: 100385 - DNA, 75 bp, Artificial Sequence
  Synthetic
gaacaagtcctaggcatgcaccatattaatgtttgctctaactttactgctcttagttatctctttcacctttac

SEQ ID NO: 100386 - DNA, 75 bp, Artificial Sequence
  Synthetic
cctggcacaaccttatcttcagataacaaggctttgcagctgttgttgatacaaggttacaacccattaatggtt

SEQ ID NO: 100387 - DNA, 75 bp, Artificial Sequence
  Synthetic
acgccttataatttggtgggaagaatgtttaatgcaccaggattgggtggaacctgctaaatgcattttaggcgg

SEQ ID NO: 100388 - DNA, 75 bp, Artificial Sequence
  Synthetic
acaaggctttgcagctgttgttgatacaaggttacaacccattaatggttggtcacgccttgtgctgtgtactca

SEQ ID NO: 100389 - DNA, 75 bp, Artificial Sequence
  Synthetic
aactgaatgtagaattgatgttaaacataaagacagtgtccttcttcaacaaacaccagtaattatttccactaa

SEQ ID NO: 100390 - DNA, 75 bp, Artificial Sequence
  Synthetic
acaagcaatttggcaaacaaaacactgtttgcttttatggaccagcttctactggtaaaacaaacatggcaaagg

SEQ ID NO: 100391 - DNA, 75 bp, Artificial Sequence
  Synthetic
actggtaaaacaaacatggcaaaggccatagtccaaggcattagactatatggctgtgttaatcatttaaacaaa

SEQ ID NO: 100392 - DNA, 75 bp, Artificial Sequence
  Synthetic
tcagctaaattttatgaaacaactgccacaaacatttggagaaatttctccagttgaaattgcagaactattgca

SEQ ID NO: 100393 - DNA, 75 bp, Artificial Sequence
  Synthetic
aacgcctagttgtttggtgggaggagtgcttaatgcaccaggattgggtggaaccagcaaagtgtatcttgggtg

SEQ ID NO: 100394 - DNA, 75 bp, Artificial Sequence
  Synthetic
ggaacttagataaagttccaaactcatttcctcttggagacctttgtcctacacattcacaggactacacgcttc

SEQ ID NO: 100395 - DNA, 75 bp, Artificial Sequence
  Synthetic
tcacaggaatcagaggaggttacagacgaagaaatgctttctgctgttgaaagcatggaaacaaatgcctccaat

SEQ ID NO: 100396 - DNA, 75 bp, Artificial Sequence
  Synthetic
acgaaaacggattctgcactgactgtggcggctatcttcctcatagtgctgacgattttgtctacactgacgtgg

SEQ ID NO: 100397 - DNA, 75 bp, Artificial Sequence
  Synthetic
ttcagctaaattttatgaaacaacttcctcaaacatttggagagatcactccagaagaaattgcagctctactgc

SEQ ID NO: 100398 - DNA, 75 bp, Artificial Sequence
  Synthetic
tggcggctatcttcctcatagtgctgacgattttgtctacactgacgtggctagcgagacaacaagcggagactg

SEQ ID NO: 100399 - DNA, 75 bp, Artificial Sequence
  Synthetic
cgccccaggtaggctttaatacatttgctaaattctattacatatttgcactttgcttatgtattaactcctaca

SEQ ID NO: 100400 - DNA, 75 bp, Artificial Sequence
  Synthetic
aatggtgtttcaatgagtacgaatgtactctgacaggctttaaaacaaaatggagcctagataaaattccaaact

SEQ ID NO: 100401 - DNA, 75 bp, Artificial Sequence
  Synthetic
tactctgacaggctttaaaacaaaatggagcctagataaaattccaaactcatttcctcttggggtcctttgtcc

SEQ ID NO: 100402 - DNA, 75 bp, Artificial Sequence
  Synthetic
tgctaaattctattacatatttgcactttgcttatgtattaactcctacagataacttgggggatacggacggag

SEQ ID NO: 100403 - DNA, 75 bp, Artificial Sequence
  Synthetic
aggactccaagtcagaggcatcggaagtggacgttcgtccatccaagaagaggcgtgtgatttcagcaactccac

SEQ ID NO: 100404 - DNA, 75 bp, Artificial Sequence
  Synthetic
tactcattcacaggacttcatactccacgaaaacggatactgcactgattgtggtggttaccttgctcatagcgc

SEQ ID NO: 100405 - DNA, 75 bp, Artificial Sequence
  Synthetic
cacgaaaacggatactgcactgattgtggtggttaccttgctcatagcgctgacgattctgtgtacactgatcgt

SEQ ID NO: 100406 - DNA, 75 bp, Artificial Sequence
  Synthetic
agtggacgttcgtccatccaagaagaggcgtgtgatttcagcaactccaccaagcagtccagtaagtggtccaag

SEQ ID NO: 100407 - DNA, 75 bp, Artificial Sequence
  Synthetic
cctttctacctttttagatacttggcagtcacaacctagagacgaagatgagctccgaatctatgaagaacaagc

SEQ ID NO: 100408 - DNA, 75 bp, Artificial Sequence
  Synthetic
gcaagcgacactagcaaagaagccatcgacgcaggtaagtttacgttctccaggcactttatatatatcctatac

SEQ ID NO: 100409 - DNA, 75 bp, Artificial Sequence
  Synthetic
tcgacgcaggtaagtttacgttctccaggcactttatatatatcctatacacaacactaaaacatatgtttaatt

SEQ ID NO: 100410 - DNA, 75 bp, Artificial Sequence
  Synthetic
cagtcacaacctagagacgaagatgagctccgaatctatgaagaacaagcatcgcaactccaaaagaacaccaag

SEQ ID NO: 100411 - DNA, 75 bp, Artificial Sequence
  Synthetic
tccactccagaaagagagaagacgcaattgggagagccacaagagtcgcagccggagcccgatccgacggcatgg

SEQ ID NO: 100412 - DNA, 75 bp, Artificial Sequence
  Synthetic
acaggtgacttgggggatacggacggagaggactccgagtcagaagcatcggaagtgggtgttcgtccatccaag

SEQ ID NO: 100413 - DNA, 75 bp, Artificial Sequence
  Synthetic
gccggagcccgatccgacggcatggggagaaaaacttggagtatgctcatcacaacagccaggagaaccgccagt

SEQ ID NO: 100414 - DNA, 75 bp, Artificial Sequence
  Synthetic
aatgtctgaaaatgaaattcaagaccaacaaccatcaggctcagcagatgaacaacgagggggtggaggaggtgc

SEQ ID NO: 100415 - DNA, 75 bp, Artificial Sequence
  Synthetic
gagaggactccgagtcagaagcatcggaagtgggtgttcgtccatccaagaagcgacgcataactattcctgcaa

SEQ ID NO: 100416 - DNA, 75 bp, Artificial Sequence
  Synthetic
ctccaccaaattctcctggcagctctgtgagtacttctgccttctttgataattggtgcgcacaaccgcgagacg

SEQ ID NO: 100417 - DNA, 75 bp, Artificial Sequence
  Synthetic
tgtgagtacttctgccttctttgataattggtgcgcacaaccgcgagacgaagatgagctcagggaatacgaaag

SEQ ID NO: 100418 - DNA, 75 bp, Artificial Sequence
  Synthetic
aaaacatcgggggggaatagaaccaatccttatactgtattcagtcagcacagggctaatcactcagatgctcct

SEQ ID NO: 100419 - DNA, 75 bp, Artificial Sequence
  Synthetic
acaagcatcgcgcctacaaaagaaaagggagtccagggagagacgagaggaaacgcccatggcaacctcgtcaca

SEQ ID NO: 100420 - DNA, 75 bp, Artificial Sequence
  Synthetic
ggatggtgtgggttttactggcattctactagacttgctagagatgggactaattgtatctttaatgaaatgaaa

SEQ ID NO: 100421 - DNA, 75 bp, Artificial Sequence
  Synthetic
aaacgcccatggcaacctcgtcacaggagtcggagtcggagcccaatccgacgcagtggggagacaagctcggag

SEQ ID NO: 100422 - DNA, 75 bp, Artificial Sequence
  Synthetic
ctactagacttgctagagatgggactaattgtatctttaatgaaatgaaacaagaatttcaagaattacaaataa

SEQ ID NO: 100423 - DNA, 75 bp, Artificial Sequence
  Synthetic
tcataccgtcaggaacaccagatcagccacctatcgtcttgcactgcttcgaagatctcagacccagtgacgaag

SEQ ID NO: 100424 - DNA, 75 bp, Artificial Sequence
  Synthetic
atggaaaaattacttgggacaatgttagagaattattgtttagtcagaaaaaaaagctagatcaaaaatacagaa

SEQ ID NO: 100425 - DNA, 75 bp, Artificial Sequence
  Synthetic
acgaatacaaaagattcagaccaaaaggtatgcatgttaaaatctacaatttacaaataaaacaaattctttcaa

SEQ ID NO: 100426 - DNA, 75 bp, Artificial Sequence
  Synthetic
acatgctgtatcattttagacacagtcctgattgtcctagatgtgattattgggataatgtataccgtagacact

SEQ ID NO: 100427 - DNA, 75 bp, Artificial Sequence
  Synthetic
gagactctagaactaatccatacactgtattcagccagcataaagcctcacatcctgatgctccaggatggtgtg

SEQ ID NO: 100428 - DNA, 75 bp, Artificial Sequence
  Synthetic
gccacctatcgtcttgcactgcttcgaagatctcagacccagtgacgaagacgaaggagaatacatcgggaaaga

SEQ ID NO: 100429 - DNA, 75 bp, Artificial Sequence
  Synthetic
tgtattcagccagcataaagcctcacatcctgatgctccaggatggtgtgggttctattggcattctactagaat

SEQ ID NO: 100430 - DNA, 75 bp, Artificial Sequence
  Synthetic
tgctagaaatggtactaatgcaatctttaatgaaatgaaacagcagttccaacaactgcagctagacaacaaaat

SEQ ID NO: 100431 - DNA, 75 bp, Artificial Sequence
  Synthetic
tttaatgaaatgaaacagcagttccaacaactgcagctagacaacaaaattggctgggatagtgctagagaatta

SEQ ID NO: 100432 - DNA, 75 bp, Artificial Sequence
  Synthetic
ttgtttagtcagaaaaaatcactagatcaacaatacagaaatatgttctggcactttagaaatgcttctgattgt

SEQ ID NO: 100433 - DNA, 75 bp, Artificial Sequence
  Synthetic
atcaacaatacagaaatatgttctggcactttagaaatgcttctgattgtgaacgttgtaattactgggacaatg

SEQ ID NO: 100434 - DNA, 75 bp, Artificial Sequence
  Synthetic
tataccgtatgcacttagctcatgtttcctctcagacagaatcagaagaaataactgacgaggaaatgctttctg

SEQ ID NO: 100435 - DNA, 75 bp, Artificial Sequence
  Synthetic
aacctacaagttggatgactggaccaggtttactcagtgcacaaagagtaggtccagctacttcagacacaggag

SEQ ID NO: 100436 - DNA, 75 bp, Artificial Sequence
  Synthetic
aggtttactcagtgcacaaagagtaggtccagctacttcagacacaggagcctggatggttgcagttaaaccaga

SEQ ID NO: 100437 - DNA, 75 bp, Artificial Sequence
  Synthetic
aaacgcaagcattgacacaggaatgtctggaattggaagtggatttgatccaccacaaggatcactagcaccaac

SEQ ID NO: 100438 - DNA, 75 bp, Artificial Sequence
  Synthetic
gatttgaaaaacgactggtctcttggtggcattattggctcaagtttctttaaacttaagcgcgccgtggctcct

SEQ ID NO: 100439 - DNA, 75 bp, Artificial Sequence
  Synthetic
gtggcattattggctcaagtttctttaaacttaagcgcgccgtggctcctgctctaggaaataaagagcgagctc

SEQ ID NO: 100440 - DNA, 75 bp, Artificial Sequence
  Synthetic
tctggaattggaagtggatttgatccaccacaaggatcactagcaccaacaaatctagaatacaaaatccaatgg

SEQ ID NO: 100441 - DNA, 75 bp, Artificial Sequence
  Synthetic
taccaaacaccacaaggaacaaacaacaatggaaacatcatatctaatcaaccactatctatgctaagagatcaa

SEQ ID NO: 100442 - DNA, 75 bp, Artificial Sequence
  Synthetic
aaaaaagacacttttattttgcaaactcaaataaaggtgctaaaaaatcaaaaaacaacgaacctaaaccaagca

SEQ ID NO: 100443 - DNA, 75 bp, Artificial Sequence
  Synthetic
accactatctatgctaagagatcaagctttatttagaggaaatcaaacaacctataacctatgttcagatgtatg

SEQ ID NO: 100444 - DNA, 75 bp, Artificial Sequence
  Synthetic
catcaatataaaacagaattaatatcaccttctacatctcaaggaaaatcacaacgatgtgtcagcacaccttgg

SEQ ID NO: 100445 - DNA, 75 bp, Artificial Sequence
  Synthetic
ctcaaataaaggtgctaaaaaatcaaaaaacaacgaacctaaaccaagcacctcaaaaatgtctgaaaatgaaat

SEQ ID NO: 100446 - DNA, 75 bp, Artificial Sequence
  Synthetic
tcaagaccaacagccatcagaacctaatgatggccaacgaggagggggaggaggtgcgaccggcagtgtgggagg

SEQ ID NO: 100447 - DNA, 75 bp, Artificial Sequence
  Synthetic
aatgatggccaacgaggagggggaggaggtgcgaccggcagtgtgggaggggggaaaggttctggtgtgggtata

SEQ ID NO: 100448 - DNA, 75 bp, Artificial Sequence
  Synthetic
tccacaggtggatgggtaggaggcagctactttactgactcctatgtaataacaaaaaacaccagacaatttctg

SEQ ID NO: 100449 - DNA, 75 bp, Artificial Sequence
  Synthetic
gctactttactgactcctatgtaataacaaaaaacaccagacaatttctggttaaaatccaaaacaaccatcaat

SEQ ID NO: 100450 - DNA, 75 bp, Artificial Sequence
  Synthetic
ataaaactgaaagtataattccttccaatggaggaggaaaatcacaaagatgtgtcagcacaccatggtcatact

SEQ ID NO: 100451 - DNA, 75 bp, Artificial Sequence
  Synthetic
caatggaggaggaaaatcacaaagatgtgtcagcacaccatggtcatactttaactttaatcaatacagcagtca

SEQ ID NO: 100452 - DNA, 75 bp, Artificial Sequence
  Synthetic
tttctcaccacaggactggcagcgcctaacaaatgaatacaaaagattcagacctaaaggtatgcatgttaaaat

SEQ ID NO: 100453 - DNA, 75 bp, Artificial Sequence
  Synthetic
ctaacaaatgaatacaaaagattcagacctaaaggtatgcatgttaaaatctacaatttacaaataaaacagatt

SEQ ID NO: 100454 - DNA, 75 bp, Artificial Sequence
  Synthetic
ttatcaaatggtgctgatgttacatacaacaacgacctaacagcaggagtacacatcttctgtgatggcgaacat

SEQ ID NO: 100455 - DNA, 75 bp, Artificial Sequence
  Synthetic
acaacaacgacctaacagcaggagtacacatcttctgtgatggcgaacatgcatatccaaacgctacacatccat

SEQ ID NO: 100456 - DNA, 75 bp, Artificial Sequence
  Synthetic
aatggacaagtggaaaaaaaagggtgactgtaatcccgagctcatgagttcaaggctacagtccgatggcagtgg

SEQ ID NO: 100457 - DNA, 75 bp, Artificial Sequence
  Synthetic
gggacgaagatgtaatgccagaacttccttaccaaacatggtatctgtttcaatatggatacatacctaccattc

SEQ ID NO: 100458 - DNA, 75 bp, Artificial Sequence
  Synthetic
tccttaccaaacatggtatctgtttcaatatggatacatacctaccattcatgaacttgcagaaatggaagactc

SEQ ID NO: 100459 - DNA, 75 bp, Artificial Sequence
  Synthetic
caatgcagtagaaaaagcaattgctttacagataccattcttcatgcttgaaaacagcgaccatgaagttctaag

SEQ ID NO: 100460 - DNA, 75 bp, Artificial Sequence
  Synthetic
ttacagataccattcttcatgcttgaaaacagcgaccatgaagttctaagaactggagaaagtgcagaatttaac

SEQ ID NO: 100461 - DNA, 75 bp, Artificial Sequence
  Synthetic
ttcaactttgactgtgaatggattaacaatgaaagagcattcattcctccaggactgatgtttaatccattggta

SEQ ID NO: 100462 - DNA, 75 bp, Artificial Sequence
  Synthetic
acaatgaaagagcattcattcctccaggactgatgtttaatccattggtaccaacaagaagagctcaatacatac

SEQ ID NO: 100463 - DNA, 75 bp, Artificial Sequence
  Synthetic
gaagaaatggaaacactcaagcaagtacatcacgagttcaaccctatgctaaacctacaagctggatgactgggc

SEQ ID NO: 100464 - DNA, 75 bp, Artificial Sequence
  Synthetic
tacatcacgagttcaaccctatgctaaacctacaagctggatgactgggccaggtttactcagtgcacaacgagt

SEQ ID NO: 100465 - DNA, 75 bp, Artificial Sequence
  Synthetic
tgctaagagatcaagccttatatagaggcaatcaaacaacatacaatttatgttcagacgtatggatgtttccaa

SEQ ID NO: 100466 - DNA, 75 bp, Artificial Sequence
  Synthetic
aggtccagctgcttctgacacagctgcatggatggttggtgtagatccagaaggcgcaaacatcaactcaggaag

SEQ ID NO: 100467 - DNA, 75 bp, Artificial Sequence
  Synthetic
gcatggatggttggtgtagatccagaaggcgcaaacatcaactcaggaagagcaggagttagcagtggatttgat

SEQ ID NO: 100468 - DNA, 75 bp, Artificial Sequence
  Synthetic
cctccagctggatcactcagacctacagatctagaatacaaagtacaatggtaccaaactccagctggaacaaac

SEQ ID NO: 100469 - DNA, 75 bp, Artificial Sequence
  Synthetic
ccttgcaatggatcatcctccaggcacaatctttattaaaatggcaaaaattccagtaccttcaaacaacaatgc

SEQ ID NO: 100470 - DNA, 75 bp, Artificial Sequence
  Synthetic
cagatctagaatacaaagtacaatggtaccaaactccagctggaacaaacaacgatggaaacatcatttcaaatc

SEQ ID NO: 100471 - DNA, 75 bp, Artificial Sequence
  Synthetic
cacctttatcaatgcttagagatcaaactctctacagaggaaaccaaacaacctacaacttatgctcagatgtat

SEQ ID NO: 100472 - DNA, 75 bp, Artificial Sequence
  Synthetic
aactctctacagaggaaaccaaacaacctacaacttatgctcagatgtatggatgtttccaaatcaaatttggga

SEQ ID NO: 100473 - DNA, 75 bp, Artificial Sequence
  Synthetic
cagatacccagtaacaagagaaaatcctatttggtgcaaacaaccaagatcagacaaacacacaacaattgatcc

SEQ ID NO: 100474 - DNA, 75 bp, Artificial Sequence
  Synthetic
cctatttggtgcaaacaaccaagatcagacaaacacacaacaattgatccttttgacggatcaatagccatggat

SEQ ID NO: 100475 - DNA, 75 bp, Artificial Sequence
  Synthetic
catccaccaggcacaattttcatcaaaatggcaaaaattccagttccttcaaacaacaacgcagactcatactta

SEQ ID NO: 100476 - DNA, 75 bp, Artificial Sequence
  Synthetic
aaatggcaaaaattccagttccttcaaacaacaacgcagactcatacttaaacatctactgcactggacaagtca

SEQ ID NO: 100477 - DNA, 75 bp, Artificial Sequence
  Synthetic
gctgcgaaattgtctgggaagtcgaaagatatgcaacaaagaactggagaccagaaagaagacacacagcactcg

SEQ ID NO: 100478 - DNA, 75 bp, Artificial Sequence
  Synthetic
tcccgagctcatgagttcgaggctacagtccgatggcagtggtgttgccgtctcgaacctagccgttactcgaga

SEQ ID NO: 100479 - DNA, 75 bp, Artificial Sequence
  Synthetic
atattcacaaggaggagtggttatatgatgtaatccataaccactcccaggaaatgacgtatgatagccaatcag

SEQ ID NO: 100480 - DNA, 75 bp, Artificial Sequence
  Synthetic
gccttggaattggaggggcagatgaaatcaacccaacataccatgttgacaaaaacggagcatacattcaaccta

SEQ ID NO: 100481 - DNA, 75 bp, Artificial Sequence
  Synthetic
caacatgggacatgtgctttccagttaaaacaaacatcaataaagtgttgtaatctcttaagcctctttattgct

SEQ ID NO: 100482 - DNA, 75 bp, Artificial Sequence
  Synthetic
aaaaatcccagtaccaactgcctctaatgcagactcatatctaaacatatactgcactggacaagtcagctgtga

SEQ ID NO: 100483 - DNA, 75 bp, Artificial Sequence
  Synthetic
gtaatcccgagctcatgagttcgaggctacagtccgatggcagtggtgttgccgtctcgaacctagccgttacag

SEQ ID NO: 100484 - DNA, 75 bp, Artificial Sequence
  Synthetic
cattgtggggggagctgttctatttgcttatgcaatcgcgaaactctatatcttttaatgtgttgttgttgtaca

SEQ ID NO: 100485 - DNA, 75 bp, Artificial Sequence
  Synthetic
taagctgctgcacttcctgattcaatcagactgcatccggtctccggcgagtgaacatctctggaaaaagctcca

SEQ ID NO: 100486 - DNA, 75 bp, Artificial Sequence
  Synthetic
tttgtatttaatgactgcagacaacgcctagttgtttggtgggaggagtgcttaatgcaccaggattgggtggaa

SEQ ID NO: 100487 - DNA, 75 bp, Artificial Sequence
  Synthetic
ccaacccgtcccatataaaaattaataaatattcacaagaagagtggtctatggatgttaatacattaaccactc

SEQ ID NO: 100488 - DNA, 75 bp, Artificial Sequence
  Synthetic
ggattccaagatggcgcatgtgcaaccacgtcacatataaaataataaatattcacaaggaggagtggttatatg

SEQ ID NO: 100489 - DNA, 75 bp, Artificial Sequence
  Synthetic
aataaaggtgcaaaaaaaacaaaaaaaagtgaacctaaaccaggaacctcaaaaatgtctgacactgacattcaa

SEQ ID NO: 100490 - DNA, 75 bp, Artificial Sequence
  Synthetic
ggacgcaccacaaaacacctcagggggaggaacaggaagtattggaggaggaaaaggatctggtgtggggatttc

SEQ ID NO: 100491 - DNA, 75 bp, Artificial Sequence
  Synthetic
agagtaggaccacagtcatcagacactgctccattcatggtttgcactaacccagaaggaacacacataaacaca

SEQ ID NO: 100492 - DNA, 75 bp, Artificial Sequence
  Synthetic
tccaaaagtcccaacaagaagagttcagtacataagacaaaacggaagcacagcagccagcacaggcagaattca

SEQ ID NO: 100493 - DNA, 75 bp, Artificial Sequence
  Synthetic
gcgcaccacatcctgaagatgatcctgtcagggaagatattttatgctcactagcagatcaacactatggtgcta

SEQ ID NO: 100494 - DNA, 75 bp, Artificial Sequence
  Synthetic
gccggcagacatattggattccaagatggcgtctgtacaaccacgtcacatataaaataataaatattcacgaag

SEQ ID NO: 100495 - DNA, 75 bp, Artificial Sequence
  Synthetic
aacctagccgacagcccttgtacattgtggggggagctgttttgtttgcttatgcaatcgcgaaactctatatct

SEQ ID NO: 100496 - DNA, 75 bp, Artificial Sequence
  Synthetic
tcacatataaaataataaatattcacaaggaggagtggctacatatggggtgatcataaacacgcccaggaagtg

SEQ ID NO: 100497 - DNA, 75 bp, Artificial Sequence
  Synthetic
acacaaagacgtccagatgaatttagaagctctttgctctagagtgctttcagagagagggctatcaactggtga

SEQ ID NO: 100498 - DNA, 75 bp, Artificial Sequence
  Synthetic
gaagctctttgctctagagtgctttcagagagagggctatcaactggtgagcctggggtatatgaccagattttt

SEQ ID NO: 100499 - DNA, 75 bp, Artificial Sequence
  Synthetic
caaggctgctaaaggaagaatgggacaaactccgcgcctccttctcatggttgagcactgatcataaagaaacac

SEQ ID NO: 100500 - DNA, 75 bp, Artificial Sequence
  Synthetic
gaaaggcctggcctcccaaaccttgaagtcacagtagactccactggggtagttgtcgatgttggggccattcct

SEQ ID NO: 100501 - DNA, 75 bp, Artificial Sequence
  Synthetic
tggatgtgggaccatttcttagtcatgttcaatttaggaatttcattgcacatgtggatgcgaagtccaggagtg

SEQ ID NO: 100502 - DNA, 75 bp, Artificial Sequence
  Synthetic
gactcagcatcacagctagggtcctcgataaatgcaggtgtgctcaccatacctctctcagaagcatataagata

SEQ ID NO: 100503 - DNA, 75 bp, Artificial Sequence
  Synthetic
ttcgactcttgggggcccctgtcaagaagtctggaggagtgactacagtgtcccaggtggtgaaatccaacttct

SEQ ID NO: 100504 - DNA, 75 bp, Artificial Sequence
  Synthetic
ttccaggtttcattttggactccagtgagagcttagatgaccaagaaagggttgaaggggtgtcaatcttgaaac

SEQ ID NO: 100505 - DNA, 75 bp, Artificial Sequence
  Synthetic
gtctgaagtattccctttggttcatgatggctcagactcaatgacccccgatgtgatacacacaagactagatgg

SEQ ID NO: 100506 - DNA, 75 bp, Artificial Sequence
  Synthetic
acattctatttatgaccttgaatggcccttacactgatgagcaaaagaaagccatggttctggaggccttccaat

SEQ ID NO: 100507 - DNA, 75 bp, Artificial Sequence
  Synthetic
aacagtagttgtaattgaattcacaacaaccagaagcaccaacatgggaggacttgaggctgcctatcggagcaa

SEQ ID NO: 100508 - DNA, 75 bp, Artificial Sequence
  Synthetic
tactataaaaacaaagaagagtcgaccgagctaaatgccttgggcgagatgtacaagaagattgttgagattgag

SEQ ID NO: 100509 - DNA, 75 bp, Artificial Sequence
  Synthetic
gacttgaggctgcctatcggagcaagcttgaaaaataccgtgacccactaaacagaagatcagacataatgcctg

SEQ ID NO: 100510 - DNA, 75 bp, Artificial Sequence
  Synthetic
gtacaagaagattgttgagattgaggctgagaagccaacatcttctgagtacctaggatggggagacactagcag

SEQ ID NO: 100511 - DNA, 75 bp, Artificial Sequence
  Synthetic
tccacaagcatttagtcaggcctacaatcagatgggttgcagcatcccaccaaatctctgagtcagaagccctgg

SEQ ID NO: 100512 - DNA, 75 bp, Artificial Sequence
  Synthetic
atgcatcaatttactttggaatcattgttgttagtgcatctggtgttctcacaaatatgcctctgacccaagatg

SEQ ID NO: 100513 - DNA, 75 bp, Artificial Sequence
  Synthetic
atggaaaacacaaatgtacagatcctgatagatggtgatggttcatcgaactggatagaagaaattaggctgagt

SEQ ID NO: 100514 - DNA, 75 bp, Artificial Sequence
  Synthetic
caggcaagagcaatggatgctgaggttgaacttcaaaagtcagaggaggaatatgaggccatatccagagcaaga

SEQ ID NO: 100515 - DNA, 75 bp, Artificial Sequence
  Synthetic
acacaaatgtacagatcctgatagatggtgatggttcatcaaactggatagaagaaattaggctgagtagtgagt

SEQ ID NO: 100516 - DNA, 75 bp, Artificial Sequence
  Synthetic
gctttcttcacgctttttgactatgacgatggcaagctctctgaggcattccctaactctgacattgagatgctc

SEQ ID NO: 100517 - DNA, 75 bp, Artificial Sequence
  Synthetic
ctaggctatttgatgtcatagaatctgtcaggaggctgtgtgacgacattaatgtcaacaatagggtcacatcaa

SEQ ID NO: 100518 - DNA, 75 bp, Artificial Sequence
  Synthetic
tgcatggaaggctgtccttgatgacaagtgtatgagaatatgcttgtttaagaaaaatcagcatggaggcctgag

SEQ ID NO: 100519 - DNA, 75 bp, Artificial Sequence
  Synthetic
caaagaaaaagagcaagaggcttataagagaatgtgtgaggagcactatctaaaaagtggcatgagcacaaaaga

SEQ ID NO: 100520 - DNA, 75 bp, Artificial Sequence
  Synthetic
aagagaatgtgtgaggagcactatctaaaaagtggcatgagcacaaaagagaggcttgaggcaaatcgcaatgat

SEQ ID NO: 100521 - DNA, 75 bp, Artificial Sequence
  Synthetic
tagagaatcatggtctcaagagtgctcgacaattagggcaggggaccattaatgtcaactcttcaaatgacgcaa

SEQ ID NO: 100522 - DNA, 75 bp, Artificial Sequence
  Synthetic
acattctaaacctgtccatcctccttcaagaggaccgagtcatgaatctgcttagctacagagctcgtgacaccg

SEQ ID NO: 100523 - DNA, 75 bp, Artificial Sequence
  Synthetic
caaggagctacactcgaataagagcacagtgaagttgcccccctgggtagtgaagccttctgataggacgttaga

SEQ ID NO: 100524 - DNA, 75 bp, Artificial Sequence
  Synthetic
aaaaatggagtcagggccattatacaaccaaattggctatggtattatgctggttcatgccagctaagttccata

SEQ ID NO: 100525 - DNA, 75 bp, Artificial Sequence
  Synthetic
tcaagaggaccgagtcatgaatctgcttagctacagagctcgtgacaccgacatctcagagtcagcagcatccta

SEQ ID NO: 100526 - DNA, 75 bp, Artificial Sequence
  Synthetic
tgtcaaaacggacacgggatcaggggagctactcaaccatggcccatatggggagttgtggtcaagatgcttcct

SEQ ID NO: 100527 - DNA, 75 bp, Artificial Sequence
  Synthetic
ggttcatatgggcaggcatctcaatgtttaggtgcaagaagatgatgatggacctcaggtttttagaaaaattga

SEQ ID NO: 100528 - DNA, 75 bp, Artificial Sequence
  Synthetic
gagctactcaaccatggcccatatggggagttgtggtcaagatgcttcctggagattatccttgggaatgtggaa

SEQ ID NO: 100529 - DNA, 75 bp, Artificial Sequence
  Synthetic
gtttaggtgcaagaagatgatgatggacctcaggtttttagaaaaattgagcacaaaggctaatcagaaaactga

SEQ ID NO: 100530 - DNA, 75 bp, Artificial Sequence
  Synthetic
ggggtcatcagcagccctgaaaaggagctggagatcgccatcagtgatgaccctgaggctgacacccctaaggct

SEQ ID NO: 100531 - DNA, 75 bp, Artificial Sequence
  Synthetic
agctggagatcgccatcagtgatgaccctgaggctgacacccctaaggctgcaaagataaaataccacaggttca

SEQ ID NO: 100532 - DNA, 75 bp, Artificial Sequence
  Synthetic
tgatgacttcaggaaagacttagctggggccttccatggcaatgttgaggttccttggatgactcaaggagctac

SEQ ID NO: 100533 - DNA, 75 bp, Artificial Sequence
  Synthetic
ggcctgagctcagtttagagagcaagcatgaattttcattacaaggcatcgagggcaaaagatggaagcattcag

SEQ ID NO: 100534 - DNA, 75 bp, Artificial Sequence
  Synthetic
ctaggaatgtccttaaagatgaaatgtcccataagacaatgagcccatttgttgatgtctcgaacattgaggagt

SEQ ID NO: 100535 - DNA, 75 bp, Artificial Sequence
  Synthetic
tgacacatcttttaatcgggaagggctgcaagaaacaatcaacctgttgttggagaaggctactgaaatgcacca

SEQ ID NO: 100536 - DNA, 75 bp, Artificial Sequence
  Synthetic
aaatggcttatcaacagctttgaatgattccttcaagagaaacttcaacacaaacgtagtgcagtggagcatgtg

SEQ ID NO: 100537 - DNA, 75 bp, Artificial Sequence
  Synthetic
ggtctcatgcttagctcaggaattggcaagtgctttgaagcaacattgcaagcctggtgagtttatcatcaaaaa

SEQ ID NO: 100538 - DNA, 75 bp, Artificial Sequence
  Synthetic
ataattaagcccactaagtcatcaagtcacatattctacagcttggcaataaaaaaaaccaacattaagaggagg

SEQ ID NO: 100539 - DNA, 75 bp, Artificial Sequence
  Synthetic
gtcacatattctacagcttggcaataaaaaaaaccaacattaagaggaggctgattggtgacgtattcacagaca

SEQ ID NO: 100540 - DNA, 75 bp, Artificial Sequence
  Synthetic
ctcgggttgaggtgaagtgactctgctgtctcacttgagctatcagtacctaaaggttgatatctggacggtctt

SEQ ID NO: 100541 - DNA, 75 bp, Artificial Sequence
  Synthetic
caattgatgcgggggagtgggagttttcagaattcaaaagcctcaagacttgcaagctgacaaatctcattaacc

SEQ ID NO: 100542 - DNA, 75 bp, Artificial Sequence
  Synthetic
aggatggggcttcccaaggactgggttgagaggatagatgaaaacccaagcatcttatataggaggcctgagaac

SEQ ID NO: 100543 - DNA, 75 bp, Artificial Sequence
  Synthetic
ttacacaaagaaccccttgaattatcaaaacatgtccttgtctaaagcctcccagcccagcgtcaagagtgcctg

SEQ ID NO: 100544 - DNA, 75 bp, Artificial Sequence
  Synthetic
tgccgtgcaccatgctcaactcaattgcgttctggagagagaagatgggagtagccccctggatttctagaaagg

SEQ ID NO: 100545 - DNA, 75 bp, Artificial Sequence
  Synthetic
cagaaaaagtgcattctccaggtgtcacttccagcttcagcaaagggcatgttgtacctagggtggtggcagctg

SEQ ID NO: 100546 - DNA, 75 bp, Artificial Sequence
  Synthetic
cctgctcagagctcagggaacaagtggcaatcactttccttatgagtctggaagacaaatcaacaacagaagagc

SEQ ID NO: 100547 - DNA, 75 bp, Artificial Sequence
  Synthetic
ggtaggggggcatctcagaaggcgagtctgattaagctgcttgtcatgtcttcaacatcagctgagaggaatcaa

SEQ ID NO: 100548 - DNA, 75 bp, Artificial Sequence
  Synthetic
ttgttactctcacgaggtattcacaaatggagggatttgtgtctccacccctgctccctaaaccccagaagatgg

SEQ ID NO: 100549 - DNA, 75 bp, Artificial Sequence
  Synthetic
tcccaacaatcctctacatgctctagagccagctgttgagcaacttcttgatgagtattctggggacctaggctc

SEQ ID NO: 100550 - DNA, 75 bp, Artificial Sequence
  Synthetic
ggaaggctgaacccaaatcaagaaagaatgctctttcctcaagtccaagagtatgaaagagtattgaccttgtta

SEQ ID NO: 100551 - DNA, 75 bp, Artificial Sequence
  Synthetic
tggaaaagttagaagttcccttgcgaacaaagcttcaagtgtttttgtttaggaggcatcttgatgctattgtta

SEQ ID NO: 100552 - DNA, 75 bp, Artificial Sequence
  Synthetic
ttatagtcagcaggagaagagtgcattgaggtggccgagtgggaaaccgtcagtccatttcttgcaggctgctca

SEQ ID NO: 100553 - DNA, 75 bp, Artificial Sequence
  Synthetic
aacaaagcttcaagtgtttttgtttaggaggcatcttgatgctattgttagagttgctgcatctccattccccat

SEQ ID NO: 100554 - DNA, 75 bp, Artificial Sequence
  Synthetic
gagttgctgcatctccattccccattgtggcaagagatggtcgagtggaatggacagggacattcaatgcaatca

SEQ ID NO: 100555 - DNA, 75 bp, Artificial Sequence
  Synthetic
agtcaaaagcagagtagagcttttccaggagcctgtggacttaaggtgcaaagctgaaaacctcattgcagaaat

SEQ ID NO: 100556 - DNA, 75 bp, Artificial Sequence
  Synthetic
tggacagggacattcaatgcaatcactggccgaagcactgggctggaaaacatggtaaacaactggtatatcggc

SEQ ID NO: 100557 - DNA, 75 bp, Artificial Sequence
  Synthetic
tgggcagtcgagacaggtcaggaaaactggagaggtttctttcacaggataacatctgggaaaaaatacaaactc

SEQ ID NO: 100558 - DNA, 75 bp, Artificial Sequence
  Synthetic
catggtaaacaactggtatatcggctattataaaaacaaagaagagtcgaccgagctaaatgccttaggtgagat

SEQ ID NO: 100559 - DNA, 75 bp, Artificial Sequence
  Synthetic
tattataaaaacaaagaagagtcgaccgagctaaatgccttaggtgagatgtataaaaagattgttgagattgag

SEQ ID NO: 100560 - DNA, 75 bp, Artificial Sequence
  Synthetic
ataacaggactgaatccaataatggatgtggctctcctccaaattgagtcactcttgcgtgttaggggtctcaca

SEQ ID NO: 100561 - DNA, 75 bp, Artificial Sequence
  Synthetic
ccctaagaggcatgagttcagtagaagcttcctcaagtcagcatgcatatctcttgagaaggagatagagatgag

SEQ ID NO: 100562 - DNA, 75 bp, Artificial Sequence
  Synthetic
agcttcctcaagtcagcatgcatatctcttgagaaggagatagagatgaggcatgggaagagctggaagcaaagc

SEQ ID NO: 100563 - DNA, 75 bp, Artificial Sequence
  Synthetic
ctcaactatcacctgttcacatcatccttccttgacaagcctctccttgactccttatattttgccatctggaga

SEQ ID NO: 100564 - DNA, 75 bp, Artificial Sequence
  Synthetic
gataaacagagagctgatgggtcatattcccaagatgggggggctcgccaggatgaccctctcaatcccttggat

SEQ ID NO: 100565 - DNA, 75 bp, Artificial Sequence
  Synthetic
ttggaggagagagtccttaaagaactgggctcaaagaacttgctggacttagcaacaatgaaggcaacaagcaac

SEQ ID NO: 100566 - DNA, 75 bp, Artificial Sequence
  Synthetic
tgggctcaaagaacttgctggacttagcaacaatgaaggcaacaagcaactttagcaaggaatgggaagctttct

SEQ ID NO: 100567 - DNA, 75 bp, Artificial Sequence
  Synthetic
gagctcttgtacctgtctgacttgcccaaaccactggcacattatctgaataaatgccctctccacaatatagtc

SEQ ID NO: 100568 - DNA, 75 bp, Artificial Sequence
  Synthetic
ttccaatattttgcactgccacatgctgctgaagttgtgaagagatcacgatcactaaccctatgcttgatgaag

SEQ ID NO: 100569 - DNA, 75 bp, Artificial Sequence
  Synthetic
aattttattgagcagagaggagggtcaatacttgaccaaattgaaaaggctcagtcaggtacagtgggtggattc

SEQ ID NO: 100570 - DNA, 75 bp, Artificial Sequence
  Synthetic
gctgaactaatagagcatgggttaatgtggtatgttgatgcagcaggtcatgcatggaaggctgtccttgatgac

SEQ ID NO: 100571 - DNA, 75 bp, Artificial Sequence
  Synthetic
atgcatgatgaggaagtcagagaggcctatctaaaccccatctggggaaaggactggccagcactttccagctcc

SEQ ID NO: 100572 - DNA, 75 bp, Artificial Sequence
  Synthetic
agtaagccccagaagccttaccgcaaacagtcaggaggcattggctacaaggggaaaggtgtttggtcaggcata

SEQ ID NO: 100573 - DNA, 75 bp, Artificial Sequence
  Synthetic
tgcatggaaggctgtccttgatgacaaatgtatgagaatatgcttgtttaagaaaaatcagcacggaggcctgag

SEQ ID NO: 100574 - DNA, 75 bp, Artificial Sequence
  Synthetic
aacagtcaggaggcattggctacaaggggaaaggtgtttggtcaggcataatggaaaacacaaatgtacagatcc

SEQ ID NO: 100575 - DNA, 75 bp, Artificial Sequence
  Synthetic
ggaaatttatgtaacgaatgcaaatgcaaggcttgtccaatttggagtagagacaatggcacggtgtgtgtgtga

SEQ ID NO: 100576 - DNA, 75 bp, Artificial Sequence
  Synthetic
gctaagcccacatgaaacaatagctaaccctagactcaagtcaagcatcatagagaatcatggtctcaagagtgc

SEQ ID NO: 100577 - DNA, 75 bp, Artificial Sequence
  Synthetic
tgacattaatgtcaataatagagttacatcaagctttcggggtcattgcatggtgaggcttagcaactttaaggt

SEQ ID NO: 100578 - DNA, 75 bp, Artificial Sequence
  Synthetic
aatgtcaactcttcaaatgacgcaaaaaaatggagtcagggtcattatacaaccaagttggccatggtattatgc

SEQ ID NO: 100579 - DNA, 75 bp, Artificial Sequence
  Synthetic
tggtgaggcttagcaactttaaggtcaagccagcttcaagggtagaaggttgcccagtgcgactcatgccctctt

SEQ ID NO: 100580 - DNA, 75 bp, Artificial Sequence
  Synthetic
tgcccagtgcgactcatgccctcttcattccggataaaggagctccaaaacccagatgaggtcttcttaagggtg

SEQ ID NO: 100581 - DNA, 75 bp, Artificial Sequence
  Synthetic
tggttcatgccagcaaaattccataggttcatatgggcaggcatctcaatgtttaggtgcaagaagatgatgatg

SEQ ID NO: 100582 - DNA, 75 bp, Artificial Sequence
  Synthetic
ggttcatatgggcaggcatctcaatgtttaggtgcaagaagatgatgatggatctcaggtttttagaaaaactga

SEQ ID NO: 100583 - DNA, 75 bp, Artificial Sequence
  Synthetic
gcacaaaggctaatcagaaaactgatgatgacttcaggaaagacttagctggggccttccatggcaatgttgaag

SEQ ID NO: 100584 - DNA, 75 bp, Artificial Sequence
  Synthetic
ttgctgagatggtggaacgtcatgttatcccactaacaagtcaggagctggtggatatcctggaggaagatgtcg

SEQ ID NO: 100585 - DNA, 75 bp, Artificial Sequence
  Synthetic
tgatgacttcaggaaagacttagctggggccttccatggcaatgttgaagttccatggatgactcaaggggctac

SEQ ID NO: 100586 - DNA, 75 bp, Artificial Sequence
  Synthetic
atatctccagactgagacagggatgatgcaagggatcctgcattttacatcaagcctactgcattcatgcgtcca

SEQ ID NO: 100587 - DNA, 75 bp, Artificial Sequence
  Synthetic
gatatcctgatggaagggtcaccaatgctctgggcagcagaagtggaggagatgggagaagctatggtgatactc

SEQ ID NO: 100588 - DNA, 75 bp, Artificial Sequence
  Synthetic
atgcaagggatcctgcattttacatcaagcctactgcattcatgcgtccaaagtttttacaaggcatattttttg

SEQ ID NO: 100589 - DNA, 75 bp, Artificial Sequence
  Synthetic
tctcggcttaaagaagggatcgcaggcaaaaccatcaaggcagctatagatgttttagaaggctctgatgactca

SEQ ID NO: 100590 - DNA, 75 bp, Artificial Sequence
  Synthetic
aaccctttcaacaatccttgggaaagatggttgcaggcttctactggggagacctactgggagatcaaatctcag

SEQ ID NO: 100591 - DNA, 75 bp, Artificial Sequence
  Synthetic
gctatcatgataagcttgaagccagcctcagacaatgaggaagcaatggctcggtttttaacagccaacttgcta

SEQ ID NO: 100592 - DNA, 75 bp, Artificial Sequence
  Synthetic
tactcagtcagagtcataaacccgctctttggcatttatagctctgagaagtcaacagtaaataccttattttgt

SEQ ID NO: 100593 - DNA, 75 bp, Artificial Sequence
  Synthetic
cgaccaaagctggaacatccagtggctcgttgccaatctcaacagctattgcagaccagtcagtcatgcttgatg

SEQ ID NO: 100594 - DNA, 75 bp, Artificial Sequence
  Synthetic
aagtagaggtaaaccgtaatccactgagatgattgtcccgattgtcctgtttctcacgctctgtccgtccgaact

SEQ ID NO: 100595 - DNA, 75 bp, Artificial Sequence
  Synthetic
gtggagtacaactcagagttccacttccacaagcatttagtcaggcctacaatcagatgggttgcagcatcccac

SEQ ID NO: 100596 - DNA, 75 bp, Artificial Sequence
  Synthetic
acacagagacggctatacattaaagtagaggtaaaccgtaatccactgagatgattgtcccgattgtcctgtttc

SEQ ID NO: 100597 - DNA, 75 bp, Artificial Sequence
  Synthetic
tagaggtaaaccgtaatccactgagatgattgtcccgattgtcctgtttctcacgctctgtccgtccgaactcag

SEQ ID NO: 100598 - DNA, 75 bp, Artificial Sequence
  Synthetic
atgattgtcccgattgtcctgtttctcacgctctgtccgtccgaactcagtgcctggggctccccaggagaccct

SEQ ID NO: 100599 - DNA, 75 bp, Artificial Sequence
  Synthetic
caagcaggcaggaagattatgcgaaccttctcactcaatgtcttgaagggggttcatcattctctctaacatatt

SEQ ID NO: 100600 - DNA, 75 bp, Artificial Sequence
  Synthetic
ctatgccagattgacaggcttggacatgtcacaagctggttaagaaaccactcatcttttcaggggcttgttggt

SEQ ID NO: 100601 - DNA, 75 bp, Artificial Sequence
  Synthetic
ggttcatcattctctctaacatatttgatccagtgtgcccagctcgtccatcattatatgctgctcgggctctgc

SEQ ID NO: 100602 - DNA, 75 bp, Artificial Sequence
  Synthetic
attgtttgtggtgtgaggactgaaacaaacaaatccattcagattgagtggaaggagggaagatcagagaagcta

SEQ ID NO: 100603 - DNA, 75 bp, Artificial Sequence
  Synthetic
gaaggagggaagatcagagaagctatgccagattgacaggcttgggcatgtcacaagctggttaagaaaccactc

SEQ ID NO: 100604 - DNA, 75 bp, Artificial Sequence
  Synthetic
ttgcacccgctgtttggaacatttgtagggatgctgattgaggatccagatccagccctaggcttcttcataatg

SEQ ID NO: 100605 - DNA, 75 bp, Artificial Sequence
  Synthetic
caggtgaagggaagaccaagtgtttcctacttcccggaaggggcttcttacccaaggtggagcggtctattaagc

SEQ ID NO: 100606 - DNA, 75 bp, Artificial Sequence
  Synthetic
tccagccctaggcttcttcataatggacaatccagcttttgcagggggagctggatttagattcaacctttggag

SEQ ID NO: 100607 - DNA, 75 bp, Artificial Sequence
  Synthetic
atctttccaggggcttattggtcaggtgaaggggagaccaagtgtttcctacttcccggaaggggcttcttaccc

SEQ ID NO: 100608 - DNA, 75 bp, Artificial Sequence
  Synthetic
ccatgtgatgctgaatggctgggaatgatagcagtgagcaaggctggagacacagacatgattgtcccagggcca

SEQ ID NO: 100609 - DNA, 75 bp, Artificial Sequence
  Synthetic
gtcttgcaagttcacaaaccttggcaaaaagtatgcattctttttcaatgagattcaaggaaaaaccaaggggga

SEQ ID NO: 100610 - DNA, 75 bp, Artificial Sequence
  Synthetic
aaggtggagcggcctattaagcccatgtgatgctgaatggctgggactgatagcagtgagcaaggctggagacac

SEQ ID NO: 100611 - DNA, 75 bp, Artificial Sequence
  Synthetic
acttacaaaggcaaaatctttgttgagagaccaacatacaacggatacaaaggctgggggtgtgcagatgggaag

SEQ ID NO: 100612 - DNA, 75 bp, Artificial Sequence
  Synthetic
agacatgattgtcccaggcccaacttacaaagggaaaatctttgttgagagaccaacatacaacggttacaaagg

SEQ ID NO: 100613 - DNA, 75 bp, Artificial Sequence
  Synthetic
tacaaagggaaaatctttgttgagagaccaacatacaacggttacaaaggctggggttgtgcagatggaaagtca

SEQ ID NO: 100614 - DNA, 75 bp, Artificial Sequence
  Synthetic
aaaaagtatgcattctttttcaatgagattcaaggaaaaaccaagggggatgcagattacagagcactggatgca

SEQ ID NO: 100615 - DNA, 75 bp, Artificial Sequence
  Synthetic
gagaaagtaccaacatctcctagacaggatggggcttcccaaggactgggttgagaggatagatgaaaacccaag

SEQ ID NO: 100616 - DNA, 75 bp, Artificial Sequence
  Synthetic
ctaagccactcaggcacatattgtgaaactgacagctcagtgagttctggtttaattcagggagatagggttctc

SEQ ID NO: 100617 - DNA, 75 bp, Artificial Sequence
  Synthetic
aggatggggcttcccaaggactgggttgagaggatagatgaaaacccaagcgtcttatacaggaggcctgagaac

SEQ ID NO: 100618 - DNA, 75 bp, Artificial Sequence
  Synthetic
agagaccaacatacaacggatacaaaggctgggggtgtgcagatgggaagtcactaagccactcaggcacatatt

SEQ ID NO: 100619 - DNA, 75 bp, Artificial Sequence
  Synthetic
aagcaggaacttatcttgaggctggcagaaaaagtgcattctccaggtgtcacttccagcttcagcaaggggcat

SEQ ID NO: 100620 - DNA, 75 bp, Artificial Sequence
  Synthetic
tgggttggggaagtagtctgtcagagagggacccctgtgccagaagatgtatttagtgaactggttagcttgagt

SEQ ID NO: 100621 - DNA, 75 bp, Artificial Sequence
  Synthetic
gttgtacctagagtggtggcagctggagtctacttgctgtcaagacattgcttcaggtacactgcatcaatccac

SEQ ID NO: 100622 - DNA, 75 bp, Artificial Sequence
  Synthetic
caaagtgagttcccagatgtgtgcaagattgatggtgttgcactgaaccagtgtgagcaggagagcatcccccag

SEQ ID NO: 100623 - DNA, 75 bp, Artificial Sequence
  Synthetic
gtgtgagcaggagagcatcccccagccactggacgttgcatggattgatgttggaaggtctcataaggtactgat

SEQ ID NO: 100624 - DNA, 75 bp, Artificial Sequence
  Synthetic
ggtaggggagcatctcagaaggcgagtctaattaagctgcttgtcatgtcttcaacatcagctgagaggaatcaa

SEQ ID NO: 100625 - DNA, 75 bp, Artificial Sequence
  Synthetic
ggaaggctaaatccaaatcaagaaagaatgctctttccccaagtccaagagtatgaaagagtactgaccttgtta

SEQ ID NO: 100626 - DNA, 75 bp, Artificial Sequence
  Synthetic
gatgaggtcactgcgctcacagggaagtttgttgtgagagaaaggaacatagtcaaaagcagagtagagcttttc

SEQ ID NO: 100627 - DNA, 75 bp, Artificial Sequence
  Synthetic
tgcttcaaaaacctggagaaatcattgtgaattatggaggcgtctctgtgagaccaacctgttatggattctcca

SEQ ID NO: 100628 - DNA, 75 bp, Artificial Sequence
  Synthetic
aagctgaaaacctcattgcagaaatgtggtttggacttaaaagaacaaagttgggcccaaggctgctaaaggaag

SEQ ID NO: 100629 - DNA, 75 bp, Artificial Sequence
  Synthetic
tagagggaggagttaaaattgtaacgcttacaagcgagctgagaagtgcaacagtttgtgcttcacatttttgtg

SEQ ID NO: 100630 - DNA, 75 bp, Artificial Sequence
  Synthetic
ttagtcatgttcaattcaggaatttcattgcacatgtggatgcgaagtctaggagtgttcgactcttgggggccc

SEQ ID NO: 100631 - DNA, 75 bp, Artificial Sequence
  Synthetic
gaaacactggatgtgggaccatttcttagtcatgttcaattcaggaatttcattgcacatgtggatgcgaagtct

SEQ ID NO: 100632 - DNA, 75 bp, Artificial Sequence
  Synthetic
catctgcaaaggggggctcaaagacaactgacatactcttccacactggtgctctcgttggacccaattccatta

SEQ ID NO: 100633 - DNA, 75 bp, Artificial Sequence
  Synthetic
ctgtcaagaagtcaggaggagtgactacagtgtcccaggtggtgaaatctaatttctttccaggtttcattttgg

SEQ ID NO: 100634 - DNA, 75 bp, Artificial Sequence
  Synthetic
gaataactggtcagttgttagatgggagcaagttctcctttgatgggcactgcatattcccagatgggtgcatgg

SEQ ID NO: 100635 - DNA, 75 bp, Artificial Sequence
  Synthetic
actccagtgagagcttagatgaccaagagagggttgagggggtgtcaatcttgaaacacattctatttatgacct

SEQ ID NO: 100636 - DNA, 75 bp, Artificial Sequence
  Synthetic
ggagttcttaagaaacccacaatgttacccagtaaagaaatggctcttcctggtggtagttataatgtgctgcta

SEQ ID NO: 100637 - DNA, 75 bp, Artificial Sequence
  Synthetic
ctcttgactgcaccttctgtaaagagttcctgagaaacccgcaatgttaccctgtaaagaaatggctcttcctgg

SEQ ID NO: 100638 - DNA, 75 bp, Artificial Sequence
  Synthetic
tggtagttataatgtgctgctattgtgccctgatgctgcttactaacatactgagagctataggtgtttggggga

SEQ ID NO: 100639 - DNA, 75 bp, Artificial Sequence
  Synthetic
ttccaatattttgcactgccacatgctgctgaggttgtgaagagatcacggtcattaaccctatgtttgatgaag

SEQ ID NO: 100640 - DNA, 75 bp, Artificial Sequence
  Synthetic
catgggtttttgctccaataaagttggctctagcattagggttgaggcttgccaaactgtcaaagaaggggctgg

SEQ ID NO: 100641 - DNA, 75 bp, Artificial Sequence
  Synthetic
agtaagccccagaagccttaccgcaaacaatctggaggcattggctacaaggggaaaggtgtttggacaggcata

SEQ ID NO: 100642 - DNA, 75 bp, Artificial Sequence
  Synthetic
atgagggaagacaaggttatggcccaagaggccccatccgtcactggctatactcacctgccctcattctcattc

SEQ ID NO: 100643 - DNA, 75 bp, Artificial Sequence
  Synthetic
atgtgatgagcttgttcatgctgagagtaaatctatcacatgcaagtctgcatctgggaatgagaaggagtgctc

SEQ ID NO: 100644 - DNA, 75 bp, Artificial Sequence
  Synthetic
ctggatagaagaaattaggctgagtagtgagtccaggctatttgatgtcatagaatctgtcaggaggctgtgtga

SEQ ID NO: 100645 - DNA, 75 bp, Artificial Sequence
  Synthetic
aagaggccccatccgtcactggctatactcacctgccctcattctcattctcaccacttcaatttgctctggatg

SEQ ID NO: 100646 - DNA, 75 bp, Artificial Sequence
  Synthetic
agtgagtccaggctatttgatgtcatagaatctgtcaggaggctgtgtgatgacattaatgtcaacaatagggtt

SEQ ID NO: 100647 - DNA, 75 bp, Artificial Sequence
  Synthetic
agtgacaggcagagctttgctcccagctgtcaatccagggcaggaagcctgcttgcacttcagcatgccaggaag

SEQ ID NO: 100648 - DNA, 75 bp, Artificial Sequence
  Synthetic
acatcaagctttcggggtcattgcatggtgaggctcagcaattttaaggtcaagccagcttcaagggtagaaggg

SEQ ID NO: 100649 - DNA, 75 bp, Artificial Sequence
  Synthetic
ctgggaatgagaaggagtgctcagtgacaggcagagctttgctcccagctgtcaatccagggcaggaggcctgct

SEQ ID NO: 100650 - DNA, 75 bp, Artificial Sequence
  Synthetic
cccagactctaagtgcctcaagatcaaagtgaaatcaataaatctcagatgtaagcaagcctcttcatattatgt

SEQ ID NO: 100651 - DNA, 75 bp, Artificial Sequence
  Synthetic
gtcaatccagggcaggaggcctgcttgcactttagcgtgccaggaagcccagactccaagtgccttaagatcaaa

SEQ ID NO: 100652 - DNA, 75 bp, Artificial Sequence
  Synthetic
cattccggataaaggagctccaaaacccagatgaggtcttcttaagggtgaggggagacattctaaacctgtcca

SEQ ID NO: 100653 - DNA, 75 bp, Artificial Sequence
  Synthetic
gtgaaatcaataaatctcagatgtaagcaagcctcttcatattatgttcctgaagcaaaggcaagatgtacatct

SEQ ID NO: 100654 - DNA, 75 bp, Artificial Sequence
  Synthetic
tggtgaggctcagcaattttaaggtcaagccagcttcaagggtagaagggtgcccagtgcgacttatgccctcct

SEQ ID NO: 100655 - DNA, 75 bp, Artificial Sequence
  Synthetic
tcctccttcaagaggaccgagtcatgaatctgcttagctacagagctcgtgacactgacatctcagagtctgcag

SEQ ID NO: 100656 - DNA, 75 bp, Artificial Sequence
  Synthetic
gggctgggctcgggatgagtgggtgctcagatgggtgtggtggagctgcatgtgggtgtttcaatgcagcgccat

SEQ ID NO: 100657 - DNA, 75 bp, Artificial Sequence
  Synthetic
catcctacctatggatgaatagaactgacttctcatttggaaagaaggagccatcttgcagctggatgtgcttga

SEQ ID NO: 100658 - DNA, 75 bp, Artificial Sequence
  Synthetic
aaacattggactcatgggcttggaatcaagcagcaagagttcttgaaagaaacatcaaaacccctggaattgata

SEQ ID NO: 100659 - DNA, 75 bp, Artificial Sequence
  Synthetic
acaccgccatggggaacattttcaaggattgcttagaaagctcactcagaaagcaggggttgcttagatctagaa

SEQ ID NO: 100660 - DNA, 75 bp, Artificial Sequence
  Synthetic
ttgctgagatggtggaacgacatgttattccactaacaagtcaggagctggtggatatcctggaggaagatgtcg

SEQ ID NO: 100661 - DNA, 75 bp, Artificial Sequence
  Synthetic
gagcctgtcacagggcaagcaactcagatgttcaagggtgttgcaatcacatatctgggatcatccattgagatt

SEQ ID NO: 100662 - DNA, 75 bp, Artificial Sequence
  Synthetic
atatctgggatcatccattgagattgttggcatgaccaggctatgtgagatgaaagagatggggactgggataat

SEQ ID NO: 100663 - DNA, 75 bp, Artificial Sequence
  Synthetic
atttttcagaaatgatgcaatctgatataatggaaggggacctagacattgatatcctgatggaagggtcaccaa

SEQ ID NO: 100664 - DNA, 75 bp, Artificial Sequence
  Synthetic
ggcactggccccctgcaatgatccagggcacgccataatgggaaatgtgggtgagatccaatgcagtagtataga

SEQ ID NO: 100665 - DNA, 75 bp, Artificial Sequence
  Synthetic
agtcagtcaggaaagtattatcatctaaaattaatggatcaagcagcaacaaccctttcaacaatccttgggaaa

SEQ ID NO: 100666 - DNA, 75 bp, Artificial Sequence
  Synthetic
gggtgcatttggaatgctgacctagttggaatagaattgagggttgatgatgctgtgtgtttctcgaaactcact

SEQ ID NO: 100667 - DNA, 75 bp, Artificial Sequence
  Synthetic
aaccctttcaacaatccttgggaaagatggttgcaggctcctactgggagagcgtacatgtggatcaaatctcag

SEQ ID NO: 100668 - DNA, 75 bp, Artificial Sequence
  Synthetic
agtgttgaggcagttgcaaatttttcaaaaatcccggcaacaatttctggggttcgctttgatcaagggaatcat

SEQ ID NO: 100669 - DNA, 75 bp, Artificial Sequence
  Synthetic
ggagcaggtgaagccctacttgacattattgcaaataagagagggagatgtcaactgggtttctgagtacaaaga

SEQ ID NO: 100670 - DNA, 75 bp, Artificial Sequence
  Synthetic
ttattgcaaataagagagggagatgtcaactgggtttctgagtacaaagacgacacacgtggtcttgatgaagac

SEQ ID NO: 100671 - DNA, 75 bp, Artificial Sequence
  Synthetic
ggagaatcacgtatctatggtagcccattagatatcacgagggttagtggggaattctcagtgtcattcagaggg

SEQ ID NO: 100672 - DNA, 75 bp, Artificial Sequence
  Synthetic
tccgcagaaatgtggggttaaaccaaccaggactggggctcgggttgaggtgaagtgactctgctgtctcacttg

SEQ ID NO: 100673 - DNA, 75 bp, Artificial Sequence
  Synthetic
atgaggctcaaactatctgagatatcagcaagctgcacaggtgagataacaaacgtctctggttgttactcctgc

SEQ ID NO: 100674 - DNA, 75 bp, Artificial Sequence
  Synthetic
gttgaggtgaagtgactctgctgtctcacttgagctttcagtacctaaaggttgatatctggacggtctttgtgt

SEQ ID NO: 100675 - DNA, 75 bp, Artificial Sequence
  Synthetic
atgactggggcctcagtcagcataaaattacatagcagtaagaacacaacaggtcatcttaagtgtgattcagat

SEQ ID NO: 100676 - DNA, 75 bp, Artificial Sequence
  Synthetic
cagcccagcgtcaagagtgcctgcgttaggcttcccatcgtggttcttgagcctaatctggccgagctcagcacc

SEQ ID NO: 100677 - DNA, 75 bp, Artificial Sequence
  Synthetic
gagactgcattcagtgtcatggagggaacacacacatataggcctcacatgagctttgataaagcagtaatagat

SEQ ID NO: 100678 - DNA, 75 bp, Artificial Sequence
  Synthetic
tcatatgttggcctggtctcatgtaagtgctctgttcttacatgctccatgatgaggaaaatgaaggccttcacc

SEQ ID NO: 100679 - DNA, 75 bp, Artificial Sequence
  Synthetic
gaggagtgtgtgctaaactgtggtggccactcatcaaaactgttgcttaaagggagccttgtttttatggacgtg

SEQ ID NO: 100680 - DNA, 75 bp, Artificial Sequence
  Synthetic
aatactgtctggctttttggcaatcccaacaatcctctacatgctctagagccagctgttgagcaacttcttgat

SEQ ID NO: 100681 - DNA, 75 bp, Artificial Sequence
  Synthetic
gtgccaaggtttgttgatgggagttatgtccaaacatatcacagcaaggtgcctgctgggggaagggtcccaaat

SEQ ID NO: 100682 - DNA, 75 bp, Artificial Sequence
  Synthetic
ccaaggtttgttgatggaagttatgtccaaacatatcacagcaaggtgcccgctgggggaagggtcccaaatccg

SEQ ID NO: 100683 - DNA, 75 bp, Artificial Sequence
  Synthetic
ccaacaatcctctacatgctctagagccagctgttgagcaacttcttgatgagtactctggggacctgggctctt

SEQ ID NO: 100684 - DNA, 75 bp, Artificial Sequence
  Synthetic
atgtccaaacatatcacagcaaggtgcctgctgggggaagggtcccaaatccagtagactggctcaatgcactgt

SEQ ID NO: 100685 - DNA, 75 bp, Artificial Sequence
  Synthetic
gaggtggccgagtgggaaaccgtcagtccatttcctgcaggctgctcatttattcttctccctcaagaacacctg

SEQ ID NO: 100686 - DNA, 75 bp, Artificial Sequence
  Synthetic
gtagactggctcaacgcactgtttggagatggcataacacgatggattcttgggattataggggttctgctggca

SEQ ID NO: 100687 - DNA, 75 bp, Artificial Sequence
  Synthetic
tattcttctccctcaagaacacctgggcagtcgagacaggtcaggaaaattggagaggtttcttccacaggataa

SEQ ID NO: 100688 - DNA, 75 bp, Artificial Sequence
  Synthetic
tgtgtcatgctatttgtggtggtggttgccatcactaggcgattgatcaagggactgactcaaagggcgaaggtg

SEQ ID NO: 100689 - DNA, 75 bp, Artificial Sequence
  Synthetic
ttgccatcactaggcgattgatcaagggactgactcaaagggcgaaggtggcatgattggcgttaattgacaaat

SEQ ID NO: 100690 - DNA, 75 bp, Artificial Sequence
  Synthetic
catctgggaaaaaatacaaattcgagggggacatggtcattgactcttgctacaaaattgatgagagacgtaggc

SEQ ID NO: 100691 - DNA, 75 bp, Artificial Sequence
  Synthetic
gaatgggtctgcctgatactttcataacaggattgaacccaataatggacgtggctctcctccaaattgagtcac

SEQ ID NO: 100692 - DNA, 75 bp, Artificial Sequence
  Synthetic
tttgaaacagatgctctgacatctggggcatgaatgataatgggtgggttttcaatttgtatagccggtctttgt

SEQ ID NO: 100693 - DNA, 75 bp, Artificial Sequence
  Synthetic
tgaaacaaatgctctgacatctgaggcatgaatgataatgggtgggttttcaatttgtatagccggtctttgtgt

SEQ ID NO: 100694 - DNA, 75 bp, Artificial Sequence
  Synthetic
acacaaagaaccccttgaattatcaaaacatgtccttgtctaaagcctctcagcccagcgtcaagagtgcctgcg

SEQ ID NO: 100695 - DNA, 75 bp, Artificial Sequence
  Synthetic
ttttgcgtgttaggggtctcacactcaactaccaccttttcacatcacccttccttgacaagcctctccttgact

SEQ ID NO: 100696 - DNA, 75 bp, Artificial Sequence
  Synthetic
caactaccaccttttcacatcacccttccttgacaagcctctccttgactccttatactttgccatctggagaga

SEQ ID NO: 100697 - DNA, 75 bp, Artificial Sequence
  Synthetic
caagaagaaagatgatgggtcatattcccaagatgagggggcccgccaggatgaccctctcaaccccttggatga

SEQ ID NO: 100698 - DNA, 75 bp, Artificial Sequence
  Synthetic
tcccaagatgagggggcccgccaggatgaccctctcaaccccttggatgagctcttgtacctgtctggcttgccc

SEQ ID NO: 100699 - DNA, 75 bp, Artificial Sequence
  Synthetic
ccaacaatcctctacatgctctagagccagctgttgagcaacttcttgatgagtactctggggacttaggctctt

SEQ ID NO: 100700 - DNA, 75 bp, Artificial Sequence
  Synthetic
aaaccactagcacattatctgaataaatgccctctccataatataatcatgcatgatgaggaggtcagagaggcc

SEQ ID NO: 100701 - DNA, 75 bp, Artificial Sequence
  Synthetic
aatgccctctccataatataatcatgcatgatgaggaggtcagagaggcctatcttaatcccatctggggaaagg

SEQ ID NO: 100702 - DNA, 75 bp, Artificial Sequence
  Synthetic
actggccagcactttccagctccccctagggggagctaatttagatcgaattcatttgatttgaccaattggaat

SEQ ID NO: 100703 - DNA, 75 bp, Artificial Sequence
  Synthetic
gaatgggtctgcctgatactttcataacaggactgaacccaataatggatgtggctctcctccaaattgagtcac

SEQ ID NO: 100704 - DNA, 75 bp, Artificial Sequence
  Synthetic
gctgcttacatgtttctgtaagcagcagccgcagccttcactgagccggatgcttccttggttgctgtgagcaag

SEQ ID NO: 100705 - DNA, 75 bp, Artificial Sequence
  Synthetic
ttttgcgtgttaggggtctcacactcaactatcaccttttcacatcatccttccttgacaagcctctccttgatt

SEQ ID NO: 100706 - DNA, 75 bp, Artificial Sequence
  Synthetic
caactatcaccttttcacatcatccttccttgacaagcctctccttgattccttatattttgccatctggagaga

SEQ ID NO: 100707 - DNA, 75 bp, Artificial Sequence
  Synthetic
cccttggcctgcagccagctgatcctggtggcatttgggaagaagagggaattgacagctgcatgcagagggtct

SEQ ID NO: 100708 - DNA, 75 bp, Artificial Sequence
  Synthetic
ctgaatttggcatacacctctgcctttgtcatcttcctttggtccacattgattgttcgagcaaatgtgtcttgc

SEQ ID NO: 100709 - DNA, 75 bp, Artificial Sequence
  Synthetic
gattgttcgagcaaatgtgtcttgccaaagggaataggcatccatgaagtcctttatgacttcaattgagacatc

SEQ ID NO: 100710 - DNA, 75 bp, Artificial Sequence
  Synthetic
caaagggaataggcatccatgaagtcctttatgacttcaattgagacatctgcctgtggaatcagtgagccaaag

SEQ ID NO: 100711 - DNA, 75 bp, Artificial Sequence
  Synthetic
gccatgcacatcatttccagtggataaccttggattttgttgtgcatgattgctggcccaacagggaggtactcc

SEQ ID NO: 100712 - DNA, 75 bp, Artificial Sequence
  Synthetic
ttcatttgatttgaccaattggaatttagcgccaaattcaaaatttatcagctgcttacatgtttctgtaagcag

SEQ ID NO: 100713 - DNA, 75 bp, Artificial Sequence
  Synthetic
ttgattgctgctgcagcagcacaggtccaggttggcaggcactgggcaactctcactggtgtcacagccattctg

SEQ ID NO: 100714 - DNA, 75 bp, Artificial Sequence
  Synthetic
tctcactggtgtcacagccattctgtcaacagcattctccttcagctcataaactctagccagatttgtcatcct

SEQ ID NO: 100715 - DNA, 75 bp, Artificial Sequence
  Synthetic
ctcagcgcctttcttagacatcttgccacatgctttcactatcttgttccctctggtgagagcaaatacaatgat

SEQ ID NO: 100716 - DNA, 75 bp, Artificial Sequence
  Synthetic
cctttatgacttcaattgagacatctgcctgtgggatcaatgagccaaaggccatgcacatcatttccagtggat

SEQ ID NO: 100717 - DNA, 75 bp, Artificial Sequence
  Synthetic
gtacttcacatcattcctccagttctcaccccctctctcacgaagcagccccaagatcacagcaggatccaggcc

SEQ ID NO: 100718 - DNA, 75 bp, Artificial Sequence
  Synthetic
tctcactggtgtcacagccattctgtcaacagcattctccttcagctcatagactctagccaggtttgtcatcct

SEQ ID NO: 100719 - DNA, 75 bp, Artificial Sequence
  Synthetic
ctcataagctatttcctttgcaaactcgaccaaagctggaacatccagtggctcgttgccaatctcaacagctat

SEQ ID NO: 100720 - DNA, 75 bp, Artificial Sequence
  Synthetic
gtggctcgttgccaatctcaacagctattgcggaccagtcagtcatgcttgatgattcaaaggggttctctgtgt

SEQ ID NO: 100721 - DNA, 75 bp, Artificial Sequence
  Synthetic
acacagagacggctatacattaaggtagaggtaaaccgtaatccactgagatgattgccccagttgtcctgtttt

SEQ ID NO: 100722 - DNA, 75 bp, Artificial Sequence
  Synthetic
gtacttcacatcattcctccagttctcaccccccctctcacgaagcagcccaaagatcacagcaggatccaggcc

SEQ ID NO: 100723 - DNA, 75 bp, Artificial Sequence
  Synthetic
tcactctctgtccgtcccaactcagcgcctggggctctccaggagaccccattgtttgtggtgtgaggaccgaaa

SEQ ID NO: 100724 - DNA, 75 bp, Artificial Sequence
  Synthetic
caaacaaatccattcagattgagtggaaggaggggagatcagagaaattatgccagattgacagacttggacatg

SEQ ID NO: 100725 - DNA, 75 bp, Artificial Sequence
  Synthetic
gacgtccagatgaatttagaagctctttgctctagagtgctttcagagagagggctatcaactggtgagcctggg

SEQ ID NO: 100726 - DNA, 75 bp, Artificial Sequence
  Synthetic
tcacaagctggttaagaaatcactcatctttccaggggcttattggtcaggtgaaggggaggccaagtgtttcct

SEQ ID NO: 100727 - DNA, 75 bp, Artificial Sequence
  Synthetic
acttcccggaaggagcttcttaccctaggtggagcgggctattaagcccatgtgatgctgaatggctgggactaa

SEQ ID NO: 100728 - DNA, 75 bp, Artificial Sequence
  Synthetic
tagcagtgagcaaggctggggatacagacatgattgtcccaggcccaacttacaaaggcaaaatctttgttgaga

SEQ ID NO: 100729 - DNA, 75 bp, Artificial Sequence
  Synthetic
gaccaacgtacaatggttataaaggctgggggtgtgcagatgggaagtcactaagccactctggcacatattgtg

SEQ ID NO: 100730 - DNA, 75 bp, Artificial Sequence
  Synthetic
aaactgacagctcagtaagttctgggttaattcagggtgatagggttctctgggttggggaagtagtctgtcaga

SEQ ID NO: 100731 - DNA, 75 bp, Artificial Sequence
  Synthetic
ccacacaagactagatggaacagttgttgtaattgaattcacaacaaccaggagcacaaacatgggaggacttga

SEQ ID NO: 100732 - DNA, 75 bp, Artificial Sequence
  Synthetic
gagggacacctgtgccagaagatgtatttagtgaactgattagcttgagtcaaagtgagttcccagatgtgtgca

SEQ ID NO: 100733 - DNA, 75 bp, Artificial Sequence
  Synthetic
aggttgatggggttgcactgaaccaatgtgagcaggagagcatcccccagccactggacgttgcatggattgatg

SEQ ID NO: 100734 - DNA, 75 bp, Artificial Sequence
  Synthetic
atgtgagcaggagagcatcccccagccactggacgttgcatggattgatgttggaaggtctcataaagtgctgat

SEQ ID NO: 100735 - DNA, 75 bp, Artificial Sequence
  Synthetic
tgcctctgacccaagatgaagctgaagaattgatgttcaggttctgtgtggcaaatgagatttattctcaggcaa

SEQ ID NO: 100736 - DNA, 75 bp, Artificial Sequence
  Synthetic
gagagaacacaaaactaaatgggtccaagagagctcagcaaaggactttgtgtgcttcaaggtgggtcaggggcc

SEQ ID NO: 100737 - DNA, 75 bp, Artificial Sequence
  Synthetic
atgttcaaaacaagaggaagatgactgcatgagtaagggcaactgccatggggatgaggttttctgcaggatggc

SEQ ID NO: 100738 - DNA, 75 bp, Artificial Sequence
  Synthetic
gggatgaggttttctgcaggatggcaggatgctctgcccgtatgcaagataatcaagaaggctgtaggtgcgaac

SEQ ID NO: 100739 - DNA, 75 bp, Artificial Sequence
  Synthetic
tgctccaaaaacctggagaaatcattgtgaattatggaggcgtctctgtaagaccaacttgttatggattctcta

SEQ ID NO: 100740 - DNA, 75 bp, Artificial Sequence
  Synthetic
gaatgatggcaacattggaagttcacaagcctgatagagaattaacagggtgcacgggttgtcacctagagtgca

SEQ ID NO: 100741 - DNA, 75 bp, Artificial Sequence
  Synthetic
tagagggaggggtcaaaattgtaacacttacaagcgagctgagaagtgcaacagtttgtgcttcacatttttgtg

SEQ ID NO: 100742 - DNA, 75 bp, Artificial Sequence
  Synthetic
catccgcaaaagggggctcaaagacaactgacatactcttccacactggtgctctcgttggacccaaatccatta

SEQ ID NO: 100743 - DNA, 75 bp, Artificial Sequence
  Synthetic
aactgacatactcttccacactggtgctctcgttggacccaaatccattagaattacgggccagttgttagatgg

SEQ ID NO: 100744 - DNA, 75 bp, Artificial Sequence
  Synthetic
gagcaagttctcctttgatgggcactgcatattcccagatgggtgcatggcacttgactgcaccttctgtaagga

SEQ ID NO: 100745 - DNA, 75 bp, Artificial Sequence
  Synthetic
gttcctgagaaacccacaatgttacccagtaaagaaatggctcttcttggtggtagttgtgatgtgctgctattg

SEQ ID NO: 100746 - DNA, 75 bp, Artificial Sequence
  Synthetic
cgcactgatgctgcttactaacatactgagagctataggtgtttggggaacatgggtttttgctccaataaagtt

SEQ ID NO: 100747 - DNA, 75 bp, Artificial Sequence
  Synthetic
catgggtttttgctccaataaagttagttctagcattaggattgaggcttgccaaactatcaaagaaggggttgg

SEQ ID NO: 100748 - DNA, 75 bp, Artificial Sequence
  Synthetic
aagacaatgagcccatttgttgatgtctcgaacattgaggagtttctgatcatgaacaacctgttaaatgacaca

SEQ ID NO: 100749 - DNA, 75 bp, Artificial Sequence
  Synthetic
ttgctgtggttacaaggggccaaatgatcgtgaatgatgagctgcaccagattcgagtggagagaggtgagcaaa

SEQ ID NO: 100750 - DNA, 75 bp, Artificial Sequence
  Synthetic
atgagggaagactaggtcatggcccaagaggtcccgtccgtcactggctatactcacctgccctcattctcattc

SEQ ID NO: 100751 - DNA, 75 bp, Artificial Sequence
  Synthetic
aagaggtcccgtccgtcactggctatactcacctgccctcattctcattctgaccacttcaatttgctctggatg

SEQ ID NO: 100752 - DNA, 75 bp, Artificial Sequence
  Synthetic
tgatgagctcgttcatgctgagagtaaatctatcacatgcaagtctgcatctgggaatgagaaggagtgctcagt

SEQ ID NO: 100753 - DNA, 75 bp, Artificial Sequence
  Synthetic
tgcttagctcaggaattagcaagtgctttgaagcaacattgcaagcctggtgagttcatcatcaaaaagttaatg

SEQ ID NO: 100754 - DNA, 75 bp, Artificial Sequence
  Synthetic
gacaggcagagctttactcccagctgttaatccaggacaggaggcctgcttgcacttcagtatgccagggagccc

SEQ ID NO: 100755 - DNA, 75 bp, Artificial Sequence
  Synthetic
gccaacattaagaggaggctgattggtgatgtattcacagacacaattgatgcgggggagtgggagttttcagaa

SEQ ID NO: 100756 - DNA, 75 bp, Artificial Sequence
  Synthetic
tgcgggggagtgggagttttcagaatttaaaagcctcaagacatgcaagctgacaaatctcatcaacctgccgtg

SEQ ID NO: 100757 - DNA, 75 bp, Artificial Sequence
  Synthetic
gtaagaaggtgcaggtgggcaggtgactgtcaatctgggtgtccaacatatttcagctcaaactcattctcagat

SEQ ID NO: 100758 - DNA, 75 bp, Artificial Sequence
  Synthetic
actgtcaatctgggtgtccaacatatttcagctcaaactcattctcagatgactgggcaaacaggatggacaggg

SEQ ID NO: 100759 - DNA, 75 bp, Artificial Sequence
  Synthetic
gggtgtttcaatgcagcgccatcctgcatcttttggagaaagtgggtggagaacccatccaatcgtgtctggaag

SEQ ID NO: 100760 - DNA, 75 bp, Artificial Sequence
  Synthetic
gtgtcaccttgtgcatcatgggtgctagctgcaatcattgagttgactttgccatcaggagaggttaagactcta

SEQ ID NO: 100761 - DNA, 75 bp, Artificial Sequence
  Synthetic
gagcctgtcacagggcaagcaactcaaatgtttaagggtgttgcaatcacgtatctgggttcatccattgagatt

SEQ ID NO: 100762 - DNA, 75 bp, Artificial Sequence
  Synthetic
tgcatccccattccccattgtggcaagagatggccgagtagaatggacagggacattcaatgcaatcactggccg

SEQ ID NO: 100763 - DNA, 75 bp, Artificial Sequence
  Synthetic
gttggcatgaccaggctatgcgagatgaaagagatgggaactgggattatggcactagccccctgcaatgaccct

SEQ ID NO: 100764 - DNA, 75 bp, Artificial Sequence
  Synthetic
agagatggccgagtagaatggacagggacattcaatgcaatcactggccgaagtactgggctggaaaacatggta

SEQ ID NO: 100765 - DNA, 75 bp, Artificial Sequence
  Synthetic
gggcacgccataatgggaaatgtgggtgagatccaatgcagtagtatagaaagcgcaaagcacatcagatctgat

SEQ ID NO: 100766 - DNA, 75 bp, Artificial Sequence
  Synthetic
aagattgttgagattgaggctgagaagccagcatcttctgagtacctagggtggggagacactagcagccctaag

SEQ ID NO: 100767 - DNA, 75 bp, Artificial Sequence
  Synthetic
gggtgcatttggaatgctgacctagttgggatagaattaagggttgatgatgctgtgtgtttctcaaaactcacc

SEQ ID NO: 100768 - DNA, 75 bp, Artificial Sequence
  Synthetic
agtgttgaggcagtcgcaaatttctcaaaaatcccggcaataatttctggggtccgttttgatcaagggaatcat

SEQ ID NO: 100769 - DNA, 75 bp, Artificial Sequence
  Synthetic
ggagaatcgcgaatctatggtagcccattagacatcacgaaggttagtggggaattctcagtgtcattcaggggg

SEQ ID NO: 100770 - DNA, 75 bp, Artificial Sequence
  Synthetic
atgaggcttaaactgtctgagatatcagcaagctgcacaggtgagataacaaacgtctctggttgctactcctgc

SEQ ID NO: 100771 - DNA, 75 bp, Artificial Sequence
  Synthetic
aggaatgggaagctttctcagaagtcagaacaaaagaatatcataggtccaaactcctagaaaagatggctgaac

SEQ ID NO: 100772 - DNA, 75 bp, Artificial Sequence
  Synthetic
atgactggggcctctgtcagcataaagctacatagcagtaagaacacaacaggtcatcttaaatgtgattcagat

SEQ ID NO: 100773 - DNA, 75 bp, Artificial Sequence
  Synthetic
gagactgcattcagtgtcatggagggaacacacacttataggcctcacatgagctttgataaagcagtggtagat

SEQ ID NO: 100774 - DNA, 75 bp, Artificial Sequence
  Synthetic
gaggagtgtgtgctaaactgtggtggccattcatcaaagctgttgcttaaggggagccttgtcttcatggacgtg

SEQ ID NO: 100775 - DNA, 75 bp, Artificial Sequence
  Synthetic
ccaaggtttgttgatgggagttatgttcaaacataccatagcaaggtgcctgctgggggaagggtcccaaatcca

SEQ ID NO: 100776 - DNA, 75 bp, Artificial Sequence
  Synthetic
gtagattggctcaacgcgctgtttggagatggcataacacgatggattcttgggattataggagttctgttggca

SEQ ID NO: 100777 - DNA, 75 bp, Artificial Sequence
  Synthetic
tgtgtcttgctatttgtggtggtggtggccatcactaggcgattgatcaaggggctgactcaaagggcgaaggtg

SEQ ID NO: 100778 - DNA, 75 bp, Artificial Sequence
  Synthetic
tggccatcactaggcgattgatcaaggggctgactcaaagggcgaaggtggcatgattggcattaattaacaaat

SEQ ID NO: 100779 - DNA, 75 bp, Artificial Sequence
  Synthetic
aagcaagcctcctgtttcaaacctctggtgggccagaagcctgacagaggtttgaaacagatgctctgacatctg

SEQ ID NO: 100780 - DNA, 75 bp, Artificial Sequence
  Synthetic
agctaatcagaaaactgatgatgacttcaggaaagacttggctggagccttccatggcaatgttgaagttccatg

SEQ ID NO: 100781 - DNA, 75 bp, Artificial Sequence
  Synthetic
tgaaacagatgctctgacatctggggtgtgaatgataatgggtgggttttcaatttgtatagccggtctttgtgt

SEQ ID NO: 100782 - DNA, 75 bp, Artificial Sequence
  Synthetic
gatgactcaaggagccacatatctccagactgagacagggatgatgcaagggatcctgcattttacatcaagcct

SEQ ID NO: 100783 - DNA, 75 bp, Artificial Sequence
  Synthetic
acctctctcagaagcatataagataaatcatgacttcactttctctggactgactaagacaacagataggaagtt

SEQ ID NO: 100784 - DNA, 75 bp, Artificial Sequence
  Synthetic
acaactcagagttccacttccataagcatttagtcaggcctacaatcagatgggttgcagcatcccaccaaattt

SEQ ID NO: 100785 - DNA, 75 bp, Artificial Sequence
  Synthetic
ctgaatcagaagccctggcaagcaggcaggaagattatgcgaaccttctcactcaatgtcttgaagggggttcat

SEQ ID NO: 100786 - DNA, 75 bp, Artificial Sequence
  Synthetic
ccctaactctgacattgagatgctcagaagatttctgagtcagcctgtagacacaagttttgtgaccacaaccct

SEQ ID NO: 100787 - DNA, 75 bp, Artificial Sequence
  Synthetic
ctaggcttcttcataatggacaatccagcttttgcagggggagctggatttaggttcaacctctggaggtcttgc

SEQ ID NO: 100788 - DNA, 75 bp, Artificial Sequence
  Synthetic
aagagaatgtgtgaggagcactatctaaagagtggcatgagcacaaaagagaggcttgaggcgaatcgcagtgat

SEQ ID NO: 100789 - DNA, 75 bp, Artificial Sequence
  Synthetic
gcaatagacaaaactagagctctcatggagagactccacaacatgagcagcaaggagctacactcgaataagagc

SEQ ID NO: 100790 - DNA, 75 bp, Artificial Sequence
  Synthetic
tacagagcactggatgcaacaactggtggaacattaagccactctgtaatgatctactggggggacaggagaaag

SEQ ID NO: 100791 - DNA, 75 bp, Artificial Sequence
  Synthetic
acagtgaagttgcctccctgggtagtgaagccttctgataggacgttagatgtcaaaacggacacgggatcaggg

SEQ ID NO: 100792 - DNA, 75 bp, Artificial Sequence
  Synthetic
gagctactcaaccatggcccatatggggagttgtggtcaagatgcttcctggagattgtccttgggaatgtggag

SEQ ID NO: 100793 - DNA, 75 bp, Artificial Sequence
  Synthetic
taccaacatctcctagacaggatggggcttcccaaggactgggttgagaggatagatgaaaacccaagcatcttg

SEQ ID NO: 100794 - DNA, 75 bp, Artificial Sequence
  Synthetic
tacaggaggcctgagaacaagcaggagcttatcttgaggctggcagagaaagtgcattctccaggtgtcacttcc

SEQ ID NO: 100795 - DNA, 75 bp, Artificial Sequence
  Synthetic
agctggagatcgccatcagtgatgaccctgaggctgacacccctaaggctgcaaagattaaataccataggttcc

SEQ ID NO: 100796 - DNA, 75 bp, Artificial Sequence
  Synthetic
gattccttcaagagaaacttcaacacaaacgttgtgcagtggagcatgtgggtctcatgcttagctcaggaattg

SEQ ID NO: 100797 - DNA, 75 bp, Artificial Sequence
  Synthetic
agagtattgaccttgttagatgaggttactgcgctcacagggaagtttgtcatgagagaaaggaacatagtcaaa

SEQ ID NO: 100798 - DNA, 75 bp, Artificial Sequence
  Synthetic
attaatgcactggccaatattcgtcataattaagcccactaagtcatcaagtcacatattctacagcttggcaat

SEQ ID NO: 100799 - DNA, 75 bp, Artificial Sequence
  Synthetic
ataatctaaactttataaaaacatccactccctgtagtctatgcttgtgggcgtagatttttcatagtggtgtct

SEQ ID NO: 100800 - DNA, 75 bp, Artificial Sequence
  Synthetic
atattcatttctgctgttaacagctttcagccagggacgtgttgcatcctaggcagtggcccacccataggtcac

SEQ ID NO: 100801 - DNA, 75 bp, Artificial Sequence
  Synthetic
aatgtcgaagatcaacaaatacggtctcgaactacactgggctccagaatttccatggatgtttgaggacgcaga

SEQ ID NO: 100802 - DNA, 75 bp, Artificial Sequence
  Synthetic
ggagaagttggataaccctagtagttcagaggtggatatagtatgctccaccactgcgcaaaagctggaaacagg

SEQ ID NO: 100803 - DNA, 75 bp, Artificial Sequence
  Synthetic
cggaatttgtcctgaaaatcatgtgatggtggattgtcgccgacttcttaaacaagagtgttgtgtgcagtctag

SEQ ID NO: 100804 - DNA, 75 bp, Artificial Sequence
  Synthetic
cctaatacgtgaaattgttatgaatacacgtccatatgatttggaggtgctacttcaagatgctttgcagtcccg

SEQ ID NO: 100805 - DNA, 75 bp, Artificial Sequence
  Synthetic
cgaagcagttttggttacaccccctctaggtatgtctcttgaggcatgctatgtgagaggttgtaatcctaatgg

SEQ ID NO: 100806 - DNA, 75 bp, Artificial Sequence
  Synthetic
atggaccatgggtttgtttcggcgtagaagtgtgtgtaacactggtcgctgcgctgttaacaagcatgtggccta

SEQ ID NO: 100807 - DNA, 75 bp, Artificial Sequence
  Synthetic
tcagctatatatgattgatcctgcgggtgtatgttttggtgcaggtcaatttgtgggttgggtcatacccttagc

SEQ ID NO: 100808 - DNA, 75 bp, Artificial Sequence
  Synthetic
tcagctatatatgattgatcctgcgggtgtttgttttggtgcaggtcaatttgtgggttgggtcatacccttagc

SEQ ID NO: 100809 - DNA, 75 bp, Artificial Sequence
  Synthetic
tcagctatatatgattgatcctgcgggtgtctgttttggtgcaggtcaatttgtgggttgggtcatacccttagc

SEQ ID NO: 100810 - DNA, 75 bp, Artificial Sequence
  Synthetic
tcagctatatatgattgatcctgcgggtgtgtgttttggtgcaggtcaatttgtgggttgggtcatacccttagc

SEQ ID NO: 100811 - DNA, 75 bp, Artificial Sequence
  Synthetic
ctttatgcctgtgcaatcccggaaatttattgttccttgggttatgtacttgcgtaagtgtggcgaaaagggtgc

SEQ ID NO: 100812 - DNA, 75 bp, Artificial Sequence
  Synthetic
ctacaataaagatcataaacgtgtcggttttgaacacgtttataattttaaagttgaggatgcttacgacctggt

SEQ ID NO: 100813 - DNA, 75 bp, Artificial Sequence
  Synthetic
tcatgatgagcctaagggtaagttttctaagaaggcttatgctttaattagaggataccgtggtgttaaaccgct

SEQ ID NO: 100814 - DNA, 75 bp, Artificial Sequence
  Synthetic
tctctatgtagaccagtatggttgtgattatactggtggtcttgcagatggcttagaggcttatgctgataagac

SEQ ID NO: 100815 - DNA, 75 bp, Artificial Sequence
  Synthetic
attgcaagaaatgaaggcattatttcctatttggagccaggaactcccttttgatgtaactgtggcatggcacgt

SEQ ID NO: 100816 - DNA, 75 bp, Artificial Sequence
  Synthetic
tgtgcgtgatccacgttatgttatgagactgcagagtgcttctactatacgtagtgttgcatatgttgctaaccc

SEQ ID NO: 100817 - DNA, 75 bp, Artificial Sequence
  Synthetic
tactgaagacttgtgtgatggttctgttgttataaaggaacctgtgcatgtttatgcggatgactctattatttt

SEQ ID NO: 100818 - DNA, 75 bp, Artificial Sequence
  Synthetic
acgtcaacataatttagttgacattatgagttgtttttatatggaggcagatgcagttgtaaatgctttttatgg

SEQ ID NO: 100819 - DNA, 75 bp, Artificial Sequence
  Synthetic
tgttgatttgaaagattgtggttttgttatgcagtttggttatattgactgcgaacaagacttgtgtgattttaa

SEQ ID NO: 100820 - DNA, 75 bp, Artificial Sequence
  Synthetic
aggttgggttcctggtaatatgatagatggttttgcttgcactacttgtggtcatgtttatgaaacaggtgattt

SEQ ID NO: 100821 - DNA, 75 bp, Artificial Sequence
  Synthetic
gctagcacaatcttcaggtgttttgcctgttaatcctgtattgcatactaagagtgcagcaggttatggtggttt

SEQ ID NO: 100822 - DNA, 75 bp, Artificial Sequence
  Synthetic
tggttgtaaggattcttttaccctgtatggccaaactgtagtttattttggaggttgtgtgtattggagtccagc

SEQ ID NO: 100823 - DNA, 75 bp, Artificial Sequence
  Synthetic
acgtaatatatggattcctatattaaaatcttctgttaagtcttatgacggtttggtttatactggagttgtagg

SEQ ID NO: 100824 - DNA, 75 bp, Artificial Sequence
  Synthetic
ttgcaaggctattgtaaaggaaacaaatctcatttgcaaagcgttgtaccttgattatgttcaacacaagtgtgg

SEQ ID NO: 100825 - DNA, 75 bp, Artificial Sequence
  Synthetic
caatttacaccagcgggagttgctaggtgtgtcagatgtgtggcataaacaattgttattaaatagaggtgtgta

SEQ ID NO: 100826 - DNA, 75 bp, Artificial Sequence
  Synthetic
caaacctcttttagagaatattgattattttaatatgcggcgcgctaaatttagtttagaaacttttactgtttg

SEQ ID NO: 100827 - DNA, 75 bp, Artificial Sequence
  Synthetic
tgcagatggttttatgccttttcttttagatgatttggttccgcgcgcatattatttggcagtaagtggtcaagc

SEQ ID NO: 100828 - DNA, 75 bp, Artificial Sequence
  Synthetic
attttgtgactacgcaggtaaattctgccatgctgttgtgtctaagagtaaagagttacttgatgtgtctctgga

SEQ ID NO: 100829 - DNA, 75 bp, Artificial Sequence
  Synthetic
ttctttaggtgcagctatacattatttgaattctaaaattgttgatttggctcaacattttagtgattttggaac

SEQ ID NO: 100830 - DNA, 75 bp, Artificial Sequence
  Synthetic
aagttttgtttctaaaattgttcatttctttaagacttttactactagcactgctcttgcatttgcatgggtttt

SEQ ID NO: 100831 - DNA, 75 bp, Artificial Sequence
  Synthetic
attacatgttttgcatggtgcttaaatagtagtggagagtgatatatattttgttaaaaacattcctcgttatgc

SEQ ID NO: 100832 - DNA, 75 bp, Artificial Sequence
  Synthetic
attacatgttttgcatggtgcttatatagtagtggagagtgatatatattttgttaaaaacattcctcgttatgc

SEQ ID NO: 100833 - DNA, 75 bp, Artificial Sequence
  Synthetic
attacatgttttgcatggtgcttacatagtagtggagagtgatatatattttgttaaaaacattcctcgttatgc

SEQ ID NO: 100834 - DNA, 75 bp, Artificial Sequence
  Synthetic
attacatgttttgcatggtgcttagatagtagtggagagtgatatatattttgttaaaaacattcctcgttatgc

SEQ ID NO: 100835 - DNA, 75 bp, Artificial Sequence
  Synthetic
atttcatgttttgcatggtgcttaaatagtagtggagagtgatatatattttgttaaaaacattcctcgttatgc

SEQ ID NO: 100836 - DNA, 75 bp, Artificial Sequence
  Synthetic
atttcatgttttgcatggtgcttatatagtagtggagagtgatatatattttgttaaaaacattcctcgttatgc

SEQ ID NO: 100837 - DNA, 75 bp, Artificial Sequence
  Synthetic
atttcatgttttgcatggtgcttacatagtagtggagagtgatatatattttgttaaaaacattcctcgttatgc

SEQ ID NO: 100838 - DNA, 75 bp, Artificial Sequence
  Synthetic
atttcatgttttgcatggtgcttagatagtagtggagagtgatatatattttgttaaaaacattcctcgttatgc

SEQ ID NO: 100839 - DNA, 75 bp, Artificial Sequence
  Synthetic
attccatgttttgcatggtgcttaaatagtagtggagagtgatatatattttgttaaaaacattcctcgttatgc

SEQ ID NO: 100840 - DNA, 75 bp, Artificial Sequence
  Synthetic
attccatgttttgcatggtgcttatatagtagtggagagtgatatatattttgttaaaaacattcctcgttatgc

SEQ ID NO: 100841 - DNA, 75 bp, Artificial Sequence
  Synthetic
attccatgttttgcatggtgcttacatagtagtggagagtgatatatattttgttaaaaacattcctcgttatgc

SEQ ID NO: 100842 - DNA, 75 bp, Artificial Sequence
  Synthetic
attccatgttttgcatggtgcttagatagtagtggagagtgatatatattttgttaaaaacattcctcgttatgc

SEQ ID NO: 100843 - DNA, 75 bp, Artificial Sequence
  Synthetic
attgcatgttttgcatggtgcttaaatagtagtggagagtgatatatattttgttaaaaacattcctcgttatgc

SEQ ID NO: 100844 - DNA, 75 bp, Artificial Sequence
  Synthetic
attgcatgttttgcatggtgcttatatagtagtggagagtgatatatattttgttaaaaacattcctcgttatgc

SEQ ID NO: 100845 - DNA, 75 bp, Artificial Sequence
  Synthetic
attgcatgttttgcatggtgcttacatagtagtggagagtgatatatattttgttaaaaacattcctcgttatgc

SEQ ID NO: 100846 - DNA, 75 bp, Artificial Sequence
  Synthetic
attgcatgttttgcatggtgcttagatagtagtggagagtgatatatattttgttaaaaacattcctcgttatgc

SEQ ID NO: 100847 - DNA, 75 bp, Artificial Sequence
  Synthetic
tagtgctgttgcacaagcatttcggagtgttgctaaagttgtactggactctttaagagttacttttattgatgg

SEQ ID NO: 100848 - DNA, 75 bp, Artificial Sequence
  Synthetic
cctttcttgttttaagattggacgtagaagaatttgtctatcaggcagtaaaatttatgaagttgagcgtggctt

SEQ ID NO: 100849 - DNA, 75 bp, Artificial Sequence
  Synthetic
cctttcttgttttaagattggacgtagaagaatttgtctttcaggcagtaaaatttatgaagttgagcgtggctt

SEQ ID NO: 100850 - DNA, 75 bp, Artificial Sequence
  Synthetic
cctttcttgttttaagattggacgtagaagaatttgtctctcaggcagtaaaatttatgaagttgagcgtggctt

SEQ ID NO: 100851 - DNA, 75 bp, Artificial Sequence
  Synthetic
cctttcttgttttaagattggacgtagaagaatttgtctgtcaggcagtaaaatttatgaagttgagcgtggctt

SEQ ID NO: 100852 - DNA, 75 bp, Artificial Sequence
  Synthetic
gttacattcatctcaattgccattagatgtttatgatttaaccatgcctagtcaagttcagaaagccaagcaaaa

SEQ ID NO: 100853 - DNA, 75 bp, Artificial Sequence
  Synthetic
acctatttatttaaaaggttctggttctgatttttcattagcagatagtgtagttgaagttgttacaacttcact

SEQ ID NO: 100854 - DNA, 75 bp, Artificial Sequence
  Synthetic
acctatttatttaaaaggttctggttctgatttttcattagctgatagtgtagttgaagttgttacaacttcact

SEQ ID NO: 100855 - DNA, 75 bp, Artificial Sequence
  Synthetic
acctatttatttaaaaggttctggttctgatttttcattagccgatagtgtagttgaagttgttacaacttcact

SEQ ID NO: 100856 - DNA, 75 bp, Artificial Sequence
  Synthetic
acctatttatttaaaaggttctggttctgatttttcattagcggatagtgtagttgaagttgttacaacttcact

SEQ ID NO: 100857 - DNA, 75 bp, Artificial Sequence
  Synthetic
tacaccatgtggttattctgaaccacctaaagttgcagataaaatttgcattgtggataatgtttatatggccaa

SEQ ID NO: 100858 - DNA, 75 bp, Artificial Sequence
  Synthetic
ggctggtgacaaatattaccctgttgtggttgatggtcatgtaggactcttggatcaagcatggagggttccttg

SEQ ID NO: 100859 - DNA, 75 bp, Artificial Sequence
  Synthetic
tgctggaaggcgtgttacatttaaggaacagcctacagtaaatgagattgcaagcacacctaagactattaaagt

SEQ ID NO: 100860 - DNA, 75 bp, Artificial Sequence
  Synthetic
tttttatgagcttgacaaagattttaatactattttaaacactgcatgtggagtgtttgaagtagatgatacagt

SEQ ID NO: 100861 - DNA, 75 bp, Artificial Sequence
  Synthetic
tttttatgagcttgacaaagattttaatactattttaaacactgcatgtggagtgtttgaagtagatgatactgt

SEQ ID NO: 100862 - DNA, 75 bp, Artificial Sequence
  Synthetic
tttttatgagcttgacaaagattttaatactattttaaacactgcatgtggagtgtttgaagtagatgataccgt

SEQ ID NO: 100863 - DNA, 75 bp, Artificial Sequence
  Synthetic
tttttatgagcttgacaaagattttaatactattttaaacactgcatgtggagtgtttgaagtagatgatacggt

SEQ ID NO: 100864 - DNA, 75 bp, Artificial Sequence
  Synthetic
tttttatgagcttgacaaagattttaatactattttaaacactgcatgtggtgtgtttgaagtagatgatacagt

SEQ ID NO: 100865 - DNA, 75 bp, Artificial Sequence
  Synthetic
tttttatgagcttgacaaagattttaatactattttaaacactgcatgtggtgtgtttgaagtagatgatactgt

SEQ ID NO: 100866 - DNA, 75 bp, Artificial Sequence
  Synthetic
tttttatgagcttgacaaagattttaatactattttaaacactgcatgtggtgtgtttgaagtagatgataccgt

SEQ ID NO: 100867 - DNA, 75 bp, Artificial Sequence
  Synthetic
tttttatgagcttgacaaagattttaatactattttaaacactgcatgtggtgtgtttgaagtagatgatacggt

SEQ ID NO: 100868 - DNA, 75 bp, Artificial Sequence
  Synthetic
tttttatgagcttgacaaagattttaatactattttaaacactgcatgtggcgtgtttgaagtagatgatacagt

SEQ ID NO: 100869 - DNA, 75 bp, Artificial Sequence
  Synthetic
tttttatgagcttgacaaagattttaatactattttaaacactgcatgtggcgtgtttgaagtagatgatactgt

SEQ ID NO: 100870 - DNA, 75 bp, Artificial Sequence
  Synthetic
tttttatgagcttgacaaagattttaatactattttaaacactgcatgtggcgtgtttgaagtagatgataccgt

SEQ ID NO: 100871 - DNA, 75 bp, Artificial Sequence
  Synthetic
tttttatgagcttgacaaagattttaatactattttaaacactgcatgtggcgtgtttgaagtagatgatacggt

SEQ ID NO: 100872 - DNA, 75 bp, Artificial Sequence
  Synthetic
tttttatgagcttgacaaagattttaatactattttaaacactgcatgtggggtgtttgaagtagatgatacagt

SEQ ID NO: 100873 - DNA, 75 bp, Artificial Sequence
  Synthetic
tttttatgagcttgacaaagattttaatactattttaaacactgcatgtggggtgtttgaagtagatgatactgt

SEQ ID NO: 100874 - DNA, 75 bp, Artificial Sequence
  Synthetic
tttttatgagcttgacaaagattttaatactattttaaacactgcatgtggggtgtttgaagtagatgataccgt

SEQ ID NO: 100875 - DNA, 75 bp, Artificial Sequence
  Synthetic
tttttatgagcttgacaaagattttaatactattttaaacactgcatgtggggtgtttgaagtagatgatacggt

SEQ ID NO: 100876 - DNA, 75 bp, Artificial Sequence
  Synthetic
ggatatggaggaattttatgctgtggtgattgatgccatagaagagaaactttctccatgtaaggagcttgaagg

SEQ ID NO: 100877 - DNA, 75 bp, Artificial Sequence
  Synthetic
tgtaggtgctaaagttagtgcctttttacagaaattagaggataattccttatttttatttgatgaggctggtga

SEQ ID NO: 100878 - DNA, 75 bp, Artificial Sequence
  Synthetic
ggaagttcttgcccctaaattgtattgtgcttttacagctcctgaagatgatgactttcttgaagaaagtggtgt

SEQ ID NO: 100879 - DNA, 75 bp, Artificial Sequence
  Synthetic
tgaagaagatgatgtagaaggtgaggaaactgatttaactgtcacaagtgctggagagccttgtgttgccagtga

SEQ ID NO: 100880 - DNA, 75 bp, Artificial Sequence
  Synthetic
acaggaggagtcttctgaaatcttagaggacactttggatgacggtccatgtgtggagacatctgattcacaatt

SEQ ID NO: 100881 - DNA, 75 bp, Artificial Sequence
  Synthetic
tgaagaagatgtagaaatgtcggattttgttgatcttgaatctgttattcaggattatgaaaatgtttgttttga

SEQ ID NO: 100882 - DNA, 75 bp, Artificial Sequence
  Synthetic
gttttatactacagagccagaatttgttaaagttttggatctgtatgtgcctaaagcaactcgcaacaattgctg

SEQ ID NO: 100883 - DNA, 75 bp, Artificial Sequence
  Synthetic
gttgcgatcagttttggcagtgatgcagaaattgccctgtcaatttaaagataaaaatttgcaggatctttgggt

SEQ ID NO: 100884 - DNA, 75 bp, Artificial Sequence
  Synthetic
gttatataagcaacagtatagtcagttgtttgttgataccttggttaataagatacctgctaatattgtagttcc

SEQ ID NO: 100885 - DNA, 75 bp, Artificial Sequence
  Synthetic
acaaggtggttatgttgctgattttgcatattggttcttaaccttatgtgattggcagtgtgttgcatactggaa

SEQ ID NO: 100886 - DNA, 75 bp, Artificial Sequence
  Synthetic
atgcattaaatgtgatttagctcttaagcttaaaggcttggatgctatgttcttttatggtgatgttgtctcaca

SEQ ID NO: 100887 - DNA, 75 bp, Artificial Sequence
  Synthetic
tgtgtgcaagtgtggtgagtctatggtacttattgatgttgatgtaccatttacagcccactttgctcttaaaga

SEQ ID NO: 100888 - DNA, 75 bp, Artificial Sequence
  Synthetic
taagttgttttgtgcatttattactaagcgtagtgtgtataaagcagcttgtgttgtggatgttaatgatagcca

SEQ ID NO: 100889 - DNA, 75 bp, Artificial Sequence
  Synthetic
ttctatggctgttgttgatggtaaacaaattgatgatcatcgtgtcactagtattactagtgataagtttgattt

SEQ ID NO: 100890 - DNA, 75 bp, Artificial Sequence
  Synthetic
tattattgggcatggcatgtcattttcaatgactacttttgaaattgcccaattgtatggttcttgtataacacc

SEQ ID NO: 100891 - DNA, 75 bp, Artificial Sequence
  Synthetic
taatgtatgttttgttaaaggtgatataattaaagtttctaagcgtgttaaagcagaagtcgttgtaaatcctgc

SEQ ID NO: 100892 - DNA, 75 bp, Artificial Sequence
  Synthetic
taatggccatatggcacatggtggtggtgttgcaaaggctattgcagtggcagctggacagcagttcgttaaaga

SEQ ID NO: 100893 - DNA, 75 bp, Artificial Sequence
  Synthetic
gactaccgatatggttaagtctaaaggagtttgtgctactggagattgttatgtctctacagggggcaaattatg

SEQ ID NO: 100894 - DNA, 75 bp, Artificial Sequence
  Synthetic
taaaactgtgcttaatgttgttggacctgatgcgaggacacagggtaaacaaagttatgcattgttagagcgtgt

SEQ ID NO: 100895 - DNA, 75 bp, Artificial Sequence
  Synthetic
ttataaacatcttaacaaatatgattgtgttgttacaactttgatttcagctggtatatttagtgtgccttctga

SEQ ID NO: 100896 - DNA, 75 bp, Artificial Sequence
  Synthetic
tgtgtctttaacatatctacttggtactgctaagaaacaagttgttcttgttagcaataatcaagaggattttga

SEQ ID NO: 100897 - DNA, 75 bp, Artificial Sequence
  Synthetic
tcttatttctaagtgtcagataactgctgttgagggcactaagaaattggcagaacgtctttcttttaatgttgg

SEQ ID NO: 100898 - DNA, 75 bp, Artificial Sequence
  Synthetic
gcgttctatcgtttacgaaacagatgctaataagttgattttaagcaatgatgttgcatttgtttcgacatttaa

SEQ ID NO: 100899 - DNA, 75 bp, Artificial Sequence
  Synthetic
tgtcttacaggacgttttatccttaagacatgatatagcacttgatgatgatgcacgaacatttgttcagagcaa

SEQ ID NO: 100900 - DNA, 75 bp, Artificial Sequence
  Synthetic
tgttgatgttgtacctgagggttggcgtgttgtcaataagttttatcaaattaatggtgttagaaccgttaagta

SEQ ID NO: 100901 - DNA, 75 bp, Artificial Sequence
  Synthetic
ttttgagtgtcctgggggcatagacatatgcagccaggataaagtttttggttatgtacagcagggtagttttaa

SEQ ID NO: 100902 - DNA, 75 bp, Artificial Sequence
  Synthetic
taaggctactgttgctcaaattaaagccttgtttttagataaagtggacatattgctaactgttgatggtgtcaa

SEQ ID NO: 100903 - DNA, 75 bp, Artificial Sequence
  Synthetic
taaggctactgttgctcaaattaaagccttgtttttagataaagtggacattttgctaactgttgatggtgtcaa

SEQ ID NO: 100904 - DNA, 75 bp, Artificial Sequence
  Synthetic
taaggctactgttgctcaaattaaagccttgtttttagataaagtggacatcttgctaactgttgatggtgtcaa

SEQ ID NO: 100905 - DNA, 75 bp, Artificial Sequence
  Synthetic
taaggctactgttgctcaaattaaagccttgtttttagataaagtggacatgttgctaactgttgatggtgtcaa

SEQ ID NO: 100906 - DNA, 75 bp, Artificial Sequence
  Synthetic
taaggctactgttgctcaaattaaagccttgttttttgataaagtggacatattgctaactgttgatggtgtcaa

SEQ ID NO: 100907 - DNA, 75 bp, Artificial Sequence
  Synthetic
taaggctactgttgctcaaattaaagccttgttttttgataaagtggacattttgctaactgttgatggtgtcaa

SEQ ID NO: 100908 - DNA, 75 bp, Artificial Sequence
  Synthetic
taaggctactgttgctcaaattaaagccttgttttttgataaagtggacatcttgctaactgttgatggtgtcaa

SEQ ID NO: 100909 - DNA, 75 bp, Artificial Sequence
  Synthetic
taaggctactgttgctcaaattaaagccttgttttttgataaagtggacatgttgctaactgttgatggtgtcaa

SEQ ID NO: 100910 - DNA, 75 bp, Artificial Sequence
  Synthetic
taaggctactgttgctcaaattaaagccttgtttttcgataaagtggacatattgctaactgttgatggtgtcaa

SEQ ID NO: 100911 - DNA, 75 bp, Artificial Sequence
  Synthetic
taaggctactgttgctcaaattaaagccttgtttttcgataaagtggacattttgctaactgttgatggtgtcaa

SEQ ID NO: 100912 - DNA, 75 bp, Artificial Sequence
  Synthetic
taaggctactgttgctcaaattaaagccttgtttttcgataaagtggacatcttgctaactgttgatggtgtcaa

SEQ ID NO: 100913 - DNA, 75 bp, Artificial Sequence
  Synthetic
taaggctactgttgctcaaattaaagccttgtttttcgataaagtggacatgttgctaactgttgatggtgtcaa

SEQ ID NO: 100914 - DNA, 75 bp, Artificial Sequence
  Synthetic
taaggctactgttgctcaaattaaagccttgtttttggataaagtggacatattgctaactgttgatggtgtcaa

SEQ ID NO: 100915 - DNA, 75 bp, Artificial Sequence
  Synthetic
taaggctactgttgctcaaattaaagccttgtttttggataaagtggacattttgctaactgttgatggtgtcaa

SEQ ID NO: 100916 - DNA, 75 bp, Artificial Sequence
  Synthetic
taaggctactgttgctcaaattaaagccttgtttttggataaagtggacatcttgctaactgttgatggtgtcaa

SEQ ID NO: 100917 - DNA, 75 bp, Artificial Sequence
  Synthetic
taaggctactgttgctcaaattaaagccttgtttttggataaagtggacatgttgctaactgttgatggtgtcaa

SEQ ID NO: 100918 - DNA, 75 bp, Artificial Sequence
  Synthetic
tttcactaacaggtttgtgcctgtaggtgaaagttttggtaagagtctaggaaatgtgttttgtgatggagttaa

SEQ ID NO: 100919 - DNA, 75 bp, Artificial Sequence
  Synthetic
tgtcacgaaacataagtgtgatataaattataaaggtaaagtctttttccagtttgataatctttctagtgaaga

SEQ ID NO: 100920 - DNA, 75 bp, Artificial Sequence
  Synthetic
tttaaaggctgtaagaagttcttttaaatttgatcagaaggaattgcttgcctactacaacatgcttgttaattg

SEQ ID NO: 100921 - DNA, 75 bp, Artificial Sequence
  Synthetic
tttaaaggctgtaagaagttcttttaaatttgatcagaaggatttgcttgcctactacaacatgcttgttaattg

SEQ ID NO: 100922 - DNA, 75 bp, Artificial Sequence
  Synthetic
tttaaaggctgtaagaagttcttttaaatttgatcagaaggacttgcttgcctactacaacatgcttgttaattg

SEQ ID NO: 100923 - DNA, 75 bp, Artificial Sequence
  Synthetic
tttaaaggctgtaagaagttcttttaaatttgatcagaaggagttgcttgcctactacaacatgcttgttaattg

SEQ ID NO: 100924 - DNA, 75 bp, Artificial Sequence
  Synthetic
tttaaaggctgtaagaagttcttttaattttgatcagaaggaattgcttgcctactacaacatgcttgttaattg

SEQ ID NO: 100925 - DNA, 75 bp, Artificial Sequence
  Synthetic
tttaaaggctgtaagaagttcttttaattttgatcagaaggatttgcttgcctactacaacatgcttgttaattg

SEQ ID NO: 100926 - DNA, 75 bp, Artificial Sequence
  Synthetic
tttaaaggctgtaagaagttcttttaattttgatcagaaggacttgcttgcctactacaacatgcttgttaattg

SEQ ID NO: 100927 - DNA, 75 bp, Artificial Sequence
  Synthetic
tttaaaggctgtaagaagttcttttaattttgatcagaaggagttgcttgcctactacaacatgcttgttaattg

SEQ ID NO: 100928 - DNA, 75 bp, Artificial Sequence
  Synthetic
tttaaaggctgtaagaagttcttttaactttgatcagaaggaattgcttgcctactacaacatgcttgttaattg

SEQ ID NO: 100929 - DNA, 75 bp, Artificial Sequence
  Synthetic
tttaaaggctgtaagaagttcttttaactttgatcagaaggatttgcttgcctactacaacatgcttgttaattg

SEQ ID NO: 100930 - DNA, 75 bp, Artificial Sequence
  Synthetic
tttaaaggctgtaagaagttcttttaactttgatcagaaggacttgcttgcctactacaacatgcttgttaattg

SEQ ID NO: 100931 - DNA, 75 bp, Artificial Sequence
  Synthetic
tttaaaggctgtaagaagttcttttaactttgatcagaaggagttgcttgcctactacaacatgcttgttaattg

SEQ ID NO: 100932 - DNA, 75 bp, Artificial Sequence
  Synthetic
tttaaaggctgtaagaagttcttttaagtttgatcagaaggaattgcttgcctactacaacatgcttgttaattg

SEQ ID NO: 100933 - DNA, 75 bp, Artificial Sequence
  Synthetic
tttaaaggctgtaagaagttcttttaagtttgatcagaaggatttgcttgcctactacaacatgcttgttaattg

SEQ ID NO: 100934 - DNA, 75 bp, Artificial Sequence
  Synthetic
tttaaaggctgtaagaagttcttttaagtttgatcagaaggacttgcttgcctactacaacatgcttgttaattg

SEQ ID NO: 100935 - DNA, 75 bp, Artificial Sequence
  Synthetic
tttaaaggctgtaagaagttcttttaagtttgatcagaaggagttgcttgcctactacaacatgcttgttaattg

SEQ ID NO: 100936 - DNA, 75 bp, Artificial Sequence
  Synthetic
ttctaagtggcaggttgtttttaatggtaagtatttcacttttaagcaagctaataacaattgttttgttaatgt

SEQ ID NO: 100937 - DNA, 75 bp, Artificial Sequence
  Synthetic
ttcttgcttaatgctccagagtttgaatctgaaatttaaaattgttcaatggcaggaggcatggcttgaatttcg

SEQ ID NO: 100938 - DNA, 75 bp, Artificial Sequence
  Synthetic
ttctggccgccctgctagatttgtatctttggttttggctaaaggtgggtttaaatttggggatcctgctgattc

SEQ ID NO: 100939 - DNA, 75 bp, Artificial Sequence
  Synthetic
tagagatttcttgcgtgttgtgtttagtcaagttgatttgacaggggcaatatgtgattttgaaattgcatgtaa

SEQ ID NO: 100940 - DNA, 75 bp, Artificial Sequence
  Synthetic
atgtggtgtaaagcaggaacagcgtactggtgtagacgctgttatgcattttggtacattgagtcgtgaagatct

SEQ ID NO: 100941 - DNA, 75 bp, Artificial Sequence
  Synthetic
atgtggtgtaaagcaggaacagcgtactggtgttgacgctgttatgcattttggtacattgagtcgtgaagatct

SEQ ID NO: 100942 - DNA, 75 bp, Artificial Sequence
  Synthetic
atgtggtgtaaagcaggaacagcgtactggtgtcgacgctgttatgcattttggtacattgagtcgtgaagatct

SEQ ID NO: 100943 - DNA, 75 bp, Artificial Sequence
  Synthetic
atgtggtgtaaagcaggaacagcgtactggtgtggacgctgttatgcattttggtacattgagtcgtgaagatct

SEQ ID NO: 100944 - DNA, 75 bp, Artificial Sequence
  Synthetic
tgagattggttacaccgtggattgttcttgcggtaaaaagctaattcattgtgtacgatttgaagtaccattttt

SEQ ID NO: 100945 - DNA, 75 bp, Artificial Sequence
  Synthetic
tgagattggttacaccgtggattgttcttgcggtaaaaagctaattcattgtgtacgatttgatgtaccattttt

SEQ ID NO: 100946 - DNA, 75 bp, Artificial Sequence
  Synthetic
tgagattggttacaccgtggattgttcttgcggtaaaaagctaattcattgtgtacgatttgacgtaccattttt

SEQ ID NO: 100947 - DNA, 75 bp, Artificial Sequence
  Synthetic
tgagattggttacaccgtggattgttcttgcggtaaaaagctaattcattgtgtacgatttgaggtaccattttt

SEQ ID NO: 100948 - DNA, 75 bp, Artificial Sequence
  Synthetic
aatttgcagtaatacacctgctagtgtaaaattacctaagggtgtaggaagtgcaaatatttttaaaggtgataa

SEQ ID NO: 100949 - DNA, 75 bp, Artificial Sequence
  Synthetic
ggttggtcattatgttcatgttaagtgtgaacagtcttatcagctttatgatgcttctaatgtaaagaaggttac

SEQ ID NO: 100950 - DNA, 75 bp, Artificial Sequence
  Synthetic
ggttggtcattatgttcatgttaagtgtgaacagtcttatcagctttatgatgcttctaatgttaagaaggttac

SEQ ID NO: 100951 - DNA, 75 bp, Artificial Sequence
  Synthetic
ggttggtcattatgttcatgttaagtgtgaacagtcttatcagctttatgatgcttctaatgtcaagaaggttac

SEQ ID NO: 100952 - DNA, 75 bp, Artificial Sequence
  Synthetic
ggttggtcattatgttcatgttaagtgtgaacagtcttatcagctttatgatgcttctaatgtgaagaaggttac

SEQ ID NO: 100953 - DNA, 75 bp, Artificial Sequence
  Synthetic
agacgttactggcaatttgtcagattgtttgtatcttaaaaatttgaaacaaacttttaaatcggtgttaaccac

SEQ ID NO: 100954 - DNA, 75 bp, Artificial Sequence
  Synthetic
ctattatttggatgatgttaagaaaattgagtataaacctgacttgtcacaatattattgtgacggaggtaagta

SEQ ID NO: 100955 - DNA, 75 bp, Artificial Sequence
  Synthetic
ttatactcagcgtattattaaagcccaatttaaaacatttgagaaagtagatggtgtgtatactaattttaaatt

SEQ ID NO: 100956 - DNA, 75 bp, Artificial Sequence
  Synthetic
gataggacacaccgtctgtgatattcttaatactaagttgggttttgatagctctaaagagtttgttgaatataa

SEQ ID NO: 100957 - DNA, 75 bp, Artificial Sequence
  Synthetic
gataggacacaccgtctgtgatattcttaattctaagttgggttttgatagctctaaagagtttgttgaatataa

SEQ ID NO: 100958 - DNA, 75 bp, Artificial Sequence
  Synthetic
gataggacacaccgtctgtgatattcttaatcctaagttgggttttgatagctctaaagagtttgttgaatataa

SEQ ID NO: 100959 - DNA, 75 bp, Artificial Sequence
  Synthetic
gataggacacaccgtctgtgatattcttaatgctaagttgggttttgatagctctaaagagtttgttgaatataa

SEQ ID NO: 100960 - DNA, 75 bp, Artificial Sequence
  Synthetic
gttaggacacaccgtctgtgatattcttaatactaagttgggttttgatagctctaaagagtttgttgaatataa

SEQ ID NO: 100961 - DNA, 75 bp, Artificial Sequence
  Synthetic
gttaggacacaccgtctgtgatattcttaattctaagttgggttttgatagctctaaagagtttgttgaatataa

SEQ ID NO: 100962 - DNA, 75 bp, Artificial Sequence
  Synthetic
gttaggacacaccgtctgtgatattcttaatcctaagttgggttttgatagctctaaagagtttgttgaatataa

SEQ ID NO: 100963 - DNA, 75 bp, Artificial Sequence
  Synthetic
gttaggacacaccgtctgtgatattcttaatgctaagttgggttttgatagctctaaagagtttgttgaatataa

SEQ ID NO: 100964 - DNA, 75 bp, Artificial Sequence
  Synthetic
gctaggacacaccgtctgtgatattcttaatactaagttgggttttgatagctctaaagagtttgttgaatataa

SEQ ID NO: 100965 - DNA, 75 bp, Artificial Sequence
  Synthetic
gctaggacacaccgtctgtgatattcttaattctaagttgggttttgatagctctaaagagtttgttgaatataa

SEQ ID NO: 100966 - DNA, 75 bp, Artificial Sequence
  Synthetic
gctaggacacaccgtctgtgatattcttaatcctaagttgggttttgatagctctaaagagtttgttgaatataa

SEQ ID NO: 100967 - DNA, 75 bp, Artificial Sequence
  Synthetic
gctaggacacaccgtctgtgatattcttaatgctaagttgggttttgatagctctaaagagtttgttgaatataa

SEQ ID NO: 100968 - DNA, 75 bp, Artificial Sequence
  Synthetic
ggtaggacacaccgtctgtgatattcttaatactaagttgggttttgatagctctaaagagtttgttgaatataa

SEQ ID NO: 100969 - DNA, 75 bp, Artificial Sequence
  Synthetic
ggtaggacacaccgtctgtgatattcttaattctaagttgggttttgatagctctaaagagtttgttgaatataa

SEQ ID NO: 100970 - DNA, 75 bp, Artificial Sequence
  Synthetic
ggtaggacacaccgtctgtgatattcttaatcctaagttgggttttgatagctctaaagagtttgttgaatataa

SEQ ID NO: 100971 - DNA, 75 bp, Artificial Sequence
  Synthetic
ggtaggacacaccgtctgtgatattcttaatgctaagttgggttttgatagctctaaagagtttgttgaatataa

SEQ ID NO: 100972 - DNA, 75 bp, Artificial Sequence
  Synthetic
ggttactgagtggccaacagctacaggtgatgtggtgttggctactgatgatttatatgttaagagatacgaaag

SEQ ID NO: 100973 - DNA, 75 bp, Artificial Sequence
  Synthetic
gggttgtattacttttggtaaacctgttatatggttgagccatgagcaagcttccctcaattctttaacatattt

SEQ ID NO: 100974 - DNA, 75 bp, Artificial Sequence
  Synthetic
taatagacctttattggttgatgagaataaatttgatgttttaaaagtggatgatgttgacgatggcggtgacaa

SEQ ID NO: 100975 - DNA, 75 bp, Artificial Sequence
  Synthetic
taatagacctttattggttgatgagaataaatttgatgttttaaaagtggatgatgttgacgatggcggtgacat

SEQ ID NO: 100976 - DNA, 75 bp, Artificial Sequence
  Synthetic
taatagacctttattggttgatgagaataaatttgatgttttaaaagtggatgatgttgacgatggcggtgacac

SEQ ID NO: 100977 - DNA, 75 bp, Artificial Sequence
  Synthetic
taatagacctttattggttgatgagaataaatttgatgttttaaaagtggatgatgttgacgatggcggtgacag

SEQ ID NO: 100978 - DNA, 75 bp, Artificial Sequence
  Synthetic
ctcagagagtgatgacaaagaacccaaagaaatcaacattattaagttaagtggtgtaaaaaaaccatttaaggt

SEQ ID NO: 100979 - DNA, 75 bp, Artificial Sequence
  Synthetic
ctcagagagtgatgacaaagaacccaaagaaatcaacattattaagttaagtggtgttaaaaaaccatttaaggt

SEQ ID NO: 100980 - DNA, 75 bp, Artificial Sequence
  Synthetic
ctcagagagtgatgacaaagaacccaaagaaatcaacattattaagttaagtggtgtcaaaaaaccatttaaggt

SEQ ID NO: 100981 - DNA, 75 bp, Artificial Sequence
  Synthetic
ctcagagagtgatgacaaagaacccaaagaaatcaacattattaagttaagtggtgtgaaaaaaccatttaaggt

SEQ ID NO: 100982 - DNA, 75 bp, Artificial Sequence
  Synthetic
ctcagagagtgatgtcaaagaacccaaagaaatcaacattattaagttaagtggtgtaaaaaaaccatttaaggt

SEQ ID NO: 100983 - DNA, 75 bp, Artificial Sequence
  Synthetic
ctcagagagtgatgtcaaagaacccaaagaaatcaacattattaagttaagtggtgttaaaaaaccatttaaggt

SEQ ID NO: 100984 - DNA, 75 bp, Artificial Sequence
  Synthetic
ctcagagagtgatgtcaaagaacccaaagaaatcaacattattaagttaagtggtgtcaaaaaaccatttaaggt

SEQ ID NO: 100985 - DNA, 75 bp, Artificial Sequence
  Synthetic
ctcagagagtgatgtcaaagaacccaaagaaatcaacattattaagttaagtggtgtgaaaaaaccatttaaggt

SEQ ID NO: 100986 - DNA, 75 bp, Artificial Sequence
  Synthetic
ctcagagagtgatgccaaagaacccaaagaaatcaacattattaagttaagtggtgtaaaaaaaccatttaaggt

SEQ ID NO: 100987 - DNA, 75 bp, Artificial Sequence
  Synthetic
ctcagagagtgatgccaaagaacccaaagaaatcaacattattaagttaagtggtgttaaaaaaccatttaaggt

SEQ ID NO: 100988 - DNA, 75 bp, Artificial Sequence
  Synthetic
ctcagagagtgatgccaaagaacccaaagaaatcaacattattaagttaagtggtgtcaaaaaaccatttaaggt

SEQ ID NO: 100989 - DNA, 75 bp, Artificial Sequence
  Synthetic
ctcagagagtgatgccaaagaacccaaagaaatcaacattattaagttaagtggtgtgaaaaaaccatttaaggt

SEQ ID NO: 100990 - DNA, 75 bp, Artificial Sequence
  Synthetic
ctcagagagtgatggcaaagaacccaaagaaatcaacattattaagttaagtggtgtaaaaaaaccatttaaggt

SEQ ID NO: 100991 - DNA, 75 bp, Artificial Sequence
  Synthetic
ctcagagagtgatggcaaagaacccaaagaaatcaacattattaagttaagtggtgttaaaaaaccatttaaggt

SEQ ID NO: 100992 - DNA, 75 bp, Artificial Sequence
  Synthetic
ctcagagagtgatggcaaagaacccaaagaaatcaacattattaagttaagtggtgtcaaaaaaccatttaaggt

SEQ ID NO: 100993 - DNA, 75 bp, Artificial Sequence
  Synthetic
ctcagagagtgatggcaaagaacccaaagaaatcaacattattaagttaagtggtgtgaaaaaaccatttaaggt

SEQ ID NO: 100994 - DNA, 75 bp, Artificial Sequence
  Synthetic
tgaagatagtgtcattgttaatgatgaaactagtgaaatcaaatatgttaagagtttgtttatagttgatgtgta

SEQ ID NO: 100995 - DNA, 75 bp, Artificial Sequence
  Synthetic
tgaagatagtgtcattgttaatgatgatactagtgaaatcaaatatgttaagagtttgtttatagttgatgtgta

SEQ ID NO: 100996 - DNA, 75 bp, Artificial Sequence
  Synthetic
tgaagatagtgtcattgttaatgatgacactagtgaaatcaaatatgttaagagtttgtttatagttgatgtgta

SEQ ID NO: 100997 - DNA, 75 bp, Artificial Sequence
  Synthetic
tgaagatagtgtcattgttaatgatgagactagtgaaatcaaatatgttaagagtttgtttatagttgatgtgta

SEQ ID NO: 100998 - DNA, 75 bp, Artificial Sequence
  Synthetic
tgatatgtggcttacaggttgtaggtatgttgttaggactgctaatgctttgagcaaagcagttaacgtacctac

SEQ ID NO: 100999 - DNA, 75 bp, Artificial Sequence
  Synthetic
tgatatgtggcttacaggttgtaggtatgttgttaggactgctaatgctttgagcatagcagttaacgtacctac

SEQ ID NO: 101000 - DNA, 75 bp, Artificial Sequence
  Synthetic
tgatatgtggcttacaggttgtaggtatgttgttaggactgctaatgctttgagcacagcagttaacgtacctac

SEQ ID NO: 101001 - DNA, 75 bp, Artificial Sequence
  Synthetic
tgatatgtggcttacaggttgtaggtatgttgttaggactgctaatgctttgagcagagcagttaacgtacctac

SEQ ID NO: 101002 - DNA, 75 bp, Artificial Sequence
  Synthetic
aatacgtaagtttataaaatttggtatgactcttgttagtataccaattgatttgttaaatttaagagagattaa

SEQ ID NO: 101003 - DNA, 75 bp, Artificial Sequence
  Synthetic
gcctgtttttaatgtggttaaaactgtgcgaaataaaatttctgcatgctttaattttattaaatggctttttgt

SEQ ID NO: 101004 - DNA, 75 bp, Artificial Sequence
  Synthetic
gcctgtttttaatgtggttaaaactgtgcgaaataaaatttctgcatgctttaatttttttaaatggctttttgt

SEQ ID NO: 101005 - DNA, 75 bp, Artificial Sequence
  Synthetic
gcctgtttttaatgtggttaaaactgtgcgaaataaaatttctgcatgctttaattttcttaaatggctttttgt

SEQ ID NO: 101006 - DNA, 75 bp, Artificial Sequence
  Synthetic
gcctgtttttaatgtggttaaaactgtgcgaaataaaatttctgcatgctttaattttgttaaatggctttttgt

SEQ ID NO: 101007 - DNA, 75 bp, Artificial Sequence
  Synthetic
gcctgtttttaatgtggttaaatctgtgcgaaataaaatttctgcatgctttaattttattaaatggctttttgt

SEQ ID NO: 101008 - DNA, 75 bp, Artificial Sequence
  Synthetic
gcctgtttttaatgtggttaaatctgtgcgaaataaaatttctgcatgctttaatttttttaaatggctttttgt

SEQ ID NO: 101009 - DNA, 75 bp, Artificial Sequence
  Synthetic
gcctgtttttaatgtggttaaatctgtgcgaaataaaatttctgcatgctttaattttcttaaatggctttttgt

SEQ ID NO: 101010 - DNA, 75 bp, Artificial Sequence
  Synthetic
gcctgtttttaatgtggttaaatctgtgcgaaataaaatttctgcatgctttaattttgttaaatggctttttgt

SEQ ID NO: 101011 - DNA, 75 bp, Artificial Sequence
  Synthetic
gcctgtttttaatgtggttaaacctgtgcgaaataaaatttctgcatgctttaattttattaaatggctttttgt

SEQ ID NO: 101012 - DNA, 75 bp, Artificial Sequence
  Synthetic
gcctgtttttaatgtggttaaacctgtgcgaaataaaatttctgcatgctttaatttttttaaatggctttttgt

SEQ ID NO: 101013 - DNA, 75 bp, Artificial Sequence
  Synthetic
gcctgtttttaatgtggttaaacctgtgcgaaataaaatttctgcatgctttaattttcttaaatggctttttgt

SEQ ID NO: 101014 - DNA, 75 bp, Artificial Sequence
  Synthetic
gcctgtttttaatgtggttaaacctgtgcgaaataaaatttctgcatgctttaattttgttaaatggctttttgt

SEQ ID NO: 101015 - DNA, 75 bp, Artificial Sequence
  Synthetic
gcctgtttttaatgtggttaaagctgtgcgaaataaaatttctgcatgctttaattttattaaatggctttttgt

SEQ ID NO: 101016 - DNA, 75 bp, Artificial Sequence
  Synthetic
gcctgtttttaatgtggttaaagctgtgcgaaataaaatttctgcatgctttaatttttttaaatggctttttgt

SEQ ID NO: 101017 - DNA, 75 bp, Artificial Sequence
  Synthetic
gcctgtttttaatgtggttaaagctgtgcgaaataaaatttctgcatgctttaattttcttaaatggctttttgt

SEQ ID NO: 101018 - DNA, 75 bp, Artificial Sequence
  Synthetic
gcctgtttttaatgtggttaaagctgtgcgaaataaaatttctgcatgctttaattttgttaaatggctttttgt

SEQ ID NO: 101019 - DNA, 75 bp, Artificial Sequence
  Synthetic
cttattatttggctggattaaaatatccgctgataataaagtaatatacaccacagaagttgcatcaaagcttac

SEQ ID NO: 101020 - DNA, 75 bp, Artificial Sequence
  Synthetic
cttattatttggctggattaaaatatccgctgataataaagtaatttacaccacagaagttgcatcaaagcttac

SEQ ID NO: 101021 - DNA, 75 bp, Artificial Sequence
  Synthetic
cttattatttggctggattaaaatatccgctgataataaagtaatctacaccacagaagttgcatcaaagcttac

SEQ ID NO: 101022 - DNA, 75 bp, Artificial Sequence
  Synthetic
cttattatttggctggattaaaatatccgctgataataaagtaatgtacaccacagaagttgcatcaaagcttac

SEQ ID NO: 101023 - DNA, 75 bp, Artificial Sequence
  Synthetic
gtgtaagcttgtagctttagcttttaaaaatgcatttttgacatttaagtggagtgtggttgctagaggtgcttg

SEQ ID NO: 101024 - DNA, 75 bp, Artificial Sequence
  Synthetic
cattatagcgactatatttctgttgtggtttaattttatatatgccaatgtaatttttagtgatttttatttgcc

SEQ ID NO: 101025 - DNA, 75 bp, Artificial Sequence
  Synthetic
taaaatcggattcttgccgacttttgttggtaagattgaacagtggattaagaacacttttagtcttgtaactat

SEQ ID NO: 101026 - DNA, 75 bp, Artificial Sequence
  Synthetic
taaaatcggattcttgccgacttttgttggtaagattgtacagtggattaagaacacttttagtcttgtaactat

SEQ ID NO: 101027 - DNA, 75 bp, Artificial Sequence
  Synthetic
taaaatcggattcttgccgacttttgttggtaagattgcacagtggattaagaacacttttagtcttgtaactat

SEQ ID NO: 101028 - DNA, 75 bp, Artificial Sequence
  Synthetic
taaaatcggattcttgccgacttttgttggtaagattggacagtggattaagaacacttttagtcttgtaactat

SEQ ID NO: 101029 - DNA, 75 bp, Artificial Sequence
  Synthetic
taaaatcggtttcttgccgacttttgttggtaagattgaacagtggattaagaacacttttagtcttgtaactat

SEQ ID NO: 101030 - DNA, 75 bp, Artificial Sequence
  Synthetic
taaaatcggtttcttgccgacttttgttggtaagattgtacagtggattaagaacacttttagtcttgtaactat

SEQ ID NO: 101031 - DNA, 75 bp, Artificial Sequence
  Synthetic
taaaatcggtttcttgccgacttttgttggtaagattgcacagtggattaagaacacttttagtcttgtaactat

SEQ ID NO: 101032 - DNA, 75 bp, Artificial Sequence
  Synthetic
taaaatcggtttcttgccgacttttgttggtaagattggacagtggattaagaacacttttagtcttgtaactat

SEQ ID NO: 101033 - DNA, 75 bp, Artificial Sequence
  Synthetic
taaaatcggcttcttgccgacttttgttggtaagattgaacagtggattaagaacacttttagtcttgtaactat

SEQ ID NO: 101034 - DNA, 75 bp, Artificial Sequence
  Synthetic
taaaatcggcttcttgccgacttttgttggtaagattgtacagtggattaagaacacttttagtcttgtaactat

SEQ ID NO: 101035 - DNA, 75 bp, Artificial Sequence
  Synthetic
taaaatcggcttcttgccgacttttgttggtaagattgcacagtggattaagaacacttttagtcttgtaactat

SEQ ID NO: 101036 - DNA, 75 bp, Artificial Sequence
  Synthetic
taaaatcggcttcttgccgacttttgttggtaagattggacagtggattaagaacacttttagtcttgtaactat

SEQ ID NO: 101037 - DNA, 75 bp, Artificial Sequence
  Synthetic
taaaatcgggttcttgccgacttttgttggtaagattgaacagtggattaagaacacttttagtcttgtaactat

SEQ ID NO: 101038 - DNA, 75 bp, Artificial Sequence
  Synthetic
taaaatcgggttcttgccgacttttgttggtaagattgtacagtggattaagaacacttttagtcttgtaactat

SEQ ID NO: 101039 - DNA, 75 bp, Artificial Sequence
  Synthetic
taaaatcgggttcttgccgacttttgttggtaagattgcacagtggattaagaacacttttagtcttgtaactat

SEQ ID NO: 101040 - DNA, 75 bp, Artificial Sequence
  Synthetic
taaaatcgggttcttgccgacttttgttggtaagattggacagtggattaagaacacttttagtcttgtaactat

SEQ ID NO: 101041 - DNA, 75 bp, Artificial Sequence
  Synthetic
ttgtgatctatattccatacaggatgtgggttttaagaatcagtattgtaatggaagtatcgcatgtcagttatg

SEQ ID NO: 101042 - DNA, 75 bp, Artificial Sequence
  Synthetic
ttgtgatctatattccattcaggatgtgggttttaagaatcagtattgtaatggaagtatcgcatgtcagttatg

SEQ ID NO: 101043 - DNA, 75 bp, Artificial Sequence
  Synthetic
ttgtgatctatattccatccaggatgtgggttttaagaatcagtattgtaatggaagtatcgcatgtcagttatg

SEQ ID NO: 101044 - DNA, 75 bp, Artificial Sequence
  Synthetic
ttgtgatctatattccatgcaggatgtgggttttaagaatcagtattgtaatggaagtatcgcatgtcagttatg

SEQ ID NO: 101045 - DNA, 75 bp, Artificial Sequence
  Synthetic
cttggcaggatttgatatgttagataattataaagccattgatgtagtacagtatgaagctgataggagagcatt

SEQ ID NO: 101046 - DNA, 75 bp, Artificial Sequence
  Synthetic
tgttgattatacaggtgtgttaaagattgtcattgaattgatagttagttacgccctgtatacggcatggtttta

SEQ ID NO: 101047 - DNA, 75 bp, Artificial Sequence
  Synthetic
cccattgtttgctcttattagtattcagatcttgaccacatggctgcctgagctttttatgcttagtacattaca

SEQ ID NO: 101048 - DNA, 75 bp, Artificial Sequence
  Synthetic
cccattgtttgctcttattagtattcagatcttgaccacttggctgcctgagctttttatgcttagtacattaca

SEQ ID NO: 101049 - DNA, 75 bp, Artificial Sequence
  Synthetic
cccattgtttgctcttattagtattcagatcttgaccacctggctgcctgagctttttatgcttagtacattaca

SEQ ID NO: 101050 - DNA, 75 bp, Artificial Sequence
  Synthetic
cccattgtttgctcttattagtattcagatcttgaccacgtggctgcctgagctttttatgcttagtacattaca

SEQ ID NO: 101051 - DNA, 75 bp, Artificial Sequence
  Synthetic
ttggagtgttaggttgctggtgtctttagctaatatgttaccagcacatgtttttatgaggttttatattattat

SEQ ID NO: 101052 - DNA, 75 bp, Artificial Sequence
  Synthetic
tgcctcttttattaagctgtttagcttgtttaggcatgttgcctatggttgtagtaaatctggttgtttgttttg

SEQ ID NO: 101053 - DNA, 75 bp, Artificial Sequence
  Synthetic
ttacaagaggaatcgtagtctacgtgttaaatgtagtactattgttggtggcatgatacgctattacgatgttat

SEQ ID NO: 101054 - DNA, 75 bp, Artificial Sequence
  Synthetic
ggctaatggtggcactggcttttgttcaaaacatcaatggaattgcattgattgtgattcttataaaccaggtaa

SEQ ID NO: 101055 - DNA, 75 bp, Artificial Sequence
  Synthetic
tacttttattactgttgaggccgctcttgatttatctaaggaattgaaacggcctattcagcctacagacgttgc

SEQ ID NO: 101056 - DNA, 75 bp, Artificial Sequence
  Synthetic
ttatcatacggtcacggatgttaagcaagttggttgttatatgcgcttgttctatgatcgtgatggacagcgcac

SEQ ID NO: 101057 - DNA, 75 bp, Artificial Sequence
  Synthetic
atatgatgatgttaatgctagtttgtttgtggattatagtaatttgctacattctaaggttaagagtgtgcctaa

SEQ ID NO: 101058 - DNA, 75 bp, Artificial Sequence
  Synthetic
tatgcatgttgtggtagtggaaaatgatgccgataaagctaattttcttaatgctgctgtattttatgcacagtc

SEQ ID NO: 101059 - DNA, 75 bp, Artificial Sequence
  Synthetic
tttgtttagacctattttaatggttgataaaaatctgataactactgctaatactggtacgtctgttacagaaac

SEQ ID NO: 101060 - DNA, 75 bp, Artificial Sequence
  Synthetic
tatgtttgatgtttatgtggacacatttttgtctatgtttgatgtggataaaaagagtcttaatgctttaatagc

SEQ ID NO: 101061 - DNA, 75 bp, Artificial Sequence
  Synthetic
aactgcgcattcttctataaaacagggtacgcagatttgtaaagttttggatacctttttaagctgtgctcgtaa

SEQ ID NO: 101062 - DNA, 75 bp, Artificial Sequence
  Synthetic
aagttgttctattgattcagatgttgatactaggtgtttagctgattctgtcatgtctgctgtatcggcaggcct

SEQ ID NO: 101063 - DNA, 75 bp, Artificial Sequence
  Synthetic
tgaattgacggatgaaagttgtaataacttggtgccaacatatttgaagggtgataacattgtggcagctgattt

SEQ ID NO: 101064 - DNA, 75 bp, Artificial Sequence
  Synthetic
aggtgttctgattcaaaattctgctaagcatgtgcagggtaatgttgctaaaatagccggtgtttcctgtatatg

SEQ ID NO: 101065 - DNA, 75 bp, Artificial Sequence
  Synthetic
gtctgtggatgcttttaatcagcttagttctgatttccagcataaattgaagaaagcatgttgtaaaactggttt

SEQ ID NO: 101066 - DNA, 75 bp, Artificial Sequence
  Synthetic
gaaactgaagcttacttataataagcagatggctaatgtctctgttttaactacaccctttagtcttaaaggggg

SEQ ID NO: 101067 - DNA, 75 bp, Artificial Sequence
  Synthetic
tgcagtttttagttattttgtttatgtatgttttgtgttgagtttggtttgttttattggattgtggtgcttaat

SEQ ID NO: 101068 - DNA, 75 bp, Artificial Sequence
  Synthetic
gcccacttacacagtacacaaatcagattttcagcttcccgtttatgccagttataaagttttagataatggtgt

SEQ ID NO: 101069 - DNA, 75 bp, Artificial Sequence
  Synthetic
tattagagatgttagcgttgaagatgtttgtttcgctaacaaatttgaacaatttgatcaatggtatgagtctac

SEQ ID NO: 101070 - DNA, 75 bp, Artificial Sequence
  Synthetic
atttggtctaagttattatagtaacagtatggcttgtcccattgttgttgctgtagtagaccaggattttggctc

SEQ ID NO: 101071 - DNA, 75 bp, Artificial Sequence
  Synthetic
tactgtgtttaacgtccctaccaaagtgttacgatatggttaccatgtgttgcactttattacacatgcactttc

SEQ ID NO: 101072 - DNA, 75 bp, Artificial Sequence
  Synthetic
tgctgatggagtgcagtgttatacgccacatagtcaaatatcgtattctaatttttatgctagtggctgtgtgct

SEQ ID NO: 101073 - DNA, 75 bp, Artificial Sequence
  Synthetic
ttcctccgcttgtactatgtttgcaatggccgatggtagtccacaaccttattgttatacagaggggcttatgca

SEQ ID NO: 101074 - DNA, 75 bp, Artificial Sequence
  Synthetic
gaacgcttctctgtatagttcattggtacctcatgtgcggtataatcttgctaatgctaaaggttttatccgttt

SEQ ID NO: 101075 - DNA, 75 bp, Artificial Sequence
  Synthetic
tccagaagtgttgcgagaaggacttgtgcgtattgtgcgtactcgttctatgtcgtattgcagagttggattatg

SEQ ID NO: 101076 - DNA, 75 bp, Artificial Sequence
  Synthetic
tgaggaagctgatgagggtatatgttttaaatttaatggttcttgggtgcttaataatgattattatagatcatt

SEQ ID NO: 101077 - DNA, 75 bp, Artificial Sequence
  Synthetic
tgaggaagctgatgagggtatatgttttaattttaatggttcttgggtgcttaataatgattattatagatcatt

SEQ ID NO: 101078 - DNA, 75 bp, Artificial Sequence
  Synthetic
tgaggaagctgatgagggtatatgttttaactttaatggttcttgggtgcttaataatgattattatagatcatt

SEQ ID NO: 101079 - DNA, 75 bp, Artificial Sequence
  Synthetic
tgaggaagctgatgagggtatatgttttaagtttaatggttcttgggtgcttaataatgattattatagatcatt

SEQ ID NO: 101080 - DNA, 75 bp, Artificial Sequence
  Synthetic
gcctgggacattttgtggtagagatgtttttgacttaatttatcagctgtttaaaggtttagcacagcctgtgga

SEQ ID NO: 101081 - DNA, 75 bp, Artificial Sequence
  Synthetic
gcctgggactttttgtggtagagatgtttttgacttaatttatcagctgtttaaaggtttagcacagcctgtgga

SEQ ID NO: 101082 - DNA, 75 bp, Artificial Sequence
  Synthetic
gcctgggaccttttgtggtagagatgtttttgacttaatttatcagctgtttaaaggtttagcacagcctgtgga

SEQ ID NO: 101083 - DNA, 75 bp, Artificial Sequence
  Synthetic
gcctgggacgttttgtggtagagatgtttttgacttaatttatcagctgtttaaaggtttagcacagcctgtgga

SEQ ID NO: 101084 - DNA, 75 bp, Artificial Sequence
  Synthetic
tttcttggcattgactgctagttccattgctggtgctatacttgctgtaattgttgttttggtgttttattactt

SEQ ID NO: 101085 - DNA, 75 bp, Artificial Sequence
  Synthetic
aataaagcttaaacgtgcttttggtgattacaccagtgttgtttttgttaatgtgattgtgtggtgtgtaaattt

SEQ ID NO: 101086 - DNA, 75 bp, Artificial Sequence
  Synthetic
tatgatgctttttgtgtttcaagtttaccctacactttcttgtgtatatgctatttgttatttttatgccacgct

SEQ ID NO: 101087 - DNA, 75 bp, Artificial Sequence
  Synthetic
ttatttcccttcggagataagtgtgataatgcatttacaatggctagttatgtatggcactattatgcctttatg

SEQ ID NO: 101088 - DNA, 75 bp, Artificial Sequence
  Synthetic
gttttgtttgctatatatatctgttgttgtttcaaatcatgctttttgggtattttcttactgcagacggcttgg

SEQ ID NO: 101089 - DNA, 75 bp, Artificial Sequence
  Synthetic
tacttctgttcgtagtgatggtacatttgaagaaatggctcttactacttttatgattacaaaagattcttattg

SEQ ID NO: 101090 - DNA, 75 bp, Artificial Sequence
  Synthetic
taagcttaagaattctttgtctgatgttgcttttaatagatacttgagtttgtataataagtataggtattacag

SEQ ID NO: 101091 - DNA, 75 bp, Artificial Sequence
  Synthetic
cggtaaaatggatactgctgcatatagggaggctgcttgttcccagttggctaaagcaatggacacatttaccaa

SEQ ID NO: 101092 - DNA, 75 bp, Artificial Sequence
  Synthetic
taataatggtagtgatgtgctttaccaaccacctactgcttccgtttcaacttcattcttgcaatcaggtattgt

SEQ ID NO: 101093 - DNA, 75 bp, Artificial Sequence
  Synthetic
gaaaatggttaatcctacttctaaggtagaaccatgtattgtcagcgttacctatggtaatatgacattgaatgg

SEQ ID NO: 101094 - DNA, 75 bp, Artificial Sequence
  Synthetic
tttatggttggatgataaggtctactgtcccagacatgtgatatgttctgcttcagatatgactaatccagatta

SEQ ID NO: 101095 - DNA, 75 bp, Artificial Sequence
  Synthetic
tacaaatttgttgtgtagagtaacatcaagtgattttactgtattgtttgatcgtttaagccttacagtgatgtc

SEQ ID NO: 101096 - DNA, 75 bp, Artificial Sequence
  Synthetic
ttatcaaatgcagggttgtatgcttgttcttacagtgaccctgcaaaattctcgtacgccaaaatatacatttgg

SEQ ID NO: 101097 - DNA, 75 bp, Artificial Sequence
  Synthetic
tgtggttaaacctggtgagacttttactgttttagctgcttataacggcaaaccacaaggagcctttcatgtgac

SEQ ID NO: 101098 - DNA, 75 bp, Artificial Sequence
  Synthetic
tatgcgtagtagttataccattaagggttcctttttatgcggatcttgtggatctgttggttatgtaataatggg

SEQ ID NO: 101099 - DNA, 75 bp, Artificial Sequence
  Synthetic
tgattgtgttaaatttgtgtatatgcatcaattggagcttagtactggttgtcatactggtactgatttcaatgg

SEQ ID NO: 101100 - DNA, 75 bp, Artificial Sequence
  Synthetic
ggatttttatggtccttataaggatgctcaggttgtccaattgcccgttcaggattatatacaatctgttaattt

SEQ ID NO: 101101 - DNA, 75 bp, Artificial Sequence
  Synthetic
tgtagcatggctttatgctgctatacttaataattgtaattggtttgtacaaagtgataagtgttctgttgaaga

SEQ ID NO: 101102 - DNA, 75 bp, Artificial Sequence
  Synthetic
ttttaatgtgtgggctttgtctaatgggtttagccaagttaagtctgatcttgttatagatgctttagcttctat

SEQ ID NO: 101103 - DNA, 75 bp, Artificial Sequence
  Synthetic
gactggtgtgtctttggaaacactattggctgctattaagcgtcttaagaatggttttcaaggacgtcagattat

SEQ ID NO: 101104 - DNA, 75 bp, Artificial Sequence
  Synthetic
gggtagttgctcctttgaggatgaattgacgcctagcgatgtttatcaacaactcgctggtatcaagttacaatc

SEQ ID NO: 101105 - DNA, 75 bp, Artificial Sequence
  Synthetic
aaagcgtactagattggttaaaggcattgtttgttggattatggcttctacatttttgtttagttgtataattac

SEQ ID NO: 101106 - DNA, 75 bp, Artificial Sequence
  Synthetic
agcatttgtgaaatggactatgtttatgtatgtaactactaatatgcttagtattacgttttgtgcactttgtgt

SEQ ID NO: 101107 - DNA, 75 bp, Artificial Sequence
  Synthetic
tataagtttggccatgttgttggttaaacataagcatctttatttgactatgtatataattcctgtgctttttac

SEQ ID NO: 101108 - DNA, 75 bp, Artificial Sequence
  Synthetic
actgctgtataacaactatttggttgtgtacaagcagacatttagaggctatgtttatgcatggctatcatatta

SEQ ID NO: 101109 - DNA, 75 bp, Artificial Sequence
  Synthetic
tgttccatcagttgagtatacttatactgatgaagttatttatggcatgttattgcttataggaatggtctttgt

SEQ ID NO: 101110 - DNA, 75 bp, Artificial Sequence
  Synthetic
tacattacgtagcattaaccatgatttgttttcttttataatgtttgttggtcgtgtgatttctgttgtctcttt

SEQ ID NO: 101111 - DNA, 75 bp, Artificial Sequence
  Synthetic
gtggtacatgggttctaacttagaggaagaaattcttcttatgttggcatctctttttggtacttacacatggac

SEQ ID NO: 101112 - DNA, 75 bp, Artificial Sequence
  Synthetic
aacagctttatctatggctgcagcaaaggttattgctaagtgggttgctgtgaatgttttgtatttcacagatat

SEQ ID NO: 101113 - DNA, 75 bp, Artificial Sequence
  Synthetic
acctcaaattaagatagtgcttgtatgctatttgtttataggttatattattagctgttattggggtttgttttc

SEQ ID NO: 101114 - DNA, 75 bp, Artificial Sequence
  Synthetic
cttgatgaacagcttgtttagaatgcctttgggtgtttataattataaaatttcagtacaggaattaagatatat

SEQ ID NO: 101115 - DNA, 75 bp, Artificial Sequence
  Synthetic
gaatgctaatggattgcgccctcctaagaatagttttgaagcccttatgcttaattttaagcttttgggtattgg

SEQ ID NO: 101116 - DNA, 75 bp, Artificial Sequence
  Synthetic
aggtgtgccaattattgaagtatctcaatttcaatcaaaattgactgatgttaaatgtgctaatgttgtcttgct

SEQ ID NO: 101117 - DNA, 75 bp, Artificial Sequence
  Synthetic
taattgcttgcaacatttgcatgttgcttctaactctaagttgtggcagtattgtagcactttgcacaatgaaat

SEQ ID NO: 101118 - DNA, 75 bp, Artificial Sequence
  Synthetic
acttgccacttcggatctgggtgttgcttttgaaaagcttgctcagttgttaattgttttgtttgctaatccagc

SEQ ID NO: 101119 - DNA, 75 bp, Artificial Sequence
  Synthetic
tgctgtggatagcaagtgcctgactagtattgaagaagtttgcgatgattacgcaaaggacaatactgttttgca

SEQ ID NO: 101120 - DNA, 75 bp, Artificial Sequence
  Synthetic
ggctttacagagtgaatttgttaatatggctagcttcgttgaatatgaagttgctaagaaaaatcttgatgaggc

SEQ ID NO: 101121 - DNA, 75 bp, Artificial Sequence
  Synthetic
gcgttctagtggttctgctaatcaacagcagttaaaacagctagagaaagcctgtaatattgctaaatctgctta

SEQ ID NO: 101122 - DNA, 75 bp, Artificial Sequence
  Synthetic
tgaacgcgaccgtgctgtagcaagaaagttggagcgtatggcagatttggctctcactaatatgtataaagaagc

SEQ ID NO: 101123 - DNA, 75 bp, Artificial Sequence
  Synthetic
tagaattaatgataagaagagtaaggttgtttctgccttgcaaactatgctttttagtatggtgcgtaagttaga

SEQ ID NO: 101124 - DNA, 75 bp, Artificial Sequence
  Synthetic
taatcaagctctgaattcaatattagataatgctgtgaagggttgtgtaccattgaatgcaatcccttcattggc

SEQ ID NO: 101125 - DNA, 75 bp, Artificial Sequence
  Synthetic
agcaaacactctgactataattgtaccagataaaagtgtttacgatcaggtggttgataatgtctatgttaccta

SEQ ID NO: 101126 - DNA, 75 bp, Artificial Sequence
  Synthetic
tgcgggtaatgtatggcagattcaaactatccaagattcagatggtacaaataagcagttgaatgagatatctga

SEQ ID NO: 101127 - DNA, 75 bp, Artificial Sequence
  Synthetic
tgattgtaactggccactagttattattgcaaatcggcataatgaggtatctgctaccgttttgcaaaataatga

SEQ ID NO: 101128 - DNA, 75 bp, Artificial Sequence
  Synthetic
attaatgcctgctaagttgaaaacgcaggttgttaatagtggtccagatcagacttgtaatacacctactcaatg

SEQ ID NO: 101129 - DNA, 75 bp, Artificial Sequence
  Synthetic
ttactataataatagtaacaatgggaagattgtttatgctatacttagtgatgttgatggtcttaagtatacaaa

SEQ ID NO: 101130 - DNA, 75 bp, Artificial Sequence
  Synthetic
aattcttaaagatgatggcaattttgttgttttggagttagatcctccttgtaaatttactgttcaagatgttaa

SEQ ID NO: 101131 - DNA, 75 bp, Artificial Sequence
  Synthetic
aggtcttaaaattaagtacctttattttgtaaaaggttgtaacacactagcaagaggctgggttgttggtacaat

SEQ ID NO: 101132 - DNA, 75 bp, Artificial Sequence
  Synthetic
ttcttctacagttagattgcaagctggaactgctactgagtatgcttccaactcatctatattatctttatgtgc

SEQ ID NO: 101133 - DNA, 75 bp, Artificial Sequence
  Synthetic
gttttctgtagatcctaagaaaacgtatttagattttatacaacagggaggaacacctattgccaattgtgttaa

SEQ ID NO: 101134 - DNA, 75 bp, Artificial Sequence
  Synthetic
aatgttgtgtgaccatgctggtaccggtatggccattactgttaaacctgatgctaccactagtcaggattcata

SEQ ID NO: 101135 - DNA, 75 bp, Artificial Sequence
  Synthetic
tggtggtgcgtctgtttgtatatattgccgcgcacgagttgaacacccagatgttgatgggttgtgcaaactacg

SEQ ID NO: 101136 - DNA, 75 bp, Artificial Sequence
  Synthetic
cggcaagtttgtacaagtgcctgtaggtataaaagatcctgtgtcttatgttttgacacatgatgtttgccaagt

SEQ ID NO: 101137 - DNA, 75 bp, Artificial Sequence
  Synthetic
ttgtggattttggcgggatggaagttgttcatgtgttagcactgacactactgttcagtcaaaagatactaattt

SEQ ID NO: 101138 - DNA, 75 bp, Artificial Sequence
  Synthetic
tttaaacgggttcggggtacgagtgtagatgcccgtctcgtaccctgtgccagtggtctatctactgatgtacaa

SEQ ID NO: 101139 - DNA, 75 bp, Artificial Sequence
  Synthetic
ttaagggcatttgatatttgcaatgctagtgttgctggcattggtttacatttaaaagttaattgttgccgtttt

SEQ ID NO: 101140 - DNA, 75 bp, Artificial Sequence
  Synthetic
cagcgtgttgatgagaacggtgataaattagatcagttctttgtcgttaagaggaccgatctgactatatataat

SEQ ID NO: 101141 - DNA, 75 bp, Artificial Sequence
  Synthetic
agagagatggaatgctatgagcgtgtaaaagattgtaagtttgtggctgaacacgatttctttacatttgatgta

SEQ ID NO: 101142 - DNA, 75 bp, Artificial Sequence
  Synthetic
gaaggtagtcgtgtgccacacattgtacgcaaggatttaacaaagtatactatgttggatctttgctacgcattg

SEQ ID NO: 101143 - DNA, 75 bp, Artificial Sequence
  Synthetic
cgacattttgatcgcaatgattgcatgctgctttgtgacattctctctatatatgctggttgtgaacaatcctac

SEQ ID NO: 101144 - DNA, 75 bp, Artificial Sequence
  Synthetic
tttactaagaaggattggtatgattttgttgaaaatcctgatattattaatgtttataaaaagctaggacctatt

SEQ ID NO: 101145 - DNA, 75 bp, Artificial Sequence
  Synthetic
tttaatagagccctagttagcgctactgagtttgcagacaaattggtggaggtaggcttagtaggcattttaaca

SEQ ID NO: 101146 - DNA, 75 bp, Artificial Sequence
  Synthetic
cttgataaccaagatttaaatggtaaatggtatgattttggtgactatgttattgcagccccagggtgtggtgtt

SEQ ID NO: 101147 - DNA, 75 bp, Artificial Sequence
  Synthetic
gctatagcagactcttattattcttatatgatgcctatgctgaccatgtgtcatgcattggattgtgaattgtat

SEQ ID NO: 101148 - DNA, 75 bp, Artificial Sequence
  Synthetic
gtgaataatgcttatagactatttgatcttgtacagtatgattttactgattacaagctcgaattgtttaataag

SEQ ID NO: 101149 - DNA, 75 bp, Artificial Sequence
  Synthetic
tattttaagcactggagtatgccataccatcctaacacggttgattgtcaggatgatcggtgtatcatacattgt

SEQ ID NO: 101150 - DNA, 75 bp, Artificial Sequence
  Synthetic
gctaattttaacatactttttagtatggttttacctaatacatgttttgggcctcttgttaggcaaatttttgtg

SEQ ID NO: 101151 - DNA, 75 bp, Artificial Sequence
  Synthetic
gatggtgtgccttttgttgtttcaattggctaccattataaagaacttggtattgtgatgaacatggatgtggat

SEQ ID NO: 101152 - DNA, 75 bp, Artificial Sequence
  Synthetic
acacatcgttatcgcttgtctttaaaagacttgcttttatatgctgctgatccagctttgcatgtagcttctgct

SEQ ID NO: 101153 - DNA, 75 bp, Artificial Sequence
  Synthetic
agtgcattatatgatttacgcacttgttgttttagtgttgcggctataacaagcggtgtaaaatttcaaacagtc

SEQ ID NO: 101154 - DNA, 75 bp, Artificial Sequence
  Synthetic
aaacctggtaattttaatcaggatttttatgattttattttaagtaagggcctgcttaaagagggtagttcagtt

SEQ ID NO: 101155 - DNA, 75 bp, Artificial Sequence
  Synthetic
gacctgaaacactttttctttacgcaggatggtaatgctgctattactgattataattattataagtataatttg

SEQ ID NO: 101156 - DNA, 75 bp, Artificial Sequence
  Synthetic
cccactatggtggacattaagcagttgttgtttgttttggaagtagtttataagtattttgagatttatgatggt

SEQ ID NO: 101157 - DNA, 75 bp, Artificial Sequence
  Synthetic
gggtgtataccggcatcacaagtcattgttaataattatgataagagtgctggctatccatttaataaatttgga

SEQ ID NO: 101158 - DNA, 75 bp, Artificial Sequence
  Synthetic
aaagccaggctctattatgaagcattatcatttgaggagcaggatgaaatttacgcttatactaagcgcaacgtc

SEQ ID NO: 101159 - DNA, 75 bp, Artificial Sequence
  Synthetic
ctgccaacacttactcaaatgaatttgaaatatgctattagtgctaagaatagagcccgcactgttgctggtgtt

SEQ ID NO: 101160 - DNA, 75 bp, Artificial Sequence
  Synthetic
tccatacttagtactatgactggcagaatgtttcatcaaaaatgtttgaaaagtatagcagctacacgtggtgtt

SEQ ID NO: 101161 - DNA, 75 bp, Artificial Sequence
  Synthetic
cctgttgttataggcaccactaagttttatggcggctgggatgatatgttacgtcgccttattaaagatgttgat

SEQ ID NO: 101162 - DNA, 75 bp, Artificial Sequence
  Synthetic
aatcctgtacttatgggttgggattatcctaagtgtgatcgtgctatgccaaacatactacgtattgttagtagt

SEQ ID NO: 101163 - DNA, 75 bp, Artificial Sequence
  Synthetic
ctggtcttggctcgaaaacatgaggcatgttgttcgcaaagcgataggttttatcgacttgcgaatgaatgcgca

SEQ ID NO: 101164 - DNA, 75 bp, Artificial Sequence
  Synthetic
caagttttgagtgaaattgttatgtgtggtggctgttattatgttaagcctggtggcactagtagtggtgatgca

SEQ ID NO: 101165 - DNA, 75 bp, Artificial Sequence
  Synthetic
actactgcttttgctaattcagtttttaacatatgtcaagctgtttcagccaatgtatgtgctttaatgtcatgc

SEQ ID NO: 101166 - DNA, 75 bp, Artificial Sequence
  Synthetic
aatggtaataagattgaagatttgagtatacgtgctcttcagaagcgcttatactcacatgtgtatagaagtgat

SEQ ID NO: 101167 - DNA, 75 bp, Artificial Sequence
  Synthetic
atggttgattcaacctttgtcacagaatattatgaatttttaaataagcattttagtatgatgattttgagtgat

SEQ ID NO: 101168 - DNA, 75 bp, Artificial Sequence
  Synthetic
gatggcgttgtgtgttataattctgattatgcgtccaaagggtatattgctaatataagtgcctttcaacaggta

SEQ ID NO: 101169 - DNA, 75 bp, Artificial Sequence
  Synthetic
ttatattatcaaaataacgtttttatgtcagaatccaaatgttgggttgaaaatgacataaacaatggacctcat

SEQ ID NO: 101170 - DNA, 75 bp, Artificial Sequence
  Synthetic
gaattctgttcacaacacacaatgcttgtaaagatggatggggacgatgtctatcttccataccctgatcctagt

SEQ ID NO: 101171 - DNA, 75 bp, Artificial Sequence
  Synthetic
cgtatattaggagctggatgttttgtagatgatttgttaaagactgatagtgttcttttaatagaacgatttgta

SEQ ID NO: 101172 - DNA, 75 bp, Artificial Sequence
  Synthetic
agtcttgcaatagatgcttatccacttgtttaccacgaaaatgaagaataccaaaaggtttttcgtgtttatttg

SEQ ID NO: 101173 - DNA, 75 bp, Artificial Sequence
  Synthetic
gagtatataaagaagttgtacaatgacctgggtaatcagatcttggatagctacagtgttattttaagtacttgt

SEQ ID NO: 101174 - DNA, 75 bp, Artificial Sequence
  Synthetic
gatggacaaaagtttactgatgagtccttttacaagaacatgtatttaagaagtgcagttatgcagagtgttgga

SEQ ID NO: 101175 - DNA, 75 bp, Artificial Sequence
  Synthetic
gcttgcgtggtttgctcttctcaaacatcattacgttgtggcagttgcatcagaaagcctcttctttgctgcaag

SEQ ID NO: 101176 - DNA, 75 bp, Artificial Sequence
  Synthetic
tgttgttacgatcatgttatggcaactgatcataaatatgttttgagtgtttcaccatatgtgtgtaatgcacca

SEQ ID NO: 101177 - DNA, 75 bp, Artificial Sequence
  Synthetic
ggatgtgatgtaaatgatgttaccaaattgtatctaggtggtatgtcatattattgtgaagatcataagccacaa

SEQ ID NO: 101178 - DNA, 75 bp, Artificial Sequence
  Synthetic
tattcgtttaagttggtaatgaatggtatggtttttggtctatataaacaatcttgtacaggatctccgtacata

SEQ ID NO: 101179 - DNA, 75 bp, Artificial Sequence
  Synthetic
gatgattttaatcgtatagctagttgtaaatggactgatgttgatgattacatactggctaatgaatgtacagag

SEQ ID NO: 101180 - DNA, 75 bp, Artificial Sequence
  Synthetic
cgcttgaaattgtttgctgcagaaacgcaaaaggcgactgaggaagcctttaagcagagttatgcatcagcaaca

SEQ ID NO: 101181 - DNA, 75 bp, Artificial Sequence
  Synthetic
atacaagagattgttagcgagcgcgaattgatcctctcttgggagattggaaaagtgaagccaccacttaataaa

SEQ ID NO: 101182 - DNA, 75 bp, Artificial Sequence
  Synthetic
aattatgtttttactggctaccattttactaaaaatggcaagacagttttaggtgaatatgtttttgataagagt

SEQ ID NO: 101183 - DNA, 75 bp, Artificial Sequence
  Synthetic
gagttgactaatggtgtgtattatcgcgccacaaccacttataagctatctgtaggagatgtttttgttttaacc

SEQ ID NO: 101184 - DNA, 75 bp, Artificial Sequence
  Synthetic
tctcattcagtagctaatttaagtgctcctacgcttgtgccgcaggagaattatagtagtattagattcgctagt

SEQ ID NO: 101185 - DNA, 75 bp, Artificial Sequence
  Synthetic
gtttatagtgtgcttgagacgtttcagaacaatgtcgttaattatcaacacattggtatgaaacgttattgcacc

SEQ ID NO: 101186 - DNA, 75 bp, Artificial Sequence
  Synthetic
gtgcaaggacctcctggtacaggaaagtcacatcttgctattggtcttgctgtatattattgtacagcacgtgta

SEQ ID NO: 101187 - DNA, 75 bp, Artificial Sequence
  Synthetic
gtatacactgcggccagccatgcagctgttgacgcattgtgtgaaaaagcatacaaatttttgaatataaatgat

SEQ ID NO: 101188 - DNA, 75 bp, Artificial Sequence
  Synthetic
tgcactcgtattgttcctgccaaagtcagggtggagtgctatgataagtttaaaattaatgacaccactcgtaag

SEQ ID NO: 101189 - DNA, 75 bp, Artificial Sequence
  Synthetic
tatgtgtttaccactataaatgcattacctgagatggtgacagatattgttgttgtagatgaagttagtatgctt

SEQ ID NO: 101190 - DNA, 75 bp, Artificial Sequence
  Synthetic
accaattatgagctttctgttattaatgctcgtattcgcgctaagcattatgtttatattggtgatcctgctcaa

SEQ ID NO: 101191 - DNA, 75 bp, Artificial Sequence
  Synthetic
ttgccagcaccacgtgtgttattgagcaagggtacacttgaacctaaatattttaacactgttactaagcttatg

SEQ ID NO: 101192 - DNA, 75 bp, Artificial Sequence
  Synthetic
tgttgcttagggccagacatttttcttggtacatgttatagatgtcctaaggaaatcgttgatacagtgtctgcc

SEQ ID NO: 101193 - DNA, 75 bp, Artificial Sequence
  Synthetic
ttggtttatgaaaataagcttaaggctaagaatgaaagtagttcattgtgttttaaggtctattataaaggcgtt

SEQ ID NO: 101194 - DNA, 75 bp, Artificial Sequence
  Synthetic
acaacacatgaaagttctagtgctgtaaatatgcagcagatttatttgattaataagtttttgaaggctaaccct

SEQ ID NO: 101195 - DNA, 75 bp, Artificial Sequence
  Synthetic
ttgtggcataaagccgtttttattagcccatataatagtcagaactttgcagctaagcgcgttttgggtttgcaa

SEQ ID NO: 101196 - DNA, 75 bp, Artificial Sequence
  Synthetic
acccaaaccgtggattctgctcaaggttctgaatatgattatgttatatattcacagactgcagaaacagcgcat

SEQ ID NO: 101197 - DNA, 75 bp, Artificial Sequence
  Synthetic
tctgtaaatgttaatcgcttcaacgttgctattactcgagccaagaaaggtattctttgtgttatgagtaatatg

SEQ ID NO: 101198 - DNA, 75 bp, Artificial Sequence
  Synthetic
cagttgtttgaagcgttacagtttactacattgaccttagataaagtgccacaggctgttgaaacgagagttcaa

SEQ ID NO: 101199 - DNA, 75 bp, Artificial Sequence
  Synthetic
tgtagtaccaatttatttaaagattgtagcaagagttatagtggttaccacccagctcatgctccttcatttttg

SEQ ID NO: 101200 - DNA, 75 bp, Artificial Sequence
  Synthetic
gcagtagatgacaaatataaggcaactggcgatttagccgtgtgtcttggtattggagattctgctgttacatat

SEQ ID NO: 101201 - DNA, 75 bp, Artificial Sequence
  Synthetic
tcaagattaatatcactcatgggttttaaacttgatgttacccttgatgggtattgtaagctttttataactaaa

SEQ ID NO: 101202 - DNA, 75 bp, Artificial Sequence
  Synthetic
gaagaagctgttaaacgcgtgcgtgcttgggttggctttgatgctgaaggtgctcatgccacgcgtgatagcatt

SEQ ID NO: 101203 - DNA, 75 bp, Artificial Sequence
  Synthetic
gggacaaatttcccacttcaattagggttttccacaggaattgactttgttgtggaagcaactggtttgtttgct

SEQ ID NO: 101204 - DNA, 75 bp, Artificial Sequence
  Synthetic
gatagagatggttacagctttaaaaaggctgtggctaaagctcctcctggtgaacaatttaagcacctcatccct

SEQ ID NO: 101205 - DNA, 75 bp, Artificial Sequence
  Synthetic
ttgatgacgagaggtcagcgctgggatgttgttagacctagaatagtacaaatgtttgcagatcatttaattgat

SEQ ID NO: 101206 - DNA, 75 bp, Artificial Sequence
  Synthetic
ctgtctgattgtgttgtgctagttacatgggcggccaactttgagctcacttgtctccgctactttgcaaaagta

SEQ ID NO: 101207 - DNA, 75 bp, Artificial Sequence
  Synthetic
ggtcgtgagatctcttgtaatgtgtgcactaaacgtgccacagcttacaattctagaactggttactatggttgt

SEQ ID NO: 101208 - DNA, 75 bp, Artificial Sequence
  Synthetic
tggcgccatagtgttacatgtgattacttgtataatccacttattgttgatattcaacagtggggatatattggt

SEQ ID NO: 101209 - DNA, 75 bp, Artificial Sequence
  Synthetic
tctttatcaagtaatcatgatttatattgtagtgtccataaaggagcacatgttgcttcctctgatgctataatg

SEQ ID NO: 101210 - DNA, 75 bp, Artificial Sequence
  Synthetic
acacggtgtttggccgtttatgattgtttttgcaataatattaattggaatgtggagtatcccatcatttcaaat

SEQ ID NO: 101211 - DNA, 75 bp, Artificial Sequence
  Synthetic
gagttaagtattaacacctcttgtagggtcttgcagcgtgttatgcttaaagctgccatgctctgcaacagatgt

SEQ ID NO: 101212 - DNA, 75 bp, Artificial Sequence
  Synthetic
actttgtgttatgatattggcaacccaaaagcgattgcctgtgtcaaagattttgattttaagttctatgatgcc

SEQ ID NO: 101213 - DNA, 75 bp, Artificial Sequence
  Synthetic
caaccaattgttaagtctgttaagactcttttgtattcttttgaggcacataaggactcttttaaagatggtttg

SEQ ID NO: 101214 - DNA, 75 bp, Artificial Sequence
  Synthetic
tgtatgttttggaactgtaatgtggataagtatccaccgaatgcagttgtatgtagatttgacacgagagtgttg

SEQ ID NO: 101215 - DNA, 75 bp, Artificial Sequence
  Synthetic
aataatttaaatcttcctggctgtaatggaggtagtttgtatgttaataaacatgcattccacactaaacccttt

SEQ ID NO: 101216 - DNA, 75 bp, Artificial Sequence
  Synthetic
tctagggcagcctttgagcatttgaagcctatgccatttttctattattcagatacgccttgcgtgtatatggat

SEQ ID NO: 101217 - DNA, 75 bp, Artificial Sequence
  Synthetic
ggcatggatgctaagcaggttgattatgtacctttgaaatccgccacttgcatcacaagatgcaatttaggtggt

SEQ ID NO: 101218 - DNA, 75 bp, Artificial Sequence
  Synthetic
gcagtttgtttaaagcatgctgaagagtatcgtgagtacctagagtcttacaatacagctactacagcaggtttt

SEQ ID NO: 101219 - DNA, 75 bp, Artificial Sequence
  Synthetic
actttttgggtctataagacatttgatttatataatttgtggaatacgttcaccaagctacaaagcttggagaat

SEQ ID NO: 101220 - DNA, 75 bp, Artificial Sequence
  Synthetic
actttttgggtctataagacatttgatttttataatttgtggaatacgttcaccaagctacaaagcttggagaat

SEQ ID NO: 101221 - DNA, 75 bp, Artificial Sequence
  Synthetic
actttttgggtctataagacatttgatttctataatttgtggaatacgttcaccaagctacaaagcttggagaat

SEQ ID NO: 101222 - DNA, 75 bp, Artificial Sequence
  Synthetic
actttttgggtctataagacatttgatttgtataatttgtggaatacgttcaccaagctacaaagcttggagaat

SEQ ID NO: 101223 - DNA, 75 bp, Artificial Sequence
  Synthetic
gttgtatataatttagtcaagactggtcattatacaggacaggctggtgaaatgccttgtgccattataaatgat

SEQ ID NO: 101224 - DNA, 75 bp, Artificial Sequence
  Synthetic
aaagttgtggctaagatcgataaggaggatgttgttatttttgttaataatacaacataccctactaatgtggct

SEQ ID NO: 101225 - DNA, 75 bp, Artificial Sequence
  Synthetic
gttgaattatttgccaagcgcagtattcgacaccacccagagcttaagctctttagaaatttgaatatagacgtt

SEQ ID NO: 101226 - DNA, 75 bp, Artificial Sequence
  Synthetic
tgctggaagcacgtcatttgggattatgctagagaaagtatattttgcagtaatacctatggtgtctgcatgtat

SEQ ID NO: 101227 - DNA, 75 bp, Artificial Sequence
  Synthetic
acagatttaaagttcattgataaattgaatgtcctttttgatggtcgtgataatggtgctcttgaagcttttaaa

SEQ ID NO: 101228 - DNA, 75 bp, Artificial Sequence
  Synthetic
cgctctaataatggcgtttacatttccacgacaaaagttaagagtctttcgatgataagaggtccaccgcgtgct

SEQ ID NO: 101229 - DNA, 75 bp, Artificial Sequence
  Synthetic
gaattaaatggcgtagtggtggataaggttggagacactgattgtgtgttttattttgctgtgcgtaaagaaggt

SEQ ID NO: 101230 - DNA, 75 bp, Artificial Sequence
  Synthetic
gaattaaatggcgtagtggtggataaggttggagacactgattgtgtgttttattttgctgtgcgtaaagatggt

SEQ ID NO: 101231 - DNA, 75 bp, Artificial Sequence
  Synthetic
gaattaaatggcgtagtggtggataaggttggagacactgattgtgtgttttattttgctgtgcgtaaagacggt

SEQ ID NO: 101232 - DNA, 75 bp, Artificial Sequence
  Synthetic
gaattaaatggcgtagtggtggataaggttggagacactgattgtgtgttttattttgctgtgcgtaaagagggt

SEQ ID NO: 101233 - DNA, 75 bp, Artificial Sequence
  Synthetic
caggatgtcatcttcagccaattcgacagcctgagagtcagctctaaccagagcccacaaggtaatctggggagt

SEQ ID NO: 101234 - DNA, 75 bp, Artificial Sequence
  Synthetic
caggatgtcatcttcagcctattcgacagcctgagagtcagctctaaccagagcccacaaggtaatctggggagt

SEQ ID NO: 101235 - DNA, 75 bp, Artificial Sequence
  Synthetic
caggatgtcatcttcagcccattcgacagcctgagagtcagctctaaccagagcccacaaggtaatctggggagt

SEQ ID NO: 101236 - DNA, 75 bp, Artificial Sequence
  Synthetic
caggatgtcatcttcagccgattcgacagcctgagagtcagctctaaccagagcccacaaggtaatctggggagt

SEQ ID NO: 101237 - DNA, 75 bp, Artificial Sequence
  Synthetic
aatgaacccggtaatgtcggtggtaatgatgctctggcaacctccactatctttacacaaagccgtgttattagc

SEQ ID NO: 101238 - DNA, 75 bp, Artificial Sequence
  Synthetic
tcttttacatgtcgtactgatatggaaaaagattttatagctttagatcaagatgtgtttattcagaagtatggt

SEQ ID NO: 101239 - DNA, 75 bp, Artificial Sequence
  Synthetic
ttggaggactatgcctttgaacacattgtttatggtaatttcaaccagaagattattggtggtttgcatttgtta

SEQ ID NO: 101240 - DNA, 75 bp, Artificial Sequence
  Synthetic
ataggcttgtaccgaagacagcaaacttccaatctggttattcaggagtttgtttcatacgactccagcatacac

SEQ ID NO: 101241 - DNA, 75 bp, Artificial Sequence
  Synthetic
tcttattttatcactgatgagaagagtggtggtagtaagagtgtttgcactgttatagatattttgttggatgat

SEQ ID NO: 101242 - DNA, 75 bp, Artificial Sequence
  Synthetic
tttgtggctcttgttaagtcacttaatcttaactgtgtgagtaaggttgttaatgttaatgttgattttaaagat

SEQ ID NO: 101243 - DNA, 75 bp, Artificial Sequence
  Synthetic
tttcagttcatgctttggtgtaacgatgagaaagttatgactttctatcctcgtttgcaagctgcatctgactgg

SEQ ID NO: 101244 - DNA, 75 bp, Artificial Sequence
  Synthetic
aagcctggttattctatgcctgtattatataagtatttgaattccccaatggaaagagttagtctctggaattat

SEQ ID NO: 101245 - DNA, 75 bp, Artificial Sequence
  Synthetic
gggaagccagttactttgcctacaggctgtatgatgaatgttgctaagtatactcagttatgtcaataactgaat

SEQ ID NO: 101246 - DNA, 75 bp, Artificial Sequence
  Synthetic
gggaagccagttactttgcctacaggctgtatgatgaatgttgctaagtatactcagttatgtcaatatctgaat

SEQ ID NO: 101247 - DNA, 75 bp, Artificial Sequence
  Synthetic
gggaagccagttactttgcctacaggctgtatgatgaatgttgctaagtatactcagttatgtcaatacctgaat

SEQ ID NO: 101248 - DNA, 75 bp, Artificial Sequence
  Synthetic
gggaagccagttactttgcctacaggctgtatgatgaatgttgctaagtatactcagttatgtcaatagctgaat

SEQ ID NO: 101249 - DNA, 75 bp, Artificial Sequence
  Synthetic
actacaacattagctgtacctgttaatatgcgagttttgcatttaggtgcaggttcagaaaaaggagtagcaccg

SEQ ID NO: 101250 - DNA, 75 bp, Artificial Sequence
  Synthetic
ggttctgcagttcttaggcagtggttgcctgctggtactattcttgtagataatgatttatacccatttgtgagt

SEQ ID NO: 101251 - DNA, 75 bp, Artificial Sequence
  Synthetic
gacagtgacgctacatattttggggattgtataaccttaccctttgattgtcaatgggatttgataatttctgat

SEQ ID NO: 101252 - DNA, 75 bp, Artificial Sequence
  Synthetic
gacagtgtcgctacatattttggggattgtataaccttaccctttgattgtcaatgggatttgataatttctgat

SEQ ID NO: 101253 - DNA, 75 bp, Artificial Sequence
  Synthetic
gacagtgccgctacatattttggggattgtataaccttaccctttgattgtcaatgggatttgataatttctgat

SEQ ID NO: 101254 - DNA, 75 bp, Artificial Sequence
  Synthetic
gacagtggcgctacatattttggggattgtataaccttaccctttgattgtcaatgggatttgataatttctgat

SEQ ID NO: 101255 - DNA, 75 bp, Artificial Sequence
  Synthetic
atgtatgaccctattactaagaacataggggagtacaatgtaagtaaagatggtttctttacatacatttgtaat

SEQ ID NO: 101256 - DNA, 75 bp, Artificial Sequence
  Synthetic
atgtatgaccctattactaagaacataggggagtacaatgtaagtaaagatggtttctttacatacatttgttat

SEQ ID NO: 101257 - DNA, 75 bp, Artificial Sequence
  Synthetic
atgtatgaccctattactaagaacataggggagtacaatgtaagtaaagatggtttctttacatacatttgtcat

SEQ ID NO: 101258 - DNA, 75 bp, Artificial Sequence
  Synthetic
atgtatgaccctattactaagaacataggggagtacaatgtaagtaaagatggtttctttacatacatttgtgat

SEQ ID NO: 101259 - DNA, 75 bp, Artificial Sequence
  Synthetic
atgattcgcgacaagttagctctgggtggcagtgttgctataaaaataacagagttttcttggaatgcagaatta

SEQ ID NO: 101260 - DNA, 75 bp, Artificial Sequence
  Synthetic
tataagttaatggggtattttgcattttggacggttttctgcacaaatgcaaatgcttcttctagtgaagggttt

SEQ ID NO: 101261 - DNA, 75 bp, Artificial Sequence
  Synthetic
ttaattggcataaattatttgggtaagcccaaggttgagatagatggaaatgttatgcatgccaattatttgttt

SEQ ID NO: 101262 - DNA, 75 bp, Artificial Sequence
  Synthetic
tggagaaattccacagtttggaacgggggtgcttatagcctttttgatatggctaaattcccgcttaagttggct

SEQ ID NO: 101263 - DNA, 75 bp, Artificial Sequence
  Synthetic
ggtactgccgtaataaatttaagagcagaccagattaatgatatggtttattcccttcttgaaaagggtaaacta

SEQ ID NO: 101264 - DNA, 75 bp, Artificial Sequence
  Synthetic
cttgttagagatacaaataaagaagtttttgttggtgacagtttggttaatgtaatctaaactttaagaatggca

SEQ ID NO: 101265 - DNA, 75 bp, Artificial Sequence
  Synthetic
gtcgcttatgcagacaagcctaatcactttatcaattttccacttacccaatttgagggttttgtgttaaattat

SEQ ID NO: 101266 - DNA, 75 bp, Artificial Sequence
  Synthetic
aaaggtttacaatttcaacttctcgatgaaggagtggattgtaaaatacaaacagcgccgcacattagtcttgct

SEQ ID NO: 101267 - DNA, 75 bp, Artificial Sequence
  Synthetic
atgctggatattcagcctgaagactaaagaagtgttgatgttgctattcaagaagttattgatgacatgcattgg

SEQ ID NO: 101268 - DNA, 75 bp, Artificial Sequence
  Synthetic
atgctggatattcagcctgaagactatagaagtgttgatgttgctattcaagaagttattgatgacatgcattgg

SEQ ID NO: 101269 - DNA, 75 bp, Artificial Sequence
  Synthetic
atgctggatattcagcctgaagactacagaagtgttgatgttgctattcaagaagttattgatgacatgcattgg

SEQ ID NO: 101270 - DNA, 75 bp, Artificial Sequence
  Synthetic
atgctggatattcagcctgaagactagagaagtgttgatgttgctattcaagaagttattgatgacatgcattgg

SEQ ID NO: 101271 - DNA, 75 bp, Artificial Sequence
  Synthetic
atgctggatattcagcctgtagactaaagaagtgttgatgttgctattcaagaagttattgatgacatgcattgg

SEQ ID NO: 101272 - DNA, 75 bp, Artificial Sequence
  Synthetic
atgctggatattcagcctgtagactatagaagtgttgatgttgctattcaagaagttattgatgacatgcattgg

SEQ ID NO: 101273 - DNA, 75 bp, Artificial Sequence
  Synthetic
atgctggatattcagcctgtagactacagaagtgttgatgttgctattcaagaagttattgatgacatgcattgg

SEQ ID NO: 101274 - DNA, 75 bp, Artificial Sequence
  Synthetic
atgctggatattcagcctgtagactagagaagtgttgatgttgctattcaagaagttattgatgacatgcattgg

SEQ ID NO: 101275 - DNA, 75 bp, Artificial Sequence
  Synthetic
atgctggatattcagcctgcagactaaagaagtgttgatgttgctattcaagaagttattgatgacatgcattgg

SEQ ID NO: 101276 - DNA, 75 bp, Artificial Sequence
  Synthetic
atgctggatattcagcctgcagactatagaagtgttgatgttgctattcaagaagttattgatgacatgcattgg

SEQ ID NO: 101277 - DNA, 75 bp, Artificial Sequence
  Synthetic
atgctggatattcagcctgcagactacagaagtgttgatgttgctattcaagaagttattgatgacatgcattgg

SEQ ID NO: 101278 - DNA, 75 bp, Artificial Sequence
  Synthetic
atgctggatattcagcctgcagactagagaagtgttgatgttgctattcaagaagttattgatgacatgcattgg

SEQ ID NO: 101279 - DNA, 75 bp, Artificial Sequence
  Synthetic
atgctggatattcagcctggagactaaagaagtgttgatgttgctattcaagaagttattgatgacatgcattgg

SEQ ID NO: 101280 - DNA, 75 bp, Artificial Sequence
  Synthetic
atgctggatattcagcctggagactatagaagtgttgatgttgctattcaagaagttattgatgacatgcattgg

SEQ ID NO: 101281 - DNA, 75 bp, Artificial Sequence
  Synthetic
atgctggatattcagcctggagactacagaagtgttgatgttgctattcaagaagttattgatgacatgcattgg

SEQ ID NO: 101282 - DNA, 75 bp, Artificial Sequence
  Synthetic
atgctggatattcagcctggagactagagaagtgttgatgttgctattcaagaagttattgatgacatgcattgg

SEQ ID NO: 101283 - DNA, 75 bp, Artificial Sequence
  Synthetic
ggtgagggctttcagattaaatttgataacccccatatcctaggaagatgcatagttttagatgttaaaggtgta

SEQ ID NO: 101284 - DNA, 75 bp, Artificial Sequence
  Synthetic
ggtgagggctttcagattaaatttgttaacccccatatcctaggaagatgcatagttttagatgttaaaggtgta

SEQ ID NO: 101285 - DNA, 75 bp, Artificial Sequence
  Synthetic
ggtgagggctttcagattaaatttgctaacccccatatcctaggaagatgcatagttttagatgttaaaggtgta

SEQ ID NO: 101286 - DNA, 75 bp, Artificial Sequence
  Synthetic
ggtgagggctttcagattaaatttggtaacccccatatcctaggaagatgcatagttttagatgttaaaggtgta

SEQ ID NO: 101287 - DNA, 75 bp, Artificial Sequence
  Synthetic
ggtgagggctttcagattatatttgataacccccatatcctaggaagatgcatagttttagatgttaaaggtgta

SEQ ID NO: 101288 - DNA, 75 bp, Artificial Sequence
  Synthetic
ggtgagggctttcagattatatttgttaacccccatatcctaggaagatgcatagttttagatgttaaaggtgta

SEQ ID NO: 101289 - DNA, 75 bp, Artificial Sequence
  Synthetic
ggtgagggctttcagattatatttgctaacccccatatcctaggaagatgcatagttttagatgttaaaggtgta

SEQ ID NO: 101290 - DNA, 75 bp, Artificial Sequence
  Synthetic
ggtgagggctttcagattatatttggtaacccccatatcctaggaagatgcatagttttagatgttaaaggtgta

SEQ ID NO: 101291 - DNA, 75 bp, Artificial Sequence
  Synthetic
ggtgagggctttcagattacatttgataacccccatatcctaggaagatgcatagttttagatgttaaaggtgta

SEQ ID NO: 101292 - DNA, 75 bp, Artificial Sequence
  Synthetic
ggtgagggctttcagattacatttgttaacccccatatcctaggaagatgcatagttttagatgttaaaggtgta

SEQ ID NO: 101293 - DNA, 75 bp, Artificial Sequence
  Synthetic
ggtgagggctttcagattacatttgctaacccccatatcctaggaagatgcatagttttagatgttaaaggtgta

SEQ ID NO: 101294 - DNA, 75 bp, Artificial Sequence
  Synthetic
ggtgagggctttcagattacatttggtaacccccatatcctaggaagatgcatagttttagatgttaaaggtgta

SEQ ID NO: 101295 - DNA, 75 bp, Artificial Sequence
  Synthetic
ggtgagggctttcagattagatttgataacccccatatcctaggaagatgcatagttttagatgttaaaggtgta

SEQ ID NO: 101296 - DNA, 75 bp, Artificial Sequence
  Synthetic
ggtgagggctttcagattagatttgttaacccccatatcctaggaagatgcatagttttagatgttaaaggtgta

SEQ ID NO: 101297 - DNA, 75 bp, Artificial Sequence
  Synthetic
ggtgagggctttcagattagatttgctaacccccatatcctaggaagatgcatagttttagatgttaaaggtgta

SEQ ID NO: 101298 - DNA, 75 bp, Artificial Sequence
  Synthetic
ggtgagggctttcagattagatttggtaacccccatatcctaggaagatgcatagttttagatgttaaaggtgta

SEQ ID NO: 101299 - DNA, 75 bp, Artificial Sequence
  Synthetic
gaagaattgcatgatgatttagttaattacattcgtgataaaggttgtgttgctgaccaatccaggaaatggatt

SEQ ID NO: 101300 - DNA, 75 bp, Artificial Sequence
  Synthetic
ggacattgcaccatagcccaactcacgaatgctgcactttccattaaggaaaatgttgatttcataaacagcatg

SEQ ID NO: 101301 - DNA, 75 bp, Artificial Sequence
  Synthetic
ggacattgcaccatagcccaactcacgtatgctgcactttccattaaggaaaatgttgatttcataaacagcatg

SEQ ID NO: 101302 - DNA, 75 bp, Artificial Sequence
  Synthetic
ggacattgcaccatagcccaactcacgcatgctgcactttccattaaggaaaatgttgatttcataaacagcatg

SEQ ID NO: 101303 - DNA, 75 bp, Artificial Sequence
  Synthetic
ggacattgcaccatagcccaactcacggatgctgcactttccattaaggaaaatgttgatttcataaacagcatg

SEQ ID NO: 101304 - DNA, 75 bp, Artificial Sequence
  Synthetic
caattcaaatataaaatcactatcaatccatcatcaccggctagacttgaaatagttaagcttggtgctgaaaag

SEQ ID NO: 101305 - DNA, 75 bp, Artificial Sequence
  Synthetic
caattcaaatataaaatcactatcaatccttcatcaccggctagacttgaaatagttaagcttggtgctgaaaag

SEQ ID NO: 101306 - DNA, 75 bp, Artificial Sequence
  Synthetic
caattcaaatataaaatcactatcaatccctcatcaccggctagacttgaaatagttaagcttggtgctgaaaag

SEQ ID NO: 101307 - DNA, 75 bp, Artificial Sequence
  Synthetic
caattcaaatataaaatcactatcaatccgtcatcaccggctagacttgaaatagttaagcttggtgctgaaaag

SEQ ID NO: 101308 - DNA, 75 bp, Artificial Sequence
  Synthetic
caattcaattataaaatcactatcaatccatcatcaccggctagacttgaaatagttaagcttggtgctgaaaag

SEQ ID NO: 101309 - DNA, 75 bp, Artificial Sequence
  Synthetic
caattcaattataaaatcactatcaatccttcatcaccggctagacttgaaatagttaagcttggtgctgaaaag

SEQ ID NO: 101310 - DNA, 75 bp, Artificial Sequence
  Synthetic
caattcaattataaaatcactatcaatccctcatcaccggctagacttgaaatagttaagcttggtgctgaaaag

SEQ ID NO: 101311 - DNA, 75 bp, Artificial Sequence
  Synthetic
caattcaattataaaatcactatcaatccgtcatcaccggctagacttgaaatagttaagcttggtgctgaaaag

SEQ ID NO: 101312 - DNA, 75 bp, Artificial Sequence
  Synthetic
caattcaactataaaatcactatcaatccatcatcaccggctagacttgaaatagttaagcttggtgctgaaaag

SEQ ID NO: 101313 - DNA, 75 bp, Artificial Sequence
  Synthetic
caattcaactataaaatcactatcaatccttcatcaccggctagacttgaaatagttaagcttggtgctgaaaag

SEQ ID NO: 101314 - DNA, 75 bp, Artificial Sequence
  Synthetic
caattcaactataaaatcactatcaatccctcatcaccggctagacttgaaatagttaagcttggtgctgaaaag

SEQ ID NO: 101315 - DNA, 75 bp, Artificial Sequence
  Synthetic
caattcaactataaaatcactatcaatccgtcatcaccggctagacttgaaatagttaagcttggtgctgaaaag

SEQ ID NO: 101316 - DNA, 75 bp, Artificial Sequence
  Synthetic
caattcaagtataaaatcactatcaatccatcatcaccggctagacttgaaatagttaagcttggtgctgaaaag

SEQ ID NO: 101317 - DNA, 75 bp, Artificial Sequence
  Synthetic
caattcaagtataaaatcactatcaatccttcatcaccggctagacttgaaatagttaagcttggtgctgaaaag

SEQ ID NO: 101318 - DNA, 75 bp, Artificial Sequence
  Synthetic
caattcaagtataaaatcactatcaatccctcatcaccggctagacttgaaatagttaagcttggtgctgaaaag

SEQ ID NO: 101319 - DNA, 75 bp, Artificial Sequence
  Synthetic
caattcaagtataaaatcactatcaatccgtcatcaccggctagacttgaaatagttaagcttggtgctgaaaag

SEQ ID NO: 101320 - DNA, 75 bp, Artificial Sequence
  Synthetic
aaagatggtttttatgaaaccatagttagccactggatgggaattcgttttgaatataatccacccactgataag

SEQ ID NO: 101321 - DNA, 75 bp, Artificial Sequence
  Synthetic
ctagctatgattatgggttattgttgtttagaagtggtgcgtaaagagctagaagaaggtgatcttcccgagaat

SEQ ID NO: 101322 - DNA, 75 bp, Artificial Sequence
  Synthetic
ctagctatgattatgggttattgttgtttagatgtggtgcgtaaagagctagaagaaggtgatcttcccgagaat

SEQ ID NO: 101323 - DNA, 75 bp, Artificial Sequence
  Synthetic
ctagctatgattatgggttattgttgtttagacgtggtgcgtaaagagctagaagaaggtgatcttcccgagaat

SEQ ID NO: 101324 - DNA, 75 bp, Artificial Sequence
  Synthetic
ctagctatgattatgggttattgttgtttagaggtggtgcgtaaagagctagaagaaggtgatcttcccgagaat

SEQ ID NO: 101325 - DNA, 75 bp, Artificial Sequence
  Synthetic
gatgatgatgcttggtttaagctatcgtaccattatgaaaacaattcttggttctttcgacatgtctacaggaaa

SEQ ID NO: 101326 - DNA, 75 bp, Artificial Sequence
  Synthetic
agttcttatttccgtaagtcttgtcaaaatttagattgtaattgtttggggttttatgaatcttcagttgaagaa

SEQ ID NO: 101327 - DNA, 75 bp, Artificial Sequence
  Synthetic
aactaaactcagtgaaaatgtttttgcttcctagatttgttctagttagctgcataattggtagtctaggttttg

SEQ ID NO: 101328 - DNA, 75 bp, Artificial Sequence
  Synthetic
tactaaactcagtgaaaatgtttttgcttcctagatttgttctagttagctgcataattggtagtctaggttttg

SEQ ID NO: 101329 - DNA, 75 bp, Artificial Sequence
  Synthetic
cactaaactcagtgaaaatgtttttgcttcctagatttgttctagttagctgcataattggtagtctaggttttg

SEQ ID NO: 101330 - DNA, 75 bp, Artificial Sequence
  Synthetic
gactaaactcagtgaaaatgtttttgcttcctagatttgttctagttagctgcataattggtagtctaggttttg

SEQ ID NO: 101331 - DNA, 75 bp, Artificial Sequence
  Synthetic
aaaaccctcctaccaatgttgtttcacatttaaatggagattggtttttatttggtgacagtcgttcagattgta

SEQ ID NO: 101332 - DNA, 75 bp, Artificial Sequence
  Synthetic
aaaaccctcctaccaatgttgtttctcatttaaatggagattggtttttatttggtgacagtcgttcagattgta

SEQ ID NO: 101333 - DNA, 75 bp, Artificial Sequence
  Synthetic
aaaaccctcctaccaatgttgtttcccatttaaatggagattggtttttatttggtgacagtcgttcagattgta

SEQ ID NO: 101334 - DNA, 75 bp, Artificial Sequence
  Synthetic
aaaaccctcctaccaatgttgtttcgcatttaaatggagattggtttttatttggtgacagtcgttcagattgta

SEQ ID NO: 101335 - DNA, 75 bp, Artificial Sequence
  Synthetic
atcatgttgttaataccaacccccgtaattattcttatatggaccttaatcctgccctgtgtgattctggtaaaa

SEQ ID NO: 101336 - DNA, 75 bp, Artificial Sequence
  Synthetic
tatcatctaaagctggcaactccatttttaggagttttcactttaccgatttttataattacacaggcgaaggtc

SEQ ID NO: 101337 - DNA, 75 bp, Artificial Sequence
  Synthetic
aacaaattattttttatgagggtgttaattttacgccttatcatgcctttaaatgcaccacttctggtagtaatg

SEQ ID NO: 101338 - DNA, 75 bp, Artificial Sequence
  Synthetic
atatttggatgcagaataaaggcttgttttacactcaggtttataagaatatggctgtgtatcgcagccttactt

SEQ ID NO: 101339 - DNA, 75 bp, Artificial Sequence
  Synthetic
ttgttaatgtaccatatgtttaaaatggctctgcacaatctacagctctttgtaaatctggtagtttagttctta

SEQ ID NO: 101340 - DNA, 75 bp, Artificial Sequence
  Synthetic
ttgttaatgtaccatatgtttataatggctctgcacaatctacagctctttgtaaatctggtagtttagttctta

SEQ ID NO: 101341 - DNA, 75 bp, Artificial Sequence
  Synthetic
ttgttaatgtaccatatgtttacaatggctctgcacaatctacagctctttgtaaatctggtagtttagttctta

SEQ ID NO: 101342 - DNA, 75 bp, Artificial Sequence
  Synthetic
ttgttaatgtaccatatgtttagaatggctctgcacaatctacagctctttgtaaatctggtagtttagttctta

SEQ ID NO: 101343 - DNA, 75 bp, Artificial Sequence
  Synthetic
ataaccctgcatatatagctcgtgaagctaattttggggattattattataaggttgaagctgatttttatttat

SEQ ID NO: 101344 - DNA, 75 bp, Artificial Sequence
  Synthetic
ataaccctgcatatatagctcgtgaagctaattttggggattattattataaggttgaagctgatttttattttt

SEQ ID NO: 101345 - DNA, 75 bp, Artificial Sequence
  Synthetic
ataaccctgcatatatagctcgtgaagctaattttggggattattattataaggttgaagctgatttttatttct

SEQ ID NO: 101346 - DNA, 75 bp, Artificial Sequence
  Synthetic
ataaccctgcatatatagctcgtgaagctaattttggggattattattataaggttgaagctgatttttatttgt

SEQ ID NO: 101347 - DNA, 75 bp, Artificial Sequence
  Synthetic
caggttgtgacgagtatatcgtaccactttgtatttttaacggcaagtttttgtcgaatacaaagtattatgatg

SEQ ID NO: 101348 - DNA, 75 bp, Artificial Sequence
  Synthetic
atagtcaatattattttaataaagacactggtgttatttatggtctcaattcaactgaaaccattaccactggtt

SEQ ID NO: 101349 - DNA, 75 bp, Artificial Sequence
  Synthetic
atagtcaatattattttaataaagacactggtgttatttatggtctcaattctactgaaaccattaccactggtt

SEQ ID NO: 101350 - DNA, 75 bp, Artificial Sequence
  Synthetic
atagtcaatattattttaataaagacactggtgttatttatggtctcaattccactgaaaccattaccactggtt

SEQ ID NO: 101351 - DNA, 75 bp, Artificial Sequence
  Synthetic
atagtcaatattattttaataaagacactggtgttatttatggtctcaattcgactgaaaccattaccactggtt

SEQ ID NO: 101352 - DNA, 75 bp, Artificial Sequence
  Synthetic
ttgattttaattgtcattatttagttctaccctctggcaattatttagccatttcaaatgagctattgttaactg

SEQ ID NO: 101353 - DNA, 75 bp, Artificial Sequence
  Synthetic
ttccaactaaagcaatctgtcttaataagcgtaaggattttacgcctgtacaggttgttgactcgcggtggaaca

SEQ ID NO: 101354 - DNA, 75 bp, Artificial Sequence
  Synthetic
ttcctactaaagcaatctgtcttaataagcgtaaggattttacgcctgtacaggttgttgactcgcggtggaaca

SEQ ID NO: 101355 - DNA, 75 bp, Artificial Sequence
  Synthetic
ttcccactaaagcaatctgtcttaataagcgtaaggattttacgcctgtacaggttgttgactcgcggtggaaca

SEQ ID NO: 101356 - DNA, 75 bp, Artificial Sequence
  Synthetic
ttccgactaaagcaatctgtcttaataagcgtaaggattttacgcctgtacaggttgttgactcgcggtggaaca

SEQ ID NO: 101357 - DNA, 75 bp, Artificial Sequence
  Synthetic
atgccaggcagtctgataacatgacggcagttgcttgtcaacccccgtactgttattttcgtaattctactacca

SEQ ID NO: 101358 - DNA, 75 bp, Artificial Sequence
  Synthetic
actatgttggtgtttatgatatcaatcatggggatgctggttttactagcatactcagtggtttgttatatgatt

SEQ ID NO: 101359 - DNA, 75 bp, Artificial Sequence
  Synthetic
caccctgtttttcacagcaaggtgtttttaggtataataatgttagcagtgtttggcctctctacccctatggca

SEQ ID NO: 101360 - DNA, 75 bp, Artificial Sequence
  Synthetic
ggtgtcctactgctgctgatattaatacccctgatgtacctatttgtgtgtatgatccgctaccacttattttgc

SEQ ID NO: 101361 - DNA, 75 bp, Artificial Sequence
  Synthetic
ttggcattcttttgggtgttgcggtcataattattgtagttttgttgttatattttatggtggataatggtacta

SEQ ID NO: 101362 - DNA, 75 bp, Artificial Sequence
  Synthetic
ggctgcatgatgcttagaccataatctaaacatgtttttgatacttttaatttccttaccaatggctctcgctgt

SEQ ID NO: 101363 - DNA, 75 bp, Artificial Sequence
  Synthetic
tataggagatttaaagtgtactacggtttccattaatgatgttgacactggtgttccttctattagcactgatac

SEQ ID NO: 101364 - DNA, 75 bp, Artificial Sequence
  Synthetic
tgtcgatgttactaatggtttaggtacttattatgttttagatcgtgtgtatttaaatactacgttgttgcttaa

SEQ ID NO: 101365 - DNA, 75 bp, Artificial Sequence
  Synthetic
tggttactatcctacttcaggttctacatatcgtaatatggcactgaagggaactttactattgagcacactatg

SEQ ID NO: 101366 - DNA, 75 bp, Artificial Sequence
  Synthetic
gtttaaaccaccttttctttctgattttactaatggtatttttgctaaggtcaaaaataccaaggttactaaaaa

SEQ ID NO: 101367 - DNA, 75 bp, Artificial Sequence
  Synthetic
tggtttaatgtatagtgagtttcctgctataactataggtagtacttttgtaaatacatcttatagtgtggtagt

SEQ ID NO: 101368 - DNA, 75 bp, Artificial Sequence
  Synthetic
acaaccacatactaccaatttggataataaattacaaggtctcttagagatctctgtttgccagtatactatgtg

SEQ ID NO: 101369 - DNA, 75 bp, Artificial Sequence
  Synthetic
cgagtacccaaatacgatttgtcatcctaatctgggtaatcgacgcgtagaactatggcattgggatacaggtgt

SEQ ID NO: 101370 - DNA, 75 bp, Artificial Sequence
  Synthetic
tgtttcctgtttatataagcgtaatttcacatatgatgtgaatgctgattatttgtatttccatttttatcaaga

SEQ ID NO: 101371 - DNA, 75 bp, Artificial Sequence
  Synthetic
aggtggtactttttatgcatattttacagacactggtgttgttactaagtttctgtttaatgtttatttaggcac

SEQ ID NO: 101372 - DNA, 75 bp, Artificial Sequence
  Synthetic
ggtgctttcacattattatgtcatgcctttgacttgtaatagtgctatgtctttagaatattgggttacacctct

SEQ ID NO: 101373 - DNA, 75 bp, Artificial Sequence
  Synthetic
cacttctaaacaatatctactagctttcaatcaagatggtgttatttttaatgctgttgattgtaagagtgattt

SEQ ID NO: 101374 - DNA, 75 bp, Artificial Sequence
  Synthetic
tatgagtgagattaagtgtaaaacactatctatagcaccatctactggtgtttatgaattaaacggttacactgt

SEQ ID NO: 101375 - DNA, 75 bp, Artificial Sequence
  Synthetic
tcagccaattgcagatgtttaccgacgtatacctaatcttcccgattgtaatatagaggcttggcttaatgataa

SEQ ID NO: 101376 - DNA, 75 bp, Artificial Sequence
  Synthetic
gtcggtgccctctccattaaattgggaacgtaagaccttttcaaattgtaattttaatatgagcagcctgatgtc

SEQ ID NO: 101377 - DNA, 75 bp, Artificial Sequence
  Synthetic
ttttattcaggcagactcatttacttgtaataatattgatgctgctaagatatatggtatgtgtttttccagcat

SEQ ID NO: 101378 - DNA, 75 bp, Artificial Sequence
  Synthetic
aactatagataagtttgctatacccaatagtaggaaggttgacctacaattgggcaatttgggctatttgcagtc

SEQ ID NO: 101379 - DNA, 75 bp, Artificial Sequence
  Synthetic
ttttaactatagaattgatactactgctacaagttgtcagttgtattataatttacctgctgctaatgtttctgt

SEQ ID NO: 101380 - DNA, 75 bp, Artificial Sequence
  Synthetic
tagcaggtttaatccttctacttggaacaggagatttggttttacagaacaatctgtttttaagcctcaacctgc

SEQ ID NO: 101381 - DNA, 75 bp, Artificial Sequence
  Synthetic
aggtgtttttactgatcatgatgttgtttatgcacaacattgttttaaagctcccacaaatttctgtccgtgtaa

SEQ ID NO: 101382 - DNA, 75 bp, Artificial Sequence
  Synthetic
attggatgggtctttgtgtgtaggtaatggtcctggtatagatgctggttataaaaatagtggtataggcacttg

SEQ ID NO: 101383 - DNA, 75 bp, Artificial Sequence
  Synthetic
tcctgcaggtactaattatttaacttgccataatgctgcccaatgtaattgtttgtgcactccagaccccattac

SEQ ID NO: 101384 - DNA, 75 bp, Artificial Sequence
  Synthetic
atctaaatctacagggccttacaagtgcccccaaactaaatacttagttggcataggtgagcactgttcgggtct

SEQ ID NO: 101385 - DNA, 75 bp, Artificial Sequence
  Synthetic
tgctattaaaagtgatcattgtggaggtaatccttgtacttgccaaccacaagcatttttgggttggtctgttga

SEQ ID NO: 101386 - DNA, 75 bp, Artificial Sequence
  Synthetic
gtcttgtttacaaggggataggtgtaatatttttgctaattttattttgcatggtgttaatagtggtactacttg

SEQ ID NO: 101387 - DNA, 75 bp, Artificial Sequence
  Synthetic
ttctactgatttacaaaaatcaaacacagacataattcttggtgtttgtgttaattatgatctttatggtattac

SEQ ID NO: 101388 - DNA, 75 bp, Artificial Sequence
  Synthetic
tggtcaaggtatttttgttgaggttaatgcgacttattataatagttggcagaaccttttatatgattctaatgg

SEQ ID NO: 101389 - DNA, 75 bp, Artificial Sequence
  Synthetic
taatctctatggttttagagactacttaacaaacagaacttttatgattcgtagttgctatagcggtcgtgtttc

SEQ ID NO: 101390 - DNA, 75 bp, Artificial Sequence
  Synthetic
agcggcctttcatgctaactcttccgaaccagcattgctatttcggaatattaaatgcaattacgtttttaataa

SEQ ID NO: 101391 - DNA, 75 bp, Artificial Sequence
  Synthetic
tactctttcacgacagctgcaacctattaactattttgatagctatcttggttgtgttgtcaatgctgataatag

SEQ ID NO: 101392 - DNA, 75 bp, Artificial Sequence
  Synthetic
tacttctagtgttgttcaaacatgtgatctcacagtaggtagtggttactgtgtggattactctacaaaaagacg

SEQ ID NO: 101393 - DNA, 75 bp, Artificial Sequence
  Synthetic
aagtcgtagagcgattaccactggttatcggtttactaattttgagccatttactgttaattcagtaaatgatag

SEQ ID NO: 101394 - DNA, 75 bp, Artificial Sequence
  Synthetic
tttagaacctgtaggtggtttgtatgaaattcaaataccttcagagtttactataggtaacatggaggagtttat

SEQ ID NO: 101395 - DNA, 75 bp, Artificial Sequence
  Synthetic
tcaaacaagctctcctaaagttactattgattgttctgcttttgtctgtggtgattatgcagcatgtaaatcaca

SEQ ID NO: 101396 - DNA, 75 bp, Artificial Sequence
  Synthetic
gttggttgaatatggtagcttctgtgacaatattaatgctatactcacagaagtaaatgaactacttgacactac

SEQ ID NO: 101397 - DNA, 75 bp, Artificial Sequence
  Synthetic
acagttgcaagtagctaatagtttaatgaatggtgtcactcttagcactaagcttaaagatggcgtcaatttcaa

SEQ ID NO: 101398 - DNA, 75 bp, Artificial Sequence
  Synthetic
tgtagatgacatcaatttttcccctgtattaggttgtctaggaagcgattgtaatagagtttccagtagatctgc

SEQ ID NO: 101399 - DNA, 75 bp, Artificial Sequence
  Synthetic
tatagaggatttacttttttctaaagtaaagttagctgatgtcggtttcgttgaggcttataataattgtactgg

SEQ ID NO: 101400 - DNA, 75 bp, Artificial Sequence
  Synthetic
aggtgccgaaattagggacctcatttgtgtgcaaagttataatggtatcaaggtgttgcctccactgctctcaga

SEQ ID NO: 101401 - DNA, 75 bp, Artificial Sequence
  Synthetic
aaatcagatcagtggatacactttggctgcgacctctgctagtttgtttcctccttggtcagcagcagcaggtgt

SEQ ID NO: 101402 - DNA, 75 bp, Artificial Sequence
  Synthetic
accattttatttaaatgttcagtatcgtattaatgggattggtgttaccatggatgtgctaagtcaaaatcaaaa

SEQ ID NO: 101403 - DNA, 75 bp, Artificial Sequence
  Synthetic
gcttattgctaatgcatttaacaatgctcttggtgctattcaggaagggtttgatgctaccaattctgctttagt

SEQ ID NO: 101404 - DNA, 75 bp, Artificial Sequence
  Synthetic
taaaattcaagctgttgttaatgcaaatgctgaagctcttaataacttattgcaacaactctctaatagatttgg

SEQ ID NO: 101405 - DNA, 75 bp, Artificial Sequence
  Synthetic
tgctataagttcttctttacaagaaattctatctagactggatgctcttgaagcgcaagctcagatagatagact

SEQ ID NO: 101406 - DNA, 75 bp, Artificial Sequence
  Synthetic
tattaacgggcgtcttaccgctcttaatgcttatgtttctcaacagcttagtgactctacactagtaaaatttag

SEQ ID NO: 101407 - DNA, 75 bp, Artificial Sequence
  Synthetic
tgcagcacaagctatggagaaggttaatgaatgtgtcaaaagccaatcatctaggataaatttttgtggtaatgg

SEQ ID NO: 101408 - DNA, 75 bp, Artificial Sequence
  Synthetic
taatcatattatatcattagtgcagaatgctccatatggtttgtattttatccactttagctatgtccctactaa

SEQ ID NO: 101409 - DNA, 75 bp, Artificial Sequence
  Synthetic
gtatgtcactgcgaaggttagtcccggtctgtgcattgctggtgatagaggtatagcccctaagagtggttattt

SEQ ID NO: 101410 - DNA, 75 bp, Artificial Sequence
  Synthetic
tgttaatgtaaataatacttggatgttcactggtagtggttattactaccctgaacctataactggaaataatgt

SEQ ID NO: 101411 - DNA, 75 bp, Artificial Sequence
  Synthetic
tgttgttatgagtacctgtgctgttaactatactaaagcaccggatgtaatgctgaacatttcaacacccaacct

SEQ ID NO: 101412 - DNA, 75 bp, Artificial Sequence
  Synthetic
ccctgattttaaggaagagttggatcaatggtttaaaaaccaaacatcagtggcaccagatttgtcacttgatta

SEQ ID NO: 101413 - DNA, 75 bp, Artificial Sequence
  Synthetic
tataaatgttacattcttggacctacaagaagaaatgaataggttacaggaggcaataaaagttttaaatcatag

SEQ ID NO: 101414 - DNA, 75 bp, Artificial Sequence
  Synthetic
ctacatcaatctcaaggacattggtacatatgagtattatgtaaaatggccttggtatgtatggcttttaattgg

SEQ ID NO: 101415 - DNA, 75 bp, Artificial Sequence
  Synthetic
ctttgctggtgtagctatgcttgttttactattcttcatatgctgttgtacaggatgtgggactagttgttttaa

SEQ ID NO: 101416 - DNA, 75 bp, Artificial Sequence
  Synthetic
gaaatgtggtggttgttgtgatgattatactggacaccaggagttagtaattaaaacatcacatgacgactaagt

SEQ ID NO: 101417 - DNA, 75 bp, Artificial Sequence
  Synthetic
tcgtctttgctttaatggctcctgacgaaacattacatcccttcaatcatgttaagctaattataagacccattg

SEQ ID NO: 101418 - DNA, 75 bp, Artificial Sequence
  Synthetic
tcgtctttgctttaatggctcctgacgatacattacatcccttcaatcatgttaagctaattataagacccattg

SEQ ID NO: 101419 - DNA, 75 bp, Artificial Sequence
  Synthetic
tcgtctttgctttaatggctcctgacgacacattacatcccttcaatcatgttaagctaattataagacccattg

SEQ ID NO: 101420 - DNA, 75 bp, Artificial Sequence
  Synthetic
tcgtctttgctttaatggctcctgacgagacattacatcccttcaatcatgttaagctaattataagacccattg

SEQ ID NO: 101421 - DNA, 75 bp, Artificial Sequence
  Synthetic
tcgtctttgctttattggctcctgacgaaacattacatcccttcaatcatgttaagctaattataagacccattg

SEQ ID NO: 101422 - DNA, 75 bp, Artificial Sequence
  Synthetic
tcgtctttgctttattggctcctgacgatacattacatcccttcaatcatgttaagctaattataagacccattg

SEQ ID NO: 101423 - DNA, 75 bp, Artificial Sequence
  Synthetic
tcgtctttgctttattggctcctgacgacacattacatcccttcaatcatgttaagctaattataagacccattg

SEQ ID NO: 101424 - DNA, 75 bp, Artificial Sequence
  Synthetic
tcgtctttgctttattggctcctgacgagacattacatcccttcaatcatgttaagctaattataagacccattg

SEQ ID NO: 101425 - DNA, 75 bp, Artificial Sequence
  Synthetic
tcgtctttgctttactggctcctgacgaaacattacatcccttcaatcatgttaagctaattataagacccattg

SEQ ID NO: 101426 - DNA, 75 bp, Artificial Sequence
  Synthetic
tcgtctttgctttactggctcctgacgatacattacatcccttcaatcatgttaagctaattataagacccattg

SEQ ID NO: 101427 - DNA, 75 bp, Artificial Sequence
  Synthetic
tcgtctttgctttactggctcctgacgacacattacatcccttcaatcatgttaagctaattataagacccattg

SEQ ID NO: 101428 - DNA, 75 bp, Artificial Sequence
  Synthetic
tcgtctttgctttactggctcctgacgagacattacatcccttcaatcatgttaagctaattataagacccattg

SEQ ID NO: 101429 - DNA, 75 bp, Artificial Sequence
  Synthetic
tcgtctttgctttagtggctcctgacgaaacattacatcccttcaatcatgttaagctaattataagacccattg

SEQ ID NO: 101430 - DNA, 75 bp, Artificial Sequence
  Synthetic
tcgtctttgctttagtggctcctgacgatacattacatcccttcaatcatgttaagctaattataagacccattg

SEQ ID NO: 101431 - DNA, 75 bp, Artificial Sequence
  Synthetic
tcgtctttgctttagtggctcctgacgacacattacatcccttcaatcatgttaagctaattataagacccattg

SEQ ID NO: 101432 - DNA, 75 bp, Artificial Sequence
  Synthetic
tcgtctttgctttagtggctcctgacgagacattacatcccttcaatcatgttaagctaattataagacccattg

SEQ ID NO: 101433 - DNA, 75 bp, Artificial Sequence
  Synthetic
aggtcgagcatattataacagctaccacaatgcctgctttttagtgggtactgtgtcttatataactagtaaacc

SEQ ID NO: 101434 - DNA, 75 bp, Artificial Sequence
  Synthetic
tgtaatgccaatggctacaaccattgatggaacagattatactaacattatgcctagtactgtttttacaacagt

SEQ ID NO: 101435 - DNA, 75 bp, Artificial Sequence
  Synthetic
tgtaatgccaatggctacaaccattgatggtacagattatactaacattatgcctagtactgtttttacaacagt

SEQ ID NO: 101436 - DNA, 75 bp, Artificial Sequence
  Synthetic
tgtaatgccaatggctacaaccattgatggcacagattatactaacattatgcctagtactgtttttacaacagt

SEQ ID NO: 101437 - DNA, 75 bp, Artificial Sequence
  Synthetic
tgtaatgccaatggctacaaccattgatgggacagattatactaacattatgcctagtactgtttttacaacagt

SEQ ID NO: 101438 - DNA, 75 bp, Artificial Sequence
  Synthetic
ttatttaggcggttttataggtattgatactagcaccactggttttacctgtttttcacggtactagtcccaaac

SEQ ID NO: 101439 - DNA, 75 bp, Artificial Sequence
  Synthetic
catattataattcaggtagaccttataactttaagcattaattgccaaagtttctaagaccacgccctagtaatg

SEQ ID NO: 101440 - DNA, 75 bp, Artificial Sequence
  Synthetic
catattataattcaggtagaccttataactttaagcattaattgccaaagtttctaagtccacgccctagtaatg

SEQ ID NO: 101441 - DNA, 75 bp, Artificial Sequence
  Synthetic
catattataattcaggtagaccttataactttaagcattaattgccaaagtttctaagcccacgccctagtaatg

SEQ ID NO: 101442 - DNA, 75 bp, Artificial Sequence
  Synthetic
catattataattcaggtagaccttataactttaagcattaattgccaaagtttctaaggccacgccctagtaatg

SEQ ID NO: 101443 - DNA, 75 bp, Artificial Sequence
  Synthetic
catattataattcaggtagaccttataactttaagcattaattgcctaagtttctaagaccacgccctagtaatg

SEQ ID NO: 101444 - DNA, 75 bp, Artificial Sequence
  Synthetic
catattataattcaggtagaccttataactttaagcattaattgcctaagtttctaagtccacgccctagtaatg

SEQ ID NO: 101445 - DNA, 75 bp, Artificial Sequence
  Synthetic
catattataattcaggtagaccttataactttaagcattaattgcctaagtttctaagcccacgccctagtaatg

SEQ ID NO: 101446 - DNA, 75 bp, Artificial Sequence
  Synthetic
catattataattcaggtagaccttataactttaagcattaattgcctaagtttctaaggccacgccctagtaatg

SEQ ID NO: 101447 - DNA, 75 bp, Artificial Sequence
  Synthetic
catattataattcaggtagaccttataactttaagcattaattgcccaagtttctaagaccacgccctagtaatg

SEQ ID NO: 101448 - DNA, 75 bp, Artificial Sequence
  Synthetic
catattataattcaggtagaccttataactttaagcattaattgcccaagtttctaagtccacgccctagtaatg

SEQ ID NO: 101449 - DNA, 75 bp, Artificial Sequence
  Synthetic
catattataattcaggtagaccttataactttaagcattaattgcccaagtttctaagcccacgccctagtaatg

SEQ ID NO: 101450 - DNA, 75 bp, Artificial Sequence
  Synthetic
catattataattcaggtagaccttataactttaagcattaattgcccaagtttctaaggccacgccctagtaatg

SEQ ID NO: 101451 - DNA, 75 bp, Artificial Sequence
  Synthetic
catattataattcaggtagaccttataactttaagcattaattgccgaagtttctaagaccacgccctagtaatg

SEQ ID NO: 101452 - DNA, 75 bp, Artificial Sequence
  Synthetic
catattataattcaggtagaccttataactttaagcattaattgccgaagtttctaagtccacgccctagtaatg

SEQ ID NO: 101453 - DNA, 75 bp, Artificial Sequence
  Synthetic
catattataattcaggtagaccttataactttaagcattaattgccgaagtttctaagcccacgccctagtaatg

SEQ ID NO: 101454 - DNA, 75 bp, Artificial Sequence
  Synthetic
catattataattcaggtagaccttataactttaagcattaattgccgaagtttctaaggccacgccctagtaatg

SEQ ID NO: 101455 - DNA, 75 bp, Artificial Sequence
  Synthetic
gaaatttggagacctgagattaaatatctccgttatactaacggttttaatgtctcagaattagaagatgcttgt

SEQ ID NO: 101456 - DNA, 75 bp, Artificial Sequence
  Synthetic
gatatttggagacctgagattaaatatctccgttatactaacggttttaatgtctcagaattagaagatgcttgt

SEQ ID NO: 101457 - DNA, 75 bp, Artificial Sequence
  Synthetic
gacatttggagacctgagattaaatatctccgttatactaacggttttaatgtctcagaattagaagatgcttgt

SEQ ID NO: 101458 - DNA, 75 bp, Artificial Sequence
  Synthetic
gagatttggagacctgagattaaatatctccgttatactaacggttttaatgtctcagaattagaagatgcttgt

SEQ ID NO: 101459 - DNA, 75 bp, Artificial Sequence
  Synthetic
tttaaatttaattataaatttcctaaagtaggatattgtagagttcctagtcatgcttggtgccgtaatcaaggt

SEQ ID NO: 101460 - DNA, 75 bp, Artificial Sequence
  Synthetic
aacttttgtgctacactcacactttatggcaaatccaaacattatgataaatattttggagtaataactggtttt

SEQ ID NO: 101461 - DNA, 75 bp, Artificial Sequence
  Synthetic
aacttttgtgctacactcactctttatggcaaatccaaacattatgataaatattttggagtaataactggtttt

SEQ ID NO: 101462 - DNA, 75 bp, Artificial Sequence
  Synthetic
aacttttgtgctacactcaccctttatggcaaatccaaacattatgataaatattttggagtaataactggtttt

SEQ ID NO: 101463 - DNA, 75 bp, Artificial Sequence
  Synthetic
aacttttgtgctacactcacgctttatggcaaatccaaacattatgataaatattttggagtaataactggtttt

SEQ ID NO: 101464 - DNA, 75 bp, Artificial Sequence
  Synthetic
atcttttgtgctacactcacactttatggcaaatccaaacattatgataaatattttggagtaataactggtttt

SEQ ID NO: 101465 - DNA, 75 bp, Artificial Sequence
  Synthetic
atcttttgtgctacactcactctttatggcaaatccaaacattatgataaatattttggagtaataactggtttt

SEQ ID NO: 101466 - DNA, 75 bp, Artificial Sequence
  Synthetic
atcttttgtgctacactcaccctttatggcaaatccaaacattatgataaatattttggagtaataactggtttt

SEQ ID NO: 101467 - DNA, 75 bp, Artificial Sequence
  Synthetic
atcttttgtgctacactcacgctttatggcaaatccaaacattatgataaatattttggagtaataactggtttt

SEQ ID NO: 101468 - DNA, 75 bp, Artificial Sequence
  Synthetic
accttttgtgctacactcacactttatggcaaatccaaacattatgataaatattttggagtaataactggtttt

SEQ ID NO: 101469 - DNA, 75 bp, Artificial Sequence
  Synthetic
accttttgtgctacactcactctttatggcaaatccaaacattatgataaatattttggagtaataactggtttt

SEQ ID NO: 101470 - DNA, 75 bp, Artificial Sequence
  Synthetic
accttttgtgctacactcaccctttatggcaaatccaaacattatgataaatattttggagtaataactggtttt

SEQ ID NO: 101471 - DNA, 75 bp, Artificial Sequence
  Synthetic
accttttgtgctacactcacgctttatggcaaatccaaacattatgataaatattttggagtaataactggtttt

SEQ ID NO: 101472 - DNA, 75 bp, Artificial Sequence
  Synthetic
agcttttgtgctacactcacactttatggcaaatccaaacattatgataaatattttggagtaataactggtttt

SEQ ID NO: 101473 - DNA, 75 bp, Artificial Sequence
  Synthetic
agcttttgtgctacactcactctttatggcaaatccaaacattatgataaatattttggagtaataactggtttt

SEQ ID NO: 101474 - DNA, 75 bp, Artificial Sequence
  Synthetic
agcttttgtgctacactcaccctttatggcaaatccaaacattatgataaatattttggagtaataactggtttt

SEQ ID NO: 101475 - DNA, 75 bp, Artificial Sequence
  Synthetic
agcttttgtgctacactcacgctttatggcaaatccaaacattatgataaatattttggagtaataactggtttt

SEQ ID NO: 101476 - DNA, 75 bp, Artificial Sequence
  Synthetic
acagcattcgctaatactgtagaggaggctgttaacaaactggttttcttagctgttgactttattacctggcgg

SEQ ID NO: 101477 - DNA, 75 bp, Artificial Sequence
  Synthetic
agacaggagttaaatgtttatggctgatgcttattttgcagacactgtgtggtatgtggggcaaataatttttat

SEQ ID NO: 101478 - DNA, 75 bp, Artificial Sequence
  Synthetic
agttgccatttgtttattggttataatagttgtagtggcatttttggcaacttttaaattgtgtattcaactttg

SEQ ID NO: 101479 - DNA, 75 bp, Artificial Sequence
  Synthetic
cggtatgtgtaataccttagtactgtccccttctatttatgtgtttaatagaggtaggcagttttatgagtttta

SEQ ID NO: 101480 - DNA, 75 bp, Artificial Sequence
  Synthetic
caatgatgtaaaaccaccagttcttgatgtggatgacgtttagttaatccaaacattatgagtagtgtaactaca

SEQ ID NO: 101481 - DNA, 75 bp, Artificial Sequence
  Synthetic
ccagcaccagtttacacctggactgctgatgaagctattaaattcctaaaggaatggaaattttctttgggtatt

SEQ ID NO: 101482 - DNA, 75 bp, Artificial Sequence
  Synthetic
ccagcaccagtttacacctggactgctgatgaagctattaaattcctaaaggaatggaatttttctttgggtatt

SEQ ID NO: 101483 - DNA, 75 bp, Artificial Sequence
  Synthetic
ccagcaccagtttacacctggactgctgatgaagctattaaattcctaaaggaatggaacttttctttgggtatt

SEQ ID NO: 101484 - DNA, 75 bp, Artificial Sequence
  Synthetic
ccagcaccagtttacacctggactgctgatgaagctattaaattcctaaaggaatggaagttttctttgggtatt

SEQ ID NO: 101485 - DNA, 75 bp, Artificial Sequence
  Synthetic
atactactttttattacagtcatattgcaatttggatacacaagtcgcagtatgtttgtttatgttattaagatg

SEQ ID NO: 101486 - DNA, 75 bp, Artificial Sequence
  Synthetic
atcattttgtggcttatgtggccccttactatcatcttaactattttcaattgcgtgtatgcattgaataatgtg

SEQ ID NO: 101487 - DNA, 75 bp, Artificial Sequence
  Synthetic
atcattttgtggcttatgtggccccttactatcatcttaactattttcaattgcgtgtatgctttgaataatgtg

SEQ ID NO: 101488 - DNA, 75 bp, Artificial Sequence
  Synthetic
atcattttgtggcttatgtggccccttactatcatcttaactattttcaattgcgtgtatgccttgaataatgtg

SEQ ID NO: 101489 - DNA, 75 bp, Artificial Sequence
  Synthetic
atcattttgtggcttatgtggccccttactatcatcttaactattttcaattgcgtgtatgcgttgaataatgtg

SEQ ID NO: 101490 - DNA, 75 bp, Artificial Sequence
  Synthetic
atctttttgtggcttatgtggccccttactatcatcttaactattttcaattgcgtgtatgcattgaataatgtg

SEQ ID NO: 101491 - DNA, 75 bp, Artificial Sequence
  Synthetic
atctttttgtggcttatgtggccccttactatcatcttaactattttcaattgcgtgtatgctttgaataatgtg

SEQ ID NO: 101492 - DNA, 75 bp, Artificial Sequence
  Synthetic
atctttttgtggcttatgtggccccttactatcatcttaactattttcaattgcgtgtatgccttgaataatgtg

SEQ ID NO: 101493 - DNA, 75 bp, Artificial Sequence
  Synthetic
atctttttgtggcttatgtggccccttactatcatcttaactattttcaattgcgtgtatgcgttgaataatgtg

SEQ ID NO: 101494 - DNA, 75 bp, Artificial Sequence
  Synthetic
atccttttgtggcttatgtggccccttactatcatcttaactattttcaattgcgtgtatgcattgaataatgtg

SEQ ID NO: 101495 - DNA, 75 bp, Artificial Sequence
  Synthetic
atccttttgtggcttatgtggccccttactatcatcttaactattttcaattgcgtgtatgctttgaataatgtg

SEQ ID NO: 101496 - DNA, 75 bp, Artificial Sequence
  Synthetic
atccttttgtggcttatgtggccccttactatcatcttaactattttcaattgcgtgtatgccttgaataatgtg

SEQ ID NO: 101497 - DNA, 75 bp, Artificial Sequence
  Synthetic
atccttttgtggcttatgtggccccttactatcatcttaactattttcaattgcgtgtatgcgttgaataatgtg

SEQ ID NO: 101498 - DNA, 75 bp, Artificial Sequence
  Synthetic
atcgttttgtggcttatgtggccccttactatcatcttaactattttcaattgcgtgtatgcattgaataatgtg

SEQ ID NO: 101499 - DNA, 75 bp, Artificial Sequence
  Synthetic
atcgttttgtggcttatgtggccccttactatcatcttaactattttcaattgcgtgtatgctttgaataatgtg

SEQ ID NO: 101500 - DNA, 75 bp, Artificial Sequence
  Synthetic
atcgttttgtggcttatgtggccccttactatcatcttaactattttcaattgcgtgtatgccttgaataatgtg

SEQ ID NO: 101501 - DNA, 75 bp, Artificial Sequence
  Synthetic
atcgttttgtggcttatgtggccccttactatcatcttaactattttcaattgcgtgtatgcgttgaataatgtg

SEQ ID NO: 101502 - DNA, 75 bp, Artificial Sequence
  Synthetic
tatcttggcttttctatagttttcactatagtggccattatcatgtggattgtgtattttgtgaatagtatcagg

SEQ ID NO: 101503 - DNA, 75 bp, Artificial Sequence
  Synthetic
ttgtttattagaactggaagttggtggagtttcaacccagaaacaaacaacttgatgtgtatagatatgaaggga

SEQ ID NO: 101504 - DNA, 75 bp, Artificial Sequence
  Synthetic
aggatgtatgttaggcctataattgaggactaccaaacccttacggtcacaataatacgtggtcatctttacatg

SEQ ID NO: 101505 - DNA, 75 bp, Artificial Sequence
  Synthetic
aggatgtatgttaggcctataattgaggactaccatacccttacggtcacaataatacgtggtcatctttacatg

SEQ ID NO: 101506 - DNA, 75 bp, Artificial Sequence
  Synthetic
aggatgtatgttaggcctataattgaggactaccacacccttacggtcacaataatacgtggtcatctttacatg

SEQ ID NO: 101507 - DNA, 75 bp, Artificial Sequence
  Synthetic
aggatgtatgttaggcctataattgaggactaccagacccttacggtcacaataatacgtggtcatctttacatg

SEQ ID NO: 101508 - DNA, 75 bp, Artificial Sequence
  Synthetic
caaggtataaaactaggtactggctattctttgtcagatttgccagcttatgtgactgttgctaaggtctcacac

SEQ ID NO: 101509 - DNA, 75 bp, Artificial Sequence
  Synthetic
ctgctcacgtataagcgtggttttcttgacaagataggcgatactagtggttttgctgtttatgttaagtccaaa

SEQ ID NO: 101510 - DNA, 75 bp, Artificial Sequence
  Synthetic
gtcggtaattaccgactgccatcaacccaaaagggttctggcatggacaccgcattgttgagaaataatatctaa

SEQ ID NO: 101511 - DNA, 75 bp, Artificial Sequence
  Synthetic
actttaaggatgtcttttactcctggtaagcaatccagtagtagagcgtcctctggaaatcgttctggtaatggc

SEQ ID NO: 101512 - DNA, 75 bp, Artificial Sequence
  Synthetic
atccttaagtgggccgatcagtccgaccaatctagaaatgttcaaaccaggggtagaagagctcaacccaagcaa

SEQ ID NO: 101513 - DNA, 75 bp, Artificial Sequence
  Synthetic
actgctacttctcagcaaccatcaggagggaatgttgtaccctactattcttggttctctggaattactcagttt

SEQ ID NO: 101514 - DNA, 75 bp, Artificial Sequence
  Synthetic
caaaaaggaaaggagtttgaatttgcagagggacaaggtgtgcctattgcaccaggagtcccagctactgaagct

SEQ ID NO: 101515 - DNA, 75 bp, Artificial Sequence
  Synthetic
aaggggtactggtacagacacaaccgacgttcttttaaaacagccgatggcaaccagcgtcaactgctgccacga

SEQ ID NO: 101516 - DNA, 75 bp, Artificial Sequence
  Synthetic
tggtatttttactatcttggaacaggaccgcatgccaaagaccagtatggcaccgacattgacggagtcttctgg

SEQ ID NO: 101517 - DNA, 75 bp, Artificial Sequence
  Synthetic
gtcgctagtaaccaggctgatgtcaataccccggctgacattctcgatcgggacccaagtagcgatgaggctatt

SEQ ID NO: 101518 - DNA, 75 bp, Artificial Sequence
  Synthetic
ccgactaggtttccgcctggcacggtactccctcagggttactatattgaaggctcaggaaggtctgctcctaat

SEQ ID NO: 101519 - DNA, 75 bp, Artificial Sequence
  Synthetic
acccctacctctggtgtaacacctgatatggctgatcaaattgctagtcttgttctggcaaaacttggcaaggat

SEQ ID NO: 101520 - DNA, 75 bp, Artificial Sequence
  Synthetic
gccactaagccacagcaagtaactaagcagactgccaaagaaatcagacagaaaattttgaataagccccgccag

SEQ ID NO: 101521 - DNA, 75 bp, Artificial Sequence
  Synthetic
aagaggagccccaataaacaatgcactgttcagcagtgctttgggaagagaggccccaatcagaattttggtggt

SEQ ID NO: 101522 - DNA, 75 bp, Artificial Sequence
  Synthetic
ggagaaatgttaaaacttggaactagtgaaccacagttccccattcttgcagaactcgcacccacagctggtgcg

SEQ ID NO: 101523 - DNA, 75 bp, Artificial Sequence
  Synthetic
ggagaaatgttaaaacttggaactagtgatccacagttccccattcttgcagaactcgcacccacagctggtgcg

SEQ ID NO: 101524 - DNA, 75 bp, Artificial Sequence
  Synthetic
ggagaaatgttaaaacttggaactagtgacccacagttccccattcttgcagaactcgcacccacagctggtgcg

SEQ ID NO: 101525 - DNA, 75 bp, Artificial Sequence
  Synthetic
ggagaaatgttaaaacttggaactagtgagccacagttccccattcttgcagaactcgcacccacagctggtgcg

SEQ ID NO: 101526 - DNA, 75 bp, Artificial Sequence
  Synthetic
tttttctttggatcaagattagagttggccaaagtgcagaatttgtctgggaatcttgaagagccccagaaggat

SEQ ID NO: 101527 - DNA, 75 bp, Artificial Sequence
  Synthetic
tttttctttggatcaagattagagttggccaaagtgcagaatttgtctgggaatcttgatgagccccagaaggat

SEQ ID NO: 101528 - DNA, 75 bp, Artificial Sequence
  Synthetic
tttttctttggatcaagattagagttggccaaagtgcagaatttgtctgggaatcttgacgagccccagaaggat

SEQ ID NO: 101529 - DNA, 75 bp, Artificial Sequence
  Synthetic
tttttctttggatcaagattagagttggccaaagtgcagaatttgtctgggaatcttgaggagccccagaaggat

SEQ ID NO: 101530 - DNA, 75 bp, Artificial Sequence
  Synthetic
gtttatgaattgcgctaaaatggagcaattagatttgacagtacactttcaggttttgagaccataatgaaggtg

SEQ ID NO: 101531 - DNA, 75 bp, Artificial Sequence
  Synthetic
gtttatgaattgcgctaaaatggtgcaattagatttgacagtacactttcaggttttgagaccataatgaaggtg

SEQ ID NO: 101532 - DNA, 75 bp, Artificial Sequence
  Synthetic
gtttatgaattgcgctaaaatggcgcaattagatttgacagtacactttcaggttttgagaccataatgaaggtg

SEQ ID NO: 101533 - DNA, 75 bp, Artificial Sequence
  Synthetic
gtttatgaattgcgctaaaatggggcaattagatttgacagtacactttcaggttttgagaccataatgaaggtg

SEQ ID NO: 101534 - DNA, 75 bp, Artificial Sequence
  Synthetic
gtttatgaattgcgctaaattggagcaattagatttgacagtacactttcaggttttgagaccataatgaaggtg

SEQ ID NO: 101535 - DNA, 75 bp, Artificial Sequence
  Synthetic
gtttatgaattgcgctaaattggtgcaattagatttgacagtacactttcaggttttgagaccataatgaaggtg

SEQ ID NO: 101536 - DNA, 75 bp, Artificial Sequence
  Synthetic
gtttatgaattgcgctaaattggcgcaattagatttgacagtacactttcaggttttgagaccataatgaaggtg

SEQ ID NO: 101537 - DNA, 75 bp, Artificial Sequence
  Synthetic
gtttatgaattgcgctaaattggggcaattagatttgacagtacactttcaggttttgagaccataatgaaggtg

SEQ ID NO: 101538 - DNA, 75 bp, Artificial Sequence
  Synthetic
gtttatgaattgcgctaaactggagcaattagatttgacagtacactttcaggttttgagaccataatgaaggtg

SEQ ID NO: 101539 - DNA, 75 bp, Artificial Sequence
  Synthetic
gtttatgaattgcgctaaactggtgcaattagatttgacagtacactttcaggttttgagaccataatgaaggtg

SEQ ID NO: 101540 - DNA, 75 bp, Artificial Sequence
  Synthetic
gtttatgaattgcgctaaactggcgcaattagatttgacagtacactttcaggttttgagaccataatgaaggtg

SEQ ID NO: 101541 - DNA, 75 bp, Artificial Sequence
  Synthetic
gtttatgaattgcgctaaactggggcaattagatttgacagtacactttcaggttttgagaccataatgaaggtg

SEQ ID NO: 101542 - DNA, 75 bp, Artificial Sequence
  Synthetic
gtttatgaattgcgctaaagtggagcaattagatttgacagtacactttcaggttttgagaccataatgaaggtg

SEQ ID NO: 101543 - DNA, 75 bp, Artificial Sequence
  Synthetic
gtttatgaattgcgctaaagtggtgcaattagatttgacagtacactttcaggttttgagaccataatgaaggtg

SEQ ID NO: 101544 - DNA, 75 bp, Artificial Sequence
  Synthetic
gtttatgaattgcgctaaagtggcgcaattagatttgacagtacactttcaggttttgagaccataatgaaggtg

SEQ ID NO: 101545 - DNA, 75 bp, Artificial Sequence
  Synthetic
gtttatgaattgcgctaaagtggggcaattagatttgacagtacactttcaggttttgagaccataatgaaggtg

SEQ ID NO: 101546 - DNA, 75 bp, Artificial Sequence
  Synthetic
gtttatgaattgcgctataatggagcaattagatttgacagtacactttcaggttttgagaccataatgaaggtg

SEQ ID NO: 101547 - DNA, 75 bp, Artificial Sequence
  Synthetic
gtttatgaattgcgctataatggtgcaattagatttgacagtacactttcaggttttgagaccataatgaaggtg

SEQ ID NO: 101548 - DNA, 75 bp, Artificial Sequence
  Synthetic
gtttatgaattgcgctataatggcgcaattagatttgacagtacactttcaggttttgagaccataatgaaggtg

SEQ ID NO: 101549 - DNA, 75 bp, Artificial Sequence
  Synthetic
gtttatgaattgcgctataatggggcaattagatttgacagtacactttcaggttttgagaccataatgaaggtg

SEQ ID NO: 101550 - DNA, 75 bp, Artificial Sequence
  Synthetic
gtttatgaattgcgctatattggagcaattagatttgacagtacactttcaggttttgagaccataatgaaggtg

SEQ ID NO: 101551 - DNA, 75 bp, Artificial Sequence
  Synthetic
gtttatgaattgcgctatattggtgcaattagatttgacagtacactttcaggttttgagaccataatgaaggtg

SEQ ID NO: 101552 - DNA, 75 bp, Artificial Sequence
  Synthetic
gtttatgaattgcgctatattggcgcaattagatttgacagtacactttcaggttttgagaccataatgaaggtg

SEQ ID NO: 101553 - DNA, 75 bp, Artificial Sequence
  Synthetic
gtttatgaattgcgctatattggggcaattagatttgacagtacactttcaggttttgagaccataatgaaggtg

SEQ ID NO: 101554 - DNA, 75 bp, Artificial Sequence
  Synthetic
gtttatgaattgcgctatactggagcaattagatttgacagtacactttcaggttttgagaccataatgaaggtg

SEQ ID NO: 101555 - DNA, 75 bp, Artificial Sequence
  Synthetic
gtttatgaattgcgctatactggtgcaattagatttgacagtacactttcaggttttgagaccataatgaaggtg

SEQ ID NO: 101556 - DNA, 75 bp, Artificial Sequence
  Synthetic
gtttatgaattgcgctatactggcgcaattagatttgacagtacactttcaggttttgagaccataatgaaggtg

SEQ ID NO: 101557 - DNA, 75 bp, Artificial Sequence
  Synthetic
gtttatgaattgcgctatactggggcaattagatttgacagtacactttcaggttttgagaccataatgaaggtg

SEQ ID NO: 101558 - DNA, 75 bp, Artificial Sequence
  Synthetic
gtttatgaattgcgctatagtggagcaattagatttgacagtacactttcaggttttgagaccataatgaaggtg

SEQ ID NO: 101559 - DNA, 75 bp, Artificial Sequence
  Synthetic
gtttatgaattgcgctatagtggtgcaattagatttgacagtacactttcaggttttgagaccataatgaaggtg

SEQ ID NO: 101560 - DNA, 75 bp, Artificial Sequence
  Synthetic
gtttatgaattgcgctatagtggcgcaattagatttgacagtacactttcaggttttgagaccataatgaaggtg

SEQ ID NO: 101561 - DNA, 75 bp, Artificial Sequence
  Synthetic
gtttatgaattgcgctatagtggggcaattagatttgacagtacactttcaggttttgagaccataatgaaggtg

SEQ ID NO: 101562 - DNA, 75 bp, Artificial Sequence
  Synthetic
gtttatgaattgcgctacaatggagcaattagatttgacagtacactttcaggttttgagaccataatgaaggtg

SEQ ID NO: 101563 - DNA, 75 bp, Artificial Sequence
  Synthetic
gtttatgaattgcgctacaatggtgcaattagatttgacagtacactttcaggttttgagaccataatgaaggtg

SEQ ID NO: 101564 - DNA, 75 bp, Artificial Sequence
  Synthetic
gtttatgaattgcgctacaatggcgcaattagatttgacagtacactttcaggttttgagaccataatgaaggtg

SEQ ID NO: 101565 - DNA, 75 bp, Artificial Sequence
  Synthetic
gtttatgaattgcgctacaatggggcaattagatttgacagtacactttcaggttttgagaccataatgaaggtg

SEQ ID NO: 101566 - DNA, 75 bp, Artificial Sequence
  Synthetic
gtttatgaattgcgctacattggagcaattagatttgacagtacactttcaggttttgagaccataatgaaggtg

SEQ ID NO: 101567 - DNA, 75 bp, Artificial Sequence
  Synthetic
gtttatgaattgcgctacattggtgcaattagatttgacagtacactttcaggttttgagaccataatgaaggtg

SEQ ID NO: 101568 - DNA, 75 bp, Artificial Sequence
  Synthetic
gtttatgaattgcgctacattggcgcaattagatttgacagtacactttcaggttttgagaccataatgaaggtg

SEQ ID NO: 101569 - DNA, 75 bp, Artificial Sequence
  Synthetic
gtttatgaattgcgctacattggggcaattagatttgacagtacactttcaggttttgagaccataatgaaggtg

SEQ ID NO: 101570 - DNA, 75 bp, Artificial Sequence
  Synthetic
gtttatgaattgcgctacactggagcaattagatttgacagtacactttcaggttttgagaccataatgaaggtg

SEQ ID NO: 101571 - DNA, 75 bp, Artificial Sequence
  Synthetic
gtttatgaattgcgctacactggtgcaattagatttgacagtacactttcaggttttgagaccataatgaaggtg

SEQ ID NO: 101572 - DNA, 75 bp, Artificial Sequence
  Synthetic
gtttatgaattgcgctacactggcgcaattagatttgacagtacactttcaggttttgagaccataatgaaggtg

SEQ ID NO: 101573 - DNA, 75 bp, Artificial Sequence
  Synthetic
gtttatgaattgcgctacactggggcaattagatttgacagtacactttcaggttttgagaccataatgaaggtg

SEQ ID NO: 101574 - DNA, 75 bp, Artificial Sequence
  Synthetic
gtttatgaattgcgctacagtggagcaattagatttgacagtacactttcaggttttgagaccataatgaaggtg

SEQ ID NO: 101575 - DNA, 75 bp, Artificial Sequence
  Synthetic
gtttatgaattgcgctacagtggtgcaattagatttgacagtacactttcaggttttgagaccataatgaaggtg

SEQ ID NO: 101576 - DNA, 75 bp, Artificial Sequence
  Synthetic
gtttatgaattgcgctacagtggcgcaattagatttgacagtacactttcaggttttgagaccataatgaaggtg

SEQ ID NO: 101577 - DNA, 75 bp, Artificial Sequence
  Synthetic
gtttatgaattgcgctacagtggggcaattagatttgacagtacactttcaggttttgagaccataatgaaggtg

SEQ ID NO: 101578 - DNA, 75 bp, Artificial Sequence
  Synthetic
gtttatgaattgcgctagaatggagcaattagatttgacagtacactttcaggttttgagaccataatgaaggtg

SEQ ID NO: 101579 - DNA, 75 bp, Artificial Sequence
  Synthetic
gtttatgaattgcgctagaatggtgcaattagatttgacagtacactttcaggttttgagaccataatgaaggtg

SEQ ID NO: 101580 - DNA, 75 bp, Artificial Sequence
  Synthetic
gtttatgaattgcgctagaatggcgcaattagatttgacagtacactttcaggttttgagaccataatgaaggtg

SEQ ID NO: 101581 - DNA, 75 bp, Artificial Sequence
  Synthetic
gtttatgaattgcgctagaatggggcaattagatttgacagtacactttcaggttttgagaccataatgaaggtg

SEQ ID NO: 101582 - DNA, 75 bp, Artificial Sequence
  Synthetic
gtttatgaattgcgctagattggagcaattagatttgacagtacactttcaggttttgagaccataatgaaggtg

SEQ ID NO: 101583 - DNA, 75 bp, Artificial Sequence
  Synthetic
gtttatgaattgcgctagattggtgcaattagatttgacagtacactttcaggttttgagaccataatgaaggtg

SEQ ID NO: 101584 - DNA, 75 bp, Artificial Sequence
  Synthetic
gtttatgaattgcgctagattggcgcaattagatttgacagtacactttcaggttttgagaccataatgaaggtg

SEQ ID NO: 101585 - DNA, 75 bp, Artificial Sequence
  Synthetic
gtttatgaattgcgctagattggggcaattagatttgacagtacactttcaggttttgagaccataatgaaggtg

SEQ ID NO: 101586 - DNA, 75 bp, Artificial Sequence
  Synthetic
gtttatgaattgcgctagactggagcaattagatttgacagtacactttcaggttttgagaccataatgaaggtg

SEQ ID NO: 101587 - DNA, 75 bp, Artificial Sequence
  Synthetic
gtttatgaattgcgctagactggtgcaattagatttgacagtacactttcaggttttgagaccataatgaaggtg

SEQ ID NO: 101588 - DNA, 75 bp, Artificial Sequence
  Synthetic
gtttatgaattgcgctagactggcgcaattagatttgacagtacactttcaggttttgagaccataatgaaggtg

SEQ ID NO: 101589 - DNA, 75 bp, Artificial Sequence
  Synthetic
gtttatgaattgcgctagactggggcaattagatttgacagtacactttcaggttttgagaccataatgaaggtg

SEQ ID NO: 101590 - DNA, 75 bp, Artificial Sequence
  Synthetic
gtttatgaattgcgctagagtggagcaattagatttgacagtacactttcaggttttgagaccataatgaaggtg

SEQ ID NO: 101591 - DNA, 75 bp, Artificial Sequence
  Synthetic
gtttatgaattgcgctagagtggtgcaattagatttgacagtacactttcaggttttgagaccataatgaaggtg

SEQ ID NO: 101592 - DNA, 75 bp, Artificial Sequence
  Synthetic
gtttatgaattgcgctagagtggcgcaattagatttgacagtacactttcaggttttgagaccataatgaaggtg

SEQ ID NO: 101593 - DNA, 75 bp, Artificial Sequence
  Synthetic
gtttatgaattgcgctagagtggggcaattagatttgacagtacactttcaggttttgagaccataatgaaggtg

SEQ ID NO: 101594 - DNA, 75 bp, Artificial Sequence
  Synthetic
ttgaatgagaatttgaatgcataccaacaacaagatggtatgatgaatatgagtccaaaaccacagcgtcagcgt

SEQ ID NO: 101595 - DNA, 75 bp, Artificial Sequence
  Synthetic
ggtcagaagaatggacaaggagaaaatgataatataagtgttgcagcgcccaaaagccgtgtgcagcaaaataag

SEQ ID NO: 101596 - DNA, 75 bp, Artificial Sequence
  Synthetic
agtagagagttgactgcagaggacatcagccttcttaagaagatggatgagccctatactgaagacacctcagaa

SEQ ID NO: 101597 - DNA, 75 bp, Artificial Sequence
  Synthetic
atataagagaatgaaccttatgtcggcacctggtggtaacccctcgcaggaaagtcgggataaggcactctctat

SEQ ID NO: 101598 - DNA, 75 bp, Artificial Sequence
  Synthetic
cagaatggatgtcttgctgctataatagatagagaaggttatagcagactatagattaattagttgaaagttttg

SEQ ID NO: 101599 - DNA, 75 bp, Artificial Sequence
  Synthetic
tgtggtaatgtatagtgttggagaaagtgaaagacttgcggaagtaattgccgacaagtgcccaaagggaagagc

SEQ ID NO: 101600 - DNA, 75 bp, Artificial Sequence
  Synthetic
acaagtgcccaaagggaagagccagcatgttaagttaccacccagtaattagtaaatgaatgaagttaattatgg

SEQ ID NO: 101601 - DNA, 75 bp, Artificial Sequence
  Synthetic
ctcctaattccagatctacttcacgcgcatccagtagagcctctagtgcaggatcgcgtagaagagccaattctg

SEQ ID NO: 101602 - DNA, 75 bp, Artificial Sequence
  Synthetic
ctcctaattccagatctacttcacgcgcatccagtagagcctctagtgcaggatcgcgtagtagagccaattctg

SEQ ID NO: 101603 - DNA, 75 bp, Artificial Sequence
  Synthetic
ctcctaattccagatctacttcacgcgcatccagtagagcctctagtgcaggatcgcgtagcagagccaattctg

SEQ ID NO: 101604 - DNA, 75 bp, Artificial Sequence
  Synthetic
ctcctaattccagatctacttcacgcgcatccagtagagcctctagtgcaggatcgcgtaggagagccaattctg

SEQ ID NO: 101605 - DNA, 75 bp, Artificial Sequence
  Synthetic
aaaagaacccctacctctggtgtaacacctgatatggctgatcaaattgctagtcttgttctggcaaaacttggc

SEQ ID NO: 101606 - DNA, 75 bp, Artificial Sequence
  Synthetic
aatagaacccctacctctggtgtaacacctgatatggctgatcaaattgctagtcttgttctggcaaaacttggc

SEQ ID NO: 101607 - DNA, 75 bp, Artificial Sequence
  Synthetic
aacagaacccctacctctggtgtaacacctgatatggctgatcaaattgctagtcttgttctggcaaaacttggc

SEQ ID NO: 101608 - DNA, 75 bp, Artificial Sequence
  Synthetic
aagagaacccctacctctggtgtaacacctgatatggctgatcaaattgctagtcttgttctggcaaaacttggc

SEQ ID NO: 101609 - DNA, 75 bp, Artificial Sequence
  Synthetic
accgaacaaggggaaatatggatacgtgttaaaaaactgcgtatgtttaaaacttaggaaccaagacagtgacaa

SEQ ID NO: 101610 - DNA, 75 bp, Artificial Sequence
  Synthetic
tatccccaataaaggaggaatgggatagtgtctatccacgcgaagtacttaattacacgccacccagatctaccg

SEQ ID NO: 101611 - DNA, 75 bp, Artificial Sequence
  Synthetic
ttggtcttggtattggacaattgttcaaggttccaaaatgagtgatatatttgaagaggcggctagtttcagaag

SEQ ID NO: 101612 - DNA, 75 bp, Artificial Sequence
  Synthetic
aaccaagaagattggtggatgtatttgtcaatgatgagaatttcgatccttataatatgttagagtatgtcctta

SEQ ID NO: 101613 - DNA, 75 bp, Artificial Sequence
  Synthetic
ctatcaatcgaaactcggtcgagatgggcgggcaagcgcggcaacagctactttgactactaagataagaatttt

SEQ ID NO: 101614 - DNA, 75 bp, Artificial Sequence
  Synthetic
caggagattatttaactgatgaacaattcaatgtttcttacagtctaaaggagaaagaaactaaacaagcaggaa

SEQ ID NO: 101615 - DNA, 75 bp, Artificial Sequence
  Synthetic
ccaaaagctcaagtgaggttgtcattgacactactcccgaggacaatgattctatcaaccaggaggaagtagttg

SEQ ID NO: 101616 - DNA, 75 bp, Artificial Sequence
  Synthetic
tgtaccagcaactaatagcccagaactgagatgggagttgactttgttcgctctcgatgtaatcagatcaccaag

SEQ ID NO: 101617 - DNA, 75 bp, Artificial Sequence
  Synthetic
gattatttgctaaaatgacatataagatgcgtgcctgtcaggtaattgctgaagctttgattgcatcgggagtgg

SEQ ID NO: 101618 - DNA, 75 bp, Artificial Sequence
  Synthetic
gggacccgtctgatcagggtttagagcatcctttccctttggggaaattcccggagaaagaagaaactcctgatg

SEQ ID NO: 101619 - DNA, 75 bp, Artificial Sequence
  Synthetic
tgcagcagaatcaatgaagattggtgctgctttcactctgatatcaatgtactcagaaagacctggcgctttaat

SEQ ID NO: 101620 - DNA, 75 bp, Artificial Sequence
  Synthetic
gaagctttgattgcatcgggagtgggcaagtattttaaagagaacgggatggttaaagatgaacatgagctactc

SEQ ID NO: 101621 - DNA, 75 bp, Artificial Sequence
  Synthetic
cttcagtacctcgaggcaatagtcagggcagagattccgaattttccaataacacagagaaaagtcttatatcac

SEQ ID NO: 101622 - DNA, 75 bp, Artificial Sequence
  Synthetic
agctataactcctgtctcaacttccaacaatctatctcacagactcagagatagatctacacagttcaagttgcc

SEQ ID NO: 101623 - DNA, 75 bp, Artificial Sequence
  Synthetic
aatggaaaggagaggggacaaagcacaagaggagatggaaggtttgatgaggattctgaagactgcacgtgaaag

SEQ ID NO: 101624 - DNA, 75 bp, Artificial Sequence
  Synthetic
tcaagagaacaacaggtaggcttctgaataatgaagttccttgtcgaatgaacattatgtcagctttaattgaca

SEQ ID NO: 101625 - DNA, 75 bp, Artificial Sequence
  Synthetic
gagaacagaaacagatgattataacggaatatatcatctgcatgtcagagataattgttgtgtcaaggaggttgc

SEQ ID NO: 101626 - DNA, 75 bp, Artificial Sequence
  Synthetic
ggattctgaagactgcacgtgaaagcagcaagggaaagaccccgtttgtagatagcagagcctatggaatgagga

SEQ ID NO: 101627 - DNA, 75 bp, Artificial Sequence
  Synthetic
gaataatgaagttccttgtcgaatgaacattatgtcagctttaattgacaaaaatcagtcagaccaaaagaagca

SEQ ID NO: 101628 - DNA, 75 bp, Artificial Sequence
  Synthetic
tcacagatatgagcactcttgtgtcagccgtcattaccatcgaagcccaaatttggatcctgattgcaaaggcag

SEQ ID NO: 101629 - DNA, 75 bp, Artificial Sequence
  Synthetic
tttaacaatagttcagatcacccctcaaaatctgggctgtgccaagtcattttccccaccatacaatccacgcag

SEQ ID NO: 101630 - DNA, 75 bp, Artificial Sequence
  Synthetic
tgactgctccagatacagccgaggaaagtgagaccagaagatgggcaaagtatgttcaacaaaagagggtcaatc

SEQ ID NO: 101631 - DNA, 75 bp, Artificial Sequence
  Synthetic
tatgcactcaaatactaaaccacattcagacagagttagacattcaagcaatcaataactacattaactataaga

SEQ ID NO: 101632 - DNA, 75 bp, Artificial Sequence
  Synthetic
tcagacagagttagacattcaagcaatcaataactacattaactataagaatgatgaatcagccctacgccaaca

SEQ ID NO: 101633 - DNA, 75 bp, Artificial Sequence
  Synthetic
cattctttgccttaacccagcaatggctgacagagatgaggaatctcctctcacaaagtctctcagtcagaaaat

SEQ ID NO: 101634 - DNA, 75 bp, Artificial Sequence
  Synthetic
aacaaagtttgacacggtgagtgctttcctaactactgacttgaagaaattctgtctcaattggcgatatgaatc

SEQ ID NO: 101635 - DNA, 75 bp, Artificial Sequence
  Synthetic
tcatggtggaaattctgatggaggtaaagaaaggcggatcagctaaaggaagggccgttgagataatatctgaca

SEQ ID NO: 101636 - DNA, 75 bp, Artificial Sequence
  Synthetic
taggaaattatgtcgaggaaacaggaatggccggcttctttgcgactatcagattcggtcttgaaacaagatacc

SEQ ID NO: 101637 - DNA, 75 bp, Artificial Sequence
  Synthetic
agagaagtcagtaatttatgtcgcagatcctaattgcccaccagacatcggaaaacatataaaccttgatgatac

SEQ ID NO: 101638 - DNA, 75 bp, Artificial Sequence
  Synthetic
tcctgaagatgacatatttatccattcaccaaaaggcgggattgaaggttatagtcagaagacttggacgatcgc

SEQ ID NO: 101639 - DNA, 75 bp, Artificial Sequence
  Synthetic
tcaccaaaaggcgggattgaaggttatagtcagaagacttggacgatcgcaacgattccctttctgtttctcagt

SEQ ID NO: 101640 - DNA, 75 bp, Artificial Sequence
  Synthetic
ctgatgctgctctacagagaaatagggcctcgagcgccatacatggtactccttgaggaatctattcagacaaag

SEQ ID NO: 101641 - DNA, 75 bp, Artificial Sequence
  Synthetic
tttgcaccaggtggttatccactcctgtggagctttgctatgggtgttgcaaccactatcgaccgatctatgggt

SEQ ID NO: 101642 - DNA, 75 bp, Artificial Sequence
  Synthetic
caccctaatttaccatacaaagtcaagaaagaaatttgtgcaaggcaagctcaattatattttgacaggctcaga

SEQ ID NO: 101643 - DNA, 75 bp, Artificial Sequence
  Synthetic
gctctcaacatcaatcgtggttatcttgaacctatgtatttcagacttggacaaaaatcagcaagacatcatgct

SEQ ID NO: 101644 - DNA, 75 bp, Artificial Sequence
  Synthetic
agaaagaaatttgtgcaaggcaagctcaattatattttgacaggctcagaatgaatcttagggccttaggacata

SEQ ID NO: 101645 - DNA, 75 bp, Artificial Sequence
  Synthetic
ggcgggattgatcaaaacatggctaataaacttggattaaattctgatcaagttgcagaactggctgctgcagtt

SEQ ID NO: 101646 - DNA, 75 bp, Artificial Sequence
  Synthetic
acttaaaagcaacagagaccattataagtacacacttatttgtctactctaagaaaatacattatgatggtgcag

SEQ ID NO: 101647 - DNA, 75 bp, Artificial Sequence
  Synthetic
caagaaacatcagttgggagacaggacaacaacatgcaggcaagagaagccaaatttgcagctgggggagttctt

SEQ ID NO: 101648 - DNA, 75 bp, Artificial Sequence
  Synthetic
tattatcacaagccctcaaatcaatgtctaggtgttgtttttggtcagaaacattggtggacgagacaagatctg

SEQ ID NO: 101649 - DNA, 75 bp, Artificial Sequence
  Synthetic
acattggtggacgagacaagatctgcttgcagcaatattagtactaccatagctaaggcgattgagaatggattg

SEQ ID NO: 101650 - DNA, 75 bp, Artificial Sequence
  Synthetic
gtggggggtggcgaacaagatattgatgaggaagaagagcctatcgaacatagtggtaggcagtcagtgactttc

SEQ ID NO: 101651 - DNA, 75 bp, Artificial Sequence
  Synthetic
aagagagaaatgagcatgtcatctctcgcagacagtgtcccaagcagttcagtgagtacatccggaggaacgaga

SEQ ID NO: 101652 - DNA, 75 bp, Artificial Sequence
  Synthetic
gcttatttctactgagtttagcatcaacgagacattgactgctgatgtaacatctccaatatccaataatctcga

SEQ ID NO: 101653 - DNA, 75 bp, Artificial Sequence
  Synthetic
tctcaactatcaagtgaatacaggatctaaaactagtatgatggctgattccaaattggtaagcctgaacaataa

SEQ ID NO: 101654 - DNA, 75 bp, Artificial Sequence
  Synthetic
ttgacaaattctctattgaatctcagatccagattggctgcaaaggctatcaaagagagtactgcacagagctca

SEQ ID NO: 101655 - DNA, 75 bp, Artificial Sequence
  Synthetic
ttggctggtaactgcatccctaattcccgcaccaattggaggtttcaattacttgaatttatcaagaatatttgt

SEQ ID NO: 101656 - DNA, 75 bp, Artificial Sequence
  Synthetic
tcgggaagaaacccacctaataaccgccctcaggcagactcaggagggaaagatgaccaggaatccaaacctgcc

SEQ ID NO: 101657 - DNA, 75 bp, Artificial Sequence
  Synthetic
aagaaatataggagaccctgtgactgcatcactagccgatctaaagagaatgatagaacatgacttgatgacaga

SEQ ID NO: 101658 - DNA, 75 bp, Artificial Sequence
  Synthetic
caaaatgatttggattttgttagagcagacgtgtgacgcttaatcagaaactcatataagctccaaatcattctc

SEQ ID NO: 101659 - DNA, 75 bp, Artificial Sequence
  Synthetic
taaagttctccaaaaagtgatgaatcaagaaccaggcgatgcaagcttcctagattgggctagtgatccgtattc

SEQ ID NO: 101660 - DNA, 75 bp, Artificial Sequence
  Synthetic
tatgacacactcttataaataaatttaagagagtggattgagattgagttatggacttgtgtcataatatacctt

SEQ ID NO: 101661 - DNA, 75 bp, Artificial Sequence
  Synthetic
aggaaatctaccggattcacagagtattacaaaaacgatcaagaatataacggctaggactatattgaggacatc

SEQ ID NO: 101662 - DNA, 75 bp, Artificial Sequence
  Synthetic
gtacagcaaagcagaaaactgtaggctttcaatgggtgtcaactccaaaagtcattatattttgagatcaggact

SEQ ID NO: 101663 - DNA, 75 bp, Artificial Sequence
  Synthetic
tgtcttttaataaattacttataccacccacatatgatgaatatgagttcgcagtagtttgtcttgtaatttaaa

SEQ ID NO: 101664 - DNA, 75 bp, Artificial Sequence
  Synthetic
accgaatccaatgctgaagggtctattccatgataaatcattcgaggaagatctggagcttgctactttcctaat

SEQ ID NO: 101665 - DNA, 75 bp, Artificial Sequence
  Synthetic
ggagacatcatactccaatttatcgagattgctgacaatagattgaccatcggttctcctagtaagatatacaat

SEQ ID NO: 101666 - DNA, 75 bp, Artificial Sequence
  Synthetic
ctttcaatgggtgtcaactccaaaagtcattatattttgagatcaggactattgaagtataatctgtctcttgga

SEQ ID NO: 101667 - DNA, 75 bp, Artificial Sequence
  Synthetic
tcactctaaagccatgcttgaacctcaactttgggtagtcacactgcaataaatacatttagatatcctcagagt

SEQ ID NO: 101668 - DNA, 75 bp, Artificial Sequence
  Synthetic
gccgcacatgaaattttagataattctttgacaggtgctagagaggaaattgctggattacttgacacaacaaag

SEQ ID NO: 101669 - DNA, 75 bp, Artificial Sequence
  Synthetic
taactctgtaagtttatcagataatcctattaatgacatactgagggttattcttgtataattcttctaaggata

SEQ ID NO: 101670 - DNA, 75 bp, Artificial Sequence
  Synthetic
gaggaaattcaacaactacatgtacatgatttgctatggcttcgtcgaagacgttgagagatcaccggagtctgg

SEQ ID NO: 101671 - DNA, 75 bp, Artificial Sequence
  Synthetic
gggctaataagatcaggattgaaaaagagcgggatacaacctaagttggtgtctagactgtctaaccatgattat

SEQ ID NO: 101672 - DNA, 75 bp, Artificial Sequence
  Synthetic
agagcgggatacaacctaagttggtgtctagactgtctaaccatgattataatcagttcctgatactcaatagac

SEQ ID NO: 101673 - DNA, 75 bp, Artificial Sequence
  Synthetic
caactttgggtagtcacactgcaataaatacatttagatatcctcagagtatttgactcactaaatctcagtagt

SEQ ID NO: 101674 - DNA, 75 bp, Artificial Sequence
  Synthetic
gaaaatataatgaactttacctcatacataactaaatgatcaaagtttgtactgaatacatctattaaagtttat

SEQ ID NO: 101675 - DNA, 75 bp, Artificial Sequence
  Synthetic
ttttgtccaataaaaagagaaacgatcttatatcccctaaaacatgttcagtggatttggccaaggctcttcgtt

SEQ ID NO: 101676 - DNA, 75 bp, Artificial Sequence
  Synthetic
gaaggccggatgatgatcgagacttcgataaaatctgatatcaaataccaacctttaattaccagatctaatgct

SEQ ID NO: 101677 - DNA, 75 bp, Artificial Sequence
  Synthetic
agacaacttgatcattatattaagaaaaacttaggatccaagaccataaatctaggatcttttacaatctcagac

SEQ ID NO: 101678 - DNA, 75 bp, Artificial Sequence
  Synthetic
ctggaagatatattacagggagtatggaatgccaactttgtgatcaagggaatactatgtatggttggtttttcg

SEQ ID NO: 101679 - DNA, 75 bp, Artificial Sequence
  Synthetic
tgacaagtcataccccaaacaatccaagtctagaatcacctgttcgctcggtattaatatcttggcaaacaccac

SEQ ID NO: 101680 - DNA, 75 bp, Artificial Sequence
  Synthetic
tgccacgagattcacaattagatcaagtgaataaagagcactcatccattagagtaccttacgtcggctcaagca

SEQ ID NO: 101681 - DNA, 75 bp, Artificial Sequence
  Synthetic
tcaggttgacaaatggacaagttggatctagtcaatgatggcctcgatattattgactttattcagaagaaccaa

SEQ ID NO: 101682 - DNA, 75 bp, Artificial Sequence
  Synthetic
ctgatgagaggtcagatatcaaactaggaaacgtcaagagaccgacaagagcactgagatctgccatccgaattg

SEQ ID NO: 101683 - DNA, 75 bp, Artificial Sequence
  Synthetic
aaagaaatacaaaagacatacggacgatcaagcatccaacaaccaagtaccaaagacaggacaagagcatgggag

SEQ ID NO: 101684 - DNA, 75 bp, Artificial Sequence
  Synthetic
gaataatgaagttccttgtcgaatgaacattatgtcagctttaattgacaaaaatcaatcagaccaaaagaggca

SEQ ID NO: 101685 - DNA, 75 bp, Artificial Sequence
  Synthetic
caactgtttatacctgggcatacggagattctgaagaaagttggtatgaggcttggtacttggcttcccagaggg

SEQ ID NO: 101686 - DNA, 75 bp, Artificial Sequence
  Synthetic
gacttcttgcagagcaccagtggagaacatgaacaggctgaggggggaatgcctaagaatgatggaggtactgaa

SEQ ID NO: 101687 - DNA, 75 bp, Artificial Sequence
  Synthetic
tcaacattgatatagatgtgttaaaagctataactcctgtctcaacttccaacaatctatctcacagactcagag

SEQ ID NO: 101688 - DNA, 75 bp, Artificial Sequence
  Synthetic
ggaagaaatgtggaggatctatccagtgttacttcctcagatggaactattggacaaagagtgtcaaacacccga

SEQ ID NO: 101689 - DNA, 75 bp, Artificial Sequence
  Synthetic
agctataactcctgtctcaacttccaacaatctatctcacagactcagagatagatctacacagttcaagtttgc

SEQ ID NO: 101690 - DNA, 75 bp, Artificial Sequence
  Synthetic
gcttgggcagaagatccagatgacatacaactggacccaatggttacagacgttgtataccatgatcatggagga

SEQ ID NO: 101691 - DNA, 75 bp, Artificial Sequence
  Synthetic
aggtagtgtccttaatagggtttctagatatgtcaacataagtaatgataatttagacttcagagtggaaggtga

SEQ ID NO: 101692 - DNA, 75 bp, Artificial Sequence
  Synthetic
gaatgtaccggacatggaccttcttcaagccctgagagagggtggagttatcacatgtcaggaacacacgatggg

SEQ ID NO: 101693 - DNA, 75 bp, Artificial Sequence
  Synthetic
aaaggtcgacaccaatctaatataccaacaaacaatgctactcggcttgtcagtattggaaggtaaatttcggtt

SEQ ID NO: 101694 - DNA, 75 bp, Artificial Sequence
  Synthetic
aatgtacgtgctgtacctgatacaaaggtgttgcccaatgctcccaaaactacagttcctgaagaagttggggaa

SEQ ID NO: 101695 - DNA, 75 bp, Artificial Sequence
  Synthetic
attgatttaattgggttggaggacaaatttgcatcagcaggattaaatccagctgcagttccctttgtccccaag

SEQ ID NO: 101696 - DNA, 75 bp, Artificial Sequence
  Synthetic
tgatattggtggtgttaatgctgagctacctgtcccagaatacactgaagtagaaaataataggctcatatatga

SEQ ID NO: 101697 - DNA, 75 bp, Artificial Sequence
  Synthetic
tcatatccaatacatcgaaacatacatacaaagtcttgtctaatgcactgtcacatcccagagtgttcaagagat

SEQ ID NO: 101698 - DNA, 75 bp, Artificial Sequence
  Synthetic
aatcaatcaaccccaactgaggagcctccagtcatcccggagtattactatggatctgggaggagaggagatctc

SEQ ID NO: 101699 - DNA, 75 bp, Artificial Sequence
  Synthetic
cccagaccctgtttctgaaattgattgtgatcgcttatcaaagcaagagtctaaggcgagagaattagactttcc

SEQ ID NO: 101700 - DNA, 75 bp, Artificial Sequence
  Synthetic
acgcaaatcaccataagccaccttggataattgatctcaacccacaagagaagatatgtgttcttagggacttta

SEQ ID NO: 101701 - DNA, 75 bp, Artificial Sequence
  Synthetic
tcgaaatctcctcctagaggtaatgtcaatctggacagcatcaagatttacacttcggacgacgaggatgaaaat

SEQ ID NO: 101702 - DNA, 75 bp, Artificial Sequence
  Synthetic
tctttggtccaccgaagaactccatgatgtgttagctaagactgtggctcaaacagttctcgagatcataactaa

SEQ ID NO: 101703 - DNA, 75 bp, Artificial Sequence
  Synthetic
cagctggagtatgaggatgagtttgccaaaagctcaagtgaggttgtcattgacactactcccgaggacaatgat

SEQ ID NO: 101704 - DNA, 75 bp, Artificial Sequence
  Synthetic
agccgataaagatgtcctcaagcaacacttagctatagactcagatgacagtatcaatagtcttataacagagtt

SEQ ID NO: 101705 - DNA, 75 bp, Artificial Sequence
  Synthetic
ccaaaagctcaagtgaggttgtcattgacactactcccgaggacaatgattctatcaaccaggagggagcagttg

SEQ ID NO: 101706 - DNA, 75 bp, Artificial Sequence
  Synthetic
tttaatggtggatcctgagctttttgccctttatttaggtcaatcaatttcagtcaagtgggcatttgaaatcca

SEQ ID NO: 101707 - DNA, 75 bp, Artificial Sequence
  Synthetic
gcatcctttccctttggggaaattcccggagaaagaagaaactcctgatgtacgcagaaaggattccctaatgca

SEQ ID NO: 101708 - DNA, 75 bp, Artificial Sequence
  Synthetic
tcatagacgcccacatggacgacatacaatggtagatttgttgtctgatctcatatccaatacatcgaaacatac

SEQ ID NO: 101709 - DNA, 75 bp, Artificial Sequence
  Synthetic
aaagctcggaactttataacatcaaaaattacataaggagaaaagttttgattctggacttcagatctcatacta

SEQ ID NO: 101710 - DNA, 75 bp, Artificial Sequence
  Synthetic
ggacagttgtaagagaggaggagtaccgaaaagactgcccatgttatctgaagagttcgagtgctccggatcgga

SEQ ID NO: 101711 - DNA, 75 bp, Artificial Sequence
  Synthetic
tgatccaataatacaagaattagaacgagaagggtctcatccaggaggttcattacgtttgagggaaccacctca

SEQ ID NO: 101712 - DNA, 75 bp, Artificial Sequence
  Synthetic
ttgtgaattgcggcttgcttcttcccactcagggtccttatcttcaccaacaagattttgagaaattatctcaga

SEQ ID NO: 101713 - DNA, 75 bp, Artificial Sequence
  Synthetic
gtggaagatcataggttacctctctttaatctgaatcggactaccacacccatcaccagtaaagcccgaacaagt

SEQ ID NO: 101714 - DNA, 75 bp, Artificial Sequence
  Synthetic
gtcgtcagggaattccagaaatcaacctgaccgtcagctgaagacaggtgatgcagcatcacccggaggcgtcca

SEQ ID NO: 101715 - DNA, 75 bp, Artificial Sequence
  Synthetic
accttttaatcacatcttatatgaattatcttatgaattggtgtgacttcaaaaaattcccttttttgatagctg

SEQ ID NO: 101716 - DNA, 75 bp, Artificial Sequence
  Synthetic
gagaccaggcacaccgatgcctaaatcaaggatcatgcccattaaaaagggcacagacgcgaagtctcaatatgt

SEQ ID NO: 101717 - DNA, 75 bp, Artificial Sequence
  Synthetic
aacaagatgaagcagtcgtagaattaagggaagatataataacatcaaaacacctgtgtatgataattgatctgt

SEQ ID NO: 101718 - DNA, 75 bp, Artificial Sequence
  Synthetic
tgggacggaagacgtgcctgggtcgaagagtggtgcaacccggcatgttcgcggattaccccccaaccaagaaag

SEQ ID NO: 101719 - DNA, 75 bp, Artificial Sequence
  Synthetic
caagagtgttactgcggagaatgtccaactgagtgctcccagtgctgtcacgaggaatgaaggacacgaccagga

SEQ ID NO: 101720 - DNA, 75 bp, Artificial Sequence
  Synthetic
tatctaagtgccgtcatactgatgtgtcatctaggtcttggaatatcactgatctggattttatggttttttatg

SEQ ID NO: 101721 - DNA, 75 bp, Artificial Sequence
  Synthetic
gatctggattttatggttttttatgcttcgttgacttatctaagaagaggaataatcaagcagctcagaattagg

SEQ ID NO: 101722 - DNA, 75 bp, Artificial Sequence
  Synthetic
agttaccagcaacgaagatagtctggatgacaaatatattatgccatcagatgattttgctaacactttcttacc

SEQ ID NO: 101723 - DNA, 75 bp, Artificial Sequence
  Synthetic
aagatatgtgttcttagggactttatatctaagtgccgtcatactgatgtgtcatctagatcctggaatatcact

SEQ ID NO: 101724 - DNA, 75 bp, Artificial Sequence
  Synthetic
caagtgacagaagtaatcgacaccactacaatgctaagagataatattttagtagaaaacccgcctattaaaact

SEQ ID NO: 101725 - DNA, 75 bp, Artificial Sequence
  Synthetic
ccatgacactgataggttaaattatcatgcagaccatctcaatgattacgatttagagaccttgtgtgaggagtc

SEQ ID NO: 101726 - DNA, 75 bp, Artificial Sequence
  Synthetic
tcgggaagaaacccacctaataaccgccctcaggcagactcaggagagaaagatgatcaggaatccaaacctgcc

SEQ ID NO: 101727 - DNA, 75 bp, Artificial Sequence
  Synthetic
ggagtactagatattagaggttgcataatatataatctagaagaaatcttatcaatgaataccaagtccacgtca

SEQ ID NO: 101728 - DNA, 75 bp, Artificial Sequence
  Synthetic
agtattgatgggcatcgttaacgcaatcaaactcatcaacattgatatgaggttgaatcacattgaggaacagat

SEQ ID NO: 101729 - DNA, 75 bp, Artificial Sequence
  Synthetic
aggaaggtgttcaatttgggttcaaagttgtcagttgaaaaccacaaatatagaaggataggattaaattcgtct

SEQ ID NO: 101730 - DNA, 75 bp, Artificial Sequence
  Synthetic
gaaagagatacccaagatcatcaacaaaatagactccattgatcgagtgttggctaagaccaatactgcattgtc

SEQ ID NO: 101731 - DNA, 75 bp, Artificial Sequence
  Synthetic
tcttgctacaaggcgttaaatctgtcaccgttgattcaacgctacctgcccgcaggttcacaacgattatttgta

SEQ ID NO: 101732 - DNA, 75 bp, Artificial Sequence
  Synthetic
gacaatagaaggacacctagtctcgatgatgatcatgataccagggaaaggcaagggtgaaaggaaagggaaaac

SEQ ID NO: 101733 - DNA, 75 bp, Artificial Sequence
  Synthetic
ggtgaagggtcaggaagtatgatgctattatatcaacagactttaggatgttcgatatccttttacaactccggt

SEQ ID NO: 101734 - DNA, 75 bp, Artificial Sequence
  Synthetic
aaatccggagctaaaacctgtaattgggagaaatatcctagaacagcaagagttattttcattcgacaatctcaa

SEQ ID NO: 101735 - DNA, 75 bp, Artificial Sequence
  Synthetic
gaacatataatgaactttacctcatacataactaaatgatcaaagtttgtactgaatatatctattaaagtttat

SEQ ID NO: 101736 - DNA, 75 bp, Artificial Sequence
  Synthetic
attgatggtgattatataccagggcagagagaattgagattattcccttccgaatattcaatagctgaagacgat

SEQ ID NO: 101737 - DNA, 75 bp, Artificial Sequence
  Synthetic
gaatttcagagatgggtcattgactgatgagccctatggaggggtggcccgaataagagatgatttgattctgcc

SEQ ID NO: 101738 - DNA, 75 bp, Artificial Sequence
  Synthetic
ccgtcacaatctgataagctaaaaggtctagtggtcccattatttaacggaaggcccgaaaccacgtggataggg

SEQ ID NO: 101739 - DNA, 75 bp, Artificial Sequence
  Synthetic
gcatcacaatttgttcctttggcagatgatgcatctaaggatgttgtgagaactatgattaggactcacatcaag

SEQ ID NO: 101740 - DNA, 75 bp, Artificial Sequence
  Synthetic
aacttagattcatacgagtacataatcaacagaacagccggtcgtaacatcggattggtacactcagatatggaa

SEQ ID NO: 101741 - DNA, 75 bp, Artificial Sequence
  Synthetic
tctaggatcttttacaatctcagactctagtgcaaggtcatatacagagcccaattctcctaattaaacagtgtc

SEQ ID NO: 101742 - DNA, 75 bp, Artificial Sequence
  Synthetic
gatagagagttgaggtctgagttgatggattatctaaatcgagcagaaacagatgaagaggttcaggaggtggcc

SEQ ID NO: 101743 - DNA, 75 bp, Artificial Sequence
  Synthetic
tcaggcatagacaaacaagtggaagaaattatgatagagcattcacatcttatctcaatagcaatcaatgtaatg

SEQ ID NO: 101744 - DNA, 75 bp, Artificial Sequence
  Synthetic
agatgaagaggttcaggaggtggccaatacagtcaatgatattattgatgggaacatctaaacatgtcagtaatt

SEQ ID NO: 101745 - DNA, 75 bp, Artificial Sequence
  Synthetic
aatacagtcaatgatattattgatgggaacatctaaacatgtcagtaatttgatagagtagcagtcagaccaaga

SEQ ID NO: 101746 - DNA, 75 bp, Artificial Sequence
  Synthetic
atagaagacggtgttcttgtatctaaaatagcatttgcaccagggttccccatatccagactactgaatatgtat

SEQ ID NO: 101747 - DNA, 75 bp, Artificial Sequence
  Synthetic
ggaacatctaaacatgtcagtaatttgatagagtagcagtcagaccaagatcatgtattagaggtacacatcata

SEQ ID NO: 101748 - DNA, 75 bp, Artificial Sequence
  Synthetic
cgttcctattttgggttagtattggtgtgtttcccagtgtatagtaatccagagtccacagaagtgtatctcatc

SEQ ID NO: 101749 - DNA, 75 bp, Artificial Sequence
  Synthetic
ttcataaaccatcagtgtttcccttataaactccattatgtagtttattaatatctagagctattctttattaag

SEQ ID NO: 101750 - DNA, 75 bp, Artificial Sequence
  Synthetic
gcatccattccctttggggaaattcccggagaaagaagaaactcctgatgtacgtagaaaggattccctaatgca

SEQ ID NO: 101751 - DNA, 75 bp, Artificial Sequence
  Synthetic
tgcttgcagaaaacaattaagaccataattccacctcaaaaagttcttgatcattcatatctcagtgatgaaatc

SEQ ID NO: 101752 - DNA, 75 bp, Artificial Sequence
  Synthetic
taataaatctgtattagattattatataatctctataatcaacacgcctattacttcatgcacttattatcacca

SEQ ID NO: 101753 - DNA, 75 bp, Artificial Sequence
  Synthetic
aatgatcaaggtattacatctgttattttcaagatcaaaaacattcaatcaaaacaattccatgaagatctagtg

SEQ ID NO: 101754 - DNA, 75 bp, Artificial Sequence
  Synthetic
tttaacaatagttcagatcacccctcaaaatctgggttgtgccaagtcattttcctcaccatataatccacgcag

SEQ ID NO: 101755 - DNA, 75 bp, Artificial Sequence
  Synthetic
ttttcaagatcaaaaacattcaatcaaaacaattccatgaagatctagtgaaacactatcaagtcgaacaaccgt

SEQ ID NO: 101756 - DNA, 75 bp, Artificial Sequence
  Synthetic
caaaatctgggttgtgccaagtcattttcctcaccatataatccacgcagtatgcattcaaatactaaaccacat

SEQ ID NO: 101757 - DNA, 75 bp, Artificial Sequence
  Synthetic
tttttgttcctagtcatatcacatgtgatgaaaagttgcttatgcaggctggtttgaaaatgaacggaccagaaa

SEQ ID NO: 101758 - DNA, 75 bp, Artificial Sequence
  Synthetic
tcagacagagttagacattcaagcaatcaataactatattaactataagaatgatgaatcagccctgcgccaaca

SEQ ID NO: 101759 - DNA, 75 bp, Artificial Sequence
  Synthetic
agagcacttctcaccctcaggatcttttagaagagctatgttctttgaaagtcacagtcagaagaacagctgggg

SEQ ID NO: 101760 - DNA, 75 bp, Artificial Sequence
  Synthetic
tcttgaagaatgaagtgggatatgatataggatcagatatcaatacactcaggagcactattattatcttactta

SEQ ID NO: 101761 - DNA, 75 bp, Artificial Sequence
  Synthetic
aggcaatgtcaatcacttgaatgcaggggtagaccccagaatccattaagaaaaacttaggagacaggtataata

SEQ ID NO: 101762 - DNA, 75 bp, Artificial Sequence
  Synthetic
ggggtagaccccagaatccattaagaaaaacttaggagacaggtataatattctcatacctgtccattcatcttg

SEQ ID NO: 101763 - DNA, 75 bp, Artificial Sequence
  Synthetic
atgaagctatgaactattttgacgatgagagaagtccttctcatcatctagagccctttccagtcctagagaaaa

SEQ ID NO: 101764 - DNA, 75 bp, Artificial Sequence
  Synthetic
ggaacatctaaacatatcagtaatttgatagagtagcagtcagaacaagatcatgtattagaggcacacatcaca

SEQ ID NO: 101765 - DNA, 75 bp, Artificial Sequence
  Synthetic
gacctaaagagagacaatcattcagccccgtccaagacacacctgagtggccagaaccatggattttagtgtgag

SEQ ID NO: 101766 - DNA, 75 bp, Artificial Sequence
  Synthetic
cgagagtcaaaactatcatggggagagtcacgagaaaagtaactgtttattctcttataaagttgaaggaaacta

SEQ ID NO: 101767 - DNA, 75 bp, Artificial Sequence
  Synthetic
tgataaccttgatgatccaatagaaggtgtttcagattttagtcccacctcatgggagaatggagggtatctaga

SEQ ID NO: 101768 - DNA, 75 bp, Artificial Sequence
  Synthetic
taaagtggagccagaaattgataagcatggcagtatgatacctaagtacaagatctatacccccggtgcaaatga

SEQ ID NO: 101769 - DNA, 75 bp, Artificial Sequence
  Synthetic
tgattaaactgctacctaaaggaatgaaagagagaagagagaaaagcggattcaaagaaatttggatatttgact

SEQ ID NO: 101770 - DNA, 75 bp, Artificial Sequence
  Synthetic
gaaagagagaagagagaaaagcggattcaaagaaatttggatatttgacttatctaatagagaagtcaaaatctg

SEQ ID NO: 101771 - DNA, 75 bp, Artificial Sequence
  Synthetic
gaggaaattcaacaactacatgtacatgatttgctatggcttcgtcgaagacgttgagagatcaccagaatctgg

SEQ ID NO: 101772 - DNA, 75 bp, Artificial Sequence
  Synthetic
actaatctcatctgtactgtctgaaagtggtcaggattgattgacagttattatttatctttaagcaatggctac

SEQ ID NO: 101773 - DNA, 75 bp, Artificial Sequence
  Synthetic
gaagcgcaagaaaatcaggaccattgccgcgtaccctcttggtgttggcaagagcacttctcaccctcaggatct

SEQ ID NO: 101774 - DNA, 75 bp, Artificial Sequence
  Synthetic
tgaagcccgaacaagtctacatagatcagttattaagaaaaacttaataacgatctctctttacccttgttcggt

SEQ ID NO: 101775 - DNA, 75 bp, Artificial Sequence
  Synthetic
caggagcctccttaacgacccagacatagaagctgtcatcatagatgtgggttccatgctcaacgggatccccgt

SEQ ID NO: 101776 - DNA, 75 bp, Artificial Sequence
  Synthetic
ctacagagaaaattgtgttcgggtcctctggcccgcttcatcatctcttaccatggaagaagattctgactggcg

SEQ ID NO: 101777 - DNA, 75 bp, Artificial Sequence
  Synthetic
gatcaatattcaatgctgtcaaggtttgccgcaatgtggatcagattcaactggagaaacaacaatcattgagga

SEQ ID NO: 101778 - DNA, 75 bp, Artificial Sequence
  Synthetic
tttttttcttgagtattactaaattgaatgactccggcatctacatgatcccaaggacaatgctagaattcagaa

SEQ ID NO: 101779 - DNA, 75 bp, Artificial Sequence
  Synthetic
tatttgaatcaatcgacattggattctctattcttatgtaatcccagatggatcaaggctagtcatatcttaaat

SEQ ID NO: 101780 - DNA, 75 bp, Artificial Sequence
  Synthetic
ggaacaacgctattgccttcaatcttctagtatacctcaaaatcgatgcagatcttgcaaaagctggaatccaag

SEQ ID NO: 101781 - DNA, 75 bp, Artificial Sequence
  Synthetic
agattcggtcttgaaacaagataccctgcacttgccctcaatgagttccagagtgatctcaataccatcaaaggg

SEQ ID NO: 101782 - DNA, 75 bp, Artificial Sequence
  Synthetic
gaagcttcgacaaagacggaaccaaagtggcatctttcatgctccatctcgggaattttgtccgacgagctggga

SEQ ID NO: 101783 - DNA, 75 bp, Artificial Sequence
  Synthetic
tcactctaaagccatgcttgaacctcaactttggatagtcacactgcaatgaatacatttagatatcctcagagt

SEQ ID NO: 101784 - DNA, 75 bp, Artificial Sequence
  Synthetic
caactttggatagtcacactgcaatgaatacatttagatatcctcagagtatttgactcactaaatctcagtagt

SEQ ID NO: 101785 - DNA, 75 bp, Artificial Sequence
  Synthetic
agtactattctgtcgaatactgcaagagaaagattgacagaatgaagctccagttctctcttggttcaattgggg

SEQ ID NO: 101786 - DNA, 75 bp, Artificial Sequence
  Synthetic
agtaagtctcactggtgataggatacaagtgcaagttccttttcaaatggtgctcaaatctaaggatcctcttgc

SEQ ID NO: 101787 - DNA, 75 bp, Artificial Sequence
  Synthetic
gtctaagcttacacatcaaaattaatggagtgatcagtaagagattatttgcccagatgggtttccagaagaacc

SEQ ID NO: 101788 - DNA, 75 bp, Artificial Sequence
  Synthetic
tgaataagctatctactatgcactggaaaatataatgaactttacctcatacataactaaatgatcaaagtttgt

SEQ ID NO: 101789 - DNA, 75 bp, Artificial Sequence
  Synthetic
aacaggctaggggcaacacctagaagtaatgtaagtctgttattttagataacagtatatgagtggcatgggtct

SEQ ID NO: 101790 - DNA, 75 bp, Artificial Sequence
  Synthetic
tttgcttttctctaatggacatcaatccttggctcaacagactgacttggaacaacagttgtgagatcagcaggg

SEQ ID NO: 101791 - DNA, 75 bp, Artificial Sequence
  Synthetic
tctaggatcttttacaatctcagactttagtgcaaggtcatatacagagcccaattctcctaattaagcagtgtc

SEQ ID NO: 101792 - DNA, 75 bp, Artificial Sequence
  Synthetic
tggcagctgtactgcagccctcggtgccacgtgaattcatgatctatgacgatgtgttcattgacaacacaggga

SEQ ID NO: 101793 - DNA, 75 bp, Artificial Sequence
  Synthetic
tggctcatgaattatctatctctgatatcatctatcctgaatgtcaccttgacagtcctatagtatcagggaaat

SEQ ID NO: 101794 - DNA, 75 bp, Artificial Sequence
  Synthetic
agatcctaaaggggtgaaataaaacattcacttggttattgtagattgataaattaaccagataaccactttaat

SEQ ID NO: 101795 - DNA, 75 bp, Artificial Sequence
  Synthetic
cttcattctaaagaatgccacagtgtcagcaagttacacaggtacaatacataatccaaattcatgtcttccctt

SEQ ID NO: 101796 - DNA, 75 bp, Artificial Sequence
  Synthetic
caaaggattgatttggacctttaaaatagtagaggtaagaattgagtatatccaatattaagaaaaacttaggag

SEQ ID NO: 101797 - DNA, 75 bp, Artificial Sequence
  Synthetic
tccaatattaagaaaaacttaggagccaagttttggtctctttagattaatcaagctgtttgtcaatccgtattc

SEQ ID NO: 101798 - DNA, 75 bp, Artificial Sequence
  Synthetic
ccaagttttggtctctttagattaatcaagctgtttgtcaatccgtattcgtaaggttgttaaaataatctgtga

SEQ ID NO: 101799 - DNA, 75 bp, Artificial Sequence
  Synthetic
ctatcctttagatatccacttgggttgtagatatattcaatcaactgacctgacaagtcataccccaaacaatcc

SEQ ID NO: 101800 - DNA, 75 bp, Artificial Sequence
  Synthetic
tgacaagtcataccccaaacaatccaagtctggaatcacctgttcgctcagtattaatatcttggcaaacactac

SEQ ID NO: 101801 - DNA, 75 bp, Artificial Sequence
  Synthetic
cgccacaagtgtgataacactagcaaaacattccttgactatcatatggagtttagtccctacaagtcagacaga

SEQ ID NO: 101802 - DNA, 75 bp, Artificial Sequence
  Synthetic
acaagaggtcaggctaaagtgtttgctctgtgggatcatagttctggttttgtcattagaagggctaggaatact

SEQ ID NO: 101803 - DNA, 75 bp, Artificial Sequence
  Synthetic
acattatgagaaacttagtaagatagggctggttaaaggtattacaagaaagtacaagattaagagtaacccttt

SEQ ID NO: 101804 - DNA, 75 bp, Artificial Sequence
  Synthetic
gaccaaggatattgtgatcaaaatgatccctaatgtttcgaatgtctcaaagtgcaccgggactgttatggagaa

SEQ ID NO: 101805 - DNA, 75 bp, Artificial Sequence
  Synthetic
ttacaaaagcagactcacagggattctctcaccaatcaaaggcgccatcgaactgtacaataataacacgcatga

SEQ ID NO: 101806 - DNA, 75 bp, Artificial Sequence
  Synthetic
taataaatctgtattagattattatataatctctataatcaacacgcctgtcacttcatgcacttattatcacca

SEQ ID NO: 101807 - DNA, 75 bp, Artificial Sequence
  Synthetic
cctagttggtgatgtcaagcttgcaggtgtggtgatggcagggattgcaatcgggatagctactgctgcacaaat

SEQ ID NO: 101808 - DNA, 75 bp, Artificial Sequence
  Synthetic
cacagcaggtgttgccttatatgaggcaatgaagaacgcagacaatatcaataaactcaagagcagcatagagtc

SEQ ID NO: 101809 - DNA, 75 bp, Artificial Sequence
  Synthetic
tacaaatgaggctgttgtcaaattacaggaaacagctgagaaaacagtctacgtccttactgctcttcaagatta

SEQ ID NO: 101810 - DNA, 75 bp, Artificial Sequence
  Synthetic
catcaacactaaccttgttcctacaatagatcaaattagctgcaagcaaacagaactcgcattagacttggcgtt

SEQ ID NO: 101811 - DNA, 75 bp, Artificial Sequence
  Synthetic
gtctaagtatctgtctgatctgctctttgttttcggacctaacttacaggatccagtctctaattccatgactat

SEQ ID NO: 101812 - DNA, 75 bp, Artificial Sequence
  Synthetic
ccaagcaatatctcaagcatttgggggcaattacgaaaccttactgagaacgcttggttacgcgaccgaggactt

SEQ ID NO: 101813 - DNA, 75 bp, Artificial Sequence
  Synthetic
cttcattctaaagaatgccacagtgtcagtaagttacacaggtacaatacataatctaaattcatgtcttccctt

SEQ ID NO: 101814 - DNA, 75 bp, Artificial Sequence
  Synthetic
cgacgaccttttagaaagtgatagcataacaggccagatagtctatgtagatctcagtagctattacataatagt

SEQ ID NO: 101815 - DNA, 75 bp, Artificial Sequence
  Synthetic
gtaaggttgttaaaataatctgtgactatcctttagatatccacttgggttgtagatatattcaatcaactgatc

SEQ ID NO: 101816 - DNA, 75 bp, Artificial Sequence
  Synthetic
aagggtgtattttcctatactaacagagatccaacaggcttatgtgcaggagttgcttccagtgagttttaataa

SEQ ID NO: 101817 - DNA, 75 bp, Artificial Sequence
  Synthetic
cgataattcagaatggatcagcattgtcccgaatttcgtgctgattaggaacacgctgatttcaaatatagaagt

SEQ ID NO: 101818 - DNA, 75 bp, Artificial Sequence
  Synthetic
actaacctcgtctgtactgtctgaaagtggtcaggattgattgacagttattatttatctttaagcaatggctac

SEQ ID NO: 101819 - DNA, 75 bp, Artificial Sequence
  Synthetic
gtcccgaatttcgtgctgattaggaacacgctgatttcaaatatagaagttaagtactgcttaatcaccaagaaa

SEQ ID NO: 101820 - DNA, 75 bp, Artificial Sequence
  Synthetic
acaagaggtcaggctaaagtgtttgctctgtgggatcatagttctggttttgtcattagaagggctagggatact

SEQ ID NO: 101821 - DNA, 75 bp, Artificial Sequence
  Synthetic
agtgtgatttgtaatcaagactatgctacacccatgacggctagcgtgagagaatgcttgacaggatccacagat

SEQ ID NO: 101822 - DNA, 75 bp, Artificial Sequence
  Synthetic
aagtgcccaagggagttagtagtctcatcccatgttccaagatttgccctctcaggaggagtcttgtttgcaaat

SEQ ID NO: 101823 - DNA, 75 bp, Artificial Sequence
  Synthetic
gaccaaggatattgtaatcaaaatgatccctaatgtttcgaatgtctcaaagtgcaccgggactgttatggagaa

SEQ ID NO: 101824 - DNA, 75 bp, Artificial Sequence
  Synthetic
tgtataagtgtgacatgtcagtgtcagactactgggagggcaatatctcaatcaggggaacagacactactgatg

SEQ ID NO: 101825 - DNA, 75 bp, Artificial Sequence
  Synthetic
attgacaatactacctgcacaacagttgttctaggaaacataatcataagccttggaaaatatttgggatcaata

SEQ ID NO: 101826 - DNA, 75 bp, Artificial Sequence
  Synthetic
ttcataagctttgtaatagttgagaaaaagagagggaattacagcaggctagatgataggcaggtgcgaccggtc

SEQ ID NO: 101827 - DNA, 75 bp, Artificial Sequence
  Synthetic
tcggaaagaaacccacctaataaccgccctcaggcagactcaggaaggaaagatgaccaggaacccaaacctgcc

SEQ ID NO: 101828 - DNA, 75 bp, Artificial Sequence
  Synthetic
aattacaattctgagagcattgctgttgggccaccagtctatacagacaaagttgatatctcaagtcagatatct

SEQ ID NO: 101829 - DNA, 75 bp, Artificial Sequence
  Synthetic
agtatgaatcaatcactacaacaatctaaggattacattaaagaagctcaaaagatcttggacactgtgaatccg

SEQ ID NO: 101830 - DNA, 75 bp, Artificial Sequence
  Synthetic
gtatattcttttattattgttaacagcagatctactaaatagtttaatccaatagattgaagataatcaattctt

SEQ ID NO: 101831 - DNA, 75 bp, Artificial Sequence
  Synthetic
tcgttgataagtatgctatcaatgatcatcctttatgttttgtccattgcggcactgtgcattggtctgatcact

SEQ ID NO: 101832 - DNA, 75 bp, Artificial Sequence
  Synthetic
ctctattcttatgtaatctcagatggatcaaggctagtcatatcttaaatcacaagctgtattattacttactgt

SEQ ID NO: 101833 - DNA, 75 bp, Artificial Sequence
  Synthetic
cacaagctgtattattacttactgtgatggataaagggactttacaaaaaacttaggacccaagtccttaaccac

SEQ ID NO: 101834 - DNA, 75 bp, Artificial Sequence
  Synthetic
agtaatggtgatctgtattatattggaacataaaatacactacaatcaatctaattgttttatctttactaatga

SEQ ID NO: 101835 - DNA, 75 bp, Artificial Sequence
  Synthetic
agtaagtctcactggtgatgggatacaagtgcaagttccttttcaaatggtgctcaaatctaaggatcctcttgc

SEQ ID NO: 101836 - DNA, 75 bp, Artificial Sequence
  Synthetic
tataaacaatacttaatcatcagctacctaagtgctcatatagctctcatgtatattcttttattattgttaaca

SEQ ID NO: 101837 - DNA, 75 bp, Artificial Sequence
  Synthetic
gtatattcttttattattgttaacagcagatctactaaatagtttaatccaataaattgaggataatcaattctt

SEQ ID NO: 101838 - DNA, 75 bp, Artificial Sequence
  Synthetic
gcattgcataaactcgttaggttgtatataacaaaaattatttttttctttttgaaagattgtatagtctggtca

SEQ ID NO: 101839 - DNA, 75 bp, Artificial Sequence
  Synthetic
ttctattgtaattgatataatgattatttgatcatattgatcaatgtacctatttgaatcaatcgacattggatt

SEQ ID NO: 101840 - DNA, 75 bp, Artificial Sequence
  Synthetic
tctaggatcctttacaatctcagaccctggtgcaaggttatatatagagcccaattctcctaattaaacagtgtc

SEQ ID NO: 101841 - DNA, 75 bp, Artificial Sequence
  Synthetic
aaaccaacttgttagttagaattaagaaaatataagagctaatactcgtaagtcatttgcttcttcaagagccta

SEQ ID NO: 101842 - DNA, 75 bp, Artificial Sequence
  Synthetic
actgtctctgattcgtcttgctgtaagaccaaaaagtgatagtggagactacaatcagaaatacatcgctataac

SEQ ID NO: 101843 - DNA, 75 bp, Artificial Sequence
  Synthetic
gatggataaagggactttacaaaaaacttaggacccaagtccttaaccacattctaatgtgagggagaattaaat

SEQ ID NO: 101844 - DNA, 75 bp, Artificial Sequence
  Synthetic
aaaccaacttgttagttagaattaagaaaatataagagctaatacttgtaaatcatttgcttcttcaagagcctg

SEQ ID NO: 101845 - DNA, 75 bp, Artificial Sequence
  Synthetic
agattgctgacaatagattgaccatcggttctcctagtaagatatacaattctctaggtcaacctgtcttctacc

SEQ ID NO: 101846 - DNA, 75 bp, Artificial Sequence
  Synthetic
aatgtctgtcccgaggtatgctgggaagggacatataatgatgcttttctaatagaccggctaaactgggttagt

SEQ ID NO: 101847 - DNA, 75 bp, Artificial Sequence
  Synthetic
ccaaattggtaagcccgaacaataatctatctggtaaaatcaaggatcaaggtaaagttatcaagaattattacg

SEQ ID NO: 101848 - DNA, 75 bp, Artificial Sequence
  Synthetic
gcacaatggacatcaagaaaattaacgatgggttattagatagtaagatacttggggcgtttaacacagtgatag

SEQ ID NO: 101849 - DNA, 75 bp, Artificial Sequence
  Synthetic
tgaactcaacttcagtgagacaaatgcatcacaatttgttcctttggcagatgatgcatctaaggatgtcgtgag

SEQ ID NO: 101850 - DNA, 75 bp, Artificial Sequence
  Synthetic
ctttgttgggatcaatcatcatcattgtgatgaatatcatgataattcaaaattacaccagaacgactgataatc

SEQ ID NO: 101851 - DNA, 75 bp, Artificial Sequence
  Synthetic
ggaacatctaaacatgtcagtaatttgatagagtagcagtcagaccaagatcatatattagaggtacacatcata

SEQ ID NO: 101852 - DNA, 75 bp, Artificial Sequence
  Synthetic
aggcactaatcaaagagtcactccagagtgtacagcaacaaatcaaagctttaacagacaaaatcgggacagaga

SEQ ID NO: 101853 - DNA, 75 bp, Artificial Sequence
  Synthetic
atggccagtgtcttaatctcaaccattcataaaccgtcagtgtttcccttataaactccattatgtagtttatta

SEQ ID NO: 101854 - DNA, 75 bp, Artificial Sequence
  Synthetic
taggccccaaagtctcactgattgacacatccagcaccatcacaattcctgctaacatagggttactgggatcca

SEQ ID NO: 101855 - DNA, 75 bp, Artificial Sequence
  Synthetic
agataagtcagtctaccagcagtattaatgagaatgttaacgataaatgcaaatttactcttcctcctttaaaga

SEQ ID NO: 101856 - DNA, 75 bp, Artificial Sequence
  Synthetic
ttcatgagtgtaatatctcttgtccgaatcctttgcctttcagagaataccgaccaatctcacaaggggtgagtg

SEQ ID NO: 101857 - DNA, 75 bp, Artificial Sequence
  Synthetic
cgaccaatctcacaaggggtgagtgatcttgtaggactgccgaaccagatctgtctacagaagacaacatcaaca

SEQ ID NO: 101858 - DNA, 75 bp, Artificial Sequence
  Synthetic
atcctaaagcccaggctgatatcctatactctaccaattaataccagagaaggggtttgcatcactgacccactt

SEQ ID NO: 101859 - DNA, 75 bp, Artificial Sequence
  Synthetic
ttggctgttgataatggcttcttcgcctatagccatcttgaaaagatcggatcatgtactagaggaattgcaaaa

SEQ ID NO: 101860 - DNA, 75 bp, Artificial Sequence
  Synthetic
caaaggataataggggtgggtgaggtattggataggggtgataaggtgccatcaatgtttatgaccaatgtttgg

SEQ ID NO: 101861 - DNA, 75 bp, Artificial Sequence
  Synthetic
taatattctcccaaacacacgaaatcgccacaagtgtgataacactagcaaaacattccttgactatcatatgga

SEQ ID NO: 101862 - DNA, 75 bp, Artificial Sequence
  Synthetic
gaaggccggatgatgatcgagacttcgataaaatctgatatcaaataccaatctttaattactagatctaacgct

SEQ ID NO: 101863 - DNA, 75 bp, Artificial Sequence
  Synthetic
acaccacccaatccaagcaccatccatcactgcagctcaacttaccatgaagatttttattacacattgtgcgca

SEQ ID NO: 101864 - DNA, 75 bp, Artificial Sequence
  Synthetic
ttagtcttggcacttttacagttgaaagatgaggcgcgcatcctaagaggggcatttctacatcactgcattaaa

SEQ ID NO: 101865 - DNA, 75 bp, Artificial Sequence
  Synthetic
gtaaggttgttaaaataatctgtgtctatcctttagatatccacttgggttgtagatatagtcaatcaactggtc

SEQ ID NO: 101866 - DNA, 75 bp, Artificial Sequence
  Synthetic
gtgtcccatgtgggagatcctatccttaacagtacttcctggacagagtcactgtctctgattcgtcttgctgta

SEQ ID NO: 101867 - DNA, 75 bp, Artificial Sequence
  Synthetic
tgacaagtcataccccaaacaatccaaatctggaatcacctgttcgctcagtagtaatatcttggcaaacactac

SEQ ID NO: 101868 - DNA, 75 bp, Artificial Sequence
  Synthetic
taaagttgaaagagggaagtacgataaggtgatgccttacggtccatcaggtatcaagcaaggggatacattgta

SEQ ID NO: 101869 - DNA, 75 bp, Artificial Sequence
  Synthetic
aagttagagagcatatgctagcagataaggtccttgaatacgggccaatcatgaaagcacacgcaatcttttgtg

SEQ ID NO: 101870 - DNA, 75 bp, Artificial Sequence
  Synthetic
agaaagaaatttgtgcaaggcaagctcaattatattttgacaggctcagaatgaatcttagggccttagggcaca

SEQ ID NO: 101871 - DNA, 75 bp, Artificial Sequence
  Synthetic
ctttccggccgtcggtttcttgccaaggaccgaatttcaatataatgactctaattgtcccataattcattgcaa

SEQ ID NO: 101872 - DNA, 75 bp, Artificial Sequence
  Synthetic
ctttcgatgggtgtcaactccaaaagtcattatattttgagatcaggactattgaagtataatctgtctctagga

SEQ ID NO: 101873 - DNA, 75 bp, Artificial Sequence
  Synthetic
gaagctttgattgcatcgggagtgggcaagtattttaaagagaatgggatggttaaagatgaacatgagctacta

SEQ ID NO: 101874 - DNA, 75 bp, Artificial Sequence
  Synthetic
agattgctgacaatagattgaccatcggttctcctagtaagatatacaattccctaggtcaacccgttttctacc

SEQ ID NO: 101875 - DNA, 75 bp, Artificial Sequence
  Synthetic
aaaactttatttcaactgtcaatctcttcagtacctcgaggcaatagtcagggcagagattccgaattttccaat

SEQ ID NO: 101876 - DNA, 75 bp, Artificial Sequence
  Synthetic
cgccacaagtgtgataacactagcaaaacattccttgactatcatatggaatttagtccctacaaatcagacaga

SEQ ID NO: 101877 - DNA, 75 bp, Artificial Sequence
  Synthetic
aggcatcatattcttgggatacgatgattaaattaggcgatgttgataccgttgaccctctaagagtacagtgga

SEQ ID NO: 101878 - DNA, 75 bp, Artificial Sequence
  Synthetic
acggataggacagagacatctgatttctcgaaatatgatgatggaacaggaacaaaatttgacacggtgagtgct

SEQ ID NO: 101879 - DNA, 75 bp, Artificial Sequence
  Synthetic
gaaataacagtgtgatttctagacctggacagtcacagtgtcctcgatttaatgtctgtcccgaggtatgctggg

SEQ ID NO: 101880 - DNA, 75 bp, Artificial Sequence
  Synthetic
catggctatttttgcagaaagacttgacgaaatttatggcttacccggtttctttaactggatgcacaaacgatt

SEQ ID NO: 101881 - DNA, 75 bp, Artificial Sequence
  Synthetic
gctggtgtttatttaaacagtaaccaaactgcagagaaccctgtgtttgccgtattcaaggataacgagatcctt

SEQ ID NO: 101882 - DNA, 75 bp, Artificial Sequence
  Synthetic
taccaagttccactggctgaagatgacacaaatgcacaaaaaaccatcacagattgcttcttgctggagaatgtc

SEQ ID NO: 101883 - DNA, 75 bp, Artificial Sequence
  Synthetic
gcctacgaaacaaatacaaggattgcagctatagttcagggggacaatgagtcaattgccataactcagaaggtc

SEQ ID NO: 101884 - DNA, 75 bp, Artificial Sequence
  Synthetic
agattgcttcttgctggagaatgtcatatggtgtatatcactagtagaaatatacgatacaggagacagtgtgat

SEQ ID NO: 101885 - DNA, 75 bp, Artificial Sequence
  Synthetic
acaggtctactaaatagtttaatccaataaattgaggataatcaattcttgcattgcataaactcgttaggttat

SEQ ID NO: 101886 - DNA, 75 bp, Artificial Sequence
  Synthetic
aataaattgaggataatcaattcttgcattgcataaactcgttaggttatatataacaaaaattatttttttctt

SEQ ID NO: 101887 - DNA, 75 bp, Artificial Sequence
  Synthetic
aaggccaaaactgtttgcagtcaagatacctgcccaatgttcagagagttgattgaccaaaagagcaataaatat

SEQ ID NO: 101888 - DNA, 75 bp, Artificial Sequence
  Synthetic
cttgcagcaatattagtactaccatagctaaggcgattgaaaatggattatcaagaaatgtgggttactgcatca

SEQ ID NO: 101889 - DNA, 75 bp, Artificial Sequence
  Synthetic
atacctgcccaatgttcagagagttgattgaccaaaagagcaataaatattatattataattgtatcagtcaaat

SEQ ID NO: 101890 - DNA, 75 bp, Artificial Sequence
  Synthetic
tcaagaaatgtgggttactgcatcaacgtcttgaaggtcatacagcaactgcttatttctactgagtttagcatc

SEQ ID NO: 101891 - DNA, 75 bp, Artificial Sequence
  Synthetic
tgtaaacatccttcttataatatactcaaaaaattaaaaattcccccaagaaaatactaaatgtaatcaaactca

SEQ ID NO: 101892 - DNA, 75 bp, Artificial Sequence
  Synthetic
ttccatgataaatcattcgaggaagatctggagcttgctactttcctaatggatcgtagaattatattgcccaga

SEQ ID NO: 101893 - DNA, 75 bp, Artificial Sequence
  Synthetic
tttgaaagattgtatagtctggtcattctattataattgatataatgattctttgatcatattgatcaatgtacc

SEQ ID NO: 101894 - DNA, 75 bp, Artificial Sequence
  Synthetic
gtacattgagactgacaatctaatatacagagtgtttgatcaagttaaaacatcaattgtcaggaattcattgat

SEQ ID NO: 101895 - DNA, 75 bp, Artificial Sequence
  Synthetic
ataaaccctgaaatattgatagtttacagagatcatatgactctttgtataattccttatagaactcctaaatat

SEQ ID NO: 101896 - DNA, 75 bp, Artificial Sequence
  Synthetic
agctaaggcgattgaaaatggattatcaagaaatgtgggttactgcatcaacgtcttgaaggtcatacagcaact

SEQ ID NO: 101897 - DNA, 75 bp, Artificial Sequence
  Synthetic
caaagagcgataaacttgctaccctgtacatttaaagcagatactgtgattaactctgtaagtttatcagataat

SEQ ID NO: 101898 - DNA, 75 bp, Artificial Sequence
  Synthetic
aaaccaacttgttagttagaattaagaaaatataagagctaatactcgcaagtcatttgcttcttcaagagcctg

SEQ ID NO: 101899 - DNA, 75 bp, Artificial Sequence
  Synthetic
taactctgtaagtttatcagataatcctattaatgacatactgagggttattcttgtataattcttctgaagata

SEQ ID NO: 101900 - DNA, 75 bp, Artificial Sequence
  Synthetic
tgattacagataatctttcaatctagtcaagtaagcctgatttcctaattataatctccctcttgggagaaggag

SEQ ID NO: 101901 - DNA, 75 bp, Artificial Sequence
  Synthetic
gtcatatgtggagagatcttgctcttggtcgatcaatctatggacttgaagtgcctgatgctttggaagcaatga

SEQ ID NO: 101902 - DNA, 75 bp, Artificial Sequence
  Synthetic
ataatctccctcttgggagaaggagaacgtatcaatgttcactatatactaagtcttttattttaaatttttctt

SEQ ID NO: 101903 - DNA, 75 bp, Artificial Sequence
  Synthetic
attgtcttcagatgagccttattacttcatctcatcagattataaattttctaataaattaagaaaaacttagga

SEQ ID NO: 101904 - DNA, 75 bp, Artificial Sequence
  Synthetic
cccaagtcctttaaacgtgcatgattgagatagtcagaaattggagctaatctgaatactagtgagtaaattagg

SEQ ID NO: 101905 - DNA, 75 bp, Artificial Sequence
  Synthetic
tctgaatactagtgagtaaattaggagtagtagtattgaaccacctcatatcttatttcttctgaactgtattaa

SEQ ID NO: 101906 - DNA, 75 bp, Artificial Sequence
  Synthetic
cttaatggtggatcctgagctttttgccctttatttaggtcaatcaatttcagttaaatgggcatttgaaatcca

SEQ ID NO: 101907 - DNA, 75 bp, Artificial Sequence
  Synthetic
ataaaccctgaaatattgatagtttacagagatcatatgactctttgtataattctttatagaactcctaaatat

SEQ ID NO: 101908 - DNA, 75 bp, Artificial Sequence
  Synthetic
tatcatctatcctgaatgtcaccttgacagtcctatagtatcaggaaaattgatttcagctatagaatatgcgca

SEQ ID NO: 101909 - DNA, 75 bp, Artificial Sequence
  Synthetic
tgatttcagctatagaatatgcgcagttgagacataaccaaccgaatggggacaagagattaactgaaaatatca

SEQ ID NO: 101910 - DNA, 75 bp, Artificial Sequence
  Synthetic
caaagagcgataaacttgctaccctgtacacttaaagcagatactgtgattaactctgtaagtttatcagataat

SEQ ID NO: 101911 - DNA, 75 bp, Artificial Sequence
  Synthetic
taactctgtaagtttatcagataatcctattagtgacatactgagggttattcttgtataattcttctgaagatg

SEQ ID NO: 101912 - DNA, 75 bp, Artificial Sequence
  Synthetic
aaattaacttacagggcaaaagaagaagtgtgtatatatccagacaatctagacttggaaattacattagagaca

SEQ ID NO: 101913 - DNA, 75 bp, Artificial Sequence
  Synthetic
atataaagaatttgaagggatttctacatgtatcatatcccgagtgcaataaatctttattctctctcaagtctc

SEQ ID NO: 101914 - DNA, 75 bp, Artificial Sequence
  Synthetic
ctggaatgacaagtaagttgagtaatatcatgaagaaatcatttaaagcatacaatatcgtgagcagaaaaatca

SEQ ID NO: 101915 - DNA, 75 bp, Artificial Sequence
  Synthetic
tttgaatactagtgagtaaattaggagtagtagtattgaaccacctcatatcttatttcttctgaactgcattaa

SEQ ID NO: 101916 - DNA, 75 bp, Artificial Sequence
  Synthetic
tagagatgttacaaaacatcaccaggaatctcataactcaggaccaaaaggatgaagttttaggtatttatgagc

SEQ ID NO: 101917 - DNA, 75 bp, Artificial Sequence
  Synthetic
aatttgtacccaggatataacaacatggctcatgaattatctatctctgatatcatctatcctgaatgtcacctt

SEQ ID NO: 101918 - DNA, 75 bp, Artificial Sequence
  Synthetic
aggacagactcagtaacatagggaaatacatgagtcaatcgcaatggtatgagtgttttctcttctggttcacaa

SEQ ID NO: 101919 - DNA, 75 bp, Artificial Sequence
  Synthetic
tcaagacagagatgagagctgttatcaagaactcacagaaacctaagtttagatctgactcttgtattattcata

SEQ ID NO: 101920 - DNA, 75 bp, Artificial Sequence
  Synthetic
aagatgaggcgcgcatcctaagaggggcatttctacatcattgcattaaagagatccaccaagagttgattggat

SEQ ID NO: 101921 - DNA, 75 bp, Artificial Sequence
  Synthetic
tgaaagataataacatggaaattgtaatgaacccaaatcttgtctgcatttacaaaaatgataaggatggaaaga

SEQ ID NO: 101922 - DNA, 75 bp, Artificial Sequence
  Synthetic
ggtgttattaccttacaccagaaattgttctaatgtgttgtgatgtcttggaaggccggatgatgatcgagactt

SEQ ID NO: 101923 - DNA, 75 bp, Artificial Sequence
  Synthetic
gaaggccggatgatgatcgagacttcgataaaatctgatatcaaataccaatctttaattaccagatctaacgct

SEQ ID NO: 101924 - DNA, 75 bp, Artificial Sequence
  Synthetic
ttgtggacattcattgattcactcttcccgattatgggtaataggatatacaatatagtatctatgatagagcct

SEQ ID NO: 101925 - DNA, 75 bp, Artificial Sequence
  Synthetic
aaagcccggaactttataacatcaaaaattacataaggagaaaagttttgattctagacttcagatctcatacta

SEQ ID NO: 101926 - DNA, 75 bp, Artificial Sequence
  Synthetic
cttcagtacctcgaggcaatagtcagggcagagattccgaattttccaataacacagagaaaagtctcatatcac

SEQ ID NO: 101927 - DNA, 75 bp, Artificial Sequence
  Synthetic
tatctaatagagaagtcaaaatctggtggaagatcataggttacctctctttagtctgaatcggactaccacacc

SEQ ID NO: 101928 - DNA, 75 bp, Artificial Sequence
  Synthetic
gtggaagatcataggttacctctctttagtctgaatcggactaccacacccatcaccaatgaagcccgaacaagt

SEQ ID NO: 101929 - DNA, 75 bp, Artificial Sequence
  Synthetic
gagattcaccaagagttgattgaatgtgggtttactgatcaaaaaacaagatctatctttatcgatgatcttcta

SEQ ID NO: 101930 - DNA, 75 bp, Artificial Sequence
  Synthetic
gtgggtttactgatcaaaaaacaagatctatctttatcgatgatcttctatcagtaatgaatattgataatatcc

SEQ ID NO: 101931 - DNA, 75 bp, Artificial Sequence
  Synthetic
cgccacaagtgtgataacactagccaaacattccttgactatcatatggaattcagtccctacaagtcagacaga

SEQ ID NO: 101932 - DNA, 75 bp, Artificial Sequence
  Synthetic
atctgttagctgagttcttttctttcttccgaacctttggtcatccaattctcgaagccaaaaccgcagcagaca

SEQ ID NO: 101933 - DNA, 75 bp, Artificial Sequence
  Synthetic
agagaagtcagtcatttatgtcgcagatcctaattgcccaccagacatcgggaaacatataaaccttgatgatac

SEQ ID NO: 101934 - DNA, 75 bp, Artificial Sequence
  Synthetic
gtacaattataaatgggtaccgtgacaggcatgggggagcttggcctccactttatctgccatcgcatgcatcga

SEQ ID NO: 101935 - DNA, 75 bp, Artificial Sequence
  Synthetic
aacacataataagactcaagaattctggtgaatcattaacagttgatgattgtgttaagaactgggagtcatttt

SEQ ID NO: 101936 - DNA, 75 bp, Artificial Sequence
  Synthetic
caccctaatttaccttacaaagtcaagaaagaaatttgtgcaaggcaagctcaattatattttgacaggctcaga

SEQ ID NO: 101937 - DNA, 75 bp, Artificial Sequence
  Synthetic
gtgggattcaatttgattgctttatggagttaaaattagacagtgatttgagcatgtatatgaaagataaagcac

SEQ ID NO: 101938 - DNA, 75 bp, Artificial Sequence
  Synthetic
agaaagaaatttgtgcaaggcaagctcaattatattttgacaggctcagaatgaatcttagggccttaggactca

SEQ ID NO: 101939 - DNA, 75 bp, Artificial Sequence
  Synthetic
ttcaagaagggtctccgggaatttccggagtccctcttggaagtccatggtgaggggacttgatacctcaccgcc

SEQ ID NO: 101940 - DNA, 75 bp, Artificial Sequence
  Synthetic
agtttgaacagtatcagaaaggagtggacttaattcaaaagctgagaactgtccattcaatggcacaggttgatc

SEQ ID NO: 101941 - DNA, 75 bp, Artificial Sequence
  Synthetic
acaattgctgttatcatgtatgtgggtcaatgccttctgggtctccttgtacagctttgttgaattcaattataa

SEQ ID NO: 101942 - DNA, 75 bp, Artificial Sequence
  Synthetic
gtgtaccatggtgtaacgaagcccaaacaagtgatcaaactggatgctgatcccgtggaatctcagtcaacatta

SEQ ID NO: 101943 - DNA, 75 bp, Artificial Sequence
  Synthetic
atcttgttcagtttggtgttggagagaaaaatggatgtgtgaggtgggttatgaatgccttaggagtgaaagatg

SEQ ID NO: 101944 - DNA, 75 bp, Artificial Sequence
  Synthetic
ttgtcctctggattacacaattttgtgccgaatgtattggggtccagctattagttattttcatttgaatccagg

SEQ ID NO: 101945 - DNA, 75 bp, Artificial Sequence
  Synthetic
ttccaagattttcaaaaaatctccagttttcttttgtgatgctgtgagaattctttgttatggagatgatgttct

SEQ ID NO: 101946 - DNA, 75 bp, Artificial Sequence
  Synthetic
acaatgttaatctgtattatgttttttccaagattttcaaaaaatctccagttttcttttgtgatgctgtgagaa

SEQ ID NO: 101947 - DNA, 75 bp, Artificial Sequence
  Synthetic
gaaaaatggatgtgtgaggtgggttatgaatgccttaggagtgaaagatgattggctgcttgtaccttctcatgc

SEQ ID NO: 101948 - DNA, 75 bp, Artificial Sequence
  Synthetic
ttccagggctctccccttgccctaggctctggccgttgcgcccggcggggtcaactccatgattagcatggagct

SEQ ID NO: 101949 - DNA, 75 bp, Artificial Sequence
  Synthetic
atgatggagttttattttaacagaggtggcacctattactctatatctgctggtaatgttgtgattcaatctttg

SEQ ID NO: 101950 - DNA, 75 bp, Artificial Sequence
  Synthetic
agatatttgttcgggaattactatttttaaaagttttaaggatgccatatattggttatgtacaaaattgaagga

SEQ ID NO: 101951 - DNA, 75 bp, Artificial Sequence
  Synthetic
tttagcaaagaaagtacctgagacatttcctgaattgaagcctggagagtccagacatacatcagatcatatgtc

SEQ ID NO: 101952 - DNA, 75 bp, Artificial Sequence
  Synthetic
tttttatgaagtaaattatggcaagaaaaaggatgttcttaatattctcaaagataaccagcaaaaaatagaaaa

SEQ ID NO: 101953 - DNA, 75 bp, Artificial Sequence
  Synthetic
ttttagagatattacagaacattttattaagaaaggtgatgtgcctcgtgccttaaatcgccttgcaacgttggt

SEQ ID NO: 101954 - DNA, 75 bp, Artificial Sequence
  Synthetic
tttaatacaacaatgatggaaaattgctcagacttggatgttgtttttactacctgtcctaaggatgaattaaga

SEQ ID NO: 101955 - DNA, 75 bp, Artificial Sequence
  Synthetic
agaattaggcctgctattgctgagaaaaccatatggtcattagttgcatggcaaaggagcaatgctgaatttgaa

SEQ ID NO: 101956 - DNA, 75 bp, Artificial Sequence
  Synthetic
gtggcacctattactctatatctgctggtaatgttgtgattcaatctttggatgtgggatttcaagatgtggttt

SEQ ID NO: 101957 - DNA, 75 bp, Artificial Sequence
  Synthetic
agaaatttgatcagtatcagaaaggggttgatttaatacaaaagctgagaactgtccattcaatggctcaagttg

SEQ ID NO: 101958 - DNA, 75 bp, Artificial Sequence
  Synthetic
tggaggaaaaagccacttatgtgcataagaagaatgatggcactactgttgatttgacagtggatcaagcttgga

SEQ ID NO: 101959 - DNA, 75 bp, Artificial Sequence
  Synthetic
ttgcttttatgcatggatatgaattttaccaacaattttatcattttgttcagtcctgtttggagaaagagatga

SEQ ID NO: 101960 - DNA, 75 bp, Artificial Sequence
  Synthetic
attaagaaaggtgatgtgcctcgtgccttaaatcgccttgcaacgttggtgacaacagtgaatggaaccccaatg

SEQ ID NO: 101961 - DNA, 75 bp, Artificial Sequence
  Synthetic
taagaagaatgatggcactactgttgatttgacagtggatcaagcttggagaggaaaaggtgagggtttgccagg

SEQ ID NO: 101962 - DNA, 75 bp, Artificial Sequence
  Synthetic
tcaaatcagtctatacagaatgcaatcttgggcatacatgtggctggaggtaattcaattcttgttgccaagtta

SEQ ID NO: 101963 - DNA, 75 bp, Artificial Sequence
  Synthetic
cagtgctttgtttgtgacctttcatgatttgtttaaacaaattttcttaaaatttctgaggtttgtttattttat

SEQ ID NO: 101964 - DNA, 75 bp, Artificial Sequence
  Synthetic
gtaactcaagaaatgtttcagaatatagataaaaagattgaaagtcagagaataatgaaagtggaatttactcag

SEQ ID NO: 101965 - DNA, 75 bp, Artificial Sequence
  Synthetic
aaccaaaatttgtaaacactatggtgttgaacctgagaaaaatatttacaccaaacctgtggcctcagattattg

SEQ ID NO: 101966 - DNA, 75 bp, Artificial Sequence
  Synthetic
ggagtccctcttgggagtccatggtgaggggacttgatacctcaccgccgtttgcctaggctataggctaaattt

SEQ ID NO: 101967 - DNA, 75 bp, Artificial Sequence
  Synthetic
ggtattttccagactgttgggagtggtcttgaccacatcctgtctttggcagacattgaggaagagcaaatgatt

SEQ ID NO: 101968 - DNA, 75 bp, Artificial Sequence
  Synthetic
tcatcacattgataaagacatgattaattttcctgcagcaatgcctttctcaagagcagaaattgacccgatggc

SEQ ID NO: 101969 - DNA, 75 bp, Artificial Sequence
  Synthetic
aatatgtccaaacaaggaattttccagactgttgggagtggtcttgaccacatcctgtctttggcagatattgag

SEQ ID NO: 101970 - DNA, 75 bp, Artificial Sequence
  Synthetic
tttgtaaatattgattcctgcaggttcagggttcttaaatctgtttctctataagaacactcatttcacgctttc

SEQ ID NO: 101971 - DNA, 75 bp, Artificial Sequence
  Synthetic
aattttcctgcagcaatgcctttctcaagagcagaaattgacccgatggctgtaatgctttctaaatattcttta

SEQ ID NO: 101972 - DNA, 75 bp, Artificial Sequence
  Synthetic
attattttgttcagtcctgtttggagaaagagatgatagaatacagacttaaatcttatgattggtggagaatga

SEQ ID NO: 101973 - DNA, 75 bp, Artificial Sequence
  Synthetic
acaaagatgtttcggttttctttcagaataaagttatggggaagagtgttttggttgatgattttttggatcttg

SEQ ID NO: 101974 - DNA, 75 bp, Artificial Sequence
  Synthetic
gaataaagttatggggaagagtgttttggttgatgattttttggatcttgacatggccattacaggggcccctgg

SEQ ID NO: 101975 - DNA, 75 bp, Artificial Sequence
  Synthetic
ttacactggctgaaccccaaaaagataaacttggcagatagaatgttgggtttatctggaatacaggaaattaaa

SEQ ID NO: 101976 - DNA, 75 bp, Artificial Sequence
  Synthetic
tctcctggattcccatatgtccaagaaagattgacaaaaagggatttaatttggcttgatgaaaatggactgctg

SEQ ID NO: 101977 - DNA, 75 bp, Artificial Sequence
  Synthetic
aaagattgacaaaaagggatttaatttggcttgatgaaaatggactgctgttaggcattcatccaagattagctc

SEQ ID NO: 101978 - DNA, 75 bp, Artificial Sequence
  Synthetic
ttttcacaagctaaaatttctcttttttatactgaggagcatgaaataatgaaattttcttggagaggagtgact

SEQ ID NO: 101979 - DNA, 75 bp, Artificial Sequence
  Synthetic
aggtttgttgagataccatacatatgcaagatttggcattgagattcaagttcagataaaccccacaccctttca

SEQ ID NO: 101980 - DNA, 75 bp, Artificial Sequence
  Synthetic
gatggaaaattgttcagatctggatgtgattttcacaacctgtccaaaagatgagctaagacccttggataaagt

SEQ ID NO: 101981 - DNA, 75 bp, Artificial Sequence
  Synthetic
ctgtgctatggttcctggtgaccagagctatggttctatagcatcattgactgtttatcctcatggtttgttaaa

SEQ ID NO: 101982 - DNA, 75 bp, Artificial Sequence
  Synthetic
agggagagaaatttttccttattcattctgctgattggttgacgacacatgctttgtttcatgaagttgcaaaat

SEQ ID NO: 101983 - DNA, 75 bp, Artificial Sequence
  Synthetic
gtgattttcacaacctgtccaaaagatgagctaagacccttggataaagtgttagaatcaaaaacaagagccatt

SEQ ID NO: 101984 - DNA, 75 bp, Artificial Sequence
  Synthetic
ttttgtgtcggatgtattggggtccagctataagttatttccatttgaatcctggatttcatactggtgtggcta

SEQ ID NO: 101985 - DNA, 75 bp, Artificial Sequence
  Synthetic
agctataagttatttccatttgaatcctggatttcatactggtgtggctattggaattgatcctgataggcaatg

SEQ ID NO: 101986 - DNA, 75 bp, Artificial Sequence
  Synthetic
tgagcaatttgctgttcagggtctgttgaggtatcatacttatgcaagatttggaattgagatacaagttcagat

SEQ ID NO: 101987 - DNA, 75 bp, Artificial Sequence
  Synthetic
ttcactcaatgttttagctagatttacagatttggagttgcatggattaactcctctttctacacaaatgatgag

SEQ ID NO: 101988 - DNA, 75 bp, Artificial Sequence
  Synthetic
agatttggggatgttggtcttgatttggatttttccgcctttgatgctagtcttagtccatttatgattagagaa

SEQ ID NO: 101989 - DNA, 75 bp, Artificial Sequence
  Synthetic
tcatttcaaagatccacagtacccagtttgggaattaacaatcagagtttggtcagagttgaatattggaacagg

SEQ ID NO: 101990 - DNA, 75 bp, Artificial Sequence
  Synthetic
tggatttttccgcctttgatgctagtcttagtccatttatgattagagaagcaggcagaattatgtctgaaattt

SEQ ID NO: 101991 - DNA, 75 bp, Artificial Sequence
  Synthetic
agctcttatcaacacaattatttactcaaaacacctgttgtacaattgttgttaccatgtgtatgggtcaatgcc

SEQ ID NO: 101992 - DNA, 75 bp, Artificial Sequence
  Synthetic
tcaaaacacctgttgtacaattgttgttaccatgtgtatgggtcaatgccatcaggatctccttgtacagctttg

SEQ ID NO: 101993 - DNA, 75 bp, Artificial Sequence
  Synthetic
aatgccatattagggatacatgttgctggtggtaactcaattttggtcgctaaattagtcactcaagaaatgttt

SEQ ID NO: 101994 - DNA, 75 bp, Artificial Sequence
  Synthetic
tgaaatgatggagttttatttcaatagaggtggaacttactattcaatttcagctggtaatgttgttattcaatc

SEQ ID NO: 101995 - DNA, 75 bp, Artificial Sequence
  Synthetic
atttgtattatgttttctcaaaaatttttaggaagtctcctgtgttttttagccaagctgtgaggattttatgtt

SEQ ID NO: 101996 - DNA, 75 bp, Artificial Sequence
  Synthetic
gttccatttatttacactagaggtgcttatcatttcaaagacccacagtatccagtttgggaattgacaatcaga

SEQ ID NO: 101997 - DNA, 75 bp, Artificial Sequence
  Synthetic
caaatgacaaatacaaatcctgaccaaaaatgtataactgctttggcttctatttgtcagatgttttgtttttgg

SEQ ID NO: 101998 - DNA, 75 bp, Artificial Sequence
  Synthetic
gcttacacatcactgaatgtgctggctagatttactgatttggagctccatgggctaacacccctgtctacacag

SEQ ID NO: 101999 - DNA, 75 bp, Artificial Sequence
  Synthetic
ttttaggaagtctcctgtgttttttagccaagctgtgaggattttatgttatggggatgatgttttaatagtctt

SEQ ID NO: 102000 - DNA, 75 bp, Artificial Sequence
  Synthetic
ttttattaagaaaggagatgtgcctagagccttgaatcgcttggcaacattagtgacaaccgttaatggaactcc

SEQ ID NO: 102001 - DNA, 75 bp, Artificial Sequence
  Synthetic
aagtttttcccaccaaatatcattcaggtagattactgttttgttttgttcctggcaatgagctaatagatgttt

SEQ ID NO: 102002 - DNA, 75 bp, Artificial Sequence
  Synthetic
cttgatcagattggacagaaaattgtgcatgaatttaaacagttggggatgacagctacttctgctgacaaaact

SEQ ID NO: 102003 - DNA, 75 bp, Artificial Sequence
  Synthetic
gtaccacaactgaagccagtttcagaattaacttttctcaagaggtcctttaatctggtagaggacagggttaga

SEQ ID NO: 102004 - DNA, 75 bp, Artificial Sequence
  Synthetic
ttgtttttgattttcaggtttttccaaccaaatatcattcaggtagattattgttttgctttgttcctgggaatg

SEQ ID NO: 102005 - DNA, 75 bp, Artificial Sequence
  Synthetic
gtccaattatgaagatgctagagcaaaaatgtcttttgctcttgaccaggaagattggaaatctgatgcctctca

SEQ ID NO: 102006 - DNA, 75 bp, Artificial Sequence
  Synthetic
ggtctttagtagcttggcaaagaagcaatgccgagtttgaacaaaatttggaaaatgctcagtggtttgctttta

SEQ ID NO: 102007 - DNA, 75 bp, Artificial Sequence
  Synthetic
acaaagtcagcacatcagaaaggtgagtacactgccattgggaagcttattgtgtattgttataacagattgacc

SEQ ID NO: 102008 - DNA, 75 bp, Artificial Sequence
  Synthetic
agtacactgccattgggaagcttattgtgtattgttataacagattgacctctccttctaacgttgcttcccatg

SEQ ID NO: 102009 - DNA, 75 bp, Artificial Sequence
  Synthetic
tgacttccaggtttttcctacaaaatatcactcaggaagattattattttgttttgttcctggaaatgaactgat

SEQ ID NO: 102010 - DNA, 75 bp, Artificial Sequence
  Synthetic
gttttgttcctggaaatgaactgattgatgtttcccacataacactgaaacaagccactactgcgccttgtgctg

SEQ ID NO: 102011 - DNA, 75 bp, Artificial Sequence
  Synthetic
tgatgtttcccacataacactgaaacaagccactactgcgccttgtgctgtgatggatattactggtgtacagtc

SEQ ID NO: 102012 - DNA, 75 bp, Artificial Sequence
  Synthetic
agaaaggggttgatttaatacaaaagttgaggactgtccattcaatggctcaaattgaccccaatttgggggttc

SEQ ID NO: 102013 - DNA, 75 bp, Artificial Sequence
  Synthetic
ctttatcatgctatggatgttactacacaagttggagatgattctggaggtttttcaacaacagtttctacagaa

SEQ ID NO: 102014 - DNA, 75 bp, Artificial Sequence
  Synthetic
tgtttatctttcagcaattaatttggaatgttttgctcctctttatcatgctatggatgttaccacacaggttgg

SEQ ID NO: 102015 - DNA, 75 bp, Artificial Sequence
  Synthetic
gaaaggagagtatactgccataggaaagttgattgtttattgttacaacagactgacttctccctccaatgtggc

SEQ ID NO: 102016 - DNA, 75 bp, Artificial Sequence
  Synthetic
tagagctattgactcttgtccacttgattatacaattttgtgtagaatgtattggggccctgctattagttattt

SEQ ID NO: 102017 - DNA, 75 bp, Artificial Sequence
  Synthetic
tttttcaacaacagtttctacagaacagaatgttccagatccccaagttggtataacaaccatgaaagatttgaa

SEQ ID NO: 102018 - DNA, 75 bp, Artificial Sequence
  Synthetic
acagtttctacagagcagaatgttcctgatccccaagtcggcataacaaccatgagggacctaaaagggaaagcc

SEQ ID NO: 102019 - DNA, 75 bp, Artificial Sequence
  Synthetic
cattggcaaccaaaatttgtaaacattatggtgttgaacctgagaaaaatatatataccaaacctgtggcttcag

SEQ ID NO: 102020 - DNA, 75 bp, Artificial Sequence
  Synthetic
tctggaggcttctctaccactgtttcaacaaaacagaatgttccagacccccaagttggcatcacaacagtcaag

SEQ ID NO: 102021 - DNA, 75 bp, Artificial Sequence
  Synthetic
atcaaaataaaatagtaggcaagactcagctagttgatgactttctagatcttgatatggccattacaggggctc

SEQ ID NO: 102022 - DNA, 75 bp, Artificial Sequence
  Synthetic
tatgtccatctacaagtttatgggaaggtctcatttcttgtgcacttttacattcaattcaaataataaagagta

SEQ ID NO: 102023 - DNA, 75 bp, Artificial Sequence
  Synthetic
aggtctcatttcttgtgcacttttacattcaattcaaataataaagagtacacatttcctataaccttgtcttca

SEQ ID NO: 102024 - DNA, 75 bp, Artificial Sequence
  Synthetic
ctgaattgaagcctggagagtccagacatacatcagatcatatgtctatttataaattcatgggaaggtctcatt

SEQ ID NO: 102025 - DNA, 75 bp, Artificial Sequence
  Synthetic
catcaacactgaggtggtttttcaacttgtttcagttgtatagagggcctttagatctgacaattattattacag

SEQ ID NO: 102026 - DNA, 75 bp, Artificial Sequence
  Synthetic
aacacaaggagaacagggaacattcagattagattaccatggtattcttatttatatgctgtgtctggagcactg

SEQ ID NO: 102027 - DNA, 75 bp, Artificial Sequence
  Synthetic
gaatccagggtttcacacaggtgttgctattggcatagatcctgatagacagtgggatgaattatttaaaacaat

SEQ ID NO: 102028 - DNA, 75 bp, Artificial Sequence
  Synthetic
agattagattaccatggtattcttatttatatgctgtgtctggagcactggatggtttgggagacaagacagatt

SEQ ID NO: 102029 - DNA, 75 bp, Artificial Sequence
  Synthetic
tcaaatgccatgttatccactgaatcaatgatgagcagaattgcagctggagacttggagtcatcagtggatgat

SEQ ID NO: 102030 - DNA, 75 bp, Artificial Sequence
  Synthetic
ccaaagaaaattaatttagcagatagaatgcttggattgtctggagtgcaggaaattaaagaacagggtgttgga

SEQ ID NO: 102031 - DNA, 75 bp, Artificial Sequence
  Synthetic
agacttggagtcatcagtggatgatcctagatcagaggaagataaaagatttgagagtcatatagaatgcaggaa

SEQ ID NO: 102032 - DNA, 75 bp, Artificial Sequence
  Synthetic
tgtgggaggatggtttgtgtataagcatttttcccgcaaagaagaagaaccaattccagctgaaggggtttatca

SEQ ID NO: 102033 - DNA, 75 bp, Artificial Sequence
  Synthetic
ttgatgatcctcgatctgaagaggatcgtaaatttgaaagtcatattgaaaagaggaaaccttataaagagttaa

SEQ ID NO: 102034 - DNA, 75 bp, Artificial Sequence
  Synthetic
ctcaggaagaattgtcaaatgaagtacttccaccccctaggaaaatgaagggactgttttcacaagccaaaattt

SEQ ID NO: 102035 - DNA, 75 bp, Artificial Sequence
  Synthetic
gtgacctttcatgatttgtttaaatgaatcttcttaaaatttctgaggtttgtttattttattgttcagtaaata

SEQ ID NO: 102036 - DNA, 75 bp, Artificial Sequence
  Synthetic
aggattagttaggaaaaatttggttcagtttggagttggtgagaaaaatggatgtgtgagatgggtcatgaatgc

SEQ ID NO: 102037 - DNA, 75 bp, Artificial Sequence
  Synthetic
atttcatgtggcaaagttttttccaaaatgttagaaacagtttttaattggcaaatggactctagaatgatggag

SEQ ID NO: 102038 - DNA, 75 bp, Artificial Sequence
  Synthetic
aatgatgaagttttcctggagaggtgtgactgctgatactagagctttaaggaggtttggattctctttggccgc

SEQ ID NO: 102039 - DNA, 75 bp, Artificial Sequence
  Synthetic
gacctgatacctcaccgccgtttgcctaggctataggctatttctccccttcccttttccctgttttgtgtaaat

SEQ ID NO: 102040 - DNA, 75 bp, Artificial Sequence
  Synthetic
ggttaagagatatttgttcaggaattactatttttaaaagtttcaaggatgccatatattggttatatacaaaat

SEQ ID NO: 102041 - DNA, 75 bp, Artificial Sequence
  Synthetic
aggcagaagtgtgtggactcttgaaatggatgctggggttcttactgggagactgattagattgaatgatgagaa

SEQ ID NO: 102042 - DNA, 75 bp, Artificial Sequence
  Synthetic
tttaatctgtttctctataagaacactcattttcacgctttctgtcttgtttgttccagggctgtccccttgccc

SEQ ID NO: 102043 - DNA, 75 bp, Artificial Sequence
  Synthetic
cacagtacccagtttgggaattaacaattagagtttggtcagaactgaatattggaacgggaacttcagcttata

SEQ ID NO: 102044 - DNA, 75 bp, Artificial Sequence
  Synthetic
ttgttattcaatctttagatgtgggatttcaagatgttgttctaatgaaggttcctacaattcccaagtttagag

SEQ ID NO: 102045 - DNA, 75 bp, Artificial Sequence
  Synthetic
attgtttcattgattgaaaagtttacaagtaacaaatattggtccaaagtgaatttcccacatgggatgttggat

SEQ ID NO: 102046 - DNA, 75 bp, Artificial Sequence
  Synthetic
gatgaaaaatggacagaaatgaaagatgacaaaatagtttctttggtggagaaatttactagtaataaacactgg

SEQ ID NO: 102047 - DNA, 75 bp, Artificial Sequence
  Synthetic
caatttttgcattttgcaaattcaagatgtagagaaatttgatcagtatcagaaaggggttgatttaatacaaaa

SEQ ID NO: 102048 - DNA, 75 bp, Artificial Sequence
  Synthetic
attgaatgatgagaaatggacagaaatgaaggatgataaaattgtttcattaatcgaaaagttcacaagcaataa

SEQ ID NO: 102049 - DNA, 75 bp, Artificial Sequence
  Synthetic
caagtaacaaatattggtccaaagtgaatttcccacatgggatgttggatcttgaagaaattgctgccaattcta

SEQ ID NO: 102050 - DNA, 75 bp, Artificial Sequence
  Synthetic
atgacaaaatagtttctttggtggagaaatttactagtaataaacactggtccaaagttaattttcctcatggaa

SEQ ID NO: 102051 - DNA, 75 bp, Artificial Sequence
  Synthetic
gaaatttactagtaataaacactggtccaaagttaattttcctcatggaatgctagatttggaagagattgctgc

SEQ ID NO: 102052 - DNA, 75 bp, Artificial Sequence
  Synthetic
gaagtctgatccctctcaaggtggtggaattaaaatcacccattttactacttggacatccattccaaccttagc

SEQ ID NO: 102053 - DNA, 75 bp, Artificial Sequence
  Synthetic
gaaatgaatttagggttagtaccactgaaaatgttgtaaatttgtcaaattatgaagatgctagggcaaaaatgt

SEQ ID NO: 102054 - DNA, 75 bp, Artificial Sequence
  Synthetic
gcttggattgtctggagtacaggaaattaaagaacagggtgttggattgatagcagagtgcagaactttcttgga

SEQ ID NO: 102055 - DNA, 75 bp, Artificial Sequence
  Synthetic
ttctattgctgggactctgaaatctatgatgtttggatttcatcattctgtgactgttgaaattataaatactgt

SEQ ID NO: 102056 - DNA, 75 bp, Artificial Sequence
  Synthetic
gctggacttttctttggggccttaggtggtgtttgcctctgaggtactcaggggcatttaggtttttcctcactc

SEQ ID NO: 102057 - DNA, 75 bp, Artificial Sequence
  Synthetic
ctcacataattggtctgttgagagtcatgaattatgtagatattggttgttcagttatttcatgtggcaaagttt

SEQ ID NO: 102058 - DNA, 75 bp, Artificial Sequence
  Synthetic
tcagtctgttgataggactgcagtgactggtgcttcttatttcacttctgtagaccaatcttcagttcacactgc

SEQ ID NO: 102059 - DNA, 75 bp, Artificial Sequence
  Synthetic
gtgaaacctcttaagctaatacttctatgaagagatgctttggatagggtaacagcggcggatattggtgagttg

SEQ ID NO: 102060 - DNA, 75 bp, Artificial Sequence
  Synthetic
actggtgcttcttatttcacttctgtagaccaatcttcagttcacactgctgaagttggctcacatcaaattgaa

SEQ ID NO: 102061 - DNA, 75 bp, Artificial Sequence
  Synthetic
cctttgaaaacctctgttgataaacctggttctaagaagactcagggggagaagtttttcttgattcattctgct

SEQ ID NO: 102062 - DNA, 75 bp, Artificial Sequence
  Synthetic
ccaactggttaagagatatttgttctgggatcaccatttttaaaaacttcaaggatgcaatttattggctttata

SEQ ID NO: 102063 - DNA, 75 bp, Artificial Sequence
  Synthetic
gttagaaacagtttttaattggcaaatggactccagaatgatggagctgagaactcagagcttttccaattggtt

SEQ ID NO: 102064 - DNA, 75 bp, Artificial Sequence
  Synthetic
cattaagtggattgtctgtcagggctgtctctaggtttaattcctgacctctctgtgcttagggcaaacaaaact

SEQ ID NO: 102065 - DNA, 75 bp, Artificial Sequence
  Synthetic
caaaattaaaggacttttatgaagtgaattatggcaagaagaaggacattttaaatattcttaaagataaccaac

SEQ ID NO: 102066 - DNA, 75 bp, Artificial Sequence
  Synthetic
acctggttcaaagaaaacacagggagaaaaatttttcctaatccattcagcggattggctaacgacacatgcctt

SEQ ID NO: 102067 - DNA, 75 bp, Artificial Sequence
  Synthetic
gaaaaatttttcctaatccattcagcggattggctaacgacacatgccttgtttcatgaagtggcaaaattggat

SEQ ID NO: 102068 - DNA, 75 bp, Artificial Sequence
  Synthetic
tatattggctatatacaaaattgaaggatttttatgaagtaaattatggcaagaagaaggatgttcttaatattc

SEQ ID NO: 102069 - DNA, 75 bp, Artificial Sequence
  Synthetic
ctattaatatggattcatctcctgggtttccttatgttcaagaaaaattgaccaaaagagatttaatttggttgg

SEQ ID NO: 102070 - DNA, 75 bp, Artificial Sequence
  Synthetic
atccaagatgtggaaaaatttgaacagtatcagaaaggggttgacttgatacaaaaattgagaactgttcattca

SEQ ID NO: 102071 - DNA, 75 bp, Artificial Sequence
  Synthetic
agtatcagaaaggggttgacttgatacaaaaattgagaactgttcattcaatggctcaggttgatccaaatttaa

SEQ ID NO: 102072 - DNA, 75 bp, Artificial Sequence
  Synthetic
attttccagactgttgggagtggccttgaccacatcctgtctttggcagatgtggaggaggaacaaatgattcag

SEQ ID NO: 102073 - DNA, 75 bp, Artificial Sequence
  Synthetic
agaggtgcttatcattttaaagatccacagtacccagtttgggaattgacaatcagggtttggtcagagttgaat

SEQ ID NO: 102074 - DNA, 75 bp, Artificial Sequence
  Synthetic
actgtttatcctcatggtttgttaaattgcaacatcaacaatgtggttagaataaaggttccatttatttatact

SEQ ID NO: 102075 - DNA, 75 bp, Artificial Sequence
  Synthetic
aatcagggtttggtcagagttgaatattggaacaggaacttcagcttacacttcactcaacgttttagctaggtt

SEQ ID NO: 102076 - DNA, 75 bp, Artificial Sequence
  Synthetic
cagagttatggctctattgcttctttaactgtttatcctcatggtttgttgaattgtaacatcaataatgtcgtg

SEQ ID NO: 102077 - DNA, 75 bp, Artificial Sequence
  Synthetic
tgttttgttaagagtggaattttgctttatgtaatacaacaattgaatcaggatgaacattctcacataattggt

SEQ ID NO: 102078 - DNA, 75 bp, Artificial Sequence
  Synthetic
aggcaatggtaacgagatgtgagccagttgtttgttatttatatggcacaagagggggaggaaagagcttaacat

SEQ ID NO: 102079 - DNA, 75 bp, Artificial Sequence
  Synthetic
tgaaaacctctgttgacaaaccaggttctaagaggacacaaggagagaaatttttccttattcattctgctgatt

SEQ ID NO: 102080 - DNA, 75 bp, Artificial Sequence
  Synthetic
caattgcattggcaaccaaaatttgtaaacattatggtgttgagcctgaaaagaatatctatactaaacctgtgg

SEQ ID NO: 102081 - DNA, 75 bp, Artificial Sequence
  Synthetic
tttttccttattcattctgctgattggttgacgacacatgctttgtttcatgaagttgcaaaattggatgtggtc

SEQ ID NO: 102082 - DNA, 75 bp, Artificial Sequence
  Synthetic
tccacagtatcctgtgtgggagttgacaatcagagtctggtctgaattgaacattggaacaggaacttcagctta

SEQ ID NO: 102083 - DNA, 75 bp, Artificial Sequence
  Synthetic
ctatgttaaggaagccatagaccgtatactccattttcaagttgaggtgaaacctgcctcattcttcaagaatcc

SEQ ID NO: 102084 - DNA, 75 bp, Artificial Sequence
  Synthetic
attggatttgacaattattatcacaggagccactgatgtagatggtatggcctggttcactccagtaggccttgc

SEQ ID NO: 102085 - DNA, 75 bp, Artificial Sequence
  Synthetic
ggtgttgaacctgagaaaaatatttacactaaacctgtggcctcagattattgggatggttacagtggacaattg

SEQ ID NO: 102086 - DNA, 75 bp, Artificial Sequence
  Synthetic
tgactcctttgtccacacagatgatgagaaatgagttcagggttagtaccacagaaaatgtggtgaatttgtcta

SEQ ID NO: 102087 - DNA, 75 bp, Artificial Sequence
  Synthetic
atacaagttcagatcaatcctacaccattccagcaaggtggtttgatatgtgccatggtgccaggagatcagagc

SEQ ID NO: 102088 - DNA, 75 bp, Artificial Sequence
  Synthetic
gatattggccaaaacacaacagatgaggattggtcagatttttgtcagttagtgtcaggatgtccaatgagatta

SEQ ID NO: 102089 - DNA, 75 bp, Artificial Sequence
  Synthetic
acaatcagagtctggtctgaattgaacattggaacaggaacttcagcttacacatctcttaatgttttggcaaga

SEQ ID NO: 102090 - DNA, 75 bp, Artificial Sequence
  Synthetic
gagaaatgagttcagggttagtaccacagaaaatgtggtgaatttgtctaattatgaggatgctagggctaaaat

SEQ ID NO: 102091 - DNA, 75 bp, Artificial Sequence
  Synthetic
tggaagtctgacccctctcagggtggaggaatcaaaataactcatttcacaacttggacatccattccaacttta

SEQ ID NO: 102092 - DNA, 75 bp, Artificial Sequence
  Synthetic
aggaagcaattgaccgcagactccatttcaaggttgaagttaaacctgcttcatttttcaaaaatcctcacaatg

SEQ ID NO: 102093 - DNA, 75 bp, Artificial Sequence
  Synthetic
gaggaatcaaaataactcatttcacaacttggacatccattccaactttagcagcacagtttccatttaatgctt

SEQ ID NO: 102094 - DNA, 75 bp, Artificial Sequence
  Synthetic
tcaaattggtcaaatccaagtccaaaaacagtttatgttaaggaagcaattgatcgtaggcttcattttaaggtt

SEQ ID NO: 102095 - DNA, 75 bp, Artificial Sequence
  Synthetic
agagtttggtctgagctaaatattggaactggtacctccgcttacacatcactgaatgtgctggctagatttact

SEQ ID NO: 102096 - DNA, 75 bp, Artificial Sequence
  Synthetic
agttattcctgttgatccatactttttccaaatgacaaattcaaatcctgatcagaaatgtataacagctttggc

SEQ ID NO: 102097 - DNA, 75 bp, Artificial Sequence
  Synthetic
aaaatcctcacaatgatatgttgaatgttaatttggctaaaacaaatgatgcaattaaggacatgtcttgtgttg

SEQ ID NO: 102098 - DNA, 75 bp, Artificial Sequence
  Synthetic
acacaagttggagatgattcaggaggtttttcaacaacagtttctacagagcagaatgttcctgatccccaagtc

SEQ ID NO: 102099 - DNA, 75 bp, Artificial Sequence
  Synthetic
gacataatgtttcattgatggatttgctcagttctttagtcatgacagttgaaattagaaaacaaaacatgactg

SEQ ID NO: 102100 - DNA, 75 bp, Artificial Sequence
  Synthetic
ttcaagtctttcctacaaagtatcattctggtaggttattgttttgttttgtgcctggtaatgaattaattgatg

SEQ ID NO: 102101 - DNA, 75 bp, Artificial Sequence
  Synthetic
gaaggagtgtatcatggtgtgacaaagccaaaacaagtaattaaactggatgctgatcctgtggagtcacaatca

SEQ ID NO: 102102 - DNA, 75 bp, Artificial Sequence
  Synthetic
ggttggcaaacaaagactcaaatatgctcaggaagagttgtcaaatgaagtgcttccacctcctaggaaaatgaa

SEQ ID NO: 102103 - DNA, 75 bp, Artificial Sequence
  Synthetic
ttccaaatgacaaattcaaatcctgatcagaaatgtataacagctttggcttctatctgccaaatgttttgtttt

SEQ ID NO: 102104 - DNA, 75 bp, Artificial Sequence
  Synthetic
gttgtggtctcagggaatttcagatgatgacaatgatagtgcagtagctgagtttttccaatcttttccatctgg

SEQ ID NO: 102105 - DNA, 75 bp, Artificial Sequence
  Synthetic
gatattgcaggagtgcagtctaccttgagatttcgagttccctggattcctgacacacgttatagagtgaacaga

SEQ ID NO: 102106 - DNA, 75 bp, Artificial Sequence
  Synthetic
ttctggtaggttattgttttgttttgtgcctggtaatgaattaattgatgtttctggaattaccttaaaacaagc

SEQ ID NO: 102107 - DNA, 75 bp, Artificial Sequence
  Synthetic
tgaaccatcaaattccaaattatctagttttttccaatctgtcactaatcacaagtgggttgctgtgggagctgc

SEQ ID NO: 102108 - DNA, 75 bp, Artificial Sequence
  Synthetic
tcatgcttacaagtttgaaaaagattatgaaatgatggaattttattttaatagaggtggtacttattattcaat

SEQ ID NO: 102109 - DNA, 75 bp, Artificial Sequence
  Synthetic
tgagatttcgagttccctggattcctgacacacgttatagagtgaacagatatacaaagtctgctcatcagaaag

SEQ ID NO: 102110 - DNA, 75 bp, Artificial Sequence
  Synthetic
gattgtttattgttataacagattaacttctccatccaatgtggcttcccatgttagagtcaatgtttatctttc
